United States Patent 11,254,933 (CRISPR/CAS TRANSCRIPTIONAL MODULATION) - sequence listing, part 6

SEQ ID NO: 231827 - DNA, 20 bp, human
ggctcccagtgcacccccgg

SEQ ID NO: 231828 - DNA, 20 bp, human
ggacctccgtcagcccgcgc

SEQ ID NO: 231829 - DNA, 20 bp, human
gttcccgtgggaggtgtcga

SEQ ID NO: 231830 - DNA, 20 bp, human
gaggccgcccgcgtccgcag

SEQ ID NO: 231831 - DNA, 20 bp, human
gcggcctggggctgctagcc

SEQ ID NO: 231832 - DNA, 20 bp, human
ggggagccccgacgcggcgg

SEQ ID NO: 231833 - DNA, 20 bp, human
gggggcggggagcgcgtcac

SEQ ID NO: 231834 - DNA, 20 bp, human
gtgcactgggagccccgacg

SEQ ID NO: 231835 - DNA, 20 bp, human
ggcggggagcgcgtcacggg

SEQ ID NO: 231836 - DNA, 20 bp, human
gtcgtgcccgcccggaccgg

SEQ ID NO: 231837 - DNA, 20 bp, human
gcggtcagcgcccccggtcc

SEQ ID NO: 231838 - DNA, 20 bp, human
gtccgggcgggcacgagttg

SEQ ID NO: 231839 - DNA, 20 bp, human
ggcgcccaggtgaaacggag

SEQ ID NO: 231840 - DNA, 20 bp, human
gccgccggatcgggaacgga

SEQ ID NO: 231841 - DNA, 20 bp, human
gcgggggcagaggtgacctg

SEQ ID NO: 231842 - DNA, 20 bp, human
gcgcatgcgcccaggtgaaa

SEQ ID NO: 231843 - DNA, 20 bp, human
gcggatcagcgcatgcgccc

SEQ ID NO: 231844 - DNA, 20 bp, human
gtcaggctgtcagtcagcac

SEQ ID NO: 231845 - DNA, 20 bp, human
gggcgggcacgagttggggc

SEQ ID NO: 231846 - DNA, 20 bp, human
ggcatcaggtagtgtatcca

SEQ ID NO: 231847 - DNA, 20 bp, human
gcagaactgtagcctgcatc

SEQ ID NO: 231848 - DNA, 20 bp, human
gaccccacctcatagctctt

SEQ ID NO: 231849 - DNA, 20 bp, human
gtcccaagagctatgaggtg

SEQ ID NO: 231850 - DNA, 20 bp, human
ggcagggcctgtacatgtat

SEQ ID NO: 231851 - DNA, 20 bp, human
gtacagttctgattctttaa

SEQ ID NO: 231852 - DNA, 20 bp, human
gtagctcttgggaaagttgt

SEQ ID NO: 231853 - DNA, 20 bp, human
gtatttcccaatacatgtac

SEQ ID NO: 231854 - DNA, 20 bp, human
gaactttcccaagagctatg

SEQ ID NO: 231855 - DNA, 20 bp, human
ggaatgcagttatttgacct

SEQ ID NO: 231856 - DNA, 20 bp, human
gtagagcttggggtttcccc

SEQ ID NO: 231857 - DNA, 20 bp, human
gttatcttaaccctggaaaa

SEQ ID NO: 231858 - DNA, 20 bp, human
ggaagcttttgctttacctg

SEQ ID NO: 231859 - DNA, 20 bp, human
gtcagcaggaaactagtatc

SEQ ID NO: 231860 - DNA, 20 bp, human
gggaagccacaaagtgcttc

SEQ ID NO: 231861 - DNA, 20 bp, human
gtttctcactgtagagcttg

SEQ ID NO: 231862 - DNA, 20 bp, human
gcttcctagaaacgaacccg

SEQ ID NO: 231863 - DNA, 20 bp, human
gagcactttgtggcttccac

SEQ ID NO: 231864 - DNA, 20 bp, human
gaagttgtaaattagccttt

SEQ ID NO: 231865 - DNA, 20 bp, human
gcttccacgggttcgtttct

SEQ ID NO: 231866 - DNA, 20 bp, human
gaacaagctggtccactgag

SEQ ID NO: 231867 - DNA, 20 bp, human
gcagggtaatatcaacaagc

SEQ ID NO: 231868 - DNA, 20 bp, human
gaagactcctgaccatttag

SEQ ID NO: 231869 - DNA, 20 bp, human
gcatcagcctctaaatggtc

SEQ ID NO: 231870 - DNA, 20 bp, human
gtcagagtctaattttatct

SEQ ID NO: 231871 - DNA, 20 bp, human
gaaccccggaagtgtgattt

SEQ ID NO: 231872 - DNA, 20 bp, human
ggatgccatcagcctctaaa

SEQ ID NO: 231873 - DNA, 20 bp, human
gttccaaaatcacacttccg

SEQ ID NO: 231874 - DNA, 20 bp, human
gttgttgatattaccctgaa

SEQ ID NO: 231875 - DNA, 20 bp, human
gtgaagggagtatcaccatt

SEQ ID NO: 231876 - DNA, 20 bp, human
gaatgggatgagtgatcgca

SEQ ID NO: 231877 - DNA, 20 bp, human
gaggggactccctctggcaa

SEQ ID NO: 231878 - DNA, 20 bp, human
gaaaactcaccgacaataaa

SEQ ID NO: 231879 - DNA, 20 bp, human
gcctaggccacctttgccag

SEQ ID NO: 231880 - DNA, 20 bp, human
gtgagtgatcgcaaggctga

SEQ ID NO: 231881 - DNA, 20 bp, human
gaaatggagccaacgccaat

SEQ ID NO: 231882 - DNA, 20 bp, human
gatgatggtaataaccagat

SEQ ID NO: 231883 - DNA, 20 bp, human
gatgggctggctatgggatg

SEQ ID NO: 231884 - DNA, 20 bp, human
gggttgggagaggttgtggc

SEQ ID NO: 231885 - DNA, 20 bp, human
gtcactcatcccattggcgt

SEQ ID NO: 231886 - DNA, 20 bp, human
gtggggagaaaggtagcagg

SEQ ID NO: 231887 - DNA, 20 bp, human
ggggcaagggttaggaccca

SEQ ID NO: 231888 - DNA, 20 bp, human
gaaggccatagggcgagacg

SEQ ID NO: 231889 - DNA, 20 bp, human
gaggggaagtatgacgtcca

SEQ ID NO: 231890 - DNA, 20 bp, human
ggcctggggagaaaggtagc

SEQ ID NO: 231891 - DNA, 20 bp, human
gctgcggctggccacgcaga

SEQ ID NO: 231892 - DNA, 20 bp, human
ggagctgatagtactcgtta

SEQ ID NO: 231893 - DNA, 20 bp, human
ggacccagggttccagggat

SEQ ID NO: 231894 - DNA, 20 bp, human
gcagacactcgagacagcct

SEQ ID NO: 231895 - DNA, 20 bp, human
gcgagtgtctgccatctgcg

SEQ ID NO: 231896 - DNA, 20 bp, human
gcggtccaatggggtgaagt

SEQ ID NO: 231897 - DNA, 20 bp, human
gcgcaggcgcagagctctag

SEQ ID NO: 231898 - DNA, 20 bp, human
ggcggccgcgcggtccaatg

SEQ ID NO: 231899 - DNA, 20 bp, human
gcacgcaccgggccggggac

SEQ ID NO: 231900 - DNA, 20 bp, human
ggcaccggggtgatttccgc

SEQ ID NO: 231901 - DNA, 20 bp, human
gtgctcggcggacagacaaa

SEQ ID NO: 231902 - DNA, 20 bp, human
gcctgcgcacgcaccgggcc

SEQ ID NO: 231903 - DNA, 20 bp, human
gcgggcgggtgtgctccgtt

SEQ ID NO: 231904 - DNA, 20 bp, human
gggtgtgctccgttcggcct

SEQ ID NO: 231905 - DNA, 20 bp, human
ggcggggaaagagcgagggc

SEQ ID NO: 231906 - DNA, 20 bp, human
gcctcagggcgggaccaaag

SEQ ID NO: 231907 - DNA, 20 bp, human
gagggcgggaccagggcgtg

SEQ ID NO: 231908 - DNA, 20 bp, human
gggactggcgcgggacgcga

SEQ ID NO: 231909 - DNA, 20 bp, human
gaaagcgggaggactggcgc

SEQ ID NO: 231910 - DNA, 20 bp, human
gcggaagcccgcggactctc

SEQ ID NO: 231911 - DNA, 20 bp, human
gctggggctgggttctcggg

SEQ ID NO: 231912 - DNA, 20 bp, human
gaccagggcgtgaggacgcg

SEQ ID NO: 231913 - DNA, 20 bp, human
ggggaccaaagcgggaggac

SEQ ID NO: 231914 - DNA, 20 bp, human
gctggcgcgggacgcgaggg

SEQ ID NO: 231915 - DNA, 20 bp, human
gctcgggcgggcgggagcta

SEQ ID NO: 231916 - DNA, 20 bp, human
gaagaagtttgggtggccac

SEQ ID NO: 231917 - DNA, 20 bp, human
ggaaactaaattccagtaat

SEQ ID NO: 231918 - DNA, 20 bp, human
gtggatagaagaagtttggg

SEQ ID NO: 231919 - DNA, 20 bp, human
gtggaatttagtttctgact

SEQ ID NO: 231920 - DNA, 20 bp, human
gtgacaaaatattatcctgt

SEQ ID NO: 231921 - DNA, 20 bp, human
gtattgggttaattcttatc

SEQ ID NO: 231922 - DNA, 20 bp, human
gcctgcaagcttagatccgc

SEQ ID NO: 231923 - DNA, 20 bp, human
gcagtgcctgcccaaaaagc

SEQ ID NO: 231924 - DNA, 20 bp, human
gactttcatttttgactctg

SEQ ID NO: 231925 - DNA, 20 bp, human
ggtttccgccctttgcaata

SEQ ID NO: 231926 - DNA, 20 bp, human
gatgaatgacagaactctat

SEQ ID NO: 231927 - DNA, 20 bp, human
gaattgttaaacaacctggt

SEQ ID NO: 231928 - DNA, 20 bp, human
gcaagagcattgactttccc

SEQ ID NO: 231929 - DNA, 20 bp, human
gagaactatatctaaagtga

SEQ ID NO: 231930 - DNA, 20 bp, human
gtgaccaggaagtttgcatt

SEQ ID NO: 231931 - DNA, 20 bp, human
gcattcatcatattcctacc

SEQ ID NO: 231932 - DNA, 20 bp, human
gaggcagatcattatcacta

SEQ ID NO: 231933 - DNA, 20 bp, human
gttaggtccaatgccacaga

SEQ ID NO: 231934 - DNA, 20 bp, human
gatgaatacagtggatgacc

SEQ ID NO: 231935 - DNA, 20 bp, human
gggacctaatgcaaacttcc

SEQ ID NO: 231936 - DNA, 20 bp, human
gtgccctgtagtaagcaaat

SEQ ID NO: 231937 - DNA, 20 bp, human
gaaaagaagatgtggggcta

SEQ ID NO: 231938 - DNA, 20 bp, human
gtgaactctagattcttccc

SEQ ID NO: 231939 - DNA, 20 bp, human
ggacaagtgattacagatta

SEQ ID NO: 231940 - DNA, 20 bp, human
gagtatattaggtgatgcag

SEQ ID NO: 231941 - DNA, 20 bp, human
gaactgacagatcagaagag

SEQ ID NO: 231942 - DNA, 20 bp, human
gaacctatagtttcatcatt

SEQ ID NO: 231943 - DNA, 20 bp, human
gttcccaatgatgaaactat

SEQ ID NO: 231944 - DNA, 20 bp, human
gtaggtacttccttattgca

SEQ ID NO: 231945 - DNA, 20 bp, human
gagccaatttgcttactaca

SEQ ID NO: 231946 - DNA, 20 bp, human
gcgcccgggctcccgtggat

SEQ ID NO: 231947 - DNA, 20 bp, human
gtgtccccccgggtggcaac

SEQ ID NO: 231948 - DNA, 20 bp, human
gcccgcggggaccaagagcg

SEQ ID NO: 231949 - DNA, 20 bp, human
ggggctccggagcgactggg

SEQ ID NO: 231950 - DNA, 20 bp, human
gtggcaactggcatgtcccc

SEQ ID NO: 231951 - DNA, 20 bp, human
gaggagctttaactctggga

SEQ ID NO: 231952 - DNA, 20 bp, human
gcccgcgctcttggtccccg

SEQ ID NO: 231953 - DNA, 20 bp, human
ggccccctgcccccgagcgt

SEQ ID NO: 231954 - DNA, 20 bp, human
gaaggaccagcccgatccac

SEQ ID NO: 231955 - DNA, 20 bp, human
gaagctcctcccagtcgctc

SEQ ID NO: 231956 - DNA, 20 bp, human
gtccccgcacgcatagtccc

SEQ ID NO: 231957 - DNA, 20 bp, human
gcgcacgcatagtccctgga

SEQ ID NO: 231958 - DNA, 20 bp, human
gactatgcgtgcggggacac

SEQ ID NO: 231959 - DNA, 20 bp, human
gttgcagagagcgccctcca

SEQ ID NO: 231960 - DNA, 20 bp, human
ggtagagcgaggggccaact

SEQ ID NO: 231961 - DNA, 20 bp, human
gcggggacacgggtcgcttt

SEQ ID NO: 231962 - DNA, 20 bp, human
gtcggggtagtgcgctccgc

SEQ ID NO: 231963 - DNA, 20 bp, human
gtaggcgtggagtcccccag

SEQ ID NO: 231964 - DNA, 20 bp, human
ggggaggagccgccctgggt

SEQ ID NO: 231965 - DNA, 20 bp, human
ggccgcgcgctctgccaagt

SEQ ID NO: 231966 - DNA, 20 bp, human
gccaggggccagtgctcagg

SEQ ID NO: 231967 - DNA, 20 bp, human
gagaccgcacgcagggcacc

SEQ ID NO: 231968 - DNA, 20 bp, human
gggtccaggagaccgcacgc

SEQ ID NO: 231969 - DNA, 20 bp, human
gtggcccctggctgtgactt

SEQ ID NO: 231970 - DNA, 20 bp, human
gctgagtcacaaacactaga

SEQ ID NO: 231971 - DNA, 20 bp, human
gcacctggccacctgagcac

SEQ ID NO: 231972 - DNA, 20 bp, human
ggaaaaaggcctggtggtcc

SEQ ID NO: 231973 - DNA, 20 bp, human
gtcgaaacaggaagtagagc

SEQ ID NO: 231974 - DNA, 20 bp, human
gaggcactctgctcactcag

SEQ ID NO: 231975 - DNA, 20 bp, human
gcgtctaatgaaggacggaa

SEQ ID NO: 231976 - DNA, 20 bp, human
gagcactctccgcagtgggc

SEQ ID NO: 231977 - DNA, 20 bp, human
gaacgacaactcacagtgcc

SEQ ID NO: 231978 - DNA, 20 bp, human
gactctccgcagtgggcggg

SEQ ID NO: 231979 - DNA, 20 bp, human
ggtgataaacggtggagaat

SEQ ID NO: 231980 - DNA, 20 bp, human
gatgggagcactctccgcag

SEQ ID NO: 231981 - DNA, 20 bp, human
gacaagtgtgtgataaacgg

SEQ ID NO: 231982 - DNA, 20 bp, human
gagtggttggagcaaaggtt

SEQ ID NO: 231983 - DNA, 20 bp, human
gcctggggagtggcagtggt

SEQ ID NO: 231984 - DNA, 20 bp, human
gtatccattcatgaattggg

SEQ ID NO: 231985 - DNA, 20 bp, human
gtgagttgtcgtttattaac

SEQ ID NO: 231986 - DNA, 20 bp, human
ggcggggcttcaataggaag

SEQ ID NO: 231987 - DNA, 20 bp, human
gagaggggcggggtgtaagg

SEQ ID NO: 231988 - DNA, 20 bp, human
gaaaggcgggaactagttgt

SEQ ID NO: 231989 - DNA, 20 bp, human
gcgctatcagggtatggagg

SEQ ID NO: 231990 - DNA, 20 bp, human
gctgacctgagtggaggtag

SEQ ID NO: 231991 - DNA, 20 bp, human
gtcggtgggcagaaaggaac

SEQ ID NO: 231992 - DNA, 20 bp, human
ggggcggggtgtaaggtggc

SEQ ID NO: 231993 - DNA, 20 bp, human
gaaggggctgacctgagtgg

SEQ ID NO: 231994 - DNA, 20 bp, human
ggatgccagggagacctcgg

SEQ ID NO: 231995 - DNA, 20 bp, human
gcacgcccctacctccactc

SEQ ID NO: 231996 - DNA, 20 bp, human
ggggagcgaagactgacccg

SEQ ID NO: 231997 - DNA, 20 bp, human
ggacgcaagagcgactcctg

SEQ ID NO: 231998 - DNA, 20 bp, human
ggcctccggacgcatctcca

SEQ ID NO: 231999 - DNA, 20 bp, human
ggcccggaagcggactgagg

SEQ ID NO: 232000 - DNA, 20 bp, human
ggggcgggacggtaacgcgg

SEQ ID NO: 232001 - DNA, 20 bp, human
gtcagtgcggggatacgggg

SEQ ID NO: 232002 - DNA, 20 bp, human
ggtgacgcggagcgtgttct

SEQ ID NO: 232003 - DNA, 20 bp, human
gcaagagcgactcctggggg

SEQ ID NO: 232004 - DNA, 20 bp, human
gtgacgtggggcgggttctg

SEQ ID NO: 232005 - DNA, 20 bp, human
gtggagcggggcggtgacgt

SEQ ID NO: 232006 - DNA, 20 bp, human
gtaggccagtgtggggaccg

SEQ ID NO: 232007 - DNA, 20 bp, human
ggggtagaagtgtaggaggt

SEQ ID NO: 232008 - DNA, 20 bp, human
gtgccctggacactggagga

SEQ ID NO: 232009 - DNA, 20 bp, human
gtgaggggtgccaatttcag

SEQ ID NO: 232010 - DNA, 20 bp, human
gtctgagttaggggctcaag

SEQ ID NO: 232011 - DNA, 20 bp, human
gggaccaggtggggactgag

SEQ ID NO: 232012 - DNA, 20 bp, human
gggtcccagattctgagtta

SEQ ID NO: 232013 - DNA, 20 bp, human
ggaggtgccctggacactgg

SEQ ID NO: 232014 - DNA, 20 bp, human
ggtccagaagaggttagctg

SEQ ID NO: 232015 - DNA, 20 bp, human
gcctggggtagaagtgtagg

SEQ ID NO: 232016 - DNA, 20 bp, human
ggagctatgtaaggtatctg

SEQ ID NO: 232017 - DNA, 20 bp, human
gaaaaacagccaagctaggg

SEQ ID NO: 232018 - DNA, 20 bp, human
gcgactggtgaagagggaag

SEQ ID NO: 232019 - DNA, 20 bp, human
gttagatacgacactgtaga

SEQ ID NO: 232020 - DNA, 20 bp, human
gggagttcctaatgagacag

SEQ ID NO: 232021 - DNA, 20 bp, human
gtagaaaaacagccaagcta

SEQ ID NO: 232022 - DNA, 20 bp, human
gctgatacagtctgtccgac

SEQ ID NO: 232023 - DNA, 20 bp, human
gaagagaaagaaactcgaga

SEQ ID NO: 232024 - DNA, 20 bp, human
gatgtaaggtatctggggct

SEQ ID NO: 232025 - DNA, 20 bp, human
gaacaactgcatcctaaaaa

SEQ ID NO: 232026 - DNA, 20 bp, human
gaagcagcgcgctgtggagt

SEQ ID NO: 232027 - DNA, 20 bp, human
gtccacagcgcgctgcttgg

SEQ ID NO: 232028 - DNA, 20 bp, human
gtatccttgtccctagcccc

SEQ ID NO: 232029 - DNA, 20 bp, human
gctgcttggaggcccggacc

SEQ ID NO: 232030 - DNA, 20 bp, human
gaaagcatactcctttgggt

SEQ ID NO: 232031 - DNA, 20 bp, human
gattctagtgctgtgatggg

SEQ ID NO: 232032 - DNA, 20 bp, human
ggggtggaatactgcattaa

SEQ ID NO: 232033 - DNA, 20 bp, human
gcaaataaagcatactcctt

SEQ ID NO: 232034 - DNA, 20 bp, human
ggacaaggataagcaaggcc

SEQ ID NO: 232035 - DNA, 20 bp, human
ggttctggaaatttccgcaa

SEQ ID NO: 232036 - DNA, 20 bp, human
gaggcattgagacgtgagtg

SEQ ID NO: 232037 - DNA, 20 bp, human
gaggataaaagcagtcaaac

SEQ ID NO: 232038 - DNA, 20 bp, human
gaatgcacaactgacagggt

SEQ ID NO: 232039 - DNA, 20 bp, human
gacactgagctcttcgaagt

SEQ ID NO: 232040 - DNA, 20 bp, human
gggtgaatgcacaactgaca

SEQ ID NO: 232041 - DNA, 20 bp, human
gctgaccgctatcagaaatt

SEQ ID NO: 232042 - DNA, 20 bp, human
gacagacaaagtgagacgtc

SEQ ID NO: 232043 - DNA, 20 bp, human
gtgagtgtggcttgtatttc

SEQ ID NO: 232044 - DNA, 20 bp, human
gaccactcttctgctttata

SEQ ID NO: 232045 - DNA, 20 bp, human
gtcaaaaagactctcccagc

SEQ ID NO: 232046 - DNA, 20 bp, human
gagcacgtggtccgcatcac

SEQ ID NO: 232047 - DNA, 20 bp, human
ggtaacctgtaatcagccgg

SEQ ID NO: 232048 - DNA, 20 bp, human
ggcgcctggcatctggagac

SEQ ID NO: 232049 - DNA, 20 bp, human
gagcccgggatgcgtgggga

SEQ ID NO: 232050 - DNA, 20 bp, human
gcgcaccgccggctgattac

SEQ ID NO: 232051 - DNA, 20 bp, human
gaataacgcagcctgtgatg

SEQ ID NO: 232052 - DNA, 20 bp, human
gcaggcgcatgacgagtcca

SEQ ID NO: 232053 - DNA, 20 bp, human
gtgcggaccacgtgctgtgt

SEQ ID NO: 232054 - DNA, 20 bp, human
ggtcacagggtgacagccga

SEQ ID NO: 232055 - DNA, 20 bp, human
gggtcccgggaaggcgacgc

SEQ ID NO: 232056 - DNA, 20 bp, human
gtagatctgggcatcgaagg

SEQ ID NO: 232057 - DNA, 20 bp, human
gcgggaccagagcagtgctg

SEQ ID NO: 232058 - DNA, 20 bp, human
gtggggccggggcgggtcac

SEQ ID NO: 232059 - DNA, 20 bp, human
gcggggcgggtcaccgggtg

SEQ ID NO: 232060 - DNA, 20 bp, human
gggtcaccgggtgaggaccg

SEQ ID NO: 232061 - DNA, 20 bp, human
gcaccgggtgaggaccgggg

SEQ ID NO: 232062 - DNA, 20 bp, human
ggcggagggtgttaagttac

SEQ ID NO: 232063 - DNA, 20 bp, human
gtaaactctcgcagctaaag

SEQ ID NO: 232064 - DNA, 20 bp, human
gagctagatctgggcatcga

SEQ ID NO: 232065 - DNA, 20 bp, human
gacaactgcaagctagatct

SEQ ID NO: 232066 - DNA, 20 bp, human
gtgggtgggaaggatccggg

SEQ ID NO: 232067 - DNA, 20 bp, human
gggagcccggccccgcgatc

SEQ ID NO: 232068 - DNA, 20 bp, human
gaaaacccgggccggatcgc

SEQ ID NO: 232069 - DNA, 20 bp, human
gcggccccgcgatccggccc

SEQ ID NO: 232070 - DNA, 20 bp, human
gctctcgcccgctgtgatta

SEQ ID NO: 232071 - DNA, 20 bp, human
gcgctcagatgctcctccgc

SEQ ID NO: 232072 - DNA, 20 bp, human
gtgggtggcatgcaaaaccc

SEQ ID NO: 232073 - DNA, 20 bp, human
gagactgggagcgaaaaatc

SEQ ID NO: 232074 - DNA, 20 bp, human
gctctctcggggttcagaac

SEQ ID NO: 232075 - DNA, 20 bp, human
gcggcgagtcgcacggcctg

SEQ ID NO: 232076 - DNA, 20 bp, human
gagaaggcagtcctcccgag

SEQ ID NO: 232077 - DNA, 20 bp, human
gagaccggagatacccagga

SEQ ID NO: 232078 - DNA, 20 bp, human
gccaagattggaagcccaat

SEQ ID NO: 232079 - DNA, 20 bp, human
gtggctgctcggcgctaggc

SEQ ID NO: 232080 - DNA, 20 bp, human
ggagcagggctctccgaagg

SEQ ID NO: 232081 - DNA, 20 bp, human
ggccctgctccgagcccatt

SEQ ID NO: 232082 - DNA, 20 bp, human
gtacccaggagggtgcggaa

SEQ ID NO: 232083 - DNA, 20 bp, human
gcaccaacggccgcgtccca

SEQ ID NO: 232084 - DNA, 20 bp, human
ggcaccctcctgggtatctc

SEQ ID NO: 232085 - DNA, 20 bp, human
gccgaaggaggcctgaagac

SEQ ID NO: 232086 - DNA, 20 bp, human
gaagcactcattcacagctt

SEQ ID NO: 232087 - DNA, 20 bp, human
gagcttaggacactctgaag

SEQ ID NO: 232088 - DNA, 20 bp, human
gtgaaatctggtatttttgt

SEQ ID NO: 232089 - DNA, 20 bp, human
ggaacgtggaagtaagatgc

SEQ ID NO: 232090 - DNA, 20 bp, human
gtcaccttggtgagatcgaa

SEQ ID NO: 232091 - DNA, 20 bp, human
gaatctttcacaatagtaag

SEQ ID NO: 232092 - DNA, 20 bp, human
gtgagatcgaatggattaaa

SEQ ID NO: 232093 - DNA, 20 bp, human
gttaccaggcaatcaactga

SEQ ID NO: 232094 - DNA, 20 bp, human
gtggatgtaaaaagtccagg

SEQ ID NO: 232095 - DNA, 20 bp, human
ggaaatgacaaacaggaacg

SEQ ID NO: 232096 - DNA, 20 bp, human
ggggactgagtcatcggtga

SEQ ID NO: 232097 - DNA, 20 bp, human
gggagtggggactgagtcat

SEQ ID NO: 232098 - DNA, 20 bp, human
gctgagtcatcggtgagggg

SEQ ID NO: 232099 - DNA, 20 bp, human
gcctctctggaaaaatgaag

SEQ ID NO: 232100 - DNA, 20 bp, human
gacgctggtcaggaagctgt

SEQ ID NO: 232101 - DNA, 20 bp, human
ggattccagtgcatgacaga

SEQ ID NO: 232102 - DNA, 20 bp, human
gtgacctgctcaagggatgg

SEQ ID NO: 232103 - DNA, 20 bp, human
gcaggaggctcctgacttgt

SEQ ID NO: 232104 - DNA, 20 bp, human
gtggtgacttgggtgagtcc

SEQ ID NO: 232105 - DNA, 20 bp, human
gtctgccttctgtcatgcac

SEQ ID NO: 232106 - DNA, 20 bp, human
gcgggcgcgcgaccacaaac

SEQ ID NO: 232107 - DNA, 20 bp, human
gcgctggcgcgtctggccca

SEQ ID NO: 232108 - DNA, 20 bp, human
gccgctctccggccactcag

SEQ ID NO: 232109 - DNA, 20 bp, human
gacaaaccggctgcctgcgc

SEQ ID NO: 232110 - DNA, 20 bp, human
gttgtcgtccgtgagttcgg

SEQ ID NO: 232111 - DNA, 20 bp, human
gccactcagcggtaaccagc

SEQ ID NO: 232112 - DNA, 20 bp, human
ggcagagtggcgtcatcagg

SEQ ID NO: 232113 - DNA, 20 bp, human
ggccgctgcctccgaactca

SEQ ID NO: 232114 - DNA, 20 bp, human
gtccgtgagttcggaggcag

SEQ ID NO: 232115 - DNA, 20 bp, human
gttggcagagtggcgtcatc

SEQ ID NO: 232116 - DNA, 20 bp, human
gaagtggggagctcccaagt

SEQ ID NO: 232117 - DNA, 20 bp, human
gctcccaagtgggtctatca

SEQ ID NO: 232118 - DNA, 20 bp, human
gtagcctttttgctgaatgg

SEQ ID NO: 232119 - DNA, 20 bp, human
gggcctgtgtctatcagctg

SEQ ID NO: 232120 - DNA, 20 bp, human
ggcccccagctgatagacac

SEQ ID NO: 232121 - DNA, 20 bp, human
gtgggcacccagcaatcatg

SEQ ID NO: 232122 - DNA, 20 bp, human
gccagagcctcatgattgct

SEQ ID NO: 232123 - DNA, 20 bp, human
ggggggcacttcttgaaggg

SEQ ID NO: 232124 - DNA, 20 bp, human
gatccatgatagacccactt

SEQ ID NO: 232125 - DNA, 20 bp, human
gcacatccagggcacagcac

SEQ ID NO: 232126 - DNA, 20 bp, human
gcctcctccgcatcccacag

SEQ ID NO: 232127 - DNA, 20 bp, human
gagactgggctggtaggaca

SEQ ID NO: 232128 - DNA, 20 bp, human
ggcatcccacagaggaagtc

SEQ ID NO: 232129 - DNA, 20 bp, human
ggatgcggaggagggccaat

SEQ ID NO: 232130 - DNA, 20 bp, human
gttggaagtcagaggctgat

SEQ ID NO: 232131 - DNA, 20 bp, human
gatccccagacttcctctgt

SEQ ID NO: 232132 - DNA, 20 bp, human
gtgactccattcaggctgca

SEQ ID NO: 232133 - DNA, 20 bp, human
gtaggacagggcagctggtg

SEQ ID NO: 232134 - DNA, 20 bp, human
ggtagaatgcagacggctgg

SEQ ID NO: 232135 - DNA, 20 bp, human
gcagcctgaatggagtcaca

SEQ ID NO: 232136 - DNA, 20 bp, human
ggagaacctccacctctcat

SEQ ID NO: 232137 - DNA, 20 bp, human
gtggttgtatgtgctcacta

SEQ ID NO: 232138 - DNA, 20 bp, human
gaggggaggagcttcataac

SEQ ID NO: 232139 - DNA, 20 bp, human
gtagagaaggccttattgac

SEQ ID NO: 232140 - DNA, 20 bp, human
gaaaggaggcaatctctcaa

SEQ ID NO: 232141 - DNA, 20 bp, human
ggcctgtggtgctctgaaag

SEQ ID NO: 232142 - DNA, 20 bp, human
gataaatgctatattaaaga

SEQ ID NO: 232143 - DNA, 20 bp, human
gcaaagttagaaatgagctg

SEQ ID NO: 232144 - DNA, 20 bp, human
gttctttaaaaaccgatgag

SEQ ID NO: 232145 - DNA, 20 bp, human
gcttcataactgggtcttta

SEQ ID NO: 232146 - DNA, 20 bp, human
gtggccgggtgcgcatactc

SEQ ID NO: 232147 - DNA, 20 bp, human
gtgggcctacgcggagaaga

SEQ ID NO: 232148 - DNA, 20 bp, human
ggcgcggattcgggcttccc

SEQ ID NO: 232149 - DNA, 20 bp, human
gcatgcgcatcaatgagtcc

SEQ ID NO: 232150 - DNA, 20 bp, human
gtcagggagctgggcctacg

SEQ ID NO: 232151 - DNA, 20 bp, human
gactctagactggccacggg

SEQ ID NO: 232152 - DNA, 20 bp, human
gcgcgtgcctcggtacccga

SEQ ID NO: 232153 - DNA, 20 bp, human
gagactggccacgggtggcc

SEQ ID NO: 232154 - DNA, 20 bp, human
gtgcgcggaggcccgctccc

SEQ ID NO: 232155 - DNA, 20 bp, human
ggggctatggcggcgagcac

SEQ ID NO: 232156 - DNA, 20 bp, human
gcgtggaaggagaaggtgtg

SEQ ID NO: 232157 - DNA, 20 bp, human
gagggcgaggaaagatcccg

SEQ ID NO: 232158 - DNA, 20 bp, human
gtggggcgaggaaacaacga

SEQ ID NO: 232159 - DNA, 20 bp, human
ggaggaggggcgttaccaga

SEQ ID NO: 232160 - DNA, 20 bp, human
gcaaaggcggaagtcggctg

SEQ ID NO: 232161 - DNA, 20 bp, human
gacggggaggaactaggaag

SEQ ID NO: 232162 - DNA, 20 bp, human
gagaaggtgtcgcggtacga

SEQ ID NO: 232163 - DNA, 20 bp, human
ggcaacccctaaggcaccga

SEQ ID NO: 232164 - DNA, 20 bp, human
gagacagttttcatcgagaa

SEQ ID NO: 232165 - DNA, 20 bp, human
ggggaaggtgagactcaaga

SEQ ID NO: 232166 - DNA, 20 bp, human
gaggacccgcaggacctcgg

SEQ ID NO: 232167 - DNA, 20 bp, human
gtaccggggcaggggtaata

SEQ ID NO: 232168 - DNA, 20 bp, human
gcgccctgcagagtacagag

SEQ ID NO: 232169 - DNA, 20 bp, human
ggcaggggtaatagggaccg

SEQ ID NO: 232170 - DNA, 20 bp, human
ggccccgccgcgcggtccga

SEQ ID NO: 232171 - DNA, 20 bp, human
gcgcccgccgccaggggtca

SEQ ID NO: 232172 - DNA, 20 bp, human
gcgaaacaggtgaagcgctc

SEQ ID NO: 232173 - DNA, 20 bp, human
gcgcaggacctcggcggcga

SEQ ID NO: 232174 - DNA, 20 bp, human
ggctcagggcgagagcgact

SEQ ID NO: 232175 - DNA, 20 bp, human
gggcgagagcgactcggctt

SEQ ID NO: 232176 - DNA, 20 bp, human
gtgcccaagcaccccagcgc

SEQ ID NO: 232177 - DNA, 20 bp, human
gcctctgctgccagaacctt

SEQ ID NO: 232178 - DNA, 20 bp, human
gtccccgggacgcctctcgg

SEQ ID NO: 232179 - DNA, 20 bp, human
gctcccgcgctggggtgctt

SEQ ID NO: 232180 - DNA, 20 bp, human
ggggtctaggcacatcccca

SEQ ID NO: 232181 - DNA, 20 bp, human
gaaccaccgagaggcgtccc

SEQ ID NO: 232182 - DNA, 20 bp, human
gacccggcgcagcacacgtc

SEQ ID NO: 232183 - DNA, 20 bp, human
gcctcctggccgcccgccaa

SEQ ID NO: 232184 - DNA, 20 bp, human
gcgtgtgctgcgccgggtct

SEQ ID NO: 232185 - DNA, 20 bp, human
ggggaaaaaaaggcgctgga

SEQ ID NO: 232186 - DNA, 20 bp, human
gggcccgggctgtgactcgt

SEQ ID NO: 232187 - DNA, 20 bp, human
gacagtacgggcccccagaa

SEQ ID NO: 232188 - DNA, 20 bp, human
ggggccgggcgctacgggaa

SEQ ID NO: 232189 - DNA, 20 bp, human
gggcccccagaagggtgacc

SEQ ID NO: 232190 - DNA, 20 bp, human
ggggctgtgactcgtgggga

SEQ ID NO: 232191 - DNA, 20 bp, human
gcggcggccgcttcccgctg

SEQ ID NO: 232192 - DNA, 20 bp, human
ggcctcctggtcacccttct

SEQ ID NO: 232193 - DNA, 20 bp, human
ggagctggcaagtcgtccca

SEQ ID NO: 232194 - DNA, 20 bp, human
gctctgaggcatgacagtac

SEQ ID NO: 232195 - DNA, 20 bp, human
gcacgcaaggcaaacacagc

SEQ ID NO: 232196 - DNA, 20 bp, human
gggcactgggcctcaggaga

SEQ ID NO: 232197 - DNA, 20 bp, human
ggtggctgtggccaactcgg

SEQ ID NO: 232198 - DNA, 20 bp, human
gaggcaggctgaagttatgt

SEQ ID NO: 232199 - DNA, 20 bp, human
ggccgatcgctccttaaagg

SEQ ID NO: 232200 - DNA, 20 bp, human
gcaactcggcggtcgctccg

SEQ ID NO: 232201 - DNA, 20 bp, human
ggggacagagtggcctagag

SEQ ID NO: 232202 - DNA, 20 bp, human
gaaggccgatcgctccttaa

SEQ ID NO: 232203 - DNA, 20 bp, human
ggggcaaattccaggggccc

SEQ ID NO: 232204 - DNA, 20 bp, human
gtggcagggacataagtctg

SEQ ID NO: 232205 - DNA, 20 bp, human
ggcagtggggcaaattccag

SEQ ID NO: 232206 - DNA, 20 bp, human
ggccgggcttccgcgtgcgt

SEQ ID NO: 232207 - DNA, 20 bp, human
ggaaggggcgggtcaggtta

SEQ ID NO: 232208 - DNA, 20 bp, human
gaggctgcgccgggattcgg

SEQ ID NO: 232209 - DNA, 20 bp, human
gggaaccgaccgccgaatcc

SEQ ID NO: 232210 - DNA, 20 bp, human
gaagtctggagctagaaagt

SEQ ID NO: 232211 - DNA, 20 bp, human
gggcgcgcgtgacgccgagg

SEQ ID NO: 232212 - DNA, 20 bp, human
gggcgggtcaggttaggggg

SEQ ID NO: 232213 - DNA, 20 bp, human
gttagggggcggtgcttaat

SEQ ID NO: 232214 - DNA, 20 bp, human
ggggccgagtgctaggggga

SEQ ID NO: 232215 - DNA, 20 bp, human
gcggtcggttcccgcggaag

SEQ ID NO: 232216 - DNA, 20 bp, human
gcccccacggccagttctta

SEQ ID NO: 232217 - DNA, 20 bp, human
gaacgcctccgccaccgggg

SEQ ID NO: 232218 - DNA, 20 bp, human
gggggcggcgccctaagaac

SEQ ID NO: 232219 - DNA, 20 bp, human
gtcttagggcgccgccccgg

SEQ ID NO: 232220 - DNA, 20 bp, human
gtgggggcggctctcggcgg

SEQ ID NO: 232221 - DNA, 20 bp, human
gcgttgggggcggctctcgg

SEQ ID NO: 232222 - DNA, 20 bp, human
gtagggcgccgccccggtgg

SEQ ID NO: 232223 - DNA, 20 bp, human
gtctccaggccggcgccccg

SEQ ID NO: 232224 - DNA, 20 bp, human
gcgccctaagaactggccgt

SEQ ID NO: 232225 - DNA, 20 bp, human
ggggcgagcgaagaggttga

SEQ ID NO: 232226 - DNA, 20 bp, human
ggcccagtggccacgctgta

SEQ ID NO: 232227 - DNA, 20 bp, human
gacgctgtagggctcagggt

SEQ ID NO: 232228 - DNA, 20 bp, human
ggccccagatggttcctgtc

SEQ ID NO: 232229 - DNA, 20 bp, human
gtccctgacaggaaccatct

SEQ ID NO: 232230 - DNA, 20 bp, human
gtggccacgctgtagggctc

SEQ ID NO: 232231 - DNA, 20 bp, human
gtcaaaccggaatggcccga

SEQ ID NO: 232232 - DNA, 20 bp, human
ggcccgagggaaggccgcgc

SEQ ID NO: 232233 - DNA, 20 bp, human
gccggccccggcattatcac

SEQ ID NO: 232234 - DNA, 20 bp, human
gtgtccccgtgataatgccg

SEQ ID NO: 232235 - DNA, 20 bp, human
gcactgggcatgtgtttcct

SEQ ID NO: 232236 - DNA, 20 bp, human
gtgggccgcggagttgtgaa

SEQ ID NO: 232237 - DNA, 20 bp, human
ggcccgcccgcctccaactc

SEQ ID NO: 232238 - DNA, 20 bp, human
gaaccgaccggcaggggtgt

SEQ ID NO: 232239 - DNA, 20 bp, human
gaggccgctccgccagcggg

SEQ ID NO: 232240 - DNA, 20 bp, human
gaaaagggccctgatgcgga

SEQ ID NO: 232241 - DNA, 20 bp, human
ggggcggcaggcaacggctg

SEQ ID NO: 232242 - DNA, 20 bp, human
gcggcctggctgtggcgccc

SEQ ID NO: 232243 - DNA, 20 bp, human
gggtggcgcatgcgcggcgt

SEQ ID NO: 232244 - DNA, 20 bp, human
ggccccggggcgccacagcc

SEQ ID NO: 232245 - DNA, 20 bp, human
gcgcaccattcacaactccg

SEQ ID NO: 232246 - DNA, 20 bp, human
gcgccaacctcccgcccaca

SEQ ID NO: 232247 - DNA, 20 bp, human
gtactgcgcagactccacct

SEQ ID NO: 232248 - DNA, 20 bp, human
ggggctcgcgcgctctgaag

SEQ ID NO: 232249 - DNA, 20 bp, human
ggaggagcggccgtggggag

SEQ ID NO: 232250 - DNA, 20 bp, human
gccgccccgccccggcgtag

SEQ ID NO: 232251 - DNA, 20 bp, human
gccgccccggcgtaggggcg

SEQ ID NO: 232252 - DNA, 20 bp, human
gcgcttctggggtgggtcat

SEQ ID NO: 232253 - DNA, 20 bp, human
gtcgctgcccagtccggccg

SEQ ID NO: 232254 - DNA, 20 bp, human
gccgccgccggctatccggg

SEQ ID NO: 232255 - DNA, 20 bp, human
ggggcacagaaacctggccg

SEQ ID NO: 232256 - DNA, 20 bp, human
gtgcgagcgggccttcctct

SEQ ID NO: 232257 - DNA, 20 bp, human
gaaatggacgaagggatgca

SEQ ID NO: 232258 - DNA, 20 bp, human
gtactgtggaggacgtggac

SEQ ID NO: 232259 - DNA, 20 bp, human
gggtgcagccaatggacggg

SEQ ID NO: 232260 - DNA, 20 bp, human
ggcggcagcgcgaggaggac

SEQ ID NO: 232261 - DNA, 20 bp, human
ggggccattgtgtactgtgg

SEQ ID NO: 232262 - DNA, 20 bp, human
gacgggcgcctcccgtccat

SEQ ID NO: 232263 - DNA, 20 bp, human
gaccgcgcactgcccgacag

SEQ ID NO: 232264 - DNA, 20 bp, human
gtgggcgtgagcgtcgggac

SEQ ID NO: 232265 - DNA, 20 bp, human
ggggaaaggaaatggacgaa

SEQ ID NO: 232266 - DNA, 20 bp, human
gggtcctagagaaccgggga

SEQ ID NO: 232267 - DNA, 20 bp, human
gcggcctcgcccagagtgaa

SEQ ID NO: 232268 - DNA, 20 bp, human
gtcgcccagagtgaaaggag

SEQ ID NO: 232269 - DNA, 20 bp, human
gggtaccagtgtctccaaag

SEQ ID NO: 232270 - DNA, 20 bp, human
gagggcgggtcctagagaac

SEQ ID NO: 232271 - DNA, 20 bp, human
gacgtgggtcttcaagaggt

SEQ ID NO: 232272 - DNA, 20 bp, human
gttcaagaggtgggatttgg

SEQ ID NO: 232273 - DNA, 20 bp, human
gccagtgtctccaaaggggg

SEQ ID NO: 232274 - DNA, 20 bp, human
gggctggaggacctggcacg

SEQ ID NO: 232275 - DNA, 20 bp, human
gggcccctccccggttctct

SEQ ID NO: 232276 - DNA, 20 bp, human
gcacgcgctcgctgcgactc

SEQ ID NO: 232277 - DNA, 20 bp, human
ggggaggcggaagtccaagc

SEQ ID NO: 232278 - DNA, 20 bp, human
gcgtgcgcactgccttccgg

SEQ ID NO: 232279 - DNA, 20 bp, human
gaccccggcgggcggagtaa

SEQ ID NO: 232280 - DNA, 20 bp, human
gaaggcagctctccgcgggg

SEQ ID NO: 232281 - DNA, 20 bp, human
gccagtgggaggttgctcag

SEQ ID NO: 232282 - DNA, 20 bp, human
gtgcgcggggcccccggagc

SEQ ID NO: 232283 - DNA, 20 bp, human
gccggaaggcgccctccagt

SEQ ID NO: 232284 - DNA, 20 bp, human
ggactcaggcatagttcggg

SEQ ID NO: 232285 - DNA, 20 bp, human
gccgcctcccggcctccgga

SEQ ID NO: 232286 - DNA, 20 bp, human
gaacaacggcgcccggggtc

SEQ ID NO: 232287 - DNA, 20 bp, human
gctccccaccgagccaatgg

SEQ ID NO: 232288 - DNA, 20 bp, human
gcccgggcgccgttgttatt

SEQ ID NO: 232289 - DNA, 20 bp, human
gtcgccgcgcctaataacaa

SEQ ID NO: 232290 - DNA, 20 bp, human
gggcgcgcggcagcagggtt

SEQ ID NO: 232291 - DNA, 20 bp, human
ggagcgcggcgcgtcaggat

SEQ ID NO: 232292 - DNA, 20 bp, human
ggtggggagcgcggcgcgtc

SEQ ID NO: 232293 - DNA, 20 bp, human
gcgctcggccacctgacccc

SEQ ID NO: 232294 - DNA, 20 bp, human
ggacagcgccgccattggct

SEQ ID NO: 232295 - DNA, 20 bp, human
ggcgctccccaccgagccaa

SEQ ID NO: 232296 - DNA, 20 bp, human
gagggcgcaaacacggacgt

SEQ ID NO: 232297 - DNA, 20 bp, human
gtccgccggtccgcagcctg

SEQ ID NO: 232298 - DNA, 20 bp, human
gggactccgacagaagacgg

SEQ ID NO: 232299 - DNA, 20 bp, human
gagtcctggccgcaaggctg

SEQ ID NO: 232300 - DNA, 20 bp, human
gcccgggcgcggcgcctaag

SEQ ID NO: 232301 - DNA, 20 bp, human
gacgccccgcgcgcccgctt

SEQ ID NO: 232302 - DNA, 20 bp, human
gacgcggggttcccggtccc

SEQ ID NO: 232303 - DNA, 20 bp, human
gtcggctgagggcgcaaaca

SEQ ID NO: 232304 - DNA, 20 bp, human
gaaacccagcgcgtctcccc

SEQ ID NO: 232305 - DNA, 20 bp, human
gggtgcgggcgcgaagccca

SEQ ID NO: 232306 - DNA, 20 bp, human
gccaccaaggaatgcactgt

SEQ ID NO: 232307 - DNA, 20 bp, human
gcaccccacagtgcattcct

SEQ ID NO: 232308 - DNA, 20 bp, human
gagcagggccgaggagagca

SEQ ID NO: 232309 - DNA, 20 bp, human
gaaccccagcctaatcccaa

SEQ ID NO: 232310 - DNA, 20 bp, human
gccaaccaggagtacctgaa

SEQ ID NO: 232311 - DNA, 20 bp, human
ggggccacattgcttccttt

SEQ ID NO: 232312 - DNA, 20 bp, human
ggatatctggctgaacaagt

SEQ ID NO: 232313 - DNA, 20 bp, human
ggagccaggaggggtgatct

SEQ ID NO: 232314 - DNA, 20 bp, human
gctgaaaacaaatatagagt

SEQ ID NO: 232315 - DNA, 20 bp, human
ggaaagatgcagtgcagttt

SEQ ID NO: 232316 - DNA, 20 bp, human
gtagcagtggagtggcacgg

SEQ ID NO: 232317 - DNA, 20 bp, human
ggcggaaagcgcatccaaag

SEQ ID NO: 232318 - DNA, 20 bp, human
gcatgcctggggaggattcg

SEQ ID NO: 232319 - DNA, 20 bp, human
gcatggccaaaaaaaagagt

SEQ ID NO: 232320 - DNA, 20 bp, human
gcacaccgcgaatcctcccc

SEQ ID NO: 232321 - DNA, 20 bp, human
gctggggcctggcgagctca

SEQ ID NO: 232322 - DNA, 20 bp, human
gtcactaaccctctctgaga

SEQ ID NO: 232323 - DNA, 20 bp, human
gtgagcctcagaagccgcag

SEQ ID NO: 232324 - DNA, 20 bp, human
gtcagagagggttagtgact

SEQ ID NO: 232325 - DNA, 20 bp, human
gccaggccgggtcgcgaaaa

SEQ ID NO: 232326 - DNA, 20 bp, human
gccccggcgaggttccggtg

SEQ ID NO: 232327 - DNA, 20 bp, human
gacccgcaggccgaagaccg

SEQ ID NO: 232328 - DNA, 20 bp, human
gtggctgttggctgcccacg

SEQ ID NO: 232329 - DNA, 20 bp, human
gccgcaccccggcgaggttc

SEQ ID NO: 232330 - DNA, 20 bp, human
gagagaccagcctcggtctt

SEQ ID NO: 232331 - DNA, 20 bp, human
gctccccaccggaacctcgc

SEQ ID NO: 232332 - DNA, 20 bp, human
gctgcgggttctgcaaagtc

SEQ ID NO: 232333 - DNA, 20 bp, human
ggcaggccgaagaccgaggc

SEQ ID NO: 232334 - DNA, 20 bp, human
gtctgcaaagtcaggctagc

SEQ ID NO: 232335 - DNA, 20 bp, human
gcggccgggcgtgtaaccca

SEQ ID NO: 232336 - DNA, 20 bp, human
gtcagagcccggatcctgaa

SEQ ID NO: 232337 - DNA, 20 bp, human
ggctgcgcccttcaggatcc

SEQ ID NO: 232338 - DNA, 20 bp, human
gaagccaaatcggaccttga

SEQ ID NO: 232339 - DNA, 20 bp, human
gagccgcggggtgatctgcg

SEQ ID NO: 232340 - DNA, 20 bp, human
gatcctgaagggcgcagcgt

SEQ ID NO: 232341 - DNA, 20 bp, human
gaccttgatgggtcagtcgg

SEQ ID NO: 232342 - DNA, 20 bp, human
ggacccatcaaggtccgatt

SEQ ID NO: 232343 - DNA, 20 bp, human
gaatgtgcccccaagtggga

SEQ ID NO: 232344 - DNA, 20 bp, human
gacagacggcccctcctcgg

SEQ ID NO: 232345 - DNA, 20 bp, human
gggtccctcccctccgagga

SEQ ID NO: 232346 - DNA, 20 bp, human
gctccccgccggcggaagaa

SEQ ID NO: 232347 - DNA, 20 bp, human
gtcggtggggaatgtacttg

SEQ ID NO: 232348 - DNA, 20 bp, human
gagagggcctcgatgcttgc

SEQ ID NO: 232349 - DNA, 20 bp, human
gccgactgatatgacccagc

SEQ ID NO: 232350 - DNA, 20 bp, human
ggccggcggggagctctcgt

SEQ ID NO: 232351 - DNA, 20 bp, human
ggcgcaggcgcgctgctcgg

SEQ ID NO: 232352 - DNA, 20 bp, human
ggcaagacgccgtgaaaagg

SEQ ID NO: 232353 - DNA, 20 bp, human
gaagcatcgaggccctctcc

SEQ ID NO: 232354 - DNA, 20 bp, human
gtcggcgtatttgttaggtg

SEQ ID NO: 232355 - DNA, 20 bp, human
gcaggtcccagcaagcatcg

SEQ ID NO: 232356 - DNA, 20 bp, human
gggagcaggcgggcggtgat

SEQ ID NO: 232357 - DNA, 20 bp, human
gggcgccggccaatgtctcg

SEQ ID NO: 232358 - DNA, 20 bp, human
gagggtcccaggctgcggcg

SEQ ID NO: 232359 - DNA, 20 bp, human
gtcgcggggacccacggcga

SEQ ID NO: 232360 - DNA, 20 bp, human
gcgggctcaggcgaagagga

SEQ ID NO: 232361 - DNA, 20 bp, human
gggaatggggcgggcggact

SEQ ID NO: 232362 - DNA, 20 bp, human
gcgcctgctcccctcgccgt

SEQ ID NO: 232363 - DNA, 20 bp, human
gtcccaggctgcggcggggt

SEQ ID NO: 232364 - DNA, 20 bp, human
ggcgccggggcgggactcga

SEQ ID NO: 232365 - DNA, 20 bp, human
ggtctgcggttgaatcaaca

SEQ ID NO: 232366 - DNA, 20 bp, human
ggcgcacgcacagtaggcga

SEQ ID NO: 232367 - DNA, 20 bp, human
ggggtctgtccaagactaca

SEQ ID NO: 232368 - DNA, 20 bp, human
gacggcaccatgggcctcgg

SEQ ID NO: 232369 - DNA, 20 bp, human
gcgcacggcaccatgggcct

SEQ ID NO: 232370 - DNA, 20 bp, human
gcgcgccgcgcacgcacagt

SEQ ID NO: 232371 - DNA, 20 bp, human
ggcttcgggccttgtagtct

SEQ ID NO: 232372 - DNA, 20 bp, human
gaggggagggccgttggccg

SEQ ID NO: 232373 - DNA, 20 bp, human
ggacccgccgcacggcacca

SEQ ID NO: 232374 - DNA, 20 bp, human
gaggctcttttgttcggctg

SEQ ID NO: 232375 - DNA, 20 bp, human
gggcgcaacgacccgccgca

SEQ ID NO: 232376 - DNA, 20 bp, human
ggcggggcgcgcattgtccg

SEQ ID NO: 232377 - DNA, 20 bp, human
gcgtgcgggccaatcagcga

SEQ ID NO: 232378 - DNA, 20 bp, human
gcccgccccccctcgctgat

SEQ ID NO: 232379 - DNA, 20 bp, human
ggcgggccaatcagcgaggg

SEQ ID NO: 232380 - DNA, 20 bp, human
gccggagcagcgcccctcga

SEQ ID NO: 232381 - DNA, 20 bp, human
ggggcgcgcattgtccgcgg

SEQ ID NO: 232382 - DNA, 20 bp, human
gcgctgcccaaatcccgtgc

SEQ ID NO: 232383 - DNA, 20 bp, human
gccccaggcccgaagtccct

SEQ ID NO: 232384 - DNA, 20 bp, human
ggaatcacgcgggactcggt

SEQ ID NO: 232385 - DNA, 20 bp, human
gtgggcctcgcgctccggcg

SEQ ID NO: 232386 - DNA, 20 bp, human
gccctatccgccgccaatgg

SEQ ID NO: 232387 - DNA, 20 bp, human
gctgggaattggggccctag

SEQ ID NO: 232388 - DNA, 20 bp, human
gcgccgcgcccgctgggaat

SEQ ID NO: 232389 - DNA, 20 bp, human
gaattggggccctaggggga

SEQ ID NO: 232390 - DNA, 20 bp, human
gtggcgcccggtggtcccca

SEQ ID NO: 232391 - DNA, 20 bp, human
gcacgccgggcggccacgaa

SEQ ID NO: 232392 - DNA, 20 bp, human
ggcggggcgaggacagtgac

SEQ ID NO: 232393 - DNA, 20 bp, human
gaccgcaggggcgaggaagt

SEQ ID NO: 232394 - DNA, 20 bp, human
gcacccctggcccgcgtctg

SEQ ID NO: 232395 - DNA, 20 bp, human
gcctcgcccctgcggtgcga

SEQ ID NO: 232396 - DNA, 20 bp, human
gcaggcccggggcctccggt

SEQ ID NO: 232397 - DNA, 20 bp, human
gagggcgccggggaggtgca

SEQ ID NO: 232398 - DNA, 20 bp, human
ggggagggatcggcgagcct

SEQ ID NO: 232399 - DNA, 20 bp, human
ggcgcagccgggcctaccgg

SEQ ID NO: 232400 - DNA, 20 bp, human
gccggggcctccggtaggcc

SEQ ID NO: 232401 - DNA, 20 bp, human
gtcgccgccgagacccttcc

SEQ ID NO: 232402 - DNA, 20 bp, human
gcggacacacctctccttcc

SEQ ID NO: 232403 - DNA, 20 bp, human
gaaggagaggtgtgtccgcc

SEQ ID NO: 232404 - DNA, 20 bp, human
gcagcccggaagggtctcgg

SEQ ID NO: 232405 - DNA, 20 bp, human
gttggcgcagccgggcctac

SEQ ID NO: 232406 - DNA, 20 bp, human
gcgcctgcgcaaccaatcct

SEQ ID NO: 232407 - DNA, 20 bp, human
gaacacgtgaaatggcgggc

SEQ ID NO: 232408 - DNA, 20 bp, human
gcctctgagaacacgtgaaa

SEQ ID NO: 232409 - DNA, 20 bp, human
gcgtagtgggcggagaaaaa

SEQ ID NO: 232410 - DNA, 20 bp, human
gggagtaggcagtgaaccta

SEQ ID NO: 232411 - DNA, 20 bp, human
gaaaatggcgagttttgcgc

SEQ ID NO: 232412 - DNA, 20 bp, human
gggaaccaatggactccaag

SEQ ID NO: 232413 - DNA, 20 bp, human
gtgagaacacgtgaaatggc

SEQ ID NO: 232414 - DNA, 20 bp, human
ggccaacacgcaggcgccgt

SEQ ID NO: 232415 - DNA, 20 bp, human
gcgcagggaaggatccgttt

SEQ ID NO: 232416 - DNA, 20 bp, human
gtcccccggggcggttgcta

SEQ ID NO: 232417 - DNA, 20 bp, human
gcgccggcaagatgtgaggg

SEQ ID NO: 232418 - DNA, 20 bp, human
gggcgcgcgctggctcttaa

SEQ ID NO: 232419 - DNA, 20 bp, human
ggatcctcgcggctggcgcg

SEQ ID NO: 232420 - DNA, 20 bp, human
gtccctagcaaccgccccgg

SEQ ID NO: 232421 - DNA, 20 bp, human
gggccgtcacgtgatcctcg

SEQ ID NO: 232422 - DNA, 20 bp, human
gggcggttgctagggaaagt

SEQ ID NO: 232423 - DNA, 20 bp, human
gagccgcgaggatcacgtga

SEQ ID NO: 232424 - DNA, 20 bp, human
gagggaaagtcggcgctcgc

SEQ ID NO: 232425 - DNA, 20 bp, human
gcacaagccgggcacccatc

SEQ ID NO: 232426 - DNA, 20 bp, human
gagcgagcgcgcgcaaggag

SEQ ID NO: 232427 - DNA, 20 bp, human
gggctcggctcgcgccctga

SEQ ID NO: 232428 - DNA, 20 bp, human
gggagcgcgcggaacggccg

SEQ ID NO: 232429 - DNA, 20 bp, human
gggggcggagctgaccctca

SEQ ID NO: 232430 - DNA, 20 bp, human
ggcccaatcgcaacccgcgg

SEQ ID NO: 232431 - DNA, 20 bp, human
gcgcgtgcgcgcccggacga

SEQ ID NO: 232432 - DNA, 20 bp, human
ggcccccgcgggttgcgatt

SEQ ID NO: 232433 - DNA, 20 bp, human
gcgctgccgtgggacttatt

SEQ ID NO: 232434 - DNA, 20 bp, human
gcccggcgtcacagcaagac

SEQ ID NO: 232435 - DNA, 20 bp, human
gagtcccacggcagcgctcg

SEQ ID NO: 232436 - DNA, 20 bp, human
gtggtcacgtagcaacgcgg

SEQ ID NO: 232437 - DNA, 20 bp, human
gtgcgcccccgcacgctgat

SEQ ID NO: 232438 - DNA, 20 bp, human
gggaggagaactgacgtcag

SEQ ID NO: 232439 - DNA, 20 bp, human
gcactcgcgcgctcggtctc

SEQ ID NO: 232440 - DNA, 20 bp, human
gtcgttagcaacacgtgggg

SEQ ID NO: 232441 - DNA, 20 bp, human
gaacgtcgttagcaacacgt

SEQ ID NO: 232442 - DNA, 20 bp, human
ggtggggcgggaggaagcac

SEQ ID NO: 232443 - DNA, 20 bp, human
ggactccgccccctggcgat

SEQ ID NO: 232444 - DNA, 20 bp, human
gaccgagcgcgcgagtggga

SEQ ID NO: 232445 - DNA, 20 bp, human
gcccggccgctgtcagtctg

SEQ ID NO: 232446 - DNA, 20 bp, human
gacaacgcggcggctcacga

SEQ ID NO: 232447 - DNA, 20 bp, human
gaccaatgtgtcagtggaga

SEQ ID NO: 232448 - DNA, 20 bp, human
ggcccagaccaatgtgtcag

SEQ ID NO: 232449 - DNA, 20 bp, human
gtccactgacacattggtct

SEQ ID NO: 232450 - DNA, 20 bp, human
gaaaggggtaaccggcgcgg

SEQ ID NO: 232451 - DNA, 20 bp, human
gcatctcgcggacaacgcgg

SEQ ID NO: 232452 - DNA, 20 bp, human
gccggctgtcaccatagaaa

SEQ ID NO: 232453 - DNA, 20 bp, human
gaaactccgtgaatcacctc

SEQ ID NO: 232454 - DNA, 20 bp, human
gacaaaggcagtgtcttctg

SEQ ID NO: 232455 - DNA, 20 bp, human
gaggaaaggggtaaccggcg

SEQ ID NO: 232456 - DNA, 20 bp, human
ggagctgtcagatagactct

SEQ ID NO: 232457 - DNA, 20 bp, human
gaggcattgtgagtcatagc

SEQ ID NO: 232458 - DNA, 20 bp, human
gacagagcgtgtcatgggtc

SEQ ID NO: 232459 - DNA, 20 bp, human
gggccaccccaggacaagaa

SEQ ID NO: 232460 - DNA, 20 bp, human
ggagctgtcattcttggcag

SEQ ID NO: 232461 - DNA, 20 bp, human
gagctaacagagcgtgtcat

SEQ ID NO: 232462 - DNA, 20 bp, human
gattcttggcaggggaatga

SEQ ID NO: 232463 - DNA, 20 bp, human
gtccacgtgagaccacactc

SEQ ID NO: 232464 - DNA, 20 bp, human
gcacaaatggcaccacagtt

SEQ ID NO: 232465 - DNA, 20 bp, human
gactaacaagatagtctctc

SEQ ID NO: 232466 - DNA, 20 bp, human
gaggggcggcgacatctgtg

SEQ ID NO: 232467 - DNA, 20 bp, human
gagagcgcgcgcaggtgtga

SEQ ID NO: 232468 - DNA, 20 bp, human
ggggcggtgctgactgtcgc

SEQ ID NO: 232469 - DNA, 20 bp, human
gctcccggcaggtagtgcgt

SEQ ID NO: 232470 - DNA, 20 bp, human
gtgactgtcgcgggctgcga

SEQ ID NO: 232471 - DNA, 20 bp, human
gaaagaggcagagcgcgcgc

SEQ ID NO: 232472 - DNA, 20 bp, human
gacgggctccggcttcacgt

SEQ ID NO: 232473 - DNA, 20 bp, human
ggagcccagtggccgcgctc

SEQ ID NO: 232474 - DNA, 20 bp, human
ggggagttgtagtttcggct

SEQ ID NO: 232475 - DNA, 20 bp, human
gcgcccacgcactacctgcc

SEQ ID NO: 232476 - DNA, 20 bp, human
gagcgagcgcccagcgcctc

SEQ ID NO: 232477 - DNA, 20 bp, human
gactctgggcggttccgccg

SEQ ID NO: 232478 - DNA, 20 bp, human
gtagcgcaggacaggaactc

SEQ ID NO: 232479 - DNA, 20 bp, human
gagtgagggaggaggttcgg

SEQ ID NO: 232480 - DNA, 20 bp, human
gccaacaggtgacaccgggg

SEQ ID NO: 232481 - DNA, 20 bp, human
gcgggtaggtagcgcaggac

SEQ ID NO: 232482 - DNA, 20 bp, human
gccaccggccggctccaatg

SEQ ID NO: 232483 - DNA, 20 bp, human
ggttccgccggggcgtccac

SEQ ID NO: 232484 - DNA, 20 bp, human
gagcgcctcgggctgagtga

SEQ ID NO: 232485 - DNA, 20 bp, human
ggctccaacaggtgacaccg

SEQ ID NO: 232486 - DNA, 20 bp, human
gtactgcccatcatagtcca

SEQ ID NO: 232487 - DNA, 20 bp, human
ggagcctcacaataaggcgg

SEQ ID NO: 232488 - DNA, 20 bp, human
ggactatgatgggcagtaga

SEQ ID NO: 232489 - DNA, 20 bp, human
gggactctagaaaagatgga

SEQ ID NO: 232490 - DNA, 20 bp, human
ggaaggccatggactatgat

SEQ ID NO: 232491 - DNA, 20 bp, human
gggacccccgccttattgtg

SEQ ID NO: 232492 - DNA, 20 bp, human
ggatgcagatgggtggtcca

SEQ ID NO: 232493 - DNA, 20 bp, human
gttcaatgaagcactaaaac

SEQ ID NO: 232494 - DNA, 20 bp, human
gagagtcctctctcaggaga

SEQ ID NO: 232495 - DNA, 20 bp, human
gatagatgagcctcacaata

SEQ ID NO: 232496 - DNA, 20 bp, human
gccaatgaccaatgaaccta

SEQ ID NO: 232497 - DNA, 20 bp, human
gtatttcttgcttagatgtg

SEQ ID NO: 232498 - DNA, 20 bp, human
gttgacaggcatgtttttca

SEQ ID NO: 232499 - DNA, 20 bp, human
ggacatggagaaaacttgac

SEQ ID NO: 232500 - DNA, 20 bp, human
gcttctttccataggttcat

SEQ ID NO: 232501 - DNA, 20 bp, human
gtatggaaagaagctcaatg

SEQ ID NO: 232502 - DNA, 20 bp, human
ggtgcaacaaattactcaat

SEQ ID NO: 232503 - DNA, 20 bp, human
gtcttccatgatgatttaga

SEQ ID NO: 232504 - DNA, 20 bp, human
gtagtccctctaaatcatca

SEQ ID NO: 232505 - DNA, 20 bp, human
ggtatggagccatttcagat

SEQ ID NO: 232506 - DNA, 20 bp, human
gcctcgcttaacaatgagcg

SEQ ID NO: 232507 - DNA, 20 bp, human
gaagggccaggcgtattgag

SEQ ID NO: 232508 - DNA, 20 bp, human
gtggccctttcgctacgaaa

SEQ ID NO: 232509 - DNA, 20 bp, human
gcgaggccaaggcaaccctt

SEQ ID NO: 232510 - DNA, 20 bp, human
ggggaaatagagcgcgccta

SEQ ID NO: 232511 - DNA, 20 bp, human
gaggcgtattgagcggtcag

SEQ ID NO: 232512 - DNA, 20 bp, human
gcgggacccgactcaggtga

SEQ ID NO: 232513 - DNA, 20 bp, human
gccagtaagcgccgttcctc

SEQ ID NO: 232514 - DNA, 20 bp, human
gaaagctgacgggtttgaaa

SEQ ID NO: 232515 - DNA, 20 bp, human
gttcccctttcgtagcgaaa

SEQ ID NO: 232516 - DNA, 20 bp, human
gaggtcggcggagacgaggg

SEQ ID NO: 232517 - DNA, 20 bp, human
ggggccccccaacccacctg

SEQ ID NO: 232518 - DNA, 20 bp, human
gtgccatcccgcggcaactg

SEQ ID NO: 232519 - DNA, 20 bp, human
gacgagggagggaccatatc

SEQ ID NO: 232520 - DNA, 20 bp, human
gcggaagcgcgaccactggt

SEQ ID NO: 232521 - DNA, 20 bp, human
ggaagtgcgccttcccggat

SEQ ID NO: 232522 - DNA, 20 bp, human
gttgccgcgggatggcaagc

SEQ ID NO: 232523 - DNA, 20 bp, human
ggagaggtcggcggagacga

SEQ ID NO: 232524 - DNA, 20 bp, human
ggccaccggaagcgcctctc

SEQ ID NO: 232525 - DNA, 20 bp, human
gtcctgacgcgcatccgatc

SEQ ID NO: 232526 - DNA, 20 bp, human
gcaggggtccggaatattat

SEQ ID NO: 232527 - DNA, 20 bp, human
gggaaaatgaggctaggagt

SEQ ID NO: 232528 - DNA, 20 bp, human
ggcgccccctgccgggaaga

SEQ ID NO: 232529 - DNA, 20 bp, human
ggtccagcaagtctgtcaat

SEQ ID NO: 232530 - DNA, 20 bp, human
gggtacctgcggtgtccggc

SEQ ID NO: 232531 - DNA, 20 bp, human
gtccggaatattatggggct

SEQ ID NO: 232532 - DNA, 20 bp, human
gcgagacaacttgaacctca

SEQ ID NO: 232533 - DNA, 20 bp, human
gaggagcaggacgcttggtc

SEQ ID NO: 232534 - DNA, 20 bp, human
gccccagccccataatattc

SEQ ID NO: 232535 - DNA, 20 bp, human
gaccacctgcacggggagca

SEQ ID NO: 232536 - DNA, 20 bp, human
ggtcacttccggggcggagg

SEQ ID NO: 232537 - DNA, 20 bp, human
gccgccgcgttcgcgcccgg

SEQ ID NO: 232538 - DNA, 20 bp, human
gctagcgccctgctgcttcg

SEQ ID NO: 232539 - DNA, 20 bp, human
gaagcagcagggcgctagcg

SEQ ID NO: 232540 - DNA, 20 bp, human
gtggccgccgcgttcgcgcc

SEQ ID NO: 232541 - DNA, 20 bp, human
gggcggtgacgtcacttccg

SEQ ID NO: 232542 - DNA, 20 bp, human
gctagcgcggaggcgagagc

SEQ ID NO: 232543 - DNA, 20 bp, human
gaggcgccggagcagcgctg

SEQ ID NO: 232544 - DNA, 20 bp, human
ggccgagggcgtgtgtaagt

SEQ ID NO: 232545 - DNA, 20 bp, human
ggtgagggacaaacaaaagg

SEQ ID NO: 232546 - DNA, 20 bp, human
gtaggccaggatctctaggc

SEQ ID NO: 232547 - DNA, 20 bp, human
gacggcgcgcgatgacggtg

SEQ ID NO: 232548 - DNA, 20 bp, human
gcccggatgtggccagggat

SEQ ID NO: 232549 - DNA, 20 bp, human
ggcgagcccggatgtggcca

SEQ ID NO: 232550 - DNA, 20 bp, human
gatcgcggaatggatggaaa

SEQ ID NO: 232551 - DNA, 20 bp, human
gcgggcttgcgggaacaagg

SEQ ID NO: 232552 - DNA, 20 bp, human
gggatgaggggtgttttttt

SEQ ID NO: 232553 - DNA, 20 bp, human
ggtggggtccgccgcgatcg

SEQ ID NO: 232554 - DNA, 20 bp, human
gttgggcttgagtgaggaag

SEQ ID NO: 232555 - DNA, 20 bp, human
ggactcacggcgcgcgatga

SEQ ID NO: 232556 - DNA, 20 bp, human
ggcagcgggtcacgtcacag

SEQ ID NO: 232557 - DNA, 20 bp, human
gacaccgctccggctcttgg

SEQ ID NO: 232558 - DNA, 20 bp, human
gacgtgacccgctgccccgt

SEQ ID NO: 232559 - DNA, 20 bp, human
gttcacttggcacaccgctc

SEQ ID NO: 232560 - DNA, 20 bp, human
ggttccgccaagagccggag

SEQ ID NO: 232561 - DNA, 20 bp, human
gggcacaccgctccggctct

SEQ ID NO: 232562 - DNA, 20 bp, human
gaacgcacaagcactttggt

SEQ ID NO: 232563 - DNA, 20 bp, human
gactttggttggttaaatta

SEQ ID NO: 232564 - DNA, 20 bp, human
gcgaacagattgctgcttgc

SEQ ID NO: 232565 - DNA, 20 bp, human
ggcgcgactacgctcataaa

SEQ ID NO: 232566 - DNA, 20 bp, human
ggggcccccgaagcggtcgc

SEQ ID NO: 232567 - DNA, 20 bp, human
ggaggccccacccccgtgag

SEQ ID NO: 232568 - DNA, 20 bp, human
gggggcgcctagtacgtagt

SEQ ID NO: 232569 - DNA, 20 bp, human
ggaggggccgagagttgcgg

SEQ ID NO: 232570 - DNA, 20 bp, human
gaactctcggcccctcacgg

SEQ ID NO: 232571 - DNA, 20 bp, human
ggggacgcccagctgttttg

SEQ ID NO: 232572 - DNA, 20 bp, human
gtaggcgcccccagcagaaa

SEQ ID NO: 232573 - DNA, 20 bp, human
ggggctccagcctaacttcg

SEQ ID NO: 232574 - DNA, 20 bp, human
gagagcgggccgtaccccaa

SEQ ID NO: 232575 - DNA, 20 bp, human
gcccaccgagctgctggggt

SEQ ID NO: 232576 - DNA, 20 bp, human
gaaacggagccgacccggag

SEQ ID NO: 232577 - DNA, 20 bp, human
gcatagccggagacggagac

SEQ ID NO: 232578 - DNA, 20 bp, human
gagcaccgcgctaactacgg

SEQ ID NO: 232579 - DNA, 20 bp, human
gaagggaaacggagccgacc

SEQ ID NO: 232580 - DNA, 20 bp, human
gtccgtctccggctatgcgc

SEQ ID NO: 232581 - DNA, 20 bp, human
gcctccacgcccaggagcgt

SEQ ID NO: 232582 - DNA, 20 bp, human
gggagtgcggcgcatgcgag

SEQ ID NO: 232583 - DNA, 20 bp, human
gccgcctgcccgcccggaaa

SEQ ID NO: 232584 - DNA, 20 bp, human
gaccgcgctaactacggggg

SEQ ID NO: 232585 - DNA, 20 bp, human
gaagctgactgtgcaaaaga

SEQ ID NO: 232586 - DNA, 20 bp, human
gttggagcagcccacgtctt

SEQ ID NO: 232587 - DNA, 20 bp, human
ggacgagtagcccaagacgt

SEQ ID NO: 232588 - DNA, 20 bp, human
gcagaccacgcccgcagctg

SEQ ID NO: 232589 - DNA, 20 bp, human
gtcgggaccaccctgaaaat

SEQ ID NO: 232590 - DNA, 20 bp, human
gactccgccttgccagtccg

SEQ ID NO: 232591 - DNA, 20 bp, human
gcctccccccattttcaggg

SEQ ID NO: 232592 - DNA, 20 bp, human
gcctgcgcccgccgccagga

SEQ ID NO: 232593 - DNA, 20 bp, human
gtgcctgaggaccagttccg

SEQ ID NO: 232594 - DNA, 20 bp, human
gggggcggaagcacgatctc

SEQ ID NO: 232595 - DNA, 20 bp, human
gaaggcgacagcggcgtctg

SEQ ID NO: 232596 - DNA, 20 bp, human
gcctgcgcacttagcgggga

SEQ ID NO: 232597 - DNA, 20 bp, human
ggaagtgaagacaactttcc

SEQ ID NO: 232598 - DNA, 20 bp, human
gcaggagcctgcgcacttag

SEQ ID NO: 232599 - DNA, 20 bp, human
gtccgggccgcggtctaggg

SEQ ID NO: 232600 - DNA, 20 bp, human
gtaaaaaagaacagtggacg

SEQ ID NO: 232601 - DNA, 20 bp, human
ggataaatgcgtaggagcca

SEQ ID NO: 232602 - DNA, 20 bp, human
gacttccgggccgcggtcta

SEQ ID NO: 232603 - DNA, 20 bp, human
gacgtagccgccctagaccg

SEQ ID NO: 232604 - DNA, 20 bp, human
gtagaaaacgcgcagtagac

SEQ ID NO: 232605 - DNA, 20 bp, human
ggcgcagtagacgggcgcgg

SEQ ID NO: 232606 - DNA, 20 bp, human
gtggacagctggaagcgctt

SEQ ID NO: 232607 - DNA, 20 bp, human
ggtcggtaagcatggaagaa

SEQ ID NO: 232608 - DNA, 20 bp, human
ggcgatgggcgcaacaaggg

SEQ ID NO: 232609 - DNA, 20 bp, human
gggcgagaaggatgctagat

SEQ ID NO: 232610 - DNA, 20 bp, human
ggctggaagcaacggcgaga

SEQ ID NO: 232611 - DNA, 20 bp, human
gcatgcgacagagtgtgacc

SEQ ID NO: 232612 - DNA, 20 bp, human
gaagggaggtggaattccag

SEQ ID NO: 232613 - DNA, 20 bp, human
ggaggtggaattccagaggt

SEQ ID NO: 232614 - DNA, 20 bp, human
ggccatgtgctggaaggtaa

SEQ ID NO: 232615 - DNA, 20 bp, human
gtcaggatgccagtgcactt

SEQ ID NO: 232616 - DNA, 20 bp, human
gcccggggactcttcaacga

SEQ ID NO: 232617 - DNA, 20 bp, human
gtggaactgagcgacggaac

SEQ ID NO: 232618 - DNA, 20 bp, human
gcctccccgaagctcaggca

SEQ ID NO: 232619 - DNA, 20 bp, human
gcacccgcgaacaggcgggg

SEQ ID NO: 232620 - DNA, 20 bp, human
ggtgtcgtggaactgagcga

SEQ ID NO: 232621 - DNA, 20 bp, human
gcccctcgttgaagagtccc

SEQ ID NO: 232622 - DNA, 20 bp, human
gggcgctagcctggcccgac

SEQ ID NO: 232623 - DNA, 20 bp, human
ggggcgggggagtgctgtaa

SEQ ID NO: 232624 - DNA, 20 bp, human
gaagtgtcacggggagccga

SEQ ID NO: 232625 - DNA, 20 bp, human
gcgtttgcggcagaagcaga

SEQ ID NO: 232626 - DNA, 20 bp, human
gcacgcgcacgcgagcaggc

SEQ ID NO: 232627 - DNA, 20 bp, human
ggccacgcccactccccgta

SEQ ID NO: 232628 - DNA, 20 bp, human
ggccccgccctacggggagt

SEQ ID NO: 232629 - DNA, 20 bp, human
ggggaaagtccccggacctc

SEQ ID NO: 232630 - DNA, 20 bp, human
gtggtctggccccgccctac

SEQ ID NO: 232631 - DNA, 20 bp, human
gcgagcaggccggccggctc

SEQ ID NO: 232632 - DNA, 20 bp, human
gaggacgtggttcgtgctga

SEQ ID NO: 232633 - DNA, 20 bp, human
gcactgcctgcgtaactaga

SEQ ID NO: 232634 - DNA, 20 bp, human
gacgcccactccccgtaggg

SEQ ID NO: 232635 - DNA, 20 bp, human
gtgtccgcgcaccaaccaca

SEQ ID NO: 232636 - DNA, 20 bp, human
gtcacaggaagctactctgt

SEQ ID NO: 232637 - DNA, 20 bp, human
gggcgtcttcagatatccca

SEQ ID NO: 232638 - DNA, 20 bp, human
ggtaagtcaagattcgtaga

SEQ ID NO: 232639 - DNA, 20 bp, human
gctaccagcaggaaaagtca

SEQ ID NO: 232640 - DNA, 20 bp, human
gcaagattcgtagaaggcga

SEQ ID NO: 232641 - DNA, 20 bp, human
gttcctgctggtagtaactg

SEQ ID NO: 232642 - DNA, 20 bp, human
gtacgaatcttgacttactc

SEQ ID NO: 232643 - DNA, 20 bp, human
ggagtagcttcctgtgaatt

SEQ ID NO: 232644 - DNA, 20 bp, human
ggggctgccgtcgttgccct

SEQ ID NO: 232645 - DNA, 20 bp, human
ggcccacagttactaccagc

SEQ ID NO: 232646 - DNA, 20 bp, human
gagcgggagcccgaggtcga

SEQ ID NO: 232647 - DNA, 20 bp, human
gagagccgacaagtggaaac

SEQ ID NO: 232648 - DNA, 20 bp, human
gtctctacgcatccgggcgc

SEQ ID NO: 232649 - DNA, 20 bp, human
gtgcgtagagagccgacaag

SEQ ID NO: 232650 - DNA, 20 bp, human
gcgcgccgcggctccagctt

SEQ ID NO: 232651 - DNA, 20 bp, human
gtgtccctgtttccacttgt

SEQ ID NO: 232652 - DNA, 20 bp, human
gccagcttgggcgggctcac

SEQ ID NO: 232653 - DNA, 20 bp, human
ggcttgggcgggctcacggg

SEQ ID NO: 232654 - DNA, 20 bp, human
gtgtcggctctctacgcatc

SEQ ID NO: 232655 - DNA, 20 bp, human
gtcgccatccaacccagacg

SEQ ID NO: 232656 - DNA, 20 bp, human
gggcggggtgaggactgcgc

SEQ ID NO: 232657 - DNA, 20 bp, human
gggtcgggcggaagtcggtc

SEQ ID NO: 232658 - DNA, 20 bp, human
ggagcaaggtcggcgggatt

SEQ ID NO: 232659 - DNA, 20 bp, human
ggggcgggtcgggcggaagt

SEQ ID NO: 232660 - DNA, 20 bp, human
gggaagggagcaaggtcggc

SEQ ID NO: 232661 - DNA, 20 bp, human
gtctgatgaaccctggagga

SEQ ID NO: 232662 - DNA, 20 bp, human
gtcccgagtgcaggcgtctg

SEQ ID NO: 232663 - DNA, 20 bp, human
gcaggcgtctgcggccccca

SEQ ID NO: 232664 - DNA, 20 bp, human
ggccgcagacgcctgcactc

SEQ ID NO: 232665 - DNA, 20 bp, human
gccgacccgcccacctctac

SEQ ID NO: 232666 - DNA, 20 bp, human
gtccgcaagcggccacccga

SEQ ID NO: 232667 - DNA, 20 bp, human
gcggccccctgcgtccgctg

SEQ ID NO: 232668 - DNA, 20 bp, human
gagactgggcgggacctgtg

SEQ ID NO: 232669 - DNA, 20 bp, human
ggggatggggcggagagact

SEQ ID NO: 232670 - DNA, 20 bp, human
ggggccgagcgggagatgtg

SEQ ID NO: 232671 - DNA, 20 bp, human
gagggctaacggctggggcg

SEQ ID NO: 232672 - DNA, 20 bp, human
gggtacccgccggaccaaag

SEQ ID NO: 232673 - DNA, 20 bp, human
gtccctggtggggtcccggt

SEQ ID NO: 232674 - DNA, 20 bp, human
gtgcggggaggcgcccaggt

SEQ ID NO: 232675 - DNA, 20 bp, human
gccaaagcggtgcggagaaa

SEQ ID NO: 232676 - DNA, 20 bp, human
ggggccgaaatgcgaggcgg

SEQ ID NO: 232677 - DNA, 20 bp, human
gagggcggggccgagatgta

SEQ ID NO: 232678 - DNA, 20 bp, human
ggcggggccgaaatgcgagg

SEQ ID NO: 232679 - DNA, 20 bp, human
gggaggggcaaggtgccggg

SEQ ID NO: 232680 - DNA, 20 bp, human
gcgagggaggggcaaggtgc

SEQ ID NO: 232681 - DNA, 20 bp, human
gcccctccccgcctgaatcc

SEQ ID NO: 232682 - DNA, 20 bp, human
gccgcccctcccctgcatcc

SEQ ID NO: 232683 - DNA, 20 bp, human
gggccgggattcaggcgggg

SEQ ID NO: 232684 - DNA, 20 bp, human
gagggcggggctgagatgcg

SEQ ID NO: 232685 - DNA, 20 bp, human
ggggggccgggattcaggcg

SEQ ID NO: 232686 - DNA, 20 bp, human
gcgaccggacgcgaggaaag

SEQ ID NO: 232687 - DNA, 20 bp, human
ggggtccgcacggagacagg

SEQ ID NO: 232688 - DNA, 20 bp, human
ggctgccaaggacacagtaa

SEQ ID NO: 232689 - DNA, 20 bp, human
ggctgggtccgcacggagac

SEQ ID NO: 232690 - DNA, 20 bp, human
gtgccccgcctgtctccgtg

SEQ ID NO: 232691 - DNA, 20 bp, human
gtcctcgcgtccggtcgccc

SEQ ID NO: 232692 - DNA, 20 bp, human
gcaacctggctgggtccgca

SEQ ID NO: 232693 - DNA, 20 bp, human
gtcgcagccggagtgacgcg

SEQ ID NO: 232694 - DNA, 20 bp, human
gacgcggtggcgcgttgccc

SEQ ID NO: 232695 - DNA, 20 bp, human
gcactccggctgcgacgcgg

SEQ ID NO: 232696 - DNA, 20 bp, human
gcgcccggggaggcccacgt

SEQ ID NO: 232697 - DNA, 20 bp, human
ggcgcgctggagggcggaag

SEQ ID NO: 232698 - DNA, 20 bp, human
ggggcgtggccagaaaccgg

SEQ ID NO: 232699 - DNA, 20 bp, human
gcggaagtgggtgagacctc

SEQ ID NO: 232700 - DNA, 20 bp, human
gtgggtgtgcccgaagcctg

SEQ ID NO: 232701 - DNA, 20 bp, human
ggtaaggcacgccccctccg

SEQ ID NO: 232702 - DNA, 20 bp, human
gtacacccactcgctctgta

SEQ ID NO: 232703 - DNA, 20 bp, human
ggcggcggctgctgcccacg

SEQ ID NO: 232704 - DNA, 20 bp, human
ggacccccctaatatcccca

SEQ ID NO: 232705 - DNA, 20 bp, human
gcagaaaccggggggcggta

SEQ ID NO: 232706 - DNA, 20 bp, human
gaggccgcgggagaaactat

SEQ ID NO: 232707 - DNA, 20 bp, human
gcgggagaaactatgggagg

SEQ ID NO: 232708 - DNA, 20 bp, human
gaggggcggagaaggatgcg

SEQ ID NO: 232709 - DNA, 20 bp, human
gccgcgggagaaactatggg

SEQ ID NO: 232710 - DNA, 20 bp, human
gggcctgtggagcggtgctg

SEQ ID NO: 232711 - DNA, 20 bp, human
ggactgagaactgatgggca

SEQ ID NO: 232712 - DNA, 20 bp, human
gtgaggacagcggccaggga

SEQ ID NO: 232713 - DNA, 20 bp, human
gccacggactgagaactgat

SEQ ID NO: 232714 - DNA, 20 bp, human
gcagtccgtgggaaccctgc

SEQ ID NO: 232715 - DNA, 20 bp, human
gtgcgaggcgtagacctgca

SEQ ID NO: 232716 - DNA, 20 bp, human
gccggcagggcgttctcctt

SEQ ID NO: 232717 - DNA, 20 bp, human
gtgggtccgggagaatctgt

SEQ ID NO: 232718 - DNA, 20 bp, human
gggcgtggggatccccagat

SEQ ID NO: 232719 - DNA, 20 bp, human
gccggcagcaccaaggcctc

SEQ ID NO: 232720 - DNA, 20 bp, human
gtctgggtcagcttctttaa

SEQ ID NO: 232721 - DNA, 20 bp, human
gcagtctatcggttatccca

SEQ ID NO: 232722 - DNA, 20 bp, human
gggaccatcttggttgaggg

SEQ ID NO: 232723 - DNA, 20 bp, human
gcaaggggcgttcccatctg

SEQ ID NO: 232724 - DNA, 20 bp, human
gctgtcctgccaaactgcgg

SEQ ID NO: 232725 - DNA, 20 bp, human
ggacgaggatggagaagcct

SEQ ID NO: 232726 - DNA, 20 bp, human
gctcccaggcgagtgtggga

SEQ ID NO: 232727 - DNA, 20 bp, human
gagccgcaggctgaggatgc

SEQ ID NO: 232728 - DNA, 20 bp, human
gccgcccccaaccattgtgt

SEQ ID NO: 232729 - DNA, 20 bp, human
gggctgcgcagcaaccaagg

SEQ ID NO: 232730 - DNA, 20 bp, human
gagcctagccccagcttcgg

SEQ ID NO: 232731 - DNA, 20 bp, human
gtcccggcagcggggagcgt

SEQ ID NO: 232732 - DNA, 20 bp, human
ggcggctcccaggcgagtgt

SEQ ID NO: 232733 - DNA, 20 bp, human
gccctctccgacacaatggt

SEQ ID NO: 232734 - DNA, 20 bp, human
gcagggctgcgcagcaacca

SEQ ID NO: 232735 - DNA, 20 bp, human
gtagccccagcttcggtggt

SEQ ID NO: 232736 - DNA, 20 bp, human
gctggggcttagggtgtctc

SEQ ID NO: 232737 - DNA, 20 bp, human
gcaaatcccggcatccctcg

SEQ ID NO: 232738 - DNA, 20 bp, human
gccggcatccctcgcggcag

SEQ ID NO: 232739 - DNA, 20 bp, human
gtgaacctaggtcatactct

SEQ ID NO: 232740 - DNA, 20 bp, human
ggacctcttagctggggctt

SEQ ID NO: 232741 - DNA, 20 bp, human
ggtgacgtggggtcgagagc

SEQ ID NO: 232742 - DNA, 20 bp, human
gggcttagggtgtctctggc

SEQ ID NO: 232743 - DNA, 20 bp, human
gtgaggtggagggttctaga

SEQ ID NO: 232744 - DNA, 20 bp, human
gttctagaaggcgtgacgtg

SEQ ID NO: 232745 - DNA, 20 bp, human
gatacgaaacttgcggagtg

SEQ ID NO: 232746 - DNA, 20 bp, human
gttgtccggaagaataaggg

SEQ ID NO: 232747 - DNA, 20 bp, human
gaagttgtccggaagaataa

SEQ ID NO: 232748 - DNA, 20 bp, human
gacaacttgcctagtgggtg

SEQ ID NO: 232749 - DNA, 20 bp, human
gcggaagaataagggcgggg

SEQ ID NO: 232750 - DNA, 20 bp, human
gacgagaatgagagactggg

SEQ ID NO: 232751 - DNA, 20 bp, human
gaatcaatgcggggttatta

SEQ ID NO: 232752 - DNA, 20 bp, human
gagagtggataaatgtctcg

SEQ ID NO: 232753 - DNA, 20 bp, human
gggcctgcgcgatgcaagac

SEQ ID NO: 232754 - DNA, 20 bp, human
gtccggacaacttgcctagt

SEQ ID NO: 232755 - DNA, 20 bp, human
gatgtctcgcggccaatcca

SEQ ID NO: 232756 - DNA, 20 bp, human
ggggttccaggatcagggtc

SEQ ID NO: 232757 - DNA, 20 bp, human
gcctactcctccctggattg

SEQ ID NO: 232758 - DNA, 20 bp, human
ggatcagggtcaggagcagg

SEQ ID NO: 232759 - DNA, 20 bp, human
gatcctggaacccccaatcc

SEQ ID NO: 232760 - DNA, 20 bp, human
gagggggagtgcaaggtaag

SEQ ID NO: 232761 - DNA, 20 bp, human
gtggaacccccaatccaggg

SEQ ID NO: 232762 - DNA, 20 bp, human
ggggtggctggccaactaaa

SEQ ID NO: 232763 - DNA, 20 bp, human
gcaggagcaggcgggcagga

SEQ ID NO: 232764 - DNA, 20 bp, human
gtgcatagcctactcctccc

SEQ ID NO: 232765 - DNA, 20 bp, human
gggcctcatagtgagggagg

SEQ ID NO: 232766 - DNA, 20 bp, human
gaggactagggtcacccctg

SEQ ID NO: 232767 - DNA, 20 bp, human
ggccctgaaactgcccccag

SEQ ID NO: 232768 - DNA, 20 bp, human
gagcagaaaactgggaagaa

SEQ ID NO: 232769 - DNA, 20 bp, human
gacccctgggggcagtttca

SEQ ID NO: 232770 - DNA, 20 bp, human
gtgagcaccctgagtggacc

SEQ ID NO: 232771 - DNA, 20 bp, human
gctactgcccaaattcccag

SEQ ID NO: 232772 - DNA, 20 bp, human
gtgggccattacctagtggg

SEQ ID NO: 232773 - DNA, 20 bp, human
gcagacaggcaagggttaaa

SEQ ID NO: 232774 - DNA, 20 bp, human
gtgtgggccggcccagttcc

SEQ ID NO: 232775 - DNA, 20 bp, human
gttcagggccaggtccactc

SEQ ID NO: 232776 - DNA, 20 bp, human
gtgcgcacacgctttctcga

SEQ ID NO: 232777 - DNA, 20 bp, human
gtggggtgaggggcgccagt

SEQ ID NO: 232778 - DNA, 20 bp, human
ggcgtggcctcggcgaggga

SEQ ID NO: 232779 - DNA, 20 bp, human
gggtccctgggggacgactt

SEQ ID NO: 232780 - DNA, 20 bp, human
ggcggagccctccctcgccg

SEQ ID NO: 232781 - DNA, 20 bp, human
gactgcttgagggtccctgg

SEQ ID NO: 232782 - DNA, 20 bp, human
gcacgctttctcgagggcgg

SEQ ID NO: 232783 - DNA, 20 bp, human
gcgccaggagcgaacaagct

SEQ ID NO: 232784 - DNA, 20 bp, human
gacaacagggagggtagctg

SEQ ID NO: 232785 - DNA, 20 bp, human
gcaccccaagtcgtccccca

SEQ ID NO: 232786 - DNA, 20 bp, human
ggaaacttccgcaatgttct

SEQ ID NO: 232787 - DNA, 20 bp, human
gacacagcatgggtgtagta

SEQ ID NO: 232788 - DNA, 20 bp, human
gggcggaaggccaggaagaa

SEQ ID NO: 232789 - DNA, 20 bp, human
gcggcacccagtgtgtctgt

SEQ ID NO: 232790 - DNA, 20 bp, human
gtgtagtaggggagcgcaaa

SEQ ID NO: 232791 - DNA, 20 bp, human
gccaacaccaacagacacac

SEQ ID NO: 232792 - DNA, 20 bp, human
gtctctatggtcgggtgggt

SEQ ID NO: 232793 - DNA, 20 bp, human
ggggaaggaactaaagttga

SEQ ID NO: 232794 - DNA, 20 bp, human
gtggaccgagtatgccctga

SEQ ID NO: 232795 - DNA, 20 bp, human
gtggggatatagcgaaaatg

SEQ ID NO: 232796 - DNA, 20 bp, human
gccgacaggaagtcccgaat

SEQ ID NO: 232797 - DNA, 20 bp, human
gtagaccggtgtgcaaccga

SEQ ID NO: 232798 - DNA, 20 bp, human
gcggctgcccaatttcgttg

SEQ ID NO: 232799 - DNA, 20 bp, human
gcctgcccgggcacctccac

SEQ ID NO: 232800 - DNA, 20 bp, human
gtcgttgaggctcaggacga

SEQ ID NO: 232801 - DNA, 20 bp, human
gactccagctgacccgctcg

SEQ ID NO: 232802 - DNA, 20 bp, human
ggaggcgggtaggaggaaca

SEQ ID NO: 232803 - DNA, 20 bp, human
ggggcggcaaattgtcacag

SEQ ID NO: 232804 - DNA, 20 bp, human
gctcaggacgagggacgggg

SEQ ID NO: 232805 - DNA, 20 bp, human
gagatggggagcaaaggtta

SEQ ID NO: 232806 - DNA, 20 bp, human
ggggcctcggacccaagcca

SEQ ID NO: 232807 - DNA, 20 bp, human
ggcccgcggtccatgagggg

SEQ ID NO: 232808 - DNA, 20 bp, human
gagcgcgcccgcggtccatg

SEQ ID NO: 232809 - DNA, 20 bp, human
gccgatgcccggatgaaaga

SEQ ID NO: 232810 - DNA, 20 bp, human
gcagtgggacgcagagactc

SEQ ID NO: 232811 - DNA, 20 bp, human
gcgtcccactggtgacgctg

SEQ ID NO: 232812 - DNA, 20 bp, human
gtaaatgagcgtagggaatg

SEQ ID NO: 232813 - DNA, 20 bp, human
ggcagctgcgactacacacg

SEQ ID NO: 232814 - DNA, 20 bp, human
gtggtccggcggcttcagcc

SEQ ID NO: 232815 - DNA, 20 bp, human
gctaggagaggggagataaa

SEQ ID NO: 232816 - DNA, 20 bp, human
ggctgcccaagtgtgattct

SEQ ID NO: 232817 - DNA, 20 bp, human
ggggcagccatgaccctctt

SEQ ID NO: 232818 - DNA, 20 bp, human
gcaggggccggaggggacat

SEQ ID NO: 232819 - DNA, 20 bp, human
gcaggctgcgggaagaggat

SEQ ID NO: 232820 - DNA, 20 bp, human
gtcttcccgcagcctgctga

SEQ ID NO: 232821 - DNA, 20 bp, human
gacaccaaatgagctcattt

SEQ ID NO: 232822 - DNA, 20 bp, human
gtgagtgccgatgtcccctc

SEQ ID NO: 232823 - DNA, 20 bp, human
gatgggggagcaggggccgg

SEQ ID NO: 232824 - DNA, 20 bp, human
gtctcaccctggaacttctt

SEQ ID NO: 232825 - DNA, 20 bp, human
ggcacccccagaatcacact

SEQ ID NO: 232826 - DNA, 20 bp, human
gcgtgggcgcagtcccagac

SEQ ID NO: 232827 - DNA, 20 bp, human
gcgcccacgcggtcacgtgg

SEQ ID NO: 232828 - DNA, 20 bp, human
gctaacatcaggttgcacac

SEQ ID NO: 232829 - DNA, 20 bp, human
gcgagctgcctccatggccc

SEQ ID NO: 232830 - DNA, 20 bp, human
gtggcccagggcgacctcac

SEQ ID NO: 232831 - DNA, 20 bp, human
gtgcacacaggaacacagtg

SEQ ID NO: 232832 - DNA, 20 bp, human
gggccaccacgtgaccgcgt

SEQ ID NO: 232833 - DNA, 20 bp, human
gagtcccagacaggaaacgc

SEQ ID NO: 232834 - DNA, 20 bp, human
ggcgcacgcgcacggagagg

SEQ ID NO: 232835 - DNA, 20 bp, human
gcggtcacgtggtggcccgg

SEQ ID NO: 232836 - DNA, 20 bp, human
gtggcccccgagtgcgggaa

SEQ ID NO: 232837 - DNA, 20 bp, human
ggcggcgcgcggcattgtgg

SEQ ID NO: 232838 - DNA, 20 bp, human
ggagcggaagccgagtgcga

SEQ ID NO: 232839 - DNA, 20 bp, human
gctgacccagggtaggtgca

SEQ ID NO: 232840 - DNA, 20 bp, human
ggctgcgtcgttctgaccca

SEQ ID NO: 232841 - DNA, 20 bp, human
ggctgcgcggcaaccagaga

SEQ ID NO: 232842 - DNA, 20 bp, human
ggccgccgcttcctcattct

SEQ ID NO: 232843 - DNA, 20 bp, human
gggcggctggcccccgagtg

SEQ ID NO: 232844 - DNA, 20 bp, human
ggcgcggcaaccagagaggg

SEQ ID NO: 232845 - DNA, 20 bp, human
gaagaccccgccgccctctc

SEQ ID NO: 232846 - DNA, 20 bp, human
gtcccccgccagctcgaccc

SEQ ID NO: 232847 - DNA, 20 bp, human
ggcggcaacagcagacatgt

SEQ ID NO: 232848 - DNA, 20 bp, human
gcacaccggggtcgagctgg

SEQ ID NO: 232849 - DNA, 20 bp, human
ggcaacagcagacatgtcgg

SEQ ID NO: 232850 - DNA, 20 bp, human
ggagtcgagcggggctgcag

SEQ ID NO: 232851 - DNA, 20 bp, human
gccggagcgggtactgagtg

SEQ ID NO: 232852 - DNA, 20 bp, human
gccgcgcctgcgcaccacgc

SEQ ID NO: 232853 - DNA, 20 bp, human
gaccacgccggagtcgagcg

SEQ ID NO: 232854 - DNA, 20 bp, human
gtcagtacccgctccgggcg

SEQ ID NO: 232855 - DNA, 20 bp, human
ggccccgctcgactccggcg

SEQ ID NO: 232856 - DNA, 20 bp, human
gtaacaacttctggattgaa

SEQ ID NO: 232857 - DNA, 20 bp, human
gtgttggcaggtctgaatgc

SEQ ID NO: 232858 - DNA, 20 bp, human
gacacacagtgtcataacca

SEQ ID NO: 232859 - DNA, 20 bp, human
gaatacaatggtttccgttg

SEQ ID NO: 232860 - DNA, 20 bp, human
gactggaatgcacttcactg

SEQ ID NO: 232861 - DNA, 20 bp, human
gtttaccctcaacttgacca

SEQ ID NO: 232862 - DNA, 20 bp, human
gcaaaccatcactggaaatg

SEQ ID NO: 232863 - DNA, 20 bp, human
ggtctgtttgcctaaagcca

SEQ ID NO: 232864 - DNA, 20 bp, human
gtgtagtcagtcttagctgc

SEQ ID NO: 232865 - DNA, 20 bp, human
gagttactagtaacaacttc

SEQ ID NO: 232866 - DNA, 20 bp, human
gaaagtgacagaggcgctga

SEQ ID NO: 232867 - DNA, 20 bp, human
ggcggctaggtcacctcctc

SEQ ID NO: 232868 - DNA, 20 bp, human
gcccaacaggagagcggaat

SEQ ID NO: 232869 - DNA, 20 bp, human
gcatctctgtgcagaacgtt

SEQ ID NO: 232870 - DNA, 20 bp, human
ggccctggcaaccgtcacca

SEQ ID NO: 232871 - DNA, 20 bp, human
gtaactccccaacaggagag

SEQ ID NO: 232872 - DNA, 20 bp, human
gagagttctgaaagtgacag

SEQ ID NO: 232873 - DNA, 20 bp, human
gctactctacgggggccgag

SEQ ID NO: 232874 - DNA, 20 bp, human
gcgttttcaacgctactcta

SEQ ID NO: 232875 - DNA, 20 bp, human
gagcacgatctcgagtgcgc

SEQ ID NO: 232876 - DNA, 20 bp, human
gcggttgggcggggcattcc

SEQ ID NO: 232877 - DNA, 20 bp, human
gcgttctgcgacgccggagt

SEQ ID NO: 232878 - DNA, 20 bp, human
ggggcggggcattcctggat

SEQ ID NO: 232879 - DNA, 20 bp, human
ggagcctcttggcgtaagcg

SEQ ID NO: 232880 - DNA, 20 bp, human
gcaaccgcgcttacgccaag

SEQ ID NO: 232881 - DNA, 20 bp, human
gcgctgcagccggtcagcga

SEQ ID NO: 232882 - DNA, 20 bp, human
gaggaggcgggcctcggatt

SEQ ID NO: 232883 - DNA, 20 bp, human
gggattgggcctcacgtagt

SEQ ID NO: 232884 - DNA, 20 bp, human
gcgccggagtgggccaatcc

SEQ ID NO: 232885 - DNA, 20 bp, human
gtgggcctcacgtagtgggc

SEQ ID NO: 232886 - DNA, 20 bp, human
ggttggccccgtgaaaacaa

SEQ ID NO: 232887 - DNA, 20 bp, human
gttgtcagggcgaccggggt

SEQ ID NO: 232888 - DNA, 20 bp, human
gtaaaggcttggccacgttc

SEQ ID NO: 232889 - DNA, 20 bp, human
ggtcgccctgacaacagcgc

SEQ ID NO: 232890 - DNA, 20 bp, human
gtgaagagcgagtaaaggct

SEQ ID NO: 232891 - DNA, 20 bp, human
gaccattgaagagcgagtaa

SEQ ID NO: 232892 - DNA, 20 bp, human
gctccaccggcgcttaatca

SEQ ID NO: 232893 - DNA, 20 bp, human
ggctgttgtcagggcgaccg

SEQ ID NO: 232894 - DNA, 20 bp, human
gacaaagaacaattaagaga

SEQ ID NO: 232895 - DNA, 20 bp, human
gagaacaattaagagaaggt

SEQ ID NO: 232896 - DNA, 20 bp, human
gaactaaagtggccaaccca

SEQ ID NO: 232897 - DNA, 20 bp, human
ggtaagaccggcgatcgcag

SEQ ID NO: 232898 - DNA, 20 bp, human
gtcccctaggagtgtgaggg

SEQ ID NO: 232899 - DNA, 20 bp, human
gtcacctggtctagaggggc

SEQ ID NO: 232900 - DNA, 20 bp, human
gtggtctagaggggcggggt

SEQ ID NO: 232901 - DNA, 20 bp, human
gcacccgctcttttgcttgc

SEQ ID NO: 232902 - DNA, 20 bp, human
ggcgatcgccggtcttacaa

SEQ ID NO: 232903 - DNA, 20 bp, human
ggcgggtgcttcagttaagc

SEQ ID NO: 232904 - DNA, 20 bp, human
gctaggcagtagctactctt

SEQ ID NO: 232905 - DNA, 20 bp, human
gtagcaacgatgaactaaag

SEQ ID NO: 232906 - DNA, 20 bp, human
gagcgcgagccgccactgcg

SEQ ID NO: 232907 - DNA, 20 bp, human
ggctccgctagcctcacttc

SEQ ID NO: 232908 - DNA, 20 bp, human
gtgggcgggacggagctcgg

SEQ ID NO: 232909 - DNA, 20 bp, human
gtagcggagccccgcagtgg

SEQ ID NO: 232910 - DNA, 20 bp, human
gagtggcggctcgcgctcat

SEQ ID NO: 232911 - DNA, 20 bp, human
ggagctcggcggtctgcgct

SEQ ID NO: 232912 - DNA, 20 bp, human
gccaacacaagctaaatcca

SEQ ID NO: 232913 - DNA, 20 bp, human
ggcaacgtgagtttagtggg

SEQ ID NO: 232914 - DNA, 20 bp, human
ggatggtgcccacagcgcgc

SEQ ID NO: 232915 - DNA, 20 bp, human
gcgtgcctccagcgcgctgt

SEQ ID NO: 232916 - DNA, 20 bp, human
ggaagctgaacgccggtcct

SEQ ID NO: 232917 - DNA, 20 bp, human
gagaaggacccatgaaacct

SEQ ID NO: 232918 - DNA, 20 bp, human
gagcggtgcactggtatagt

SEQ ID NO: 232919 - DNA, 20 bp, human
gtcggcatgccgtggggcag

SEQ ID NO: 232920 - DNA, 20 bp, human
gtagtcttcccaggtttcat

SEQ ID NO: 232921 - DNA, 20 bp, human
gccttctgccagcggtgcac

SEQ ID NO: 232922 - DNA, 20 bp, human
gaacctgggaagctgaacgc

SEQ ID NO: 232923 - DNA, 20 bp, human
gtcctgggagaggaggcttc

SEQ ID NO: 232924 - DNA, 20 bp, human
gccccacggcatgccgaatg

SEQ ID NO: 232925 - DNA, 20 bp, human
gccggcctggactagaaccc

SEQ ID NO: 232926 - DNA, 20 bp, human
ggagctcccgagtgctggga

SEQ ID NO: 232927 - DNA, 20 bp, human
gggctccccgcgctctctag

SEQ ID NO: 232928 - DNA, 20 bp, human
gggagctccgagcccgtgca

SEQ ID NO: 232929 - DNA, 20 bp, human
ggggacccgccgccagaacc

SEQ ID NO: 232930 - DNA, 20 bp, human
gcgaccccggatacgcccca

SEQ ID NO: 232931 - DNA, 20 bp, human
ggagccttggggcgtatccg

SEQ ID NO: 232932 - DNA, 20 bp, human
gtctgagcgggctactgtgg

SEQ ID NO: 232933 - DNA, 20 bp, human
gtctcggcaaggatagaagt

SEQ ID NO: 232934 - DNA, 20 bp, human
ggggcacagcagaccccggg

SEQ ID NO: 232935 - DNA, 20 bp, human
gggacggcaaaggacgaggt

SEQ ID NO: 232936 - DNA, 20 bp, human
gcgcccgccgctcacggtca

SEQ ID NO: 232937 - DNA, 20 bp, human
gctgctgcggagggtggtcg

SEQ ID NO: 232938 - DNA, 20 bp, human
gggttgccggatcccgtccg

SEQ ID NO: 232939 - DNA, 20 bp, human
gtccgcgggcgatgctgctg

SEQ ID NO: 232940 - DNA, 20 bp, human
gaagcggaagtgccgatcgg

SEQ ID NO: 232941 - DNA, 20 bp, human
gaacccctgaccgtgagcgg

SEQ ID NO: 232942 - DNA, 20 bp, human
ggccgagccacggaccgcgg

SEQ ID NO: 232943 - DNA, 20 bp, human
gtccgcagcagcatcgcccg

SEQ ID NO: 232944 - DNA, 20 bp, human
ggctcacggtcaggggttgc

SEQ ID NO: 232945 - DNA, 20 bp, human
gcggccaatcccggaccttc

SEQ ID NO: 232946 - DNA, 20 bp, human
gagccggggcaggactatcg

SEQ ID NO: 232947 - DNA, 20 bp, human
gccccgcgatagtcctgccc

SEQ ID NO: 232948 - DNA, 20 bp, human
gccccccgaggcacgcacgg

SEQ ID NO: 232949 - DNA, 20 bp, human
gggaggacgcgctgacaagc

SEQ ID NO: 232950 - DNA, 20 bp, human
gcgacccggagactgcagcc

SEQ ID NO: 232951 - DNA, 20 bp, human
gacgcacggcggcagggaaa

SEQ ID NO: 232952 - DNA, 20 bp, human
ggctagcacgagaaacttgg

SEQ ID NO: 232953 - DNA, 20 bp, human
ggcaatactactcagttacg

SEQ ID NO: 232954 - DNA, 20 bp, human
gagcgctgcaggcaggtgcg

SEQ ID NO: 232955 - DNA, 20 bp, human
gcctgggtgccacgggttga

SEQ ID NO: 232956 - DNA, 20 bp, human
gacaagccgggaagcttgga

SEQ ID NO: 232957 - DNA, 20 bp, human
gaaagggagtggaggcgcgt

SEQ ID NO: 232958 - DNA, 20 bp, human
ggctccaggcccagcgcctt

SEQ ID NO: 232959 - DNA, 20 bp, human
gtgcgtacgcccaaggcgct

SEQ ID NO: 232960 - DNA, 20 bp, human
gtcacccaccggcaggggtt

SEQ ID NO: 232961 - DNA, 20 bp, human
gacttgcggtggggaaaacg

SEQ ID NO: 232962 - DNA, 20 bp, human
gtagacccctccaagcttcc

SEQ ID NO: 232963 - DNA, 20 bp, human
ggcttgtcacccaccggcag

SEQ ID NO: 232964 - DNA, 20 bp, human
gtctcccaacccctgccggt

SEQ ID NO: 232965 - DNA, 20 bp, human
gcgagaaaagagttaagcgg

SEQ ID NO: 232966 - DNA, 20 bp, human
gggtccggatgtgatgatac

SEQ ID NO: 232967 - DNA, 20 bp, human
gggccccaggcgtgattctc

SEQ ID NO: 232968 - DNA, 20 bp, human
gtcaggatgcagtaaaagtt

SEQ ID NO: 232969 - DNA, 20 bp, human
gtgaagggccgagctctggc

SEQ ID NO: 232970 - DNA, 20 bp, human
gaggctgccgggggctcacg

SEQ ID NO: 232971 - DNA, 20 bp, human
gggcctaatgactgtcactg

SEQ ID NO: 232972 - DNA, 20 bp, human
gtgatcatgagcttccggtc

SEQ ID NO: 232973 - DNA, 20 bp, human
gtcctcttaagacctgtgtc

SEQ ID NO: 232974 - DNA, 20 bp, human
gtagacgcacgcatccaaac

SEQ ID NO: 232975 - DNA, 20 bp, human
gcgggatgagttcggattaa

SEQ ID NO: 232976 - DNA, 20 bp, human
gaattgccacgcccctagta

SEQ ID NO: 232977 - DNA, 20 bp, human
gtcggtggcaaaactaattt

SEQ ID NO: 232978 - DNA, 20 bp, human
gtacaatggcatagtttcgg

SEQ ID NO: 232979 - DNA, 20 bp, human
gacttagtgtcaccatacta

SEQ ID NO: 232980 - DNA, 20 bp, human
gtgtcaccatactaggggcg

SEQ ID NO: 232981 - DNA, 20 bp, human
gagtttatcgtgagagagaa

SEQ ID NO: 232982 - DNA, 20 bp, human
gtctctcacgataaactcaa

SEQ ID NO: 232983 - DNA, 20 bp, human
ggctgttatcttaaatgtgg

SEQ ID NO: 232984 - DNA, 20 bp, human
gaaaactaatttgggttgtc

SEQ ID NO: 232985 - DNA, 20 bp, human
gtcaaccagcatttataaat

SEQ ID NO: 232986 - DNA, 20 bp, human
ggcgccgattccaaagactg

SEQ ID NO: 232987 - DNA, 20 bp, human
gcagcgggctcgggacagat

SEQ ID NO: 232988 - DNA, 20 bp, human
gcgggtcactgtagatgcga

SEQ ID NO: 232989 - DNA, 20 bp, human
ggcggatcaagctaggtgag

SEQ ID NO: 232990 - DNA, 20 bp, human
gaccacaggtggacccaaga

SEQ ID NO: 232991 - DNA, 20 bp, human
ggcagagggcggagagtcga

SEQ ID NO: 232992 - DNA, 20 bp, human
gtgtcccgagcccgctgacg

SEQ ID NO: 232993 - DNA, 20 bp, human
ggggcggggtgggacagagt

SEQ ID NO: 232994 - DNA, 20 bp, human
ggaaggcggagcctcgtcag

SEQ ID NO: 232995 - DNA, 20 bp, human
gctgtggggcggatcaagct

SEQ ID NO: 232996 - DNA, 20 bp, human
ggtggctgttggcttggcgg

SEQ ID NO: 232997 - DNA, 20 bp, human
ggaggctttgcggtggctgt

SEQ ID NO: 232998 - DNA, 20 bp, human
gcccctagcgtcgggagcca

SEQ ID NO: 232999 - DNA, 20 bp, human
gtggagccagggaccagctc

SEQ ID NO: 233000 - DNA, 20 bp, human
gtttgcggtggctgttggct

SEQ ID NO: 233001 - DNA, 20 bp, human
gtgtttttccaccagctgta

SEQ ID NO: 233002 - DNA, 20 bp, human
gagccaccgcaaagcctcgt

SEQ ID NO: 233003 - DNA, 20 bp, human
gacaggttccgtgatgtcac

SEQ ID NO: 233004 - DNA, 20 bp, human
gtggcttggccttacccacg

SEQ ID NO: 233005 - DNA, 20 bp, human
gttgctcggttcaggggtac

SEQ ID NO: 233006 - DNA, 20 bp, human
gagatagaggggagtaacga

SEQ ID NO: 233007 - DNA, 20 bp, human
gtgacggagagagagcagcg

SEQ ID NO: 233008 - DNA, 20 bp, human
gacagttttgggacagatag

SEQ ID NO: 233009 - DNA, 20 bp, human
gctggactgcatgtcttgat

SEQ ID NO: 233010 - DNA, 20 bp, human
gactaggaatcaggagtcgg

SEQ ID NO: 233011 - DNA, 20 bp, human
gggctggagcaggtaggaga

SEQ ID NO: 233012 - DNA, 20 bp, human
ggcagtccaggaacctccgt

SEQ ID NO: 233013 - DNA, 20 bp, human
gggatgagaaaaaaacctcc

SEQ ID NO: 233014 - DNA, 20 bp, human
gtaatgcccacggaggttcc

SEQ ID NO: 233015 - DNA, 20 bp, human
gaggactaggaatcaggagt

SEQ ID NO: 233016 - DNA, 20 bp, human
gccgctgcgcgcatttgccc

SEQ ID NO: 233017 - DNA, 20 bp, human
gacaggttcagtgacgtcaa

SEQ ID NO: 233018 - DNA, 20 bp, human
gagtgacgtcaaaggtgcgc

SEQ ID NO: 233019 - DNA, 20 bp, human
gagtgccaacctgggccggc

SEQ ID NO: 233020 - DNA, 20 bp, human
gcggagccagggaccagctt

SEQ ID NO: 233021 - DNA, 20 bp, human
gggagctgcagatgcagtga

SEQ ID NO: 233022 - DNA, 20 bp, human
gcaaatgcgcgcagcggctg

SEQ ID NO: 233023 - DNA, 20 bp, human
gcaggcgcactggtgtgtaa

SEQ ID NO: 233024 - DNA, 20 bp, human
gagggaggaccagccggccc

SEQ ID NO: 233025 - DNA, 20 bp, human
gctaggagcaggtgcaccgg

SEQ ID NO: 233026 - DNA, 20 bp, human
ggggatacgtagttctaaag

SEQ ID NO: 233027 - DNA, 20 bp, human
gtggaggggcggtacatggg

SEQ ID NO: 233028 - DNA, 20 bp, human
gcaatgggaagcacggaagg

SEQ ID NO: 233029 - DNA, 20 bp, human
gatacgtagttctaaagcgg

SEQ ID NO: 233030 - DNA, 20 bp, human
gcatcagctgcgtaatcccc

SEQ ID NO: 233031 - DNA, 20 bp, human
ggcacggaagggggcaacga

SEQ ID NO: 233032 - DNA, 20 bp, human
gggagcacgggtaagagggc

SEQ ID NO: 233033 - DNA, 20 bp, human
ggccaatggtcttgaaacaa

SEQ ID NO: 233034 - DNA, 20 bp, human
gcttagaaaccacatatccc

SEQ ID NO: 233035 - DNA, 20 bp, human
gatatgtggtttctaagagg

SEQ ID NO: 233036 - DNA, 20 bp, human
ggggaggagtcccacggtgt

SEQ ID NO: 233037 - DNA, 20 bp, human
gagggggcggtgcccctgag

SEQ ID NO: 233038 - DNA, 20 bp, human
ggctagcgggaattcgaaag

SEQ ID NO: 233039 - DNA, 20 bp, human
ggcaacggacacgccctcta

SEQ ID NO: 233040 - DNA, 20 bp, human
gtcggcccgtcgcctggcaa

SEQ ID NO: 233041 - DNA, 20 bp, human
gtcccgctagcgcccctaga

SEQ ID NO: 233042 - DNA, 20 bp, human
gcaaatatatcccaatgggg

SEQ ID NO: 233043 - DNA, 20 bp, human
gggcggagccaaggaagtga

SEQ ID NO: 233044 - DNA, 20 bp, human
gagcgggaattcgaaagggg

SEQ ID NO: 233045 - DNA, 20 bp, human
gcaccgccccctcacttcct

SEQ ID NO: 233046 - DNA, 20 bp, human
gtcccttttcactcccttaa

SEQ ID NO: 233047 - DNA, 20 bp, human
gtattgtggagtgtctgttg

SEQ ID NO: 233048 - DNA, 20 bp, human
gcaataaaaggatacccaag

SEQ ID NO: 233049 - DNA, 20 bp, human
gcttctgccccattttttat

SEQ ID NO: 233050 - DNA, 20 bp, human
gtacctctataaacacacta

SEQ ID NO: 233051 - DNA, 20 bp, human
gatggaaaacataataagtt

SEQ ID NO: 233052 - DNA, 20 bp, human
gtaccctagtgtgtttatag

SEQ ID NO: 233053 - DNA, 20 bp, human
gttatagaggtattgcactg

SEQ ID NO: 233054 - DNA, 20 bp, human
gttaaattggattttgctaa

SEQ ID NO: 233055 - DNA, 20 bp, human
gcatccaaagacaccattaa

SEQ ID NO: 233056 - DNA, 20 bp, human
ggccccgcgcggccccgaga

SEQ ID NO: 233057 - DNA, 20 bp, human
gggggtccggagtgacctgt

SEQ ID NO: 233058 - DNA, 20 bp, human
ggtggagtcaacagcgctgg

SEQ ID NO: 233059 - DNA, 20 bp, human
ggacgtggagtcaacagcgc

SEQ ID NO: 233060 - DNA, 20 bp, human
gtcgtgatggtggtcggaga

SEQ ID NO: 233061 - DNA, 20 bp, human
gcggagagcgctgaggggtc

SEQ ID NO: 233062 - DNA, 20 bp, human
ggcgcggagcccgaggtcgc

SEQ ID NO: 233063 - DNA, 20 bp, human
gcggggccgcagacacagcc

SEQ ID NO: 233064 - DNA, 20 bp, human
ggcgacgcgacgtcgcgagg

SEQ ID NO: 233065 - DNA, 20 bp, human
gcggaggcgccgggccctct

SEQ ID NO: 233066 - DNA, 20 bp, human
gggagctgggaaggcgtgag

SEQ ID NO: 233067 - DNA, 20 bp, human
gccctcagccggacaggaag

SEQ ID NO: 233068 - DNA, 20 bp, human
gtgagggggcggggacgtgt

SEQ ID NO: 233069 - DNA, 20 bp, human
gcccgccccctcagccggac

SEQ ID NO: 233070 - DNA, 20 bp, human
gaagggcgggcataaggcta

SEQ ID NO: 233071 - DNA, 20 bp, human
ggctgggaaggcgtgagagg

SEQ ID NO: 233072 - DNA, 20 bp, human
gcgggcataaggctacggat

SEQ ID NO: 233073 - DNA, 20 bp, human
gtgtgggtaagcggagtcgc

SEQ ID NO: 233074 - DNA, 20 bp, human
gacgtccccgccccctcagc

SEQ ID NO: 233075 - DNA, 20 bp, human
gcctccggaaagggatgcgt

SEQ ID NO: 233076 - DNA, 20 bp, human
gccggcctgggtcccgccca

SEQ ID NO: 233077 - DNA, 20 bp, human
ggacccaggccggcatccgg

SEQ ID NO: 233078 - DNA, 20 bp, human
gcacccgtggcagggcatgt

SEQ ID NO: 233079 - DNA, 20 bp, human
gcggcatccggcggcgctca

SEQ ID NO: 233080 - DNA, 20 bp, human
gagcgccgtgaaccgaatgg

SEQ ID NO: 233081 - DNA, 20 bp, human
gcgccgccggatgccggcct

SEQ ID NO: 233082 - DNA, 20 bp, human
gctccccggcgcagtagctc

SEQ ID NO: 233083 - DNA, 20 bp, human
gcgtagcgccgtgaaccgaa

SEQ ID NO: 233084 - DNA, 20 bp, human
gcctgccgccattcggttca

SEQ ID NO: 233085 - DNA, 20 bp, human
gcgcaggcgcacccgtggca

SEQ ID NO: 233086 - DNA, 20 bp, human
gaacccccaggggcgggata

SEQ ID NO: 233087 - DNA, 20 bp, human
ggaggggcggtcccaacagt

SEQ ID NO: 233088 - DNA, 20 bp, human
gtggctgaggctgcatagag

SEQ ID NO: 233089 - DNA, 20 bp, human
gagccgcgccgcaggacgga

SEQ ID NO: 233090 - DNA, 20 bp, human
ggctgacactgcgttctcat

SEQ ID NO: 233091 - DNA, 20 bp, human
gggaacgcgggtgatctcca

SEQ ID NO: 233092 - DNA, 20 bp, human
ggaaacagtggagagagacg

SEQ ID NO: 233093 - DNA, 20 bp, human
gcccaggggcgggataaggt

SEQ ID NO: 233094 - DNA, 20 bp, human
ggcggtcccaacagtgggcg

SEQ ID NO: 233095 - DNA, 20 bp, human
ggtagagccgcgccgcagga

SEQ ID NO: 233096 - DNA, 20 bp, human
gagaaaggcgggcccattgt

SEQ ID NO: 233097 - DNA, 20 bp, human
gaaggcgggcccattgttgg

SEQ ID NO: 233098 - DNA, 20 bp, human
gggcgggcccagagaaaggc

SEQ ID NO: 233099 - DNA, 20 bp, human
gccagcatagcgcacagggc

SEQ ID NO: 233100 - DNA, 20 bp, human
gagctccagcatagcgcaca

SEQ ID NO: 233101 - DNA, 20 bp, human
gtcagcatctgcggctgctt

SEQ ID NO: 233102 - DNA, 20 bp, human
gggaaaccatatctattaac

SEQ ID NO: 233103 - DNA, 20 bp, human
gagccgaatcccccaacaat

SEQ ID NO: 233104 - DNA, 20 bp, human
ggattcggcttccggaggag

SEQ ID NO: 233105 - DNA, 20 bp, human
gccagcagttcttaccaact

SEQ ID NO: 233106 - DNA, 20 bp, human
gagagaaggcccaactagcg

SEQ ID NO: 233107 - DNA, 20 bp, human
gggtcctgggagccaatcct

SEQ ID NO: 233108 - DNA, 20 bp, human
ggactgagggctggaaggtt

SEQ ID NO: 233109 - DNA, 20 bp, human
gtggaaggttgggtttccag

SEQ ID NO: 233110 - DNA, 20 bp, human
gaggacccaggccccgcctc

SEQ ID NO: 233111 - DNA, 20 bp, human
gcctgggagccaatccttgg

SEQ ID NO: 233112 - DNA, 20 bp, human
gccaactagcgaggagcctg

SEQ ID NO: 233113 - DNA, 20 bp, human
gaaacatggagttcacagga

SEQ ID NO: 233114 - DNA, 20 bp, human
ggaaatttgccaccaaggat

SEQ ID NO: 233115 - DNA, 20 bp, human
gtaaaatatcaaggtctcaa

SEQ ID NO: 233116 - DNA, 20 bp, human
gcgagccggcggacccgcct

SEQ ID NO: 233117 - DNA, 20 bp, human
gcctccgcccggatagccgg

SEQ ID NO: 233118 - DNA, 20 bp, human
gccgccgccgccggctatcc

SEQ ID NO: 233119 - DNA, 20 bp, human
gccgccgccggctatccggg

SEQ ID NO: 233120 - DNA, 20 bp, human
ggaggagcggccgtggggag

SEQ ID NO: 233121 - DNA, 20 bp, human
gtcggctcgactgcgagcga

SEQ ID NO: 233122 - DNA, 20 bp, human
ggagaagcagggcgtgaagg

SEQ ID NO: 233123 - DNA, 20 bp, human
gggagagaagcagggcgtga

SEQ ID NO: 233124 - DNA, 20 bp, human
gacggtggacaagaagatgg

SEQ ID NO: 233125 - DNA, 20 bp, human
ggggacggtggacaagaaga

SEQ ID NO: 233126 - DNA, 20 bp, human
gaggggccccactcccgaga

SEQ ID NO: 233127 - DNA, 20 bp, human
gcatccagaagcaggcagtt

SEQ ID NO: 233128 - DNA, 20 bp, human
gcacgtgtctgcgccctctc

SEQ ID NO: 233129 - DNA, 20 bp, human
gccccccaactgcctgcttc

SEQ ID NO: 233130 - DNA, 20 bp, human
gtggggggccctgcgggagt

SEQ ID NO: 233131 - DNA, 20 bp, human
gaggcctgggcacgccggga

SEQ ID NO: 233132 - DNA, 20 bp, human
ggacacgtgtcctctggcaa

SEQ ID NO: 233133 - DNA, 20 bp, human
ggcgtgcccaggcctcgtca

SEQ ID NO: 233134 - DNA, 20 bp, human
gaagaagtcccctttgccag

SEQ ID NO: 233135 - DNA, 20 bp, human
gtctgcgccctctcgggagt

SEQ ID NO: 233136 - DNA, 20 bp, human
gcggactcctcttaagacgc

SEQ ID NO: 233137 - DNA, 20 bp, human
gtggctgcgcccgccatgct

SEQ ID NO: 233138 - DNA, 20 bp, human
gagacgcaggtgcaaaccgg

SEQ ID NO: 233139 - DNA, 20 bp, human
gcgtgacacgcgtcggccgc

SEQ ID NO: 233140 - DNA, 20 bp, human
gttaagacgcaggtgcaaac

SEQ ID NO: 233141 - DNA, 20 bp, human
ggcgcatgcgtgacacgcgt

SEQ ID NO: 233142 - DNA, 20 bp, human
gacgaacggcagttgagttg

SEQ ID NO: 233143 - DNA, 20 bp, human
gaaaaagcaaaaggaggcga

SEQ ID NO: 233144 - DNA, 20 bp, human
gcaccaccagacaaactccg

SEQ ID NO: 233145 - DNA, 20 bp, human
ggtcttaagaggagtccggg

SEQ ID NO: 233146 - DNA, 20 bp, human
gcggggaggctgtcttgagg

SEQ ID NO: 233147 - DNA, 20 bp, human
gcgacgagctcgcaagatgg

SEQ ID NO: 233148 - DNA, 20 bp, human
gagcggccggccgctatgaa

SEQ ID NO: 233149 - DNA, 20 bp, human
gagcgcccaggccaaccctc

SEQ ID NO: 233150 - DNA, 20 bp, human
ggcggcggccgagcgagttg

SEQ ID NO: 233151 - DNA, 20 bp, human
gtcgtactgaccgagcgggg

SEQ ID NO: 233152 - DNA, 20 bp, human
ggcaccgctcaccgacaccg

SEQ ID NO: 233153 - DNA, 20 bp, human
gggcaccgcctgcacgggtc

SEQ ID NO: 233154 - DNA, 20 bp, human
gcacggcgaggggacggtcc

SEQ ID NO: 233155 - DNA, 20 bp, human
gggcatgactgcgacgctca

SEQ ID NO: 233156 - DNA, 20 bp, human
gctctatgctgtgtacaaga

SEQ ID NO: 233157 - DNA, 20 bp, human
ggaagcataaaggaatgagt

SEQ ID NO: 233158 - DNA, 20 bp, human
gtagaaccacaaccaaatac

SEQ ID NO: 233159 - DNA, 20 bp, human
gacgtcgaagtagacaagtg

SEQ ID NO: 233160 - DNA, 20 bp, human
ggctttagaatattctgatg

SEQ ID NO: 233161 - DNA, 20 bp, human
gccttgcctattgaaagaaa

SEQ ID NO: 233162 - DNA, 20 bp, human
gtatatgatttgccagtatt

SEQ ID NO: 233163 - DNA, 20 bp, human
gacactaacatgatacattt

SEQ ID NO: 233164 - DNA, 20 bp, human
gaaagactttagtattaagc

SEQ ID NO: 233165 - DNA, 20 bp, human
gaatgttagtcaagattgct

SEQ ID NO: 233166 - DNA, 20 bp, human
gtggataaaagcccgtggag

SEQ ID NO: 233167 - DNA, 20 bp, human
ggggaggcgggacgaattat

SEQ ID NO: 233168 - DNA, 20 bp, human
gagtcaatacccaggagggc

SEQ ID NO: 233169 - DNA, 20 bp, human
gccaggagggcgggatagaa

SEQ ID NO: 233170 - DNA, 20 bp, human
gaagcgcagctgaagcgtga

SEQ ID NO: 233171 - DNA, 20 bp, human
gccttcggctactccggcag

SEQ ID NO: 233172 - DNA, 20 bp, human
gaggggcggaactaaaatgc

SEQ ID NO: 233173 - DNA, 20 bp, human
gaaggcgccaatgaggcctt

SEQ ID NO: 233174 - DNA, 20 bp, human
gcgggacgaattattggttg

SEQ ID NO: 233175 - DNA, 20 bp, human
gctacgacccgattggcttc

SEQ ID NO: 233176 - DNA, 20 bp, human
gagaaataggagctcgtgga

SEQ ID NO: 233177 - DNA, 20 bp, human
gaggcagccccacccgcagt

SEQ ID NO: 233178 - DNA, 20 bp, human
gggtccagacggcgtggcat

SEQ ID NO: 233179 - DNA, 20 bp, human
gggtgaagcgggtaccgcgg

SEQ ID NO: 233180 - DNA, 20 bp, human
gcttctgcccggcaagaaat

SEQ ID NO: 233181 - DNA, 20 bp, human
gaataatcccactgcgggtg

SEQ ID NO: 233182 - DNA, 20 bp, human
gaagctgagtcagggtggga

SEQ ID NO: 233183 - DNA, 20 bp, human
ggtggaaggaaagctgagtc

SEQ ID NO: 233184 - DNA, 20 bp, human
gcccgcagtcaaagcctggc

SEQ ID NO: 233185 - DNA, 20 bp, human
gcccggtgaagcgggtaccg

SEQ ID NO: 233186 - DNA, 20 bp, human
gaaggcgaagggcgcttctg

SEQ ID NO: 233187 - DNA, 20 bp, human
gatcgccagagtaacggggt

SEQ ID NO: 233188 - DNA, 20 bp, human
ggggcctgagctgacaaaac

SEQ ID NO: 233189 - DNA, 20 bp, human
gtgaatgtgcccccagagat

SEQ ID NO: 233190 - DNA, 20 bp, human
gcatccgggcacacggggaa

SEQ ID NO: 233191 - DNA, 20 bp, human
gctacccagctgcagagccg

SEQ ID NO: 233192 - DNA, 20 bp, human
gagctcaggccctatctctg

SEQ ID NO: 233193 - DNA, 20 bp, human
gcccacgggggcctcaccga

SEQ ID NO: 233194 - DNA, 20 bp, human
gtcagcaacgggccttctcc

SEQ ID NO: 233195 - DNA, 20 bp, human
gaggcccgttgctgaaccga

SEQ ID NO: 233196 - DNA, 20 bp, human
gcccctcaacaagatggcga

SEQ ID NO: 233197 - DNA, 20 bp, human
ggccgtcgccatcttgttga

SEQ ID NO: 233198 - DNA, 20 bp, human
gccacctcccgctgactcgg

SEQ ID NO: 233199 - DNA, 20 bp, human
gtggccaccgagtcagcggg

SEQ ID NO: 233200 - DNA, 20 bp, human
gggtgcggacatgtttatga

SEQ ID NO: 233201 - DNA, 20 bp, human
ggccgcgcccctcaacaaga

SEQ ID NO: 233202 - DNA, 20 bp, human
ggggcgcggccggcttggtg

SEQ ID NO: 233203 - DNA, 20 bp, human
ggggtggagggtggaaaagt

SEQ ID NO: 233204 - DNA, 20 bp, human
ggaggcagaatgtacagccc

SEQ ID NO: 233205 - DNA, 20 bp, human
ggggcgcgtccagtgatgac

SEQ ID NO: 233206 - DNA, 20 bp, human
gagcaataatggaagttcat

SEQ ID NO: 233207 - DNA, 20 bp, human
gcacgtacctcacttaactt

SEQ ID NO: 233208 - DNA, 20 bp, human
gtagcaacataattctatca

SEQ ID NO: 233209 - DNA, 20 bp, human
ggtgaggtacgtgtcatagt

SEQ ID NO: 233210 - DNA, 20 bp, human
gtatctatgaagttaagaga

SEQ ID NO: 233211 - DNA, 20 bp, human
gtttatgcttctttgtggta

SEQ ID NO: 233212 - DNA, 20 bp, human
gcattctacatagttgtaat

SEQ ID NO: 233213 - DNA, 20 bp, human
ggcataaaatacattgttcc

SEQ ID NO: 233214 - DNA, 20 bp, human
gtatatttctttttgctagc

SEQ ID NO: 233215 - DNA, 20 bp, human
ggaatatagatagagttgac

SEQ ID NO: 233216 - DNA, 20 bp, human
gaccctggataacagctcca

SEQ ID NO: 233217 - DNA, 20 bp, human
gtcgctccaccgcacagagt

SEQ ID NO: 233218 - DNA, 20 bp, human
gtggagaagcctactctgtg

SEQ ID NO: 233219 - DNA, 20 bp, human
gctgtgcggtggagcgaccc

SEQ ID NO: 233220 - DNA, 20 bp, human
gcgatgcccgcaggcggcag

SEQ ID NO: 233221 - DNA, 20 bp, human
ggtccctggagctgttatcc

SEQ ID NO: 233222 - DNA, 20 bp, human
gaaccccagcgtcttgagca

SEQ ID NO: 233223 - DNA, 20 bp, human
gggcgcgggaggtgcgaccg

SEQ ID NO: 233224 - DNA, 20 bp, human
gagaagcctactctgtgcgg

SEQ ID NO: 233225 - DNA, 20 bp, human
ggctggggttagacgtgctc

SEQ ID NO: 233226 - DNA, 20 bp, human
gaccctggataacagctcca

SEQ ID NO: 233227 - DNA, 20 bp, human
gtggagaagcctactctgtg

SEQ ID NO: 233228 - DNA, 20 bp, human
gtcgctccaccgcacagagt

SEQ ID NO: 233229 - DNA, 20 bp, human
gctgtgcggtggagcgaccc

SEQ ID NO: 233230 - DNA, 20 bp, human
gcgatgcccgcaggcggcag

SEQ ID NO: 233231 - DNA, 20 bp, human
gaaccccagcgtcttgagca

SEQ ID NO: 233232 - DNA, 20 bp, human
ggtccctggagctgttatcc

SEQ ID NO: 233233 - DNA, 20 bp, human
ggctggggttagacgtgctc

SEQ ID NO: 233234 - DNA, 20 bp, human
ggccgtccggggcaatgttt

SEQ ID NO: 233235 - DNA, 20 bp, human
gagaagcctactctgtgcgg

SEQ ID NO: 233236 - DNA, 20 bp, human
ggggcccagcctagtctagg

SEQ ID NO: 233237 - DNA, 20 bp, human
gctgcctcctagactaggct

SEQ ID NO: 233238 - DNA, 20 bp, human
gtaagggcccagcctagtct

SEQ ID NO: 233239 - DNA, 20 bp, human
ggaaacctcggccgtttggg

SEQ ID NO: 233240 - DNA, 20 bp, human
gtggacagcaaccacagggc

SEQ ID NO: 233241 - DNA, 20 bp, human
gtccctgactattaataaag

SEQ ID NO: 233242 - DNA, 20 bp, human
gtgttacaaagtctgaacgt

SEQ ID NO: 233243 - DNA, 20 bp, human
ggttgctgtccagggagcta

SEQ ID NO: 233244 - DNA, 20 bp, human
gaatcagggaatgggagtta

SEQ ID NO: 233245 - DNA, 20 bp, human
gtcctctttattaatagtca

SEQ ID NO: 233246 - DNA, 20 bp, human
gccacggaggccacgctcgg

SEQ ID NO: 233247 - DNA, 20 bp, human
ggcgagggcctgcaactgag

SEQ ID NO: 233248 - DNA, 20 bp, human
gcagttgcaggccctcgcca

SEQ ID NO: 233249 - DNA, 20 bp, human
gagtcggcggggataacggt

SEQ ID NO: 233250 - DNA, 20 bp, human
gtgagcggccgaaactgcca

SEQ ID NO: 233251 - DNA, 20 bp, human
gagcgtggcctccgtggcga

SEQ ID NO: 233252 - DNA, 20 bp, human
gtatcgctgacataaggatg

SEQ ID NO: 233253 - DNA, 20 bp, human
gcggctgcgcgcgagtaggg

SEQ ID NO: 233254 - DNA, 20 bp, human
gagccagtgggcactgtgaa

SEQ ID NO: 233255 - DNA, 20 bp, human
ggcgacctggggggagtcgg

SEQ ID NO: 233256 - DNA, 20 bp, human
gccttcgctgagggacgaac

SEQ ID NO: 233257 - DNA, 20 bp, human
gaagcagcgcgccttcgctg

SEQ ID NO: 233258 - DNA, 20 bp, human
gggcgcatgcgccgttgctg

SEQ ID NO: 233259 - DNA, 20 bp, human
gcctggagcgagagcgcgtg

SEQ ID NO: 233260 - DNA, 20 bp, human
gtactccgagaacgctggct

SEQ ID NO: 233261 - DNA, 20 bp, human
gcgaaggcgcgctgcttggc

SEQ ID NO: 233262 - DNA, 20 bp, human
gcgagaacgctggctcggat

SEQ ID NO: 233263 - DNA, 20 bp, human
ggcagggcgcacccccgcgc

SEQ ID NO: 233264 - DNA, 20 bp, human
gatgcgccgttgctggggag

SEQ ID NO: 233265 - DNA, 20 bp, human
gaaaagccacagcagcgcgt

SEQ ID NO: 233266 - DNA, 20 bp, human
gtagggttgcccggtatcca

SEQ ID NO: 233267 - DNA, 20 bp, human
ggggcaaccctactccaact

SEQ ID NO: 233268 - DNA, 20 bp, human
gtcttaggcccagttggagt

SEQ ID NO: 233269 - DNA, 20 bp, human
gactgggcctaagacctttg

SEQ ID NO: 233270 - DNA, 20 bp, human
gggaccatcctgtggggggc

SEQ ID NO: 233271 - DNA, 20 bp, human
gtaaactacggcggctcatt

SEQ ID NO: 233272 - DNA, 20 bp, human
gtgtttgcgccttggatacc

SEQ ID NO: 233273 - DNA, 20 bp, human
gactgcagcttgattacaaa

SEQ ID NO: 233274 - DNA, 20 bp, human
gaagtcttatactttgacga

SEQ ID NO: 233275 - DNA, 20 bp, human
ggattacaaaggaatgatta

SEQ ID NO: 233276 - DNA, 20 bp, human
ggaacccgcaggagcgtcac

SEQ ID NO: 233277 - DNA, 20 bp, human
ggcgagctgggcttgtgagt

SEQ ID NO: 233278 - DNA, 20 bp, human
ggggtccgatgcctaccctc

SEQ ID NO: 233279 - DNA, 20 bp, human
gtgtgagtggggctgccgag

SEQ ID NO: 233280 - DNA, 20 bp, human
gccacctgcgcgctccccat

SEQ ID NO: 233281 - DNA, 20 bp, human
gcgtccgcagatctcctcgc

SEQ ID NO: 233282 - DNA, 20 bp, human
gggcgcccgtgacgctcctg

SEQ ID NO: 233283 - DNA, 20 bp, human
gggtaggcatcggacccaat

SEQ ID NO: 233284 - DNA, 20 bp, human
ggcgcctgcgcttgcgagct

SEQ ID NO: 233285 - DNA, 20 bp, human
gaggcatcggacccaatcgg

SEQ ID NO: 233286 - DNA, 20 bp, human
ggctaaggtcatcttgaggg

SEQ ID NO: 233287 - DNA, 20 bp, human
gttgagggcggaaggtaaca

SEQ ID NO: 233288 - DNA, 20 bp, human
gaactcgagcgtctcgggaa

SEQ ID NO: 233289 - DNA, 20 bp, human
gactgctaaggtcatcttga

SEQ ID NO: 233290 - DNA, 20 bp, human
gttggaaaggtcatagagtg

SEQ ID NO: 233291 - DNA, 20 bp, human
gaggttgacgctaactgcta

SEQ ID NO: 233292 - DNA, 20 bp, human
ggacgccatattgggtgggg

SEQ ID NO: 233293 - DNA, 20 bp, human
gaggtaacaaggattggtgt

SEQ ID NO: 233294 - DNA, 20 bp, human
ggtctcgggaaaggtggatt

SEQ ID NO: 233295 - DNA, 20 bp, human
gtcgctgtcgaagacacttc

SEQ ID NO: 233296 - DNA, 20 bp, human
gagggggcgccccacgacct

SEQ ID NO: 233297 - DNA, 20 bp, human
gagggtacctactagaggtg

SEQ ID NO: 233298 - DNA, 20 bp, human
gcgtggcccgcacctctagt

SEQ ID NO: 233299 - DNA, 20 bp, human
gcctctagtaggtaccctcc

SEQ ID NO: 233300 - DNA, 20 bp, human
gaaggattgccggttgccac

SEQ ID NO: 233301 - DNA, 20 bp, human
gtagaggtgcgggccacgag

SEQ ID NO: 233302 - DNA, 20 bp, human
gacgaggacaccgaggtcgt

SEQ ID NO: 233303 - DNA, 20 bp, human
gaacgcaatggaaattgaaa

SEQ ID NO: 233304 - DNA, 20 bp, human
gacgggcaacgaggacaccg

SEQ ID NO: 233305 - DNA, 20 bp, human
gaacggctcaagaccacaag

SEQ ID NO: 233306 - DNA, 20 bp, human
ggagcccgggccccacgtag

SEQ ID NO: 233307 - DNA, 20 bp, human
ggtgagtgtgcgagtgtcgg

SEQ ID NO: 233308 - DNA, 20 bp, human
ggcgccggatcctctacgtg

SEQ ID NO: 233309 - DNA, 20 bp, human
ggggccccacgtagaggatc

SEQ ID NO: 233310 - DNA, 20 bp, human
gggcgcctgggctacgtcac

SEQ ID NO: 233311 - DNA, 20 bp, human
ggcggtgagtgtgcgagtgt

SEQ ID NO: 233312 - DNA, 20 bp, human
ggcggcgggctgccgcgcaa

SEQ ID NO: 233313 - DNA, 20 bp, human
gcgcgcgcgccacccttgcg

SEQ ID NO: 233314 - DNA, 20 bp, human
ggacgaagcgctaccgcctg

SEQ ID NO: 233315 - DNA, 20 bp, human
gcgcgcccgtgacgtagccc

SEQ ID NO: 233316 - DNA, 20 bp, human
gtgagcgccagaacggggat

SEQ ID NO: 233317 - DNA, 20 bp, human
ggcctccaccccgcattccg

SEQ ID NO: 233318 - DNA, 20 bp, human
ggggtgactatggatgagga

SEQ ID NO: 233319 - DNA, 20 bp, human
gagttgggatggggtgacta

SEQ ID NO: 233320 - DNA, 20 bp, human
gaaccgatgtcggaaagccc

SEQ ID NO: 233321 - DNA, 20 bp, human
gtcagccccggaatgcgggg

SEQ ID NO: 233322 - DNA, 20 bp, human
gagcctgggctttccgacat

SEQ ID NO: 233323 - DNA, 20 bp, human
gcccagaggagcctcgccac

SEQ ID NO: 233324 - DNA, 20 bp, human
ggatggggtgactatggatg

SEQ ID NO: 233325 - DNA, 20 bp, human
gtctgagcctaatccgaaag

SEQ ID NO: 233326 - DNA, 20 bp, human
gagtgaggttagaacgtgag

SEQ ID NO: 233327 - DNA, 20 bp, human
gcccgcggttgcctggacac

SEQ ID NO: 233328 - DNA, 20 bp, human
gacagacttcgtccaccttc

SEQ ID NO: 233329 - DNA, 20 bp, human
gcttccctctccggtaaaga

SEQ ID NO: 233330 - DNA, 20 bp, human
gcctgcggtcctcccgaagg

SEQ ID NO: 233331 - DNA, 20 bp, human
ggcggcctggagcgctgatc

SEQ ID NO: 233332 - DNA, 20 bp, human
gacacgggataaccgacttg

SEQ ID NO: 233333 - DNA, 20 bp, human
gtaacctcactgctgtacga

SEQ ID NO: 233334 - DNA, 20 bp, human
ggctaagggctcgagccagg

SEQ ID NO: 233335 - DNA, 20 bp, human
ggcgataaccccatgtggtt

SEQ ID NO: 233336 - DNA, 20 bp, human
gcctctaggcggccagcgga

SEQ ID NO: 233337 - DNA, 20 bp, human
gaagcagagtctccctccgc

SEQ ID NO: 233338 - DNA, 20 bp, human
gaaactggaggacggagaac

SEQ ID NO: 233339 - DNA, 20 bp, human
gcccccggcagtggggactg

SEQ ID NO: 233340 - DNA, 20 bp, human
gaagacgaagttcctctagg

SEQ ID NO: 233341 - DNA, 20 bp, human
gaacagggggacaaaacgac

SEQ ID NO: 233342 - DNA, 20 bp, human
gactccccaccgcctctgga

SEQ ID NO: 233343 - DNA, 20 bp, human
ggacaagacgaagttcctct

SEQ ID NO: 233344 - DNA, 20 bp, human
gagggggacaaaacgactgg

SEQ ID NO: 233345 - DNA, 20 bp, human
ggggcggcgcccactccccc

SEQ ID NO: 233346 - DNA, 20 bp, human
ggggaagaaggcagacagtt

SEQ ID NO: 233347 - DNA, 20 bp, human
gctggactggaatacaactg

SEQ ID NO: 233348 - DNA, 20 bp, human
gaaagggtggggcccatagc

SEQ ID NO: 233349 - DNA, 20 bp, human
gaatagtgatggaactgggt

SEQ ID NO: 233350 - DNA, 20 bp, human
gagtctgaagtaagagaaca

SEQ ID NO: 233351 - DNA, 20 bp, human
ggataggatataaggaatta

SEQ ID NO: 233352 - DNA, 20 bp, human
gtgccttccctgcactggac

SEQ ID NO: 233353 - DNA, 20 bp, human
gctgcagtgtctttgagtta

SEQ ID NO: 233354 - DNA, 20 bp, human
gggaagaaggataggatata

SEQ ID NO: 233355 - DNA, 20 bp, human
ggagagactagagagatgaa

SEQ ID NO: 233356 - DNA, 20 bp, human
ggctcgccgaccacgatccc

SEQ ID NO: 233357 - DNA, 20 bp, human
gccagaaggagcacggggaa

SEQ ID NO: 233358 - DNA, 20 bp, human
ggggctccgctagtgggctc

SEQ ID NO: 233359 - DNA, 20 bp, human
ggggaaccggaggccgtcag

SEQ ID NO: 233360 - DNA, 20 bp, human
gactgaggcggttgcggaat

SEQ ID NO: 233361 - DNA, 20 bp, human
gggcatcatggcggtaattg

SEQ ID NO: 233362 - DNA, 20 bp, human
gccggggcggggcagtgacc

SEQ ID NO: 233363 - DNA, 20 bp, human
gtccgcaaccgcctcagtct

SEQ ID NO: 233364 - DNA, 20 bp, human
ggcttgccggggatcgtggt

SEQ ID NO: 233365 - DNA, 20 bp, human
ggggaagccatgggaaccgg

SEQ ID NO: 233366 - DNA, 20 bp, human
ggagcgcgggtcccaggcca

SEQ ID NO: 233367 - DNA, 20 bp, human
gaaggagaacgtgttggccc

SEQ ID NO: 233368 - DNA, 20 bp, human
ggcccgggcctccataacca

SEQ ID NO: 233369 - DNA, 20 bp, human
ggcgggcgcgtggcctgctg

SEQ ID NO: 233370 - DNA, 20 bp, human
gcggggcgggaggctacgcg

SEQ ID NO: 233371 - DNA, 20 bp, human
ggagcgcgggtcccgggact

SEQ ID NO: 233372 - DNA, 20 bp, human
gacgcagcgtgctgctagcg

SEQ ID NO: 233373 - DNA, 20 bp, human
gtcactcggaccaagcctcc

SEQ ID NO: 233374 - DNA, 20 bp, human
ggctcgttggctacttacga

SEQ ID NO: 233375 - DNA, 20 bp, human
ggtcttcccagcccgcaccc

SEQ ID NO: 233376 - DNA, 20 bp, human
gcgaagggccagtgaagctg

SEQ ID NO: 233377 - DNA, 20 bp, human
gtgaagctgaggtttctaag

SEQ ID NO: 233378 - DNA, 20 bp, human
ggtttctaaggggacgacta

SEQ ID NO: 233379 - DNA, 20 bp, human
gccttcgcaagcaccgggat

SEQ ID NO: 233380 - DNA, 20 bp, human
gacgagagacagctacaaga

SEQ ID NO: 233381 - DNA, 20 bp, human
gaccgggatgggtgccggga

SEQ ID NO: 233382 - DNA, 20 bp, human
gtcagaccaccgacccctcc

SEQ ID NO: 233383 - DNA, 20 bp, human
gctggcccttcgcaagcacc

SEQ ID NO: 233384 - DNA, 20 bp, human
gcaagcaccgggatgggtgc

SEQ ID NO: 233385 - DNA, 20 bp, human
gcccctcccggcacccatcc

SEQ ID NO: 233386 - DNA, 20 bp, human
ggcgccgcagcgcagaagga

SEQ ID NO: 233387 - DNA, 20 bp, human
gtggaggctgaggtactcac

SEQ ID NO: 233388 - DNA, 20 bp, human
ggaggactgcttgagacaga

SEQ ID NO: 233389 - DNA, 20 bp, human
gagaccagagcaagggttaa

SEQ ID NO: 233390 - DNA, 20 bp, human
ggagtctgaatctacaaagg

SEQ ID NO: 233391 - DNA, 20 bp, human
gctactggggcacaagtcta

SEQ ID NO: 233392 - DNA, 20 bp, human
gggtccgccccgtctgaggc

SEQ ID NO: 233393 - DNA, 20 bp, human
gtctacaaaggcggctgcag

SEQ ID NO: 233394 - DNA, 20 bp, human
gagcaagggttaaaggttcg

SEQ ID NO: 233395 - DNA, 20 bp, human
gggggagtctgaatctacaa

SEQ ID NO: 233396 - DNA, 20 bp, human
ggaaaaaggaacaacccgtg

SEQ ID NO: 233397 - DNA, 20 bp, human
gtggaggggccggacagaaa

SEQ ID NO: 233398 - DNA, 20 bp, human
gaggaacaacccgtgtggtg

SEQ ID NO: 233399 - DNA, 20 bp, human
gtcaccccaggcctcacatc

SEQ ID NO: 233400 - DNA, 20 bp, human
gagtccagtgggctcttcca

SEQ ID NO: 233401 - DNA, 20 bp, human
gacggcgcatgccggatgtg

SEQ ID NO: 233402 - DNA, 20 bp, human
gatgccggatgtgaggcctg

SEQ ID NO: 233403 - DNA, 20 bp, human
gcaggaagcccctttctgtc

SEQ ID NO: 233404 - DNA, 20 bp, human
gttgagcttgcaatagctgc

SEQ ID NO: 233405 - DNA, 20 bp, human
ggagcgagcacggcgcatgc

SEQ ID NO: 233406 - DNA, 20 bp, human
gaggcttccgcccgcaggag

SEQ ID NO: 233407 - DNA, 20 bp, human
gcgcgcgtgcgcagagagga

SEQ ID NO: 233408 - DNA, 20 bp, human
gcggccccgcccaggacgag

SEQ ID NO: 233409 - DNA, 20 bp, human
gcgtgcgcagagaggatggc

SEQ ID NO: 233410 - DNA, 20 bp, human
ggggcggagccacaccgggg

SEQ ID NO: 233411 - DNA, 20 bp, human
gtggaaacccgcgtagaggg

SEQ ID NO: 233412 - DNA, 20 bp, human
gggagccacaccggggtggg

SEQ ID NO: 233413 - DNA, 20 bp, human
ggcaggggcggagccacacc

SEQ ID NO: 233414 - DNA, 20 bp, human
ggggcggggcaagccggtgc

SEQ ID NO: 233415 - DNA, 20 bp, human
gggctggaaacccgcgtaga

SEQ ID NO: 233416 - DNA, 20 bp, human
ggggcccccggcatccgagt

SEQ ID NO: 233417 - DNA, 20 bp, human
ggggcggggccctagagtcg

SEQ ID NO: 233418 - DNA, 20 bp, human
gaaaccacgccgcgactcta

SEQ ID NO: 233419 - DNA, 20 bp, human
ggctctgccgctggtcccct

SEQ ID NO: 233420 - DNA, 20 bp, human
gccgcccgccggaccaaaca

SEQ ID NO: 233421 - DNA, 20 bp, human
gccgccggaccaaacacggg

SEQ ID NO: 233422 - DNA, 20 bp, human
gtggccacgcggaagaggtg

SEQ ID NO: 233423 - DNA, 20 bp, human
ggggccctagagtcgcggcg

SEQ ID NO: 233424 - DNA, 20 bp, human
gcagcggcagagcacgggtg

SEQ ID NO: 233425 - DNA, 20 bp, human
ggagtcgcggcgtggtttcc

SEQ ID NO: 233426 - DNA, 20 bp, human
gctggcgaggcgaagtgtag

SEQ ID NO: 233427 - DNA, 20 bp, human
gtcggggcgcgtcataacgc

SEQ ID NO: 233428 - DNA, 20 bp, human
ggcctcgccaggattaaaaa

SEQ ID NO: 233429 - DNA, 20 bp, human
ggacgtccgccggaagtgca

SEQ ID NO: 233430 - DNA, 20 bp, human
ggaagtgcacggaggagttc

SEQ ID NO: 233431 - DNA, 20 bp, human
gcgcgtcataacgccggccg

SEQ ID NO: 233432 - DNA, 20 bp, human
ggtccgccggaagtgcacgg

SEQ ID NO: 233433 - DNA, 20 bp, human
ggtgcacggaggagttccgg

SEQ ID NO: 233434 - DNA, 20 bp, human
gtaaaaatggcgcccacggc

SEQ ID NO: 233435 - DNA, 20 bp, human
ggacgcgccccgacgtccgc

SEQ ID NO: 233436 - DNA, 20 bp, human
gggccccttttgctcaataa

SEQ ID NO: 233437 - DNA, 20 bp, human
gagcaaaaggggcccgcggc

SEQ ID NO: 233438 - DNA, 20 bp, human
gattgagcaaaaggggcccg

SEQ ID NO: 233439 - DNA, 20 bp, human
gaggccagtgctgtgacacc

SEQ ID NO: 233440 - DNA, 20 bp, human
ggaaaccgttattgagcaaa

SEQ ID NO: 233441 - DNA, 20 bp, human
gtgatgccaccactgctccc

SEQ ID NO: 233442 - DNA, 20 bp, human
gtgaaggttgccttctgggc

SEQ ID NO: 233443 - DNA, 20 bp, human
gaatattgaaggttgccttc

SEQ ID NO: 233444 - DNA, 20 bp, human
gcacatggagacatttgagc

SEQ ID NO: 233445 - DNA, 20 bp, human
ggtattagaaaaggttaggc

SEQ ID NO: 233446 - DNA, 20 bp, human
ggagccaagagcgacactgg

SEQ ID NO: 233447 - DNA, 20 bp, human
gggaagcaatgaaatgccga

SEQ ID NO: 233448 - DNA, 20 bp, human
ggtgttgggtgtgtcgtttt

SEQ ID NO: 233449 - DNA, 20 bp, human
gagaagtccgggcaaccaat

SEQ ID NO: 233450 - DNA, 20 bp, human
ggcggagccaagagcgacac

SEQ ID NO: 233451 - DNA, 20 bp, human
gcatgctcgaacagcattct

SEQ ID NO: 233452 - DNA, 20 bp, human
gtaactccggcgggcgtgtt

SEQ ID NO: 233453 - DNA, 20 bp, human
ggggaattgtagttcggggg

SEQ ID NO: 233454 - DNA, 20 bp, human
gggcggagtagcttccggaa

SEQ ID NO: 233455 - DNA, 20 bp, human
gtacagctaaaggaaggaca

SEQ ID NO: 233456 - DNA, 20 bp, human
gtgaacctaggggaccctgt

SEQ ID NO: 233457 - DNA, 20 bp, human
gtagcgcggtggggtgagat

SEQ ID NO: 233458 - DNA, 20 bp, human
gggaggtgaggtcgagtgag

SEQ ID NO: 233459 - DNA, 20 bp, human
gacaaccaacagggtcccct

SEQ ID NO: 233460 - DNA, 20 bp, human
gggtcccctaggttcaggcg

SEQ ID NO: 233461 - DNA, 20 bp, human
gttcacccggtggtgttccc

SEQ ID NO: 233462 - DNA, 20 bp, human
gacctccccgcctgaaccta

SEQ ID NO: 233463 - DNA, 20 bp, human
gaccttctccttagcgcggt

SEQ ID NO: 233464 - DNA, 20 bp, human
gccccaccgcgctaaggaga

SEQ ID NO: 233465 - DNA, 20 bp, human
gagacatcacacaaccaaca

SEQ ID NO: 233466 - DNA, 20 bp, human
ggctggcagaggaaatgtag

SEQ ID NO: 233467 - DNA, 20 bp, human
gctggggcttcctgtcacgg

SEQ ID NO: 233468 - DNA, 20 bp, human
ggaagcccagccgaagatta

SEQ ID NO: 233469 - DNA, 20 bp, human
gctactggggcttcctgtca

SEQ ID NO: 233470 - DNA, 20 bp, human
ggcccctgataaatagaata

SEQ ID NO: 233471 - DNA, 20 bp, human
gaatgtagtgggagacaaga

SEQ ID NO: 233472 - DNA, 20 bp, human
gaaccctgccctgtatgctg

SEQ ID NO: 233473 - DNA, 20 bp, human
ggccccccagccaccgtgac

SEQ ID NO: 233474 - DNA, 20 bp, human
gcacacccgcgggacctata

SEQ ID NO: 233475 - DNA, 20 bp, human
gttaagacatccctaatctt

SEQ ID NO: 233476 - DNA, 20 bp, human
gccccctgcggctggggcgt

SEQ ID NO: 233477 - DNA, 20 bp, human
ggaggggcggggagtcgggc

SEQ ID NO: 233478 - DNA, 20 bp, human
gaccagggactcggagaacg

SEQ ID NO: 233479 - DNA, 20 bp, human
ggccctgccccctgcggctg

SEQ ID NO: 233480 - DNA, 20 bp, human
gtcggagaacgcggggacgc

SEQ ID NO: 233481 - DNA, 20 bp, human
gggccactgtccccaattca

SEQ ID NO: 233482 - DNA, 20 bp, human
gtggggcgccaggagattgc

SEQ ID NO: 233483 - DNA, 20 bp, human
gctcggaccacgtccatcgt

SEQ ID NO: 233484 - DNA, 20 bp, human
gcccgcgttctccgagtccc

SEQ ID NO: 233485 - DNA, 20 bp, human
ggcccacgccccagccgcag

SEQ ID NO: 233486 - DNA, 20 bp, human
gcccccgacccgaaggccaa

SEQ ID NO: 233487 - DNA, 20 bp, human
gaactccgcccccgacccga

SEQ ID NO: 233488 - DNA, 20 bp, human
gccacaagaaccacagtctc

SEQ ID NO: 233489 - DNA, 20 bp, human
gcgcagacgcgtccttccgg

SEQ ID NO: 233490 - DNA, 20 bp, human
gcaccattggccttcgggtc

SEQ ID NO: 233491 - DNA, 20 bp, human
gcaactcattccattggctt

SEQ ID NO: 233492 - DNA, 20 bp, human
gaacgctcgacatgttacca

SEQ ID NO: 233493 - DNA, 20 bp, human
gatgacgcccaggtctccgt

SEQ ID NO: 233494 - DNA, 20 bp, human
gttgactagaattgtcccta

SEQ ID NO: 233495 - DNA, 20 bp, human
ggtcgggggcggagttgtcc

SEQ ID NO: 233496 - DNA, 20 bp, human
ggggtgtaggggagtctcaa

SEQ ID NO: 233497 - DNA, 20 bp, human
ggagggctggagttattgtt

SEQ ID NO: 233498 - DNA, 20 bp, human
ggggacaaggaagaagattc

SEQ ID NO: 233499 - DNA, 20 bp, human
ggctaaaaggaagggatcga

SEQ ID NO: 233500 - DNA, 20 bp, human
gggtaacaaggcaggaagct

SEQ ID NO: 233501 - DNA, 20 bp, human
gtcctcaaacaaacagaggt

SEQ ID NO: 233502 - DNA, 20 bp, human
gtaggggagtctcaagggaa

SEQ ID NO: 233503 - DNA, 20 bp, human
gctcccagaatgggaagttc

SEQ ID NO: 233504 - DNA, 20 bp, human
gttattgtttggttcactgc

SEQ ID NO: 233505 - DNA, 20 bp, human
ggaacaggctctcccagaat

SEQ ID NO: 233506 - DNA, 20 bp, human
ggctggccacaccacagggt

SEQ ID NO: 233507 - DNA, 20 bp, human
gggttggtggagactacttg

SEQ ID NO: 233508 - DNA, 20 bp, human
ggtagtctccaccaaccctg

SEQ ID NO: 233509 - DNA, 20 bp, human
gcaacactgtgtgatgtcac

SEQ ID NO: 233510 - DNA, 20 bp, human
gcacctgccgcctggcactc

SEQ ID NO: 233511 - DNA, 20 bp, human
ggcaggtggaacacagctcc

SEQ ID NO: 233512 - DNA, 20 bp, human
gaccagccatcgtgcctctt

SEQ ID NO: 233513 - DNA, 20 bp, human
ggaagatcggggagagaaga

SEQ ID NO: 233514 - DNA, 20 bp, human
gagactataggtacccaaag

SEQ ID NO: 233515 - DNA, 20 bp, human
gtagctcactgcacctggac

SEQ ID NO: 233516 - DNA, 20 bp, human
gggccctgacaaagtcctcc

SEQ ID NO: 233517 - DNA, 20 bp, human
ggcgacgcgtggaggccggg

SEQ ID NO: 233518 - DNA, 20 bp, human
gaggaccccgccagtggcgt

SEQ ID NO: 233519 - DNA, 20 bp, human
gggaaagcgcgtccccgccg

SEQ ID NO: 233520 - DNA, 20 bp, human
ggacaggccctcaaagttgt

SEQ ID NO: 233521 - DNA, 20 bp, human
gcacagaccccgcgttgcca

SEQ ID NO: 233522 - DNA, 20 bp, human
ggggctggctaagggaggcc

SEQ ID NO: 233523 - DNA, 20 bp, human
gtggcccgccaagttcaaac

SEQ ID NO: 233524 - DNA, 20 bp, human
gcaaactggcggagccgcgg

SEQ ID NO: 233525 - DNA, 20 bp, human
gggtctgtgctggccgggat

SEQ ID NO: 233526 - DNA, 20 bp, human
ggcggggcccacaatcagcg

SEQ ID NO: 233527 - DNA, 20 bp, human
gcggaatcccagttggtcag

SEQ ID NO: 233528 - DNA, 20 bp, human
gtagctgcctgtcgcggcga

SEQ ID NO: 233529 - DNA, 20 bp, human
ggggccgagggtggccattc

SEQ ID NO: 233530 - DNA, 20 bp, human
ggactggacggaatcccagt

SEQ ID NO: 233531 - DNA, 20 bp, human
gggattccgtccagtcccca

SEQ ID NO: 233532 - DNA, 20 bp, human
gacagcatgtggggtggaac

SEQ ID NO: 233533 - DNA, 20 bp, human
gcgtcccgctgcctctgcaa

SEQ ID NO: 233534 - DNA, 20 bp, human
ggccgcgcgtgccgttgcag

SEQ ID NO: 233535 - DNA, 20 bp, human
gggtgtgagggaacgttgca

SEQ ID NO: 233536 - DNA, 20 bp, human
ggcggagtgttgaacctcag

SEQ ID NO: 233537 - DNA, 20 bp, human
gcaacactccgcacttgggt

SEQ ID NO: 233538 - DNA, 20 bp, human
gacgtgccaagcactgaaga

SEQ ID NO: 233539 - DNA, 20 bp, human
ggggccaggcgctgtcctgg

SEQ ID NO: 233540 - DNA, 20 bp, human
ggcggaggctgggcgcttga

SEQ ID NO: 233541 - DNA, 20 bp, human
ggctgctgggtccgagctct

SEQ ID NO: 233542 - DNA, 20 bp, human
gtgtgacgccacaaaggccg

SEQ ID NO: 233543 - DNA, 20 bp, human
gtccaaggcaaccattcttc

SEQ ID NO: 233544 - DNA, 20 bp, human
gagggatcgcactttctaga

SEQ ID NO: 233545 - DNA, 20 bp, human
ggctggctgtgacgccacaa

SEQ ID NO: 233546 - DNA, 20 bp, human
ggctcccgccccagaacctg

SEQ ID NO: 233547 - DNA, 20 bp, human
gcctccacgcagtaccctcc

SEQ ID NO: 233548 - DNA, 20 bp, human
gctgcccacaggttctgggg

SEQ ID NO: 233549 - DNA, 20 bp, human
gggcagggacgggagcttgg

SEQ ID NO: 233550 - DNA, 20 bp, human
ggtcccagcaccctaggcag

SEQ ID NO: 233551 - DNA, 20 bp, human
gtcaagggttggctgggtga

SEQ ID NO: 233552 - DNA, 20 bp, human
gtcagagaggaacaccccat

SEQ ID NO: 233553 - DNA, 20 bp, human
gcggccagctccgcccgtgg

SEQ ID NO: 233554 - DNA, 20 bp, human
gctggggtagagccccggaa

SEQ ID NO: 233555 - DNA, 20 bp, human
ggccccgggagggtactgcg

SEQ ID NO: 233556 - DNA, 20 bp, human
gacccccgggaacgtcggga

SEQ ID NO: 233557 - DNA, 20 bp, human
gtggcaacccccgggaacgt

SEQ ID NO: 233558 - DNA, 20 bp, human
gagcccgaaggcgaaacttc

SEQ ID NO: 233559 - DNA, 20 bp, human
gcccctcccgacgttcccgg

SEQ ID NO: 233560 - DNA, 20 bp, human
gcaggcagggagttctcaac

SEQ ID NO: 233561 - DNA, 20 bp, human
ggtcctccagccagctccgg

SEQ ID NO: 233562 - DNA, 20 bp, human
gcaaccggaagtttcgcctt

SEQ ID NO: 233563 - DNA, 20 bp, human
gggacgcgggaaggttgcta

SEQ ID NO: 233564 - DNA, 20 bp, human
ggttcccgggggttgccagg

SEQ ID NO: 233565 - DNA, 20 bp, human
gaggaaacgctccagcccga

SEQ ID NO: 233566 - DNA, 20 bp, human
gcgggcgcagagagcgataa

SEQ ID NO: 233567 - DNA, 20 bp, human
gaccacgcgcgctgcgaggg

SEQ ID NO: 233568 - DNA, 20 bp, human
ggggaccacgcgcgctgcga

SEQ ID NO: 233569 - DNA, 20 bp, human
gtcagcgtgtgcccagcggg

SEQ ID NO: 233570 - DNA, 20 bp, human
gaaattgagcgcagccgagg

SEQ ID NO: 233571 - DNA, 20 bp, human
ggggcggctcgaggtcccga

SEQ ID NO: 233572 - DNA, 20 bp, human
gggtgcccggcaggtccctt

SEQ ID NO: 233573 - DNA, 20 bp, human
gaggtcccgaagggacctgc

SEQ ID NO: 233574 - DNA, 20 bp, human
gaggaagggaagatacgctc

SEQ ID NO: 233575 - DNA, 20 bp, human
gagcgcgcgtggtcccggcc

SEQ ID NO: 233576 - DNA, 20 bp, human
gtcggtggcgtgggtgacgt

SEQ ID NO: 233577 - DNA, 20 bp, human
gctccggcagcaaccggcgt

SEQ ID NO: 233578 - DNA, 20 bp, human
gcaaccggcgtcggtggcgt

SEQ ID NO: 233579 - DNA, 20 bp, human
gtgccggagccgttagaggg

SEQ ID NO: 233580 - DNA, 20 bp, human
ggcgtgggtgacgtcggcgt

SEQ ID NO: 233581 - DNA, 20 bp, human
ggcccagcggcacgcgaagc

SEQ ID NO: 233582 - DNA, 20 bp, human
gggaggagacaaacgaaccg

SEQ ID NO: 233583 - DNA, 20 bp, human
ggagcggccacgggtgacag

SEQ ID NO: 233584 - DNA, 20 bp, human
gcaccgacgccggttgctgc

SEQ ID NO: 233585 - DNA, 20 bp, human
gctcccgaaggcgttcctgg

SEQ ID NO: 233586 - DNA, 20 bp, human
gccttcccagaagttcctga

SEQ ID NO: 233587 - DNA, 20 bp, human
gaggcagtttctggtgagtg

SEQ ID NO: 233588 - DNA, 20 bp, human
gcctccctggggttcaggtg

SEQ ID NO: 233589 - DNA, 20 bp, human
gtgtggctgagaaggggcat

SEQ ID NO: 233590 - DNA, 20 bp, human
gtgcgggcgccctgctctta

SEQ ID NO: 233591 - DNA, 20 bp, human
ggctgagaaggggcatcggg

SEQ ID NO: 233592 - DNA, 20 bp, human
gtggccggcacgtggagtcc

SEQ ID NO: 233593 - DNA, 20 bp, human
gacgtgccggccacagaacc

SEQ ID NO: 233594 - DNA, 20 bp, human
ggagaaggggcatcgggtgg

SEQ ID NO: 233595 - DNA, 20 bp, human
ggcaaggggaggaccaatgg

SEQ ID NO: 233596 - DNA, 20 bp, human
gaatcggtggtgcaatggag

SEQ ID NO: 233597 - DNA, 20 bp, human
gcatcaaatcggtggtgcaa

SEQ ID NO: 233598 - DNA, 20 bp, human
gtaacaccccatcaaatcgg

SEQ ID NO: 233599 - DNA, 20 bp, human
gaagaagcttggccaaacgt

SEQ ID NO: 233600 - DNA, 20 bp, human
gtaggcgatggaatgttgtg

SEQ ID NO: 233601 - DNA, 20 bp, human
gacagggagtggcgcctcaa

SEQ ID NO: 233602 - DNA, 20 bp, human
gccaggcggcagctaggcga

SEQ ID NO: 233603 - DNA, 20 bp, human
ggagccccatcaccaggaca

SEQ ID NO: 233604 - DNA, 20 bp, human
gggagcccccagcctggtta

SEQ ID NO: 233605 - DNA, 20 bp, human
gggcaaccagagcctgctgg

SEQ ID NO: 233606 - DNA, 20 bp, human
ggcaaagagcgcagccgtgt

SEQ ID NO: 233607 - DNA, 20 bp, human
gactgcggtaggcgccctag

SEQ ID NO: 233608 - DNA, 20 bp, human
gccaccgcgcatgcctgaag

SEQ ID NO: 233609 - DNA, 20 bp, human
gcggggaaggcagctcggtc

SEQ ID NO: 233610 - DNA, 20 bp, human
gacgcggctaataactaccc

SEQ ID NO: 233611 - DNA, 20 bp, human
gaggcagctcggtcgggtgg

SEQ ID NO: 233612 - DNA, 20 bp, human
gcgcggcccgtcaggcactg

SEQ ID NO: 233613 - DNA, 20 bp, human
gtcccccgaaagcgcgggga

SEQ ID NO: 233614 - DNA, 20 bp, human
gggcatgcgcggtggacctg

SEQ ID NO: 233615 - DNA, 20 bp, human
gactctcaagccggccgaca

SEQ ID NO: 233616 - DNA, 20 bp, human
gaggtctcgcgctttccccg

SEQ ID NO: 233617 - DNA, 20 bp, human
ggaggcgaggtggggctttt

SEQ ID NO: 233618 - DNA, 20 bp, human
gtctacgtaacggacggcgg

SEQ ID NO: 233619 - DNA, 20 bp, human
gtaggtaggaggattgggat

SEQ ID NO: 233620 - DNA, 20 bp, human
ggggttgcgtcccgccccgc

SEQ ID NO: 233621 - DNA, 20 bp, human
ggagggcagttccggcccag

SEQ ID NO: 233622 - DNA, 20 bp, human
gaaaggtggccatgctgtgt

SEQ ID NO: 233623 - DNA, 20 bp, human
gaatcctaggtaggaggatt

SEQ ID NO: 233624 - DNA, 20 bp, human
gggaggattgggataggcga

SEQ ID NO: 233625 - DNA, 20 bp, human
ggcggaggctacgtgaagag

SEQ ID NO: 233626 - DNA, 20 bp, human
gctgcccccctcctacggga

SEQ ID NO: 233627 - DNA, 20 bp, human
gggccctgcccccctcctac

SEQ ID NO: 233628 - DNA, 20 bp, human
gggcgcgtcactgagcacaa

SEQ ID NO: 233629 - DNA, 20 bp, human
gcgaccctcccgtaggaggg

SEQ ID NO: 233630 - DNA, 20 bp, human
ggggtcgcgtctttaggtgg

SEQ ID NO: 233631 - DNA, 20 bp, human
gacgcgaccctcccgtagga

SEQ ID NO: 233632 - DNA, 20 bp, human
gcggggccgtccagtacgga

SEQ ID NO: 233633 - DNA, 20 bp, human
ggacaacagcgaggcggcag

SEQ ID NO: 233634 - DNA, 20 bp, human
gaaaggagacaacagcgagg

SEQ ID NO: 233635 - DNA, 20 bp, human
gggaccggggccgtccagta

SEQ ID NO: 233636 - DNA, 20 bp, human
gtccaggggcgggtactaac

SEQ ID NO: 233637 - DNA, 20 bp, human
gctgtctacgacagagggtg

SEQ ID NO: 233638 - DNA, 20 bp, human
ggcgaggcggccccgctgat

SEQ ID NO: 233639 - DNA, 20 bp, human
ggcgggtactaacaggtcag

SEQ ID NO: 233640 - DNA, 20 bp, human
gctgactaggagccaatcag

SEQ ID NO: 233641 - DNA, 20 bp, human
gaggtcagaggtcaactgag

SEQ ID NO: 233642 - DNA, 20 bp, human
ggcccctggagcgccgcatc

SEQ ID NO: 233643 - DNA, 20 bp, human
gcctcgctgtctacgacaga

SEQ ID NO: 233644 - DNA, 20 bp, human
ggagtggcagacgattggtc

SEQ ID NO: 233645 - DNA, 20 bp, human
gcaactgagtggcagacgat

SEQ ID NO: 233646 - DNA, 20 bp, human
gccgccgagtgattagtgag

SEQ ID NO: 233647 - DNA, 20 bp, human
gcctcctcgctcggcattct

SEQ ID NO: 233648 - DNA, 20 bp, human
gaatcccagaatgccgagcg

SEQ ID NO: 233649 - DNA, 20 bp, human
gtgtgacgtcaatttcgggg

SEQ ID NO: 233650 - DNA, 20 bp, human
gccggaggcgggcacttggg

SEQ ID NO: 233651 - DNA, 20 bp, human
gtaacagacaggactaagta

SEQ ID NO: 233652 - DNA, 20 bp, human
ggagcggagaagctttcttc

SEQ ID NO: 233653 - DNA, 20 bp, human
gcgaaattgacgtcacaatc

SEQ ID NO: 233654 - DNA, 20 bp, human
ggccccggaggcgggcactt

SEQ ID NO: 233655 - DNA, 20 bp, human
gcactgaaatcttagaaagg

SEQ ID NO: 233656 - DNA, 20 bp, human
gtctcaaaagttttggtcat

SEQ ID NO: 233657 - DNA, 20 bp, human
gtcattgtgacatcagcagc

SEQ ID NO: 233658 - DNA, 20 bp, human
gctgatgtcacaatgactgc

SEQ ID NO: 233659 - DNA, 20 bp, human
ggaaattgttgagcagcctg

SEQ ID NO: 233660 - DNA, 20 bp, human
ggtgtttttctgtgttcctc

SEQ ID NO: 233661 - DNA, 20 bp, human
gcagcagttctcaaaagttt

SEQ ID NO: 233662 - DNA, 20 bp, human
gcacacagattttgtttatt

SEQ ID NO: 233663 - DNA, 20 bp, human
gtaaaaatgaaaaattattg

SEQ ID NO: 233664 - DNA, 20 bp, human
gattttcataaaaaataatt

SEQ ID NO: 233665 - DNA, 20 bp, human
gagactgtagtatgccatga

SEQ ID NO: 233666 - DNA, 20 bp, human
ggcgctgcgcccgggtccga

SEQ ID NO: 233667 - DNA, 20 bp, human
gcaccgccgcagatcgaagg

SEQ ID NO: 233668 - DNA, 20 bp, human
ggtcgccccgctgaccggtg

SEQ ID NO: 233669 - DNA, 20 bp, human
ggggtcccgccgacaggaaa

SEQ ID NO: 233670 - DNA, 20 bp, human
ggaccaccgccgcagatcga

SEQ ID NO: 233671 - DNA, 20 bp, human
gggtccctggcgctaggttc

SEQ ID NO: 233672 - DNA, 20 bp, human
gcggcctcctcaccggtcag

SEQ ID NO: 233673 - DNA, 20 bp, human
gggctccctccttcgatctg

SEQ ID NO: 233674 - DNA, 20 bp, human
ggggccggaacctagcgcca

SEQ ID NO: 233675 - DNA, 20 bp, human
gtcagcggggcgactccgga

SEQ ID NO: 233676 - DNA, 20 bp, human
gagcagggtgacaggttccg

SEQ ID NO: 233677 - DNA, 20 bp, human
gtccaggaggacatgttaaa

SEQ ID NO: 233678 - DNA, 20 bp, human
gagggtgacaggttccgagg

SEQ ID NO: 233679 - DNA, 20 bp, human
gtagtacgaggggaatcctt

SEQ ID NO: 233680 - DNA, 20 bp, human
ggcaaggcttgagttcaacg

SEQ ID NO: 233681 - DNA, 20 bp, human
gttaaaagggttgggacagc

SEQ ID NO: 233682 - DNA, 20 bp, human
gaggacatgttaaaagggtt

SEQ ID NO: 233683 - DNA, 20 bp, human
gcttaggaaagctgagtgca

SEQ ID NO: 233684 - DNA, 20 bp, human
gcggggaggaggttaggcac

SEQ ID NO: 233685 - DNA, 20 bp, human
gacaaaaaatatagtacgag

SEQ ID NO: 233686 - DNA, 20 bp, human
gtgggcaggtccggggtcac

SEQ ID NO: 233687 - DNA, 20 bp, human
gggtccggggtcaccgggag

SEQ ID NO: 233688 - DNA, 20 bp, human
ggcgccacctacagcctcgg

SEQ ID NO: 233689 - DNA, 20 bp, human
ggctgtaggtggcgcaaaca

SEQ ID NO: 233690 - DNA, 20 bp, human
gcccgctgggaaaccgagga

SEQ ID NO: 233691 - DNA, 20 bp, human
gagcctgcctgtgctaattt

SEQ ID NO: 233692 - DNA, 20 bp, human
gtttgcgccacctacagcct

SEQ ID NO: 233693 - DNA, 20 bp, human
gaggaagtcagcgtcggaga

SEQ ID NO: 233694 - DNA, 20 bp, human
ggaggggtcggattagttga

SEQ ID NO: 233695 - DNA, 20 bp, human
ggcaacttggcacgcagcgt

SEQ ID NO: 233696 - DNA, 20 bp, human
gcccgcccgtggtcaccaga

SEQ ID NO: 233697 - DNA, 20 bp, human
gctaggccgcccagcaaagc

SEQ ID NO: 233698 - DNA, 20 bp, human
gcgggctgggcgcgctccct

SEQ ID NO: 233699 - DNA, 20 bp, human
ggccgtgggcttagatcagg

SEQ ID NO: 233700 - DNA, 20 bp, human
gcttgggcagtattgcactg

SEQ ID NO: 233701 - DNA, 20 bp, human
gccagggcgcagactcggag

SEQ ID NO: 233702 - DNA, 20 bp, human
gtggggccacaacacggtag

SEQ ID NO: 233703 - DNA, 20 bp, human
gcgtggtcaccagacggcgg

SEQ ID NO: 233704 - DNA, 20 bp, human
gtgcgggtgcgggaaagcca

SEQ ID NO: 233705 - DNA, 20 bp, human
gccacaacacggtagaggat

SEQ ID NO: 233706 - DNA, 20 bp, human
gagccggcgtcccagcaacc

SEQ ID NO: 233707 - DNA, 20 bp, human
ggacgccggctcagagcagc

SEQ ID NO: 233708 - DNA, 20 bp, human
gccgaggagggcttcctcat

SEQ ID NO: 233709 - DNA, 20 bp, human
gttagagaatgcagctccgg

SEQ ID NO: 233710 - DNA, 20 bp, human
ggtgaactctcccaggttgc

SEQ ID NO: 233711 - DNA, 20 bp, human
gctcattggctggaattcgt

SEQ ID NO: 233712 - DNA, 20 bp, human
ggtcccgttgccaagcaact

SEQ ID NO: 233713 - DNA, 20 bp, human
gatgcagctccggtggcagc

SEQ ID NO: 233714 - DNA, 20 bp, human
gtggggggaacccagttgct

SEQ ID NO: 233715 - DNA, 20 bp, human
gtggctggaattcgtggggg

SEQ ID NO: 233716 - DNA, 20 bp, human
gagaagaggctgtcccaaat

SEQ ID NO: 233717 - DNA, 20 bp, human
gaggctgtcccaaatgggtt

SEQ ID NO: 233718 - DNA, 20 bp, human
gaggccgcgcccacgtggtg

SEQ ID NO: 233719 - DNA, 20 bp, human
ggtcccaaatgggttggggg

SEQ ID NO: 233720 - DNA, 20 bp, human
gtagagaagagcccgacgtt

SEQ ID NO: 233721 - DNA, 20 bp, human
gagggtaggccgcgcccacg

SEQ ID NO: 233722 - DNA, 20 bp, human
gtgggggaggcacctaacgt

SEQ ID NO: 233723 - DNA, 20 bp, human
gtggagggcgggttctcctc

SEQ ID NO: 233724 - DNA, 20 bp, human
ggccctccaaaacttccaat

SEQ ID NO: 233725 - DNA, 20 bp, human
ggggtaataggtggagtcaa

SEQ ID NO: 233726 - DNA, 20 bp, human
gcgagctcacggttattagg

SEQ ID NO: 233727 - DNA, 20 bp, human
gagggggaagatggaagata

SEQ ID NO: 233728 - DNA, 20 bp, human
gtgtagctggctcccagaac

SEQ ID NO: 233729 - DNA, 20 bp, human
ggaaactgggggctcccaag

SEQ ID NO: 233730 - DNA, 20 bp, human
gcgagtgtcaggtcctgttc

SEQ ID NO: 233731 - DNA, 20 bp, human
gcaccagcgcagcggggctg

SEQ ID NO: 233732 - DNA, 20 bp, human
ggtgctcgctcctgtgtagc

SEQ ID NO: 233733 - DNA, 20 bp, human
gccctcggggataacagttg

SEQ ID NO: 233734 - DNA, 20 bp, human
ggggggctcccaagtggctc

SEQ ID NO: 233735 - DNA, 20 bp, human
gctgacactcgaatgcgtgg

SEQ ID NO: 233736 - DNA, 20 bp, human
gtagtctggtaaggggtcgc

SEQ ID NO: 233737 - DNA, 20 bp, human
gggtccgggtagtctggtaa

SEQ ID NO: 233738 - DNA, 20 bp, human
ggaccccttaccagactacc

SEQ ID NO: 233739 - DNA, 20 bp, human
gaacgcccgggcgtggggct

SEQ ID NO: 233740 - DNA, 20 bp, human
gcacaaaggcgcccgttcca

SEQ ID NO: 233741 - DNA, 20 bp, human
gctgctgtgagcatgagtgt

SEQ ID NO: 233742 - DNA, 20 bp, human
gacggtgaatggggtgtgag

SEQ ID NO: 233743 - DNA, 20 bp, human
gttggagggaagcttttggt

SEQ ID NO: 233744 - DNA, 20 bp, human
gccccacgcccgggcgttct

SEQ ID NO: 233745 - DNA, 20 bp, human
gtcccagaacgcccgggcgt

SEQ ID NO: 233746 - DNA, 20 bp, human
gagcggcagcggcaacaggg

SEQ ID NO: 233747 - DNA, 20 bp, human
gtagtggcggagtaggtggt

SEQ ID NO: 233748 - DNA, 20 bp, human
gagggcggctgagaacccgg

SEQ ID NO: 233749 - DNA, 20 bp, human
ggactcaggaacagagactg

SEQ ID NO: 233750 - DNA, 20 bp, human
gcgcgcgcgccaggctgcag

SEQ ID NO: 233751 - DNA, 20 bp, human
gcgggcagcgcctcacgggg

SEQ ID NO: 233752 - DNA, 20 bp, human
ggggccgggccgcaccgctg

SEQ ID NO: 233753 - DNA, 20 bp, human
ggagggtcggcgaagcggga

SEQ ID NO: 233754 - DNA, 20 bp, human
ggggacgcggccggaagccc

SEQ ID NO: 233755 - DNA, 20 bp, human
gggccgggcagcgcctcacg

SEQ ID NO: 233756 - DNA, 20 bp, human
ggggctcagagggctcatat

SEQ ID NO: 233757 - DNA, 20 bp, human
gtgcctggggtgtctgtcgc

SEQ ID NO: 233758 - DNA, 20 bp, human
gcctcaggctggtgcggggt

SEQ ID NO: 233759 - DNA, 20 bp, human
gaaggctgggaggtggacat

SEQ ID NO: 233760 - DNA, 20 bp, human
gtctgtcgcaggcagaggag

SEQ ID NO: 233761 - DNA, 20 bp, human
gcagggagaagcattgggag

SEQ ID NO: 233762 - DNA, 20 bp, human
gaagctccctatacctggat

SEQ ID NO: 233763 - DNA, 20 bp, human
gggggtggagcagggttagt

SEQ ID NO: 233764 - DNA, 20 bp, human
gcaggtatagggagcttagt

SEQ ID NO: 233765 - DNA, 20 bp, human
ggcattgggagtggaactaa

SEQ ID NO: 233766 - DNA, 20 bp, human
gaccgcggtcggtttttgag

SEQ ID NO: 233767 - DNA, 20 bp, human
gcgcggtcctccactgggta

SEQ ID NO: 233768 - DNA, 20 bp, human
ggctagaagagtccctgtct

SEQ ID NO: 233769 - DNA, 20 bp, human
gaccgaccgcggtcctccac

SEQ ID NO: 233770 - DNA, 20 bp, human
gtagggggcgctccaagaca

SEQ ID NO: 233771 - DNA, 20 bp, human
gataaaagtgcactgagggg

SEQ ID NO: 233772 - DNA, 20 bp, human
gcccagtggaggaccgcggt

SEQ ID NO: 233773 - DNA, 20 bp, human
ggctaacatggagaggcaac

SEQ ID NO: 233774 - DNA, 20 bp, human
gaacgaggatatcgctaaca

SEQ ID NO: 233775 - DNA, 20 bp, human
gccctctcaaaaaccgaccg

SEQ ID NO: 233776 - DNA, 20 bp, human
gttagccagcccacagacct

SEQ ID NO: 233777 - DNA, 20 bp, human
gaggaaatgctgcatttggg

SEQ ID NO: 233778 - DNA, 20 bp, human
gagcccacagacctaggttt

SEQ ID NO: 233779 - DNA, 20 bp, human
gccaaatggcaaggctcacg

SEQ ID NO: 233780 - DNA, 20 bp, human
gggcctgtggtgaactggag

SEQ ID NO: 233781 - DNA, 20 bp, human
gaaatgctgcatttgggagg

SEQ ID NO: 233782 - DNA, 20 bp, human
gggctaagattgcaacctcg

SEQ ID NO: 233783 - DNA, 20 bp, human
ggaccattctaaattgtcaa

SEQ ID NO: 233784 - DNA, 20 bp, human
gggaaagcactttggatcaa

SEQ ID NO: 233785 - DNA, 20 bp, human
ggaactccatacccaaacct

SEQ ID NO: 233786 - DNA, 20 bp, human
gtatgagtctaaagcttcgg

SEQ ID NO: 233787 - DNA, 20 bp, human
gcatacgcaaccgtccccgc

SEQ ID NO: 233788 - DNA, 20 bp, human
gggcacaaacggggcacaaa

SEQ ID NO: 233789 - DNA, 20 bp, human
gtgagcaagtggaccaatca

SEQ ID NO: 233790 - DNA, 20 bp, human
gggaacaaacggcacaaacg

SEQ ID NO: 233791 - DNA, 20 bp, human
ggagtctaaagcttcggtgg

SEQ ID NO: 233792 - DNA, 20 bp, human
gcagcatgccccaccctgat

SEQ ID NO: 233793 - DNA, 20 bp, human
gcaattggatataggggtgc

SEQ ID NO: 233794 - DNA, 20 bp, human
ggctacgccaattggatata

SEQ ID NO: 233795 - DNA, 20 bp, human
ggcaagtggaccaatcaggg

SEQ ID NO: 233796 - DNA, 20 bp, human
ggcgccgccgcgtgttgcca

SEQ ID NO: 233797 - DNA, 20 bp, human
gcgcccatcccccactccga

SEQ ID NO: 233798 - DNA, 20 bp, human
gacgtcgcggcccgaactcg

SEQ ID NO: 233799 - DNA, 20 bp, human
gtccccatggcaacacgcgg

SEQ ID NO: 233800 - DNA, 20 bp, human
gtcgggccgcgacgtcccca

SEQ ID NO: 233801 - DNA, 20 bp, human
gtcgcgcggggtgaggttgg

SEQ ID NO: 233802 - DNA, 20 bp, human
gggcccgaactcgtggccgt

SEQ ID NO: 233803 - DNA, 20 bp, human
gacgtccccatggcaacacg

SEQ ID NO: 233804 - DNA, 20 bp, human
ggaactcgtggccgtcggag

SEQ ID NO: 233805 - DNA, 20 bp, human
gagaggcccaactgcctcgt

SEQ ID NO: 233806 - DNA, 20 bp, human
ggggtgctgtacaggcgggt

SEQ ID NO: 233807 - DNA, 20 bp, human
gaccctagcgaggggcgtga

SEQ ID NO: 233808 - DNA, 20 bp, human
gtgtacagcaccctagcgag

SEQ ID NO: 233809 - DNA, 20 bp, human
gcccggggaggagtcgcggc

SEQ ID NO: 233810 - DNA, 20 bp, human
ggccccgcggggcgcgccca

SEQ ID NO: 233811 - DNA, 20 bp, human
gtccggcgccggtgaggccc

SEQ ID NO: 233812 - DNA, 20 bp, human
ggcagagtccggcgccggtg

SEQ ID NO: 233813 - DNA, 20 bp, human
gccagggcagagtccggcgc

SEQ ID NO: 233814 - DNA, 20 bp, human
gggacgcgtacgcccagcgc

SEQ ID NO: 233815 - DNA, 20 bp, human
ggcccctcacgcccctcgct

SEQ ID NO: 233816 - DNA, 20 bp, human
gggccctgcgggctacactg

SEQ ID NO: 233817 - DNA, 20 bp, human
gcgaaccctcagctaagaaa

SEQ ID NO: 233818 - DNA, 20 bp, human
ggtgtagcccgcagggccag

SEQ ID NO: 233819 - DNA, 20 bp, human
gacactgaggccccgctctt

SEQ ID NO: 233820 - DNA, 20 bp, human
ggattctggtcacctgcctc

SEQ ID NO: 233821 - DNA, 20 bp, human
gtaataggaagctctggtca

SEQ ID NO: 233822 - DNA, 20 bp, human
gcccgctcttcgggtattta

SEQ ID NO: 233823 - DNA, 20 bp, human
ggccgtaaatacccgaagag

SEQ ID NO: 233824 - DNA, 20 bp, human
gtcagctaagaaagggccgg

SEQ ID NO: 233825 - DNA, 20 bp, human
gtcttgagcctgagctgggg

SEQ ID NO: 233826 - DNA, 20 bp, human
gaagaggagacgcagtttgg

SEQ ID NO: 233827 - DNA, 20 bp, human
gcggaagaggagacgcagtt

SEQ ID NO: 233828 - DNA, 20 bp, human
ggtgagctgcgcgccgagag

SEQ ID NO: 233829 - DNA, 20 bp, human
ggctgtggggatttgccgga

SEQ ID NO: 233830 - DNA, 20 bp, human
ggccgttgaagccacgtccc

SEQ ID NO: 233831 - DNA, 20 bp, human
ggcctgggacgtggcttcaa

SEQ ID NO: 233832 - DNA, 20 bp, human
gcaacggccccatccggcgc

SEQ ID NO: 233833 - DNA, 20 bp, human
gggcgtcctggaattacact

SEQ ID NO: 233834 - DNA, 20 bp, human
ggcgtcgggcgcctgggacg

SEQ ID NO: 233835 - DNA, 20 bp, human
gctcgcagcgtcagcgacgc

SEQ ID NO: 233836 - DNA, 20 bp, human
gaaaggagggggcacttgaa

SEQ ID NO: 233837 - DNA, 20 bp, human
gctgtgagtcaggactgaaa

SEQ ID NO: 233838 - DNA, 20 bp, human
gggaagtcatgttctggtgg

SEQ ID NO: 233839 - DNA, 20 bp, human
ggtgaagtcaaagattgaag

SEQ ID NO: 233840 - DNA, 20 bp, human
gccaatgctgacagaatcta

SEQ ID NO: 233841 - DNA, 20 bp, human
gacccctataaaagacttta

SEQ ID NO: 233842 - DNA, 20 bp, human
ggttccgggagcatggttct

SEQ ID NO: 233843 - DNA, 20 bp, human
gtggggatctgacatgacaa

SEQ ID NO: 233844 - DNA, 20 bp, human
gaagccaaagacgaagaatc

SEQ ID NO: 233845 - DNA, 20 bp, human
gcccagtgatgcgtgcttgc

SEQ ID NO: 233846 - DNA, 20 bp, human
gtccccacaaagtctggggg

SEQ ID NO: 233847 - DNA, 20 bp, human
gcggagcagattgggtacca

SEQ ID NO: 233848 - DNA, 20 bp, human
gcaggggtcaagggtcggta

SEQ ID NO: 233849 - DNA, 20 bp, human
ggggtcaagggtcggtaggg

SEQ ID NO: 233850 - DNA, 20 bp, human
gtctgggggcggagcagatt

SEQ ID NO: 233851 - DNA, 20 bp, human
gtgactgctccaaacccgtt

SEQ ID NO: 233852 - DNA, 20 bp, human
ggcacagggccgaacgggtt

SEQ ID NO: 233853 - DNA, 20 bp, human
gaatggggtctcaggggtca

SEQ ID NO: 233854 - DNA, 20 bp, human
gcggaagcgcagtgcacttc

SEQ ID NO: 233855 - DNA, 20 bp, human
gtgccacaggccctattctc

SEQ ID NO: 233856 - DNA, 20 bp, human
gacgtaagtcaacggttggg

SEQ ID NO: 233857 - DNA, 20 bp, human
ggtggatgttggctacacca

SEQ ID NO: 233858 - DNA, 20 bp, human
gcacccaatgggtggagtcg

SEQ ID NO: 233859 - DNA, 20 bp, human
gctgccacgtctagagtaag

SEQ ID NO: 233860 - DNA, 20 bp, human
gaagaggggcggggactgat

SEQ ID NO: 233861 - DNA, 20 bp, human
gcagccccgactccacccat

SEQ ID NO: 233862 - DNA, 20 bp, human
gtgctctcagaagaggggcg

SEQ ID NO: 233863 - DNA, 20 bp, human
gtgaacgtaagtcaacggtt

SEQ ID NO: 233864 - DNA, 20 bp, human
gtctgagagcacccaatggg

SEQ ID NO: 233865 - DNA, 20 bp, human
gaaaggcagccggcgaaaag

SEQ ID NO: 233866 - DNA, 20 bp, human
gtcccgccctagggcacttc

SEQ ID NO: 233867 - DNA, 20 bp, human
ggggtaatcttgagcatctg

SEQ ID NO: 233868 - DNA, 20 bp, human
gagtgccctagggcgggaaa

SEQ ID NO: 233869 - DNA, 20 bp, human
ggaagtgtgtggatgggaac

SEQ ID NO: 233870 - DNA, 20 bp, human
gaggctaatgaccttcaagc

SEQ ID NO: 233871 - DNA, 20 bp, human
gtcaagccggaagtgcccta

SEQ ID NO: 233872 - DNA, 20 bp, human
ggtcattagcctaagatacg

SEQ ID NO: 233873 - DNA, 20 bp, human
gaaaaaacgaatatatcggg

SEQ ID NO: 233874 - DNA, 20 bp, human
gccaatacatgttgtactta

SEQ ID NO: 233875 - DNA, 20 bp, human
gagccggaagtgccctaggg

SEQ ID NO: 233876 - DNA, 20 bp, human
ggaaggcgcgaggcggttgg

SEQ ID NO: 233877 - DNA, 20 bp, human
ggagtctctgtcgtccagat

SEQ ID NO: 233878 - DNA, 20 bp, human
gtctcactttccattcaggc

SEQ ID NO: 233879 - DNA, 20 bp, human
gggggtctcactttccattc

SEQ ID NO: 233880 - DNA, 20 bp, human
gataataataaaaggcatcc

SEQ ID NO: 233881 - DNA, 20 bp, human
gtcaggctggaaaggatgcc

SEQ ID NO: 233882 - DNA, 20 bp, human
gggcgcgaggcggttggcgg

SEQ ID NO: 233883 - DNA, 20 bp, human
gctcggcctcccaaacttcg

SEQ ID NO: 233884 - DNA, 20 bp, human
ggcctgtaatccccgaagtt

SEQ ID NO: 233885 - DNA, 20 bp, human
gcgaggcggttggcgggggc

SEQ ID NO: 233886 - DNA, 20 bp, human
ggtcgggagcaccgcgagga

SEQ ID NO: 233887 - DNA, 20 bp, human
gtcgccccgcgcagagctcc

SEQ ID NO: 233888 - DNA, 20 bp, human
gccgaccgcgcagaggtctc

SEQ ID NO: 233889 - DNA, 20 bp, human
gcgcgaggaggggcgagatg

SEQ ID NO: 233890 - DNA, 20 bp, human
gggtgctcccgaccgcgcag

SEQ ID NO: 233891 - DNA, 20 bp, human
gcagttgagcaatcttaagt

SEQ ID NO: 233892 - DNA, 20 bp, human
ggaatgcgcaccaatgggaa

SEQ ID NO: 233893 - DNA, 20 bp, human
ggacgggtagtgtgacgttt

SEQ ID NO: 233894 - DNA, 20 bp, human
gcattggtgcgcattccaaa

SEQ ID NO: 233895 - DNA, 20 bp, human
gtgcgcggggcgacgcagct

SEQ ID NO: 233896 - DNA, 20 bp, human
gggggggggggggtccccgt

SEQ ID NO: 233897 - DNA, 20 bp, human
gtctgtcaggggacttgaac

SEQ ID NO: 233898 - DNA, 20 bp, human
gaggccgaagcgcatcttcg

SEQ ID NO: 233899 - DNA, 20 bp, human
ggggaggaggaagcgattct

SEQ ID NO: 233900 - DNA, 20 bp, human
gggtccccgtggggaaccgg

SEQ ID NO: 233901 - DNA, 20 bp, human
gcccgccattgcaacggccg

SEQ ID NO: 233902 - DNA, 20 bp, human
gggaaccggtggagaaaagc

SEQ ID NO: 233903 - DNA, 20 bp, human
gcccacgcccgccattgcaa

SEQ ID NO: 233904 - DNA, 20 bp, human
gggacttgaacgggcttagt

SEQ ID NO: 233905 - DNA, 20 bp, human
gtgtccgcgaagatgcgctt

SEQ ID NO: 233906 - DNA, 20 bp, human
ggggccgcattccccagatg

SEQ ID NO: 233907 - DNA, 20 bp, human
gcgtgcgcgtggcgccccac

SEQ ID NO: 233908 - DNA, 20 bp, human
gagaccacaaggcccgccgg

SEQ ID NO: 233909 - DNA, 20 bp, human
gaccctgtgcagatggaacc

SEQ ID NO: 233910 - DNA, 20 bp, human
gtgcacagggtatgtgcagg

SEQ ID NO: 233911 - DNA, 20 bp, human
gggcctcggccgccggtcac

SEQ ID NO: 233912 - DNA, 20 bp, human
gtcagtccggaccccgtgac

SEQ ID NO: 233913 - DNA, 20 bp, human
gcacctctggcctgagaaga

SEQ ID NO: 233914 - DNA, 20 bp, human
gggcggtgcgcgtgcccggt

SEQ ID NO: 233915 - DNA, 20 bp, human
gggcggggcgcgtccgcgga

SEQ ID NO: 233916 - DNA, 20 bp, human
gggggagtcagaagtgaaat

SEQ ID NO: 233917 - DNA, 20 bp, human
ggctgtggggactacagccg

SEQ ID NO: 233918 - DNA, 20 bp, human
gggtgctgatggctcacgag

SEQ ID NO: 233919 - DNA, 20 bp, human
gcacagcacctgagcgggga

SEQ ID NO: 233920 - DNA, 20 bp, human
ggcctggcacctgctcataa

SEQ ID NO: 233921 - DNA, 20 bp, human
ggtgactttgatgtgtggag

SEQ ID NO: 233922 - DNA, 20 bp, human
gccgaccaggctcacgtccg

SEQ ID NO: 233923 - DNA, 20 bp, human
gagggtgggacccaccggtg

SEQ ID NO: 233924 - DNA, 20 bp, human
gtgggaaacgacctcaccgg

SEQ ID NO: 233925 - DNA, 20 bp, human
gacggggcggtaagacatcc

SEQ ID NO: 233926 - DNA, 20 bp, human
gggaaggaggccgccccgaa

SEQ ID NO: 233927 - DNA, 20 bp, human
gactctggaagactgacagg

SEQ ID NO: 233928 - DNA, 20 bp, human
gggcgcggccacacccctgt

SEQ ID NO: 233929 - DNA, 20 bp, human
ggggctgtccactcccttcg

SEQ ID NO: 233930 - DNA, 20 bp, human
gtgggccactgccgcttcgc

SEQ ID NO: 233931 - DNA, 20 bp, human
gctgtccactcccttcgggg

SEQ ID NO: 233932 - DNA, 20 bp, human
ggggaaggtgggcctcattc

SEQ ID NO: 233933 - DNA, 20 bp, human
gggaagcaatgggcccagct

SEQ ID NO: 233934 - DNA, 20 bp, human
gtcaggaaaggtgctgacgt

SEQ ID NO: 233935 - DNA, 20 bp, human
gaatgggcccagctaggccc

SEQ ID NO: 233936 - DNA, 20 bp, human
ggctgcagatggtagactaa

SEQ ID NO: 233937 - DNA, 20 bp, human
gagaagttaccccgatgact

SEQ ID NO: 233938 - DNA, 20 bp, human
gtgaacgtgctaaaatggga

SEQ ID NO: 233939 - DNA, 20 bp, human
ggttcagagtggactcagtg

SEQ ID NO: 233940 - DNA, 20 bp, human
gctgttcttacactgtactt

SEQ ID NO: 233941 - DNA, 20 bp, human
gttaccccgatgacttggtt

SEQ ID NO: 233942 - DNA, 20 bp, human
gagtgagaaggctgttcttt

SEQ ID NO: 233943 - DNA, 20 bp, human
gcccttccaaaccaagtcat

SEQ ID NO: 233944 - DNA, 20 bp, human
gactctgaacgtgctaaaat

SEQ ID NO: 233945 - DNA, 20 bp, human
gacagatactcatttgggtc

SEQ ID NO: 233946 - DNA, 20 bp, human
gaaaagctttcgagtcaggt

SEQ ID NO: 233947 - DNA, 20 bp, human
gaattgctgtgcagctaccc

SEQ ID NO: 233948 - DNA, 20 bp, human
gcccagaaacctagtgccta

SEQ ID NO: 233949 - DNA, 20 bp, human
gctgaaggcaattccctaaa

SEQ ID NO: 233950 - DNA, 20 bp, human
gggtttctggggataataaa

SEQ ID NO: 233951 - DNA, 20 bp, human
gttcatcagagcaatcaccc

SEQ ID NO: 233952 - DNA, 20 bp, human
gagagaaaagctttcgagtc

SEQ ID NO: 233953 - DNA, 20 bp, human
gaacaacaagaaaagtatcg

SEQ ID NO: 233954 - DNA, 20 bp, human
gcagactttgtaaaaatatc

SEQ ID NO: 233955 - DNA, 20 bp, human
ggtgctagctacttacatag

SEQ ID NO: 233956 - DNA, 20 bp, human
gggcgggagggatcatcttc

SEQ ID NO: 233957 - DNA, 20 bp, human
ggactgccgcgcgatagtca

SEQ ID NO: 233958 - DNA, 20 bp, human
gccgcccctagccacgctcc

SEQ ID NO: 233959 - DNA, 20 bp, human
gggaagtcccgcctctgggt

SEQ ID NO: 233960 - DNA, 20 bp, human
gccccccttccggggaccaa

SEQ ID NO: 233961 - DNA, 20 bp, human
gcgatagtcagggagctgtg

SEQ ID NO: 233962 - DNA, 20 bp, human
gtcttccgggagcgtggcta

SEQ ID NO: 233963 - DNA, 20 bp, human
ggactggcacccttcctcag

SEQ ID NO: 233964 - DNA, 20 bp, human
gggggcctggcgggttttga

SEQ ID NO: 233965 - DNA, 20 bp, human
gcagctccctgactatcgcg

SEQ ID NO: 233966 - DNA, 20 bp, human
ggccgggtatccgcccctgc

SEQ ID NO: 233967 - DNA, 20 bp, human
gaggctgtggaggggatgtc

SEQ ID NO: 233968 - DNA, 20 bp, human
ggtgtcagactggaaggagt

SEQ ID NO: 233969 - DNA, 20 bp, human
gtagtcgcaagcctggaagt

SEQ ID NO: 233970 - DNA, 20 bp, human
gaccgctgctaccaaggcgg

SEQ ID NO: 233971 - DNA, 20 bp, human
gcccgtggagggtggtcggg

SEQ ID NO: 233972 - DNA, 20 bp, human
ggctaccgctgctaccaagg

SEQ ID NO: 233973 - DNA, 20 bp, human
gggggcggatacccggccct

SEQ ID NO: 233974 - DNA, 20 bp, human
gagtcgggggccaagaaaag

SEQ ID NO: 233975 - DNA, 20 bp, human
gagtgcgagctgtccgccca

SEQ ID NO: 233976 - DNA, 20 bp, human
gcggctgcgcagactcctcc

SEQ ID NO: 233977 - DNA, 20 bp, human
ggccactgcaagcccttctg

SEQ ID NO: 233978 - DNA, 20 bp, human
gtccccgcacatctgcagga

SEQ ID NO: 233979 - DNA, 20 bp, human
ggctgggcgggttaaggagg

SEQ ID NO: 233980 - DNA, 20 bp, human
gtgggcgggactagaggccc

SEQ ID NO: 233981 - DNA, 20 bp, human
gagagctgggcgggttaagg

SEQ ID NO: 233982 - DNA, 20 bp, human
ggcgccgtcctgcagatgtg

SEQ ID NO: 233983 - DNA, 20 bp, human
gcacacgcaactctgagcat

SEQ ID NO: 233984 - DNA, 20 bp, human
gctctgggatgttgttgcct

SEQ ID NO: 233985 - DNA, 20 bp, human
gcccagagctgggcgggtta

SEQ ID NO: 233986 - DNA, 20 bp, human
gtggccgcccggtctttggg

SEQ ID NO: 233987 - DNA, 20 bp, human
ggacaaggccggtgtgcaga

SEQ ID NO: 233988 - DNA, 20 bp, human
gggccctcgaggtgcgctcc

SEQ ID NO: 233989 - DNA, 20 bp, human
gggcccgggcagcggtcgag

SEQ ID NO: 233990 - DNA, 20 bp, human
gcccggctgtcctgcccggg

SEQ ID NO: 233991 - DNA, 20 bp, human
gtttctgcgcccgggcgggt

SEQ ID NO: 233992 - DNA, 20 bp, human
ggagcctcccaaagaccggg

SEQ ID NO: 233993 - DNA, 20 bp, human
gatcggggatcaggaaagat

SEQ ID NO: 233994 - DNA, 20 bp, human
gcgcgcgcgccaccgtgtgg

SEQ ID NO: 233995 - DNA, 20 bp, human
ggcgcgagcctcccaaagac

SEQ ID NO: 233996 - DNA, 20 bp, human
ggatcagtaacacccggagt

SEQ ID NO: 233997 - DNA, 20 bp, human
gagtaacacccggagtgggt

SEQ ID NO: 233998 - DNA, 20 bp, human
gggagtgggtggggaacgag

SEQ ID NO: 233999 - DNA, 20 bp, human
gcggtgaaacgtccccggaa

SEQ ID NO: 234000 - DNA, 20 bp, human
ggtggagggcgatgacgcgc

SEQ ID NO: 234001 - DNA, 20 bp, human
ggggttgagaccgatgtgga

SEQ ID NO: 234002 - DNA, 20 bp, human
ggcggggccgcatgtcgtta

SEQ ID NO: 234003 - DNA, 20 bp, human
gcaatccggtgaaacgtccc

SEQ ID NO: 234004 - DNA, 20 bp, human
ggcgtcatcgccctccacat

SEQ ID NO: 234005 - DNA, 20 bp, human
gaacgtccccggaaaggggc

SEQ ID NO: 234006 - DNA, 20 bp, human
gccggaacgcgcctctgaga

SEQ ID NO: 234007 - DNA, 20 bp, human
gcctctgagagggcactgga

SEQ ID NO: 234008 - DNA, 20 bp, human
gcccaccccgggcggagagt

SEQ ID NO: 234009 - DNA, 20 bp, human
gggaagctgcggcggtggta

SEQ ID NO: 234010 - DNA, 20 bp, human
gtgagagggcactggacggg

SEQ ID NO: 234011 - DNA, 20 bp, human
gcccccgccgtccccctgcg

SEQ ID NO: 234012 - DNA, 20 bp, human
ggctccccagtcgccctcgg

SEQ ID NO: 234013 - DNA, 20 bp, human
gcccaatcgcccggccggga

SEQ ID NO: 234014 - DNA, 20 bp, human
ggagagtgggcgggtctccg

SEQ ID NO: 234015 - DNA, 20 bp, human
gccggagcggcccaatcgcc

SEQ ID NO: 234016 - DNA, 20 bp, human
gtccgtgacgcacaggaggg

SEQ ID NO: 234017 - DNA, 20 bp, human
ggagaggcgggaccggggtt

SEQ ID NO: 234018 - DNA, 20 bp, human
gcggcgactcctgacgtcat

SEQ ID NO: 234019 - DNA, 20 bp, human
gagagcgagcaagtagaaaa

SEQ ID NO: 234020 - DNA, 20 bp, human
ggcgtccgtgacgcacagga

SEQ ID NO: 234021 - DNA, 20 bp, human
gatgagccagtctttttcct

SEQ ID NO: 234022 - DNA, 20 bp, human
ggaaggcgccggtttcggcg

SEQ ID NO: 234023 - DNA, 20 bp, human
gcgaatcccaggaaaaagac

SEQ ID NO: 234024 - DNA, 20 bp, human
gagagaacagagtcgaaaaa

SEQ ID NO: 234025 - DNA, 20 bp, human
gtccgaggagcccataggca

SEQ ID NO: 234026 - DNA, 20 bp, human
ggtggtgactgggtccagaa

SEQ ID NO: 234027 - DNA, 20 bp, human
gccaaccagcgcggcgtcgc

SEQ ID NO: 234028 - DNA, 20 bp, human
ggagttaagggtggctttag

SEQ ID NO: 234029 - DNA, 20 bp, human
gccggaggagttctgcgtct

SEQ ID NO: 234030 - DNA, 20 bp, human
ggcgtctcggggtggtgact

SEQ ID NO: 234031 - DNA, 20 bp, human
gctggttggtgctcctgcgc

SEQ ID NO: 234032 - DNA, 20 bp, human
gtgcgtgcgcacgcactagg

SEQ ID NO: 234033 - DNA, 20 bp, human
ggcaggagcaccaaccagcg

SEQ ID NO: 234034 - DNA, 20 bp, human
ggggccctgcgtgagtgttg

SEQ ID NO: 234035 - DNA, 20 bp, human
gactgggtccagaatggctt

SEQ ID NO: 234036 - DNA, 20 bp, human
gtccctttgacggcggcccc

SEQ ID NO: 234037 - DNA, 20 bp, human
gcagaggcagctgcacggga

SEQ ID NO: 234038 - DNA, 20 bp, human
ggcagctgcctctggattgt

SEQ ID NO: 234039 - DNA, 20 bp, human
gcccaccaggcaaccgtcct

SEQ ID NO: 234040 - DNA, 20 bp, human
gcctgggcgcaaccgaggag

SEQ ID NO: 234041 - DNA, 20 bp, human
gcggcggcgaggctagcccg

SEQ ID NO: 234042 - DNA, 20 bp, human
gtgacggcggcccccggcat

SEQ ID NO: 234043 - DNA, 20 bp, human
ggccgccgcccagatcctgg

SEQ ID NO: 234044 - DNA, 20 bp, human
gcgccgcccgccaatgccgg

SEQ ID NO: 234045 - DNA, 20 bp, human
ggccgcccagatcctggcgg

SEQ ID NO: 234046 - DNA, 20 bp, human
ggggctagcccagaggttgg

SEQ ID NO: 234047 - DNA, 20 bp, human
gctagcccagaggttggcgg

SEQ ID NO: 234048 - DNA, 20 bp, human
gatgctaggaggatgcaggg

SEQ ID NO: 234049 - DNA, 20 bp, human
gcccagcctgggaccttcga

SEQ ID NO: 234050 - DNA, 20 bp, human
ggcagggctagcccagaggt

SEQ ID NO: 234051 - DNA, 20 bp, human
gctagccctgcagagatgct

SEQ ID NO: 234052 - DNA, 20 bp, human
ggccctgcagagatgctagg

SEQ ID NO: 234053 - DNA, 20 bp, human
gtgaggccctcgaaggtccc

SEQ ID NO: 234054 - DNA, 20 bp, human
gccttccgccgccaacctct

SEQ ID NO: 234055 - DNA, 20 bp, human
gcacagctcccctggctcca

SEQ ID NO: 234056 - DNA, 20 bp, human
ggctcggggaggaacaatac

SEQ ID NO: 234057 - DNA, 20 bp, human
gcgcgcgagcccacgttccg

SEQ ID NO: 234058 - DNA, 20 bp, human
gcggggaggaacaatacggg

SEQ ID NO: 234059 - DNA, 20 bp, human
ggcggcgcgccggtcgccca

SEQ ID NO: 234060 - DNA, 20 bp, human
ggctacgcggggcgctggga

SEQ ID NO: 234061 - DNA, 20 bp, human
gtgctggggccccacacgcg

SEQ ID NO: 234062 - DNA, 20 bp, human
ggtcccgcgcccgggctccc

SEQ ID NO: 234063 - DNA, 20 bp, human
gcgccgaagccgcggaacgt

SEQ ID NO: 234064 - DNA, 20 bp, human
ggtagcctggtcccgcgccc

SEQ ID NO: 234065 - DNA, 20 bp, human
ggggactggtggcccgaggc

SEQ ID NO: 234066 - DNA, 20 bp, human
gagtccagagccaatctggt

SEQ ID NO: 234067 - DNA, 20 bp, human
gaacccgaccagattggctc

SEQ ID NO: 234068 - DNA, 20 bp, human
ggctggctggagattgagtg

SEQ ID NO: 234069 - DNA, 20 bp, human
gaaaagtaacccgaccagat

SEQ ID NO: 234070 - DNA, 20 bp, human
gaagtaacaacaggggaatc

SEQ ID NO: 234071 - DNA, 20 bp, human
ggctggagattgagtggggt

SEQ ID NO: 234072 - DNA, 20 bp, human
gagccctgtaattggtggac

SEQ ID NO: 234073 - DNA, 20 bp, human
ggacaactgagagctgtgat

SEQ ID NO: 234074 - DNA, 20 bp, human
gtcaatctccagccagcatc

SEQ ID NO: 234075 - DNA, 20 bp, human
gctggaaaaaccaactgctg

SEQ ID NO: 234076 - DNA, 20 bp, human
gagcttgcggaacacccggg

SEQ ID NO: 234077 - DNA, 20 bp, human
gctcccggaaacggtcccac

SEQ ID NO: 234078 - DNA, 20 bp, human
ggaacacccggggggccagt

SEQ ID NO: 234079 - DNA, 20 bp, human
gcccgctcccgcatccatcg

SEQ ID NO: 234080 - DNA, 20 bp, human
gcgcgcctccgcgatggatg

SEQ ID NO: 234081 - DNA, 20 bp, human
gcggggccgactggcccccc

SEQ ID NO: 234082 - DNA, 20 bp, human
gtgcctgcaccacgtgagga

SEQ ID NO: 234083 - DNA, 20 bp, human
gagggtcacttccggtcctg

SEQ ID NO: 234084 - DNA, 20 bp, human
gaggaagttggatgagcttg

SEQ ID NO: 234085 - DNA, 20 bp, human
ggctcccgcatccatcgcgg

SEQ ID NO: 234086 - DNA, 20 bp, human
gacgcctcacgaaaagtgag

SEQ ID NO: 234087 - DNA, 20 bp, human
gtgaagagacccagtttcgt

SEQ ID NO: 234088 - DNA, 20 bp, human
gtcaccctctggtgcacggg

SEQ ID NO: 234089 - DNA, 20 bp, human
gaccgtggtcccacgaaact

SEQ ID NO: 234090 - DNA, 20 bp, human
gagggccaacgaaaccttct

SEQ ID NO: 234091 - DNA, 20 bp, human
ggggtgattgcgtagtgcga

SEQ ID NO: 234092 - DNA, 20 bp, human
gggtcctcccgtgcaccaga

SEQ ID NO: 234093 - DNA, 20 bp, human
gtggggcatagtccaacagc

SEQ ID NO: 234094 - DNA, 20 bp, human
gaagccgctcacttttcgtg

SEQ ID NO: 234095 - DNA, 20 bp, human
ggggcggtgaaggcgttcaa

SEQ ID NO: 234096 - DNA, 20 bp, human
gtggcagggctctgaacatg

SEQ ID NO: 234097 - DNA, 20 bp, human
gccagcttgagcgtggtctt

SEQ ID NO: 234098 - DNA, 20 bp, human
ggaccacgctcaagctgggg

SEQ ID NO: 234099 - DNA, 20 bp, human
ggagcgttgccctgtgaaaa

SEQ ID NO: 234100 - DNA, 20 bp, human
gtgaacatggggccccgacc

SEQ ID NO: 234101 - DNA, 20 bp, human
ggggcagaggtgttcgaagc

SEQ ID NO: 234102 - DNA, 20 bp, human
gggcggaaatcaacttccgg

SEQ ID NO: 234103 - DNA, 20 bp, human
gacgcgcgtcacgtggcccc

SEQ ID NO: 234104 - DNA, 20 bp, human
gggtgcttgagagttcagac

SEQ ID NO: 234105 - DNA, 20 bp, human
ggacgggcgctgtgttgggc

SEQ ID NO: 234106 - DNA, 20 bp, human
gggacgcaggcgcacagctc

SEQ ID NO: 234107 - DNA, 20 bp, human
gcaggcgcacagctcaggtg

SEQ ID NO: 234108 - DNA, 20 bp, human
ggtaacgcggcccgagggag

SEQ ID NO: 234109 - DNA, 20 bp, human
ggggcgaaggccgaggggaa

SEQ ID NO: 234110 - DNA, 20 bp, human
gcctcgggccgcgttaccca

SEQ ID NO: 234111 - DNA, 20 bp, human
gccgaggggaagggagggtc

SEQ ID NO: 234112 - DNA, 20 bp, human
gctcaggtgcggccgcactg

SEQ ID NO: 234113 - DNA, 20 bp, human
gaggcctggccgcgctgacc

SEQ ID NO: 234114 - DNA, 20 bp, human
gacccagggcaaccgcagtg

SEQ ID NO: 234115 - DNA, 20 bp, human
gcacgcgcgctgtcccccgg

SEQ ID NO: 234116 - DNA, 20 bp, human
ggatggcagcgagaagagaa

SEQ ID NO: 234117 - DNA, 20 bp, human
gccgggcagagcatgcgcgc

SEQ ID NO: 234118 - DNA, 20 bp, human
gcgcatgctctgcccggctg

SEQ ID NO: 234119 - DNA, 20 bp, human
gcggctgcggcgcttcgggc

SEQ ID NO: 234120 - DNA, 20 bp, human
gaccggggtggagtacaaag

SEQ ID NO: 234121 - DNA, 20 bp, human
gcgaggggacaggacctatt

SEQ ID NO: 234122 - DNA, 20 bp, human
gccctcggtgaatcagactt

SEQ ID NO: 234123 - DNA, 20 bp, human
gggagaaaacttcagagtac

SEQ ID NO: 234124 - DNA, 20 bp, human
gccgtggcgctctttgagag

SEQ ID NO: 234125 - DNA, 20 bp, human
gcgcggagctgctaccgggg

SEQ ID NO: 234126 - DNA, 20 bp, human
gacttccagcttgataggcg

SEQ ID NO: 234127 - DNA, 20 bp, human
gggattggaaccaatgaaag

SEQ ID NO: 234128 - DNA, 20 bp, human
gctgggacttccagcttgat

SEQ ID NO: 234129 - DNA, 20 bp, human
gactcaggttgcaactccgg

SEQ ID NO: 234130 - DNA, 20 bp, human
gagtcccagcgtcttccctc

SEQ ID NO: 234131 - DNA, 20 bp, human
ggcgctgcgccccctagaag

SEQ ID NO: 234132 - DNA, 20 bp, human
ggagccgctgcccgcttcta

SEQ ID NO: 234133 - DNA, 20 bp, human
gtagcgcgaaataaggattc

SEQ ID NO: 234134 - DNA, 20 bp, human
ggccccctagaagcgggcag

SEQ ID NO: 234135 - DNA, 20 bp, human
ggggcccgcaactctcacat

SEQ ID NO: 234136 - DNA, 20 bp, human
ggggagaaggcgctggacga

SEQ ID NO: 234137 - DNA, 20 bp, human
gaggcccggcggtgggaaat

SEQ ID NO: 234138 - DNA, 20 bp, human
ggaggccgcgagctgacgat

SEQ ID NO: 234139 - DNA, 20 bp, human
ggacgataggcgagattgat

SEQ ID NO: 234140 - DNA, 20 bp, human
ggcgagagcaagccaatggg

SEQ ID NO: 234141 - DNA, 20 bp, human
gcaggcagaaagcccggcgg

SEQ ID NO: 234142 - DNA, 20 bp, human
gaggcgagattgattggaag

SEQ ID NO: 234143 - DNA, 20 bp, human
gccggcgagagcaagccaat

SEQ ID NO: 234144 - DNA, 20 bp, human
ggggccgggcgtccgcaagg

SEQ ID NO: 234145 - DNA, 20 bp, human
ggggcaggcagaaagcccgg

SEQ ID NO: 234146 - DNA, 20 bp, human
gccgccctccgcagccagga

SEQ ID NO: 234147 - DNA, 20 bp, human
ggcgcatgcgtgcctctctc

SEQ ID NO: 234148 - DNA, 20 bp, human
gcaccgaagttccgggccta

SEQ ID NO: 234149 - DNA, 20 bp, human
gtcccagcgtgcttaatttt

SEQ ID NO: 234150 - DNA, 20 bp, human
ggcaatgcaacgtctgcctt

SEQ ID NO: 234151 - DNA, 20 bp, human
gcgcccaggcaccgaagttc

SEQ ID NO: 234152 - DNA, 20 bp, human
gccggacccggaacattctc

SEQ ID NO: 234153 - DNA, 20 bp, human
gcgggtgcaccgctgcgccc

SEQ ID NO: 234154 - DNA, 20 bp, human
gtggagccgtcatacgctga

SEQ ID NO: 234155 - DNA, 20 bp, human
ggactgacaggagaggttta

SEQ ID NO: 234156 - DNA, 20 bp, human
gtccaggtgaacattcgcag

SEQ ID NO: 234157 - DNA, 20 bp, human
ggggaggtgaagaggggtcc

SEQ ID NO: 234158 - DNA, 20 bp, human
ggtggtggggacccgggagt

SEQ ID NO: 234159 - DNA, 20 bp, human
gggcttgtgacgcagcgttt

SEQ ID NO: 234160 - DNA, 20 bp, human
gccccaccgggttcagatga

SEQ ID NO: 234161 - DNA, 20 bp, human
gcggcgacagtgaagcacct

SEQ ID NO: 234162 - DNA, 20 bp, human
gtcactgtcgccgtcctggc

SEQ ID NO: 234163 - DNA, 20 bp, human
ggcctcagcagagccgggtg

SEQ ID NO: 234164 - DNA, 20 bp, human
gcgtcctggcaggactgtgg

SEQ ID NO: 234165 - DNA, 20 bp, human
ggatcccttaggccctccaa

SEQ ID NO: 234166 - DNA, 20 bp, human
gtggaaggcgggagatcttg

SEQ ID NO: 234167 - DNA, 20 bp, human
gcagtgaggaggagccgcct

SEQ ID NO: 234168 - DNA, 20 bp, human
gttgggcccactaaatgcgt

SEQ ID NO: 234169 - DNA, 20 bp, human
gaaggtgtacgcaggcgcag

SEQ ID NO: 234170 - DNA, 20 bp, human
gcggaagagaacacatgagc

SEQ ID NO: 234171 - DNA, 20 bp, human
ggagggggaaaggtgtacgc

SEQ ID NO: 234172 - DNA, 20 bp, human
gcttgcgcaggcgcggtcag

SEQ ID NO: 234173 - DNA, 20 bp, human
gcgcagtggcgtctaaattt

SEQ ID NO: 234174 - DNA, 20 bp, human
gtcggagcatctccgcgccc

SEQ ID NO: 234175 - DNA, 20 bp, human
gttcccgggttgccgcagtg

SEQ ID NO: 234176 - DNA, 20 bp, human
gaagttgccgcccatccctg

SEQ ID NO: 234177 - DNA, 20 bp, human
gaggcctgtctcagaggcac

SEQ ID NO: 234178 - DNA, 20 bp, human
ggcctctgagacaggcctca

SEQ ID NO: 234179 - DNA, 20 bp, human
ggagctcaggaggaacctca

SEQ ID NO: 234180 - DNA, 20 bp, human
gcaaggccacataccctagc

SEQ ID NO: 234181 - DNA, 20 bp, human
ggtgtaggagagataagggg

SEQ ID NO: 234182 - DNA, 20 bp, human
gggcccagtgcctctgagac

SEQ ID NO: 234183 - DNA, 20 bp, human
gtagtcaggagcttccagaa

SEQ ID NO: 234184 - DNA, 20 bp, human
gactacggtttgaaagtccc

SEQ ID NO: 234185 - DNA, 20 bp, human
gagggctttaggtcctgcta

SEQ ID NO: 234186 - DNA, 20 bp, human
ggacacccggcaccgcgcgt

SEQ ID NO: 234187 - DNA, 20 bp, human
gagggggaggtggtctagtg

SEQ ID NO: 234188 - DNA, 20 bp, human
ggggcgacaaccggttgaag

SEQ ID NO: 234189 - DNA, 20 bp, human
ggaagcttctcggacccaga

SEQ ID NO: 234190 - DNA, 20 bp, human
gcggccactggggcgacaac

SEQ ID NO: 234191 - DNA, 20 bp, human
gtcccaggagccacttcaac

SEQ ID NO: 234192 - DNA, 20 bp, human
ggctcagagggcggccactg

SEQ ID NO: 234193 - DNA, 20 bp, human
gaggggagcggcacctggaa

SEQ ID NO: 234194 - DNA, 20 bp, human
gcaaccggttgtcgccccag

SEQ ID NO: 234195 - DNA, 20 bp, human
gcccggcaccgcgcgtggga

SEQ ID NO: 234196 - DNA, 20 bp, human
gaaagtggagcagcaaccgg

SEQ ID NO: 234197 - DNA, 20 bp, human
ggcctctcaggattagaaag

SEQ ID NO: 234198 - DNA, 20 bp, human
ggaactacacaaaccttagc

SEQ ID NO: 234199 - DNA, 20 bp, human
gggcggcccagagacgcctc

SEQ ID NO: 234200 - DNA, 20 bp, human
ggattgtggcaagacatgtc

SEQ ID NO: 234201 - DNA, 20 bp, human
gaggctcgtggcgaaaccac

SEQ ID NO: 234202 - DNA, 20 bp, human
gcagcaaccggaggcgtctc

SEQ ID NO: 234203 - DNA, 20 bp, human
gggaaggaattcggattctt

SEQ ID NO: 234204 - DNA, 20 bp, human
gctgcgtttctgcaacctat

SEQ ID NO: 234205 - DNA, 20 bp, human
gtagaaagtggagcagcaac

SEQ ID NO: 234206 - DNA, 20 bp, human
ggtgacgggttcctatatag

SEQ ID NO: 234207 - DNA, 20 bp, human
gctaagactggcccaggaaa

SEQ ID NO: 234208 - DNA, 20 bp, human
gcaacctgccgtggaggagc

SEQ ID NO: 234209 - DNA, 20 bp, human
gtggcccaggaaagggccgg

SEQ ID NO: 234210 - DNA, 20 bp, human
gccccagtactcctctatat

SEQ ID NO: 234211 - DNA, 20 bp, human
ggccctgagtacagacagcc

SEQ ID NO: 234212 - DNA, 20 bp, human
gcaaaccggctgtgtgagac

SEQ ID NO: 234213 - DNA, 20 bp, human
gcatatgtctgggatggtga

SEQ ID NO: 234214 - DNA, 20 bp, human
gacaaatgctggagtgagtg

SEQ ID NO: 234215 - DNA, 20 bp, human
gagccaggctgtctgtactc

SEQ ID NO: 234216 - DNA, 20 bp, human
gaggagacgggacacatcta

SEQ ID NO: 234217 - DNA, 20 bp, human
gaggacagtcgcacagggag

SEQ ID NO: 234218 - DNA, 20 bp, human
ggggcagaactcccgagcca

SEQ ID NO: 234219 - DNA, 20 bp, human
gcagtcacctggcgggacag

SEQ ID NO: 234220 - DNA, 20 bp, human
gggcgggtgataaagagagg

SEQ ID NO: 234221 - DNA, 20 bp, human
ggcctggaggacagtcgcac

SEQ ID NO: 234222 - DNA, 20 bp, human
gcggccactgcaacacagta

SEQ ID NO: 234223 - DNA, 20 bp, human
ggggtgcacagtcacctggc

SEQ ID NO: 234224 - DNA, 20 bp, human
gtctcattcctgggaatcgg

SEQ ID NO: 234225 - DNA, 20 bp, human
ggcgagccgcgggagagtgg

SEQ ID NO: 234226 - DNA, 20 bp, human
gtgggaacttccctaagtgt

SEQ ID NO: 234227 - DNA, 20 bp, human
gcatggtgggagccacaagt

SEQ ID NO: 234228 - DNA, 20 bp, human
ggccctgaagcagtagtact

SEQ ID NO: 234229 - DNA, 20 bp, human
gtacttggatggaatgacgt

SEQ ID NO: 234230 - DNA, 20 bp, human
ggggaactgtcctggttgag

SEQ ID NO: 234231 - DNA, 20 bp, human
gtgaagcagtagtacttgga

SEQ ID NO: 234232 - DNA, 20 bp, human
gctcacacccagcgaccatg

SEQ ID NO: 234233 - DNA, 20 bp, human
gaccaccacgaataccagcc

SEQ ID NO: 234234 - DNA, 20 bp, human
gctctcctggctggtattcg

SEQ ID NO: 234235 - DNA, 20 bp, human
ggcttcagggcagaagagtc

SEQ ID NO: 234236 - DNA, 20 bp, human
gagaagagaggcaagctagt

SEQ ID NO: 234237 - DNA, 20 bp, human
gcaagctagtaggagggact

SEQ ID NO: 234238 - DNA, 20 bp, human
ggagaggcaagctagtagga

SEQ ID NO: 234239 - DNA, 20 bp, human
ggtgacccccgcatgggcaa

SEQ ID NO: 234240 - DNA, 20 bp, human
gggaaaaggaggggaatatg

SEQ ID NO: 234241 - DNA, 20 bp, human
gtgaccagattccagatcct

SEQ ID NO: 234242 - DNA, 20 bp, human
gatgcgggggtcacgatgaa

SEQ ID NO: 234243 - DNA, 20 bp, human
gctggatcttgccttggaaa

SEQ ID NO: 234244 - DNA, 20 bp, human
ggaagcctttgcccatgcgg

SEQ ID NO: 234245 - DNA, 20 bp, human
gtggaatctggtcagcaatc

SEQ ID NO: 234246 - DNA, 20 bp, human
gcgccccagccattcaccat

SEQ ID NO: 234247 - DNA, 20 bp, human
gtgaccaagtcatgatgaag

SEQ ID NO: 234248 - DNA, 20 bp, human
ggggcaccaaagacttttct

SEQ ID NO: 234249 - DNA, 20 bp, human
gaggccacaaggagccagag

SEQ ID NO: 234250 - DNA, 20 bp, human
gttcccatggtgaatggctg

SEQ ID NO: 234251 - DNA, 20 bp, human
gtgtggcctgaacagccaga

SEQ ID NO: 234252 - DNA, 20 bp, human
ggagaaagagtgctgtgcta

SEQ ID NO: 234253 - DNA, 20 bp, human
gtatagggagtggagaagct

SEQ ID NO: 234254 - DNA, 20 bp, human
gtggaactctcagaggacct

SEQ ID NO: 234255 - DNA, 20 bp, human
ggaagaaaacagctccttta

SEQ ID NO: 234256 - DNA, 20 bp, human
gccccacgtggcctgttcta

SEQ ID NO: 234257 - DNA, 20 bp, human
gagggagagccaaggtttaa

SEQ ID NO: 234258 - DNA, 20 bp, human
gggctctccctgcttccttc

SEQ ID NO: 234259 - DNA, 20 bp, human
gaacttcttcccactgggga

SEQ ID NO: 234260 - DNA, 20 bp, human
gtaggcatgaacatgagcac

SEQ ID NO: 234261 - DNA, 20 bp, human
gcctccaagtcaggtctcat

SEQ ID NO: 234262 - DNA, 20 bp, human
gacgtggggcctggacattc

SEQ ID NO: 234263 - DNA, 20 bp, human
gagttgaacttcttcccact

SEQ ID NO: 234264 - DNA, 20 bp, human
gctaaggcctgagatggaat

SEQ ID NO: 234265 - DNA, 20 bp, human
gatggtcttccatccccagt

SEQ ID NO: 234266 - DNA, 20 bp, human
gtaactacctactatgaaac

SEQ ID NO: 234267 - DNA, 20 bp, human
gggtctgccagcactaggga

SEQ ID NO: 234268 - DNA, 20 bp, human
gtgacctaggaacacttgac

SEQ ID NO: 234269 - DNA, 20 bp, human
gaacacttgactggtcaaga

SEQ ID NO: 234270 - DNA, 20 bp, human
gcaaaatggcagagttcaac

SEQ ID NO: 234271 - DNA, 20 bp, human
gttcaactggtatgtgacct

SEQ ID NO: 234272 - DNA, 20 bp, human
gtgaccagtcaagtgttcct

SEQ ID NO: 234273 - DNA, 20 bp, human
gtctcaggagtcaggcaagt

SEQ ID NO: 234274 - DNA, 20 bp, human
gtgactcctgagatcttaat

SEQ ID NO: 234275 - DNA, 20 bp, human
gtgcagcccctccctagtgc

SEQ ID NO: 234276 - DNA, 20 bp, human
gagtcccccactcctatctc

SEQ ID NO: 234277 - DNA, 20 bp, human
gaggctgctgcagactgata

SEQ ID NO: 234278 - DNA, 20 bp, human
gaagcctgagataggagtgg

SEQ ID NO: 234279 - DNA, 20 bp, human
gaatcctctaagcctgagat

SEQ ID NO: 234280 - DNA, 20 bp, human
gagagtgcaacagaaagtag

SEQ ID NO: 234281 - DNA, 20 bp, human
gacctcctggttggaactac

SEQ ID NO: 234282 - DNA, 20 bp, human
gagactcttggattcaggat

SEQ ID NO: 234283 - DNA, 20 bp, human
gggaactacaggaatagaac

SEQ ID NO: 234284 - DNA, 20 bp, human
gctggtttgacctttggatt

SEQ ID NO: 234285 - DNA, 20 bp, human
gcaccactgctaacacctcc

SEQ ID NO: 234286 - DNA, 20 bp, human
gcaaggtcacctgggtggat

SEQ ID NO: 234287 - DNA, 20 bp, human
gcccccaggtgatcagtctt

SEQ ID NO: 234288 - DNA, 20 bp, human
gtgaattcacgtgaagaaat

SEQ ID NO: 234289 - DNA, 20 bp, human
gatataagatagggcatgta

SEQ ID NO: 234290 - DNA, 20 bp, human
gaccgcatcagagccggtag

SEQ ID NO: 234291 - DNA, 20 bp, human
gtacttccctgggactactg

SEQ ID NO: 234292 - DNA, 20 bp, human
gtctaggcctcagtagtccc

SEQ ID NO: 234293 - DNA, 20 bp, human
gacagagggcagcagaggat

SEQ ID NO: 234294 - DNA, 20 bp, human
gccccaagactgatcacctg

SEQ ID NO: 234295 - DNA, 20 bp, human
ggagctgagtagttggcaag

SEQ ID NO: 234296 - DNA, 20 bp, human
gggcactcaactggagacag

SEQ ID NO: 234297 - DNA, 20 bp, human
gtcaactggagacagaggtg

SEQ ID NO: 234298 - DNA, 20 bp, human
gctcaagccaccatgcatga

SEQ ID NO: 234299 - DNA, 20 bp, human
gaagtgtcggggagtcaacc

SEQ ID NO: 234300 - DNA, 20 bp, human
gggggcagacggaagtgtcg

SEQ ID NO: 234301 - DNA, 20 bp, human
gctagctcttggaatgtttg

SEQ ID NO: 234302 - DNA, 20 bp, human
gttgtggatttccagagaat

SEQ ID NO: 234303 - DNA, 20 bp, human
gagaagtgtgtcactgccat

SEQ ID NO: 234304 - DNA, 20 bp, human
ggggttcatctctctgtagc

SEQ ID NO: 234305 - DNA, 20 bp, human
gggagagcatccttcatgca

SEQ ID NO: 234306 - DNA, 20 bp, human
ggcacccagggattatgctt

SEQ ID NO: 234307 - DNA, 20 bp, human
gcagatgggtgaccaggagt

SEQ ID NO: 234308 - DNA, 20 bp, human
gttgcctatggttacttgaa

SEQ ID NO: 234309 - DNA, 20 bp, human
gtataggcagactggaccat

SEQ ID NO: 234310 - DNA, 20 bp, human
gagaagttgtatctccagat

SEQ ID NO: 234311 - DNA, 20 bp, human
gcattctgctctatcaaagg

SEQ ID NO: 234312 - DNA, 20 bp, human
gtatctccagatgggtgacc

SEQ ID NO: 234313 - DNA, 20 bp, human
gtaatcctaagcataatccc

SEQ ID NO: 234314 - DNA, 20 bp, human
gagtaaccataggcaaccct

SEQ ID NO: 234315 - DNA, 20 bp, human
ggtggttcacttgttgattg

SEQ ID NO: 234316 - DNA, 20 bp, human
gaacaggggaatcacagaat

SEQ ID NO: 234317 - DNA, 20 bp, human
gcagtctggcccagtaaagg

SEQ ID NO: 234318 - DNA, 20 bp, human
gaaggaaagggcaaccgcag

SEQ ID NO: 234319 - DNA, 20 bp, human
gggacatgaaggggaatttc

SEQ ID NO: 234320 - DNA, 20 bp, human
gagaaagaggggggcaacag

SEQ ID NO: 234321 - DNA, 20 bp, human
gaggacaagggataaaccta

SEQ ID NO: 234322 - DNA, 20 bp, human
gcaagaaagaagcaccagtg

SEQ ID NO: 234323 - DNA, 20 bp, human
ggtgcgattctgccagaaag

SEQ ID NO: 234324 - DNA, 20 bp, human
ggattctgccagaaagaggg

SEQ ID NO: 234325 - DNA, 20 bp, human
gggaaccagtccttcccttg

SEQ ID NO: 234326 - DNA, 20 bp, human
gagagagggcggagtcaagc

SEQ ID NO: 234327 - DNA, 20 bp, human
ggcggagtcaagcaggagga

SEQ ID NO: 234328 - DNA, 20 bp, human
gtctgcccgctttcaataag

SEQ ID NO: 234329 - DNA, 20 bp, human
gtcttccatgagtgataagt

SEQ ID NO: 234330 - DNA, 20 bp, human
gaccacagatgtgaactaag

SEQ ID NO: 234331 - DNA, 20 bp, human
gctacttcctggaaatccac

SEQ ID NO: 234332 - DNA, 20 bp, human
gtcacatctgtggtcagtct

SEQ ID NO: 234333 - DNA, 20 bp, human
gtcgctgccagcttaccttc

SEQ ID NO: 234334 - DNA, 20 bp, human
gacagcccacttatcactca

SEQ ID NO: 234335 - DNA, 20 bp, human
gccctcttagttcacatctg

SEQ ID NO: 234336 - DNA, 20 bp, human
gtgggaaggtgcgaaggtca

SEQ ID NO: 234337 - DNA, 20 bp, human
gacaaaggtcagccccacac

SEQ ID NO: 234338 - DNA, 20 bp, human
ggatggggccagttgatcaa

SEQ ID NO: 234339 - DNA, 20 bp, human
gagaaggcgtgttgccacat

SEQ ID NO: 234340 - DNA, 20 bp, human
gcagaaccagtcaaggagga

SEQ ID NO: 234341 - DNA, 20 bp, human
ggaaggtgcgaaggtcaggg

SEQ ID NO: 234342 - DNA, 20 bp, human
gcaatggggaaaaccccatg

SEQ ID NO: 234343 - DNA, 20 bp, human
gctggatgaaagtcttttct

SEQ ID NO: 234344 - DNA, 20 bp, human
gtattgggaatgtacacaga

SEQ ID NO: 234345 - DNA, 20 bp, human
gttcgcaccttcccaatatg

SEQ ID NO: 234346 - DNA, 20 bp, human
gccttcaagcagtagggaag

SEQ ID NO: 234347 - DNA, 20 bp, human
gtgacgaataaaccacttag

SEQ ID NO: 234348 - DNA, 20 bp, human
ggttctcaacgaccttacaa

SEQ ID NO: 234349 - DNA, 20 bp, human
gaataaacttatcctgtgat

SEQ ID NO: 234350 - DNA, 20 bp, human
gcacaggacttctcataagt

SEQ ID NO: 234351 - DNA, 20 bp, human
gagggttccttcaagcagta

SEQ ID NO: 234352 - DNA, 20 bp, human
gactgtaaactatgttagat

SEQ ID NO: 234353 - DNA, 20 bp, human
gtttgtgtgccgagaagttt

SEQ ID NO: 234354 - DNA, 20 bp, human
gttgagaaatagagctacaa

SEQ ID NO: 234355 - DNA, 20 bp, human
gtgtcttggaaacctttgta

SEQ ID NO: 234356 - DNA, 20 bp, human
ggtagctgggaatagaagga

SEQ ID NO: 234357 - DNA, 20 bp, human
gaggggaagggtatggatcc

SEQ ID NO: 234358 - DNA, 20 bp, human
gagacagtcatggtgttcca

SEQ ID NO: 234359 - DNA, 20 bp, human
gacataaaatttggcagctg

SEQ ID NO: 234360 - DNA, 20 bp, human
gcgtagtgaggagacagtca

SEQ ID NO: 234361 - DNA, 20 bp, human
gctgcatgaaagcagtagct

SEQ ID NO: 234362 - DNA, 20 bp, human
gcagacatattcaactaatg

SEQ ID NO: 234363 - DNA, 20 bp, human
gctaatgaggacataaaatt

SEQ ID NO: 234364 - DNA, 20 bp, human
gtggatcctggagcgtagtg

SEQ ID NO: 234365 - DNA, 20 bp, human
gtgtctcctcactacgctcc

SEQ ID NO: 234366 - DNA, 20 bp, human
ggggagcacaagcctctaag

SEQ ID NO: 234367 - DNA, 20 bp, human
gtggcggggaaccactcaga

SEQ ID NO: 234368 - DNA, 20 bp, human
ggaggcgaggacagagttga

SEQ ID NO: 234369 - DNA, 20 bp, human
ggggcaccccggtgactaag

SEQ ID NO: 234370 - DNA, 20 bp, human
gggacccattgacccatctg

SEQ ID NO: 234371 - DNA, 20 bp, human
gagggggggtcccctctgag

SEQ ID NO: 234372 - DNA, 20 bp, human
gactaagaggtaagtaagtg

SEQ ID NO: 234373 - DNA, 20 bp, human
gaagccccagatgggtcaat

SEQ ID NO: 234374 - DNA, 20 bp, human
gagcacaagcctctaagagg

SEQ ID NO: 234375 - DNA, 20 bp, human
gcaaccctcacctagaattg

SEQ ID NO: 234376 - DNA, 20 bp, human
gacaactcgggaagtccaca

SEQ ID NO: 234377 - DNA, 20 bp, human
gatgacttggactgtccttg

SEQ ID NO: 234378 - DNA, 20 bp, human
gacaaggctgagaatgcaat

SEQ ID NO: 234379 - DNA, 20 bp, human
gtgaaggtggttagctcctg

SEQ ID NO: 234380 - DNA, 20 bp, human
gtggtggtccccatgtgtac

SEQ ID NO: 234381 - DNA, 20 bp, human
ggagttgttccaataagtac

SEQ ID NO: 234382 - DNA, 20 bp, human
ggatgaatgaatctcccaga

SEQ ID NO: 234383 - DNA, 20 bp, human
gtatgatggatccttccctc

SEQ ID NO: 234384 - DNA, 20 bp, human
gtctctctgcctgtacttat

SEQ ID NO: 234385 - DNA, 20 bp, human
ggtagacgacaaagatgact

SEQ ID NO: 234386 - DNA, 20 bp, human
gctgagtcaagggttatctt

SEQ ID NO: 234387 - DNA, 20 bp, human
gtgttgcccagctgagtcaa

SEQ ID NO: 234388 - DNA, 20 bp, human
ggactcagctgggcaacaac

SEQ ID NO: 234389 - DNA, 20 bp, human
gggctccgaacgaaagaact

SEQ ID NO: 234390 - DNA, 20 bp, human
gaggccaagttcaaaggtgt

SEQ ID NO: 234391 - DNA, 20 bp, human
ggcactgggaggactctaat

SEQ ID NO: 234392 - DNA, 20 bp, human
gaacacagccaggatcccat

SEQ ID NO: 234393 - DNA, 20 bp, human
gcttctagttgccccataaa

SEQ ID NO: 234394 - DNA, 20 bp, human
gcctttgaacttggcctagg

SEQ ID NO: 234395 - DNA, 20 bp, human
gcatccaacacctttgaact

SEQ ID NO: 234396 - DNA, 20 bp, human
gctggagacagtaggggtgc

SEQ ID NO: 234397 - DNA, 20 bp, human
gcagtctgagccttgttcgc

SEQ ID NO: 234398 - DNA, 20 bp, human
gggggggagcatgaaggtaa

SEQ ID NO: 234399 - DNA, 20 bp, human
gcagggaacaggtggcttga

SEQ ID NO: 234400 - DNA, 20 bp, human
gaaggtaagggcttgtttgg

SEQ ID NO: 234401 - DNA, 20 bp, human
gcactggctgcctgcgaaca

SEQ ID NO: 234402 - DNA, 20 bp, human
gggaacaggtggcttgaggg

SEQ ID NO: 234403 - DNA, 20 bp, human
gtggagcttgctgtagaaga

SEQ ID NO: 234404 - DNA, 20 bp, human
gactgactgtgagagggtat

SEQ ID NO: 234405 - DNA, 20 bp, human
gggggcctgtgggtcgaggt

SEQ ID NO: 234406 - DNA, 20 bp, human
gaagaaagataatctggcac

SEQ ID NO: 234407 - DNA, 20 bp, human
gacagtgaagaaagataatc

SEQ ID NO: 234408 - DNA, 20 bp, human
gggatcaggcaggaggagtt

SEQ ID NO: 234409 - DNA, 20 bp, human
gccgtctcagtctcataaaa

SEQ ID NO: 234410 - DNA, 20 bp, human
gagtctcataaaaggggatc

SEQ ID NO: 234411 - DNA, 20 bp, human
ggataatctggcactgggcg

SEQ ID NO: 234412 - DNA, 20 bp, human
gagcacttttgacccaacaa

SEQ ID NO: 234413 - DNA, 20 bp, human
gtcccaaccacagaattctc

SEQ ID NO: 234414 - DNA, 20 bp, human
gattctctggaattgttttc

SEQ ID NO: 234415 - DNA, 20 bp, human
gttattgaattccatcaaca

SEQ ID NO: 234416 - DNA, 20 bp, human
gtgacaggggagttgtgggt

SEQ ID NO: 234417 - DNA, 20 bp, human
gggaaggagtctgtggcaac

SEQ ID NO: 234418 - DNA, 20 bp, human
gaggattagtgtgtgatgta

SEQ ID NO: 234419 - DNA, 20 bp, human
gattctgacaggggagttgt

SEQ ID NO: 234420 - DNA, 20 bp, human
gtagggcccaggagtgtcac

SEQ ID NO: 234421 - DNA, 20 bp, human
gggcaacaggccgagaatta

SEQ ID NO: 234422 - DNA, 20 bp, human
ggaaatggctatcctagatg

SEQ ID NO: 234423 - DNA, 20 bp, human
gtgtgaaaacacaattgggt

SEQ ID NO: 234424 - DNA, 20 bp, human
gccatgtgctcctaagctct

SEQ ID NO: 234425 - DNA, 20 bp, human
gtgtgtgatgtagggactga

SEQ ID NO: 234426 - DNA, 20 bp, human
gaccaggcctagcctaccgc

SEQ ID NO: 234427 - DNA, 20 bp, human
gactacgcgaagggtaggta

SEQ ID NO: 234428 - DNA, 20 bp, human
gggcgcacgcctggacccgg

SEQ ID NO: 234429 - DNA, 20 bp, human
ggtaggctaggcctggtcct

SEQ ID NO: 234430 - DNA, 20 bp, human
gggcataatcccaataacag

SEQ ID NO: 234431 - DNA, 20 bp, human
ggggcagcccgcggtaggct

SEQ ID NO: 234432 - DNA, 20 bp, human
ggtgaagggcagcccgcggt

SEQ ID NO: 234433 - DNA, 20 bp, human
gtggtcctgggcgccccagc

SEQ ID NO: 234434 - DNA, 20 bp, human
gcggccgtcacgcgctgcct

SEQ ID NO: 234435 - DNA, 20 bp, human
ggtggaccaggagggtactt

SEQ ID NO: 234436 - DNA, 20 bp, human
gatgctaagttgcacaactc

SEQ ID NO: 234437 - DNA, 20 bp, human
gaccacagggatagggttga

SEQ ID NO: 234438 - DNA, 20 bp, human
gtgctataaccacagggata

SEQ ID NO: 234439 - DNA, 20 bp, human
ggacttgttatagtttcata

SEQ ID NO: 234440 - DNA, 20 bp, human
gcccatcaaccctatccctg

SEQ ID NO: 234441 - DNA, 20 bp, human
gttatagtttcatagggaaa

SEQ ID NO: 234442 - DNA, 20 bp, human
gtattagtcatgtagtgact

SEQ ID NO: 234443 - DNA, 20 bp, human
gtcagttctttgcctctggg

SEQ ID NO: 234444 - DNA, 20 bp, human
gtcattcagttctttgcctc

SEQ ID NO: 234445 - DNA, 20 bp, human
gaagcagaattgcagctctg

SEQ ID NO: 234446 - DNA, 20 bp, human
gctgagtgttgcacaactca

SEQ ID NO: 234447 - DNA, 20 bp, human
gagaactggtctatgcagcc

SEQ ID NO: 234448 - DNA, 20 bp, human
gtgactggttctagcttcat

SEQ ID NO: 234449 - DNA, 20 bp, human
gtggtctatgcagccaggca

SEQ ID NO: 234450 - DNA, 20 bp, human
ggagtttctctttcttggtc

SEQ ID NO: 234451 - DNA, 20 bp, human
gagatggagtttctctttct

SEQ ID NO: 234452 - DNA, 20 bp, human
gctcctgtgagtgtgaagag

SEQ ID NO: 234453 - DNA, 20 bp, human
ggatggggaaatggaatctg

SEQ ID NO: 234454 - DNA, 20 bp, human
gttgcacaactcagggtccc

SEQ ID NO: 234455 - DNA, 20 bp, human
gagggtccctggtgaccaca

SEQ ID NO: 234456 - DNA, 20 bp, human
gctgagtgttgcacaactca

SEQ ID NO: 234457 - DNA, 20 bp, human
gagaactggtctatgcagcc

SEQ ID NO: 234458 - DNA, 20 bp, human
gtgactggttctagcttcat

SEQ ID NO: 234459 - DNA, 20 bp, human
gtggtctatgcagccaggca

SEQ ID NO: 234460 - DNA, 20 bp, human
ggagtttctctttcttggtc

SEQ ID NO: 234461 - DNA, 20 bp, human
gagatggagtttctctttct

SEQ ID NO: 234462 - DNA, 20 bp, human
ggatggggaaatggaatctg

SEQ ID NO: 234463 - DNA, 20 bp, human
gctcctgtgagtgtgaagag

SEQ ID NO: 234464 - DNA, 20 bp, human
gaggggtgtgtgtcaaccca

SEQ ID NO: 234465 - DNA, 20 bp, human
gttgcacaactcagggtccc

SEQ ID NO: 234466 - DNA, 20 bp, human
gccactttgttcttggggtc

SEQ ID NO: 234467 - DNA, 20 bp, human
ggtcaggcttgtggccagcc

SEQ ID NO: 234468 - DNA, 20 bp, human
gcagtctcggtcactgcctt

SEQ ID NO: 234469 - DNA, 20 bp, human
gtggctcccactttgttctt

SEQ ID NO: 234470 - DNA, 20 bp, human
gtccagcattggatgtgagg

SEQ ID NO: 234471 - DNA, 20 bp, human
ggttcttggggtcaggcttg

SEQ ID NO: 234472 - DNA, 20 bp, human
gaggcctaggacaaatgtgg

SEQ ID NO: 234473 - DNA, 20 bp, human
gagagtgagtggaatttcca

SEQ ID NO: 234474 - DNA, 20 bp, human
gaggtgcaggcgagaagaaa

SEQ ID NO: 234475 - DNA, 20 bp, human
gcagggcgatgtcatcatag

SEQ ID NO: 234476 - DNA, 20 bp, human
gtccaggctggccacagtcc

SEQ ID NO: 234477 - DNA, 20 bp, human
gggttcccgctttgtttttg

SEQ ID NO: 234478 - DNA, 20 bp, human
ggtggccagcctggaaagac

SEQ ID NO: 234479 - DNA, 20 bp, human
gcatggtagagatgatgtca

SEQ ID NO: 234480 - DNA, 20 bp, human
gctggccccaaaaacaaagc

SEQ ID NO: 234481 - DNA, 20 bp, human
ggcatgaaccctccagcatc

SEQ ID NO: 234482 - DNA, 20 bp, human
ggtttttggggccaggactg

SEQ ID NO: 234483 - DNA, 20 bp, human
gaaaagcagtgaccgagact

SEQ ID NO: 234484 - DNA, 20 bp, human
gagagtgagtggaatttcca

SEQ ID NO: 234485 - DNA, 20 bp, human
gaggcctaggacaaatgtgg

SEQ ID NO: 234486 - DNA, 20 bp, human
gtggttcccgctttgttctt

SEQ ID NO: 234487 - DNA, 20 bp, human
gtccaggctggccactgtcc

SEQ ID NO: 234488 - DNA, 20 bp, human
ggtggccagcctggaaagac

SEQ ID NO: 234489 - DNA, 20 bp, human
gctggccccaagaacaaagc

SEQ ID NO: 234490 - DNA, 20 bp, human
gcatggtagagatgatgtca

SEQ ID NO: 234491 - DNA, 20 bp, human
ggcatgaaccctccagcatc

SEQ ID NO: 234492 - DNA, 20 bp, human
ggttcttggggccaggacag

SEQ ID NO: 234493 - DNA, 20 bp, human
gagagtgagtggaatttcca

SEQ ID NO: 234494 - DNA, 20 bp, human
gaggcctaggacaaatgtgg

SEQ ID NO: 234495 - DNA, 20 bp, human
gggcacccccagatgctgga

SEQ ID NO: 234496 - DNA, 20 bp, human
gtggcattgagcgccatcag

SEQ ID NO: 234497 - DNA, 20 bp, human
gtcagagagtggtccactga

SEQ ID NO: 234498 - DNA, 20 bp, human
gcgaatcttgattcaaatct

SEQ ID NO: 234499 - DNA, 20 bp, human
gtggttcccgctttgttctt

SEQ ID NO: 234500 - DNA, 20 bp, human
gtccaggctggccactgtcc

SEQ ID NO: 234501 - DNA, 20 bp, human
ggtgccattcatcagttctg

SEQ ID NO: 234502 - DNA, 20 bp, human
gctggccccaagaacaaagc

SEQ ID NO: 234503 - DNA, 20 bp, human
ggtggccagcctggaaagac

SEQ ID NO: 234504 - DNA, 20 bp, human
ggttcttggggccaggacag

SEQ ID NO: 234505 - DNA, 20 bp, human
ggcatgaaccctccagcatc

SEQ ID NO: 234506 - DNA, 20 bp, human
gaaggagtggcagttaggac

SEQ ID NO: 234507 - DNA, 20 bp, human
gagacagagactcgaatttc

SEQ ID NO: 234508 - DNA, 20 bp, human
gcattggtgcttggtcaaag

SEQ ID NO: 234509 - DNA, 20 bp, human
gagttgaggggcatccccta

SEQ ID NO: 234510 - DNA, 20 bp, human
gcaaaatagcaaccaagcat

SEQ ID NO: 234511 - DNA, 20 bp, human
gcagagactcgaatttccgg

SEQ ID NO: 234512 - DNA, 20 bp, human
gcctcaactggccctataaa

SEQ ID NO: 234513 - DNA, 20 bp, human
ggcaggaagccgctttcttg

SEQ ID NO: 234514 - DNA, 20 bp, human
gcttgttgtccccaagaaag

SEQ ID NO: 234515 - DNA, 20 bp, human
gattttggaaactcccctta

SEQ ID NO: 234516 - DNA, 20 bp, human
gtgagccagtgcacttcagt

SEQ ID NO: 234517 - DNA, 20 bp, human
ggaaatgacagtatgagtcg

SEQ ID NO: 234518 - DNA, 20 bp, human
gtgaggtagggtctatgtag

SEQ ID NO: 234519 - DNA, 20 bp, human
ggccagtgcacttcagtggg

SEQ ID NO: 234520 - DNA, 20 bp, human
gctagggataccactccaaa

SEQ ID NO: 234521 - DNA, 20 bp, human
gctgtttttcagctaagacc

SEQ ID NO: 234522 - DNA, 20 bp, human
gtcctcccactgaagtgcac

SEQ ID NO: 234523 - DNA, 20 bp, human
ggaccacagtatgtaatcta

SEQ ID NO: 234524 - DNA, 20 bp, human
gctacctcacctaccactcc

SEQ ID NO: 234525 - DNA, 20 bp, human
gccaaagtcaaagatatgta

SEQ ID NO: 234526 - DNA, 20 bp, human
gtgagtaagcaccagatcct

SEQ ID NO: 234527 - DNA, 20 bp, human
gctgggcatggtcacaatca

SEQ ID NO: 234528 - DNA, 20 bp, human
ggcctcctgttacccacaga

SEQ ID NO: 234529 - DNA, 20 bp, human
gcccctctgtgggtaacagg

SEQ ID NO: 234530 - DNA, 20 bp, human
gatggaagctgacgtcatag

SEQ ID NO: 234531 - DNA, 20 bp, human
gagcccttaatagttcagtg

SEQ ID NO: 234532 - DNA, 20 bp, human
gaaccccagccacagaacgt

SEQ ID NO: 234533 - DNA, 20 bp, human
gtgcttactcagcatattca

SEQ ID NO: 234534 - DNA, 20 bp, human
gtactcagcatattcaagga

SEQ ID NO: 234535 - DNA, 20 bp, human
gtcatagtggaagagagcca

SEQ ID NO: 234536 - DNA, 20 bp, human
ggggtctgatcgctgcgggt

SEQ ID NO: 234537 - DNA, 20 bp, human
ggggcccgaagtctccgccc

SEQ ID NO: 234538 - DNA, 20 bp, human
gcgttctcggccgtcctgaa

SEQ ID NO: 234539 - DNA, 20 bp, human
gtcccttgggcctgaaagtg

SEQ ID NO: 234540 - DNA, 20 bp, human
ggatgagcgacaaccgtggg

SEQ ID NO: 234541 - DNA, 20 bp, human
ggccgtgcagaagcgaagta

SEQ ID NO: 234542 - DNA, 20 bp, human
gcggcgagagcaccgcccac

SEQ ID NO: 234543 - DNA, 20 bp, human
gggccgtgttctccctgaag

SEQ ID NO: 234544 - DNA, 20 bp, human
gtctcctgaaggacgcgggg

SEQ ID NO: 234545 - DNA, 20 bp, human
ggctgcgggtcggattccct

SEQ ID NO: 234546 - DNA, 20 bp, human
gtccacccctggcctctcgg

SEQ ID NO: 234547 - DNA, 20 bp, human
gccaggggcgcaggcgtcgt

SEQ ID NO: 234548 - DNA, 20 bp, human
gcagccctggcctaggtctt

SEQ ID NO: 234549 - DNA, 20 bp, human
gaagcccaagacctaggcca

SEQ ID NO: 234550 - DNA, 20 bp, human
gtaactggggacccagtccc

SEQ ID NO: 234551 - DNA, 20 bp, human
gccccagttaaggctccctt

SEQ ID NO: 234552 - DNA, 20 bp, human
ggggaagtcagaatccaagg

SEQ ID NO: 234553 - DNA, 20 bp, human
gccctggcctctcggtggtc

SEQ ID NO: 234554 - DNA, 20 bp, human
ggacctgccctctgaacaga

SEQ ID NO: 234555 - DNA, 20 bp, human
gctgccctctgaacagaggg

SEQ ID NO: 234556 - DNA, 20 bp, human
gccctccccatcagatggga

SEQ ID NO: 234557 - DNA, 20 bp, human
gggagcttgggaattggcca

SEQ ID NO: 234558 - DNA, 20 bp, human
gagctgaagggtggaagccc

SEQ ID NO: 234559 - DNA, 20 bp, human
ggccagaaggcgggttattg

SEQ ID NO: 234560 - DNA, 20 bp, human
gggcagagctgacctgagga

SEQ ID NO: 234561 - DNA, 20 bp, human
gcccctcccatctgatgggg

SEQ ID NO: 234562 - DNA, 20 bp, human
gcctgcccctcccatctgat

SEQ ID NO: 234563 - DNA, 20 bp, human
gcaggcaggaaaaagaacaa

SEQ ID NO: 234564 - DNA, 20 bp, human
gcccccaataacccgccttc

SEQ ID NO: 234565 - DNA, 20 bp, human
ggcttccacccttcagctgc

SEQ ID NO: 234566 - DNA, 20 bp, human
ggggaaggaccaagtgtcga

SEQ ID NO: 234567 - DNA, 20 bp, human
gctccggggccgcatcgcca

SEQ ID NO: 234568 - DNA, 20 bp, human
ggaaacgctcccgctaggtc

SEQ ID NO: 234569 - DNA, 20 bp, human
gagtccacccggagcgagtc

SEQ ID NO: 234570 - DNA, 20 bp, human
gagcgcacgcctgccgcggt

SEQ ID NO: 234571 - DNA, 20 bp, human
gtggccgattcaacagacgc

SEQ ID NO: 234572 - DNA, 20 bp, human
gccaaagccggggccatcgt

SEQ ID NO: 234573 - DNA, 20 bp, human
gtggactcgccgcgacccct

SEQ ID NO: 234574 - DNA, 20 bp, human
gcggcgcccccggacctagc

SEQ ID NO: 234575 - DNA, 20 bp, human
ggcggcaggcgtgcgctctc

SEQ ID NO: 234576 - DNA, 20 bp, human
gagggagaaacaaactggct

SEQ ID NO: 234577 - DNA, 20 bp, human
gagaaacaaactggctgggg

SEQ ID NO: 234578 - DNA, 20 bp, human
gcgagtgaagggtaaaccaa

SEQ ID NO: 234579 - DNA, 20 bp, human
gagggtcgcaggcgagtgaa

SEQ ID NO: 234580 - DNA, 20 bp, human
gagtgagcgaggctgtccga

SEQ ID NO: 234581 - DNA, 20 bp, human
gaaaccaaaggaaactgagc

SEQ ID NO: 234582 - DNA, 20 bp, human
ggggagaaaacgcctgcgcg

SEQ ID NO: 234583 - DNA, 20 bp, human
ggccctgcgtggtctcgagc

SEQ ID NO: 234584 - DNA, 20 bp, human
gttcaaggcgacagggtcgc

SEQ ID NO: 234585 - DNA, 20 bp, human
gagaaaacgcctgcgcgggg

SEQ ID NO: 234586 - DNA, 20 bp, human
ggtgcgccgcccacctggaa

SEQ ID NO: 234587 - DNA, 20 bp, human
ggcgcgaaggcgttcgagag

SEQ ID NO: 234588 - DNA, 20 bp, human
gacgaacaggccaataagga

SEQ ID NO: 234589 - DNA, 20 bp, human
gaaggcgttcgagaggggcg

SEQ ID NO: 234590 - DNA, 20 bp, human
gggccacagtgaggctaggc

SEQ ID NO: 234591 - DNA, 20 bp, human
gacagtgaggctaggccgga

SEQ ID NO: 234592 - DNA, 20 bp, human
gccggcagccgccaatggga

SEQ ID NO: 234593 - DNA, 20 bp, human
ggcctggccaggctctcacg

SEQ ID NO: 234594 - DNA, 20 bp, human
ggaaacgcattctctgcgac

SEQ ID NO: 234595 - DNA, 20 bp, human
gtctgctgggtgtaggtcct

SEQ ID NO: 234596 - DNA, 20 bp, human
gatcactggtccataaagag

SEQ ID NO: 234597 - DNA, 20 bp, human
gccataaagaggggtggagt

SEQ ID NO: 234598 - DNA, 20 bp, human
gactggtccataaagagggg

SEQ ID NO: 234599 - DNA, 20 bp, human
gtcagcaccttttaaggtaa

SEQ ID NO: 234600 - DNA, 20 bp, human
ggttctgaagacacttccca

SEQ ID NO: 234601 - DNA, 20 bp, human
ggataagaaattacccttaa

SEQ ID NO: 234602 - DNA, 20 bp, human
gtacacgttgttgtttgcgt

SEQ ID NO: 234603 - DNA, 20 bp, human
gttgaactcattagccaatc

SEQ ID NO: 234604 - DNA, 20 bp, human
gaagcatgttgaggtcacaa

SEQ ID NO: 234605 - DNA, 20 bp, human
ggcaccttttaaggtaaagg

SEQ ID NO: 234606 - DNA, 20 bp, human
gtgcactctcgcactctcat

SEQ ID NO: 234607 - DNA, 20 bp, human
gcacgggtcgctgttctcat

SEQ ID NO: 234608 - DNA, 20 bp, human
gcgtgcgcagggccgcccaa

SEQ ID NO: 234609 - DNA, 20 bp, human
gcatccctgagcaacccgga

SEQ ID NO: 234610 - DNA, 20 bp, human
gagaacagcgacccgtgcgc

SEQ ID NO: 234611 - DNA, 20 bp, human
gcaatggggcgcaagcgacg

SEQ ID NO: 234612 - DNA, 20 bp, human
ggcagaaaaaacaccccaac

SEQ ID NO: 234613 - DNA, 20 bp, human
gaaaaaggaactgtctcatt

SEQ ID NO: 234614 - DNA, 20 bp, human
ggtctctgagacaaacaaaa

SEQ ID NO: 234615 - DNA, 20 bp, human
gtcgcttgcgccccattggg

SEQ ID NO: 234616 - DNA, 20 bp, human
ggagaatggtggggtcaatc

SEQ ID NO: 234617 - DNA, 20 bp, human
gcccctgctggtgagaatgg

SEQ ID NO: 234618 - DNA, 20 bp, human
gacccccacccccaagacga

SEQ ID NO: 234619 - DNA, 20 bp, human
gtggccacttccatcgtctt

SEQ ID NO: 234620 - DNA, 20 bp, human
gtgggggtgcttggcagcac

SEQ ID NO: 234621 - DNA, 20 bp, human
gagcgcagaggccacgtgac

SEQ ID NO: 234622 - DNA, 20 bp, human
gtcagaacaactggtacgag

SEQ ID NO: 234623 - DNA, 20 bp, human
gaactggtacgagaggcggc

SEQ ID NO: 234624 - DNA, 20 bp, human
ggaacaactggtacgagagg

SEQ ID NO: 234625 - DNA, 20 bp, human
gcagacttaaaaccaccaga

SEQ ID NO: 234626 - DNA, 20 bp, human
ggggaggtgctgacccttgg

SEQ ID NO: 234627 - DNA, 20 bp, human
gctgaagacaggagaccgag

SEQ ID NO: 234628 - DNA, 20 bp, human
gacaggagaccgagcggctt

SEQ ID NO: 234629 - DNA, 20 bp, human
ggggtctaacctaggcgaag

SEQ ID NO: 234630 - DNA, 20 bp, human
ggcgaagtggctcagatacg

SEQ ID NO: 234631 - DNA, 20 bp, human
ggaggggaggtgctgaccct

SEQ ID NO: 234632 - DNA, 20 bp, human
gtccggcccgcggtagcgga

SEQ ID NO: 234633 - DNA, 20 bp, human
gtgttcacgagagctcgcgg

SEQ ID NO: 234634 - DNA, 20 bp, human
gcaactcccgtgctgaagac

SEQ ID NO: 234635 - DNA, 20 bp, human
gccggcgtgaaggagactag

SEQ ID NO: 234636 - DNA, 20 bp, human
gcaaacgccgggagcagcga

SEQ ID NO: 234637 - DNA, 20 bp, human
gagcccaaaagccatccctg

SEQ ID NO: 234638 - DNA, 20 bp, human
gtcaaagcccggcagagaat

SEQ ID NO: 234639 - DNA, 20 bp, human
gcctggggagaccacgagaa

SEQ ID NO: 234640 - DNA, 20 bp, human
gggcgcgggcgccaaacgcc

SEQ ID NO: 234641 - DNA, 20 bp, human
ggggtcccccgggatttagg

SEQ ID NO: 234642 - DNA, 20 bp, human
ggcccggcagagaatgggag

SEQ ID NO: 234643 - DNA, 20 bp, human
gcgcctcagggatggctttt

SEQ ID NO: 234644 - DNA, 20 bp, human
gcagtaggggacaactagga

SEQ ID NO: 234645 - DNA, 20 bp, human
ggacccactcgaggcggacg

SEQ ID NO: 234646 - DNA, 20 bp, human
gaggactttgaggcaagtgt

SEQ ID NO: 234647 - DNA, 20 bp, human
gagggagggcagttttctaa

SEQ ID NO: 234648 - DNA, 20 bp, human
gagcgtagcagggtcgggaa

SEQ ID NO: 234649 - DNA, 20 bp, human
ggggcagttttctaatggaa

SEQ ID NO: 234650 - DNA, 20 bp, human
gttctctaggtaaacctctg

SEQ ID NO: 234651 - DNA, 20 bp, human
gggaaaggaacttatcatcc

SEQ ID NO: 234652 - DNA, 20 bp, human
gaaacaccagttggcaccaa

SEQ ID NO: 234653 - DNA, 20 bp, human
ggtgcccgacaaacctccac

SEQ ID NO: 234654 - DNA, 20 bp, human
ggggcaccagccagcgtagc

SEQ ID NO: 234655 - DNA, 20 bp, human
gccaactggtgtttgaaagt

SEQ ID NO: 234656 - DNA, 20 bp, human
gttctccttaataacgagag

SEQ ID NO: 234657 - DNA, 20 bp, human
gcccgacccaacttcaaacg

SEQ ID NO: 234658 - DNA, 20 bp, human
gggggaccgcgtttgaagtt

SEQ ID NO: 234659 - DNA, 20 bp, human
gaggaggggaggaccgggag

SEQ ID NO: 234660 - DNA, 20 bp, human
gcatgccaggggccccggac

SEQ ID NO: 234661 - DNA, 20 bp, human
gctgaagcggtgacgcaagc

SEQ ID NO: 234662 - DNA, 20 bp, human
gagcggagaagagcgagcag

SEQ ID NO: 234663 - DNA, 20 bp, human
gttaataacgagaggggaaa

SEQ ID NO: 234664 - DNA, 20 bp, human
gaccgcgtttgaagttgggt

SEQ ID NO: 234665 - DNA, 20 bp, human
gttgcgtcaccgcttcagag

SEQ ID NO: 234666 - DNA, 20 bp, human
ggtccgagaagcaaaatggg

SEQ ID NO: 234667 - DNA, 20 bp, human
ggaaagttctctgcacccgg

SEQ ID NO: 234668 - DNA, 20 bp, human
ggcggcgccccggacggaaa

SEQ ID NO: 234669 - DNA, 20 bp, human
ggcccaatggggccgcggga

SEQ ID NO: 234670 - DNA, 20 bp, human
gcgccccggacggaaagggt

SEQ ID NO: 234671 - DNA, 20 bp, human
gcagcggcccaatggggccg

SEQ ID NO: 234672 - DNA, 20 bp, human
gctgcacccggtggtccaga

SEQ ID NO: 234673 - DNA, 20 bp, human
ggcgcaagccggccggcttc

SEQ ID NO: 234674 - DNA, 20 bp, human
gggagggcccgtgggtgggt

SEQ ID NO: 234675 - DNA, 20 bp, human
gcgcaacgctccgaggggcg

SEQ ID NO: 234676 - DNA, 20 bp, human
gcctctgagagtgggatggt

SEQ ID NO: 234677 - DNA, 20 bp, human
gaggcctggtctctgataac

SEQ ID NO: 234678 - DNA, 20 bp, human
gtgtcctggcctctgagagt

SEQ ID NO: 234679 - DNA, 20 bp, human
ggggctggacggcttgttga

SEQ ID NO: 234680 - DNA, 20 bp, human
gggttggtgctgtacctcag

SEQ ID NO: 234681 - DNA, 20 bp, human
gctggcctctgagagtggga

SEQ ID NO: 234682 - DNA, 20 bp, human
gcatcccgttatcagagacc

SEQ ID NO: 234683 - DNA, 20 bp, human
gtctctgataacgggatggg

SEQ ID NO: 234684 - DNA, 20 bp, human
gttccgggccacagcgtcaa

SEQ ID NO: 234685 - DNA, 20 bp, human
ggggcagggcctctgggacg

SEQ ID NO: 234686 - DNA, 20 bp, human
gagggcggggccaagtgaca

SEQ ID NO: 234687 - DNA, 20 bp, human
ggcgcagggacggggaatca

SEQ ID NO: 234688 - DNA, 20 bp, human
gggacggggaatcaggggcg

SEQ ID NO: 234689 - DNA, 20 bp, human
gacggggcgggacgggctct

SEQ ID NO: 234690 - DNA, 20 bp, human
ggcgcgcaggccctgtcact

SEQ ID NO: 234691 - DNA, 20 bp, human
ggcgggacgcgggagaagtc

SEQ ID NO: 234692 - DNA, 20 bp, human
gagcccctcagcggccgcgc

SEQ ID NO: 234693 - DNA, 20 bp, human
ggagccaaggggatgtgtgg

SEQ ID NO: 234694 - DNA, 20 bp, human
ggacagggcctgcgcgccga

SEQ ID NO: 234695 - DNA, 20 bp, human
gggagaagtctggcgcgcgg

SEQ ID NO: 234696 - DNA, 20 bp, human
ggccgtggggtccactctac

SEQ ID NO: 234697 - DNA, 20 bp, human
gggctgggaagtgaccgtcc

SEQ ID NO: 234698 - DNA, 20 bp, human
ggcgcgcccgccacccggag

SEQ ID NO: 234699 - DNA, 20 bp, human
ggcggtagggaaactctcag

SEQ ID NO: 234700 - DNA, 20 bp, human
gagcccgggcgcataacagg

SEQ ID NO: 234701 - DNA, 20 bp, human
gcgggcgcgcactgagagca

SEQ ID NO: 234702 - DNA, 20 bp, human
ggtccggaggtgtcagtctg

SEQ ID NO: 234703 - DNA, 20 bp, human
gcgcctcagactgacacctc

SEQ ID NO: 234704 - DNA, 20 bp, human
gaggggagcgcgctgtccgg

SEQ ID NO: 234705 - DNA, 20 bp, human
gacacgactcgggcgaccat

SEQ ID NO: 234706 - DNA, 20 bp, human
gccggcgggcaggggtttgt

SEQ ID NO: 234707 - DNA, 20 bp, human
gggcgaagcccgaacccatg

SEQ ID NO: 234708 - DNA, 20 bp, human
ggcacagggcgggacatggg

SEQ ID NO: 234709 - DNA, 20 bp, human
ggcgtggagggcggtaaatg

SEQ ID NO: 234710 - DNA, 20 bp, human
gaggagcgcttcccggccgg

SEQ ID NO: 234711 - DNA, 20 bp, human
gcgagcacagggcgggacat

SEQ ID NO: 234712 - DNA, 20 bp, human
gcccgggcaggccaatggga

SEQ ID NO: 234713 - DNA, 20 bp, human
gggccgggaagcgctcctac

SEQ ID NO: 234714 - DNA, 20 bp, human
gaggacgcgaattcgaacat

SEQ ID NO: 234715 - DNA, 20 bp, human
gccgccccgcctccccaacg

SEQ ID NO: 234716 - DNA, 20 bp, human
ggagagacgcttagaggtag

SEQ ID NO: 234717 - DNA, 20 bp, human
gtatctggcctcaaattccc

SEQ ID NO: 234718 - DNA, 20 bp, human
gtagaggtaggggcgtggaa

SEQ ID NO: 234719 - DNA, 20 bp, human
gggcctccgcgatccgtaaa

SEQ ID NO: 234720 - DNA, 20 bp, human
gacctctaagcgtctctcat

SEQ ID NO: 234721 - DNA, 20 bp, human
gacgggaagtgtgagccgat

SEQ ID NO: 234722 - DNA, 20 bp, human
gtccacggcccagccgttta

SEQ ID NO: 234723 - DNA, 20 bp, human
gtccgtaaacggctgggccg

SEQ ID NO: 234724 - DNA, 20 bp, human
gagtgagaagtccggccaat

SEQ ID NO: 234725 - DNA, 20 bp, human
gggtgcagcaaccctcgcct

SEQ ID NO: 234726 - DNA, 20 bp, human
ggatctgcgttggggaacgg

SEQ ID NO: 234727 - DNA, 20 bp, human
ggcaaagccaaggagagcta

SEQ ID NO: 234728 - DNA, 20 bp, human
gagggcggagagcggaatct

SEQ ID NO: 234729 - DNA, 20 bp, human
gccgcgagagaggctcgaga

SEQ ID NO: 234730 - DNA, 20 bp, human
gggcacgtgactccccgcgg

SEQ ID NO: 234731 - DNA, 20 bp, human
gttagccaatccagattcga

SEQ ID NO: 234732 - DNA, 20 bp, human
gtggggccttagcaactcca

SEQ ID NO: 234733 - DNA, 20 bp, human
gaggctcgagacggcagctt

SEQ ID NO: 234734 - DNA, 20 bp, human
gccccaacgcagatcaatcg

SEQ ID NO: 234735 - DNA, 20 bp, human
gctggcgctagggcggagag

SEQ ID NO: 234736 - DNA, 20 bp, human
gccactgagacgtaagtggg

SEQ ID NO: 234737 - DNA, 20 bp, human
gcgcccactgagacgtaagt

SEQ ID NO: 234738 - DNA, 20 bp, human
gtgggcgccctaacgaaccc

SEQ ID NO: 234739 - DNA, 20 bp, human
gtaaactgagggtacggagt

SEQ ID NO: 234740 - DNA, 20 bp, human
gaccgagaggagcgttctct

SEQ ID NO: 234741 - DNA, 20 bp, human
gccggctagccggacgccct

SEQ ID NO: 234742 - DNA, 20 bp, human
gccctaacgaacccgggata

SEQ ID NO: 234743 - DNA, 20 bp, human
gtaggaacagaccgtatccc

SEQ ID NO: 234744 - DNA, 20 bp, human
gttcaaggggcataaactga

SEQ ID NO: 234745 - DNA, 20 bp, human
ggcctagagaacgctcctct

SEQ ID NO: 234746 - DNA, 20 bp, human
gcggcggggaggaacaggaa

SEQ ID NO: 234747 - DNA, 20 bp, human
gagtgggcgagtctaggaat

SEQ ID NO: 234748 - DNA, 20 bp, human
ggaaggcggcggggaggaac

SEQ ID NO: 234749 - DNA, 20 bp, human
gtctaggaatcggtccgcga

SEQ ID NO: 234750 - DNA, 20 bp, human
gtccgctcgcggggaaggct

SEQ ID NO: 234751 - DNA, 20 bp, human
gaagtgcggccgaaaggaga

SEQ ID NO: 234752 - DNA, 20 bp, human
gagacgctgacgtcaccgtg

SEQ ID NO: 234753 - DNA, 20 bp, human
gtctctgggcccccactgag

SEQ ID NO: 234754 - DNA, 20 bp, human
gtaagagcctggggacgagt

SEQ ID NO: 234755 - DNA, 20 bp, human
gacaaggagtgggcgagtct

SEQ ID NO: 234756 - DNA, 20 bp, human
gcgcggggcgagtgcccagg

SEQ ID NO: 234757 - DNA, 20 bp, human
gacccgcggggcgagtgccc

SEQ ID NO: 234758 - DNA, 20 bp, human
gaagacccagggtctgtgtc

SEQ ID NO: 234759 - DNA, 20 bp, human
ggccccacccacaacgctcg

SEQ ID NO: 234760 - DNA, 20 bp, human
ggggccgcgcctcgcctcct

SEQ ID NO: 234761 - DNA, 20 bp, human
gggtgcgcgccgcccacccg

SEQ ID NO: 234762 - DNA, 20 bp, human
gcccaggatgcggcaggact

SEQ ID NO: 234763 - DNA, 20 bp, human
gcaccgcgagcgttgtgggt

SEQ ID NO: 234764 - DNA, 20 bp, human
gcgtgcgctaggcagcagcg

SEQ ID NO: 234765 - DNA, 20 bp, human
gagcacggccggcagggggg

SEQ ID NO: 234766 - DNA, 20 bp, human
gcatcccgcacggcgcggcg

SEQ ID NO: 234767 - DNA, 20 bp, human
ggtacggtcagcatcccgca

SEQ ID NO: 234768 - DNA, 20 bp, human
ggcgaagccggcctgatcgc

SEQ ID NO: 234769 - DNA, 20 bp, human
ggccgcctggcgctgcacct

SEQ ID NO: 234770 - DNA, 20 bp, human
ggatgctgaccgtacccagg

SEQ ID NO: 234771 - DNA, 20 bp, human
gccggcttcgcagtaggtgg

SEQ ID NO: 234772 - DNA, 20 bp, human
gggcccggccgccaattgga

SEQ ID NO: 234773 - DNA, 20 bp, human
gtcgccccgagccgtccaat

SEQ ID NO: 234774 - DNA, 20 bp, human
gcgggatgctgaccgtaccc

SEQ ID NO: 234775 - DNA, 20 bp, human
gcaggccacgccgcgccgtg

SEQ ID NO: 234776 - DNA, 20 bp, human
gctaccactagcctcagcga

SEQ ID NO: 234777 - DNA, 20 bp, human
ggctccctgcgcaagccgga

SEQ ID NO: 234778 - DNA, 20 bp, human
ggcaccacgcgtgaaacgtg

SEQ ID NO: 234779 - DNA, 20 bp, human
gagccttctgggcacccctc

SEQ ID NO: 234780 - DNA, 20 bp, human
gcggcttgcgcagggagcaa

SEQ ID NO: 234781 - DNA, 20 bp, human
gcacccctccggcttgcgca

SEQ ID NO: 234782 - DNA, 20 bp, human
gcccccaattcccccagcga

SEQ ID NO: 234783 - DNA, 20 bp, human
gccgccctcctccctcgctt

SEQ ID NO: 234784 - DNA, 20 bp, human
gccctcctccctcgcttcgg

SEQ ID NO: 234785 - DNA, 20 bp, human
gaggctagtggtagccttct

SEQ ID NO: 234786 - DNA, 20 bp, human
gccggaggggcggagagagt

SEQ ID NO: 234787 - DNA, 20 bp, human
gagccactgacccgcggggc

SEQ ID NO: 234788 - DNA, 20 bp, human
gcgcccgccccgcgggtcag

SEQ ID NO: 234789 - DNA, 20 bp, human
gcgccaccaagcgaccggag

SEQ ID NO: 234790 - DNA, 20 bp, human
gaggatgcctgtcaaccaat

SEQ ID NO: 234791 - DNA, 20 bp, human
gcagcagccactgacccgcg

SEQ ID NO: 234792 - DNA, 20 bp, human
gggctgctgcttacagaggg

SEQ ID NO: 234793 - DNA, 20 bp, human
ggccacagggcccatcccgt

SEQ ID NO: 234794 - DNA, 20 bp, human
gcgcccctccggtcgcttgg

SEQ ID NO: 234795 - DNA, 20 bp, human
ggaacctgctaacggaactt

SEQ ID NO: 234796 - DNA, 20 bp, human
ggttgcacacaacgaagatg

SEQ ID NO: 234797 - DNA, 20 bp, human
gcatgcttaggtcctcgtag

SEQ ID NO: 234798 - DNA, 20 bp, human
gtgctcacatatgtctatct

SEQ ID NO: 234799 - DNA, 20 bp, human
gcccatgtataggagatggt

SEQ ID NO: 234800 - DNA, 20 bp, human
gtcttcgttgtgtgcaacac

SEQ ID NO: 234801 - DNA, 20 bp, human
gcaccaccttgtcactgcag

SEQ ID NO: 234802 - DNA, 20 bp, human
gcaaacccatgtataggaga

SEQ ID NO: 234803 - DNA, 20 bp, human
ggacctccaaacccatgtat

SEQ ID NO: 234804 - DNA, 20 bp, human
gaatccattcttgggactca

SEQ ID NO: 234805 - DNA, 20 bp, human
gttgtccaaacacatacttt

SEQ ID NO: 234806 - DNA, 20 bp, human
gggcctgcgaggggagtgtt

SEQ ID NO: 234807 - DNA, 20 bp, human
gcacccaacactcccctcgc

SEQ ID NO: 234808 - DNA, 20 bp, human
gcaggcccagatgccgaggg

SEQ ID NO: 234809 - DNA, 20 bp, human
gtcgcaggcccagatgccga

SEQ ID NO: 234810 - DNA, 20 bp, human
ggcggcctggagggactagt

SEQ ID NO: 234811 - DNA, 20 bp, human
ggcccagatgccgagggcgg

SEQ ID NO: 234812 - DNA, 20 bp, human
ggcctccgccctcggcatct

SEQ ID NO: 234813 - DNA, 20 bp, human
gcggcgtggtgacgtcaggg

SEQ ID NO: 234814 - DNA, 20 bp, human
gcgcgccaactagtccctcc

SEQ ID NO: 234815 - DNA, 20 bp, human
ggaagcggcccagaacccgg

SEQ ID NO: 234816 - DNA, 20 bp, human
ggaagagtcccagccccgct

SEQ ID NO: 234817 - DNA, 20 bp, human
gtctgtccctagcggaggcg

SEQ ID NO: 234818 - DNA, 20 bp, human
gccggcaccgcggagtcccc

SEQ ID NO: 234819 - DNA, 20 bp, human
ggggcgggctcgttacccag

SEQ ID NO: 234820 - DNA, 20 bp, human
gggcacccgcgcctccgcta

SEQ ID NO: 234821 - DNA, 20 bp, human
gtggtcgcgggccgaaccaa

SEQ ID NO: 234822 - DNA, 20 bp, human
gccggaacctggcgcgggtg

SEQ ID NO: 234823 - DNA, 20 bp, human
gtaacgccgacgccggaacc

SEQ ID NO: 234824 - DNA, 20 bp, human
gccgtcgcgtgccattggtt

SEQ ID NO: 234825 - DNA, 20 bp, human
ggacagacatgcttccgggt

SEQ ID NO: 234826 - DNA, 20 bp, human
gggtgcacggagtgggagta

SEQ ID NO: 234827 - DNA, 20 bp, human
gcacacccccggcctctcac

SEQ ID NO: 234828 - DNA, 20 bp, human
gaggcagcgcgtcgcctccg

SEQ ID NO: 234829 - DNA, 20 bp, human
gtggagaaccactcgcctca

SEQ ID NO: 234830 - DNA, 20 bp, human
gcaccggagccgcgattttc

SEQ ID NO: 234831 - DNA, 20 bp, human
gcggagcccggtgcacggag

SEQ ID NO: 234832 - DNA, 20 bp, human
gacccgggctccggttgccc

SEQ ID NO: 234833 - DNA, 20 bp, human
gcgggggtgtggtagagaga

SEQ ID NO: 234834 - DNA, 20 bp, human
gccctccccccggcgggccg

SEQ ID NO: 234835 - DNA, 20 bp, human
gcccaggtaacgcaggacgc

SEQ ID NO: 234836 - DNA, 20 bp, human
gggcctcgcagcctgacccg

SEQ ID NO: 234837 - DNA, 20 bp, human
gccgcccacgcgccgcttgg

SEQ ID NO: 234838 - DNA, 20 bp, human
gggggcgccaacgctcaatc

SEQ ID NO: 234839 - DNA, 20 bp, human
ggaggcaagtaacaacccgg

SEQ ID NO: 234840 - DNA, 20 bp, human
gggtgtagcgaggtgcattc

SEQ ID NO: 234841 - DNA, 20 bp, human
ggaccgttgggcggtggagt

SEQ ID NO: 234842 - DNA, 20 bp, human
gtcacgtgaccgttgggcgg

SEQ ID NO: 234843 - DNA, 20 bp, human
gttggctgttaactcggcta

SEQ ID NO: 234844 - DNA, 20 bp, human
gggcgcgtcacgtgaccgtt

SEQ ID NO: 234845 - DNA, 20 bp, human
gagcgttggcgccccgggtc

SEQ ID NO: 234846 - DNA, 20 bp, human
gcggaggcggtggtgaaaaa

SEQ ID NO: 234847 - DNA, 20 bp, human
gggcgcctcccaatgacaag

SEQ ID NO: 234848 - DNA, 20 bp, human
ggcagcgcatgccgggtcta

SEQ ID NO: 234849 - DNA, 20 bp, human
gtgcgcaagagcgaggccga

SEQ ID NO: 234850 - DNA, 20 bp, human
ggctccgcgccgcttgtcat

SEQ ID NO: 234851 - DNA, 20 bp, human
gaggtcggctcggaaggaaa

SEQ ID NO: 234852 - DNA, 20 bp, human
gtgtcattgggaggcgccga

SEQ ID NO: 234853 - DNA, 20 bp, human
gcgcgccgcttgtcattggg

SEQ ID NO: 234854 - DNA, 20 bp, human
gggaggcgccgaaggtggag

SEQ ID NO: 234855 - DNA, 20 bp, human
ggttggcggggcgaaggggt

SEQ ID NO: 234856 - DNA, 20 bp, human
gtgccctggaagcagatcgg

SEQ ID NO: 234857 - DNA, 20 bp, human
ggggtcgcgggagacgtcgt

SEQ ID NO: 234858 - DNA, 20 bp, human
gagcgatcccacaaccgcgc

SEQ ID NO: 234859 - DNA, 20 bp, human
gcggttgtgggatcgctccc

SEQ ID NO: 234860 - DNA, 20 bp, human
gggcggccgcggggaggttc

SEQ ID NO: 234861 - DNA, 20 bp, human
gcgcgccgcgaggagtccgg

SEQ ID NO: 234862 - DNA, 20 bp, human
gcgcagccccgcgcggttgt

SEQ ID NO: 234863 - DNA, 20 bp, human
gccgctgcccgcccgctcgt

SEQ ID NO: 234864 - DNA, 20 bp, human
gcggccgccgatctgcttcc

SEQ ID NO: 234865 - DNA, 20 bp, human
gcgagagaggagcggccccc

SEQ ID NO: 234866 - DNA, 20 bp, human
gccaaccggaacgcgacctg

SEQ ID NO: 234867 - DNA, 20 bp, human
ggggcagcaggtcacgtgcc

SEQ ID NO: 234868 - DNA, 20 bp, human
ggacctgcggtcacctggtt

SEQ ID NO: 234869 - DNA, 20 bp, human
gctggccggtgcctgccaac

SEQ ID NO: 234870 - DNA, 20 bp, human
ggccttcagtcggtaggcgg

SEQ ID NO: 234871 - DNA, 20 bp, human
gaacgcgacctgcggtcacc

SEQ ID NO: 234872 - DNA, 20 bp, human
gccagcggccttcagtcggt

SEQ ID NO: 234873 - DNA, 20 bp, human
gacgccgctatcccagactc

SEQ ID NO: 234874 - DNA, 20 bp, human
gccgcgctctctcccggcag

SEQ ID NO: 234875 - DNA, 20 bp, human
gggggaactctgaccatgat

SEQ ID NO: 234876 - DNA, 20 bp, human
gcgggcgcgcaatgcacctc

SEQ ID NO: 234877 - DNA, 20 bp, human
gatggaggacgtaatgctta

SEQ ID NO: 234878 - DNA, 20 bp, human
ggcgcaatgcacctcgggga

SEQ ID NO: 234879 - DNA, 20 bp, human
ggtgcattgcgcgcccgcga

SEQ ID NO: 234880 - DNA, 20 bp, human
gacttccggtggttgattcc

SEQ ID NO: 234881 - DNA, 20 bp, human
gcagaacactaccatccccg

SEQ ID NO: 234882 - DNA, 20 bp, human
gctgagaggtggagtcgggg

SEQ ID NO: 234883 - DNA, 20 bp, human
gaatcaaccaccggaagtgc

SEQ ID NO: 234884 - DNA, 20 bp, human
gtagaataggaacacccctc

SEQ ID NO: 234885 - DNA, 20 bp, human
gcaaggaagactacgtttcc

SEQ ID NO: 234886 - DNA, 20 bp, human
gtgcgcctcctgcccggcag

SEQ ID NO: 234887 - DNA, 20 bp, human
ggcggcctgcgctccacttc

SEQ ID NO: 234888 - DNA, 20 bp, human
gccggctcccggatgttgtg

SEQ ID NO: 234889 - DNA, 20 bp, human
gagcaactggaagtggtcgc

SEQ ID NO: 234890 - DNA, 20 bp, human
gcaggcgggactacgcgtca

SEQ ID NO: 234891 - DNA, 20 bp, human
gcgggcggctgcgggaagct

SEQ ID NO: 234892 - DNA, 20 bp, human
gcactcccgaagtggagcgc

SEQ ID NO: 234893 - DNA, 20 bp, human
gagaactaccactcccgaag

SEQ ID NO: 234894 - DNA, 20 bp, human
ggcagccggcaggcggtgac

SEQ ID NO: 234895 - DNA, 20 bp, human
ggcagatccccacaacatcc

SEQ ID NO: 234896 - DNA, 20 bp, human
gcccagggccaagactcaag

SEQ ID NO: 234897 - DNA, 20 bp, human
gccaggaagtggccactggt

SEQ ID NO: 234898 - DNA, 20 bp, human
ggggcaggtgaagctgagtt

SEQ ID NO: 234899 - DNA, 20 bp, human
gtggccacaacgcccaccag

SEQ ID NO: 234900 - DNA, 20 bp, human
gaaaatcctcgcagttaact

SEQ ID NO: 234901 - DNA, 20 bp, human
gcctgcccccaattccctta

SEQ ID NO: 234902 - DNA, 20 bp, human
ggcttccaggaagtggccac

SEQ ID NO: 234903 - DNA, 20 bp, human
gggtgaagctgagttgggtg

SEQ ID NO: 234904 - DNA, 20 bp, human
gcccaccaaacctcagagag

SEQ ID NO: 234905 - DNA, 20 bp, human
gtggccactggtgggcgttg

SEQ ID NO: 234906 - DNA, 20 bp, human
gaggtggggattagggtcta

SEQ ID NO: 234907 - DNA, 20 bp, human
gagtgaggacagggaaccta

SEQ ID NO: 234908 - DNA, 20 bp, human
ggggccacaggagtgaggac

SEQ ID NO: 234909 - DNA, 20 bp, human
gagagagtgaagtcttttgg

SEQ ID NO: 234910 - DNA, 20 bp, human
gacaagagagtgaagtcttt

SEQ ID NO: 234911 - DNA, 20 bp, human
gatgctctaggagtggtgct

SEQ ID NO: 234912 - DNA, 20 bp, human
gggaaggcaaattatgctct

SEQ ID NO: 234913 - DNA, 20 bp, human
gaactactagcgggacagga

SEQ ID NO: 234914 - DNA, 20 bp, human
ggcaaattatgctctaggag

SEQ ID NO: 234915 - DNA, 20 bp, human
ggtgaagaaagaacgggctt

SEQ ID NO: 234916 - DNA, 20 bp, human
gaaacaggagcagatgtaca

SEQ ID NO: 234917 - DNA, 20 bp, human
gaagtgaaggcggagataca

SEQ ID NO: 234918 - DNA, 20 bp, human
ggctcagagtcgttagaaac

SEQ ID NO: 234919 - DNA, 20 bp, human
gagtcaggaacattgtacat

SEQ ID NO: 234920 - DNA, 20 bp, human
gaccaataccctttattctc

SEQ ID NO: 234921 - DNA, 20 bp, human
ggcaaccttgagtgtgagtc

SEQ ID NO: 234922 - DNA, 20 bp, human
gggagatacagggcaactaa

SEQ ID NO: 234923 - DNA, 20 bp, human
gttcaaaattaatcctattc

SEQ ID NO: 234924 - DNA, 20 bp, human
ggtatcatggattcagaatc

SEQ ID NO: 234925 - DNA, 20 bp, human
gtttgcctgactcacactca

SEQ ID NO: 234926 - DNA, 20 bp, human
gcaggtgactggttagtatg

SEQ ID NO: 234927 - DNA, 20 bp, human
gttaggggctctccacccat

SEQ ID NO: 234928 - DNA, 20 bp, human
gtggcattgctcatttttag

SEQ ID NO: 234929 - DNA, 20 bp, human
gctaattgcaaggatttctc

SEQ ID NO: 234930 - DNA, 20 bp, human
gtaaagcagcactaattgca

SEQ ID NO: 234931 - DNA, 20 bp, human
gcaaggatttctcaggtgac

SEQ ID NO: 234932 - DNA, 20 bp, human
gactaatgtctgtgatctga

SEQ ID NO: 234933 - DNA, 20 bp, human
ggctcatttttagtggtggg

SEQ ID NO: 234934 - DNA, 20 bp, human
ggtgacgcctaagctatcac

SEQ ID NO: 234935 - DNA, 20 bp, human
ggctatcactggacatatca

SEQ ID NO: 234936 - DNA, 20 bp, human
gagtcatttcccaagaccga

SEQ ID NO: 234937 - DNA, 20 bp, human
gggagataactcgtgctcac

SEQ ID NO: 234938 - DNA, 20 bp, human
gaacttagtacagttgggtg

SEQ ID NO: 234939 - DNA, 20 bp, human
gaggacccggtgcctttcaa

SEQ ID NO: 234940 - DNA, 20 bp, human
gggggttttttgatagaagt

SEQ ID NO: 234941 - DNA, 20 bp, human
gcttcttggccttcggtctt

SEQ ID NO: 234942 - DNA, 20 bp, human
ggaagccacgcacccttgaa

SEQ ID NO: 234943 - DNA, 20 bp, human
gcacttgaacttagtacagt

SEQ ID NO: 234944 - DNA, 20 bp, human
gggtgcctttcaagggtgcg

SEQ ID NO: 234945 - DNA, 20 bp, human
gggcacatcttcttggcctt

SEQ ID NO: 234946 - DNA, 20 bp, human
gaagctagagaatagatctc

SEQ ID NO: 234947 - DNA, 20 bp, human
gtggtctgaaggtttattta

SEQ ID NO: 234948 - DNA, 20 bp, human
gctaacagattctgtgtagt

SEQ ID NO: 234949 - DNA, 20 bp, human
ggaatagatctctggtctga

SEQ ID NO: 234950 - DNA, 20 bp, human
ggggtgggataggggatacg

SEQ ID NO: 234951 - DNA, 20 bp, human
ggtggtgagcatctgtgtgg

SEQ ID NO: 234952 - DNA, 20 bp, human
gataggggatacggggagag

SEQ ID NO: 234953 - DNA, 20 bp, human
gaaatcattaagtgtattga

SEQ ID NO: 234954 - DNA, 20 bp, human
gtaaatgtagagggggatcc

SEQ ID NO: 234955 - DNA, 20 bp, human
gccccctctacatttaaagt

SEQ ID NO: 234956 - DNA, 20 bp, human
ggggctcagtggcccttctg

SEQ ID NO: 234957 - DNA, 20 bp, human
ggacgggcatggctatttct

SEQ ID NO: 234958 - DNA, 20 bp, human
gaatctctgggtgacgatgc

SEQ ID NO: 234959 - DNA, 20 bp, human
gctcctcggcttccgtggac

SEQ ID NO: 234960 - DNA, 20 bp, human
gcgggcacctaatcttcatg

SEQ ID NO: 234961 - DNA, 20 bp, human
gaaatagccatgcccgtcca

SEQ ID NO: 234962 - DNA, 20 bp, human
ggccgaggagcagcgcctga

SEQ ID NO: 234963 - DNA, 20 bp, human
gaggtgcccgcttttgattg

SEQ ID NO: 234964 - DNA, 20 bp, human
gcgctgctcctcggcttccg

SEQ ID NO: 234965 - DNA, 20 bp, human
gtatttctcggaaccctctg

SEQ ID NO: 234966 - DNA, 20 bp, human
gaaggaggcagcagtgtggc

SEQ ID NO: 234967 - DNA, 20 bp, human
gagaaaggagacaaataagg

SEQ ID NO: 234968 - DNA, 20 bp, human
gaagatgggttgatgtaact

SEQ ID NO: 234969 - DNA, 20 bp, human
gcagcacaccacccagtgta

SEQ ID NO: 234970 - DNA, 20 bp, human
gccttcacccatacactggg

SEQ ID NO: 234971 - DNA, 20 bp, human
gggccacagattgtagaaaa

SEQ ID NO: 234972 - DNA, 20 bp, human
gcctccttcacccatacact

SEQ ID NO: 234973 - DNA, 20 bp, human
gggcagcagtgtggccggag

SEQ ID NO: 234974 - DNA, 20 bp, human
gtagggtatgccttcttttg

SEQ ID NO: 234975 - DNA, 20 bp, human
gcacacttcagatcacagaa

SEQ ID NO: 234976 - DNA, 20 bp, human
gttctgccaggcagcgcagg

SEQ ID NO: 234977 - DNA, 20 bp, human
gggtgacagtcgctggtcat

SEQ ID NO: 234978 - DNA, 20 bp, human
gaaggggccctgcatgagtc

SEQ ID NO: 234979 - DNA, 20 bp, human
ggacagagggtgacagtcgc

SEQ ID NO: 234980 - DNA, 20 bp, human
gttctccgacaacttaaaag

SEQ ID NO: 234981 - DNA, 20 bp, human
gggccctgcatgagtcaggg

SEQ ID NO: 234982 - DNA, 20 bp, human
gcctggcagaatctagatga

SEQ ID NO: 234983 - DNA, 20 bp, human
ggccctccctgactcatgca

SEQ ID NO: 234984 - DNA, 20 bp, human
gcaggccatgggttagatgt

SEQ ID NO: 234985 - DNA, 20 bp, human
gtctgcccctttatctctga

SEQ ID NO: 234986 - DNA, 20 bp, human
gcctccactgactcatctag

SEQ ID NO: 234987 - DNA, 20 bp, human
gaagcccgctctgactgtca

SEQ ID NO: 234988 - DNA, 20 bp, human
gtctccctgacagtcagagc

SEQ ID NO: 234989 - DNA, 20 bp, human
gcgacctctagatgagtcag

SEQ ID NO: 234990 - DNA, 20 bp, human
gggacagcgtccgggagaag

SEQ ID NO: 234991 - DNA, 20 bp, human
gtaaacgtggacttaaactc

SEQ ID NO: 234992 - DNA, 20 bp, human
gatctagaggtcgagtctcg

SEQ ID NO: 234993 - DNA, 20 bp, human
ggaaccgtgaagagtgtggt

SEQ ID NO: 234994 - DNA, 20 bp, human
gctgctgttcccgtcagggg

SEQ ID NO: 234995 - DNA, 20 bp, human
gaaaacacgtaagtgtcttt

SEQ ID NO: 234996 - DNA, 20 bp, human
gaaatgagatcgtaaggctg

SEQ ID NO: 234997 - DNA, 20 bp, human
gctcacacctagtcacctaa

SEQ ID NO: 234998 - DNA, 20 bp, human
gagagaaggcagtctcttga

SEQ ID NO: 234999 - DNA, 20 bp, human
gaggtgactaggtgtgaggg

SEQ ID NO: 235000 - DNA, 20 bp, human
gggtgtgtattcctctacct

SEQ ID NO: 235001 - DNA, 20 bp, human
gactggtgtctcctaggtag

SEQ ID NO: 235002 - DNA, 20 bp, human
gtgggaggatacctccagag

SEQ ID NO: 235003 - DNA, 20 bp, human
gcacctagtcacctaaaggg

SEQ ID NO: 235004 - DNA, 20 bp, human
gaccaaggtgcccacaagtc

SEQ ID NO: 235005 - DNA, 20 bp, human
gtccatctgctgtttgtagt

SEQ ID NO: 235006 - DNA, 20 bp, human
gctggtggggtagcccaaga

SEQ ID NO: 235007 - DNA, 20 bp, human
ggagagaagtcagccttgtc

SEQ ID NO: 235008 - DNA, 20 bp, human
gcccctgcctgtgttgtcac

SEQ ID NO: 235009 - DNA, 20 bp, human
gcaaggctgacttctctcga

SEQ ID NO: 235010 - DNA, 20 bp, human
gaccccaccagtgacaacac

SEQ ID NO: 235011 - DNA, 20 bp, human
gacagctgcttacagggaat

SEQ ID NO: 235012 - DNA, 20 bp, human
ggacagcacagctgcttaca

SEQ ID NO: 235013 - DNA, 20 bp, human
ggcctgtgttgtcactggtg

SEQ ID NO: 235014 - DNA, 20 bp, human
gcccgataacaacacgagaa

SEQ ID NO: 235015 - DNA, 20 bp, human
gacctctggcaagcctgaca

SEQ ID NO: 235016 - DNA, 20 bp, human
ggagaactgccaagacgctc

SEQ ID NO: 235017 - DNA, 20 bp, human
gtagcaaggaagtgatgtca

SEQ ID NO: 235018 - DNA, 20 bp, human
ggccacaagccagagcgtct

SEQ ID NO: 235019 - DNA, 20 bp, human
ggtaccagctactgtcagca

SEQ ID NO: 235020 - DNA, 20 bp, human
gttctggccttctgagataa

SEQ ID NO: 235021 - DNA, 20 bp, human
gggtgagaggccgcattaga

SEQ ID NO: 235022 - DNA, 20 bp, human
ggtcacagggaaatcaaagg

SEQ ID NO: 235023 - DNA, 20 bp, human
ggacactctgagtaggtaac

SEQ ID NO: 235024 - DNA, 20 bp, human
ggggtcctgaccctctaatg

SEQ ID NO: 235025 - DNA, 20 bp, human
gttagagggtcaggaccctc

SEQ ID NO: 235026 - DNA, 20 bp, human
gctaccaagcgggagctgga

SEQ ID NO: 235027 - DNA, 20 bp, human
gttaaaaggaagcggggctt

SEQ ID NO: 235028 - DNA, 20 bp, human
ggcgctgcgcgctgacaaag

SEQ ID NO: 235029 - DNA, 20 bp, human
ggagctggaggggaatccgc

SEQ ID NO: 235030 - DNA, 20 bp, human
gagacctggcgagacctgca

SEQ ID NO: 235031 - DNA, 20 bp, human
gaggtgcaacaccgctgcgt

SEQ ID NO: 235032 - DNA, 20 bp, human
gacgccgggtcgagggagcc

SEQ ID NO: 235033 - DNA, 20 bp, human
gggcgctaccaagcgggagc

SEQ ID NO: 235034 - DNA, 20 bp, human
ggaggggaatccgcgggacc

SEQ ID NO: 235035 - DNA, 20 bp, human
gtcgcgcggcgcaggttctg

SEQ ID NO: 235036 - DNA, 20 bp, human
ggaaagccgaggggttacta

SEQ ID NO: 235037 - DNA, 20 bp, human
gcaggcgcactcgggccgtc

SEQ ID NO: 235038 - DNA, 20 bp, human
gtggggacgtcgtcctagtg

SEQ ID NO: 235039 - DNA, 20 bp, human
ggctcaggctcgggcttcgg

SEQ ID NO: 235040 - DNA, 20 bp, human
gcagccggtggtaaaaccgc

SEQ ID NO: 235041 - DNA, 20 bp, human
ggcggccgccggctctatga

SEQ ID NO: 235042 - DNA, 20 bp, human
gccaccgtcagcttcgccag

SEQ ID NO: 235043 - DNA, 20 bp, human
gtagtggggaagagcgacag

SEQ ID NO: 235044 - DNA, 20 bp, human
ggtcagcttcgccagaggga

SEQ ID NO: 235045 - DNA, 20 bp, human
gggagctcaggctcgggctt

SEQ ID NO: 235046 - DNA, 20 bp, human
gagggggcgggtcccggcga

SEQ ID NO: 235047 - DNA, 20 bp, human
gcgggggcggcctcacccgg

SEQ ID NO: 235048 - DNA, 20 bp, human
gccggggctgctggggtcga

SEQ ID NO: 235049 - DNA, 20 bp, human
ggggctgctcagtgggcgga

SEQ ID NO: 235050 - DNA, 20 bp, human
gccgaggagggctgctcagt

SEQ ID NO: 235051 - DNA, 20 bp, human
gccgccgcgacgtttaaacc

SEQ ID NO: 235052 - DNA, 20 bp, human
gcccgtgatcgggtggtcct

SEQ ID NO: 235053 - DNA, 20 bp, human
gccctgctcccgtccgggcg

SEQ ID NO: 235054 - DNA, 20 bp, human
gggaccgcacgcctagctca

SEQ ID NO: 235055 - DNA, 20 bp, human
gggaggctccgggactgagg

SEQ ID NO: 235056 - DNA, 20 bp, human
gcaagcgcggcctttataca

SEQ ID NO: 235057 - DNA, 20 bp, human
gaggatgcgtgcgtggaatc

SEQ ID NO: 235058 - DNA, 20 bp, human
gatacaaggaggagtgtggt

SEQ ID NO: 235059 - DNA, 20 bp, human
gggcggggcggcttggaggg

SEQ ID NO: 235060 - DNA, 20 bp, human
gctgggcggggcggcttgga

SEQ ID NO: 235061 - DNA, 20 bp, human
gtggaatccggcggacgcag

SEQ ID NO: 235062 - DNA, 20 bp, human
gcacactcctccttgtataa

SEQ ID NO: 235063 - DNA, 20 bp, human
gaaggccaggtcagcacggt

SEQ ID NO: 235064 - DNA, 20 bp, human
gtgcgcggagtgtgactgtg

SEQ ID NO: 235065 - DNA, 20 bp, human
gaagcactaggatggactgg

SEQ ID NO: 235066 - DNA, 20 bp, human
gcgcaggcgcgagcctcacg

SEQ ID NO: 235067 - DNA, 20 bp, human
gggcggccaggcaaggtcag

SEQ ID NO: 235068 - DNA, 20 bp, human
gtagtccaggggacggctag

SEQ ID NO: 235069 - DNA, 20 bp, human
gcgaagcggaggcggagctt

SEQ ID NO: 235070 - DNA, 20 bp, human
gcgcgagcctcacggggcta

SEQ ID NO: 235071 - DNA, 20 bp, human
gcggtccccgtagccccgtg

SEQ ID NO: 235072 - DNA, 20 bp, human
gcaggcaaggtcagtggagg

SEQ ID NO: 235073 - DNA, 20 bp, human
ggaggccggatcaggcggtg

SEQ ID NO: 235074 - DNA, 20 bp, human
gaagactggcgtcactgcgt

SEQ ID NO: 235075 - DNA, 20 bp, human
gaagcagcaaatgtagtcca

SEQ ID NO: 235076 - DNA, 20 bp, human
gacgccccctccagtgtgaa

SEQ ID NO: 235077 - DNA, 20 bp, human
gggccccgccccccgaagta

SEQ ID NO: 235078 - DNA, 20 bp, human
gccgctccagaacaaagagg

SEQ ID NO: 235079 - DNA, 20 bp, human
gaaagaggcggctgccgcgc

SEQ ID NO: 235080 - DNA, 20 bp, human
ggcgcgggttgccatagaaa

SEQ ID NO: 235081 - DNA, 20 bp, human
ggccacacgccctacttcgg

SEQ ID NO: 235082 - DNA, 20 bp, human
gaaaatgggacgcctgctgg

SEQ ID NO: 235083 - DNA, 20 bp, human
ggctgcgtttccggcccgtg

SEQ ID NO: 235084 - DNA, 20 bp, human
gcgtggggctccaatcaaaa

SEQ ID NO: 235085 - DNA, 20 bp, human
gggcagccgcctctttgttc

SEQ ID NO: 235086 - DNA, 20 bp, human
gcacgacgaaggcactggga

SEQ ID NO: 235087 - DNA, 20 bp, human
ggacagagagcgcacgacga

SEQ ID NO: 235088 - DNA, 20 bp, human
gcgggactaaggctgtcaat

SEQ ID NO: 235089 - DNA, 20 bp, human
gcgcatgtgtgtcaactcta

SEQ ID NO: 235090 - DNA, 20 bp, human
gagcgcacgacgaaggcact

SEQ ID NO: 235091 - DNA, 20 bp, human
ggcagcgcgaacgtcggcgc

SEQ ID NO: 235092 - DNA, 20 bp, human
gtgtctggccgttcttgcgt

SEQ ID NO: 235093 - DNA, 20 bp, human
gccgacgttcgcgctgcacg

SEQ ID NO: 235094 - DNA, 20 bp, human
gggcgcaggcgccaaggctc

SEQ ID NO: 235095 - DNA, 20 bp, human
gctggccgttcttgcgtagg

SEQ ID NO: 235096 - DNA, 20 bp, human
gcgggcgaggaggatgcgtg

SEQ ID NO: 235097 - DNA, 20 bp, human
gggcgctggcgtgacgtagg

SEQ ID NO: 235098 - DNA, 20 bp, human
gtggcgagattgtacgcccg

SEQ ID NO: 235099 - DNA, 20 bp, human
ggcgaggaggatgcgtgcgg

SEQ ID NO: 235100 - DNA, 20 bp, human
gtgtgggtgaagagcgccgg

SEQ ID NO: 235101 - DNA, 20 bp, human
gaggctgtccgctgcgcgcc

SEQ ID NO: 235102 - DNA, 20 bp, human
gctcctcgcccggcgcgcag

SEQ ID NO: 235103 - DNA, 20 bp, human
ggcgtacaatctcgccagcc

SEQ ID NO: 235104 - DNA, 20 bp, human
gtcttcacccacagcgcccc

SEQ ID NO: 235105 - DNA, 20 bp, human
ggggacctcatagccgtgca

SEQ ID NO: 235106 - DNA, 20 bp, human
ggattccagaagatactgtc

SEQ ID NO: 235107 - DNA, 20 bp, human
gttatccaggaagccgggga

SEQ ID NO: 235108 - DNA, 20 bp, human
gcacgccagacagtatcttc

SEQ ID NO: 235109 - DNA, 20 bp, human
gcactccggctccgagaaga

SEQ ID NO: 235110 - DNA, 20 bp, human
gttcctgggggcatgagaag

SEQ ID NO: 235111 - DNA, 20 bp, human
gttctggaatcggcggcctt

SEQ ID NO: 235112 - DNA, 20 bp, human
gccggctccgagaagatggt

SEQ ID NO: 235113 - DNA, 20 bp, human
gcagtatcttctggaatcgg

SEQ ID NO: 235114 - DNA, 20 bp, human
ggaggtttgaagacacttag

SEQ ID NO: 235115 - DNA, 20 bp, human
gcggcttggcgggttcctgg

SEQ ID NO: 235116 - DNA, 20 bp, human
gaggccgaggcgcgaagggt

SEQ ID NO: 235117 - DNA, 20 bp, human
gtggccgggaggaactatcc

SEQ ID NO: 235118 - DNA, 20 bp, human
gcccgtgcgcgatgacgaca

SEQ ID NO: 235119 - DNA, 20 bp, human
gcacgggaggagcttgttcc

SEQ ID NO: 235120 - DNA, 20 bp, human
gacgacctgtggcccaatgg

SEQ ID NO: 235121 - DNA, 20 bp, human
gagctccaacgccggaacca

SEQ ID NO: 235122 - DNA, 20 bp, human
gtcgtccggcgcccgctcat

SEQ ID NO: 235123 - DNA, 20 bp, human
gcgcgatgacgacaaggccg

SEQ ID NO: 235124 - DNA, 20 bp, human
gacctgtggcccaatggcgg

SEQ ID NO: 235125 - DNA, 20 bp, human
gtcccggaccgtgtgctcga

SEQ ID NO: 235126 - DNA, 20 bp, human
gtccgcctccgcccggactc

SEQ ID NO: 235127 - DNA, 20 bp, human
gttccctgccggagtccggg

SEQ ID NO: 235128 - DNA, 20 bp, human
gctccgcccggactccggca

SEQ ID NO: 235129 - DNA, 20 bp, human
ggaggcggaggacgccatct

SEQ ID NO: 235130 - DNA, 20 bp, human
gaaatcaggaagaattgcgg

SEQ ID NO: 235131 - DNA, 20 bp, human
gcgcttccctgccggagtcc

SEQ ID NO: 235132 - DNA, 20 bp, human
gcggaaaccagaatcgtttt

SEQ ID NO: 235133 - DNA, 20 bp, human
gataacgtcacttcctgtaa

SEQ ID NO: 235134 - DNA, 20 bp, human
gtaagggcgatgattggccg

SEQ ID NO: 235135 - DNA, 20 bp, human
gacaggagctcgctcttaac

SEQ ID NO: 235136 - DNA, 20 bp, human
ggaggggcgttcattaaaga

SEQ ID NO: 235137 - DNA, 20 bp, human
ggtaacgaaccatagagtag

SEQ ID NO: 235138 - DNA, 20 bp, human
ggacctgaggctgggcttcg

SEQ ID NO: 235139 - DNA, 20 bp, human
ggaccacttccgctactcta

SEQ ID NO: 235140 - DNA, 20 bp, human
gtcggggactctctagtgag

SEQ ID NO: 235141 - DNA, 20 bp, human
ggggacgcaaagtgtgggat

SEQ ID NO: 235142 - DNA, 20 bp, human
gtctagccgcaccgagtcgg

SEQ ID NO: 235143 - DNA, 20 bp, human
gaaccatagagtagcggaag

SEQ ID NO: 235144 - DNA, 20 bp, human
gccttctagccgcaccgagt

SEQ ID NO: 235145 - DNA, 20 bp, human
gaagaggggtcgccgcattt

SEQ ID NO: 235146 - DNA, 20 bp, human
gcgtgagccagaaacccgag

SEQ ID NO: 235147 - DNA, 20 bp, human
gaagctgacgatccccgatc

SEQ ID NO: 235148 - DNA, 20 bp, human
gctatcgatcgacccgatcg

SEQ ID NO: 235149 - DNA, 20 bp, human
ggagcaacctctcacggcct

SEQ ID NO: 235150 - DNA, 20 bp, human
gcagacctggcggcagggaa

SEQ ID NO: 235151 - DNA, 20 bp, human
gacgcacgcgcagacagccc

SEQ ID NO: 235152 - DNA, 20 bp, human
ggggatcgtcagcttggttc

SEQ ID NO: 235153 - DNA, 20 bp, human
ggaaacccgaggggctccct

SEQ ID NO: 235154 - DNA, 20 bp, human
ggatcgatagggcgggccca

SEQ ID NO: 235155 - DNA, 20 bp, human
gagactggagcaacctctca

SEQ ID NO: 235156 - DNA, 20 bp, human
gactccagatagggtgaaat

SEQ ID NO: 235157 - DNA, 20 bp, human
gctacccatttcaccctatc

SEQ ID NO: 235158 - DNA, 20 bp, human
gacttgggaacctgagcagg

SEQ ID NO: 235159 - DNA, 20 bp, human
gaacgtaagagacaatgagg

SEQ ID NO: 235160 - DNA, 20 bp, human
gaaggtggaaggctctcttg

SEQ ID NO: 235161 - DNA, 20 bp, human
gggtacttgggaacctgagc

SEQ ID NO: 235162 - DNA, 20 bp, human
gcataaccatggttcactgc

SEQ ID NO: 235163 - DNA, 20 bp, human
gctgggcctgcagtgaacca

SEQ ID NO: 235164 - DNA, 20 bp, human
gttcaccctatctggagtgc

SEQ ID NO: 235165 - DNA, 20 bp, human
ggaatgaggtcacagaaggc

SEQ ID NO: 235166 - DNA, 20 bp, human
gccaggaaacagccacccgg

SEQ ID NO: 235167 - DNA, 20 bp, human
gggagaaaactccgcgagcc

SEQ ID NO: 235168 - DNA, 20 bp, human
gcggccaggaaacagccacc

SEQ ID NO: 235169 - DNA, 20 bp, human
gggccgagtttgtgttttcc

SEQ ID NO: 235170 - DNA, 20 bp, human
gcacccgggggtgcctgaag

SEQ ID NO: 235171 - DNA, 20 bp, human
ggcgaggcggattctttttc

SEQ ID NO: 235172 - DNA, 20 bp, human
ggtcctcttcaggcaccccc

SEQ ID NO: 235173 - DNA, 20 bp, human
ggcttgagtctcggacgttg

SEQ ID NO: 235174 - DNA, 20 bp, human
gacaacaacaggctgggcgg

SEQ ID NO: 235175 - DNA, 20 bp, human
gagtgcggtgttttagccgg

SEQ ID NO: 235176 - DNA, 20 bp, human
gcaagaacctgggcaatcca

SEQ ID NO: 235177 - DNA, 20 bp, human
gctctaactcttggcatcaa

SEQ ID NO: 235178 - DNA, 20 bp, human
gtagatagatagtagagaca

SEQ ID NO: 235179 - DNA, 20 bp, human
gaccttccatccagtagcag

SEQ ID NO: 235180 - DNA, 20 bp, human
gggatggaaggtcttgaccg

SEQ ID NO: 235181 - DNA, 20 bp, human
gaaagtacaactcacagagc

SEQ ID NO: 235182 - DNA, 20 bp, human
ggcctctgctactggatgga

SEQ ID NO: 235183 - DNA, 20 bp, human
gatccagtagcagaggcagg

SEQ ID NO: 235184 - DNA, 20 bp, human
ggcccctaggtgcccgttag

SEQ ID NO: 235185 - DNA, 20 bp, human
ggacctctaacgggcaccta

SEQ ID NO: 235186 - DNA, 20 bp, human
gaggtggtgctgaaggttac

SEQ ID NO: 235187 - DNA, 20 bp, human
ggaaaagatgggtctcaacc

SEQ ID NO: 235188 - DNA, 20 bp, human
gccctgaaaaacatgaactt

SEQ ID NO: 235189 - DNA, 20 bp, human
ggataaaactaagaaaagat

SEQ ID NO: 235190 - DNA, 20 bp, human
gggttacaggctctagagtc

SEQ ID NO: 235191 - DNA, 20 bp, human
gatgaacttggggcgacatg

SEQ ID NO: 235192 - DNA, 20 bp, human
gcgacatgaggtggtgctga

SEQ ID NO: 235193 - DNA, 20 bp, human
ggtcttgtgaaaagcaaaac

SEQ ID NO: 235194 - DNA, 20 bp, human
ggaggaaatgactgagaaat

SEQ ID NO: 235195 - DNA, 20 bp, human
gttactaatcactcaaattt

SEQ ID NO: 235196 - DNA, 20 bp, human
ggcaaacatcgcaaatccag

SEQ ID NO: 235197 - DNA, 20 bp, human
gcgagaagcgccattgtaat

SEQ ID NO: 235198 - DNA, 20 bp, human
gtgggacgccgggccaggtg

SEQ ID NO: 235199 - DNA, 20 bp, human
ggggcgcgctctgttctccg

SEQ ID NO: 235200 - DNA, 20 bp, human
gcctcccatccccattacaa

SEQ ID NO: 235201 - DNA, 20 bp, human
gccggcccaccgggttcctc

SEQ ID NO: 235202 - DNA, 20 bp, human
gaaaccggggcgtatttcct

SEQ ID NO: 235203 - DNA, 20 bp, human
gacagcctgaggaacccggt

SEQ ID NO: 235204 - DNA, 20 bp, human
gaatttctcctcacaaggat

SEQ ID NO: 235205 - DNA, 20 bp, human
ggctctaccaacgatgccca

SEQ ID NO: 235206 - DNA, 20 bp, human
gtaacaggaaggattctgca

SEQ ID NO: 235207 - DNA, 20 bp, human
gctctgggatataaggtagg

SEQ ID NO: 235208 - DNA, 20 bp, human
gatgaaggatgtttcaggga

SEQ ID NO: 235209 - DNA, 20 bp, human
gctggggcgcctgagtcatc

SEQ ID NO: 235210 - DNA, 20 bp, human
ggagggggaccgtaacagga

SEQ ID NO: 235211 - DNA, 20 bp, human
gcagggagggggaccgtaac

SEQ ID NO: 235212 - DNA, 20 bp, human
gcctggaaatattgcaatga

SEQ ID NO: 235213 - DNA, 20 bp, human
gcccttggtgccaacagatg

SEQ ID NO: 235214 - DNA, 20 bp, human
gggcagtgtcctgatgactc

SEQ ID NO: 235215 - DNA, 20 bp, human
ggggaactgaatgacatccc

SEQ ID NO: 235216 - DNA, 20 bp, human
gggtcgacctggcactgcgg

SEQ ID NO: 235217 - DNA, 20 bp, human
gggcaggtctgaacccgcgt

SEQ ID NO: 235218 - DNA, 20 bp, human
gcggcccggagcctacgagg

SEQ ID NO: 235219 - DNA, 20 bp, human
gcagcctctgggcggttcct

SEQ ID NO: 235220 - DNA, 20 bp, human
gtctgaacccgcgtgggtgt

SEQ ID NO: 235221 - DNA, 20 bp, human
gccagcgcctacacccacgc

SEQ ID NO: 235222 - DNA, 20 bp, human
gcagcctagccagaggccct

SEQ ID NO: 235223 - DNA, 20 bp, human
gggcccatcccgtccaagga

SEQ ID NO: 235224 - DNA, 20 bp, human
gtaggcgctgggggtcgacc

SEQ ID NO: 235225 - DNA, 20 bp, human
gggcggggcgtccccctcgt

SEQ ID NO: 235226 - DNA, 20 bp, human
gatagactagggtgctgagg

SEQ ID NO: 235227 - DNA, 20 bp, human
ggagaaaaaaatccacagtg

SEQ ID NO: 235228 - DNA, 20 bp, human
gtggtgttagaaatagacta

SEQ ID NO: 235229 - DNA, 20 bp, human
gcaggggaggcaacgagtgg

SEQ ID NO: 235230 - DNA, 20 bp, human
gggtcagggagctgtcaaga

SEQ ID NO: 235231 - DNA, 20 bp, human
gaaaatggtcctgatgtggt

SEQ ID NO: 235232 - DNA, 20 bp, human
ggctgaaagggaagaaggtc

SEQ ID NO: 235233 - DNA, 20 bp, human
ggaaatagactagggtgctg

SEQ ID NO: 235234 - DNA, 20 bp, human
ggagcaggggaggcaacgag

SEQ ID NO: 235235 - DNA, 20 bp, human
gcttctaacaacccattctg

SEQ ID NO: 235236 - DNA, 20 bp, human
ggaagtcattgaaagagctg

SEQ ID NO: 235237 - DNA, 20 bp, human
gatgaaaaggctacatatgg

SEQ ID NO: 235238 - DNA, 20 bp, human
ggtaatatcagtaatagtca

SEQ ID NO: 235239 - DNA, 20 bp, human
gtgaaacaaccaaaggaaat

SEQ ID NO: 235240 - DNA, 20 bp, human
gtctaatttttcgaaatctg

SEQ ID NO: 235241 - DNA, 20 bp, human
gggcggagtcaactcaaaaa

SEQ ID NO: 235242 - DNA, 20 bp, human
gtagcacatgaaacaaccaa

SEQ ID NO: 235243 - DNA, 20 bp, human
gaaaatgaaaaggctacata

SEQ ID NO: 235244 - DNA, 20 bp, human
gtaaaaaactaaagcaaaac

SEQ ID NO: 235245 - DNA, 20 bp, human
gagtgtttcccaatttcctt

SEQ ID NO: 235246 - DNA, 20 bp, human
gtccttatcacgttaggata

SEQ ID NO: 235247 - DNA, 20 bp, human
gggaaagtctcacagaataa

SEQ ID NO: 235248 - DNA, 20 bp, human
ggaagtcattataaaagctg

SEQ ID NO: 235249 - DNA, 20 bp, human
ggctacttccttatcacgtt

SEQ ID NO: 235250 - DNA, 20 bp, human
gtgagttcatagttttccaa

SEQ ID NO: 235251 - DNA, 20 bp, human
gggaagttaaataatatgcc

SEQ ID NO: 235252 - DNA, 20 bp, human
gaggttacattgctgaaaac

SEQ ID NO: 235253 - DNA, 20 bp, human
gatgctaaaaggatcagaag

SEQ ID NO: 235254 - DNA, 20 bp, human
ggttaggatatggaaaacaa

SEQ ID NO: 235255 - DNA, 20 bp, human
gaaagataaaatatatcatc

SEQ ID NO: 235256 - DNA, 20 bp, human
ggggctcggacgataccaac

SEQ ID NO: 235257 - DNA, 20 bp, human
gccaacgggaatcctacggg

SEQ ID NO: 235258 - DNA, 20 bp, human
gcccccgcgggagcgcgcag

SEQ ID NO: 235259 - DNA, 20 bp, human
gtgggggccgtccctatcgc

SEQ ID NO: 235260 - DNA, 20 bp, human
gggcgccgcaggggattgag

SEQ ID NO: 235261 - DNA, 20 bp, human
gcgcgcaggggtcacgtgag

SEQ ID NO: 235262 - DNA, 20 bp, human
ggataccaacgggaatccta

SEQ ID NO: 235263 - DNA, 20 bp, human
gctcccctgcttccccccgt

SEQ ID NO: 235264 - DNA, 20 bp, human
gaatcctacggggggaagca

SEQ ID NO: 235265 - DNA, 20 bp, human
gacagcctggcggggcgctc

SEQ ID NO: 235266 - DNA, 20 bp, human
gtgaaggcggggccagttag

SEQ ID NO: 235267 - DNA, 20 bp, human
ggcggggcttggactaaagc

SEQ ID NO: 235268 - DNA, 20 bp, human
ggggcggggctcgtcggtcg

SEQ ID NO: 235269 - DNA, 20 bp, human
gcgcggccaggtgagttcgg

SEQ ID NO: 235270 - DNA, 20 bp, human
gactaaagcaggtggggtcc

SEQ ID NO: 235271 - DNA, 20 bp, human
gaaccggggcgtggccaggt

SEQ ID NO: 235272 - DNA, 20 bp, human
ggcggagccaggtgaaggcg

SEQ ID NO: 235273 - DNA, 20 bp, human
ggggcttggactaaagcagg

SEQ ID NO: 235274 - DNA, 20 bp, human
ggtgcgcggccaggtgagtt

SEQ ID NO: 235275 - DNA, 20 bp, human
gcggggctcgtcggtcgggg

SEQ ID NO: 235276 - DNA, 20 bp, human
gggagggccttgcaaaatgg

SEQ ID NO: 235277 - DNA, 20 bp, human
gaggggagggccttgcaaaa

SEQ ID NO: 235278 - DNA, 20 bp, human
ggccccaccccaagtctcaa

SEQ ID NO: 235279 - DNA, 20 bp, human
ggcctggacccgaaggtctg

SEQ ID NO: 235280 - DNA, 20 bp, human
gaagaaagggggtccctgat

SEQ ID NO: 235281 - DNA, 20 bp, human
gcggccattgagacttgggg

SEQ ID NO: 235282 - DNA, 20 bp, human
gtcctggaccctccatctga

SEQ ID NO: 235283 - DNA, 20 bp, human
gttctgggctggctgcttaa

SEQ ID NO: 235284 - DNA, 20 bp, human
ggccagcccagaaaagggtg

SEQ ID NO: 235285 - DNA, 20 bp, human
gtcctcagaccttcgggtcc

SEQ ID NO: 235286 - DNA, 20 bp, human
gagggcagagcactctgcag

SEQ ID NO: 235287 - DNA, 20 bp, human
gtctgtgtgatcagcccaaa

SEQ ID NO: 235288 - DNA, 20 bp, human
gaatgcaacgggccattctg

SEQ ID NO: 235289 - DNA, 20 bp, human
gtcagttgtgcagtcctttt

SEQ ID NO: 235290 - DNA, 20 bp, human
gacacagactctcattgtga

SEQ ID NO: 235291 - DNA, 20 bp, human
gaatggcccgttgcatttcc

SEQ ID NO: 235292 - DNA, 20 bp, human
ggaccagaagctgttggagt

SEQ ID NO: 235293 - DNA, 20 bp, human
gcacctctggtcttcgtata

SEQ ID NO: 235294 - DNA, 20 bp, human
gaacgggccattctggggtt

SEQ ID NO: 235295 - DNA, 20 bp, human
gttgggtcctcagttatttt

SEQ ID NO: 235296 - DNA, 20 bp, human
ggaggcaagtgttgtgagtc

SEQ ID NO: 235297 - DNA, 20 bp, human
gaaaataaaacagcgtggca

SEQ ID NO: 235298 - DNA, 20 bp, human
gccgcccccgcagacaccca

SEQ ID NO: 235299 - DNA, 20 bp, human
ggggcacccagcttcgcgca

SEQ ID NO: 235300 - DNA, 20 bp, human
gctggagggttcctggagaa

SEQ ID NO: 235301 - DNA, 20 bp, human
ggcatggtggtcagactctc

SEQ ID NO: 235302 - DNA, 20 bp, human
gcaaccatgggtgtctgcgg

SEQ ID NO: 235303 - DNA, 20 bp, human
gcttcgcgcaggggatgctg

SEQ ID NO: 235304 - DNA, 20 bp, human
gaaggcggtggtcacgcctc

SEQ ID NO: 235305 - DNA, 20 bp, human
gttcccgtggtagtgagagc

SEQ ID NO: 235306 - DNA, 20 bp, human
gacaggggaagagaatacat

SEQ ID NO: 235307 - DNA, 20 bp, human
gtcaaaaagagcagggacat

SEQ ID NO: 235308 - DNA, 20 bp, human
ggaaatgtgaatgtagtaag

SEQ ID NO: 235309 - DNA, 20 bp, human
gcagagtgatcaaaaagagc

SEQ ID NO: 235310 - DNA, 20 bp, human
gaggtgctaagagagactgt

SEQ ID NO: 235311 - DNA, 20 bp, human
gtgtcgcacagggcagtcgt

SEQ ID NO: 235312 - DNA, 20 bp, human
ggcagggacatgggagcatt

SEQ ID NO: 235313 - DNA, 20 bp, human
gggctcttctctaagaataa

SEQ ID NO: 235314 - DNA, 20 bp, human
gttccatagcagttgaatta

SEQ ID NO: 235315 - DNA, 20 bp, human
gtcccctaattcaactgcta

SEQ ID NO: 235316 - DNA, 20 bp, human
ggatgtgggaataaaggcta

SEQ ID NO: 235317 - DNA, 20 bp, human
ggggagagcggctggaagtc

SEQ ID NO: 235318 - DNA, 20 bp, human
gcctatagatgtgggaataa

SEQ ID NO: 235319 - DNA, 20 bp, human
ggagggggagaaactaagtg

SEQ ID NO: 235320 - DNA, 20 bp, human
gtgaaaatgcagaatcatat

SEQ ID NO: 235321 - DNA, 20 bp, human
gccagctgccttatcttctc

SEQ ID NO: 235322 - DNA, 20 bp, human
gaggtgaggtaagaggctca

SEQ ID NO: 235323 - DNA, 20 bp, human
ggagagaagaagtcactaca

SEQ ID NO: 235324 - DNA, 20 bp, human
gtctaaaaatcagggcttga

SEQ ID NO: 235325 - DNA, 20 bp, human
gtatgggggcttttccaagg

SEQ ID NO: 235326 - DNA, 20 bp, human
gcaaagttaagtggagaaac

SEQ ID NO: 235327 - DNA, 20 bp, human
gagattgagtaggaggacca

SEQ ID NO: 235328 - DNA, 20 bp, human
gggggaagattgttggtaga

SEQ ID NO: 235329 - DNA, 20 bp, human
ggagtggaggcaaagttaag

SEQ ID NO: 235330 - DNA, 20 bp, human
gggaagggaagtagatataa

SEQ ID NO: 235331 - DNA, 20 bp, human
ggtaggaggaccaaggttga

SEQ ID NO: 235332 - DNA, 20 bp, human
gactttagttcagagcaggt

SEQ ID NO: 235333 - DNA, 20 bp, human
ggcagccattcagaatgcat

SEQ ID NO: 235334 - DNA, 20 bp, human
ggaggggacactatggagag

SEQ ID NO: 235335 - DNA, 20 bp, human
ggtgtatggcattgaaagaa

SEQ ID NO: 235336 - DNA, 20 bp, human
ggcaaagaggtcggggtccc

SEQ ID NO: 235337 - DNA, 20 bp, human
gcgtccccaaaaaggagaca

SEQ ID NO: 235338 - DNA, 20 bp, human
ggagactttgggtcaacgtg

SEQ ID NO: 235339 - DNA, 20 bp, human
gtgcgagctgcaaagaggtc

SEQ ID NO: 235340 - DNA, 20 bp, human
gcggcggcgccaggattcct

SEQ ID NO: 235341 - DNA, 20 bp, human
gtttagcagtacatgtctct

SEQ ID NO: 235342 - DNA, 20 bp, human
gtgagagaactggattaggt

SEQ ID NO: 235343 - DNA, 20 bp, human
gttgcagctcgcacagctaa

SEQ ID NO: 235344 - DNA, 20 bp, human
gactgaggtggaggaatcct

SEQ ID NO: 235345 - DNA, 20 bp, human
gagaggaggaagagagtctg

SEQ ID NO: 235346 - DNA, 20 bp, human
ggggaaatgaaaaaccccgt

SEQ ID NO: 235347 - DNA, 20 bp, human
gatcacagagaggtagaagt

SEQ ID NO: 235348 - DNA, 20 bp, human
gggaggatgtacacaagagc

SEQ ID NO: 235349 - DNA, 20 bp, human
gactgctggaaaacgagtcc

SEQ ID NO: 235350 - DNA, 20 bp, human
gtagtgcaattagggaggtt

SEQ ID NO: 235351 - DNA, 20 bp, human
gtaaaacaaagtctgtggtc

SEQ ID NO: 235352 - DNA, 20 bp, human
ggcagttagtgcaattaggg

SEQ ID NO: 235353 - DNA, 20 bp, human
ggggaggctgcagcaaagcg

SEQ ID NO: 235354 - DNA, 20 bp, human
gcagagagttggattatgga

SEQ ID NO: 235355 - DNA, 20 bp, human
gctgacagggaagtcagcag

SEQ ID NO: 235356 - DNA, 20 bp, human
ggcaaaggagcacatcagaa

SEQ ID NO: 235357 - DNA, 20 bp, human
gaacacatctgctttggcaa

SEQ ID NO: 235358 - DNA, 20 bp, human
gggaactgaagtgagactgg

SEQ ID NO: 235359 - DNA, 20 bp, human
gtggttaagctctcggggtg

SEQ ID NO: 235360 - DNA, 20 bp, human
gctcataaacacatctgctt

SEQ ID NO: 235361 - DNA, 20 bp, human
ggcacgtggttaagctctcg

SEQ ID NO: 235362 - DNA, 20 bp, human
ggaggctaagtagatcacta

SEQ ID NO: 235363 - DNA, 20 bp, human
gaaggctgtgtggttgaatt

SEQ ID NO: 235364 - DNA, 20 bp, human
gtagggacagtatacctaag

SEQ ID NO: 235365 - DNA, 20 bp, human
ggtatacctaagtggataaa

SEQ ID NO: 235366 - DNA, 20 bp, human
gacagcctccgctcctgtga

SEQ ID NO: 235367 - DNA, 20 bp, human
gggcgtggggaaaacggagt

SEQ ID NO: 235368 - DNA, 20 bp, human
gtccgctcctgtgagggcgt

SEQ ID NO: 235369 - DNA, 20 bp, human
gccccacgccctcacaggag

SEQ ID NO: 235370 - DNA, 20 bp, human
gcagcggtcacctttgaaaa

SEQ ID NO: 235371 - DNA, 20 bp, human
ggcggaggctgtctgtgtgg

SEQ ID NO: 235372 - DNA, 20 bp, human
gaagaggcgggaggtgcggc

SEQ ID NO: 235373 - DNA, 20 bp, human
gtggagctctgctaggcagg

SEQ ID NO: 235374 - DNA, 20 bp, human
gctgctacctggactgagaa

SEQ ID NO: 235375 - DNA, 20 bp, human
ggagaagggggctagcgagg

SEQ ID NO: 235376 - DNA, 20 bp, human
gtgtgtacagcagaagtgag

SEQ ID NO: 235377 - DNA, 20 bp, human
gacttttagaggctttctcc

SEQ ID NO: 235378 - DNA, 20 bp, human
ggccgtaaagctcttcaacc

SEQ ID NO: 235379 - DNA, 20 bp, human
gtctaaaagtcatcataatt

SEQ ID NO: 235380 - DNA, 20 bp, human
gacagacaaactttacagta

SEQ ID NO: 235381 - DNA, 20 bp, human
gctaaaccacatagacgtga

SEQ ID NO: 235382 - DNA, 20 bp, human
gtagacaaatctgtttatct

SEQ ID NO: 235383 - DNA, 20 bp, human
gcgtgaaggaaggggctaga

SEQ ID NO: 235384 - DNA, 20 bp, human
gcggccttagtatttgagtc

SEQ ID NO: 235385 - DNA, 20 bp, human
gccacatagacgtgaaggaa

SEQ ID NO: 235386 - DNA, 20 bp, human
gcacacagtggttgcacaca

SEQ ID NO: 235387 - DNA, 20 bp, human
gggagctataagtaacaaag

SEQ ID NO: 235388 - DNA, 20 bp, human
gggacagggtaacaacacac

SEQ ID NO: 235389 - DNA, 20 bp, human
ggctaaggcacagggttctc

SEQ ID NO: 235390 - DNA, 20 bp, human
gaacatgaagactcttggat

SEQ ID NO: 235391 - DNA, 20 bp, human
ggtagagagtaccttatata

SEQ ID NO: 235392 - DNA, 20 bp, human
gacttagccctgggcaatta

SEQ ID NO: 235393 - DNA, 20 bp, human
ggtaccttatatatggtaat

SEQ ID NO: 235394 - DNA, 20 bp, human
gaaggggagctaactgttag

SEQ ID NO: 235395 - DNA, 20 bp, human
gagactcttggataggtgaa

SEQ ID NO: 235396 - DNA, 20 bp, human
gccccagagaagacaacaaa

SEQ ID NO: 235397 - DNA, 20 bp, human
gcctgactagataccttgtc

SEQ ID NO: 235398 - DNA, 20 bp, human
gtagtcaggaatagggaagt

SEQ ID NO: 235399 - DNA, 20 bp, human
gccattcaccccacaaatac

SEQ ID NO: 235400 - DNA, 20 bp, human
gtctctgggggtctgttaca

SEQ ID NO: 235401 - DNA, 20 bp, human
ggcactcagcctgtatttgt

SEQ ID NO: 235402 - DNA, 20 bp, human
gggccatttgttgtcttctc

SEQ ID NO: 235403 - DNA, 20 bp, human
gtacaggctgagtgccttct

SEQ ID NO: 235404 - DNA, 20 bp, human
gggataggtttgggacaaga

SEQ ID NO: 235405 - DNA, 20 bp, human
gtagagcatcagtacctaga

SEQ ID NO: 235406 - DNA, 20 bp, human
gctacccttgccctagtgga

SEQ ID NO: 235407 - DNA, 20 bp, human
gggactcatccactcatgga

SEQ ID NO: 235408 - DNA, 20 bp, human
gacagtgcttccaggaactg

SEQ ID NO: 235409 - DNA, 20 bp, human
gaggtagcacccccagttcc

SEQ ID NO: 235410 - DNA, 20 bp, human
gaagcatcagagcatgagat

SEQ ID NO: 235411 - DNA, 20 bp, human
gaagaatttcagggaggcag

SEQ ID NO: 235412 - DNA, 20 bp, human
ggagaaacaggaagttgggt

SEQ ID NO: 235413 - DNA, 20 bp, human
ggtgttacaccccctccact

SEQ ID NO: 235414 - DNA, 20 bp, human
gctgtcatccaaaagactag

SEQ ID NO: 235415 - DNA, 20 bp, human
gcggatctttcaagaatttc

SEQ ID NO: 235416 - DNA, 20 bp, human
gtggggaaaagagacgattg

SEQ ID NO: 235417 - DNA, 20 bp, human
gggaagactcgaatacgtat

SEQ ID NO: 235418 - DNA, 20 bp, human
gcacaccccctgcttctcta

SEQ ID NO: 235419 - DNA, 20 bp, human
gcaagcagcaccgtgatctg

SEQ ID NO: 235420 - DNA, 20 bp, human
gtgcgggctcggagtcagat

SEQ ID NO: 235421 - DNA, 20 bp, human
gagcaccgtgatctggggag

SEQ ID NO: 235422 - DNA, 20 bp, human
gtgcaaacccatacacggaa

SEQ ID NO: 235423 - DNA, 20 bp, human
gagagccatagagaagcagg

SEQ ID NO: 235424 - DNA, 20 bp, human
gtcctgagagctgggtagag

SEQ ID NO: 235425 - DNA, 20 bp, human
ggtaaagtctctggtgacag

SEQ ID NO: 235426 - DNA, 20 bp, human
gggctgtcagcgctgggcgt

SEQ ID NO: 235427 - DNA, 20 bp, human
gcagaggctgaagtgggcgg

SEQ ID NO: 235428 - DNA, 20 bp, human
gtgacccctgacagaacctg

SEQ ID NO: 235429 - DNA, 20 bp, human
ggggcttttgatctgttttt

SEQ ID NO: 235430 - DNA, 20 bp, human
gtcagacatttgctttgatg

SEQ ID NO: 235431 - DNA, 20 bp, human
gacaaaagtatgctggccca

SEQ ID NO: 235432 - DNA, 20 bp, human
gaggatgggctgtcagcgct

SEQ ID NO: 235433 - DNA, 20 bp, human
gtgtccccaggttctgtcag

SEQ ID NO: 235434 - DNA, 20 bp, human
ggaagttaaatctctcataa

SEQ ID NO: 235435 - DNA, 20 bp, human
gagtaaaaattgggaaaagt

SEQ ID NO: 235436 - DNA, 20 bp, human
gaaagcaagggcttcgggga

SEQ ID NO: 235437 - DNA, 20 bp, human
gaggcgcagtgagctcacgg

SEQ ID NO: 235438 - DNA, 20 bp, human
ggcctagcgcgaacccttcc

SEQ ID NO: 235439 - DNA, 20 bp, human
gcgcgcagatcgctccggac

SEQ ID NO: 235440 - DNA, 20 bp, human
gtgagcgcctcgtgtcagcc

SEQ ID NO: 235441 - DNA, 20 bp, human
gagcgccgaccagccgggaa

SEQ ID NO: 235442 - DNA, 20 bp, human
gaggagacggcccaccctaa

SEQ ID NO: 235443 - DNA, 20 bp, human
ggaacaaagcaagggcttcg

SEQ ID NO: 235444 - DNA, 20 bp, human
gcgcaggcggtgtcccggtc

SEQ ID NO: 235445 - DNA, 20 bp, human
gcgggtccgcgcccagcgag

SEQ ID NO: 235446 - DNA, 20 bp, human
gccaacagacattgtggagg

SEQ ID NO: 235447 - DNA, 20 bp, human
ggaggtaagcttcaccagtt

SEQ ID NO: 235448 - DNA, 20 bp, human
gtatatggagagacccccat

SEQ ID NO: 235449 - DNA, 20 bp, human
ggaagcttacctcaagtggg

SEQ ID NO: 235450 - DNA, 20 bp, human
ggggctgaaacgtagggccc

SEQ ID NO: 235451 - DNA, 20 bp, human
gaagcggctaacagtgttga

SEQ ID NO: 235452 - DNA, 20 bp, human
gaggagtgggctgaaacgta

SEQ ID NO: 235453 - DNA, 20 bp, human
gtggtgaagcttacctcaag

SEQ ID NO: 235454 - DNA, 20 bp, human
ggaggaaactgtggctggac

SEQ ID NO: 235455 - DNA, 20 bp, human
gtctgttggaatggaacagt

SEQ ID NO: 235456 - DNA, 20 bp, human
gggaagccctggaggtttga

SEQ ID NO: 235457 - DNA, 20 bp, human
ggagaaagcacctgccgaca

SEQ ID NO: 235458 - DNA, 20 bp, human
gttcctgcctgtgaaccgaa

SEQ ID NO: 235459 - DNA, 20 bp, human
gtgtcctggactctaatcca

SEQ ID NO: 235460 - DNA, 20 bp, human
gtcggcaggtgctttctcaa

SEQ ID NO: 235461 - DNA, 20 bp, human
gctgcctgtgaaccgaaagg

SEQ ID NO: 235462 - DNA, 20 bp, human
gactccccctttcggttcac

SEQ ID NO: 235463 - DNA, 20 bp, human
gcccaggaagtggaggactg

SEQ ID NO: 235464 - DNA, 20 bp, human
gcctggaggtttgagggttt

SEQ ID NO: 235465 - DNA, 20 bp, human
gggcaaatacaagttctcga

SEQ ID NO: 235466 - DNA, 20 bp, human
gcctgctctagcggcccccg

SEQ ID NO: 235467 - DNA, 20 bp, human
gctcaggccttgtaaggagt

SEQ ID NO: 235468 - DNA, 20 bp, human
ggccccgagccccaacttga

SEQ ID NO: 235469 - DNA, 20 bp, human
gactgctcccgggtgtgatg

SEQ ID NO: 235470 - DNA, 20 bp, human
gtggggggctctaaggttgg

SEQ ID NO: 235471 - DNA, 20 bp, human
ggcagctcttgacaggggga

SEQ ID NO: 235472 - DNA, 20 bp, human
ggccgggctcaggccttgta

SEQ ID NO: 235473 - DNA, 20 bp, human
ggggctgctgtgtccagatt

SEQ ID NO: 235474 - DNA, 20 bp, human
gggggagaaggcgcagttga

SEQ ID NO: 235475 - DNA, 20 bp, human
gccttgtaaggagtgggctg

SEQ ID NO: 235476 - DNA, 20 bp, human
gccagcacacggaaggggaa

SEQ ID NO: 235477 - DNA, 20 bp, human
gaaaggagggatgcaggtat

SEQ ID NO: 235478 - DNA, 20 bp, human
gcaaagaagcaggagtcagt

SEQ ID NO: 235479 - DNA, 20 bp, human
ggggtgggggggggtaacgt

SEQ ID NO: 235480 - DNA, 20 bp, human
gtctgtaaactgtggacggg

SEQ ID NO: 235481 - DNA, 20 bp, human
gcacaagtgcatgaatagga

SEQ ID NO: 235482 - DNA, 20 bp, human
gtgtgcacaagtgcatgaat

SEQ ID NO: 235483 - DNA, 20 bp, human
ggagaaccagaattgagcac

SEQ ID NO: 235484 - DNA, 20 bp, human
gcgtgcttcatgagcaggag

SEQ ID NO: 235485 - DNA, 20 bp, human
gtaaactgtggacggggggg

SEQ ID NO: 235486 - DNA, 20 bp, human
gcggcggaagctttcagttt

SEQ ID NO: 235487 - DNA, 20 bp, human
gcttccgccgatttcaccga

SEQ ID NO: 235488 - DNA, 20 bp, human
ggttgcgccaggcccggagg

SEQ ID NO: 235489 - DNA, 20 bp, human
gagcgttgcgccaggcccgg

SEQ ID NO: 235490 - DNA, 20 bp, human
gccctctgaaggtaaaatca

SEQ ID NO: 235491 - DNA, 20 bp, human
ggtcaggaaagtccaacgcc

SEQ ID NO: 235492 - DNA, 20 bp, human
gaaactggatttgctgcctt

SEQ ID NO: 235493 - DNA, 20 bp, human
gtcctgaccttcggtgaaat

SEQ ID NO: 235494 - DNA, 20 bp, human
gtaagctcttacccctctga

SEQ ID NO: 235495 - DNA, 20 bp, human
gcagtttaggtatctagtgt

SEQ ID NO: 235496 - DNA, 20 bp, human
gaagaacccaagactggggt

SEQ ID NO: 235497 - DNA, 20 bp, human
gaggcccggaaaggcggctc

SEQ ID NO: 235498 - DNA, 20 bp, human
gcggctccggtgcgtccctg

SEQ ID NO: 235499 - DNA, 20 bp, human
gccctggcggggaaaaccct

SEQ ID NO: 235500 - DNA, 20 bp, human
gggcggcccggggagtccga

SEQ ID NO: 235501 - DNA, 20 bp, human
ggggctggtcggatggccgt

SEQ ID NO: 235502 - DNA, 20 bp, human
gcgccaccgcggggccaatc

SEQ ID NO: 235503 - DNA, 20 bp, human
gaggcctgagccagcccgct

SEQ ID NO: 235504 - DNA, 20 bp, human
ggcgccggagaatccgcctg

SEQ ID NO: 235505 - DNA, 20 bp, human
gtgcgtccctgaggccggat

SEQ ID NO: 235506 - DNA, 20 bp, human
gtgccctaaggggatggtgg

SEQ ID NO: 235507 - DNA, 20 bp, human
gtgactgcagcatttcacac

SEQ ID NO: 235508 - DNA, 20 bp, human
gatcatgtgccctaagggga

SEQ ID NO: 235509 - DNA, 20 bp, human
gtagtcggtcactacatgat

SEQ ID NO: 235510 - DNA, 20 bp, human
gctgcagtcaggatgccttg

SEQ ID NO: 235511 - DNA, 20 bp, human
gtcaaggcactcaaaccaca

SEQ ID NO: 235512 - DNA, 20 bp, human
gccttgatcatgtgccctaa

SEQ ID NO: 235513 - DNA, 20 bp, human
gtgagagtctccgtcatcca

SEQ ID NO: 235514 - DNA, 20 bp, human
gcaccgccaccatcccctta

SEQ ID NO: 235515 - DNA, 20 bp, human
gatgtgccctaaggggatgg

SEQ ID NO: 235516 - DNA, 20 bp, human
gaagcggtgcagaggagctt

SEQ ID NO: 235517 - DNA, 20 bp, human
ggggctcgctctccccccgg

SEQ ID NO: 235518 - DNA, 20 bp, human
gagtgctaaggaagaggcga

SEQ ID NO: 235519 - DNA, 20 bp, human
gagagagcccgaacgcgacg

SEQ ID NO: 235520 - DNA, 20 bp, human
gcaggtgcagcgagcggatg

SEQ ID NO: 235521 - DNA, 20 bp, human
ggagcccgaacgcgacgggg

SEQ ID NO: 235522 - DNA, 20 bp, human
gggtccccacggctgctgcc

SEQ ID NO: 235523 - DNA, 20 bp, human
gcgacaccgtagactaaggt

SEQ ID NO: 235524 - DNA, 20 bp, human
gcagcgagcggatgaggaag

SEQ ID NO: 235525 - DNA, 20 bp, human
gcgcgtccaggtgcagcgag

SEQ ID NO: 235526 - DNA, 20 bp, human
gtgactgacgtcacttctgg

SEQ ID NO: 235527 - DNA, 20 bp, human
ggaagtgacgtcagtcacgt

SEQ ID NO: 235528 - DNA, 20 bp, human
ggtcacttctggcgggagag

SEQ ID NO: 235529 - DNA, 20 bp, human
gcccggaagtggcttcactc

SEQ ID NO: 235530 - DNA, 20 bp, human
gtctgactgggcgtgagaaa

SEQ ID NO: 235531 - DNA, 20 bp, human
ggaggggcaaagtccgagca

SEQ ID NO: 235532 - DNA, 20 bp, human
gaagtggcttcactcgggtt

SEQ ID NO: 235533 - DNA, 20 bp, human
ggcacccggccgccatcacc

SEQ ID NO: 235534 - DNA, 20 bp, human
ggcctctactgcttgaatga

SEQ ID NO: 235535 - DNA, 20 bp, human
gaactaactggaagagcggg

SEQ ID NO: 235536 - DNA, 20 bp, human
gaagctacggagtcactaca

SEQ ID NO: 235537 - DNA, 20 bp, human
gcccggggaagtgagagtcg

SEQ ID NO: 235538 - DNA, 20 bp, human
gtccccgggtctcctcctag

SEQ ID NO: 235539 - DNA, 20 bp, human
gttcccctcgggtccaggta

SEQ ID NO: 235540 - DNA, 20 bp, human
gtggtcaaggtgggcaaccc

SEQ ID NO: 235541 - DNA, 20 bp, human
gaggccctacctggacccga

SEQ ID NO: 235542 - DNA, 20 bp, human
gtcctcgtgggcaccaccga

SEQ ID NO: 235543 - DNA, 20 bp, human
gtggacctccaagggactca

SEQ ID NO: 235544 - DNA, 20 bp, human
gggcacgtcctccttaacgc

SEQ ID NO: 235545 - DNA, 20 bp, human
gggatcagtcctgcaagcta

SEQ ID NO: 235546 - DNA, 20 bp, human
gtggacaatcttgtggttgg

SEQ ID NO: 235547 - DNA, 20 bp, human
ggggacctagctgaagatta

SEQ ID NO: 235548 - DNA, 20 bp, human
gaagggacacaacctctctc

SEQ ID NO: 235549 - DNA, 20 bp, human
ggggccatttcctaccacat

SEQ ID NO: 235550 - DNA, 20 bp, human
gaagaagagctgggggtctt

SEQ ID NO: 235551 - DNA, 20 bp, human
gtgagccagcacacacccca

SEQ ID NO: 235552 - DNA, 20 bp, human
ggggacatgcagatggtgtc

SEQ ID NO: 235553 - DNA, 20 bp, human
gggaagtgacatgtcacaga

SEQ ID NO: 235554 - DNA, 20 bp, human
ggtcaggatggacaatcttg

SEQ ID NO: 235555 - DNA, 20 bp, human
gcctccaaggctaaagaagg

SEQ ID NO: 235556 - DNA, 20 bp, human
gccgagtcatgaaatctcag

SEQ ID NO: 235557 - DNA, 20 bp, human
gaacttggacaagtagaaag

SEQ ID NO: 235558 - DNA, 20 bp, human
gcgatgaagtaatcccagat

SEQ ID NO: 235559 - DNA, 20 bp, human
ggtcatccgcatggagataa

SEQ ID NO: 235560 - DNA, 20 bp, human
gtagatgagtgagaacacaa

SEQ ID NO: 235561 - DNA, 20 bp, human
gggattacttcatcgatcta

SEQ ID NO: 235562 - DNA, 20 bp, human
gagtagaaagtggatgaccc

SEQ ID NO: 235563 - DNA, 20 bp, human
gaacggttgagaaagacatg

SEQ ID NO: 235564 - DNA, 20 bp, human
gttggagaggtttcgtaaac

SEQ ID NO: 235565 - DNA, 20 bp, human
gctaagtaaggcttaaaatt

SEQ ID NO: 235566 - DNA, 20 bp, human
ggggagatacgtctgcagaa

SEQ ID NO: 235567 - DNA, 20 bp, human
gctagcaggccttgggtcca

SEQ ID NO: 235568 - DNA, 20 bp, human
ggggactgtgcagggtcttt

SEQ ID NO: 235569 - DNA, 20 bp, human
ggtgcagggtctttagggta

SEQ ID NO: 235570 - DNA, 20 bp, human
gccaaggggtataacactct

SEQ ID NO: 235571 - DNA, 20 bp, human
gacccatccgacatctgagt

SEQ ID NO: 235572 - DNA, 20 bp, human
gcccaactcagatgtcggat

SEQ ID NO: 235573 - DNA, 20 bp, human
gtcactatgtaaaaaagagg

SEQ ID NO: 235574 - DNA, 20 bp, human
gatgtcggatgggtcatgct

SEQ ID NO: 235575 - DNA, 20 bp, human
ggaactacccactctataaa

SEQ ID NO: 235576 - DNA, 20 bp, human
gcctctccctgcactcctca

SEQ ID NO: 235577 - DNA, 20 bp, human
gggagtgcacgtaggagcca

SEQ ID NO: 235578 - DNA, 20 bp, human
gacttgaaggagattcgagt

SEQ ID NO: 235579 - DNA, 20 bp, human
gacggacaaggccagccatg

SEQ ID NO: 235580 - DNA, 20 bp, human
gccgcagctcctcaatgctt

SEQ ID NO: 235581 - DNA, 20 bp, human
gaatgtgtccgggactggtc

SEQ ID NO: 235582 - DNA, 20 bp, human
gggactggtcaggtttgcac

SEQ ID NO: 235583 - DNA, 20 bp, human
gtccctgcactcctcatggc

SEQ ID NO: 235584 - DNA, 20 bp, human
gaagtagctacagatgtaac

SEQ ID NO: 235585 - DNA, 20 bp, human
gaggaggaacccaagcattg

SEQ ID NO: 235586 - DNA, 20 bp, human
gtgcccccagccaacccacc

SEQ ID NO: 235587 - DNA, 20 bp, human
gactgaaggaggaagttcaa

SEQ ID NO: 235588 - DNA, 20 bp, human
gccagccaacccaccaggtt

SEQ ID NO: 235589 - DNA, 20 bp, human
gaggcagttgacaatgcaag

SEQ ID NO: 235590 - DNA, 20 bp, human
gggtggttggttgggcaccg

SEQ ID NO: 235591 - DNA, 20 bp, human
ggccaacccaccaggtttgg

SEQ ID NO: 235592 - DNA, 20 bp, human
gtctctgtacacagccaccg

SEQ ID NO: 235593 - DNA, 20 bp, human
gtggaaagggtgaaatttcg

SEQ ID NO: 235594 - DNA, 20 bp, human
gccaatcctccaaacctggt

SEQ ID NO: 235595 - DNA, 20 bp, human
gtcgtggctcctctgtcatg

SEQ ID NO: 235596 - DNA, 20 bp, human
gcgcgtgggcgctcagaaaa

SEQ ID NO: 235597 - DNA, 20 bp, human
gccctggggtaggcacgcgt

SEQ ID NO: 235598 - DNA, 20 bp, human
gttaggagaaactctggtgt

SEQ ID NO: 235599 - DNA, 20 bp, human
gtcgacttacagacccctta

SEQ ID NO: 235600 - DNA, 20 bp, human
gtccccggctgggcctgcgg

SEQ ID NO: 235601 - DNA, 20 bp, human
gagtcctggaaggtgagccc

SEQ ID NO: 235602 - DNA, 20 bp, human
gaggttaaggcccccttgaa

SEQ ID NO: 235603 - DNA, 20 bp, human
ggcgcacggaccacaggtta

SEQ ID NO: 235604 - DNA, 20 bp, human
ggtcgcgtgaaaccaggcca

SEQ ID NO: 235605 - DNA, 20 bp, human
gctaaactcgtgccccttca

SEQ ID NO: 235606 - DNA, 20 bp, human
gggaacgtgaacggcactgg

SEQ ID NO: 235607 - DNA, 20 bp, human
gcccccgggcggaacgtgaa

SEQ ID NO: 235608 - DNA, 20 bp, human
ggtgtcccgtcccgcaggag

SEQ ID NO: 235609 - DNA, 20 bp, human
gcctgcgggacgggacaccc

SEQ ID NO: 235610 - DNA, 20 bp, human
gggctcccaccaggagaacc

SEQ ID NO: 235611 - DNA, 20 bp, human
gccagccgctcctgcgggac

SEQ ID NO: 235612 - DNA, 20 bp, human
gggcactgggggctcccacc

SEQ ID NO: 235613 - DNA, 20 bp, human
ggacacccgggttctcctgg

SEQ ID NO: 235614 - DNA, 20 bp, human
gggcggaacgtgaacggcac

SEQ ID NO: 235615 - DNA, 20 bp, human
gcgggacacccgggttctcc

SEQ ID NO: 235616 - DNA, 20 bp, human
gcgggcgccgcagaactcag

SEQ ID NO: 235617 - DNA, 20 bp, human
ggaaatgcggagtgcctgag

SEQ ID NO: 235618 - DNA, 20 bp, human
gcacgcgcacgcgcggggtt

SEQ ID NO: 235619 - DNA, 20 bp, human
ggtgcgcagggataagagag

SEQ ID NO: 235620 - DNA, 20 bp, human
ggcagggaaaagagaattag

SEQ ID NO: 235621 - DNA, 20 bp, human
gttgaagttagaaacttctg

SEQ ID NO: 235622 - DNA, 20 bp, human
gaaaagcagtgggatgaggg

SEQ ID NO: 235623 - DNA, 20 bp, human
gcgtaaatgtcagaatagca

SEQ ID NO: 235624 - DNA, 20 bp, human
gtagaatgctagctactgga

SEQ ID NO: 235625 - DNA, 20 bp, human
gtcggcgccacaaaagcagt

SEQ ID NO: 235626 - DNA, 20 bp, human
gaggggatgcagaatcagga

SEQ ID NO: 235627 - DNA, 20 bp, human
ggggatgggaccctggtact

SEQ ID NO: 235628 - DNA, 20 bp, human
gggccgcaagggaagttcat

SEQ ID NO: 235629 - DNA, 20 bp, human
gagaaacaaagaagagtcct

SEQ ID NO: 235630 - DNA, 20 bp, human
gagcgggggagcttgaccag

SEQ ID NO: 235631 - DNA, 20 bp, human
ggcttcagaagtggccgcaa

SEQ ID NO: 235632 - DNA, 20 bp, human
gtacccatgaacttcccttg

SEQ ID NO: 235633 - DNA, 20 bp, human
ggaagttcatgggtactgca

SEQ ID NO: 235634 - DNA, 20 bp, human
ggggaccctggtactgggag

SEQ ID NO: 235635 - DNA, 20 bp, human
gaaccagtaaccatgaactg

SEQ ID NO: 235636 - DNA, 20 bp, human
gcctgccctggccaccggca

SEQ ID NO: 235637 - DNA, 20 bp, human
ggccttgccaagactaaaaa

SEQ ID NO: 235638 - DNA, 20 bp, human
gtggttggtcccaaaggcgg

SEQ ID NO: 235639 - DNA, 20 bp, human
ggcaaggcagcgcctctcct

SEQ ID NO: 235640 - DNA, 20 bp, human
gaaagtggggaaaaaatcgg

SEQ ID NO: 235641 - DNA, 20 bp, human
ggggaaatatggaaggtcac

SEQ ID NO: 235642 - DNA, 20 bp, human
ggaccagcatccttcccgcg

SEQ ID NO: 235643 - DNA, 20 bp, human
gccgtcgaggccaaaaaagg

SEQ ID NO: 235644 - DNA, 20 bp, human
gccctggttggtcccaaagg

SEQ ID NO: 235645 - DNA, 20 bp, human
gccgccgtcgaggccaaaaa

SEQ ID NO: 235646 - DNA, 20 bp, human
gtcccatccaagtaagtcag

SEQ ID NO: 235647 - DNA, 20 bp, human
gacacagcacattactgata

SEQ ID NO: 235648 - DNA, 20 bp, human
gtggcaacaaaccacacact

SEQ ID NO: 235649 - DNA, 20 bp, human
gtggagactgtcaatcagca

SEQ ID NO: 235650 - DNA, 20 bp, human
gtcagtaatgtgctgtgtgg

SEQ ID NO: 235651 - DNA, 20 bp, human
ggcatctgagaatatgttag

SEQ ID NO: 235652 - DNA, 20 bp, human
gctcacgcatttatgtactg

SEQ ID NO: 235653 - DNA, 20 bp, human
ggctgaactgagaccgctgg

SEQ ID NO: 235654 - DNA, 20 bp, human
gagtgtcagatcccagtgtg

SEQ ID NO: 235655 - DNA, 20 bp, human
ggatgctgaactgagaccgc

SEQ ID NO: 235656 - DNA, 20 bp, human
gaggcgctgggggatctaaa

SEQ ID NO: 235657 - DNA, 20 bp, human
gtccactgggacacatgctc

SEQ ID NO: 235658 - DNA, 20 bp, human
gcgcctgagacatggagacc

SEQ ID NO: 235659 - DNA, 20 bp, human
gacacatgctctggtacctg

SEQ ID NO: 235660 - DNA, 20 bp, human
gggactgccccatgagtcct

SEQ ID NO: 235661 - DNA, 20 bp, human
gggtgggttccagtagatca

SEQ ID NO: 235662 - DNA, 20 bp, human
gagagactctgctgagataa

SEQ ID NO: 235663 - DNA, 20 bp, human
gtgtgggcaccaaggactca

SEQ ID NO: 235664 - DNA, 20 bp, human
gactcccgcttcatgtaagg

SEQ ID NO: 235665 - DNA, 20 bp, human
gcccaaaagaggaagttcca

SEQ ID NO: 235666 - DNA, 20 bp, human
gaactctgaggcaaggggtt

SEQ ID NO: 235667 - DNA, 20 bp, human
gcccttgcctcagagttccg

SEQ ID NO: 235668 - DNA, 20 bp, human
gagtgggtgggtcactgcac

SEQ ID NO: 235669 - DNA, 20 bp, human
gggtggctgtttctccctgg

SEQ ID NO: 235670 - DNA, 20 bp, human
gaaaaggcaagtgaaacaga

SEQ ID NO: 235671 - DNA, 20 bp, human
gcacctgcagaggattaagg

SEQ ID NO: 235672 - DNA, 20 bp, human
gctctgcaggtgtcctaagg

SEQ ID NO: 235673 - DNA, 20 bp, human
gtaaggtggctgtttctccc

SEQ ID NO: 235674 - DNA, 20 bp, human
gcacaggagcctatagttgt

SEQ ID NO: 235675 - DNA, 20 bp, human
gaaccagccacggaactctg

SEQ ID NO: 235676 - DNA, 20 bp, human
ggtaccggaaagaggagagt

SEQ ID NO: 235677 - DNA, 20 bp, human
gctgtgagtcagctagggga

SEQ ID NO: 235678 - DNA, 20 bp, human
gggtacctgtgagtcagcta

SEQ ID NO: 235679 - DNA, 20 bp, human
gactcacaggtaccggaaag

SEQ ID NO: 235680 - DNA, 20 bp, human
ggcagagaatatggaaaagg

SEQ ID NO: 235681 - DNA, 20 bp, human
gtccctggctgcctagtgaa

SEQ ID NO: 235682 - DNA, 20 bp, human
gtgtggttgcattgtcaata

SEQ ID NO: 235683 - DNA, 20 bp, human
gaatagggacgctaaagttc

SEQ ID NO: 235684 - DNA, 20 bp, human
gctcaaggggcttcgagatg

SEQ ID NO: 235685 - DNA, 20 bp, human
ggggccgacggcttctctca

SEQ ID NO: 235686 - DNA, 20 bp, human
ggactctgacaatacctgga

SEQ ID NO: 235687 - DNA, 20 bp, human
gggaagaccccgcaatgtgg

SEQ ID NO: 235688 - DNA, 20 bp, human
gtcctcttgtttggccttct

SEQ ID NO: 235689 - DNA, 20 bp, human
gtataagctctgacaggaag

SEQ ID NO: 235690 - DNA, 20 bp, human
gttcctctataagctctgac

SEQ ID NO: 235691 - DNA, 20 bp, human
gtcctagaaggccaaacaag

SEQ ID NO: 235692 - DNA, 20 bp, human
ggtaaaacccgcaggcccag

SEQ ID NO: 235693 - DNA, 20 bp, human
gcctcacttggaaacgttca

SEQ ID NO: 235694 - DNA, 20 bp, human
gttgtcagagtcctcttgtt

SEQ ID NO: 235695 - DNA, 20 bp, human
gccccacacaggaagtagag

SEQ ID NO: 235696 - DNA, 20 bp, human
gcgggagcgcccaactggtg

SEQ ID NO: 235697 - DNA, 20 bp, human
ggcgacccatcgggacccga

SEQ ID NO: 235698 - DNA, 20 bp, human
gggggagcgggaaacatagg

SEQ ID NO: 235699 - DNA, 20 bp, human
gaggcccgtcgggtcccgat

SEQ ID NO: 235700 - DNA, 20 bp, human
gtgtggggctcctgggtccg

SEQ ID NO: 235701 - DNA, 20 bp, human
gccccatcgtctgtccaata

SEQ ID NO: 235702 - DNA, 20 bp, human
ggggcggggcttctggactc

SEQ ID NO: 235703 - DNA, 20 bp, human
gaacgcggggcggccccagt

SEQ ID NO: 235704 - DNA, 20 bp, human
ggctggagtcagaggcccgt

SEQ ID NO: 235705 - DNA, 20 bp, human
gagcttgtggttctcgaggg

SEQ ID NO: 235706 - DNA, 20 bp, human
ggcaagatgagtctctgagt

SEQ ID NO: 235707 - DNA, 20 bp, human
gggctccacccatcactgtt

SEQ ID NO: 235708 - DNA, 20 bp, human
gaaccgcaatggatgctggg

SEQ ID NO: 235709 - DNA, 20 bp, human
ggctggctggctggctgcta

SEQ ID NO: 235710 - DNA, 20 bp, human
ggccagtctagctgctgcac

SEQ ID NO: 235711 - DNA, 20 bp, human
gagggaaccgcaatggatgc

SEQ ID NO: 235712 - DNA, 20 bp, human
gcagccccaacagtgatggg

SEQ ID NO: 235713 - DNA, 20 bp, human
gcttgcacagggaaccgcaa

SEQ ID NO: 235714 - DNA, 20 bp, human
ggtccctgtcattagttgtt

SEQ ID NO: 235715 - DNA, 20 bp, human
gagggactctcagatgcttg

SEQ ID NO: 235716 - DNA, 20 bp, human
ggtgaaaatgccaaagtcaa

SEQ ID NO: 235717 - DNA, 20 bp, human
ggaaaaagttaagcagaatc

SEQ ID NO: 235718 - DNA, 20 bp, human
ggggcatatgggaacagcag

SEQ ID NO: 235719 - DNA, 20 bp, human
gtgttccctgagagcctggg

SEQ ID NO: 235720 - DNA, 20 bp, human
gagtgtggaagagagggcgt

SEQ ID NO: 235721 - DNA, 20 bp, human
gccactggacacatgccctc

SEQ ID NO: 235722 - DNA, 20 bp, human
gggtagcgccatgtctgacc

SEQ ID NO: 235723 - DNA, 20 bp, human
gtggggaacccagctccagc

SEQ ID NO: 235724 - DNA, 20 bp, human
gttttcttgccgcttaacag

SEQ ID NO: 235725 - DNA, 20 bp, human
gggccccaaacgtcaccagc

SEQ ID NO: 235726 - DNA, 20 bp, human
gcctgcgcggtgaattgctg

SEQ ID NO: 235727 - DNA, 20 bp, human
gcgcggtccacctatcgggg

SEQ ID NO: 235728 - DNA, 20 bp, human
gcaatcgcggtccacctatc

SEQ ID NO: 235729 - DNA, 20 bp, human
ggctccgcccccccgatagg

SEQ ID NO: 235730 - DNA, 20 bp, human
ggatgcgtccctaaactccc

SEQ ID NO: 235731 - DNA, 20 bp, human
gttggccccgcccaggaaag

SEQ ID NO: 235732 - DNA, 20 bp, human
gggggctccgcccccccgat

SEQ ID NO: 235733 - DNA, 20 bp, human
gaaaaccgtgagggtccctg

SEQ ID NO: 235734 - DNA, 20 bp, human
gtggcctttgtgggacctgg

SEQ ID NO: 235735 - DNA, 20 bp, human
gtcccacaaaggccaagccg

SEQ ID NO: 235736 - DNA, 20 bp, human
gcatgagaagactgtcaaag

SEQ ID NO: 235737 - DNA, 20 bp, human
gcaaaaagttagacagtgat

SEQ ID NO: 235738 - DNA, 20 bp, human
ggaaataagtctattgctgg

SEQ ID NO: 235739 - DNA, 20 bp, human
ggaagcgggaacctggtata

SEQ ID NO: 235740 - DNA, 20 bp, human
ggcctggaagtgaatgatat

SEQ ID NO: 235741 - DNA, 20 bp, human
gcaaagtggccaccttactc

SEQ ID NO: 235742 - DNA, 20 bp, human
gtaactaatcctgagtaagg

SEQ ID NO: 235743 - DNA, 20 bp, human
gacccatatcattcacttcc

SEQ ID NO: 235744 - DNA, 20 bp, human
gcagcaaaaacgttacgtaa

SEQ ID NO: 235745 - DNA, 20 bp, human
gctaatacgaagcgggaacc

SEQ ID NO: 235746 - DNA, 20 bp, human
gggggcagaggggcccgccc

SEQ ID NO: 235747 - DNA, 20 bp, human
ggtgacctaagacggaggga

SEQ ID NO: 235748 - DNA, 20 bp, human
gctgaggctgtaaataatcg

SEQ ID NO: 235749 - DNA, 20 bp, human
ggtgactaagcagcccgcag

SEQ ID NO: 235750 - DNA, 20 bp, human
gcctgcgcccagagacgcac

SEQ ID NO: 235751 - DNA, 20 bp, human
gaagtagcagccctcccggg

SEQ ID NO: 235752 - DNA, 20 bp, human
gtaaataatcggggctgcca

SEQ ID NO: 235753 - DNA, 20 bp, human
gtacagcctcagcagagcac

SEQ ID NO: 235754 - DNA, 20 bp, human
ggtcacagccccccttgctt

SEQ ID NO: 235755 - DNA, 20 bp, human
gtcggggctgccagggacgt

SEQ ID NO: 235756 - DNA, 20 bp, human
gcctccccctgacctctcga

SEQ ID NO: 235757 - DNA, 20 bp, human
ggaagtgcgtcgagtcacca

SEQ ID NO: 235758 - DNA, 20 bp, human
ggcggagcctcggcgttcat

SEQ ID NO: 235759 - DNA, 20 bp, human
gtggccttcgagaggtcagg

SEQ ID NO: 235760 - DNA, 20 bp, human
gttccgggatggtaggccaa

SEQ ID NO: 235761 - DNA, 20 bp, human
ggcagcccttggccttcgag

SEQ ID NO: 235762 - DNA, 20 bp, human
ggcgtcctgcgggaaaggac

SEQ ID NO: 235763 - DNA, 20 bp, human
gccttggccttcgagaggtc

SEQ ID NO: 235764 - DNA, 20 bp, human
gctgaggcgtcctgcgggaa

SEQ ID NO: 235765 - DNA, 20 bp, human
gagcccttggcctaccatcc

SEQ ID NO: 235766 - DNA, 20 bp, human
gggtctggagcctgcgactg

SEQ ID NO: 235767 - DNA, 20 bp, human
gggcgccgcgtcaacagcag

SEQ ID NO: 235768 - DNA, 20 bp, human
ggcgtcaacagcagcggttg

SEQ ID NO: 235769 - DNA, 20 bp, human
ggcgcgtgcgcggctctcgc

SEQ ID NO: 235770 - DNA, 20 bp, human
gtggagcctgcgactgggga

SEQ ID NO: 235771 - DNA, 20 bp, human
gaggccggatgcctgctcca

SEQ ID NO: 235772 - DNA, 20 bp, human
gccgcctgcccgctccacgg

SEQ ID NO: 235773 - DNA, 20 bp, human
ggggcccagcgccgcgcgaa

SEQ ID NO: 235774 - DNA, 20 bp, human
gagcaggcatccggcctccg

SEQ ID NO: 235775 - DNA, 20 bp, human
ggtcgcaggctccagacccg

SEQ ID NO: 235776 - DNA, 20 bp, human
gccacccagcacacttgtgt

SEQ ID NO: 235777 - DNA, 20 bp, human
gaaaaggccggggctaaaaa

SEQ ID NO: 235778 - DNA, 20 bp, human
ggggccccacacaagtgtgc

SEQ ID NO: 235779 - DNA, 20 bp, human
gaatcagagggattcctgcc

SEQ ID NO: 235780 - DNA, 20 bp, human
gaaaacggaacttaccaaac

SEQ ID NO: 235781 - DNA, 20 bp, human
gacacctacccaggcttgac

SEQ ID NO: 235782 - DNA, 20 bp, human
gctctgaatgacacctaccc

SEQ ID NO: 235783 - DNA, 20 bp, human
gagcccctgaattaatcaga

SEQ ID NO: 235784 - DNA, 20 bp, human
gttacaagacctccggtttc

SEQ ID NO: 235785 - DNA, 20 bp, human
gaaaaaatttacaagacctc

SEQ ID NO: 235786 - DNA, 20 bp, human
gttcctgcccaaggtaccca

SEQ ID NO: 235787 - DNA, 20 bp, human
gacggggagcaggcagtgtg

SEQ ID NO: 235788 - DNA, 20 bp, human
gccccagccctgggtacctt

SEQ ID NO: 235789 - DNA, 20 bp, human
gccacctgcccctgtttgaa

SEQ ID NO: 235790 - DNA, 20 bp, human
gcggggtggcgtgctcaggg

SEQ ID NO: 235791 - DNA, 20 bp, human
gccctgagcgggggttacgg

SEQ ID NO: 235792 - DNA, 20 bp, human
gagggcggggtggcgtgctc

SEQ ID NO: 235793 - DNA, 20 bp, human
gcatgcatcctggagggaca

SEQ ID NO: 235794 - DNA, 20 bp, human
gccagggctgccattcaaac

SEQ ID NO: 235795 - DNA, 20 bp, human
gaggacaaggccatgcatcc

SEQ ID NO: 235796 - DNA, 20 bp, human
ggaggaggcggggtgaggta

SEQ ID NO: 235797 - DNA, 20 bp, human
gagaggaaggagggcttaca

SEQ ID NO: 235798 - DNA, 20 bp, human
gaggctagatcgtacaagat

SEQ ID NO: 235799 - DNA, 20 bp, human
gggaaggagggcttacaagg

SEQ ID NO: 235800 - DNA, 20 bp, human
gttcctttctgcagatctgg

SEQ ID NO: 235801 - DNA, 20 bp, human
ggcaacggtgggagtaagta

SEQ ID NO: 235802 - DNA, 20 bp, human
gtctgggggtggataatacc

SEQ ID NO: 235803 - DNA, 20 bp, human
gatcgtacaagataggagag

SEQ ID NO: 235804 - DNA, 20 bp, human
gaggagggcttacaaggtgg

SEQ ID NO: 235805 - DNA, 20 bp, human
gtgggagtaagtagggccca

SEQ ID NO: 235806 - DNA, 20 bp, human
gacagatctgtgagcagtgg

SEQ ID NO: 235807 - DNA, 20 bp, human
gcacaaaactagtttagggt

SEQ ID NO: 235808 - DNA, 20 bp, human
ggaagcttctaaaaagccac

SEQ ID NO: 235809 - DNA, 20 bp, human
gggcacagatctgtgagcag

SEQ ID NO: 235810 - DNA, 20 bp, human
gagatttagtactttcccag

SEQ ID NO: 235811 - DNA, 20 bp, human
gtctctgagactaaagaggg

SEQ ID NO: 235812 - DNA, 20 bp, human
ggtttcacaaaactagttta

SEQ ID NO: 235813 - DNA, 20 bp, human
gacagactggaggggaacac

SEQ ID NO: 235814 - DNA, 20 bp, human
gactggctgaagccagacag

SEQ ID NO: 235815 - DNA, 20 bp, human
gttcaaaaccaagttggttc

SEQ ID NO: 235816 - DNA, 20 bp, human
gcccccggggcgtatgacgc

SEQ ID NO: 235817 - DNA, 20 bp, human
gcctagactcggggagagtg

SEQ ID NO: 235818 - DNA, 20 bp, human
gagggtgggacaaacaagac

SEQ ID NO: 235819 - DNA, 20 bp, human
gggaaggaggaggagctcgc

SEQ ID NO: 235820 - DNA, 20 bp, human
gcccgggggccctagactcg

SEQ ID NO: 235821 - DNA, 20 bp, human
gaacaagacgggtggagtag

SEQ ID NO: 235822 - DNA, 20 bp, human
ggctccggcgtcatacgccc

SEQ ID NO: 235823 - DNA, 20 bp, human
gctcgctggcaacaccctct

SEQ ID NO: 235824 - DNA, 20 bp, human
gggagagagtgagtcccaga

SEQ ID NO: 235825 - DNA, 20 bp, human
gctggggctctgcgtcacca

SEQ ID NO: 235826 - DNA, 20 bp, human
ggaggccagaggcgcgcccg

SEQ ID NO: 235827 - DNA, 20 bp, human
gacgggagggaccgagctgg

SEQ ID NO: 235828 - DNA, 20 bp, human
ggacggcgccccggggacac

SEQ ID NO: 235829 - DNA, 20 bp, human
gtaggcggtgcttgaactta

SEQ ID NO: 235830 - DNA, 20 bp, human
gcctccttcctgtgtccccg

SEQ ID NO: 235831 - DNA, 20 bp, human
gtacgcggtcggccagaagt

SEQ ID NO: 235832 - DNA, 20 bp, human
gacaaacgcggcgccgcgga

SEQ ID NO: 235833 - DNA, 20 bp, human
gggaagcgcgaagacaaacg

SEQ ID NO: 235834 - DNA, 20 bp, human
gtggaatggcggcggaatga

SEQ ID NO: 235835 - DNA, 20 bp, human
gatggcggcggaatgacggg

SEQ ID NO: 235836 - DNA, 20 bp, human
gctggagcgaaagaatgcgg

SEQ ID NO: 235837 - DNA, 20 bp, human
ggggctggagcgaaagaatg

SEQ ID NO: 235838 - DNA, 20 bp, human
gcgcgcagccgcacctcggc

SEQ ID NO: 235839 - DNA, 20 bp, human
gtctcagaacctgggccagg

SEQ ID NO: 235840 - DNA, 20 bp, human
gccttctcagaacctgggcc

SEQ ID NO: 235841 - DNA, 20 bp, human
gaggttctgagaaggccggg

SEQ ID NO: 235842 - DNA, 20 bp, human
gggaggttcctgccgaggtg

SEQ ID NO: 235843 - DNA, 20 bp, human
ggggttttgaaggtgctcat

SEQ ID NO: 235844 - DNA, 20 bp, human
gccagggaactgaaagtttg

SEQ ID NO: 235845 - DNA, 20 bp, human
gaagtcacaaggcacggata

SEQ ID NO: 235846 - DNA, 20 bp, human
gaggtgaacaggacgtagtt

SEQ ID NO: 235847 - DNA, 20 bp, human
gatagccaattagtggaaga

SEQ ID NO: 235848 - DNA, 20 bp, human
gcaaaccctcttccactaat

SEQ ID NO: 235849 - DNA, 20 bp, human
gcagagacatagccaattag

SEQ ID NO: 235850 - DNA, 20 bp, human
gcttgtagatatttcatttc

SEQ ID NO: 235851 - DNA, 20 bp, human
gaagtagacttgctgacctg

SEQ ID NO: 235852 - DNA, 20 bp, human
ggcttcccactcagctcctc

SEQ ID NO: 235853 - DNA, 20 bp, human
gggatcgctcaaggtcactt

SEQ ID NO: 235854 - DNA, 20 bp, human
gttcctaactacaaaatcca

SEQ ID NO: 235855 - DNA, 20 bp, human
gaagtgcaattgttttttac

SEQ ID NO: 235856 - DNA, 20 bp, human
gaaacacctcccacaaggaa

SEQ ID NO: 235857 - DNA, 20 bp, human
gacctgcctttccttgtggg

SEQ ID NO: 235858 - DNA, 20 bp, human
gtgaaatcagcatgttccag

SEQ ID NO: 235859 - DNA, 20 bp, human
ggaaacaggctatcatgact

SEQ ID NO: 235860 - DNA, 20 bp, human
gtaggagagacagacggagc

SEQ ID NO: 235861 - DNA, 20 bp, human
gagaaaccaatagactcggg

SEQ ID NO: 235862 - DNA, 20 bp, human
gcctctgtttacatagcaaa

SEQ ID NO: 235863 - DNA, 20 bp, human
ggatcagaaaccaatagact

SEQ ID NO: 235864 - DNA, 20 bp, human
gggtgccaatctccacatac

SEQ ID NO: 235865 - DNA, 20 bp, human
gtcagcatgttccagaggaa

SEQ ID NO: 235866 - DNA, 20 bp, human
gaagctgggctgctgttaca

SEQ ID NO: 235867 - DNA, 20 bp, human
ggggctgctgttacaggggc

SEQ ID NO: 235868 - DNA, 20 bp, human
gtctggctccgtgactcttg

SEQ ID NO: 235869 - DNA, 20 bp, human
gtcttggggtgcagcctgga

SEQ ID NO: 235870 - DNA, 20 bp, human
gggctgcaccccaagagtca

SEQ ID NO: 235871 - DNA, 20 bp, human
gctgctgttacaggggctgg

SEQ ID NO: 235872 - DNA, 20 bp, human
gtcttcttagaagaccctcg

SEQ ID NO: 235873 - DNA, 20 bp, human
gtgtcccggtccgtgtaatt

SEQ ID NO: 235874 - DNA, 20 bp, human
gatgggtgggctcccagcac

SEQ ID NO: 235875 - DNA, 20 bp, human
gctgctcaatcagtacatat

SEQ ID NO: 235876 - DNA, 20 bp, human
gccaactcggggtaggagag

SEQ ID NO: 235877 - DNA, 20 bp, human
gtgggaggggccgggaatcg

SEQ ID NO: 235878 - DNA, 20 bp, human
gtgggcgccttcttccgggt

SEQ ID NO: 235879 - DNA, 20 bp, human
gggggtgggcgccttcttcc

SEQ ID NO: 235880 - DNA, 20 bp, human
ggggccacgtggcccctacc

SEQ ID NO: 235881 - DNA, 20 bp, human
gaaggcgcccacccccgcaa

SEQ ID NO: 235882 - DNA, 20 bp, human
ggccggcggccactcggcgg

SEQ ID NO: 235883 - DNA, 20 bp, human
ggcctcacctgggcttccca

SEQ ID NO: 235884 - DNA, 20 bp, human
gggcgcctggggcccccctc

SEQ ID NO: 235885 - DNA, 20 bp, human
gttaccgcgtcacatgaggg

SEQ ID NO: 235886 - DNA, 20 bp, human
gggtcagcccagaggtccag

SEQ ID NO: 235887 - DNA, 20 bp, human
ggggtgcaaacggagtccta

SEQ ID NO: 235888 - DNA, 20 bp, human
gtacaggcccctcccttggt

SEQ ID NO: 235889 - DNA, 20 bp, human
gctaatgactaagagagagg

SEQ ID NO: 235890 - DNA, 20 bp, human
ggtaaccatctgctggggaa

SEQ ID NO: 235891 - DNA, 20 bp, human
gaaagtcaacagtgtcacat

SEQ ID NO: 235892 - DNA, 20 bp, human
gcaaaggtaaccatctgctg

SEQ ID NO: 235893 - DNA, 20 bp, human
gcagccctctcttggaaagg

SEQ ID NO: 235894 - DNA, 20 bp, human
gaaagtctcacttcctgtac

SEQ ID NO: 235895 - DNA, 20 bp, human
gcagttgtggcaagtagcta

SEQ ID NO: 235896 - DNA, 20 bp, human
gaagtaggcggcaagaggaa

SEQ ID NO: 235897 - DNA, 20 bp, human
ggggggcggagacatcatca

SEQ ID NO: 235898 - DNA, 20 bp, human
gtatacattgtctggtccac

SEQ ID NO: 235899 - DNA, 20 bp, human
gtgttgttgtggtgaagtat

SEQ ID NO: 235900 - DNA, 20 bp, human
gacagtgtcaggtgcatagg

SEQ ID NO: 235901 - DNA, 20 bp, human
gcacaactgtaaggtgtagc

SEQ ID NO: 235902 - DNA, 20 bp, human
gcaacacactatacattgtc

SEQ ID NO: 235903 - DNA, 20 bp, human
gcaagcaagtaggcggcaag

SEQ ID NO: 235904 - DNA, 20 bp, human
gaatgtatagtgtgttgttg

SEQ ID NO: 235905 - DNA, 20 bp, human
gaactgtaaggtgtagcagg

SEQ ID NO: 235906 - DNA, 20 bp, human
ggctgtgggcccggtgggag

SEQ ID NO: 235907 - DNA, 20 bp, human
ggagagctgccctgagagca

SEQ ID NO: 235908 - DNA, 20 bp, human
ggcggtgcctcagaccaggg

SEQ ID NO: 235909 - DNA, 20 bp, human
gtgggtgactcatgggtcat

SEQ ID NO: 235910 - DNA, 20 bp, human
ggtggtgctgtgggcccggt

SEQ ID NO: 235911 - DNA, 20 bp, human
ggcactgtgtgggtgactca

SEQ ID NO: 235912 - DNA, 20 bp, human
ggtgactcatgggtcatggg

SEQ ID NO: 235913 - DNA, 20 bp, human
gtcctccctgtggagatgca

SEQ ID NO: 235914 - DNA, 20 bp, human
gaggcgggaggtctgaggta

SEQ ID NO: 235915 - DNA, 20 bp, human
ggcctgacgcactcctccca

SEQ ID NO: 235916 - DNA, 20 bp, human
ggggatgtccggccggtcga

SEQ ID NO: 235917 - DNA, 20 bp, human
gggacttgagcaattggcga

SEQ ID NO: 235918 - DNA, 20 bp, human
gttgggggcaggcaactctg

SEQ ID NO: 235919 - DNA, 20 bp, human
gggcaggctggtcccctgac

SEQ ID NO: 235920 - DNA, 20 bp, human
gctctctggggatgtccggc

SEQ ID NO: 235921 - DNA, 20 bp, human
ggcaactctgaggctcaccc

SEQ ID NO: 235922 - DNA, 20 bp, human
gagtctgaagatcctaaagt

SEQ ID NO: 235923 - DNA, 20 bp, human
gctccactgcacatttatta

SEQ ID NO: 235924 - DNA, 20 bp, human
gtgtccggccggtcgagggg

SEQ ID NO: 235925 - DNA, 20 bp, human
ggcccctctctggggatgtc

SEQ ID NO: 235926 - DNA, 20 bp, human
ggaacacaggggtaggggat

SEQ ID NO: 235927 - DNA, 20 bp, human
gacgctgaggtccagaacac

SEQ ID NO: 235928 - DNA, 20 bp, human
gtggagctggggagatcgtc

SEQ ID NO: 235929 - DNA, 20 bp, human
gacagggaggacatggggac

SEQ ID NO: 235930 - DNA, 20 bp, human
gggtccagaacacaggggta

SEQ ID NO: 235931 - DNA, 20 bp, human
gcaggaacccccagtctcat

SEQ ID NO: 235932 - DNA, 20 bp, human
ggaagcacagggaggacatg

SEQ ID NO: 235933 - DNA, 20 bp, human
gtaaccagaaggaccgagtt

SEQ ID NO: 235934 - DNA, 20 bp, human
gggagaacggagcctcaccc

SEQ ID NO: 235935 - DNA, 20 bp, human
gtgaagcagaaggcatccct

SEQ ID NO: 235936 - DNA, 20 bp, human
gcgaaggcggcgagcgccgt

SEQ ID NO: 235937 - DNA, 20 bp, human
gtgggcgggccaggagaacc

SEQ ID NO: 235938 - DNA, 20 bp, human
gcccgcctgcgcagaagtgg

SEQ ID NO: 235939 - DNA, 20 bp, human
ggcgggatgtggggttctga

SEQ ID NO: 235940 - DNA, 20 bp, human
gggtgcttcgaggagatctg

SEQ ID NO: 235941 - DNA, 20 bp, human
gcgagcgccgtgggtctggg

SEQ ID NO: 235942 - DNA, 20 bp, human
gtgcggggaaccaccggcag

SEQ ID NO: 235943 - DNA, 20 bp, human
gtcgccgccttcgcccgctt

SEQ ID NO: 235944 - DNA, 20 bp, human
ggcggcgagcgccgtgggtc

SEQ ID NO: 235945 - DNA, 20 bp, human
gagtcctaagcgggcgaagg

SEQ ID NO: 235946 - DNA, 20 bp, human
ggaaggccactccgcccact

SEQ ID NO: 235947 - DNA, 20 bp, human
gccacatcctgccccgcaaa

SEQ ID NO: 235948 - DNA, 20 bp, human
gtgcccagaaacaagtgatg

SEQ ID NO: 235949 - DNA, 20 bp, human
ggcagccaatgggatcgtgc

SEQ ID NO: 235950 - DNA, 20 bp, human
gtgggcggagtggccttctg

SEQ ID NO: 235951 - DNA, 20 bp, human
gaacaagtgatgagggccct

SEQ ID NO: 235952 - DNA, 20 bp, human
gggccctcatcacttgtttc

SEQ ID NO: 235953 - DNA, 20 bp, human
gaagctgccttttgcggggc

SEQ ID NO: 235954 - DNA, 20 bp, human
gcaaagtgctttcctgtcta

SEQ ID NO: 235955 - DNA, 20 bp, human
gtggcctttctacctgcctg

SEQ ID NO: 235956 - DNA, 20 bp, human
gcccctgccgggtatgcttc

SEQ ID NO: 235957 - DNA, 20 bp, human
gacccaagcagccacctctc

SEQ ID NO: 235958 - DNA, 20 bp, human
ggcaaagggcccagtagcga

SEQ ID NO: 235959 - DNA, 20 bp, human
gaaactgctccctgcacctg

SEQ ID NO: 235960 - DNA, 20 bp, human
gccactggagcccatctccg

SEQ ID NO: 235961 - DNA, 20 bp, human
gagtcctgggcatgtgtcat

SEQ ID NO: 235962 - DNA, 20 bp, human
gaagaggctggttcaagggc

SEQ ID NO: 235963 - DNA, 20 bp, human
gcctagggaacctgagtcct

SEQ ID NO: 235964 - DNA, 20 bp, human
ggggggaagaggctggttca

SEQ ID NO: 235965 - DNA, 20 bp, human
gactgggccctttgcttgtt

SEQ ID NO: 235966 - DNA, 20 bp, human
gggggtaagcacagacagag

SEQ ID NO: 235967 - DNA, 20 bp, human
gggcgaccgccaaaccttag

SEQ ID NO: 235968 - DNA, 20 bp, human
gcacagacagaggggagcac

SEQ ID NO: 235969 - DNA, 20 bp, human
gcctgggccgtgagcgaaat

SEQ ID NO: 235970 - DNA, 20 bp, human
gccggcaagtctctattcct

SEQ ID NO: 235971 - DNA, 20 bp, human
gccttcggggagttggcaga

SEQ ID NO: 235972 - DNA, 20 bp, human
gtcctctgtggatgcctctg

SEQ ID NO: 235973 - DNA, 20 bp, human
gcaggggatgaccaccggtg

SEQ ID NO: 235974 - DNA, 20 bp, human
gaccagctctccggggaccc

SEQ ID NO: 235975 - DNA, 20 bp, human
ggggagttggcagacggcag

SEQ ID NO: 235976 - DNA, 20 bp, human
gcacgagcaccaggcggcct

SEQ ID NO: 235977 - DNA, 20 bp, human
gagtccatgcacggtggtga

SEQ ID NO: 235978 - DNA, 20 bp, human
gtcagtgccaggagttggac

SEQ ID NO: 235979 - DNA, 20 bp, human
gatggtgcccgagaagagtg

SEQ ID NO: 235980 - DNA, 20 bp, human
gcctccctcaccaccgtgca

SEQ ID NO: 235981 - DNA, 20 bp, human
gagaagaagacggcagcaga

SEQ ID NO: 235982 - DNA, 20 bp, human
ggggactcaggagtaactct

SEQ ID NO: 235983 - DNA, 20 bp, human
ggttgcttttgtagaggctg

SEQ ID NO: 235984 - DNA, 20 bp, human
gtggcaacctagttggaaat

SEQ ID NO: 235985 - DNA, 20 bp, human
gagatgcccctcactcttct

SEQ ID NO: 235986 - DNA, 20 bp, human
ggcgcgcagccgaggggtat

SEQ ID NO: 235987 - DNA, 20 bp, human
gccgaaacgcgccaagttgg

SEQ ID NO: 235988 - DNA, 20 bp, human
gcagggccgcgcctgaggac

SEQ ID NO: 235989 - DNA, 20 bp, human
gccggggcggggcctatgga

SEQ ID NO: 235990 - DNA, 20 bp, human
gccgccagggcgcgcagccg

SEQ ID NO: 235991 - DNA, 20 bp, human
ggcggggcctatggaggggc

SEQ ID NO: 235992 - DNA, 20 bp, human
gaacgcgccaagttgggggt

SEQ ID NO: 235993 - DNA, 20 bp, human
gcggagcgcgacagcagctt

SEQ ID NO: 235994 - DNA, 20 bp, human
ggggcccaggtgcaccgtgc

SEQ ID NO: 235995 - DNA, 20 bp, human
ggccctgctgccaccccctt

SEQ ID NO: 235996 - DNA, 20 bp, human
ggggccaggctccaagtaga

SEQ ID NO: 235997 - DNA, 20 bp, human
gccccgggagtcaggagcat

SEQ ID NO: 235998 - DNA, 20 bp, human
gtaggccttgcgtgtggggt

SEQ ID NO: 235999 - DNA, 20 bp, human
gccttgctggctcccgagca

SEQ ID NO: 236000 - DNA, 20 bp, human
gctgaagagccccgggagtc

SEQ ID NO: 236001 - DNA, 20 bp, human
gtgacacctggtccctgctc

SEQ ID NO: 236002 - DNA, 20 bp, human
ggagcatggggcgggtgctt

SEQ ID NO: 236003 - DNA, 20 bp, human
gctgcttaggccttgcgtgt

SEQ ID NO: 236004 - DNA, 20 bp, human
ggtacgaagagcactgcagc

SEQ ID NO: 236005 - DNA, 20 bp, human
gtgcgcccaccccacacgca

SEQ ID NO: 236006 - DNA, 20 bp, human
gagcgcaccgccttcccaaa

SEQ ID NO: 236007 - DNA, 20 bp, human
gggcgaggctggttggggta

SEQ ID NO: 236008 - DNA, 20 bp, human
gccgcccccaggttacactg

SEQ ID NO: 236009 - DNA, 20 bp, human
ggcagcgccgtgagtggaca

SEQ ID NO: 236010 - DNA, 20 bp, human
gttcccaaagggctcggggg

SEQ ID NO: 236011 - DNA, 20 bp, human
gggggtacggccatagtggg

SEQ ID NO: 236012 - DNA, 20 bp, human
gctgcagccggggaacgccg

SEQ ID NO: 236013 - DNA, 20 bp, human
gccccgcccccgagcccttt

SEQ ID NO: 236014 - DNA, 20 bp, human
gcccgggggcgaggctggtt

SEQ ID NO: 236015 - DNA, 20 bp, human
ggccttcccaaagggctcgg

SEQ ID NO: 236016 - DNA, 20 bp, human
gaactcggggcgcccggccc

SEQ ID NO: 236017 - DNA, 20 bp, human
gcgccctcctagtcccgctt

SEQ ID NO: 236018 - DNA, 20 bp, human
gggggacgcgcacgcggcga

SEQ ID NO: 236019 - DNA, 20 bp, human
ggcagcagcgacgcgaactc

SEQ ID NO: 236020 - DNA, 20 bp, human
gcccgcgtgacgcccagcgc

SEQ ID NO: 236021 - DNA, 20 bp, human
gtgcccgccggggaatcccc

SEQ ID NO: 236022 - DNA, 20 bp, human
gccccggcctaagcgggact

SEQ ID NO: 236023 - DNA, 20 bp, human
gcggcctaagcgggactagg

SEQ ID NO: 236024 - DNA, 20 bp, human
gggggcgccccggcctaagc

SEQ ID NO: 236025 - DNA, 20 bp, human
gagcccgggggattccccgg

SEQ ID NO: 236026 - DNA, 20 bp, human
gggaactatgagaggaatag

SEQ ID NO: 236027 - DNA, 20 bp, human
ggaataggggcatctaactc

SEQ ID NO: 236028 - DNA, 20 bp, human
ggcggtgggggatatgaaag

SEQ ID NO: 236029 - DNA, 20 bp, human
gggctaagaaaagttggagt

SEQ ID NO: 236030 - DNA, 20 bp, human
gattaggcgaatggcggtgg

SEQ ID NO: 236031 - DNA, 20 bp, human
gcttaaatgtcgttataaaa

SEQ ID NO: 236032 - DNA, 20 bp, human
gtaactgatttagttaacat

SEQ ID NO: 236033 - DNA, 20 bp, human
gagagtataaatgccatgaa

SEQ ID NO: 236034 - DNA, 20 bp, human
gaatgcttactacattaaat

SEQ ID NO: 236035 - DNA, 20 bp, human
gaaatacagggaactatgag

SEQ ID NO: 236036 - DNA, 20 bp, human
ggatggggagatgttctgta

SEQ ID NO: 236037 - DNA, 20 bp, human
gaggactgcataaccaagga

SEQ ID NO: 236038 - DNA, 20 bp, human
gtgtaaggactgcataacca

SEQ ID NO: 236039 - DNA, 20 bp, human
gctcatcttaacgtcatgtc

SEQ ID NO: 236040 - DNA, 20 bp, human
gagtttaaactcattgacgt

SEQ ID NO: 236041 - DNA, 20 bp, human
gtgtggaaattggcagggtt

SEQ ID NO: 236042 - DNA, 20 bp, human
ggagtttcactgagctgggg

SEQ ID NO: 236043 - DNA, 20 bp, human
gagtgaaactctccacactt

SEQ ID NO: 236044 - DNA, 20 bp, human
gttctattttgttgctgcgg

SEQ ID NO: 236045 - DNA, 20 bp, human
gtttttgagggaatttcaag

SEQ ID NO: 236046 - DNA, 20 bp, human
gtctgggaatctgtcaggga

SEQ ID NO: 236047 - DNA, 20 bp, human
gggatctctgggaatctgtc

SEQ ID NO: 236048 - DNA, 20 bp, human
gagcatgagtgtaaagccct

SEQ ID NO: 236049 - DNA, 20 bp, human
gttgtggatggggctccctt

SEQ ID NO: 236050 - DNA, 20 bp, human
gtggatggggctccctttgg

SEQ ID NO: 236051 - DNA, 20 bp, human
ggacagccttcaatgagtga

SEQ ID NO: 236052 - DNA, 20 bp, human
gagtggaaatgcccacctgc

SEQ ID NO: 236053 - DNA, 20 bp, human
ggctttacactcatgctccg

SEQ ID NO: 236054 - DNA, 20 bp, human
ggaactgcattttcatctat

SEQ ID NO: 236055 - DNA, 20 bp, human
ggggctagaagtgaagcaca

SEQ ID NO: 236056 - DNA, 20 bp, human
gaggctggggcccgtgaata

SEQ ID NO: 236057 - DNA, 20 bp, human
gcccgtgaatagggccgtcg

SEQ ID NO: 236058 - DNA, 20 bp, human
ggcagcctggccaggcaact

SEQ ID NO: 236059 - DNA, 20 bp, human
ggcctcgacggccctattca

SEQ ID NO: 236060 - DNA, 20 bp, human
gcctggccaggctgcctcga

SEQ ID NO: 236061 - DNA, 20 bp, human
ggggtgactctcctcggcgg

SEQ ID NO: 236062 - DNA, 20 bp, human
gacaccgacacccaaagctt

SEQ ID NO: 236063 - DNA, 20 bp, human
gcagctgaaaactgcgggtt

SEQ ID NO: 236064 - DNA, 20 bp, human
ggggggcagctgaaaactgc

SEQ ID NO: 236065 - DNA, 20 bp, human
ggcgacaaccgcgaaaagga

SEQ ID NO: 236066 - DNA, 20 bp, human
gactcaaacaagacaagaag

SEQ ID NO: 236067 - DNA, 20 bp, human
gcgacgctgtttgtaggttg

SEQ ID NO: 236068 - DNA, 20 bp, human
ggaggtgagctgggaactgg

SEQ ID NO: 236069 - DNA, 20 bp, human
gagggaggtgagctgggaac

SEQ ID NO: 236070 - DNA, 20 bp, human
ggaaggactgtgacgatcac

SEQ ID NO: 236071 - DNA, 20 bp, human
gaggccccgacgctgtttgt

SEQ ID NO: 236072 - DNA, 20 bp, human
gtagatcttaagaatttcga

SEQ ID NO: 236073 - DNA, 20 bp, human
gcgctgtttgtaggttgtgg

SEQ ID NO: 236074 - DNA, 20 bp, human
gtgaccccgagtgacagtag

SEQ ID NO: 236075 - DNA, 20 bp, human
gtgcaatgctaggaggatga

SEQ ID NO: 236076 - DNA, 20 bp, human
ggcgactaggcggggaaaca

SEQ ID NO: 236077 - DNA, 20 bp, human
gggagagggtcgggctccgc

SEQ ID NO: 236078 - DNA, 20 bp, human
gccccaagacggcttgaaga

SEQ ID NO: 236079 - DNA, 20 bp, human
gaggcctccacgtaagtccg

SEQ ID NO: 236080 - DNA, 20 bp, human
gcggtaaaagtggcagggag

SEQ ID NO: 236081 - DNA, 20 bp, human
ggggccggggctcgccgacc

SEQ ID NO: 236082 - DNA, 20 bp, human
gggctcgccgacctgggcgg

SEQ ID NO: 236083 - DNA, 20 bp, human
ggcctgcaaagaccccaaga

SEQ ID NO: 236084 - DNA, 20 bp, human
gcggggctcgccgacctggg

SEQ ID NO: 236085 - DNA, 20 bp, human
gcaaacgcgggggaaccgga

SEQ ID NO: 236086 - DNA, 20 bp, human
gactgtggaaacagcgacgg

SEQ ID NO: 236087 - DNA, 20 bp, human
gaacaacagcaccgtgatga

SEQ ID NO: 236088 - DNA, 20 bp, human
gcggtgctgttgttcataaa

SEQ ID NO: 236089 - DNA, 20 bp, human
gtcaagccggcagtatctcg

SEQ ID NO: 236090 - DNA, 20 bp, human
ggagcctcggaggcatgcca

SEQ ID NO: 236091 - DNA, 20 bp, human
gcatgccatggagtgagcag

SEQ ID NO: 236092 - DNA, 20 bp, human
gatggcatgaggagcctcgg

SEQ ID NO: 236093 - DNA, 20 bp, human
ggcaccgtgatgaaggcagc

SEQ ID NO: 236094 - DNA, 20 bp, human
gactccatggcatgcctccg

SEQ ID NO: 236095 - DNA, 20 bp, human
gaggatgcgccttgggtcag

SEQ ID NO: 236096 - DNA, 20 bp, human
gcaggaaagtaatgtggttc

SEQ ID NO: 236097 - DNA, 20 bp, human
gcaggaaatgaaacgtagac

SEQ ID NO: 236098 - DNA, 20 bp, human
gaactctaccacacacgcct

SEQ ID NO: 236099 - DNA, 20 bp, human
gtcctgaataagagactctt

SEQ ID NO: 236100 - DNA, 20 bp, human
gtgggaagacgagggaaggt

SEQ ID NO: 236101 - DNA, 20 bp, human
gcgtctgggaagacgaggga

SEQ ID NO: 236102 - DNA, 20 bp, human
gccctcgtctgggaagacga

SEQ ID NO: 236103 - DNA, 20 bp, human
gcctgggtctgtttatcact

SEQ ID NO: 236104 - DNA, 20 bp, human
ggggttttttagcacgaagt

SEQ ID NO: 236105 - DNA, 20 bp, human
gctgcgtgatatcctttgtt

SEQ ID NO: 236106 - DNA, 20 bp, human
ggggcgagtcccaccagcgt

SEQ ID NO: 236107 - DNA, 20 bp, human
gttggggctggctgctctga

SEQ ID NO: 236108 - DNA, 20 bp, human
ggcagccagccccaacacag

SEQ ID NO: 236109 - DNA, 20 bp, human
gccccaacacagaggccaaa

SEQ ID NO: 236110 - DNA, 20 bp, human
gtccctgggcaggcgcaaag

SEQ ID NO: 236111 - DNA, 20 bp, human
gtctggacgcccacgctggt

SEQ ID NO: 236112 - DNA, 20 bp, human
gaccctttggcctctgtgtt

SEQ ID NO: 236113 - DNA, 20 bp, human
ggtggctctgacgaaccctt

SEQ ID NO: 236114 - DNA, 20 bp, human
ggtgtgtatgcagcgcccct

SEQ ID NO: 236115 - DNA, 20 bp, human
gtagctctggacgcccacgc

SEQ ID NO: 236116 - DNA, 20 bp, human
gaagcccggggactcgaagg

SEQ ID NO: 236117 - DNA, 20 bp, human
gggcccggggaggagacaga

SEQ ID NO: 236118 - DNA, 20 bp, human
gcacgcgcgcacagaagggg

SEQ ID NO: 236119 - DNA, 20 bp, human
gcctccacgcgcgcacagaa

SEQ ID NO: 236120 - DNA, 20 bp, human
ggcgaagcccggggactcga

SEQ ID NO: 236121 - DNA, 20 bp, human
gctggctacggccctgtggg

SEQ ID NO: 236122 - DNA, 20 bp, human
gcacagggccgtagccaggg

SEQ ID NO: 236123 - DNA, 20 bp, human
gactcccctcggcgctgcct

SEQ ID NO: 236124 - DNA, 20 bp, human
ggtcggcgccgccctggcta

SEQ ID NO: 236125 - DNA, 20 bp, human
gactcgaagggggcgggtga

SEQ ID NO: 236126 - DNA, 20 bp, human
gcccaggcgccctcaggcgc

SEQ ID NO: 236127 - DNA, 20 bp, human
gggcgaggctgcagtatcgg

SEQ ID NO: 236128 - DNA, 20 bp, human
gctagagagccggcgcctga

SEQ ID NO: 236129 - DNA, 20 bp, human
gtgggctggggttaggccgg

SEQ ID NO: 236130 - DNA, 20 bp, human
gcggggcgaggctgcagtat

SEQ ID NO: 236131 - DNA, 20 bp, human
ggtcgggcgcgctagagagc

SEQ ID NO: 236132 - DNA, 20 bp, human
ggggccgcgttctggaggcg

SEQ ID NO: 236133 - DNA, 20 bp, human
gcgcgcgcgcgggctttggg

SEQ ID NO: 236134 - DNA, 20 bp, human
gcgggtggggacagagtgcg

SEQ ID NO: 236135 - DNA, 20 bp, human
ggagccccgccgcctctgca

SEQ ID NO: 236136 - DNA, 20 bp, human
ggggcagtgtgagatctcaa

SEQ ID NO: 236137 - DNA, 20 bp, human
gctaggagaggagcctccca

SEQ ID NO: 236138 - DNA, 20 bp, human
gtgaggggtgggtcagaagg

SEQ ID NO: 236139 - DNA, 20 bp, human
gccttaggaaccactctcac

SEQ ID NO: 236140 - DNA, 20 bp, human
ggctgagtccaaaccatggg

SEQ ID NO: 236141 - DNA, 20 bp, human
ggctgcagggacacacccaa

SEQ ID NO: 236142 - DNA, 20 bp, human
gcagccactgcggcatcccg

SEQ ID NO: 236143 - DNA, 20 bp, human
gcagcgggaaacaggagctc

SEQ ID NO: 236144 - DNA, 20 bp, human
gctctccttcactgagggaa

SEQ ID NO: 236145 - DNA, 20 bp, human
gggaagggctgaggctgaaa

SEQ ID NO: 236146 - DNA, 20 bp, human
gcggtgcttaactcggtcac

SEQ ID NO: 236147 - DNA, 20 bp, human
gcacacgaggagccctgaag

SEQ ID NO: 236148 - DNA, 20 bp, human
ggtgtgacgtcatagagagg

SEQ ID NO: 236149 - DNA, 20 bp, human
gtacagctcggtgcttaact

SEQ ID NO: 236150 - DNA, 20 bp, human
ggcgagaggcgggggcgcta

SEQ ID NO: 236151 - DNA, 20 bp, human
gtcaagcttgaggcgtcatc

SEQ ID NO: 236152 - DNA, 20 bp, human
gtaactcggtcaccggccga

SEQ ID NO: 236153 - DNA, 20 bp, human
gctcgtgtgacgtcatagag

SEQ ID NO: 236154 - DNA, 20 bp, human
gcctcctctcagcaactgta

SEQ ID NO: 236155 - DNA, 20 bp, human
ggcggggctttggcgccaga

SEQ ID NO: 236156 - DNA, 20 bp, human
gcgagaggccggttgttagg

SEQ ID NO: 236157 - DNA, 20 bp, human
gctggagcgacctgaaggga

SEQ ID NO: 236158 - DNA, 20 bp, human
ggggaacgaccgttgggtcg

SEQ ID NO: 236159 - DNA, 20 bp, human
gacaaccggcctctcggccg

SEQ ID NO: 236160 - DNA, 20 bp, human
ggcccagacccacggagtca

SEQ ID NO: 236161 - DNA, 20 bp, human
gcggggttgaggactcagcg

SEQ ID NO: 236162 - DNA, 20 bp, human
gacccgggagagaggtagag

SEQ ID NO: 236163 - DNA, 20 bp, human
gcgccctggagcgacctgaa

SEQ ID NO: 236164 - DNA, 20 bp, human
ggtcctgggtctccctagag

SEQ ID NO: 236165 - DNA, 20 bp, human
ggaccgttgggtcgcgggat

SEQ ID NO: 236166 - DNA, 20 bp, human
gtgggcgcgcaccctccttc

SEQ ID NO: 236167 - DNA, 20 bp, human
gtctacggatgccggaagga

SEQ ID NO: 236168 - DNA, 20 bp, human
gggcgcccagagttccggga

SEQ ID NO: 236169 - DNA, 20 bp, human
gcgagccgtggcaccggcat

SEQ ID NO: 236170 - DNA, 20 bp, human
ggggttctacggatgccgga

SEQ ID NO: 236171 - DNA, 20 bp, human
gctcgcggtgctaaaaggat

SEQ ID NO: 236172 - DNA, 20 bp, human
ggaccgagaaaaggaagcgg

SEQ ID NO: 236173 - DNA, 20 bp, human
gccctaaacgcacgctgacc

SEQ ID NO: 236174 - DNA, 20 bp, human
gcgtgcgtttagggcgaaga

SEQ ID NO: 236175 - DNA, 20 bp, human
ggtcaaaggcgggggttcta

SEQ ID NO: 236176 - DNA, 20 bp, human
ggcggggcgcctggtaactg

SEQ ID NO: 236177 - DNA, 20 bp, human
gctgctgcggagaaaggagc

SEQ ID NO: 236178 - DNA, 20 bp, human
ggcggagtcgtgaaagtgga

SEQ ID NO: 236179 - DNA, 20 bp, human
gtccgcggccatcccttaaa

SEQ ID NO: 236180 - DNA, 20 bp, human
ggcaacaaagccttagcaac

SEQ ID NO: 236181 - DNA, 20 bp, human
gctgaacagcaattggtgga

SEQ ID NO: 236182 - DNA, 20 bp, human
ggggctgtccctttaaggga

SEQ ID NO: 236183 - DNA, 20 bp, human
gcggctcctagtgacccgcg

SEQ ID NO: 236184 - DNA, 20 bp, human
gcactaggagccggttgcta

SEQ ID NO: 236185 - DNA, 20 bp, human
ggagtgggacaagacttaga

SEQ ID NO: 236186 - DNA, 20 bp, human
ggcaggaggcgctgtagcga

SEQ ID NO: 236187 - DNA, 20 bp, human
gcggcgtgacgtcacggaga

SEQ ID NO: 236188 - DNA, 20 bp, human
ggggcccacaaccctcctcg

SEQ ID NO: 236189 - DNA, 20 bp, human
gccacggaacagccctcctg

SEQ ID NO: 236190 - DNA, 20 bp, human
gccaatgcggcgtgacgtca

SEQ ID NO: 236191 - DNA, 20 bp, human
ggccgcggccgctgctgcgt

SEQ ID NO: 236192 - DNA, 20 bp, human
ggccgctgctgcgtaggcgc

SEQ ID NO: 236193 - DNA, 20 bp, human
ggggccccgaggagggttgt

SEQ ID NO: 236194 - DNA, 20 bp, human
gcagccggctgcgggcacct

SEQ ID NO: 236195 - DNA, 20 bp, human
ggctacagcgcctcctgccg

SEQ ID NO: 236196 - DNA, 20 bp, human
ggaaaacggacccgagttgt

SEQ ID NO: 236197 - DNA, 20 bp, human
gcccatctggcgcgggaaaa

SEQ ID NO: 236198 - DNA, 20 bp, human
gaggcgccgcagcgattcca

SEQ ID NO: 236199 - DNA, 20 bp, human
ggcatcggaaccaacaactc

SEQ ID NO: 236200 - DNA, 20 bp, human
ggatgcctctcctggcacgt

SEQ ID NO: 236201 - DNA, 20 bp, human
gaacgaatcccatctggcgc

SEQ ID NO: 236202 - DNA, 20 bp, human
gtgggcttctggttgccttg

SEQ ID NO: 236203 - DNA, 20 bp, human
ggggcattggcgagagagtc

SEQ ID NO: 236204 - DNA, 20 bp, human
gcgccgcagcgattccaggg

SEQ ID NO: 236205 - DNA, 20 bp, human
gttgctgtggacttccgggg

SEQ ID NO: 236206 - DNA, 20 bp, human
ggatttgaagggtacgagag

SEQ ID NO: 236207 - DNA, 20 bp, human
gcggcggagcgcgatttgaa

SEQ ID NO: 236208 - DNA, 20 bp, human
gaggactagtactggaaagc

SEQ ID NO: 236209 - DNA, 20 bp, human
gcggtggaaggcacgcaaaa

SEQ ID NO: 236210 - DNA, 20 bp, human
gcggagaggccaatgggcta

SEQ ID NO: 236211 - DNA, 20 bp, human
ggaagggggcgggccttccg

SEQ ID NO: 236212 - DNA, 20 bp, human
gggcgccagaggactagtac

SEQ ID NO: 236213 - DNA, 20 bp, human
gtgaagggtacgagaggggc

SEQ ID NO: 236214 - DNA, 20 bp, human
gtatcacgagagtctagcgg

SEQ ID NO: 236215 - DNA, 20 bp, human
gtggaaagccggccgggaca

SEQ ID NO: 236216 - DNA, 20 bp, human
ggcgccggggaatcccaccc

SEQ ID NO: 236217 - DNA, 20 bp, human
ggtgtcgtcagagcccgggt

SEQ ID NO: 236218 - DNA, 20 bp, human
gtccggccgaggcgcgcacc

SEQ ID NO: 236219 - DNA, 20 bp, human
gcgcccctgccggccctctc

SEQ ID NO: 236220 - DNA, 20 bp, human
gcccgggtgcgcgcctcggc

SEQ ID NO: 236221 - DNA, 20 bp, human
gggcccagagagggccggca

SEQ ID NO: 236222 - DNA, 20 bp, human
gcccctcgccggcttcttat

SEQ ID NO: 236223 - DNA, 20 bp, human
gccgcggtgtcgtcagagcc

SEQ ID NO: 236224 - DNA, 20 bp, human
ggggttggcgggcgaagaag

SEQ ID NO: 236225 - DNA, 20 bp, human
gtctgacgacaccgcggcgc

SEQ ID NO: 236226 - DNA, 20 bp, human
gtggccaagagctactgagg

SEQ ID NO: 236227 - DNA, 20 bp, human
gtgggagtaggggcaagaaa

SEQ ID NO: 236228 - DNA, 20 bp, human
gaaacgtcacgaagaggcgg

SEQ ID NO: 236229 - DNA, 20 bp, human
ggcaagagccggccaatgac

SEQ ID NO: 236230 - DNA, 20 bp, human
gtagaaaataggcggggcga

SEQ ID NO: 236231 - DNA, 20 bp, human
gagaagccacgacctctggg

SEQ ID NO: 236232 - DNA, 20 bp, human
gagggagaagccacgacctc

SEQ ID NO: 236233 - DNA, 20 bp, human
gaaatggccaagagctactg

SEQ ID NO: 236234 - DNA, 20 bp, human
gaaacaactacatccccaaa

SEQ ID NO: 236235 - DNA, 20 bp, human
gtgactgggaaaagtaaact

SEQ ID NO: 236236 - DNA, 20 bp, human
gcgggactctgccaggtcat

SEQ ID NO: 236237 - DNA, 20 bp, human
ggctgccgtccagttagctt

SEQ ID NO: 236238 - DNA, 20 bp, human
ggcccagcctagctgccatt

SEQ ID NO: 236239 - DNA, 20 bp, human
gaggtcatcggctctcagaa

SEQ ID NO: 236240 - DNA, 20 bp, human
gagcggggatcaaaatgaga

SEQ ID NO: 236241 - DNA, 20 bp, human
gctaggctgggccaatgaga

SEQ ID NO: 236242 - DNA, 20 bp, human
gagcccagagcagaagagcg

SEQ ID NO: 236243 - DNA, 20 bp, human
gctgccattcggttgagagg

SEQ ID NO: 236244 - DNA, 20 bp, human
gtctcctcctctcaaccgaa

SEQ ID NO: 236245 - DNA, 20 bp, human
gtagctgccattcggttgag

SEQ ID NO: 236246 - DNA, 20 bp, human
gggctctaaacggtggaact

SEQ ID NO: 236247 - DNA, 20 bp, human
gaactgatgggctctttcgc

SEQ ID NO: 236248 - DNA, 20 bp, human
ggcgccagggggatgtgcga

SEQ ID NO: 236249 - DNA, 20 bp, human
gcatccctagcggtgatccc

SEQ ID NO: 236250 - DNA, 20 bp, human
gagggtgtcagcaaccagag

SEQ ID NO: 236251 - DNA, 20 bp, human
gtcacctgggatcaccgcta

SEQ ID NO: 236252 - DNA, 20 bp, human
gggcccccaagcggaactga

SEQ ID NO: 236253 - DNA, 20 bp, human
gagcgcccagcgtaggaggt

SEQ ID NO: 236254 - DNA, 20 bp, human
gggggtagcgggttagatga

SEQ ID NO: 236255 - DNA, 20 bp, human
ggacgccaccaatggggtag

SEQ ID NO: 236256 - DNA, 20 bp, human
ggatctgcgagcccaacgat

SEQ ID NO: 236257 - DNA, 20 bp, human
gtgggcgcgcgcgcggagat

SEQ ID NO: 236258 - DNA, 20 bp, human
gctgctctggctatggggcg

SEQ ID NO: 236259 - DNA, 20 bp, human
gatgcgccaggctccccgtg

SEQ ID NO: 236260 - DNA, 20 bp, human
gcgagcggggataggttact

SEQ ID NO: 236261 - DNA, 20 bp, human
gggcctcatggcctatcgtt

SEQ ID NO: 236262 - DNA, 20 bp, human
gggggagcctggcgcatcat

SEQ ID NO: 236263 - DNA, 20 bp, human
ggccagagcaggatagtgtt

SEQ ID NO: 236264 - DNA, 20 bp, human
gtcgtggggctgagggaacg

SEQ ID NO: 236265 - DNA, 20 bp, human
gcgtgtgcttgctctggaaa

SEQ ID NO: 236266 - DNA, 20 bp, human
ggagtgttcgggtttcgctg

SEQ ID NO: 236267 - DNA, 20 bp, human
gcggtctgaaagggagtgtt

SEQ ID NO: 236268 - DNA, 20 bp, human
gggaaggggccgttaaggag

SEQ ID NO: 236269 - DNA, 20 bp, human
gacaagacgtgggccaagag

SEQ ID NO: 236270 - DNA, 20 bp, human
gcgcggtggacggtctgaaa

SEQ ID NO: 236271 - DNA, 20 bp, human
gtgcgtcactgacaagacgt

SEQ ID NO: 236272 - DNA, 20 bp, human
gtcctcgcgagcctcttcca

SEQ ID NO: 236273 - DNA, 20 bp, human
ggggctctgtaccgtggaag

SEQ ID NO: 236274 - DNA, 20 bp, human
gccagagtgagctgggatcc

SEQ ID NO: 236275 - DNA, 20 bp, human
gccaccgcgcgcccagcaga

SEQ ID NO: 236276 - DNA, 20 bp, human
gagaagagaaacctacgctt

SEQ ID NO: 236277 - DNA, 20 bp, human
gaaccctgggacggccgatt

SEQ ID NO: 236278 - DNA, 20 bp, human
gaagccgagcgggaaccaga

SEQ ID NO: 236279 - DNA, 20 bp, human
gagtcggaaatacccgaggt

SEQ ID NO: 236280 - DNA, 20 bp, human
ggggcgtggcgtgacagcgc

SEQ ID NO: 236281 - DNA, 20 bp, human
gagggagtcggaaatacccg

SEQ ID NO: 236282 - DNA, 20 bp, human
gacgcccaatcggccgtccc

SEQ ID NO: 236283 - DNA, 20 bp, human
ggtgtgcgtggctgaaggcg

SEQ ID NO: 236284 - DNA, 20 bp, human
gggaaaagcccgaagggagt

SEQ ID NO: 236285 - DNA, 20 bp, human
gcgagtctgacccaaagcgt

SEQ ID NO: 236286 - DNA, 20 bp, human
gtcggggatcggaagagccc

SEQ ID NO: 236287 - DNA, 20 bp, human
gccggccccggtcccgccta

SEQ ID NO: 236288 - DNA, 20 bp, human
gtccttgcgcacagcgtccg

SEQ ID NO: 236289 - DNA, 20 bp, human
gggcgccgtaggcgggaccg

SEQ ID NO: 236290 - DNA, 20 bp, human
gcacctcccggcgtcccctg

SEQ ID NO: 236291 - DNA, 20 bp, human
ggggccgggactccacctcc

SEQ ID NO: 236292 - DNA, 20 bp, human
gacgctgtgcgcaaggaggc

SEQ ID NO: 236293 - DNA, 20 bp, human
gcgcaggcgcaagtcggacc

SEQ ID NO: 236294 - DNA, 20 bp, human
ggccgagcgcctccgccggg

SEQ ID NO: 236295 - DNA, 20 bp, human
gcgggcgcgcaggcgcaagt

SEQ ID NO: 236296 - DNA, 20 bp, human
gggacggcctatcaactctg

SEQ ID NO: 236297 - DNA, 20 bp, human
ggcagggattgggtatgggg

SEQ ID NO: 236298 - DNA, 20 bp, human
gtgccagcgcacacccaagt

SEQ ID NO: 236299 - DNA, 20 bp, human
gacgactccccagagttgat

SEQ ID NO: 236300 - DNA, 20 bp, human
gtggacgcgtactttttcct

SEQ ID NO: 236301 - DNA, 20 bp, human
gtgccgaggcagattgtgta

SEQ ID NO: 236302 - DNA, 20 bp, human
gtgggagaccagggcacggg

SEQ ID NO: 236303 - DNA, 20 bp, human
gcgcacacccaagtggggtc

SEQ ID NO: 236304 - DNA, 20 bp, human
gctggcacctgtgggcgcag

SEQ ID NO: 236305 - DNA, 20 bp, human
gtgctccatgcgttccaccc

SEQ ID NO: 236306 - DNA, 20 bp, human
gggacggcggaagaaatagt

SEQ ID NO: 236307 - DNA, 20 bp, human
gagaaaacggggcttgaaac

SEQ ID NO: 236308 - DNA, 20 bp, human
gtaaccgctaatggcgctgt

SEQ ID NO: 236309 - DNA, 20 bp, human
gacagcctgggcctcgccac

SEQ ID NO: 236310 - DNA, 20 bp, human
gcgggccctttgcgtgtagt

SEQ ID NO: 236311 - DNA, 20 bp, human
gcggtgcgtcacttccggtt

SEQ ID NO: 236312 - DNA, 20 bp, human
gcgaagagctgcaagaaaac

SEQ ID NO: 236313 - DNA, 20 bp, human
ggccctttgcgtgtagtggg

SEQ ID NO: 236314 - DNA, 20 bp, human
ggcacacccggcgacagcct

SEQ ID NO: 236315 - DNA, 20 bp, human
gcggcgcggtgcgtcacttc

SEQ ID NO: 236316 - DNA, 20 bp, human
gaagcgcgagagggcacaat

SEQ ID NO: 236317 - DNA, 20 bp, human
ggaatggaacatccattcgg

SEQ ID NO: 236318 - DNA, 20 bp, human
gtcctgccgcgctgcacgct

SEQ ID NO: 236319 - DNA, 20 bp, human
gcattcgggggcggggtcaa

SEQ ID NO: 236320 - DNA, 20 bp, human
gtcgggggcggggtcaaagg

SEQ ID NO: 236321 - DNA, 20 bp, human
gcaacgagggggcggaacgg

SEQ ID NO: 236322 - DNA, 20 bp, human
gcgagcttcggccccactaa

SEQ ID NO: 236323 - DNA, 20 bp, human
gaggtcctgacagattgcaa

SEQ ID NO: 236324 - DNA, 20 bp, human
gccacagaacctcaggaaag

SEQ ID NO: 236325 - DNA, 20 bp, human
gggaagtgtagtttgcaacg

SEQ ID NO: 236326 - DNA, 20 bp, human
gggcggagccagggcagtcc

SEQ ID NO: 236327 - DNA, 20 bp, human
gaggctggggcgggtcaagg

SEQ ID NO: 236328 - DNA, 20 bp, human
gggcgcagctcgtgagttcg

SEQ ID NO: 236329 - DNA, 20 bp, human
gcgacaggcgggcggagcca

SEQ ID NO: 236330 - DNA, 20 bp, human
ggggtgcccgcggaagtggg

SEQ ID NO: 236331 - DNA, 20 bp, human
gtctcctgcgcgctgacgtc

SEQ ID NO: 236332 - DNA, 20 bp, human
gcgcgtgcgcgacaggcggg

SEQ ID NO: 236333 - DNA, 20 bp, human
gctgtcgcgcacgcgcgggc

SEQ ID NO: 236334 - DNA, 20 bp, human
gccgcgcgtgcgcgacaggc

SEQ ID NO: 236335 - DNA, 20 bp, human
gggcggtgcctggactgccc

SEQ ID NO: 236336 - DNA, 20 bp, human
gtgcgccagcccgaggggag

SEQ ID NO: 236337 - DNA, 20 bp, human
gcgggctggcgcagccactc

SEQ ID NO: 236338 - DNA, 20 bp, human
gcagtcccgccgcacagagg

SEQ ID NO: 236339 - DNA, 20 bp, human
ggctgccgcagcgtggaatg

SEQ ID NO: 236340 - DNA, 20 bp, human
gcgagcccgcgcccccttgg

SEQ ID NO: 236341 - DNA, 20 bp, human
ggacgagtctggatccaata

SEQ ID NO: 236342 - DNA, 20 bp, human
gccggtggggagcaggtaag

SEQ ID NO: 236343 - DNA, 20 bp, human
gcccagcggaggcccccaag

SEQ ID NO: 236344 - DNA, 20 bp, human
gtggcggagcatatggaggc

SEQ ID NO: 236345 - DNA, 20 bp, human
ggcgcgagcgcgagaggaga

SEQ ID NO: 236346 - DNA, 20 bp, human
gccagcgcagccaaccacta

SEQ ID NO: 236347 - DNA, 20 bp, human
ggggcctcgccgcttgccgt

SEQ ID NO: 236348 - DNA, 20 bp, human
ggggctgggccgccgggtcg

SEQ ID NO: 236349 - DNA, 20 bp, human
gcggccggccccgtagtggt

SEQ ID NO: 236350 - DNA, 20 bp, human
ggcggcggccggccccgtag

SEQ ID NO: 236351 - DNA, 20 bp, human
gcagccaaccactacggggc

SEQ ID NO: 236352 - DNA, 20 bp, human
gccagcatcccggctcccta

SEQ ID NO: 236353 - DNA, 20 bp, human
gcgggccgcccgagctggga

SEQ ID NO: 236354 - DNA, 20 bp, human
gcccgcagccaaccagggcg

SEQ ID NO: 236355 - DNA, 20 bp, human
gcgcgctgaggtcagcgcgg

SEQ ID NO: 236356 - DNA, 20 bp, human
gtcccggccaggaagtgcgg

SEQ ID NO: 236357 - DNA, 20 bp, human
gcgggggcgggcccaactcc

SEQ ID NO: 236358 - DNA, 20 bp, human
gcacctgcccgtccgtcggg

SEQ ID NO: 236359 - DNA, 20 bp, human
gcgcggctagaggtgaaggt

SEQ ID NO: 236360 - DNA, 20 bp, human
ggagccgcggctagaggtga

SEQ ID NO: 236361 - DNA, 20 bp, human
gggccctgacccaggaggcg

SEQ ID NO: 236362 - DNA, 20 bp, human
gggcgcggtggggttctgcg

SEQ ID NO: 236363 - DNA, 20 bp, human
gcggtggggttctgcggggt

SEQ ID NO: 236364 - DNA, 20 bp, human
ggccccgccccccgacggac

SEQ ID NO: 236365 - DNA, 20 bp, human
gcgcgcacctgcccgtccgt

SEQ ID NO: 236366 - DNA, 20 bp, human
gaggggaaccggtggaagag

SEQ ID NO: 236367 - DNA, 20 bp, human
gccgagagctggcagggacg

SEQ ID NO: 236368 - DNA, 20 bp, human
ggaccggagtcgcctccccg

SEQ ID NO: 236369 - DNA, 20 bp, human
gaggccacgaggggaaccgg

SEQ ID NO: 236370 - DNA, 20 bp, human
gagctggcagggacgcggct

SEQ ID NO: 236371 - DNA, 20 bp, human
gtgccccggggaggcgactc

SEQ ID NO: 236372 - DNA, 20 bp, human
gcggccgcgaggacggtgcc

SEQ ID NO: 236373 - DNA, 20 bp, human
ggccccaagcaaggccacga

SEQ ID NO: 236374 - DNA, 20 bp, human
ggaagaggggttggcggccg

SEQ ID NO: 236375 - DNA, 20 bp, human
gaggccagccggggaacgtg

SEQ ID NO: 236376 - DNA, 20 bp, human
gcgaccgctggacccgggag

SEQ ID NO: 236377 - DNA, 20 bp, human
ggtgccgctcccgggtccag

SEQ ID NO: 236378 - DNA, 20 bp, human
gccactccgggcaccgcccg

SEQ ID NO: 236379 - DNA, 20 bp, human
gcgcccggggctcccggcgt

SEQ ID NO: 236380 - DNA, 20 bp, human
ggcgccctggagtcctgtcc

SEQ ID NO: 236381 - DNA, 20 bp, human
gcgcgcgcgaccgctggacc

SEQ ID NO: 236382 - DNA, 20 bp, human
gcgtgggaggtgccgctccc

SEQ ID NO: 236383 - DNA, 20 bp, human
gcagggaaggatccggtcca

SEQ ID NO: 236384 - DNA, 20 bp, human
gccagcggtcgcgcgcgccc

SEQ ID NO: 236385 - DNA, 20 bp, human
ggcccgcggagccaatgccg

SEQ ID NO: 236386 - DNA, 20 bp, human
ggcgctggggaggtaacaat

SEQ ID NO: 236387 - DNA, 20 bp, human
gggccagggcacaggtaccg

SEQ ID NO: 236388 - DNA, 20 bp, human
ggggccgaccctcccagccg

SEQ ID NO: 236389 - DNA, 20 bp, human
ggcggcgcggggactcactg

SEQ ID NO: 236390 - DNA, 20 bp, human
gtccgcgcccaccggagccc

SEQ ID NO: 236391 - DNA, 20 bp, human
gtggaccctcggaggacaat

SEQ ID NO: 236392 - DNA, 20 bp, human
ggtcaccgttggaccctcgg

SEQ ID NO: 236393 - DNA, 20 bp, human
gcgcgcgcgcgcccggccac

SEQ ID NO: 236394 - DNA, 20 bp, human
ggagagaagtcgcctactgg

SEQ ID NO: 236395 - DNA, 20 bp, human
ggtacctgtgccctggcccg

SEQ ID NO: 236396 - DNA, 20 bp, human
gcggcccgcgatctccgcga

SEQ ID NO: 236397 - DNA, 20 bp, human
gaggccgaggcgcctcctgg

SEQ ID NO: 236398 - DNA, 20 bp, human
ggccgcgcggagcccacgaa

SEQ ID NO: 236399 - DNA, 20 bp, human
gcgcgggcggagcctggaag

SEQ ID NO: 236400 - DNA, 20 bp, human
gcggccgcgaacccccactg

SEQ ID NO: 236401 - DNA, 20 bp, human
gcccctctgcgctgatgtca

SEQ ID NO: 236402 - DNA, 20 bp, human
ggaacctctgcccgactgct

SEQ ID NO: 236403 - DNA, 20 bp, human
gccgaggaggccgagcagtc

SEQ ID NO: 236404 - DNA, 20 bp, human
gcggcctcccgggcttccga

SEQ ID NO: 236405 - DNA, 20 bp, human
gaggctgccccatacggagt

SEQ ID NO: 236406 - DNA, 20 bp, human
gaggcagggaggttcatcta

SEQ ID NO: 236407 - DNA, 20 bp, human
gcatggagggtgtctgagag

SEQ ID NO: 236408 - DNA, 20 bp, human
gcccctctgggcggagtgtg

SEQ ID NO: 236409 - DNA, 20 bp, human
gtcctgaaactggggaagtc

SEQ ID NO: 236410 - DNA, 20 bp, human
gtgtctgagaggggcagctc

SEQ ID NO: 236411 - DNA, 20 bp, human
ggaaaagctgaggcccctct

SEQ ID NO: 236412 - DNA, 20 bp, human
ggccaggactaagtgtgcag

SEQ ID NO: 236413 - DNA, 20 bp, human
gtctccatacagctgcaatc

SEQ ID NO: 236414 - DNA, 20 bp, human
gctaagtgtgcagggggaac

SEQ ID NO: 236415 - DNA, 20 bp, human
gccccctgcacacttagtcc

SEQ ID NO: 236416 - DNA, 20 bp, human
gcactgcgcgggacgtggga

SEQ ID NO: 236417 - DNA, 20 bp, human
gcggaggcactgcactgcgc

SEQ ID NO: 236418 - DNA, 20 bp, human
gcagaggggagcagtgcgcc

SEQ ID NO: 236419 - DNA, 20 bp, human
gcactgcactgcgcgggacg

SEQ ID NO: 236420 - DNA, 20 bp, human
gactgctcccctctggactg

SEQ ID NO: 236421 - DNA, 20 bp, human
gtaaagggaacgtgagattc

SEQ ID NO: 236422 - DNA, 20 bp, human
ggaggccctggcacccaagc

SEQ ID NO: 236423 - DNA, 20 bp, human
ggtacgagccggcagaggtg

SEQ ID NO: 236424 - DNA, 20 bp, human
ggctcccctctggactgcgg

SEQ ID NO: 236425 - DNA, 20 bp, human
gcgcgattacgaaacccgtc

SEQ ID NO: 236426 - DNA, 20 bp, human
gcggcaggcgatgggacccc

SEQ ID NO: 236427 - DNA, 20 bp, human
gactgcagcactcgcgggaa

SEQ ID NO: 236428 - DNA, 20 bp, human
gcccgcccccgccgtacctc

SEQ ID NO: 236429 - DNA, 20 bp, human
gcgcccctccggccgctcta

SEQ ID NO: 236430 - DNA, 20 bp, human
gcgcccctagagcggccgga

SEQ ID NO: 236431 - DNA, 20 bp, human
gacctccggcatgggcgaat

SEQ ID NO: 236432 - DNA, 20 bp, human
gcatgccggaggtacggcgg

SEQ ID NO: 236433 - DNA, 20 bp, human
gccaacccgcgcgcgagcct

SEQ ID NO: 236434 - DNA, 20 bp, human
gcccgcgagtgctgcagtcc

SEQ ID NO: 236435 - DNA, 20 bp, human
gcgggccgcggacatccgtg

SEQ ID NO: 236436 - DNA, 20 bp, human
ggtggcccaatcagaaagaa

SEQ ID NO: 236437 - DNA, 20 bp, human
gagaggtgacgcttctttgg

SEQ ID NO: 236438 - DNA, 20 bp, human
gctaatggccgcctccaatg

SEQ ID NO: 236439 - DNA, 20 bp, human
ggtgaatggcagagcgctaa

SEQ ID NO: 236440 - DNA, 20 bp, human
gtcctcgatggctgaagcag

SEQ ID NO: 236441 - DNA, 20 bp, human
ggttccgcccgagtcctcga

SEQ ID NO: 236442 - DNA, 20 bp, human
ggggccctactaaattcgtc

SEQ ID NO: 236443 - DNA, 20 bp, human
gggtgcccgggacaaagcgt

SEQ ID NO: 236444 - DNA, 20 bp, human
gtctgattgggccacattgg

SEQ ID NO: 236445 - DNA, 20 bp, human
gtgtttgcgttcggcctcag

SEQ ID NO: 236446 - DNA, 20 bp, human
gtggctgggaacttagtggt

SEQ ID NO: 236447 - DNA, 20 bp, human
gtaaggcgctttggccagag

SEQ ID NO: 236448 - DNA, 20 bp, human
gggctctcgcgagatagcgg

SEQ ID NO: 236449 - DNA, 20 bp, human
gtggacatgcgcggggcgta

SEQ ID NO: 236450 - DNA, 20 bp, human
gagatagcggcggtagcgct

SEQ ID NO: 236451 - DNA, 20 bp, human
gcgcggggcgtaaggcgctt

SEQ ID NO: 236452 - DNA, 20 bp, human
gaaagggaaaaagtgtcttg

SEQ ID NO: 236453 - DNA, 20 bp, human
gagtctcgcgagatattggg

SEQ ID NO: 236454 - DNA, 20 bp, human
gtacggctctcgcgagatag

SEQ ID NO: 236455 - DNA, 20 bp, human
gggtgggaacgtcacgcgta

SEQ ID NO: 236456 - DNA, 20 bp, human
gaggcggtgcccaaggcgaa

SEQ ID NO: 236457 - DNA, 20 bp, human
gaggccacgaccactgaacg

SEQ ID NO: 236458 - DNA, 20 bp, human
ggggagggaatctacatccg

SEQ ID NO: 236459 - DNA, 20 bp, human
gagacttggggctctctcat

SEQ ID NO: 236460 - DNA, 20 bp, human
gacagcgactctaagacttg

SEQ ID NO: 236461 - DNA, 20 bp, human
gaagacgcgcgattgcggca

SEQ ID NO: 236462 - DNA, 20 bp, human
ggtggaaagacgcgcgattg

SEQ ID NO: 236463 - DNA, 20 bp, human
ggcccggcctcgattctgat

SEQ ID NO: 236464 - DNA, 20 bp, human
gagggcgactctgggtaaag

SEQ ID NO: 236465 - DNA, 20 bp, human
gcacgaccactgaacggggg

SEQ ID NO: 236466 - DNA, 20 bp, human
gactgggcgtttgcgcaaga

SEQ ID NO: 236467 - DNA, 20 bp, human
gccagctagaagagcggtta

SEQ ID NO: 236468 - DNA, 20 bp, human
gccttggccagctagaagag

SEQ ID NO: 236469 - DNA, 20 bp, human
gggcgtttgcgcaagagggt

SEQ ID NO: 236470 - DNA, 20 bp, human
gaggtaggtgggtttttcta

SEQ ID NO: 236471 - DNA, 20 bp, human
gaccccgcggattccgctac

SEQ ID NO: 236472 - DNA, 20 bp, human
ggttacgggaatgaagcccg

SEQ ID NO: 236473 - DNA, 20 bp, human
ggcggcgggaagtgttgcgc

SEQ ID NO: 236474 - DNA, 20 bp, human
ggcggccggccacgtatata

SEQ ID NO: 236475 - DNA, 20 bp, human
gcccagtagcggaatccgcg

SEQ ID NO: 236476 - DNA, 20 bp, human
ggcccagctgaagtctggga

SEQ ID NO: 236477 - DNA, 20 bp, human
ggggccttgccttacagcgc

SEQ ID NO: 236478 - DNA, 20 bp, human
gggtgcgcgccgcggggtac

SEQ ID NO: 236479 - DNA, 20 bp, human
gcccacgtacggcgcacgta

SEQ ID NO: 236480 - DNA, 20 bp, human
gcccctcccagacttcagct

SEQ ID NO: 236481 - DNA, 20 bp, human
ggaccccgcgctgtaaggca

SEQ ID NO: 236482 - DNA, 20 bp, human
gtccgtgcccagctgaagtc

SEQ ID NO: 236483 - DNA, 20 bp, human
gctgctgtcgtaggcgagga

SEQ ID NO: 236484 - DNA, 20 bp, human
gagggggagccgcgaccgcc

SEQ ID NO: 236485 - DNA, 20 bp, human
gggggcaccgcgcccacgta

SEQ ID NO: 236486 - DNA, 20 bp, human
gagtgtgcgcggactggaga

SEQ ID NO: 236487 - DNA, 20 bp, human
gggagcgctcggagtgtgcg

SEQ ID NO: 236488 - DNA, 20 bp, human
gcaggcctctccctcggcac

SEQ ID NO: 236489 - DNA, 20 bp, human
ggcgagctgcagtcaacccg

SEQ ID NO: 236490 - DNA, 20 bp, human
gctaggaaacggctgcggta

SEQ ID NO: 236491 - DNA, 20 bp, human
ggaagccactccagtgccga

SEQ ID NO: 236492 - DNA, 20 bp, human
gctctccctcggcactggag

SEQ ID NO: 236493 - DNA, 20 bp, human
gcccagctaggaaacggctg

SEQ ID NO: 236494 - DNA, 20 bp, human
ggaaacggctgcggtaggga

SEQ ID NO: 236495 - DNA, 20 bp, human
gcggggctaacgctggagga

SEQ ID NO: 236496 - DNA, 20 bp, human
ggggcctatgggaactacgt

SEQ ID NO: 236497 - DNA, 20 bp, human
gccccctgccctgaccctat

SEQ ID NO: 236498 - DNA, 20 bp, human
gccaaaggaagctgttggtc

SEQ ID NO: 236499 - DNA, 20 bp, human
gtcgagccaaaggaagctgt

SEQ ID NO: 236500 - DNA, 20 bp, human
gggtgacgcctccttgataa

SEQ ID NO: 236501 - DNA, 20 bp, human
gtcaaggaggcgtcacccct

SEQ ID NO: 236502 - DNA, 20 bp, human
gaagacccgcctcgagccaa

SEQ ID NO: 236503 - DNA, 20 bp, human
gcggggcaggggcggagcac

SEQ ID NO: 236504 - DNA, 20 bp, human
gcgcgagaatggcagttgga

SEQ ID NO: 236505 - DNA, 20 bp, human
gtggtgactgtaggtgtcaa

SEQ ID NO: 236506 - DNA, 20 bp, human
gcacgcgggcggggcatctg

SEQ ID NO: 236507 - DNA, 20 bp, human
gcccgcgagtggccaatcag

SEQ ID NO: 236508 - DNA, 20 bp, human
gccgcccgagggccccacgt

SEQ ID NO: 236509 - DNA, 20 bp, human
gtgcgcctggggcccacgtg

SEQ ID NO: 236510 - DNA, 20 bp, human
ggcgcaggcgcgttcagttc

SEQ ID NO: 236511 - DNA, 20 bp, human
gggcgtggcggggcaaacag

SEQ ID NO: 236512 - DNA, 20 bp, human
ggccactcggcgtccacaaa

SEQ ID NO: 236513 - DNA, 20 bp, human
ggggcgcgcgcgagccccaa

SEQ ID NO: 236514 - DNA, 20 bp, human
ggcgggggcggggcaaccga

SEQ ID NO: 236515 - DNA, 20 bp, human
ggctgcggcgacggccgttg

SEQ ID NO: 236516 - DNA, 20 bp, human
gtggcagcggagggataatc

SEQ ID NO: 236517 - DNA, 20 bp, human
ggccgcacccggaagagacg

SEQ ID NO: 236518 - DNA, 20 bp, human
gcagcggaggcgtggcccag

SEQ ID NO: 236519 - DNA, 20 bp, human
ggcgtggcccaggggcgcga

SEQ ID NO: 236520 - DNA, 20 bp, human
gagcggagggataatcgggg

SEQ ID NO: 236521 - DNA, 20 bp, human
gcccggaagagacgtggcag

SEQ ID NO: 236522 - DNA, 20 bp, human
gagaaggggcgggacttgga

SEQ ID NO: 236523 - DNA, 20 bp, human
gacgcctccgctgccgctag

SEQ ID NO: 236524 - DNA, 20 bp, human
gtgccgctagaggtgaagac

SEQ ID NO: 236525 - DNA, 20 bp, human
gactggggtctgtagagaag

SEQ ID NO: 236526 - DNA, 20 bp, human
gtgagcgagtggcgcgaaaa

SEQ ID NO: 236527 - DNA, 20 bp, human
gaggctgggcgcgccgaccc

SEQ ID NO: 236528 - DNA, 20 bp, human
gtgagaaaggggggctttag

SEQ ID NO: 236529 - DNA, 20 bp, human
gaggaccgcgcagctgcaca

SEQ ID NO: 236530 - DNA, 20 bp, human
gctttctcaaaggggatttt

SEQ ID NO: 236531 - DNA, 20 bp, human
gcggtgaactcgattatgaa

SEQ ID NO: 236532 - DNA, 20 bp, human
gataagaggtgctacatcca

SEQ ID NO: 236533 - DNA, 20 bp, human
gtgcccaaggctatcctttg

SEQ ID NO: 236534 - DNA, 20 bp, human
ggtcctgcaagctgtggtaa

SEQ ID NO: 236535 - DNA, 20 bp, human
gaaaatggttcgtattgccc

SEQ ID NO: 236536 - DNA, 20 bp, human
gcctgcgaagacaaggtcag

SEQ ID NO: 236537 - DNA, 20 bp, human
gttagcgcgggagaaatgag

SEQ ID NO: 236538 - DNA, 20 bp, human
gttcgcaggcggcgcgagag

SEQ ID NO: 236539 - DNA, 20 bp, human
gaggtcagtggccgcgaagt

SEQ ID NO: 236540 - DNA, 20 bp, human
gctcccgcgctaaaccccgc

SEQ ID NO: 236541 - DNA, 20 bp, human
gcgcgaagttggaacgtgat

SEQ ID NO: 236542 - DNA, 20 bp, human
gcgcacttgacgccctggac

SEQ ID NO: 236543 - DNA, 20 bp, human
gggagccacgaggcccagtg

SEQ ID NO: 236544 - DNA, 20 bp, human
ggccgcctcactgggcctcg

SEQ ID NO: 236545 - DNA, 20 bp, human
gcagtgaggcggcaccgagg

SEQ ID NO: 236546 - DNA, 20 bp, human
gctgtcgcactcaggctata

SEQ ID NO: 236547 - DNA, 20 bp, human
ggcattgggcggaagaccct

SEQ ID NO: 236548 - DNA, 20 bp, human
gccaggagtacccgcgacgg

SEQ ID NO: 236549 - DNA, 20 bp, human
gtgggcggaagaccctgggc

SEQ ID NO: 236550 - DNA, 20 bp, human
gctcccaggagtacccgcga

SEQ ID NO: 236551 - DNA, 20 bp, human
gcggcctcgctgtcgcactc

SEQ ID NO: 236552 - DNA, 20 bp, human
gaggctatagggggcgcatt

SEQ ID NO: 236553 - DNA, 20 bp, human
gcggagccgggtgggttggt

SEQ ID NO: 236554 - DNA, 20 bp, human
gtgactgtggagtttgaatt

SEQ ID NO: 236555 - DNA, 20 bp, human
gtagcctgagtgcgacagcg

SEQ ID NO: 236556 - DNA, 20 bp, human
gggtgcagggctcccggcac

SEQ ID NO: 236557 - DNA, 20 bp, human
ggccgcaatggggagtagta

SEQ ID NO: 236558 - DNA, 20 bp, human
gggacccagcaacccggtgc

SEQ ID NO: 236559 - DNA, 20 bp, human
gctactccccattgcggcgt

SEQ ID NO: 236560 - DNA, 20 bp, human
gtcgcgaaggtcgcccatag

SEQ ID NO: 236561 - DNA, 20 bp, human
gtcaagtagcagaggatcca

SEQ ID NO: 236562 - DNA, 20 bp, human
ggtagactggcttcctctat

SEQ ID NO: 236563 - DNA, 20 bp, human
ggagaggcggtcgctgaggc

SEQ ID NO: 236564 - DNA, 20 bp, human
ggacttgtccccacctttcc

SEQ ID NO: 236565 - DNA, 20 bp, human
gccgctccaacgccgcaatg

SEQ ID NO: 236566 - DNA, 20 bp, human
gacagcccaggatcctcact

SEQ ID NO: 236567 - DNA, 20 bp, human
gctctcccagtgaggatcct

SEQ ID NO: 236568 - DNA, 20 bp, human
gaatcctctcagcaaactgc

SEQ ID NO: 236569 - DNA, 20 bp, human
gtgcctggctgtggtagccc

SEQ ID NO: 236570 - DNA, 20 bp, human
gagagttgggttactttccc

SEQ ID NO: 236571 - DNA, 20 bp, human
gcggagcctcaggacccgtc

SEQ ID NO: 236572 - DNA, 20 bp, human
ggcctcagagttacagagtt

SEQ ID NO: 236573 - DNA, 20 bp, human
gacccaactctgtaactctg

SEQ ID NO: 236574 - DNA, 20 bp, human
gcctgcagcaaagggctccc

SEQ ID NO: 236575 - DNA, 20 bp, human
gttcccgggctaccacagcc

SEQ ID NO: 236576 - DNA, 20 bp, human
gcgtctatgcgaggccgggt

SEQ ID NO: 236577 - DNA, 20 bp, human
gcggtggctcactaagacct

SEQ ID NO: 236578 - DNA, 20 bp, human
ggggtcaccgcgtctatgcg

SEQ ID NO: 236579 - DNA, 20 bp, human
gggccgtcagctccgccctg

SEQ ID NO: 236580 - DNA, 20 bp, human
gtcttagtgagccaccggcg

SEQ ID NO: 236581 - DNA, 20 bp, human
gcgtcagctccgccctgggg

SEQ ID NO: 236582 - DNA, 20 bp, human
gacgcggtgaccctctagcc

SEQ ID NO: 236583 - DNA, 20 bp, human
gctagggtctaggtgggtta

SEQ ID NO: 236584 - DNA, 20 bp, human
ggagttgctagggtctaggt

SEQ ID NO: 236585 - DNA, 20 bp, human
gtgcacggttctgattccac

SEQ ID NO: 236586 - DNA, 20 bp, human
ggacacaggcggattagatt

SEQ ID NO: 236587 - DNA, 20 bp, human
gaggggagggcgcatccgag

SEQ ID NO: 236588 - DNA, 20 bp, human
ggcaagtgaatgcgagggga

SEQ ID NO: 236589 - DNA, 20 bp, human
ggtgtccgtaatacaatctc

SEQ ID NO: 236590 - DNA, 20 bp, human
ggagggcgcatccgagagga

SEQ ID NO: 236591 - DNA, 20 bp, human
gcggtagtctggtgtaagga

SEQ ID NO: 236592 - DNA, 20 bp, human
ggagtctttctgccctgcgg

SEQ ID NO: 236593 - DNA, 20 bp, human
gagagagtctttctgccctg

SEQ ID NO: 236594 - DNA, 20 bp, human
gtgttcctgagattgtatta

SEQ ID NO: 236595 - DNA, 20 bp, human
gattgtattacggacacagg

SEQ ID NO: 236596 - DNA, 20 bp, human
gcggcgctccgactccctca

SEQ ID NO: 236597 - DNA, 20 bp, human
gcgggggctgagagaagccg

SEQ ID NO: 236598 - DNA, 20 bp, human
gctgcgagaggcagcgagat

SEQ ID NO: 236599 - DNA, 20 bp, human
gacgcacagccaatcaggga

SEQ ID NO: 236600 - DNA, 20 bp, human
gagcgagatgggcctcgcag

SEQ ID NO: 236601 - DNA, 20 bp, human
gagtctggagcgactgaagt

SEQ ID NO: 236602 - DNA, 20 bp, human
gagggaggctgccgctgtga

SEQ ID NO: 236603 - DNA, 20 bp, human
gggggcggccacgaatccag

SEQ ID NO: 236604 - DNA, 20 bp, human
ggtgagggaaggaaagggcg

SEQ ID NO: 236605 - DNA, 20 bp, human
gatccaggggttagcatctc

SEQ ID NO: 236606 - DNA, 20 bp, human
gctagcagcgggtgaagatt

SEQ ID NO: 236607 - DNA, 20 bp, human
ggggcggggagatgacagga

SEQ ID NO: 236608 - DNA, 20 bp, human
gggctggagctcaactgcag

SEQ ID NO: 236609 - DNA, 20 bp, human
gctgagagctaaggagtcct

SEQ ID NO: 236610 - DNA, 20 bp, human
ggcgagcggcgagccaatgg

SEQ ID NO: 236611 - DNA, 20 bp, human
gcattctacaatgaacgcta

SEQ ID NO: 236612 - DNA, 20 bp, human
gtctacaatgaacgctaggg

SEQ ID NO: 236613 - DNA, 20 bp, human
gttgagggcggggagatgac

SEQ ID NO: 236614 - DNA, 20 bp, human
ggcggcgagcggcgagccaa

SEQ ID NO: 236615 - DNA, 20 bp, human
gaaacattgagacagcttcc

SEQ ID NO: 236616 - DNA, 20 bp, human
gttgcccagcgtgatttgtg

SEQ ID NO: 236617 - DNA, 20 bp, human
gacggggtgagcacctcgcg

SEQ ID NO: 236618 - DNA, 20 bp, human
gtatctgccatgcaaaacga

SEQ ID NO: 236619 - DNA, 20 bp, human
gcccgtgcaattccattctc

SEQ ID NO: 236620 - DNA, 20 bp, human
gtcacgaaagcattgggtag

SEQ ID NO: 236621 - DNA, 20 bp, human
ggttttgcatggcagatacg

SEQ ID NO: 236622 - DNA, 20 bp, human
gaaatgggatgccacctccg

SEQ ID NO: 236623 - DNA, 20 bp, human
gaaacgagggagcgttagga

SEQ ID NO: 236624 - DNA, 20 bp, human
gtcagcctcacaaatcacgc

SEQ ID NO: 236625 - DNA, 20 bp, human
gtcgcgaggagcgagccccg

SEQ ID NO: 236626 - DNA, 20 bp, human
gcacgaaggaggcctctgac

SEQ ID NO: 236627 - DNA, 20 bp, human
gccccgccctagctcgccag

SEQ ID NO: 236628 - DNA, 20 bp, human
gctgagtgacagcacgaagg

SEQ ID NO: 236629 - DNA, 20 bp, human
gagcctctggcgagctaggg

SEQ ID NO: 236630 - DNA, 20 bp, human
ggggctgagtgacagcacga

SEQ ID NO: 236631 - DNA, 20 bp, human
ggaggcctctgacgggccga

SEQ ID NO: 236632 - DNA, 20 bp, human
gaggctgagtgacagcgtgt

SEQ ID NO: 236633 - DNA, 20 bp, human
gtgacagcgtgttggcaggc

SEQ ID NO: 236634 - DNA, 20 bp, human
gtgaccgcacgaggctggtg

SEQ ID NO: 236635 - DNA, 20 bp, human
gacgggccgagggccggcct

SEQ ID NO: 236636 - DNA, 20 bp, human
gcgtgactgccagctccagg

SEQ ID NO: 236637 - DNA, 20 bp, human
gcagcccaggaggtattcct

SEQ ID NO: 236638 - DNA, 20 bp, human
gagggccaaggaatacctcc

SEQ ID NO: 236639 - DNA, 20 bp, human
gaatacctcctgggctgtgc

SEQ ID NO: 236640 - DNA, 20 bp, human
gggttcagccacgcttgctc

SEQ ID NO: 236641 - DNA, 20 bp, human
gaagtcaatgagtaacttgg

SEQ ID NO: 236642 - DNA, 20 bp, human
gccaaagtcaatgagtaact

SEQ ID NO: 236643 - DNA, 20 bp, human
gaacaagcctgggaacatag

SEQ ID NO: 236644 - DNA, 20 bp, human
ggcttgctcaggagtggaaa

SEQ ID NO: 236645 - DNA, 20 bp, human
gggaggggcattcccagagg

SEQ ID NO: 236646 - DNA, 20 bp, human
gcaactatctctagagtgtg

SEQ ID NO: 236647 - DNA, 20 bp, human
gtgactgaagctgaagggag

SEQ ID NO: 236648 - DNA, 20 bp, human
gcatgaggaaagacacaata

SEQ ID NO: 236649 - DNA, 20 bp, human
gatctaatccatctcaaaac

SEQ ID NO: 236650 - DNA, 20 bp, human
gtctcctgtgctaagtgttg

SEQ ID NO: 236651 - DNA, 20 bp, human
gccgtcttttgtgtttgaga

SEQ ID NO: 236652 - DNA, 20 bp, human
ggtgtcattacttttactcc

SEQ ID NO: 236653 - DNA, 20 bp, human
gcactttttatgatacccag

SEQ ID NO: 236654 - DNA, 20 bp, human
gcaaacacaaaagacggagc

SEQ ID NO: 236655 - DNA, 20 bp, human
gctgtgtcattgctcagaca

SEQ ID NO: 236656 - DNA, 20 bp, human
gaaagggatatcagctggag

SEQ ID NO: 236657 - DNA, 20 bp, human
gaacgctataggggataaag

SEQ ID NO: 236658 - DNA, 20 bp, human
ggtggcgggaaacgctatag

SEQ ID NO: 236659 - DNA, 20 bp, human
ggctctgtaacaagggaaat

SEQ ID NO: 236660 - DNA, 20 bp, human
gaatggggaggaaatataaa

SEQ ID NO: 236661 - DNA, 20 bp, human
gataaagtggtgggtattac

SEQ ID NO: 236662 - DNA, 20 bp, human
gctataggggataaagtggt

SEQ ID NO: 236663 - DNA, 20 bp, human
gtaagcaggcttttcagcga

SEQ ID NO: 236664 - DNA, 20 bp, human
gtcaggaccagggtagaaag

SEQ ID NO: 236665 - DNA, 20 bp, human
gaatataaagggatatcagc

SEQ ID NO: 236666 - DNA, 20 bp, human
gcaaaagtatgcacggtggg

SEQ ID NO: 236667 - DNA, 20 bp, human
gtcccgagcgcgcctctgat

SEQ ID NO: 236668 - DNA, 20 bp, human
ggggaaactggggagcgaga

SEQ ID NO: 236669 - DNA, 20 bp, human
gaccgggagagcgcagcatc

SEQ ID NO: 236670 - DNA, 20 bp, human
gagcgcagcatcaggcagac

SEQ ID NO: 236671 - DNA, 20 bp, human
ggccccaaaagtatgcacgg

SEQ ID NO: 236672 - DNA, 20 bp, human
gatggagtgggagtagccac

SEQ ID NO: 236673 - DNA, 20 bp, human
gagtatgcacggtggggggt

SEQ ID NO: 236674 - DNA, 20 bp, human
gagccctgggctccgaggct

SEQ ID NO: 236675 - DNA, 20 bp, human
ggcctgatgctgcgctctcc

SEQ ID NO: 236676 - DNA, 20 bp, human
gcggacgtgccctctgtttg

SEQ ID NO: 236677 - DNA, 20 bp, human
gctgacgctcgttcatagtc

SEQ ID NO: 236678 - DNA, 20 bp, human
gaagaattttgcaagtagag

SEQ ID NO: 236679 - DNA, 20 bp, human
gtgtctttacttgatttctg

SEQ ID NO: 236680 - DNA, 20 bp, human
ggcttactcaatgctatttt

SEQ ID NO: 236681 - DNA, 20 bp, human
gactgtgtgtctatgcctca

SEQ ID NO: 236682 - DNA, 20 bp, human
gttatgatattttgcacaaa

SEQ ID NO: 236683 - DNA, 20 bp, human
gtttacataataataaacca

SEQ ID NO: 236684 - DNA, 20 bp, human
gtattggcctgagttgataa

SEQ ID NO: 236685 - DNA, 20 bp, human
gcagctaatccccaaacaga

SEQ ID NO: 236686 - DNA, 20 bp, human
gcggagagcagcgaagaagg

SEQ ID NO: 236687 - DNA, 20 bp, human
gagcgtctgcgagtgtgtgg

SEQ ID NO: 236688 - DNA, 20 bp, human
gagtccgcgggactcgcacc

SEQ ID NO: 236689 - DNA, 20 bp, human
ggagcggagagcagcgaaga

SEQ ID NO: 236690 - DNA, 20 bp, human
gcccagagatcaaggagctg

SEQ ID NO: 236691 - DNA, 20 bp, human
gcggggaccttggccggtgg

SEQ ID NO: 236692 - DNA, 20 bp, human
ggctctccgctccccgccaa

SEQ ID NO: 236693 - DNA, 20 bp, human
gacgccggggacagcgccgc

SEQ ID NO: 236694 - DNA, 20 bp, human
ggcgagtcccgcggactccg

SEQ ID NO: 236695 - DNA, 20 bp, human
ggaggtggaagtggagcgga

SEQ ID NO: 236696 - DNA, 20 bp, human
gaaaggggatgtgtggacgt

SEQ ID NO: 236697 - DNA, 20 bp, human
gaaagcaattaacgtccggt

SEQ ID NO: 236698 - DNA, 20 bp, human
gcctgctagggaaggcgcga

SEQ ID NO: 236699 - DNA, 20 bp, human
ggaccagtgaggggcaaaat

SEQ ID NO: 236700 - DNA, 20 bp, human
ggagaagagccccctggtcg

SEQ ID NO: 236701 - DNA, 20 bp, human
ggatgaaagcaattaacgtc

SEQ ID NO: 236702 - DNA, 20 bp, human
ggggacggtgaccgcgacca

SEQ ID NO: 236703 - DNA, 20 bp, human
gggaccgcgcgccacgctcg

SEQ ID NO: 236704 - DNA, 20 bp, human
ggggatgtgtggacgtgggg

SEQ ID NO: 236705 - DNA, 20 bp, human
gaccagggggctcttctcac

SEQ ID NO: 236706 - DNA, 20 bp, human
ggtggagactcggagaatgc

SEQ ID NO: 236707 - DNA, 20 bp, human
gggagtgtgcgtgtctgact

SEQ ID NO: 236708 - DNA, 20 bp, human
gctcccttcgcgcggatctg

SEQ ID NO: 236709 - DNA, 20 bp, human
ggcccctcctacaccaggag

SEQ ID NO: 236710 - DNA, 20 bp, human
gttcctcccgcagcctctgg

SEQ ID NO: 236711 - DNA, 20 bp, human
ggtcccctcctggtgtagga

SEQ ID NO: 236712 - DNA, 20 bp, human
gcgaagggagcgcccccagg

SEQ ID NO: 236713 - DNA, 20 bp, human
gcgcgcggatctggggttgg

SEQ ID NO: 236714 - DNA, 20 bp, human
gttctccgagtctccaccag

SEQ ID NO: 236715 - DNA, 20 bp, human
ggcgctgcgcggctcctgcc

SEQ ID NO: 236716 - DNA, 20 bp, human
ggcagccggtgccatgacat

SEQ ID NO: 236717 - DNA, 20 bp, human
gggtgccatgacatcggcag

SEQ ID NO: 236718 - DNA, 20 bp, human
gcggggcggacgagacgctg

SEQ ID NO: 236719 - DNA, 20 bp, human
ggaggcggggtctggacggc

SEQ ID NO: 236720 - DNA, 20 bp, human
ggagccccgccgggcgctca

SEQ ID NO: 236721 - DNA, 20 bp, human
gtaaagccaacagatggcgc

SEQ ID NO: 236722 - DNA, 20 bp, human
gcgcccctctgcgggacggc

SEQ ID NO: 236723 - DNA, 20 bp, human
gctgccctctgccgatgtca

SEQ ID NO: 236724 - DNA, 20 bp, human
gccccctgcgcgcccctctg

SEQ ID NO: 236725 - DNA, 20 bp, human
ggggggtcctggcggcctga

SEQ ID NO: 236726 - DNA, 20 bp, human
gcagcccaggagcgccgagg

SEQ ID NO: 236727 - DNA, 20 bp, human
ggctggccggggagggtcgg

SEQ ID NO: 236728 - DNA, 20 bp, human
gtgcggggcgcatacagatg

SEQ ID NO: 236729 - DNA, 20 bp, human
gtgtatgcgccccgcagccc

SEQ ID NO: 236730 - DNA, 20 bp, human
gcccggcagggcactcgggc

SEQ ID NO: 236731 - DNA, 20 bp, human
ggggaagaagactccgcctg

SEQ ID NO: 236732 - DNA, 20 bp, human
gaacaagggagcgagacgga

SEQ ID NO: 236733 - DNA, 20 bp, human
gccgcagcccaggagcgccg

SEQ ID NO: 236734 - DNA, 20 bp, human
gcgggaggacgtccaggcca

SEQ ID NO: 236735 - DNA, 20 bp, human
ggggcccgcagcgcccggca

SEQ ID NO: 236736 - DNA, 20 bp, human
ggatgattggaccttctatt

SEQ ID NO: 236737 - DNA, 20 bp, human
gctggctggggtctgacctc

SEQ ID NO: 236738 - DNA, 20 bp, human
gagaatgataactttattaa

SEQ ID NO: 236739 - DNA, 20 bp, human
gtgtacgtgcaggaccatgg

SEQ ID NO: 236740 - DNA, 20 bp, human
gttctcatgcaaagactccc

SEQ ID NO: 236741 - DNA, 20 bp, human
gaagtaaaaccagcacctat

SEQ ID NO: 236742 - DNA, 20 bp, human
gaaagagcctccctatggac

SEQ ID NO: 236743 - DNA, 20 bp, human
gcacagagatccctgtccat

SEQ ID NO: 236744 - DNA, 20 bp, human
ggggatctctgtggcaaccc

SEQ ID NO: 236745 - DNA, 20 bp, human
gttattccaacaatatccca

SEQ ID NO: 236746 - DNA, 20 bp, human
gtcgcaggtgggaccgatgt

SEQ ID NO: 236747 - DNA, 20 bp, human
ggcgcaggagggcatccggg

SEQ ID NO: 236748 - DNA, 20 bp, human
gacccagaactgcgagacag

SEQ ID NO: 236749 - DNA, 20 bp, human
ggtcccgccccctcgcaggt

SEQ ID NO: 236750 - DNA, 20 bp, human
gaggccaggaggggttcgct

SEQ ID NO: 236751 - DNA, 20 bp, human
ggcctcaaccgcacccacat

SEQ ID NO: 236752 - DNA, 20 bp, human
gaggccaggtgagcgcaggt

SEQ ID NO: 236753 - DNA, 20 bp, human
gctccccggcgggctggcac

SEQ ID NO: 236754 - DNA, 20 bp, human
gtaccccggaggatcctccc

SEQ ID NO: 236755 - DNA, 20 bp, human
gggagggcatccgggaggcc

SEQ ID NO: 236756 - DNA, 20 bp, human
gttccaggggaaaaaggcgc

SEQ ID NO: 236757 - DNA, 20 bp, human
gcggctccagacgtccagga

SEQ ID NO: 236758 - DNA, 20 bp, human
gggaccgccccatccagaaa

SEQ ID NO: 236759 - DNA, 20 bp, human
gcgggcggctccagacgtcc

SEQ ID NO: 236760 - DNA, 20 bp, human
gctgccgacgcgggccttaa

SEQ ID NO: 236761 - DNA, 20 bp, human
gcacccgcgcctttttcccc

SEQ ID NO: 236762 - DNA, 20 bp, human
ggagactgaagacagcgctg

SEQ ID NO: 236763 - DNA, 20 bp, human
gctctgccctcctggacgtc

SEQ ID NO: 236764 - DNA, 20 bp, human
gactaccgtccccaatccta

SEQ ID NO: 236765 - DNA, 20 bp, human
gaacccaggtcgggcagctc

SEQ ID NO: 236766 - DNA, 20 bp, human
ggctcccctccaaagacggt

SEQ ID NO: 236767 - DNA, 20 bp, human
ggaggggagccacaccccgc

SEQ ID NO: 236768 - DNA, 20 bp, human
gcgggagtaggggttcaagt

SEQ ID NO: 236769 - DNA, 20 bp, human
gcacaccccgctggcgaggg

SEQ ID NO: 236770 - DNA, 20 bp, human
gagccacaccccgctggcga

SEQ ID NO: 236771 - DNA, 20 bp, human
gctgtggagacagccatccg

SEQ ID NO: 236772 - DNA, 20 bp, human
gaataacaggaaaccatccc

SEQ ID NO: 236773 - DNA, 20 bp, human
gctcacaaaggaacaataac

SEQ ID NO: 236774 - DNA, 20 bp, human
gggttcaagtggggtgcccc

SEQ ID NO: 236775 - DNA, 20 bp, human
gagacagccatccggggccg

SEQ ID NO: 236776 - DNA, 20 bp, human
gactgggagtcattctgtca

SEQ ID NO: 236777 - DNA, 20 bp, human
gtcattctgtcaaggggagg

SEQ ID NO: 236778 - DNA, 20 bp, human
ggctcaggacttcaaacact

SEQ ID NO: 236779 - DNA, 20 bp, human
gtccagggagcgaattgctc

SEQ ID NO: 236780 - DNA, 20 bp, human
ggagtcattctgtcaagggg

SEQ ID NO: 236781 - DNA, 20 bp, human
ggaggaggactttgttaaag

SEQ ID NO: 236782 - DNA, 20 bp, human
gcctgagatgacaataccga

SEQ ID NO: 236783 - DNA, 20 bp, human
gtcctgagcaattcgctccc

SEQ ID NO: 236784 - DNA, 20 bp, human
gggaacactccttcagcccc

SEQ ID NO: 236785 - DNA, 20 bp, human
gttctgtcaaggggaggggg

SEQ ID NO: 236786 - DNA, 20 bp, human
gggagcgcgcggccagagag

SEQ ID NO: 236787 - DNA, 20 bp, human
ggcctcacggagagatggat

SEQ ID NO: 236788 - DNA, 20 bp, human
gtccccgcgcaccgcggagt

SEQ ID NO: 236789 - DNA, 20 bp, human
gcctcccagagacccggtgg

SEQ ID NO: 236790 - DNA, 20 bp, human
gctgcccgggcgagccggag

SEQ ID NO: 236791 - DNA, 20 bp, human
ggccggggccgaagagggag

SEQ ID NO: 236792 - DNA, 20 bp, human
gggaggcgccgaagtctcag

SEQ ID NO: 236793 - DNA, 20 bp, human
gaagaggggtgaaagtagga

SEQ ID NO: 236794 - DNA, 20 bp, human
gcaaatgcctcacggagaga

SEQ ID NO: 236795 - DNA, 20 bp, human
ggggaagagggcgacgatgg

SEQ ID NO: 236796 - DNA, 20 bp, human
gtgtgcgcccacttgggtag

SEQ ID NO: 236797 - DNA, 20 bp, human
gagccagcgcgggagagcga

SEQ ID NO: 236798 - DNA, 20 bp, human
gtcccctgacggatctcatt

SEQ ID NO: 236799 - DNA, 20 bp, human
gaccgagctcctggataagt

SEQ ID NO: 236800 - DNA, 20 bp, human
ggagacgcgcggggcttgct

SEQ ID NO: 236801 - DNA, 20 bp, human
gagggcaaagggttgagcgt

SEQ ID NO: 236802 - DNA, 20 bp, human
gaaaagttgtgcgcccactt

SEQ ID NO: 236803 - DNA, 20 bp, human
gtgcccaatgagatccgtca

SEQ ID NO: 236804 - DNA, 20 bp, human
gagccgggtgcctcccctga

SEQ ID NO: 236805 - DNA, 20 bp, human
gagggcgcatcttcacctcg

SEQ ID NO: 236806 - DNA, 20 bp, human
ggctgcagggcgccaggttt

SEQ ID NO: 236807 - DNA, 20 bp, human
ggaagtgggaggactcagaa

SEQ ID NO: 236808 - DNA, 20 bp, human
gactcccccaagcccaaacc

SEQ ID NO: 236809 - DNA, 20 bp, human
ggggcgccaggtttgggctt

SEQ ID NO: 236810 - DNA, 20 bp, human
gtaagagacgtccctcaaat

SEQ ID NO: 236811 - DNA, 20 bp, human
gggggagtaaggacttcttt

SEQ ID NO: 236812 - DNA, 20 bp, human
gcgccctgcagcgccatcag

SEQ ID NO: 236813 - DNA, 20 bp, human
gtaaccgagactaaaaacac

SEQ ID NO: 236814 - DNA, 20 bp, human
ggggtcgttttctcttatgg

SEQ ID NO: 236815 - DNA, 20 bp, human
gaaggaactctctatctgat

SEQ ID NO: 236816 - DNA, 20 bp, human
ggcccccagtcctggacagg

SEQ ID NO: 236817 - DNA, 20 bp, human
gggacaggaggacaccatgg

SEQ ID NO: 236818 - DNA, 20 bp, human
gaaagcctcaggacaacttg

SEQ ID NO: 236819 - DNA, 20 bp, human
gggcaggagggcgtgacaag

SEQ ID NO: 236820 - DNA, 20 bp, human
gtcctcctgtccaggactgg

SEQ ID NO: 236821 - DNA, 20 bp, human
gactgggggccgccggcaaa

SEQ ID NO: 236822 - DNA, 20 bp, human
gggagcggcgggtggcgtga

SEQ ID NO: 236823 - DNA, 20 bp, human
ggggcgctaagaggatgaca

SEQ ID NO: 236824 - DNA, 20 bp, human
ggcctgacgagaccaattag

SEQ ID NO: 236825 - DNA, 20 bp, human
gtcccagggtacttaagtcc

SEQ ID NO: 236826 - DNA, 20 bp, human
ggaggggtcgactcctaatg

SEQ ID NO: 236827 - DNA, 20 bp, human
gagagctcctggcgctcctg

SEQ ID NO: 236828 - DNA, 20 bp, human
ggggcgccggacaggaggaa

SEQ ID NO: 236829 - DNA, 20 bp, human
gggctggaggcccacaccac

SEQ ID NO: 236830 - DNA, 20 bp, human
gaccaaggcgccagagctcc

SEQ ID NO: 236831 - DNA, 20 bp, human
ggctgggggcgccggacagg

SEQ ID NO: 236832 - DNA, 20 bp, human
gggagtcgacccctcctggg

SEQ ID NO: 236833 - DNA, 20 bp, human
gtgaagactcgtagcaggga

SEQ ID NO: 236834 - DNA, 20 bp, human
gtcactgaagactcgtagca

SEQ ID NO: 236835 - DNA, 20 bp, human
gatgaggcagagtacagctg

SEQ ID NO: 236836 - DNA, 20 bp, human
ggaagctgcgcagccggtgt

SEQ ID NO: 236837 - DNA, 20 bp, human
gggtgcaggggaaccgtccg

SEQ ID NO: 236838 - DNA, 20 bp, human
ggtcctggaagctgcgcagc

SEQ ID NO: 236839 - DNA, 20 bp, human
ggggcgcgcggggcccacac

SEQ ID NO: 236840 - DNA, 20 bp, human
gcccgcgcgcccgggtggtg

SEQ ID NO: 236841 - DNA, 20 bp, human
ggacgcgccggccgccgggt

SEQ ID NO: 236842 - DNA, 20 bp, human
gtccgcggacctcaccaccc

SEQ ID NO: 236843 - DNA, 20 bp, human
gccgccccgcacgcgtggtg

SEQ ID NO: 236844 - DNA, 20 bp, human
ggcagcccaggctcgcggtg

SEQ ID NO: 236845 - DNA, 20 bp, human
gcccctgcaccgggccggag

SEQ ID NO: 236846 - DNA, 20 bp, human
gactggctggttggtctctt

SEQ ID NO: 236847 - DNA, 20 bp, human
ggggcgaccgagaccatcat

SEQ ID NO: 236848 - DNA, 20 bp, human
ggagaccaaccagccagtcc

SEQ ID NO: 236849 - DNA, 20 bp, human
gctgaccaggactggctggt

SEQ ID NO: 236850 - DNA, 20 bp, human
gactctgagctgaccaggac

SEQ ID NO: 236851 - DNA, 20 bp, human
gcgaccgagaccatcatggg

SEQ ID NO: 236852 - DNA, 20 bp, human
ggggagcagacccctcctcg

SEQ ID NO: 236853 - DNA, 20 bp, human
gaggctttggcggtagccaa

SEQ ID NO: 236854 - DNA, 20 bp, human
ggtgcgtagtccacccatga

SEQ ID NO: 236855 - DNA, 20 bp, human
ggggagactccaaacaccac

SEQ ID NO: 236856 - DNA, 20 bp, human
gaatgggggcaatggaaaat

SEQ ID NO: 236857 - DNA, 20 bp, human
ggatgggtggggatagaatc

SEQ ID NO: 236858 - DNA, 20 bp, human
ggtctagaactcagtcacca

SEQ ID NO: 236859 - DNA, 20 bp, human
gtctaagggcatggaagggg

SEQ ID NO: 236860 - DNA, 20 bp, human
ggaggattaaggttcagatg

SEQ ID NO: 236861 - DNA, 20 bp, human
gaactctaagggcatggaag

SEQ ID NO: 236862 - DNA, 20 bp, human
gtgactgagttctagacctc

SEQ ID NO: 236863 - DNA, 20 bp, human
gtgagttctagacctctggc

SEQ ID NO: 236864 - DNA, 20 bp, human
gtgctcaaacatagctgggc

SEQ ID NO: 236865 - DNA, 20 bp, human
gttgtaatgaatgggggcaa

SEQ ID NO: 236866 - DNA, 20 bp, human
gtggcagaagccggtcgtaa

SEQ ID NO: 236867 - DNA, 20 bp, human
gcagcccactgccagaagga

SEQ ID NO: 236868 - DNA, 20 bp, human
gagaaggaggggcagtcgtt

SEQ ID NO: 236869 - DNA, 20 bp, human
ggagtgcaggggtcaaccag

SEQ ID NO: 236870 - DNA, 20 bp, human
gggggctcggcccttggtgt

SEQ ID NO: 236871 - DNA, 20 bp, human
gcctgcactcagtccaactt

SEQ ID NO: 236872 - DNA, 20 bp, human
gttcctaaggccaccccttg

SEQ ID NO: 236873 - DNA, 20 bp, human
gtgctccctggggaacaccc

SEQ ID NO: 236874 - DNA, 20 bp, human
gctgcccctccttctggcag

SEQ ID NO: 236875 - DNA, 20 bp, human
gtaggggaggagccaagcca

SEQ ID NO: 236876 - DNA, 20 bp, human
ggtacacgaggctggagaat

SEQ ID NO: 236877 - DNA, 20 bp, human
ggcgccgtgatgacgtcagt

SEQ ID NO: 236878 - DNA, 20 bp, human
gctccagcctcgtgtacatt

SEQ ID NO: 236879 - DNA, 20 bp, human
gatgacgtcagtgggagcgg

SEQ ID NO: 236880 - DNA, 20 bp, human
ggcccgggacgtcacggtgg

SEQ ID NO: 236881 - DNA, 20 bp, human
gagtgggagcggaggcgatt

SEQ ID NO: 236882 - DNA, 20 bp, human
gtgcccaatgtacacgaggc

SEQ ID NO: 236883 - DNA, 20 bp, human
ggtgatgacgtcagtgggag

SEQ ID NO: 236884 - DNA, 20 bp, human
ggcgatttggcctagagctg

SEQ ID NO: 236885 - DNA, 20 bp, human
ggactggacgcattcggaga

SEQ ID NO: 236886 - DNA, 20 bp, human
gggctcgtaccaaagcgcag

SEQ ID NO: 236887 - DNA, 20 bp, human
gttggtacgagccaagggag

SEQ ID NO: 236888 - DNA, 20 bp, human
ggaagccgacaggccttaaa

SEQ ID NO: 236889 - DNA, 20 bp, human
gcggctggagacttaggggg

SEQ ID NO: 236890 - DNA, 20 bp, human
gtgctctcgcaggctctagg

SEQ ID NO: 236891 - DNA, 20 bp, human
ggaaaagcaacccatctgca

SEQ ID NO: 236892 - DNA, 20 bp, human
ggagcctgcgagagcaaagg

SEQ ID NO: 236893 - DNA, 20 bp, human
gcttggggacgcaaagactc

SEQ ID NO: 236894 - DNA, 20 bp, human
gaggactgcaccaaatctcc

SEQ ID NO: 236895 - DNA, 20 bp, human
gaaggcggctggagacttag

SEQ ID NO: 236896 - DNA, 20 bp, human
gcaagcgctctcctccagtc

SEQ ID NO: 236897 - DNA, 20 bp, human
gacgctgggcaggccttccc

SEQ ID NO: 236898 - DNA, 20 bp, human
gaaggcctgcccagcgtagc

SEQ ID NO: 236899 - DNA, 20 bp, human
gaggacgacactctcccgac

SEQ ID NO: 236900 - DNA, 20 bp, human
ggctagagcgcgaaagaaag

SEQ ID NO: 236901 - DNA, 20 bp, human
gggccccggattcaccaatc

SEQ ID NO: 236902 - DNA, 20 bp, human
gtggctgctttgaaagtcta

SEQ ID NO: 236903 - DNA, 20 bp, human
gacgacactctcccgactgg

SEQ ID NO: 236904 - DNA, 20 bp, human
gtcaccgcgctaaagggccc

SEQ ID NO: 236905 - DNA, 20 bp, human
gaatcagagcccagctacgc

SEQ ID NO: 236906 - DNA, 20 bp, human
gccctggagcccagcgccta

SEQ ID NO: 236907 - DNA, 20 bp, human
gcctgcgcgcaagagaggcg

SEQ ID NO: 236908 - DNA, 20 bp, human
gggcgcgaaagctccttccc

SEQ ID NO: 236909 - DNA, 20 bp, human
ggacccggctgcgccgtagt

SEQ ID NO: 236910 - DNA, 20 bp, human
gggtaaccgttgctaaggag

SEQ ID NO: 236911 - DNA, 20 bp, human
ggacccgcgggagcgtctct

SEQ ID NO: 236912 - DNA, 20 bp, human
gcgggtccgccctaggcgct

SEQ ID NO: 236913 - DNA, 20 bp, human
gcgtaaggagggcttcttca

SEQ ID NO: 236914 - DNA, 20 bp, human
ggggccagcgctcggcatgg

SEQ ID NO: 236915 - DNA, 20 bp, human
gagcagtcggagccgatccc

SEQ ID NO: 236916 - DNA, 20 bp, human
gaagtcggaagtgcagctca

SEQ ID NO: 236917 - DNA, 20 bp, human
gctcacggcgcagtttcttt

SEQ ID NO: 236918 - DNA, 20 bp, human
gccagaactcaagacgacag

SEQ ID NO: 236919 - DNA, 20 bp, human
ggcagagcgacgccgacttt

SEQ ID NO: 236920 - DNA, 20 bp, human
ggtcgctctgctcggcgccc

SEQ ID NO: 236921 - DNA, 20 bp, human
gcaggaagtgaggatacttc

SEQ ID NO: 236922 - DNA, 20 bp, human
gtccgacttcggcgcgggcc

SEQ ID NO: 236923 - DNA, 20 bp, human
gcatcattaggcgtcaacac

SEQ ID NO: 236924 - DNA, 20 bp, human
gggcgtcaacacaggaagtg

SEQ ID NO: 236925 - DNA, 20 bp, human
ggcagtttcttttggagtcc

SEQ ID NO: 236926 - DNA, 20 bp, human
ggacagggttttcgccgtgt

SEQ ID NO: 236927 - DNA, 20 bp, human
gaagtcttactttgttatgt

SEQ ID NO: 236928 - DNA, 20 bp, human
gccggcgcagtggctcaaga

SEQ ID NO: 236929 - DNA, 20 bp, human
ggagcagatcgctggagttc

SEQ ID NO: 236930 - DNA, 20 bp, human
ggaaggaggctgctagaggc

SEQ ID NO: 236931 - DNA, 20 bp, human
gaagaataagaagttgtgcc

SEQ ID NO: 236932 - DNA, 20 bp, human
ggtaagctctaggctgaggc

SEQ ID NO: 236933 - DNA, 20 bp, human
ggcttgctgtgtcctgatgt

SEQ ID NO: 236934 - DNA, 20 bp, human
gacttgaatcagagaggtca

SEQ ID NO: 236935 - DNA, 20 bp, human
gtgaacctagtcacttttga

SEQ ID NO: 236936 - DNA, 20 bp, human
ggccatattttttaagtaag

SEQ ID NO: 236937 - DNA, 20 bp, human
gaccacttacttaaaaaata

SEQ ID NO: 236938 - DNA, 20 bp, human
ggggtgatgaaaaggactct

SEQ ID NO: 236939 - DNA, 20 bp, human
gaaacgaaggaaggaacaag

SEQ ID NO: 236940 - DNA, 20 bp, human
ggcttgctgtgtcctgatgt

SEQ ID NO: 236941 - DNA, 20 bp, human
ggaaggaggctgctagaggc

SEQ ID NO: 236942 - DNA, 20 bp, human
gactcaaatgggtgatgaaa

SEQ ID NO: 236943 - DNA, 20 bp, human
gtcttcaggaaaagaaacga

SEQ ID NO: 236944 - DNA, 20 bp, human
gtgttctaatggaaaaatga

SEQ ID NO: 236945 - DNA, 20 bp, human
gccggcgcagtggctcaaga

SEQ ID NO: 236946 - DNA, 20 bp, human
gaagcacgaaacatcgcgag

SEQ ID NO: 236947 - DNA, 20 bp, human
gggagctcatcgcgagactc

SEQ ID NO: 236948 - DNA, 20 bp, human
gtgctcaaacggggagctcc

SEQ ID NO: 236949 - DNA, 20 bp, human
ggtgaaacgcgtttctagtt

SEQ ID NO: 236950 - DNA, 20 bp, human
gtagaagggtgctgaggcgt

SEQ ID NO: 236951 - DNA, 20 bp, human
gtaaaccgaaacggcacttg

SEQ ID NO: 236952 - DNA, 20 bp, human
gcgaaacggcacttggggaa

SEQ ID NO: 236953 - DNA, 20 bp, human
ggactctcgcgacgatttct

SEQ ID NO: 236954 - DNA, 20 bp, human
gtggtgtggaggtgaaacgg

SEQ ID NO: 236955 - DNA, 20 bp, human
gtcaggagcgagggacaaag

SEQ ID NO: 236956 - DNA, 20 bp, human
ggtagctccgccacctctgc

SEQ ID NO: 236957 - DNA, 20 bp, human
ggacgacgtcgacgccgagg

SEQ ID NO: 236958 - DNA, 20 bp, human
gcgctcccggtcgtacgtca

SEQ ID NO: 236959 - DNA, 20 bp, human
ggggctgcggctctcggttg

SEQ ID NO: 236960 - DNA, 20 bp, human
gcgagaaggaggggttgtgg

SEQ ID NO: 236961 - DNA, 20 bp, human
gaaagagcgaggcgagaagg

SEQ ID NO: 236962 - DNA, 20 bp, human
ggggaaaagccgaaagagcg

SEQ ID NO: 236963 - DNA, 20 bp, human
gacgaggagcggagagggaa

SEQ ID NO: 236964 - DNA, 20 bp, human
gcaggcccaggccacttccg

SEQ ID NO: 236965 - DNA, 20 bp, human
gagtgcgcgaggccctaggc

SEQ ID NO: 236966 - DNA, 20 bp, human
ggcgctgcgcccgcaactct

SEQ ID NO: 236967 - DNA, 20 bp, human
ggactcccgcaccttgtacc

SEQ ID NO: 236968 - DNA, 20 bp, human
gggagtggtgcggccgaagg

SEQ ID NO: 236969 - DNA, 20 bp, human
gaaaatgagccgggcggcgg

SEQ ID NO: 236970 - DNA, 20 bp, human
gagagaagcgcggccggcag

SEQ ID NO: 236971 - DNA, 20 bp, human
ggcggggcgggccgggtaca

SEQ ID NO: 236972 - DNA, 20 bp, human
gcccgccccgcctcctcctt

SEQ ID NO: 236973 - DNA, 20 bp, human
gcgggccgggtacaaggtgc

SEQ ID NO: 236974 - DNA, 20 bp, human
gggcgcgagccagacacaga

SEQ ID NO: 236975 - DNA, 20 bp, human
gcttctctccgttacaaagg

SEQ ID NO: 236976 - DNA, 20 bp, human
gaaaaactgctgaagttgtg

SEQ ID NO: 236977 - DNA, 20 bp, human
gtgctgacctctggcaaaaa

SEQ ID NO: 236978 - DNA, 20 bp, human
gtgggggaaaggttcaagtg

SEQ ID NO: 236979 - DNA, 20 bp, human
gtgctaaagtggacatgttg

SEQ ID NO: 236980 - DNA, 20 bp, human
gggccacaagttagtgctat

SEQ ID NO: 236981 - DNA, 20 bp, human
gtaccaatagcactaacttg

SEQ ID NO: 236982 - DNA, 20 bp, human
gtcttgacccataatcttgt

SEQ ID NO: 236983 - DNA, 20 bp, human
gttctctccctttttgccag

SEQ ID NO: 236984 - DNA, 20 bp, human
gttgccagaggtcagcagcg

SEQ ID NO: 236985 - DNA, 20 bp, human
ggtatccaatagtcttagaa

SEQ ID NO: 236986 - DNA, 20 bp, human
gcgcacgcaggcgctcggaa

SEQ ID NO: 236987 - DNA, 20 bp, human
ggggctgcacacgttcacta

SEQ ID NO: 236988 - DNA, 20 bp, human
gggcgctcggaagggtgaag

SEQ ID NO: 236989 - DNA, 20 bp, human
gcgagcaagaataaagggcg

SEQ ID NO: 236990 - DNA, 20 bp, human
gccaaaggacccgtccgcag

SEQ ID NO: 236991 - DNA, 20 bp, human
gcactacgggaatgaggtag

SEQ ID NO: 236992 - DNA, 20 bp, human
gtcctcctctgggctcgcga

SEQ ID NO: 236993 - DNA, 20 bp, human
gttctccctggtgccgtctc

SEQ ID NO: 236994 - DNA, 20 bp, human
ggcccgctgtatgagatgga

SEQ ID NO: 236995 - DNA, 20 bp, human
gaaaacctatgaaacctggg

SEQ ID NO: 236996 - DNA, 20 bp, human
gtgcccccggcgagccgctc

SEQ ID NO: 236997 - DNA, 20 bp, human
ggcagcgcgacccctgccgg

SEQ ID NO: 236998 - DNA, 20 bp, human
gcggcgagccgctcaggcgg

SEQ ID NO: 236999 - DNA, 20 bp, human
ggaaacgatccaaccagcgg

SEQ ID NO: 237000 - DNA, 20 bp, human
gtgcctgtccgcagcgactg

SEQ ID NO: 237001 - DNA, 20 bp, human
gagccgctcaggcgggggtg

SEQ ID NO: 237002 - DNA, 20 bp, human
gggcggcggagaaaagcgac

SEQ ID NO: 237003 - DNA, 20 bp, human
ggacaggcactcattccggt

SEQ ID NO: 237004 - DNA, 20 bp, human
gcggagcgggcagtttcccg

SEQ ID NO: 237005 - DNA, 20 bp, human
ggagaaaagcgaccggccgc

SEQ ID NO: 237006 - DNA, 20 bp, human
ggagccctggggattggtag

SEQ ID NO: 237007 - DNA, 20 bp, human
ggggtgggcacccgggcaga

SEQ ID NO: 237008 - DNA, 20 bp, human
gcagccgctaccaatcccca

SEQ ID NO: 237009 - DNA, 20 bp, human
ggccctgagagccttggcta

SEQ ID NO: 237010 - DNA, 20 bp, human
gtggggtgatccagtccaga

SEQ ID NO: 237011 - DNA, 20 bp, human
ggagaggtgggaactttgtc

SEQ ID NO: 237012 - DNA, 20 bp, human
gtacatgtgaaaaactctgg

SEQ ID NO: 237013 - DNA, 20 bp, human
gcaacctgagctggccgagg

SEQ ID NO: 237014 - DNA, 20 bp, human
gtacaagttgactccgcccc

SEQ ID NO: 237015 - DNA, 20 bp, human
ggctaggggatgaggccttc

SEQ ID NO: 237016 - DNA, 20 bp, human
gacagctcccaggttacctc

SEQ ID NO: 237017 - DNA, 20 bp, human
gaggggcggccctggtacgc

SEQ ID NO: 237018 - DNA, 20 bp, human
ggagccgtgcgctacctgag

SEQ ID NO: 237019 - DNA, 20 bp, human
gtggtggcccgaggtaacct

SEQ ID NO: 237020 - DNA, 20 bp, human
gaaggagggaggcgggactg

SEQ ID NO: 237021 - DNA, 20 bp, human
gcaggcgcgcatgctttgtg

SEQ ID NO: 237022 - DNA, 20 bp, human
gcatgcgcgcctgcgtacca

SEQ ID NO: 237023 - DNA, 20 bp, human
ggaagtcgcgaaggcctcag

SEQ ID NO: 237024 - DNA, 20 bp, human
gagcctccgcgaccatgggg

SEQ ID NO: 237025 - DNA, 20 bp, human
gctgggaaatgaagtcgcga

SEQ ID NO: 237026 - DNA, 20 bp, human
ggctagacaagtttcttccc

SEQ ID NO: 237027 - DNA, 20 bp, human
gagtgttcagccgccccacc

SEQ ID NO: 237028 - DNA, 20 bp, human
gggcgggatcatttgcgggg

SEQ ID NO: 237029 - DNA, 20 bp, human
gcccaggcaagtttggttct

SEQ ID NO: 237030 - DNA, 20 bp, human
gatcccgccccaggcaagtt

SEQ ID NO: 237031 - DNA, 20 bp, human
gcctggggcgggatcatttg

SEQ ID NO: 237032 - DNA, 20 bp, human
gggtcaacgtcagagccggg

SEQ ID NO: 237033 - DNA, 20 bp, human
gcgcccccaggcctttctat

SEQ ID NO: 237034 - DNA, 20 bp, human
gaacgactcctctgaggccc

SEQ ID NO: 237035 - DNA, 20 bp, human
ggtggcggtcgggaactcgg

SEQ ID NO: 237036 - DNA, 20 bp, human
gctggtgcacgcagccggga

SEQ ID NO: 237037 - DNA, 20 bp, human
gacagcggagggctaggaaa

SEQ ID NO: 237038 - DNA, 20 bp, human
gcggcagctgaccactgggg

SEQ ID NO: 237039 - DNA, 20 bp, human
gcccacggaacgatgacagc

SEQ ID NO: 237040 - DNA, 20 bp, human
ggctgctgcgtgacagcgga

SEQ ID NO: 237041 - DNA, 20 bp, human
gcgagagcgtgcccgcagca

SEQ ID NO: 237042 - DNA, 20 bp, human
gggaagctgcgtcgagtcag

SEQ ID NO: 237043 - DNA, 20 bp, human
gccactggggcggttcctgt

SEQ ID NO: 237044 - DNA, 20 bp, human
ggcagctagtcacgtgacgc

SEQ ID NO: 237045 - DNA, 20 bp, human
ggtcacgtgactagctgcgc

SEQ ID NO: 237046 - DNA, 20 bp, human
gaccccagccccccaaactt

SEQ ID NO: 237047 - DNA, 20 bp, human
gcccgcaacttgccaaagtt

SEQ ID NO: 237048 - DNA, 20 bp, human
gggggcggcccggcgtcagg

SEQ ID NO: 237049 - DNA, 20 bp, human
ggcaacttgccaaagtttgg

SEQ ID NO: 237050 - DNA, 20 bp, human
gcgcccctgcgccgcacccg

SEQ ID NO: 237051 - DNA, 20 bp, human
gtgcgggcgccgagcgcacc

SEQ ID NO: 237052 - DNA, 20 bp, human
gggagccgccccctgacgcc

SEQ ID NO: 237053 - DNA, 20 bp, human
gcgagcgcacccggaggcgc

SEQ ID NO: 237054 - DNA, 20 bp, human
ggcgggaggccagggcgaac

SEQ ID NO: 237055 - DNA, 20 bp, human
gcggctccgcggaaagtttg

SEQ ID NO: 237056 - DNA, 20 bp, human
gtcccaaggccccgcctcta

SEQ ID NO: 237057 - DNA, 20 bp, human
ggacaggtgcgaggtccgga

SEQ ID NO: 237058 - DNA, 20 bp, human
gacctcgcacctgtctgctc

SEQ ID NO: 237059 - DNA, 20 bp, human
gggcggaggccaatcggcgg

SEQ ID NO: 237060 - DNA, 20 bp, human
gaggtgcgaggtccggaagg

SEQ ID NO: 237061 - DNA, 20 bp, human
gcggtggccaccgcccaatc

SEQ ID NO: 237062 - DNA, 20 bp, human
gccggaaggcggaggccaat

SEQ ID NO: 237063 - DNA, 20 bp, human
gacgtggcggcatccatgag

SEQ ID NO: 237064 - DNA, 20 bp, human
gcggcggttgcgacctgctg

SEQ ID NO: 237065 - DNA, 20 bp, human
gtgcgaggtccggaaggcgg

SEQ ID NO: 237066 - DNA, 20 bp, human
gaagtaagcaccgaccgagg

SEQ ID NO: 237067 - DNA, 20 bp, human
ggcgccggccggaccctagg

SEQ ID NO: 237068 - DNA, 20 bp, human
gccctctggcccagcgttag

SEQ ID NO: 237069 - DNA, 20 bp, human
ggccgccgagagatcggtga

SEQ ID NO: 237070 - DNA, 20 bp, human
ggccctcaccgatctctcgg

SEQ ID NO: 237071 - DNA, 20 bp, human
gctgcctcctagggtccggc

SEQ ID NO: 237072 - DNA, 20 bp, human
ggcggcgccgggttttctcg

SEQ ID NO: 237073 - DNA, 20 bp, human
ggcgaagtaagcaccgaccg

SEQ ID NO: 237074 - DNA, 20 bp, human
ggaccctaggaggcagcctc

SEQ ID NO: 237075 - DNA, 20 bp, human
ggattccgccagcttcaacc

SEQ ID NO: 237076 - DNA, 20 bp, human
gccacccatgcgctgagggg

SEQ ID NO: 237077 - DNA, 20 bp, human
gaggagggcgaagagtgtaa

SEQ ID NO: 237078 - DNA, 20 bp, human
ggaccgccacccatgcgctg

SEQ ID NO: 237079 - DNA, 20 bp, human
gaggcgcgcggaaactggga

SEQ ID NO: 237080 - DNA, 20 bp, human
ggtgatagcaacagatcacg

SEQ ID NO: 237081 - DNA, 20 bp, human
ggggcgaacgccggacgttc

SEQ ID NO: 237082 - DNA, 20 bp, human
ggacaggaggtgcttcgact

SEQ ID NO: 237083 - DNA, 20 bp, human
gtgtccgcccctcagcgcat

SEQ ID NO: 237084 - DNA, 20 bp, human
gaccgcttgacattgctctg

SEQ ID NO: 237085 - DNA, 20 bp, human
gcagaggtgtggctacgcgg

SEQ ID NO: 237086 - DNA, 20 bp, human
gtctgcagcactcgactcca

SEQ ID NO: 237087 - DNA, 20 bp, human
gcggcggggcgcccggaaaa

SEQ ID NO: 237088 - DNA, 20 bp, human
gagcgtgagcgcagacggct

SEQ ID NO: 237089 - DNA, 20 bp, human
gtcctgggacttgaagtcca

SEQ ID NO: 237090 - DNA, 20 bp, human
gggagcggcccttttcaaga

SEQ ID NO: 237091 - DNA, 20 bp, human
ggcccgcgcagggccttctg

SEQ ID NO: 237092 - DNA, 20 bp, human
gcagagagcgtgagcgcaga

SEQ ID NO: 237093 - DNA, 20 bp, human
gagggctgggagcacataaa

SEQ ID NO: 237094 - DNA, 20 bp, human
gaacaacagcggggcacact

SEQ ID NO: 237095 - DNA, 20 bp, human
gcctgcgcgggcagacgggg

SEQ ID NO: 237096 - DNA, 20 bp, human
gtcggccgagagtgcccccg

SEQ ID NO: 237097 - DNA, 20 bp, human
gccggccgcgggggcactct

SEQ ID NO: 237098 - DNA, 20 bp, human
gctctctgaggctgccgccc

SEQ ID NO: 237099 - DNA, 20 bp, human
gggcgccgcggcgggaacaa

SEQ ID NO: 237100 - DNA, 20 bp, human
gcaacccaactctgccgacg

SEQ ID NO: 237101 - DNA, 20 bp, human
ggcggcagcctcagagaggg

SEQ ID NO: 237102 - DNA, 20 bp, human
gggcgccgaggactctccgg

SEQ ID NO: 237103 - DNA, 20 bp, human
gccggccgccggagagtcct

SEQ ID NO: 237104 - DNA, 20 bp, human
gctcggccgagtccctgccc

SEQ ID NO: 237105 - DNA, 20 bp, human
ggccccgcgtcggcagagtt

SEQ ID NO: 237106 - DNA, 20 bp, human
gggaaaagactcagggcgga

SEQ ID NO: 237107 - DNA, 20 bp, human
gcaggagtgcaactcgggag

SEQ ID NO: 237108 - DNA, 20 bp, human
gcccgagttgcactcctgat

SEQ ID NO: 237109 - DNA, 20 bp, human
gacgaaaaaaggggcccaag

SEQ ID NO: 237110 - DNA, 20 bp, human
gttccccttcctccgctcgg

SEQ ID NO: 237111 - DNA, 20 bp, human
gggcacggcgcgacgaaaaa

SEQ ID NO: 237112 - DNA, 20 bp, human
gaagactcagggcggagggt

SEQ ID NO: 237113 - DNA, 20 bp, human
ggcccatcaggagtgcaact

SEQ ID NO: 237114 - DNA, 20 bp, human
ggtgcaactcgggagcggat

SEQ ID NO: 237115 - DNA, 20 bp, human
gtggtccaggccctaggatc

SEQ ID NO: 237116 - DNA, 20 bp, human
gtggacccaaagctccgtgg

SEQ ID NO: 237117 - DNA, 20 bp, human
gacccggcctgaagtagcgg

SEQ ID NO: 237118 - DNA, 20 bp, human
ggtggcggtgctgaacttta

SEQ ID NO: 237119 - DNA, 20 bp, human
ggcaattgagctcctcaaag

SEQ ID NO: 237120 - DNA, 20 bp, human
ggggtggacccaaagctccg

SEQ ID NO: 237121 - DNA, 20 bp, human
gtcaggccgggtcatgctaa

SEQ ID NO: 237122 - DNA, 20 bp, human
gcactagccacggacttaag

SEQ ID NO: 237123 - DNA, 20 bp, human
gatgtcagatacactggatg

SEQ ID NO: 237124 - DNA, 20 bp, human
ggtccacccggactgtaaaa

SEQ ID NO: 237125 - DNA, 20 bp, human
gcaattgccgcttaagtccg

SEQ ID NO: 237126 - DNA, 20 bp, human
gtgtcccaaggcaagctgta

SEQ ID NO: 237127 - DNA, 20 bp, human
gacagggcatagtattttag

SEQ ID NO: 237128 - DNA, 20 bp, human
ggaagggagaatctgtccca

SEQ ID NO: 237129 - DNA, 20 bp, human
gtcagagtgtgccacaccat

SEQ ID NO: 237130 - DNA, 20 bp, human
gaattccatacagcttgcct

SEQ ID NO: 237131 - DNA, 20 bp, human
gaactccataacataggcta

SEQ ID NO: 237132 - DNA, 20 bp, human
gagaatagtttatgctggcc

SEQ ID NO: 237133 - DNA, 20 bp, human
gtgactaagccacagggcac

SEQ ID NO: 237134 - DNA, 20 bp, human
gcataacataggctaaggac

SEQ ID NO: 237135 - DNA, 20 bp, human
gttcgctaactccataacat

SEQ ID NO: 237136 - DNA, 20 bp, human
gtggcgccagaggacgggca

SEQ ID NO: 237137 - DNA, 20 bp, human
gtaagtgccctcacaaaaaa

SEQ ID NO: 237138 - DNA, 20 bp, human
gtgtgagggcacttagggag

SEQ ID NO: 237139 - DNA, 20 bp, human
gaacggactagggcccgctt

SEQ ID NO: 237140 - DNA, 20 bp, human
gcgcacgcagtgaagccgac

SEQ ID NO: 237141 - DNA, 20 bp, human
gccggctggcgccagaggac

SEQ ID NO: 237142 - DNA, 20 bp, human
gccggctgccattttttgtg

SEQ ID NO: 237143 - DNA, 20 bp, human
gaactttgaggattcctgag

SEQ ID NO: 237144 - DNA, 20 bp, human
ggaaaagcaaacacgaggtt

SEQ ID NO: 237145 - DNA, 20 bp, human
gtaggtgccatcttaactaa

SEQ ID NO: 237146 - DNA, 20 bp, human
ggcccaccccaggctccgaa

SEQ ID NO: 237147 - DNA, 20 bp, human
ggtggagcgtaaaccctgat

SEQ ID NO: 237148 - DNA, 20 bp, human
ggagacgcgaggcgggctca

SEQ ID NO: 237149 - DNA, 20 bp, human
ggccgcctgtcgcaatccca

SEQ ID NO: 237150 - DNA, 20 bp, human
gccttccgtacagccaatca

SEQ ID NO: 237151 - DNA, 20 bp, human
gaaggcggcgacgtggccga

SEQ ID NO: 237152 - DNA, 20 bp, human
ggagaatggagacagccaat

SEQ ID NO: 237153 - DNA, 20 bp, human
gtaaaccctgattggctgta

SEQ ID NO: 237154 - DNA, 20 bp, human
gggctcggccacaacgccac

SEQ ID NO: 237155 - DNA, 20 bp, human
gcctccgtttagacacaaac

SEQ ID NO: 237156 - DNA, 20 bp, human
ggggctagaagggcgcggtg

SEQ ID NO: 237157 - DNA, 20 bp, human
gggtgggtctccggcagagt

SEQ ID NO: 237158 - DNA, 20 bp, human
gcagctggggcgaccgtgcg

SEQ ID NO: 237159 - DNA, 20 bp, human
gcccgcgaagccaactctgc

SEQ ID NO: 237160 - DNA, 20 bp, human
ggctcccttctacgagtcgg

SEQ ID NO: 237161 - DNA, 20 bp, human
gaaatgaggcggccgagtcc

SEQ ID NO: 237162 - DNA, 20 bp, human
gtggggcgaccgtgcggggt

SEQ ID NO: 237163 - DNA, 20 bp, human
gcgcccgcgccgctcgctgg

SEQ ID NO: 237164 - DNA, 20 bp, human
gtggggcccccagcgccggc

SEQ ID NO: 237165 - DNA, 20 bp, human
ggactcgtagaagggagcta

SEQ ID NO: 237166 - DNA, 20 bp, human
gagcccccacccacattctg

SEQ ID NO: 237167 - DNA, 20 bp, human
gcatcgggttacagggtcct

SEQ ID NO: 237168 - DNA, 20 bp, human
gtgcacgtccgggcctcagg

SEQ ID NO: 237169 - DNA, 20 bp, human
gcccggacgtgcagggagac

SEQ ID NO: 237170 - DNA, 20 bp, human
gtgcagggagacggggtcca

SEQ ID NO: 237171 - DNA, 20 bp, human
gtggggccgcagaatgtggg

SEQ ID NO: 237172 - DNA, 20 bp, human
gcgtgtggggccgcagaatg

SEQ ID NO: 237173 - DNA, 20 bp, human
ggggacgcagtggaacggga

SEQ ID NO: 237174 - DNA, 20 bp, human
gactgtgggtccatccgtgt

SEQ ID NO: 237175 - DNA, 20 bp, human
ggtccgggcctcaggaggcg

SEQ ID NO: 237176 - DNA, 20 bp, human
gcctgtcggtgcctgaagtg

SEQ ID NO: 237177 - DNA, 20 bp, human
gccgacaggcgtcacgtgac

SEQ ID NO: 237178 - DNA, 20 bp, human
gacaggcgtcacgtgacggg

SEQ ID NO: 237179 - DNA, 20 bp, human
gaggaagctgcgctaggccc

SEQ ID NO: 237180 - DNA, 20 bp, human
gtggggaacgccaaccgcct

SEQ ID NO: 237181 - DNA, 20 bp, human
ggagcccggtggacggaagt

SEQ ID NO: 237182 - DNA, 20 bp, human
gctaaagcgacggagcccgg

SEQ ID NO: 237183 - DNA, 20 bp, human
gggcggggatactaaagcga

SEQ ID NO: 237184 - DNA, 20 bp, human
gcccaccacggaagtgaggc

SEQ ID NO: 237185 - DNA, 20 bp, human
gcagcttcctccgcccacca

SEQ ID NO: 237186 - DNA, 20 bp, human
gcactcgcggaacacggccg

SEQ ID NO: 237187 - DNA, 20 bp, human
ggtggggcggagtcgtagaa

SEQ ID NO: 237188 - DNA, 20 bp, human
gaccctgaggaccgtgtgga

SEQ ID NO: 237189 - DNA, 20 bp, human
gcgactccgccccacacggt

SEQ ID NO: 237190 - DNA, 20 bp, human
gccccacacggtgggaatat

SEQ ID NO: 237191 - DNA, 20 bp, human
ggcccggccaccgctggggc

SEQ ID NO: 237192 - DNA, 20 bp, human
gggcggagtcgtagaagggg

SEQ ID NO: 237193 - DNA, 20 bp, human
gggagggcactcgcggaaca

SEQ ID NO: 237194 - DNA, 20 bp, human
gcaggggcggccagccaccg

SEQ ID NO: 237195 - DNA, 20 bp, human
gctccctccacacggtcctc

SEQ ID NO: 237196 - DNA, 20 bp, human
ggggacttgtagttcccgag

SEQ ID NO: 237197 - DNA, 20 bp, human
gagggggcgcgttataaagg

SEQ ID NO: 237198 - DNA, 20 bp, human
ggggccgccgctagtagtgg

SEQ ID NO: 237199 - DNA, 20 bp, human
gccgccgccactactagcgg

SEQ ID NO: 237200 - DNA, 20 bp, human
gtgtagttcccgagaggcca

SEQ ID NO: 237201 - DNA, 20 bp, human
gctcccaggccgcggctcgg

SEQ ID NO: 237202 - DNA, 20 bp, human
gctgcagctccggctccccc

SEQ ID NO: 237203 - DNA, 20 bp, human
gcccgggccttctatcgctg

SEQ ID NO: 237204 - DNA, 20 bp, human
gcgtcccgctgcatgggccc

SEQ ID NO: 237205 - DNA, 20 bp, human
gtagcggcggccccgatcgg

SEQ ID NO: 237206 - DNA, 20 bp, human
gtctaggaacccgaggactc

SEQ ID NO: 237207 - DNA, 20 bp, human
gcatgcgcaaataaacgtgg

SEQ ID NO: 237208 - DNA, 20 bp, human
gataacaaccctgagtcctc

SEQ ID NO: 237209 - DNA, 20 bp, human
gttgctgaaagcgctagttc

SEQ ID NO: 237210 - DNA, 20 bp, human
ggagcatgcgcaaataaacg

SEQ ID NO: 237211 - DNA, 20 bp, human
gtactagtcgtgctgcgctc

SEQ ID NO: 237212 - DNA, 20 bp, human
ggtctaacacataaaagctt

SEQ ID NO: 237213 - DNA, 20 bp, human
ggatgtaatttgatctcttc

SEQ ID NO: 237214 - DNA, 20 bp, human
gaagcatttctaggaacccg

SEQ ID NO: 237215 - DNA, 20 bp, human
ggggttgttattttagttct

SEQ ID NO: 237216 - DNA, 20 bp, human
gagggccgccctccgtccat

SEQ ID NO: 237217 - DNA, 20 bp, human
ggacagctcccatggacgga

SEQ ID NO: 237218 - DNA, 20 bp, human
gagctcccatggacggaggg

SEQ ID NO: 237219 - DNA, 20 bp, human
ggcgggagccggttcccata

SEQ ID NO: 237220 - DNA, 20 bp, human
ggacggagggcggccctccg

SEQ ID NO: 237221 - DNA, 20 bp, human
gaatgtggaccgctcaggag

SEQ ID NO: 237222 - DNA, 20 bp, human
gcaggactcggcccgcggtc

SEQ ID NO: 237223 - DNA, 20 bp, human
gtgggagctgtcctgaccgc

SEQ ID NO: 237224 - DNA, 20 bp, human
gcacgccgagccgagctggg

SEQ ID NO: 237225 - DNA, 20 bp, human
gcctttccctgcagccggga

SEQ ID NO: 237226 - DNA, 20 bp, human
gcaccccgccccttcaccta

SEQ ID NO: 237227 - DNA, 20 bp, human
ggggccgagccctaggtgaa

SEQ ID NO: 237228 - DNA, 20 bp, human
gcgagccctaggtgaagggg

SEQ ID NO: 237229 - DNA, 20 bp, human
gcccacgcgaagggtaaagg

SEQ ID NO: 237230 - DNA, 20 bp, human
ggcagggcctctgcgtgtca

SEQ ID NO: 237231 - DNA, 20 bp, human
gcggccaatcagaagaaggg

SEQ ID NO: 237232 - DNA, 20 bp, human
ggacgagaaccaaggcgtgt

SEQ ID NO: 237233 - DNA, 20 bp, human
gtacccctgggcgaaggcgt

SEQ ID NO: 237234 - DNA, 20 bp, human
ggtgtcagggagcagaacct

SEQ ID NO: 237235 - DNA, 20 bp, human
gaggcctcccttcttctgat

SEQ ID NO: 237236 - DNA, 20 bp, human
gcctaaactagtgacgggga

SEQ ID NO: 237237 - DNA, 20 bp, human
gctcggcggggtggagaaag

SEQ ID NO: 237238 - DNA, 20 bp, human
ggcggggcgcggttccccct

SEQ ID NO: 237239 - DNA, 20 bp, human
gggaaccgcgccccgctgaa

SEQ ID NO: 237240 - DNA, 20 bp, human
gccgagcctaaactagtgac

SEQ ID NO: 237241 - DNA, 20 bp, human
gcaggggtggattgttgaca

SEQ ID NO: 237242 - DNA, 20 bp, human
gcatccgggccagagatttc

SEQ ID NO: 237243 - DNA, 20 bp, human
gcactagtttaggctcggcg

SEQ ID NO: 237244 - DNA, 20 bp, human
gccgctgaagggctcgggga

SEQ ID NO: 237245 - DNA, 20 bp, human
gttccctgaaatctctggcc

SEQ ID NO: 237246 - DNA, 20 bp, human
gccgacccggaaggggaagt

SEQ ID NO: 237247 - DNA, 20 bp, human
gcaaaagcaaccttgtgagg

SEQ ID NO: 237248 - DNA, 20 bp, human
gactctgggtaggcgcaagg

SEQ ID NO: 237249 - DNA, 20 bp, human
ggtgctgtgcttgggaatgg

SEQ ID NO: 237250 - DNA, 20 bp, human
ggcagggtcccgacccggaa

SEQ ID NO: 237251 - DNA, 20 bp, human
gaagaaacggaaacctactc

SEQ ID NO: 237252 - DNA, 20 bp, human
ggtgcgcaagaccggaacat

SEQ ID NO: 237253 - DNA, 20 bp, human
gacaaggttgcttttgaatg

SEQ ID NO: 237254 - DNA, 20 bp, human
gcatgggcagggtcccgacc

SEQ ID NO: 237255 - DNA, 20 bp, human
ggcaagaccggaacatgggc

SEQ ID NO: 237256 - DNA, 20 bp, human
gtggagagaagaaagagcgt

SEQ ID NO: 237257 - DNA, 20 bp, human
gtgcatacacaatgactagg

SEQ ID NO: 237258 - DNA, 20 bp, human
gctttggcatgtggacaaat

SEQ ID NO: 237259 - DNA, 20 bp, human
gtaaaagacaatgttctcac

SEQ ID NO: 237260 - DNA, 20 bp, human
gaaagtgctatacttccacc

SEQ ID NO: 237261 - DNA, 20 bp, human
gagtcattgtgtatgcactt

SEQ ID NO: 237262 - DNA, 20 bp, human
gtatgaaatcttttgatagc

SEQ ID NO: 237263 - DNA, 20 bp, human
ggttgaactaaaagaatttg

SEQ ID NO: 237264 - DNA, 20 bp, human
gaatataaacctttggcatg

SEQ ID NO: 237265 - DNA, 20 bp, human
gtgctgtaaaatccagctga

SEQ ID NO: 237266 - DNA, 20 bp, human
gaggaggaagcgcttgtcct

SEQ ID NO: 237267 - DNA, 20 bp, human
gccggcccgttcggaccaat

SEQ ID NO: 237268 - DNA, 20 bp, human
gtaccccgcccccttctggt

SEQ ID NO: 237269 - DNA, 20 bp, human
gaaccagcgttcttcggctt

SEQ ID NO: 237270 - DNA, 20 bp, human
gtctccagcccaggttgcta

SEQ ID NO: 237271 - DNA, 20 bp, human
ggcggggcagttagcaaaat

SEQ ID NO: 237272 - DNA, 20 bp, human
gcggcgcgagcccgaacccc

SEQ ID NO: 237273 - DNA, 20 bp, human
gcgggatcgggcaaaacctg

SEQ ID NO: 237274 - DNA, 20 bp, human
ggcggggtaaaggcgggatc

SEQ ID NO: 237275 - DNA, 20 bp, human
gtcggagactcgagcacgag

SEQ ID NO: 237276 - DNA, 20 bp, human
gcggctggcctgctggaact

SEQ ID NO: 237277 - DNA, 20 bp, human
gagcctggccgagttccagc

SEQ ID NO: 237278 - DNA, 20 bp, human
gcgggcccgcctcaaggagg

SEQ ID NO: 237279 - DNA, 20 bp, human
gaacgcaggcgagggactgg

SEQ ID NO: 237280 - DNA, 20 bp, human
gcgcccgggaccgccctccc

SEQ ID NO: 237281 - DNA, 20 bp, human
gaacctcgcgtgctgcagga

SEQ ID NO: 237282 - DNA, 20 bp, human
ggggtcccgcctccttgagg

SEQ ID NO: 237283 - DNA, 20 bp, human
gcgcgggtcccgcctccttg

SEQ ID NO: 237284 - DNA, 20 bp, human
gggcctgctggaactcggcc

SEQ ID NO: 237285 - DNA, 20 bp, human
ggcacgcgaggttccgggac

SEQ ID NO: 237286 - DNA, 20 bp, human
gagctcgctaggagccgggg

SEQ ID NO: 237287 - DNA, 20 bp, human
ggtccaggtcccggcttccc

SEQ ID NO: 237288 - DNA, 20 bp, human
gcgaccagccaatctcccgg

SEQ ID NO: 237289 - DNA, 20 bp, human
ggctcgggaacgaggggagg

SEQ ID NO: 237290 - DNA, 20 bp, human
gcgcgctcgggaacgagggg

SEQ ID NO: 237291 - DNA, 20 bp, human
gcggcgcgctcgggaacgag

SEQ ID NO: 237292 - DNA, 20 bp, human
gggcgagcgcggccttaagg

SEQ ID NO: 237293 - DNA, 20 bp, human
gccgagcgccgccgggagat

SEQ ID NO: 237294 - DNA, 20 bp, human
ggcgccgccgggagattggc

SEQ ID NO: 237295 - DNA, 20 bp, human
gaggtggcggaaccgcgccg

SEQ ID NO: 237296 - DNA, 20 bp, human
ggggtgtgcgcgcggccaat

SEQ ID NO: 237297 - DNA, 20 bp, human
gtggccgcgcgcacacccac

SEQ ID NO: 237298 - DNA, 20 bp, human
gtgtgcgcgcggccaatggg

SEQ ID NO: 237299 - DNA, 20 bp, human
ggggcggccgccaatcgccg

SEQ ID NO: 237300 - DNA, 20 bp, human
ggggcccgcgcgtataaagg

SEQ ID NO: 237301 - DNA, 20 bp, human
ggccaatgggcggtgcgcgg

SEQ ID NO: 237302 - DNA, 20 bp, human
ggggcgagcgcgctgtagca

SEQ ID NO: 237303 - DNA, 20 bp, human
ggcgcgctgtagcaggggaa

SEQ ID NO: 237304 - DNA, 20 bp, human
ggcccccgcgcaccgcccat

SEQ ID NO: 237305 - DNA, 20 bp, human
gctacagcgcgctcgccccg

SEQ ID NO: 237306 - DNA, 20 bp, human
gagccctgcgcacgcgggaa

SEQ ID NO: 237307 - DNA, 20 bp, human
gcgcgcgcgcgcctccctac

SEQ ID NO: 237308 - DNA, 20 bp, human
gaaagtggcggtaggcggga

SEQ ID NO: 237309 - DNA, 20 bp, human
gagatcttggaggtccgggt

SEQ ID NO: 237310 - DNA, 20 bp, human
gcgcgctgagggtgggaaga

SEQ ID NO: 237311 - DNA, 20 bp, human
gagcccttcccgcgtgcgca

SEQ ID NO: 237312 - DNA, 20 bp, human
ggctgccggaggcgcccgta

SEQ ID NO: 237313 - DNA, 20 bp, human
ggacctccaagatctcggaa

SEQ ID NO: 237314 - DNA, 20 bp, human
gagccgttccgagatcttgg

SEQ ID NO: 237315 - DNA, 20 bp, human
gagggcgggaaagtggcggt

SEQ ID NO: 237316 - DNA, 20 bp, human
gccaacctggggcgacttca

SEQ ID NO: 237317 - DNA, 20 bp, human
gccaacgctggctctggcga

SEQ ID NO: 237318 - DNA, 20 bp, human
ggccgtgagcgagtgctcgg

SEQ ID NO: 237319 - DNA, 20 bp, human
ggtgagcgagtgctcggagg

SEQ ID NO: 237320 - DNA, 20 bp, human
ggggaccgcggtatctttcc

SEQ ID NO: 237321 - DNA, 20 bp, human
gcccgggggagacccaacct

SEQ ID NO: 237322 - DNA, 20 bp, human
ggctcttccgccagcaccgg

SEQ ID NO: 237323 - DNA, 20 bp, human
ggtccctcaaatcctctgga

SEQ ID NO: 237324 - DNA, 20 bp, human
ggacgccgtgagcgagtgct

SEQ ID NO: 237325 - DNA, 20 bp, human
ggcacccctgaagtcgcccc

SEQ ID NO: 237326 - DNA, 20 bp, human
gccgagtctcggcggaaccc

SEQ ID NO: 237327 - DNA, 20 bp, human
ggccacggagggcaccccgg

SEQ ID NO: 237328 - DNA, 20 bp, human
ggtgccctccgtggcctcac

SEQ ID NO: 237329 - DNA, 20 bp, human
ggcgacgctgcgtccccgtg

SEQ ID NO: 237330 - DNA, 20 bp, human
gcgtccccgtgaggccacgg

SEQ ID NO: 237331 - DNA, 20 bp, human
ggcggcggcgaggttataaa

SEQ ID NO: 237332 - DNA, 20 bp, human
gacttgcagtccgccctcgt

SEQ ID NO: 237333 - DNA, 20 bp, human
gggcaccccgggggtgaggt

SEQ ID NO: 237334 - DNA, 20 bp, human
gtgggacgaccgagtctcgg

SEQ ID NO: 237335 - DNA, 20 bp, human
gctgcgtccccgtgaggcca

SEQ ID NO: 237336 - DNA, 20 bp, human
ggaccctgcggggaaccggt

SEQ ID NO: 237337 - DNA, 20 bp, human
gcaagggcacagcatagctc

SEQ ID NO: 237338 - DNA, 20 bp, human
gggagcgccctcgcccggag

SEQ ID NO: 237339 - DNA, 20 bp, human
gaggccgccgctccgggcga

SEQ ID NO: 237340 - DNA, 20 bp, human
gcacgggctgcggcggtctg

SEQ ID NO: 237341 - DNA, 20 bp, human
ggggccccctgatgtcgctc

SEQ ID NO: 237342 - DNA, 20 bp, human
gggtctacccagggctacaa

SEQ ID NO: 237343 - DNA, 20 bp, human
gaacctggagcgccctcgcc

SEQ ID NO: 237344 - DNA, 20 bp, human
gagccgctctgtgcccccgc

SEQ ID NO: 237345 - DNA, 20 bp, human
ggcagtgcgcgtcgggaagg

SEQ ID NO: 237346 - DNA, 20 bp, human
gccgggccgacgcgtcacga

SEQ ID NO: 237347 - DNA, 20 bp, human
gccgacgcgtcacgagggcg

SEQ ID NO: 237348 - DNA, 20 bp, human
gagggagccgccaggaatgc

SEQ ID NO: 237349 - DNA, 20 bp, human
gtgcgccagagactgggcca

SEQ ID NO: 237350 - DNA, 20 bp, human
gtggatgtccagtaaagcca

SEQ ID NO: 237351 - DNA, 20 bp, human
ggacgcatgcgccagagact

SEQ ID NO: 237352 - DNA, 20 bp, human
gcgtcctagcatctttgggc

SEQ ID NO: 237353 - DNA, 20 bp, human
gccggcgatcacagcggaca

SEQ ID NO: 237354 - DNA, 20 bp, human
ggctcctaatccccagtagg

SEQ ID NO: 237355 - DNA, 20 bp, human
ggcagtgcagccagcattcc

SEQ ID NO: 237356 - DNA, 20 bp, human
ggcgaacgggagtagcagtt

SEQ ID NO: 237357 - DNA, 20 bp, human
ggttaaaagatgatcgccaa

SEQ ID NO: 237358 - DNA, 20 bp, human
ggactcaagggactatagat

SEQ ID NO: 237359 - DNA, 20 bp, human
gaaactgagccattggagag

SEQ ID NO: 237360 - DNA, 20 bp, human
ggcgaggagcccctctccaa

SEQ ID NO: 237361 - DNA, 20 bp, human
gtacgctacagatctctgtg

SEQ ID NO: 237362 - DNA, 20 bp, human
ggggttaagctaaaaaagcg

SEQ ID NO: 237363 - DNA, 20 bp, human
ggactccggacgtcagatgt

SEQ ID NO: 237364 - DNA, 20 bp, human
gacgtccggagtcattaacc

SEQ ID NO: 237365 - DNA, 20 bp, human
gtcgtcagaattcttcatag

SEQ ID NO: 237366 - DNA, 20 bp, human
gagcgcgagcgccagcaggg

SEQ ID NO: 237367 - DNA, 20 bp, human
gcgagcgccagcagggcgga

SEQ ID NO: 237368 - DNA, 20 bp, human
gccggcgcgagagacttgac

SEQ ID NO: 237369 - DNA, 20 bp, human
gcgagagacttgacgggagg

SEQ ID NO: 237370 - DNA, 20 bp, human
gggaatgagggcgcgggacc

SEQ ID NO: 237371 - DNA, 20 bp, human
gagagcgggaggcgggaatg

SEQ ID NO: 237372 - DNA, 20 bp, human
gctccctcctgccggctagg

SEQ ID NO: 237373 - DNA, 20 bp, human
gtcctcgcccccgtaggaat

SEQ ID NO: 237374 - DNA, 20 bp, human
gaagggcaggccggacttcg

SEQ ID NO: 237375 - DNA, 20 bp, human
gtggggacaggccgcctagc

SEQ ID NO: 237376 - DNA, 20 bp, human
gttacggcgttccgcccaca

SEQ ID NO: 237377 - DNA, 20 bp, human
gacagggcctgcataaccag

SEQ ID NO: 237378 - DNA, 20 bp, human
ggccgctgaggcagccgcca

SEQ ID NO: 237379 - DNA, 20 bp, human
ggcgtcgccggggaaacttc

SEQ ID NO: 237380 - DNA, 20 bp, human
gtgcccggcgcgcgacctta

SEQ ID NO: 237381 - DNA, 20 bp, human
ggttatgcaggccctgtggg

SEQ ID NO: 237382 - DNA, 20 bp, human
gagacccggcccccaagggg

SEQ ID NO: 237383 - DNA, 20 bp, human
ggcgcagccactggttatgc

SEQ ID NO: 237384 - DNA, 20 bp, human
gttaactgacccagggagaa

SEQ ID NO: 237385 - DNA, 20 bp, human
gggaggagggagggtgagtt

SEQ ID NO: 237386 - DNA, 20 bp, human
gggccctgtgggacgttgat

SEQ ID NO: 237387 - DNA, 20 bp, human
gcgagtcttcggccacccaa

SEQ ID NO: 237388 - DNA, 20 bp, human
gcctcccgcgcgtctttcaa

SEQ ID NO: 237389 - DNA, 20 bp, human
gctcccaactggcgggagga

SEQ ID NO: 237390 - DNA, 20 bp, human
gcgccagttgggagagtgca

SEQ ID NO: 237391 - DNA, 20 bp, human
gcggagtaagaaaccagaag

SEQ ID NO: 237392 - DNA, 20 bp, human
gggaaccagtcagcgattag

SEQ ID NO: 237393 - DNA, 20 bp, human
gcgccctcctcccgccagtt

SEQ ID NO: 237394 - DNA, 20 bp, human
gtcggcctctaatcgctgac

SEQ ID NO: 237395 - DNA, 20 bp, human
gcactctcccaactggcggg

SEQ ID NO: 237396 - DNA, 20 bp, human
gtgcgcacgcgcaaccgggg

SEQ ID NO: 237397 - DNA, 20 bp, human
gcgcgcaaccggggagggac

SEQ ID NO: 237398 - DNA, 20 bp, human
ggcggactgcgcgtgaagaa

SEQ ID NO: 237399 - DNA, 20 bp, human
ggcgcactgtgcagtttccg

SEQ ID NO: 237400 - DNA, 20 bp, human
ggacgcgctgaagctactcg

SEQ ID NO: 237401 - DNA, 20 bp, human
gctcaaggaagggataggaa

SEQ ID NO: 237402 - DNA, 20 bp, human
ggactgcgcgtgaagaaagg

SEQ ID NO: 237403 - DNA, 20 bp, human
gtcgccgccaatcagcgtga

SEQ ID NO: 237404 - DNA, 20 bp, human
ggaaccttcacgctgattgg

SEQ ID NO: 237405 - DNA, 20 bp, human
gaagctccgcggtgcctgat

SEQ ID NO: 237406 - DNA, 20 bp, human
ggacaacggggctcttggga

SEQ ID NO: 237407 - DNA, 20 bp, human
gaaaacgcgccgttaaagtg

SEQ ID NO: 237408 - DNA, 20 bp, human
gcacccaagaaaggtggcgg

SEQ ID NO: 237409 - DNA, 20 bp, human
gagccacccaagaaaggtgg

SEQ ID NO: 237410 - DNA, 20 bp, human
gcggagcccacgcgatccct

SEQ ID NO: 237411 - DNA, 20 bp, human
gcggagacaacggggctctt

SEQ ID NO: 237412 - DNA, 20 bp, human
gcggctcacgcgcacatccc

SEQ ID NO: 237413 - DNA, 20 bp, human
gcgcgtgagccgtgcccgca

SEQ ID NO: 237414 - DNA, 20 bp, human
gggcgtcccagggatcgcgt

SEQ ID NO: 237415 - DNA, 20 bp, human
gcgcctccgccacctttctt

SEQ ID NO: 237416 - DNA, 20 bp, human
gcgcgggcacgtaactcgga

SEQ ID NO: 237417 - DNA, 20 bp, human
gtgcgcgcgcacactccggc

SEQ ID NO: 237418 - DNA, 20 bp, human
gaccggggaatgactgacgg

SEQ ID NO: 237419 - DNA, 20 bp, human
ggggccgtaccaagtgacgg

SEQ ID NO: 237420 - DNA, 20 bp, human
gggagcgcgggcacgtaact

SEQ ID NO: 237421 - DNA, 20 bp, human
gtcaccggggcgcgcccccg

SEQ ID NO: 237422 - DNA, 20 bp, human
gcggggcacagcggcctcta

SEQ ID NO: 237423 - DNA, 20 bp, human
gaggctgcgcgcgcacactc

SEQ ID NO: 237424 - DNA, 20 bp, human
gtgacggaggcgggccgtag

SEQ ID NO: 237425 - DNA, 20 bp, human
gcccggagcacgcgagcagc

SEQ ID NO: 237426 - DNA, 20 bp, human
gcgtgtcagaggccacgggc

SEQ ID NO: 237427 - DNA, 20 bp, human
gcggtcctctgcgcgggatg

SEQ ID NO: 237428 - DNA, 20 bp, human
gtcgccgcggtcctctgcgc

SEQ ID NO: 237429 - DNA, 20 bp, human
gcgctccgcgcctgcgtctg

SEQ ID NO: 237430 - DNA, 20 bp, human
gagcacggaacccagcctcg

SEQ ID NO: 237431 - DNA, 20 bp, human
gaggctgggttccgtgctga

SEQ ID NO: 237432 - DNA, 20 bp, human
gtcgcagcggccaggacagc

SEQ ID NO: 237433 - DNA, 20 bp, human
gcgcggcgaccggaaaagca

SEQ ID NO: 237434 - DNA, 20 bp, human
gagggcaggtgggagactgg

SEQ ID NO: 237435 - DNA, 20 bp, human
gggatgtggctctgagcttc

SEQ ID NO: 237436 - DNA, 20 bp, human
ggggaagcctagatttgaaa

SEQ ID NO: 237437 - DNA, 20 bp, human
gctggaagacgtggagatgt

SEQ ID NO: 237438 - DNA, 20 bp, human
ggagccagttgatggaagac

SEQ ID NO: 237439 - DNA, 20 bp, human
gttggaagacatgaagatgc

SEQ ID NO: 237440 - DNA, 20 bp, human
gatcagcacactggagacgt

SEQ ID NO: 237441 - DNA, 20 bp, human
gaacatgggaaggctcagac

SEQ ID NO: 237442 - DNA, 20 bp, human
gtggaagactgggtagttgt

SEQ ID NO: 237443 - DNA, 20 bp, human
gtggatattgagccagttga

SEQ ID NO: 237444 - DNA, 20 bp, human
gtccaggccttttcaaatct

SEQ ID NO: 237445 - DNA, 20 bp, human
gttggaagacgagcagatgc

SEQ ID NO: 237446 - DNA, 20 bp, human
ggcggctcgcccggtatcga

SEQ ID NO: 237447 - DNA, 20 bp, human
gggctgcttgccctcgatac

SEQ ID NO: 237448 - DNA, 20 bp, human
gaagcagccaatggtgggtc

SEQ ID NO: 237449 - DNA, 20 bp, human
gacagcgcagatcaggggac

SEQ ID NO: 237450 - DNA, 20 bp, human
gcgggcgagccgccggtctt

SEQ ID NO: 237451 - DNA, 20 bp, human
gccagcagcccgctcgcgat

SEQ ID NO: 237452 - DNA, 20 bp, human
gatcgagggcaagcagccaa

SEQ ID NO: 237453 - DNA, 20 bp, human
ggagggcaagcagccaatgg

SEQ ID NO: 237454 - DNA, 20 bp, human
gggacgaagtccctgccgct

SEQ ID NO: 237455 - DNA, 20 bp, human
ggcctcacagcgcagatcag

SEQ ID NO: 237456 - DNA, 20 bp, human
gagggggaagtaggacgaaa

SEQ ID NO: 237457 - DNA, 20 bp, human
gcccagaccaagacaccagg

SEQ ID NO: 237458 - DNA, 20 bp, human
gaaactgaataggtcgtagg

SEQ ID NO: 237459 - DNA, 20 bp, human
gcgggaccctcctggtgtct

SEQ ID NO: 237460 - DNA, 20 bp, human
gctgccgccgccgaccaatc

SEQ ID NO: 237461 - DNA, 20 bp, human
ggtatgcaaagctggaggcg

SEQ ID NO: 237462 - DNA, 20 bp, human
gcgggctgcggcgacacaaa

SEQ ID NO: 237463 - DNA, 20 bp, human
gaacaggctgctcaccagtc

SEQ ID NO: 237464 - DNA, 20 bp, human
gccctcctggtgtcttggtc

SEQ ID NO: 237465 - DNA, 20 bp, human
gcataaactgaataggtcgt

SEQ ID NO: 237466 - DNA, 20 bp, human
gaatttacattaaacatttc

SEQ ID NO: 237467 - DNA, 20 bp, human
gtatctgttcagttacaaag

SEQ ID NO: 237468 - DNA, 20 bp, human
ggtaactgccagcagaagtc

SEQ ID NO: 237469 - DNA, 20 bp, human
gctcccagagcaaaagtaaa

SEQ ID NO: 237470 - DNA, 20 bp, human
gtaaagccatgtttccaagg

SEQ ID NO: 237471 - DNA, 20 bp, human
gggcagttactgagagagat

SEQ ID NO: 237472 - DNA, 20 bp, human
ggccaggtttaggagattta

SEQ ID NO: 237473 - DNA, 20 bp, human
gcggtaaagccatgtttcca

SEQ ID NO: 237474 - DNA, 20 bp, human
gcaaacactagaggaacggg

SEQ ID NO: 237475 - DNA, 20 bp, human
gccaccaaacactagaggaa

SEQ ID NO: 237476 - DNA, 20 bp, human
gcttgggtctaatgtctacc

SEQ ID NO: 237477 - DNA, 20 bp, human
gacattagacccaagtcccc

SEQ ID NO: 237478 - DNA, 20 bp, human
gaatgtctacctggagcctt

SEQ ID NO: 237479 - DNA, 20 bp, human
ggatgatcacctggggactt

SEQ ID NO: 237480 - DNA, 20 bp, human
gtatggaaggaaggggacta

SEQ ID NO: 237481 - DNA, 20 bp, human
gtgggcctgatgatcacctg

SEQ ID NO: 237482 - DNA, 20 bp, human
ggttcgtgtggtcatcatcc

SEQ ID NO: 237483 - DNA, 20 bp, human
gacattagacccaaggctcc

SEQ ID NO: 237484 - DNA, 20 bp, human
ggttctaagttctgttcgtg

SEQ ID NO: 237485 - DNA, 20 bp, human
gggtcaggagatgacctgag

SEQ ID NO: 237486 - DNA, 20 bp, human
gtgagtagtcagtaacccag

SEQ ID NO: 237487 - DNA, 20 bp, human
gtccttccataagcctactc

SEQ ID NO: 237488 - DNA, 20 bp, human
gggagtcctgagtaggctta

SEQ ID NO: 237489 - DNA, 20 bp, human
gtcctgagtaggcttatgga

SEQ ID NO: 237490 - DNA, 20 bp, human
ggtaggcttatggaaggaag

SEQ ID NO: 237491 - DNA, 20 bp, human
gaggtgtccaagcagagcct

SEQ ID NO: 237492 - DNA, 20 bp, human
gttcgtgtgtgtcatcatcg

SEQ ID NO: 237493 - DNA, 20 bp, human
gcagtccccaggtgatcatc

SEQ ID NO: 237494 - DNA, 20 bp, human
gtgggcctgatgatcacctg

SEQ ID NO: 237495 - DNA, 20 bp, human
gaggcacacacccagtcccc

SEQ ID NO: 237496 - DNA, 20 bp, human
gagggcagaagattcaggag

SEQ ID NO: 237497 - DNA, 20 bp, human
gagtaggtgttcactcttgg

SEQ ID NO: 237498 - DNA, 20 bp, human
gactctaatgtccgtgtttg

SEQ ID NO: 237499 - DNA, 20 bp, human
gcaaatgaggtcatgcatgt

SEQ ID NO: 237500 - DNA, 20 bp, human
gtgtgtatgtgtttggtcta

SEQ ID NO: 237501 - DNA, 20 bp, human
gcatagtaggtgttcactct

SEQ ID NO: 237502 - DNA, 20 bp, human
ggcaatgcagtcctcaaaca

SEQ ID NO: 237503 - DNA, 20 bp, human
ggagaatggctgtcactaac

SEQ ID NO: 237504 - DNA, 20 bp, human
ggccagaagtcaggagtgaa

SEQ ID NO: 237505 - DNA, 20 bp, human
gtctgtagttggctgcgtct

SEQ ID NO: 237506 - DNA, 20 bp, human
gtgcggcgcgagacctggtg

SEQ ID NO: 237507 - DNA, 20 bp, human
ggcgcgagacctggtgcggg

SEQ ID NO: 237508 - DNA, 20 bp, human
ggctcctgacgtcacctcac

SEQ ID NO: 237509 - DNA, 20 bp, human
ggggcagggagaagtgtgcg

SEQ ID NO: 237510 - DNA, 20 bp, human
gctccccgtgaggtgacgtc

SEQ ID NO: 237511 - DNA, 20 bp, human
ggacaagccggctccgagtc

SEQ ID NO: 237512 - DNA, 20 bp, human
ggtcacctcacggggaggcg

SEQ ID NO: 237513 - DNA, 20 bp, human
ggggcctgcggcgcgagacc

SEQ ID NO: 237514 - DNA, 20 bp, human
gagaaaaggtgggagcggtg

SEQ ID NO: 237515 - DNA, 20 bp, human
gagggagaagtgtgcggggc

SEQ ID NO: 237516 - DNA, 20 bp, human
gccgctcggcccgggtgaaa

SEQ ID NO: 237517 - DNA, 20 bp, human
gagctctcgggtcggggcta

SEQ ID NO: 237518 - DNA, 20 bp, human
gagagggagctctcgggtcg

SEQ ID NO: 237519 - DNA, 20 bp, human
ggcggtgacggcactgggtg

SEQ ID NO: 237520 - DNA, 20 bp, human
ggagccctgctcccgggaga

SEQ ID NO: 237521 - DNA, 20 bp, human
gcagcgccaccatcacggtc

SEQ ID NO: 237522 - DNA, 20 bp, human
gtgggtggggccgagctcca

SEQ ID NO: 237523 - DNA, 20 bp, human
gcattggacggcagcgtcag

SEQ ID NO: 237524 - DNA, 20 bp, human
ggaaagggcggtgacggcac

SEQ ID NO: 237525 - DNA, 20 bp, human
gggggcggagcagagtcgag

SEQ ID NO: 237526 - DNA, 20 bp, human
gaggccgtgcagtccgagat

SEQ ID NO: 237527 - DNA, 20 bp, human
gctgagtaggcagatgcacc

SEQ ID NO: 237528 - DNA, 20 bp, human
ggccccaggggaagttggtg

SEQ ID NO: 237529 - DNA, 20 bp, human
gtccgagatgggctcgtctc

SEQ ID NO: 237530 - DNA, 20 bp, human
gtgggtgccccaggggaagt

SEQ ID NO: 237531 - DNA, 20 bp, human
ggccaggcctgtcaggtggc

SEQ ID NO: 237532 - DNA, 20 bp, human
gctgcagtgtggggtaccca

SEQ ID NO: 237533 - DNA, 20 bp, human
gagagtggccgccccagagt

SEQ ID NO: 237534 - DNA, 20 bp, human
ggtggccgccccagagtggg

SEQ ID NO: 237535 - DNA, 20 bp, human
ggtggggtacccatggccac

SEQ ID NO: 237536 - DNA, 20 bp, human
gggggcagagcacgggggga

SEQ ID NO: 237537 - DNA, 20 bp, human
gaaccatcggggcagagcac

SEQ ID NO: 237538 - DNA, 20 bp, human
gcggcggcgcgcgaagaagt

SEQ ID NO: 237539 - DNA, 20 bp, human
gcatgcgcgctggtgggcgc

SEQ ID NO: 237540 - DNA, 20 bp, human
gacgcggcgctgctccatgg

SEQ ID NO: 237541 - DNA, 20 bp, human
gcatcggggcagagcacggg

SEQ ID NO: 237542 - DNA, 20 bp, human
gccggcgcggaccgaaccat

SEQ ID NO: 237543 - DNA, 20 bp, human
gcgagtccacgcccgcacgt

SEQ ID NO: 237544 - DNA, 20 bp, human
ggctctgcagaggaccccga

SEQ ID NO: 237545 - DNA, 20 bp, human
gggcgcgcatgcgcgctggt

SEQ ID NO: 237546 - DNA, 20 bp, human
ggggcggagtccaagcatgg

SEQ ID NO: 237547 - DNA, 20 bp, human
gacggggcggagtccaagca

SEQ ID NO: 237548 - DNA, 20 bp, human
gccgctgtgggatcgccaag

SEQ ID NO: 237549 - DNA, 20 bp, human
gctccgccccgtctgggtca

SEQ ID NO: 237550 - DNA, 20 bp, human
gttgagggcgggcatgttga

SEQ ID NO: 237551 - DNA, 20 bp, human
gcaggcagagcaaaatacgc

SEQ ID NO: 237552 - DNA, 20 bp, human
ggagtccaagcatgggggcg

SEQ ID NO: 237553 - DNA, 20 bp, human
ggtgccaggacgaagctctt

SEQ ID NO: 237554 - DNA, 20 bp, human
gatccctgacccagacgggg

SEQ ID NO: 237555 - DNA, 20 bp, human
gcttcgtcctggcacctgat

SEQ ID NO: 237556 - DNA, 20 bp, human
gcctccgggccgcgaatcaa

SEQ ID NO: 237557 - DNA, 20 bp, human
gaaagggggaaacccgtcgg

SEQ ID NO: 237558 - DNA, 20 bp, human
gcgggggcggggggttcaaa

SEQ ID NO: 237559 - DNA, 20 bp, human
ggagggcgcgtcttgggcga

SEQ ID NO: 237560 - DNA, 20 bp, human
gggcggcccggagctataaa

SEQ ID NO: 237561 - DNA, 20 bp, human
ggccagtccacctcccgctt

SEQ ID NO: 237562 - DNA, 20 bp, human
gtcgaggccgcgctgcgagt

SEQ ID NO: 237563 - DNA, 20 bp, human
gcggttgctcgtcgtcgggg

SEQ ID NO: 237564 - DNA, 20 bp, human
gcggcaggacagccgagttc

SEQ ID NO: 237565 - DNA, 20 bp, human
gccgggccgcgaatcaaagg

SEQ ID NO: 237566 - DNA, 20 bp, human
ggggagggaggctcgtgaga

SEQ ID NO: 237567 - DNA, 20 bp, human
gaggaagctcttaacaataa

SEQ ID NO: 237568 - DNA, 20 bp, human
gccactaggctgcagaggcg

SEQ ID NO: 237569 - DNA, 20 bp, human
ggggaagacccgccacaggc

SEQ ID NO: 237570 - DNA, 20 bp, human
gaggaatggcccatctctta

SEQ ID NO: 237571 - DNA, 20 bp, human
gccttcccactaggctgcag

SEQ ID NO: 237572 - DNA, 20 bp, human
gcctcgacgtctccaaccat

SEQ ID NO: 237573 - DNA, 20 bp, human
gtaaagtgcaccaggttgga

SEQ ID NO: 237574 - DNA, 20 bp, human
gccaggagcacagggcggga

SEQ ID NO: 237575 - DNA, 20 bp, human
gacggaaggccgccggcctg

SEQ ID NO: 237576 - DNA, 20 bp, human
gggagctggtcagaaatccc

SEQ ID NO: 237577 - DNA, 20 bp, human
ggcagatgcaggttggacgc

SEQ ID NO: 237578 - DNA, 20 bp, human
gtgacgctatggggaccaga

SEQ ID NO: 237579 - DNA, 20 bp, human
gcgcgggaagatcggtgaaa

SEQ ID NO: 237580 - DNA, 20 bp, human
ggggaagatcggtgaaaggg

SEQ ID NO: 237581 - DNA, 20 bp, human
gcgtcagtattgtgcttttg

SEQ ID NO: 237582 - DNA, 20 bp, human
ggctggtcagaaatccctgg

SEQ ID NO: 237583 - DNA, 20 bp, human
ggggcaaagttccgctctct

SEQ ID NO: 237584 - DNA, 20 bp, human
gatagagacctgcagaaacc

SEQ ID NO: 237585 - DNA, 20 bp, human
gaagcacaatactgacgcta

SEQ ID NO: 237586 - DNA, 20 bp, human
gggcccgaaaacccggagcg

SEQ ID NO: 237587 - DNA, 20 bp, human
gcgcccgcctcggccccgag

SEQ ID NO: 237588 - DNA, 20 bp, human
gccccgccggccgcccgcct

SEQ ID NO: 237589 - DNA, 20 bp, human
gcggagcccactgctcccct

SEQ ID NO: 237590 - DNA, 20 bp, human
ggggagcagtgggctccgct

SEQ ID NO: 237591 - DNA, 20 bp, human
ggaccccgcaagcgggactg

SEQ ID NO: 237592 - DNA, 20 bp, human
gctcccgcgctccgggtttt

SEQ ID NO: 237593 - DNA, 20 bp, human
ggcgagccggcaggaagggg

SEQ ID NO: 237594 - DNA, 20 bp, human
gcgggagcgagccggcagga

SEQ ID NO: 237595 - DNA, 20 bp, human
ggctccgctcggggccgagg

SEQ ID NO: 237596 - DNA, 20 bp, human
gcccaaccataaaacgcctt

SEQ ID NO: 237597 - DNA, 20 bp, human
gaggcatccaaggggagatg

SEQ ID NO: 237598 - DNA, 20 bp, human
gccaaggggagatgggggat

SEQ ID NO: 237599 - DNA, 20 bp, human
ggccaaaggcgttttatggt

SEQ ID NO: 237600 - DNA, 20 bp, human
gggggtacaaaactgttgaa

SEQ ID NO: 237601 - DNA, 20 bp, human
gcctggtttggctggtgatt

SEQ ID NO: 237602 - DNA, 20 bp, human
gcaggatagaatatgctttg

SEQ ID NO: 237603 - DNA, 20 bp, human
gaaattttgggttatggagg

SEQ ID NO: 237604 - DNA, 20 bp, human
gggttatggaggaggtaacc

SEQ ID NO: 237605 - DNA, 20 bp, human
gaagacatgcctggtttggc

SEQ ID NO: 237606 - DNA, 20 bp, human
ggccgggtgcgcccgatctg

SEQ ID NO: 237607 - DNA, 20 bp, human
gagctggcggggcccccggg

SEQ ID NO: 237608 - DNA, 20 bp, human
gcggcgtccactcccctcga

SEQ ID NO: 237609 - DNA, 20 bp, human
gggccggggagccaggtaga

SEQ ID NO: 237610 - DNA, 20 bp, human
gaggggccaggtctcccagg

SEQ ID NO: 237611 - DNA, 20 bp, human
gaggggccgcgcagccccga

SEQ ID NO: 237612 - DNA, 20 bp, human
gagcagctggcggggccccc

SEQ ID NO: 237613 - DNA, 20 bp, human
gcccgagcgctagtcgactc

SEQ ID NO: 237614 - DNA, 20 bp, human
gtgggagacctggcccctcg

SEQ ID NO: 237615 - DNA, 20 bp, human
gaggggagtggacgccgcct

SEQ ID NO: 237616 - DNA, 20 bp, human
ggagacctctgtccccatca

SEQ ID NO: 237617 - DNA, 20 bp, human
gaccacatttggatatgcca

SEQ ID NO: 237618 - DNA, 20 bp, human
gacacaatagaggtcagtgc

SEQ ID NO: 237619 - DNA, 20 bp, human
gccagcacactgaagagcat

SEQ ID NO: 237620 - DNA, 20 bp, human
gtgtctgatcatgtgtgctg

SEQ ID NO: 237621 - DNA, 20 bp, human
gcagctcccggatatggagg

SEQ ID NO: 237622 - DNA, 20 bp, human
gcatagccaggacacaatag

SEQ ID NO: 237623 - DNA, 20 bp, human
gcacctgagacccctggact

SEQ ID NO: 237624 - DNA, 20 bp, human
gggacaaaggtaggaatgag

SEQ ID NO: 237625 - DNA, 20 bp, human
ggatcatgtgtgctggggcg

SEQ ID NO: 237626 - DNA, 20 bp, human
ggactcagtggacacaatgg

SEQ ID NO: 237627 - DNA, 20 bp, human
ggggttgtgacttagtagag

SEQ ID NO: 237628 - DNA, 20 bp, human
gccagactcagtggacacaa

SEQ ID NO: 237629 - DNA, 20 bp, human
gacacaatggaggtttggtt

SEQ ID NO: 237630 - DNA, 20 bp, human
gcctgggtgtccagggttaa

SEQ ID NO: 237631 - DNA, 20 bp, human
gcccagcctgaaccaagaat

SEQ ID NO: 237632 - DNA, 20 bp, human
gcccctcctattcttggttc

SEQ ID NO: 237633 - DNA, 20 bp, human
gggacgcagacccttaaccc

SEQ ID NO: 237634 - DNA, 20 bp, human
gactgcggttcgcactcact

SEQ ID NO: 237635 - DNA, 20 bp, human
gggtgacattcaaggtgact

SEQ ID NO: 237636 - DNA, 20 bp, human
gaggtcccctgcactgggtg

SEQ ID NO: 237637 - DNA, 20 bp, human
gcaggccctcggcacaaaga

SEQ ID NO: 237638 - DNA, 20 bp, human
ggtgactcccaggctctctg

SEQ ID NO: 237639 - DNA, 20 bp, human
gagggcctggatttggtact

SEQ ID NO: 237640 - DNA, 20 bp, human
gcagaggccgtgacctgggc

SEQ ID NO: 237641 - DNA, 20 bp, human
gcctcggcacaaagagggtt

SEQ ID NO: 237642 - DNA, 20 bp, human
gcggcacaaagagggttagg

SEQ ID NO: 237643 - DNA, 20 bp, human
ggagaggaaccaggtcaccg

SEQ ID NO: 237644 - DNA, 20 bp, human
gtggagggatcgagtcacca

SEQ ID NO: 237645 - DNA, 20 bp, human
gcggccagaggccgtgacct

SEQ ID NO: 237646 - DNA, 20 bp, human
gtggggcagggctctaacaa

SEQ ID NO: 237647 - DNA, 20 bp, human
gaaccaggacaggtgagcac

SEQ ID NO: 237648 - DNA, 20 bp, human
ggatgctgggcaggagccga

SEQ ID NO: 237649 - DNA, 20 bp, human
ggcaaatgtcggccccctga

SEQ ID NO: 237650 - DNA, 20 bp, human
ggggggagaaggccctgagg

SEQ ID NO: 237651 - DNA, 20 bp, human
ggggctgccctcgtggggca

SEQ ID NO: 237652 - DNA, 20 bp, human
gtgtcctgggctgccctcgt

SEQ ID NO: 237653 - DNA, 20 bp, human
gttagagccctgccccacga

SEQ ID NO: 237654 - DNA, 20 bp, human
ggaaggccctgaggaggtgc

SEQ ID NO: 237655 - DNA, 20 bp, human
gacacagctatcagcagctc

SEQ ID NO: 237656 - DNA, 20 bp, human
gaagccataaagataaggtt

SEQ ID NO: 237657 - DNA, 20 bp, human
gctggtcagagtgcaccctg

SEQ ID NO: 237658 - DNA, 20 bp, human
gaaaacacaggctcactgtt

SEQ ID NO: 237659 - DNA, 20 bp, human
ggaaacaggacatacagttg

SEQ ID NO: 237660 - DNA, 20 bp, human
ggcactctgaccagcagggg

SEQ ID NO: 237661 - DNA, 20 bp, human
ggagcccaaccttatcttta

SEQ ID NO: 237662 - DNA, 20 bp, human
gggtgcactctgaccagcag

SEQ ID NO: 237663 - DNA, 20 bp, human
gcacttggacccggaagacg

SEQ ID NO: 237664 - DNA, 20 bp, human
gagccaagtgcctcaaagat

SEQ ID NO: 237665 - DNA, 20 bp, human
gggcacttggctgtattttc

SEQ ID NO: 237666 - DNA, 20 bp, human
gaggggaattgttcaaacag

SEQ ID NO: 237667 - DNA, 20 bp, human
gggtgactggggaacttccc

SEQ ID NO: 237668 - DNA, 20 bp, human
gggttgaagagggtcagggg

SEQ ID NO: 237669 - DNA, 20 bp, human
gttatggtggctgctgaatg

SEQ ID NO: 237670 - DNA, 20 bp, human
gcacgctgagtgagaaaaag

SEQ ID NO: 237671 - DNA, 20 bp, human
gtctgccaatagacagaggt

SEQ ID NO: 237672 - DNA, 20 bp, human
ggagaaaaagaggttgaaga

SEQ ID NO: 237673 - DNA, 20 bp, human
gaggttgaaccagtttttca

SEQ ID NO: 237674 - DNA, 20 bp, human
gtgggaacagttatttatgg

SEQ ID NO: 237675 - DNA, 20 bp, human
gcaatgggaacagttattta

SEQ ID NO: 237676 - DNA, 20 bp, human
ggcgggaagtccaggaaccc

SEQ ID NO: 237677 - DNA, 20 bp, human
ggaaggaaagtgagccctgg

SEQ ID NO: 237678 - DNA, 20 bp, human
gagtgagccctgggggtaga

SEQ ID NO: 237679 - DNA, 20 bp, human
gactggttattaagctctcg

SEQ ID NO: 237680 - DNA, 20 bp, human
gaggagcctgacgtggtctt

SEQ ID NO: 237681 - DNA, 20 bp, human
gtcgcagttcccggtctcca

SEQ ID NO: 237682 - DNA, 20 bp, human
gatgaacttggcactgggac

SEQ ID NO: 237683 - DNA, 20 bp, human
ggctctcggggacaaggagc

SEQ ID NO: 237684 - DNA, 20 bp, human
gtatatcacaagcatgattc

SEQ ID NO: 237685 - DNA, 20 bp, human
gcaggaatctcagactgagc

SEQ ID NO: 237686 - DNA, 20 bp, human
gaggcccagtaggggaacaa

SEQ ID NO: 237687 - DNA, 20 bp, human
gtctgctgcccctgtgggga

SEQ ID NO: 237688 - DNA, 20 bp, human
gttagtgtgctcaactacac

SEQ ID NO: 237689 - DNA, 20 bp, human
ggcagaaggaggaatgacta

SEQ ID NO: 237690 - DNA, 20 bp, human
ggacacttgggatttcacga

SEQ ID NO: 237691 - DNA, 20 bp, human
gcgccccaagtgacttttta

SEQ ID NO: 237692 - DNA, 20 bp, human
gagtcttctgtcaaagaggg

SEQ ID NO: 237693 - DNA, 20 bp, human
gcacagaaagtcactctcac

SEQ ID NO: 237694 - DNA, 20 bp, human
gtctctgcttccccttccta

SEQ ID NO: 237695 - DNA, 20 bp, human
gagagtgcaaatgtcagagg

SEQ ID NO: 237696 - DNA, 20 bp, human
gaaaatgaggcaaaactgag

SEQ ID NO: 237697 - DNA, 20 bp, human
gtggatccctgtttcataac

SEQ ID NO: 237698 - DNA, 20 bp, human
gctgagaagcaaggcttact

SEQ ID NO: 237699 - DNA, 20 bp, human
ggcagagcagaggtccacgc

SEQ ID NO: 237700 - DNA, 20 bp, human
gggtcatcctgttatgaaac

SEQ ID NO: 237701 - DNA, 20 bp, human
gtgaccctccctccccagcg

SEQ ID NO: 237702 - DNA, 20 bp, human
gagagcttcacccatgaccc

SEQ ID NO: 237703 - DNA, 20 bp, human
gagcaccatgcagagtccct

SEQ ID NO: 237704 - DNA, 20 bp, human
ggcagaggtccacgctgggg

SEQ ID NO: 237705 - DNA, 20 bp, human
gctacaaatggatatatcta

SEQ ID NO: 237706 - DNA, 20 bp, human
gtgacaagtcaccctctctg

SEQ ID NO: 237707 - DNA, 20 bp, human
ggaggtgtcctgcatgtcct

SEQ ID NO: 237708 - DNA, 20 bp, human
gggaatgtcaccacaaacag

SEQ ID NO: 237709 - DNA, 20 bp, human
gtttgtggtgacattcccaa

SEQ ID NO: 237710 - DNA, 20 bp, human
gacactttgagaagcagggt

SEQ ID NO: 237711 - DNA, 20 bp, human
gcacaaacagaggtactctg

SEQ ID NO: 237712 - DNA, 20 bp, human
gggggagcatgaggagacct

SEQ ID NO: 237713 - DNA, 20 bp, human
gagaaaatggggggcgacta

SEQ ID NO: 237714 - DNA, 20 bp, human
gtcatgctccccaatactca

SEQ ID NO: 237715 - DNA, 20 bp, human
gctctcttcccaggacatgc

SEQ ID NO: 237716 - DNA, 20 bp, human
ggggagacccgggaccctgc

SEQ ID NO: 237717 - DNA, 20 bp, human
gtgccctaggaagagactca

SEQ ID NO: 237718 - DNA, 20 bp, human
gagaaacccagcagggtccc

SEQ ID NO: 237719 - DNA, 20 bp, human
gtgccgaaaagatttgtctg

SEQ ID NO: 237720 - DNA, 20 bp, human
ggaagacaggttgtcctccc

SEQ ID NO: 237721 - DNA, 20 bp, human
gaaaaaggctcactgggtgg

SEQ ID NO: 237722 - DNA, 20 bp, human
gtgccctgagtctcttccta

SEQ ID NO: 237723 - DNA, 20 bp, human
gcaaccccgccactgaccca

SEQ ID NO: 237724 - DNA, 20 bp, human
ggggcctgggtctccatccc

SEQ ID NO: 237725 - DNA, 20 bp, human
gcctccacatgcaggatctg

SEQ ID NO: 237726 - DNA, 20 bp, human
gagggcgggtcgtcctgtta

SEQ ID NO: 237727 - DNA, 20 bp, human
gtcgtcctgttatggaacag

SEQ ID NO: 237728 - DNA, 20 bp, human
gcttctcagagcatcttctg

SEQ ID NO: 237729 - DNA, 20 bp, human
gcgacccgccctccccagca

SEQ ID NO: 237730 - DNA, 20 bp, human
gctaggagtggacacatcca

SEQ ID NO: 237731 - DNA, 20 bp, human
ggggatagaagcatttccca

SEQ ID NO: 237732 - DNA, 20 bp, human
gtccctggggtcctcaaacc

SEQ ID NO: 237733 - DNA, 20 bp, human
gatgggtgcggtctctgttc

SEQ ID NO: 237734 - DNA, 20 bp, human
gcaaggcccagacacagcag

SEQ ID NO: 237735 - DNA, 20 bp, human
gacatcctgcacacatagag

SEQ ID NO: 237736 - DNA, 20 bp, human
gctactcaaagctttgtatc

SEQ ID NO: 237737 - DNA, 20 bp, human
gcataggtcagcactgggaa

SEQ ID NO: 237738 - DNA, 20 bp, human
ggaggtgtctggtgtgtcct

SEQ ID NO: 237739 - DNA, 20 bp, human
gtccaagatcacatggtcca

SEQ ID NO: 237740 - DNA, 20 bp, human
gcccctggaccatgtgatct

SEQ ID NO: 237741 - DNA, 20 bp, human
gaggggtggggtctctgctc

SEQ ID NO: 237742 - DNA, 20 bp, human
gagaaacccagctgggcctt

SEQ ID NO: 237743 - DNA, 20 bp, human
gaccaaggcccaggggtctc

SEQ ID NO: 237744 - DNA, 20 bp, human
gtacagctcctgggtgtgga

SEQ ID NO: 237745 - DNA, 20 bp, human
gtatgctgtgttctggcctt

SEQ ID NO: 237746 - DNA, 20 bp, human
gtgtgctcacccagtctcca

SEQ ID NO: 237747 - DNA, 20 bp, human
gcaccccgacctggagacat

SEQ ID NO: 237748 - DNA, 20 bp, human
ggcagcctatgtctccaggt

SEQ ID NO: 237749 - DNA, 20 bp, human
gggacaccaccactgagctt

SEQ ID NO: 237750 - DNA, 20 bp, human
gccgcaaggaccctgtcaca

SEQ ID NO: 237751 - DNA, 20 bp, human
gtggctcttcccttcagatc

SEQ ID NO: 237752 - DNA, 20 bp, human
gacacctccccaaagctcag

SEQ ID NO: 237753 - DNA, 20 bp, human
gtggtggtgtccctgtgaca

SEQ ID NO: 237754 - DNA, 20 bp, human
gaatgccctggatatcccag

SEQ ID NO: 237755 - DNA, 20 bp, human
ggtctgcatagtgtgtgcag

SEQ ID NO: 237756 - DNA, 20 bp, human
ggcagcctcgggatactcct

SEQ ID NO: 237757 - DNA, 20 bp, human
gtcccggccgtggctggata

SEQ ID NO: 237758 - DNA, 20 bp, human
ggcacagcgccgcgctcccc

SEQ ID NO: 237759 - DNA, 20 bp, human
gttgcgccgcggcctgcctg

SEQ ID NO: 237760 - DNA, 20 bp, human
gcccacgtggtcggtagcgg

SEQ ID NO: 237761 - DNA, 20 bp, human
ggcccccgcgcccacgtggt

SEQ ID NO: 237762 - DNA, 20 bp, human
gaggccgcctcggactctag

SEQ ID NO: 237763 - DNA, 20 bp, human
gaggctgcacggggtagggg

SEQ ID NO: 237764 - DNA, 20 bp, human
ggcccccgctaccgaccacg

SEQ ID NO: 237765 - DNA, 20 bp, human
gggagcccaggagtatcccg

SEQ ID NO: 237766 - DNA, 20 bp, human
gcctgccgccgtcctcccgg

SEQ ID NO: 237767 - DNA, 20 bp, human
ggggccggggccgcgtctcg

SEQ ID NO: 237768 - DNA, 20 bp, human
gaggggccggcgtgacgcag

SEQ ID NO: 237769 - DNA, 20 bp, human
gccgcgcacgggactgggaa

SEQ ID NO: 237770 - DNA, 20 bp, human
ggggaaggggacccacccga

SEQ ID NO: 237771 - DNA, 20 bp, human
ggagacccccgggaggacgg

SEQ ID NO: 237772 - DNA, 20 bp, human
gcacccggagcgcgttttcg

SEQ ID NO: 237773 - DNA, 20 bp, human
ggtggccgctattagtgagg

SEQ ID NO: 237774 - DNA, 20 bp, human
gtcctcccgggggtctcggg

SEQ ID NO: 237775 - DNA, 20 bp, human
gccgggattgggagcgagag

SEQ ID NO: 237776 - DNA, 20 bp, human
gccccggggaggaactgaga

SEQ ID NO: 237777 - DNA, 20 bp, human
ggggcaccctcctgcaacgt

SEQ ID NO: 237778 - DNA, 20 bp, human
ggacccccagcccacgttgc

SEQ ID NO: 237779 - DNA, 20 bp, human
gccaaccccgaggagcgagg

SEQ ID NO: 237780 - DNA, 20 bp, human
gggggctagaaaaggcggcg

SEQ ID NO: 237781 - DNA, 20 bp, human
gcgtcagccggggctagaaa

SEQ ID NO: 237782 - DNA, 20 bp, human
gggggcgtgcacgtcagccg

SEQ ID NO: 237783 - DNA, 20 bp, human
ggagccgccccgagccttcc

SEQ ID NO: 237784 - DNA, 20 bp, human
gctcctgcaacgtgggctgg

SEQ ID NO: 237785 - DNA, 20 bp, human
gccccgcggtgccggagtcg

SEQ ID NO: 237786 - DNA, 20 bp, human
ggggtctagggagtagtgat

SEQ ID NO: 237787 - DNA, 20 bp, human
gagagaggccacacaggagt

SEQ ID NO: 237788 - DNA, 20 bp, human
gactgcagagggcaggtcta

SEQ ID NO: 237789 - DNA, 20 bp, human
gcctccctgagtcaccccaa

SEQ ID NO: 237790 - DNA, 20 bp, human
gagggcagaagatcgagaga

SEQ ID NO: 237791 - DNA, 20 bp, human
gggcagccggagcaccccaa

SEQ ID NO: 237792 - DNA, 20 bp, human
gccagaggaaggcgtgtcaa

SEQ ID NO: 237793 - DNA, 20 bp, human
gtgctcttgaggcacccctt

SEQ ID NO: 237794 - DNA, 20 bp, human
gcccaactgagggtaggcac

SEQ ID NO: 237795 - DNA, 20 bp, human
gatcgagagagggcaggccc

SEQ ID NO: 237796 - DNA, 20 bp, human
gtgcccgtcgcgagagaagg

SEQ ID NO: 237797 - DNA, 20 bp, human
gagcccagtcgaccaatcgt

SEQ ID NO: 237798 - DNA, 20 bp, human
gagcccgggcgagctgccta

SEQ ID NO: 237799 - DNA, 20 bp, human
ggggaggcgggcccacggtg

SEQ ID NO: 237800 - DNA, 20 bp, human
ggcaccgccttctctcgcga

SEQ ID NO: 237801 - DNA, 20 bp, human
gccgccagcctgcccacgat

SEQ ID NO: 237802 - DNA, 20 bp, human
gtgcccacgattggtcgact

SEQ ID NO: 237803 - DNA, 20 bp, human
ggggagcgccggcctgccgg

SEQ ID NO: 237804 - DNA, 20 bp, human
ggggcccacggtgggggagt

SEQ ID NO: 237805 - DNA, 20 bp, human
gggcaggccggcgctcccat

SEQ ID NO: 237806 - DNA, 20 bp, human
gcacggcaaccgggcttcga

SEQ ID NO: 237807 - DNA, 20 bp, human
gctcgctccgccaggagctg

SEQ ID NO: 237808 - DNA, 20 bp, human
gcactcatgctgaaattcgc

SEQ ID NO: 237809 - DNA, 20 bp, human
ggagggtaccgggggatcaa

SEQ ID NO: 237810 - DNA, 20 bp, human
gttggggccgttgtgtgccg

SEQ ID NO: 237811 - DNA, 20 bp, human
gccactggcagagcggaaat

SEQ ID NO: 237812 - DNA, 20 bp, human
gcagcatgagtgtactgctg

SEQ ID NO: 237813 - DNA, 20 bp, human
ggggctcacttccaccttga

SEQ ID NO: 237814 - DNA, 20 bp, human
gaccctcaactgaagagctg

SEQ ID NO: 237815 - DNA, 20 bp, human
gctgaggaaggcgccccacg

SEQ ID NO: 237816 - DNA, 20 bp, human
gccaactagaggccggggag

SEQ ID NO: 237817 - DNA, 20 bp, human
gcatctgagtttgatgtggg

SEQ ID NO: 237818 - DNA, 20 bp, human
gcggcctctagttggatccc

SEQ ID NO: 237819 - DNA, 20 bp, human
ggcaccagggatccaactag

SEQ ID NO: 237820 - DNA, 20 bp, human
gatccctggtgcacactgga

SEQ ID NO: 237821 - DNA, 20 bp, human
ggtgcatctgagtttgatgt

SEQ ID NO: 237822 - DNA, 20 bp, human
gttccctccagtgtgcacca

SEQ ID NO: 237823 - DNA, 20 bp, human
ggcttgtgcgcatgttcatg

SEQ ID NO: 237824 - DNA, 20 bp, human
gcaacaggaagtgaaacagt

SEQ ID NO: 237825 - DNA, 20 bp, human
gaaataaaacctaccccaac

SEQ ID NO: 237826 - DNA, 20 bp, human
gagcttgatgaaggtcaaat

SEQ ID NO: 237827 - DNA, 20 bp, human
gtgaggaaagcgacgaactt

SEQ ID NO: 237828 - DNA, 20 bp, human
gacgctcagagagcccagcg

SEQ ID NO: 237829 - DNA, 20 bp, human
gtgggatcgccatttgaggt

SEQ ID NO: 237830 - DNA, 20 bp, human
gaaggtcaaataggtagtaa

SEQ ID NO: 237831 - DNA, 20 bp, human
gtgaggtgggcgtggctatt

SEQ ID NO: 237832 - DNA, 20 bp, human
ggcgacgaacttaggagccc

SEQ ID NO: 237833 - DNA, 20 bp, human
gggtaaaaccccatctcgcc

SEQ ID NO: 237834 - DNA, 20 bp, human
gtcaaataggtagtaagggg

SEQ ID NO: 237835 - DNA, 20 bp, human
gtagccacgcccacctcaaa

SEQ ID NO: 237836 - DNA, 20 bp, human
gtcacagtagccagaaggaa

SEQ ID NO: 237837 - DNA, 20 bp, human
gaaaaagaaaacgcggaatc

SEQ ID NO: 237838 - DNA, 20 bp, human
gtgggaccattcagttcttg

SEQ ID NO: 237839 - DNA, 20 bp, human
gtgtgccggtaagaggaatg

SEQ ID NO: 237840 - DNA, 20 bp, human
gctactgtgagaagagcaac

SEQ ID NO: 237841 - DNA, 20 bp, human
gcttgtgctggcggtaggaa

SEQ ID NO: 237842 - DNA, 20 bp, human
gccaaccccattcctcttac

SEQ ID NO: 237843 - DNA, 20 bp, human
ggaatggtcccagcagcgga

SEQ ID NO: 237844 - DNA, 20 bp, human
gcagttcttggggcttgtgc

SEQ ID NO: 237845 - DNA, 20 bp, human
gccctgggaaaaagaaaacg

SEQ ID NO: 237846 - DNA, 20 bp, human
gtaagcgcgcggagcccgtc

SEQ ID NO: 237847 - DNA, 20 bp, human
gtcggcgcgcgcggcatcac

SEQ ID NO: 237848 - DNA, 20 bp, human
gccgctgcacagccaatcag

SEQ ID NO: 237849 - DNA, 20 bp, human
gcctatggaactcgacccgc

SEQ ID NO: 237850 - DNA, 20 bp, human
gggagcccgtcgggcgccta

SEQ ID NO: 237851 - DNA, 20 bp, human
gccgcggcgcacaatgggca

SEQ ID NO: 237852 - DNA, 20 bp, human
gacggccggatggctgcgtg

SEQ ID NO: 237853 - DNA, 20 bp, human
gctcgacccgcaggccaaag

SEQ ID NO: 237854 - DNA, 20 bp, human
gagttccataggcgcccgac

SEQ ID NO: 237855 - DNA, 20 bp, human
ggcagcggacggactcgcgg

SEQ ID NO: 237856 - DNA, 20 bp, human
gaaaccaggactggattcga

SEQ ID NO: 237857 - DNA, 20 bp, human
ggaggaagcagcgagaccag

SEQ ID NO: 237858 - DNA, 20 bp, human
ggcggcggggaaaccaggac

SEQ ID NO: 237859 - DNA, 20 bp, human
gcgcggcgcgctggatcaac

SEQ ID NO: 237860 - DNA, 20 bp, human
gtggatcaacgggaagagaa

SEQ ID NO: 237861 - DNA, 20 bp, human
ggggaagggcgctggacgga

SEQ ID NO: 237862 - DNA, 20 bp, human
gggtgcagtgcgtcacagtc

SEQ ID NO: 237863 - DNA, 20 bp, human
gggagcgagtcccgccggga

SEQ ID NO: 237864 - DNA, 20 bp, human
ggtgaagacaggcgaggcgg

SEQ ID NO: 237865 - DNA, 20 bp, human
gagggcgaggcgacccggtg

SEQ ID NO: 237866 - DNA, 20 bp, human
ggcctctgggcacgcggagt

SEQ ID NO: 237867 - DNA, 20 bp, human
gcctgagcattgcagggcag

SEQ ID NO: 237868 - DNA, 20 bp, human
gtcaaccagtgttcccacta

SEQ ID NO: 237869 - DNA, 20 bp, human
gtacacagaaggtgggttcg

SEQ ID NO: 237870 - DNA, 20 bp, human
gcccagctgcgagggagaca

SEQ ID NO: 237871 - DNA, 20 bp, human
gctaaagccctgagcattgc

SEQ ID NO: 237872 - DNA, 20 bp, human
gcccatcggcctgaatccgg

SEQ ID NO: 237873 - DNA, 20 bp, human
gacacggcgcccagctgcga

SEQ ID NO: 237874 - DNA, 20 bp, human
gagctctgcacaggagaccc

SEQ ID NO: 237875 - DNA, 20 bp, human
gcacccctcagaaaggagga

SEQ ID NO: 237876 - DNA, 20 bp, human
ggaggacaacgagagagtga

SEQ ID NO: 237877 - DNA, 20 bp, human
gagagagtgatggatgacaa

SEQ ID NO: 237878 - DNA, 20 bp, human
ggaggaaagtactgagaaac

SEQ ID NO: 237879 - DNA, 20 bp, human
ggcagtggagataattctgg

SEQ ID NO: 237880 - DNA, 20 bp, human
gcctccagctgctagtgcac

SEQ ID NO: 237881 - DNA, 20 bp, human
gggagtggttagcaagggca

SEQ ID NO: 237882 - DNA, 20 bp, human
ggcccccaggatgcaggcat

SEQ ID NO: 237883 - DNA, 20 bp, human
gcaccctcagccctgccagt

SEQ ID NO: 237884 - DNA, 20 bp, human
gactctctcgttgtcctcag

SEQ ID NO: 237885 - DNA, 20 bp, human
gcagggggatagtggaagag

SEQ ID NO: 237886 - DNA, 20 bp, human
gagatgccaaaggtagatat

SEQ ID NO: 237887 - DNA, 20 bp, human
gaaggtagatattggaatat

SEQ ID NO: 237888 - DNA, 20 bp, human
gttctagggtgacatttggg

SEQ ID NO: 237889 - DNA, 20 bp, human
gtgtttttgttcccctccct

SEQ ID NO: 237890 - DNA, 20 bp, human
ggtgacatttgggaggaaat

SEQ ID NO: 237891 - DNA, 20 bp, human
gactttgaaaaagatgccaa

SEQ ID NO: 237892 - DNA, 20 bp, human
gtctttttcaaagtatttct

SEQ ID NO: 237893 - DNA, 20 bp, human
gacacagctcttttttccac

SEQ ID NO: 237894 - DNA, 20 bp, human
gtatttctagggtgacattt

SEQ ID NO: 237895 - DNA, 20 bp, human
gcctcagtcttacccaggga

SEQ ID NO: 237896 - DNA, 20 bp, human
gagatgccaagggtagatac

SEQ ID NO: 237897 - DNA, 20 bp, human
gtatcagtgagagatacact

SEQ ID NO: 237898 - DNA, 20 bp, human
gatattccagtatctaccct

SEQ ID NO: 237899 - DNA, 20 bp, human
gtactttgagaagatgccaa

SEQ ID NO: 237900 - DNA, 20 bp, human
gatcttctcaaagtatttct

SEQ ID NO: 237901 - DNA, 20 bp, human
gcacaagctcttttttccac

SEQ ID NO: 237902 - DNA, 20 bp, human
gggggaatcacttgtaaccc

SEQ ID NO: 237903 - DNA, 20 bp, human
gtatttctagggtgacagtt

SEQ ID NO: 237904 - DNA, 20 bp, human
gcctcagtcttacccaagga

SEQ ID NO: 237905 - DNA, 20 bp, human
gaatactaattgttggtcct

SEQ ID NO: 237906 - DNA, 20 bp, human
ggggcagaaggtaagcaggg

SEQ ID NO: 237907 - DNA, 20 bp, human
gcacctgtccagccacctgt

SEQ ID NO: 237908 - DNA, 20 bp, human
gtggacaagtgacagccaaa

SEQ ID NO: 237909 - DNA, 20 bp, human
ggtaagcaggggggctgatt

SEQ ID NO: 237910 - DNA, 20 bp, human
gctccaacaggtggctggac

SEQ ID NO: 237911 - DNA, 20 bp, human
ggttccctccaacaggtggc

SEQ ID NO: 237912 - DNA, 20 bp, human
gtgtccatctgcagcaggcg

SEQ ID NO: 237913 - DNA, 20 bp, human
gacaagtgacagccaaaggg

SEQ ID NO: 237914 - DNA, 20 bp, human
gtatagggcagaaggtaagc

SEQ ID NO: 237915 - DNA, 20 bp, human
ggaacaggtggtggaactcc

SEQ ID NO: 237916 - DNA, 20 bp, human
gcacctgtgcggccacctgt

SEQ ID NO: 237917 - DNA, 20 bp, human
gccactccacaccacctgtg

SEQ ID NO: 237918 - DNA, 20 bp, human
gggcagaaggtaagcaaagg

SEQ ID NO: 237919 - DNA, 20 bp, human
gctccaacaggtggccgcac

SEQ ID NO: 237920 - DNA, 20 bp, human
gaggagtgacagccaaagga

SEQ ID NO: 237921 - DNA, 20 bp, human
ggtaagcaaagggggctgac

SEQ ID NO: 237922 - DNA, 20 bp, human
gctagactcaaactctagaa

SEQ ID NO: 237923 - DNA, 20 bp, human
gagttctcactcactgcaga

SEQ ID NO: 237924 - DNA, 20 bp, human
gtgagtgagaactgtggcct

SEQ ID NO: 237925 - DNA, 20 bp, human
gtctcactcactgcagatgg

SEQ ID NO: 237926 - DNA, 20 bp, human
gggccccaggggcttaggtg

SEQ ID NO: 237927 - DNA, 20 bp, human
gcgagcggagcgcggcgtag

SEQ ID NO: 237928 - DNA, 20 bp, human
gcccgcggccccaggggctt

SEQ ID NO: 237929 - DNA, 20 bp, human
gcctccacttcccagcccga

SEQ ID NO: 237930 - DNA, 20 bp, human
gctggctcttccctccagta

SEQ ID NO: 237931 - DNA, 20 bp, human
gctgcagcgccccctcgggc

SEQ ID NO: 237932 - DNA, 20 bp, human
ggagggggaacgtatcaccg

SEQ ID NO: 237933 - DNA, 20 bp, human
gcagccgcacctaagcccct

SEQ ID NO: 237934 - DNA, 20 bp, human
gcggagcgcggcgtaggggc

SEQ ID NO: 237935 - DNA, 20 bp, human
gcccgcagcgccgatgcgag

SEQ ID NO: 237936 - DNA, 20 bp, human
gccctgccgcctgtcaccca

SEQ ID NO: 237937 - DNA, 20 bp, human
gagccagggtagggctgata

SEQ ID NO: 237938 - DNA, 20 bp, human
ggccgccgaggagcaactca

SEQ ID NO: 237939 - DNA, 20 bp, human
gagttagggcggcacgatga

SEQ ID NO: 237940 - DNA, 20 bp, human
ggacatcttggaggctcggg

SEQ ID NO: 237941 - DNA, 20 bp, human
gctccaagatgtccacgccc

SEQ ID NO: 237942 - DNA, 20 bp, human
gtgtccacgccctgggtgac

SEQ ID NO: 237943 - DNA, 20 bp, human
gtaaggcgctgatgcgttga

SEQ ID NO: 237944 - DNA, 20 bp, human
gacccagggcgtggacatct

SEQ ID NO: 237945 - DNA, 20 bp, human
gtgctgctgtcgagcagagc

SEQ ID NO: 237946 - DNA, 20 bp, human
gtgactggggagtaagatgg

SEQ ID NO: 237947 - DNA, 20 bp, human
gaggaccagctgctcttctg

SEQ ID NO: 237948 - DNA, 20 bp, human
ggattgtgcgtccctctcca

SEQ ID NO: 237949 - DNA, 20 bp, human
gtgggggcgggaagggagtc

SEQ ID NO: 237950 - DNA, 20 bp, human
ggggaagggttattatcaac

SEQ ID NO: 237951 - DNA, 20 bp, human
ggctcttctgggggcgggaa

SEQ ID NO: 237952 - DNA, 20 bp, human
ggttgggcaaagcactaaga

SEQ ID NO: 237953 - DNA, 20 bp, human
gagagggcgtggctcgtgcc

SEQ ID NO: 237954 - DNA, 20 bp, human
gatgtcaggggaaaggaggt

SEQ ID NO: 237955 - DNA, 20 bp, human
gtcagtgatgtcagtctcag

SEQ ID NO: 237956 - DNA, 20 bp, human
gagatcagaccgagagagag

SEQ ID NO: 237957 - DNA, 20 bp, human
gagtgtgcgcgcgcggagga

SEQ ID NO: 237958 - DNA, 20 bp, human
gcgcgagcgagcgagagaag

SEQ ID NO: 237959 - DNA, 20 bp, human
gttcccagccagaccagggg

SEQ ID NO: 237960 - DNA, 20 bp, human
gtctggctgggaacttgaac

SEQ ID NO: 237961 - DNA, 20 bp, human
ggggaatgggcgcgctgtgg

SEQ ID NO: 237962 - DNA, 20 bp, human
ggccaccgcgcctcccccgt

SEQ ID NO: 237963 - DNA, 20 bp, human
gccggtccagcctgtttaaa

SEQ ID NO: 237964 - DNA, 20 bp, human
gcggccccgcgccgtggcga

SEQ ID NO: 237965 - DNA, 20 bp, human
gaggcgcatggctcttcggg

SEQ ID NO: 237966 - DNA, 20 bp, human
gcccggcatcgggaccacaa

SEQ ID NO: 237967 - DNA, 20 bp, human
gcacaaaggcggctccgcag

SEQ ID NO: 237968 - DNA, 20 bp, human
gggcatcgggaccacaaagg

SEQ ID NO: 237969 - DNA, 20 bp, human
gaggccccgggccccgccta

SEQ ID NO: 237970 - DNA, 20 bp, human
gcccgcctacgggtgggcga

SEQ ID NO: 237971 - DNA, 20 bp, human
gggcggactcgcagctggag

SEQ ID NO: 237972 - DNA, 20 bp, human
gacccctgggaagccggcta

SEQ ID NO: 237973 - DNA, 20 bp, human
gaggcgccggctgccccgcg

SEQ ID NO: 237974 - DNA, 20 bp, human
gccgggccccgcctacgggt

SEQ ID NO: 237975 - DNA, 20 bp, human
ggggcagcccgacggcatga

SEQ ID NO: 237976 - DNA, 20 bp, human
gcaactcccactctgattgg

SEQ ID NO: 237977 - DNA, 20 bp, human
gaatcagagtgggagttgac

SEQ ID NO: 237978 - DNA, 20 bp, human
gaagcagccgccaatcagag

SEQ ID NO: 237979 - DNA, 20 bp, human
gacacacacagggcattcga

SEQ ID NO: 237980 - DNA, 20 bp, human
gagttgactgggctcgccgg

SEQ ID NO: 237981 - DNA, 20 bp, human
gcacagggcattcgagggtc

SEQ ID NO: 237982 - DNA, 20 bp, human
gttcgagggtccggttgcca

SEQ ID NO: 237983 - DNA, 20 bp, human
gtggggattagccccgactc

SEQ ID NO: 237984 - DNA, 20 bp, human
ggatcgcgcgtgtgcgcctt

SEQ ID NO: 237985 - DNA, 20 bp, human
gctgacgtcaccaagcacgg

SEQ ID NO: 237986 - DNA, 20 bp, human
gggactggggccctactccc

SEQ ID NO: 237987 - DNA, 20 bp, human
gtcggccccgccccaccggg

SEQ ID NO: 237988 - DNA, 20 bp, human
ggggaggcctccggggagta

SEQ ID NO: 237989 - DNA, 20 bp, human
ggatcgctatggagacgcga

SEQ ID NO: 237990 - DNA, 20 bp, human
gcaacagggccgggaaaggt

SEQ ID NO: 237991 - DNA, 20 bp, human
gcgcgccgagaggatcgcta

SEQ ID NO: 237992 - DNA, 20 bp, human
gtcggcgcgcacctccgagc

SEQ ID NO: 237993 - DNA, 20 bp, human
gccccaccgggaggctgggt

SEQ ID NO: 237994 - DNA, 20 bp, human
ggtggccgctacccgtgggg

SEQ ID NO: 237995 - DNA, 20 bp, human
gccccggcagaacagatcca

SEQ ID NO: 237996 - DNA, 20 bp, human
gaggccggcctggggaaatt

SEQ ID NO: 237997 - DNA, 20 bp, human
gcatctggcgaggccggcct

SEQ ID NO: 237998 - DNA, 20 bp, human
gtgggaggggacagcaacga

SEQ ID NO: 237999 - DNA, 20 bp, human
gctggggaaattgggatgga

SEQ ID NO: 238000 - DNA, 20 bp, human
gcgccaggattccctccagc

SEQ ID NO: 238001 - DNA, 20 bp, human
ggtaccctaagtatgcctag

SEQ ID NO: 238002 - DNA, 20 bp, human
gtcgcaccgggcatctggcg

SEQ ID NO: 238003 - DNA, 20 bp, human
gcccggtgcgaattagcgat

SEQ ID NO: 238004 - DNA, 20 bp, human
ggggacggtagggagcgagt

SEQ ID NO: 238005 - DNA, 20 bp, human
gcgcggcgcgagcaggtcta

SEQ ID NO: 238006 - DNA, 20 bp, human
gccctctcgtagctgacacc

SEQ ID NO: 238007 - DNA, 20 bp, human
gcaggggtggggacatatag

SEQ ID NO: 238008 - DNA, 20 bp, human
gctggcgcgtgcggaacatg

SEQ ID NO: 238009 - DNA, 20 bp, human
ggcctgcagcaggacaccgt

SEQ ID NO: 238010 - DNA, 20 bp, human
gcggctggacagaagtggct

SEQ ID NO: 238011 - DNA, 20 bp, human
gtagaggccgctggatccgt

SEQ ID NO: 238012 - DNA, 20 bp, human
gcccagctgaggccatagag

SEQ ID NO: 238013 - DNA, 20 bp, human
ggggtttgatggtccagaaa

SEQ ID NO: 238014 - DNA, 20 bp, human
gaccttcccaacggatccag

SEQ ID NO: 238015 - DNA, 20 bp, human
gcaggtgatgcatggaaggg

SEQ ID NO: 238016 - DNA, 20 bp, human
ggggagggcggacccaacga

SEQ ID NO: 238017 - DNA, 20 bp, human
gggacagcgccctagaagga

SEQ ID NO: 238018 - DNA, 20 bp, human
gcggcgaccgaaagtgggga

SEQ ID NO: 238019 - DNA, 20 bp, human
gaagatggcggcaacatctt

SEQ ID NO: 238020 - DNA, 20 bp, human
gaaggcggcgaccgaaagtg

SEQ ID NO: 238021 - DNA, 20 bp, human
gggtgctgaacagagcgcga

SEQ ID NO: 238022 - DNA, 20 bp, human
gaggacgtgagcgttgctcc

SEQ ID NO: 238023 - DNA, 20 bp, human
gggacacggttcagaactag

SEQ ID NO: 238024 - DNA, 20 bp, human
ggggtgcagcctccagtgaa

SEQ ID NO: 238025 - DNA, 20 bp, human
gcgttctcatagctctggga

SEQ ID NO: 238026 - DNA, 20 bp, human
gtagcgcaggcgctgagtcc

SEQ ID NO: 238027 - DNA, 20 bp, human
gccgcccagcctcgtagcgc

SEQ ID NO: 238028 - DNA, 20 bp, human
ggggccttgcctactgtggg

SEQ ID NO: 238029 - DNA, 20 bp, human
ggcggcgcgtgccttccctg

SEQ ID NO: 238030 - DNA, 20 bp, human
gcgcaactctgggagcgttg

SEQ ID NO: 238031 - DNA, 20 bp, human
gcaggctgacgcgcaactct

SEQ ID NO: 238032 - DNA, 20 bp, human
ggcggggccttgcctactgt

SEQ ID NO: 238033 - DNA, 20 bp, human
gaggacgctctcgaccgatc

SEQ ID NO: 238034 - DNA, 20 bp, human
gacgccccaaacgcagtctc

SEQ ID NO: 238035 - DNA, 20 bp, human
gtccctgcggcgatcctaat

SEQ ID NO: 238036 - DNA, 20 bp, human
gccgccccgccgggaaccgt

SEQ ID NO: 238037 - DNA, 20 bp, human
gccagctccgccttagatcc

SEQ ID NO: 238038 - DNA, 20 bp, human
ggggtccgagagagcaactg

SEQ ID NO: 238039 - DNA, 20 bp, human
gtctacccctggatctaagg

SEQ ID NO: 238040 - DNA, 20 bp, human
ggatccaggggtagaaactt

SEQ ID NO: 238041 - DNA, 20 bp, human
ggcctctggcagtcccagat

SEQ ID NO: 238042 - DNA, 20 bp, human
gcctagccctgcagtctgaa

SEQ ID NO: 238043 - DNA, 20 bp, human
gaggggcaccctggcctaga

SEQ ID NO: 238044 - DNA, 20 bp, human
gtctgaagggagccagttat

SEQ ID NO: 238045 - DNA, 20 bp, human
ggatcccacggttcccggcg

SEQ ID NO: 238046 - DNA, 20 bp, human
gcgtgaaagagaagtgtcag

SEQ ID NO: 238047 - DNA, 20 bp, human
ggtccatgaccactcctcaa

SEQ ID NO: 238048 - DNA, 20 bp, human
gggggctccgatcacctcct

SEQ ID NO: 238049 - DNA, 20 bp, human
ggccccttgaggagtggtca

SEQ ID NO: 238050 - DNA, 20 bp, human
gagtgtcagaggcccacggg

SEQ ID NO: 238051 - DNA, 20 bp, human
gaggtgatcggagccccagt

SEQ ID NO: 238052 - DNA, 20 bp, human
gccacgggaggcccctgagc

SEQ ID NO: 238053 - DNA, 20 bp, human
gtggcccttgcctctgcggc

SEQ ID NO: 238054 - DNA, 20 bp, human
gtggtggggaagtaaggatc

SEQ ID NO: 238055 - DNA, 20 bp, human
gggctcttggtggggaagta

SEQ ID NO: 238056 - DNA, 20 bp, human
gaaagcgctccaggacgact

SEQ ID NO: 238057 - DNA, 20 bp, human
gtcgtcctggagcgctttgg

SEQ ID NO: 238058 - DNA, 20 bp, human
ggctcaggcgcgctccccgg

SEQ ID NO: 238059 - DNA, 20 bp, human
ggcgctctgccgagtcgtcc

SEQ ID NO: 238060 - DNA, 20 bp, human
ggtggccaccaaagcgctcc

SEQ ID NO: 238061 - DNA, 20 bp, human
gcgctcgcgcaggagacccc

SEQ ID NO: 238062 - DNA, 20 bp, human
ggcgccgggccccgtcaccc

SEQ ID NO: 238063 - DNA, 20 bp, human
gcctgggccgtgatttgcca

SEQ ID NO: 238064 - DNA, 20 bp, human
gggtggccacgccgtggccc

SEQ ID NO: 238065 - DNA, 20 bp, human
ggtggctcaggcgcgctccc

SEQ ID NO: 238066 - DNA, 20 bp, human
gcaccgagacacaaatatag

SEQ ID NO: 238067 - DNA, 20 bp, human
gcgtagagcgactgcaggta

SEQ ID NO: 238068 - DNA, 20 bp, human
gcgaatccagcgactcccag

SEQ ID NO: 238069 - DNA, 20 bp, human
gcaaatatagcggcgatgat

SEQ ID NO: 238070 - DNA, 20 bp, human
ggcggcgatgataggaggac

SEQ ID NO: 238071 - DNA, 20 bp, human
ggcacctgaggacgtcagta

SEQ ID NO: 238072 - DNA, 20 bp, human
gcaaagaccagcaaccagat

SEQ ID NO: 238073 - DNA, 20 bp, human
gcaaccagattggcaagcag

SEQ ID NO: 238074 - DNA, 20 bp, human
gtctcggtgcatactctcat

SEQ ID NO: 238075 - DNA, 20 bp, human
gatatagcggcgatgatagg

SEQ ID NO: 238076 - DNA, 20 bp, human
gcccccgcggtatgtcccgg

SEQ ID NO: 238077 - DNA, 20 bp, human
gtcgccggaggccgcagcac

SEQ ID NO: 238078 - DNA, 20 bp, human
ggggcggagcgggatctcgc

SEQ ID NO: 238079 - DNA, 20 bp, human
ggcccccccgcggtatgtcc

SEQ ID NO: 238080 - DNA, 20 bp, human
gccgccgccgggacataccg

SEQ ID NO: 238081 - DNA, 20 bp, human
gcggaaggcaggaagtgccg

SEQ ID NO: 238082 - DNA, 20 bp, human
gcgggccgggggcacctccg

SEQ ID NO: 238083 - DNA, 20 bp, human
ggctgcggcctccggcgacc

SEQ ID NO: 238084 - DNA, 20 bp, human
ggagctgggagcgcggcgag

SEQ ID NO: 238085 - DNA, 20 bp, human
gtccccgcccgcgtcgctgc

SEQ ID NO: 238086 - DNA, 20 bp, human
ggggtctggggatgtggtac

SEQ ID NO: 238087 - DNA, 20 bp, human
gccggctggggccccgtctt

SEQ ID NO: 238088 - DNA, 20 bp, human
gcagaccagccgcccggcac

SEQ ID NO: 238089 - DNA, 20 bp, human
ggcggccggcagtagagcgg

SEQ ID NO: 238090 - DNA, 20 bp, human
gtcccctcggacatcggaac

SEQ ID NO: 238091 - DNA, 20 bp, human
ggcggcgcgggatctgggtc

SEQ ID NO: 238092 - DNA, 20 bp, human
gcgcatgcgcaatgggagag

SEQ ID NO: 238093 - DNA, 20 bp, human
ggcggcggccggcagtagag

SEQ ID NO: 238094 - DNA, 20 bp, human
gtcactgcgcggaccaggtc

SEQ ID NO: 238095 - DNA, 20 bp, human
gcaatgggagagcggtccta

SEQ ID NO: 238096 - DNA, 20 bp, human
ggaaggggcgagcccactaa

SEQ ID NO: 238097 - DNA, 20 bp, human
gcgttggcctggagcatgaa

SEQ ID NO: 238098 - DNA, 20 bp, human
gcgggcgcggcgctgaggaa

SEQ ID NO: 238099 - DNA, 20 bp, human
gggtgggtctgcaggctgga

SEQ ID NO: 238100 - DNA, 20 bp, human
gctgcaggctggagggccgt

SEQ ID NO: 238101 - DNA, 20 bp, human
gagagcggctagaggtaggg

SEQ ID NO: 238102 - DNA, 20 bp, human
gagcagagcggctagaggta

SEQ ID NO: 238103 - DNA, 20 bp, human
gtgtctccgggttcaaaccc

SEQ ID NO: 238104 - DNA, 20 bp, human
gtaggaagcaagccgttagt

SEQ ID NO: 238105 - DNA, 20 bp, human
gaacaacactcccccgccat

SEQ ID NO: 238106 - DNA, 20 bp, human
gaggagagggccgaagggag

SEQ ID NO: 238107 - DNA, 20 bp, human
ggggcccagcagagagtcgg

SEQ ID NO: 238108 - DNA, 20 bp, human
ggagcagcgcgggggacgca

SEQ ID NO: 238109 - DNA, 20 bp, human
gaccactgctaaacaggaga

SEQ ID NO: 238110 - DNA, 20 bp, human
gtccacgtgcggagcagcgc

SEQ ID NO: 238111 - DNA, 20 bp, human
gggcgtgaccactgctaaac

SEQ ID NO: 238112 - DNA, 20 bp, human
gcagcgcgggggacgcaagg

SEQ ID NO: 238113 - DNA, 20 bp, human
ggccgcatctgattgagccg

SEQ ID NO: 238114 - DNA, 20 bp, human
gacaggagaggggatttaaa

SEQ ID NO: 238115 - DNA, 20 bp, human
gccccgcgctgctccgcacg

SEQ ID NO: 238116 - DNA, 20 bp, human
gcgcaggcacctccagtaga

SEQ ID NO: 238117 - DNA, 20 bp, human
gctaatgctagacgcggttt

SEQ ID NO: 238118 - DNA, 20 bp, human
gcgaaagggccaatcagacg

SEQ ID NO: 238119 - DNA, 20 bp, human
ggcgaattgggcaccggtgg

SEQ ID NO: 238120 - DNA, 20 bp, human
gtgagtgcgcaggcgcggat

SEQ ID NO: 238121 - DNA, 20 bp, human
ggctacttagagtgaccaat

SEQ ID NO: 238122 - DNA, 20 bp, human
gaaaacaagccctctactgg

SEQ ID NO: 238123 - DNA, 20 bp, human
gtctgattggccctttcgga

SEQ ID NO: 238124 - DNA, 20 bp, human
gcgcggcagtctgagtgcgc

SEQ ID NO: 238125 - DNA, 20 bp, human
gggtacgtgcagtttaaaag

SEQ ID NO: 238126 - DNA, 20 bp, human
gcgggcacacccatcttcaa

SEQ ID NO: 238127 - DNA, 20 bp, human
gcggttgccgtggttactac

SEQ ID NO: 238128 - DNA, 20 bp, human
gcagacggctggtaaaaagt

SEQ ID NO: 238129 - DNA, 20 bp, human
gaaacaaggcggaaagggtg

SEQ ID NO: 238130 - DNA, 20 bp, human
ggaggagcccgtagtaacca

SEQ ID NO: 238131 - DNA, 20 bp, human
gaatagctttcgttaagcgt

SEQ ID NO: 238132 - DNA, 20 bp, human
gctcccgtgtccaagcgcca

SEQ ID NO: 238133 - DNA, 20 bp, human
gagtagagcccggatgaaag

SEQ ID NO: 238134 - DNA, 20 bp, human
ggtggggccctgggcggaag

SEQ ID NO: 238135 - DNA, 20 bp, human
ggacgccgggaaaaggcccg

SEQ ID NO: 238136 - DNA, 20 bp, human
gcctgattggctagaggtgg

SEQ ID NO: 238137 - DNA, 20 bp, human
ggtggcgcgcgcgacgacgc

SEQ ID NO: 238138 - DNA, 20 bp, human
ggcaagccgctctccgtaat

SEQ ID NO: 238139 - DNA, 20 bp, human
gtagaaccaattacggagag

SEQ ID NO: 238140 - DNA, 20 bp, human
gctcacaggcccaggtgggt

SEQ ID NO: 238141 - DNA, 20 bp, human
gcactcagctgaagcctgat

SEQ ID NO: 238142 - DNA, 20 bp, human
gtggcgggaggctcggtggc

SEQ ID NO: 238143 - DNA, 20 bp, human
ggcggcttgccccacccacc

SEQ ID NO: 238144 - DNA, 20 bp, human
gcagacccagaggggcggct

SEQ ID NO: 238145 - DNA, 20 bp, human
gtgtgaggagagcagcgagt

SEQ ID NO: 238146 - DNA, 20 bp, human
gcccgtcgctgtggcgtcac

SEQ ID NO: 238147 - DNA, 20 bp, human
ggggcgacgtccaccacgga

SEQ ID NO: 238148 - DNA, 20 bp, human
gcgggcaacgcccgtcgctg

SEQ ID NO: 238149 - DNA, 20 bp, human
gggccagtggtcgacgtagg

SEQ ID NO: 238150 - DNA, 20 bp, human
gtggcccgctgctggtcgga

SEQ ID NO: 238151 - DNA, 20 bp, human
gcccagtgacgccacagcga

SEQ ID NO: 238152 - DNA, 20 bp, human
gccccgtcccgaggtcctgt

SEQ ID NO: 238153 - DNA, 20 bp, human
ggacgggcgttgcccggcgg

SEQ ID NO: 238154 - DNA, 20 bp, human
gcctggggcgacgtccacca

SEQ ID NO: 238155 - DNA, 20 bp, human
gtcgaccactggcccgctgc

SEQ ID NO: 238156 - DNA, 20 bp, human
gcagcgcgcgcagaagtccg

SEQ ID NO: 238157 - DNA, 20 bp, human
gtccgagcgagtttcgggat

SEQ ID NO: 238158 - DNA, 20 bp, human
ggatgcgaacaacatggcgg

SEQ ID NO: 238159 - DNA, 20 bp, human
ggggaatgagcacatccaat

SEQ ID NO: 238160 - DNA, 20 bp, human
gtgcgccgctgctttgggat

SEQ ID NO: 238161 - DNA, 20 bp, human
gaagactgcgccgctgcttt

SEQ ID NO: 238162 - DNA, 20 bp, human
gcgagtttcgggattggctg

SEQ ID NO: 238163 - DNA, 20 bp, human
gcgccgggacccggaggaac

SEQ ID NO: 238164 - DNA, 20 bp, human
ggtgtcccaggagaacgatg

SEQ ID NO: 238165 - DNA, 20 bp, human
gtctgacgatgcgaacaaca

SEQ ID NO: 238166 - DNA, 20 bp, human
ggtctctggggtgcttgctg

SEQ ID NO: 238167 - DNA, 20 bp, human
ggacaaatctccaaggtctc

SEQ ID NO: 238168 - DNA, 20 bp, human
gaatcggcgaggcgccaagg

SEQ ID NO: 238169 - DNA, 20 bp, human
gacaaccagaggcggtcaca

SEQ ID NO: 238170 - DNA, 20 bp, human
gtctcgagaagcgtggaaag

SEQ ID NO: 238171 - DNA, 20 bp, human
gagagagcgactccacgtag

SEQ ID NO: 238172 - DNA, 20 bp, human
gggaccacccaaccgatctg

SEQ ID NO: 238173 - DNA, 20 bp, human
gcaaccgagcacgattggaa

SEQ ID NO: 238174 - DNA, 20 bp, human
ggttgggtggtccttctgat

SEQ ID NO: 238175 - DNA, 20 bp, human
ggaccgcctctggttgtctt

SEQ ID NO: 238176 - DNA, 20 bp, human
gacgggacggggcctcttaa

SEQ ID NO: 238177 - DNA, 20 bp, human
ggcccccaggccgcgctcta

SEQ ID NO: 238178 - DNA, 20 bp, human
gctgtggagcgtggaaccaa

SEQ ID NO: 238179 - DNA, 20 bp, human
gctacccgtggaacacgtgg

SEQ ID NO: 238180 - DNA, 20 bp, human
gctaggggctggactcaggg

SEQ ID NO: 238181 - DNA, 20 bp, human
ggctctaggggctggactca

SEQ ID NO: 238182 - DNA, 20 bp, human
gtgtccaccacgtgttccac

SEQ ID NO: 238183 - DNA, 20 bp, human
gcttataggcggggcttcgc

SEQ ID NO: 238184 - DNA, 20 bp, human
gggggcacgtgcctccttat

SEQ ID NO: 238185 - DNA, 20 bp, human
gagaaaaggagataaaggtt

SEQ ID NO: 238186 - DNA, 20 bp, human
gctaagaagagcggcgtggg

SEQ ID NO: 238187 - DNA, 20 bp, human
gtgcctccccccacgacgga

SEQ ID NO: 238188 - DNA, 20 bp, human
gcccccacgacggacggaaa

SEQ ID NO: 238189 - DNA, 20 bp, human
gccaccggagcacaagcatc

SEQ ID NO: 238190 - DNA, 20 bp, human
gcggcgggaactgcaattgg

SEQ ID NO: 238191 - DNA, 20 bp, human
ggggggagcgactgaagcga

SEQ ID NO: 238192 - DNA, 20 bp, human
gactgtgcctccccccacga

SEQ ID NO: 238193 - DNA, 20 bp, human
gtgcgccgcctgtcctggag

SEQ ID NO: 238194 - DNA, 20 bp, human
gcgcccgccactcactcaac

SEQ ID NO: 238195 - DNA, 20 bp, human
ggaggcacagtgagtccact

SEQ ID NO: 238196 - DNA, 20 bp, human
gggaggtgctgagacatcga

SEQ ID NO: 238197 - DNA, 20 bp, human
gtgagtgtgcaaggccgcgg

SEQ ID NO: 238198 - DNA, 20 bp, human
gcgcccgccggccaggagaa

SEQ ID NO: 238199 - DNA, 20 bp, human
gaaaggccggacctactccc

SEQ ID NO: 238200 - DNA, 20 bp, human
gctactccccggtgcatctt

SEQ ID NO: 238201 - DNA, 20 bp, human
gagtgggtgcggcgggagtt

SEQ ID NO: 238202 - DNA, 20 bp, human
gaggtgaggcactcgggcgg

SEQ ID NO: 238203 - DNA, 20 bp, human
gtgaggcactcgggcggagg

SEQ ID NO: 238204 - DNA, 20 bp, human
gtcgaggtgaggcactcggg

SEQ ID NO: 238205 - DNA, 20 bp, human
gtgggctcgcggtaaagtgg

SEQ ID NO: 238206 - DNA, 20 bp, human
gacagccagggaaacgtgtg

SEQ ID NO: 238207 - DNA, 20 bp, human
gagggctgggatcacgtgga

SEQ ID NO: 238208 - DNA, 20 bp, human
gggtgagcagcggagcgctt

SEQ ID NO: 238209 - DNA, 20 bp, human
gaggcagggctgggatcacg

SEQ ID NO: 238210 - DNA, 20 bp, human
ggctccaaggctgccggcta

SEQ ID NO: 238211 - DNA, 20 bp, human
ggcggggaagtggaggactc

SEQ ID NO: 238212 - DNA, 20 bp, human
ggccgcgtgcctcactaaag

SEQ ID NO: 238213 - DNA, 20 bp, human
gtcccctccgcgtgagctct

SEQ ID NO: 238214 - DNA, 20 bp, human
gacgcggccgggcggctcca

SEQ ID NO: 238215 - DNA, 20 bp, human
gaacgtgtgcggggaagtgg

SEQ ID NO: 238216 - DNA, 20 bp, human
ggcggtggcgcggtttgtgt

SEQ ID NO: 238217 - DNA, 20 bp, human
gcatgagagcgctattagat

SEQ ID NO: 238218 - DNA, 20 bp, human
gctacgcccccagagtcgtc

SEQ ID NO: 238219 - DNA, 20 bp, human
ggctggagggagggcggtgt

SEQ ID NO: 238220 - DNA, 20 bp, human
gagcgtcagccggacgactc

SEQ ID NO: 238221 - DNA, 20 bp, human
gaggagacccggaagtgggt

SEQ ID NO: 238222 - DNA, 20 bp, human
gagagcgctattagattggc

SEQ ID NO: 238223 - DNA, 20 bp, human
ggtcagccggacgactctgg

SEQ ID NO: 238224 - DNA, 20 bp, human
gcctgatgacgtttaggggt

SEQ ID NO: 238225 - DNA, 20 bp, human
ggtcgtccggctgacgctgg

SEQ ID NO: 238226 - DNA, 20 bp, human
gctcgcggggtggacagtga

SEQ ID NO: 238227 - DNA, 20 bp, human
gaggctgcctccaaagcatc

SEQ ID NO: 238228 - DNA, 20 bp, human
gcgcactatcgcagctcgcg

SEQ ID NO: 238229 - DNA, 20 bp, human
ggcgagagttacattaactg

SEQ ID NO: 238230 - DNA, 20 bp, human
gactatcgcagctcgcgggg

SEQ ID NO: 238231 - DNA, 20 bp, human
gcgagaactacaattcccgt

SEQ ID NO: 238232 - DNA, 20 bp, human
gcctcgctgcgggtaaacct

SEQ ID NO: 238233 - DNA, 20 bp, human
ggctggctgggcggttagga

SEQ ID NO: 238234 - DNA, 20 bp, human
gacacgataagccagggcac

SEQ ID NO: 238235 - DNA, 20 bp, human
ggcttgcattacattaaccg

SEQ ID NO: 238236 - DNA, 20 bp, human
gcctgcgggactgaacaggc

SEQ ID NO: 238237 - DNA, 20 bp, human
gtctgcctgcgggactgaac

SEQ ID NO: 238238 - DNA, 20 bp, human
gaggcagaggggctgcgcct

SEQ ID NO: 238239 - DNA, 20 bp, human
ggggcctgaagactggcggg

SEQ ID NO: 238240 - DNA, 20 bp, human
ggccccctgggcctgaagac

SEQ ID NO: 238241 - DNA, 20 bp, human
gcaggtgcgtcccagcggcc

SEQ ID NO: 238242 - DNA, 20 bp, human
ggggttgggcctgaattcgc

SEQ ID NO: 238243 - DNA, 20 bp, human
gaatccactcgcacctgcga

SEQ ID NO: 238244 - DNA, 20 bp, human
gccgccgcccgccagtcttc

SEQ ID NO: 238245 - DNA, 20 bp, human
gacaggcaggtgcgtcccag

SEQ ID NO: 238246 - DNA, 20 bp, human
gcccggagacgcctgcctgt

SEQ ID NO: 238247 - DNA, 20 bp, human
gtgtaggtggaaaacgccca

SEQ ID NO: 238248 - DNA, 20 bp, human
gaggtggaaaacgcccacgg

SEQ ID NO: 238249 - DNA, 20 bp, human
gggagacgcctgcctgtagg

SEQ ID NO: 238250 - DNA, 20 bp, human
gaatgacgtcaggtattccc

SEQ ID NO: 238251 - DNA, 20 bp, human
ggggcgcgttccgttggcgg

SEQ ID NO: 238252 - DNA, 20 bp, human
ggaaaacgcccacggtgggc

SEQ ID NO: 238253 - DNA, 20 bp, human
ggcaggctctcaatgacgtc

SEQ ID NO: 238254 - DNA, 20 bp, human
ggccgggcgcgttccgttgg

SEQ ID NO: 238255 - DNA, 20 bp, human
gagtgatgaaaggaggacgc

SEQ ID NO: 238256 - DNA, 20 bp, human
gcctgcgcacaagaccgcgt

SEQ ID NO: 238257 - DNA, 20 bp, human
gtaaggtaatgtggtgtccg

SEQ ID NO: 238258 - DNA, 20 bp, human
gcgcgcctgcgcacaagggg

SEQ ID NO: 238259 - DNA, 20 bp, human
gctggtgtgcccaggtgccg

SEQ ID NO: 238260 - DNA, 20 bp, human
gtccgctactctggccctca

SEQ ID NO: 238261 - DNA, 20 bp, human
gaccctgagggccagagtag

SEQ ID NO: 238262 - DNA, 20 bp, human
gccttctgagtaaggtaatg

SEQ ID NO: 238263 - DNA, 20 bp, human
ggtgcgcaggcgtcgcccca

SEQ ID NO: 238264 - DNA, 20 bp, human
gggaaaagtgaggcccgacg

SEQ ID NO: 238265 - DNA, 20 bp, human
gaggccgcgcctgcgcacaa

SEQ ID NO: 238266 - DNA, 20 bp, human
gaccaccggcgccccaggct

SEQ ID NO: 238267 - DNA, 20 bp, human
ggccgccgggaacgtcgcca

SEQ ID NO: 238268 - DNA, 20 bp, human
gcaaccgcaccgcaggctag

SEQ ID NO: 238269 - DNA, 20 bp, human
ggggtggagaaatgcccgcg

SEQ ID NO: 238270 - DNA, 20 bp, human
gtatcccggaagcttcgact

SEQ ID NO: 238271 - DNA, 20 bp, human
ggaagtctccgcccccagcc

SEQ ID NO: 238272 - DNA, 20 bp, human
gagctggggtgcgagtctgg

SEQ ID NO: 238273 - DNA, 20 bp, human
gccaaggggcccacaagctg

SEQ ID NO: 238274 - DNA, 20 bp, human
gacaagctggggtgcgagtc

SEQ ID NO: 238275 - DNA, 20 bp, human
gacccctctagcctgcggtg

SEQ ID NO: 238276 - DNA, 20 bp, human
gtcgcccgcctctcctcgtc

SEQ ID NO: 238277 - DNA, 20 bp, human
gaatgaaggcgtcctcctta

SEQ ID NO: 238278 - DNA, 20 bp, human
ggggcgctgtgaggtaatga

SEQ ID NO: 238279 - DNA, 20 bp, human
gtcctcgtccggctagcaga

SEQ ID NO: 238280 - DNA, 20 bp, human
ggaacagagcgtaaaagggc

SEQ ID NO: 238281 - DNA, 20 bp, human
ggaggcgggcgacttggtgt

SEQ ID NO: 238282 - DNA, 20 bp, human
gtagccggacgaggagaggc

SEQ ID NO: 238283 - DNA, 20 bp, human
ggggaggcgaagctcgctga

SEQ ID NO: 238284 - DNA, 20 bp, human
gctgttccagagccctaagg

SEQ ID NO: 238285 - DNA, 20 bp, human
gctctggaacagagcgtaaa

SEQ ID NO: 238286 - DNA, 20 bp, human
gtacccgaaggccagctata

SEQ ID NO: 238287 - DNA, 20 bp, human
gatccgggaaagttacccga

SEQ ID NO: 238288 - DNA, 20 bp, human
ggggtcctgtactcttgctg

SEQ ID NO: 238289 - DNA, 20 bp, human
gaaaaggaactgcaaatccc

SEQ ID NO: 238290 - DNA, 20 bp, human
gaagggagagagtcccgaaa

SEQ ID NO: 238291 - DNA, 20 bp, human
gggccttcgggtaactttcc

SEQ ID NO: 238292 - DNA, 20 bp, human
ggaccagcctcctttgtagg

SEQ ID NO: 238293 - DNA, 20 bp, human
gggcaagagggcgcggccaa

SEQ ID NO: 238294 - DNA, 20 bp, human
gcatgatcaaggaattacca

SEQ ID NO: 238295 - DNA, 20 bp, human
gcatctcggcctcatgatca

SEQ ID NO: 238296 - DNA, 20 bp, human
ggggacgcgcttggcgacga

SEQ ID NO: 238297 - DNA, 20 bp, human
ggggagcggcggacgattag

SEQ ID NO: 238298 - DNA, 20 bp, human
gcacacctcccgccgacagg

SEQ ID NO: 238299 - DNA, 20 bp, human
gtcccgccgacaggaggaag

SEQ ID NO: 238300 - DNA, 20 bp, human
gcaacggcccggacagcgcg

SEQ ID NO: 238301 - DNA, 20 bp, human
gaggaagaggatgccagctc

SEQ ID NO: 238302 - DNA, 20 bp, human
ggttgccccggtaacgggag

SEQ ID NO: 238303 - DNA, 20 bp, human
ggcgggcgccgacctccagg

SEQ ID NO: 238304 - DNA, 20 bp, human
gacgatcggggccgacacgg

SEQ ID NO: 238305 - DNA, 20 bp, human
gcacggcgccccctggaggt

SEQ ID NO: 238306 - DNA, 20 bp, human
gggctctcgaatccaccaat

SEQ ID NO: 238307 - DNA, 20 bp, human
ggcaccctggccgaaggtag

SEQ ID NO: 238308 - DNA, 20 bp, human
gtctcaaccaagcttgagga

SEQ ID NO: 238309 - DNA, 20 bp, human
ggatcagcccgcccactccg

SEQ ID NO: 238310 - DNA, 20 bp, human
gcaaccaagcttgaggaagg

SEQ ID NO: 238311 - DNA, 20 bp, human
ggcggagccgtgccagctca

SEQ ID NO: 238312 - DNA, 20 bp, human
gcaccgggcgagcttctagt

SEQ ID NO: 238313 - DNA, 20 bp, human
gccaccaatgggcgcacagg

SEQ ID NO: 238314 - DNA, 20 bp, human
gggcctccgccccgtgagtt

SEQ ID NO: 238315 - DNA, 20 bp, human
ggggagcttcccgccacctc

SEQ ID NO: 238316 - DNA, 20 bp, human
ggagagctgtgacaatggat

SEQ ID NO: 238317 - DNA, 20 bp, human
ggcaggagccaataggtcgc

SEQ ID NO: 238318 - DNA, 20 bp, human
gctctcagccggcgacctat

SEQ ID NO: 238319 - DNA, 20 bp, human
gggttgaaagagaacctcat

SEQ ID NO: 238320 - DNA, 20 bp, human
gcgcccggagccttccgggg

SEQ ID NO: 238321 - DNA, 20 bp, human
gaagggagcgagcgtggcgg

SEQ ID NO: 238322 - DNA, 20 bp, human
ggggactcccggttgctagg

SEQ ID NO: 238323 - DNA, 20 bp, human
gtagttgaggacctcatcga

SEQ ID NO: 238324 - DNA, 20 bp, human
gtgggtgttgggtggcgttg

SEQ ID NO: 238325 - DNA, 20 bp, human
ggattggctcgaagtccctt

SEQ ID NO: 238326 - DNA, 20 bp, human
gctgcgcagtaagggatcgt

SEQ ID NO: 238327 - DNA, 20 bp, human
ggcgcaggcgcctcgggaaa

SEQ ID NO: 238328 - DNA, 20 bp, human
ggtaagggatcgttggaact

SEQ ID NO: 238329 - DNA, 20 bp, human
gggcaagctggaaaagcgtg

SEQ ID NO: 238330 - DNA, 20 bp, human
gtgtggcgcctgcgcagtaa

SEQ ID NO: 238331 - DNA, 20 bp, human
gatgaaaaggggttgtgcga

SEQ ID NO: 238332 - DNA, 20 bp, human
gaactgggcaggaggggata

SEQ ID NO: 238333 - DNA, 20 bp, human
ggccccacacatagcggtaa

SEQ ID NO: 238334 - DNA, 20 bp, human
gccgctgcggtcgagctccg

SEQ ID NO: 238335 - DNA, 20 bp, human
ggggatcgttggaactgggc

SEQ ID NO: 238336 - DNA, 20 bp, human
gcccgccggaaaccaggtta

SEQ ID NO: 238337 - DNA, 20 bp, human
gaccacgcgcggggctaccg

SEQ ID NO: 238338 - DNA, 20 bp, human
ggggcgctgccgagacggga

SEQ ID NO: 238339 - DNA, 20 bp, human
gccgggtgcgagatgagccg

SEQ ID NO: 238340 - DNA, 20 bp, human
gcgcgggtccctgacgtctg

SEQ ID NO: 238341 - DNA, 20 bp, human
gccgcggacccgccctaacc

SEQ ID NO: 238342 - DNA, 20 bp, human
gggtccctgacgtctgcggg

SEQ ID NO: 238343 - DNA, 20 bp, human
gcgggctcacctggcggccg

SEQ ID NO: 238344 - DNA, 20 bp, human
ggagcctcccgcagacgtca

SEQ ID NO: 238345 - DNA, 20 bp, human
gcccccggaacgccccgccc

SEQ ID NO: 238346 - DNA, 20 bp, human
ggccgcgcgggaacccttgg

SEQ ID NO: 238347 - DNA, 20 bp, human
ggcccccaagggttcccgcg

SEQ ID NO: 238348 - DNA, 20 bp, human
gcgcgctgccccagatttat

SEQ ID NO: 238349 - DNA, 20 bp, human
ggtcccagccgataaatctg

SEQ ID NO: 238350 - DNA, 20 bp, human
gtgcaggcagctgggaaccg

SEQ ID NO: 238351 - DNA, 20 bp, human
gcgggaacccttgggggccg

SEQ ID NO: 238352 - DNA, 20 bp, human
gtgcgcgcgcctagcgcccg

SEQ ID NO: 238353 - DNA, 20 bp, human
gggcggagcaaggaacagct

SEQ ID NO: 238354 - DNA, 20 bp, human
gaagggttcccgcgcggcgt

SEQ ID NO: 238355 - DNA, 20 bp, human
gcgcgcccggcctgtcgctg

SEQ ID NO: 238356 - DNA, 20 bp, human
gcgggaagaagcccggtgat

SEQ ID NO: 238357 - DNA, 20 bp, human
gtggacagcgggaagacatg

SEQ ID NO: 238358 - DNA, 20 bp, human
ggccgcgcgccctgcgagtc

SEQ ID NO: 238359 - DNA, 20 bp, human
ggcgcgccctgcgagtccgg

SEQ ID NO: 238360 - DNA, 20 bp, human
gcgccctgcgagtccggagg

SEQ ID NO: 238361 - DNA, 20 bp, human
gcagcgggaagacatggggc

SEQ ID NO: 238362 - DNA, 20 bp, human
gctggcttttgattggacag

SEQ ID NO: 238363 - DNA, 20 bp, human
gccaacgggagccgtccccc

SEQ ID NO: 238364 - DNA, 20 bp, human
ggcgaacagacgtaaaccag

SEQ ID NO: 238365 - DNA, 20 bp, human
ggttcgcggcaccaggcaag

SEQ ID NO: 238366 - DNA, 20 bp, human
gaggggcgggcccctcccaa

SEQ ID NO: 238367 - DNA, 20 bp, human
gcagggcctcccgccatgtt

SEQ ID NO: 238368 - DNA, 20 bp, human
gggagccgagcgtggtgagg

SEQ ID NO: 238369 - DNA, 20 bp, human
gggcagccgacttactagag

SEQ ID NO: 238370 - DNA, 20 bp, human
gccaaagggcgggagtttgg

SEQ ID NO: 238371 - DNA, 20 bp, human
gcgcaggcgcacctagaacc

SEQ ID NO: 238372 - DNA, 20 bp, human
gggcctggccctctgcctcg

SEQ ID NO: 238373 - DNA, 20 bp, human
gctccaagtcctgcacctat

SEQ ID NO: 238374 - DNA, 20 bp, human
gcagggcctctctagtaagt

SEQ ID NO: 238375 - DNA, 20 bp, human
ggccggctcagtctgcctat

SEQ ID NO: 238376 - DNA, 20 bp, human
gtcaggcagaactgcactct

SEQ ID NO: 238377 - DNA, 20 bp, human
gacccacggtcgtgaactgt

SEQ ID NO: 238378 - DNA, 20 bp, human
ggactgcgacggtaccgggg

SEQ ID NO: 238379 - DNA, 20 bp, human
gacaccgagctctgggactc

SEQ ID NO: 238380 - DNA, 20 bp, human
gcccagcatgcagaagcctc

SEQ ID NO: 238381 - DNA, 20 bp, human
ggcggggaaggaccgagagg

SEQ ID NO: 238382 - DNA, 20 bp, human
gccgagctctgggactccgg

SEQ ID NO: 238383 - DNA, 20 bp, human
ggatgagaaggcgtggaacg

SEQ ID NO: 238384 - DNA, 20 bp, human
gtaagactgcgacggtaccg

SEQ ID NO: 238385 - DNA, 20 bp, human
gagaggaggtaaggcgctcc

SEQ ID NO: 238386 - DNA, 20 bp, human
gtcaacatggccctaaccga

SEQ ID NO: 238387 - DNA, 20 bp, human
ggtgggagcgaaataaaaca

SEQ ID NO: 238388 - DNA, 20 bp, human
ggcatgccaaccttcggtta

SEQ ID NO: 238389 - DNA, 20 bp, human
gtaaactcgtaggacttggg

SEQ ID NO: 238390 - DNA, 20 bp, human
gagcgtcaaagcgaaagggc

SEQ ID NO: 238391 - DNA, 20 bp, human
gttgagtgtggccgaaaggt

SEQ ID NO: 238392 - DNA, 20 bp, human
gtctcgggacagttctcgcg

SEQ ID NO: 238393 - DNA, 20 bp, human
ggggctgagaaaacaagctg

SEQ ID NO: 238394 - DNA, 20 bp, human
gtgtcccgagacagtgccac

SEQ ID NO: 238395 - DNA, 20 bp, human
ggttagggccatgttgagtg

SEQ ID NO: 238396 - DNA, 20 bp, human
gagggcgggaagagaggcgc

SEQ ID NO: 238397 - DNA, 20 bp, human
gagggcaagacgccgctcaa

SEQ ID NO: 238398 - DNA, 20 bp, human
gccggggaagacgggccaat

SEQ ID NO: 238399 - DNA, 20 bp, human
gttccccggccggccaatgg

SEQ ID NO: 238400 - DNA, 20 bp, human
ggcccttggcaaccattgag

SEQ ID NO: 238401 - DNA, 20 bp, human
ggcggctgaacaaggttgtg

SEQ ID NO: 238402 - DNA, 20 bp, human
gaacaaaaggcctcgctagc

SEQ ID NO: 238403 - DNA, 20 bp, human
gacgggccaatcggagaaga

SEQ ID NO: 238404 - DNA, 20 bp, human
gtcatctcagggtcgcagaa

SEQ ID NO: 238405 - DNA, 20 bp, human
gctcgccggctccagcctta

SEQ ID NO: 238406 - DNA, 20 bp, human
gctacgaccctcagaactca

SEQ ID NO: 238407 - DNA, 20 bp, human
gtgttgccggaagtgacgtt

SEQ ID NO: 238408 - DNA, 20 bp, human
gtcatcgcggtcacctctac

SEQ ID NO: 238409 - DNA, 20 bp, human
gttcacaggagtcttgaacg

SEQ ID NO: 238410 - DNA, 20 bp, human
gggaggtaccctgagttctg

SEQ ID NO: 238411 - DNA, 20 bp, human
gccgctgagagcctcctcaa

SEQ ID NO: 238412 - DNA, 20 bp, human
gcggagcctaacgtcacttc

SEQ ID NO: 238413 - DNA, 20 bp, human
gcccagaggccaattcgtcg

SEQ ID NO: 238414 - DNA, 20 bp, human
ggttaggctccgactcttaa

SEQ ID NO: 238415 - DNA, 20 bp, human
gcttgaacgcggtgtggaat

SEQ ID NO: 238416 - DNA, 20 bp, human
gcagctaattctgggatcgg

SEQ ID NO: 238417 - DNA, 20 bp, human
gggctgccgcctttgaaggg

SEQ ID NO: 238418 - DNA, 20 bp, human
gctgagggcgggccgagaag

SEQ ID NO: 238419 - DNA, 20 bp, human
gggagagtaaacctgagggc

SEQ ID NO: 238420 - DNA, 20 bp, human
ggggcccgccagctaattct

SEQ ID NO: 238421 - DNA, 20 bp, human
ggggcggagagtaaacctga

SEQ ID NO: 238422 - DNA, 20 bp, human
gaagcggcatccacacctga

SEQ ID NO: 238423 - DNA, 20 bp, human
gattggctgccgcctttgaa

SEQ ID NO: 238424 - DNA, 20 bp, human
gcaaaggcggcagccaatcg

SEQ ID NO: 238425 - DNA, 20 bp, human
gggggacgcggctccccgat

SEQ ID NO: 238426 - DNA, 20 bp, human
gcggctctgcggggattcta

SEQ ID NO: 238427 - DNA, 20 bp, human
gcgcgtaacggggcccgctg

SEQ ID NO: 238428 - DNA, 20 bp, human
gcgctggggcagacaacgcc

SEQ ID NO: 238429 - DNA, 20 bp, human
gagcgtaggcggccctgagg

SEQ ID NO: 238430 - DNA, 20 bp, human
gtctgcggggattctacgga

SEQ ID NO: 238431 - DNA, 20 bp, human
gcagacaacgccggggttac

SEQ ID NO: 238432 - DNA, 20 bp, human
gactcgcccacgcttcttac

SEQ ID NO: 238433 - DNA, 20 bp, human
gaagaagcgtgggcgagtag

SEQ ID NO: 238434 - DNA, 20 bp, human
gtcacaaggtagcgcgtaac

SEQ ID NO: 238435 - DNA, 20 bp, human
gcagagccggcctgtaaccc

SEQ ID NO: 238436 - DNA, 20 bp, human
gctggcaatcctcgagcgcc

SEQ ID NO: 238437 - DNA, 20 bp, human
ggcggctcccggtttgtgcc

SEQ ID NO: 238438 - DNA, 20 bp, human
ggggctgatccccaccgatg

SEQ ID NO: 238439 - DNA, 20 bp, human
gtctgcctgggcggggaaga

SEQ ID NO: 238440 - DNA, 20 bp, human
gcggtggggatcagcccaga

SEQ ID NO: 238441 - DNA, 20 bp, human
gcatgcgtagcagccggcag

SEQ ID NO: 238442 - DNA, 20 bp, human
gcctctggcaggctaccctc

SEQ ID NO: 238443 - DNA, 20 bp, human
gtctccgcccggcacaaacc

SEQ ID NO: 238444 - DNA, 20 bp, human
gtcctaccgacttaaatctg

SEQ ID NO: 238445 - DNA, 20 bp, human
gggcgcacttggggtccgga

SEQ ID NO: 238446 - DNA, 20 bp, human
gacaggccgtccctcagctg

SEQ ID NO: 238447 - DNA, 20 bp, human
gtaacggcgggaaggctcag

SEQ ID NO: 238448 - DNA, 20 bp, human
ggaactgtgagacccctgga

SEQ ID NO: 238449 - DNA, 20 bp, human
gtgcaggggaagtctggaga

SEQ ID NO: 238450 - DNA, 20 bp, human
gcctcggccgatgggaatag

SEQ ID NO: 238451 - DNA, 20 bp, human
gcctccaaaacctaggccgg

SEQ ID NO: 238452 - DNA, 20 bp, human
gaaggtgccttccctcataa

SEQ ID NO: 238453 - DNA, 20 bp, human
gtgagggacggcctgtcgta

SEQ ID NO: 238454 - DNA, 20 bp, human
gcccaggctgagtgcggtcc

SEQ ID NO: 238455 - DNA, 20 bp, human
gcactcgtgtcgggaggaaa

SEQ ID NO: 238456 - DNA, 20 bp, human
gaatcgcagctctaagtccg

SEQ ID NO: 238457 - DNA, 20 bp, human
ggtcggagctccaaaagcga

SEQ ID NO: 238458 - DNA, 20 bp, human
gccctcccgcggagggagaa

SEQ ID NO: 238459 - DNA, 20 bp, human
gcataggccaggacgaagta

SEQ ID NO: 238460 - DNA, 20 bp, human
gtgcaggagcgtccacgtat

SEQ ID NO: 238461 - DNA, 20 bp, human
ggccgaaagccctcccgcgg

SEQ ID NO: 238462 - DNA, 20 bp, human
gtgcgagctgggttgtgtaa

SEQ ID NO: 238463 - DNA, 20 bp, human
gccgcggctccaccaatacg

SEQ ID NO: 238464 - DNA, 20 bp, human
gagaagtcccggcttcccat

SEQ ID NO: 238465 - DNA, 20 bp, human
gacagccgctgaagaagtcc

SEQ ID NO: 238466 - DNA, 20 bp, human
gaggctggagagaatcgttt

SEQ ID NO: 238467 - DNA, 20 bp, human
gctgacccgtaccccagcaa

SEQ ID NO: 238468 - DNA, 20 bp, human
gccgccccgctccctccggt

SEQ ID NO: 238469 - DNA, 20 bp, human
gggtgcgatgtgctggtctc

SEQ ID NO: 238470 - DNA, 20 bp, human
ggtgagccaaccggagggag

SEQ ID NO: 238471 - DNA, 20 bp, human
gcggacccagcttcccggag

SEQ ID NO: 238472 - DNA, 20 bp, human
gttaccgcaaacgaaggcgt

SEQ ID NO: 238473 - DNA, 20 bp, human
gccctccggttggctcacta

SEQ ID NO: 238474 - DNA, 20 bp, human
ggcaccgacgccttcgtttg

SEQ ID NO: 238475 - DNA, 20 bp, human
gagcctccatgtaagtgaca

SEQ ID NO: 238476 - DNA, 20 bp, human
gggagggggcgggactgcgt

SEQ ID NO: 238477 - DNA, 20 bp, human
ggcggggcgaggctacgaga

SEQ ID NO: 238478 - DNA, 20 bp, human
gaggacaccgcgtgtgtcaa

SEQ ID NO: 238479 - DNA, 20 bp, human
gagaggggcgggacctgcgt

SEQ ID NO: 238480 - DNA, 20 bp, human
gggggggttctcctgaatgg

SEQ ID NO: 238481 - DNA, 20 bp, human
gagtaggcgcggtggaatcg

SEQ ID NO: 238482 - DNA, 20 bp, human
ggggtcgcgtggccagtacc

SEQ ID NO: 238483 - DNA, 20 bp, human
gcctgaatggcggttctccc

SEQ ID NO: 238484 - DNA, 20 bp, human
ggaaccccccgccaggctct

SEQ ID NO: 238485 - DNA, 20 bp, human
gaccggccgtggggagtgac

SEQ ID NO: 238486 - DNA, 20 bp, human
gccggcgcccagggactcaa

SEQ ID NO: 238487 - DNA, 20 bp, human
gaccctggcaagcaaggcga

SEQ ID NO: 238488 - DNA, 20 bp, human
gggcccgtccagctaactgc

SEQ ID NO: 238489 - DNA, 20 bp, human
ggcggcgggcggaaacgatc

SEQ ID NO: 238490 - DNA, 20 bp, human
gaaacagtggcggacaaaca

SEQ ID NO: 238491 - DNA, 20 bp, human
gcaacgccgcgtcaggccgg

SEQ ID NO: 238492 - DNA, 20 bp, human
gttagctggacgggcctcaa

SEQ ID NO: 238493 - DNA, 20 bp, human
gatggggtgcgctgaggtct

SEQ ID NO: 238494 - DNA, 20 bp, human
gtggcggacaaacagggctt

SEQ ID NO: 238495 - DNA, 20 bp, human
gtaactgccggttcagaggg

SEQ ID NO: 238496 - DNA, 20 bp, human
gaggtcccgcctcctgagga

SEQ ID NO: 238497 - DNA, 20 bp, human
ggctacctgagatagtggtc

SEQ ID NO: 238498 - DNA, 20 bp, human
gtcgctgctacctgagatag

SEQ ID NO: 238499 - DNA, 20 bp, human
ggaggcgccgggattcaagc

SEQ ID NO: 238500 - DNA, 20 bp, human
gcaacgtgctcgctgtgcgt

SEQ ID NO: 238501 - DNA, 20 bp, human
gctctcccgaccactatctc

SEQ ID NO: 238502 - DNA, 20 bp, human
gagcgaactcacccgtcctc

SEQ ID NO: 238503 - DNA, 20 bp, human
gttgaatcccggcgcctcag

SEQ ID NO: 238504 - DNA, 20 bp, human
ggaactcacccgtcctcagg

SEQ ID NO: 238505 - DNA, 20 bp, human
gcgcccaccggcttgaatcc

SEQ ID NO: 238506 - DNA, 20 bp, human
ggagcagagggtagcgtgtg

SEQ ID NO: 238507 - DNA, 20 bp, human
gtgggggcgggataccgacg

SEQ ID NO: 238508 - DNA, 20 bp, human
gctgccgcctctggccaatc

SEQ ID NO: 238509 - DNA, 20 bp, human
gtacaggtaaaacgcggcaa

SEQ ID NO: 238510 - DNA, 20 bp, human
ggctgccgattggtcagaag

SEQ ID NO: 238511 - DNA, 20 bp, human
gtggccagaggcggcagaac

SEQ ID NO: 238512 - DNA, 20 bp, human
gaaggagccaagtggcgacg

SEQ ID NO: 238513 - DNA, 20 bp, human
gacgcggcaaggggcagaga

SEQ ID NO: 238514 - DNA, 20 bp, human
gatgcgcagaaagatccgtc

SEQ ID NO: 238515 - DNA, 20 bp, human
gagaactgatagaccggcgt

SEQ ID NO: 238516 - DNA, 20 bp, human
gcaaggaggcgaagcggggt

SEQ ID NO: 238517 - DNA, 20 bp, human
gggcctcgggcaatgacttc

SEQ ID NO: 238518 - DNA, 20 bp, human
gggcgtgagggattacccaa

SEQ ID NO: 238519 - DNA, 20 bp, human
ggccctgcgagttgagtaga

SEQ ID NO: 238520 - DNA, 20 bp, human
gagcccagtcgccgccaagg

SEQ ID NO: 238521 - DNA, 20 bp, human
ggacagcccagtcgccgcca

SEQ ID NO: 238522 - DNA, 20 bp, human
gcgccgccaaggaggcgaag

SEQ ID NO: 238523 - DNA, 20 bp, human
gaactcgcagggcgggagga

SEQ ID NO: 238524 - DNA, 20 bp, human
ggccctctactcaactcgca

SEQ ID NO: 238525 - DNA, 20 bp, human
gggggcgagtatcgcaaaat

SEQ ID NO: 238526 - DNA, 20 bp, human
ggcctcccgcagcgccggat

SEQ ID NO: 238527 - DNA, 20 bp, human
ggccctggcggggatttgaa

SEQ ID NO: 238528 - DNA, 20 bp, human
gtctgacgccacagcctatc

SEQ ID NO: 238529 - DNA, 20 bp, human
gactggttgccaagaacgac

SEQ ID NO: 238530 - DNA, 20 bp, human
gagggcggacgtttccgccc

SEQ ID NO: 238531 - DNA, 20 bp, human
gtaggctgtggcgtcagaaa

SEQ ID NO: 238532 - DNA, 20 bp, human
gagcaccgagggcgtgaacc

SEQ ID NO: 238533 - DNA, 20 bp, human
gaaggactgggcgagcaccg

SEQ ID NO: 238534 - DNA, 20 bp, human
gcctcgaccaatcagagcta

SEQ ID NO: 238535 - DNA, 20 bp, human
gccaataagagaacggataa

SEQ ID NO: 238536 - DNA, 20 bp, human
gggtgcgagcagcgcacttc

SEQ ID NO: 238537 - DNA, 20 bp, human
gtcggacggtccacatcagc

SEQ ID NO: 238538 - DNA, 20 bp, human
ggggcggggtggcttgcttg

SEQ ID NO: 238539 - DNA, 20 bp, human
gtcacgtggctgtaccaccc

SEQ ID NO: 238540 - DNA, 20 bp, human
gagtgcgctgctcgcacccc

SEQ ID NO: 238541 - DNA, 20 bp, human
gccgctctctcggtggtccg

SEQ ID NO: 238542 - DNA, 20 bp, human
ggaggagcacttcctttcac

SEQ ID NO: 238543 - DNA, 20 bp, human
ggtcagggcccacccaccat

SEQ ID NO: 238544 - DNA, 20 bp, human
gggggcctggcgttgtcacg

SEQ ID NO: 238545 - DNA, 20 bp, human
ggggcgattaggtcatagag

SEQ ID NO: 238546 - DNA, 20 bp, human
gaagctggagttagaatctg

SEQ ID NO: 238547 - DNA, 20 bp, human
gtaggcgtaagcagccaatt

SEQ ID NO: 238548 - DNA, 20 bp, human
ggtaatctgaaggagggagc

SEQ ID NO: 238549 - DNA, 20 bp, human
gcaaataagcgagtgggcca

SEQ ID NO: 238550 - DNA, 20 bp, human
gggagcttgtaatctgaagg

SEQ ID NO: 238551 - DNA, 20 bp, human
gggctcccagacggcccaat

SEQ ID NO: 238552 - DNA, 20 bp, human
gcatctgtcaaataagcgag

SEQ ID NO: 238553 - DNA, 20 bp, human
gatctgagggtagtgagctc

SEQ ID NO: 238554 - DNA, 20 bp, human
gaggatgcacggctcccaga

SEQ ID NO: 238555 - DNA, 20 bp, human
gcattgctggaagtctctgt

SEQ ID NO: 238556 - DNA, 20 bp, human
gggcgcgctcccgagcagac

SEQ ID NO: 238557 - DNA, 20 bp, human
gcctatgctaaaaggagaca

SEQ ID NO: 238558 - DNA, 20 bp, human
gccgaagcccctatgctaaa

SEQ ID NO: 238559 - DNA, 20 bp, human
gtagcccccggaggcaatga

SEQ ID NO: 238560 - DNA, 20 bp, human
gcgctcccgagcagaccggc

SEQ ID NO: 238561 - DNA, 20 bp, human
ggcagcccgctccctctaga

SEQ ID NO: 238562 - DNA, 20 bp, human
ggcaccgaggagcgcgcctg

SEQ ID NO: 238563 - DNA, 20 bp, human
gagcgctagtcggtctggta

SEQ ID NO: 238564 - DNA, 20 bp, human
gctctagaagggtgcgtcag

SEQ ID NO: 238565 - DNA, 20 bp, human
gcgcctgcgacgcgggtaag

SEQ ID NO: 238566 - DNA, 20 bp, human
ggatacctgcctggcgggat

SEQ ID NO: 238567 - DNA, 20 bp, human
gtaattaccccctgggtccc

SEQ ID NO: 238568 - DNA, 20 bp, human
gtggcctcctgccgtcactt

SEQ ID NO: 238569 - DNA, 20 bp, human
gctcttagctaattaccccc

SEQ ID NO: 238570 - DNA, 20 bp, human
gaagagtttagctatgtctg

SEQ ID NO: 238571 - DNA, 20 bp, human
gtatatagatacctgcctgg

SEQ ID NO: 238572 - DNA, 20 bp, human
gaaaggccccagtgaaagcc

SEQ ID NO: 238573 - DNA, 20 bp, human
gttgaattatgtagtgctaa

SEQ ID NO: 238574 - DNA, 20 bp, human
gaaaccaaagtgacggcagg

SEQ ID NO: 238575 - DNA, 20 bp, human
ggtatatatagatacctgcc

SEQ ID NO: 238576 - DNA, 20 bp, human
ggggccggaggaccggacag

SEQ ID NO: 238577 - DNA, 20 bp, human
ggggcgtccgagaacagtag

SEQ ID NO: 238578 - DNA, 20 bp, human
ggagcaggatcccactctga

SEQ ID NO: 238579 - DNA, 20 bp, human
gctggaccccggaggggcga

SEQ ID NO: 238580 - DNA, 20 bp, human
gccggaggaccggacagggg

SEQ ID NO: 238581 - DNA, 20 bp, human
gggccgaggcagacccggag

SEQ ID NO: 238582 - DNA, 20 bp, human
ggccgggcggggctgctcca

SEQ ID NO: 238583 - DNA, 20 bp, human
gccgcccggctggaccccgg

SEQ ID NO: 238584 - DNA, 20 bp, human
ggaccagccgggccacgcgt

SEQ ID NO: 238585 - DNA, 20 bp, human
gcaccggagggccagggccc

SEQ ID NO: 238586 - DNA, 20 bp, human
gcgggagccagggagagacg

SEQ ID NO: 238587 - DNA, 20 bp, human
gaggacgccaggatcgtaga

SEQ ID NO: 238588 - DNA, 20 bp, human
ggggtgccgggtgctgaatc

SEQ ID NO: 238589 - DNA, 20 bp, human
ggacggggggacccgagaag

SEQ ID NO: 238590 - DNA, 20 bp, human
gtcaccccgtacgcgggcgg

SEQ ID NO: 238591 - DNA, 20 bp, human
ggcgtcaccccgtacgcggg

SEQ ID NO: 238592 - DNA, 20 bp, human
gggaaggcgccactgagtcc

SEQ ID NO: 238593 - DNA, 20 bp, human
ggtccccgccgcccgcgtac

SEQ ID NO: 238594 - DNA, 20 bp, human
gtccgcgcgggcctcggttc

SEQ ID NO: 238595 - DNA, 20 bp, human
ggcccaggctccggttccta

SEQ ID NO: 238596 - DNA, 20 bp, human
ggagggctggtttaactcga

SEQ ID NO: 238597 - DNA, 20 bp, human
gtacaggagaagctaggcgg

SEQ ID NO: 238598 - DNA, 20 bp, human
gtgcaagtttaagattgagg

SEQ ID NO: 238599 - DNA, 20 bp, human
ggtacgaaatcgtactttac

SEQ ID NO: 238600 - DNA, 20 bp, human
gaacttgcatataatcgctt

SEQ ID NO: 238601 - DNA, 20 bp, human
gctaagaaaatactaggtga

SEQ ID NO: 238602 - DNA, 20 bp, human
gcttagatatgtggtatctg

SEQ ID NO: 238603 - DNA, 20 bp, human
gcctccaggtgtaagtattt

SEQ ID NO: 238604 - DNA, 20 bp, human
gggtgagtggcgaagcggcg

SEQ ID NO: 238605 - DNA, 20 bp, human
gagtggcgaagcggcgaggc

SEQ ID NO: 238606 - DNA, 20 bp, human
gccgcggcatacaaatgggc

SEQ ID NO: 238607 - DNA, 20 bp, human
gcagaagggacggggataga

SEQ ID NO: 238608 - DNA, 20 bp, human
gctggaccgggaagaccata

SEQ ID NO: 238609 - DNA, 20 bp, human
gcgctccgcggcatacaaat

SEQ ID NO: 238610 - DNA, 20 bp, human
ggcaaggcgtggggagaagt

SEQ ID NO: 238611 - DNA, 20 bp, human
gtgaggggagcggttgtcgg

SEQ ID NO: 238612 - DNA, 20 bp, human
gggtccgcggagtctctaac

SEQ ID NO: 238613 - DNA, 20 bp, human
ggggagcggttgtcggagga

SEQ ID NO: 238614 - DNA, 20 bp, human
gtctctaactggcgacagat

SEQ ID NO: 238615 - DNA, 20 bp, human
gcatatggcgcatgccgggg

SEQ ID NO: 238616 - DNA, 20 bp, human
gggtccttgagaaggagcga

SEQ ID NO: 238617 - DNA, 20 bp, human
gcggtgcgcggggtctctcg

SEQ ID NO: 238618 - DNA, 20 bp, human
gcagagaaacccaggcgcgg

SEQ ID NO: 238619 - DNA, 20 bp, human
gcagctgcggcgcgtgacgc

SEQ ID NO: 238620 - DNA, 20 bp, human
gtcacgcgccgcagctgggc

SEQ ID NO: 238621 - DNA, 20 bp, human
gtctcggggtccaggtccaa

SEQ ID NO: 238622 - DNA, 20 bp, human
gcggctccgtcggctaccgc

SEQ ID NO: 238623 - DNA, 20 bp, human
ggctccaagaacggtgaggt

SEQ ID NO: 238624 - DNA, 20 bp, human
gtcccgcattcaggaggcgt

SEQ ID NO: 238625 - DNA, 20 bp, human
ggtcacgggcacggcgcggt

SEQ ID NO: 238626 - DNA, 20 bp, human
gaggctgggcgtgacgggag

SEQ ID NO: 238627 - DNA, 20 bp, human
ggagcccagccgggaaaaaa

SEQ ID NO: 238628 - DNA, 20 bp, human
ggggccgggagcggagggtt

SEQ ID NO: 238629 - DNA, 20 bp, human
gaaggccgcgagcagcccaa

SEQ ID NO: 238630 - DNA, 20 bp, human
gccgggaggctgggcgtgac

SEQ ID NO: 238631 - DNA, 20 bp, human
ggctcgcggcctttttttcc

SEQ ID NO: 238632 - DNA, 20 bp, human
gttctctagcgcaaggtgac

SEQ ID NO: 238633 - DNA, 20 bp, human
ggcctcccgcgccggggcga

SEQ ID NO: 238634 - DNA, 20 bp, human
gagaaaccgccgacctgggg

SEQ ID NO: 238635 - DNA, 20 bp, human
gtcagctcgactgggctcgg

SEQ ID NO: 238636 - DNA, 20 bp, human
ggtgaggcgaagctactgga

SEQ ID NO: 238637 - DNA, 20 bp, human
gccaaaaggcaacaacgatg

SEQ ID NO: 238638 - DNA, 20 bp, human
gcccatcaggaagaacctga

SEQ ID NO: 238639 - DNA, 20 bp, human
gcatctgtcaactgctgaac

SEQ ID NO: 238640 - DNA, 20 bp, human
gaccctcaggttcttcctga

SEQ ID NO: 238641 - DNA, 20 bp, human
gccacaaaactcatccacta

SEQ ID NO: 238642 - DNA, 20 bp, human
ggacagtacagggttgtgac

SEQ ID NO: 238643 - DNA, 20 bp, human
ggactcgcaactttggaggg

SEQ ID NO: 238644 - DNA, 20 bp, human
ggggttgtgactggtgtttt

SEQ ID NO: 238645 - DNA, 20 bp, human
gtgacgtgaggcgaagctac

SEQ ID NO: 238646 - DNA, 20 bp, human
gcgcgccgcggggcagagat

SEQ ID NO: 238647 - DNA, 20 bp, human
gggggcgggggcgagaatgg

SEQ ID NO: 238648 - DNA, 20 bp, human
gcacgcgccccggaacggtg

SEQ ID NO: 238649 - DNA, 20 bp, human
gagaggcctagttgcgtcga

SEQ ID NO: 238650 - DNA, 20 bp, human
gacgcaactaggcctctccc

SEQ ID NO: 238651 - DNA, 20 bp, human
gcgccaggccccaccgttcc

SEQ ID NO: 238652 - DNA, 20 bp, human
ggagatgggcggagcgggaa

SEQ ID NO: 238653 - DNA, 20 bp, human
ggaaacgctaggctggaccc

SEQ ID NO: 238654 - DNA, 20 bp, human
gtgcgcgctccgtccggccc

SEQ ID NO: 238655 - DNA, 20 bp, human
ggacaatactgggttcaaag

SEQ ID NO: 238656 - DNA, 20 bp, human
gtagctggatggaagagtga

SEQ ID NO: 238657 - DNA, 20 bp, human
gaaggggcgtggatccccgg

SEQ ID NO: 238658 - DNA, 20 bp, human
gtgaccagaaggggccggaa

SEQ ID NO: 238659 - DNA, 20 bp, human
gcgagtcagaggctcgggaa

SEQ ID NO: 238660 - DNA, 20 bp, human
ggccgggctgggcgagtcag

SEQ ID NO: 238661 - DNA, 20 bp, human
gccgcccgaggcgtggtccc

SEQ ID NO: 238662 - DNA, 20 bp, human
ggggttgcagtgagggaagt

SEQ ID NO: 238663 - DNA, 20 bp, human
gggtccccgggttgcagtga

SEQ ID NO: 238664 - DNA, 20 bp, human
gtgagggaggagtagaagcg

SEQ ID NO: 238665 - DNA, 20 bp, human
gctgggcgagtcagaggctc

SEQ ID NO: 238666 - DNA, 20 bp, human
gccaactcgcccacacccgc

SEQ ID NO: 238667 - DNA, 20 bp, human
gaggggcgggcgacactccc

SEQ ID NO: 238668 - DNA, 20 bp, human
ggggctagggcggatttggg

SEQ ID NO: 238669 - DNA, 20 bp, human
gcgaaagagcggtgagagca

SEQ ID NO: 238670 - DNA, 20 bp, human
gcgagccagccagggggcta

SEQ ID NO: 238671 - DNA, 20 bp, human
ggcgcaggggcaccgctccg

SEQ ID NO: 238672 - DNA, 20 bp, human
gcgcccacacccgcagggca

SEQ ID NO: 238673 - DNA, 20 bp, human
gccccagcgcggccagaggg

SEQ ID NO: 238674 - DNA, 20 bp, human
gaaacagcgaggcacacacg

SEQ ID NO: 238675 - DNA, 20 bp, human
gcgggcgacactccccggag

SEQ ID NO: 238676 - DNA, 20 bp, human
gcagggcggtaactctgggc

SEQ ID NO: 238677 - DNA, 20 bp, human
gctgacagtagagtccagac

SEQ ID NO: 238678 - DNA, 20 bp, human
ggcactgtgacggcccccaa

SEQ ID NO: 238679 - DNA, 20 bp, human
gagcgcagggcggtaactct

SEQ ID NO: 238680 - DNA, 20 bp, human
ggacaccgatggtgtgtgac

SEQ ID NO: 238681 - DNA, 20 bp, human
gcccttatgtaacaagtagt

SEQ ID NO: 238682 - DNA, 20 bp, human
gcataagggttcacccttgc

SEQ ID NO: 238683 - DNA, 20 bp, human
gaccgatggtgtgtgacagg

SEQ ID NO: 238684 - DNA, 20 bp, human
gctgctggtgtgggcccttg

SEQ ID NO: 238685 - DNA, 20 bp, human
gcccaactacttgttacata

SEQ ID NO: 238686 - DNA, 20 bp, human
gcacttccggagaacgggaa

SEQ ID NO: 238687 - DNA, 20 bp, human
gagagcgctggtagatgagg

SEQ ID NO: 238688 - DNA, 20 bp, human
ggggagcggcctgtgacggc

SEQ ID NO: 238689 - DNA, 20 bp, human
gccgccgccgcctaccatcg

SEQ ID NO: 238690 - DNA, 20 bp, human
gagcggtggtggttccgcga

SEQ ID NO: 238691 - DNA, 20 bp, human
gtctccggaagtgcgcgggt

SEQ ID NO: 238692 - DNA, 20 bp, human
gcgcctgctaggatcagcgg

SEQ ID NO: 238693 - DNA, 20 bp, human
gacccgcccgcgcccagcag

SEQ ID NO: 238694 - DNA, 20 bp, human
gtggcgacggagtcgcgcga

SEQ ID NO: 238695 - DNA, 20 bp, human
gcctcctcgcctgccgtcac

SEQ ID NO: 238696 - DNA, 20 bp, human
ggagcccgggcaaaggaaag

SEQ ID NO: 238697 - DNA, 20 bp, human
gcgggcctgtggacaaggac

SEQ ID NO: 238698 - DNA, 20 bp, human
gaatggcacagccccttccg

SEQ ID NO: 238699 - DNA, 20 bp, human
gcagcggggtgcgctggctt

SEQ ID NO: 238700 - DNA, 20 bp, human
ggattccctggatcgcggaa

SEQ ID NO: 238701 - DNA, 20 bp, human
gactgggcagggagtcagcg

SEQ ID NO: 238702 - DNA, 20 bp, human
ggcagcccttccgcgatcca

SEQ ID NO: 238703 - DNA, 20 bp, human
ggtttgaagagaggattccc

SEQ ID NO: 238704 - DNA, 20 bp, human
gctcctttggcatcctcgga

SEQ ID NO: 238705 - DNA, 20 bp, human
gtagaattggagaccccagg

SEQ ID NO: 238706 - DNA, 20 bp, human
gggtggccagccccatgctc

SEQ ID NO: 238707 - DNA, 20 bp, human
gtgaccacatcactgaccct

SEQ ID NO: 238708 - DNA, 20 bp, human
gagcaccaccgatctctaaa

SEQ ID NO: 238709 - DNA, 20 bp, human
gagtggcaccccagggtcac

SEQ ID NO: 238710 - DNA, 20 bp, human
ggagggctgtcatatcaacc

SEQ ID NO: 238711 - DNA, 20 bp, human
gaaggacagcgccacctagc

SEQ ID NO: 238712 - DNA, 20 bp, human
gcactcggagtggcacccca

SEQ ID NO: 238713 - DNA, 20 bp, human
gacagccctttagagatcgg

SEQ ID NO: 238714 - DNA, 20 bp, human
gctgaggtgagggcttgata

SEQ ID NO: 238715 - DNA, 20 bp, human
gtcagtgatgtggtcacctt

SEQ ID NO: 238716 - DNA, 20 bp, human
gaggagcaggaatctctcca

SEQ ID NO: 238717 - DNA, 20 bp, human
gtgcccggcgcctcagtccg

SEQ ID NO: 238718 - DNA, 20 bp, human
gagggtggggcatgaaagac

SEQ ID NO: 238719 - DNA, 20 bp, human
gggaggggatggttcctgag

SEQ ID NO: 238720 - DNA, 20 bp, human
gggaatctctccacggactg

SEQ ID NO: 238721 - DNA, 20 bp, human
gagtgtggccgaggagtagg

SEQ ID NO: 238722 - DNA, 20 bp, human
gtctccacggactgaggcgc

SEQ ID NO: 238723 - DNA, 20 bp, human
gtgacagcaccaacaggagc

SEQ ID NO: 238724 - DNA, 20 bp, human
gcagagtgtggccgaggagt

SEQ ID NO: 238725 - DNA, 20 bp, human
gcctcccagtcctgggcccc

SEQ ID NO: 238726 - DNA, 20 bp, human
gtgctgctgggacaagcgag

SEQ ID NO: 238727 - DNA, 20 bp, human
gccagctcagacaagcagcc

SEQ ID NO: 238728 - DNA, 20 bp, human
ggctttggacttccgggatg

SEQ ID NO: 238729 - DNA, 20 bp, human
gtgtgtctttctggcatcac

SEQ ID NO: 238730 - DNA, 20 bp, human
gttgataggctttggacttc

SEQ ID NO: 238731 - DNA, 20 bp, human
gggccattgaagactcttgt

SEQ ID NO: 238732 - DNA, 20 bp, human
ggaggaagaaggttgctgct

SEQ ID NO: 238733 - DNA, 20 bp, human
gtatgagttctagagaccca

SEQ ID NO: 238734 - DNA, 20 bp, human
gaatcttaaaatgtcttgcc

SEQ ID NO: 238735 - DNA, 20 bp, human
gtggggaaagataatttgat

SEQ ID NO: 238736 - DNA, 20 bp, human
ggtcccctcgggtcattaac

SEQ ID NO: 238737 - DNA, 20 bp, human
gtaatgacccgaggggacag

SEQ ID NO: 238738 - DNA, 20 bp, human
gcaagatcccgcagatggga

SEQ ID NO: 238739 - DNA, 20 bp, human
gcatctgcgggatcttgctt

SEQ ID NO: 238740 - DNA, 20 bp, human
gaaaccggttaatgacccga

SEQ ID NO: 238741 - DNA, 20 bp, human
gccccagcgggcgtgggcgt

SEQ ID NO: 238742 - DNA, 20 bp, human
ggggcgttggcagtgagcga

SEQ ID NO: 238743 - DNA, 20 bp, human
gcgagaatccgctgtcccct

SEQ ID NO: 238744 - DNA, 20 bp, human
gggcgcccgaatgagagcgc

SEQ ID NO: 238745 - DNA, 20 bp, human
gtcctacgccctcccatctg

SEQ ID NO: 238746 - DNA, 20 bp, human
ggccctgcaccaatagggag

SEQ ID NO: 238747 - DNA, 20 bp, human
gacagagccccgtctttatt

SEQ ID NO: 238748 - DNA, 20 bp, human
gcgtcgccgcctctccctat

SEQ ID NO: 238749 - DNA, 20 bp, human
gtcacgcgggaggggagtaa

SEQ ID NO: 238750 - DNA, 20 bp, human
gtgatcttgcccaataaaga

SEQ ID NO: 238751 - DNA, 20 bp, human
gtattggtgcagggccgaag

SEQ ID NO: 238752 - DNA, 20 bp, human
gcggcgacgactcagccaat

SEQ ID NO: 238753 - DNA, 20 bp, human
ggaagagggtgggactaacc

SEQ ID NO: 238754 - DNA, 20 bp, human
gtccgggcctggagttcagt

SEQ ID NO: 238755 - DNA, 20 bp, human
ggcgcgcggggcggtgggaa

SEQ ID NO: 238756 - DNA, 20 bp, human
gtactgggaaggggagtact

SEQ ID NO: 238757 - DNA, 20 bp, human
ggggaagtcggagtacttac

SEQ ID NO: 238758 - DNA, 20 bp, human
gtcggagtacttactgggaa

SEQ ID NO: 238759 - DNA, 20 bp, human
gtttgccttcttaaagttgg

SEQ ID NO: 238760 - DNA, 20 bp, human
ggaaagataacagggtttac

SEQ ID NO: 238761 - DNA, 20 bp, human
gttcccgaacgtggggatcc

SEQ ID NO: 238762 - DNA, 20 bp, human
gggagatcacttgttcagta

SEQ ID NO: 238763 - DNA, 20 bp, human
gttaagcaaagctttggaat

SEQ ID NO: 238764 - DNA, 20 bp, human
gtgtattgcataacatataa

SEQ ID NO: 238765 - DNA, 20 bp, human
gttcagtaagctcaggctta

SEQ ID NO: 238766 - DNA, 20 bp, human
gcccccgcccccccaatcta

SEQ ID NO: 238767 - DNA, 20 bp, human
gcgagagcggccctagattg

SEQ ID NO: 238768 - DNA, 20 bp, human
ggggggcgttaggaggtggg

SEQ ID NO: 238769 - DNA, 20 bp, human
gtagggccgctctcgccctt

SEQ ID NO: 238770 - DNA, 20 bp, human
gcggacccgcaaaggattcg

SEQ ID NO: 238771 - DNA, 20 bp, human
gccggcctccgatccctgtg

SEQ ID NO: 238772 - DNA, 20 bp, human
ggcgggggggcgttaggagg

SEQ ID NO: 238773 - DNA, 20 bp, human
gccgctctcgcccttcggat

SEQ ID NO: 238774 - DNA, 20 bp, human
ggagcggccctagattgggg

SEQ ID NO: 238775 - DNA, 20 bp, human
gaaagcttccgccccctaat

SEQ ID NO: 238776 - DNA, 20 bp, human
ggcaaaaatggtgcagatgg

SEQ ID NO: 238777 - DNA, 20 bp, human
gtatgtccgcccagccccca

SEQ ID NO: 238778 - DNA, 20 bp, human
gaaatggtgcagatggtgga

SEQ ID NO: 238779 - DNA, 20 bp, human
gtgggcggacatacatatac

SEQ ID NO: 238780 - DNA, 20 bp, human
gagagcctcatgttccgtgg

SEQ ID NO: 238781 - DNA, 20 bp, human
gaactctagaggaggccgca

SEQ ID NO: 238782 - DNA, 20 bp, human
gatggcaaaaatggtgcaga

SEQ ID NO: 238783 - DNA, 20 bp, human
gaggggagacaagtagaagt

SEQ ID NO: 238784 - DNA, 20 bp, human
gtcaagcttggggtcattgt

SEQ ID NO: 238785 - DNA, 20 bp, human
gtggctctgaactctagagg

SEQ ID NO: 238786 - DNA, 20 bp, human
gccggagaggaggtactgaa

SEQ ID NO: 238787 - DNA, 20 bp, human
ggtactgaaggggagagtcc

SEQ ID NO: 238788 - DNA, 20 bp, human
gctacctggcctccagatag

SEQ ID NO: 238789 - DNA, 20 bp, human
ggggtggtttgggcttactg

SEQ ID NO: 238790 - DNA, 20 bp, human
gactggggaggagctaaggc

SEQ ID NO: 238791 - DNA, 20 bp, human
gcctttgctgccaaaggtcc

SEQ ID NO: 238792 - DNA, 20 bp, human
ggatgtgggtaggacaggcg

SEQ ID NO: 238793 - DNA, 20 bp, human
gcctacccacatcactttcc

SEQ ID NO: 238794 - DNA, 20 bp, human
gccggaacatccaagcggga

SEQ ID NO: 238795 - DNA, 20 bp, human
gaaagtgatgtgggtaggac

SEQ ID NO: 238796 - DNA, 20 bp, human
ggaatggcaccgatatgatg

SEQ ID NO: 238797 - DNA, 20 bp, human
ggggtatctcctcatcatat

SEQ ID NO: 238798 - DNA, 20 bp, human
ggatctctgagaaacatgaa

SEQ ID NO: 238799 - DNA, 20 bp, human
gtcagagatctaactgccaa

SEQ ID NO: 238800 - DNA, 20 bp, human
gtgaggggccctgtgggaga

SEQ ID NO: 238801 - DNA, 20 bp, human
gagatggtgaggggccctgt

SEQ ID NO: 238802 - DNA, 20 bp, human
ggccctgagtggggaacacg

SEQ ID NO: 238803 - DNA, 20 bp, human
ggggtcccagccgccctgag

SEQ ID NO: 238804 - DNA, 20 bp, human
ggtggggaacacgaggataa

SEQ ID NO: 238805 - DNA, 20 bp, human
gggggcctctcttaaagcag

SEQ ID NO: 238806 - DNA, 20 bp, human
ggaatggcaccgatatgatg

SEQ ID NO: 238807 - DNA, 20 bp, human
ggggtatctcctcatcatat

SEQ ID NO: 238808 - DNA, 20 bp, human
ggatctctgagaaacatgaa

SEQ ID NO: 238809 - DNA, 20 bp, human
gtcagagatctaactgccaa

SEQ ID NO: 238810 - DNA, 20 bp, human
gtgaggggccctgtgggaga

SEQ ID NO: 238811 - DNA, 20 bp, human
gagatggtgaggggccctgt

SEQ ID NO: 238812 - DNA, 20 bp, human
ggccctgagtggggaacacg

SEQ ID NO: 238813 - DNA, 20 bp, human
ggggtcccagccgccctgag

SEQ ID NO: 238814 - DNA, 20 bp, human
gggggcacaggcaacagcct

SEQ ID NO: 238815 - DNA, 20 bp, human
ggtggggaacacgaggataa

SEQ ID NO: 238816 - DNA, 20 bp, human
gaggaggtaacccagtcccg

SEQ ID NO: 238817 - DNA, 20 bp, human
gaaacaccctgggggactct

SEQ ID NO: 238818 - DNA, 20 bp, human
gaccagagtcgacaagtcgc

SEQ ID NO: 238819 - DNA, 20 bp, human
gaggtaacccagtcccgggg

SEQ ID NO: 238820 - DNA, 20 bp, human
gtaggattgtgaaacaccct

SEQ ID NO: 238821 - DNA, 20 bp, human
gggggggcagtccctcagat

SEQ ID NO: 238822 - DNA, 20 bp, human
gtgtggtgaagttggggccg

SEQ ID NO: 238823 - DNA, 20 bp, human
gccgctgcccacccggggag

SEQ ID NO: 238824 - DNA, 20 bp, human
gggcgggccgctccccgggt

SEQ ID NO: 238825 - DNA, 20 bp, human
gctgggaagactggctacaa

SEQ ID NO: 238826 - DNA, 20 bp, human
ggacgccagcccggaggcat

SEQ ID NO: 238827 - DNA, 20 bp, human
gccggccgatgcctccgggc

SEQ ID NO: 238828 - DNA, 20 bp, human
gctgggagcccgaacccgcc

SEQ ID NO: 238829 - DNA, 20 bp, human
gcgtccctgaagccctcgct

SEQ ID NO: 238830 - DNA, 20 bp, human
gtgctggaacttgtagtctt

SEQ ID NO: 238831 - DNA, 20 bp, human
gggttgccctacgacacttc

SEQ ID NO: 238832 - DNA, 20 bp, human
gttccagcatgcaccgcgtc

SEQ ID NO: 238833 - DNA, 20 bp, human
gacttccggccgatgcctcc

SEQ ID NO: 238834 - DNA, 20 bp, human
gcatcggccggaagtgtcgt

SEQ ID NO: 238835 - DNA, 20 bp, human
gttcagggacgccagcccgg

SEQ ID NO: 238836 - DNA, 20 bp, human
gaacgtagggtagtcttcag

SEQ ID NO: 238837 - DNA, 20 bp, human
gcctacgatagaagaacgta

SEQ ID NO: 238838 - DNA, 20 bp, human
gaacagggtttatgtcctct

SEQ ID NO: 238839 - DNA, 20 bp, human
gttcgttaggtgaagagtag

SEQ ID NO: 238840 - DNA, 20 bp, human
ggtcagacactgacattcaa

SEQ ID NO: 238841 - DNA, 20 bp, human
gggtgatcagacaggaataa

SEQ ID NO: 238842 - DNA, 20 bp, human
gaggaaatgatgttttcgtt

SEQ ID NO: 238843 - DNA, 20 bp, human
ggaatgtcagtgtctgacaa

SEQ ID NO: 238844 - DNA, 20 bp, human
gcttaaaagtcacaatgaac

SEQ ID NO: 238845 - DNA, 20 bp, human
gtgatgcactacctcatctt

SEQ ID NO: 238846 - DNA, 20 bp, human
gagcagctggtgatatcctc

SEQ ID NO: 238847 - DNA, 20 bp, human
gtaaatgttaatgctgtgac

SEQ ID NO: 238848 - DNA, 20 bp, human
ggagaattgggtttaacttc

SEQ ID NO: 238849 - DNA, 20 bp, human
gagctagggaaattctccgt

SEQ ID NO: 238850 - DNA, 20 bp, human
gtgcaaaagtttctgatagg

SEQ ID NO: 238851 - DNA, 20 bp, human
gggaaagaacttgctgcaaa

SEQ ID NO: 238852 - DNA, 20 bp, human
gtaatgctgtgaccggctct

SEQ ID NO: 238853 - DNA, 20 bp, human
gtatatgtgtatgaagcaac

SEQ ID NO: 238854 - DNA, 20 bp, human
ggcagtgcttgatgaatttg

SEQ ID NO: 238855 - DNA, 20 bp, human
gatagagtttgaataattga

SEQ ID NO: 238856 - DNA, 20 bp, human
ggctttccagtgtacaaatt

SEQ ID NO: 238857 - DNA, 20 bp, human
gagtacatgactatttgagg

SEQ ID NO: 238858 - DNA, 20 bp, human
gaggagtacatgactatttg

SEQ ID NO: 238859 - DNA, 20 bp, human
gatgaaaagcatcactaact

SEQ ID NO: 238860 - DNA, 20 bp, human
gtatacagtagaaaagtgat

SEQ ID NO: 238861 - DNA, 20 bp, human
gtcattcctaatttgtacac

SEQ ID NO: 238862 - DNA, 20 bp, human
gtattctcattgactgccat

SEQ ID NO: 238863 - DNA, 20 bp, human
gaaaaataggacagagtttc

SEQ ID NO: 238864 - DNA, 20 bp, human
gtggaaagcatttaagctaa

SEQ ID NO: 238865 - DNA, 20 bp, human
gttcttaaattgttgtgtgt

SEQ ID NO: 238866 - DNA, 20 bp, human
gagactcagggaccacaaca

SEQ ID NO: 238867 - DNA, 20 bp, human
gcagaaatgggccattgaag

SEQ ID NO: 238868 - DNA, 20 bp, human
ggggccattgaagaggaaag

SEQ ID NO: 238869 - DNA, 20 bp, human
gttccaaactcagagactca

SEQ ID NO: 238870 - DNA, 20 bp, human
gagtttggaatattcagaaa

SEQ ID NO: 238871 - DNA, 20 bp, human
gtcagtaggcaagcaagtga

SEQ ID NO: 238872 - DNA, 20 bp, human
gcttggctagaaaaaagaag

SEQ ID NO: 238873 - DNA, 20 bp, human
gcttcctctttcctcttcaa

SEQ ID NO: 238874 - DNA, 20 bp, human
gaggtaacttcagaccatcc

SEQ ID NO: 238875 - DNA, 20 bp, human
gatgctgttatgttaagatg

SEQ ID NO: 238876 - DNA, 20 bp, human
gcagaaatgggccattgaag

SEQ ID NO: 238877 - DNA, 20 bp, human
ggggccattgaagaggaaag

SEQ ID NO: 238878 - DNA, 20 bp, human
gagactcagggaccacaaca

SEQ ID NO: 238879 - DNA, 20 bp, human
gtcagtaggcaagcaagtga

SEQ ID NO: 238880 - DNA, 20 bp, human
gttccaaactcagagactca

SEQ ID NO: 238881 - DNA, 20 bp, human
gagtttggaatattcagaaa

SEQ ID NO: 238882 - DNA, 20 bp, human
gcttggctagaaaaaagaag

SEQ ID NO: 238883 - DNA, 20 bp, human
gaggtaacttcagaccatcc

SEQ ID NO: 238884 - DNA, 20 bp, human
gatgctgttatgttaagatg

SEQ ID NO: 238885 - DNA, 20 bp, human
gcttcctctttcctcttcaa

SEQ ID NO: 238886 - DNA, 20 bp, human
gaattgtaccagtacatatc

SEQ ID NO: 238887 - DNA, 20 bp, human
gcatgaagctaggggcttta

SEQ ID NO: 238888 - DNA, 20 bp, human
gtgcactaccatgaagctag

SEQ ID NO: 238889 - DNA, 20 bp, human
gcattattagttaccaagtg

SEQ ID NO: 238890 - DNA, 20 bp, human
gcagtagctttctttgattc

SEQ ID NO: 238891 - DNA, 20 bp, human
gagaaagacaagggattatc

SEQ ID NO: 238892 - DNA, 20 bp, human
gctaagggagaagcaagcta

SEQ ID NO: 238893 - DNA, 20 bp, human
gagaagcaagctatggagaa

SEQ ID NO: 238894 - DNA, 20 bp, human
gttgattgcctgatatgtac

SEQ ID NO: 238895 - DNA, 20 bp, human
gcatctcatgggggaatcta

SEQ ID NO: 238896 - DNA, 20 bp, human
gatctctggaattgattccc

SEQ ID NO: 238897 - DNA, 20 bp, human
gtggaagcattgagggacaa

SEQ ID NO: 238898 - DNA, 20 bp, human
ggcaactattggaagcattg

SEQ ID NO: 238899 - DNA, 20 bp, human
ggctgcagtggatgtttctc

SEQ ID NO: 238900 - DNA, 20 bp, human
ggctgtacatgtacatacca

SEQ ID NO: 238901 - DNA, 20 bp, human
gaagcaagttatggagaaac

SEQ ID NO: 238902 - DNA, 20 bp, human
gctttatttagtgacagtaa

SEQ ID NO: 238903 - DNA, 20 bp, human
ggtgcactaccacaaagcta

SEQ ID NO: 238904 - DNA, 20 bp, human
gccacaaagctagggcttta

SEQ ID NO: 238905 - DNA, 20 bp, human
ggtaaagagagttttaatac

SEQ ID NO: 238906 - DNA, 20 bp, human
gagaggaagctccccaccgc

SEQ ID NO: 238907 - DNA, 20 bp, human
gaacccagggggccggcggt

SEQ ID NO: 238908 - DNA, 20 bp, human
gtcagaaatggactgtttag

SEQ ID NO: 238909 - DNA, 20 bp, human
gaaaactggcactaagaatt

SEQ ID NO: 238910 - DNA, 20 bp, human
gaaaaaaaaacccagggggc

SEQ ID NO: 238911 - DNA, 20 bp, human
ggtaaattcccttttaaaac

SEQ ID NO: 238912 - DNA, 20 bp, human
gagggttcagctgtttcaaa

SEQ ID NO: 238913 - DNA, 20 bp, human
gtggactgtttagaggagag

SEQ ID NO: 238914 - DNA, 20 bp, human
gatattgttgtattaagatg

SEQ ID NO: 238915 - DNA, 20 bp, human
gttgaatttcaatgtactaa

SEQ ID NO: 238916 - DNA, 20 bp, human
ggctgagggaggtgaccaat

SEQ ID NO: 238917 - DNA, 20 bp, human
gggtggaaacaagttcctat

SEQ ID NO: 238918 - DNA, 20 bp, human
gccttcccattaaagagctg

SEQ ID NO: 238919 - DNA, 20 bp, human
gcctccctcagctctttaat

SEQ ID NO: 238920 - DNA, 20 bp, human
gtgagtcattgcaattaaca

SEQ ID NO: 238921 - DNA, 20 bp, human
gtcattgcaattaacagggt

SEQ ID NO: 238922 - DNA, 20 bp, human
gggaaatcagtctcttctgg

SEQ ID NO: 238923 - DNA, 20 bp, human
gtggggcacaagtgtttgtt

SEQ ID NO: 238924 - DNA, 20 bp, human
gacttgagacagtgagtgtg

SEQ ID NO: 238925 - DNA, 20 bp, human
gcagttacggtaaatctctc

SEQ ID NO: 238926 - DNA, 20 bp, human
gccgagctgcagtgcatgta

SEQ ID NO: 238927 - DNA, 20 bp, human
gcgcctcgctcgctgggtaa

SEQ ID NO: 238928 - DNA, 20 bp, human
gggtaacggagtcttcccgc

SEQ ID NO: 238929 - DNA, 20 bp, human
gagtgcatgtagggaaatgt

SEQ ID NO: 238930 - DNA, 20 bp, human
ggggctcgcgctgcgcgctg

SEQ ID NO: 238931 - DNA, 20 bp, human
gcgcctcgccgggctcagag

SEQ ID NO: 238932 - DNA, 20 bp, human
gttactgagcgccgcctcgc

SEQ ID NO: 238933 - DNA, 20 bp, human
gagccgcacaatgaggggtg

SEQ ID NO: 238934 - DNA, 20 bp, human
gcgccgccgcctcgctcgct

SEQ ID NO: 238935 - DNA, 20 bp, human
ggcgcgcagcgcgagcccat

SEQ ID NO: 238936 - DNA, 20 bp, human
gccggggccgcgagacagaa

SEQ ID NO: 238937 - DNA, 20 bp, human
ggggctcgcgctctgaggtc

SEQ ID NO: 238938 - DNA, 20 bp, human
ggagacagaagggccggcct

SEQ ID NO: 238939 - DNA, 20 bp, human
gccccggctgtccgcgtcct

SEQ ID NO: 238940 - DNA, 20 bp, human
gccaggggtgggtgcgtgtg

SEQ ID NO: 238941 - DNA, 20 bp, human
ggcgcagggccctacggagg

SEQ ID NO: 238942 - DNA, 20 bp, human
gggcacgcctggtccccagc

SEQ ID NO: 238943 - DNA, 20 bp, human
gtccgtagggccctgcgcca

SEQ ID NO: 238944 - DNA, 20 bp, human
gaccaccgcgtcgccccccc

SEQ ID NO: 238945 - DNA, 20 bp, human
ggggggcgacgcggtggtag

SEQ ID NO: 238946 - DNA, 20 bp, human
gactgagtatgcagtaaccg

SEQ ID NO: 238947 - DNA, 20 bp, human
gagtatgcagtaaccggggg

SEQ ID NO: 238948 - DNA, 20 bp, human
ggacacaagttccacgcgtt

SEQ ID NO: 238949 - DNA, 20 bp, human
gttgtgtcgacatccacccc

SEQ ID NO: 238950 - DNA, 20 bp, human
gcaaacgtgaacacactttg

SEQ ID NO: 238951 - DNA, 20 bp, human
gagtgtttacaattgttgtc

SEQ ID NO: 238952 - DNA, 20 bp, human
ggtttgagagcgggaaatcc

SEQ ID NO: 238953 - DNA, 20 bp, human
gtaaacactcgcgccgggcg

SEQ ID NO: 238954 - DNA, 20 bp, human
gcaattgtaaacactcgcgc

SEQ ID NO: 238955 - DNA, 20 bp, human
gagtgtttactcctaacgcg

SEQ ID NO: 238956 - DNA, 20 bp, human
ggcagctcctagtaggtggt

SEQ ID NO: 238957 - DNA, 20 bp, human
gctggtggggtcgcacgtaa

SEQ ID NO: 238958 - DNA, 20 bp, human
gaccccaccaggactgagtg

SEQ ID NO: 238959 - DNA, 20 bp, human
ggtccccactcagtcctggt

SEQ ID NO: 238960 - DNA, 20 bp, human
gagggccactcgcgtgtctc

SEQ ID NO: 238961 - DNA, 20 bp, human
gtaggcccctggggcattgg

SEQ ID NO: 238962 - DNA, 20 bp, human
gccactcgcgtgtctctggg

SEQ ID NO: 238963 - DNA, 20 bp, human
gtaggacctccaatgcccca

SEQ ID NO: 238964 - DNA, 20 bp, human
ggggtcgcgcaagactttcg

SEQ ID NO: 238965 - DNA, 20 bp, human
gtcctaccgcagctcctagt

SEQ ID NO: 238966 - DNA, 20 bp, human
ggggaggagcgcgaggtgct

SEQ ID NO: 238967 - DNA, 20 bp, human
gtgaccacagggaacctctc

SEQ ID NO: 238968 - DNA, 20 bp, human
gccaagagtaagacaggaaa

SEQ ID NO: 238969 - DNA, 20 bp, human
ggagggccgaggttaaggga

SEQ ID NO: 238970 - DNA, 20 bp, human
ggaaaggagggccgaggtta

SEQ ID NO: 238971 - DNA, 20 bp, human
gaggaggtcccgctttatct

SEQ ID NO: 238972 - DNA, 20 bp, human
ggacagggtggggtcaaagc

SEQ ID NO: 238973 - DNA, 20 bp, human
gatgacggggtcaacctcgt

SEQ ID NO: 238974 - DNA, 20 bp, human
ggtcggggaggtcagcacaa

SEQ ID NO: 238975 - DNA, 20 bp, human
gcagggaaagaggaacctag

SEQ ID NO: 238976 - DNA, 20 bp, human
ggctggcgggggtgcgtagt

SEQ ID NO: 238977 - DNA, 20 bp, human
gttaacctgggcagtgaagg

SEQ ID NO: 238978 - DNA, 20 bp, human
ggtgctgggcggtaaggaca

SEQ ID NO: 238979 - DNA, 20 bp, human
gagcactcggcttttaacct

SEQ ID NO: 238980 - DNA, 20 bp, human
gagtcagaatcgggaaaggg

SEQ ID NO: 238981 - DNA, 20 bp, human
gaaagccgctagagcaaatt

SEQ ID NO: 238982 - DNA, 20 bp, human
ggggagtcagaatcgggaaa

SEQ ID NO: 238983 - DNA, 20 bp, human
ggtggtgtgcggagtagggg

SEQ ID NO: 238984 - DNA, 20 bp, human
gaggggtggtgtgcggagta

SEQ ID NO: 238985 - DNA, 20 bp, human
gtgtcgcccacctgcgggat

SEQ ID NO: 238986 - DNA, 20 bp, human
gccaaacaaaaatgacctaa

SEQ ID NO: 238987 - DNA, 20 bp, human
ggatcccagggcttagatgc

SEQ ID NO: 238988 - DNA, 20 bp, human
gtccacctgcatctaagccc

SEQ ID NO: 238989 - DNA, 20 bp, human
gtcaggtgatggtgacgaca

SEQ ID NO: 238990 - DNA, 20 bp, human
gcgtcaccatcacctgaaaa

SEQ ID NO: 238991 - DNA, 20 bp, human
gactctgctggtataaaagc

SEQ ID NO: 238992 - DNA, 20 bp, human
gcagcgtactctcttttcat

SEQ ID NO: 238993 - DNA, 20 bp, human
ggaatttcctgttgatccca

SEQ ID NO: 238994 - DNA, 20 bp, human
gcccagggcttagatgcagg

SEQ ID NO: 238995 - DNA, 20 bp, human
ggcaggtggaaacactctgc

SEQ ID NO: 238996 - DNA, 20 bp, human
gtacagttaatgtgagaaat

SEQ ID NO: 238997 - DNA, 20 bp, human
gcatggttttagtatatgtt

SEQ ID NO: 238998 - DNA, 20 bp, human
ggacattgaggcttcttaac

SEQ ID NO: 238999 - DNA, 20 bp, human
gtatgttgggagctaaaagc

SEQ ID NO: 239000 - DNA, 20 bp, human
ggttatctatctctttccta

SEQ ID NO: 239001 - DNA, 20 bp, human
gtcacattaactgtagaaat

SEQ ID NO: 239002 - DNA, 20 bp, human
gtactggttgttgttatgac

SEQ ID NO: 239003 - DNA, 20 bp, human
gatagtaatgttgaaactac

SEQ ID NO: 239004 - DNA, 20 bp, human
gatatacaatcatttgatgg

SEQ ID NO: 239005 - DNA, 20 bp, human
gttgggagctaaaagcaggg

SEQ ID NO: 239006 - DNA, 20 bp, human
gggctctcaaggctaggcga

SEQ ID NO: 239007 - DNA, 20 bp, human
gaggctaggcgagggtgtga

SEQ ID NO: 239008 - DNA, 20 bp, human
ggggatgagcctcttgtgat

SEQ ID NO: 239009 - DNA, 20 bp, human
ggccgattgagcctgccctc

SEQ ID NO: 239010 - DNA, 20 bp, human
gaaaggatgggcccgacaac

SEQ ID NO: 239011 - DNA, 20 bp, human
gcctagccttgagagcccga

SEQ ID NO: 239012 - DNA, 20 bp, human
gtgtgagggactggagttcg

SEQ ID NO: 239013 - DNA, 20 bp, human
ggcccgagggcaggctcaat

SEQ ID NO: 239014 - DNA, 20 bp, human
gccacaatggctccggttgt

SEQ ID NO: 239015 - DNA, 20 bp, human
ggcctgccctcgggctctca

SEQ ID NO: 239016 - DNA, 20 bp, human
gggctctcaaggctaggcga

SEQ ID NO: 239017 - DNA, 20 bp, human
gaggctaggcgagggtgtga

SEQ ID NO: 239018 - DNA, 20 bp, human
ggggatgagcctcttgtgat

SEQ ID NO: 239019 - DNA, 20 bp, human
ggccgattgagcctgccctc

SEQ ID NO: 239020 - DNA, 20 bp, human
gaaaggatgggcccgacaac

SEQ ID NO: 239021 - DNA, 20 bp, human
gcctagccttgagagcccga

SEQ ID NO: 239022 - DNA, 20 bp, human
gtgtgagggactggagttcg

SEQ ID NO: 239023 - DNA, 20 bp, human
ggcccgagggcaggctcaat

SEQ ID NO: 239024 - DNA, 20 bp, human
gccacaatggctccggttgt

SEQ ID NO: 239025 - DNA, 20 bp, human
ggcctgccctcgggctctca

SEQ ID NO: 239026 - DNA, 20 bp, human
gggtcggagccacaatagct

SEQ ID NO: 239027 - DNA, 20 bp, human
gtgatggagccaatcaggag

SEQ ID NO: 239028 - DNA, 20 bp, human
gggggtgagcctctcctgat

SEQ ID NO: 239029 - DNA, 20 bp, human
gccacaatagctcggggtgt

SEQ ID NO: 239030 - DNA, 20 bp, human
gaccggttgcgcgtgccctc

SEQ ID NO: 239031 - DNA, 20 bp, human
gcaaccaatgtggacccggt

SEQ ID NO: 239032 - DNA, 20 bp, human
gcagggtgatggagccaatc

SEQ ID NO: 239033 - DNA, 20 bp, human
gtgccctcgggccctcaggg

SEQ ID NO: 239034 - DNA, 20 bp, human
gaggccaaccgggtccacat

SEQ ID NO: 239035 - DNA, 20 bp, human
ggcgtgccctcgggccctca

SEQ ID NO: 239036 - DNA, 20 bp, human
gcacagggggagtttaagca

SEQ ID NO: 239037 - DNA, 20 bp, human
gataatgagctaccgatcac

SEQ ID NO: 239038 - DNA, 20 bp, human
gatgagctaccgatcacagg

SEQ ID NO: 239039 - DNA, 20 bp, human
gcttaaactccccctgtgat

SEQ ID NO: 239040 - DNA, 20 bp, human
gcacggggccgaagcctcag

SEQ ID NO: 239041 - DNA, 20 bp, human
gcccagatgccccccaacga

SEQ ID NO: 239042 - DNA, 20 bp, human
gtggcagcacagtcacgggg

SEQ ID NO: 239043 - DNA, 20 bp, human
gtagggtataggttggcaca

SEQ ID NO: 239044 - DNA, 20 bp, human
ggcacagttcagccctgggt

SEQ ID NO: 239045 - DNA, 20 bp, human
gggctgaatccctcgttggg

SEQ ID NO: 239046 - DNA, 20 bp, human
ggggactcctgtgaccaagg

SEQ ID NO: 239047 - DNA, 20 bp, human
ggactcctgggtctgaaggg

SEQ ID NO: 239048 - DNA, 20 bp, human
gcactcgcgtgccgggacct

SEQ ID NO: 239049 - DNA, 20 bp, human
gaggtggtggggggaactgt

SEQ ID NO: 239050 - DNA, 20 bp, human
gaggcctggctcgttcaacg

SEQ ID NO: 239051 - DNA, 20 bp, human
gggctggggtcgcaagtcct

SEQ ID NO: 239052 - DNA, 20 bp, human
gagtgcaaggcaggatcccc

SEQ ID NO: 239053 - DNA, 20 bp, human
gcggccgcgttgaacgagcc

SEQ ID NO: 239054 - DNA, 20 bp, human
ggtcccggcacgcgagtgca

SEQ ID NO: 239055 - DNA, 20 bp, human
gcggcacgcgagtgcaaggc

SEQ ID NO: 239056 - DNA, 20 bp, human
gcgcgcgcccccaaatacgt

SEQ ID NO: 239057 - DNA, 20 bp, human
gccggcgctggcgagaccag

SEQ ID NO: 239058 - DNA, 20 bp, human
ggtggtccgagagttgtgag

SEQ ID NO: 239059 - DNA, 20 bp, human
gtggggagcgccggagtctg

SEQ ID NO: 239060 - DNA, 20 bp, human
gtggggcccgacgtatttgg

SEQ ID NO: 239061 - DNA, 20 bp, human
gggagcgccggagtctgcgg

SEQ ID NO: 239062 - DNA, 20 bp, human
gaaaggatctggggcgggat

SEQ ID NO: 239063 - DNA, 20 bp, human
ggcgagaccagcggagctcc

SEQ ID NO: 239064 - DNA, 20 bp, human
gggctggggcccgacgtatt

SEQ ID NO: 239065 - DNA, 20 bp, human
gtacacttgctctcccggcc

SEQ ID NO: 239066 - DNA, 20 bp, human
gggctctcaaggctaggcga

SEQ ID NO: 239067 - DNA, 20 bp, human
gaggctaggcgagggtgtga

SEQ ID NO: 239068 - DNA, 20 bp, human
ggggatgagcctcttgtgat

SEQ ID NO: 239069 - DNA, 20 bp, human
ggccgattgagcctgccctc

SEQ ID NO: 239070 - DNA, 20 bp, human
gaaaggatgggcccgacaac

SEQ ID NO: 239071 - DNA, 20 bp, human
gcctagccttgagagcccga

SEQ ID NO: 239072 - DNA, 20 bp, human
gtgtgagggactggagttcg

SEQ ID NO: 239073 - DNA, 20 bp, human
ggcccgagggcaggctcaat

SEQ ID NO: 239074 - DNA, 20 bp, human
gccacaatggctccggttgt

SEQ ID NO: 239075 - DNA, 20 bp, human
ggcctgccctcgggctctca

SEQ ID NO: 239076 - DNA, 20 bp, human
ggcacggcgggccatgtctc

SEQ ID NO: 239077 - DNA, 20 bp, human
gcgctggaggcgacttgggg

SEQ ID NO: 239078 - DNA, 20 bp, human
gcgggcggaagcggtcgagc

SEQ ID NO: 239079 - DNA, 20 bp, human
gcgcctccagcgggcggaag

SEQ ID NO: 239080 - DNA, 20 bp, human
gcgcccgctggaggcgactt

SEQ ID NO: 239081 - DNA, 20 bp, human
ggctgtaagccggggctagt

SEQ ID NO: 239082 - DNA, 20 bp, human
gcgggccatgtctccggctc

SEQ ID NO: 239083 - DNA, 20 bp, human
gggcaggctcccactagccc

SEQ ID NO: 239084 - DNA, 20 bp, human
gcggcctgagcgggagttct

SEQ ID NO: 239085 - DNA, 20 bp, human
ggcaccgagaactcccgctc

SEQ ID NO: 239086 - DNA, 20 bp, human
gccctgtccggctagggagg

SEQ ID NO: 239087 - DNA, 20 bp, human
gcccgcctttccactactat

SEQ ID NO: 239088 - DNA, 20 bp, human
gttcaccaatagtagtggaa

SEQ ID NO: 239089 - DNA, 20 bp, human
gagaggcccctgtccggcta

SEQ ID NO: 239090 - DNA, 20 bp, human
gccacgcccccagtttttat

SEQ ID NO: 239091 - DNA, 20 bp, human
gaccaatagtagtggaaagg

SEQ ID NO: 239092 - DNA, 20 bp, human
ggaagtagagcccagccgag

SEQ ID NO: 239093 - DNA, 20 bp, human
gttagcctaggcatctacgg

SEQ ID NO: 239094 - DNA, 20 bp, human
gccctcctccctagccggac

SEQ ID NO: 239095 - DNA, 20 bp, human
gctggcagcggcaactgcgg

SEQ ID NO: 239096 - DNA, 20 bp, human
gaatactggaggcccttcga

SEQ ID NO: 239097 - DNA, 20 bp, human
gtcccccccagtcccgggga

SEQ ID NO: 239098 - DNA, 20 bp, human
gtcccggggatggagatgtc

SEQ ID NO: 239099 - DNA, 20 bp, human
gcgacggagaacaacaagaa

SEQ ID NO: 239100 - DNA, 20 bp, human
gctccatccccgggactggg

SEQ ID NO: 239101 - DNA, 20 bp, human
ggcgggcccagtgggccgta

SEQ ID NO: 239102 - DNA, 20 bp, human
ggactgggggggaaagacaa

SEQ ID NO: 239103 - DNA, 20 bp, human
gtaggcgtgaggccggggaa

SEQ ID NO: 239104 - DNA, 20 bp, human
gacaacaagaaaggcacttc

SEQ ID NO: 239105 - DNA, 20 bp, human
gggcaacaatgtcgccccta

SEQ ID NO: 239106 - DNA, 20 bp, human
gtgacctggcccgcccttcg

SEQ ID NO: 239107 - DNA, 20 bp, human
gcggaggccccgccccctac

SEQ ID NO: 239108 - DNA, 20 bp, human
gcaaccggagcggggaaagg

SEQ ID NO: 239109 - DNA, 20 bp, human
gggaagcggaccaaccggag

SEQ ID NO: 239110 - DNA, 20 bp, human
ggggcctccggtgcggggac

SEQ ID NO: 239111 - DNA, 20 bp, human
ggaccaaccggagcggggaa

SEQ ID NO: 239112 - DNA, 20 bp, human
gaaggcggggcgggcactga

SEQ ID NO: 239113 - DNA, 20 bp, human
ggggcactgacggcccgcgg

SEQ ID NO: 239114 - DNA, 20 bp, human
gccggggtctccagccgcga

SEQ ID NO: 239115 - DNA, 20 bp, human
ggaccgccggccaagatccc

SEQ ID NO: 239116 - DNA, 20 bp, human
ggggccgcgggcggattgaa

SEQ ID NO: 239117 - DNA, 20 bp, human
gcgagagcgcgaaataggga

SEQ ID NO: 239118 - DNA, 20 bp, human
gcgcgggcggattgaaggga

SEQ ID NO: 239119 - DNA, 20 bp, human
gccgggcccagcggagccga

SEQ ID NO: 239120 - DNA, 20 bp, human
gcgtcgggacgaacctaccc

SEQ ID NO: 239121 - DNA, 20 bp, human
gggctcgctcggcctcccgg

SEQ ID NO: 239122 - DNA, 20 bp, human
ggcccagcggagccgagggc

SEQ ID NO: 239123 - DNA, 20 bp, human
ggcggattgaagggagggtt

SEQ ID NO: 239124 - DNA, 20 bp, human
gggcccgccggcagccccgg

SEQ ID NO: 239125 - DNA, 20 bp, human
gggggaggtggaaggacgaa

SEQ ID NO: 239126 - DNA, 20 bp, human
ggagagaccaagagacagtg

SEQ ID NO: 239127 - DNA, 20 bp, human
gaggaatttgtgacacggta

SEQ ID NO: 239128 - DNA, 20 bp, human
gaacttactgttagcatgtg

SEQ ID NO: 239129 - DNA, 20 bp, human
gtttaactgtgctcatgctt

SEQ ID NO: 239130 - DNA, 20 bp, human
gtagcatgtgcggttgtgac

SEQ ID NO: 239131 - DNA, 20 bp, human
gacatacatctgggtccctc

SEQ ID NO: 239132 - DNA, 20 bp, human
ggcgcactcacgagcacacg

SEQ ID NO: 239133 - DNA, 20 bp, human
gccagatgtatgtgacaaaa

SEQ ID NO: 239134 - DNA, 20 bp, human
gtgcatccgtgtgatagtgt

SEQ ID NO: 239135 - DNA, 20 bp, human
gatgtgtggctctgtgtatg

SEQ ID NO: 239136 - DNA, 20 bp, human
gggagctggcgtgccaatca

SEQ ID NO: 239137 - DNA, 20 bp, human
gccagctcccgctgtccgcg

SEQ ID NO: 239138 - DNA, 20 bp, human
ggggcgtggcgtgtccggca

SEQ ID NO: 239139 - DNA, 20 bp, human
gtaccaatcctgggagtcgg

SEQ ID NO: 239140 - DNA, 20 bp, human
gcgcccccgactcccaggat

SEQ ID NO: 239141 - DNA, 20 bp, human
gcccgctgggtaccaatcct

SEQ ID NO: 239142 - DNA, 20 bp, human
ggggtaccaatcctgggagt

SEQ ID NO: 239143 - DNA, 20 bp, human
ggtagccaatagctcgggac

SEQ ID NO: 239144 - DNA, 20 bp, human
gtctcatgagctagacttta

SEQ ID NO: 239145 - DNA, 20 bp, human
gcgctcccgtcccgagctat

SEQ ID NO: 239146 - DNA, 20 bp, human
gtacacgcatatctaaaagc

SEQ ID NO: 239147 - DNA, 20 bp, human
gagtcctgtgaaaagtcgat

SEQ ID NO: 239148 - DNA, 20 bp, human
gtctaaaagccggtaagatg

SEQ ID NO: 239149 - DNA, 20 bp, human
gtagatatgcgtgtatgcag

SEQ ID NO: 239150 - DNA, 20 bp, human
gcagctgacatcactcgggg

SEQ ID NO: 239151 - DNA, 20 bp, human
gaatgaagggccactctgcc

SEQ ID NO: 239152 - DNA, 20 bp, human
gagcacatttacagcaatga

SEQ ID NO: 239153 - DNA, 20 bp, human
gaaggcagctgacatcactc

SEQ ID NO: 239154 - DNA, 20 bp, human
gcgacttttcacaggactca

SEQ ID NO: 239155 - DNA, 20 bp, human
gtattcaagcttcgcatcgc

SEQ ID NO: 239156 - DNA, 20 bp, human
gaggagtgatgcaacggcag

SEQ ID NO: 239157 - DNA, 20 bp, human
ggccaggtttgccacagagg

SEQ ID NO: 239158 - DNA, 20 bp, human
gagtgatgcaacggcagggg

SEQ ID NO: 239159 - DNA, 20 bp, human
ggggtcccacacctggtccg

SEQ ID NO: 239160 - DNA, 20 bp, human
gcagcgccggcatgcagcaa

SEQ ID NO: 239161 - DNA, 20 bp, human
gtgccccaccccaatcaccg

SEQ ID NO: 239162 - DNA, 20 bp, human
gctgccgcggtgattggggt

SEQ ID NO: 239163 - DNA, 20 bp, human
gggcccaggtcatgaggggg

SEQ ID NO: 239164 - DNA, 20 bp, human
ggccagctgccgcggtgatt

SEQ ID NO: 239165 - DNA, 20 bp, human
ggggttctgcagagactgcg

SEQ ID NO: 239166 - DNA, 20 bp, human
gcgggcactaaaggtaggtt

SEQ ID NO: 239167 - DNA, 20 bp, human
ggcacacgggcactaaaggt

SEQ ID NO: 239168 - DNA, 20 bp, human
gcactcgtgtccagatacgg

SEQ ID NO: 239169 - DNA, 20 bp, human
gtaccggaggcttcagtccc

SEQ ID NO: 239170 - DNA, 20 bp, human
gcggccggttactcgcttac

SEQ ID NO: 239171 - DNA, 20 bp, human
ggaactgggcttatttctaa

SEQ ID NO: 239172 - DNA, 20 bp, human
ggtcaagaggcattgacctt

SEQ ID NO: 239173 - DNA, 20 bp, human
gcctcttgacaccctaatca

SEQ ID NO: 239174 - DNA, 20 bp, human
gggtacaccgcctccgtatc

SEQ ID NO: 239175 - DNA, 20 bp, human
gcgcaggcgcgatggccact

SEQ ID NO: 239176 - DNA, 20 bp, human
gccccctcatgcacggtagc

SEQ ID NO: 239177 - DNA, 20 bp, human
ggccggctaccgtgcatgag

SEQ ID NO: 239178 - DNA, 20 bp, human
gccccgccctccacggggaa

SEQ ID NO: 239179 - DNA, 20 bp, human
gccgcccccttccccgtgga

SEQ ID NO: 239180 - DNA, 20 bp, human
gctcagggctcggggctcgg

SEQ ID NO: 239181 - DNA, 20 bp, human
ggcggggccgttcccccagc

SEQ ID NO: 239182 - DNA, 20 bp, human
ggagcaccataggagagcgg

SEQ ID NO: 239183 - DNA, 20 bp, human
ggcacccggccgagcgtgtg

SEQ ID NO: 239184 - DNA, 20 bp, human
gaagccccgggaaaggcggt

SEQ ID NO: 239185 - DNA, 20 bp, human
gtcctcccgcctcgcatcca

SEQ ID NO: 239186 - DNA, 20 bp, human
ggggcctcagtcctcggctg

SEQ ID NO: 239187 - DNA, 20 bp, human
gcccaggctgaggtgaagaa

SEQ ID NO: 239188 - DNA, 20 bp, human
gaggccccggcctgaatcct

SEQ ID NO: 239189 - DNA, 20 bp, human
ggctggtgccccctccctgt

SEQ ID NO: 239190 - DNA, 20 bp, human
gagctgggacagggctgaat

SEQ ID NO: 239191 - DNA, 20 bp, human
gggccagcccgacagggagg

SEQ ID NO: 239192 - DNA, 20 bp, human
gctgccccagccgaggactg

SEQ ID NO: 239193 - DNA, 20 bp, human
ggctgaatgggaggcattgt

SEQ ID NO: 239194 - DNA, 20 bp, human
gtccctgtcgggctggccca

SEQ ID NO: 239195 - DNA, 20 bp, human
ggcccaggactgctgactcc

SEQ ID NO: 239196 - DNA, 20 bp, human
gcccctcggaggcctgtcat

SEQ ID NO: 239197 - DNA, 20 bp, human
gtcaatgggcgagccctggg

SEQ ID NO: 239198 - DNA, 20 bp, human
gccctcgcggatatgtcaat

SEQ ID NO: 239199 - DNA, 20 bp, human
gggactgggcttcccctcgg

SEQ ID NO: 239200 - DNA, 20 bp, human
gtgggatagtccctaagagg

SEQ ID NO: 239201 - DNA, 20 bp, human
ggcgtgggatagtccctaag

SEQ ID NO: 239202 - DNA, 20 bp, human
ggggcgagccctgggaggaa

SEQ ID NO: 239203 - DNA, 20 bp, human
gtcacgtgacggcccgcctc

SEQ ID NO: 239204 - DNA, 20 bp, human
ggacatatccgcgagggact

SEQ ID NO: 239205 - DNA, 20 bp, human
gggaggagctgccctgcgat

SEQ ID NO: 239206 - DNA, 20 bp, human
gccgacgtgggcggtacccc

SEQ ID NO: 239207 - DNA, 20 bp, human
gaggtcccgcccgacgtggg

SEQ ID NO: 239208 - DNA, 20 bp, human
gcacgtcgggcgggacctga

SEQ ID NO: 239209 - DNA, 20 bp, human
gcgcccactcatagacgcca

SEQ ID NO: 239210 - DNA, 20 bp, human
ggaggggcggggcgtctatg

SEQ ID NO: 239211 - DNA, 20 bp, human
gcggccgggattccgacccc

SEQ ID NO: 239212 - DNA, 20 bp, human
gcgccttggcgtctatgagt

SEQ ID NO: 239213 - DNA, 20 bp, human
ggggacctgagggccgctgg

SEQ ID NO: 239214 - DNA, 20 bp, human
ggccaaggcgagtcctgctc

SEQ ID NO: 239215 - DNA, 20 bp, human
gtctgtctaacacacagccc

SEQ ID NO: 239216 - DNA, 20 bp, human
gctcgcgcgggccttcggaa

SEQ ID NO: 239217 - DNA, 20 bp, human
gggcacgtgcggcacttccg

SEQ ID NO: 239218 - DNA, 20 bp, human
gcaggccggggccgttccaa

SEQ ID NO: 239219 - DNA, 20 bp, human
gagtgcgtgggcaaaactag

SEQ ID NO: 239220 - DNA, 20 bp, human
ggggcacgcagcccttccga

SEQ ID NO: 239221 - DNA, 20 bp, human
gcggctgtgccaaaagtgcg

SEQ ID NO: 239222 - DNA, 20 bp, human
gagacgcggcggaaccctcc

SEQ ID NO: 239223 - DNA, 20 bp, human
gggctgacgggaagcaagtt

SEQ ID NO: 239224 - DNA, 20 bp, human
gcaggcccttggaacggccc

SEQ ID NO: 239225 - DNA, 20 bp, human
ggaggcggggtgatgagaaa

SEQ ID NO: 239226 - DNA, 20 bp, human
ggggacccgggcgacgtcgg

SEQ ID NO: 239227 - DNA, 20 bp, human
ggtccccgcggccacccgac

SEQ ID NO: 239228 - DNA, 20 bp, human
gctgaggacagcgaagaaga

SEQ ID NO: 239229 - DNA, 20 bp, human
gtacccggagcgcttcccgg

SEQ ID NO: 239230 - DNA, 20 bp, human
gagggcctccgacgtcgccc

SEQ ID NO: 239231 - DNA, 20 bp, human
ggagctgagatccctgggcg

SEQ ID NO: 239232 - DNA, 20 bp, human
gttcctccgggaagcgctcc

SEQ ID NO: 239233 - DNA, 20 bp, human
ggcagcctgggttcccggca

SEQ ID NO: 239234 - DNA, 20 bp, human
ggaggccctgccgggaaccc

SEQ ID NO: 239235 - DNA, 20 bp, human
gccggcccccagaatctacc

SEQ ID NO: 239236 - DNA, 20 bp, human
ggcgctaggcctggaaaaga

SEQ ID NO: 239237 - DNA, 20 bp, human
gggaaaagagggtctatcct

SEQ ID NO: 239238 - DNA, 20 bp, human
gcatccccgggctctgcgct

SEQ ID NO: 239239 - DNA, 20 bp, human
gtcccccgggcggcatcccc

SEQ ID NO: 239240 - DNA, 20 bp, human
gagcccggggatgccgcccg

SEQ ID NO: 239241 - DNA, 20 bp, human
gaaggaagcaaacccaacaa

SEQ ID NO: 239242 - DNA, 20 bp, human
gagggtctatcctgggctga

SEQ ID NO: 239243 - DNA, 20 bp, human
ggtgtggggcgtgtcctcaa

SEQ ID NO: 239244 - DNA, 20 bp, human
ggcagaggggagggtgaact

SEQ ID NO: 239245 - DNA, 20 bp, human
gctagctggagcgggtcctc

SEQ ID NO: 239246 - DNA, 20 bp, human
ggagctcggggaaggctcgt

SEQ ID NO: 239247 - DNA, 20 bp, human
gtgacctcgcgtgaccccta

SEQ ID NO: 239248 - DNA, 20 bp, human
gtcggcgcggagctcgggga

SEQ ID NO: 239249 - DNA, 20 bp, human
ggtactgcccccagacttcg

SEQ ID NO: 239250 - DNA, 20 bp, human
gtggtagccggcttggtcta

SEQ ID NO: 239251 - DNA, 20 bp, human
ggccggggacatgcaggaaa

SEQ ID NO: 239252 - DNA, 20 bp, human
gccgattcgtccagcccgta

SEQ ID NO: 239253 - DNA, 20 bp, human
gcgacgctgggttcgaacag

SEQ ID NO: 239254 - DNA, 20 bp, human
gctccgggccccgaagtctg

SEQ ID NO: 239255 - DNA, 20 bp, human
gtctaggggcgattggcata

SEQ ID NO: 239256 - DNA, 20 bp, human
gctggaagggagatgtccgg

SEQ ID NO: 239257 - DNA, 20 bp, human
gagggcagggagcggagttg

SEQ ID NO: 239258 - DNA, 20 bp, human
gagcgccgagggcttaagga

SEQ ID NO: 239259 - DNA, 20 bp, human
gggccccgccttttttgcgc

SEQ ID NO: 239260 - DNA, 20 bp, human
ggcagtgccgcctcccgctg

SEQ ID NO: 239261 - DNA, 20 bp, human
gccccctcgtgggagttctg

SEQ ID NO: 239262 - DNA, 20 bp, human
gagaagggggatagggttgg

SEQ ID NO: 239263 - DNA, 20 bp, human
gtcagcagaccctgtctgga

SEQ ID NO: 239264 - DNA, 20 bp, human
gggaacacgcccccagcggg

SEQ ID NO: 239265 - DNA, 20 bp, human
gcagacagccgagtccggga

SEQ ID NO: 239266 - DNA, 20 bp, human
gtgtgagtcactcttaaggt

SEQ ID NO: 239267 - DNA, 20 bp, human
ggctctgatgcgaggaccgg

SEQ ID NO: 239268 - DNA, 20 bp, human
ggaccggaggacaaggttcg

SEQ ID NO: 239269 - DNA, 20 bp, human
gtggaagagcaggacgtcac

SEQ ID NO: 239270 - DNA, 20 bp, human
gttcagggcgttgaccgcga

SEQ ID NO: 239271 - DNA, 20 bp, human
gtaaaacccggaagttcctg

SEQ ID NO: 239272 - DNA, 20 bp, human
ggcggtcaacgccctgaact

SEQ ID NO: 239273 - DNA, 20 bp, human
gagtgctctgatgcgaggac

SEQ ID NO: 239274 - DNA, 20 bp, human
ggcgttgaccgcgaaggacg

SEQ ID NO: 239275 - DNA, 20 bp, human
gcgacaggccagctgcccta

SEQ ID NO: 239276 - DNA, 20 bp, human
ggggaactgtggtctcgatc

SEQ ID NO: 239277 - DNA, 20 bp, human
ggggtcgggtgaaccaatcc

SEQ ID NO: 239278 - DNA, 20 bp, human
ggggcgccctcgccgaacag

SEQ ID NO: 239279 - DNA, 20 bp, human
gtcacccgacccggatgcta

SEQ ID NO: 239280 - DNA, 20 bp, human
gcgccctcgccgaacagagg

SEQ ID NO: 239281 - DNA, 20 bp, human
ggcccgcctctgttcggcga

SEQ ID NO: 239282 - DNA, 20 bp, human
gtcggcgagggcgcccggat

SEQ ID NO: 239283 - DNA, 20 bp, human
gatctggcgcggtgggtgat

SEQ ID NO: 239284 - DNA, 20 bp, human
gcacctgttgccatagcatc

SEQ ID NO: 239285 - DNA, 20 bp, human
gtggtctcgatctggcgcgg

SEQ ID NO: 239286 - DNA, 20 bp, human
gtgcgcgcggcgagacgtcc

SEQ ID NO: 239287 - DNA, 20 bp, human
gagacgtcctggaaactata

SEQ ID NO: 239288 - DNA, 20 bp, human
gcgctcctcgacagctctcc

SEQ ID NO: 239289 - DNA, 20 bp, human
gaaaatccgcgtggactcca

SEQ ID NO: 239290 - DNA, 20 bp, human
gtcctggaaactatacggtc

SEQ ID NO: 239291 - DNA, 20 bp, human
gagcgagccgggtcccacca

SEQ ID NO: 239292 - DNA, 20 bp, human
ggtgcgcaggcgcatcaatg

SEQ ID NO: 239293 - DNA, 20 bp, human
gcgctgttcagctaggaagt

SEQ ID NO: 239294 - DNA, 20 bp, human
gcagaaacactgggcacagg

SEQ ID NO: 239295 - DNA, 20 bp, human
gactgcctggagagctgtcg

SEQ ID NO: 239296 - DNA, 20 bp, human
gagggcggaagtggctactc

SEQ ID NO: 239297 - DNA, 20 bp, human
gccggcccggctcgtcatgg

SEQ ID NO: 239298 - DNA, 20 bp, human
gccatggcaagccggaaata

SEQ ID NO: 239299 - DNA, 20 bp, human
ggggcgccgccatgacgagc

SEQ ID NO: 239300 - DNA, 20 bp, human
gccgggccggaagaagaggt

SEQ ID NO: 239301 - DNA, 20 bp, human
gcgagccgggccggaagaag

SEQ ID NO: 239302 - DNA, 20 bp, human
gtaaaccccgagcgctgcca

SEQ ID NO: 239303 - DNA, 20 bp, human
gcaggtgccgcgcaactcag

SEQ ID NO: 239304 - DNA, 20 bp, human
gtaggactaatctgtcacgg

SEQ ID NO: 239305 - DNA, 20 bp, human
ggagttgcgcggcacctgac

SEQ ID NO: 239306 - DNA, 20 bp, human
gccccacccctccagacgga

SEQ ID NO: 239307 - DNA, 20 bp, human
gcgactcagcgccacccgat

SEQ ID NO: 239308 - DNA, 20 bp, human
gtgaggccgaagatgtgtac

SEQ ID NO: 239309 - DNA, 20 bp, human
gagccaagggtgatgttctg

SEQ ID NO: 239310 - DNA, 20 bp, human
ggcagtccttccgtctggag

SEQ ID NO: 239311 - DNA, 20 bp, human
gaaggactgcaatccccaca

SEQ ID NO: 239312 - DNA, 20 bp, human
gcagcctaacgcactctagc

SEQ ID NO: 239313 - DNA, 20 bp, human
gggcctcagaacatcaccct

SEQ ID NO: 239314 - DNA, 20 bp, human
gaacacgtgtagagcagcac

SEQ ID NO: 239315 - DNA, 20 bp, human
gctgagtcgcggtgccttgt

SEQ ID NO: 239316 - DNA, 20 bp, human
gcccccgcctggcgaaagga

SEQ ID NO: 239317 - DNA, 20 bp, human
gcccgcccccgcctggcgaa

SEQ ID NO: 239318 - DNA, 20 bp, human
gcgaggcccgaccgcccctg

SEQ ID NO: 239319 - DNA, 20 bp, human
gcgaccgcccctgcggccca

SEQ ID NO: 239320 - DNA, 20 bp, human
ggcggctgtcagtctggcgg

SEQ ID NO: 239321 - DNA, 20 bp, human
gccccgcgcggctgtcagtc

SEQ ID NO: 239322 - DNA, 20 bp, human
gtgctgcccccgctccccgg

SEQ ID NO: 239323 - DNA, 20 bp, human
gaacacttcggcttgacggg

SEQ ID NO: 239324 - DNA, 20 bp, human
ggcggcgcgcgccgattggg

SEQ ID NO: 239325 - DNA, 20 bp, human
gggcccgtctcttaacactt

SEQ ID NO: 239326 - DNA, 20 bp, human
gcagctgttaaggaagaagt

SEQ ID NO: 239327 - DNA, 20 bp, human
gaattagactacagctgtta

SEQ ID NO: 239328 - DNA, 20 bp, human
gttcttggtgataggagtga

SEQ ID NO: 239329 - DNA, 20 bp, human
ggactccgttatctactctt

SEQ ID NO: 239330 - DNA, 20 bp, human
gacgctcccatgggaggaac

SEQ ID NO: 239331 - DNA, 20 bp, human
ggtatgaagttcttggtgat

SEQ ID NO: 239332 - DNA, 20 bp, human
ggtcgaataaatgaagtggg

SEQ ID NO: 239333 - DNA, 20 bp, human
gtaaattctagttagcagtc

SEQ ID NO: 239334 - DNA, 20 bp, human
ggttctgaaaacgctcccat

SEQ ID NO: 239335 - DNA, 20 bp, human
ggatttatacgttttagaca

SEQ ID NO: 239336 - DNA, 20 bp, human
ggcggcgcctcgctcatagg

SEQ ID NO: 239337 - DNA, 20 bp, human
gcgcgtcctgccaagatatc

SEQ ID NO: 239338 - DNA, 20 bp, human
gcaagaactgcctgtccgga

SEQ ID NO: 239339 - DNA, 20 bp, human
gccgctccggatatcttggc

SEQ ID NO: 239340 - DNA, 20 bp, human
gtggggcccacctatgagcg

SEQ ID NO: 239341 - DNA, 20 bp, human
gtgagcgaggcgccgccaga

SEQ ID NO: 239342 - DNA, 20 bp, human
gcccccgcgcgttgggaagt

SEQ ID NO: 239343 - DNA, 20 bp, human
ggtcgcccgcccccgcgcgt

SEQ ID NO: 239344 - DNA, 20 bp, human
gggcgggcgactgcgcgctg

SEQ ID NO: 239345 - DNA, 20 bp, human
gttgcagtgcggagcgtgga

SEQ ID NO: 239346 - DNA, 20 bp, human
gcctccagaccaccccaaca

SEQ ID NO: 239347 - DNA, 20 bp, human
ggtccttaggctccctggga

SEQ ID NO: 239348 - DNA, 20 bp, human
ggagacagatcctccatccc

SEQ ID NO: 239349 - DNA, 20 bp, human
gctcccccctccccctgttg

SEQ ID NO: 239350 - DNA, 20 bp, human
gcttaggctccctgggatgg

SEQ ID NO: 239351 - DNA, 20 bp, human
gagggcttcttaaccccctc

SEQ ID NO: 239352 - DNA, 20 bp, human
gtccccctgttggggtggtc

SEQ ID NO: 239353 - DNA, 20 bp, human
gccaccccaacagggggagg

SEQ ID NO: 239354 - DNA, 20 bp, human
gggtacatcacctgagttgt

SEQ ID NO: 239355 - DNA, 20 bp, human
gtgtagagagtgtcaatcaa

SEQ ID NO: 239356 - DNA, 20 bp, human
ggaagaagttgttgttggga

SEQ ID NO: 239357 - DNA, 20 bp, human
ggtgaggccgctcccggata

SEQ ID NO: 239358 - DNA, 20 bp, human
ggaatggaagaagttgttgt

SEQ ID NO: 239359 - DNA, 20 bp, human
gaggggatgcaggaagctcg

SEQ ID NO: 239360 - DNA, 20 bp, human
gccgcctccttcgtgcggat

SEQ ID NO: 239361 - DNA, 20 bp, human
gcggcctcacgcacgttagc

SEQ ID NO: 239362 - DNA, 20 bp, human
gccgcacgaaggaggcggaa

SEQ ID NO: 239363 - DNA, 20 bp, human
gcgcgtgcgcgttggccccc

SEQ ID NO: 239364 - DNA, 20 bp, human
gacgccagctaacgtgcgtg

SEQ ID NO: 239365 - DNA, 20 bp, human
gcagcctatccgcacgaagg

SEQ ID NO: 239366 - DNA, 20 bp, human
gagggtgggggtttcggagg

SEQ ID NO: 239367 - DNA, 20 bp, human
gccgagggtgggggtttcgg

SEQ ID NO: 239368 - DNA, 20 bp, human
ggggccgccgtctgaggagg

SEQ ID NO: 239369 - DNA, 20 bp, human
gccaccccctccataaagaa

SEQ ID NO: 239370 - DNA, 20 bp, human
gcctcagacggcggccccga

SEQ ID NO: 239371 - DNA, 20 bp, human
gagacggcggccccgagggt

SEQ ID NO: 239372 - DNA, 20 bp, human
gttcggaggggggtggcccg

SEQ ID NO: 239373 - DNA, 20 bp, human
gccacccccaaaaattgtct

SEQ ID NO: 239374 - DNA, 20 bp, human
gtttaaagcaacggagaggg

SEQ ID NO: 239375 - DNA, 20 bp, human
gctccctttctttatggagg

SEQ ID NO: 239376 - DNA, 20 bp, human
ggggttgcccgggagacctg

SEQ ID NO: 239377 - DNA, 20 bp, human
gagggtggcggtagtggaag

SEQ ID NO: 239378 - DNA, 20 bp, human
ggtggcggtagtggaagggg

SEQ ID NO: 239379 - DNA, 20 bp, human
ggggaggagggtggcggtag

SEQ ID NO: 239380 - DNA, 20 bp, human
gtggttgcctgagcgacgag

SEQ ID NO: 239381 - DNA, 20 bp, human
gcctcctccccaggtctccc

SEQ ID NO: 239382 - DNA, 20 bp, human
gccccgccccctcgtcgctc

SEQ ID NO: 239383 - DNA, 20 bp, human
ggcgcgcgcccgctgcgaag

SEQ ID NO: 239384 - DNA, 20 bp, human
gggggtgtccgtgtgtatta

SEQ ID NO: 239385 - DNA, 20 bp, human
gtgcctgagcgacgaggggg

SEQ ID NO: 239386 - DNA, 20 bp, human
gggtccccaccctcacccgg

SEQ ID NO: 239387 - DNA, 20 bp, human
ggtcctgagccgccgggtga

SEQ ID NO: 239388 - DNA, 20 bp, human
gtgagccgccgggtgagggt

SEQ ID NO: 239389 - DNA, 20 bp, human
gtgcggggagcaggctaagg

SEQ ID NO: 239390 - DNA, 20 bp, human
gagaaaggggggtcgagacg

SEQ ID NO: 239391 - DNA, 20 bp, human
gagccggccgagggtggcgg

SEQ ID NO: 239392 - DNA, 20 bp, human
gacagcagagaacaagttgg

SEQ ID NO: 239393 - DNA, 20 bp, human
gaggcggccgagagaaaggg

SEQ ID NO: 239394 - DNA, 20 bp, human
gaggcacggcggcacggcgg

SEQ ID NO: 239395 - DNA, 20 bp, human
gtcgacggctccccctgccg

SEQ ID NO: 239396 - DNA, 20 bp, human
gcggcagccgggatgaccaa

SEQ ID NO: 239397 - DNA, 20 bp, human
ggcttgcaggggcgagtgat

SEQ ID NO: 239398 - DNA, 20 bp, human
gcgcagcggcgtctccaagg

SEQ ID NO: 239399 - DNA, 20 bp, human
gcctgccgctagtcccgggg

SEQ ID NO: 239400 - DNA, 20 bp, human
gtggccctgccgctagtccc

SEQ ID NO: 239401 - DNA, 20 bp, human
ggggaaggcgggcccgagat

SEQ ID NO: 239402 - DNA, 20 bp, human
gcccaatggcgcgacaggga

SEQ ID NO: 239403 - DNA, 20 bp, human
gcctgcaagcaagcttgaaa

SEQ ID NO: 239404 - DNA, 20 bp, human
ggcggcgtctccaaggcggg

SEQ ID NO: 239405 - DNA, 20 bp, human
ggcgggcccgagatgggtta

SEQ ID NO: 239406 - DNA, 20 bp, human
gcgagagaaaaggggcggcg

SEQ ID NO: 239407 - DNA, 20 bp, human
gagcagcgcaccggccggcg

SEQ ID NO: 239408 - DNA, 20 bp, human
gggagaggccgagagaaaag

SEQ ID NO: 239409 - DNA, 20 bp, human
gaattcggccggggtggcgg

SEQ ID NO: 239410 - DNA, 20 bp, human
ggccaggcgcgcctgacgtc

SEQ ID NO: 239411 - DNA, 20 bp, human
gcgcgccgccacctgacgtc

SEQ ID NO: 239412 - DNA, 20 bp, human
gcgcgggccgcgggccgcaa

SEQ ID NO: 239413 - DNA, 20 bp, human
gcgcccgggcgcggactgga

SEQ ID NO: 239414 - DNA, 20 bp, human
gcgcgcctgacgtcaggtgg

SEQ ID NO: 239415 - DNA, 20 bp, human
gggccggtgcgctgctgccg

SEQ ID NO: 239416 - DNA, 20 bp, human
ggagggtggaaggtcctagg

SEQ ID NO: 239417 - DNA, 20 bp, human
gctctgacgactcagttcac

SEQ ID NO: 239418 - DNA, 20 bp, human
gggcgctcacactagctcgc

SEQ ID NO: 239419 - DNA, 20 bp, human
gtagctcgctggaagaggcc

SEQ ID NO: 239420 - DNA, 20 bp, human
gcacactagctcgctggaag

SEQ ID NO: 239421 - DNA, 20 bp, human
gccaggaagtctcttgaggg

SEQ ID NO: 239422 - DNA, 20 bp, human
ggtacccttctcatcctcct

SEQ ID NO: 239423 - DNA, 20 bp, human
gcttgagggtggaaggtcct

SEQ ID NO: 239424 - DNA, 20 bp, human
gcgggcttcggtgctgccat

SEQ ID NO: 239425 - DNA, 20 bp, human
ggaagtctcttgagggtgga

SEQ ID NO: 239426 - DNA, 20 bp, human
gtcgcctcggccctagaaac

SEQ ID NO: 239427 - DNA, 20 bp, human
gtccccctcccccgcaggtt

SEQ ID NO: 239428 - DNA, 20 bp, human
ggaggcctatccggtttcta

SEQ ID NO: 239429 - DNA, 20 bp, human
gtcggccctagaaaccggat

SEQ ID NO: 239430 - DNA, 20 bp, human
gcgcaaagggtgggactata

SEQ ID NO: 239431 - DNA, 20 bp, human
ggcaaaacagcgcaaagggt

SEQ ID NO: 239432 - DNA, 20 bp, human
gctctcaacctaacctgcgg

SEQ ID NO: 239433 - DNA, 20 bp, human
ggcgctctcaacctaacctg

SEQ ID NO: 239434 - DNA, 20 bp, human
ggcgcacggagaggcctatc

SEQ ID NO: 239435 - DNA, 20 bp, human
gtcaacctaacctgcggggg

SEQ ID NO: 239436 - DNA, 20 bp, human
gcaggcgggagcgcagtcca

SEQ ID NO: 239437 - DNA, 20 bp, human
ggggcactgggatctaaact

SEQ ID NO: 239438 - DNA, 20 bp, human
gccagggcttcttcccacgt

SEQ ID NO: 239439 - DNA, 20 bp, human
gccacctagtgggcgcgggg

SEQ ID NO: 239440 - DNA, 20 bp, human
gggaccaccttcacccgctg

SEQ ID NO: 239441 - DNA, 20 bp, human
gctgtggccagatccggcct

SEQ ID NO: 239442 - DNA, 20 bp, human
ggctggaaaaccgcccacgt

SEQ ID NO: 239443 - DNA, 20 bp, human
gagcccggaaaaccggagga

SEQ ID NO: 239444 - DNA, 20 bp, human
gttcacccgctgcggggcac

SEQ ID NO: 239445 - DNA, 20 bp, human
gagcgcaggcgccacctagt

SEQ ID NO: 239446 - DNA, 20 bp, human
ggggccgcgccaggagggaa

SEQ ID NO: 239447 - DNA, 20 bp, human
gggggctggtggggtcgcgc

SEQ ID NO: 239448 - DNA, 20 bp, human
ggaaggggacgctccctctt

SEQ ID NO: 239449 - DNA, 20 bp, human
gcggcccgacccagggcgga

SEQ ID NO: 239450 - DNA, 20 bp, human
gcgcgtcgggctgcctaaga

SEQ ID NO: 239451 - DNA, 20 bp, human
gcggcgcggcggggccatgt

SEQ ID NO: 239452 - DNA, 20 bp, human
gcggcggggccatgttggag

SEQ ID NO: 239453 - DNA, 20 bp, human
gagcggcactccggcagcac

SEQ ID NO: 239454 - DNA, 20 bp, human
ggcgccgccgacccaatcgc

SEQ ID NO: 239455 - DNA, 20 bp, human
ggccgcggctccagccgcgt

SEQ ID NO: 239456 - DNA, 20 bp, human
gaagccttactgtgggaatc

SEQ ID NO: 239457 - DNA, 20 bp, human
gccatcaagaagccttactg

SEQ ID NO: 239458 - DNA, 20 bp, human
gtacatttaaagccaatgac

SEQ ID NO: 239459 - DNA, 20 bp, human
gtttaaagccaatgactggc

SEQ ID NO: 239460 - DNA, 20 bp, human
gcaaaagttatcactttaat

SEQ ID NO: 239461 - DNA, 20 bp, human
gatattccttttgttctata

SEQ ID NO: 239462 - DNA, 20 bp, human
gacagtaatttctatcatga

SEQ ID NO: 239463 - DNA, 20 bp, human
gtgtccagattcccacagta

SEQ ID NO: 239464 - DNA, 20 bp, human
gcaaaatacctgccagtcat

SEQ ID NO: 239465 - DNA, 20 bp, human
gaacagatgcatatacatgt

SEQ ID NO: 239466 - DNA, 20 bp, human
gtaaaagcgcagcgtgcggg

SEQ ID NO: 239467 - DNA, 20 bp, human
ggggtcggcgctgcgagagg

SEQ ID NO: 239468 - DNA, 20 bp, human
gggcccgccctctgttcggg

SEQ ID NO: 239469 - DNA, 20 bp, human
gtggcctggatcccgcgcag

SEQ ID NO: 239470 - DNA, 20 bp, human
ggagaggcggagccgagaag

SEQ ID NO: 239471 - DNA, 20 bp, human
ggggataaaagcgcagcgtg

SEQ ID NO: 239472 - DNA, 20 bp, human
gaatgggtcggcgctgcgag

SEQ ID NO: 239473 - DNA, 20 bp, human
gagcgggcccgccctctgtt

SEQ ID NO: 239474 - DNA, 20 bp, human
gtgctggggctcggagggat

SEQ ID NO: 239475 - DNA, 20 bp, human
ggcagcgccctcgcctgctg

SEQ ID NO: 239476 - DNA, 20 bp, human
gaatgtcggcggctccaaaa

SEQ ID NO: 239477 - DNA, 20 bp, human
gaagcagccctgggcgggag

SEQ ID NO: 239478 - DNA, 20 bp, human
ggtcctgcccctctgaatgt

SEQ ID NO: 239479 - DNA, 20 bp, human
gggtcggtcgcgcgcccctg

SEQ ID NO: 239480 - DNA, 20 bp, human
gatgttgccgctcccgccca

SEQ ID NO: 239481 - DNA, 20 bp, human
gctgcccctctgaatgtcgg

SEQ ID NO: 239482 - DNA, 20 bp, human
gtcggggtctagattagtga

SEQ ID NO: 239483 - DNA, 20 bp, human
gtggagccgccgacattcag

SEQ ID NO: 239484 - DNA, 20 bp, human
gaagggcggccggtagagta

SEQ ID NO: 239485 - DNA, 20 bp, human
gtaaggacggcggaccgcat

SEQ ID NO: 239486 - DNA, 20 bp, human
gagggggcgggatcacccga

SEQ ID NO: 239487 - DNA, 20 bp, human
gggccgccggccagatgtgg

SEQ ID NO: 239488 - DNA, 20 bp, human
gagagcggaacttagaaccc

SEQ ID NO: 239489 - DNA, 20 bp, human
gttagaacccgggttcccct

SEQ ID NO: 239490 - DNA, 20 bp, human
gccctgccgccggaccaatg

SEQ ID NO: 239491 - DNA, 20 bp, human
ggatcacccgaggggaaccc

SEQ ID NO: 239492 - DNA, 20 bp, human
gattggctggggagtcgagg

SEQ ID NO: 239493 - DNA, 20 bp, human
gtgggagttgtagtttagaa

SEQ ID NO: 239494 - DNA, 20 bp, human
gactgagggaagcaacgttg

SEQ ID NO: 239495 - DNA, 20 bp, human
ggccgacaggggttcccaga

SEQ ID NO: 239496 - DNA, 20 bp, human
ggggctgcgacgccgaccaa

SEQ ID NO: 239497 - DNA, 20 bp, human
gaaactccggaagtgagagc

SEQ ID NO: 239498 - DNA, 20 bp, human
gccgcgcgccaggcatcgcg

SEQ ID NO: 239499 - DNA, 20 bp, human
gagcaaccagccagcccatc

SEQ ID NO: 239500 - DNA, 20 bp, human
gggaaaggctggaacggcgc

SEQ ID NO: 239501 - DNA, 20 bp, human
gggccgtcgctgggaaactc

SEQ ID NO: 239502 - DNA, 20 bp, human
gcgagggagccgtttacggc

SEQ ID NO: 239503 - DNA, 20 bp, human
gcccactctgcgaaagtgtc

SEQ ID NO: 239504 - DNA, 20 bp, human
ggaagaagccgcgcgatgcc

SEQ ID NO: 239505 - DNA, 20 bp, human
ggtcggcgtcgcagcccgat

SEQ ID NO: 239506 - DNA, 20 bp, human
ggcgagagtaggcgcgtgga

SEQ ID NO: 239507 - DNA, 20 bp, human
gtactctcgcgggccactcc

SEQ ID NO: 239508 - DNA, 20 bp, human
gcggcggcgctcaccaagag

SEQ ID NO: 239509 - DNA, 20 bp, human
gcgcaggcgacgaagtcgcc

SEQ ID NO: 239510 - DNA, 20 bp, human
gccgccgccagccaatcgcg

SEQ ID NO: 239511 - DNA, 20 bp, human
gagtgggagcggctgcttgt

SEQ ID NO: 239512 - DNA, 20 bp, human
gggacggggaacttccggat

SEQ ID NO: 239513 - DNA, 20 bp, human
gccgccccgcggatcagctg

SEQ ID NO: 239514 - DNA, 20 bp, human
ggcgccccgcgattggctgg

SEQ ID NO: 239515 - DNA, 20 bp, human
gtaatctggggatgactcct

SEQ ID NO: 239516 - DNA, 20 bp, human
gcggaggccagaggtagcga

SEQ ID NO: 239517 - DNA, 20 bp, human
gcaaatcggtggaatcgtcg

SEQ ID NO: 239518 - DNA, 20 bp, human
gacccaccagctccaagcgg

SEQ ID NO: 239519 - DNA, 20 bp, human
gcggtggaatcgtcgagggg

SEQ ID NO: 239520 - DNA, 20 bp, human
gaaaccagatacccgcctcg

SEQ ID NO: 239521 - DNA, 20 bp, human
gtggccgcgaggcgggtatc

SEQ ID NO: 239522 - DNA, 20 bp, human
gcgggtatctggtttccaag

SEQ ID NO: 239523 - DNA, 20 bp, human
ggggacacaaggcaaatcgg

SEQ ID NO: 239524 - DNA, 20 bp, human
gtggaatcgtcgaggggtgg

SEQ ID NO: 239525 - DNA, 20 bp, human
gtagcgaggggtgaggttag

SEQ ID NO: 239526 - DNA, 20 bp, human
gcccaggcggcgacgcaaat

SEQ ID NO: 239527 - DNA, 20 bp, human
ggtgctgcttcgtgacgtca

SEQ ID NO: 239528 - DNA, 20 bp, human
gaccctgcacaccaggcgac

SEQ ID NO: 239529 - DNA, 20 bp, human
ggctccagaccctgcacacc

SEQ ID NO: 239530 - DNA, 20 bp, human
gaggcggcgacgcaaatggg

SEQ ID NO: 239531 - DNA, 20 bp, human
gaggctgaggcactcgaagc

SEQ ID NO: 239532 - DNA, 20 bp, human
gccctcggccgtccattctt

SEQ ID NO: 239533 - DNA, 20 bp, human
ggagtagtgcagatctgaga

SEQ ID NO: 239534 - DNA, 20 bp, human
gggaaaggcgggccaaagaa

SEQ ID NO: 239535 - DNA, 20 bp, human
gagtgcagatctgagatggt

SEQ ID NO: 239536 - DNA, 20 bp, human
gactatggattaccagagga

SEQ ID NO: 239537 - DNA, 20 bp, human
gccactagggtgatgatggg

SEQ ID NO: 239538 - DNA, 20 bp, human
ggagtactatggattaccag

SEQ ID NO: 239539 - DNA, 20 bp, human
gggctggcaagtggaggcgg

SEQ ID NO: 239540 - DNA, 20 bp, human
gtggaggcgggggagtacta

SEQ ID NO: 239541 - DNA, 20 bp, human
gtgtcaatgaaggaatcacg

SEQ ID NO: 239542 - DNA, 20 bp, human
ggccagcagaagagccacta

SEQ ID NO: 239543 - DNA, 20 bp, human
ggagccactagggtgatgat

SEQ ID NO: 239544 - DNA, 20 bp, human
gcctgaagacagaaagtgtg

SEQ ID NO: 239545 - DNA, 20 bp, human
gggcaaaccagcccttttat

SEQ ID NO: 239546 - DNA, 20 bp, human
ggggacccggtcctggagaa

SEQ ID NO: 239547 - DNA, 20 bp, human
gtaggtgagactagatgaaa

SEQ ID NO: 239548 - DNA, 20 bp, human
gggccgagggtgataccagg

SEQ ID NO: 239549 - DNA, 20 bp, human
gtgcctcctggtatcaccct

SEQ ID NO: 239550 - DNA, 20 bp, human
gtcatctagtctcacctaaa

SEQ ID NO: 239551 - DNA, 20 bp, human
gccaggaccgggtccctttt

SEQ ID NO: 239552 - DNA, 20 bp, human
ggaaggagattcagggccga

SEQ ID NO: 239553 - DNA, 20 bp, human
gtgatgaggaaggagattca

SEQ ID NO: 239554 - DNA, 20 bp, human
gcaggctgtcgaaacctcag

SEQ ID NO: 239555 - DNA, 20 bp, human
gacagcaactaatttctgac

SEQ ID NO: 239556 - DNA, 20 bp, human
gggggagcccagatgaagtg

SEQ ID NO: 239557 - DNA, 20 bp, human
gcggcctgtggtttctttat

SEQ ID NO: 239558 - DNA, 20 bp, human
gtagagacacaaggcacccc

SEQ ID NO: 239559 - DNA, 20 bp, human
ggatagagccacacttcatc

SEQ ID NO: 239560 - DNA, 20 bp, human
gttggaacatgtttctgcct

SEQ ID NO: 239561 - DNA, 20 bp, human
gaagcattgctcaggacact

SEQ ID NO: 239562 - DNA, 20 bp, human
gcttgtgtctctacattcct

SEQ ID NO: 239563 - DNA, 20 bp, human
gtgattcaataaaactttgt

SEQ ID NO: 239564 - DNA, 20 bp, human
ggtttctttataggaccttg

SEQ ID NO: 239565 - DNA, 20 bp, human
gcccagggctggggacctca

SEQ ID NO: 239566 - DNA, 20 bp, human
gcccttcacaactaggttca

SEQ ID NO: 239567 - DNA, 20 bp, human
gcttacagatacatggggaa

SEQ ID NO: 239568 - DNA, 20 bp, human
gtccttgaacctagttgtga

SEQ ID NO: 239569 - DNA, 20 bp, human
gcaatctgatactcaattgc

SEQ ID NO: 239570 - DNA, 20 bp, human
gcacaaagccatgttgggtg

SEQ ID NO: 239571 - DNA, 20 bp, human
gattactcacaaagccatgt

SEQ ID NO: 239572 - DNA, 20 bp, human
gaaggtgcaaaaccctcctt

SEQ ID NO: 239573 - DNA, 20 bp, human
gaatacccttacagatacat

SEQ ID NO: 239574 - DNA, 20 bp, human
gcaaaaccctccttgggctg

SEQ ID NO: 239575 - DNA, 20 bp, human
gataaaaaccacacccaaca

SEQ ID NO: 239576 - DNA, 20 bp, human
gtacgcttgcgcagctccaa

SEQ ID NO: 239577 - DNA, 20 bp, human
ggcgtgttgggcagacgggg

SEQ ID NO: 239578 - DNA, 20 bp, human
gagcacccgcagaccggacc

SEQ ID NO: 239579 - DNA, 20 bp, human
gtgggcagacgggggggtgg

SEQ ID NO: 239580 - DNA, 20 bp, human
gcgcctgcgtgttgggcaga

SEQ ID NO: 239581 - DNA, 20 bp, human
gcttgcgcagctccaagggg

SEQ ID NO: 239582 - DNA, 20 bp, human
gagaggaggggtgtagggac

SEQ ID NO: 239583 - DNA, 20 bp, human
gaggagacgcgcctgcgtgt

SEQ ID NO: 239584 - DNA, 20 bp, human
gccgctagaggtgaactcca

SEQ ID NO: 239585 - DNA, 20 bp, human
gaaggcgagcacccgcagac

SEQ ID NO: 239586 - DNA, 20 bp, human
gagaagcagaggaaagacgg

SEQ ID NO: 239587 - DNA, 20 bp, human
ggcgccccggtcgccgtctg

SEQ ID NO: 239588 - DNA, 20 bp, human
gggcgcgtgcgtgggcgcgt

SEQ ID NO: 239589 - DNA, 20 bp, human
gggcgggcgggcgcgtgcgt

SEQ ID NO: 239590 - DNA, 20 bp, human
gtacccgcagacggcgaccg

SEQ ID NO: 239591 - DNA, 20 bp, human
gccacccagaagtcggcgga

SEQ ID NO: 239592 - DNA, 20 bp, human
gcgtgggcgagcggactggc

SEQ ID NO: 239593 - DNA, 20 bp, human
gtctgggtggcggaccctgg

SEQ ID NO: 239594 - DNA, 20 bp, human
gcccccctccgccgacttct

SEQ ID NO: 239595 - DNA, 20 bp, human
gggtcgcggcctccagtcag

SEQ ID NO: 239596 - DNA, 20 bp, human
gtgggaacccggctacccct

SEQ ID NO: 239597 - DNA, 20 bp, human
gaacccggctacccctgggc

SEQ ID NO: 239598 - DNA, 20 bp, human
gcgagcaccaggggcgctca

SEQ ID NO: 239599 - DNA, 20 bp, human
gcagggctgcccgaaagtcg

SEQ ID NO: 239600 - DNA, 20 bp, human
ggctgcccgaaagtcggggc

SEQ ID NO: 239601 - DNA, 20 bp, human
ggcgctcaaggtgaacgcgc

SEQ ID NO: 239602 - DNA, 20 bp, human
gtcccagcgccacggctctt

SEQ ID NO: 239603 - DNA, 20 bp, human
gcgcgctggagctggttatc

SEQ ID NO: 239604 - DNA, 20 bp, human
gggccccggccccgactttc

SEQ ID NO: 239605 - DNA, 20 bp, human
gagctccagcgcgagcacca

SEQ ID NO: 239606 - DNA, 20 bp, human
gatgtcaagcagcatgaatt

SEQ ID NO: 239607 - DNA, 20 bp, human
gagcagccccagacttaata

SEQ ID NO: 239608 - DNA, 20 bp, human
gcccctgattgcaacactcc

SEQ ID NO: 239609 - DNA, 20 bp, human
gcaaagccctattaagtctg

SEQ ID NO: 239610 - DNA, 20 bp, human
gtcatccatcaggaggttca

SEQ ID NO: 239611 - DNA, 20 bp, human
gagccaggagtgttgcaatc

SEQ ID NO: 239612 - DNA, 20 bp, human
ggtgttgcaatcaggggcac

SEQ ID NO: 239613 - DNA, 20 bp, human
gcaactacacaaagaaagtc

SEQ ID NO: 239614 - DNA, 20 bp, human
gttaagtctggggctgctta

SEQ ID NO: 239615 - DNA, 20 bp, human
gaacagaggaaagcgggaag

SEQ ID NO: 239616 - DNA, 20 bp, human
ggctgcggcctccgtgagcg

SEQ ID NO: 239617 - DNA, 20 bp, human
gaggccgcagcgctctgggt

SEQ ID NO: 239618 - DNA, 20 bp, human
ggaagggggcggggcgtcga

SEQ ID NO: 239619 - DNA, 20 bp, human
gccccggcggtcgcagggaa

SEQ ID NO: 239620 - DNA, 20 bp, human
gtgagcggggcctgggcgaa

SEQ ID NO: 239621 - DNA, 20 bp, human
ggggcgccccggcggtcgca

SEQ ID NO: 239622 - DNA, 20 bp, human
gccgcagcgctctgggttgg

SEQ ID NO: 239623 - DNA, 20 bp, human
gagccaatggggaggcggtg

SEQ ID NO: 239624 - DNA, 20 bp, human
gcggctccgtcccaccgcgg

SEQ ID NO: 239625 - DNA, 20 bp, human
gggcgctcctcgtgcggcgg

SEQ ID NO: 239626 - DNA, 20 bp, human
gggtccttgcccataggggc

SEQ ID NO: 239627 - DNA, 20 bp, human
gggaaagagcccccgggccg

SEQ ID NO: 239628 - DNA, 20 bp, human
gcccgggcgcggtagcgtac

SEQ ID NO: 239629 - DNA, 20 bp, human
ggcgccggaggccaatcagt

SEQ ID NO: 239630 - DNA, 20 bp, human
gcggtagcgtacgggaagac

SEQ ID NO: 239631 - DNA, 20 bp, human
gtctctccgtgccccggccc

SEQ ID NO: 239632 - DNA, 20 bp, human
gggcctccggcgcctcggat

SEQ ID NO: 239633 - DNA, 20 bp, human
gcgcgggcgaggaactgccc

SEQ ID NO: 239634 - DNA, 20 bp, human
gtgccgggccccgcccctat

SEQ ID NO: 239635 - DNA, 20 bp, human
ggccgtgagccgaatagagc

SEQ ID NO: 239636 - DNA, 20 bp, human
gcgagtgaaaccatcgggga

SEQ ID NO: 239637 - DNA, 20 bp, human
ggcgggagcgtgcaaaggga

SEQ ID NO: 239638 - DNA, 20 bp, human
ggtcccgcgggagcgtgcaa

SEQ ID NO: 239639 - DNA, 20 bp, human
ggaaccgagtgaaaccatcg

SEQ ID NO: 239640 - DNA, 20 bp, human
gtgtaactctccctgtcccg

SEQ ID NO: 239641 - DNA, 20 bp, human
ggctgcgtcttagaggggtg

SEQ ID NO: 239642 - DNA, 20 bp, human
gaaaccatcggggagggggt

SEQ ID NO: 239643 - DNA, 20 bp, human
gaagataagcggcgtgggtg

SEQ ID NO: 239644 - DNA, 20 bp, human
ggagggaagataagcggcgt

SEQ ID NO: 239645 - DNA, 20 bp, human
ggagaccaagccaaaaactt

SEQ ID NO: 239646 - DNA, 20 bp, human
ggacacgtttcccgtcaaga

SEQ ID NO: 239647 - DNA, 20 bp, human
ggggtgttgtagttcttggg

SEQ ID NO: 239648 - DNA, 20 bp, human
gagttggcagttacagggag

SEQ ID NO: 239649 - DNA, 20 bp, human
gccaactcccgcgctgactc

SEQ ID NO: 239650 - DNA, 20 bp, human
gaagttaggcattccctccg

SEQ ID NO: 239651 - DNA, 20 bp, human
ggagtatccgccatcttgac

SEQ ID NO: 239652 - DNA, 20 bp, human
gtaggcattccctccgtgga

SEQ ID NO: 239653 - DNA, 20 bp, human
ggggacgggtatgtgtagcc

SEQ ID NO: 239654 - DNA, 20 bp, human
gatcgtgggtcgagagtggg

SEQ ID NO: 239655 - DNA, 20 bp, human
gatggcggatactctccctt

SEQ ID NO: 239656 - DNA, 20 bp, human
gcagcaaaacaatgacattg

SEQ ID NO: 239657 - DNA, 20 bp, human
gtgctacgccagtcaggata

SEQ ID NO: 239658 - DNA, 20 bp, human
gaggacaacgttgaagagat

SEQ ID NO: 239659 - DNA, 20 bp, human
gtaaccacatcaaactctgt

SEQ ID NO: 239660 - DNA, 20 bp, human
ggcagctgcaaggatggatt

SEQ ID NO: 239661 - DNA, 20 bp, human
gtacgccagtcaggatatgg

SEQ ID NO: 239662 - DNA, 20 bp, human
gggaagaaagtactgttgta

SEQ ID NO: 239663 - DNA, 20 bp, human
gactgctgatgaaagaaatg

SEQ ID NO: 239664 - DNA, 20 bp, human
ggaaagtactgttgtatggc

SEQ ID NO: 239665 - DNA, 20 bp, human
gtccttcttgcgaagagtga

SEQ ID NO: 239666 - DNA, 20 bp, human
ggtggccggtcccgccagag

SEQ ID NO: 239667 - DNA, 20 bp, human
gccagcggcgtgcgtcacca

SEQ ID NO: 239668 - DNA, 20 bp, human
gcgcggaggtgtggggaccc

SEQ ID NO: 239669 - DNA, 20 bp, human
ggccgggagcgactcacaaa

SEQ ID NO: 239670 - DNA, 20 bp, human
ggacccgggcttgcgtcgga

SEQ ID NO: 239671 - DNA, 20 bp, human
ggcacccggcggggacttcc

SEQ ID NO: 239672 - DNA, 20 bp, human
ggcgcggcgcgcggtcgcca

SEQ ID NO: 239673 - DNA, 20 bp, human
ggccccacttccggtcgcac

SEQ ID NO: 239674 - DNA, 20 bp, human
gcccgcccctctggcgggac

SEQ ID NO: 239675 - DNA, 20 bp, human
gtgctctcgcgagaggatgg

SEQ ID NO: 239676 - DNA, 20 bp, human
gcatgcagggggattctggc

SEQ ID NO: 239677 - DNA, 20 bp, human
gccaggggctgcgcatgcag

SEQ ID NO: 239678 - DNA, 20 bp, human
gtgcgcatgcagggggattc

SEQ ID NO: 239679 - DNA, 20 bp, human
ggtgggacgtaagacgccag

SEQ ID NO: 239680 - DNA, 20 bp, human
ggctggacgctccggcgctg

SEQ ID NO: 239681 - DNA, 20 bp, human
gcgtcagagcccagcgccaa

SEQ ID NO: 239682 - DNA, 20 bp, human
gaccgggtagaacgcagcgc

SEQ ID NO: 239683 - DNA, 20 bp, human
gccgaagtagacaggatctg

SEQ ID NO: 239684 - DNA, 20 bp, human
gaggctccgcctttggcgct

SEQ ID NO: 239685 - DNA, 20 bp, human
gggattctggctggacgctc

SEQ ID NO: 239686 - DNA, 20 bp, human
gaaagcgcccaccccggtac

SEQ ID NO: 239687 - DNA, 20 bp, human
ggggtcctcaagtggaggtt

SEQ ID NO: 239688 - DNA, 20 bp, human
gcccaccccggtactggctt

SEQ ID NO: 239689 - DNA, 20 bp, human
gtcggacgcgcagaggaaac

SEQ ID NO: 239690 - DNA, 20 bp, human
gtgcgcccgtgccccggaac

SEQ ID NO: 239691 - DNA, 20 bp, human
gacccaagccagtaccgggg

SEQ ID NO: 239692 - DNA, 20 bp, human
ggggcagctgaggtccatta

SEQ ID NO: 239693 - DNA, 20 bp, human
gctggcttgggtcactcggg

SEQ ID NO: 239694 - DNA, 20 bp, human
ggtactggcttgggtcactc

SEQ ID NO: 239695 - DNA, 20 bp, human
gcggacgctggcccgttccg

SEQ ID NO: 239696 - DNA, 20 bp, human
ggccgctttcctcacgtctg

SEQ ID NO: 239697 - DNA, 20 bp, human
gggcggggataggagagcgt

SEQ ID NO: 239698 - DNA, 20 bp, human
gataggagagcgtggggcca

SEQ ID NO: 239699 - DNA, 20 bp, human
gtcgccccgctgccaactcc

SEQ ID NO: 239700 - DNA, 20 bp, human
ggacgtgaggaaagcggccg

SEQ ID NO: 239701 - DNA, 20 bp, human
gcgggctcctagactaagtg

SEQ ID NO: 239702 - DNA, 20 bp, human
gaagctggatgagggatctc

SEQ ID NO: 239703 - DNA, 20 bp, human
gcgctgccaactcccggtgc

SEQ ID NO: 239704 - DNA, 20 bp, human
gaacccgcgcacagaagccg

SEQ ID NO: 239705 - DNA, 20 bp, human
ggtctggagctggcggggat

SEQ ID NO: 239706 - DNA, 20 bp, human
gagtgggagactagtcaaaa

SEQ ID NO: 239707 - DNA, 20 bp, human
gtgcgcagaatcgagtgagt

SEQ ID NO: 239708 - DNA, 20 bp, human
gccgccgctccctactctgg

SEQ ID NO: 239709 - DNA, 20 bp, human
gcaacccccagagtagggag

SEQ ID NO: 239710 - DNA, 20 bp, human
gagtcccaacccccagagta

SEQ ID NO: 239711 - DNA, 20 bp, human
gcggctgcccgtgacctgcc

SEQ ID NO: 239712 - DNA, 20 bp, human
gaggtcacgggcagccgcct

SEQ ID NO: 239713 - DNA, 20 bp, human
ggacgtcatcgcacatgttc

SEQ ID NO: 239714 - DNA, 20 bp, human
ggtgccgccgctccctactc

SEQ ID NO: 239715 - DNA, 20 bp, human
gggattcggtgcttttcgta

SEQ ID NO: 239716 - DNA, 20 bp, human
gagaggagcgcgtcggtctg

SEQ ID NO: 239717 - DNA, 20 bp, human
ggcgccgccgcgacatcaag

SEQ ID NO: 239718 - DNA, 20 bp, human
gcggcgccctgaggacggat

SEQ ID NO: 239719 - DNA, 20 bp, human
gggagaacaagcacgtactc

SEQ ID NO: 239720 - DNA, 20 bp, human
ggaggcgcaaacgagaccac

SEQ ID NO: 239721 - DNA, 20 bp, human
gttgggtcacgtgacaccgg

SEQ ID NO: 239722 - DNA, 20 bp, human
gcctgaggacggattgggca

SEQ ID NO: 239723 - DNA, 20 bp, human
gaggacggattgggcaaggc

SEQ ID NO: 239724 - DNA, 20 bp, human
gcaggagcaaggcggaagtc

SEQ ID NO: 239725 - DNA, 20 bp, human
gcacactgcacatttccttc

SEQ ID NO: 239726 - DNA, 20 bp, human
ggcactcttgcgccatctcc

SEQ ID NO: 239727 - DNA, 20 bp, human
gtgggtggagtggagaagta

SEQ ID NO: 239728 - DNA, 20 bp, human
gcaagagtgccatctgatgc

SEQ ID NO: 239729 - DNA, 20 bp, human
ggactagagcgtcgccactc

SEQ ID NO: 239730 - DNA, 20 bp, human
ggttgcatgtgtggtcgtgt

SEQ ID NO: 239731 - DNA, 20 bp, human
gcctgcctgccatagacaaa

SEQ ID NO: 239732 - DNA, 20 bp, human
gggggaagaggattgcagcg

SEQ ID NO: 239733 - DNA, 20 bp, human
gaggctgatgacgccccgag

SEQ ID NO: 239734 - DNA, 20 bp, human
gtgccatctgatgctgggcg

SEQ ID NO: 239735 - DNA, 20 bp, human
gggaggttccgcactctcta

SEQ ID NO: 239736 - DNA, 20 bp, human
ggccgcgcctcaaatctaat

SEQ ID NO: 239737 - DNA, 20 bp, human
ggggaagcgtgctgcatgcc

SEQ ID NO: 239738 - DNA, 20 bp, human
ggcgcctcaaatctaatagg

SEQ ID NO: 239739 - DNA, 20 bp, human
gcactgggagttgtagtcag

SEQ ID NO: 239740 - DNA, 20 bp, human
gtgctgtagctggggtcaaa

SEQ ID NO: 239741 - DNA, 20 bp, human
gcggccggcgcgttgcccac

SEQ ID NO: 239742 - DNA, 20 bp, human
gcccggcccggcaggcgtca

SEQ ID NO: 239743 - DNA, 20 bp, human
gtacagcaaaagacgcgccg

SEQ ID NO: 239744 - DNA, 20 bp, human
gccggaagactatagcttcc

SEQ ID NO: 239745 - DNA, 20 bp, human
ggcgtcttttgctgtagctg

SEQ ID NO: 239746 - DNA, 20 bp, human
gctctcgctcaactcccaga

SEQ ID NO: 239747 - DNA, 20 bp, human
ggaggccaccgctgggacgt

SEQ ID NO: 239748 - DNA, 20 bp, human
gccaccgctgggacgtcggc

SEQ ID NO: 239749 - DNA, 20 bp, human
gcggcgccacccggccctct

SEQ ID NO: 239750 - DNA, 20 bp, human
gaaaagaccgacaaagactg

SEQ ID NO: 239751 - DNA, 20 bp, human
gccgcccagccgctgtgcag

SEQ ID NO: 239752 - DNA, 20 bp, human
ggacaaagactgtgggaagt

SEQ ID NO: 239753 - DNA, 20 bp, human
gcagccgctgtgcagcgggg

SEQ ID NO: 239754 - DNA, 20 bp, human
gtcggctggccggcgccacc

SEQ ID NO: 239755 - DNA, 20 bp, human
gaaaagcaaaccgatgtcca

SEQ ID NO: 239756 - DNA, 20 bp, human
gggggcggggtgttggtaga

SEQ ID NO: 239757 - DNA, 20 bp, human
ggggctgggaagtagtcggg

SEQ ID NO: 239758 - DNA, 20 bp, human
ggctgggcggtcaacaagtg

SEQ ID NO: 239759 - DNA, 20 bp, human
ggcggggctgggaagtagtc

SEQ ID NO: 239760 - DNA, 20 bp, human
gggcctcagttgagtgggtg

SEQ ID NO: 239761 - DNA, 20 bp, human
ggggtgttggtagaaggagt

SEQ ID NO: 239762 - DNA, 20 bp, human
gggcctggaggcaactaacg

SEQ ID NO: 239763 - DNA, 20 bp, human
gctaacgcggcatagggcga

SEQ ID NO: 239764 - DNA, 20 bp, human
ggaggggccggaagtcgagg

SEQ ID NO: 239765 - DNA, 20 bp, human
gacgcggcatagggcgaggg

SEQ ID NO: 239766 - DNA, 20 bp, human
gcaggcgccgcggaacgcga

SEQ ID NO: 239767 - DNA, 20 bp, human
ggaggccgcggtgttcgcgg

SEQ ID NO: 239768 - DNA, 20 bp, human
gcggcctccttggaccggta

SEQ ID NO: 239769 - DNA, 20 bp, human
gtctccgtaccggtccaagg

SEQ ID NO: 239770 - DNA, 20 bp, human
gaaccacagcccgccggtct

SEQ ID NO: 239771 - DNA, 20 bp, human
ggcgaccgccgcgaacaccg

SEQ ID NO: 239772 - DNA, 20 bp, human
ggcgaacaccgcggcctcct

SEQ ID NO: 239773 - DNA, 20 bp, human
gttggaccggtacggagaag

SEQ ID NO: 239774 - DNA, 20 bp, human
gaacccgcggcaacggcgcg

SEQ ID NO: 239775 - DNA, 20 bp, human
ggggaggacccgagctacgg

SEQ ID NO: 239776 - DNA, 20 bp, human
gtcggcacaaagaccgtggg

SEQ ID NO: 239777 - DNA, 20 bp, human
gcggtgacgtgtgaacgaga

SEQ ID NO: 239778 - DNA, 20 bp, human
gcacaaagaccgtgggagga

SEQ ID NO: 239779 - DNA, 20 bp, human
gggtgcccggaccacccgga

SEQ ID NO: 239780 - DNA, 20 bp, human
gcatgcgccttgaagactta

SEQ ID NO: 239781 - DNA, 20 bp, human
gaggggtcggcgcaagcgct

SEQ ID NO: 239782 - DNA, 20 bp, human
gcatactgcctcctggctga

SEQ ID NO: 239783 - DNA, 20 bp, human
gctgcgctccgtcagccagg

SEQ ID NO: 239784 - DNA, 20 bp, human
gccgaactccagaatcttga

SEQ ID NO: 239785 - DNA, 20 bp, human
gggtctttgtgccgaaagaa

SEQ ID NO: 239786 - DNA, 20 bp, human
gggcgcgcgcgggggtaaga

SEQ ID NO: 239787 - DNA, 20 bp, human
gtccgggcggccgcctccag

SEQ ID NO: 239788 - DNA, 20 bp, human
ggccaccagcgcccccctgg

SEQ ID NO: 239789 - DNA, 20 bp, human
gagtgagcgcgccccgccgg

SEQ ID NO: 239790 - DNA, 20 bp, human
ggcggcgcggccgagctcgt

SEQ ID NO: 239791 - DNA, 20 bp, human
gctcgcagccgcgggaatga

SEQ ID NO: 239792 - DNA, 20 bp, human
gcactcgaccgggaagcccg

SEQ ID NO: 239793 - DNA, 20 bp, human
gtctgcgaggccgcgggatg

SEQ ID NO: 239794 - DNA, 20 bp, human
gcgcgcgcgcccgttgccat

SEQ ID NO: 239795 - DNA, 20 bp, human
ggggagacgctatcgcaaga

SEQ ID NO: 239796 - DNA, 20 bp, human
ggggagcgtggacggcagag

SEQ ID NO: 239797 - DNA, 20 bp, human
ggccgaggggcagccgggac

SEQ ID NO: 239798 - DNA, 20 bp, human
gagctcccgcaccctctcct

SEQ ID NO: 239799 - DNA, 20 bp, human
gagccgagatccgcccgtcc

SEQ ID NO: 239800 - DNA, 20 bp, human
gcggtctactcgaagtgcgg

SEQ ID NO: 239801 - DNA, 20 bp, human
gcctttgcacgcttttctat

SEQ ID NO: 239802 - DNA, 20 bp, human
ggtccacgctcccctgtgcg

SEQ ID NO: 239803 - DNA, 20 bp, human
gagccgggacgggcggatct

SEQ ID NO: 239804 - DNA, 20 bp, human
gctggtcccagccgcgcaca

SEQ ID NO: 239805 - DNA, 20 bp, human
gtgggtgtcagggggtaggt

SEQ ID NO: 239806 - DNA, 20 bp, human
gagggcaggcggcacttacg

SEQ ID NO: 239807 - DNA, 20 bp, human
gggtgctcctccctgagccg

SEQ ID NO: 239808 - DNA, 20 bp, human
gcctcggtccctcggactta

SEQ ID NO: 239809 - DNA, 20 bp, human
gaagccctcagcaccaacag

SEQ ID NO: 239810 - DNA, 20 bp, human
gcccgcgctccctaagtccg

SEQ ID NO: 239811 - DNA, 20 bp, human
gagtgccgcctgccctgcgt

SEQ ID NO: 239812 - DNA, 20 bp, human
gagctggcacgacccacgca

SEQ ID NO: 239813 - DNA, 20 bp, human
gagtccgagggaccgaggcg

SEQ ID NO: 239814 - DNA, 20 bp, human
ggctgcaaggacaaccggct

SEQ ID NO: 239815 - DNA, 20 bp, human
gacgacccacgcagggcagg

SEQ ID NO: 239816 - DNA, 20 bp, human
gcgaatggaaagaggggaca

SEQ ID NO: 239817 - DNA, 20 bp, human
ggggctcccgtgtttagggg

SEQ ID NO: 239818 - DNA, 20 bp, human
ggggacgtgggtatataaga

SEQ ID NO: 239819 - DNA, 20 bp, human
gccgctagcgaatggaaaga

SEQ ID NO: 239820 - DNA, 20 bp, human
gggccggaacctcgggacgt

SEQ ID NO: 239821 - DNA, 20 bp, human
gcaaaggggctcccgtgttt

SEQ ID NO: 239822 - DNA, 20 bp, human
gcagcacctcccctaaacac

SEQ ID NO: 239823 - DNA, 20 bp, human
gtgactggactgttttcaaa

SEQ ID NO: 239824 - DNA, 20 bp, human
gtacccacgtcccgaggttc

SEQ ID NO: 239825 - DNA, 20 bp, human
gtatccagtccgctagcgaa

SEQ ID NO: 239826 - DNA, 20 bp, human
gagcccgggccacgataggt

SEQ ID NO: 239827 - DNA, 20 bp, human
gagcaactgggggtcggaag

SEQ ID NO: 239828 - DNA, 20 bp, human
gggagcccagacaacagcgg

SEQ ID NO: 239829 - DNA, 20 bp, human
gctacagctggtagcaactg

SEQ ID NO: 239830 - DNA, 20 bp, human
gagtggagcccagacaacag

SEQ ID NO: 239831 - DNA, 20 bp, human
ggacgaggcggaggtagcgg

SEQ ID NO: 239832 - DNA, 20 bp, human
ggaagggtgctgggtcgcag

SEQ ID NO: 239833 - DNA, 20 bp, human
ggcgcaggcgcagaggagaa

SEQ ID NO: 239834 - DNA, 20 bp, human
gcgggaggctggcactagcc

SEQ ID NO: 239835 - DNA, 20 bp, human
gtgggtcgcaggggatgaga

SEQ ID NO: 239836 - DNA, 20 bp, human
ggagctgggctgattcattc

SEQ ID NO: 239837 - DNA, 20 bp, human
gggaactcgaacgctgacgt

SEQ ID NO: 239838 - DNA, 20 bp, human
ggggctgattcattcggggc

SEQ ID NO: 239839 - DNA, 20 bp, human
ggacccgggagggaacccag

SEQ ID NO: 239840 - DNA, 20 bp, human
gtccccgaagggtacaccct

SEQ ID NO: 239841 - DNA, 20 bp, human
ggacccgccaatcaggcgcg

SEQ ID NO: 239842 - DNA, 20 bp, human
gctgcctcgcgcctgattgg

SEQ ID NO: 239843 - DNA, 20 bp, human
gttaaaggggcgatgccact

SEQ ID NO: 239844 - DNA, 20 bp, human
gagcgcgtgcagtccccgaa

SEQ ID NO: 239845 - DNA, 20 bp, human
ggctaacgacgcaattaaaa

SEQ ID NO: 239846 - DNA, 20 bp, human
gcacccgcgacccgggcgaa

SEQ ID NO: 239847 - DNA, 20 bp, human
gtgcagggtggcgggtcaga

SEQ ID NO: 239848 - DNA, 20 bp, human
gtgggaggagaggcacgccg

SEQ ID NO: 239849 - DNA, 20 bp, human
gtcgaccagcctctcccgtg

SEQ ID NO: 239850 - DNA, 20 bp, human
gtgggaaccggccccggggg

SEQ ID NO: 239851 - DNA, 20 bp, human
gagagggaggctgcgaacaa

SEQ ID NO: 239852 - DNA, 20 bp, human
gtctcctcccacccgcgacc

SEQ ID NO: 239853 - DNA, 20 bp, human
gctccccggcgtcgacgctg

SEQ ID NO: 239854 - DNA, 20 bp, human
ggaatggaaaacaatgtgca

SEQ ID NO: 239855 - DNA, 20 bp, human
gcgtgcggatcgcaaaatct

SEQ ID NO: 239856 - DNA, 20 bp, human
ggggctctcgctaccggaga

SEQ ID NO: 239857 - DNA, 20 bp, human
ggtgcgccctgagtgacgtc

SEQ ID NO: 239858 - DNA, 20 bp, human
gtccctctcccgcactgagg

SEQ ID NO: 239859 - DNA, 20 bp, human
ggcccccggggtggggtctc

SEQ ID NO: 239860 - DNA, 20 bp, human
ggggccggagagaatggtgt

SEQ ID NO: 239861 - DNA, 20 bp, human
gccctcctcagtgcgggaga

SEQ ID NO: 239862 - DNA, 20 bp, human
ggtccgacgtgtcactgcaa

SEQ ID NO: 239863 - DNA, 20 bp, human
ggagaagggggaggttaaag

SEQ ID NO: 239864 - DNA, 20 bp, human
gagcaccaaaggccgcgggc

SEQ ID NO: 239865 - DNA, 20 bp, human
gactgaggagggggcacttc

SEQ ID NO: 239866 - DNA, 20 bp, human
gtcagcaccgcgcacctcct

SEQ ID NO: 239867 - DNA, 20 bp, human
gcacctcctcggctgggatc

SEQ ID NO: 239868 - DNA, 20 bp, human
ggggagaaaagcgctctcga

SEQ ID NO: 239869 - DNA, 20 bp, human
gtccgcccgcgcgttctcta

SEQ ID NO: 239870 - DNA, 20 bp, human
gtcccagccgaggaggtgcg

SEQ ID NO: 239871 - DNA, 20 bp, human
gggggcgaacgcgtcttatc

SEQ ID NO: 239872 - DNA, 20 bp, human
gaaagcgctctcgagggtgg

SEQ ID NO: 239873 - DNA, 20 bp, human
ggcagcccggatcccagccg

SEQ ID NO: 239874 - DNA, 20 bp, human
gaacgcgtcttatcgggggg

SEQ ID NO: 239875 - DNA, 20 bp, human
gacgggtgactgacaggcag

SEQ ID NO: 239876 - DNA, 20 bp, human
gaaggtccttgactccccag

SEQ ID NO: 239877 - DNA, 20 bp, human
gcaccctcggcgcccgccaa

SEQ ID NO: 239878 - DNA, 20 bp, human
ggccggctgcactgcgcctg

SEQ ID NO: 239879 - DNA, 20 bp, human
ggggcgtaatccgacgccgt

SEQ ID NO: 239880 - DNA, 20 bp, human
gcgcgctcgcgggtcaccct

SEQ ID NO: 239881 - DNA, 20 bp, human
gcccgcgaggagacgacctc

SEQ ID NO: 239882 - DNA, 20 bp, human
gccctgaggtcgtctcctcg

SEQ ID NO: 239883 - DNA, 20 bp, human
ggccaacggcaacttgttat

SEQ ID NO: 239884 - DNA, 20 bp, human
gggttaagacatcagacctc

SEQ ID NO: 239885 - DNA, 20 bp, human
gagaggaaccggctcggtcg

SEQ ID NO: 239886 - DNA, 20 bp, human
gaccgcagcccggagactcc

SEQ ID NO: 239887 - DNA, 20 bp, human
gcacgaggcccggagtcaga

SEQ ID NO: 239888 - DNA, 20 bp, human
gcccgggagtctccgggctg

SEQ ID NO: 239889 - DNA, 20 bp, human
gcggcagccgagagcctggc

SEQ ID NO: 239890 - DNA, 20 bp, human
ggcgaggcccggcgcggaac

SEQ ID NO: 239891 - DNA, 20 bp, human
gtcggctgccggttccgcgc

SEQ ID NO: 239892 - DNA, 20 bp, human
gcgcccccgagtgcgaggcc

SEQ ID NO: 239893 - DNA, 20 bp, human
ggggggcggtgtccgagcgt

SEQ ID NO: 239894 - DNA, 20 bp, human
gccgtgggagttgtagtgtg

SEQ ID NO: 239895 - DNA, 20 bp, human
gcggcgcatgcgcagatcgg

SEQ ID NO: 239896 - DNA, 20 bp, human
gcggcccggcgccgactctg

SEQ ID NO: 239897 - DNA, 20 bp, human
gagggaggcgggagtgcgga

SEQ ID NO: 239898 - DNA, 20 bp, human
gggccggggcagtgccgcga

SEQ ID NO: 239899 - DNA, 20 bp, human
gcgggcgcggggcataaaac

SEQ ID NO: 239900 - DNA, 20 bp, human
ggctctactgccccgggcgc

SEQ ID NO: 239901 - DNA, 20 bp, human
gggcccaggcagggggagat

SEQ ID NO: 239902 - DNA, 20 bp, human
gcagcagcggcccggatcgc

SEQ ID NO: 239903 - DNA, 20 bp, human
ggtagagccgcgtacggccc

SEQ ID NO: 239904 - DNA, 20 bp, human
ggggcgggcgggcgctgacc

SEQ ID NO: 239905 - DNA, 20 bp, human
gaggacccggttccgcccga

SEQ ID NO: 239906 - DNA, 20 bp, human
ggccgagcggccggcttctc

SEQ ID NO: 239907 - DNA, 20 bp, human
ggggccaagtggggagcgag

SEQ ID NO: 239908 - DNA, 20 bp, human
gccggcttctcgggccaagt

SEQ ID NO: 239909 - DNA, 20 bp, human
gaaagtgtgcgtgcttgcag

SEQ ID NO: 239910 - DNA, 20 bp, human
gcgagcgttggggtcttaaa

SEQ ID NO: 239911 - DNA, 20 bp, human
gctcccgctcgctccccact

SEQ ID NO: 239912 - DNA, 20 bp, human
ggggagggggaactcaaaag

SEQ ID NO: 239913 - DNA, 20 bp, human
gcaccgccctcacaccacga

SEQ ID NO: 239914 - DNA, 20 bp, human
gagggtagtcggtatcttca

SEQ ID NO: 239915 - DNA, 20 bp, human
gcagagccaaggcgcgggcg

SEQ ID NO: 239916 - DNA, 20 bp, human
gccggagacccgcacaagag

SEQ ID NO: 239917 - DNA, 20 bp, human
gagacccgcacaagagagga

SEQ ID NO: 239918 - DNA, 20 bp, human
ggggacggacgctccaggcg

SEQ ID NO: 239919 - DNA, 20 bp, human
gtggcgtcgcggggagtcag

SEQ ID NO: 239920 - DNA, 20 bp, human
gcggcgccgagtggaggcga

SEQ ID NO: 239921 - DNA, 20 bp, human
gcaggcgcggcgccgagtgg

SEQ ID NO: 239922 - DNA, 20 bp, human
gcgacgccaagaatgcagga

SEQ ID NO: 239923 - DNA, 20 bp, human
gtggaactttcaggtgggga

SEQ ID NO: 239924 - DNA, 20 bp, human
ggaggcgagggggctgcgga

SEQ ID NO: 239925 - DNA, 20 bp, human
gaaaagtgggcctgtttctc

SEQ ID NO: 239926 - DNA, 20 bp, human
gaagcctcaggcagcgtctg

SEQ ID NO: 239927 - DNA, 20 bp, human
ggggagagaaggcggataca

SEQ ID NO: 239928 - DNA, 20 bp, human
gaagtcccggacgggagaga

SEQ ID NO: 239929 - DNA, 20 bp, human
gacccactgcacagacccgg

SEQ ID NO: 239930 - DNA, 20 bp, human
gagggctggcgcacccgccc

SEQ ID NO: 239931 - DNA, 20 bp, human
gaaacagtgtgcctttgtga

SEQ ID NO: 239932 - DNA, 20 bp, human
ggcgggtgcgccagccctct

SEQ ID NO: 239933 - DNA, 20 bp, human
gctcaggcagcgtctggggt

SEQ ID NO: 239934 - DNA, 20 bp, human
gaaggctaaaagtcccggac

SEQ ID NO: 239935 - DNA, 20 bp, human
gacgccagccttagcgggga

SEQ ID NO: 239936 - DNA, 20 bp, human
gggaagggactcggggttgg

SEQ ID NO: 239937 - DNA, 20 bp, human
gcttgcagggaagggactcg

SEQ ID NO: 239938 - DNA, 20 bp, human
gtagcactcacacacttgca

SEQ ID NO: 239939 - DNA, 20 bp, human
gagagcacagaagatttcat

SEQ ID NO: 239940 - DNA, 20 bp, human
gcgccagggcgcaaagacct

SEQ ID NO: 239941 - DNA, 20 bp, human
gaagtgtgtgagtgctacaa

SEQ ID NO: 239942 - DNA, 20 bp, human
gaaaggtgacatggcatatt

SEQ ID NO: 239943 - DNA, 20 bp, human
gaagcccagtttttccaggt

SEQ ID NO: 239944 - DNA, 20 bp, human
gaatccagcccagctcgccg

SEQ ID NO: 239945 - DNA, 20 bp, human
gcctggagaccaaaatagaa

SEQ ID NO: 239946 - DNA, 20 bp, human
gaaaagcatgaactacagga

SEQ ID NO: 239947 - DNA, 20 bp, human
gtgggtgaggccacctagca

SEQ ID NO: 239948 - DNA, 20 bp, human
gatggccccctgcctcatgg

SEQ ID NO: 239949 - DNA, 20 bp, human
gccagagcccacatgctcgt

SEQ ID NO: 239950 - DNA, 20 bp, human
ggcgggacagagttctctca

SEQ ID NO: 239951 - DNA, 20 bp, human
gtgaactacaggagggaatg

SEQ ID NO: 239952 - DNA, 20 bp, human
gccagatgacctggtgggtg

SEQ ID NO: 239953 - DNA, 20 bp, human
gcatcacccagatgacctgg

SEQ ID NO: 239954 - DNA, 20 bp, human
gaggaggagagtggtcccag

SEQ ID NO: 239955 - DNA, 20 bp, human
gcagaggcccacgagcatgt

SEQ ID NO: 239956 - DNA, 20 bp, human
ggacagcagtatatcctgaa

SEQ ID NO: 239957 - DNA, 20 bp, human
gaaaccagacagcaaactga

SEQ ID NO: 239958 - DNA, 20 bp, human
ggcagcttcagagtgtgatc

SEQ ID NO: 239959 - DNA, 20 bp, human
gcatggaggtagctggaata

SEQ ID NO: 239960 - DNA, 20 bp, human
ggagtgtgatcaggtagaat

SEQ ID NO: 239961 - DNA, 20 bp, human
gatcccatcagtttgctgtc

SEQ ID NO: 239962 - DNA, 20 bp, human
gcagttaagtgacgtatttt

SEQ ID NO: 239963 - DNA, 20 bp, human
ggtcattgagaagagaatcc

SEQ ID NO: 239964 - DNA, 20 bp, human
gtctagccaaaaagactaac

SEQ ID NO: 239965 - DNA, 20 bp, human
gatatactgctgtccagcag

SEQ ID NO: 239966 - DNA, 20 bp, human
gctggagcccagggagttac

SEQ ID NO: 239967 - DNA, 20 bp, human
gttcatactcagcttgtcaa

SEQ ID NO: 239968 - DNA, 20 bp, human
gtgggtgcttgtctgctgga

SEQ ID NO: 239969 - DNA, 20 bp, human
gaagtgaggcatatctgtaa

SEQ ID NO: 239970 - DNA, 20 bp, human
gtacagtcccagtaactccc

SEQ ID NO: 239971 - DNA, 20 bp, human
gggaagcccccacgttgatt

SEQ ID NO: 239972 - DNA, 20 bp, human
gtaagcaattgtgtaaagtg

SEQ ID NO: 239973 - DNA, 20 bp, human
gtggctgggtgcttgtctgc

SEQ ID NO: 239974 - DNA, 20 bp, human
gtctgtgggttgacttgatt

SEQ ID NO: 239975 - DNA, 20 bp, human
gtgtcgctcccacaaacagg

SEQ ID NO: 239976 - DNA, 20 bp, human
gcaggtggggagcataggaa

SEQ ID NO: 239977 - DNA, 20 bp, human
ggggatgatcagagtcaggg

SEQ ID NO: 239978 - DNA, 20 bp, human
ggggctgcagggctcgctgg

SEQ ID NO: 239979 - DNA, 20 bp, human
gacgactctgggctgatcaa

SEQ ID NO: 239980 - DNA, 20 bp, human
gcaaagcaggtggggagcat

SEQ ID NO: 239981 - DNA, 20 bp, human
gagaccaagaaagttacaga

SEQ ID NO: 239982 - DNA, 20 bp, human
gggggcaggcacaaattgga

SEQ ID NO: 239983 - DNA, 20 bp, human
gcaggggatgatcagagtca

SEQ ID NO: 239984 - DNA, 20 bp, human
gactctgggctgatcaaggg

SEQ ID NO: 239985 - DNA, 20 bp, human
ggggctgtggtcctgtgcct

SEQ ID NO: 239986 - DNA, 20 bp, human
gagggcaaggagagaaccgt

SEQ ID NO: 239987 - DNA, 20 bp, human
gaacctgtgggtgcactcag

SEQ ID NO: 239988 - DNA, 20 bp, human
ggggccccaggcagtgatcc

SEQ ID NO: 239989 - DNA, 20 bp, human
gagcagggaagggagcatcg

SEQ ID NO: 239990 - DNA, 20 bp, human
gggctccaggatcactgcct

SEQ ID NO: 239991 - DNA, 20 bp, human
gaagggagcatcgtggtgac

SEQ ID NO: 239992 - DNA, 20 bp, human
gtggccgcgcaagtgaccgg

SEQ ID NO: 239993 - DNA, 20 bp, human
ggggaggggtctcacagggg

SEQ ID NO: 239994 - DNA, 20 bp, human
gacccaggacccagaacctg

SEQ ID NO: 239995 - DNA, 20 bp, human
gctccagcctatgtccggtg

SEQ ID NO: 239996 - DNA, 20 bp, human
gcgtacgtgcggtaggggaa

SEQ ID NO: 239997 - DNA, 20 bp, human
ggcacccagcccggcggaga

SEQ ID NO: 239998 - DNA, 20 bp, human
gtacacaaggcgtccttccc

SEQ ID NO: 239999 - DNA, 20 bp, human
gcgtgtgcagctcccgcagg

SEQ ID NO: 240000 - DNA, 20 bp, human
ggcggggcgtacgtgcggta

SEQ ID NO: 240001 - DNA, 20 bp, human
ggggcgagctccttctccgc

SEQ ID NO: 240002 - DNA, 20 bp, human
gagagacgctaacacaccct

SEQ ID NO: 240003 - DNA, 20 bp, human
ggcgggagctgcacacgccc

SEQ ID NO: 240004 - DNA, 20 bp, human
gtttctgtcccaggtttccg

SEQ ID NO: 240005 - DNA, 20 bp, human
ggcacctgctcagatctggt

SEQ ID NO: 240006 - DNA, 20 bp, human
gaccgcgcgcccagggggac

SEQ ID NO: 240007 - DNA, 20 bp, human
ggggtcactgagtgcgactg

SEQ ID NO: 240008 - DNA, 20 bp, human
gcgcccaggctggagatgtg

SEQ ID NO: 240009 - DNA, 20 bp, human
gcgcgcccagggggacgggg

SEQ ID NO: 240010 - DNA, 20 bp, human
ggggatggaccgcgcgccca

SEQ ID NO: 240011 - DNA, 20 bp, human
ggaggtaccagggaaggcgg

SEQ ID NO: 240012 - DNA, 20 bp, human
ggcagggagcgccgggctgt

SEQ ID NO: 240013 - DNA, 20 bp, human
gcccgcctcagccggctggg

SEQ ID NO: 240014 - DNA, 20 bp, human
ggggaggtcagactgactcc

SEQ ID NO: 240015 - DNA, 20 bp, human
gggggtggggggcacatcta

SEQ ID NO: 240016 - DNA, 20 bp, human
gggcggggctatgaatagac

SEQ ID NO: 240017 - DNA, 20 bp, human
ggggccaggcgtggaaaaag

SEQ ID NO: 240018 - DNA, 20 bp, human
ggcagacagggttggaccag

SEQ ID NO: 240019 - DNA, 20 bp, human
gaagggttggtggggatcgg

SEQ ID NO: 240020 - DNA, 20 bp, human
gggttggtggggatcggagg

SEQ ID NO: 240021 - DNA, 20 bp, human
ggacatccggtggttagaga

SEQ ID NO: 240022 - DNA, 20 bp, human
gggccagagggaaatagggg

SEQ ID NO: 240023 - DNA, 20 bp, human
gtgactaggccaaggacatc

SEQ ID NO: 240024 - DNA, 20 bp, human
gaacaaggcgaggattgggc

SEQ ID NO: 240025 - DNA, 20 bp, human
gccaggaaggcaaagacttg

SEQ ID NO: 240026 - DNA, 20 bp, human
gcacaggtgttcatcctccc

SEQ ID NO: 240027 - DNA, 20 bp, human
gaaagatctcagccactcac

SEQ ID NO: 240028 - DNA, 20 bp, human
ggtgaattcccctaagatta

SEQ ID NO: 240029 - DNA, 20 bp, human
gaagagacatctaggctgtc

SEQ ID NO: 240030 - DNA, 20 bp, human
gatgtctcttcatgcaagaa

SEQ ID NO: 240031 - DNA, 20 bp, human
ggagtcagaacaaacttgtt

SEQ ID NO: 240032 - DNA, 20 bp, human
gtacaggtaaagctcatgct

SEQ ID NO: 240033 - DNA, 20 bp, human
gcaatctcaaccgtaatctt

SEQ ID NO: 240034 - DNA, 20 bp, human
gaggttgagccttgattaac

SEQ ID NO: 240035 - DNA, 20 bp, human
gggagttctccagttaatca

SEQ ID NO: 240036 - DNA, 20 bp, human
gagcccgctcggtggagact

SEQ ID NO: 240037 - DNA, 20 bp, human
gccggcgctgggtacgctcc

SEQ ID NO: 240038 - DNA, 20 bp, human
gtgtgagcgggaggtactcc

SEQ ID NO: 240039 - DNA, 20 bp, human
gcgcgcgcccggctccttaa

SEQ ID NO: 240040 - DNA, 20 bp, human
gctgcagcccgaggtgtgag

SEQ ID NO: 240041 - DNA, 20 bp, human
gaggccgagagcccgctcgg

SEQ ID NO: 240042 - DNA, 20 bp, human
ggccgccgagacgctggccc

SEQ ID NO: 240043 - DNA, 20 bp, human
gagcgtctcggcggccaccc

SEQ ID NO: 240044 - DNA, 20 bp, human
gagcccgaggtgtgagcggg

SEQ ID NO: 240045 - DNA, 20 bp, human
gcgggaggtactcccggcgc

SEQ ID NO: 240046 - DNA, 20 bp, human
gtagggaccctcaactgaga

SEQ ID NO: 240047 - DNA, 20 bp, human
gaggtagatgcaggcaacag

SEQ ID NO: 240048 - DNA, 20 bp, human
gtctgcttagatggagtctc

SEQ ID NO: 240049 - DNA, 20 bp, human
gctaacacaccctgggttcc

SEQ ID NO: 240050 - DNA, 20 bp, human
gccaacagtgctgttgtggg

SEQ ID NO: 240051 - DNA, 20 bp, human
gcagaaaaggaggtagatgc

SEQ ID NO: 240052 - DNA, 20 bp, human
ggagggcaggcctggatctc

SEQ ID NO: 240053 - DNA, 20 bp, human
gcaggagggatcagaagctg

SEQ ID NO: 240054 - DNA, 20 bp, human
gtggggggccatctcagttg

SEQ ID NO: 240055 - DNA, 20 bp, human
gtcccttagtccctggactc

SEQ ID NO: 240056 - DNA, 20 bp, human
gggccctaagggagggacta

SEQ ID NO: 240057 - DNA, 20 bp, human
gaggcaggatcaagtcccgg

SEQ ID NO: 240058 - DNA, 20 bp, human
gcggggcctgggacgagacc

SEQ ID NO: 240059 - DNA, 20 bp, human
ggtaagtgtaggccccgaag

SEQ ID NO: 240060 - DNA, 20 bp, human
gcctgtgctggcggtcccag

SEQ ID NO: 240061 - DNA, 20 bp, human
gtaggctgagggggccctaa

SEQ ID NO: 240062 - DNA, 20 bp, human
gccccgaaggggcagtgacg

SEQ ID NO: 240063 - DNA, 20 bp, human
gagtggagacccgatcccct

SEQ ID NO: 240064 - DNA, 20 bp, human
gccgccaggctatgacccca

SEQ ID NO: 240065 - DNA, 20 bp, human
gaacctgctagtgaactagg

SEQ ID NO: 240066 - DNA, 20 bp, human
ggaaaaaaaaggggggtccc

SEQ ID NO: 240067 - DNA, 20 bp, human
gctgcagcatggtcggagaa

SEQ ID NO: 240068 - DNA, 20 bp, human
gagaacgagcgtcgggagac

SEQ ID NO: 240069 - DNA, 20 bp, human
gaagaagggctgttcctcca

SEQ ID NO: 240070 - DNA, 20 bp, human
gaatacaattgggacggtga

SEQ ID NO: 240071 - DNA, 20 bp, human
gttcctccacggcacggtgg

SEQ ID NO: 240072 - DNA, 20 bp, human
gccccggaggcggaaacgct

SEQ ID NO: 240073 - DNA, 20 bp, human
gtcttcgattggttctgccg

SEQ ID NO: 240074 - DNA, 20 bp, human
gacgagcgtcgggagacagg

SEQ ID NO: 240075 - DNA, 20 bp, human
gagacggccagaacgagcgt

SEQ ID NO: 240076 - DNA, 20 bp, human
gtactcccttgcaagagatg

SEQ ID NO: 240077 - DNA, 20 bp, human
gtgccccgcatctcttgcaa

SEQ ID NO: 240078 - DNA, 20 bp, human
gagagaatagagaaataacg

SEQ ID NO: 240079 - DNA, 20 bp, human
gaaacttttcactatggatg

SEQ ID NO: 240080 - DNA, 20 bp, human
gctatggatgtggtaaagtg

SEQ ID NO: 240081 - DNA, 20 bp, human
gaagtctaaaacatatctct

SEQ ID NO: 240082 - DNA, 20 bp, human
gaattaataagtcaggagtt

SEQ ID NO: 240083 - DNA, 20 bp, human
ggatgagaaacttttcacta

SEQ ID NO: 240084 - DNA, 20 bp, human
ggtgctatttttcttacagt

SEQ ID NO: 240085 - DNA, 20 bp, human
ggggagtaaattaataagtc

SEQ ID NO: 240086 - DNA, 20 bp, human
gtagcgtccgccgccctcga

SEQ ID NO: 240087 - DNA, 20 bp, human
ggagactgagccctcgaggg

SEQ ID NO: 240088 - DNA, 20 bp, human
gtgcgaggcccgaagagata

SEQ ID NO: 240089 - DNA, 20 bp, human
gaaggcaggcaggacagtgc

SEQ ID NO: 240090 - DNA, 20 bp, human
gggggagactgagccctcga

SEQ ID NO: 240091 - DNA, 20 bp, human
ggcctcgcaaccttccccca

SEQ ID NO: 240092 - DNA, 20 bp, human
gactgagccctcgagggcgg

SEQ ID NO: 240093 - DNA, 20 bp, human
ggggcggcggacgctagcgc

SEQ ID NO: 240094 - DNA, 20 bp, human
gggggtccagaccacccagg

SEQ ID NO: 240095 - DNA, 20 bp, human
ggtcctgcctgccttccttg

SEQ ID NO: 240096 - DNA, 20 bp, human
gtccccgcagctcggaggcg

SEQ ID NO: 240097 - DNA, 20 bp, human
gatgctggaaaggggctgta

SEQ ID NO: 240098 - DNA, 20 bp, human
ggctgggcagccatgcacgg

SEQ ID NO: 240099 - DNA, 20 bp, human
ggcaggagataggctcagat

SEQ ID NO: 240100 - DNA, 20 bp, human
gggtgctgggcggagacgct

SEQ ID NO: 240101 - DNA, 20 bp, human
gctacagggctgtggaatga

SEQ ID NO: 240102 - DNA, 20 bp, human
gcccccgcctccgagctgcg

SEQ ID NO: 240103 - DNA, 20 bp, human
gtgggtggacattcagtctc

SEQ ID NO: 240104 - DNA, 20 bp, human
ggctgcggggagtcccagcc

SEQ ID NO: 240105 - DNA, 20 bp, human
gaggtgtcagattgtgtttc

SEQ ID NO: 240106 - DNA, 20 bp, human
ggggcaggaaacacaggatg

SEQ ID NO: 240107 - DNA, 20 bp, human
ggggcaggggcaggaaacac

SEQ ID NO: 240108 - DNA, 20 bp, human
gggaggagggtgttagttcc

SEQ ID NO: 240109 - DNA, 20 bp, human
gtgactgatgaacacatctg

SEQ ID NO: 240110 - DNA, 20 bp, human
gcaggagacgcccacatctg

SEQ ID NO: 240111 - DNA, 20 bp, human
gtgccagggtgcctgtgtga

SEQ ID NO: 240112 - DNA, 20 bp, human
gactccccagccacagatgt

SEQ ID NO: 240113 - DNA, 20 bp, human
gataccaggcaaaggacgct

SEQ ID NO: 240114 - DNA, 20 bp, human
gttggccaaataccaggcaa

SEQ ID NO: 240115 - DNA, 20 bp, human
gcacagggcagcttactcaa

SEQ ID NO: 240116 - DNA, 20 bp, human
gggacaactgagcccgagtt

SEQ ID NO: 240117 - DNA, 20 bp, human
gtggacacaatgctgggctc

SEQ ID NO: 240118 - DNA, 20 bp, human
gaaggtggatgtctcttttg

SEQ ID NO: 240119 - DNA, 20 bp, human
gggaacagctgacaacgctg

SEQ ID NO: 240120 - DNA, 20 bp, human
gtcgccgaggaacctgacag

SEQ ID NO: 240121 - DNA, 20 bp, human
gctgacagcggctccagaga

SEQ ID NO: 240122 - DNA, 20 bp, human
ggggctcaggttacctgggc

SEQ ID NO: 240123 - DNA, 20 bp, human
gcagctgggtgtggtaggga

SEQ ID NO: 240124 - DNA, 20 bp, human
gatgctgggctcaggttacc

SEQ ID NO: 240125 - DNA, 20 bp, human
ggagccgctgtcaggttcct

SEQ ID NO: 240126 - DNA, 20 bp, human
gaaggcgcgcgccgaagggg

SEQ ID NO: 240127 - DNA, 20 bp, human
gggccggcgggcaagggcac

SEQ ID NO: 240128 - DNA, 20 bp, human
gcgcccgaagtccgggtggt

SEQ ID NO: 240129 - DNA, 20 bp, human
ggggaaggcgcgcgccgaag

SEQ ID NO: 240130 - DNA, 20 bp, human
gcaagggcaccggctgtctc

SEQ ID NO: 240131 - DNA, 20 bp, human
gtccagggcgctcgcggctg

SEQ ID NO: 240132 - DNA, 20 bp, human
gtgggtgtccagggcgctcg

SEQ ID NO: 240133 - DNA, 20 bp, human
gagaaggggcgggcggctcg

SEQ ID NO: 240134 - DNA, 20 bp, human
gccgccggccgcccgaagtc

SEQ ID NO: 240135 - DNA, 20 bp, human
gagccggtgcccttgcccgc

SEQ ID NO: 240136 - DNA, 20 bp, human
gggggcgcacggaaaaaccg

SEQ ID NO: 240137 - DNA, 20 bp, human
gaaagggagactcgggatcc

SEQ ID NO: 240138 - DNA, 20 bp, human
gagaaagaacgcttttgcag

SEQ ID NO: 240139 - DNA, 20 bp, human
gcggccgtgcgcgttccagc

SEQ ID NO: 240140 - DNA, 20 bp, human
ggggcctccatccagaaaac

SEQ ID NO: 240141 - DNA, 20 bp, human
gggcccagcgggacttgttc

SEQ ID NO: 240142 - DNA, 20 bp, human
gcggccggataggcgcgagg

SEQ ID NO: 240143 - DNA, 20 bp, human
gagactcgggatccgggcct

SEQ ID NO: 240144 - DNA, 20 bp, human
gggccggaacaagtcccgct

SEQ ID NO: 240145 - DNA, 20 bp, human
gcggccccctcgcgcctatc

SEQ ID NO: 240146 - DNA, 20 bp, human
gacgctccgccccggcgcta

SEQ ID NO: 240147 - DNA, 20 bp, human
gctggacgcgaccatatccc

SEQ ID NO: 240148 - DNA, 20 bp, human
gtgcgcgccgcgctcccgca

SEQ ID NO: 240149 - DNA, 20 bp, human
ggggctcggccgccgtctgg

SEQ ID NO: 240150 - DNA, 20 bp, human
gaccatatcccgggtagggg

SEQ ID NO: 240151 - DNA, 20 bp, human
ggggagggaccctagcgccg

SEQ ID NO: 240152 - DNA, 20 bp, human
gagggcttttgggaccctgc

SEQ ID NO: 240153 - DNA, 20 bp, human
gcgagcccggccggggactg

SEQ ID NO: 240154 - DNA, 20 bp, human
gtgggagtcggggttaaaga

SEQ ID NO: 240155 - DNA, 20 bp, human
gggagcgcgacgctccgccc

SEQ ID NO: 240156 - DNA, 20 bp, human
gggtgggcggagtcgatctc

SEQ ID NO: 240157 - DNA, 20 bp, human
gagaagacgaccggtaggag

SEQ ID NO: 240158 - DNA, 20 bp, human
gcactggctcgcgagggcgg

SEQ ID NO: 240159 - DNA, 20 bp, human
ggctcgtggcggccggtggg

SEQ ID NO: 240160 - DNA, 20 bp, human
gacatggcactggctcgcga

SEQ ID NO: 240161 - DNA, 20 bp, human
gaaaggggcgtggctcgtgg

SEQ ID NO: 240162 - DNA, 20 bp, human
gcgcggcgttgactccgccc

SEQ ID NO: 240163 - DNA, 20 bp, human
gagacgtcgcggccgccgga

SEQ ID NO: 240164 - DNA, 20 bp, human
gcggagtcaacgccgcggat

SEQ ID NO: 240165 - DNA, 20 bp, human
ggtggctcgtggcggccggt

SEQ ID NO: 240166 - DNA, 20 bp, human
gccaagaggcattgtcgcgg

SEQ ID NO: 240167 - DNA, 20 bp, human
gcacccctgggcaaacccta

SEQ ID NO: 240168 - DNA, 20 bp, human
gctagggcggagactgattg

SEQ ID NO: 240169 - DNA, 20 bp, human
gcgcccctagggtttgccca

SEQ ID NO: 240170 - DNA, 20 bp, human
gaggcacaagctccattccc

SEQ ID NO: 240171 - DNA, 20 bp, human
gtggggaagcccctcgcctc

SEQ ID NO: 240172 - DNA, 20 bp, human
ggggtgccattatccaccca

SEQ ID NO: 240173 - DNA, 20 bp, human
ggccgaagtccagggcgcta

SEQ ID NO: 240174 - DNA, 20 bp, human
gcagcccctgcgagtcgctg

SEQ ID NO: 240175 - DNA, 20 bp, human
ggacagggcaacgctctact

SEQ ID NO: 240176 - DNA, 20 bp, human
ggcaagggggagcacaccga

SEQ ID NO: 240177 - DNA, 20 bp, human
gagaggggcgggcgcccctg

SEQ ID NO: 240178 - DNA, 20 bp, human
ggaagagggcgcctgagtca

SEQ ID NO: 240179 - DNA, 20 bp, human
ggcgcacgcggacccctacc

SEQ ID NO: 240180 - DNA, 20 bp, human
gctctccccgcccccggcgt

SEQ ID NO: 240181 - DNA, 20 bp, human
gcgaaggcagaaaagactcg

SEQ ID NO: 240182 - DNA, 20 bp, human
ggcggacccctacccggaag

SEQ ID NO: 240183 - DNA, 20 bp, human
gaacatggtgctcaaggggt

SEQ ID NO: 240184 - DNA, 20 bp, human
gcgggggcgggcccacgccg

SEQ ID NO: 240185 - DNA, 20 bp, human
gcaggcgccctcttccgggt

SEQ ID NO: 240186 - DNA, 20 bp, human
gggacccggttcagggaagg

SEQ ID NO: 240187 - DNA, 20 bp, human
gctcccgcgcctaagcccgt

SEQ ID NO: 240188 - DNA, 20 bp, human
ggcgggcctgggaagagata

SEQ ID NO: 240189 - DNA, 20 bp, human
gaaccgggtcccacgggctt

SEQ ID NO: 240190 - DNA, 20 bp, human
ggtcccacgggcttaggcgc

SEQ ID NO: 240191 - DNA, 20 bp, human
ggccttgcggcggttccggg

SEQ ID NO: 240192 - DNA, 20 bp, human
gcgccgcaaggctagagcca

SEQ ID NO: 240193 - DNA, 20 bp, human
gctagccttgcggcggttcc

SEQ ID NO: 240194 - DNA, 20 bp, human
gaaccctggctctagccttg

SEQ ID NO: 240195 - DNA, 20 bp, human
gcaaaagttcacaccgctcg

SEQ ID NO: 240196 - DNA, 20 bp, human
gacaagcagtgttgactcgg

SEQ ID NO: 240197 - DNA, 20 bp, human
gacggcgaatgaaacatccg

SEQ ID NO: 240198 - DNA, 20 bp, human
gtgtcactgccagatttcag

SEQ ID NO: 240199 - DNA, 20 bp, human
gtgtcagcgcgacatggggc

SEQ ID NO: 240200 - DNA, 20 bp, human
gagtctggaatgtgagatca

SEQ ID NO: 240201 - DNA, 20 bp, human
gcacacaagcagtgttgact

SEQ ID NO: 240202 - DNA, 20 bp, human
gtgttgactcggagggggag

SEQ ID NO: 240203 - DNA, 20 bp, human
gagcagtgttgactcggagg

SEQ ID NO: 240204 - DNA, 20 bp, human
gcatcgaaacccctgaaatc

SEQ ID NO: 240205 - DNA, 20 bp, human
gtcaaggcgtgtgcgccgag

SEQ ID NO: 240206 - DNA, 20 bp, human
gccccgaggcgcagcgacgg

SEQ ID NO: 240207 - DNA, 20 bp, human
gcggggccggcgaaggggga

SEQ ID NO: 240208 - DNA, 20 bp, human
ggagccgcggcgacagacgg

SEQ ID NO: 240209 - DNA, 20 bp, human
gcccgcccccaacgccgagc

SEQ ID NO: 240210 - DNA, 20 bp, human
gagcccccgaggcgcagcga

SEQ ID NO: 240211 - DNA, 20 bp, human
ggcgccgccgtctgtcgccg

SEQ ID NO: 240212 - DNA, 20 bp, human
gcccgcgcgtcgcggtaaag

SEQ ID NO: 240213 - DNA, 20 bp, human
gctgccagccggcgcccggt

SEQ ID NO: 240214 - DNA, 20 bp, human
gtgcgggcgcccggcgtaag

SEQ ID NO: 240215 - DNA, 20 bp, human
ggcccggcgtaaggggagtc

SEQ ID NO: 240216 - DNA, 20 bp, human
gcgagtccccggggactgga

SEQ ID NO: 240217 - DNA, 20 bp, human
gcctgcgcgcccggcaactt

SEQ ID NO: 240218 - DNA, 20 bp, human
gcggccccaagcgagtcccc

SEQ ID NO: 240219 - DNA, 20 bp, human
gtctccctggcaaaggtcgg

SEQ ID NO: 240220 - DNA, 20 bp, human
ggcagcgccaacttcgccaa

SEQ ID NO: 240221 - DNA, 20 bp, human
ggggaacccgtgcagccaga

SEQ ID NO: 240222 - DNA, 20 bp, human
gccggggagccgctgtctcc

SEQ ID NO: 240223 - DNA, 20 bp, human
gagtccccggggactcgctt

SEQ ID NO: 240224 - DNA, 20 bp, human
gcggaacaaaggcccgcaga

SEQ ID NO: 240225 - DNA, 20 bp, human
gtgggaaccgttggcgaagt

SEQ ID NO: 240226 - DNA, 20 bp, human
gtgccaggatgcctccagtc

SEQ ID NO: 240227 - DNA, 20 bp, human
ggtgaaggtcaactccctat

SEQ ID NO: 240228 - DNA, 20 bp, human
ggagactgcttgaggtgggc

SEQ ID NO: 240229 - DNA, 20 bp, human
gaggaagccaagaggggagt

SEQ ID NO: 240230 - DNA, 20 bp, human
gcccagggagctagtagatg

SEQ ID NO: 240231 - DNA, 20 bp, human
gttaacactgctgagactca

SEQ ID NO: 240232 - DNA, 20 bp, human
gtggcatgttgactactgaa

SEQ ID NO: 240233 - DNA, 20 bp, human
gccccagactggaggcatcc

SEQ ID NO: 240234 - DNA, 20 bp, human
gtactgaaaggcaactgtga

SEQ ID NO: 240235 - DNA, 20 bp, human
gaaggacccaccttgcaaga

SEQ ID NO: 240236 - DNA, 20 bp, human
gcgcgccggccaacaaccct

SEQ ID NO: 240237 - DNA, 20 bp, human
gggcatggacgaagagtcgg

SEQ ID NO: 240238 - DNA, 20 bp, human
ggcagagcgaatctgggaac

SEQ ID NO: 240239 - DNA, 20 bp, human
gagcgccgagggttgttggc

SEQ ID NO: 240240 - DNA, 20 bp, human
gaggcagcgctgaagattgc

SEQ ID NO: 240241 - DNA, 20 bp, human
gtattaagggacacccagtg

SEQ ID NO: 240242 - DNA, 20 bp, human
ggggccgcagtgccgggctc

SEQ ID NO: 240243 - DNA, 20 bp, human
gactcgaggcagagcgaatc

SEQ ID NO: 240244 - DNA, 20 bp, human
gggtgaggagctttcagacg

SEQ ID NO: 240245 - DNA, 20 bp, human
gaccgaggggccatgtctcg

SEQ ID NO: 240246 - DNA, 20 bp, human
gccgaggggccacgcctcgg

SEQ ID NO: 240247 - DNA, 20 bp, human
gatgcccccgagagtgagga

SEQ ID NO: 240248 - DNA, 20 bp, human
gcgaccgaggggccacgcct

SEQ ID NO: 240249 - DNA, 20 bp, human
gccaaatccccagagaaggg

SEQ ID NO: 240250 - DNA, 20 bp, human
gagggcagggaatgcgcagg

SEQ ID NO: 240251 - DNA, 20 bp, human
gcgcctctgggcctaggcta

SEQ ID NO: 240252 - DNA, 20 bp, human
gttctctggggatttggggt

SEQ ID NO: 240253 - DNA, 20 bp, human
gtgaccctcctcactctcgg

SEQ ID NO: 240254 - DNA, 20 bp, human
gtcctctgtagtcagatgag

SEQ ID NO: 240255 - DNA, 20 bp, human
gacctctcatctgactacag

SEQ ID NO: 240256 - DNA, 20 bp, human
gtctgggcggggctgtagcg

SEQ ID NO: 240257 - DNA, 20 bp, human
gatgaagacttcattacgga

SEQ ID NO: 240258 - DNA, 20 bp, human
ggctctgccagatctgggcg

SEQ ID NO: 240259 - DNA, 20 bp, human
gctacagccccgcccagatc

SEQ ID NO: 240260 - DNA, 20 bp, human
ggggtctatggccctttact

SEQ ID NO: 240261 - DNA, 20 bp, human
ggaaaggtgggggtctggct

SEQ ID NO: 240262 - DNA, 20 bp, human
gcagagccgtgggcgaaccc

SEQ ID NO: 240263 - DNA, 20 bp, human
gagccgtgggcgaacccagg

SEQ ID NO: 240264 - DNA, 20 bp, human
gcccacggctctgccagatc

SEQ ID NO: 240265 - DNA, 20 bp, human
gtatctgcctaggatagcga

SEQ ID NO: 240266 - DNA, 20 bp, human
gcgcccgcgagcccccggga

SEQ ID NO: 240267 - DNA, 20 bp, human
gatgcactcggccctcccgg

SEQ ID NO: 240268 - DNA, 20 bp, human
gggagccgcagagcgcgcgt

SEQ ID NO: 240269 - DNA, 20 bp, human
gggagggccgagtgcatcgc

SEQ ID NO: 240270 - DNA, 20 bp, human
gcccgccgtggtggcggcta

SEQ ID NO: 240271 - DNA, 20 bp, human
gtctgagagcgctgccagag

SEQ ID NO: 240272 - DNA, 20 bp, human
ggcgcagggccggtgaaagg

SEQ ID NO: 240273 - DNA, 20 bp, human
ggcagtggcagcactggccg

SEQ ID NO: 240274 - DNA, 20 bp, human
gctagcgtcaggccggagtc

SEQ ID NO: 240275 - DNA, 20 bp, human
gcgcgcccacgcgcgctctg

SEQ ID NO: 240276 - DNA, 20 bp, human
gaattgggaaagaactgcta

SEQ ID NO: 240277 - DNA, 20 bp, human
gtgggagggcgagtcgccag

SEQ ID NO: 240278 - DNA, 20 bp, human
ggccaccccatgcccagtcg

SEQ ID NO: 240279 - DNA, 20 bp, human
gggagaagaccccagcgcag

SEQ ID NO: 240280 - DNA, 20 bp, human
gggagaggagagggcgaatt

SEQ ID NO: 240281 - DNA, 20 bp, human
gggcgaggccagaaagtcag

SEQ ID NO: 240282 - DNA, 20 bp, human
gggggaccagagagccacaa

SEQ ID NO: 240283 - DNA, 20 bp, human
gaacacgtccataggttaga

SEQ ID NO: 240284 - DNA, 20 bp, human
gcacttcctcgactgggcat

SEQ ID NO: 240285 - DNA, 20 bp, human
gggtaatcacttcctcgact

SEQ ID NO: 240286 - DNA, 20 bp, human
gtgcggatcacgggcagctc

SEQ ID NO: 240287 - DNA, 20 bp, human
gcgcccgcgcggtctgcgac

SEQ ID NO: 240288 - DNA, 20 bp, human
gactggagctggcgggcgga

SEQ ID NO: 240289 - DNA, 20 bp, human
gggtgctaggtgcggatcac

SEQ ID NO: 240290 - DNA, 20 bp, human
gcgcaaaagtgaatgagggg

SEQ ID NO: 240291 - DNA, 20 bp, human
gtggcgcaaaagtgaatgag

SEQ ID NO: 240292 - DNA, 20 bp, human
ggcgcccgggcgcgaatctc

SEQ ID NO: 240293 - DNA, 20 bp, human
gcgcggacggatcccgagag

SEQ ID NO: 240294 - DNA, 20 bp, human
gctccagtcgcagaccgcgc

SEQ ID NO: 240295 - DNA, 20 bp, human
gcgtccccagggctccggga

SEQ ID NO: 240296 - DNA, 20 bp, human
ggggacgaagagcaagagct

SEQ ID NO: 240297 - DNA, 20 bp, human
gagccggcctcctctccgga

SEQ ID NO: 240298 - DNA, 20 bp, human
gatccctgtcgggccgcctc

SEQ ID NO: 240299 - DNA, 20 bp, human
gcggcaacgcgtccgctcct

SEQ ID NO: 240300 - DNA, 20 bp, human
gggactgaggcgcggacggg

SEQ ID NO: 240301 - DNA, 20 bp, human
gctccgagctggcccggagg

SEQ ID NO: 240302 - DNA, 20 bp, human
ggccagccggagagaagcgc

SEQ ID NO: 240303 - DNA, 20 bp, human
gcccaggcgcgccactgaca

SEQ ID NO: 240304 - DNA, 20 bp, human
gacggggggcgtccaagggc

SEQ ID NO: 240305 - DNA, 20 bp, human
ggacagggatcgtttccttc

SEQ ID NO: 240306 - DNA, 20 bp, human
ggaccctggaagctccgctc

SEQ ID NO: 240307 - DNA, 20 bp, human
gctccccaggacaggacgcg

SEQ ID NO: 240308 - DNA, 20 bp, human
ggcccccgcgtcctgtcctg

SEQ ID NO: 240309 - DNA, 20 bp, human
gcacgccggctgctgattgg

SEQ ID NO: 240310 - DNA, 20 bp, human
gcgcgcgcagcggtgcaggg

SEQ ID NO: 240311 - DNA, 20 bp, human
gggccaatggcgagctcccc

SEQ ID NO: 240312 - DNA, 20 bp, human
gcagcagccggcgtgcccgg

SEQ ID NO: 240313 - DNA, 20 bp, human
gcggggcgggcagtgcgcga

SEQ ID NO: 240314 - DNA, 20 bp, human
ggggcacgccggctgctgat

SEQ ID NO: 240315 - DNA, 20 bp, human
ggtccggagcggagcttcca

SEQ ID NO: 240316 - DNA, 20 bp, human
ggcaccgggaaggggagcgt

SEQ ID NO: 240317 - DNA, 20 bp, human
gtggggccgctggtgagttg

SEQ ID NO: 240318 - DNA, 20 bp, human
ggagaggcgagcaccgggaa

SEQ ID NO: 240319 - DNA, 20 bp, human
ggggtctccttgtcccgagg

SEQ ID NO: 240320 - DNA, 20 bp, human
ggaagcggctgcgagagctg

SEQ ID NO: 240321 - DNA, 20 bp, human
gtgcgccaggagcacttccg

SEQ ID NO: 240322 - DNA, 20 bp, human
gagagcaagcgcgttcggtc

SEQ ID NO: 240323 - DNA, 20 bp, human
gaaggtggccggcccagggt

SEQ ID NO: 240324 - DNA, 20 bp, human
gctgggggggtcttacaagg

SEQ ID NO: 240325 - DNA, 20 bp, human
ggagctgggggggtcttaca

SEQ ID NO: 240326 - DNA, 20 bp, human
gacgcctgcgcagaggtcag

SEQ ID NO: 240327 - DNA, 20 bp, human
gcctgcgcagaggtcagagg

SEQ ID NO: 240328 - DNA, 20 bp, human
gggtcagaggcggagcctta

SEQ ID NO: 240329 - DNA, 20 bp, human
gaggcggagccttagggcga

SEQ ID NO: 240330 - DNA, 20 bp, human
gcccctaggggcgtggccaa

SEQ ID NO: 240331 - DNA, 20 bp, human
ggccaatggtcctgttgttg

SEQ ID NO: 240332 - DNA, 20 bp, human
gtccgcgcacgactagaggg

SEQ ID NO: 240333 - DNA, 20 bp, human
ggccccaacaacaggaccat

SEQ ID NO: 240334 - DNA, 20 bp, human
gtactggaacgtgaagtccc

SEQ ID NO: 240335 - DNA, 20 bp, human
gcggagccttagggcgaagg

SEQ ID NO: 240336 - DNA, 20 bp, human
ggccctgccggctaagggat

SEQ ID NO: 240337 - DNA, 20 bp, human
gccagagccctgccggctaa

SEQ ID NO: 240338 - DNA, 20 bp, human
gccctcccggaaaatacgta

SEQ ID NO: 240339 - DNA, 20 bp, human
gagcgccctgggagaactta

SEQ ID NO: 240340 - DNA, 20 bp, human
ggggaagggccttctcgcag

SEQ ID NO: 240341 - DNA, 20 bp, human
gagggctctggcagcgccct

SEQ ID NO: 240342 - DNA, 20 bp, human
gcctgggagaacttagggaa

SEQ ID NO: 240343 - DNA, 20 bp, human
gaaagacgcgcgagcatcgg

SEQ ID NO: 240344 - DNA, 20 bp, human
gacgtaggggacttaaagag

SEQ ID NO: 240345 - DNA, 20 bp, human
gcccctacgtattttccggg

SEQ ID NO: 240346 - DNA, 20 bp, human
gcgtgcgtgggcaaagggtg

SEQ ID NO: 240347 - DNA, 20 bp, human
gtctccttggcaccgtgcgt

SEQ ID NO: 240348 - DNA, 20 bp, human
gctcctgggtattccgtctc

SEQ ID NO: 240349 - DNA, 20 bp, human
gtggcaccgtgcgtgggcaa

SEQ ID NO: 240350 - DNA, 20 bp, human
gtgctaaggggcggagactt

SEQ ID NO: 240351 - DNA, 20 bp, human
gttcccgagacggaataccc

SEQ ID NO: 240352 - DNA, 20 bp, human
gaggcagggcacagtctcct

SEQ ID NO: 240353 - DNA, 20 bp, human
ggacaacagttgctaagggg

SEQ ID NO: 240354 - DNA, 20 bp, human
gtgtgcgctaacagatgtga

SEQ ID NO: 240355 - DNA, 20 bp, human
gagcaactgttgtcaaggca

SEQ ID NO: 240356 - DNA, 20 bp, human
gcgtgcgtgggcaaagggtg

SEQ ID NO: 240357 - DNA, 20 bp, human
gctcctgggtattccgtctc

SEQ ID NO: 240358 - DNA, 20 bp, human
gtctccttggcaccgtgcgt

SEQ ID NO: 240359 - DNA, 20 bp, human
gtggcaccgtgcgtgggcaa

SEQ ID NO: 240360 - DNA, 20 bp, human
gtgctaaggggcggagactt

SEQ ID NO: 240361 - DNA, 20 bp, human
gttcccgagacggaataccc

SEQ ID NO: 240362 - DNA, 20 bp, human
gaggcagggcacagtctcct

SEQ ID NO: 240363 - DNA, 20 bp, human
ggacaacagttgctaagggg

SEQ ID NO: 240364 - DNA, 20 bp, human
gacccaggagtcgagtactt

SEQ ID NO: 240365 - DNA, 20 bp, human
gagcaactgttgtcaaggca

SEQ ID NO: 240366 - DNA, 20 bp, human
ggctctgcgcagggcctcac

SEQ ID NO: 240367 - DNA, 20 bp, human
gtcggcagggaaagcatcgc

SEQ ID NO: 240368 - DNA, 20 bp, human
ggtagtcgctcccctcacct

SEQ ID NO: 240369 - DNA, 20 bp, human
ggcgcagggcctcacgggac

SEQ ID NO: 240370 - DNA, 20 bp, human
gcccgcgcgcgtcacagcct

SEQ ID NO: 240371 - DNA, 20 bp, human
gtcacgggactggtagttcg

SEQ ID NO: 240372 - DNA, 20 bp, human
gcgcgccgccggctctgcgc

SEQ ID NO: 240373 - DNA, 20 bp, human
gctgcggccgccataccctc

SEQ ID NO: 240374 - DNA, 20 bp, human
ggctttccctgccgaggtga

SEQ ID NO: 240375 - DNA, 20 bp, human
gcggggcgacccaggtcctc

SEQ ID NO: 240376 - DNA, 20 bp, human
ggggctgccaagccggggag

SEQ ID NO: 240377 - DNA, 20 bp, human
ggggaccacggccctaagga

SEQ ID NO: 240378 - DNA, 20 bp, human
gctaccggtcgcgtcgccgt

SEQ ID NO: 240379 - DNA, 20 bp, human
ggcgacgcgaccggtagcta

SEQ ID NO: 240380 - DNA, 20 bp, human
gacgacttccgccctcctta

SEQ ID NO: 240381 - DNA, 20 bp, human
gaccacggccctaaggaggg

SEQ ID NO: 240382 - DNA, 20 bp, human
ggaagcgggcacgtcgccca

SEQ ID NO: 240383 - DNA, 20 bp, human
gaggtgaagggcatcggcgc

SEQ ID NO: 240384 - DNA, 20 bp, human
ggacgtgcccgcttccaaaa

SEQ ID NO: 240385 - DNA, 20 bp, human
ggcgatgcctgcccggtgag

SEQ ID NO: 240386 - DNA, 20 bp, human
ggcagctcgcctgccaaacc

SEQ ID NO: 240387 - DNA, 20 bp, human
gggaggggcccgacgctccg

SEQ ID NO: 240388 - DNA, 20 bp, human
ggccggctccaagcggtcct

SEQ ID NO: 240389 - DNA, 20 bp, human
gcagtgacgcggcccaaggg

SEQ ID NO: 240390 - DNA, 20 bp, human
ggttcccagccgggtttggc

SEQ ID NO: 240391 - DNA, 20 bp, human
gaaacccggctgggaacgcc

SEQ ID NO: 240392 - DNA, 20 bp, human
gcctaggcgagctggaggcg

SEQ ID NO: 240393 - DNA, 20 bp, human
ggggctccgccccggagcgt

SEQ ID NO: 240394 - DNA, 20 bp, human
ggaggcggggccgtgagtcc

SEQ ID NO: 240395 - DNA, 20 bp, human
gctggctgcgtatgcgtcac

SEQ ID NO: 240396 - DNA, 20 bp, human
gggagccaagggttcgtgcc

SEQ ID NO: 240397 - DNA, 20 bp, human
gtgagcccgggtcccgccgt

SEQ ID NO: 240398 - DNA, 20 bp, human
gggacaaagacccggagcgg

SEQ ID NO: 240399 - DNA, 20 bp, human
gcaggaagaggtgtgagccc

SEQ ID NO: 240400 - DNA, 20 bp, human
gcccgcggccggaagtgctg

SEQ ID NO: 240401 - DNA, 20 bp, human
gagggacagggcccgggtaa

SEQ ID NO: 240402 - DNA, 20 bp, human
ggctgcccggcacgaaccct

SEQ ID NO: 240403 - DNA, 20 bp, human
gctgcagcgcgcccgggtcc

SEQ ID NO: 240404 - DNA, 20 bp, human
gaacccttggctcccgcggc

SEQ ID NO: 240405 - DNA, 20 bp, human
ggcgcccgggtcccggcagg

SEQ ID NO: 240406 - DNA, 20 bp, human
gtgtccatgggtaaggataa

SEQ ID NO: 240407 - DNA, 20 bp, human
gtgggtaaggataagggctg

SEQ ID NO: 240408 - DNA, 20 bp, human
gcttacccatggacacattc

SEQ ID NO: 240409 - DNA, 20 bp, human
gacagcctgaatgtgtccat

SEQ ID NO: 240410 - DNA, 20 bp, human
ggggtgatggcgtaggtggg

SEQ ID NO: 240411 - DNA, 20 bp, human
ggtcacagagaagacctcag

SEQ ID NO: 240412 - DNA, 20 bp, human
gacaggcagggtatacagaa

SEQ ID NO: 240413 - DNA, 20 bp, human
gaaattacagccaggctctc

SEQ ID NO: 240414 - DNA, 20 bp, human
gaagcagggggtgatggcgt

SEQ ID NO: 240415 - DNA, 20 bp, human
gagagaagacctcagtgggg

SEQ ID NO: 240416 - DNA, 20 bp, human
ggaaaggcagtccaaagatg

SEQ ID NO: 240417 - DNA, 20 bp, human
ggttacaatggggtggatct

SEQ ID NO: 240418 - DNA, 20 bp, human
gcttgtcccaggttacaatg

SEQ ID NO: 240419 - DNA, 20 bp, human
gagagtcacactgtcagctc

SEQ ID NO: 240420 - DNA, 20 bp, human
ggtcccaggttacaatgggg

SEQ ID NO: 240421 - DNA, 20 bp, human
gatattgaagagcttgtccc

SEQ ID NO: 240422 - DNA, 20 bp, human
ggactgatgcctcttagctt

SEQ ID NO: 240423 - DNA, 20 bp, human
gaccatgcccagctaggttg

SEQ ID NO: 240424 - DNA, 20 bp, human
gctcaggtggaatgggcaga

SEQ ID NO: 240425 - DNA, 20 bp, human
gaatggggtggatctgggat

SEQ ID NO: 240426 - DNA, 20 bp, human
gcgagccagcgagcggggaa

SEQ ID NO: 240427 - DNA, 20 bp, human
gcgcccgccggactccgcga

SEQ ID NO: 240428 - DNA, 20 bp, human
gcggactccgcgagggagga

SEQ ID NO: 240429 - DNA, 20 bp, human
gctccctcgcggagtccggc

SEQ ID NO: 240430 - DNA, 20 bp, human
ggccagcgagcggggaaggg

SEQ ID NO: 240431 - DNA, 20 bp, human
gttacccgccggagctgcga

SEQ ID NO: 240432 - DNA, 20 bp, human
gcccgccggagctgcgaggg

SEQ ID NO: 240433 - DNA, 20 bp, human
gggagcgcgtagtagtggcg

SEQ ID NO: 240434 - DNA, 20 bp, human
gccctcccttccccgctcgc

SEQ ID NO: 240435 - DNA, 20 bp, human
gggccagagccgttacccgc

SEQ ID NO: 240436 - DNA, 20 bp, human
ggtacggcccaaggcagcga

SEQ ID NO: 240437 - DNA, 20 bp, human
gcgggagccaggacgaccgg

SEQ ID NO: 240438 - DNA, 20 bp, human
gtgggagcccccggtcgtcc

SEQ ID NO: 240439 - DNA, 20 bp, human
ggcgcctcggagaacctgaa

SEQ ID NO: 240440 - DNA, 20 bp, human
gctgcgggagccaggacgac

SEQ ID NO: 240441 - DNA, 20 bp, human
gaagtcgcgatcctcggcgg

SEQ ID NO: 240442 - DNA, 20 bp, human
ggcgaagtcgcgatcctcgg

SEQ ID NO: 240443 - DNA, 20 bp, human
gagagacccggggagcatct

SEQ ID NO: 240444 - DNA, 20 bp, human
ggcagcttccgcatccctgc

SEQ ID NO: 240445 - DNA, 20 bp, human
gagcgcgaagtcgcgatcct

SEQ ID NO: 240446 - DNA, 20 bp, human
ggggccagatggggtcctgg

SEQ ID NO: 240447 - DNA, 20 bp, human
gagaagctgcagtttatgag

SEQ ID NO: 240448 - DNA, 20 bp, human
gggaacccggggcagagtgt

SEQ ID NO: 240449 - DNA, 20 bp, human
ggtgatgacatgtgttgtga

SEQ ID NO: 240450 - DNA, 20 bp, human
gcctgcctggccagtaagaa

SEQ ID NO: 240451 - DNA, 20 bp, human
gaagggcaaagtccaagggg

SEQ ID NO: 240452 - DNA, 20 bp, human
ggggacggtttctggctctc

SEQ ID NO: 240453 - DNA, 20 bp, human
gtcctggaggaagaattgcc

SEQ ID NO: 240454 - DNA, 20 bp, human
ggatcctgatacatggattc

SEQ ID NO: 240455 - DNA, 20 bp, human
ggccaggcaattcttcctcc

SEQ ID NO: 240456 - DNA, 20 bp, human
gcggggcagcagatctccag

SEQ ID NO: 240457 - DNA, 20 bp, human
ggggcggccgctctagggaa

SEQ ID NO: 240458 - DNA, 20 bp, human
gtcctcacgcggctcttcga

SEQ ID NO: 240459 - DNA, 20 bp, human
gaggaaacggggacctgccc

SEQ ID NO: 240460 - DNA, 20 bp, human
gaagagccgcgtgaggaaac

SEQ ID NO: 240461 - DNA, 20 bp, human
gaacactgacctctggaggg

SEQ ID NO: 240462 - DNA, 20 bp, human
gcggtgaagacgtagagcac

SEQ ID NO: 240463 - DNA, 20 bp, human
ggcaatggagacccgggggg

SEQ ID NO: 240464 - DNA, 20 bp, human
gcggctcttcgaaggctctg

SEQ ID NO: 240465 - DNA, 20 bp, human
gcgcggcaatggagacccgg

SEQ ID NO: 240466 - DNA, 20 bp, human
gctggggaggagcttcatgg

SEQ ID NO: 240467 - DNA, 20 bp, human
gcaagcaagctgatatgggg

SEQ ID NO: 240468 - DNA, 20 bp, human
ggctcaagcaagctgatatg

SEQ ID NO: 240469 - DNA, 20 bp, human
gcagaaaaggcctaaaagga

SEQ ID NO: 240470 - DNA, 20 bp, human
gtaggccttttctggaagtc

SEQ ID NO: 240471 - DNA, 20 bp, human
ggtgcttgatctcatgtcat

SEQ ID NO: 240472 - DNA, 20 bp, human
gagctggggaaaagagcttg

SEQ ID NO: 240473 - DNA, 20 bp, human
gccagcctgacttccagaaa

SEQ ID NO: 240474 - DNA, 20 bp, human
gagcaggcagatgtgggttg

SEQ ID NO: 240475 - DNA, 20 bp, human
gaggctggggaggagcttca

SEQ ID NO: 240476 - DNA, 20 bp, human
ggtattggagagtatgtaca

SEQ ID NO: 240477 - DNA, 20 bp, human
gaaggggctcggattgctca

SEQ ID NO: 240478 - DNA, 20 bp, human
ggacaggaacaaatcgggca

SEQ ID NO: 240479 - DNA, 20 bp, human
ggtctctggactagaggtga

SEQ ID NO: 240480 - DNA, 20 bp, human
gtcaaggacccatgggagag

SEQ ID NO: 240481 - DNA, 20 bp, human
gaaagcctcctctctcccat

SEQ ID NO: 240482 - DNA, 20 bp, human
gtctagtccagagacctcac

SEQ ID NO: 240483 - DNA, 20 bp, human
gggattgctcaaggacccat

SEQ ID NO: 240484 - DNA, 20 bp, human
gttggccactgtgaagcctc

SEQ ID NO: 240485 - DNA, 20 bp, human
gacctcctgccagcgtaaag

SEQ ID NO: 240486 - DNA, 20 bp, human
gggagtgtggtaaaattaga

SEQ ID NO: 240487 - DNA, 20 bp, human
gaggtgtggggagggcttaa

SEQ ID NO: 240488 - DNA, 20 bp, human
gcgcttggggccaccttgca

SEQ ID NO: 240489 - DNA, 20 bp, human
gcatgcaaagaaacaagtga

SEQ ID NO: 240490 - DNA, 20 bp, human
gaacagaaatctgaccgctt

SEQ ID NO: 240491 - DNA, 20 bp, human
gccttactgtggactgaatt

SEQ ID NO: 240492 - DNA, 20 bp, human
gttgcacagaaagtctgttg

SEQ ID NO: 240493 - DNA, 20 bp, human
gagcttggcgggctcccaac

SEQ ID NO: 240494 - DNA, 20 bp, human
gttggcagctggcaccagtg

SEQ ID NO: 240495 - DNA, 20 bp, human
gctgaacgtcagactgttga

SEQ ID NO: 240496 - DNA, 20 bp, human
ggtgaactgcaaggggacat

SEQ ID NO: 240497 - DNA, 20 bp, human
ggcccacctggcccatcacc

SEQ ID NO: 240498 - DNA, 20 bp, human
gccaccagctgtgctatata

SEQ ID NO: 240499 - DNA, 20 bp, human
gcctaaggaggagatgccgc

SEQ ID NO: 240500 - DNA, 20 bp, human
gggcaactactcagcttctc

SEQ ID NO: 240501 - DNA, 20 bp, human
gattttatgtccagatccta

SEQ ID NO: 240502 - DNA, 20 bp, human
gggaggctcatgctcagatc

SEQ ID NO: 240503 - DNA, 20 bp, human
ggacctggtgatgggccagg

SEQ ID NO: 240504 - DNA, 20 bp, human
gggaacctcagaagggataa

SEQ ID NO: 240505 - DNA, 20 bp, human
gccacggggaattctagatc

SEQ ID NO: 240506 - DNA, 20 bp, human
gggcgctcgagcaacccctc

SEQ ID NO: 240507 - DNA, 20 bp, human
ggcacagccagacgcaccaa

SEQ ID NO: 240508 - DNA, 20 bp, human
gccaaggggggcgacccaga

SEQ ID NO: 240509 - DNA, 20 bp, human
gcagccagacgcaccaaggg

SEQ ID NO: 240510 - DNA, 20 bp, human
gggctgtcctgggttccccg

SEQ ID NO: 240511 - DNA, 20 bp, human
gagggggcgtggcctgaatg

SEQ ID NO: 240512 - DNA, 20 bp, human
gtccaagtgacacttccctc

SEQ ID NO: 240513 - DNA, 20 bp, human
gagcaggccacggggaaccc

SEQ ID NO: 240514 - DNA, 20 bp, human
gggtccgagcagcttgaggc

SEQ ID NO: 240515 - DNA, 20 bp, human
ggctcgagcgccgtcaccca

SEQ ID NO: 240516 - DNA, 20 bp, human
gccggcggggccgacgagtc

SEQ ID NO: 240517 - DNA, 20 bp, human
gggggccgacgagtccggag

SEQ ID NO: 240518 - DNA, 20 bp, human
ggcagcccctccggactcgt

SEQ ID NO: 240519 - DNA, 20 bp, human
gctgccgggagcctgttccc

SEQ ID NO: 240520 - DNA, 20 bp, human
gtgcccagggaacaggctcc

SEQ ID NO: 240521 - DNA, 20 bp, human
ggccccgttgcccagggaac

SEQ ID NO: 240522 - DNA, 20 bp, human
gccacaagtggcagcgggcg

SEQ ID NO: 240523 - DNA, 20 bp, human
gggtccgcagcggggaacag

SEQ ID NO: 240524 - DNA, 20 bp, human
ggggcggatgtaagggacgc

SEQ ID NO: 240525 - DNA, 20 bp, human
ggctccgccgggggctagag

SEQ ID NO: 240526 - DNA, 20 bp, human
ggaagtgacaggtggacgga

SEQ ID NO: 240527 - DNA, 20 bp, human
gacccgaagtgacaggtgga

SEQ ID NO: 240528 - DNA, 20 bp, human
gaggtgaggggcgcgcacgg

SEQ ID NO: 240529 - DNA, 20 bp, human
gcccagctacccgaagtgac

SEQ ID NO: 240530 - DNA, 20 bp, human
gcagtggaggcatcagttgc

SEQ ID NO: 240531 - DNA, 20 bp, human
gcggggtgcggggtggaccg

SEQ ID NO: 240532 - DNA, 20 bp, human
gcatagttgagacagaaacc

SEQ ID NO: 240533 - DNA, 20 bp, human
gggaagacccaactgtggcg

SEQ ID NO: 240534 - DNA, 20 bp, human
gggggaacttccgagatcaa

SEQ ID NO: 240535 - DNA, 20 bp, human
ggcggcggcccttcgaccaa

SEQ ID NO: 240536 - DNA, 20 bp, human
ggtgcgcgccccttccgaga

SEQ ID NO: 240537 - DNA, 20 bp, human
ggcctctagccccgattccc

SEQ ID NO: 240538 - DNA, 20 bp, human
gcctgcggcggggaacaaat

SEQ ID NO: 240539 - DNA, 20 bp, human
gggagcaggcacgcgtaact

SEQ ID NO: 240540 - DNA, 20 bp, human
gccctcccgcggactggtgt

SEQ ID NO: 240541 - DNA, 20 bp, human
gcgagcccgacaccagtccg

SEQ ID NO: 240542 - DNA, 20 bp, human
gtggtgtcgggctcgactat

SEQ ID NO: 240543 - DNA, 20 bp, human
gccccctcgagcgcgggtgg

SEQ ID NO: 240544 - DNA, 20 bp, human
ggtcctccacccgcgctcga

SEQ ID NO: 240545 - DNA, 20 bp, human
ggtcacgccccctcgagcgc

SEQ ID NO: 240546 - DNA, 20 bp, human
gcgcggctcggagagaagaa

SEQ ID NO: 240547 - DNA, 20 bp, human
gccaccccggaggcccctcc

SEQ ID NO: 240548 - DNA, 20 bp, human
ggtgtggagacggaaggcgg

SEQ ID NO: 240549 - DNA, 20 bp, human
gagcgggagaagggcggaaa

SEQ ID NO: 240550 - DNA, 20 bp, human
ggaagggagcggtgtggaga

SEQ ID NO: 240551 - DNA, 20 bp, human
gaagcccggaggggcctccg

SEQ ID NO: 240552 - DNA, 20 bp, human
ggagaagaatggcgagccga

SEQ ID NO: 240553 - DNA, 20 bp, human
gaggtgggggcaagcccgga

SEQ ID NO: 240554 - DNA, 20 bp, human
gtgcgccaggagcacttccg

SEQ ID NO: 240555 - DNA, 20 bp, human
ggcgagggagcgggaagcta

SEQ ID NO: 240556 - DNA, 20 bp, human
gtgggaggaggaaaagactt

SEQ ID NO: 240557 - DNA, 20 bp, human
gtggagctgtcctggccata

SEQ ID NO: 240558 - DNA, 20 bp, human
ggtgtgagctcgaccctggt

SEQ ID NO: 240559 - DNA, 20 bp, human
gtcccgtagctgtcaaaatc

SEQ ID NO: 240560 - DNA, 20 bp, human
gtttgcgcaacgccgagggg

SEQ ID NO: 240561 - DNA, 20 bp, human
gaggcgccgcggcgggtcgt

SEQ ID NO: 240562 - DNA, 20 bp, human
gcataaggaagtctggactc

SEQ ID NO: 240563 - DNA, 20 bp, human
gctggaagagacgtaaaatc

SEQ ID NO: 240564 - DNA, 20 bp, human
gcgcctgcgcggtagcatcg

SEQ ID NO: 240565 - DNA, 20 bp, human
gagagtttgcgcaacgccga

SEQ ID NO: 240566 - DNA, 20 bp, human
gggcgagtgacgtacgctcg

SEQ ID NO: 240567 - DNA, 20 bp, human
ggccgggcgccgattggcgg

SEQ ID NO: 240568 - DNA, 20 bp, human
ggagtgacgtacgctcgcgg

SEQ ID NO: 240569 - DNA, 20 bp, human
gcgggtagcgaggccctcct

SEQ ID NO: 240570 - DNA, 20 bp, human
gaggcactggggtctgggta

SEQ ID NO: 240571 - DNA, 20 bp, human
gcgctcgcggcggactgccg

SEQ ID NO: 240572 - DNA, 20 bp, human
gtcacacgagattccgagga

SEQ ID NO: 240573 - DNA, 20 bp, human
gtcggaatctcgtgtgaagg

SEQ ID NO: 240574 - DNA, 20 bp, human
ggccgaggcgcgggaactgg

SEQ ID NO: 240575 - DNA, 20 bp, human
ggtagggggaggatactcat

SEQ ID NO: 240576 - DNA, 20 bp, human
gacgccgcggcgttctgcga

SEQ ID NO: 240577 - DNA, 20 bp, human
ggggaccgaccgctcacgcc

SEQ ID NO: 240578 - DNA, 20 bp, human
gcacgcccggcgtgctgagg

SEQ ID NO: 240579 - DNA, 20 bp, human
gaacgccgcggcgtcttccg

SEQ ID NO: 240580 - DNA, 20 bp, human
gtcagcacgccgggcgtgag

SEQ ID NO: 240581 - DNA, 20 bp, human
ggggtacggaagcccgacca

SEQ ID NO: 240582 - DNA, 20 bp, human
gccgcggcgttctgcgaggg

SEQ ID NO: 240583 - DNA, 20 bp, human
ggctgggcgggcgccgtggt

SEQ ID NO: 240584 - DNA, 20 bp, human
gctggcgggccggggaccga

SEQ ID NO: 240585 - DNA, 20 bp, human
ggggcggggaggtgacccgg

SEQ ID NO: 240586 - DNA, 20 bp, human
gggtgcgcgggccccgtcgc

SEQ ID NO: 240587 - DNA, 20 bp, human
gcgggccccgtcgccgggtc

SEQ ID NO: 240588 - DNA, 20 bp, human
gaagacgctgcttccgggaa

SEQ ID NO: 240589 - DNA, 20 bp, human
gagggccccagacccggcga

SEQ ID NO: 240590 - DNA, 20 bp, human
gcggggctgaagctacccag

SEQ ID NO: 240591 - DNA, 20 bp, human
ggctggaacgcggcagacaa

SEQ ID NO: 240592 - DNA, 20 bp, human
gaccgcctgcgagggcgagg

SEQ ID NO: 240593 - DNA, 20 bp, human
gtgaccaatcgcgacgctga

SEQ ID NO: 240594 - DNA, 20 bp, human
gggggcgggccagacgagcg

SEQ ID NO: 240595 - DNA, 20 bp, human
gacgcggcagacaaaggatt

SEQ ID NO: 240596 - DNA, 20 bp, human
ggccccgcccatgtccctaa

SEQ ID NO: 240597 - DNA, 20 bp, human
gcccgttggtcgcgagtcaa

SEQ ID NO: 240598 - DNA, 20 bp, human
gagacgcccatgtctatcat

SEQ ID NO: 240599 - DNA, 20 bp, human
ggaccaacgggaaaaaggga

SEQ ID NO: 240600 - DNA, 20 bp, human
gacgctgattggtccaaaca

SEQ ID NO: 240601 - DNA, 20 bp, human
gaggacgcgactgttaatct

SEQ ID NO: 240602 - DNA, 20 bp, human
gatccctgaggaggtcgcca

SEQ ID NO: 240603 - DNA, 20 bp, human
gagggaagggcaaaatcagc

SEQ ID NO: 240604 - DNA, 20 bp, human
gagagcaggggacagcgccc

SEQ ID NO: 240605 - DNA, 20 bp, human
gtaatctaggatccctgagg

SEQ ID NO: 240606 - DNA, 20 bp, human
gcgggtgcccgcttctcccg

SEQ ID NO: 240607 - DNA, 20 bp, human
ggggagattagcaaagtcgg

SEQ ID NO: 240608 - DNA, 20 bp, human
gaggcaagagggggcttttc

SEQ ID NO: 240609 - DNA, 20 bp, human
gagagcgtccagatgcggtc

SEQ ID NO: 240610 - DNA, 20 bp, human
ggagccagagcgtccagatg

SEQ ID NO: 240611 - DNA, 20 bp, human
ggaggtcgactgggcagtag

SEQ ID NO: 240612 - DNA, 20 bp, human
ggggagggctgaggtcgact

SEQ ID NO: 240613 - DNA, 20 bp, human
ggccgagttcagcggaattg

SEQ ID NO: 240614 - DNA, 20 bp, human
gtgccagcgcgcccccctgc

SEQ ID NO: 240615 - DNA, 20 bp, human
gaggcgggccggagggttct

SEQ ID NO: 240616 - DNA, 20 bp, human
gctggggaacggagtccacg

SEQ ID NO: 240617 - DNA, 20 bp, human
gagaagccgggcactggcca

SEQ ID NO: 240618 - DNA, 20 bp, human
gggccaaggctcccggggtg

SEQ ID NO: 240619 - DNA, 20 bp, human
ggagccttggccggtccaca

SEQ ID NO: 240620 - DNA, 20 bp, human
gcgagctggtgcagtcaccg

SEQ ID NO: 240621 - DNA, 20 bp, human
gcagccctgtggaccggcca

SEQ ID NO: 240622 - DNA, 20 bp, human
gcggatcgtgtgaaagcaaa

SEQ ID NO: 240623 - DNA, 20 bp, human
gtgggcaagtccacgcaggg

SEQ ID NO: 240624 - DNA, 20 bp, human
gggggtggggctggcgagtc

SEQ ID NO: 240625 - DNA, 20 bp, human
gcggggcgcacacgagacgg

SEQ ID NO: 240626 - DNA, 20 bp, human
ggggaagaaaccagagtcgg

SEQ ID NO: 240627 - DNA, 20 bp, human
gcggtcctgccgagctgtga

SEQ ID NO: 240628 - DNA, 20 bp, human
gaacaccctggaccgggtcc

SEQ ID NO: 240629 - DNA, 20 bp, human
ggagctgtgagggcaacgga

SEQ ID NO: 240630 - DNA, 20 bp, human
gcccgcggcacgtgctgcag

SEQ ID NO: 240631 - DNA, 20 bp, human
gacccggtccagggtgttcg

SEQ ID NO: 240632 - DNA, 20 bp, human
gcgcccgatcgcaggggaag

SEQ ID NO: 240633 - DNA, 20 bp, human
gtgcaacaacaggatgagga

SEQ ID NO: 240634 - DNA, 20 bp, human
gttggcgccgcccgccctgg

SEQ ID NO: 240635 - DNA, 20 bp, human
ggcaacggaggggaaataaa

SEQ ID NO: 240636 - DNA, 20 bp, human
ggggactccggccacgcccc

SEQ ID NO: 240637 - DNA, 20 bp, human
ggcgtggccggagtcccaag

SEQ ID NO: 240638 - DNA, 20 bp, human
gtctgagcaccgccctgggg

SEQ ID NO: 240639 - DNA, 20 bp, human
gcacgcctgcatctaggtct

SEQ ID NO: 240640 - DNA, 20 bp, human
gagggcttcggaatcggact

SEQ ID NO: 240641 - DNA, 20 bp, human
gccagccaatgagcgtccga

SEQ ID NO: 240642 - DNA, 20 bp, human
gaccccgccccttgggactc

SEQ ID NO: 240643 - DNA, 20 bp, human
gcactggaaccccgcccctt

SEQ ID NO: 240644 - DNA, 20 bp, human
gggctctgagcaccgccctg

SEQ ID NO: 240645 - DNA, 20 bp, human
gagagcttgaactgaccaga

SEQ ID NO: 240646 - DNA, 20 bp, human
gatcccgcggggcatcgagg

SEQ ID NO: 240647 - DNA, 20 bp, human
gcctccgcatcgcgaagggg

SEQ ID NO: 240648 - DNA, 20 bp, human
gggggcgctagcaggtgcga

SEQ ID NO: 240649 - DNA, 20 bp, human
gcacaagtcacgctgggggg

SEQ ID NO: 240650 - DNA, 20 bp, human
gaagggtcagccatcccgcg

SEQ ID NO: 240651 - DNA, 20 bp, human
gcagtgcacaagtcacgctg

SEQ ID NO: 240652 - DNA, 20 bp, human
ggatcctggggccccgcgcg

SEQ ID NO: 240653 - DNA, 20 bp, human
gccccaggatcgcaggaccg

SEQ ID NO: 240654 - DNA, 20 bp, human
ggcatcgcgaaggggaggct

SEQ ID NO: 240655 - DNA, 20 bp, human
ggcggaggacgcgggacaga

SEQ ID NO: 240656 - DNA, 20 bp, human
ggactcagtcccaaccgaac

SEQ ID NO: 240657 - DNA, 20 bp, human
ggtgtctgcccagttcggtt

SEQ ID NO: 240658 - DNA, 20 bp, human
gaactgggcagacaccagac

SEQ ID NO: 240659 - DNA, 20 bp, human
gcatcctggacgtgcgatgg

SEQ ID NO: 240660 - DNA, 20 bp, human
ggccccggcaactgcagtcc

SEQ ID NO: 240661 - DNA, 20 bp, human
gtccgcctccctacgcccat

SEQ ID NO: 240662 - DNA, 20 bp, human
gtatgtcgtggggactgagc

SEQ ID NO: 240663 - DNA, 20 bp, human
gtgaataagccaatgggcgt

SEQ ID NO: 240664 - DNA, 20 bp, human
ggccaatgggcgtagggagg

SEQ ID NO: 240665 - DNA, 20 bp, human
gaattcacgcaggaaccaat

SEQ ID NO: 240666 - DNA, 20 bp, human
ggaagccgccctcaatgccg

SEQ ID NO: 240667 - DNA, 20 bp, human
gcgcacctcggcattgaggg

SEQ ID NO: 240668 - DNA, 20 bp, human
ggggtcccacgcccactcgg

SEQ ID NO: 240669 - DNA, 20 bp, human
gtgggcgtgggaccctccgt

SEQ ID NO: 240670 - DNA, 20 bp, human
gccggctgaggcccccacgg

SEQ ID NO: 240671 - DNA, 20 bp, human
ggggcgggacaacaggcaat

SEQ ID NO: 240672 - DNA, 20 bp, human
gtgtgagtgcgcctccgagt

SEQ ID NO: 240673 - DNA, 20 bp, human
gagtccctgggcggagagac

SEQ ID NO: 240674 - DNA, 20 bp, human
gggctctttgcggttggctc

SEQ ID NO: 240675 - DNA, 20 bp, human
ggccttgagaacccgacctt

SEQ ID NO: 240676 - DNA, 20 bp, human
gcgaccccgcctcccggtaa

SEQ ID NO: 240677 - DNA, 20 bp, human
gtccctctccggggtcgtgg

SEQ ID NO: 240678 - DNA, 20 bp, human
gggccgggcggggtctacgg

SEQ ID NO: 240679 - DNA, 20 bp, human
gtctcccggctcggctcgct

SEQ ID NO: 240680 - DNA, 20 bp, human
gccccgcctcccggtaaggg

SEQ ID NO: 240681 - DNA, 20 bp, human
gtcgctcggcctcccttacc

SEQ ID NO: 240682 - DNA, 20 bp, human
ggagggccgggcggggtcta

SEQ ID NO: 240683 - DNA, 20 bp, human
gccccgggagtgggagtcag

SEQ ID NO: 240684 - DNA, 20 bp, human
ggccggggtgggcaccgagg

SEQ ID NO: 240685 - DNA, 20 bp, human
gccctccctctccggggtcg

SEQ ID NO: 240686 - DNA, 20 bp, human
gggggacgctggtcgctgcc

SEQ ID NO: 240687 - DNA, 20 bp, human
gaggcggcgtctggtccaga

SEQ ID NO: 240688 - DNA, 20 bp, human
ggccgcccgcagccttaaag

SEQ ID NO: 240689 - DNA, 20 bp, human
ggcgcagccgtgtttccctc

SEQ ID NO: 240690 - DNA, 20 bp, human
gtctggtccagagggaaaca

SEQ ID NO: 240691 - DNA, 20 bp, human
gcagacgccgcctgcacggg

SEQ ID NO: 240692 - DNA, 20 bp, human
gccagcgtccccacccgtgc

SEQ ID NO: 240693 - DNA, 20 bp, human
ggtgaagctaagtgctgtga

SEQ ID NO: 240694 - DNA, 20 bp, human
gggaccaataaaagtccgat

SEQ ID NO: 240695 - DNA, 20 bp, human
gggaccagacgccgcctgca

SEQ ID NO: 240696 - DNA, 20 bp, human
ggacctagaagcagcgcctg

SEQ ID NO: 240697 - DNA, 20 bp, human
gtctgggcgaagatacactg

SEQ ID NO: 240698 - DNA, 20 bp, human
gcctgaggcctgcaaacctc

SEQ ID NO: 240699 - DNA, 20 bp, human
ggtgcggagaggggagctga

SEQ ID NO: 240700 - DNA, 20 bp, human
ggaaacgcctcctccgaggg

SEQ ID NO: 240701 - DNA, 20 bp, human
gggtaacagccaaagcatca

SEQ ID NO: 240702 - DNA, 20 bp, human
gtcttcaaatggcaactcaa

SEQ ID NO: 240703 - DNA, 20 bp, human
gcactctgacagtggcgctc

SEQ ID NO: 240704 - DNA, 20 bp, human
gctcttgcctgggaaagcct

SEQ ID NO: 240705 - DNA, 20 bp, human
gtttcagagtgtgcggagag

SEQ ID NO: 240706 - DNA, 20 bp, human
gctgcgcggggtcccagcga

SEQ ID NO: 240707 - DNA, 20 bp, human
ggcctctgggcgggaaactg

SEQ ID NO: 240708 - DNA, 20 bp, human
gcagaggcaagggcgtgcga

SEQ ID NO: 240709 - DNA, 20 bp, human
ggcctcgaggtcttgggcgg

SEQ ID NO: 240710 - DNA, 20 bp, human
gcgctcccgcggctcttaag

SEQ ID NO: 240711 - DNA, 20 bp, human
gaggggacagctcgggtggg

SEQ ID NO: 240712 - DNA, 20 bp, human
gcgcgggccaatggaatgaa

SEQ ID NO: 240713 - DNA, 20 bp, human
gtccgggagctgccgacgga

SEQ ID NO: 240714 - DNA, 20 bp, human
gaagcggcggcaccaccccg

SEQ ID NO: 240715 - DNA, 20 bp, human
ggcgaggggacagctcgggt

SEQ ID NO: 240716 - DNA, 20 bp, human
gatcccgcggccgtccgctc

SEQ ID NO: 240717 - DNA, 20 bp, human
gcggccgcgggatcccgttg

SEQ ID NO: 240718 - DNA, 20 bp, human
ggcgccccaacgggatcccg

SEQ ID NO: 240719 - DNA, 20 bp, human
gctcgcgcatgcgccccaac

SEQ ID NO: 240720 - DNA, 20 bp, human
gcgagctgggcgagaagtag

SEQ ID NO: 240721 - DNA, 20 bp, human
gcgcatgcgcgcaagagagc

SEQ ID NO: 240722 - DNA, 20 bp, human
gctgtcgggaaatcctccca

SEQ ID NO: 240723 - DNA, 20 bp, human
gggcctgcgtgcccacctct

SEQ ID NO: 240724 - DNA, 20 bp, human
ggcatgcgcgagagcgaacg

SEQ ID NO: 240725 - DNA, 20 bp, human
gttatcgcgtagcacattag

SEQ ID NO: 240726 - DNA, 20 bp, human
gatcccgcggccgtccgctc

SEQ ID NO: 240727 - DNA, 20 bp, human
gcggccgcgggatcccgttg

SEQ ID NO: 240728 - DNA, 20 bp, human
ggcgccccaacgggatcccg

SEQ ID NO: 240729 - DNA, 20 bp, human
gctcgcgcatgcgccccaac

SEQ ID NO: 240730 - DNA, 20 bp, human
gcgagctgggcgagaagtag

SEQ ID NO: 240731 - DNA, 20 bp, human
gcgcatgcgcgcaagagagc

SEQ ID NO: 240732 - DNA, 20 bp, human
gctgtcgggaaatcctccca

SEQ ID NO: 240733 - DNA, 20 bp, human
gggcctgcgtgcccacctct

SEQ ID NO: 240734 - DNA, 20 bp, human
ggcatgcgcgagagcgaacg

SEQ ID NO: 240735 - DNA, 20 bp, human
gttatcgcgtagcacattag

SEQ ID NO: 240736 - DNA, 20 bp, human
gcatacaaggccatggggct

SEQ ID NO: 240737 - DNA, 20 bp, human
gggccccccgccgggaacat

SEQ ID NO: 240738 - DNA, 20 bp, human
gcgccgggaacatgggacgg

SEQ ID NO: 240739 - DNA, 20 bp, human
gcccagggaggagttctgga

SEQ ID NO: 240740 - DNA, 20 bp, human
gtgccgctgggactcgggta

SEQ ID NO: 240741 - DNA, 20 bp, human
gtcagcccatacaaggccat

SEQ ID NO: 240742 - DNA, 20 bp, human
ggtggctgaaggagactcag

SEQ ID NO: 240743 - DNA, 20 bp, human
gcctgggttcagggtgggta

SEQ ID NO: 240744 - DNA, 20 bp, human
gccccgccgggaacatggga

SEQ ID NO: 240745 - DNA, 20 bp, human
ggggacctaggctgtgctat

SEQ ID NO: 240746 - DNA, 20 bp, human
gaaagcacagggttagaggc

SEQ ID NO: 240747 - DNA, 20 bp, human
gtgcccccgggagaccgaag

SEQ ID NO: 240748 - DNA, 20 bp, human
gtgtaaggcgtgcacagagg

SEQ ID NO: 240749 - DNA, 20 bp, human
gtcaccttttccttagaacc

SEQ ID NO: 240750 - DNA, 20 bp, human
gggagaaagcacagggttag

SEQ ID NO: 240751 - DNA, 20 bp, human
ggaggatatggagaaagcac

SEQ ID NO: 240752 - DNA, 20 bp, human
ggagaccgaagaggtggctg

SEQ ID NO: 240753 - DNA, 20 bp, human
gcacctcttcggtctcccgg

SEQ ID NO: 240754 - DNA, 20 bp, human
ggctcctcttcctggttcta

SEQ ID NO: 240755 - DNA, 20 bp, human
gaggggacgtggaggaaagt

SEQ ID NO: 240756 - DNA, 20 bp, human
gaggacacaaggaaggccta

SEQ ID NO: 240757 - DNA, 20 bp, human
gatgacaaaggtagaataaa

SEQ ID NO: 240758 - DNA, 20 bp, human
ggaataaaaggacacaagga

SEQ ID NO: 240759 - DNA, 20 bp, human
gggtagaataaaaggacaca

SEQ ID NO: 240760 - DNA, 20 bp, human
ggaatacccacaaatgacaa

SEQ ID NO: 240761 - DNA, 20 bp, human
gttctacctttgtcatttgt

SEQ ID NO: 240762 - DNA, 20 bp, human
gacaaaggcatgaggtggtc

SEQ ID NO: 240763 - DNA, 20 bp, human
ggcagaggggaccacgagga

SEQ ID NO: 240764 - DNA, 20 bp, human
gaaaggcgagtggtgtacaa

SEQ ID NO: 240765 - DNA, 20 bp, human
gggtgtacaaaggcatgagg

SEQ ID NO: 240766 - DNA, 20 bp, human
gaggacacaaggaaggccta

SEQ ID NO: 240767 - DNA, 20 bp, human
gatgacaaaggtagaataaa

SEQ ID NO: 240768 - DNA, 20 bp, human
ggaataaaaggacacaagga

SEQ ID NO: 240769 - DNA, 20 bp, human
gggtagaataaaaggacaca

SEQ ID NO: 240770 - DNA, 20 bp, human
ggaatacccacaaatgacaa

SEQ ID NO: 240771 - DNA, 20 bp, human
gttctacctttgtcatttgt

SEQ ID NO: 240772 - DNA, 20 bp, human
gcaaaggcatgaggtcgtca

SEQ ID NO: 240773 - DNA, 20 bp, human
ggcagaggggaccacgagga

SEQ ID NO: 240774 - DNA, 20 bp, human
gaaaggcgagtggtgtacaa

SEQ ID NO: 240775 - DNA, 20 bp, human
gaggaaacacatgtggtgtc

SEQ ID NO: 240776 - DNA, 20 bp, human
gctaccctgtgggtgtgcaa

SEQ ID NO: 240777 - DNA, 20 bp, human
gtgcccccgggagaccgaag

SEQ ID NO: 240778 - DNA, 20 bp, human
gcgaaagcagaggaaaggtt

SEQ ID NO: 240779 - DNA, 20 bp, human
gtcacccttgcacacccaca

SEQ ID NO: 240780 - DNA, 20 bp, human
ggagaccgaagaggtggctg

SEQ ID NO: 240781 - DNA, 20 bp, human
gctcgatccgtctaccctgt

SEQ ID NO: 240782 - DNA, 20 bp, human
gtggggcaggccgaaagcag

SEQ ID NO: 240783 - DNA, 20 bp, human
gcacctcttcggtctcccgg

SEQ ID NO: 240784 - DNA, 20 bp, human
gcttaaaccgaggggtgtgg

SEQ ID NO: 240785 - DNA, 20 bp, human
ggggttcagctagtccacgt

SEQ ID NO: 240786 - DNA, 20 bp, human
gaaagggcaggtgctataaa

SEQ ID NO: 240787 - DNA, 20 bp, human
ggcgcccggaggtctacgct

SEQ ID NO: 240788 - DNA, 20 bp, human
ggggccctggtgagctctgg

SEQ ID NO: 240789 - DNA, 20 bp, human
gaaggcaggcccgtgggcgc

SEQ ID NO: 240790 - DNA, 20 bp, human
gcccacagctgtacccttga

SEQ ID NO: 240791 - DNA, 20 bp, human
gaatcccagcgtagacctcc

SEQ ID NO: 240792 - DNA, 20 bp, human
gcccttgaaggcaggcccgt

SEQ ID NO: 240793 - DNA, 20 bp, human
ggcccacgggcctgccttca

SEQ ID NO: 240794 - DNA, 20 bp, human
gaaatcctccctggcggggc

SEQ ID NO: 240795 - DNA, 20 bp, human
gcagctgtacccttgaaggc

SEQ ID NO: 240796 - DNA, 20 bp, human
gctgttgcgaggttgcccga

SEQ ID NO: 240797 - DNA, 20 bp, human
ggggaagataggtacgtcac

SEQ ID NO: 240798 - DNA, 20 bp, human
gaggacctgaaggtggagtg

SEQ ID NO: 240799 - DNA, 20 bp, human
ggacgtacctatcttccctc

SEQ ID NO: 240800 - DNA, 20 bp, human
gaggttgcccgagggaagat

SEQ ID NO: 240801 - DNA, 20 bp, human
ggggtggcagggcccttaac

SEQ ID NO: 240802 - DNA, 20 bp, human
gctcgcaacagatctctgat

SEQ ID NO: 240803 - DNA, 20 bp, human
gggccagaggagggcgaagt

SEQ ID NO: 240804 - DNA, 20 bp, human
gggcgaagtcgggacgttaa

SEQ ID NO: 240805 - DNA, 20 bp, human
ggggctgtcggattcaaatc

SEQ ID NO: 240806 - DNA, 20 bp, human
ggcgctggcctggccgtgtt

SEQ ID NO: 240807 - DNA, 20 bp, human
gttcgctggcgtaaagtccc

SEQ ID NO: 240808 - DNA, 20 bp, human
gaccctacgggtccccatca

SEQ ID NO: 240809 - DNA, 20 bp, human
gagagcgagagagacgccga

SEQ ID NO: 240810 - DNA, 20 bp, human
ggcggggcgttaccatagag

SEQ ID NO: 240811 - DNA, 20 bp, human
gggtggcggtaagaagaaaa

SEQ ID NO: 240812 - DNA, 20 bp, human
gagaggcggctgcctctcta

SEQ ID NO: 240813 - DNA, 20 bp, human
ggtgaggggcaaagctcccg

SEQ ID NO: 240814 - DNA, 20 bp, human
gtggccgtgttaggcttcgc

SEQ ID NO: 240815 - DNA, 20 bp, human
gatggggacccgtagggtaa

SEQ ID NO: 240816 - DNA, 20 bp, human
ggggagcgataggacctcta

SEQ ID NO: 240817 - DNA, 20 bp, human
ggagacttggggtccgagtt

SEQ ID NO: 240818 - DNA, 20 bp, human
gaggacctctagggagactt

SEQ ID NO: 240819 - DNA, 20 bp, human
gggaccccaagtctccctag

SEQ ID NO: 240820 - DNA, 20 bp, human
ggggcagggtgccctgacag

SEQ ID NO: 240821 - DNA, 20 bp, human
gagaacggcccgcctcccag

SEQ ID NO: 240822 - DNA, 20 bp, human
gcagggggctcggcccaact

SEQ ID NO: 240823 - DNA, 20 bp, human
gaggtggctgcggaaaccgc

SEQ ID NO: 240824 - DNA, 20 bp, human
ggccgagccccctgggaggc

SEQ ID NO: 240825 - DNA, 20 bp, human
gggaaaccgctgggagcgat

SEQ ID NO: 240826 - DNA, 20 bp, human
ggtcaaaggcagcccatcaa

SEQ ID NO: 240827 - DNA, 20 bp, human
gccaataaatgccatcccgc

SEQ ID NO: 240828 - DNA, 20 bp, human
gtagcagctgttggctattg

SEQ ID NO: 240829 - DNA, 20 bp, human
gggctgtgctaaataaacga

SEQ ID NO: 240830 - DNA, 20 bp, human
ggaagtggagtagcagctgt

SEQ ID NO: 240831 - DNA, 20 bp, human
gttagctgcacatatgctgt

SEQ ID NO: 240832 - DNA, 20 bp, human
gccacttcaaaataaaagtc

SEQ ID NO: 240833 - DNA, 20 bp, human
gcgtaaacaaatcacgtcaa

SEQ ID NO: 240834 - DNA, 20 bp, human
gattatgcaggaagcatttc

SEQ ID NO: 240835 - DNA, 20 bp, human
gagcagttaatcatggaaac

SEQ ID NO: 240836 - DNA, 20 bp, human
ggggatcccgaggaagaagt

SEQ ID NO: 240837 - DNA, 20 bp, human
ggcgggtcctagagtcgaga

SEQ ID NO: 240838 - DNA, 20 bp, human
ggacccgcctctctcgtcgg

SEQ ID NO: 240839 - DNA, 20 bp, human
gcgagaggggcgggatcccg

SEQ ID NO: 240840 - DNA, 20 bp, human
gctggctgacaggagggcgt

SEQ ID NO: 240841 - DNA, 20 bp, human
ggtcctagagtcgagagggg

SEQ ID NO: 240842 - DNA, 20 bp, human
ggagaccgaaggtttggacg

SEQ ID NO: 240843 - DNA, 20 bp, human
ggcgaccagccggtgagtgc

SEQ ID NO: 240844 - DNA, 20 bp, human
gcttccgccgacgagagagg

SEQ ID NO: 240845 - DNA, 20 bp, human
ggcacttccgccgacgagag

SEQ ID NO: 240846 - DNA, 20 bp, human
gacgacagtgagggaggtac

SEQ ID NO: 240847 - DNA, 20 bp, human
gtctgctgcatcacaggcac

SEQ ID NO: 240848 - DNA, 20 bp, human
gacgatggagtgaggatgag

SEQ ID NO: 240849 - DNA, 20 bp, human
ggcagaaacgacagtgaggg

SEQ ID NO: 240850 - DNA, 20 bp, human
gctcccagaaccactggaga

SEQ ID NO: 240851 - DNA, 20 bp, human
ggtaaaaagctggagatcct

SEQ ID NO: 240852 - DNA, 20 bp, human
gttcctcacacagtgagaag

SEQ ID NO: 240853 - DNA, 20 bp, human
gaatgcacagataaagacga

SEQ ID NO: 240854 - DNA, 20 bp, human
gaggagaacgcacaccttcc

SEQ ID NO: 240855 - DNA, 20 bp, human
gtgtgcagaatctaccagga

SEQ ID NO: 240856 - DNA, 20 bp, human
gcttccaaggaaccggatgt

SEQ ID NO: 240857 - DNA, 20 bp, human
gaagcagcttggccgctgat

SEQ ID NO: 240858 - DNA, 20 bp, human
ggtaaaacacatcaggtcag

SEQ ID NO: 240859 - DNA, 20 bp, human
gttgggtgggttggtgtcca

SEQ ID NO: 240860 - DNA, 20 bp, human
ggtggtaaagaccaccatga

SEQ ID NO: 240861 - DNA, 20 bp, human
ggtgagtgcttccaaggaac

SEQ ID NO: 240862 - DNA, 20 bp, human
gaagtaaacaaacctatcag

SEQ ID NO: 240863 - DNA, 20 bp, human
ggagcccacatccggttcct

SEQ ID NO: 240864 - DNA, 20 bp, human
gaggtgttgaggttatgtca

SEQ ID NO: 240865 - DNA, 20 bp, human
gtcacaggtgacaagcagct

SEQ ID NO: 240866 - DNA, 20 bp, human
gctgcctcctgaatcatggt

SEQ ID NO: 240867 - DNA, 20 bp, human
gacccaagggctgtagggac

SEQ ID NO: 240868 - DNA, 20 bp, human
ggaggaggttatgaaaaatg

SEQ ID NO: 240869 - DNA, 20 bp, human
gtgagctgcctcctgaatca

SEQ ID NO: 240870 - DNA, 20 bp, human
gagcttaaaagcaggaaata

SEQ ID NO: 240871 - DNA, 20 bp, human
gcaagtgtagcattgcctgg

SEQ ID NO: 240872 - DNA, 20 bp, human
gtcttgcccaaccatgattc

SEQ ID NO: 240873 - DNA, 20 bp, human
gcccttgggtcagatagtct

SEQ ID NO: 240874 - DNA, 20 bp, human
ggtctggggtggatccatct

SEQ ID NO: 240875 - DNA, 20 bp, human
gtacttgtgccaactgatgg

SEQ ID NO: 240876 - DNA, 20 bp, human
ggagccaggaataactagag

SEQ ID NO: 240877 - DNA, 20 bp, human
ggaacaatggggttattcag

SEQ ID NO: 240878 - DNA, 20 bp, human
gctcggggaaaaggatagga

SEQ ID NO: 240879 - DNA, 20 bp, human
gctaagggctccttgacaac

SEQ ID NO: 240880 - DNA, 20 bp, human
gaaagaaaacgtgttccaac

SEQ ID NO: 240881 - DNA, 20 bp, human
gtaactagagaggaacaatg

SEQ ID NO: 240882 - DNA, 20 bp, human
ggttcctctctagttattcc

SEQ ID NO: 240883 - DNA, 20 bp, human
gtaccagtattggctgatta

SEQ ID NO: 240884 - DNA, 20 bp, human
gtcccataatcagccaatac

SEQ ID NO: 240885 - DNA, 20 bp, human
gtcctaaaacttaccagtat

SEQ ID NO: 240886 - DNA, 20 bp, human
gtggcctcgttgattgggcg

SEQ ID NO: 240887 - DNA, 20 bp, human
gtagccccgcccaatcaacg

SEQ ID NO: 240888 - DNA, 20 bp, human
ggcggggctagtagcgggac

SEQ ID NO: 240889 - DNA, 20 bp, human
gaatcagcggcccgcaacgg

SEQ ID NO: 240890 - DNA, 20 bp, human
ggccaatcagcggcccgcaa

SEQ ID NO: 240891 - DNA, 20 bp, human
gataacccgcgcgcagaggc

SEQ ID NO: 240892 - DNA, 20 bp, human
ggaaaataacccgcgcgcag

SEQ ID NO: 240893 - DNA, 20 bp, human
gaatcaacgaggccaatcag

SEQ ID NO: 240894 - DNA, 20 bp, human
gattgggcggggctagtagc

SEQ ID NO: 240895 - DNA, 20 bp, human
gagcggcccgcaacggggga

SEQ ID NO: 240896 - DNA, 20 bp, human
gctcccacagcaccgagggg

SEQ ID NO: 240897 - DNA, 20 bp, human
gagggaccccgcatcggcag

SEQ ID NO: 240898 - DNA, 20 bp, human
ggggagcagggacctcgcac

SEQ ID NO: 240899 - DNA, 20 bp, human
ggcctcacctcaccccccct

SEQ ID NO: 240900 - DNA, 20 bp, human
ggggcggtcagcccagacaa

SEQ ID NO: 240901 - DNA, 20 bp, human
gctcacaatgccccctgcgg

SEQ ID NO: 240902 - DNA, 20 bp, human
ggaccagggagaatgtacat

SEQ ID NO: 240903 - DNA, 20 bp, human
gacagcaccgagggggggtg

SEQ ID NO: 240904 - DNA, 20 bp, human
gggacaagcggcgggacaat

SEQ ID NO: 240905 - DNA, 20 bp, human
ggacagcgccggcttcgggt

SEQ ID NO: 240906 - DNA, 20 bp, human
gggagctggaagcctactac

SEQ ID NO: 240907 - DNA, 20 bp, human
gctactggtgactaagaagg

SEQ ID NO: 240908 - DNA, 20 bp, human
gggttgggatgagaacctga

SEQ ID NO: 240909 - DNA, 20 bp, human
gcagatccggctctacacat

SEQ ID NO: 240910 - DNA, 20 bp, human
gagcagagggaattccctgt

SEQ ID NO: 240911 - DNA, 20 bp, human
gaccccaagcagatcagatg

SEQ ID NO: 240912 - DNA, 20 bp, human
ggggggtcatgtgacggaga

SEQ ID NO: 240913 - DNA, 20 bp, human
gtatagagggaccagtgaca

SEQ ID NO: 240914 - DNA, 20 bp, human
gacctgagggacagccccac

SEQ ID NO: 240915 - DNA, 20 bp, human
ggtgagtgcagtgtgggggt

SEQ ID NO: 240916 - DNA, 20 bp, human
gcccgccggcccatccggag

SEQ ID NO: 240917 - DNA, 20 bp, human
gtgggccgtcccctccggat

SEQ ID NO: 240918 - DNA, 20 bp, human
gggaaggcgcaagcccgcgc

SEQ ID NO: 240919 - DNA, 20 bp, human
gcggatgcccgggtcggaga

SEQ ID NO: 240920 - DNA, 20 bp, human
gaggggaggcggctcctaac

SEQ ID NO: 240921 - DNA, 20 bp, human
gtccctgcggatgcccgggt

SEQ ID NO: 240922 - DNA, 20 bp, human
ggcctcccgagaggcggcaa

SEQ ID NO: 240923 - DNA, 20 bp, human
ggggaaccgcgaacccgggc

SEQ ID NO: 240924 - DNA, 20 bp, human
ggggccgctcgtctcttcgg

SEQ ID NO: 240925 - DNA, 20 bp, human
gctccgcccgccggcccatc

SEQ ID NO: 240926 - DNA, 20 bp, human
gagcgtcggcgcctattggg

SEQ ID NO: 240927 - DNA, 20 bp, human
gcgttcccacgccgcccaat

SEQ ID NO: 240928 - DNA, 20 bp, human
ggtcagcagcagggcaaaca

SEQ ID NO: 240929 - DNA, 20 bp, human
gggactgggtctcgaggagg

SEQ ID NO: 240930 - DNA, 20 bp, human
ggccactcgctgagtagcgt

SEQ ID NO: 240931 - DNA, 20 bp, human
ggggccgggactgggtctcg

SEQ ID NO: 240932 - DNA, 20 bp, human
gagtagcgtcggcgcctatt

SEQ ID NO: 240933 - DNA, 20 bp, human
gggcgcctattgggcggcgt

SEQ ID NO: 240934 - DNA, 20 bp, human
gctactcagcgagtggccgg

SEQ ID NO: 240935 - DNA, 20 bp, human
gccgggactgggtctcgagg

SEQ ID NO: 240936 - DNA, 20 bp, human
gaagcgaaacgcctgagggg

SEQ ID NO: 240937 - DNA, 20 bp, human
gtgaggggcggccagcgcga

SEQ ID NO: 240938 - DNA, 20 bp, human
gagaccctggaagtcccggg

SEQ ID NO: 240939 - DNA, 20 bp, human
gcccgggaggtgagggtcga

SEQ ID NO: 240940 - DNA, 20 bp, human
ggggaagaccctggaagtcc

SEQ ID NO: 240941 - DNA, 20 bp, human
gaggcagggaggtgtgcgcg

SEQ ID NO: 240942 - DNA, 20 bp, human
gccctcggggcgaggcaggg

SEQ ID NO: 240943 - DNA, 20 bp, human
gcggggtggggggaagaccc

SEQ ID NO: 240944 - DNA, 20 bp, human
gagggaggtgtgcgcggggt

SEQ ID NO: 240945 - DNA, 20 bp, human
gtggccagaaaccctcgcgc

SEQ ID NO: 240946 - DNA, 20 bp, human
gggtaggaggcgaatgacac

SEQ ID NO: 240947 - DNA, 20 bp, human
gggtggggcgtcctgtctcc

SEQ ID NO: 240948 - DNA, 20 bp, human
gtctggacacgaatgctccg

SEQ ID NO: 240949 - DNA, 20 bp, human
gcgaatgctccgggggtagg

SEQ ID NO: 240950 - DNA, 20 bp, human
ggacaggacgccccaccctc

SEQ ID NO: 240951 - DNA, 20 bp, human
gaacccggcgtcccggagac

SEQ ID NO: 240952 - DNA, 20 bp, human
gacacgaatgctccgggggt

SEQ ID NO: 240953 - DNA, 20 bp, human
ggcgaatgacactggcacgg

SEQ ID NO: 240954 - DNA, 20 bp, human
ggaggcgaatgacactggca

SEQ ID NO: 240955 - DNA, 20 bp, human
ggctgggagcatcacgtgct

SEQ ID NO: 240956 - DNA, 20 bp, human
gacttgatctctgatgtaac

SEQ ID NO: 240957 - DNA, 20 bp, human
ggataagggactatgatggg

SEQ ID NO: 240958 - DNA, 20 bp, human
ggtagataagggactatgat

SEQ ID NO: 240959 - DNA, 20 bp, human
gtgcagttgaaggatcaggg

SEQ ID NO: 240960 - DNA, 20 bp, human
ggcctcttcacgagttaagt

SEQ ID NO: 240961 - DNA, 20 bp, human
ggaacgatgaatcagacatc

SEQ ID NO: 240962 - DNA, 20 bp, human
gcccaaagcaaagtagataa

SEQ ID NO: 240963 - DNA, 20 bp, human
ggtgctagacactgtagaga

SEQ ID NO: 240964 - DNA, 20 bp, human
gttgatgaacggtgggaatg

SEQ ID NO: 240965 - DNA, 20 bp, human
ggactccaaataaagcatgt

SEQ ID NO: 240966 - DNA, 20 bp, human
gcgggcagtcgggtcagctc

SEQ ID NO: 240967 - DNA, 20 bp, human
gagaagctacccagagtaga

SEQ ID NO: 240968 - DNA, 20 bp, human
gtgggaggggcacatggcaa

SEQ ID NO: 240969 - DNA, 20 bp, human
gcactagatagcagcaacgt

SEQ ID NO: 240970 - DNA, 20 bp, human
gaggggtcctaagtataaaa

SEQ ID NO: 240971 - DNA, 20 bp, human
gcgggtcagctcaggaaacc

SEQ ID NO: 240972 - DNA, 20 bp, human
gctaagacttgtctggaccc

SEQ ID NO: 240973 - DNA, 20 bp, human
gccaggctggtccaaaggtc

SEQ ID NO: 240974 - DNA, 20 bp, human
gaactaccagtgttccctgg

SEQ ID NO: 240975 - DNA, 20 bp, human
gtagagggctgccatgtggg

SEQ ID NO: 240976 - DNA, 20 bp, human
ggggcggggaacgcagtgaa

SEQ ID NO: 240977 - DNA, 20 bp, human
gcggcctccaacgagacctg

SEQ ID NO: 240978 - DNA, 20 bp, human
ggggcggaaaccaccggcgc

SEQ ID NO: 240979 - DNA, 20 bp, human
gccgtgcccacaggtctcgt

SEQ ID NO: 240980 - DNA, 20 bp, human
gtgcccacaggtctcgttgg

SEQ ID NO: 240981 - DNA, 20 bp, human
ggagtggctgcagacgggtg

SEQ ID NO: 240982 - DNA, 20 bp, human
gtcacatgacgataaaggca

SEQ ID NO: 240983 - DNA, 20 bp, human
gaaccaccggcgcgggtgac

SEQ ID NO: 240984 - DNA, 20 bp, human
gagggccacgtgaccgtccc

SEQ ID NO: 240985 - DNA, 20 bp, human
gctggagaggcgggcctaca

SEQ ID NO: 240986 - DNA, 20 bp, human
ggggccgcggcgattctcta

SEQ ID NO: 240987 - DNA, 20 bp, human
ggggcagaacggggtcctca

SEQ ID NO: 240988 - DNA, 20 bp, human
gcagtcgcgtgggcagaacg

SEQ ID NO: 240989 - DNA, 20 bp, human
gccgccctagagaatcgccg

SEQ ID NO: 240990 - DNA, 20 bp, human
gggggccacgtgatgagcga

SEQ ID NO: 240991 - DNA, 20 bp, human
gcggtcgcgcgggggctcct

SEQ ID NO: 240992 - DNA, 20 bp, human
ggtcacgagaacaaacacgg

SEQ ID NO: 240993 - DNA, 20 bp, human
gtgggagccgcgctcccggc

SEQ ID NO: 240994 - DNA, 20 bp, human
gctcctgggagccgcgctcc

SEQ ID NO: 240995 - DNA, 20 bp, human
gccgaggcccggtcgcgcgg

SEQ ID NO: 240996 - DNA, 20 bp, human
gtgaaggggcacagggtttg

SEQ ID NO: 240997 - DNA, 20 bp, human
ggggctagggagggatttag

SEQ ID NO: 240998 - DNA, 20 bp, human
gcgggccatgtgcatctccg

SEQ ID NO: 240999 - DNA, 20 bp, human
gaatgccaaggccaacgcca

SEQ ID NO: 241000 - DNA, 20 bp, human
gagggatgggggttcaatgt

SEQ ID NO: 241001 - DNA, 20 bp, human
gagagattgtagaatgaagg

SEQ ID NO: 241002 - DNA, 20 bp, human
gaggggggacagtgactgtg

SEQ ID NO: 241003 - DNA, 20 bp, human
gagggatttaggggctcagt

SEQ ID NO: 241004 - DNA, 20 bp, human
ggatgccactgcggggtgaa

SEQ ID NO: 241005 - DNA, 20 bp, human
gggagggctggccaatgcca

SEQ ID NO: 241006 - DNA, 20 bp, human
ggacaaaccaaccagaactg

SEQ ID NO: 241007 - DNA, 20 bp, human
ggggtaattaatctgggaga

SEQ ID NO: 241008 - DNA, 20 bp, human
gctgtgcagctgtgatgggt

SEQ ID NO: 241009 - DNA, 20 bp, human
gcgccggccggggtttacca

SEQ ID NO: 241010 - DNA, 20 bp, human
gctccatggtaaaccccggc

SEQ ID NO: 241011 - DNA, 20 bp, human
ggctctggcctccacagttc

SEQ ID NO: 241012 - DNA, 20 bp, human
ggcaggggggcaatggtgag

SEQ ID NO: 241013 - DNA, 20 bp, human
gctcccagctccagtgcacc

SEQ ID NO: 241014 - DNA, 20 bp, human
gtatacctgtccaggtgcac

SEQ ID NO: 241015 - DNA, 20 bp, human
gtgtccaggtgcactggagc

SEQ ID NO: 241016 - DNA, 20 bp, human
gaccctctgtgcagctatgg

SEQ ID NO: 241017 - DNA, 20 bp, human
gaccaccctctgtgcagcta

SEQ ID NO: 241018 - DNA, 20 bp, human
ggcagagctgccaacaggga

SEQ ID NO: 241019 - DNA, 20 bp, human
gcctgggcccaggcgggaaa

SEQ ID NO: 241020 - DNA, 20 bp, human
gctgtgcagctatggtgggt

SEQ ID NO: 241021 - DNA, 20 bp, human
gcgcctgggcccagggttta

SEQ ID NO: 241022 - DNA, 20 bp, human
gcgatcagaactgcccaggc

SEQ ID NO: 241023 - DNA, 20 bp, human
gggagaaagcaggccggcaa

SEQ ID NO: 241024 - DNA, 20 bp, human
gaatggtgtctcagggaggt

SEQ ID NO: 241025 - DNA, 20 bp, human
gaaaccgatcagaactgccc

SEQ ID NO: 241026 - DNA, 20 bp, human
gaacgcgcggctggcggcgt

SEQ ID NO: 241027 - DNA, 20 bp, human
gtcagggcggctcaccgaga

SEQ ID NO: 241028 - DNA, 20 bp, human
ggggaccacccggcaggacc

SEQ ID NO: 241029 - DNA, 20 bp, human
gtggcggcgtggggaccacc

SEQ ID NO: 241030 - DNA, 20 bp, human
gccccctggcggtttcaggg

SEQ ID NO: 241031 - DNA, 20 bp, human
gcgcccggttggggaacgcg

SEQ ID NO: 241032 - DNA, 20 bp, human
gttggggaacgcgcggctgg

SEQ ID NO: 241033 - DNA, 20 bp, human
gcggctcaccgagagggcgc

SEQ ID NO: 241034 - DNA, 20 bp, human
gttccccaaccgggcgctcc

SEQ ID NO: 241035 - DNA, 20 bp, human
ggcgccgggagcgcccggtt

SEQ ID NO: 241036 - DNA, 20 bp, human
gtgcagatggagaacccggg

SEQ ID NO: 241037 - DNA, 20 bp, human
gccctggcgccgggtccgct

SEQ ID NO: 241038 - DNA, 20 bp, human
ggccctctgaggcccctcaa

SEQ ID NO: 241039 - DNA, 20 bp, human
gtcccttgaggggcctcaga

SEQ ID NO: 241040 - DNA, 20 bp, human
gagggctcgcggtcgccccc

SEQ ID NO: 241041 - DNA, 20 bp, human
gggcgaccgcgagccctctg

SEQ ID NO: 241042 - DNA, 20 bp, human
gtggcgccgggtccgctggg

SEQ ID NO: 241043 - DNA, 20 bp, human
gagctgcagatggagaaccc

SEQ ID NO: 241044 - DNA, 20 bp, human
gaagggctcgcttgttggag

SEQ ID NO: 241045 - DNA, 20 bp, human
gctacccaaggcaaatagct

SEQ ID NO: 241046 - DNA, 20 bp, human
gcggcccaatggcccccctg

SEQ ID NO: 241047 - DNA, 20 bp, human
gccgggagggaagcgtgaag

SEQ ID NO: 241048 - DNA, 20 bp, human
ggggagcagagtaaccccag

SEQ ID NO: 241049 - DNA, 20 bp, human
ggagccgcggggcttaaaga

SEQ ID NO: 241050 - DNA, 20 bp, human
ggaaacggagagcgcaaaga

SEQ ID NO: 241051 - DNA, 20 bp, human
gactgcgctgcggacggggt

SEQ ID NO: 241052 - DNA, 20 bp, human
ggccggcgagcaccaatcgg

SEQ ID NO: 241053 - DNA, 20 bp, human
gccccggggctgccgccgat

SEQ ID NO: 241054 - DNA, 20 bp, human
gccggccggcgagcaccaat

SEQ ID NO: 241055 - DNA, 20 bp, human
gacggggtggggcggcccaa

SEQ ID NO: 241056 - DNA, 20 bp, human
gaagggcaggaggtggtcgc

SEQ ID NO: 241057 - DNA, 20 bp, human
gtcccagcgaggtacaccgg

SEQ ID NO: 241058 - DNA, 20 bp, human
gtgaacggcaatgccctgga

SEQ ID NO: 241059 - DNA, 20 bp, human
ggccctgaacggcaatgccc

SEQ ID NO: 241060 - DNA, 20 bp, human
ggtgcaagagaaatccgggg

SEQ ID NO: 241061 - DNA, 20 bp, human
gggtcgcaggatgttgcctg

SEQ ID NO: 241062 - DNA, 20 bp, human
gaaggtgcaagagaaatccg

SEQ ID NO: 241063 - DNA, 20 bp, human
gcgttcccagcgaggtacac

SEQ ID NO: 241064 - DNA, 20 bp, human
gagcctccggtgtacctcgc

SEQ ID NO: 241065 - DNA, 20 bp, human
ggcgcagtcaggttttcccg

SEQ ID NO: 241066 - DNA, 20 bp, human
ggaagtcgaccaaaactcta

SEQ ID NO: 241067 - DNA, 20 bp, human
gtcattaaaccttagagttt

SEQ ID NO: 241068 - DNA, 20 bp, human
gggtccctccccacgacacg

SEQ ID NO: 241069 - DNA, 20 bp, human
gctggaatgagttaagtcct

SEQ ID NO: 241070 - DNA, 20 bp, human
ggaatgagttaagtccttgg

SEQ ID NO: 241071 - DNA, 20 bp, human
gtccttgggggactgttgga

SEQ ID NO: 241072 - DNA, 20 bp, human
ggcaagttcgaaatccaata

SEQ ID NO: 241073 - DNA, 20 bp, human
gtccccacgtgtcgtgggga

SEQ ID NO: 241074 - DNA, 20 bp, human
gataatccccacgtgtcgtg

SEQ ID NO: 241075 - DNA, 20 bp, human
gtggatttcgaacttgcatg

SEQ ID NO: 241076 - DNA, 20 bp, human
gcggagggactcaactgctg

SEQ ID NO: 241077 - DNA, 20 bp, human
gaaatagcacaacctggcgg

SEQ ID NO: 241078 - DNA, 20 bp, human
gtgttcccagcaaggctgca

SEQ ID NO: 241079 - DNA, 20 bp, human
gccctccgcgcacctacttg

SEQ ID NO: 241080 - DNA, 20 bp, human
gcatttgcatactcagtttc

SEQ ID NO: 241081 - DNA, 20 bp, human
gaccgcaagtaggtgcgcgg

SEQ ID NO: 241082 - DNA, 20 bp, human
gggactcaactgctggggca

SEQ ID NO: 241083 - DNA, 20 bp, human
gccttccacctggccggagg

SEQ ID NO: 241084 - DNA, 20 bp, human
gcctacttgcggtgtagggt

SEQ ID NO: 241085 - DNA, 20 bp, human
ggaaaagagcagtagtcctt

SEQ ID NO: 241086 - DNA, 20 bp, human
ggggcccccaagggaggcac

SEQ ID NO: 241087 - DNA, 20 bp, human
ggccaaggaggggcccccaa

SEQ ID NO: 241088 - DNA, 20 bp, human
gacagacgtgagagcaataa

SEQ ID NO: 241089 - DNA, 20 bp, human
gctccccgccccacgagggt

SEQ ID NO: 241090 - DNA, 20 bp, human
gcaagctggaatgaggggat

SEQ ID NO: 241091 - DNA, 20 bp, human
ggtatccgtcagtggctcca

SEQ ID NO: 241092 - DNA, 20 bp, human
gccactgacggatacagcca

SEQ ID NO: 241093 - DNA, 20 bp, human
gctgacggatacagccaagg

SEQ ID NO: 241094 - DNA, 20 bp, human
ggttcccagtgcctcccttg

SEQ ID NO: 241095 - DNA, 20 bp, human
gtctgactcagctttcattg

SEQ ID NO: 241096 - DNA, 20 bp, human
ggctgagtgtgtttcgggtg

SEQ ID NO: 241097 - DNA, 20 bp, human
gcagaaggcaggtcagtgca

SEQ ID NO: 241098 - DNA, 20 bp, human
gttggcactggcacttggtc

SEQ ID NO: 241099 - DNA, 20 bp, human
gcactcggaagaaggctaca

SEQ ID NO: 241100 - DNA, 20 bp, human
gccaagtgccagtgccaaga

SEQ ID NO: 241101 - DNA, 20 bp, human
ggaagggtcccaccccatgc

SEQ ID NO: 241102 - DNA, 20 bp, human
gaccaacagtggggtcctgg

SEQ ID NO: 241103 - DNA, 20 bp, human
gctcctccccactcggaaga

SEQ ID NO: 241104 - DNA, 20 bp, human
ggtgccaagacgggggaagg

SEQ ID NO: 241105 - DNA, 20 bp, human
gtgggcagtagggacagcca

SEQ ID NO: 241106 - DNA, 20 bp, human
gccaataagaaggtagctag

SEQ ID NO: 241107 - DNA, 20 bp, human
gagtgtcaaagtttctattg

SEQ ID NO: 241108 - DNA, 20 bp, human
gtgtttcccagccaataaga

SEQ ID NO: 241109 - DNA, 20 bp, human
gaaaactgttgatacttagc

SEQ ID NO: 241110 - DNA, 20 bp, human
gaatgaatgtgtatgaaaaa

SEQ ID NO: 241111 - DNA, 20 bp, human
gagaattgattaccatctta

SEQ ID NO: 241112 - DNA, 20 bp, human
gaagccacttttccttaaga

SEQ ID NO: 241113 - DNA, 20 bp, human
gttaccatcttaaggaaaag

SEQ ID NO: 241114 - DNA, 20 bp, human
gagctaccttcttattggct

SEQ ID NO: 241115 - DNA, 20 bp, human
gttaataaagatgcctcaat

SEQ ID NO: 241116 - DNA, 20 bp, human
ggctctgcgctgaacccacc

SEQ ID NO: 241117 - DNA, 20 bp, human
gtgctctccgcaggccgggt

SEQ ID NO: 241118 - DNA, 20 bp, human
gagctggagggaggccggtc

SEQ ID NO: 241119 - DNA, 20 bp, human
gtaagcgaggtcagccaaag

SEQ ID NO: 241120 - DNA, 20 bp, human
ggagcagacaagtgcctctt

SEQ ID NO: 241121 - DNA, 20 bp, human
gtccctgctccgggccagac

SEQ ID NO: 241122 - DNA, 20 bp, human
ggctgaacccacccggcctg

SEQ ID NO: 241123 - DNA, 20 bp, human
ggggagctcttctaatcaga

SEQ ID NO: 241124 - DNA, 20 bp, human
ggagggaggccggtctggcc

SEQ ID NO: 241125 - DNA, 20 bp, human
ggcagaaggactccctgctc

SEQ ID NO: 241126 - DNA, 20 bp, human
gagtgagtagagtgtacata

SEQ ID NO: 241127 - DNA, 20 bp, human
ggagtagagtgtacatatgg

SEQ ID NO: 241128 - DNA, 20 bp, human
ggtggaaaacaaatgactct

SEQ ID NO: 241129 - DNA, 20 bp, human
ggaggggagcctggttaatc

SEQ ID NO: 241130 - DNA, 20 bp, human
gagaggctggtgtacacgtc

SEQ ID NO: 241131 - DNA, 20 bp, human
gacggaccatgtaatggagg

SEQ ID NO: 241132 - DNA, 20 bp, human
gactcttggtaccctattgt

SEQ ID NO: 241133 - DNA, 20 bp, human
gggaacggaccatgtaatgg

SEQ ID NO: 241134 - DNA, 20 bp, human
gtcaggaacggaccatgtaa

SEQ ID NO: 241135 - DNA, 20 bp, human
gaaggcactgcagattggtc

SEQ ID NO: 241136 - DNA, 20 bp, human
gtatccctgcggaacggggc

SEQ ID NO: 241137 - DNA, 20 bp, human
gggccggcccatggcccagg

SEQ ID NO: 241138 - DNA, 20 bp, human
ggcggggcagggacaccacc

SEQ ID NO: 241139 - DNA, 20 bp, human
gcttccctatccctgcggaa

SEQ ID NO: 241140 - DNA, 20 bp, human
gtgccccgccccgttccgca

SEQ ID NO: 241141 - DNA, 20 bp, human
gcccacagggaaaccccttt

SEQ ID NO: 241142 - DNA, 20 bp, human
ggggctctgaagctggatgt

SEQ ID NO: 241143 - DNA, 20 bp, human
gaatgacccagctgccctct

SEQ ID NO: 241144 - DNA, 20 bp, human
gcagccgcctaagccagagc

SEQ ID NO: 241145 - DNA, 20 bp, human
gaagctcatgcccagccccc

SEQ ID NO: 241146 - DNA, 20 bp, human
gctaaggcatgtgcctacgc

SEQ ID NO: 241147 - DNA, 20 bp, human
gttgtccagctgccaaccta

SEQ ID NO: 241148 - DNA, 20 bp, human
ggcaggaggcgatgacattt

SEQ ID NO: 241149 - DNA, 20 bp, human
gaggcatgtgcctacgcagg

SEQ ID NO: 241150 - DNA, 20 bp, human
gcggaaagcagccacctgtc

SEQ ID NO: 241151 - DNA, 20 bp, human
gaggtggctgctttccggga

SEQ ID NO: 241152 - DNA, 20 bp, human
gaggcctcttgaatctccag

SEQ ID NO: 241153 - DNA, 20 bp, human
gactgccatcatcaccttcc

SEQ ID NO: 241154 - DNA, 20 bp, human
ggtaggcacatgccttaggt

SEQ ID NO: 241155 - DNA, 20 bp, human
gtggcctcagtctgcaattg

SEQ ID NO: 241156 - DNA, 20 bp, human
ggcctctcctgggttcacag

SEQ ID NO: 241157 - DNA, 20 bp, human
gcagaacattccagctttga

SEQ ID NO: 241158 - DNA, 20 bp, human
ggggctctgtcccaccaatt

SEQ ID NO: 241159 - DNA, 20 bp, human
gtggtgacctctgtgaaccc

SEQ ID NO: 241160 - DNA, 20 bp, human
gctacaaggtggaactgagt

SEQ ID NO: 241161 - DNA, 20 bp, human
gtggaggctgggaaagattg

SEQ ID NO: 241162 - DNA, 20 bp, human
ggggcaaacatgggtactgt

SEQ ID NO: 241163 - DNA, 20 bp, human
ggccagggacacctaattgg

SEQ ID NO: 241164 - DNA, 20 bp, human
gcccaccaattaggtgtccc

SEQ ID NO: 241165 - DNA, 20 bp, human
gaaggctcaagggcaaacat

SEQ ID NO: 241166 - DNA, 20 bp, human
gagggtgtctaggacgtgac

SEQ ID NO: 241167 - DNA, 20 bp, human
gtggaactcacaagggaccc

SEQ ID NO: 241168 - DNA, 20 bp, human
gcagcacttggaactcacaa

SEQ ID NO: 241169 - DNA, 20 bp, human
gtcacaagggacccgggcta

SEQ ID NO: 241170 - DNA, 20 bp, human
gttgacgtatagggttagaa

SEQ ID NO: 241171 - DNA, 20 bp, human
gctcgggcctgttatggcca

SEQ ID NO: 241172 - DNA, 20 bp, human
gtgttacagcgttgacgtat

SEQ ID NO: 241173 - DNA, 20 bp, human
gtgggcatatgataatcatc

SEQ ID NO: 241174 - DNA, 20 bp, human
gtaatcaacatgatatacag

SEQ ID NO: 241175 - DNA, 20 bp, human
gatgtcctagtttccaggcc

SEQ ID NO: 241176 - DNA, 20 bp, human
gccgccaaccagtaatgcca

SEQ ID NO: 241177 - DNA, 20 bp, human
gaaccagtaatgccaaggtg

SEQ ID NO: 241178 - DNA, 20 bp, human
gggccacaccttggcattac

SEQ ID NO: 241179 - DNA, 20 bp, human
gttgtgaaacccattcaaca

SEQ ID NO: 241180 - DNA, 20 bp, human
gaatcaaacaatagcaactc

SEQ ID NO: 241181 - DNA, 20 bp, human
gtgggtttcacaaaaggata

SEQ ID NO: 241182 - DNA, 20 bp, human
ggtgtttgtgtcctgtgggc

SEQ ID NO: 241183 - DNA, 20 bp, human
gcacaatcttggccacacct

SEQ ID NO: 241184 - DNA, 20 bp, human
gtgtttgattccatgttgaa

SEQ ID NO: 241185 - DNA, 20 bp, human
gtcaggctacatataccaca

SEQ ID NO: 241186 - DNA, 20 bp, human
gagcgcagggtcgacgggca

SEQ ID NO: 241187 - DNA, 20 bp, human
ggctataagcgcagggtcga

SEQ ID NO: 241188 - DNA, 20 bp, human
ggcggtgccgagcgctcccg

SEQ ID NO: 241189 - DNA, 20 bp, human
ggagcgctcccggggattgg

SEQ ID NO: 241190 - DNA, 20 bp, human
gcgcccgcggcaggtgagat

SEQ ID NO: 241191 - DNA, 20 bp, human
gacacgctcctggactgggt

SEQ ID NO: 241192 - DNA, 20 bp, human
gtggaaccctctgggagtaa

SEQ ID NO: 241193 - DNA, 20 bp, human
gggttcctagaatttgtttc

SEQ ID NO: 241194 - DNA, 20 bp, human
gagccgcccggctgcaaggt

SEQ ID NO: 241195 - DNA, 20 bp, human
gcggcgcgaggacccagggg

SEQ ID NO: 241196 - DNA, 20 bp, human
gaaggacagcagatcctata

SEQ ID NO: 241197 - DNA, 20 bp, human
gctgcctggaatataagctg

SEQ ID NO: 241198 - DNA, 20 bp, human
gagtctaaggatgaacaaag

SEQ ID NO: 241199 - DNA, 20 bp, human
gctgtggtcattaactcttt

SEQ ID NO: 241200 - DNA, 20 bp, human
gtctgttaaaactatgagtt

SEQ ID NO: 241201 - DNA, 20 bp, human
ggacggtaatgtgacaatct

SEQ ID NO: 241202 - DNA, 20 bp, human
gccacatcctcgagtgtcgc

SEQ ID NO: 241203 - DNA, 20 bp, human
gcaggctcttgtgtaggtta

SEQ ID NO: 241204 - DNA, 20 bp, human
ggatctgttaccttccaatt

SEQ ID NO: 241205 - DNA, 20 bp, human
gcttgatgattataagtcta

SEQ ID NO: 241206 - DNA, 20 bp, human
ggatgtgggtgtgaaatctg

SEQ ID NO: 241207 - DNA, 20 bp, human
gaccagcaaaaaagccatac

SEQ ID NO: 241208 - DNA, 20 bp, human
gtgggtgtgaaatctggggg

SEQ ID NO: 241209 - DNA, 20 bp, human
gggcaatgtttgggtttaga

SEQ ID NO: 241210 - DNA, 20 bp, human
gtagagggtgtgtccaatat

SEQ ID NO: 241211 - DNA, 20 bp, human
gccaggaattggcaatgttt

SEQ ID NO: 241212 - DNA, 20 bp, human
gtggcttttttgctggtcat

SEQ ID NO: 241213 - DNA, 20 bp, human
gtcacacccacatccgatat

SEQ ID NO: 241214 - DNA, 20 bp, human
ggtgtgtccaatatcggatg

SEQ ID NO: 241215 - DNA, 20 bp, human
ggtattgatggctccctgta

SEQ ID NO: 241216 - DNA, 20 bp, human
gcggcccacaacgccggggt

SEQ ID NO: 241217 - DNA, 20 bp, human
gccacaacgccggggtaggg

SEQ ID NO: 241218 - DNA, 20 bp, human
ggacgctcggtgaaggtggg

SEQ ID NO: 241219 - DNA, 20 bp, human
gcgaggacgggatgcgtcag

SEQ ID NO: 241220 - DNA, 20 bp, human
gcaggacgctcggtgaaggt

SEQ ID NO: 241221 - DNA, 20 bp, human
gctcccaggacgctcggtga

SEQ ID NO: 241222 - DNA, 20 bp, human
gcagagagggacaaggaccg

SEQ ID NO: 241223 - DNA, 20 bp, human
gccggggcaaaaccgaggac

SEQ ID NO: 241224 - DNA, 20 bp, human
gagggacaaggaccgagggg

SEQ ID NO: 241225 - DNA, 20 bp, human
gtgctcgggaatgaattctc

SEQ ID NO: 241226 - DNA, 20 bp, human
ggagactggatagtgactca

SEQ ID NO: 241227 - DNA, 20 bp, human
gtgaacatccagctgtccct

SEQ ID NO: 241228 - DNA, 20 bp, human
gtcagcatgggctttgagga

SEQ ID NO: 241229 - DNA, 20 bp, human
ggcctcaaaagtgcctttgt

SEQ ID NO: 241230 - DNA, 20 bp, human
gagggaggggtttttgtcac

SEQ ID NO: 241231 - DNA, 20 bp, human
gtcctcctgaccagtttctc

SEQ ID NO: 241232 - DNA, 20 bp, human
gtgtggggaccctggtcttc

SEQ ID NO: 241233 - DNA, 20 bp, human
ggacactgaatcacagccca

SEQ ID NO: 241234 - DNA, 20 bp, human
ggattcagtgtctgtctccc

SEQ ID NO: 241235 - DNA, 20 bp, human
gctcaggaatccagagaaac

SEQ ID NO: 241236 - DNA, 20 bp, human
gactaggacaacggcgggtg

SEQ ID NO: 241237 - DNA, 20 bp, human
gacaacggcgggtggggctg

SEQ ID NO: 241238 - DNA, 20 bp, human
gtggctcacctagtgtgggg

SEQ ID NO: 241239 - DNA, 20 bp, human
gccccctacgagggcctcta

SEQ ID NO: 241240 - DNA, 20 bp, human
gagagacaaagggacacgga

SEQ ID NO: 241241 - DNA, 20 bp, human
gagaccacccggctcagtcg

SEQ ID NO: 241242 - DNA, 20 bp, human
ggctcttgaggggtagctga

SEQ ID NO: 241243 - DNA, 20 bp, human
ggccgcgactaggacaacgg

SEQ ID NO: 241244 - DNA, 20 bp, human
gtgaggctggtcacagatgt

SEQ ID NO: 241245 - DNA, 20 bp, human
ggccctccatagaaaaagta

SEQ ID NO: 241246 - DNA, 20 bp, human
gaccctgtccctgacggcag

SEQ ID NO: 241247 - DNA, 20 bp, human
gcagcgggcgtgcgaatccc

SEQ ID NO: 241248 - DNA, 20 bp, human
gaatcccaggcttgtcagag

SEQ ID NO: 241249 - DNA, 20 bp, human
gccctcaccctgggtgagtc

SEQ ID NO: 241250 - DNA, 20 bp, human
gtaagcagcgcggtgacatg

SEQ ID NO: 241251 - DNA, 20 bp, human
gaagcctggcgccctcaccc

SEQ ID NO: 241252 - DNA, 20 bp, human
gcgcacgcccgctgccgtca

SEQ ID NO: 241253 - DNA, 20 bp, human
gagacgtccagactcaccca

SEQ ID NO: 241254 - DNA, 20 bp, human
ggcccgctgccgtcagggac

SEQ ID NO: 241255 - DNA, 20 bp, human
gaggaaacgaaggctcggga

SEQ ID NO: 241256 - DNA, 20 bp, human
ggggacctaaagccggccga

SEQ ID NO: 241257 - DNA, 20 bp, human
gaggtctgaaaagactctaa

SEQ ID NO: 241258 - DNA, 20 bp, human
gagggaaatccagtccggag

SEQ ID NO: 241259 - DNA, 20 bp, human
gggaggggacagtggtaggt

SEQ ID NO: 241260 - DNA, 20 bp, human
gaaagagaaacgggcgagtg

SEQ ID NO: 241261 - DNA, 20 bp, human
gggtgggaaaggtggaggat

SEQ ID NO: 241262 - DNA, 20 bp, human
gtctaagggaggggaacgat

SEQ ID NO: 241263 - DNA, 20 bp, human
gaggggctgactcggagctt

SEQ ID NO: 241264 - DNA, 20 bp, human
gcgtcccaggcgcacctgtt

SEQ ID NO: 241265 - DNA, 20 bp, human
gaagcgaaggggcgtgaccc

SEQ ID NO: 241266 - DNA, 20 bp, human
ggttccaagtacccaagtgt

SEQ ID NO: 241267 - DNA, 20 bp, human
gcgatcccttgtaatgtgaa

SEQ ID NO: 241268 - DNA, 20 bp, human
gtgtgtctaaaccaacactt

SEQ ID NO: 241269 - DNA, 20 bp, human
gtaaacttacaaatcaggtg

SEQ ID NO: 241270 - DNA, 20 bp, human
gattaccatccaccttttat

SEQ ID NO: 241271 - DNA, 20 bp, human
gcctgggaagccacattctt

SEQ ID NO: 241272 - DNA, 20 bp, human
gtaagagctgctgggaccaa

SEQ ID NO: 241273 - DNA, 20 bp, human
gccctgctattggctgcaac

SEQ ID NO: 241274 - DNA, 20 bp, human
gtcagccaataaaaggtgga

SEQ ID NO: 241275 - DNA, 20 bp, human
gccaaagtgaaacgagagta

SEQ ID NO: 241276 - DNA, 20 bp, human
gtgggaaccaagggtaaagg

SEQ ID NO: 241277 - DNA, 20 bp, human
gtgggcagcggatggatgag

SEQ ID NO: 241278 - DNA, 20 bp, human
ggagacctgagccacgggga

SEQ ID NO: 241279 - DNA, 20 bp, human
gctgcggctgagtggggaca

SEQ ID NO: 241280 - DNA, 20 bp, human
gtgaggaagaagagacggat

SEQ ID NO: 241281 - DNA, 20 bp, human
gcagccgcagcatcccccgc

SEQ ID NO: 241282 - DNA, 20 bp, human
gtgcggggctgggggttcgt

SEQ ID NO: 241283 - DNA, 20 bp, human
ggctgggggttcgtgggcag

SEQ ID NO: 241284 - DNA, 20 bp, human
gcgggagtgtgcgatactcg

SEQ ID NO: 241285 - DNA, 20 bp, human
gcgggggtcaaaaaagtaac

SEQ ID NO: 241286 - DNA, 20 bp, human
gaggaggcgcggggagagta

SEQ ID NO: 241287 - DNA, 20 bp, human
gccttgtgggagttgtagga

SEQ ID NO: 241288 - DNA, 20 bp, human
gcggggccgaggggccttgt

SEQ ID NO: 241289 - DNA, 20 bp, human
ggaggcgcgggagttatgga

SEQ ID NO: 241290 - DNA, 20 bp, human
gaggcggcgataggcattcc

SEQ ID NO: 241291 - DNA, 20 bp, human
gggcaagccggtacgcagaa

SEQ ID NO: 241292 - DNA, 20 bp, human
gctgcagggaagtgcgtcag

SEQ ID NO: 241293 - DNA, 20 bp, human
gtgcgtaccggcttgccctg

SEQ ID NO: 241294 - DNA, 20 bp, human
gggcggaggcgcgggagtta

SEQ ID NO: 241295 - DNA, 20 bp, human
gcagggaagtgcgtcagagg

SEQ ID NO: 241296 - DNA, 20 bp, human
gactcagttgagagctgcgg

SEQ ID NO: 241297 - DNA, 20 bp, human
ggggtgtatgcgatggtggt

SEQ ID NO: 241298 - DNA, 20 bp, human
gttgggggccgttacatgat

SEQ ID NO: 241299 - DNA, 20 bp, human
ggctgcgggggtgtatgcga

SEQ ID NO: 241300 - DNA, 20 bp, human
ggtcactcagttgagagctg

SEQ ID NO: 241301 - DNA, 20 bp, human
ggactcggcctatcatgtaa

SEQ ID NO: 241302 - DNA, 20 bp, human
gcccccagtggctgtttaaa

SEQ ID NO: 241303 - DNA, 20 bp, human
ggcgggggtgtatgcgatgg

SEQ ID NO: 241304 - DNA, 20 bp, human
gtatccctttaaacagccac

SEQ ID NO: 241305 - DNA, 20 bp, human
ggagggggttctggaacccc

SEQ ID NO: 241306 - DNA, 20 bp, human
gggaagtgaaaggaagtgta

SEQ ID NO: 241307 - DNA, 20 bp, human
gctcccagatggtaaaaatg

SEQ ID NO: 241308 - DNA, 20 bp, human
gtgtagaggcaggaagtgaa

SEQ ID NO: 241309 - DNA, 20 bp, human
ggatggagacccaacaattc

SEQ ID NO: 241310 - DNA, 20 bp, human
gcaatcctggcctgagtccc

SEQ ID NO: 241311 - DNA, 20 bp, human
gccgaatgactgggacccag

SEQ ID NO: 241312 - DNA, 20 bp, human
gtccactcggaaggagggaa

SEQ ID NO: 241313 - DNA, 20 bp, human
gaaaggaagtaggcatggcc

SEQ ID NO: 241314 - DNA, 20 bp, human
gagaacttcttggccctaat

SEQ ID NO: 241315 - DNA, 20 bp, human
gaggatcagaggtgcgatga

SEQ ID NO: 241316 - DNA, 20 bp, human
ggagacccaaggcgggatct

SEQ ID NO: 241317 - DNA, 20 bp, human
gaacccgctcagaaccatct

SEQ ID NO: 241318 - DNA, 20 bp, human
gtgtgcgaggagacccaagg

SEQ ID NO: 241319 - DNA, 20 bp, human
gcatcccaccactgccgaga

SEQ ID NO: 241320 - DNA, 20 bp, human
gcaaggcgggatctaggctt

SEQ ID NO: 241321 - DNA, 20 bp, human
ggggtgtgcgaggagaccca

SEQ ID NO: 241322 - DNA, 20 bp, human
gtggttctgagcgggttcct

SEQ ID NO: 241323 - DNA, 20 bp, human
gacggggctcggggattaat

SEQ ID NO: 241324 - DNA, 20 bp, human
gctggctctccaaggaatct

SEQ ID NO: 241325 - DNA, 20 bp, human
gaccctggaagacggggctc

SEQ ID NO: 241326 - DNA, 20 bp, human
gacactatgtctgcaccatg

SEQ ID NO: 241327 - DNA, 20 bp, human
gggtttgcctaagagaggta

SEQ ID NO: 241328 - DNA, 20 bp, human
gacaaataactagcaccaca

SEQ ID NO: 241329 - DNA, 20 bp, human
gtgaagagaacccttctatc

SEQ ID NO: 241330 - DNA, 20 bp, human
gactcactaatctgcagctg

SEQ ID NO: 241331 - DNA, 20 bp, human
gtagaagggttctcttcact

SEQ ID NO: 241332 - DNA, 20 bp, human
gtgatgaaggtcctgataga

SEQ ID NO: 241333 - DNA, 20 bp, human
gcaaaaggaatatctatgcc

SEQ ID NO: 241334 - DNA, 20 bp, human
gaccttcatcatcatacaaa

SEQ ID NO: 241335 - DNA, 20 bp, human
gtagctatgtaacatggcaa

SEQ ID NO: 241336 - DNA, 20 bp, human
gcagacagcaaggaatacac

SEQ ID NO: 241337 - DNA, 20 bp, human
gaacccaggaaaatatgggg

SEQ ID NO: 241338 - DNA, 20 bp, human
ggggggagcgctatatatga

SEQ ID NO: 241339 - DNA, 20 bp, human
gtgtacttaggggaaggatt

SEQ ID NO: 241340 - DNA, 20 bp, human
gtccccccccatattttcct

SEQ ID NO: 241341 - DNA, 20 bp, human
gagagacatggtgttggtaa

SEQ ID NO: 241342 - DNA, 20 bp, human
gtgtctgcaggattatccca

SEQ ID NO: 241343 - DNA, 20 bp, human
ggataactgtacttagggga

SEQ ID NO: 241344 - DNA, 20 bp, human
gtctaatgagaatatctcta

SEQ ID NO: 241345 - DNA, 20 bp, human
gcagaacccaggaaaatatg

SEQ ID NO: 241346 - DNA, 20 bp, human
gtggggaagccagctgtaga

SEQ ID NO: 241347 - DNA, 20 bp, human
ggcagccctgagttattctg

SEQ ID NO: 241348 - DNA, 20 bp, human
gcctgaccccagaataactc

SEQ ID NO: 241349 - DNA, 20 bp, human
ggagcgagggcggaggggaa

SEQ ID NO: 241350 - DNA, 20 bp, human
gccgcgacaggaaatgtgtg

SEQ ID NO: 241351 - DNA, 20 bp, human
gacagctggcgccgggtaca

SEQ ID NO: 241352 - DNA, 20 bp, human
ggcggcctaagggaaactgt

SEQ ID NO: 241353 - DNA, 20 bp, human
gcctccgccctcgctcccga

SEQ ID NO: 241354 - DNA, 20 bp, human
gaagggagggggaaccgggt

SEQ ID NO: 241355 - DNA, 20 bp, human
gacagctggcttccccaacc

SEQ ID NO: 241356 - DNA, 20 bp, human
ggcagtcccggagagggaat

SEQ ID NO: 241357 - DNA, 20 bp, human
gtttgggcgcagtcccggag

SEQ ID NO: 241358 - DNA, 20 bp, human
ggggccttgtagtccgttcg

SEQ ID NO: 241359 - DNA, 20 bp, human
gctgccgccgaaggccacgc

SEQ ID NO: 241360 - DNA, 20 bp, human
gggcggcaggactccgcgaa

SEQ ID NO: 241361 - DNA, 20 bp, human
gagagggaatcggcgtagat

SEQ ID NO: 241362 - DNA, 20 bp, human
gtcacccgcgtggccttcgg

SEQ ID NO: 241363 - DNA, 20 bp, human
gaatcggcgtagatgggtca

SEQ ID NO: 241364 - DNA, 20 bp, human
gcgcggagtcctgccgccga

SEQ ID NO: 241365 - DNA, 20 bp, human
gactccgcgaacggactaca

SEQ ID NO: 241366 - DNA, 20 bp, human
gtgagcacgtgtgaggtctg

SEQ ID NO: 241367 - DNA, 20 bp, human
gtctccgactcaggcgtctg

SEQ ID NO: 241368 - DNA, 20 bp, human
gtgtgcgtgaatccaaactg

SEQ ID NO: 241369 - DNA, 20 bp, human
gccccctgtctctccgactc

SEQ ID NO: 241370 - DNA, 20 bp, human
ggcctgagtcggagagacag

SEQ ID NO: 241371 - DNA, 20 bp, human
gtggtgtggtggctctcgcc

SEQ ID NO: 241372 - DNA, 20 bp, human
ggtttggattcacgcacaga

SEQ ID NO: 241373 - DNA, 20 bp, human
ggcatgtatttgactttgaa

SEQ ID NO: 241374 - DNA, 20 bp, human
gtgagatggatggtttatcc

SEQ ID NO: 241375 - DNA, 20 bp, human
ggaatccaaactggggagaa

SEQ ID NO: 241376 - DNA, 20 bp, human
gtgcagcactggaatgtccg

SEQ ID NO: 241377 - DNA, 20 bp, human
gtatggtccttctggtgagc

SEQ ID NO: 241378 - DNA, 20 bp, human
ggggagcggaagccatcagt

SEQ ID NO: 241379 - DNA, 20 bp, human
gggcccctgctaatcattgt

SEQ ID NO: 241380 - DNA, 20 bp, human
gccactctgcctgctgtcgg

SEQ ID NO: 241381 - DNA, 20 bp, human
gccaatcagcggggtctctg

SEQ ID NO: 241382 - DNA, 20 bp, human
gccagccaggacacggccat

SEQ ID NO: 241383 - DNA, 20 bp, human
ggtctctgggggctccccaa

SEQ ID NO: 241384 - DNA, 20 bp, human
gggtcactaatctgcagcac

SEQ ID NO: 241385 - DNA, 20 bp, human
gtgtcctccgagcccactga

SEQ ID NO: 241386 - DNA, 20 bp, human
gtatggtccttctggtgagc

SEQ ID NO: 241387 - DNA, 20 bp, human
gaagtttctcagaaaataca

SEQ ID NO: 241388 - DNA, 20 bp, human
gtgtgggctcaaaggggggt

SEQ ID NO: 241389 - DNA, 20 bp, human
gccagaggggtgcaatctgt

SEQ ID NO: 241390 - DNA, 20 bp, human
gaatctgtgggctcaaaggg

SEQ ID NO: 241391 - DNA, 20 bp, human
gtctgtctgggcagggtcgg

SEQ ID NO: 241392 - DNA, 20 bp, human
gagaggtaaccgcacaccag

SEQ ID NO: 241393 - DNA, 20 bp, human
gcgcacctgcacgaggaaaa

SEQ ID NO: 241394 - DNA, 20 bp, human
ggaactgggcaagaccccag

SEQ ID NO: 241395 - DNA, 20 bp, human
gattgcacccctctggtgtg

SEQ ID NO: 241396 - DNA, 20 bp, human
ggattggcctggggacattc

SEQ ID NO: 241397 - DNA, 20 bp, human
ggcagcaccggaatgtcccc

SEQ ID NO: 241398 - DNA, 20 bp, human
ggagaccccgctgattggcc

SEQ ID NO: 241399 - DNA, 20 bp, human
gtgaaaagagacaactcccg

SEQ ID NO: 241400 - DNA, 20 bp, human
gatgattagcaggggccgcg

SEQ ID NO: 241401 - DNA, 20 bp, human
gtatggtccttctggtgagc

SEQ ID NO: 241402 - DNA, 20 bp, human
gccaatcagcggggtctctg

SEQ ID NO: 241403 - DNA, 20 bp, human
gccactctgcctgctgtcgg

SEQ ID NO: 241404 - DNA, 20 bp, human
ggggagcggaagccatcagt

SEQ ID NO: 241405 - DNA, 20 bp, human
gggcccctgctaatcattgt

SEQ ID NO: 241406 - DNA, 20 bp, human
gaaaatacatagcttcctgt

SEQ ID NO: 241407 - DNA, 20 bp, human
gtcctctcggggaagaccaa

SEQ ID NO: 241408 - DNA, 20 bp, human
gcctgtagtcacgttggtga

SEQ ID NO: 241409 - DNA, 20 bp, human
ggcattaggctgcagcccac

SEQ ID NO: 241410 - DNA, 20 bp, human
gctaatgcccacgttcctct

SEQ ID NO: 241411 - DNA, 20 bp, human
ggccctggttgaataacctt

SEQ ID NO: 241412 - DNA, 20 bp, human
gaccaaaggttattcaacca

SEQ ID NO: 241413 - DNA, 20 bp, human
gtcttccccgagaggaacgt

SEQ ID NO: 241414 - DNA, 20 bp, human
gggttattcaaccagggcaa

SEQ ID NO: 241415 - DNA, 20 bp, human
gacctttggtcttccccgag

SEQ ID NO: 241416 - DNA, 20 bp, human
gtctcttggttctttgaggg

SEQ ID NO: 241417 - DNA, 20 bp, human
gtccaacagtgtgaagagga

SEQ ID NO: 241418 - DNA, 20 bp, human
gtcacattccagcctgtcac

SEQ ID NO: 241419 - DNA, 20 bp, human
gaccaaacaaatgacatcca

SEQ ID NO: 241420 - DNA, 20 bp, human
gccagtacatatctactctg

SEQ ID NO: 241421 - DNA, 20 bp, human
gaatgtctcttggttctttg

SEQ ID NO: 241422 - DNA, 20 bp, human
gctgccttctattggaaaat

SEQ ID NO: 241423 - DNA, 20 bp, human
gctacagggcaacaattgca

SEQ ID NO: 241424 - DNA, 20 bp, human
gtgtctccaacagtgtgaag

SEQ ID NO: 241425 - DNA, 20 bp, human
gttgagcgcagaggtctcct

SEQ ID NO: 241426 - DNA, 20 bp, human
gcccctcagcctgactgatt

SEQ ID NO: 241427 - DNA, 20 bp, human
ggccaaatcagtcaggctga

SEQ ID NO: 241428 - DNA, 20 bp, human
gctagctcacagtagcccgg

SEQ ID NO: 241429 - DNA, 20 bp, human
ggtacaagctcacaggagag

SEQ ID NO: 241430 - DNA, 20 bp, human
gtctgaatgccaaatcagtc

SEQ ID NO: 241431 - DNA, 20 bp, human
gtaagtgactccctaaagga

SEQ ID NO: 241432 - DNA, 20 bp, human
gcaaaaagttggcctttctc

SEQ ID NO: 241433 - DNA, 20 bp, human
gctgcaattcctgactggac

SEQ ID NO: 241434 - DNA, 20 bp, human
gaaactaagtgactccctaa

SEQ ID NO: 241435 - DNA, 20 bp, human
gatagcacggtgtagcactg

SEQ ID NO: 241436 - DNA, 20 bp, human
gagggtagaaccatgtgaga

SEQ ID NO: 241437 - DNA, 20 bp, human
gtgtggtaaaggagtagata

SEQ ID NO: 241438 - DNA, 20 bp, human
gcagctatgaagaagcttcc

SEQ ID NO: 241439 - DNA, 20 bp, human
gcctggaaaacaataagcaa

SEQ ID NO: 241440 - DNA, 20 bp, human
gttagaaaggatgcacatga

SEQ ID NO: 241441 - DNA, 20 bp, human
ggttctaccctactaaagac

SEQ ID NO: 241442 - DNA, 20 bp, human
ggatcttcctgtctttagta

SEQ ID NO: 241443 - DNA, 20 bp, human
gtgtaatttagactaagcta

SEQ ID NO: 241444 - DNA, 20 bp, human
gtgaacttttgttcttagaa

SEQ ID NO: 241445 - DNA, 20 bp, human
gctgtttcatagtcttgtgt

SEQ ID NO: 241446 - DNA, 20 bp, human
gtaatgcttgccagggtcca

SEQ ID NO: 241447 - DNA, 20 bp, human
ggagacttaaccaatccaaa

SEQ ID NO: 241448 - DNA, 20 bp, human
gttaactcatccataacaaa

SEQ ID NO: 241449 - DNA, 20 bp, human
gaggcagacttgttagttta

SEQ ID NO: 241450 - DNA, 20 bp, human
gagacttgttagtttaagga

SEQ ID NO: 241451 - DNA, 20 bp, human
gttccatagcacggttgttg

SEQ ID NO: 241452 - DNA, 20 bp, human
gcaccacaacaaccgtgcta

SEQ ID NO: 241453 - DNA, 20 bp, human
gaagcaaagtaatgcttgcc

SEQ ID NO: 241454 - DNA, 20 bp, human
gatggaaatgttccatagca

SEQ ID NO: 241455 - DNA, 20 bp, human
gctttacgatccttttgtta

SEQ ID NO: 241456 - DNA, 20 bp, human
gccttccagaactgtaggag

SEQ ID NO: 241457 - DNA, 20 bp, human
gtgagcaatttcgtgttctg

SEQ ID NO: 241458 - DNA, 20 bp, human
gcgtggttaagtaccactcc

SEQ ID NO: 241459 - DNA, 20 bp, human
gcgtgcaaagtcacacgtgt

SEQ ID NO: 241460 - DNA, 20 bp, human
gacagttctggaaggatacg

SEQ ID NO: 241461 - DNA, 20 bp, human
gtcagcctctcctacagttc

SEQ ID NO: 241462 - DNA, 20 bp, human
gaaaagaaagcttgccaagg

SEQ ID NO: 241463 - DNA, 20 bp, human
ggaacacgaaattgctcaag

SEQ ID NO: 241464 - DNA, 20 bp, human
gaggtgatctttcttaacac

SEQ ID NO: 241465 - DNA, 20 bp, human
gtgactaatagatagtcaca

SEQ ID NO: 241466 - DNA, 20 bp, human
gttaagttaaatatagctag

SEQ ID NO: 241467 - DNA, 20 bp, human
gctcagaggaaatgaatgtt

SEQ ID NO: 241468 - DNA, 20 bp, human
gtcatcacaacagaataaac

SEQ ID NO: 241469 - DNA, 20 bp, human
gtgaatgagcgtaaactctt

SEQ ID NO: 241470 - DNA, 20 bp, human
ggcttgacattttgagttac

SEQ ID NO: 241471 - DNA, 20 bp, human
gttagatcactcatagaaac

SEQ ID NO: 241472 - DNA, 20 bp, human
ggatcactcatagaaactgg

SEQ ID NO: 241473 - DNA, 20 bp, human
gacttacacgttttagtcgt

SEQ ID NO: 241474 - DNA, 20 bp, human
gttttgggaatttgctgcta

SEQ ID NO: 241475 - DNA, 20 bp, human
gttgttttgaatcattcttg

SEQ ID NO: 241476 - DNA, 20 bp, human
gagccgggagccgtggaccc

SEQ ID NO: 241477 - DNA, 20 bp, human
gagcccaggtggcggggtcg

SEQ ID NO: 241478 - DNA, 20 bp, human
gttcacagatggtgagcagg

SEQ ID NO: 241479 - DNA, 20 bp, human
ggggagccgtggacccgggc

SEQ ID NO: 241480 - DNA, 20 bp, human
gcccgccccgcccgggtcca

SEQ ID NO: 241481 - DNA, 20 bp, human
ggcggaggagcggggacagc

SEQ ID NO: 241482 - DNA, 20 bp, human
gccacagcagagggtggtag

SEQ ID NO: 241483 - DNA, 20 bp, human
gaagttcgcggggacagtgc

SEQ ID NO: 241484 - DNA, 20 bp, human
ggggagcgcagtcttggagc

SEQ ID NO: 241485 - DNA, 20 bp, human
gcggctgtgcgtggaggctg

SEQ ID NO: 241486 - DNA, 20 bp, human
gaagaggccaccttatgctg

SEQ ID NO: 241487 - DNA, 20 bp, human
gtgctggccacagcataagg

SEQ ID NO: 241488 - DNA, 20 bp, human
gcatgaggcacaagaacaag

SEQ ID NO: 241489 - DNA, 20 bp, human
gtccaaaaaggcaaatcact

SEQ ID NO: 241490 - DNA, 20 bp, human
gctctgctggccacagcata

SEQ ID NO: 241491 - DNA, 20 bp, human
gttataaaagtgagcttcgg

SEQ ID NO: 241492 - DNA, 20 bp, human
gaaaagtgagcttcggaggt

SEQ ID NO: 241493 - DNA, 20 bp, human
gtggaagtagttttctcagt

SEQ ID NO: 241494 - DNA, 20 bp, human
gttaaactctgagaagattg

SEQ ID NO: 241495 - DNA, 20 bp, human
gaatgtttgaatgcctctgc

SEQ ID NO: 241496 - DNA, 20 bp, human
gcctgcagccaagttgggga

SEQ ID NO: 241497 - DNA, 20 bp, human
gcagggccaggatgctgcgt

SEQ ID NO: 241498 - DNA, 20 bp, human
ggagcagctaccttgggtag

SEQ ID NO: 241499 - DNA, 20 bp, human
gggtagcaatgcccccttat

SEQ ID NO: 241500 - DNA, 20 bp, human
gcccccttatagggtgatct

SEQ ID NO: 241501 - DNA, 20 bp, human
ggcagaaggatgaagtcctg

SEQ ID NO: 241502 - DNA, 20 bp, human
gggacaggactcaggagaaa

SEQ ID NO: 241503 - DNA, 20 bp, human
gtctgcggagcagctacctt

SEQ ID NO: 241504 - DNA, 20 bp, human
gctggggctggctgtctgat

SEQ ID NO: 241505 - DNA, 20 bp, human
gcacgcctgcagccaagttg

SEQ ID NO: 241506 - DNA, 20 bp, human
gtaggcacatatcctcaaga

SEQ ID NO: 241507 - DNA, 20 bp, human
gtctcatgagacccctcttg

SEQ ID NO: 241508 - DNA, 20 bp, human
ggaaactaattcgtgaaggt

SEQ ID NO: 241509 - DNA, 20 bp, human
gttgaggatatgtgcctatc

SEQ ID NO: 241510 - DNA, 20 bp, human
gaaacaggaaccaaacatgg

SEQ ID NO: 241511 - DNA, 20 bp, human
gacaggaaactaattcgtga

SEQ ID NO: 241512 - DNA, 20 bp, human
gataaaagtgggaactcaaa

SEQ ID NO: 241513 - DNA, 20 bp, human
ggctgtgattctcactatac

SEQ ID NO: 241514 - DNA, 20 bp, human
gtctcactatactggtcctg

SEQ ID NO: 241515 - DNA, 20 bp, human
ggaacagcttcagaagacat

SEQ ID NO: 241516 - DNA, 20 bp, human
gtaggcgaagaaggatctaa

SEQ ID NO: 241517 - DNA, 20 bp, human
gaaaggaagagatgtgactt

SEQ ID NO: 241518 - DNA, 20 bp, human
gaaaaacagttcatggttgc

SEQ ID NO: 241519 - DNA, 20 bp, human
gaccccgaaagtaacatctt

SEQ ID NO: 241520 - DNA, 20 bp, human
gtcttcgcctactcttgcaa

SEQ ID NO: 241521 - DNA, 20 bp, human
ggaagaaggatctaagggct

SEQ ID NO: 241522 - DNA, 20 bp, human
gtccaaagatgttactttcg

SEQ ID NO: 241523 - DNA, 20 bp, human
gagtgcaacggcaggaggtc

SEQ ID NO: 241524 - DNA, 20 bp, human
ggctggagtgcaacggcagg

SEQ ID NO: 241525 - DNA, 20 bp, human
gtctcttcctttgcaagagt

SEQ ID NO: 241526 - DNA, 20 bp, human
ggtgatctcaacatacttgt

SEQ ID NO: 241527 - DNA, 20 bp, human
gatctcccggaatgtatcaa

SEQ ID NO: 241528 - DNA, 20 bp, human
gagcaaaaagagttgtgtta

SEQ ID NO: 241529 - DNA, 20 bp, human
gtctatactaaaaagttctc

SEQ ID NO: 241530 - DNA, 20 bp, human
ggtttcctttgatacattcc

SEQ ID NO: 241531 - DNA, 20 bp, human
gctgtgataaagacaccatc

SEQ ID NO: 241532 - DNA, 20 bp, human
gaaaggcagttatattcttg

SEQ ID NO: 241533 - DNA, 20 bp, human
ggtgaatattatattttcaa

SEQ ID NO: 241534 - DNA, 20 bp, human
gagtgctataaatgaagtca

SEQ ID NO: 241535 - DNA, 20 bp, human
gaacctttgttttcgagttg

SEQ ID NO: 241536 - DNA, 20 bp, human
gaggctagccatggggaaac

SEQ ID NO: 241537 - DNA, 20 bp, human
gacacaaataggctagccat

SEQ ID NO: 241538 - DNA, 20 bp, human
gagaatattaacttgttctg

SEQ ID NO: 241539 - DNA, 20 bp, human
ggacaacatagcacaaagct

SEQ ID NO: 241540 - DNA, 20 bp, human
gagtgtatgtatttaggaca

SEQ ID NO: 241541 - DNA, 20 bp, human
ggttaatattctacatctat

SEQ ID NO: 241542 - DNA, 20 bp, human
gtgcactctgaatttcactt

SEQ ID NO: 241543 - DNA, 20 bp, human
gaaatgttgtttcgtttcgt

SEQ ID NO: 241544 - DNA, 20 bp, human
gggaggacaaggaagtttat

SEQ ID NO: 241545 - DNA, 20 bp, human
gtgtggctacgcattaagtc

SEQ ID NO: 241546 - DNA, 20 bp, human
ggggctgagaactgacggga

SEQ ID NO: 241547 - DNA, 20 bp, human
gctgacgggaaggtgctaat

SEQ ID NO: 241548 - DNA, 20 bp, human
ggatggggctgagaactgac

SEQ ID NO: 241549 - DNA, 20 bp, human
ggggccgtcccgtggaccaa

SEQ ID NO: 241550 - DNA, 20 bp, human
ggggtatctgggagcctcta

SEQ ID NO: 241551 - DNA, 20 bp, human
gggaagaaaatagggcagat

SEQ ID NO: 241552 - DNA, 20 bp, human
gcagtgggcccctcccctag

SEQ ID NO: 241553 - DNA, 20 bp, human
gtgggactggcacctaggaa

SEQ ID NO: 241554 - DNA, 20 bp, human
gggtcaggagcatataagtg

SEQ ID NO: 241555 - DNA, 20 bp, human
ggttatgctggatgcggcag

SEQ ID NO: 241556 - DNA, 20 bp, human
ggaacccatggaccaatcac

SEQ ID NO: 241557 - DNA, 20 bp, human
ggggctggagtgaggccggg

SEQ ID NO: 241558 - DNA, 20 bp, human
gttcccgttgccaggaatta

SEQ ID NO: 241559 - DNA, 20 bp, human
gtgcagtggccagaaccagg

SEQ ID NO: 241560 - DNA, 20 bp, human
ggcccagcccagccttgaaa

SEQ ID NO: 241561 - DNA, 20 bp, human
gcatggaccaatcacaggat

SEQ ID NO: 241562 - DNA, 20 bp, human
gctacctagaacccatacag

SEQ ID NO: 241563 - DNA, 20 bp, human
gggccctttcaaggctgggc

SEQ ID NO: 241564 - DNA, 20 bp, human
ggcgtaggtccagtgagaac

SEQ ID NO: 241565 - DNA, 20 bp, human
gcaggactctaccactgtat

SEQ ID NO: 241566 - DNA, 20 bp, human
ggcaaggtcaggccgatctc

SEQ ID NO: 241567 - DNA, 20 bp, human
ggactcctccactcatgaca

SEQ ID NO: 241568 - DNA, 20 bp, human
gcaccagaaaggctagtgaa

SEQ ID NO: 241569 - DNA, 20 bp, human
gtcaaccatgtcatgagtgg

SEQ ID NO: 241570 - DNA, 20 bp, human
gtaagatcacatcaccagaa

SEQ ID NO: 241571 - DNA, 20 bp, human
gtctaaatctactgtctctc

SEQ ID NO: 241572 - DNA, 20 bp, human
gaatttcagggaggtgttgg

SEQ ID NO: 241573 - DNA, 20 bp, human
gtcatgacatggttgagcga

SEQ ID NO: 241574 - DNA, 20 bp, human
gcctccctgaaattcctgca

SEQ ID NO: 241575 - DNA, 20 bp, human
gcccacccctgccctacgta

SEQ ID NO: 241576 - DNA, 20 bp, human
ggagcaggcggggcaaagaa

SEQ ID NO: 241577 - DNA, 20 bp, human
ggaagggtgaatctgtgttg

SEQ ID NO: 241578 - DNA, 20 bp, human
gcaaggagatttagacacag

SEQ ID NO: 241579 - DNA, 20 bp, human
gagatttagacacagaggaa

SEQ ID NO: 241580 - DNA, 20 bp, human
gtctgctcttgccaccacta

SEQ ID NO: 241581 - DNA, 20 bp, human
gaatctggataaaaggtagc

SEQ ID NO: 241582 - DNA, 20 bp, human
gagccaccatgaggtctgga

SEQ ID NO: 241583 - DNA, 20 bp, human
ggactctctagccctagtgg

SEQ ID NO: 241584 - DNA, 20 bp, human
gacactgaagagccaccatg

SEQ ID NO: 241585 - DNA, 20 bp, human
gtcagtggggttcttggcaa

SEQ ID NO: 241586 - DNA, 20 bp, human
gccaatgtaaaggttagtta

SEQ ID NO: 241587 - DNA, 20 bp, human
gctgttcaacacatggatta

SEQ ID NO: 241588 - DNA, 20 bp, human
gtccagtgatttcgatacgt

SEQ ID NO: 241589 - DNA, 20 bp, human
gactgcatccagactaatat

SEQ ID NO: 241590 - DNA, 20 bp, human
gggctcccttttgcctaatc

SEQ ID NO: 241591 - DNA, 20 bp, human
gcatctgcccaatattagtc

SEQ ID NO: 241592 - DNA, 20 bp, human
gtaggacactgttcaacaca

SEQ ID NO: 241593 - DNA, 20 bp, human
gccccacgtatcgaaatcac

SEQ ID NO: 241594 - DNA, 20 bp, human
ggtgatataaaatcagaaac

SEQ ID NO: 241595 - DNA, 20 bp, human
gctctaaatagatgtctttt

SEQ ID NO: 241596 - DNA, 20 bp, human
gctgactcaggaaaactaaa

SEQ ID NO: 241597 - DNA, 20 bp, human
gagtcagcagtctcagaaac

SEQ ID NO: 241598 - DNA, 20 bp, human
gaagctcctaccaattgaaa

SEQ ID NO: 241599 - DNA, 20 bp, human
gcaaccagatattcaagagc

SEQ ID NO: 241600 - DNA, 20 bp, human
gaacaaagttatggtaaact

SEQ ID NO: 241601 - DNA, 20 bp, human
gtatatagataggtaaatga

SEQ ID NO: 241602 - DNA, 20 bp, human
gatgtgggctaggtacttac

SEQ ID NO: 241603 - DNA, 20 bp, human
gggatgcccaccttttcaat

SEQ ID NO: 241604 - DNA, 20 bp, human
gaaactgaaatagtttgcat

SEQ ID NO: 241605 - DNA, 20 bp, human
gtatgcatttttcttacatt

SEQ ID NO: 241606 - DNA, 20 bp, human
ggcaggctgcgcagatggtg

SEQ ID NO: 241607 - DNA, 20 bp, human
gtcggggctctcggctgtga

SEQ ID NO: 241608 - DNA, 20 bp, human
gtgagctgctgcggccctcg

SEQ ID NO: 241609 - DNA, 20 bp, human
ggtgtggtcctgcgccccga

SEQ ID NO: 241610 - DNA, 20 bp, human
gagaaactgtcaagtttacc

SEQ ID NO: 241611 - DNA, 20 bp, human
gagggccgcagcagctcatc

SEQ ID NO: 241612 - DNA, 20 bp, human
gagcctgcaccctcgcggcc

SEQ ID NO: 241613 - DNA, 20 bp, human
gtggtctcagcagtgtgtac

SEQ ID NO: 241614 - DNA, 20 bp, human
ggctgccggatgagctgctg

SEQ ID NO: 241615 - DNA, 20 bp, human
gtaccgggccgcgagggtgc

SEQ ID NO: 241616 - DNA, 20 bp, human
gggaaagcagtccacacagg

SEQ ID NO: 241617 - DNA, 20 bp, human
ggtaaagggtgggagatcac

SEQ ID NO: 241618 - DNA, 20 bp, human
gtgggcaaaccacggtgtaa

SEQ ID NO: 241619 - DNA, 20 bp, human
ggaacaagtaactcctcttg

SEQ ID NO: 241620 - DNA, 20 bp, human
ggttacattttcacagtagt

SEQ ID NO: 241621 - DNA, 20 bp, human
gaaacacaacttggtgaaaa

SEQ ID NO: 241622 - DNA, 20 bp, human
gttggtgtaagaactgaaat

SEQ ID NO: 241623 - DNA, 20 bp, human
ggtataggagatgaagcgtg

SEQ ID NO: 241624 - DNA, 20 bp, human
gcaaagaacgcacttgcatt

SEQ ID NO: 241625 - DNA, 20 bp, human
gacgcacttgcatttggtat

SEQ ID NO: 241626 - DNA, 20 bp, human
gaaaagaggaagtggtctat

SEQ ID NO: 241627 - DNA, 20 bp, human
gaatggtgagatatcttctg

SEQ ID NO: 241628 - DNA, 20 bp, human
gaaaacgagaacctactgta

SEQ ID NO: 241629 - DNA, 20 bp, human
gcctgaactaaaagaggaag

SEQ ID NO: 241630 - DNA, 20 bp, human
gagaggaggataaaagacat

SEQ ID NO: 241631 - DNA, 20 bp, human
gccaaatagctatcctactt

SEQ ID NO: 241632 - DNA, 20 bp, human
gtattacgaaagttacagaa

SEQ ID NO: 241633 - DNA, 20 bp, human
gcaatacaatgcatttagag

SEQ ID NO: 241634 - DNA, 20 bp, human
gctcgaatacttgtatgaca

SEQ ID NO: 241635 - DNA, 20 bp, human
gtaaaacatgaattatgcag

SEQ ID NO: 241636 - DNA, 20 bp, human
gagcgcgtagcacacacctc

SEQ ID NO: 241637 - DNA, 20 bp, human
gcccgctcccgggttagccc

SEQ ID NO: 241638 - DNA, 20 bp, human
gggtccaggccacaaccggc

SEQ ID NO: 241639 - DNA, 20 bp, human
ggcggggtccaggccacaac

SEQ ID NO: 241640 - DNA, 20 bp, human
gaaccggccggcggcggcac

SEQ ID NO: 241641 - DNA, 20 bp, human
ggggctcaaccgcctccagg

SEQ ID NO: 241642 - DNA, 20 bp, human
ggctacgcgctcctgctccg

SEQ ID NO: 241643 - DNA, 20 bp, human
gtcctgggctaacccgggag

SEQ ID NO: 241644 - DNA, 20 bp, human
gaataagtgcagcaagatta

SEQ ID NO: 241645 - DNA, 20 bp, human
gccgccggccggttgtggcc

SEQ ID NO: 241646 - DNA, 20 bp, human
ggagaaataagcccaggcta

SEQ ID NO: 241647 - DNA, 20 bp, human
ggaagagacaggttaggtca

SEQ ID NO: 241648 - DNA, 20 bp, human
gtttaaaaggaggtcgaggg

SEQ ID NO: 241649 - DNA, 20 bp, human
gtaaggggtgggtccttcgg

SEQ ID NO: 241650 - DNA, 20 bp, human
gtcttgggacaagtagtcca

SEQ ID NO: 241651 - DNA, 20 bp, human
ggggacggcagtcaggcatt

SEQ ID NO: 241652 - DNA, 20 bp, human
gttttcccgtacaatcaacg

SEQ ID NO: 241653 - DNA, 20 bp, human
gtcctagtctggcaccgggt

SEQ ID NO: 241654 - DNA, 20 bp, human
ggtgtggtcgcctaaggggt

SEQ ID NO: 241655 - DNA, 20 bp, human
ggcggtgggtgtctgcactt

SEQ ID NO: 241656 - DNA, 20 bp, human
ggggccggtcggtgagtcag

SEQ ID NO: 241657 - DNA, 20 bp, human
gcggccccgccctgaacctg

SEQ ID NO: 241658 - DNA, 20 bp, human
gccgccctgaacctggggag

SEQ ID NO: 241659 - DNA, 20 bp, human
gtctcccacaggatggggat

SEQ ID NO: 241660 - DNA, 20 bp, human
ggggcgggactcgacgatgt

SEQ ID NO: 241661 - DNA, 20 bp, human
gagggacagccctgggtcta

SEQ ID NO: 241662 - DNA, 20 bp, human
ggatggggatgggggtgtta

SEQ ID NO: 241663 - DNA, 20 bp, human
gagaggtcggagaaacaagg

SEQ ID NO: 241664 - DNA, 20 bp, human
gacgatgtagggagtgagtc

SEQ ID NO: 241665 - DNA, 20 bp, human
ggtagggagtgagtccggaa

SEQ ID NO: 241666 - DNA, 20 bp, human
ggagcccaggtctcaaaggg

SEQ ID NO: 241667 - DNA, 20 bp, human
gaactgcctggctagaaggg

SEQ ID NO: 241668 - DNA, 20 bp, human
gggaggctctagaaaacatc

SEQ ID NO: 241669 - DNA, 20 bp, human
gcatggcattgaagcctctc

SEQ ID NO: 241670 - DNA, 20 bp, human
ggggctccatgcccagaaaa

SEQ ID NO: 241671 - DNA, 20 bp, human
gatggagcccaggtctcaaa

SEQ ID NO: 241672 - DNA, 20 bp, human
gtgcctggctagaagggtgg

SEQ ID NO: 241673 - DNA, 20 bp, human
gaaatcaaggaggagccaaa

SEQ ID NO: 241674 - DNA, 20 bp, human
gataaactgcctggctagaa

SEQ ID NO: 241675 - DNA, 20 bp, human
gagagcctccctttgagacc

SEQ ID NO: 241676 - DNA, 20 bp, human
gaccctgaggtcacaccctc

SEQ ID NO: 241677 - DNA, 20 bp, human
gcacaccagactcaagtcca

SEQ ID NO: 241678 - DNA, 20 bp, human
gagcacactcagtaccgggt

SEQ ID NO: 241679 - DNA, 20 bp, human
gccggggtgtctgagcctga

SEQ ID NO: 241680 - DNA, 20 bp, human
ggggtggcggaatggtgtgg

SEQ ID NO: 241681 - DNA, 20 bp, human
gtgacctcagggtggcggaa

SEQ ID NO: 241682 - DNA, 20 bp, human
gagggtgataagcccacctg

SEQ ID NO: 241683 - DNA, 20 bp, human
gtcagggtggcggaatggtg

SEQ ID NO: 241684 - DNA, 20 bp, human
gacactcagtaccgggtggg

SEQ ID NO: 241685 - DNA, 20 bp, human
ggctgccctggacttgagtc

SEQ ID NO: 241686 - DNA, 20 bp, human
ggcgtggcctcgagcgggga

SEQ ID NO: 241687 - DNA, 20 bp, human
gtggcctcgagcggggaagg

SEQ ID NO: 241688 - DNA, 20 bp, human
ggaaggcggagggaccgctc

SEQ ID NO: 241689 - DNA, 20 bp, human
ggggcctcgggctgtaggca

SEQ ID NO: 241690 - DNA, 20 bp, human
gggactctccggggaaaata

SEQ ID NO: 241691 - DNA, 20 bp, human
ggcggcgcctcgggactctc

SEQ ID NO: 241692 - DNA, 20 bp, human
ggccgcagaggtcctttctt

SEQ ID NO: 241693 - DNA, 20 bp, human
gccgctccggagccgaagaa

SEQ ID NO: 241694 - DNA, 20 bp, human
gctctccggggaaaataagg

SEQ ID NO: 241695 - DNA, 20 bp, human
gacccgggtacgcctctcta

SEQ ID NO: 241696 - DNA, 20 bp, human
gtggtagtggagtaactcgg

SEQ ID NO: 241697 - DNA, 20 bp, human
gggggcggataatgaggcga

SEQ ID NO: 241698 - DNA, 20 bp, human
gaggccaagaggatgtcctg

SEQ ID NO: 241699 - DNA, 20 bp, human
gccccgccccaagaccccgc

SEQ ID NO: 241700 - DNA, 20 bp, human
gcgcccccaggacatcctct

SEQ ID NO: 241701 - DNA, 20 bp, human
ggcggagacagagctggtcc

SEQ ID NO: 241702 - DNA, 20 bp, human
ggcgaaggcagaaagagtcg

SEQ ID NO: 241703 - DNA, 20 bp, human
gccaacgcgcccaaaatagc

SEQ ID NO: 241704 - DNA, 20 bp, human
ggcgggatcgctgacagtcg

SEQ ID NO: 241705 - DNA, 20 bp, human
gagaaagagtcgaggagaag

SEQ ID NO: 241706 - DNA, 20 bp, human
ggtgccaactccatcccctg

SEQ ID NO: 241707 - DNA, 20 bp, human
gtccacaagggtcacgagaa

SEQ ID NO: 241708 - DNA, 20 bp, human
gctagagaacaacacccaag

SEQ ID NO: 241709 - DNA, 20 bp, human
gctacccaaacaaaggaggg

SEQ ID NO: 241710 - DNA, 20 bp, human
gtcacgagaaaggctgtcat

SEQ ID NO: 241711 - DNA, 20 bp, human
gtgtcattggccaagctcct

SEQ ID NO: 241712 - DNA, 20 bp, human
gaaaccccgcccaagcccca

SEQ ID NO: 241713 - DNA, 20 bp, human
gtgggtgttgttctctagaa

SEQ ID NO: 241714 - DNA, 20 bp, human
ggacatcttcagttgggtac

SEQ ID NO: 241715 - DNA, 20 bp, human
gggacaacagcgcccatctc

SEQ ID NO: 241716 - DNA, 20 bp, human
ggagctcggccggttgagtt

SEQ ID NO: 241717 - DNA, 20 bp, human
gtcagctctcccaactcaac

SEQ ID NO: 241718 - DNA, 20 bp, human
gcgtctcgacgtgtcaccgg

SEQ ID NO: 241719 - DNA, 20 bp, human
gcgtcgagacgcggcagcac

SEQ ID NO: 241720 - DNA, 20 bp, human
gtgactagaccctgcaccag

SEQ ID NO: 241721 - DNA, 20 bp, human
gccgcgtctcgacgtgtcac

SEQ ID NO: 241722 - DNA, 20 bp, human
gtttccctgagtgccgagct

SEQ ID NO: 241723 - DNA, 20 bp, human
gtgtaaaagcacagatcgct

SEQ ID NO: 241724 - DNA, 20 bp, human
gcctaccgagccagaaattt

SEQ ID NO: 241725 - DNA, 20 bp, human
gaccgagccagaaattttgg

SEQ ID NO: 241726 - DNA, 20 bp, human
gagggccggtgcggactcga

SEQ ID NO: 241727 - DNA, 20 bp, human
gcggcccctcgagtccgcac

SEQ ID NO: 241728 - DNA, 20 bp, human
ggctcgggagggttcgaggg

SEQ ID NO: 241729 - DNA, 20 bp, human
gaaagagcgggctgaggtcg

SEQ ID NO: 241730 - DNA, 20 bp, human
gacgagaagcccctcggagc

SEQ ID NO: 241731 - DNA, 20 bp, human
gcttggggagcaaggtgcga

SEQ ID NO: 241732 - DNA, 20 bp, human
gcggggccagggtcctcccg

SEQ ID NO: 241733 - DNA, 20 bp, human
gctgaggtcgaggctgaatg

SEQ ID NO: 241734 - DNA, 20 bp, human
ggggttcgagggcggagcgg

SEQ ID NO: 241735 - DNA, 20 bp, human
gagccccaaagagcgggctg

SEQ ID NO: 241736 - DNA, 20 bp, human
gaaccctggacgccccacaa

SEQ ID NO: 241737 - DNA, 20 bp, human
gcgcccgcctgctttccgcg

SEQ ID NO: 241738 - DNA, 20 bp, human
gcgggtcaggcgcgcgtggg

SEQ ID NO: 241739 - DNA, 20 bp, human
ggggcgggtcaggcgcgcgt

SEQ ID NO: 241740 - DNA, 20 bp, human
gctccgggagggaacaaaag

SEQ ID NO: 241741 - DNA, 20 bp, human
ggggcggcctcgcggttttc

SEQ ID NO: 241742 - DNA, 20 bp, human
gttcaggcctcagtgcctcg

SEQ ID NO: 241743 - DNA, 20 bp, human
ggtgcctcgcggaaagcagg

SEQ ID NO: 241744 - DNA, 20 bp, human
gccagcgcggaggtggatgt

SEQ ID NO: 241745 - DNA, 20 bp, human
gggcgggcgggcggaaaacg

SEQ ID NO: 241746 - DNA, 20 bp, human
gaggcgctcgcattgatgga

SEQ ID NO: 241747 - DNA, 20 bp, human
gccagaggcggcgactgaaa

SEQ ID NO: 241748 - DNA, 20 bp, human
ggggaccaaagtggagactg

SEQ ID NO: 241749 - DNA, 20 bp, human
gactgaaaggggagagcctc

SEQ ID NO: 241750 - DNA, 20 bp, human
gaggcccagacgccgacagg

SEQ ID NO: 241751 - DNA, 20 bp, human
gggtgagggcagtggtcttg

SEQ ID NO: 241752 - DNA, 20 bp, human
gctcccccgccgccggtagg

SEQ ID NO: 241753 - DNA, 20 bp, human
gcgggaggcgctcgcattga

SEQ ID NO: 241754 - DNA, 20 bp, human
gcctgctgcccccctaccgg

SEQ ID NO: 241755 - DNA, 20 bp, human
gggagaaggggtccggtcta

SEQ ID NO: 241756 - DNA, 20 bp, human
gcacgcgctggggactcggt

SEQ ID NO: 241757 - DNA, 20 bp, human
gtgactgctggggagtgcgg

SEQ ID NO: 241758 - DNA, 20 bp, human
gccccggctgacagcgtctg

SEQ ID NO: 241759 - DNA, 20 bp, human
gcacgctcggctggactctg

SEQ ID NO: 241760 - DNA, 20 bp, human
gaaggggtcaggagaaaacg

SEQ ID NO: 241761 - DNA, 20 bp, human
gacgggtaagactaggtccc

SEQ ID NO: 241762 - DNA, 20 bp, human
gagcgctgccagcagggaac

SEQ ID NO: 241763 - DNA, 20 bp, human
ggctcaacgtgggtgtagca

SEQ ID NO: 241764 - DNA, 20 bp, human
ggcctcacgtctctaacctg

SEQ ID NO: 241765 - DNA, 20 bp, human
gacgtgaggccgcgaggctg

SEQ ID NO: 241766 - DNA, 20 bp, human
gagggaaccagagcccgctg

SEQ ID NO: 241767 - DNA, 20 bp, human
gtcgcgcgcgcgaccatcgt

SEQ ID NO: 241768 - DNA, 20 bp, human
gacggggcgagcaggcggaa

SEQ ID NO: 241769 - DNA, 20 bp, human
gagtggggacaacacgccga

SEQ ID NO: 241770 - DNA, 20 bp, human
ggcggggcgggtcatgcacg

SEQ ID NO: 241771 - DNA, 20 bp, human
ggcggatgaaaggaagccgt

SEQ ID NO: 241772 - DNA, 20 bp, human
ggcccgctgtggcggatgaa

SEQ ID NO: 241773 - DNA, 20 bp, human
ggcgagcaggcggaaagggc

SEQ ID NO: 241774 - DNA, 20 bp, human
gcatgcacggggcgagcagg

SEQ ID NO: 241775 - DNA, 20 bp, human
ggcgcgaccatcgtgggcgc

SEQ ID NO: 241776 - DNA, 20 bp, human
gcctccgaggctctgacagg

SEQ ID NO: 241777 - DNA, 20 bp, human
gtgggggcggaagttcatag

SEQ ID NO: 241778 - DNA, 20 bp, human
gacaggaggcggggcatagc

SEQ ID NO: 241779 - DNA, 20 bp, human
gagagcctcggaggtactgg

SEQ ID NO: 241780 - DNA, 20 bp, human
gcatccgcctgtcagagcct

SEQ ID NO: 241781 - DNA, 20 bp, human
gaagttcataggggcgagga

SEQ ID NO: 241782 - DNA, 20 bp, human
ggtacctccgaggctctgac

SEQ ID NO: 241783 - DNA, 20 bp, human
ggggaagcgacgcaggacgt

SEQ ID NO: 241784 - DNA, 20 bp, human
gcaccacgtgctcacgtagt

SEQ ID NO: 241785 - DNA, 20 bp, human
gaggggcgaggagggtccac

SEQ ID NO: 241786 - DNA, 20 bp, human
gtaggagactagttccggga

SEQ ID NO: 241787 - DNA, 20 bp, human
ggctctagcccccgactcga

SEQ ID NO: 241788 - DNA, 20 bp, human
gtcggctcgacccggctcgg

SEQ ID NO: 241789 - DNA, 20 bp, human
gagggccgaggggacgagcc

SEQ ID NO: 241790 - DNA, 20 bp, human
gtgccccggagccttcgagt

SEQ ID NO: 241791 - DNA, 20 bp, human
gcgccagcctcggctcgacc

SEQ ID NO: 241792 - DNA, 20 bp, human
gacggctgcgtcacgcgagg

SEQ ID NO: 241793 - DNA, 20 bp, human
gcgggccaggctcgtcccct

SEQ ID NO: 241794 - DNA, 20 bp, human
gcggcctaggagactagttc

SEQ ID NO: 241795 - DNA, 20 bp, human
gccgccggagcggagagggc

SEQ ID NO: 241796 - DNA, 20 bp, human
gagggcacgtgactcaatcc

SEQ ID NO: 241797 - DNA, 20 bp, human
gctgcccggcagcaagccac

SEQ ID NO: 241798 - DNA, 20 bp, human
ggtgccctccccagagccaa

SEQ ID NO: 241799 - DNA, 20 bp, human
gacaggccccgccacgccat

SEQ ID NO: 241800 - DNA, 20 bp, human
gtgaagaaggcgtgggtgaa

SEQ ID NO: 241801 - DNA, 20 bp, human
gcacccacgccttcttcaaa

SEQ ID NO: 241802 - DNA, 20 bp, human
gagagccaatgggagcgagg

SEQ ID NO: 241803 - DNA, 20 bp, human
ggcttttctaggagcttctg

SEQ ID NO: 241804 - DNA, 20 bp, human
gctgccgggcaggcttttct

SEQ ID NO: 241805 - DNA, 20 bp, human
ggcgcagggcgggcagtcta

SEQ ID NO: 241806 - DNA, 20 bp, human
gtccacgtgacgtaagagcg

SEQ ID NO: 241807 - DNA, 20 bp, human
gggtgctagaggcgactcgg

SEQ ID NO: 241808 - DNA, 20 bp, human
gggtcccggggcctctaggc

SEQ ID NO: 241809 - DNA, 20 bp, human
gagggtgtttacgttctcta

SEQ ID NO: 241810 - DNA, 20 bp, human
gagaggccccgggaccgggt

SEQ ID NO: 241811 - DNA, 20 bp, human
gcacgtggagccccgccctt

SEQ ID NO: 241812 - DNA, 20 bp, human
ggctcccgccgctccaccta

SEQ ID NO: 241813 - DNA, 20 bp, human
ggacacgcggtacacactga

SEQ ID NO: 241814 - DNA, 20 bp, human
gccgccgctccacctaaggg

SEQ ID NO: 241815 - DNA, 20 bp, human
gggctcgggtggaaccggga

SEQ ID NO: 241816 - DNA, 20 bp, human
gtgactagcagtcttaactt

SEQ ID NO: 241817 - DNA, 20 bp, human
gtaagactgctagtcaccct

SEQ ID NO: 241818 - DNA, 20 bp, human
ggataatcccatagccccat

SEQ ID NO: 241819 - DNA, 20 bp, human
gagtttctcctctttaaggt

SEQ ID NO: 241820 - DNA, 20 bp, human
gtgctgggtcacagcatgta

SEQ ID NO: 241821 - DNA, 20 bp, human
gtagcatgacgttataattc

SEQ ID NO: 241822 - DNA, 20 bp, human
ggggaaataaaatgagccat

SEQ ID NO: 241823 - DNA, 20 bp, human
gataaaaggagagaaaatac

SEQ ID NO: 241824 - DNA, 20 bp, human
gtagggctcaatttcataaa

SEQ ID NO: 241825 - DNA, 20 bp, human
gttatctatctggacaactg

SEQ ID NO: 241826 - DNA, 20 bp, human
gaatgatcaagcataggccc

SEQ ID NO: 241827 - DNA, 20 bp, human
gactgacagctctcaataac

SEQ ID NO: 241828 - DNA, 20 bp, human
gtataagcaggtctacatga

SEQ ID NO: 241829 - DNA, 20 bp, human
gaaagtggaaatttccttgg

SEQ ID NO: 241830 - DNA, 20 bp, human
ggtagacctgcttatattcc

SEQ ID NO: 241831 - DNA, 20 bp, human
gttctgcatgagtacaaatc

SEQ ID NO: 241832 - DNA, 20 bp, human
gtttatgtaactacctcggt

SEQ ID NO: 241833 - DNA, 20 bp, human
gagattctgtgatttcctta

SEQ ID NO: 241834 - DNA, 20 bp, human
gccttaaggaactgataaat

SEQ ID NO: 241835 - DNA, 20 bp, human
gaaatcacagaatctaaaag

SEQ ID NO: 241836 - DNA, 20 bp, human
gggcccccgcccccgcacgg

SEQ ID NO: 241837 - DNA, 20 bp, human
gcgctcgcgccagcccgcgg

SEQ ID NO: 241838 - DNA, 20 bp, human
gggctggcgcgagcgagcgc

SEQ ID NO: 241839 - DNA, 20 bp, human
gctctcactcccccgtgcgg

SEQ ID NO: 241840 - DNA, 20 bp, human
gtcgctctcactcccccgtg

SEQ ID NO: 241841 - DNA, 20 bp, human
gcctcgcccctcgctcctca

SEQ ID NO: 241842 - DNA, 20 bp, human
gcctgcgtggggagtgtcga

SEQ ID NO: 241843 - DNA, 20 bp, human
gtcactcccccgtgcggggg

SEQ ID NO: 241844 - DNA, 20 bp, human
gacccgcgcctcatcacagc

SEQ ID NO: 241845 - DNA, 20 bp, human
ggctcgctcgcgccagcccg

SEQ ID NO: 241846 - DNA, 20 bp, human
gacctggggccgtgcagagg

SEQ ID NO: 241847 - DNA, 20 bp, human
ggagacctggggccgtgcag

SEQ ID NO: 241848 - DNA, 20 bp, human
gagggaggggctgcggtagg

SEQ ID NO: 241849 - DNA, 20 bp, human
gcgaacaaggagacctagag

SEQ ID NO: 241850 - DNA, 20 bp, human
gccctcccgcgcggcgtttg

SEQ ID NO: 241851 - DNA, 20 bp, human
gcggacaaggcctcgtccat

SEQ ID NO: 241852 - DNA, 20 bp, human
gcggcgtttggggtttgcgg

SEQ ID NO: 241853 - DNA, 20 bp, human
gcaacccacccgcctctgca

SEQ ID NO: 241854 - DNA, 20 bp, human
gcgggtgggttgagaggcgc

SEQ ID NO: 241855 - DNA, 20 bp, human
gagagctctaggaacggaca

SEQ ID NO: 241856 - DNA, 20 bp, human
gtcggagcgtgaaaaaggga

SEQ ID NO: 241857 - DNA, 20 bp, human
gggcttcggagcgtgaaaaa

SEQ ID NO: 241858 - DNA, 20 bp, human
gcagagaggacccggaagta

SEQ ID NO: 241859 - DNA, 20 bp, human
gcgccactgatctaaggtca

SEQ ID NO: 241860 - DNA, 20 bp, human
gcaagtgagtgctgaaggaa

SEQ ID NO: 241861 - DNA, 20 bp, human
gagccgtgaccttagatcag

SEQ ID NO: 241862 - DNA, 20 bp, human
gaaacctctgagcacgtgat

SEQ ID NO: 241863 - DNA, 20 bp, human
gaggctactgtctcggtctt

SEQ ID NO: 241864 - DNA, 20 bp, human
gcttgggcgccactgatcta

SEQ ID NO: 241865 - DNA, 20 bp, human
ggcccaaagcgaagacagag

SEQ ID NO: 241866 - DNA, 20 bp, human
ggccccgcgtcccggactgg

SEQ ID NO: 241867 - DNA, 20 bp, human
ggcggggaggtgtcatgcgc

SEQ ID NO: 241868 - DNA, 20 bp, human
gggcctgcgacgccggtggg

SEQ ID NO: 241869 - DNA, 20 bp, human
gtggccccaagcgcaggttc

SEQ ID NO: 241870 - DNA, 20 bp, human
ggcgccggaacctgcgcttg

SEQ ID NO: 241871 - DNA, 20 bp, human
ggagctgacgcgcaggggca

SEQ ID NO: 241872 - DNA, 20 bp, human
ggccgccagtccgggacgcg

SEQ ID NO: 241873 - DNA, 20 bp, human
gcccgcgccccgccgcatct

SEQ ID NO: 241874 - DNA, 20 bp, human
gctctggagctgacgcgcag

SEQ ID NO: 241875 - DNA, 20 bp, human
gagagcttggccccaagcgc

SEQ ID NO: 241876 - DNA, 20 bp, human
gggcgggctccgctagggga

SEQ ID NO: 241877 - DNA, 20 bp, human
ggacggggcgggctccgcta

SEQ ID NO: 241878 - DNA, 20 bp, human
gccctcgggaggaacaggcg

SEQ ID NO: 241879 - DNA, 20 bp, human
gctgcgcgcgtgaccaccag

SEQ ID NO: 241880 - DNA, 20 bp, human
gagcgggctgggatgtgtta

SEQ ID NO: 241881 - DNA, 20 bp, human
ggtacgggaatctctgtcta

SEQ ID NO: 241882 - DNA, 20 bp, human
gcgagtgtggcgtcctcgcg

SEQ ID NO: 241883 - DNA, 20 bp, human
ggcaaattcccagcgcgggg

SEQ ID NO: 241884 - DNA, 20 bp, human
gtcccagcgcggggcggttc

SEQ ID NO: 241885 - DNA, 20 bp, human
ggccccgcctgttcctcccg

SEQ ID NO: 241886 - DNA, 20 bp, human
gcgcctaggcgctacgacgg

SEQ ID NO: 241887 - DNA, 20 bp, human
gcacgcgttctgcccccctg

SEQ ID NO: 241888 - DNA, 20 bp, human
gtaggcgctacgacggcggc

SEQ ID NO: 241889 - DNA, 20 bp, human
gccccgcctaggcgctacga

SEQ ID NO: 241890 - DNA, 20 bp, human
gcgcgggcggtgtttgaggc

SEQ ID NO: 241891 - DNA, 20 bp, human
gcgtagcgacgcccccaggg

SEQ ID NO: 241892 - DNA, 20 bp, human
gcgtgcgcgggcggtgtttg

SEQ ID NO: 241893 - DNA, 20 bp, human
ggggtggacgcgctgaacca

SEQ ID NO: 241894 - DNA, 20 bp, human
ggggccgggctgaaccatgg

SEQ ID NO: 241895 - DNA, 20 bp, human
ggcggggccgggctgaacca

SEQ ID NO: 241896 - DNA, 20 bp, human
gacctgagaggtctgacctg

SEQ ID NO: 241897 - DNA, 20 bp, human
gagaggtctgacctgagggc

SEQ ID NO: 241898 - DNA, 20 bp, human
gcaatacgtgaagctttcag

SEQ ID NO: 241899 - DNA, 20 bp, human
gggcaacactcaagcatgga

SEQ ID NO: 241900 - DNA, 20 bp, human
gttaaaaacaccctttgcat

SEQ ID NO: 241901 - DNA, 20 bp, human
gacactcaagcatggaaggt

SEQ ID NO: 241902 - DNA, 20 bp, human
ggacacacggtgtccttatg

SEQ ID NO: 241903 - DNA, 20 bp, human
gctaaaacggacctatcagg

SEQ ID NO: 241904 - DNA, 20 bp, human
gaactatgaagtgccacata

SEQ ID NO: 241905 - DNA, 20 bp, human
gaacacctggtccatgtgtc

SEQ ID NO: 241906 - DNA, 20 bp, human
gcagaaatggcgaggaagaa

SEQ ID NO: 241907 - DNA, 20 bp, human
ggtcgacggcgttcagattc

SEQ ID NO: 241908 - DNA, 20 bp, human
gctggaagaggcagtcaccc

SEQ ID NO: 241909 - DNA, 20 bp, human
ggaaggggaagggtgttgcg

SEQ ID NO: 241910 - DNA, 20 bp, human
ggaggtcggctaagaacgtg

SEQ ID NO: 241911 - DNA, 20 bp, human
ggcagactaagttgttcttc

SEQ ID NO: 241912 - DNA, 20 bp, human
ggttctgtgggaagtccctc

SEQ ID NO: 241913 - DNA, 20 bp, human
ggtctcatctctatggtcga

SEQ ID NO: 241914 - DNA, 20 bp, human
gcaaagcctcagaaatggcg

SEQ ID NO: 241915 - DNA, 20 bp, human
gtcaataactgagggttctg

SEQ ID NO: 241916 - DNA, 20 bp, human
ggagccgcgccaggggatcc

SEQ ID NO: 241917 - DNA, 20 bp, human
gccccggccgggaacggcgc

SEQ ID NO: 241918 - DNA, 20 bp, human
gcggctccgtgctgcctaac

SEQ ID NO: 241919 - DNA, 20 bp, human
gtgcgcaccgagccgcgctg

SEQ ID NO: 241920 - DNA, 20 bp, human
gcgtccgggatcccctggcg

SEQ ID NO: 241921 - DNA, 20 bp, human
ggccggccgtctgagcccgc

SEQ ID NO: 241922 - DNA, 20 bp, human
gaaccggcgccgttcccggc

SEQ ID NO: 241923 - DNA, 20 bp, human
gtccccggctttctagtaac

SEQ ID NO: 241924 - DNA, 20 bp, human
gtcccggccggggcagggaa

SEQ ID NO: 241925 - DNA, 20 bp, human
ggggggcgcaatcacggact

SEQ ID NO: 241926 - DNA, 20 bp, human
gcaggggagcaggaaatctg

SEQ ID NO: 241927 - DNA, 20 bp, human
gctgggcagggacaggtcga

SEQ ID NO: 241928 - DNA, 20 bp, human
gttgccggagcagccgagag

SEQ ID NO: 241929 - DNA, 20 bp, human
ggtgacgccaaaggtgggag

SEQ ID NO: 241930 - DNA, 20 bp, human
ggacgcgcactgccgaagcc

SEQ ID NO: 241931 - DNA, 20 bp, human
ggaggggtgaggaggcgtgg

SEQ ID NO: 241932 - DNA, 20 bp, human
gaggtcgagggaccaggctt

SEQ ID NO: 241933 - DNA, 20 bp, human
gtattcgtgcagccggaggg

SEQ ID NO: 241934 - DNA, 20 bp, human
gtagcgagtgcacccgctct

SEQ ID NO: 241935 - DNA, 20 bp, human
gtgaacgtgacgccaaaggt

SEQ ID NO: 241936 - DNA, 20 bp, human
gaaactaggaaagaagtctt

SEQ ID NO: 241937 - DNA, 20 bp, human
ggagttgcgcactacctcac

SEQ ID NO: 241938 - DNA, 20 bp, human
gtagaagcccggggcatatt

SEQ ID NO: 241939 - DNA, 20 bp, human
gattgcgtcacaatgactgc

SEQ ID NO: 241940 - DNA, 20 bp, human
gttcgaagacgccgcgaaca

SEQ ID NO: 241941 - DNA, 20 bp, human
ggcgcactacctcacgggag

SEQ ID NO: 241942 - DNA, 20 bp, human
gcgcaactccaccctgttcg

SEQ ID NO: 241943 - DNA, 20 bp, human
ggcggcagccatgttggacg

SEQ ID NO: 241944 - DNA, 20 bp, human
ggtggactacctctcccgtg

SEQ ID NO: 241945 - DNA, 20 bp, human
gacgcaatcccacagccttc

SEQ ID NO: 241946 - DNA, 20 bp, human
gtctgggcgggcgccattaa

SEQ ID NO: 241947 - DNA, 20 bp, human
gatagggacggagcctgaaa

SEQ ID NO: 241948 - DNA, 20 bp, human
gcgccattaagggtgaggcg

SEQ ID NO: 241949 - DNA, 20 bp, human
gcgctcacttccaggagtct

SEQ ID NO: 241950 - DNA, 20 bp, human
gtggcgcccgcccagactcc

SEQ ID NO: 241951 - DNA, 20 bp, human
gtggcccggaatattggtag

SEQ ID NO: 241952 - DNA, 20 bp, human
gcccactcaatttacttcat

SEQ ID NO: 241953 - DNA, 20 bp, human
ggcgggcgccattaagggtg

SEQ ID NO: 241954 - DNA, 20 bp, human
gttaagggtgaggcggggat

SEQ ID NO: 241955 - DNA, 20 bp, human
gcgctaggccgctcacttcc

SEQ ID NO: 241956 - DNA, 20 bp, human
gaaactgggtgagtacctgg

SEQ ID NO: 241957 - DNA, 20 bp, human
gcacctgcatcccacagggc

SEQ ID NO: 241958 - DNA, 20 bp, human
gtggccaatctgctgtgggg

SEQ ID NO: 241959 - DNA, 20 bp, human
gctgtggccaatctgctgtg

SEQ ID NO: 241960 - DNA, 20 bp, human
gtgtggggcggttcctgata

SEQ ID NO: 241961 - DNA, 20 bp, human
gacacacgaaaaaggccacc

SEQ ID NO: 241962 - DNA, 20 bp, human
gagatccacctgcatcccac

SEQ ID NO: 241963 - DNA, 20 bp, human
ggccacataagcagtgggta

SEQ ID NO: 241964 - DNA, 20 bp, human
gcataagcagtgggtaaggg

SEQ ID NO: 241965 - DNA, 20 bp, human
gctcacccagtttccttatc

SEQ ID NO: 241966 - DNA, 20 bp, human
gccaccacaataattagttc

SEQ ID NO: 241967 - DNA, 20 bp, human
gtcagcaaacatcctaagat

SEQ ID NO: 241968 - DNA, 20 bp, human
gtcctaagatcggttctgat

SEQ ID NO: 241969 - DNA, 20 bp, human
gagatcggttctgattggat

SEQ ID NO: 241970 - DNA, 20 bp, human
gctgcctgaactaattattg

SEQ ID NO: 241971 - DNA, 20 bp, human
gtatcgaggctcctaaagta

SEQ ID NO: 241972 - DNA, 20 bp, human
gcctgagtattgtgcaggat

SEQ ID NO: 241973 - DNA, 20 bp, human
gcctctggggcaggattgtc

SEQ ID NO: 241974 - DNA, 20 bp, human
ggggaaaattctgacggggt

SEQ ID NO: 241975 - DNA, 20 bp, human
gacagtattgatgtacatgg

SEQ ID NO: 241976 - DNA, 20 bp, human
ggggcggtgggaatgcatgt

SEQ ID NO: 241977 - DNA, 20 bp, human
gggaggtcattgatgtgtgt

SEQ ID NO: 241978 - DNA, 20 bp, human
gccacccagcactggggctt

SEQ ID NO: 241979 - DNA, 20 bp, human
gagggtgagtatgagttttg

SEQ ID NO: 241980 - DNA, 20 bp, human
gggtcattgatgtgtgtagg

SEQ ID NO: 241981 - DNA, 20 bp, human
gaggaaagtctagaccactc

SEQ ID NO: 241982 - DNA, 20 bp, human
ggtaggtgaccatcaggcac

SEQ ID NO: 241983 - DNA, 20 bp, human
gaatgacctccacccagcac

SEQ ID NO: 241984 - DNA, 20 bp, human
gtatgagttttggggcgaga

SEQ ID NO: 241985 - DNA, 20 bp, human
gtgagaagcagcctatgttg

SEQ ID NO: 241986 - DNA, 20 bp, human
gtggagggcgaggacgcctg

SEQ ID NO: 241987 - DNA, 20 bp, human
gggcgaggacgcctgcggaa

SEQ ID NO: 241988 - DNA, 20 bp, human
gcgctcaggctcgcacgggc

SEQ ID NO: 241989 - DNA, 20 bp, human
gttggaagtaacacgtatgg

SEQ ID NO: 241990 - DNA, 20 bp, human
gtacttggaagtaacacgta

SEQ ID NO: 241991 - DNA, 20 bp, human
gaaggcgctcaggctcgcac

SEQ ID NO: 241992 - DNA, 20 bp, human
gttccagactgtaggggccc

SEQ ID NO: 241993 - DNA, 20 bp, human
gcctccgccggggtggcctg

SEQ ID NO: 241994 - DNA, 20 bp, human
gcgggataaaacctcttccc

SEQ ID NO: 241995 - DNA, 20 bp, human
gcgtccctcctccgccgggg

SEQ ID NO: 241996 - DNA, 20 bp, human
ggggagaaagacgagtacgg

SEQ ID NO: 241997 - DNA, 20 bp, human
ggctgggagaaagacgagta

SEQ ID NO: 241998 - DNA, 20 bp, human
gcggaagtggccttcctgag

SEQ ID NO: 241999 - DNA, 20 bp, human
ggcagccacgcctctcagga

SEQ ID NO: 242000 - DNA, 20 bp, human
gcccgccgggccaccctatc

SEQ ID NO: 242001 - DNA, 20 bp, human
gaaaaggcgggttaatgtga

SEQ ID NO: 242002 - DNA, 20 bp, human
ggcggacaggatgtcccgaa

SEQ ID NO: 242003 - DNA, 20 bp, human
gaggacgcgaagaatcggca

SEQ ID NO: 242004 - DNA, 20 bp, human
gtatcatagggtctcatcgg

SEQ ID NO: 242005 - DNA, 20 bp, human
ggctaggcagggcagtccga

SEQ ID NO: 242006 - DNA, 20 bp, human
gccctcctggggtgcctctc

SEQ ID NO: 242007 - DNA, 20 bp, human
gcgcccgcgccgccctcctg

SEQ ID NO: 242008 - DNA, 20 bp, human
gcgcacgcgcatccaggatg

SEQ ID NO: 242009 - DNA, 20 bp, human
gaagctgggggtcaggttca

SEQ ID NO: 242010 - DNA, 20 bp, human
ggccccgcgaacgccctccg

SEQ ID NO: 242011 - DNA, 20 bp, human
gggggcgccggggaaggcta

SEQ ID NO: 242012 - DNA, 20 bp, human
gcctgccagaccaccaagtg

SEQ ID NO: 242013 - DNA, 20 bp, human
gccctgagaggcaccccagg

SEQ ID NO: 242014 - DNA, 20 bp, human
gaggtgcccggcttctgtga

SEQ ID NO: 242015 - DNA, 20 bp, human
gtccctgggaaacggagtct

SEQ ID NO: 242016 - DNA, 20 bp, human
gtgcgccctaggcccgggga

SEQ ID NO: 242017 - DNA, 20 bp, human
gcaagctccccgggcccagt

SEQ ID NO: 242018 - DNA, 20 bp, human
gcaggcgcgcgcaagctccc

SEQ ID NO: 242019 - DNA, 20 bp, human
gcgcgcctgcgccctaggcc

SEQ ID NO: 242020 - DNA, 20 bp, human
gtacgtgaggcgaaggcgag

SEQ ID NO: 242021 - DNA, 20 bp, human
gagctcgactatgacgactc

SEQ ID NO: 242022 - DNA, 20 bp, human
gggcgccaatgagttcccta

SEQ ID NO: 242023 - DNA, 20 bp, human
gcaagcgtctagccccaact

SEQ ID NO: 242024 - DNA, 20 bp, human
gacctgtagtcgccccagtt

SEQ ID NO: 242025 - DNA, 20 bp, human
ggggctagacgcttgccgta

SEQ ID NO: 242026 - DNA, 20 bp, human
gggacagctcccagctgaaa

SEQ ID NO: 242027 - DNA, 20 bp, human
gacctggcgagaaccgtcga

SEQ ID NO: 242028 - DNA, 20 bp, human
gaaggcaacttcaccatcga

SEQ ID NO: 242029 - DNA, 20 bp, human
gcctttgtgagcaatgggaa

SEQ ID NO: 242030 - DNA, 20 bp, human
gccaatcagacaaaaggctg

SEQ ID NO: 242031 - DNA, 20 bp, human
ggtgaagttgccttttcagc

SEQ ID NO: 242032 - DNA, 20 bp, human
gaaaggtcgaagataacaga

SEQ ID NO: 242033 - DNA, 20 bp, human
gagtccaaagatttccaatt

SEQ ID NO: 242034 - DNA, 20 bp, human
gtctttgactgcatttatta

SEQ ID NO: 242035 - DNA, 20 bp, human
gcctcatcatcactcatact

SEQ ID NO: 242036 - DNA, 20 bp, human
gtagcggagtgtgttactga

SEQ ID NO: 242037 - DNA, 20 bp, human
gtagtctaggaggagatata

SEQ ID NO: 242038 - DNA, 20 bp, human
gtgcaagcttgcgctgaagg

SEQ ID NO: 242039 - DNA, 20 bp, human
gcacactccgctacatagtc

SEQ ID NO: 242040 - DNA, 20 bp, human
gtcttcacctgactatgtag

SEQ ID NO: 242041 - DNA, 20 bp, human
ggtcgatctcgctgatgcat

SEQ ID NO: 242042 - DNA, 20 bp, human
ggatgtggttgtaggaagca

SEQ ID NO: 242043 - DNA, 20 bp, human
ggtggacctcgtaatgataa

SEQ ID NO: 242044 - DNA, 20 bp, human
ggtgaagattgtctctgtag

SEQ ID NO: 242045 - DNA, 20 bp, human
gtatttaaatacttgaaacg

SEQ ID NO: 242046 - DNA, 20 bp, human
gtagcctaccatatcatgac

SEQ ID NO: 242047 - DNA, 20 bp, human
gactcctgtcatgatatggt

SEQ ID NO: 242048 - DNA, 20 bp, human
gaactttggtctggagtaag

SEQ ID NO: 242049 - DNA, 20 bp, human
gggtgggcatggtcttccca

SEQ ID NO: 242050 - DNA, 20 bp, human
ggtagaattcctaaataata

SEQ ID NO: 242051 - DNA, 20 bp, human
gctggagtaagaggctgcta

SEQ ID NO: 242052 - DNA, 20 bp, human
gaacttgcttccatgacact

SEQ ID NO: 242053 - DNA, 20 bp, human
ggccaaccagcatgaacaag

SEQ ID NO: 242054 - DNA, 20 bp, human
gcatgattgaggaagtccct

SEQ ID NO: 242055 - DNA, 20 bp, human
gctagactcagcaacgcttt

SEQ ID NO: 242056 - DNA, 20 bp, human
ggggcggggcagtcggtacc

SEQ ID NO: 242057 - DNA, 20 bp, human
ggcgacccgccaactcagcc

SEQ ID NO: 242058 - DNA, 20 bp, human
ggccagaggcgctgcgtgat

SEQ ID NO: 242059 - DNA, 20 bp, human
ggcccaatctcctattaccc

SEQ ID NO: 242060 - DNA, 20 bp, human
gcgtgattggtgggtcggaa

SEQ ID NO: 242061 - DNA, 20 bp, human
gagaggcgctgcgtgattgg

SEQ ID NO: 242062 - DNA, 20 bp, human
gctgctggtagcggagcctg

SEQ ID NO: 242063 - DNA, 20 bp, human
gagctggaggtgcacggggg

SEQ ID NO: 242064 - DNA, 20 bp, human
gagtggaggtcccacccaga

SEQ ID NO: 242065 - DNA, 20 bp, human
gctcgctggaaagccccctc

SEQ ID NO: 242066 - DNA, 20 bp, human
gcgctccaggcggggccgac

SEQ ID NO: 242067 - DNA, 20 bp, human
gcgcgcgcgcggcggaccct

SEQ ID NO: 242068 - DNA, 20 bp, human
gcccggccgggtaccctcgc

SEQ ID NO: 242069 - DNA, 20 bp, human
gcaggcggggccgacgggct

SEQ ID NO: 242070 - DNA, 20 bp, human
ggcggaccctgggagcgcgc

SEQ ID NO: 242071 - DNA, 20 bp, human
ggaaagggatacagtccccc

SEQ ID NO: 242072 - DNA, 20 bp, human
gcgcccgcggggacgcgcct

SEQ ID NO: 242073 - DNA, 20 bp, human
gtctctctcgggtccggcga

SEQ ID NO: 242074 - DNA, 20 bp, human
gtggcggcggcgctctctct

SEQ ID NO: 242075 - DNA, 20 bp, human
gggaggcgcgcgcccgctgc

SEQ ID NO: 242076 - DNA, 20 bp, human
ggcccccagaggaccctggt

SEQ ID NO: 242077 - DNA, 20 bp, human
gggcccggtcccgactgggc

SEQ ID NO: 242078 - DNA, 20 bp, human
gcccctgcccagtcgggacc

SEQ ID NO: 242079 - DNA, 20 bp, human
gacgctccggggccctgtcc

SEQ ID NO: 242080 - DNA, 20 bp, human
ggacctggatggcaatggca

SEQ ID NO: 242081 - DNA, 20 bp, human
gtctccggagccgcccacca

SEQ ID NO: 242082 - DNA, 20 bp, human
ggaggcctgagggtcatctg

SEQ ID NO: 242083 - DNA, 20 bp, human
gtgggggcccggtcccgact

SEQ ID NO: 242084 - DNA, 20 bp, human
gcgtgcatattcatgaacgc

SEQ ID NO: 242085 - DNA, 20 bp, human
gtgaacgcgggcatcggcgc

SEQ ID NO: 242086 - DNA, 20 bp, human
gcccgacgccccagtctcat

SEQ ID NO: 242087 - DNA, 20 bp, human
gggaccaggtgctgcagcgg

SEQ ID NO: 242088 - DNA, 20 bp, human
ggagggagccaatgagactg

SEQ ID NO: 242089 - DNA, 20 bp, human
gtcggggctggagagtttca

SEQ ID NO: 242090 - DNA, 20 bp, human
gaagctggagagccacggag

SEQ ID NO: 242091 - DNA, 20 bp, human
gcagccgggcaacgattgat

SEQ ID NO: 242092 - DNA, 20 bp, human
gtggggaagagagacgtcag

SEQ ID NO: 242093 - DNA, 20 bp, human
ggggagccgaggaactgcgg

SEQ ID NO: 242094 - DNA, 20 bp, human
ggccaatcaggtgactggga

SEQ ID NO: 242095 - DNA, 20 bp, human
gtgggaaagaagagggacgt

SEQ ID NO: 242096 - DNA, 20 bp, human
gaccttggaaccagtgtcga

SEQ ID NO: 242097 - DNA, 20 bp, human
gtcctgggaacgggggataa

SEQ ID NO: 242098 - DNA, 20 bp, human
gtccctcgacactggttcca

SEQ ID NO: 242099 - DNA, 20 bp, human
gccaggggcagtgccttcac

SEQ ID NO: 242100 - DNA, 20 bp, human
gctggttccaaggtgaagac

SEQ ID NO: 242101 - DNA, 20 bp, human
ggggcacactccctcgacac

SEQ ID NO: 242102 - DNA, 20 bp, human
ggtcaggatggggaccaact

SEQ ID NO: 242103 - DNA, 20 bp, human
gttggctggtggcctcaagt

SEQ ID NO: 242104 - DNA, 20 bp, human
ggcaggaaatagtgtctctc

SEQ ID NO: 242105 - DNA, 20 bp, human
gcagcagagtccgttctaat

SEQ ID NO: 242106 - DNA, 20 bp, human
gtacccaatcagcaagtgga

SEQ ID NO: 242107 - DNA, 20 bp, human
gacaactcgtgactggggta

SEQ ID NO: 242108 - DNA, 20 bp, human
gcaatcagcaagtggagggg

SEQ ID NO: 242109 - DNA, 20 bp, human
gccaccccgtctgctggagc

SEQ ID NO: 242110 - DNA, 20 bp, human
gagggacggccacccctgag

SEQ ID NO: 242111 - DNA, 20 bp, human
gcggtgttgcagagccgaaa

SEQ ID NO: 242112 - DNA, 20 bp, human
gcagaggacaacaatggttc

SEQ ID NO: 242113 - DNA, 20 bp, human
gcagcactagagtcccctca

SEQ ID NO: 242114 - DNA, 20 bp, human
gcccagtcacgagttgtttt

SEQ ID NO: 242115 - DNA, 20 bp, human
ggtgactggggtagggcggg

SEQ ID NO: 242116 - DNA, 20 bp, human
gcgggagcagtgcctagccc

SEQ ID NO: 242117 - DNA, 20 bp, human
gcgcccagctgctcgcgtcg

SEQ ID NO: 242118 - DNA, 20 bp, human
gcaggagggcgcctcaggac

SEQ ID NO: 242119 - DNA, 20 bp, human
ggctaggcactgctcccgcc

SEQ ID NO: 242120 - DNA, 20 bp, human
gtcaggactgggcgcagcgc

SEQ ID NO: 242121 - DNA, 20 bp, human
ggaggagcggagccggaatg

SEQ ID NO: 242122 - DNA, 20 bp, human
gtgctcgcgtcgaggacacc

SEQ ID NO: 242123 - DNA, 20 bp, human
gggcctggaggcgaaacgca

SEQ ID NO: 242124 - DNA, 20 bp, human
gccgctgctcggcgacctcc

SEQ ID NO: 242125 - DNA, 20 bp, human
gagctgggcgccgctgcgga

SEQ ID NO: 242126 - DNA, 20 bp, human
ggatactgatggggaagggt

SEQ ID NO: 242127 - DNA, 20 bp, human
gcggcgggcgcaggaattcg

SEQ ID NO: 242128 - DNA, 20 bp, human
ggcacctggaagtacgtggg

SEQ ID NO: 242129 - DNA, 20 bp, human
gggaggggtacataaggcgg

SEQ ID NO: 242130 - DNA, 20 bp, human
gctccgtggaggggtacata

SEQ ID NO: 242131 - DNA, 20 bp, human
gcgtggaggggtacataagg

SEQ ID NO: 242132 - DNA, 20 bp, human
ggcgcgcggcgctccgtgga

SEQ ID NO: 242133 - DNA, 20 bp, human
ggagcccagcggaaggatcc

SEQ ID NO: 242134 - DNA, 20 bp, human
gggtgcacgtgatactgatg

SEQ ID NO: 242135 - DNA, 20 bp, human
gcttcctgacgccacatggg

SEQ ID NO: 242136 - DNA, 20 bp, human
gcgcccgctccgagggtccg

SEQ ID NO: 242137 - DNA, 20 bp, human
ggatccgcgcaggcgggacg

SEQ ID NO: 242138 - DNA, 20 bp, human
gcgggcggagggatccgcgc

SEQ ID NO: 242139 - DNA, 20 bp, human
gcctcgcgcgggctgaccgg

SEQ ID NO: 242140 - DNA, 20 bp, human
gggcccgctccacatgtgga

SEQ ID NO: 242141 - DNA, 20 bp, human
ggcgggccggggcgcggtca

SEQ ID NO: 242142 - DNA, 20 bp, human
gtgaccggtggcgacggcgc

SEQ ID NO: 242143 - DNA, 20 bp, human
gggccgccgcagaccccatc

SEQ ID NO: 242144 - DNA, 20 bp, human
ggtcagcccgcgcgaggggt

SEQ ID NO: 242145 - DNA, 20 bp, human
gtgccccgagctcccggtcc

SEQ ID NO: 242146 - DNA, 20 bp, human
gcgcacctcagggtctctcc

SEQ ID NO: 242147 - DNA, 20 bp, human
gcacacaccccctttggggc

SEQ ID NO: 242148 - DNA, 20 bp, human
ggtgggggccggtgcagcac

SEQ ID NO: 242149 - DNA, 20 bp, human
ggccgagcggccgcacctca

SEQ ID NO: 242150 - DNA, 20 bp, human
gtcaccacgaatagctgtgc

SEQ ID NO: 242151 - DNA, 20 bp, human
gtgaactcgcgtgcccatct

SEQ ID NO: 242152 - DNA, 20 bp, human
gagaatgccgcggaaagcaa

SEQ ID NO: 242153 - DNA, 20 bp, human
gttgcagccagccccaaagg

SEQ ID NO: 242154 - DNA, 20 bp, human
gcgggctaaccgcgtgagag

SEQ ID NO: 242155 - DNA, 20 bp, human
ggagccagcacagctattcg

SEQ ID NO: 242156 - DNA, 20 bp, human
gtgtctctctggcatgacaa

SEQ ID NO: 242157 - DNA, 20 bp, human
ggggctgggctctcatccca

SEQ ID NO: 242158 - DNA, 20 bp, human
gaggaaggctgtggtctcac

SEQ ID NO: 242159 - DNA, 20 bp, human
ggagaccgggctcaccagga

SEQ ID NO: 242160 - DNA, 20 bp, human
ggccccctaccccatctctg

SEQ ID NO: 242161 - DNA, 20 bp, human
gaagagccagggagcagcgt

SEQ ID NO: 242162 - DNA, 20 bp, human
gttccccagagatggggtag

SEQ ID NO: 242163 - DNA, 20 bp, human
gggcttcagcctcaccgcta

SEQ ID NO: 242164 - DNA, 20 bp, human
ggcagccaaaggcaagatac

SEQ ID NO: 242165 - DNA, 20 bp, human
gaccgctagggtagagaggt

SEQ ID NO: 242166 - DNA, 20 bp, human
gagcgctcctgagacgccga

SEQ ID NO: 242167 - DNA, 20 bp, human
gcctctgccctcggcgtctc

SEQ ID NO: 242168 - DNA, 20 bp, human
ggcagagggcgtggcgatac

SEQ ID NO: 242169 - DNA, 20 bp, human
ggcggcacgtgcatacgcac

SEQ ID NO: 242170 - DNA, 20 bp, human
gacgcacggggagagcgggc

SEQ ID NO: 242171 - DNA, 20 bp, human
ggcgataccggcgtctatga

SEQ ID NO: 242172 - DNA, 20 bp, human
gtctcaggagcgctctctgc

SEQ ID NO: 242173 - DNA, 20 bp, human
gtaaacagacgcccagaagc

SEQ ID NO: 242174 - DNA, 20 bp, human
gttgcagccctcatagacgc

SEQ ID NO: 242175 - DNA, 20 bp, human
gcagcgctcgacgatctcta

SEQ ID NO: 242176 - DNA, 20 bp, human
gcactctgactcaaggccca

SEQ ID NO: 242177 - DNA, 20 bp, human
ggggcgggcactgtgacctt

SEQ ID NO: 242178 - DNA, 20 bp, human
gtctgactcaaggcccaggg

SEQ ID NO: 242179 - DNA, 20 bp, human
gggaaagtcaccgcgtccgt

SEQ ID NO: 242180 - DNA, 20 bp, human
ggccacggcgcgcaccacgt

SEQ ID NO: 242181 - DNA, 20 bp, human
gggtgcggctggattattga

SEQ ID NO: 242182 - DNA, 20 bp, human
gggttccccgcccacggacg

SEQ ID NO: 242183 - DNA, 20 bp, human
ggggtggggcagggaaacgg

SEQ ID NO: 242184 - DNA, 20 bp, human
ggaggctgggcgccctcgcg

SEQ ID NO: 242185 - DNA, 20 bp, human
ggcgcctggttccccgccca

SEQ ID NO: 242186 - DNA, 20 bp, human
gcgttcagctggagtagaga

SEQ ID NO: 242187 - DNA, 20 bp, human
gggtcgtcaggaaggaatgt

SEQ ID NO: 242188 - DNA, 20 bp, human
gtactccagctgaacggtga

SEQ ID NO: 242189 - DNA, 20 bp, human
ggctctgctcgcttcagatc

SEQ ID NO: 242190 - DNA, 20 bp, human
gtgcagaggacctgcgcgtc

SEQ ID NO: 242191 - DNA, 20 bp, human
gacggtgatggtcgtcagga

SEQ ID NO: 242192 - DNA, 20 bp, human
gcaggggagcaactgctcag

SEQ ID NO: 242193 - DNA, 20 bp, human
gtctgggcagataaagcagg

SEQ ID NO: 242194 - DNA, 20 bp, human
ggcttcagatccggacgcgc

SEQ ID NO: 242195 - DNA, 20 bp, human
gctgaacggtgatggtcgtc

SEQ ID NO: 242196 - DNA, 20 bp, human
gggcaggctgtgtacacaat

SEQ ID NO: 242197 - DNA, 20 bp, human
gaattggcaacagtgacctt

SEQ ID NO: 242198 - DNA, 20 bp, human
ggaagaaaacactagagggc

SEQ ID NO: 242199 - DNA, 20 bp, human
gtatataggaaggtagccca

SEQ ID NO: 242200 - DNA, 20 bp, human
ggttcagaagaaaacactag

SEQ ID NO: 242201 - DNA, 20 bp, human
gacaactatgatctaaaatt

SEQ ID NO: 242202 - DNA, 20 bp, human
gaacacatttgtatatagga

SEQ ID NO: 242203 - DNA, 20 bp, human
gttgtaaatctcaaaatgtt

SEQ ID NO: 242204 - DNA, 20 bp, human
gagactaattttgcttacat

SEQ ID NO: 242205 - DNA, 20 bp, human
gtcaagtagcaaattacggt

SEQ ID NO: 242206 - DNA, 20 bp, human
gtccgtaccacaaccctccc

SEQ ID NO: 242207 - DNA, 20 bp, human
gggtacgtctcaacggaacc

SEQ ID NO: 242208 - DNA, 20 bp, human
gcgtctcaacggaaccaggg

SEQ ID NO: 242209 - DNA, 20 bp, human
ggtgtggggagtgatgacgc

SEQ ID NO: 242210 - DNA, 20 bp, human
gtatagaaggacagagaatc

SEQ ID NO: 242211 - DNA, 20 bp, human
gtaggacccaggggaaagct

SEQ ID NO: 242212 - DNA, 20 bp, human
gaaggggctgtgattttggt

SEQ ID NO: 242213 - DNA, 20 bp, human
gcggagcctagctttcccct

SEQ ID NO: 242214 - DNA, 20 bp, human
gcggaggcatttaggaccca

SEQ ID NO: 242215 - DNA, 20 bp, human
gaattattggtacgtctcaa

SEQ ID NO: 242216 - DNA, 20 bp, human
gtcagcagcctgctgaggag

SEQ ID NO: 242217 - DNA, 20 bp, human
gcgaagagaggggcgtgggg

SEQ ID NO: 242218 - DNA, 20 bp, human
gtggggtaggacggcaattt

SEQ ID NO: 242219 - DNA, 20 bp, human
gctggggtcttgcacacaaa

SEQ ID NO: 242220 - DNA, 20 bp, human
gcgaagagcagcctaaactt

SEQ ID NO: 242221 - DNA, 20 bp, human
gcagcctaaacttagggctc

SEQ ID NO: 242222 - DNA, 20 bp, human
gacacaaagggcgaagagag

SEQ ID NO: 242223 - DNA, 20 bp, human
ggtcctaccccaacgaggca

SEQ ID NO: 242224 - DNA, 20 bp, human
gtatcccgagccctaagttt

SEQ ID NO: 242225 - DNA, 20 bp, human
ggggataattagagaggagt

SEQ ID NO: 242226 - DNA, 20 bp, human
gcgccccgcggcgagtcccg

SEQ ID NO: 242227 - DNA, 20 bp, human
gcgggagggcagttgacctc

SEQ ID NO: 242228 - DNA, 20 bp, human
gtcaactgccctcccggcca

SEQ ID NO: 242229 - DNA, 20 bp, human
gggaaggagggcgtggctgg

SEQ ID NO: 242230 - DNA, 20 bp, human
ggacctcgggactcgccgcg

SEQ ID NO: 242231 - DNA, 20 bp, human
ggtggctggcggggtgtggc

SEQ ID NO: 242232 - DNA, 20 bp, human
ggctctgtcccccatgacag

SEQ ID NO: 242233 - DNA, 20 bp, human
ggggtgtggctggcgggacg

SEQ ID NO: 242234 - DNA, 20 bp, human
gggggtcggtgtcgccgtgg

SEQ ID NO: 242235 - DNA, 20 bp, human
ggtcctaagccctggccggg

SEQ ID NO: 242236 - DNA, 20 bp, human
ggaaaagtcaccatagttga

SEQ ID NO: 242237 - DNA, 20 bp, human
ggggcaaggctggtaaccac

SEQ ID NO: 242238 - DNA, 20 bp, human
gacccagtgtttttctagaa

SEQ ID NO: 242239 - DNA, 20 bp, human
ggccagcacttgggagttca

SEQ ID NO: 242240 - DNA, 20 bp, human
gtcagatgtaccctcaacta

SEQ ID NO: 242241 - DNA, 20 bp, human
gggtaaccacaggaactgca

SEQ ID NO: 242242 - DNA, 20 bp, human
gtttcacaagctgccctaat

SEQ ID NO: 242243 - DNA, 20 bp, human
gctcccagaaggcaagagag

SEQ ID NO: 242244 - DNA, 20 bp, human
gcgtgaccatgcagttcctg

SEQ ID NO: 242245 - DNA, 20 bp, human
gcatctgagaagccagcact

SEQ ID NO: 242246 - DNA, 20 bp, human
gtggggccagtaggccaagt

SEQ ID NO: 242247 - DNA, 20 bp, human
gtccgcggccgcctcgtctg

SEQ ID NO: 242248 - DNA, 20 bp, human
gccagctgccaggcggggat

SEQ ID NO: 242249 - DNA, 20 bp, human
gctactggccccagacgagg

SEQ ID NO: 242250 - DNA, 20 bp, human
gatcgggcggcgccgagctg

SEQ ID NO: 242251 - DNA, 20 bp, human
gcgctgggaattgtagtccg

SEQ ID NO: 242252 - DNA, 20 bp, human
gtcccagcgagcaccgcgag

SEQ ID NO: 242253 - DNA, 20 bp, human
gggccaagtaggctctgatg

SEQ ID NO: 242254 - DNA, 20 bp, human
gacccaggggcattaaaaaa

SEQ ID NO: 242255 - DNA, 20 bp, human
ggcccctcgcggtgctcgct

SEQ ID NO: 242256 - DNA, 20 bp, human
gaagaagtggggtggtcgga

SEQ ID NO: 242257 - DNA, 20 bp, human
gaagtggggtggtcggaggg

SEQ ID NO: 242258 - DNA, 20 bp, human
ggaggctccaagataaagaa

SEQ ID NO: 242259 - DNA, 20 bp, human
ggagggaaccgcagagagga

SEQ ID NO: 242260 - DNA, 20 bp, human
gccaagataaagaaaggtgc

SEQ ID NO: 242261 - DNA, 20 bp, human
gaatctgcaaagtcggggaa

SEQ ID NO: 242262 - DNA, 20 bp, human
ggagaatcaggcagccttga

SEQ ID NO: 242263 - DNA, 20 bp, human
gaatcaggcagccttgaggg

SEQ ID NO: 242264 - DNA, 20 bp, human
gcgcacgtaaatctcacaga

SEQ ID NO: 242265 - DNA, 20 bp, human
gcaggcagccttgagggagg

SEQ ID NO: 242266 - DNA, 20 bp, human
gaggctgcgcgcgtcctgca

SEQ ID NO: 242267 - DNA, 20 bp, human
gctgcacggtcccgccccaa

SEQ ID NO: 242268 - DNA, 20 bp, human
gggcgtgtctgcgtgccttt

SEQ ID NO: 242269 - DNA, 20 bp, human
gagagtggaactgacttcgc

SEQ ID NO: 242270 - DNA, 20 bp, human
gacgcgcgcagcctcgcttc

SEQ ID NO: 242271 - DNA, 20 bp, human
ggcacaagcctcctgaagcg

SEQ ID NO: 242272 - DNA, 20 bp, human
ggccgacccgggtctgcaac

SEQ ID NO: 242273 - DNA, 20 bp, human
gcgcgcagcctcgcttcagg

SEQ ID NO: 242274 - DNA, 20 bp, human
gaaggcgggtatgggggacg

SEQ ID NO: 242275 - DNA, 20 bp, human
ggacccgggtcggccgtgac

SEQ ID NO: 242276 - DNA, 20 bp, human
gtgcctccccccacgacgga

SEQ ID NO: 242277 - DNA, 20 bp, human
ggaggcacagtgagtccact

SEQ ID NO: 242278 - DNA, 20 bp, human
gcccccacgacggacggaaa

SEQ ID NO: 242279 - DNA, 20 bp, human
gctaagaagagcggcgtggg

SEQ ID NO: 242280 - DNA, 20 bp, human
gactgtgcctccccccacga

SEQ ID NO: 242281 - DNA, 20 bp, human
ggcccatttccgtccgtcgt

SEQ ID NO: 242282 - DNA, 20 bp, human
gtgcgccgcctgtcctggag

SEQ ID NO: 242283 - DNA, 20 bp, human
gccgcccggggctctcttac

SEQ ID NO: 242284 - DNA, 20 bp, human
gtgggccggtaagagagccc

SEQ ID NO: 242285 - DNA, 20 bp, human
gccaccggagcacaagcatc

SEQ ID NO: 242286 - DNA, 20 bp, human
gaacccgcgcgccgaaggcc

SEQ ID NO: 242287 - DNA, 20 bp, human
gctgcgccgcagcacccggt

SEQ ID NO: 242288 - DNA, 20 bp, human
gcggcgcgcgggttcctagg

SEQ ID NO: 242289 - DNA, 20 bp, human
gcccgaggcggacgtgagaa

SEQ ID NO: 242290 - DNA, 20 bp, human
gccgcagcacccggttggtc

SEQ ID NO: 242291 - DNA, 20 bp, human
gggaccaagtgggcccgagg

SEQ ID NO: 242292 - DNA, 20 bp, human
gtccgcccaggcctggcctt

SEQ ID NO: 242293 - DNA, 20 bp, human
gcttcggcgcgcgggttcct

SEQ ID NO: 242294 - DNA, 20 bp, human
gagcgcacagcgctgggcgc

SEQ ID NO: 242295 - DNA, 20 bp, human
gcccaccccggggacacact

SEQ ID NO: 242296 - DNA, 20 bp, human
gtccgggcgagagtggccgc

SEQ ID NO: 242297 - DNA, 20 bp, human
ggtcgggtgcatgctcgcgg

SEQ ID NO: 242298 - DNA, 20 bp, human
ggggcgggcacatgaccctg

SEQ ID NO: 242299 - DNA, 20 bp, human
gtgtgtccgcgcggccgtcc

SEQ ID NO: 242300 - DNA, 20 bp, human
ggtgggggcgggcgtgtctc

SEQ ID NO: 242301 - DNA, 20 bp, human
gtcaatggcggcaacggcgg

SEQ ID NO: 242302 - DNA, 20 bp, human
gacgtcaatggcggcaacgg

SEQ ID NO: 242303 - DNA, 20 bp, human
gctgacgtcaatggcggcaa

SEQ ID NO: 242304 - DNA, 20 bp, human
gcccgcccctctgacgtcaa

SEQ ID NO: 242305 - DNA, 20 bp, human
gcggggtcgcggcccacgac

SEQ ID NO: 242306 - DNA, 20 bp, human
gctgcaagaggctgccagag

SEQ ID NO: 242307 - DNA, 20 bp, human
gggctagctgcgtggagagg

SEQ ID NO: 242308 - DNA, 20 bp, human
gcaagaggctgccagagggg

SEQ ID NO: 242309 - DNA, 20 bp, human
gagggtgcccctaccagccg

SEQ ID NO: 242310 - DNA, 20 bp, human
gaacagcgttgcaaaggccc

SEQ ID NO: 242311 - DNA, 20 bp, human
gcgcctctgctcccggtgag

SEQ ID NO: 242312 - DNA, 20 bp, human
gaaactgggctgacctaggg

SEQ ID NO: 242313 - DNA, 20 bp, human
gtggggacgacccgcccctc

SEQ ID NO: 242314 - DNA, 20 bp, human
gtggagcttgagcccctcac

SEQ ID NO: 242315 - DNA, 20 bp, human
gggctgacctagggcggggg

SEQ ID NO: 242316 - DNA, 20 bp, human
gtcactccaggggtccccgt

SEQ ID NO: 242317 - DNA, 20 bp, human
ggaaactgagccagcagctt

SEQ ID NO: 242318 - DNA, 20 bp, human
gcattcattcgttctacaag

SEQ ID NO: 242319 - DNA, 20 bp, human
gggggaccctgctagtgaag

SEQ ID NO: 242320 - DNA, 20 bp, human
ggctggctcagtttcctgga

SEQ ID NO: 242321 - DNA, 20 bp, human
ggctcagtttcctggagggt

SEQ ID NO: 242322 - DNA, 20 bp, human
gtaggaccaaccaggtcctc

SEQ ID NO: 242323 - DNA, 20 bp, human
ggaacaacaggatggtattg

SEQ ID NO: 242324 - DNA, 20 bp, human
gagcacaatgctcactccag

SEQ ID NO: 242325 - DNA, 20 bp, human
ggctgagggcaattcttagg

SEQ ID NO: 242326 - DNA, 20 bp, human
gcgtccgcggccctgtcgga

SEQ ID NO: 242327 - DNA, 20 bp, human
gaggctgggacgtgatccgc

SEQ ID NO: 242328 - DNA, 20 bp, human
gtcctgcgccctcaagtgtc

SEQ ID NO: 242329 - DNA, 20 bp, human
gctccccatacctcactggc

SEQ ID NO: 242330 - DNA, 20 bp, human
gagcactaataaccacccaa

SEQ ID NO: 242331 - DNA, 20 bp, human
gcattccagccagtgaggta

SEQ ID NO: 242332 - DNA, 20 bp, human
ggtggctgcccgggcgtccg

SEQ ID NO: 242333 - DNA, 20 bp, human
gcgtctcggcgacactcgtg

SEQ ID NO: 242334 - DNA, 20 bp, human
ggaggagcttcgcacggcgg

SEQ ID NO: 242335 - DNA, 20 bp, human
gcattgcgagcagagacaat

SEQ ID NO: 242336 - DNA, 20 bp, human
gggcgggaaacgaaacccgg

SEQ ID NO: 242337 - DNA, 20 bp, human
gcctagggcgaagtgagcca

SEQ ID NO: 242338 - DNA, 20 bp, human
gcctgcgcgggccactgtcg

SEQ ID NO: 242339 - DNA, 20 bp, human
ggccggcgggaaacgaaacc

SEQ ID NO: 242340 - DNA, 20 bp, human
gagggagcccatggtctgca

SEQ ID NO: 242341 - DNA, 20 bp, human
gcgagcagcggccccgacag

SEQ ID NO: 242342 - DNA, 20 bp, human
gatctcgcggcgaggaggag

SEQ ID NO: 242343 - DNA, 20 bp, human
gcacccggcataagccgcag

SEQ ID NO: 242344 - DNA, 20 bp, human
ggggcctggtcagtcatcca

SEQ ID NO: 242345 - DNA, 20 bp, human
gccgcctcggaaacgaaacc

SEQ ID NO: 242346 - DNA, 20 bp, human
gcggaggcgacagtgtctag

SEQ ID NO: 242347 - DNA, 20 bp, human
gagcggctgccggagaggcg

SEQ ID NO: 242348 - DNA, 20 bp, human
gtggaaactgcgacgagtct

SEQ ID NO: 242349 - DNA, 20 bp, human
gaggtgtgacgtcatcgccg

SEQ ID NO: 242350 - DNA, 20 bp, human
gccgacaggcagaagcagtt

SEQ ID NO: 242351 - DNA, 20 bp, human
gactgcgacgagtctgggag

SEQ ID NO: 242352 - DNA, 20 bp, human
gtgacgtcatcgccgcgggg

SEQ ID NO: 242353 - DNA, 20 bp, human
gaaaacacacgcacatgttt

SEQ ID NO: 242354 - DNA, 20 bp, human
ggagaaaaatcgtcttcaca

SEQ ID NO: 242355 - DNA, 20 bp, human
gaaaaggaacataagacgaa

SEQ ID NO: 242356 - DNA, 20 bp, human
gagacctagctgggcggatg

SEQ ID NO: 242357 - DNA, 20 bp, human
gtggcaaagtgaattatgga

SEQ ID NO: 242358 - DNA, 20 bp, human
gccccgtgggcatttccccg

SEQ ID NO: 242359 - DNA, 20 bp, human
gtctggagctggcaccccgt

SEQ ID NO: 242360 - DNA, 20 bp, human
gctagctgggcggatgtggc

SEQ ID NO: 242361 - DNA, 20 bp, human
gcgatcaaagagcgcgtgga

SEQ ID NO: 242362 - DNA, 20 bp, human
gagactgcggggtgcttccg

SEQ ID NO: 242363 - DNA, 20 bp, human
gatgtggccggcagtggcct

SEQ ID NO: 242364 - DNA, 20 bp, human
gcagccgccgcacgtcccca

SEQ ID NO: 242365 - DNA, 20 bp, human
gagagctggtgagacctagc

SEQ ID NO: 242366 - DNA, 20 bp, human
gtgccctcgcggtcccatcc

SEQ ID NO: 242367 - DNA, 20 bp, human
gcgccgggatgggaccgcga

SEQ ID NO: 242368 - DNA, 20 bp, human
ggaggtgggaccggcgggtt

SEQ ID NO: 242369 - DNA, 20 bp, human
ggagcggcggcttacagacc

SEQ ID NO: 242370 - DNA, 20 bp, human
ggggaccggcgggttgggaa

SEQ ID NO: 242371 - DNA, 20 bp, human
gccacctggagacgccggga

SEQ ID NO: 242372 - DNA, 20 bp, human
gtcacggccctgagctccgc

SEQ ID NO: 242373 - DNA, 20 bp, human
gcagccccccgaccccgcag

SEQ ID NO: 242374 - DNA, 20 bp, human
gtgacagcatgcgagctcgg

SEQ ID NO: 242375 - DNA, 20 bp, human
gggcagctccgcgcggaggt

SEQ ID NO: 242376 - DNA, 20 bp, human
ggggaccctggctttggctg

SEQ ID NO: 242377 - DNA, 20 bp, human
gagggggctggtgacttcac

SEQ ID NO: 242378 - DNA, 20 bp, human
gtatctgtggccctccagct

SEQ ID NO: 242379 - DNA, 20 bp, human
gagggtgcagtgtttgttga

SEQ ID NO: 242380 - DNA, 20 bp, human
ggataaacacacaccgggct

SEQ ID NO: 242381 - DNA, 20 bp, human
gttagcatcctggacttttt

SEQ ID NO: 242382 - DNA, 20 bp, human
gacagagagatggtagaaga

SEQ ID NO: 242383 - DNA, 20 bp, human
gttcacaggcttcagcacga

SEQ ID NO: 242384 - DNA, 20 bp, human
gcctggctagcttcctccaa

SEQ ID NO: 242385 - DNA, 20 bp, human
gataataaatgagtattagt

SEQ ID NO: 242386 - DNA, 20 bp, human
gtctccagcggcccgaacca

SEQ ID NO: 242387 - DNA, 20 bp, human
gcgaaccagggtgaagaaga

SEQ ID NO: 242388 - DNA, 20 bp, human
gcgtctgcccctatccagaa

SEQ ID NO: 242389 - DNA, 20 bp, human
gtggataggggcagacgggt

SEQ ID NO: 242390 - DNA, 20 bp, human
gaagaaggtggagtctgcgg

SEQ ID NO: 242391 - DNA, 20 bp, human
gtgccggggcggtgatcggg

SEQ ID NO: 242392 - DNA, 20 bp, human
ggggtgccggggcggtgatc

SEQ ID NO: 242393 - DNA, 20 bp, human
gatagacagcccttctggat

SEQ ID NO: 242394 - DNA, 20 bp, human
gccgcagccggggtccgagg

SEQ ID NO: 242395 - DNA, 20 bp, human
ggacctcccgatcaccgccc

SEQ ID NO: 242396 - DNA, 20 bp, human
gcccacctgcgcctagagcc

SEQ ID NO: 242397 - DNA, 20 bp, human
ggcgctccgcggctcgagcg

SEQ ID NO: 242398 - DNA, 20 bp, human
gcgcggctcgagcgaggtgg

SEQ ID NO: 242399 - DNA, 20 bp, human
ggatcgccagcgcccaccag

SEQ ID NO: 242400 - DNA, 20 bp, human
ggccgcggagcgcctccgag

SEQ ID NO: 242401 - DNA, 20 bp, human
gttcaggcagcggggtcttg

SEQ ID NO: 242402 - DNA, 20 bp, human
gtctaggcgcaggtgggggc

SEQ ID NO: 242403 - DNA, 20 bp, human
gatcccggcacgcggggcga

SEQ ID NO: 242404 - DNA, 20 bp, human
gctccgcggctcgagcgagg

SEQ ID NO: 242405 - DNA, 20 bp, human
gacgcggggcgatggggttc

SEQ ID NO: 242406 - DNA, 20 bp, human
gtgggttgggctctaagcaa

SEQ ID NO: 242407 - DNA, 20 bp, human
gcctccccatgggtctctag

SEQ ID NO: 242408 - DNA, 20 bp, human
ggatgtgagtagaggaacag

SEQ ID NO: 242409 - DNA, 20 bp, human
gaggaggtccgaaaagaaac

SEQ ID NO: 242410 - DNA, 20 bp, human
gggtccgaaaagaaactggg

SEQ ID NO: 242411 - DNA, 20 bp, human
ggctgctgcagcttggtcct

SEQ ID NO: 242412 - DNA, 20 bp, human
gagagggttaaggttagaga

SEQ ID NO: 242413 - DNA, 20 bp, human
gcagccccctagagacccat

SEQ ID NO: 242414 - DNA, 20 bp, human
gtggcccatcccaaacacca

SEQ ID NO: 242415 - DNA, 20 bp, human
gcttagagcccaacccagcc

SEQ ID NO: 242416 - DNA, 20 bp, human
ggaggtgagaaatccatcaa

SEQ ID NO: 242417 - DNA, 20 bp, human
gcacccaagtacctagaacg

SEQ ID NO: 242418 - DNA, 20 bp, human
gtcaggaggatgaaagatgg

SEQ ID NO: 242419 - DNA, 20 bp, human
gaacaagcaaatttgctgag

SEQ ID NO: 242420 - DNA, 20 bp, human
ggaggcggccgtcacttcct

SEQ ID NO: 242421 - DNA, 20 bp, human
gaagtactacccaaaatcac

SEQ ID NO: 242422 - DNA, 20 bp, human
gaagcaaatttgctgagagg

SEQ ID NO: 242423 - DNA, 20 bp, human
ggtgcagtgaaccccgttct

SEQ ID NO: 242424 - DNA, 20 bp, human
gtcaattcttggatgaaagt

SEQ ID NO: 242425 - DNA, 20 bp, human
gcaaatttgctgagaggggg

SEQ ID NO: 242426 - DNA, 20 bp, human
gcggccggccagtcaccgga

SEQ ID NO: 242427 - DNA, 20 bp, human
ggcgccggccggccagtcac

SEQ ID NO: 242428 - DNA, 20 bp, human
ggcctctggcgggatccctc

SEQ ID NO: 242429 - DNA, 20 bp, human
gaccggagggatcccgccag

SEQ ID NO: 242430 - DNA, 20 bp, human
gcggccggcgccttccagaa

SEQ ID NO: 242431 - DNA, 20 bp, human
gacgcggagccgcctctggc

SEQ ID NO: 242432 - DNA, 20 bp, human
ggatccctccggtgactggc

SEQ ID NO: 242433 - DNA, 20 bp, human
ggcgggatccctccggtgac

SEQ ID NO: 242434 - DNA, 20 bp, human
gaacttccgcgcatctacga

SEQ ID NO: 242435 - DNA, 20 bp, human
ggggactgccgctacctttc

SEQ ID NO: 242436 - DNA, 20 bp, human
ggtcgggcaacaggtgaaga

SEQ ID NO: 242437 - DNA, 20 bp, human
gcgccgcgtcgcacccaggg

SEQ ID NO: 242438 - DNA, 20 bp, human
gtgaagagggcgggcgtccg

SEQ ID NO: 242439 - DNA, 20 bp, human
gccgctgggagtcgggcaac

SEQ ID NO: 242440 - DNA, 20 bp, human
gaaggcgccgcgtcgcaccc

SEQ ID NO: 242441 - DNA, 20 bp, human
gcggggcctgacagaagtaa

SEQ ID NO: 242442 - DNA, 20 bp, human
gcttctccgccgctgggagt

SEQ ID NO: 242443 - DNA, 20 bp, human
ggcgtcgcacccagggtggc

SEQ ID NO: 242444 - DNA, 20 bp, human
gcaggagagggaccgccccg

SEQ ID NO: 242445 - DNA, 20 bp, human
ggaggcctgggtttccttaa

SEQ ID NO: 242446 - DNA, 20 bp, human
gtctcaacctgggaggtcca

SEQ ID NO: 242447 - DNA, 20 bp, human
ggacctcccaggttgagagg

SEQ ID NO: 242448 - DNA, 20 bp, human
gcggaaaagccgcccggaaa

SEQ ID NO: 242449 - DNA, 20 bp, human
gggacccgagcgcgacggtg

SEQ ID NO: 242450 - DNA, 20 bp, human
ggtactggacccgagcgcga

SEQ ID NO: 242451 - DNA, 20 bp, human
gccgcgcctcggtcctcccc

SEQ ID NO: 242452 - DNA, 20 bp, human
gcctgcgcggaaaagccgcc

SEQ ID NO: 242453 - DNA, 20 bp, human
ggcgctcgggtccagtactg

SEQ ID NO: 242454 - DNA, 20 bp, human
ggctgcgctgcccgcagtac

SEQ ID NO: 242455 - DNA, 20 bp, human
gacggtgcggctggcggacc

SEQ ID NO: 242456 - DNA, 20 bp, human
gcccccggccactatggcaa

SEQ ID NO: 242457 - DNA, 20 bp, human
gtaggcgaggcgagagtcgc

SEQ ID NO: 242458 - DNA, 20 bp, human
gctcccgcccccggccacta

SEQ ID NO: 242459 - DNA, 20 bp, human
ggccactatggcaacggaag

SEQ ID NO: 242460 - DNA, 20 bp, human
gctccgcgaagcaaaaccta

SEQ ID NO: 242461 - DNA, 20 bp, human
ggtcccgaagaggggtgaaa

SEQ ID NO: 242462 - DNA, 20 bp, human
ggcgcaggcggagcattctt

SEQ ID NO: 242463 - DNA, 20 bp, human
gcactggctgctggccccaa

SEQ ID NO: 242464 - DNA, 20 bp, human
gtccgttgccatagtggccg

SEQ ID NO: 242465 - DNA, 20 bp, human
gcgcacgcgccctgtaggcc

SEQ ID NO: 242466 - DNA, 20 bp, human
gcagggatctggcgaaacgg

SEQ ID NO: 242467 - DNA, 20 bp, human
ggctgcaccagggggttcaa

SEQ ID NO: 242468 - DNA, 20 bp, human
ggaaaggcccgccagggatc

SEQ ID NO: 242469 - DNA, 20 bp, human
gcgggctccggctgcaccag

SEQ ID NO: 242470 - DNA, 20 bp, human
gggatctggcgaaacggggg

SEQ ID NO: 242471 - DNA, 20 bp, human
ggcaccagggggttcaaagg

SEQ ID NO: 242472 - DNA, 20 bp, human
gctggaggaaataagagacg

SEQ ID NO: 242473 - DNA, 20 bp, human
gtctggcgaaacgggggcgg

SEQ ID NO: 242474 - DNA, 20 bp, human
gttgtccgaaaggcccgcca

SEQ ID NO: 242475 - DNA, 20 bp, human
gtttcgccaccgagcttctg

SEQ ID NO: 242476 - DNA, 20 bp, human
gagagtagcaataatgaaga

SEQ ID NO: 242477 - DNA, 20 bp, human
gtctgctgtatcagccttgt

SEQ ID NO: 242478 - DNA, 20 bp, human
gcaagagtgtcatctagacc

SEQ ID NO: 242479 - DNA, 20 bp, human
gggaaaagggctctggacta

SEQ ID NO: 242480 - DNA, 20 bp, human
gtaagctggggtgggtttat

SEQ ID NO: 242481 - DNA, 20 bp, human
gaggatagttacaatggcta

SEQ ID NO: 242482 - DNA, 20 bp, human
gtctggactatggaagacca

SEQ ID NO: 242483 - DNA, 20 bp, human
ggatacccagtgtaaacatt

SEQ ID NO: 242484 - DNA, 20 bp, human
gcccagtgtaaacatttggt

SEQ ID NO: 242485 - DNA, 20 bp, human
gtcctccttatgatttccac

SEQ ID NO: 242486 - DNA, 20 bp, human
gagccccagtctcctatgta

SEQ ID NO: 242487 - DNA, 20 bp, human
gaactccatacataggagac

SEQ ID NO: 242488 - DNA, 20 bp, human
gagttgagtaaaagtttggg

SEQ ID NO: 242489 - DNA, 20 bp, human
gtaaatggctgccagagtcc

SEQ ID NO: 242490 - DNA, 20 bp, human
gggagtgtcttatgttaatg

SEQ ID NO: 242491 - DNA, 20 bp, human
gggggtcctagatcctgttt

SEQ ID NO: 242492 - DNA, 20 bp, human
gtcctgtctcaccaggactc

SEQ ID NO: 242493 - DNA, 20 bp, human
gatggagttgagtaaaagtt

SEQ ID NO: 242494 - DNA, 20 bp, human
gtgacagtgtacaaatgtct

SEQ ID NO: 242495 - DNA, 20 bp, human
ggtcttatgttaatgaggga

SEQ ID NO: 242496 - DNA, 20 bp, human
gagcaccgggacccggatcc

SEQ ID NO: 242497 - DNA, 20 bp, human
gacccggatcccggcgtgaa

SEQ ID NO: 242498 - DNA, 20 bp, human
gagggccgcccactagagcg

SEQ ID NO: 242499 - DNA, 20 bp, human
ggcccactagagcgcggcgc

SEQ ID NO: 242500 - DNA, 20 bp, human
gggaatgaaccgagaagcac

SEQ ID NO: 242501 - DNA, 20 bp, human
gtccgggtcccggtgcttct

SEQ ID NO: 242502 - DNA, 20 bp, human
gccccgcgccgcgctctagt

SEQ ID NO: 242503 - DNA, 20 bp, human
gtgggcggccctgccgcggg

SEQ ID NO: 242504 - DNA, 20 bp, human
ggatgccaggggacgggtct

SEQ ID NO: 242505 - DNA, 20 bp, human
gcgcgcgcggcctttcacgc

SEQ ID NO: 242506 - DNA, 20 bp, human
ggaagaacccgaggagtcgc

SEQ ID NO: 242507 - DNA, 20 bp, human
gcatctcatacgcgcagata

SEQ ID NO: 242508 - DNA, 20 bp, human
gtacgcgcagatacgggatg

SEQ ID NO: 242509 - DNA, 20 bp, human
gaacccgaggagtcgcaggc

SEQ ID NO: 242510 - DNA, 20 bp, human
ggcccacagccacagtgtgt

SEQ ID NO: 242511 - DNA, 20 bp, human
gtcattcagctcaactgcag

SEQ ID NO: 242512 - DNA, 20 bp, human
gagtgacatcacatgacttt

SEQ ID NO: 242513 - DNA, 20 bp, human
gactcctcgggttcttcttt

SEQ ID NO: 242514 - DNA, 20 bp, human
gcagatacgggatgaggcag

SEQ ID NO: 242515 - DNA, 20 bp, human
ggagaacaaagcggcttcgg

SEQ ID NO: 242516 - DNA, 20 bp, human
gcccgtctaccgtcggggag

SEQ ID NO: 242517 - DNA, 20 bp, human
gtcagggcggaaatggggcg

SEQ ID NO: 242518 - DNA, 20 bp, human
gtgcctgtggctggattggt

SEQ ID NO: 242519 - DNA, 20 bp, human
gcctggctcagggcggaaat

SEQ ID NO: 242520 - DNA, 20 bp, human
gccgtcccgcccaccaatcc

SEQ ID NO: 242521 - DNA, 20 bp, human
gaatccagccacaggcagag

SEQ ID NO: 242522 - DNA, 20 bp, human
gcaaccccgccttgtccgga

SEQ ID NO: 242523 - DNA, 20 bp, human
gcctgccctccggacaaggc

SEQ ID NO: 242524 - DNA, 20 bp, human
gttggtgggcgggacggaaa

SEQ ID NO: 242525 - DNA, 20 bp, human
ggccctgagccaggtgcgga

SEQ ID NO: 242526 - DNA, 20 bp, human
gtcacttcctggagcgtctc

SEQ ID NO: 242527 - DNA, 20 bp, human
gtggctgggtgttgcagtgc

SEQ ID NO: 242528 - DNA, 20 bp, human
gggcaggtaacaacagaggg

SEQ ID NO: 242529 - DNA, 20 bp, human
ggggaaccagttagaggctg

SEQ ID NO: 242530 - DNA, 20 bp, human
ggcttcagagacaaaaactt

SEQ ID NO: 242531 - DNA, 20 bp, human
gacccagccagagacgctcc

SEQ ID NO: 242532 - DNA, 20 bp, human
gtgggtgttgcagtgctggc

SEQ ID NO: 242533 - DNA, 20 bp, human
gcctgtgtggcctcttggtc

SEQ ID NO: 242534 - DNA, 20 bp, human
gttcctggagcgtctctggc

SEQ ID NO: 242535 - DNA, 20 bp, human
gaactttgggaaccagttag

SEQ ID NO: 242536 - DNA, 20 bp, human
gggccaggcgggcgtaacgc

SEQ ID NO: 242537 - DNA, 20 bp, human
gacgaatgaaagaaccaagc

SEQ ID NO: 242538 - DNA, 20 bp, human
gcgttggacggtcagccgga

SEQ ID NO: 242539 - DNA, 20 bp, human
gcggctgaccgtccaacgct

SEQ ID NO: 242540 - DNA, 20 bp, human
gcggcctcggcgcctagcgt

SEQ ID NO: 242541 - DNA, 20 bp, human
gcggagggaccaagaactgc

SEQ ID NO: 242542 - DNA, 20 bp, human
gctggcgtcgcctgctgccc

SEQ ID NO: 242543 - DNA, 20 bp, human
ggtcgcctgctgccccgggg

SEQ ID NO: 242544 - DNA, 20 bp, human
gagggaccaagaactgccgg

SEQ ID NO: 242545 - DNA, 20 bp, human
gaggggcggtgcgacgggga

SEQ ID NO: 242546 - DNA, 20 bp, human
ggggagagggtcgatcagac

SEQ ID NO: 242547 - DNA, 20 bp, human
ggggcgggaaatcccagtgt

SEQ ID NO: 242548 - DNA, 20 bp, human
gggggtgggaggtttggcgg

SEQ ID NO: 242549 - DNA, 20 bp, human
gggtgcccagggagccaagc

SEQ ID NO: 242550 - DNA, 20 bp, human
gtctgtcagagccccgccca

SEQ ID NO: 242551 - DNA, 20 bp, human
ggcgtggccgcccatataag

SEQ ID NO: 242552 - DNA, 20 bp, human
gccaggacccagggaaaaga

SEQ ID NO: 242553 - DNA, 20 bp, human
gggctctgacagaggtgccc

SEQ ID NO: 242554 - DNA, 20 bp, human
ggcgcagagaccaaaagaga

SEQ ID NO: 242555 - DNA, 20 bp, human
ggaggtgccaagaaacagag

SEQ ID NO: 242556 - DNA, 20 bp, human
gtggccatgcccattggcgg

SEQ ID NO: 242557 - DNA, 20 bp, human
ggccgcgggtgcgtgtggag

SEQ ID NO: 242558 - DNA, 20 bp, human
gtgccaggtccctcggctca

SEQ ID NO: 242559 - DNA, 20 bp, human
gcacacgcacccgcggcggg

SEQ ID NO: 242560 - DNA, 20 bp, human
gggagcgggcttccggaacg

SEQ ID NO: 242561 - DNA, 20 bp, human
gagcccgctcccggggccat

SEQ ID NO: 242562 - DNA, 20 bp, human
gttccggaagcccgctcccg

SEQ ID NO: 242563 - DNA, 20 bp, human
gcacttgcggagactggaaa

SEQ ID NO: 242564 - DNA, 20 bp, human
gcccggggccatgggggcac

SEQ ID NO: 242565 - DNA, 20 bp, human
gagaccgggtgggcggtccc

SEQ ID NO: 242566 - DNA, 20 bp, human
ggggagagtggcaagtgaac

SEQ ID NO: 242567 - DNA, 20 bp, human
gccactctctgtgggtgtca

SEQ ID NO: 242568 - DNA, 20 bp, human
ggagtggcaagtgaacagga

SEQ ID NO: 242569 - DNA, 20 bp, human
gccctggtgcctggcattta

SEQ ID NO: 242570 - DNA, 20 bp, human
gctgccacagcagtgcctga

SEQ ID NO: 242571 - DNA, 20 bp, human
gctgtggcagtcagggcagt

SEQ ID NO: 242572 - DNA, 20 bp, human
ggggagtaccctcattttct

SEQ ID NO: 242573 - DNA, 20 bp, human
gtacaattacatattagggt

SEQ ID NO: 242574 - DNA, 20 bp, human
gccctcattttcttgggccc

SEQ ID NO: 242575 - DNA, 20 bp, human
gtcagcagtccctaaatgcc

SEQ ID NO: 242576 - DNA, 20 bp, human
gtccgtgggaaagtaaggtg

SEQ ID NO: 242577 - DNA, 20 bp, human
gtgaggctctggagcctcaa

SEQ ID NO: 242578 - DNA, 20 bp, human
gtctccccgtcctccctggg

SEQ ID NO: 242579 - DNA, 20 bp, human
gctcaaaggcggtccgaaag

SEQ ID NO: 242580 - DNA, 20 bp, human
ggactctccccgtcctccct

SEQ ID NO: 242581 - DNA, 20 bp, human
gctgtggcctccctctccgt

SEQ ID NO: 242582 - DNA, 20 bp, human
gggctctggagcctcaaagg

SEQ ID NO: 242583 - DNA, 20 bp, human
gagtcgccgagcagagtcct

SEQ ID NO: 242584 - DNA, 20 bp, human
gagaacccagaacggaacga

SEQ ID NO: 242585 - DNA, 20 bp, human
gtctgctcggcgactgctga

SEQ ID NO: 242586 - DNA, 20 bp, human
gagagctagcgctactgaag

SEQ ID NO: 242587 - DNA, 20 bp, human
gcgtatgtggaggtagataa

SEQ ID NO: 242588 - DNA, 20 bp, human
gtgggggtgcatgcctcaga

SEQ ID NO: 242589 - DNA, 20 bp, human
gtctccagggatctcattag

SEQ ID NO: 242590 - DNA, 20 bp, human
ggctagcgctactgaagggg

SEQ ID NO: 242591 - DNA, 20 bp, human
ggagctacataggtgtcctc

SEQ ID NO: 242592 - DNA, 20 bp, human
gacacctctaatgagatccc

SEQ ID NO: 242593 - DNA, 20 bp, human
gaagacctcagttttagtgt

SEQ ID NO: 242594 - DNA, 20 bp, human
gtgatcctacactaaaactg

SEQ ID NO: 242595 - DNA, 20 bp, human
gcctatgagaatggtgtgat

SEQ ID NO: 242596 - DNA, 20 bp, human
gtgcgcttgagaagcgatgg

SEQ ID NO: 242597 - DNA, 20 bp, human
gtggtgcgcttgagaagcga

SEQ ID NO: 242598 - DNA, 20 bp, human
ggaaacaagcgtccttgctc

SEQ ID NO: 242599 - DNA, 20 bp, human
gcggttgcgtgtggtgcgcg

SEQ ID NO: 242600 - DNA, 20 bp, human
ggacgccgggcggttgcgtg

SEQ ID NO: 242601 - DNA, 20 bp, human
gccgcccggcgtcgcacgac

SEQ ID NO: 242602 - DNA, 20 bp, human
gggcctggagagtcgtttgt

SEQ ID NO: 242603 - DNA, 20 bp, human
gtcggcgttccgtgagtgaa

SEQ ID NO: 242604 - DNA, 20 bp, human
gtccttgctcgggtttggtc

SEQ ID NO: 242605 - DNA, 20 bp, human
gactgggaaaagacggtgac

SEQ ID NO: 242606 - DNA, 20 bp, human
ggacctgcccggcttaccag

SEQ ID NO: 242607 - DNA, 20 bp, human
gaagacacggagtggctgat

SEQ ID NO: 242608 - DNA, 20 bp, human
gttgctggaccctgggagtt

SEQ ID NO: 242609 - DNA, 20 bp, human
gggttgccaggggacctgcc

SEQ ID NO: 242610 - DNA, 20 bp, human
gctcctgcatggcccaggtt

SEQ ID NO: 242611 - DNA, 20 bp, human
gcaggtcccctggcaaccca

SEQ ID NO: 242612 - DNA, 20 bp, human
gcagggtccagcaaggatgt

SEQ ID NO: 242613 - DNA, 20 bp, human
ggagcaccatgggttgccag

SEQ ID NO: 242614 - DNA, 20 bp, human
gccttggccaagacacggag

SEQ ID NO: 242615 - DNA, 20 bp, human
gggcccctggtaagccgggc

SEQ ID NO: 242616 - DNA, 20 bp, human
gtagctaaggagttgcctgt

SEQ ID NO: 242617 - DNA, 20 bp, human
ggcaactccttagctagtca

SEQ ID NO: 242618 - DNA, 20 bp, human
gcagcaaaatacttctgctt

SEQ ID NO: 242619 - DNA, 20 bp, human
gccttagctagtcagggctt

SEQ ID NO: 242620 - DNA, 20 bp, human
gtagacagataaagataagt

SEQ ID NO: 242621 - DNA, 20 bp, human
gacagataaagataagtagg

SEQ ID NO: 242622 - DNA, 20 bp, human
gttgaccccaaacctgtgtg

SEQ ID NO: 242623 - DNA, 20 bp, human
gtgttctggttaattcctac

SEQ ID NO: 242624 - DNA, 20 bp, human
gaatagtggcctaacattgc

SEQ ID NO: 242625 - DNA, 20 bp, human
gactctgtttatgaacttta

SEQ ID NO: 242626 - DNA, 20 bp, human
gccatcagagggcgccgggg

SEQ ID NO: 242627 - DNA, 20 bp, human
ggcagactccggccatcaga

SEQ ID NO: 242628 - DNA, 20 bp, human
ggcggtagcggtggcggtcg

SEQ ID NO: 242629 - DNA, 20 bp, human
gtccggccatcagagggcgc

SEQ ID NO: 242630 - DNA, 20 bp, human
gcccgtaaacggatgtgtgt

SEQ ID NO: 242631 - DNA, 20 bp, human
gatcctgcctaaatgctcca

SEQ ID NO: 242632 - DNA, 20 bp, human
gaggcggcgcagggccctct

SEQ ID NO: 242633 - DNA, 20 bp, human
gtgcctaaatgctccagggc

SEQ ID NO: 242634 - DNA, 20 bp, human
ggtcagtgcaacgcagactc

SEQ ID NO: 242635 - DNA, 20 bp, human
gcgttgccagcggagaaagg

SEQ ID NO: 242636 - DNA, 20 bp, human
ggggcgggcgctcagggcaa

SEQ ID NO: 242637 - DNA, 20 bp, human
ggagccgggcgggcagacga

SEQ ID NO: 242638 - DNA, 20 bp, human
gaacggccgcgggcttgtcg

SEQ ID NO: 242639 - DNA, 20 bp, human
ggcactcggccccctcgggc

SEQ ID NO: 242640 - DNA, 20 bp, human
gcgcgtctacgctgtccgga

SEQ ID NO: 242641 - DNA, 20 bp, human
gacgctgtccggagggtgaa

SEQ ID NO: 242642 - DNA, 20 bp, human
gccggtggctggagtgccga

SEQ ID NO: 242643 - DNA, 20 bp, human
gcccgcggggcacacggcag

SEQ ID NO: 242644 - DNA, 20 bp, human
gtccgccccgccggcttcgc

SEQ ID NO: 242645 - DNA, 20 bp, human
gccgccgcgcgagcggcctc

SEQ ID NO: 242646 - DNA, 20 bp, human
gaacacctggcgcgggctca

SEQ ID NO: 242647 - DNA, 20 bp, human
gcccagcaaacacctggcgc

SEQ ID NO: 242648 - DNA, 20 bp, human
gtggcggggcggtggttgcc

SEQ ID NO: 242649 - DNA, 20 bp, human
ggtgggagacgggaagacgg

SEQ ID NO: 242650 - DNA, 20 bp, human
gggcgaccgtcaccatggaa

SEQ ID NO: 242651 - DNA, 20 bp, human
gaggctctgggccgttgcca

SEQ ID NO: 242652 - DNA, 20 bp, human
gcaaccaccgccccgccaag

SEQ ID NO: 242653 - DNA, 20 bp, human
ggaccaggggaaccctgcgc

SEQ ID NO: 242654 - DNA, 20 bp, human
gaggaagggggcatggccgt

SEQ ID NO: 242655 - DNA, 20 bp, human
ggggctgagttcctcttggc

SEQ ID NO: 242656 - DNA, 20 bp, human
ggaggtgggaagctgcggaa

SEQ ID NO: 242657 - DNA, 20 bp, human
ggtgcacgcccgcctctcgg

SEQ ID NO: 242658 - DNA, 20 bp, human
gtgcacagctgcagtggcgg

SEQ ID NO: 242659 - DNA, 20 bp, human
ggggaagctgcggaagggta

SEQ ID NO: 242660 - DNA, 20 bp, human
ggaggtggggcgggaccggt

SEQ ID NO: 242661 - DNA, 20 bp, human
gcggaacaggagtcgagggt

SEQ ID NO: 242662 - DNA, 20 bp, human
gaggggcggctgcggcgttt

SEQ ID NO: 242663 - DNA, 20 bp, human
gtggaggccgagcggaggtg

SEQ ID NO: 242664 - DNA, 20 bp, human
ggggcgggaccggttggagc

SEQ ID NO: 242665 - DNA, 20 bp, human
gtgaagccagcagtacaagc

SEQ ID NO: 242666 - DNA, 20 bp, human
gccagcatgcgtcagaatta

SEQ ID NO: 242667 - DNA, 20 bp, human
gcccggcaagggcctatcag

SEQ ID NO: 242668 - DNA, 20 bp, human
ggtacaagtccatatcaaag

SEQ ID NO: 242669 - DNA, 20 bp, human
gtggtcctcgaatcctggtg

SEQ ID NO: 242670 - DNA, 20 bp, human
gtgggtcggggcatccgagc

SEQ ID NO: 242671 - DNA, 20 bp, human
gcctgcccacctctttgata

SEQ ID NO: 242672 - DNA, 20 bp, human
ggcgtgtggtcctcgaatcc

SEQ ID NO: 242673 - DNA, 20 bp, human
gggcaagggcctatcagggg

SEQ ID NO: 242674 - DNA, 20 bp, human
gaagtccatatcaaagaggt

SEQ ID NO: 242675 - DNA, 20 bp, human
ggccccgacccacccctgat

SEQ ID NO: 242676 - DNA, 20 bp, human
gcggcccttcagacatccta

SEQ ID NO: 242677 - DNA, 20 bp, human
ggccactggcctcatatcgc

SEQ ID NO: 242678 - DNA, 20 bp, human
ggggtgggaccctgaccctt

SEQ ID NO: 242679 - DNA, 20 bp, human
gtggcctcatatcgcggggt

SEQ ID NO: 242680 - DNA, 20 bp, human
gcgcgagatgccagagccct

SEQ ID NO: 242681 - DNA, 20 bp, human
gttgccgtctgtgtgagccc

SEQ ID NO: 242682 - DNA, 20 bp, human
ggagccctaggatgtctgaa

SEQ ID NO: 242683 - DNA, 20 bp, human
gggtcccaccccgcgatatg

SEQ ID NO: 242684 - DNA, 20 bp, human
gtcacacagacggcaagatg

SEQ ID NO: 242685 - DNA, 20 bp, human
gtatgcagtaggctccgccc

SEQ ID NO: 242686 - DNA, 20 bp, human
gtgcctgccagacagaccct

SEQ ID NO: 242687 - DNA, 20 bp, human
ggcccggcggaaatgacgag

SEQ ID NO: 242688 - DNA, 20 bp, human
gcgcctgccgtcggccctgg

SEQ ID NO: 242689 - DNA, 20 bp, human
gagcccggggtcggtcaatc

SEQ ID NO: 242690 - DNA, 20 bp, human
gtgaactccgacagctgagg

SEQ ID NO: 242691 - DNA, 20 bp, human
ggcgcgtgccggcacgaggc

SEQ ID NO: 242692 - DNA, 20 bp, human
ggggctgcggagagatattt

SEQ ID NO: 242693 - DNA, 20 bp, human
gcgcctcgcgcgcctgccgt

SEQ ID NO: 242694 - DNA, 20 bp, human
gcgcccccagggccgacggc

SEQ ID NO: 242695 - DNA, 20 bp, human
gctgggctccggcctcgtgc

SEQ ID NO: 242696 - DNA, 20 bp, human
gagggtctagggaaactcgt

SEQ ID NO: 242697 - DNA, 20 bp, human
ggccccgctttccttttcaa

SEQ ID NO: 242698 - DNA, 20 bp, human
ggggcggggccgagggtcta

SEQ ID NO: 242699 - DNA, 20 bp, human
gagccggaccggcttagaga

SEQ ID NO: 242700 - DNA, 20 bp, human
gctcccgtgccgccctggca

SEQ ID NO: 242701 - DNA, 20 bp, human
gctcacacccgcagcgtccc

SEQ ID NO: 242702 - DNA, 20 bp, human
gtacaacccgccccttgaaa

SEQ ID NO: 242703 - DNA, 20 bp, human
gctgcgggtgtgagccggac

SEQ ID NO: 242704 - DNA, 20 bp, human
gagggcctcacacaaaccag

SEQ ID NO: 242705 - DNA, 20 bp, human
gaacccgagtccgccgcttc

SEQ ID NO: 242706 - DNA, 20 bp, human
ggtgctcactaaactacctt

SEQ ID NO: 242707 - DNA, 20 bp, human
gaggcccaatggacagtggg

SEQ ID NO: 242708 - DNA, 20 bp, human
gggaaggcagctgaggttgt

SEQ ID NO: 242709 - DNA, 20 bp, human
gaagggcctgacatcacaag

SEQ ID NO: 242710 - DNA, 20 bp, human
gggcctgacatcacaagggg

SEQ ID NO: 242711 - DNA, 20 bp, human
gacagccaatggaacggccc

SEQ ID NO: 242712 - DNA, 20 bp, human
ggcgacccgggtctcttcca

SEQ ID NO: 242713 - DNA, 20 bp, human
ggggcagcctgcgttattct

SEQ ID NO: 242714 - DNA, 20 bp, human
gtggctgtaggggcctgcca

SEQ ID NO: 242715 - DNA, 20 bp, human
gcacccctcccactgtccat

SEQ ID NO: 242716 - DNA, 20 bp, human
gtggggcgggctgagagcca

SEQ ID NO: 242717 - DNA, 20 bp, human
ggggaaggacgagggagatc

SEQ ID NO: 242718 - DNA, 20 bp, human
gtcccccaactatggatctg

SEQ ID NO: 242719 - DNA, 20 bp, human
ggccttagttgggaaggacg

SEQ ID NO: 242720 - DNA, 20 bp, human
gaagggaagaaggatgtcta

SEQ ID NO: 242721 - DNA, 20 bp, human
gctgcccagggggccattcc

SEQ ID NO: 242722 - DNA, 20 bp, human
gaaaggggtgaggatgcatt

SEQ ID NO: 242723 - DNA, 20 bp, human
gggccattccgggcattctg

SEQ ID NO: 242724 - DNA, 20 bp, human
gtgccccagatccatagttg

SEQ ID NO: 242725 - DNA, 20 bp, human
gccccctctgtgccccctgt

SEQ ID NO: 242726 - DNA, 20 bp, human
gggggtccgggggcgaccga

SEQ ID NO: 242727 - DNA, 20 bp, human
gtgcgctccgggccaatcag

SEQ ID NO: 242728 - DNA, 20 bp, human
gagggggctcaggaagtccg

SEQ ID NO: 242729 - DNA, 20 bp, human
gacagcacccccgtcaccag

SEQ ID NO: 242730 - DNA, 20 bp, human
gcgcccccggacccccgcct

SEQ ID NO: 242731 - DNA, 20 bp, human
gaggggagaaggctaccttt

SEQ ID NO: 242732 - DNA, 20 bp, human
ggagcgcaaatgtccttata

SEQ ID NO: 242733 - DNA, 20 bp, human
gcaggagtgccacgtcccgg

SEQ ID NO: 242734 - DNA, 20 bp, human
gctctctgctcagagctcgt

SEQ ID NO: 242735 - DNA, 20 bp, human
gtttcccgtggcatcaaagg

SEQ ID NO: 242736 - DNA, 20 bp, human
gtctgcgccgaggggcggtg

SEQ ID NO: 242737 - DNA, 20 bp, human
ggggcggtgcggccaattga

SEQ ID NO: 242738 - DNA, 20 bp, human
gcccggcggccaatcctcga

SEQ ID NO: 242739 - DNA, 20 bp, human
ggcccccgcggcccttcaat

SEQ ID NO: 242740 - DNA, 20 bp, human
ggccaattgaagggccgcgg

SEQ ID NO: 242741 - DNA, 20 bp, human
gcctcccgcctctgcgccga

SEQ ID NO: 242742 - DNA, 20 bp, human
gggccgccgggcccgaccaa

SEQ ID NO: 242743 - DNA, 20 bp, human
gctcacgccaccggggccgg

SEQ ID NO: 242744 - DNA, 20 bp, human
gaattggccgcaccgcccct

SEQ ID NO: 242745 - DNA, 20 bp, human
ggccgggcccgaccaatgga

SEQ ID NO: 242746 - DNA, 20 bp, human
gaagccgagcgagagctgga

SEQ ID NO: 242747 - DNA, 20 bp, human
ggcgtagcgggtacacactt

SEQ ID NO: 242748 - DNA, 20 bp, human
ggccgggtaggagttcgcag

SEQ ID NO: 242749 - DNA, 20 bp, human
gtcaccgcactgtgcgtagc

SEQ ID NO: 242750 - DNA, 20 bp, human
gcgcgtgggctggtggcggt

SEQ ID NO: 242751 - DNA, 20 bp, human
ggggcattcagactccacct

SEQ ID NO: 242752 - DNA, 20 bp, human
gcagcggggacctcctgccc

SEQ ID NO: 242753 - DNA, 20 bp, human
gggcaggagaagcgaaaagc

SEQ ID NO: 242754 - DNA, 20 bp, human
gaccagcccacgcgcgcagt

SEQ ID NO: 242755 - DNA, 20 bp, human
gtgtacgcccactgcgcgcg

SEQ ID NO: 242756 - DNA, 20 bp, human
ggaccaatggcaaggtaagt

SEQ ID NO: 242757 - DNA, 20 bp, human
ggctccgcggaccaatggca

SEQ ID NO: 242758 - DNA, 20 bp, human
gttaccttgccattggtccg

SEQ ID NO: 242759 - DNA, 20 bp, human
gcacccacttaccttgccat

SEQ ID NO: 242760 - DNA, 20 bp, human
ggactcttgtgtatgtgcga

SEQ ID NO: 242761 - DNA, 20 bp, human
ggaaacttggcgtgcagacg

SEQ ID NO: 242762 - DNA, 20 bp, human
gagcctcggggttcctcagc

SEQ ID NO: 242763 - DNA, 20 bp, human
gcccctgggcgagactgcaa

SEQ ID NO: 242764 - DNA, 20 bp, human
ggtggagtcagtgtcagtca

SEQ ID NO: 242765 - DNA, 20 bp, human
ggtgccgctccgcggaccaa

SEQ ID NO: 242766 - DNA, 20 bp, human
gggccccgccgagtctgctg

SEQ ID NO: 242767 - DNA, 20 bp, human
ggcgccggggagtaaacaag

SEQ ID NO: 242768 - DNA, 20 bp, human
gggagccgcagcagactcgg

SEQ ID NO: 242769 - DNA, 20 bp, human
gccggggagtaaacaagtgg

SEQ ID NO: 242770 - DNA, 20 bp, human
gcgggccccagggtcggact

SEQ ID NO: 242771 - DNA, 20 bp, human
gagggggcagcaggcgatgg

SEQ ID NO: 242772 - DNA, 20 bp, human
gctccccgggccaatcgtta

SEQ ID NO: 242773 - DNA, 20 bp, human
gtagctgcggcgggtcggtt

SEQ ID NO: 242774 - DNA, 20 bp, human
gccgacctacggggctaaga

SEQ ID NO: 242775 - DNA, 20 bp, human
ggccaataggcggtgggcgg

SEQ ID NO: 242776 - DNA, 20 bp, human
gactgtacccccttaagggc

SEQ ID NO: 242777 - DNA, 20 bp, human
gccgtgcgaggccgaggaac

SEQ ID NO: 242778 - DNA, 20 bp, human
gggcagagaaaggcggggaa

SEQ ID NO: 242779 - DNA, 20 bp, human
gtggccccactggcagagaa

SEQ ID NO: 242780 - DNA, 20 bp, human
gtgagcgcccgcccttaagg

SEQ ID NO: 242781 - DNA, 20 bp, human
gggagaccaggtcccggaga

SEQ ID NO: 242782 - DNA, 20 bp, human
ggcactgggcgggtacccgc

SEQ ID NO: 242783 - DNA, 20 bp, human
gggcgcggaggcggagcact

SEQ ID NO: 242784 - DNA, 20 bp, human
gctagctgcaggtgagggac

SEQ ID NO: 242785 - DNA, 20 bp, human
ggggcctccaatgcaaatga

SEQ ID NO: 242786 - DNA, 20 bp, human
ggcgaagtaggaggccggat

SEQ ID NO: 242787 - DNA, 20 bp, human
gtggccaaagtccgcgaagt

SEQ ID NO: 242788 - DNA, 20 bp, human
ggggcagcgaatgatgaaat

SEQ ID NO: 242789 - DNA, 20 bp, human
gaatggccgcgccccgcctg

SEQ ID NO: 242790 - DNA, 20 bp, human
gctcgaggcgagggccaata

SEQ ID NO: 242791 - DNA, 20 bp, human
gggcgcgagggctctgactc

SEQ ID NO: 242792 - DNA, 20 bp, human
gtgggtagaagccacaggcg

SEQ ID NO: 242793 - DNA, 20 bp, human
gcgggcacctgtcggtgatt

SEQ ID NO: 242794 - DNA, 20 bp, human
ggcgcctgcgctcgaggcga

SEQ ID NO: 242795 - DNA, 20 bp, human
gatgaaatgggaacggggag

SEQ ID NO: 242796 - DNA, 20 bp, human
gcctccggccggacgtactc

SEQ ID NO: 242797 - DNA, 20 bp, human
ggaacctctggatgttcaca

SEQ ID NO: 242798 - DNA, 20 bp, human
ggcggaggggacgtcggcgt

SEQ ID NO: 242799 - DNA, 20 bp, human
gcggccggacgtactctggc

SEQ ID NO: 242800 - DNA, 20 bp, human
ggatgttcacagggctgacg

SEQ ID NO: 242801 - DNA, 20 bp, human
gttcacagggctgacgcggt

SEQ ID NO: 242802 - DNA, 20 bp, human
gggaagctgtgtatggcggg

SEQ ID NO: 242803 - DNA, 20 bp, human
gaggggacgtcggcgtgggg

SEQ ID NO: 242804 - DNA, 20 bp, human
gcccggaagtagtgggtacc

SEQ ID NO: 242805 - DNA, 20 bp, human
gccggcgtgggaactgctac

SEQ ID NO: 242806 - DNA, 20 bp, human
gcctttggcggtccccagga

SEQ ID NO: 242807 - DNA, 20 bp, human
ggggcgaattggcaggaagc

SEQ ID NO: 242808 - DNA, 20 bp, human
gacagcgcccagcgaaagcg

SEQ ID NO: 242809 - DNA, 20 bp, human
gcggggtaggcggggcgaat

SEQ ID NO: 242810 - DNA, 20 bp, human
gaggctgatggagcgaagcc

SEQ ID NO: 242811 - DNA, 20 bp, human
gaagaggatgcggagacgcg

SEQ ID NO: 242812 - DNA, 20 bp, human
ggtaggcggggcgaattggc

SEQ ID NO: 242813 - DNA, 20 bp, human
gaaaccagaccgccgcggag

SEQ ID NO: 242814 - DNA, 20 bp, human
gaattggcaggaagcggggg

SEQ ID NO: 242815 - DNA, 20 bp, human
gcggggaaaccagaccgccg

SEQ ID NO: 242816 - DNA, 20 bp, human
gtggagggaagccggagcga

SEQ ID NO: 242817 - DNA, 20 bp, human
gaagcctccctgtgagtcgg

SEQ ID NO: 242818 - DNA, 20 bp, human
gacagagagcggggcttctg

SEQ ID NO: 242819 - DNA, 20 bp, human
gagcggcggtaagggcggta

SEQ ID NO: 242820 - DNA, 20 bp, human
gctcccaccgactcacaggg

SEQ ID NO: 242821 - DNA, 20 bp, human
ggggagcgacgactgcaaaa

SEQ ID NO: 242822 - DNA, 20 bp, human
gcaaaacggcagcgatgggg

SEQ ID NO: 242823 - DNA, 20 bp, human
ggctccggcttccctccagg

SEQ ID NO: 242824 - DNA, 20 bp, human
ggggtcacggcggcggtcag

SEQ ID NO: 242825 - DNA, 20 bp, human
gacaagacggagcggcggta

SEQ ID NO: 242826 - DNA, 20 bp, human
gccaaggcgcggcgttcgat

SEQ ID NO: 242827 - DNA, 20 bp, human
gacccttggaggctttctat

SEQ ID NO: 242828 - DNA, 20 bp, human
ggaacgtcgctcctgaccct

SEQ ID NO: 242829 - DNA, 20 bp, human
gttcgattggcctcccgcgc

SEQ ID NO: 242830 - DNA, 20 bp, human
ggcctcccgcgcaggctgct

SEQ ID NO: 242831 - DNA, 20 bp, human
ggcgccagagacgagaagag

SEQ ID NO: 242832 - DNA, 20 bp, human
gcgggcccggtcagcttccg

SEQ ID NO: 242833 - DNA, 20 bp, human
gaggctgctaggattggctc

SEQ ID NO: 242834 - DNA, 20 bp, human
gtcacccaatccgcgaaagg

SEQ ID NO: 242835 - DNA, 20 bp, human
ggcccccgagtcccgaatat

SEQ ID NO: 242836 - DNA, 20 bp, human
ggggagttgaagtcctcgga

SEQ ID NO: 242837 - DNA, 20 bp, human
gtaacctcccaggggcacgc

SEQ ID NO: 242838 - DNA, 20 bp, human
gggggatcgcccacctcacg

SEQ ID NO: 242839 - DNA, 20 bp, human
gcctcggagggtaacctccc

SEQ ID NO: 242840 - DNA, 20 bp, human
gcccctccgccctctgagag

SEQ ID NO: 242841 - DNA, 20 bp, human
gagttgaagtcctctctcag

SEQ ID NO: 242842 - DNA, 20 bp, human
ggaagtcctctctcagaggg

SEQ ID NO: 242843 - DNA, 20 bp, human
gcacgctgatccggccagga

SEQ ID NO: 242844 - DNA, 20 bp, human
ggagagaggacttcaactcc

SEQ ID NO: 242845 - DNA, 20 bp, human
gtccagcagccacgtgaggt

SEQ ID NO: 242846 - DNA, 20 bp, human
gctccagcgcgggggtaagg

SEQ ID NO: 242847 - DNA, 20 bp, human
gttacccccgcgctggagag

SEQ ID NO: 242848 - DNA, 20 bp, human
gagacgaaggatggacggag

SEQ ID NO: 242849 - DNA, 20 bp, human
ggagcgacccccgcaccgaa

SEQ ID NO: 242850 - DNA, 20 bp, human
gggagagcggtggaccggcc

SEQ ID NO: 242851 - DNA, 20 bp, human
gcgacccccgcaccgaaggg

SEQ ID NO: 242852 - DNA, 20 bp, human
gaacagaaggagacgaagga

SEQ ID NO: 242853 - DNA, 20 bp, human
ggcgctggagagcggtggac

SEQ ID NO: 242854 - DNA, 20 bp, human
gcatccgcccttcggtgcgg

SEQ ID NO: 242855 - DNA, 20 bp, human
gggcacaaccatccgccctt

SEQ ID NO: 242856 - DNA, 20 bp, human
gaacccgggcccggggtctc

SEQ ID NO: 242857 - DNA, 20 bp, human
gaccccggcgcgctgaatgc

SEQ ID NO: 242858 - DNA, 20 bp, human
gcacacagggcccgtaaccg

SEQ ID NO: 242859 - DNA, 20 bp, human
ggcgctgaatgcaggtgagg

SEQ ID NO: 242860 - DNA, 20 bp, human
gccccgaggggaagccgcgg

SEQ ID NO: 242861 - DNA, 20 bp, human
gcgcccgcgagccccggtta

SEQ ID NO: 242862 - DNA, 20 bp, human
ggaagccgcggcggcacaca

SEQ ID NO: 242863 - DNA, 20 bp, human
gtgccgccgcggcttcccct

SEQ ID NO: 242864 - DNA, 20 bp, human
gcgcagggaacccgggcccg

SEQ ID NO: 242865 - DNA, 20 bp, human
gggcgcgctgaatgcaggtg

SEQ ID NO: 242866 - DNA, 20 bp, human
gatgacgcgacacgcagagg

SEQ ID NO: 242867 - DNA, 20 bp, human
ggggcggggcacgcaagtga

SEQ ID NO: 242868 - DNA, 20 bp, human
ggctccctggctggccggtt

SEQ ID NO: 242869 - DNA, 20 bp, human
gcggggcacgcaagtgacgg

SEQ ID NO: 242870 - DNA, 20 bp, human
ggaaacttgcggcccggaac

SEQ ID NO: 242871 - DNA, 20 bp, human
gacgcgacacgcagaggggg

SEQ ID NO: 242872 - DNA, 20 bp, human
gcgcccaaaccggccagcca

SEQ ID NO: 242873 - DNA, 20 bp, human
gcctgcgctccccgagttct

SEQ ID NO: 242874 - DNA, 20 bp, human
ggggacatgctacgaacggc

SEQ ID NO: 242875 - DNA, 20 bp, human
gacatgctacgaacggcggg

SEQ ID NO: 242876 - DNA, 20 bp, human
gaacacgcacggagtcgcag

SEQ ID NO: 242877 - DNA, 20 bp, human
gtcgcaggggcgcgcaaagg

SEQ ID NO: 242878 - DNA, 20 bp, human
gcgagtcgggcggatcgggt

SEQ ID NO: 242879 - DNA, 20 bp, human
ggggtgccgccgaataggtg

SEQ ID NO: 242880 - DNA, 20 bp, human
gcaggcgagtcgggcggatc

SEQ ID NO: 242881 - DNA, 20 bp, human
ggagtcgcaggggcgcgcaa

SEQ ID NO: 242882 - DNA, 20 bp, human
gtctagagagcaggcgagtc

SEQ ID NO: 242883 - DNA, 20 bp, human
ggtgcctcccaccaaacaac

SEQ ID NO: 242884 - DNA, 20 bp, human
gtggagtgactctagagagc

SEQ ID NO: 242885 - DNA, 20 bp, human
ggggaggagcgggcgtgacc

SEQ ID NO: 242886 - DNA, 20 bp, human
gtcgccgcgcgcgggaacct

SEQ ID NO: 242887 - DNA, 20 bp, human
gctaatccacgggaccgggg

SEQ ID NO: 242888 - DNA, 20 bp, human
gcgcctgcgcgcagaggaga

SEQ ID NO: 242889 - DNA, 20 bp, human
ggcagtgggtgggtgcgcgt

SEQ ID NO: 242890 - DNA, 20 bp, human
gaggcagggtcgtgcaaagt

SEQ ID NO: 242891 - DNA, 20 bp, human
ggtaactcagtcaccctccc

SEQ ID NO: 242892 - DNA, 20 bp, human
gactgcgcctgcgagctgag

SEQ ID NO: 242893 - DNA, 20 bp, human
gcctgctaatccacgggacc

SEQ ID NO: 242894 - DNA, 20 bp, human
gccccccgggctatgtaaag

SEQ ID NO: 242895 - DNA, 20 bp, human
ggtgggtgcgcgtggggagc

SEQ ID NO: 242896 - DNA, 20 bp, human
ggcggggcccgggctgaact

SEQ ID NO: 242897 - DNA, 20 bp, human
gccgtgcgacgctcacctcg

SEQ ID NO: 242898 - DNA, 20 bp, human
ggagggagctgcgagggcga

SEQ ID NO: 242899 - DNA, 20 bp, human
gagaaatggggacaattcgt

SEQ ID NO: 242900 - DNA, 20 bp, human
ggggggccctaggcccggga

SEQ ID NO: 242901 - DNA, 20 bp, human
gtgtaaacgccgggcggacg

SEQ ID NO: 242902 - DNA, 20 bp, human
gaacaagccaggcgtagcaa

SEQ ID NO: 242903 - DNA, 20 bp, human
gacctcccttcccgggccta

SEQ ID NO: 242904 - DNA, 20 bp, human
ggaggcgcccagttcagccc

SEQ ID NO: 242905 - DNA, 20 bp, human
gcgggcggacgcggcacagg

SEQ ID NO: 242906 - DNA, 20 bp, human
ggacgagcgtcacgtgactg

SEQ ID NO: 242907 - DNA, 20 bp, human
ggcgccgcggaggacagcag

SEQ ID NO: 242908 - DNA, 20 bp, human
gcggcccgccctatccgggg

SEQ ID NO: 242909 - DNA, 20 bp, human
ggggcgcgtcaggcggaagg

SEQ ID NO: 242910 - DNA, 20 bp, human
gccgcctgacgcgcccccgg

SEQ ID NO: 242911 - DNA, 20 bp, human
gttaggccgcgtcacgtgac

SEQ ID NO: 242912 - DNA, 20 bp, human
gccgagcccgcgaggagcca

SEQ ID NO: 242913 - DNA, 20 bp, human
ggcgcggcccgccctatccg

SEQ ID NO: 242914 - DNA, 20 bp, human
ggcggcggggctatggcgag

SEQ ID NO: 242915 - DNA, 20 bp, human
gacccccccccccccggata

SEQ ID NO: 242916 - DNA, 20 bp, human
gccggaggactggaagcccg

SEQ ID NO: 242917 - DNA, 20 bp, human
gccggccgccacctcaacaa

SEQ ID NO: 242918 - DNA, 20 bp, human
gcttcccggcggggccagca

SEQ ID NO: 242919 - DNA, 20 bp, human
gaggcatgtcagtgtcctag

SEQ ID NO: 242920 - DNA, 20 bp, human
ggggtgttaaccccttgttg

SEQ ID NO: 242921 - DNA, 20 bp, human
ggacgcagtgctcttcccgg

SEQ ID NO: 242922 - DNA, 20 bp, human
gactggaagcccggggggaa

SEQ ID NO: 242923 - DNA, 20 bp, human
gaatccctgaggtttgggag

SEQ ID NO: 242924 - DNA, 20 bp, human
gccgctgcagtgcacataca

SEQ ID NO: 242925 - DNA, 20 bp, human
gcagggggacctttcccccc

SEQ ID NO: 242926 - DNA, 20 bp, human
gtaaggccactcctattcta

SEQ ID NO: 242927 - DNA, 20 bp, human
gctgacccctggtggtcacg

SEQ ID NO: 242928 - DNA, 20 bp, human
gcgggcgtgctgtatgggag

SEQ ID NO: 242929 - DNA, 20 bp, human
gcaggggtcagccgtagaat

SEQ ID NO: 242930 - DNA, 20 bp, human
ggaccggggtccttgctgtt

SEQ ID NO: 242931 - DNA, 20 bp, human
ggagtccgggcgtgctgtat

SEQ ID NO: 242932 - DNA, 20 bp, human
ggaccccggtcaatcgccga

SEQ ID NO: 242933 - DNA, 20 bp, human
ggtcagccgtagaataggag

SEQ ID NO: 242934 - DNA, 20 bp, human
gtgggctaggaccttcaaaa

SEQ ID NO: 242935 - DNA, 20 bp, human
gcgaaggacccagacttgcg

SEQ ID NO: 242936 - DNA, 20 bp, human
ggcagccaataggctttctg

SEQ ID NO: 242937 - DNA, 20 bp, human
gctcccagagcctccgttag

SEQ ID NO: 242938 - DNA, 20 bp, human
gcagacgcaggcttcttctc

SEQ ID NO: 242939 - DNA, 20 bp, human
gagggaagtgacgttcgagg

SEQ ID NO: 242940 - DNA, 20 bp, human
gcgcggacggcgcagccaat

SEQ ID NO: 242941 - DNA, 20 bp, human
gcaccccctaacggaggctc

SEQ ID NO: 242942 - DNA, 20 bp, human
gccgcagcccgccttcaaag

SEQ ID NO: 242943 - DNA, 20 bp, human
gcgcaggtgctggaagatgt

SEQ ID NO: 242944 - DNA, 20 bp, human
ggggccttggtccgctttga

SEQ ID NO: 242945 - DNA, 20 bp, human
gcaaaccccagaaagcctat

SEQ ID NO: 242946 - DNA, 20 bp, human
gaagaggcgccacaaaacgg

SEQ ID NO: 242947 - DNA, 20 bp, human
ggggagcaggaaaactctag

SEQ ID NO: 242948 - DNA, 20 bp, human
ggatcagcccaacaagggtg

SEQ ID NO: 242949 - DNA, 20 bp, human
gccaggacctgctcccacga

SEQ ID NO: 242950 - DNA, 20 bp, human
gcgcatgcgccgaccttcct

SEQ ID NO: 242951 - DNA, 20 bp, human
gcctggcagccgggtagtga

SEQ ID NO: 242952 - DNA, 20 bp, human
gaacgaggccccacccttgt

SEQ ID NO: 242953 - DNA, 20 bp, human
gggtggggcctcgttgctac

SEQ ID NO: 242954 - DNA, 20 bp, human
gtataaggagcactccctct

SEQ ID NO: 242955 - DNA, 20 bp, human
ggcaaccttaaatccagccg

SEQ ID NO: 242956 - DNA, 20 bp, human
gacagcgcgagcggagggag

SEQ ID NO: 242957 - DNA, 20 bp, human
gccgccgcggcgccagccct

SEQ ID NO: 242958 - DNA, 20 bp, human
gtaggtgacgcgggccgaag

SEQ ID NO: 242959 - DNA, 20 bp, human
gcgagggaactgcgcgggga

SEQ ID NO: 242960 - DNA, 20 bp, human
gccgccccaagcaaagtttg

SEQ ID NO: 242961 - DNA, 20 bp, human
gcctccgctcgcgctgtctc

SEQ ID NO: 242962 - DNA, 20 bp, human
gtggcctggtcagggtgtga

SEQ ID NO: 242963 - DNA, 20 bp, human
ggggaccgcgcttcataaat

SEQ ID NO: 242964 - DNA, 20 bp, human
gcagaggggacaagcctctt

SEQ ID NO: 242965 - DNA, 20 bp, human
ggccccgcctggcccggcgt

SEQ ID NO: 242966 - DNA, 20 bp, human
gctggaggggaagtggtaac

SEQ ID NO: 242967 - DNA, 20 bp, human
gaccctggagtcaagggact

SEQ ID NO: 242968 - DNA, 20 bp, human
gtcccttgactccagggtct

SEQ ID NO: 242969 - DNA, 20 bp, human
gggcctagaccctggagtca

SEQ ID NO: 242970 - DNA, 20 bp, human
gtcacagatgagtgagtgtg

SEQ ID NO: 242971 - DNA, 20 bp, human
gcaagagcattgtggcacca

SEQ ID NO: 242972 - DNA, 20 bp, human
gaagtggtaacaggcacgga

SEQ ID NO: 242973 - DNA, 20 bp, human
gtatctcttacaacgaactc

SEQ ID NO: 242974 - DNA, 20 bp, human
gatcctggtgtggggcaata

SEQ ID NO: 242975 - DNA, 20 bp, human
gctctggcctagtggtgaag

SEQ ID NO: 242976 - DNA, 20 bp, human
gtgcccggggctgttctagg

SEQ ID NO: 242977 - DNA, 20 bp, human
gaggaagcgggcccaagaga

SEQ ID NO: 242978 - DNA, 20 bp, human
ggaggctgagggggggtaaa

SEQ ID NO: 242979 - DNA, 20 bp, human
gaacagccccgggcaggagg

SEQ ID NO: 242980 - DNA, 20 bp, human
ggctcctcctagaacagccc

SEQ ID NO: 242981 - DNA, 20 bp, human
ggatccggcgccagccaggc

SEQ ID NO: 242982 - DNA, 20 bp, human
ggcgccctccacgcacccga

SEQ ID NO: 242983 - DNA, 20 bp, human
gcgcacccgaaggctcgctc

SEQ ID NO: 242984 - DNA, 20 bp, human
gagggcgcagcactggagcg

SEQ ID NO: 242985 - DNA, 20 bp, human
gccgtccgcccgggcttttg

SEQ ID NO: 242986 - DNA, 20 bp, human
gggtcggtcgctctcctcaa

SEQ ID NO: 242987 - DNA, 20 bp, human
ggccgcccgaggattgtgag

SEQ ID NO: 242988 - DNA, 20 bp, human
gacggtccactcacaatcct

SEQ ID NO: 242989 - DNA, 20 bp, human
gaccgcggagcatagagcac

SEQ ID NO: 242990 - DNA, 20 bp, human
gagcctgcgcatgcgaacag

SEQ ID NO: 242991 - DNA, 20 bp, human
gcaaccatagagtacgagtc

SEQ ID NO: 242992 - DNA, 20 bp, human
ggattgtgagtggaccgttg

SEQ ID NO: 242993 - DNA, 20 bp, human
gtccctctgcgcacccctcg

SEQ ID NO: 242994 - DNA, 20 bp, human
ggcggagcatagagcactgg

SEQ ID NO: 242995 - DNA, 20 bp, human
gccacgcagggtatcccacg

SEQ ID NO: 242996 - DNA, 20 bp, human
gcgcgcggcggcaccgcgaa

SEQ ID NO: 242997 - DNA, 20 bp, human
gtcgggagctggtgaccctc

SEQ ID NO: 242998 - DNA, 20 bp, human
gtccacgcttagaatccaga

SEQ ID NO: 242999 - DNA, 20 bp, human
gagtggcaacatggcgtctt

SEQ ID NO: 243000 - DNA, 20 bp, human
gtgtcagcttctcccgagtc

SEQ ID NO: 243001 - DNA, 20 bp, human
gccgccgcgcgggcctcgct

SEQ ID NO: 243002 - DNA, 20 bp, human
gaccctctggattctaagcg

SEQ ID NO: 243003 - DNA, 20 bp, human
gcagcgtatcgacccgactc

SEQ ID NO: 243004 - DNA, 20 bp, human
gagtccactgcagcggccaa

SEQ ID NO: 243005 - DNA, 20 bp, human
ggaagggaggagtggcaaca

SEQ ID NO: 243006 - DNA, 20 bp, human
gccagctgtccgaccttaga

SEQ ID NO: 243007 - DNA, 20 bp, human
gcgcccgggcaggtgcacaa

SEQ ID NO: 243008 - DNA, 20 bp, human
gtctcgaagccctctaaggt

SEQ ID NO: 243009 - DNA, 20 bp, human
gctttcctgaccataaagtc

SEQ ID NO: 243010 - DNA, 20 bp, human
ggctcagtgcgcacgcgccc

SEQ ID NO: 243011 - DNA, 20 bp, human
gggtttgcaccgtcagagga

SEQ ID NO: 243012 - DNA, 20 bp, human
ggtcctctcgaagccctcta

SEQ ID NO: 243013 - DNA, 20 bp, human
gtcagggtttgcaccgtcag

SEQ ID NO: 243014 - DNA, 20 bp, human
gacaaaggtgagtgccccgc

SEQ ID NO: 243015 - DNA, 20 bp, human
gtgaaatcatcccgacttta

SEQ ID NO: 243016 - DNA, 20 bp, human
gaacctagagggagacgccc

SEQ ID NO: 243017 - DNA, 20 bp, human
gctcctgggcgtctccctct

SEQ ID NO: 243018 - DNA, 20 bp, human
gctaggtgaggacacgtaag

SEQ ID NO: 243019 - DNA, 20 bp, human
ggtccacgtggcggagaggt

SEQ ID NO: 243020 - DNA, 20 bp, human
ggtgtcctcacctagaactc

SEQ ID NO: 243021 - DNA, 20 bp, human
gagacgcccaggagtccacg

SEQ ID NO: 243022 - DNA, 20 bp, human
gtacccacctctccgccacg

SEQ ID NO: 243023 - DNA, 20 bp, human
gaggagtccacgtggcggag

SEQ ID NO: 243024 - DNA, 20 bp, human
gcagaggggttgaggattcg

SEQ ID NO: 243025 - DNA, 20 bp, human
gaggtgggtatggaggcatc

SEQ ID NO: 243026 - DNA, 20 bp, human
ggcaggggtgccatgaggat

SEQ ID NO: 243027 - DNA, 20 bp, human
gaagtgtgctaagtactgag

SEQ ID NO: 243028 - DNA, 20 bp, human
ggatggaggcagacgctgca

SEQ ID NO: 243029 - DNA, 20 bp, human
gagaggaggtagcaaattcc

SEQ ID NO: 243030 - DNA, 20 bp, human
gattaggcaggggtgccatg

SEQ ID NO: 243031 - DNA, 20 bp, human
gctgggcattctctactaat

SEQ ID NO: 243032 - DNA, 20 bp, human
gagatagattacattaggca

SEQ ID NO: 243033 - DNA, 20 bp, human
gtttgtgcctgtggaatcaa

SEQ ID NO: 243034 - DNA, 20 bp, human
gactatcataccaatcctca

SEQ ID NO: 243035 - DNA, 20 bp, human
ggtgtgagatagattacatt

SEQ ID NO: 243036 - DNA, 20 bp, human
gcgggcgcccgcggtcacat

SEQ ID NO: 243037 - DNA, 20 bp, human
gcgcggggagacaaggcaag

SEQ ID NO: 243038 - DNA, 20 bp, human
gtcacatgggcgagagaagg

SEQ ID NO: 243039 - DNA, 20 bp, human
gcgcggggcccgtggcgggg

SEQ ID NO: 243040 - DNA, 20 bp, human
gtgggcgcgcactcaccccc

SEQ ID NO: 243041 - DNA, 20 bp, human
gtgcgcgcccagccgcccta

SEQ ID NO: 243042 - DNA, 20 bp, human
gtgagggcgcgcccgagaaa

SEQ ID NO: 243043 - DNA, 20 bp, human
gccagtggaggcttctcccc

SEQ ID NO: 243044 - DNA, 20 bp, human
ggacgagtgtgccagcgggg

SEQ ID NO: 243045 - DNA, 20 bp, human
gtgtgaaggagcgatcccgg

SEQ ID NO: 243046 - DNA, 20 bp, human
gttaagaggtgggatgtaag

SEQ ID NO: 243047 - DNA, 20 bp, human
ggactcaggcacaggacgct

SEQ ID NO: 243048 - DNA, 20 bp, human
ggcgcccagcgcgagccttg

SEQ ID NO: 243049 - DNA, 20 bp, human
gcacgcgccgtggcccgaaa

SEQ ID NO: 243050 - DNA, 20 bp, human
gcaggcacaggacgctggga

SEQ ID NO: 243051 - DNA, 20 bp, human
ggccgtggcccgaaagggta

SEQ ID NO: 243052 - DNA, 20 bp, human
gtggcccgaaagggtaaggc

SEQ ID NO: 243053 - DNA, 20 bp, human
gggcaggcagggctttaggt

SEQ ID NO: 243054 - DNA, 20 bp, human
gcggaccggccttacccttt

SEQ ID NO: 243055 - DNA, 20 bp, human
gcgtaccccaaggctcgcgc

SEQ ID NO: 243056 - DNA, 20 bp, human
gtcacccccaggaccagcgc

SEQ ID NO: 243057 - DNA, 20 bp, human
gaaagtggggcggggaccac

SEQ ID NO: 243058 - DNA, 20 bp, human
gtgcagcctgcgctggtcct

SEQ ID NO: 243059 - DNA, 20 bp, human
gggaaacccgcttctctgat

SEQ ID NO: 243060 - DNA, 20 bp, human
ggatccggtagcagcaggtt

SEQ ID NO: 243061 - DNA, 20 bp, human
gcagcgcaggctgcagactt

SEQ ID NO: 243062 - DNA, 20 bp, human
gagagaagcgggtttccctg

SEQ ID NO: 243063 - DNA, 20 bp, human
gggaccctccctccctcttg

SEQ ID NO: 243064 - DNA, 20 bp, human
gaacccaaacctgctgctac

SEQ ID NO: 243065 - DNA, 20 bp, human
gggagcagatggtcccttca

SEQ ID NO: 243066 - DNA, 20 bp, human
gctccagggcccccgagcgt

SEQ ID NO: 243067 - DNA, 20 bp, human
gtggtcctcagccaacgctc

SEQ ID NO: 243068 - DNA, 20 bp, human
gggcccccgagcgttggctg

SEQ ID NO: 243069 - DNA, 20 bp, human
ggggctgggcaggatcggga

SEQ ID NO: 243070 - DNA, 20 bp, human
gcccctgcccagggctgaag

SEQ ID NO: 243071 - DNA, 20 bp, human
gcccgcggcctgtccatgag

SEQ ID NO: 243072 - DNA, 20 bp, human
gcattatggaagacgcgcgc

SEQ ID NO: 243073 - DNA, 20 bp, human
gcgggccagacagcgccccg

SEQ ID NO: 243074 - DNA, 20 bp, human
gcgcgtcttccataatgcat

SEQ ID NO: 243075 - DNA, 20 bp, human
gcccagaaatcccctatccg

SEQ ID NO: 243076 - DNA, 20 bp, human
gcatgtaactcataggtaga

SEQ ID NO: 243077 - DNA, 20 bp, human
gttctctaacgatagcattc

SEQ ID NO: 243078 - DNA, 20 bp, human
ggtaaaaactgtttatcatt

SEQ ID NO: 243079 - DNA, 20 bp, human
gctgttttgatacaaaatag

SEQ ID NO: 243080 - DNA, 20 bp, human
gatgctatcgttagagaaaa

SEQ ID NO: 243081 - DNA, 20 bp, human
gtggaaaaagttagaatttt

SEQ ID NO: 243082 - DNA, 20 bp, human
gataatttgcatgctttatt

SEQ ID NO: 243083 - DNA, 20 bp, human
gacagatttgttttatctga

SEQ ID NO: 243084 - DNA, 20 bp, human
gtaaaaaaataggtctaaga

SEQ ID NO: 243085 - DNA, 20 bp, human
gtgcagttttctaaaaaaat

SEQ ID NO: 243086 - DNA, 20 bp, human
gctcccccgccccgcggcta

SEQ ID NO: 243087 - DNA, 20 bp, human
gaacgggcgggagacgagcg

SEQ ID NO: 243088 - DNA, 20 bp, human
gggcgcgggcgggtgggaac

SEQ ID NO: 243089 - DNA, 20 bp, human
gcgggagacgagcggggacg

SEQ ID NO: 243090 - DNA, 20 bp, human
ggagccggcagcccgaactc

SEQ ID NO: 243091 - DNA, 20 bp, human
gacgtccccgcacgggaatc

SEQ ID NO: 243092 - DNA, 20 bp, human
gttcgcgcgctggggacctg

SEQ ID NO: 243093 - DNA, 20 bp, human
gcggctccttagccgcgggg

SEQ ID NO: 243094 - DNA, 20 bp, human
ggccgcgccagacggagccc

SEQ ID NO: 243095 - DNA, 20 bp, human
ggcggggcgggggagacgct

SEQ ID NO: 243096 - DNA, 20 bp, human
gtggctgtgtcctcccgggg

SEQ ID NO: 243097 - DNA, 20 bp, human
gcgggcgccggtgacagcgc

SEQ ID NO: 243098 - DNA, 20 bp, human
gtgcgccccgcgcctctgac

SEQ ID NO: 243099 - DNA, 20 bp, human
ggcagtgaggcgctggacgc

SEQ ID NO: 243100 - DNA, 20 bp, human
gtcactgcctcttgctgcaa

SEQ ID NO: 243101 - DNA, 20 bp, human
ggcagggcgcgcggacgcat

SEQ ID NO: 243102 - DNA, 20 bp, human
gcaaacgtgctggctggagt

SEQ ID NO: 243103 - DNA, 20 bp, human
gagcagaaacgctcggggaa

SEQ ID NO: 243104 - DNA, 20 bp, human
ggttcattgagcatgtccct

SEQ ID NO: 243105 - DNA, 20 bp, human
gacacagccagtcagaggcg

SEQ ID NO: 243106 - DNA, 20 bp, human
ggctctctctgattctgtga

SEQ ID NO: 243107 - DNA, 20 bp, human
gcatgtgcaaagctctcgtt

SEQ ID NO: 243108 - DNA, 20 bp, human
ggcctcaagaactgattgtc

SEQ ID NO: 243109 - DNA, 20 bp, human
ggccagacaatcagttcttg

SEQ ID NO: 243110 - DNA, 20 bp, human
gcaaagattaagctggtcaa

SEQ ID NO: 243111 - DNA, 20 bp, human
gtggagatagtcactcctgt

SEQ ID NO: 243112 - DNA, 20 bp, human
gtatctccagtcaaagaaag

SEQ ID NO: 243113 - DNA, 20 bp, human
ggacaatgcagtgaaaccag

SEQ ID NO: 243114 - DNA, 20 bp, human
gctccagtcaaagaaagagg

SEQ ID NO: 243115 - DNA, 20 bp, human
gagagccacgcaatactcag

SEQ ID NO: 243116 - DNA, 20 bp, human
ggggccacaggagtgaggac

SEQ ID NO: 243117 - DNA, 20 bp, human
gctcctgtggccctagtccc

SEQ ID NO: 243118 - DNA, 20 bp, human
gagtgaggacagggaaccta

SEQ ID NO: 243119 - DNA, 20 bp, human
gccctgctgcgaaagggcgg

SEQ ID NO: 243120 - DNA, 20 bp, human
gtgcccgggactagggccac

SEQ ID NO: 243121 - DNA, 20 bp, human
ggaaaaccccaagtaacccg

SEQ ID NO: 243122 - DNA, 20 bp, human
gcctcagccctgctgcgaaa

SEQ ID NO: 243123 - DNA, 20 bp, human
gatgctctaggagtggtgct

SEQ ID NO: 243124 - DNA, 20 bp, human
gtgcgcggggtccgggaaac

SEQ ID NO: 243125 - DNA, 20 bp, human
ggcaaattatgctctaggag

SEQ ID NO: 243126 - DNA, 20 bp, human
gccgcacggagggagaacga

SEQ ID NO: 243127 - DNA, 20 bp, human
gtgtgccagtgcaacgccgg

SEQ ID NO: 243128 - DNA, 20 bp, human
gtcctcccccggcgttgcac

SEQ ID NO: 243129 - DNA, 20 bp, human
gtccaggctccagttcttcc

SEQ ID NO: 243130 - DNA, 20 bp, human
ggctccaagcccggaagaac

SEQ ID NO: 243131 - DNA, 20 bp, human
gagaggcaatacccgcacgg

SEQ ID NO: 243132 - DNA, 20 bp, human
ggcaagaggcaatacccgca

SEQ ID NO: 243133 - DNA, 20 bp, human
gtcccctgccgctccaagcc

SEQ ID NO: 243134 - DNA, 20 bp, human
gcgaggaagcatctcccggg

SEQ ID NO: 243135 - DNA, 20 bp, human
gtccgggcttggagcggcag

SEQ ID NO: 243136 - DNA, 20 bp, human
ggctagagactggacagggg

SEQ ID NO: 243137 - DNA, 20 bp, human
gaactctgcggcgtgtactt

SEQ ID NO: 243138 - DNA, 20 bp, human
gtggggcagaaataactctg

SEQ ID NO: 243139 - DNA, 20 bp, human
gagttcaaatagggaagatg

SEQ ID NO: 243140 - DNA, 20 bp, human
gcgctgttcacccaacgcag

SEQ ID NO: 243141 - DNA, 20 bp, human
gtgggtgcagcccctgcgtt

SEQ ID NO: 243142 - DNA, 20 bp, human
ggtcctgtttgagttcaaat

SEQ ID NO: 243143 - DNA, 20 bp, human
gaacaggacagcattttcct

SEQ ID NO: 243144 - DNA, 20 bp, human
gtccctatttgaactcaaac

SEQ ID NO: 243145 - DNA, 20 bp, human
gacagcgcagtgataaagcc

SEQ ID NO: 243146 - DNA, 20 bp, human
gctcgcttcttgactcgcgt

SEQ ID NO: 243147 - DNA, 20 bp, human
ggcttgcacttgcagaaccc

SEQ ID NO: 243148 - DNA, 20 bp, human
gaggccaggactagggtgaa

SEQ ID NO: 243149 - DNA, 20 bp, human
gggactaacgcactagtctc

SEQ ID NO: 243150 - DNA, 20 bp, human
gagtcccttcaccctagtcc

SEQ ID NO: 243151 - DNA, 20 bp, human
gaccctagtcctggccttgg

SEQ ID NO: 243152 - DNA, 20 bp, human
gttagacttccaccaaggcc

SEQ ID NO: 243153 - DNA, 20 bp, human
gttccaccaaggccaggact

SEQ ID NO: 243154 - DNA, 20 bp, human
gaaaactatttcattcattc

SEQ ID NO: 243155 - DNA, 20 bp, human
gatattaaaactttaaataa

SEQ ID NO: 243156 - DNA, 20 bp, human
gagctgggagaaaagggtta

SEQ ID NO: 243157 - DNA, 20 bp, human
gccagctggaggtgtgagtg

SEQ ID NO: 243158 - DNA, 20 bp, human
gaacgggaggccgcgcctct

SEQ ID NO: 243159 - DNA, 20 bp, human
gcccaaggaggcccacgaac

SEQ ID NO: 243160 - DNA, 20 bp, human
gcgagctccgctgcacccag

SEQ ID NO: 243161 - DNA, 20 bp, human
gcagcagcggtcccacaaat

SEQ ID NO: 243162 - DNA, 20 bp, human
gactcccggataatcaggaa

SEQ ID NO: 243163 - DNA, 20 bp, human
gtcccgttcgtgggcctcct

SEQ ID NO: 243164 - DNA, 20 bp, human
ggatgcactcccggataatc

SEQ ID NO: 243165 - DNA, 20 bp, human
gcgaggagtgggcgtggcct

SEQ ID NO: 243166 - DNA, 20 bp, human
gtagccaaagcgcaccgcag

SEQ ID NO: 243167 - DNA, 20 bp, human
gccgcccaggctgctcttat

SEQ ID NO: 243168 - DNA, 20 bp, human
gaagccgctgcggtgcgctt

SEQ ID NO: 243169 - DNA, 20 bp, human
ggaggaaaagcgcccgagcg

SEQ ID NO: 243170 - DNA, 20 bp, human
gtcgcctataagagcagcct

SEQ ID NO: 243171 - DNA, 20 bp, human
ggcggtgcgctttggctacc

SEQ ID NO: 243172 - DNA, 20 bp, human
ggcgctttggctacctggga

SEQ ID NO: 243173 - DNA, 20 bp, human
ggcggccccgctcgcctata

SEQ ID NO: 243174 - DNA, 20 bp, human
gccgcagcggcttggcttcc

SEQ ID NO: 243175 - DNA, 20 bp, human
gtgcggtgggagtagctgcg

SEQ ID NO: 243176 - DNA, 20 bp, human
gcgaaggcaccgcatcccgt

SEQ ID NO: 243177 - DNA, 20 bp, human
gctaggatgccggggagtct

SEQ ID NO: 243178 - DNA, 20 bp, human
ggcgttgcaggtgaagtgtc

SEQ ID NO: 243179 - DNA, 20 bp, human
gcacctgcaacgcaatccga

SEQ ID NO: 243180 - DNA, 20 bp, human
gccagcgcgctaggatgccg

SEQ ID NO: 243181 - DNA, 20 bp, human
gagcgcgcaagcatcagaag

SEQ ID NO: 243182 - DNA, 20 bp, human
ggcgtcccttccaacagtac

SEQ ID NO: 243183 - DNA, 20 bp, human
gccttccaacagtaccggag

SEQ ID NO: 243184 - DNA, 20 bp, human
ggcgctggctgcaaaagagg

SEQ ID NO: 243185 - DNA, 20 bp, human
gccggggagtcttgggcgcg

SEQ ID NO: 243186 - DNA, 20 bp, human
gaacccgagcccaaggagtg

SEQ ID NO: 243187 - DNA, 20 bp, human
gggagtctgacaagcagcac

SEQ ID NO: 243188 - DNA, 20 bp, human
gggctccggtggccacagat

SEQ ID NO: 243189 - DNA, 20 bp, human
gccgagcgagaaccccccta

SEQ ID NO: 243190 - DNA, 20 bp, human
gccacagattggctgaggga

SEQ ID NO: 243191 - DNA, 20 bp, human
gcgagaacccccctaagggg

SEQ ID NO: 243192 - DNA, 20 bp, human
gggtggggtccccacctggt

SEQ ID NO: 243193 - DNA, 20 bp, human
ggtggccacagattggctga

SEQ ID NO: 243194 - DNA, 20 bp, human
gtctgcgagcgtggtctcgc

SEQ ID NO: 243195 - DNA, 20 bp, human
gcctaaggggcggagctccg

SEQ ID NO: 243196 - DNA, 20 bp, human
gctaacacgggtcctccggc

SEQ ID NO: 243197 - DNA, 20 bp, human
gaagcagaagccacacgtcc

SEQ ID NO: 243198 - DNA, 20 bp, human
ggtcccggcgacctaagttc

SEQ ID NO: 243199 - DNA, 20 bp, human
gagggctagagcgtcgaacc

SEQ ID NO: 243200 - DNA, 20 bp, human
ggatccagaacttaggtcgc

SEQ ID NO: 243201 - DNA, 20 bp, human
gcagtagagacttccggcgt

SEQ ID NO: 243202 - DNA, 20 bp, human
gcggaggcttcagctcacct

SEQ ID NO: 243203 - DNA, 20 bp, human
gaatgctaacacgggtcctc

SEQ ID NO: 243204 - DNA, 20 bp, human
gtccggcgtcggctgctcgc

SEQ ID NO: 243205 - DNA, 20 bp, human
gggggagcagtagagacttc

SEQ ID NO: 243206 - DNA, 20 bp, human
gcgcgcggcggcaccgcgaa

SEQ ID NO: 243207 - DNA, 20 bp, human
gttggggcgggaaaaagctg

SEQ ID NO: 243208 - DNA, 20 bp, human
gaaaagctgtggagggttcg

SEQ ID NO: 243209 - DNA, 20 bp, human
gcagccgcacccacgatctg

SEQ ID NO: 243210 - DNA, 20 bp, human
gcccctgtgcccgggaaccg

SEQ ID NO: 243211 - DNA, 20 bp, human
ggaaggggacgaggaatcca

SEQ ID NO: 243212 - DNA, 20 bp, human
gccgccgcgcgggcctcgct

SEQ ID NO: 243213 - DNA, 20 bp, human
gagtccactgcagcggccaa

SEQ ID NO: 243214 - DNA, 20 bp, human
gagcggacgtgctttctgat

SEQ ID NO: 243215 - DNA, 20 bp, human
gccagggtgtggcagaagac

SEQ ID NO: 243216 - DNA, 20 bp, human
gggtggaggcggggtcgaga

SEQ ID NO: 243217 - DNA, 20 bp, human
gcggggactcacttccggga

SEQ ID NO: 243218 - DNA, 20 bp, human
gaagcgtgcggcgaggacag

SEQ ID NO: 243219 - DNA, 20 bp, human
gaggcccagaacagagtcag

SEQ ID NO: 243220 - DNA, 20 bp, human
gtcctcgccgcacgcttctc

SEQ ID NO: 243221 - DNA, 20 bp, human
ggggagcgtgcacacggaag

SEQ ID NO: 243222 - DNA, 20 bp, human
gtgagtccccgagaagcgtg

SEQ ID NO: 243223 - DNA, 20 bp, human
gcgactgggcgcaagccctc

SEQ ID NO: 243224 - DNA, 20 bp, human
gagcgtgcacacggaagggg

SEQ ID NO: 243225 - DNA, 20 bp, human
gtcaggaaccagcccctcgt

SEQ ID NO: 243226 - DNA, 20 bp, human
ggtagggccgaggactacgg

SEQ ID NO: 243227 - DNA, 20 bp, human
gcaagggccggctccgttga

SEQ ID NO: 243228 - DNA, 20 bp, human
ggccggctccgttgagggaa

SEQ ID NO: 243229 - DNA, 20 bp, human
ggtgacgcggcgcgccccaa

SEQ ID NO: 243230 - DNA, 20 bp, human
gccgagaggtggcgcgtccg

SEQ ID NO: 243231 - DNA, 20 bp, human
ggcggtagggccgaggacta

SEQ ID NO: 243232 - DNA, 20 bp, human
ggcaacacttgcaaccgggt

SEQ ID NO: 243233 - DNA, 20 bp, human
gaccccagccgccaccgggc

SEQ ID NO: 243234 - DNA, 20 bp, human
ggaagtcggttcccgtgacg

SEQ ID NO: 243235 - DNA, 20 bp, human
ggactacgggggccgagagg

SEQ ID NO: 243236 - DNA, 20 bp, human
gaccgacttccggccttcaa

SEQ ID NO: 243237 - DNA, 20 bp, human
gtgagagtgcgagagctgga

SEQ ID NO: 243238 - DNA, 20 bp, human
gccctcttgcccttgaaggc

SEQ ID NO: 243239 - DNA, 20 bp, human
gtcggctcgccttgtcccgc

SEQ ID NO: 243240 - DNA, 20 bp, human
gtatctgtaagaccgacttc

SEQ ID NO: 243241 - DNA, 20 bp, human
gcccctctatggaaagtaaa

SEQ ID NO: 243242 - DNA, 20 bp, human
gatgctagtcccgcgggaca

SEQ ID NO: 243243 - DNA, 20 bp, human
gctagcatatcaagccttcc

SEQ ID NO: 243244 - DNA, 20 bp, human
gatcatcgcacggtgtgtcc

SEQ ID NO: 243245 - DNA, 20 bp, human
gttacagataaaagcgaaac

SEQ ID NO: 243246 - DNA, 20 bp, human
gggggtggggctgatcccga

SEQ ID NO: 243247 - DNA, 20 bp, human
gaaaccgcaactcggaacta

SEQ ID NO: 243248 - DNA, 20 bp, human
ggcgagatttccagtggcat

SEQ ID NO: 243249 - DNA, 20 bp, human
gtctcctcatcaggccagaa

SEQ ID NO: 243250 - DNA, 20 bp, human
gctgtgtcctgctgatgggg

SEQ ID NO: 243251 - DNA, 20 bp, human
gcaactcggaactacggaaa

SEQ ID NO: 243252 - DNA, 20 bp, human
gatgccgatcggacccccgc

SEQ ID NO: 243253 - DNA, 20 bp, human
gagaagggaatctgtgaaat

SEQ ID NO: 243254 - DNA, 20 bp, human
ggactgagagggtactagga

SEQ ID NO: 243255 - DNA, 20 bp, human
ggaactacggaaacggagga

SEQ ID NO: 243256 - DNA, 20 bp, human
gtgccggaggattccttccc

SEQ ID NO: 243257 - DNA, 20 bp, human
ggtccggggaaggaatcctc

SEQ ID NO: 243258 - DNA, 20 bp, human
gggcccgcggcgagcgtccg

SEQ ID NO: 243259 - DNA, 20 bp, human
ggtcctccgccggcccgcgt

SEQ ID NO: 243260 - DNA, 20 bp, human
gtcgggactctgagcaggcg

SEQ ID NO: 243261 - DNA, 20 bp, human
gccgggtcgggactctgagc

SEQ ID NO: 243262 - DNA, 20 bp, human
gtgcagggcccaggtgccgg

SEQ ID NO: 243263 - DNA, 20 bp, human
gggccggcggaggacagcgg

SEQ ID NO: 243264 - DNA, 20 bp, human
ggcgcggcgcaccttgctcc

SEQ ID NO: 243265 - DNA, 20 bp, human
ggagcctggaggccgtgcga

SEQ ID NO: 243266 - DNA, 20 bp, human
ggactccgggcagggaaatg

SEQ ID NO: 243267 - DNA, 20 bp, human
gcggcgagctcccggactcc

SEQ ID NO: 243268 - DNA, 20 bp, human
gagctcccggactccgggca

SEQ ID NO: 243269 - DNA, 20 bp, human
gcagcacggccgcacataag

SEQ ID NO: 243270 - DNA, 20 bp, human
ggcttcgggtctttggggtc

SEQ ID NO: 243271 - DNA, 20 bp, human
ggcagcctagcggtgggaat

SEQ ID NO: 243272 - DNA, 20 bp, human
gaaggctggtgcgcctgaac

SEQ ID NO: 243273 - DNA, 20 bp, human
gccgaagcgcagcctagcgg

SEQ ID NO: 243274 - DNA, 20 bp, human
gctcggcggcattggagcga

SEQ ID NO: 243275 - DNA, 20 bp, human
gtaagtggggaccagctcgg

SEQ ID NO: 243276 - DNA, 20 bp, human
gggaccttcgtgcccctcta

SEQ ID NO: 243277 - DNA, 20 bp, human
gccgcgccggcctcaccccg

SEQ ID NO: 243278 - DNA, 20 bp, human
gcgcggcgccagtccctaga

SEQ ID NO: 243279 - DNA, 20 bp, human
ggactggcgccgcgtccagg

SEQ ID NO: 243280 - DNA, 20 bp, human
gagtccctagaggggcacga

SEQ ID NO: 243281 - DNA, 20 bp, human
ggggccggcggccccgacgg

SEQ ID NO: 243282 - DNA, 20 bp, human
gaggctcggccacctggacg

SEQ ID NO: 243283 - DNA, 20 bp, human
gccctgctctgccgggacca

SEQ ID NO: 243284 - DNA, 20 bp, human
gggaggaggcgcctccgcgc

SEQ ID NO: 243285 - DNA, 20 bp, human
gcgcgggagccggtcccccg

SEQ ID NO: 243286 - DNA, 20 bp, human
gggtgcgatccgagacccag

SEQ ID NO: 243287 - DNA, 20 bp, human
gcttccgcccccaacgaaga

SEQ ID NO: 243288 - DNA, 20 bp, human
gccaacgccgtcagtccgcg

SEQ ID NO: 243289 - DNA, 20 bp, human
gtcttcccggggaacagcga

SEQ ID NO: 243290 - DNA, 20 bp, human
ggcaccccgcgtgcagtttt

SEQ ID NO: 243291 - DNA, 20 bp, human
gcccctccgccatcttcgtt

SEQ ID NO: 243292 - DNA, 20 bp, human
gctaccacgccgcccctgaa

SEQ ID NO: 243293 - DNA, 20 bp, human
gggcgggactaaaagggcgt

SEQ ID NO: 243294 - DNA, 20 bp, human
gccccctcgggtaacaaaca

SEQ ID NO: 243295 - DNA, 20 bp, human
gggcgcccgcgagcagactc

SEQ ID NO: 243296 - DNA, 20 bp, human
gctgcaggggtgggtcaaaa

SEQ ID NO: 243297 - DNA, 20 bp, human
gccgccgctgctgcacgggt

SEQ ID NO: 243298 - DNA, 20 bp, human
gcggcctacccgtgcagcag

SEQ ID NO: 243299 - DNA, 20 bp, human
gggggccgccgctgctgcac

SEQ ID NO: 243300 - DNA, 20 bp, human
gctggccaagaggggcgcgg

SEQ ID NO: 243301 - DNA, 20 bp, human
gtcagccacgcctcctaggg

SEQ ID NO: 243302 - DNA, 20 bp, human
gtgggtcaaaaggggtgagc

SEQ ID NO: 243303 - DNA, 20 bp, human
gcctcgcgcgggctcctgca

SEQ ID NO: 243304 - DNA, 20 bp, human
gccgtgctgccctcatgtgg

SEQ ID NO: 243305 - DNA, 20 bp, human
gaccgccctccgccacatga

SEQ ID NO: 243306 - DNA, 20 bp, human
gaccgaggccagtaccgacg

SEQ ID NO: 243307 - DNA, 20 bp, human
ggaaatagaaatgcccctac

SEQ ID NO: 243308 - DNA, 20 bp, human
gaacggttccgcagtgtggg

SEQ ID NO: 243309 - DNA, 20 bp, human
gtggagaagacaggacccaa

SEQ ID NO: 243310 - DNA, 20 bp, human
gccggttgaaacgtagaagg

SEQ ID NO: 243311 - DNA, 20 bp, human
gtaccgacgtggctttaaat

SEQ ID NO: 243312 - DNA, 20 bp, human
gtttccggttgaaacgtaga

SEQ ID NO: 243313 - DNA, 20 bp, human
gaccctgccggcaggagact

SEQ ID NO: 243314 - DNA, 20 bp, human
ggtagtctgggtagaatgtg

SEQ ID NO: 243315 - DNA, 20 bp, human
gcgtagaaggtggagaagac

SEQ ID NO: 243316 - DNA, 20 bp, human
ggaccaggaggaggtaccga

SEQ ID NO: 243317 - DNA, 20 bp, human
gcgggaccggaagtgccgaa

SEQ ID NO: 243318 - DNA, 20 bp, human
gaacgaagagggggcctcgc

SEQ ID NO: 243319 - DNA, 20 bp, human
gtgacccccgccaaagtctc

SEQ ID NO: 243320 - DNA, 20 bp, human
gagaccggccatatggaagg

SEQ ID NO: 243321 - DNA, 20 bp, human
gtctgtgggcagccccaaat

SEQ ID NO: 243322 - DNA, 20 bp, human
gtccctgtcttgaggtctaa

SEQ ID NO: 243323 - DNA, 20 bp, human
gggacccgagactttggcgg

SEQ ID NO: 243324 - DNA, 20 bp, human
gggtggcgcgcggcggaaaa

SEQ ID NO: 243325 - DNA, 20 bp, human
ggatggttgaggcgccaaaa

SEQ ID NO: 243326 - DNA, 20 bp, human
gtgactctcagcccgcgcct

SEQ ID NO: 243327 - DNA, 20 bp, human
ggggccgcgcggcgtaaggc

SEQ ID NO: 243328 - DNA, 20 bp, human
gcactgctcgagtacctgcg

SEQ ID NO: 243329 - DNA, 20 bp, human
gaccccaggagtgccaatca

SEQ ID NO: 243330 - DNA, 20 bp, human
ggagagtcagttcgccaggt

SEQ ID NO: 243331 - DNA, 20 bp, human
gtagggagagtcgatgaaga

SEQ ID NO: 243332 - DNA, 20 bp, human
gtctgcgcccagcgcaccga

SEQ ID NO: 243333 - DNA, 20 bp, human
gaagcgctgcggccacgttc

SEQ ID NO: 243334 - DNA, 20 bp, human
gactcgagcagtgggcgccc

SEQ ID NO: 243335 - DNA, 20 bp, human
gcagcagaacggctccgccc

SEQ ID NO: 243336 - DNA, 20 bp, human
ggggctctcagaagcgtgag

SEQ ID NO: 243337 - DNA, 20 bp, human
gctctcagaagcgtgagggg

SEQ ID NO: 243338 - DNA, 20 bp, human
ggaggggcggagaagatgtg

SEQ ID NO: 243339 - DNA, 20 bp, human
gtcgccgggtaaccctgctt

SEQ ID NO: 243340 - DNA, 20 bp, human
gtacccggcgaagacttccg

SEQ ID NO: 243341 - DNA, 20 bp, human
gggccccggaagtcttcgcc

SEQ ID NO: 243342 - DNA, 20 bp, human
gcggagaagatgtggggggc

SEQ ID NO: 243343 - DNA, 20 bp, human
gggggcgggacaagaccctc

SEQ ID NO: 243344 - DNA, 20 bp, human
ggacaagaccctcaggtaga

SEQ ID NO: 243345 - DNA, 20 bp, human
gcggggccgatgcgcatgcg

SEQ ID NO: 243346 - DNA, 20 bp, human
gcggacgcctgcagtcacta

SEQ ID NO: 243347 - DNA, 20 bp, human
gtgggtgtgggaaaacgccc

SEQ ID NO: 243348 - DNA, 20 bp, human
ggccgggagctctcagtccg

SEQ ID NO: 243349 - DNA, 20 bp, human
gacttccggaagaagaacgg

SEQ ID NO: 243350 - DNA, 20 bp, human
ggcaaactgagtgcgctgag

SEQ ID NO: 243351 - DNA, 20 bp, human
gcctgcagtcactatggtaa

SEQ ID NO: 243352 - DNA, 20 bp, human
gcgagcctgcgagagcaccg

SEQ ID NO: 243353 - DNA, 20 bp, human
gggcaacagtggagcgcagt

SEQ ID NO: 243354 - DNA, 20 bp, human
gacccgtcctggcgtttctg

SEQ ID NO: 243355 - DNA, 20 bp, human
gccgcccgccgttcttcttc

SEQ ID NO: 243356 - DNA, 20 bp, human
gggtacggggctagagagga

SEQ ID NO: 243357 - DNA, 20 bp, human
gtattggtacggggctagag

SEQ ID NO: 243358 - DNA, 20 bp, human
ggagacgaactattggtacg

SEQ ID NO: 243359 - DNA, 20 bp, human
gaccgcggcgactatcccat

SEQ ID NO: 243360 - DNA, 20 bp, human
gtcgctagcgcccaatagtc

SEQ ID NO: 243361 - DNA, 20 bp, human
gggtaactggaaacggaagt

SEQ ID NO: 243362 - DNA, 20 bp, human
gggcggacgcgggagtgtgt

SEQ ID NO: 243363 - DNA, 20 bp, human
ggggaagtgacgttgttgct

SEQ ID NO: 243364 - DNA, 20 bp, human
gcgccccttgtggtccggaa

SEQ ID NO: 243365 - DNA, 20 bp, human
ggggcgctgactccgaactt

SEQ ID NO: 243366 - DNA, 20 bp, human
gtaggcgagaactcggagcg

SEQ ID NO: 243367 - DNA, 20 bp, human
gataccacggggccaccgag

SEQ ID NO: 243368 - DNA, 20 bp, human
ggcccgagcacgcctctcgg

SEQ ID NO: 243369 - DNA, 20 bp, human
ggaagccgagagataccacg

SEQ ID NO: 243370 - DNA, 20 bp, human
ggccaccgagaggcgtgctc

SEQ ID NO: 243371 - DNA, 20 bp, human
gtggcacacgccaaaggctc

SEQ ID NO: 243372 - DNA, 20 bp, human
gcacacgccaaaggctccgg

SEQ ID NO: 243373 - DNA, 20 bp, human
gtcgcccccgccggagcctt

SEQ ID NO: 243374 - DNA, 20 bp, human
ggtggccccgtggtatctct

SEQ ID NO: 243375 - DNA, 20 bp, human
gaagatggcagcttccgaga

SEQ ID NO: 243376 - DNA, 20 bp, human
gtgggtaggcacacaagatc

SEQ ID NO: 243377 - DNA, 20 bp, human
gaggcacacaagatcgggct

SEQ ID NO: 243378 - DNA, 20 bp, human
gagtgcttaccaactttgag

SEQ ID NO: 243379 - DNA, 20 bp, human
gaagctcctcccctcaaagt

SEQ ID NO: 243380 - DNA, 20 bp, human
gtgttcaggctggttcacgg

SEQ ID NO: 243381 - DNA, 20 bp, human
gagggtaacctcatgtagta

SEQ ID NO: 243382 - DNA, 20 bp, human
gggggaggagcttaagctca

SEQ ID NO: 243383 - DNA, 20 bp, human
gagttggtaagcactaatta

SEQ ID NO: 243384 - DNA, 20 bp, human
ggcttaccaactttgagggg

SEQ ID NO: 243385 - DNA, 20 bp, human
gaatactctagtgttcaggc

SEQ ID NO: 243386 - DNA, 20 bp, human
ggctcggagtcctcattctt

SEQ ID NO: 243387 - DNA, 20 bp, human
gacccaatcacacgactctg

SEQ ID NO: 243388 - DNA, 20 bp, human
ggccccagagtcgtgtgatt

SEQ ID NO: 243389 - DNA, 20 bp, human
gcactcgtccagcccactga

SEQ ID NO: 243390 - DNA, 20 bp, human
ggaaaactccgtgtgctccg

SEQ ID NO: 243391 - DNA, 20 bp, human
gaaaaatgggagggagttac

SEQ ID NO: 243392 - DNA, 20 bp, human
gtgtcagtttcgccctggga

SEQ ID NO: 243393 - DNA, 20 bp, human
gtttttctcggggatttggt

SEQ ID NO: 243394 - DNA, 20 bp, human
ggggatttggtaggcgagga

SEQ ID NO: 243395 - DNA, 20 bp, human
gtccccgagaaaaaatggga

SEQ ID NO: 243396 - DNA, 20 bp, human
gagagcgagcgatagaggga

SEQ ID NO: 243397 - DNA, 20 bp, human
gaggagagagcgagcgatag

SEQ ID NO: 243398 - DNA, 20 bp, human
gaggccgttgagacctacaa

SEQ ID NO: 243399 - DNA, 20 bp, human
gtgggtcctagaaaaggaag

SEQ ID NO: 243400 - DNA, 20 bp, human
gccaccctcagtctccacct

SEQ ID NO: 243401 - DNA, 20 bp, human
gaggggctagggaagatatt

SEQ ID NO: 243402 - DNA, 20 bp, human
gtgccccttgtaggtctcaa

SEQ ID NO: 243403 - DNA, 20 bp, human
gtcccgaaaagagaatctta

SEQ ID NO: 243404 - DNA, 20 bp, human
gcccgcccacagccaccgaa

SEQ ID NO: 243405 - DNA, 20 bp, human
ggacgtttgggtcctagaaa

SEQ ID NO: 243406 - DNA, 20 bp, human
gtatgctcctccggcggtga

SEQ ID NO: 243407 - DNA, 20 bp, human
ggtagcagtgccccgctggg

SEQ ID NO: 243408 - DNA, 20 bp, human
gccgcgggctacttaataga

SEQ ID NO: 243409 - DNA, 20 bp, human
gcagcggggcactgctacta

SEQ ID NO: 243410 - DNA, 20 bp, human
gcatacttcgagcattcctt

SEQ ID NO: 243411 - DNA, 20 bp, human
ggatcgccacctcacgccga

SEQ ID NO: 243412 - DNA, 20 bp, human
ggaagggagggagcgtagag

SEQ ID NO: 243413 - DNA, 20 bp, human
gggggtgatgtatgctcctc

SEQ ID NO: 243414 - DNA, 20 bp, human
gccccaagtggcggagtacg

SEQ ID NO: 243415 - DNA, 20 bp, human
gtaagtgcacccaggacaga

SEQ ID NO: 243416 - DNA, 20 bp, human
gcaaactcgcccagggtggg

SEQ ID NO: 243417 - DNA, 20 bp, human
gcccccggggagtcggttgt

SEQ ID NO: 243418 - DNA, 20 bp, human
gccacctcccgcggggccga

SEQ ID NO: 243419 - DNA, 20 bp, human
ggcgtggtgagcaggtccgg

SEQ ID NO: 243420 - DNA, 20 bp, human
gaggtggaggaggagtgacg

SEQ ID NO: 243421 - DNA, 20 bp, human
gtccctgcggcggcacggat

SEQ ID NO: 243422 - DNA, 20 bp, human
ggacggggagcgcggcagag

SEQ ID NO: 243423 - DNA, 20 bp, human
gtaacttgacacactccctg

SEQ ID NO: 243424 - DNA, 20 bp, human
gtcccgcggggccgacggct

SEQ ID NO: 243425 - DNA, 20 bp, human
ggggagggagagattagttt

SEQ ID NO: 243426 - DNA, 20 bp, human
gggaccgccaggttcggggt

SEQ ID NO: 243427 - DNA, 20 bp, human
ggggtaggcgagcgcgtgag

SEQ ID NO: 243428 - DNA, 20 bp, human
gcgagcgcgtgagcggcacg

SEQ ID NO: 243429 - DNA, 20 bp, human
gcgctcgcctaccccgaacc

SEQ ID NO: 243430 - DNA, 20 bp, human
gcgcacctggggggaccgcc

SEQ ID NO: 243431 - DNA, 20 bp, human
gtgcgcgcggcagccggatg

SEQ ID NO: 243432 - DNA, 20 bp, human
gccccgccctaccggagatg

SEQ ID NO: 243433 - DNA, 20 bp, human
gcgaacctggcggtcccccc

SEQ ID NO: 243434 - DNA, 20 bp, human
gccaccctccgctctataat

SEQ ID NO: 243435 - DNA, 20 bp, human
gatagagcggagggtggccg

SEQ ID NO: 243436 - DNA, 20 bp, human
ggcgagcgcacgtccgtcga

SEQ ID NO: 243437 - DNA, 20 bp, human
gcccgacaggacagacttaa

SEQ ID NO: 243438 - DNA, 20 bp, human
ggctgcgcactcacgcccgg

SEQ ID NO: 243439 - DNA, 20 bp, human
gcgtccgtcgagggggaaag

SEQ ID NO: 243440 - DNA, 20 bp, human
gcctctgctgcctccacccg

SEQ ID NO: 243441 - DNA, 20 bp, human
ggacagacttaagggcggga

SEQ ID NO: 243442 - DNA, 20 bp, human
gggcgcggggctttcctcgc

SEQ ID NO: 243443 - DNA, 20 bp, human
gggggcggccggtatccccc

SEQ ID NO: 243444 - DNA, 20 bp, human
gcccgcgcccgcgttcgttg

SEQ ID NO: 243445 - DNA, 20 bp, human
gtcgttggggcaagcgggat

SEQ ID NO: 243446 - DNA, 20 bp, human
gaccagaggcggctagactg

SEQ ID NO: 243447 - DNA, 20 bp, human
gactgccggccactccgggt

SEQ ID NO: 243448 - DNA, 20 bp, human
gggcctgccagggacactaa

SEQ ID NO: 243449 - DNA, 20 bp, human
gtgggagctcggccagaccc

SEQ ID NO: 243450 - DNA, 20 bp, human
gccgcaggagcccccttcca

SEQ ID NO: 243451 - DNA, 20 bp, human
gtgccgctggagccccctct

SEQ ID NO: 243452 - DNA, 20 bp, human
ggggcagctctgggcacgta

SEQ ID NO: 243453 - DNA, 20 bp, human
gcagctggaccggcccgcca

SEQ ID NO: 243454 - DNA, 20 bp, human
gccaccccgcagccttctgg

SEQ ID NO: 243455 - DNA, 20 bp, human
ggacactaatggaacacagc

SEQ ID NO: 243456 - DNA, 20 bp, human
gtcctgacaaaggtgtgtca

SEQ ID NO: 243457 - DNA, 20 bp, human
gccagcaagtgtcagataat

SEQ ID NO: 243458 - DNA, 20 bp, human
gcatggggaaaaggaaacaa

SEQ ID NO: 243459 - DNA, 20 bp, human
gtacccttcctcagtgccat

SEQ ID NO: 243460 - DNA, 20 bp, human
ggactcatgaatcatgcagt

SEQ ID NO: 243461 - DNA, 20 bp, human
gaaacaaaggaccagcataa

SEQ ID NO: 243462 - DNA, 20 bp, human
gcatggtctaggcacatgga

SEQ ID NO: 243463 - DNA, 20 bp, human
gagtgggattccagtaccca

SEQ ID NO: 243464 - DNA, 20 bp, human
gtgtcagataattggaaggg

SEQ ID NO: 243465 - DNA, 20 bp, human
gttaatctacctaagctgga

SEQ ID NO: 243466 - DNA, 20 bp, human
gtgtgtggtggtatctgctg

SEQ ID NO: 243467 - DNA, 20 bp, human
gtctgtggaaccattccggg

SEQ ID NO: 243468 - DNA, 20 bp, human
ggtggaagacagccggccag

SEQ ID NO: 243469 - DNA, 20 bp, human
gcgggctctcggcagaagtg

SEQ ID NO: 243470 - DNA, 20 bp, human
ggagcctagcggagcacgtt

SEQ ID NO: 243471 - DNA, 20 bp, human
ggagagcccggacgcgccag

SEQ ID NO: 243472 - DNA, 20 bp, human
gtgggaagcctgcacagggg

SEQ ID NO: 243473 - DNA, 20 bp, human
ggctgtgtgcagtgtccaca

SEQ ID NO: 243474 - DNA, 20 bp, human
gtccagccgcactgccccga

SEQ ID NO: 243475 - DNA, 20 bp, human
gcccactgagagcttggcca

SEQ ID NO: 243476 - DNA, 20 bp, human
gactcagccaactcaggcac

SEQ ID NO: 243477 - DNA, 20 bp, human
gtcacagataaaatgacggt

SEQ ID NO: 243478 - DNA, 20 bp, human
ggacagaggactctgcaaga

SEQ ID NO: 243479 - DNA, 20 bp, human
gtcccactccgcgaggacag

SEQ ID NO: 243480 - DNA, 20 bp, human
gacactgggagagactaata

SEQ ID NO: 243481 - DNA, 20 bp, human
gtcctctgtcctcgcggagt

SEQ ID NO: 243482 - DNA, 20 bp, human
ggcagagtcctctgtcctcg

SEQ ID NO: 243483 - DNA, 20 bp, human
ggctgggagtaatgcctttc

SEQ ID NO: 243484 - DNA, 20 bp, human
ggtgaccctcccactccgcg

SEQ ID NO: 243485 - DNA, 20 bp, human
gacgttcacgagtaggtaat

SEQ ID NO: 243486 - DNA, 20 bp, human
gctgcgaagaggggagatgt

SEQ ID NO: 243487 - DNA, 20 bp, human
ggggaggcagagctgcgaag

SEQ ID NO: 243488 - DNA, 20 bp, human
gcggcccccaatttgggagt

SEQ ID NO: 243489 - DNA, 20 bp, human
ggaaccctgcccctcggaga

SEQ ID NO: 243490 - DNA, 20 bp, human
ggggccagaggtgctgtggt

SEQ ID NO: 243491 - DNA, 20 bp, human
gcgggccaggcagctctgat

SEQ ID NO: 243492 - DNA, 20 bp, human
gtgggctaaccagtgggtag

SEQ ID NO: 243493 - DNA, 20 bp, human
gtgggtcctcagaatggcgt

SEQ ID NO: 243494 - DNA, 20 bp, human
ggccggctccccctctccga

SEQ ID NO: 243495 - DNA, 20 bp, human
gtgggtggggagacttccaa

SEQ ID NO: 243496 - DNA, 20 bp, human
gagggcctccaccaatggga

SEQ ID NO: 243497 - DNA, 20 bp, human
ggcagaggagggagcgaatg

SEQ ID NO: 243498 - DNA, 20 bp, human
ggggaagggacgtggccacg

SEQ ID NO: 243499 - DNA, 20 bp, human
gggagggcgggaggatgcgg

SEQ ID NO: 243500 - DNA, 20 bp, human
gtgctctgcagccccgacat

SEQ ID NO: 243501 - DNA, 20 bp, human
gtggaggcaccctagggcca

SEQ ID NO: 243502 - DNA, 20 bp, human
gcaaaagggcctccaccaat

SEQ ID NO: 243503 - DNA, 20 bp, human
gcctgcgggggcgcagagga

SEQ ID NO: 243504 - DNA, 20 bp, human
gccagccctcccattggtgg

SEQ ID NO: 243505 - DNA, 20 bp, human
ggccctgtaggccacttgta

SEQ ID NO: 243506 - DNA, 20 bp, human
gccggggcggcagacaggaa

SEQ ID NO: 243507 - DNA, 20 bp, human
gaggaagggtggagggcaaa

SEQ ID NO: 243508 - DNA, 20 bp, human
ggggtccatcctgcaaggag

SEQ ID NO: 243509 - DNA, 20 bp, human
ggctggggcagtgacttctg

SEQ ID NO: 243510 - DNA, 20 bp, human
gcttggagagatgcccgggg

SEQ ID NO: 243511 - DNA, 20 bp, human
gcagggtcccaccagtgagg

SEQ ID NO: 243512 - DNA, 20 bp, human
gagagaggcaggccgagggg

SEQ ID NO: 243513 - DNA, 20 bp, human
ggcagcctgctccccacagt

SEQ ID NO: 243514 - DNA, 20 bp, human
gccgggcatctctccaagaa

SEQ ID NO: 243515 - DNA, 20 bp, human
gcttgcaggatggaccctct

SEQ ID NO: 243516 - DNA, 20 bp, human
gcgaactgctagtgtcgccc

SEQ ID NO: 243517 - DNA, 20 bp, human
gaggcggagcccgggagata

SEQ ID NO: 243518 - DNA, 20 bp, human
gctaaaggaggcaaagactt

SEQ ID NO: 243519 - DNA, 20 bp, human
gggtcttcggccaaggaaag

SEQ ID NO: 243520 - DNA, 20 bp, human
gagcgcgaaccttatctccc

SEQ ID NO: 243521 - DNA, 20 bp, human
gcccgggctccgcctccagg

SEQ ID NO: 243522 - DNA, 20 bp, human
gagaacggactccgggcgga

SEQ ID NO: 243523 - DNA, 20 bp, human
gtccttggccgaagaccaga

SEQ ID NO: 243524 - DNA, 20 bp, human
gactgctagtgtcgccctgg

SEQ ID NO: 243525 - DNA, 20 bp, human
gtgaactgagtgtttccacc

SEQ ID NO: 243526 - DNA, 20 bp, human
gaggccccggacagtggcga

SEQ ID NO: 243527 - DNA, 20 bp, human
gccactgtccggggcctcgt

SEQ ID NO: 243528 - DNA, 20 bp, human
gaccccagagaaaacgagag

SEQ ID NO: 243529 - DNA, 20 bp, human
gagcccctcgccactgtccg

SEQ ID NO: 243530 - DNA, 20 bp, human
gtaggagctcggggcgggag

SEQ ID NO: 243531 - DNA, 20 bp, human
gggggcgggcctaggagctc

SEQ ID NO: 243532 - DNA, 20 bp, human
ggtgggcagggacctcggga

SEQ ID NO: 243533 - DNA, 20 bp, human
ggccctgggaagcccaaaag

SEQ ID NO: 243534 - DNA, 20 bp, human
gaaaacgagagaggccgacg

SEQ ID NO: 243535 - DNA, 20 bp, human
gcggcctctctcgttttctc

SEQ ID NO: 243536 - DNA, 20 bp, human
gcggcgcccgggctaggtga

SEQ ID NO: 243537 - DNA, 20 bp, human
gtcagcccggcgccgacggg

SEQ ID NO: 243538 - DNA, 20 bp, human
gggctcccctccgacctctg

SEQ ID NO: 243539 - DNA, 20 bp, human
gtggaccccagaggtcggag

SEQ ID NO: 243540 - DNA, 20 bp, human
gggctggccccgcgcggcga

SEQ ID NO: 243541 - DNA, 20 bp, human
gggagccacccgtcggcgcc

SEQ ID NO: 243542 - DNA, 20 bp, human
ggctgcgcgtgggatcagcc

SEQ ID NO: 243543 - DNA, 20 bp, human
ggaggaaggagcgagctcct

SEQ ID NO: 243544 - DNA, 20 bp, human
gggagcagggacccacccag

SEQ ID NO: 243545 - DNA, 20 bp, human
ggggtccacagtgcgggctt

SEQ ID NO: 243546 - DNA, 20 bp, human
gtggcccagcccgaccccga

SEQ ID NO: 243547 - DNA, 20 bp, human
gtgggccggacgctgggtcg

SEQ ID NO: 243548 - DNA, 20 bp, human
gttcgccagcccttcggggt

SEQ ID NO: 243549 - DNA, 20 bp, human
gcccgaagggctggcgaacg

SEQ ID NO: 243550 - DNA, 20 bp, human
gaaatcaagtcggtgcgagg

SEQ ID NO: 243551 - DNA, 20 bp, human
gcatccgggtcgtacccagg

SEQ ID NO: 243552 - DNA, 20 bp, human
gaaggttgcgggggcagagg

SEQ ID NO: 243553 - DNA, 20 bp, human
gcctccgcctgggtacgacc

SEQ ID NO: 243554 - DNA, 20 bp, human
ggtagggaaggagatgaagt

SEQ ID NO: 243555 - DNA, 20 bp, human
gaagtgggggaggaagtcct

SEQ ID NO: 243556 - DNA, 20 bp, human
gcggcccggggaacccccaa

SEQ ID NO: 243557 - DNA, 20 bp, human
ggggcgcgcagcagcgggag

SEQ ID NO: 243558 - DNA, 20 bp, human
gcggcccgcgggctgggcca

SEQ ID NO: 243559 - DNA, 20 bp, human
gggctcctctccaatcacgg

SEQ ID NO: 243560 - DNA, 20 bp, human
gggaggcgggaagcttgggt

SEQ ID NO: 243561 - DNA, 20 bp, human
gctggagcggccaccgtgat

SEQ ID NO: 243562 - DNA, 20 bp, human
gttactccgcgcagggggag

SEQ ID NO: 243563 - DNA, 20 bp, human
gctgcgcgccccccttccga

SEQ ID NO: 243564 - DNA, 20 bp, human
gtcctgctttgccttcggaa

SEQ ID NO: 243565 - DNA, 20 bp, human
gtcaccttggcccagcccgc

SEQ ID NO: 243566 - DNA, 20 bp, human
ggttctaaggtgtgtagcgg

SEQ ID NO: 243567 - DNA, 20 bp, human
gggcgctccgaaagcattcg

SEQ ID NO: 243568 - DNA, 20 bp, human
gggcagtggcggcagagcta

SEQ ID NO: 243569 - DNA, 20 bp, human
gcgcggacccgaagaaggtt

SEQ ID NO: 243570 - DNA, 20 bp, human
gagggtgcgagctccgcagg

SEQ ID NO: 243571 - DNA, 20 bp, human
gggcgcgaggtctggctttc

SEQ ID NO: 243572 - DNA, 20 bp, human
gaggggcggaagggtcagtt

SEQ ID NO: 243573 - DNA, 20 bp, human
gtgaaaaggcggccccggag

SEQ ID NO: 243574 - DNA, 20 bp, human
ggggaccatcgagggcagtg

SEQ ID NO: 243575 - DNA, 20 bp, human
gttcggggtgttaggctcca

SEQ ID NO: 243576 - DNA, 20 bp, human
ggtcccatcggggctgtagt

SEQ ID NO: 243577 - DNA, 20 bp, human
gtggcccactacagccccga

SEQ ID NO: 243578 - DNA, 20 bp, human
ggggggcgggtgtcccatcg

SEQ ID NO: 243579 - DNA, 20 bp, human
gtatacaaggaggagggggg

SEQ ID NO: 243580 - DNA, 20 bp, human
gccctgccggccggagccaa

SEQ ID NO: 243581 - DNA, 20 bp, human
gccagctgaggctgtaccct

SEQ ID NO: 243582 - DNA, 20 bp, human
gggctgtagtgggccagctg

SEQ ID NO: 243583 - DNA, 20 bp, human
ggaaggtggagagccaccgc

SEQ ID NO: 243584 - DNA, 20 bp, human
gccaccctatatgttctcca

SEQ ID NO: 243585 - DNA, 20 bp, human
gttaaagtctcggcccgcgg

SEQ ID NO: 243586 - DNA, 20 bp, human
ggggatgtgctctaagatac

SEQ ID NO: 243587 - DNA, 20 bp, human
gttggccagggtgcaagatc

SEQ ID NO: 243588 - DNA, 20 bp, human
gggatcagtaagcaatttaa

SEQ ID NO: 243589 - DNA, 20 bp, human
gaacacagtctcattctgaa

SEQ ID NO: 243590 - DNA, 20 bp, human
gccacccagatcttgcaccc

SEQ ID NO: 243591 - DNA, 20 bp, human
gaagcccccataaaagttag

SEQ ID NO: 243592 - DNA, 20 bp, human
ggttctgcccctaactttta

SEQ ID NO: 243593 - DNA, 20 bp, human
gatcttagagcacatccccc

SEQ ID NO: 243594 - DNA, 20 bp, human
gctgcccctaacttttatgg

SEQ ID NO: 243595 - DNA, 20 bp, human
gctttctacattttaggcat

SEQ ID NO: 243596 - DNA, 20 bp, human
gccgcagccccgggtttggg

SEQ ID NO: 243597 - DNA, 20 bp, human
gccactcggcgcactagggg

SEQ ID NO: 243598 - DNA, 20 bp, human
gaggccactcggcgcactag

SEQ ID NO: 243599 - DNA, 20 bp, human
gcaagccggacccccctctc

SEQ ID NO: 243600 - DNA, 20 bp, human
gtcggcgcactaggggtgga

SEQ ID NO: 243601 - DNA, 20 bp, human
ggaagcgtgactcccagaga

SEQ ID NO: 243602 - DNA, 20 bp, human
gactcccagagaggggggtc

SEQ ID NO: 243603 - DNA, 20 bp, human
gccttcccgcctgtggtcag

SEQ ID NO: 243604 - DNA, 20 bp, human
gcccctgccccccaaacccg

SEQ ID NO: 243605 - DNA, 20 bp, human
gtgcgccgagtggcctgatc

SEQ ID NO: 243606 - DNA, 20 bp, human
gggctctcatatttcagaaa

SEQ ID NO: 243607 - DNA, 20 bp, human
gcagttgttaacttcataag

SEQ ID NO: 243608 - DNA, 20 bp, human
ggtgggttgtgtcttctata

SEQ ID NO: 243609 - DNA, 20 bp, human
gaacttctaggacccagggt

SEQ ID NO: 243610 - DNA, 20 bp, human
ggggtgggtggatgagtcga

SEQ ID NO: 243611 - DNA, 20 bp, human
ggagtcgaaggggcatacgg

SEQ ID NO: 243612 - DNA, 20 bp, human
ggatgagtcgaaggggcata

SEQ ID NO: 243613 - DNA, 20 bp, human
ggtcctagaagttaagtttc

SEQ ID NO: 243614 - DNA, 20 bp, human
gtcatatttcagaaaggggc

SEQ ID NO: 243615 - DNA, 20 bp, human
gctcctatttaaattgagtt

SEQ ID NO: 243616 - DNA, 20 bp, human
gggcgcgaggggttgggacg

SEQ ID NO: 243617 - DNA, 20 bp, human
gaccctgcggcgcgggtaag

SEQ ID NO: 243618 - DNA, 20 bp, human
gagcgcgcggcccgggagtg

SEQ ID NO: 243619 - DNA, 20 bp, human
gcgcactgcagccacactcc

SEQ ID NO: 243620 - DNA, 20 bp, human
gagtgtggctgcagtgcgcc

SEQ ID NO: 243621 - DNA, 20 bp, human
gcgcgaacgcgcgggcgcga

SEQ ID NO: 243622 - DNA, 20 bp, human
gtccgcgctccgcactcaag

SEQ ID NO: 243623 - DNA, 20 bp, human
gcgcgcgggcgcgaggggtt

SEQ ID NO: 243624 - DNA, 20 bp, human
gcgcgggcggcgcctcaaag

SEQ ID NO: 243625 - DNA, 20 bp, human
ggctgcacgctctcctgctt

SEQ ID NO: 243626 - DNA, 20 bp, human
gggagccgccgcacccggga

SEQ ID NO: 243627 - DNA, 20 bp, human
gcgggtgcggcggctccaag

SEQ ID NO: 243628 - DNA, 20 bp, human
gcggacagctagctctcgga

SEQ ID NO: 243629 - DNA, 20 bp, human
gccccatggtggcgcgcccg

SEQ ID NO: 243630 - DNA, 20 bp, human
gaccctgcggcgcgggtaag

SEQ ID NO: 243631 - DNA, 20 bp, human
gtcgtggagcagaagggcgg

SEQ ID NO: 243632 - DNA, 20 bp, human
gccagcgctacgcaccgtcc

SEQ ID NO: 243633 - DNA, 20 bp, human
gacggctgcccggcgtgcgg

SEQ ID NO: 243634 - DNA, 20 bp, human
ggcggcggacagctagctct

SEQ ID NO: 243635 - DNA, 20 bp, human
gggcccggctgtgctcctcg

SEQ ID NO: 243636 - DNA, 20 bp, human
ggtgcccaggaggcgagaaa

SEQ ID NO: 243637 - DNA, 20 bp, human
gctacccgggcatcgtgccc

SEQ ID NO: 243638 - DNA, 20 bp, human
ggcacgatgcccgggtagaa

SEQ ID NO: 243639 - DNA, 20 bp, human
ggggacactgcctggtaagt

SEQ ID NO: 243640 - DNA, 20 bp, human
ggggcgcctgaggggcaggt

SEQ ID NO: 243641 - DNA, 20 bp, human
gactgcctggtaagttggga

SEQ ID NO: 243642 - DNA, 20 bp, human
ggatccagggtaaggggtta

SEQ ID NO: 243643 - DNA, 20 bp, human
gccctccctcccaacttacc

SEQ ID NO: 243644 - DNA, 20 bp, human
gtggggaggtggctgcgcgg

SEQ ID NO: 243645 - DNA, 20 bp, human
gcctcctgggcacgatgccc

SEQ ID NO: 243646 - DNA, 20 bp, human
gagagccggaggtagggttc

SEQ ID NO: 243647 - DNA, 20 bp, human
gtgacgacgggtagaaaagc

SEQ ID NO: 243648 - DNA, 20 bp, human
gttcgggaggaggatcccga

SEQ ID NO: 243649 - DNA, 20 bp, human
gcgtcacccgggagagccgg

SEQ ID NO: 243650 - DNA, 20 bp, human
gcccgggagagccggaggta

SEQ ID NO: 243651 - DNA, 20 bp, human
gtcctcccgaaccctacctc

SEQ ID NO: 243652 - DNA, 20 bp, human
ggaggaggatcccgaaggct

SEQ ID NO: 243653 - DNA, 20 bp, human
gaccctacctccggctctcc

SEQ ID NO: 243654 - DNA, 20 bp, human
ggggagtagtgggggagaat

SEQ ID NO: 243655 - DNA, 20 bp, human
ggaaaggagagggcggggta

SEQ ID NO: 243656 - DNA, 20 bp, human
ggtgcccaggaggcgagaaa

SEQ ID NO: 243657 - DNA, 20 bp, human
gctacccgggcatcgtgccc

SEQ ID NO: 243658 - DNA, 20 bp, human
gggaagtggggtgcggtcgg

SEQ ID NO: 243659 - DNA, 20 bp, human
ggatccagggtaaggggtta

SEQ ID NO: 243660 - DNA, 20 bp, human
ggggcgcctgaggggcaggt

SEQ ID NO: 243661 - DNA, 20 bp, human
gtggggaggtggctgcgcgg

SEQ ID NO: 243662 - DNA, 20 bp, human
gcggccctgcccagattaag

SEQ ID NO: 243663 - DNA, 20 bp, human
gtgggcgcggatccagggta

SEQ ID NO: 243664 - DNA, 20 bp, human
gaaagggctgggcgcctgag

SEQ ID NO: 243665 - DNA, 20 bp, human
gagggtccccggactcgccc

SEQ ID NO: 243666 - DNA, 20 bp, human
gagtgacgctcagttatttg

SEQ ID NO: 243667 - DNA, 20 bp, human
gactgcaccggcaacctgcg

SEQ ID NO: 243668 - DNA, 20 bp, human
ggtacgcacaccaatgagat

SEQ ID NO: 243669 - DNA, 20 bp, human
gtcactccctcgcaggttgc

SEQ ID NO: 243670 - DNA, 20 bp, human
gccggtgcagtctaaaactg

SEQ ID NO: 243671 - DNA, 20 bp, human
gggtgctcagtcaactagtc

SEQ ID NO: 243672 - DNA, 20 bp, human
ggtgcagtctaaaactgtgg

SEQ ID NO: 243673 - DNA, 20 bp, human
ggagcaccatgagtccaacc

SEQ ID NO: 243674 - DNA, 20 bp, human
gcctagaaaagtagtatcaa

SEQ ID NO: 243675 - DNA, 20 bp, human
gtcccttgtgctggtgagga

SEQ ID NO: 243676 - DNA, 20 bp, human
gtagcgtataggtctctaag

SEQ ID NO: 243677 - DNA, 20 bp, human
ggggcccatctgtcttatgt

SEQ ID NO: 243678 - DNA, 20 bp, human
gtaccggctgcccaaggtag

SEQ ID NO: 243679 - DNA, 20 bp, human
gtgcttaggtcttagcgtat

SEQ ID NO: 243680 - DNA, 20 bp, human
gtacactaggctattgggaa

SEQ ID NO: 243681 - DNA, 20 bp, human
ggaagctgtggagatactta

SEQ ID NO: 243682 - DNA, 20 bp, human
gttagggctgttgtgtggaa

SEQ ID NO: 243683 - DNA, 20 bp, human
gaaagactaccggctgccca

SEQ ID NO: 243684 - DNA, 20 bp, human
gcaatcatcccccctacctt

SEQ ID NO: 243685 - DNA, 20 bp, human
gggtagtctttctcactttc

SEQ ID NO: 243686 - DNA, 20 bp, human
ggtacgcacaccaatgagat

SEQ ID NO: 243687 - DNA, 20 bp, human
gagtgacgctcagttatttg

SEQ ID NO: 243688 - DNA, 20 bp, human
gactgcaccggcaacctgcg

SEQ ID NO: 243689 - DNA, 20 bp, human
gccggtgcagtctaaaactg

SEQ ID NO: 243690 - DNA, 20 bp, human
gtcactccctcgcaggttgc

SEQ ID NO: 243691 - DNA, 20 bp, human
ggtgcagtctaaaactgtgg

SEQ ID NO: 243692 - DNA, 20 bp, human
gcctagaaaagtagtatcaa

SEQ ID NO: 243693 - DNA, 20 bp, human
ggggaggaaagtagatctgt

SEQ ID NO: 243694 - DNA, 20 bp, human
gtcccttgtgctggtgagga

SEQ ID NO: 243695 - DNA, 20 bp, human
ggagcaccatgagtccaacc

SEQ ID NO: 243696 - DNA, 20 bp, human
ggggcgagtcgcagcgagga

SEQ ID NO: 243697 - DNA, 20 bp, human
gccggggcggagcggacgtg

SEQ ID NO: 243698 - DNA, 20 bp, human
gctcgcccgcggcgcccagt

SEQ ID NO: 243699 - DNA, 20 bp, human
gcccaggcccgcccgcctac

SEQ ID NO: 243700 - DNA, 20 bp, human
gtggggatcgacagcctccg

SEQ ID NO: 243701 - DNA, 20 bp, human
gcggctgccttccaggagag

SEQ ID NO: 243702 - DNA, 20 bp, human
gcccgcagcaaatcagagcc

SEQ ID NO: 243703 - DNA, 20 bp, human
gcaaatcagagcccggcgct

SEQ ID NO: 243704 - DNA, 20 bp, human
gagagtgcggacctcgcctt

SEQ ID NO: 243705 - DNA, 20 bp, human
ggcctcccactgggcgccgc

SEQ ID NO: 243706 - DNA, 20 bp, human
gcaagcaacggtctgattga

SEQ ID NO: 243707 - DNA, 20 bp, human
gagagacgcgtgttctgatt

SEQ ID NO: 243708 - DNA, 20 bp, human
gaagttaaagggtgtgtgtc

SEQ ID NO: 243709 - DNA, 20 bp, human
gtaacttttaagcatagatg

SEQ ID NO: 243710 - DNA, 20 bp, human
gctggggggaagggttaggg

SEQ ID NO: 243711 - DNA, 20 bp, human
gaatgaaatagggaaagttc

SEQ ID NO: 243712 - DNA, 20 bp, human
gaccgttgcttggcagacac

SEQ ID NO: 243713 - DNA, 20 bp, human
ggcctgaacaagctgaaaag

SEQ ID NO: 243714 - DNA, 20 bp, human
gggggcaggaaaagaagtgg

SEQ ID NO: 243715 - DNA, 20 bp, human
gtctaaatgtaaaaaaacta

SEQ ID NO: 243716 - DNA, 20 bp, human
gctggaaccctcgaactcta

SEQ ID NO: 243717 - DNA, 20 bp, human
ggcacctcctcctaattcta

SEQ ID NO: 243718 - DNA, 20 bp, human
ggaggctgaagtcttgaatg

SEQ ID NO: 243719 - DNA, 20 bp, human
gacaacccagctcctggcgc

SEQ ID NO: 243720 - DNA, 20 bp, human
gacagctggactgggaagtt

SEQ ID NO: 243721 - DNA, 20 bp, human
gggagcgctgacagctggac

SEQ ID NO: 243722 - DNA, 20 bp, human
gtctcctccacagtggggtg

SEQ ID NO: 243723 - DNA, 20 bp, human
gaaaaggtttggggtaagac

SEQ ID NO: 243724 - DNA, 20 bp, human
ggggatctgctaggcggaaa

SEQ ID NO: 243725 - DNA, 20 bp, human
gaccctcgaactctagggct

SEQ ID NO: 243726 - DNA, 20 bp, human
ggggagagaccccagcaagg

SEQ ID NO: 243727 - DNA, 20 bp, human
ggcaaggaggtggtgactca

SEQ ID NO: 243728 - DNA, 20 bp, human
gagggaaaccgccttctccc

SEQ ID NO: 243729 - DNA, 20 bp, human
gcgtcccgcatggagacgtc

SEQ ID NO: 243730 - DNA, 20 bp, human
ggggtctctccctccagaac

SEQ ID NO: 243731 - DNA, 20 bp, human
gggccgcggcgagccagcca

SEQ ID NO: 243732 - DNA, 20 bp, human
gaaaaccagcgtgtcaccca

SEQ ID NO: 243733 - DNA, 20 bp, human
gagaaggcggtttccctggc

SEQ ID NO: 243734 - DNA, 20 bp, human
gtcggagctgctgccggttc

SEQ ID NO: 243735 - DNA, 20 bp, human
ggacacgggaactgaactgc

SEQ ID NO: 243736 - DNA, 20 bp, human
ggggaagcggggaccctcga

SEQ ID NO: 243737 - DNA, 20 bp, human
gggggccgggggcacgggag

SEQ ID NO: 243738 - DNA, 20 bp, human
gaagcggggaccctcgaggg

SEQ ID NO: 243739 - DNA, 20 bp, human
ggcggggcggggtataaagg

SEQ ID NO: 243740 - DNA, 20 bp, human
gaggcgctcacctggtcccg

SEQ ID NO: 243741 - DNA, 20 bp, human
gccggcggggcggggtataa

SEQ ID NO: 243742 - DNA, 20 bp, human
gcgggcgccgagtaagcagc

SEQ ID NO: 243743 - DNA, 20 bp, human
gtctgcgagcggttcgggtc

SEQ ID NO: 243744 - DNA, 20 bp, human
gccgcagcgcttcctggcgg

SEQ ID NO: 243745 - DNA, 20 bp, human
gttcccggacgacctggctg

SEQ ID NO: 243746 - DNA, 20 bp, human
ggggtgaagacagaattcag

SEQ ID NO: 243747 - DNA, 20 bp, human
ggggccagggataccagtca

SEQ ID NO: 243748 - DNA, 20 bp, human
gagggtgacatcagcctgag

SEQ ID NO: 243749 - DNA, 20 bp, human
ggtgacatcagcctgagcgg

SEQ ID NO: 243750 - DNA, 20 bp, human
ggaaacagagtggaggagtc

SEQ ID NO: 243751 - DNA, 20 bp, human
gagcccaaaaggtgacgagt

SEQ ID NO: 243752 - DNA, 20 bp, human
ggtccagctaaacgcttgta

SEQ ID NO: 243753 - DNA, 20 bp, human
ggccaagggcccagcccaaa

SEQ ID NO: 243754 - DNA, 20 bp, human
gtttcttctggcccccgctc

SEQ ID NO: 243755 - DNA, 20 bp, human
gagctggaggaagccctgac

SEQ ID NO: 243756 - DNA, 20 bp, human
gcctccttgggcattttcgt

SEQ ID NO: 243757 - DNA, 20 bp, human
gcaaggaggagcaaagtcct

SEQ ID NO: 243758 - DNA, 20 bp, human
ggaggctgcctctgagaaat

SEQ ID NO: 243759 - DNA, 20 bp, human
gacttctactacttagacag

SEQ ID NO: 243760 - DNA, 20 bp, human
gagacagaggaatcgccatt

SEQ ID NO: 243761 - DNA, 20 bp, human
gaagtcccccaatttctcag

SEQ ID NO: 243762 - DNA, 20 bp, human
gccggctgccaaatgaactt

SEQ ID NO: 243763 - DNA, 20 bp, human
gcttgggcattttcgttggg

SEQ ID NO: 243764 - DNA, 20 bp, human
gagtagaagtgaccgcagct

SEQ ID NO: 243765 - DNA, 20 bp, human
gctgctgcctctagcatcag

SEQ ID NO: 243766 - DNA, 20 bp, human
gctaacctgtaaaagtgtaa

SEQ ID NO: 243767 - DNA, 20 bp, human
gtgaacccttacacttttac

SEQ ID NO: 243768 - DNA, 20 bp, human
gacaacaagaggaatcaaaa

SEQ ID NO: 243769 - DNA, 20 bp, human
gatatccctaaagtacactg

SEQ ID NO: 243770 - DNA, 20 bp, human
gtgatttatatttctaaaaa

SEQ ID NO: 243771 - DNA, 20 bp, human
gcataaatgaataaagaaag

SEQ ID NO: 243772 - DNA, 20 bp, human
gacaccaagcaagatctcaa

SEQ ID NO: 243773 - DNA, 20 bp, human
gatcacaaaggactcatcta

SEQ ID NO: 243774 - DNA, 20 bp, human
gcatttccacagtgtacttt

SEQ ID NO: 243775 - DNA, 20 bp, human
gagaaaaaaataaatcacaa

SEQ ID NO: 243776 - DNA, 20 bp, human
gttcccagaaggttctgcat

SEQ ID NO: 243777 - DNA, 20 bp, human
gtgcccatgcagaaccttct

SEQ ID NO: 243778 - DNA, 20 bp, human
gggcgggacccatggcctga

SEQ ID NO: 243779 - DNA, 20 bp, human
gcagcagcgccgtggggggt

SEQ ID NO: 243780 - DNA, 20 bp, human
gtgggcacccccactggatt

SEQ ID NO: 243781 - DNA, 20 bp, human
gctctcagggatatgggtga

SEQ ID NO: 243782 - DNA, 20 bp, human
gtgaccttagatggagttag

SEQ ID NO: 243783 - DNA, 20 bp, human
gctgcatgggcagatgctga

SEQ ID NO: 243784 - DNA, 20 bp, human
gtaaaccccccgaccccccg

SEQ ID NO: 243785 - DNA, 20 bp, human
ggagtggccggcgggaccca

SEQ ID NO: 243786 - DNA, 20 bp, human
ggggagcgcggtcacaacgg

SEQ ID NO: 243787 - DNA, 20 bp, human
gaggcggaggagagacgacg

SEQ ID NO: 243788 - DNA, 20 bp, human
gagggggagcgcggtcacaa

SEQ ID NO: 243789 - DNA, 20 bp, human
gcggaggagagacgacgggg

SEQ ID NO: 243790 - DNA, 20 bp, human
gaggagagacgacggggcgg

SEQ ID NO: 243791 - DNA, 20 bp, human
ggcgcggtcacaacggagga

SEQ ID NO: 243792 - DNA, 20 bp, human
ggggaactagaaatagtgaa

SEQ ID NO: 243793 - DNA, 20 bp, human
ggctgctcctcatagtaggt

SEQ ID NO: 243794 - DNA, 20 bp, human
gcacagatggggaaaggtgg

SEQ ID NO: 243795 - DNA, 20 bp, human
gagctggacactcttctctg

SEQ ID NO: 243796 - DNA, 20 bp, human
gcgcccagcgcggactcgga

SEQ ID NO: 243797 - DNA, 20 bp, human
gcaggcaggtggcccctcga

SEQ ID NO: 243798 - DNA, 20 bp, human
gtcggcgtgggtgtcgggga

SEQ ID NO: 243799 - DNA, 20 bp, human
ggggctcggcgtgggtgtcg

SEQ ID NO: 243800 - DNA, 20 bp, human
gcaggtggacggggagggat

SEQ ID NO: 243801 - DNA, 20 bp, human
ggagccgcgggtcaggtgga

SEQ ID NO: 243802 - DNA, 20 bp, human
gtgtggagggggctcggcgt

SEQ ID NO: 243803 - DNA, 20 bp, human
gcagccgcgtccgtccccac

SEQ ID NO: 243804 - DNA, 20 bp, human
gccgggagcgcgtgtgtgga

SEQ ID NO: 243805 - DNA, 20 bp, human
gctgcctgtggggacggacg

SEQ ID NO: 243806 - DNA, 20 bp, human
ggccacccgggaagtctccg

SEQ ID NO: 243807 - DNA, 20 bp, human
gcctgtgcggcggcagggaa

SEQ ID NO: 243808 - DNA, 20 bp, human
gtcctcggagacttcccggg

SEQ ID NO: 243809 - DNA, 20 bp, human
gagcactggcacaggccacc

SEQ ID NO: 243810 - DNA, 20 bp, human
gtactggccagcactggcac

SEQ ID NO: 243811 - DNA, 20 bp, human
gccctgccgccgcacaggcg

SEQ ID NO: 243812 - DNA, 20 bp, human
ggacagccagaagctgcact

SEQ ID NO: 243813 - DNA, 20 bp, human
gccggagagggtcctgggat

SEQ ID NO: 243814 - DNA, 20 bp, human
gtcagtcctcgcctgtgcgg

SEQ ID NO: 243815 - DNA, 20 bp, human
ggctggggaggtggcaagat

SEQ ID NO: 243816 - DNA, 20 bp, human
gggcacaggctgtgcgtcag

SEQ ID NO: 243817 - DNA, 20 bp, human
gtgtcctcgaggggcgaccg

SEQ ID NO: 243818 - DNA, 20 bp, human
ggggcgaccggggtgcgggt

SEQ ID NO: 243819 - DNA, 20 bp, human
ggggccctggagaggacgta

SEQ ID NO: 243820 - DNA, 20 bp, human
ggtcgcccctcgaggacaga

SEQ ID NO: 243821 - DNA, 20 bp, human
ggggtgcgggtcggagatga

SEQ ID NO: 243822 - DNA, 20 bp, human
ggcccaccctctgtcctcga

SEQ ID NO: 243823 - DNA, 20 bp, human
gcaaccccgccggtcctctc

SEQ ID NO: 243824 - DNA, 20 bp, human
gcccaggccgagagcacctc

SEQ ID NO: 243825 - DNA, 20 bp, human
gtccctcccggcaaccccgc

SEQ ID NO: 243826 - DNA, 20 bp, human
gggagggaggcggcagacaa

SEQ ID NO: 243827 - DNA, 20 bp, human
gacgaggggcactacatctc

SEQ ID NO: 243828 - DNA, 20 bp, human
gcgggagtgcctggatccga

SEQ ID NO: 243829 - DNA, 20 bp, human
ggagaactttgtgagcgctg

SEQ ID NO: 243830 - DNA, 20 bp, human
ggcactcccggcggtcccgg

SEQ ID NO: 243831 - DNA, 20 bp, human
gaaacggcgtccttgtggtg

SEQ ID NO: 243832 - DNA, 20 bp, human
gtttgtgagcgctgtggtgg

SEQ ID NO: 243833 - DNA, 20 bp, human
gagtctctaacctgagacca

SEQ ID NO: 243834 - DNA, 20 bp, human
ggcgggccggcgccgcctat

SEQ ID NO: 243835 - DNA, 20 bp, human
gtctaacctgagaccagggc

SEQ ID NO: 243836 - DNA, 20 bp, human
gcacgcgcgcggcccggcca

SEQ ID NO: 243837 - DNA, 20 bp, human
ggcgggcggcgcgttctctc

SEQ ID NO: 243838 - DNA, 20 bp, human
gcaggtgggcccggctgaat

SEQ ID NO: 243839 - DNA, 20 bp, human
ggtgggcccggctgaatggg

SEQ ID NO: 243840 - DNA, 20 bp, human
ggaagcccccccgcccaggt

SEQ ID NO: 243841 - DNA, 20 bp, human
gtgtgcaacgcgccagtccc

SEQ ID NO: 243842 - DNA, 20 bp, human
gcccaggaacaccccgggga

SEQ ID NO: 243843 - DNA, 20 bp, human
gtgctcctcaacccgagtgt

SEQ ID NO: 243844 - DNA, 20 bp, human
gcgcgagttaaaattatcct

SEQ ID NO: 243845 - DNA, 20 bp, human
gcgcccccacactcgggttg

SEQ ID NO: 243846 - DNA, 20 bp, human
gtccctgcgcggaccccgag

SEQ ID NO: 243847 - DNA, 20 bp, human
gtccggagccgatcggggaa

SEQ ID NO: 243848 - DNA, 20 bp, human
ggattccctgggtccgggct

SEQ ID NO: 243849 - DNA, 20 bp, human
gaagccgggttccaggagtt

SEQ ID NO: 243850 - DNA, 20 bp, human
ggacgcctggagatagtgcc

SEQ ID NO: 243851 - DNA, 20 bp, human
gggcctctgccctccgggac

SEQ ID NO: 243852 - DNA, 20 bp, human
gagccgatcggggaacgggg

SEQ ID NO: 243853 - DNA, 20 bp, human
ggaccctaactcctggaacc

SEQ ID NO: 243854 - DNA, 20 bp, human
ggcatcctggcactatctcc

SEQ ID NO: 243855 - DNA, 20 bp, human
gcgcccagaagctgctacgg

SEQ ID NO: 243856 - DNA, 20 bp, human
gaaacagtctggacaatgta

SEQ ID NO: 243857 - DNA, 20 bp, human
gtggaacacacattccaaaa

SEQ ID NO: 243858 - DNA, 20 bp, human
gtttctactgacatgcacac

SEQ ID NO: 243859 - DNA, 20 bp, human
gcaggaaggaagcataccct

SEQ ID NO: 243860 - DNA, 20 bp, human
gagcaagagtaagaaggtca

SEQ ID NO: 243861 - DNA, 20 bp, human
gctgtctctgtagccctttt

SEQ ID NO: 243862 - DNA, 20 bp, human
gaggctaaaagctataaact

SEQ ID NO: 243863 - DNA, 20 bp, human
gaaaagctcaaagccatgca

SEQ ID NO: 243864 - DNA, 20 bp, human
gtggctttgagcttttcata

SEQ ID NO: 243865 - DNA, 20 bp, human
gaagagtaagaaggtcatgg

SEQ ID NO: 243866 - DNA, 20 bp, human
gcggccgcagcgttatctcg

SEQ ID NO: 243867 - DNA, 20 bp, human
ggcgtccaccgtcctgcctg

SEQ ID NO: 243868 - DNA, 20 bp, human
gcgtcctgcctggggagtgt

SEQ ID NO: 243869 - DNA, 20 bp, human
gaactccctgaggccggctt

SEQ ID NO: 243870 - DNA, 20 bp, human
gcggtggacgcagcgcagac

SEQ ID NO: 243871 - DNA, 20 bp, human
ggccgggcggcctgatttgc

SEQ ID NO: 243872 - DNA, 20 bp, human
ggctccccgagataacgctg

SEQ ID NO: 243873 - DNA, 20 bp, human
gcagggagaagcctcggccc

SEQ ID NO: 243874 - DNA, 20 bp, human
ggaggcttctccctgcgcct

SEQ ID NO: 243875 - DNA, 20 bp, human
gcaaaagagcataaagagga

SEQ ID NO: 243876 - DNA, 20 bp, human
gccgctgaggggagtcacgt

SEQ ID NO: 243877 - DNA, 20 bp, human
ggagtcacgtggttgatgag

SEQ ID NO: 243878 - DNA, 20 bp, human
gacgtgggtgctgaggaggc

SEQ ID NO: 243879 - DNA, 20 bp, human
gcggccctgccacccgacac

SEQ ID NO: 243880 - DNA, 20 bp, human
gaccggccgcagcagagtcc

SEQ ID NO: 243881 - DNA, 20 bp, human
ggcagagtgtgtgccagtgt

SEQ ID NO: 243882 - DNA, 20 bp, human
ggcaacaggtccccaagcct

SEQ ID NO: 243883 - DNA, 20 bp, human
gactcccctcagcggcggcc

SEQ ID NO: 243884 - DNA, 20 bp, human
gaccgggctcccccaggctt

SEQ ID NO: 243885 - DNA, 20 bp, human
ggcctggactctgctgcggc

SEQ ID NO: 243886 - DNA, 20 bp, human
gggcccgcgcctgccctcgc

SEQ ID NO: 243887 - DNA, 20 bp, human
gggcgctgggagagcgagag

SEQ ID NO: 243888 - DNA, 20 bp, human
gggccagggcgcgcaggaga

SEQ ID NO: 243889 - DNA, 20 bp, human
gcgccctggccccactcgcg

SEQ ID NO: 243890 - DNA, 20 bp, human
ggcggtccagcgttcacctt

SEQ ID NO: 243891 - DNA, 20 bp, human
ggcgagaaagtgcccggcga

SEQ ID NO: 243892 - DNA, 20 bp, human
ggggagctgctgtgccccgg

SEQ ID NO: 243893 - DNA, 20 bp, human
gagagagagcccgcgcgagt

SEQ ID NO: 243894 - DNA, 20 bp, human
gccttccccaaacggctctg

SEQ ID NO: 243895 - DNA, 20 bp, human
gcgctggaccgccccgggaa

SEQ ID NO: 243896 - DNA, 20 bp, human
ggggcggggcgtcctgggta

SEQ ID NO: 243897 - DNA, 20 bp, human
gcgcgtggaagggatgttag

SEQ ID NO: 243898 - DNA, 20 bp, human
gagcgctcggagcgcgtgga

SEQ ID NO: 243899 - DNA, 20 bp, human
gagacgctctccgagtccca

SEQ ID NO: 243900 - DNA, 20 bp, human
ggcccccgcaccgatcttaa

SEQ ID NO: 243901 - DNA, 20 bp, human
ggatgttaggggtagcgtta

SEQ ID NO: 243902 - DNA, 20 bp, human
gcactccgggccttgggact

SEQ ID NO: 243903 - DNA, 20 bp, human
gggactcggagagcgtctgg

SEQ ID NO: 243904 - DNA, 20 bp, human
gcgcgccgggcgtgaagtcc

SEQ ID NO: 243905 - DNA, 20 bp, human
gcgctatgtgcctttaagat

SEQ ID NO: 243906 - DNA, 20 bp, human
ggcagacagtagtggccgag

SEQ ID NO: 243907 - DNA, 20 bp, human
gtcgggctcgcagacagtag

SEQ ID NO: 243908 - DNA, 20 bp, human
gcagacagggccacaactcg

SEQ ID NO: 243909 - DNA, 20 bp, human
ggccacaactcgcggctcta

SEQ ID NO: 243910 - DNA, 20 bp, human
gaggcgcaggggagcgccag

SEQ ID NO: 243911 - DNA, 20 bp, human
ggtacgctgcgcacccgcac

SEQ ID NO: 243912 - DNA, 20 bp, human
ggaactttcctcaggactca

SEQ ID NO: 243913 - DNA, 20 bp, human
gggttccgctcgtacagctg

SEQ ID NO: 243914 - DNA, 20 bp, human
gagtaagcctcctcacagga

SEQ ID NO: 243915 - DNA, 20 bp, human
gtctgcgagcccgaggcgca

SEQ ID NO: 243916 - DNA, 20 bp, human
gcactggaggcagtcctcaa

SEQ ID NO: 243917 - DNA, 20 bp, human
gtagcatggagacagtttaa

SEQ ID NO: 243918 - DNA, 20 bp, human
ggcgcacgcaaacagcagtg

SEQ ID NO: 243919 - DNA, 20 bp, human
gtagtgaagaggtgatgaga

SEQ ID NO: 243920 - DNA, 20 bp, human
ggagacagtttaatgggata

SEQ ID NO: 243921 - DNA, 20 bp, human
gtggcattctttcttggtaa

SEQ ID NO: 243922 - DNA, 20 bp, human
gtctttcttggtaaaggcat

SEQ ID NO: 243923 - DNA, 20 bp, human
gtcacaggctgacagtggag

SEQ ID NO: 243924 - DNA, 20 bp, human
gttaatgtgggcatttgata

SEQ ID NO: 243925 - DNA, 20 bp, human
gtggtggcacataaccaatt

SEQ ID NO: 243926 - DNA, 20 bp, human
gcagtgatgaaggggatcag

SEQ ID NO: 243927 - DNA, 20 bp, human
gggaacctcggggaacctgg

SEQ ID NO: 243928 - DNA, 20 bp, human
gtccgtggaggtatcctaag

SEQ ID NO: 243929 - DNA, 20 bp, human
gaggctctgcagtgatgaag

SEQ ID NO: 243930 - DNA, 20 bp, human
ggagccgtgccccgccacgg

SEQ ID NO: 243931 - DNA, 20 bp, human
gcttccccaggggtcagagt

SEQ ID NO: 243932 - DNA, 20 bp, human
gggaagcaaagtgaccctac

SEQ ID NO: 243933 - DNA, 20 bp, human
gctcggggaacctggaggca

SEQ ID NO: 243934 - DNA, 20 bp, human
gtggaggtatcctaagggga

SEQ ID NO: 243935 - DNA, 20 bp, human
gcaaacggatatttccgtgg

SEQ ID NO: 243936 - DNA, 20 bp, human
gccgcgcaggggccgtttta

SEQ ID NO: 243937 - DNA, 20 bp, human
gaagcggcgcatcacccctc

SEQ ID NO: 243938 - DNA, 20 bp, human
gtctcctgcgacccgggcgc

SEQ ID NO: 243939 - DNA, 20 bp, human
gcacgattggagtgtcggga

SEQ ID NO: 243940 - DNA, 20 bp, human
ggcccgggtcgcaggagacc

SEQ ID NO: 243941 - DNA, 20 bp, human
gggagtgtcgggagggcaac

SEQ ID NO: 243942 - DNA, 20 bp, human
ggaggcaccacctctcctga

SEQ ID NO: 243943 - DNA, 20 bp, human
ggggtgatgcgccgcttcct

SEQ ID NO: 243944 - DNA, 20 bp, human
ggagacttgtcccgcagtcc

SEQ ID NO: 243945 - DNA, 20 bp, human
gcatcacccctcaggagagg

SEQ ID NO: 243946 - DNA, 20 bp, human
ggcaaggtgctaggctctat

SEQ ID NO: 243947 - DNA, 20 bp, human
gcgtccggagctttgggttc

SEQ ID NO: 243948 - DNA, 20 bp, human
gaggccggaacccaaagctc

SEQ ID NO: 243949 - DNA, 20 bp, human
ggaagtggcgaaggcggggt

SEQ ID NO: 243950 - DNA, 20 bp, human
gtgacctcagcctgcgctgc

SEQ ID NO: 243951 - DNA, 20 bp, human
gcgggcgccggaagtggcga

SEQ ID NO: 243952 - DNA, 20 bp, human
gcccgtgtcccggcgcctag

SEQ ID NO: 243953 - DNA, 20 bp, human
ggcgccggaagtggcgaagg

SEQ ID NO: 243954 - DNA, 20 bp, human
gctagcaccttgcacccagc

SEQ ID NO: 243955 - DNA, 20 bp, human
gggctctatgggagatgaaa

SEQ ID NO: 243956 - DNA, 20 bp, human
gggtgggaggccgtaggcgg

SEQ ID NO: 243957 - DNA, 20 bp, human
gagagctggacggaaacggt

SEQ ID NO: 243958 - DNA, 20 bp, human
gggaaacggtgggaggccgt

SEQ ID NO: 243959 - DNA, 20 bp, human
gagagaccccggggagactg

SEQ ID NO: 243960 - DNA, 20 bp, human
gtggacaagcgagagctgga

SEQ ID NO: 243961 - DNA, 20 bp, human
gagcgagagctggacggaaa

SEQ ID NO: 243962 - DNA, 20 bp, human
gaacggtgggaggccgtagg

SEQ ID NO: 243963 - DNA, 20 bp, human
ggcgcgcacgcggctcgggg

SEQ ID NO: 243964 - DNA, 20 bp, human
ggctggacggaaacggtggg

SEQ ID NO: 243965 - DNA, 20 bp, human
ggggagactgcggacggtgt

SEQ ID NO: 243966 - DNA, 20 bp, human
gggtgggaggccgtaggcgg

SEQ ID NO: 243967 - DNA, 20 bp, human
gagagctggacggaaacggt

SEQ ID NO: 243968 - DNA, 20 bp, human
gggaaacggtgggaggccgt

SEQ ID NO: 243969 - DNA, 20 bp, human
gagagaccccggggagactg

SEQ ID NO: 243970 - DNA, 20 bp, human
gtggacaagcgagagctgga

SEQ ID NO: 243971 - DNA, 20 bp, human
gagcgagagctggacggaaa

SEQ ID NO: 243972 - DNA, 20 bp, human
gaacggtgggaggccgtagg

SEQ ID NO: 243973 - DNA, 20 bp, human
ggcgcgcacgcggctcgggg

SEQ ID NO: 243974 - DNA, 20 bp, human
ggctggacggaaacggtggg

SEQ ID NO: 243975 - DNA, 20 bp, human
ggggagactgcggacggtgt

SEQ ID NO: 243976 - DNA, 20 bp, human
ggttggcgccagttttttcc

SEQ ID NO: 243977 - DNA, 20 bp, human
gtcaatgacctgaaacaccc

SEQ ID NO: 243978 - DNA, 20 bp, human
gccgggagccagggtgtttc

SEQ ID NO: 243979 - DNA, 20 bp, human
gcgccagttttttccaggga

SEQ ID NO: 243980 - DNA, 20 bp, human
gtctggtttatttccttacc

SEQ ID NO: 243981 - DNA, 20 bp, human
gctgtcataattacttgctc

SEQ ID NO: 243982 - DNA, 20 bp, human
gcctcacataaccagcaccc

SEQ ID NO: 243983 - DNA, 20 bp, human
gatctaggtgcctagcaaaa

SEQ ID NO: 243984 - DNA, 20 bp, human
gacttattaagctttataat

SEQ ID NO: 243985 - DNA, 20 bp, human
ggcagcccgctggaggtgca

SEQ ID NO: 243986 - DNA, 20 bp, human
gaagatgtgagtagacatca

SEQ ID NO: 243987 - DNA, 20 bp, human
ggcgaatggaagccacgggg

SEQ ID NO: 243988 - DNA, 20 bp, human
gaagatacaaagtgggtaat

SEQ ID NO: 243989 - DNA, 20 bp, human
gatgaaatggcacctccccg

SEQ ID NO: 243990 - DNA, 20 bp, human
gcatcaaggaagatacaaag

SEQ ID NO: 243991 - DNA, 20 bp, human
gggaccgagctcctgcgcta

SEQ ID NO: 243992 - DNA, 20 bp, human
gctctgttgggccctagcgc

SEQ ID NO: 243993 - DNA, 20 bp, human
gatcttctgcccatttaatt

SEQ ID NO: 243994 - DNA, 20 bp, human
ggggaaacaacctaattaaa

SEQ ID NO: 243995 - DNA, 20 bp, human
gaatgcgaatggaagccacg

SEQ ID NO: 243996 - DNA, 20 bp, human
gcccatgcgccaggccgcta

SEQ ID NO: 243997 - DNA, 20 bp, human
gcatggggcggacgtagcag

SEQ ID NO: 243998 - DNA, 20 bp, human
ggggctcttccagactggag

SEQ ID NO: 243999 - DNA, 20 bp, human
ggcccagcgccttccgaatt

SEQ ID NO: 244000 - DNA, 20 bp, human
ggcgccaggccgctaggggc

SEQ ID NO: 244001 - DNA, 20 bp, human
gcttccagactggagcgggg

SEQ ID NO: 244002 - DNA, 20 bp, human
gtaggggcaggacgtggaag

SEQ ID NO: 244003 - DNA, 20 bp, human
gccatctaacagtgacacgt

SEQ ID NO: 244004 - DNA, 20 bp, human
gacaaactcccatgtgccgg

SEQ ID NO: 244005 - DNA, 20 bp, human
ggacgtggaagcggaagcgc

SEQ ID NO: 244006 - DNA, 20 bp, human
gcggaagagtccaagcgtga

SEQ ID NO: 244007 - DNA, 20 bp, human
gcctgcacggagcggttaag

SEQ ID NO: 244008 - DNA, 20 bp, human
gagaacgcgagcgctcggca

SEQ ID NO: 244009 - DNA, 20 bp, human
gtgaccacgcggtcccagac

SEQ ID NO: 244010 - DNA, 20 bp, human
ggtccaagcgtgaggggaga

SEQ ID NO: 244011 - DNA, 20 bp, human
gcgctcggcaaggctcggct

SEQ ID NO: 244012 - DNA, 20 bp, human
gtccgggcggtgtgttggga

SEQ ID NO: 244013 - DNA, 20 bp, human
gcctacggccctgcacggag

SEQ ID NO: 244014 - DNA, 20 bp, human
ggcgagcgctcggcaaggct

SEQ ID NO: 244015 - DNA, 20 bp, human
gccaacacaccgcccggagg

SEQ ID NO: 244016 - DNA, 20 bp, human
gcgtgtccgcggccctgcga

SEQ ID NO: 244017 - DNA, 20 bp, human
ggagccggggagccctcgca

SEQ ID NO: 244018 - DNA, 20 bp, human
ggtacccaaaggtcactcag

SEQ ID NO: 244019 - DNA, 20 bp, human
gctcccgctgagtgaccttt

SEQ ID NO: 244020 - DNA, 20 bp, human
ggccggcaccggcagacgcg

SEQ ID NO: 244021 - DNA, 20 bp, human
gaggctgccataaatatctc

SEQ ID NO: 244022 - DNA, 20 bp, human
gacaagaggtcttcaatcaa

SEQ ID NO: 244023 - DNA, 20 bp, human
gcacaaccgcactttcgcca

SEQ ID NO: 244024 - DNA, 20 bp, human
ggcagggccgcggacacgcg

SEQ ID NO: 244025 - DNA, 20 bp, human
gtcaccatctgagaaaatga

SEQ ID NO: 244026 - DNA, 20 bp, human
gtacggggaaagcggtagtt

SEQ ID NO: 244027 - DNA, 20 bp, human
gtcgcccacgtgactctcgc

SEQ ID NO: 244028 - DNA, 20 bp, human
gtgactctcgccggcgggga

SEQ ID NO: 244029 - DNA, 20 bp, human
gcccgccggcgagagtcacg

SEQ ID NO: 244030 - DNA, 20 bp, human
gactgcagtttgcagtgatg

SEQ ID NO: 244031 - DNA, 20 bp, human
gaagcgcacagggacttctt

SEQ ID NO: 244032 - DNA, 20 bp, human
gaccgctttccccgtaacca

SEQ ID NO: 244033 - DNA, 20 bp, human
gtccctggttacggggaaag

SEQ ID NO: 244034 - DNA, 20 bp, human
gggtctctgcgcaagcgcac

SEQ ID NO: 244035 - DNA, 20 bp, human
ggggcttgggtcacgtgtca

SEQ ID NO: 244036 - DNA, 20 bp, human
gcggatcaagacggacgcgg

SEQ ID NO: 244037 - DNA, 20 bp, human
ggcggaggatggtttactcg

SEQ ID NO: 244038 - DNA, 20 bp, human
gttgtcgcggggcctgccgg

SEQ ID NO: 244039 - DNA, 20 bp, human
gtgcgccagcccacccacat

SEQ ID NO: 244040 - DNA, 20 bp, human
gcagtgagcgcggatcaaga

SEQ ID NO: 244041 - DNA, 20 bp, human
gtggctgtcgctgttgtcgc

SEQ ID NO: 244042 - DNA, 20 bp, human
gcgtttcggttgtggtgctg

SEQ ID NO: 244043 - DNA, 20 bp, human
gggggaaggcgtttcggttg

SEQ ID NO: 244044 - DNA, 20 bp, human
gccagggaagcgaggtcacg

SEQ ID NO: 244045 - DNA, 20 bp, human
gggtgctgcggcagtgagcg

SEQ ID NO: 244046 - DNA, 20 bp, human
gcccgcggctgaatccgaca

SEQ ID NO: 244047 - DNA, 20 bp, human
gggctgaatccgacatggtg

SEQ ID NO: 244048 - DNA, 20 bp, human
gtcagccgcgggcgacttcg

SEQ ID NO: 244049 - DNA, 20 bp, human
gcgggcggggacttgaacgc

SEQ ID NO: 244050 - DNA, 20 bp, human
gcagctctctccacagaccc

SEQ ID NO: 244051 - DNA, 20 bp, human
gaactgagtcccggggtctg

SEQ ID NO: 244052 - DNA, 20 bp, human
gcgacttcgcggggcattcc

SEQ ID NO: 244053 - DNA, 20 bp, human
gacacacagtgaatgaaagt

SEQ ID NO: 244054 - DNA, 20 bp, human
gctgtggtgggccgtccctg

SEQ ID NO: 244055 - DNA, 20 bp, human
gtggggccggccgtgccttg

SEQ ID NO: 244056 - DNA, 20 bp, human
gcggccggggtgtcctcgtg

SEQ ID NO: 244057 - DNA, 20 bp, human
gggggcgcagcaggtaggat

SEQ ID NO: 244058 - DNA, 20 bp, human
gtatgtggacacccccgcgt

SEQ ID NO: 244059 - DNA, 20 bp, human
gtggccagggtgtccccgtg

SEQ ID NO: 244060 - DNA, 20 bp, human
gcccgcgtgggcacccccac

SEQ ID NO: 244061 - DNA, 20 bp, human
gcagcaggtaggatggggtc

SEQ ID NO: 244062 - DNA, 20 bp, human
gtgtccgcgcggcggtggcc

SEQ ID NO: 244063 - DNA, 20 bp, human
gcgtgagggtgtccgcgcgg

SEQ ID NO: 244064 - DNA, 20 bp, human
gagaccaagaggccggtatg

SEQ ID NO: 244065 - DNA, 20 bp, human
ggtaggtgtccgcgcggccg

SEQ ID NO: 244066 - DNA, 20 bp, human
gagagccgggcgcgatctgg

SEQ ID NO: 244067 - DNA, 20 bp, human
gcgcgcccggctctctcggg

SEQ ID NO: 244068 - DNA, 20 bp, human
ggaggcaggcacctggactg

SEQ ID NO: 244069 - DNA, 20 bp, human
gccgccgggctccaccttgt

SEQ ID NO: 244070 - DNA, 20 bp, human
ggcggccaccagatcgcgcc

SEQ ID NO: 244071 - DNA, 20 bp, human
gagatcgcgcccggctctct

SEQ ID NO: 244072 - DNA, 20 bp, human
ggccgggaactgcgcccctg

SEQ ID NO: 244073 - DNA, 20 bp, human
gaggagaaaaaagcattggc

SEQ ID NO: 244074 - DNA, 20 bp, human
ggggtagtgccccgacaagg

SEQ ID NO: 244075 - DNA, 20 bp, human
gaagccccgcccgagagagc

SEQ ID NO: 244076 - DNA, 20 bp, human
gcagagaggcaagatggcta

SEQ ID NO: 244077 - DNA, 20 bp, human
ggggctgacccgggaagtcg

SEQ ID NO: 244078 - DNA, 20 bp, human
gaggcaagatggctacggca

SEQ ID NO: 244079 - DNA, 20 bp, human
ggccacagagacggtgtcag

SEQ ID NO: 244080 - DNA, 20 bp, human
gaaggagaccccgacttccc

SEQ ID NO: 244081 - DNA, 20 bp, human
gacagacaggagccgaacgg

SEQ ID NO: 244082 - DNA, 20 bp, human
gaccactgacaccgtctctg

SEQ ID NO: 244083 - DNA, 20 bp, human
gggcccggagcctaagagac

SEQ ID NO: 244084 - DNA, 20 bp, human
gctaacagacaggagccgaa

SEQ ID NO: 244085 - DNA, 20 bp, human
gagagaggccgctaacagac

SEQ ID NO: 244086 - DNA, 20 bp, human
gctgcggcctaatcaaaccc

SEQ ID NO: 244087 - DNA, 20 bp, human
gaaaccctggacaagagaag

SEQ ID NO: 244088 - DNA, 20 bp, human
gagtcgccgtaggtgctagg

SEQ ID NO: 244089 - DNA, 20 bp, human
gcacctacggcgactcagag

SEQ ID NO: 244090 - DNA, 20 bp, human
gcacagccacctagcaccta

SEQ ID NO: 244091 - DNA, 20 bp, human
gccacgtcagccaaggactc

SEQ ID NO: 244092 - DNA, 20 bp, human
gctgagtcgccgtaggtgct

SEQ ID NO: 244093 - DNA, 20 bp, human
ggtccttggctgacgtggaa

SEQ ID NO: 244094 - DNA, 20 bp, human
gccttcttcaggaacagtca

SEQ ID NO: 244095 - DNA, 20 bp, human
gggctgacgtggaagggggt

SEQ ID NO: 244096 - DNA, 20 bp, human
ggcctcaagtccactaccag

SEQ ID NO: 244097 - DNA, 20 bp, human
gtgaggctgtcgggaaggag

SEQ ID NO: 244098 - DNA, 20 bp, human
gaccgctggtagtggacttg

SEQ ID NO: 244099 - DNA, 20 bp, human
ggtgtggcctagaccactaa

SEQ ID NO: 244100 - DNA, 20 bp, human
gtgcctaggaaactggggcg

SEQ ID NO: 244101 - DNA, 20 bp, human
gaccacgtcacggcccttag

SEQ ID NO: 244102 - DNA, 20 bp, human
gaccactaagggccgtgacg

SEQ ID NO: 244103 - DNA, 20 bp, human
gggacttgaggctgtcggga

SEQ ID NO: 244104 - DNA, 20 bp, human
gtgcgcaggcgctccggccc

SEQ ID NO: 244105 - DNA, 20 bp, human
gcccgctggacgctaactgc

SEQ ID NO: 244106 - DNA, 20 bp, human
gggaaggcgtaagtgcgtca

SEQ ID NO: 244107 - DNA, 20 bp, human
ggcgtcacggagagcatctc

SEQ ID NO: 244108 - DNA, 20 bp, human
gtgcaagccaatgggatccg

SEQ ID NO: 244109 - DNA, 20 bp, human
gcggcggcgaagtaagccaa

SEQ ID NO: 244110 - DNA, 20 bp, human
ggggaaacatgataaggatg

SEQ ID NO: 244111 - DNA, 20 bp, human
ggatccggggaaacatgata

SEQ ID NO: 244112 - DNA, 20 bp, human
gtccacaataatatgcaagg

SEQ ID NO: 244113 - DNA, 20 bp, human
gcatgataaggatgcggtcg

SEQ ID NO: 244114 - DNA, 20 bp, human
gcgtgcccgtgtcttgcttc

SEQ ID NO: 244115 - DNA, 20 bp, human
gccggaagcgcggatcacac

SEQ ID NO: 244116 - DNA, 20 bp, human
gaagccagacggaggggcaa

SEQ ID NO: 244117 - DNA, 20 bp, human
gctaaggttaacattagacg

SEQ ID NO: 244118 - DNA, 20 bp, human
gtcccgctccggcggagcta

SEQ ID NO: 244119 - DNA, 20 bp, human
gtggctaccggaaagagcgc

SEQ ID NO: 244120 - DNA, 20 bp, human
ggtggggaaagccagacgga

SEQ ID NO: 244121 - DNA, 20 bp, human
gttaacattagacgaggctg

SEQ ID NO: 244122 - DNA, 20 bp, human
ggctccgccggagcgggagt

SEQ ID NO: 244123 - DNA, 20 bp, human
gagacggaggggcaagggct

SEQ ID NO: 244124 - DNA, 20 bp, human
gtctgcgcctgcgctctttc

SEQ ID NO: 244125 - DNA, 20 bp, human
ggtcgcccagcgctctgcgc

SEQ ID NO: 244126 - DNA, 20 bp, human
gtgacaggaaagagtgatag

SEQ ID NO: 244127 - DNA, 20 bp, human
ggaagagaactcagagagca

SEQ ID NO: 244128 - DNA, 20 bp, human
ggagtataagcgcgctatcg

SEQ ID NO: 244129 - DNA, 20 bp, human
gcaggtcttcaactcttttc

SEQ ID NO: 244130 - DNA, 20 bp, human
gacagggcacttggttctct

SEQ ID NO: 244131 - DNA, 20 bp, human
gcatctgtgcgagttcatcg

SEQ ID NO: 244132 - DNA, 20 bp, human
ggactgcgagttcacagtgc

SEQ ID NO: 244133 - DNA, 20 bp, human
gtgtctccaagttctgtgtt

SEQ ID NO: 244134 - DNA, 20 bp, human
ggaccagccttttgtttgac

SEQ ID NO: 244135 - DNA, 20 bp, human
ggtgtttggacaactgtcct

SEQ ID NO: 244136 - DNA, 20 bp, human
gagggtcgagccgaagtctc

SEQ ID NO: 244137 - DNA, 20 bp, human
ggacttcggctcgaccctcc

SEQ ID NO: 244138 - DNA, 20 bp, human
gcccgggtcgcaagccggga

SEQ ID NO: 244139 - DNA, 20 bp, human
ggtcgagccgaagtctccgg

SEQ ID NO: 244140 - DNA, 20 bp, human
gggcgggccgcaagaggaga

SEQ ID NO: 244141 - DNA, 20 bp, human
gtgcggcccgccggagactt

SEQ ID NO: 244142 - DNA, 20 bp, human
gcggccccgcgctctcacgc

SEQ ID NO: 244143 - DNA, 20 bp, human
ggggccttggccccgagtga

SEQ ID NO: 244144 - DNA, 20 bp, human
ggggccgccgcgccttcact

SEQ ID NO: 244145 - DNA, 20 bp, human
gagtctcaagagagcgaggc

SEQ ID NO: 244146 - DNA, 20 bp, human
ggggtgtcacgagcaagcgg

SEQ ID NO: 244147 - DNA, 20 bp, human
ggcgccaatcagcctgggga

SEQ ID NO: 244148 - DNA, 20 bp, human
gtgtcacgagcaagcggggg

SEQ ID NO: 244149 - DNA, 20 bp, human
gcaccccgagtggccgagta

SEQ ID NO: 244150 - DNA, 20 bp, human
gcgggggtgtcacgagcaag

SEQ ID NO: 244151 - DNA, 20 bp, human
gtaccctactcggccactcg

SEQ ID NO: 244152 - DNA, 20 bp, human
gtgggtaccggccaagaggg

SEQ ID NO: 244153 - DNA, 20 bp, human
gcctctcggtgcatatccta

SEQ ID NO: 244154 - DNA, 20 bp, human
gaggctgattggcgcttctg

SEQ ID NO: 244155 - DNA, 20 bp, human
gacgccaagcgtaccctact

SEQ ID NO: 244156 - DNA, 20 bp, human
gggaaacagctcctctaaga

SEQ ID NO: 244157 - DNA, 20 bp, human
gaaggcaccaaccacttcgg

SEQ ID NO: 244158 - DNA, 20 bp, human
gcggctgagacctgcagcac

SEQ ID NO: 244159 - DNA, 20 bp, human
gaaccacttcggaggaaacg

SEQ ID NO: 244160 - DNA, 20 bp, human
ggctaaggcaccaaccactt

SEQ ID NO: 244161 - DNA, 20 bp, human
gttgccagctttagttgcta

SEQ ID NO: 244162 - DNA, 20 bp, human
gggtctcagccgaagggcgt

SEQ ID NO: 244163 - DNA, 20 bp, human
gctcctcccacaatcctccg

SEQ ID NO: 244164 - DNA, 20 bp, human
ggctgcaggtctcagccgaa

SEQ ID NO: 244165 - DNA, 20 bp, human
gtcctctaagagggactgga

SEQ ID NO: 244166 - DNA, 20 bp, human
gatcacggggaaaacctcac

SEQ ID NO: 244167 - DNA, 20 bp, human
gcatggaaacagtaacgggt

SEQ ID NO: 244168 - DNA, 20 bp, human
gcacctgaggtcctcgcgag

SEQ ID NO: 244169 - DNA, 20 bp, human
gcgccgctcgcgaggacctc

SEQ ID NO: 244170 - DNA, 20 bp, human
gactatggaacactaatttc

SEQ ID NO: 244171 - DNA, 20 bp, human
gttccggctacggcgaattc

SEQ ID NO: 244172 - DNA, 20 bp, human
gtccctccgcaggttaaatg

SEQ ID NO: 244173 - DNA, 20 bp, human
gctcgcggtgcttgaaccag

SEQ ID NO: 244174 - DNA, 20 bp, human
ggaacactaatttccggcta

SEQ ID NO: 244175 - DNA, 20 bp, human
gcaggttaaatggggatagt

SEQ ID NO: 244176 - DNA, 20 bp, human
gtgggccagagcgtcgggtg

SEQ ID NO: 244177 - DNA, 20 bp, human
gtgggcaggcctcagacctg

SEQ ID NO: 244178 - DNA, 20 bp, human
gcgtgagagccagagcctgt

SEQ ID NO: 244179 - DNA, 20 bp, human
gctgcccaggtctctcctac

SEQ ID NO: 244180 - DNA, 20 bp, human
gccgcatcactcaaccctgg

SEQ ID NO: 244181 - DNA, 20 bp, human
gaactccagtagtgagtctc

SEQ ID NO: 244182 - DNA, 20 bp, human
gtctgtgtgggccagagcgt

SEQ ID NO: 244183 - DNA, 20 bp, human
gctacagagtagcgtctgtg

SEQ ID NO: 244184 - DNA, 20 bp, human
gagagcctgtaggagagacc

SEQ ID NO: 244185 - DNA, 20 bp, human
ggctccgcatcactcaaccc

SEQ ID NO: 244186 - DNA, 20 bp, human
gcttaagagcgggatgtgga

SEQ ID NO: 244187 - DNA, 20 bp, human
ggtagctggagccttaagag

SEQ ID NO: 244188 - DNA, 20 bp, human
ggagccttaagagcgggatg

SEQ ID NO: 244189 - DNA, 20 bp, human
gtcggcctccgccatattaa

SEQ ID NO: 244190 - DNA, 20 bp, human
ggtcttccgcaccggaagaa

SEQ ID NO: 244191 - DNA, 20 bp, human
ggctccagctacctttaata

SEQ ID NO: 244192 - DNA, 20 bp, human
gtacatgcgtaaaagctaac

SEQ ID NO: 244193 - DNA, 20 bp, human
ggcggaaagtgtttttgtgt

SEQ ID NO: 244194 - DNA, 20 bp, human
gacatgcccttcttccggtg

SEQ ID NO: 244195 - DNA, 20 bp, human
ggctacctttaatatggcgg

SEQ ID NO: 244196 - DNA, 20 bp, human
ggggacgcccgacgccctct

SEQ ID NO: 244197 - DNA, 20 bp, human
gaccgaggcccagagggcgt

SEQ ID NO: 244198 - DNA, 20 bp, human
gcacccgcaggcgacaggcg

SEQ ID NO: 244199 - DNA, 20 bp, human
ggcgggcggcactcggtgcg

SEQ ID NO: 244200 - DNA, 20 bp, human
gtgtccccgcctgtcgcctg

SEQ ID NO: 244201 - DNA, 20 bp, human
gccgggaactgcctgctccc

SEQ ID NO: 244202 - DNA, 20 bp, human
gctggcgggcgcggggaaaa

SEQ ID NO: 244203 - DNA, 20 bp, human
gcgtcctcgtctgtgaaatt

SEQ ID NO: 244204 - DNA, 20 bp, human
gggcagttcccgggtcgcgg

SEQ ID NO: 244205 - DNA, 20 bp, human
gcaagtcgttaatttgtcaa

SEQ ID NO: 244206 - DNA, 20 bp, human
gtccctcactggagcttcag

SEQ ID NO: 244207 - DNA, 20 bp, human
gcggccgtacttccgctcta

SEQ ID NO: 244208 - DNA, 20 bp, human
gttcagcggtcggaacgcgg

SEQ ID NO: 244209 - DNA, 20 bp, human
ggaccgctgaagctccagtg

SEQ ID NO: 244210 - DNA, 20 bp, human
gtggccactaaactctatgg

SEQ ID NO: 244211 - DNA, 20 bp, human
gaactacagacgtctctggt

SEQ ID NO: 244212 - DNA, 20 bp, human
gagcttcagcggtcggaacg

SEQ ID NO: 244213 - DNA, 20 bp, human
gctctggccactaaactcta

SEQ ID NO: 244214 - DNA, 20 bp, human
gcctccctgaagagtcgctc

SEQ ID NO: 244215 - DNA, 20 bp, human
gcgtccttagagcggaagta

SEQ ID NO: 244216 - DNA, 20 bp, human
gtggctaggggcccaaggag

SEQ ID NO: 244217 - DNA, 20 bp, human
gcgacctccggtggggaagt

SEQ ID NO: 244218 - DNA, 20 bp, human
gctgcagcccgggaaccagg

SEQ ID NO: 244219 - DNA, 20 bp, human
gaggtcgaaggctgtaaacg

SEQ ID NO: 244220 - DNA, 20 bp, human
gcggaacgcgagtgcagcgg

SEQ ID NO: 244221 - DNA, 20 bp, human
gcggggaagagtctgcagcc

SEQ ID NO: 244222 - DNA, 20 bp, human
gcagccttcgacctccggtg

SEQ ID NO: 244223 - DNA, 20 bp, human
gttggggcccgggatggcga

SEQ ID NO: 244224 - DNA, 20 bp, human
ggatggcgatggcgacggtt

SEQ ID NO: 244225 - DNA, 20 bp, human
gtcgaaggctgtaaacgcgg

SEQ ID NO: 244226 - DNA, 20 bp, human
gggtcccccgagtgcgccgc

SEQ ID NO: 244227 - DNA, 20 bp, human
gcctccccgggaagtcccat

SEQ ID NO: 244228 - DNA, 20 bp, human
gcattccagcggcgcactcg

SEQ ID NO: 244229 - DNA, 20 bp, human
gagacggctagtgtgctcag

SEQ ID NO: 244230 - DNA, 20 bp, human
gcgcgcagcggcttcgcagg

SEQ ID NO: 244231 - DNA, 20 bp, human
ggtgtcctatgggacttccc

SEQ ID NO: 244232 - DNA, 20 bp, human
gtagtccccgggcctctttg

SEQ ID NO: 244233 - DNA, 20 bp, human
gtacagaggaaccgagtgca

SEQ ID NO: 244234 - DNA, 20 bp, human
gctccgctgggacaaactct

SEQ ID NO: 244235 - DNA, 20 bp, human
ggccaaggctggctttccat

SEQ ID NO: 244236 - DNA, 20 bp, human
gagaaagccggccagaacgg

SEQ ID NO: 244237 - DNA, 20 bp, human
ggcgccgtcagacatcgctg

SEQ ID NO: 244238 - DNA, 20 bp, human
gacgcctgagggacagtctg

SEQ ID NO: 244239 - DNA, 20 bp, human
gagagcgcgcggccgccctc

SEQ ID NO: 244240 - DNA, 20 bp, human
gcggccgcagcgatgtctga

SEQ ID NO: 244241 - DNA, 20 bp, human
gcatcgctgcggccgggata

SEQ ID NO: 244242 - DNA, 20 bp, human
gcggccgccctctggcaggg

SEQ ID NO: 244243 - DNA, 20 bp, human
gagggcgccgccgttctggc

SEQ ID NO: 244244 - DNA, 20 bp, human
gcgccccggaactgacggtc

SEQ ID NO: 244245 - DNA, 20 bp, human
gaggacctggccggctccgc

SEQ ID NO: 244246 - DNA, 20 bp, human
gtggggcgggagggttagtg

SEQ ID NO: 244247 - DNA, 20 bp, human
gggaacgtatggccaatcag

SEQ ID NO: 244248 - DNA, 20 bp, human
ggggcggggttgtttccatg

SEQ ID NO: 244249 - DNA, 20 bp, human
gatcctaggcggggcctaat

SEQ ID NO: 244250 - DNA, 20 bp, human
gacgactcattggggcggga

SEQ ID NO: 244251 - DNA, 20 bp, human
gcaaaacctcacgactcatt

SEQ ID NO: 244252 - DNA, 20 bp, human
gacctcacgactcattgggg

SEQ ID NO: 244253 - DNA, 20 bp, human
gcgaggacacgtgatattgt

SEQ ID NO: 244254 - DNA, 20 bp, human
gaacacctgagccttctggt

SEQ ID NO: 244255 - DNA, 20 bp, human
gagcaaagtgtccaaccaga

SEQ ID NO: 244256 - DNA, 20 bp, human
gaggagagccacggggaaag

SEQ ID NO: 244257 - DNA, 20 bp, human
gcaccagcgtctgaagccct

SEQ ID NO: 244258 - DNA, 20 bp, human
gggtcctcgcagattctcaa

SEQ ID NO: 244259 - DNA, 20 bp, human
gacgctggtgcgcctgcttg

SEQ ID NO: 244260 - DNA, 20 bp, human
ggactgagaactcaggccga

SEQ ID NO: 244261 - DNA, 20 bp, human
ggagcctgagctgacactgc

SEQ ID NO: 244262 - DNA, 20 bp, human
ggaggaaggactgagaactc

SEQ ID NO: 244263 - DNA, 20 bp, human
ggctcccggtgttgtctctg

SEQ ID NO: 244264 - DNA, 20 bp, human
gtgcccctttcggccaagag

SEQ ID NO: 244265 - DNA, 20 bp, human
gtgtgggcagaaaccacatc

SEQ ID NO: 244266 - DNA, 20 bp, human
gcaggcaggaagcaggacga

SEQ ID NO: 244267 - DNA, 20 bp, human
gactcgggaaggagccaagg

SEQ ID NO: 244268 - DNA, 20 bp, human
ggcagagttcggggatgtaa

SEQ ID NO: 244269 - DNA, 20 bp, human
ggagaacgagcaagaggacg

SEQ ID NO: 244270 - DNA, 20 bp, human
gcaggacgagggctggtctt

SEQ ID NO: 244271 - DNA, 20 bp, human
gggacggggccccgaggaaa

SEQ ID NO: 244272 - DNA, 20 bp, human
gcctgaggatgcagagttcg

SEQ ID NO: 244273 - DNA, 20 bp, human
ggggcggcgctgtcagtgcg

SEQ ID NO: 244274 - DNA, 20 bp, human
gtcggggatgtaagggactc

SEQ ID NO: 244275 - DNA, 20 bp, human
gcggcgctgtcagtgcgagg

SEQ ID NO: 244276 - DNA, 20 bp, human
gaagctgcaaagatggttcg

SEQ ID NO: 244277 - DNA, 20 bp, human
gggcacagaggcgacttcgt

SEQ ID NO: 244278 - DNA, 20 bp, human
ggtcacaggacccgataggt

SEQ ID NO: 244279 - DNA, 20 bp, human
gtgtggtcacaggacccgat

SEQ ID NO: 244280 - DNA, 20 bp, human
gcggggactgaggtcgcctg

SEQ ID NO: 244281 - DNA, 20 bp, human
gaggggacaacgccgcctgt

SEQ ID NO: 244282 - DNA, 20 bp, human
gaaagatggttcggggactg

SEQ ID NO: 244283 - DNA, 20 bp, human
gtggcaacagcgtgacgtgg

SEQ ID NO: 244284 - DNA, 20 bp, human
gcgcctctgtgcctacctat

SEQ ID NO: 244285 - DNA, 20 bp, human
gtgtccctctagagaaccta

SEQ ID NO: 244286 - DNA, 20 bp, human
gcacgggaaaagcgattggt

SEQ ID NO: 244287 - DNA, 20 bp, human
gaggctgacgggaacgttta

SEQ ID NO: 244288 - DNA, 20 bp, human
gtgtcggccaatcggagctg

SEQ ID NO: 244289 - DNA, 20 bp, human
gcaacccggaagggaagaag

SEQ ID NO: 244290 - DNA, 20 bp, human
gagggaagaaggggcgtgtc

SEQ ID NO: 244291 - DNA, 20 bp, human
ggaaaagcgattggtcggtc

SEQ ID NO: 244292 - DNA, 20 bp, human
ggcaccgccctcctctggtc

SEQ ID NO: 244293 - DNA, 20 bp, human
gagcgacgtgcaacccggaa

SEQ ID NO: 244294 - DNA, 20 bp, human
ggcgggcccgcagctccgat

SEQ ID NO: 244295 - DNA, 20 bp, human
ggagagaggtgtgtcctggc

SEQ ID NO: 244296 - DNA, 20 bp, human
gccccggcaggcatgcgcag

SEQ ID NO: 244297 - DNA, 20 bp, human
gatcgtggtcgcttactcta

SEQ ID NO: 244298 - DNA, 20 bp, human
ggtggtcgcttactctaggg

SEQ ID NO: 244299 - DNA, 20 bp, human
gactcagaacggggtctctg

SEQ ID NO: 244300 - DNA, 20 bp, human
gtgccactgcgcatgcctgc

SEQ ID NO: 244301 - DNA, 20 bp, human
gtcggattgacgtcattccc

SEQ ID NO: 244302 - DNA, 20 bp, human
gatcgggcaacactcagaac

SEQ ID NO: 244303 - DNA, 20 bp, human
gcatgcgcagtggcacccgc

SEQ ID NO: 244304 - DNA, 20 bp, human
ggatgcaatcctagtctgcc

SEQ ID NO: 244305 - DNA, 20 bp, human
gtctgagtgttgcccgataa

SEQ ID NO: 244306 - DNA, 20 bp, human
ggatcccagaatccgagatg

SEQ ID NO: 244307 - DNA, 20 bp, human
gagtccccatctcggattct

SEQ ID NO: 244308 - DNA, 20 bp, human
gcagacggcgaaagtgatct

SEQ ID NO: 244309 - DNA, 20 bp, human
gtggggatcttttttcggga

SEQ ID NO: 244310 - DNA, 20 bp, human
gcgaagtaatggcctgattg

SEQ ID NO: 244311 - DNA, 20 bp, human
gaaaaagatccccaacataa

SEQ ID NO: 244312 - DNA, 20 bp, human
ggagggaccggaaaagaggt

SEQ ID NO: 244313 - DNA, 20 bp, human
gtcgggagggaccggaaaag

SEQ ID NO: 244314 - DNA, 20 bp, human
gacaatacaatcatgaaagt

SEQ ID NO: 244315 - DNA, 20 bp, human
gaaaaaaagtcggctgcaga

SEQ ID NO: 244316 - DNA, 20 bp, human
ggtagcctacggcctttcga

SEQ ID NO: 244317 - DNA, 20 bp, human
gagaacgagagcgggaacgt

SEQ ID NO: 244318 - DNA, 20 bp, human
gaggggaaacatcgcttcac

SEQ ID NO: 244319 - DNA, 20 bp, human
gttggatcggtggacgtaga

SEQ ID NO: 244320 - DNA, 20 bp, human
gtcacgggcagaaggcatgt

SEQ ID NO: 244321 - DNA, 20 bp, human
gggcgagagtcttggatcgg

SEQ ID NO: 244322 - DNA, 20 bp, human
gcctttgcagacactttctg

SEQ ID NO: 244323 - DNA, 20 bp, human
gggtgacatggcgagagtct

SEQ ID NO: 244324 - DNA, 20 bp, human
gggaacgtgggtctggttcg

SEQ ID NO: 244325 - DNA, 20 bp, human
gtatagtcttcggggaaaac

SEQ ID NO: 244326 - DNA, 20 bp, human
ggccgctaagaggtgacccg

SEQ ID NO: 244327 - DNA, 20 bp, human
ggccccgggtcacctcttag

SEQ ID NO: 244328 - DNA, 20 bp, human
gaggaatcaggggatctcag

SEQ ID NO: 244329 - DNA, 20 bp, human
gatctctaggatccaaaggg

SEQ ID NO: 244330 - DNA, 20 bp, human
gggccagccgccgtcgttcg

SEQ ID NO: 244331 - DNA, 20 bp, human
gcaactgtgtatcagatttc

SEQ ID NO: 244332 - DNA, 20 bp, human
gttgtgccggcattatctct

SEQ ID NO: 244333 - DNA, 20 bp, human
gtacaattcaccaggaatca

SEQ ID NO: 244334 - DNA, 20 bp, human
ggtcactccacgaacgacgg

SEQ ID NO: 244335 - DNA, 20 bp, human
gtgcgtcactccacgaacga

SEQ ID NO: 244336 - DNA, 20 bp, human
gctcgggcgggatggatcgg

SEQ ID NO: 244337 - DNA, 20 bp, human
gcgaaccttgcctcctcggg

SEQ ID NO: 244338 - DNA, 20 bp, human
gagacgccaaagctagaaag

SEQ ID NO: 244339 - DNA, 20 bp, human
gaaaacgaaccttgcctcct

SEQ ID NO: 244340 - DNA, 20 bp, human
gcatcccgcccgaggaggca

SEQ ID NO: 244341 - DNA, 20 bp, human
gggcgtctggttggcttcca

SEQ ID NO: 244342 - DNA, 20 bp, human
gggcgcggaggggagccgtc

SEQ ID NO: 244343 - DNA, 20 bp, human
gtctagctttggcgtctggt

SEQ ID NO: 244344 - DNA, 20 bp, human
gctcctcgggcgggatggat

SEQ ID NO: 244345 - DNA, 20 bp, human
gtctgaggacgccgcggaag

SEQ ID NO: 244346 - DNA, 20 bp, human
ggccccctagctctgcgcta

SEQ ID NO: 244347 - DNA, 20 bp, human
gtctgcgctaggggttagat

SEQ ID NO: 244348 - DNA, 20 bp, human
gaacccctagcgcagagcta

SEQ ID NO: 244349 - DNA, 20 bp, human
gtcaatcactcggaagacca

SEQ ID NO: 244350 - DNA, 20 bp, human
gatgacgcacagcagacgta

SEQ ID NO: 244351 - DNA, 20 bp, human
gaccaaggccaaggcgcctt

SEQ ID NO: 244352 - DNA, 20 bp, human
gagctcgcccgcgcaccggt

SEQ ID NO: 244353 - DNA, 20 bp, human
gtccgagccaagggcactat

SEQ ID NO: 244354 - DNA, 20 bp, human
ggggcgttcccaccggtgcg

SEQ ID NO: 244355 - DNA, 20 bp, human
gaactggccaatagtgccct

SEQ ID NO: 244356 - DNA, 20 bp, human
ggcgcaaggcgtggagtcga

SEQ ID NO: 244357 - DNA, 20 bp, human
gaggatgtgggaacgagggt

SEQ ID NO: 244358 - DNA, 20 bp, human
gtcccatcgaggaacggggt

SEQ ID NO: 244359 - DNA, 20 bp, human
ggggacagttgagggagctc

SEQ ID NO: 244360 - DNA, 20 bp, human
ggcggcaggtgagagtggtg

SEQ ID NO: 244361 - DNA, 20 bp, human
ggggaccacggccctaagga

SEQ ID NO: 244362 - DNA, 20 bp, human
gaaggcgtggagtcgacggc

SEQ ID NO: 244363 - DNA, 20 bp, human
gaccacggccctaaggaggg

SEQ ID NO: 244364 - DNA, 20 bp, human
gacgacttccgccctcctta

SEQ ID NO: 244365 - DNA, 20 bp, human
ggggagcgagcccaggcggc

SEQ ID NO: 244366 - DNA, 20 bp, human
gcaaagaggtggggacacgg

SEQ ID NO: 244367 - DNA, 20 bp, human
ggtggagtgtaagtttttga

SEQ ID NO: 244368 - DNA, 20 bp, human
gtctttgaatgcaaagaggt

SEQ ID NO: 244369 - DNA, 20 bp, human
gatgggtgggacccagagac

SEQ ID NO: 244370 - DNA, 20 bp, human
ggacccagagacgggagtga

SEQ ID NO: 244371 - DNA, 20 bp, human
ggtagagcagacaaaatatg

SEQ ID NO: 244372 - DNA, 20 bp, human
gaaaaacttacactccacga

SEQ ID NO: 244373 - DNA, 20 bp, human
gaagttgtggaagactggtt

SEQ ID NO: 244374 - DNA, 20 bp, human
gaacttctttgaatgcaaag

SEQ ID NO: 244375 - DNA, 20 bp, human
gcacggaggatctgtcatta

SEQ ID NO: 244376 - DNA, 20 bp, human
gtggtccccaaccatagcgc

SEQ ID NO: 244377 - DNA, 20 bp, human
gccctgcccgtgcaccacgt

SEQ ID NO: 244378 - DNA, 20 bp, human
gcgctcccgggctcccgctg

SEQ ID NO: 244379 - DNA, 20 bp, human
gccaaggggcgcggccaccc

SEQ ID NO: 244380 - DNA, 20 bp, human
gctatggttggggaccaacg

SEQ ID NO: 244381 - DNA, 20 bp, human
ggcagcctgcgctatggttg

SEQ ID NO: 244382 - DNA, 20 bp, human
gtggggaccaacgtggtgca

SEQ ID NO: 244383 - DNA, 20 bp, human
gtggaagagctccgccccaa

SEQ ID NO: 244384 - DNA, 20 bp, human
ggggatggcagcctgcgcta

SEQ ID NO: 244385 - DNA, 20 bp, human
ggaagccaggagatccaggg

SEQ ID NO: 244386 - DNA, 20 bp, human
gccaccgggtcctaggaaag

SEQ ID NO: 244387 - DNA, 20 bp, human
ggggcctcgggtccgctgta

SEQ ID NO: 244388 - DNA, 20 bp, human
gcgcacctgcggcgcctctg

SEQ ID NO: 244389 - DNA, 20 bp, human
gatgaggagcaagaacgcga

SEQ ID NO: 244390 - DNA, 20 bp, human
ggaggtgtgcgttccgtcgg

SEQ ID NO: 244391 - DNA, 20 bp, human
gtgcgggtgcagccttacag

SEQ ID NO: 244392 - DNA, 20 bp, human
gcctctgcggcggccgccgt

SEQ ID NO: 244393 - DNA, 20 bp, human
gacggaacgcacacctccaa

SEQ ID NO: 244394 - DNA, 20 bp, human
ggggcgctccaccgggtcct

SEQ ID NO: 244395 - DNA, 20 bp, human
ggcggggcctcacccaatcc

SEQ ID NO: 244396 - DNA, 20 bp, human
gctggtgtcggggtcgtaga

SEQ ID NO: 244397 - DNA, 20 bp, human
gccagtgtggtctacgtctg

SEQ ID NO: 244398 - DNA, 20 bp, human
gtacgaccccgacaccagtg

SEQ ID NO: 244399 - DNA, 20 bp, human
gctacgtctgcggcaaggtg

SEQ ID NO: 244400 - DNA, 20 bp, human
gacgtagaccacactggtgt

SEQ ID NO: 244401 - DNA, 20 bp, human
gcagggccatgggttcctcg

SEQ ID NO: 244402 - DNA, 20 bp, human
gagggcccacctgcatttag

SEQ ID NO: 244403 - DNA, 20 bp, human
gatgtgccaggaaaacctcg

SEQ ID NO: 244404 - DNA, 20 bp, human
gcaggtgggggtcgtcatgt

SEQ ID NO: 244405 - DNA, 20 bp, human
gaggaactggactcgagcaa

SEQ ID NO: 244406 - DNA, 20 bp, human
ggtagcgaggcgtggaacgt

SEQ ID NO: 244407 - DNA, 20 bp, human
gaaccccgctccggggtcta

SEQ ID NO: 244408 - DNA, 20 bp, human
ggccgcgcgggacccaacca

SEQ ID NO: 244409 - DNA, 20 bp, human
gccccctctggtcgcaccga

SEQ ID NO: 244410 - DNA, 20 bp, human
ggggaagcgggcttcccctc

SEQ ID NO: 244411 - DNA, 20 bp, human
gtgtgcgccacgcccacttc

SEQ ID NO: 244412 - DNA, 20 bp, human
gcatccctcggtgcgaccag

SEQ ID NO: 244413 - DNA, 20 bp, human
ggcgccacgcccacttccgg

SEQ ID NO: 244414 - DNA, 20 bp, human
ggggcgagttctgaagcagt

SEQ ID NO: 244415 - DNA, 20 bp, human
ggggcttcccctccggaagt

SEQ ID NO: 244416 - DNA, 20 bp, human
gagcgcggtcggggtcgtgg

SEQ ID NO: 244417 - DNA, 20 bp, human
gcagcccgccccaatcactg

SEQ ID NO: 244418 - DNA, 20 bp, human
ggggtcgtgggggcggaaaa

SEQ ID NO: 244419 - DNA, 20 bp, human
gcacgccgcagtgattgggg

SEQ ID NO: 244420 - DNA, 20 bp, human
gtcggggcgcgcacacgtgc

SEQ ID NO: 244421 - DNA, 20 bp, human
gacccgcggggcgggcaaaa

SEQ ID NO: 244422 - DNA, 20 bp, human
ggggagccaggagcgcggtc

SEQ ID NO: 244423 - DNA, 20 bp, human
gcgcacacgccgcagtgatt

SEQ ID NO: 244424 - DNA, 20 bp, human
gctggtcccgagagaaggaa

SEQ ID NO: 244425 - DNA, 20 bp, human
ggggcaaaagggcggacctt

SEQ ID NO: 244426 - DNA, 20 bp, human
ggaactcgctacaaaggagg

SEQ ID NO: 244427 - DNA, 20 bp, human
gaggaagcgcagcccgccag

SEQ ID NO: 244428 - DNA, 20 bp, human
gcgggaactcgctacaaagg

SEQ ID NO: 244429 - DNA, 20 bp, human
gcggccggcgatcgagcggg

SEQ ID NO: 244430 - DNA, 20 bp, human
gggccgggaactcgctacaa

SEQ ID NO: 244431 - DNA, 20 bp, human
gcaccgctgctcccggagtc

SEQ ID NO: 244432 - DNA, 20 bp, human
ggagcctcccgctcgatcgc

SEQ ID NO: 244433 - DNA, 20 bp, human
gcacctgccggctgggagaa

SEQ ID NO: 244434 - DNA, 20 bp, human
gcgggcgcccgtccggactc

SEQ ID NO: 244435 - DNA, 20 bp, human
gcgcaggcccgaaggggtta

SEQ ID NO: 244436 - DNA, 20 bp, human
ggaagctgggaggggagtcg

SEQ ID NO: 244437 - DNA, 20 bp, human
gcctacccgggagtcatgga

SEQ ID NO: 244438 - DNA, 20 bp, human
gggagggggcggggcaactt

SEQ ID NO: 244439 - DNA, 20 bp, human
gaggccggcggaagctggga

SEQ ID NO: 244440 - DNA, 20 bp, human
gcgagcctccccagcctacc

SEQ ID NO: 244441 - DNA, 20 bp, human
gagagggcggggctagcata

SEQ ID NO: 244442 - DNA, 20 bp, human
gatgactcccgggtaggctg

SEQ ID NO: 244443 - DNA, 20 bp, human
ggaggctggaatgcgggtgg

SEQ ID NO: 244444 - DNA, 20 bp, human
gccctccctccatgactccc

SEQ ID NO: 244445 - DNA, 20 bp, human
ggcggggctagcataggggc

SEQ ID NO: 244446 - DNA, 20 bp, human
gaggccacgccctgataccg

SEQ ID NO: 244447 - DNA, 20 bp, human
gtgcgcgcgcgaaaggagag

SEQ ID NO: 244448 - DNA, 20 bp, human
gctcccggccaatccaggta

SEQ ID NO: 244449 - DNA, 20 bp, human
gcgccctgataccgagggga

SEQ ID NO: 244450 - DNA, 20 bp, human
gcgcgaaaggagaggggctt

SEQ ID NO: 244451 - DNA, 20 bp, human
gctcgcggggcggccgtacc

SEQ ID NO: 244452 - DNA, 20 bp, human
gcaagcaccgcaggagacgt

SEQ ID NO: 244453 - DNA, 20 bp, human
ggggacggactggcgcgggt

SEQ ID NO: 244454 - DNA, 20 bp, human
gcccgcctcccggccaatcc

SEQ ID NO: 244455 - DNA, 20 bp, human
gggggcggccgtacctggat

SEQ ID NO: 244456 - DNA, 20 bp, human
gaggccacgccctgataccg

SEQ ID NO: 244457 - DNA, 20 bp, human
gtgcgcgcgcgaaaggagag

SEQ ID NO: 244458 - DNA, 20 bp, human
gctcccggccaatccaggta

SEQ ID NO: 244459 - DNA, 20 bp, human
gcgccctgataccgagggga

SEQ ID NO: 244460 - DNA, 20 bp, human
gcgcgaaaggagaggggctt

SEQ ID NO: 244461 - DNA, 20 bp, human
gctcgcggggcggccgtacc

SEQ ID NO: 244462 - DNA, 20 bp, human
gcaagcaccgcaggagacgt

SEQ ID NO: 244463 - DNA, 20 bp, human
ggggacggactggcgcgggt

SEQ ID NO: 244464 - DNA, 20 bp, human
gcccgcctcccggccaatcc

SEQ ID NO: 244465 - DNA, 20 bp, human
gggggcggccgtacctggat

SEQ ID NO: 244466 - DNA, 20 bp, human
gcacaaaagcgctctggggt

SEQ ID NO: 244467 - DNA, 20 bp, human
gtgcccacaaaagcgctctg

SEQ ID NO: 244468 - DNA, 20 bp, human
gcttctgcgtcactgcgcga

SEQ ID NO: 244469 - DNA, 20 bp, human
ggtcactgcgcgagggaaga

SEQ ID NO: 244470 - DNA, 20 bp, human
gacctgaagctttaattaag

SEQ ID NO: 244471 - DNA, 20 bp, human
gtgggctgagaggcagtact

SEQ ID NO: 244472 - DNA, 20 bp, human
gagtactgggagcgattctt

SEQ ID NO: 244473 - DNA, 20 bp, human
ggcaaattcgctctaaacac

SEQ ID NO: 244474 - DNA, 20 bp, human
gtgctataggcataattacg

SEQ ID NO: 244475 - DNA, 20 bp, human
gcacaaaaacagctggagat

SEQ ID NO: 244476 - DNA, 20 bp, human
gcggccaatcccagaccgga

SEQ ID NO: 244477 - DNA, 20 bp, human
gcggcggcccgcctcttcat

SEQ ID NO: 244478 - DNA, 20 bp, human
gtgcgcaagccttccggtct

SEQ ID NO: 244479 - DNA, 20 bp, human
ggcggagcgtcttgattctc

SEQ ID NO: 244480 - DNA, 20 bp, human
gcttgcgcaactccgcggtg

SEQ ID NO: 244481 - DNA, 20 bp, human
gaagccttccggtctgggat

SEQ ID NO: 244482 - DNA, 20 bp, human
gcggagttgcgcaagccttc

SEQ ID NO: 244483 - DNA, 20 bp, human
ggagcgtcttgattctctgg

SEQ ID NO: 244484 - DNA, 20 bp, human
gctggcggccaatcccagac

SEQ ID NO: 244485 - DNA, 20 bp, human
gcctactccagcccccaccg

SEQ ID NO: 244486 - DNA, 20 bp, human
gggactggctggagtgtggc

SEQ ID NO: 244487 - DNA, 20 bp, human
gtggcgggctgacaggtctg

SEQ ID NO: 244488 - DNA, 20 bp, human
gtgtctggaggtgatcggaa

SEQ ID NO: 244489 - DNA, 20 bp, human
ggaaaggagagcgtggtgtc

SEQ ID NO: 244490 - DNA, 20 bp, human
gccggcgggcgggctccgaa

SEQ ID NO: 244491 - DNA, 20 bp, human
gcccctgtgggagtagttcc

SEQ ID NO: 244492 - DNA, 20 bp, human
gcggttcccggaagtccttc

SEQ ID NO: 244493 - DNA, 20 bp, human
gtggagtgtggcgggctgac

SEQ ID NO: 244494 - DNA, 20 bp, human
ggggagctgcaagcgcgggc

SEQ ID NO: 244495 - DNA, 20 bp, human
ggcccggaactactcccaca

SEQ ID NO: 244496 - DNA, 20 bp, human
gaggccgggttgccagatta

SEQ ID NO: 244497 - DNA, 20 bp, human
gggtggcagcgcttgcagtc

SEQ ID NO: 244498 - DNA, 20 bp, human
gtgcaagcttgccatcactt

SEQ ID NO: 244499 - DNA, 20 bp, human
ggcttgcagtcgggctacgg

SEQ ID NO: 244500 - DNA, 20 bp, human
gtacccgtaatctggcaacc

SEQ ID NO: 244501 - DNA, 20 bp, human
ggctccgtctcgcgagatct

SEQ ID NO: 244502 - DNA, 20 bp, human
gcagtcgggctacggaggcc

SEQ ID NO: 244503 - DNA, 20 bp, human
gggctgccgggtcgagacaa

SEQ ID NO: 244504 - DNA, 20 bp, human
gggggaagccgactgcccac

SEQ ID NO: 244505 - DNA, 20 bp, human
gttctggcgagaagcgaagt

SEQ ID NO: 244506 - DNA, 20 bp, human
gcgagagcacggcgcgtctg

SEQ ID NO: 244507 - DNA, 20 bp, human
gtccgcgcaggccgtcactc

SEQ ID NO: 244508 - DNA, 20 bp, human
ggggaactgcgcatcagacg

SEQ ID NO: 244509 - DNA, 20 bp, human
gcgtctgaggatgcgtagta

SEQ ID NO: 244510 - DNA, 20 bp, human
ggcggcaagccgaatcctag

SEQ ID NO: 244511 - DNA, 20 bp, human
ggatgcgtagtaaggataac

SEQ ID NO: 244512 - DNA, 20 bp, human
gctaaggcgggagtccgcgc

SEQ ID NO: 244513 - DNA, 20 bp, human
gtcggcttgccgcgctataa

SEQ ID NO: 244514 - DNA, 20 bp, human
gacaactccgcccactaagg

SEQ ID NO: 244515 - DNA, 20 bp, human
ggacgctaccctcacgtgtc

SEQ ID NO: 244516 - DNA, 20 bp, human
ggctgctggggcgtaggtgt

SEQ ID NO: 244517 - DNA, 20 bp, human
gtgcgactccgctttcgcgg

SEQ ID NO: 244518 - DNA, 20 bp, human
gggaaactgcaggcgcacga

SEQ ID NO: 244519 - DNA, 20 bp, human
ggaaagcggagtcgcaacgc

SEQ ID NO: 244520 - DNA, 20 bp, human
gcgggagccccgccttctct

SEQ ID NO: 244521 - DNA, 20 bp, human
ggaaacggagggcgtgacga

SEQ ID NO: 244522 - DNA, 20 bp, human
ggaggggcaggtagcgagaa

SEQ ID NO: 244523 - DNA, 20 bp, human
gaactgcaggcgcacgaggg

SEQ ID NO: 244524 - DNA, 20 bp, human
gtcccggggtcccctcataa

SEQ ID NO: 244525 - DNA, 20 bp, human
gccgtccgggaaggccggtg

SEQ ID NO: 244526 - DNA, 20 bp, human
gtgcgtccgcccagaaatgt

SEQ ID NO: 244527 - DNA, 20 bp, human
gacgcacaagtatgttacga

SEQ ID NO: 244528 - DNA, 20 bp, human
ggggatttagagatttgaat

SEQ ID NO: 244529 - DNA, 20 bp, human
ggtaacgtcggcgtgcaatt

SEQ ID NO: 244530 - DNA, 20 bp, human
gacgctgacgcccacatttc

SEQ ID NO: 244531 - DNA, 20 bp, human
gctgcttagaacactccctt

SEQ ID NO: 244532 - DNA, 20 bp, human
gatgtgggcgtcagcgtttt

SEQ ID NO: 244533 - DNA, 20 bp, human
ggattacaggccacccaccc

SEQ ID NO: 244534 - DNA, 20 bp, human
ggatcaccaccaaattgatc

SEQ ID NO: 244535 - DNA, 20 bp, human
gtagttaggacccagaacgt

SEQ ID NO: 244536 - DNA, 20 bp, human
gtgaacgctcacctggactg

SEQ ID NO: 244537 - DNA, 20 bp, human
gggcccgctgaacgctcacc

SEQ ID NO: 244538 - DNA, 20 bp, human
gagtgtaaataccacagtcc

SEQ ID NO: 244539 - DNA, 20 bp, human
ggacaggtggggaatttaaa

SEQ ID NO: 244540 - DNA, 20 bp, human
gcgcagaagaggcaaaattc

SEQ ID NO: 244541 - DNA, 20 bp, human
gcttgcgcatgcgctgaagg

SEQ ID NO: 244542 - DNA, 20 bp, human
gcgactgccggaagtgactg

SEQ ID NO: 244543 - DNA, 20 bp, human
gtgttaaatcaacttgggga

SEQ ID NO: 244544 - DNA, 20 bp, human
gaattcgggccttaacgaga

SEQ ID NO: 244545 - DNA, 20 bp, human
gtgggcttccgtttcgatat

SEQ ID NO: 244546 - DNA, 20 bp, human
gtggatgtgacgcaagagat

SEQ ID NO: 244547 - DNA, 20 bp, human
gttcccacgcggcactggac

SEQ ID NO: 244548 - DNA, 20 bp, human
gggcctgtccagtgccgcgt

SEQ ID NO: 244549 - DNA, 20 bp, human
gtgactgggaaggtcaatcg

SEQ ID NO: 244550 - DNA, 20 bp, human
gctagggtgtagttagtccg

SEQ ID NO: 244551 - DNA, 20 bp, human
gactaactacaccctagcag

SEQ ID NO: 244552 - DNA, 20 bp, human
gctgcgacgcaagacgtcac

SEQ ID NO: 244553 - DNA, 20 bp, human
gcgaaagtttcccgctgcta

SEQ ID NO: 244554 - DNA, 20 bp, human
gcagtgccgcgtgggaaagg

SEQ ID NO: 244555 - DNA, 20 bp, human
ggtcaccggcttgactggga

SEQ ID NO: 244556 - DNA, 20 bp, human
gcaagctcctgagccccggt

SEQ ID NO: 244557 - DNA, 20 bp, human
gaggagcttgctgactccga

SEQ ID NO: 244558 - DNA, 20 bp, human
ggccccggtgggcgctgccc

SEQ ID NO: 244559 - DNA, 20 bp, human
gagcgccgagcacgtcgagc

SEQ ID NO: 244560 - DNA, 20 bp, human
gctgctaccgactgctgtga

SEQ ID NO: 244561 - DNA, 20 bp, human
gagcgccgagcaggcacccc

SEQ ID NO: 244562 - DNA, 20 bp, human
gtggaattggtgagaaaccg

SEQ ID NO: 244563 - DNA, 20 bp, human
gaagcccgggcagcgcccac

SEQ ID NO: 244564 - DNA, 20 bp, human
gtcatcacggggcccatccg

SEQ ID NO: 244565 - DNA, 20 bp, human
ggactgctgtgagggtccca

SEQ ID NO: 244566 - DNA, 20 bp, human
gcggccccgtgcggccactg

SEQ ID NO: 244567 - DNA, 20 bp, human
gcgggagagcggaaggagat

SEQ ID NO: 244568 - DNA, 20 bp, human
gtcgccaggaatctaggagt

SEQ ID NO: 244569 - DNA, 20 bp, human
ggcggccggcgcgtcggaac

SEQ ID NO: 244570 - DNA, 20 bp, human
gcccacctcgccaggaatct

SEQ ID NO: 244571 - DNA, 20 bp, human
gtgagcacgcgcgccggaga

SEQ ID NO: 244572 - DNA, 20 bp, human
ggcggccactgcggagcgtt

SEQ ID NO: 244573 - DNA, 20 bp, human
gcccgtggccggaaggacaa

SEQ ID NO: 244574 - DNA, 20 bp, human
gcgccggagacggttagaaa

SEQ ID NO: 244575 - DNA, 20 bp, human
gccagcgcggagcgccttcc

SEQ ID NO: 244576 - DNA, 20 bp, human
ggaagcgcgactggagtctg

SEQ ID NO: 244577 - DNA, 20 bp, human
ggccgggccgggctgctttc

SEQ ID NO: 244578 - DNA, 20 bp, human
ggcggagcaccacgggatcg

SEQ ID NO: 244579 - DNA, 20 bp, human
gtggagaggctgctttccgg

SEQ ID NO: 244580 - DNA, 20 bp, human
ggccgggcgagaagcgcgac

SEQ ID NO: 244581 - DNA, 20 bp, human
gggtcaccgtggagcggaaa

SEQ ID NO: 244582 - DNA, 20 bp, human
gacgtcgtaaaatgccgggc

SEQ ID NO: 244583 - DNA, 20 bp, human
ggccgcgccgcggagcacca

SEQ ID NO: 244584 - DNA, 20 bp, human
gcccgcacccggccgcacgg

SEQ ID NO: 244585 - DNA, 20 bp, human
gtccagtcgcgcttctcgcc

SEQ ID NO: 244586 - DNA, 20 bp, human
gcagaggcaggaccccggta

SEQ ID NO: 244587 - DNA, 20 bp, human
gcaccccggcccacagattg

SEQ ID NO: 244588 - DNA, 20 bp, human
ggacagtagtcccaagaaca

SEQ ID NO: 244589 - DNA, 20 bp, human
gtgtgggccggggtgccccc

SEQ ID NO: 244590 - DNA, 20 bp, human
gccggtagggacactgatgc

SEQ ID NO: 244591 - DNA, 20 bp, human
gccccccaatctgtgggccg

SEQ ID NO: 244592 - DNA, 20 bp, human
gcgcacagcctgcgtccctg

SEQ ID NO: 244593 - DNA, 20 bp, human
ggcagggagaccctgttctt

SEQ ID NO: 244594 - DNA, 20 bp, human
gtgcgtccctgggggcaccc

SEQ ID NO: 244595 - DNA, 20 bp, human
ggtgcctccccccaatctgt

SEQ ID NO: 244596 - DNA, 20 bp, human
gtcgcgtcccgccttgtctc

SEQ ID NO: 244597 - DNA, 20 bp, human
gtcccgccttgtctctggtc

SEQ ID NO: 244598 - DNA, 20 bp, human
gcagctgccatcctgtaagt

SEQ ID NO: 244599 - DNA, 20 bp, human
gtaagtaggaatggaggcga

SEQ ID NO: 244600 - DNA, 20 bp, human
gactcgaacaagatcacggt

SEQ ID NO: 244601 - DNA, 20 bp, human
gggcccgcccactgcgactc

SEQ ID NO: 244602 - DNA, 20 bp, human
gcactgcgactctggcgcgt

SEQ ID NO: 244603 - DNA, 20 bp, human
gactctggcgcgtgggcggg

SEQ ID NO: 244604 - DNA, 20 bp, human
gtgcgactctggcgcgtggg

SEQ ID NO: 244605 - DNA, 20 bp, human
ggcaacccgcgagcttacac

SEQ ID NO: 244606 - DNA, 20 bp, human
gtgggagtgggcgggctcga

SEQ ID NO: 244607 - DNA, 20 bp, human
gccgcccccgccacagtctt

SEQ ID NO: 244608 - DNA, 20 bp, human
gccgcccactcccaagactg

SEQ ID NO: 244609 - DNA, 20 bp, human
gccaagcctcagccactacg

SEQ ID NO: 244610 - DNA, 20 bp, human
gctgcaccgcgtagtggctg

SEQ ID NO: 244611 - DNA, 20 bp, human
gagacaggagggacttccgg

SEQ ID NO: 244612 - DNA, 20 bp, human
gcacctcccagcgttattaa

SEQ ID NO: 244613 - DNA, 20 bp, human
ggggttgcctttaataacgc

SEQ ID NO: 244614 - DNA, 20 bp, human
gggaccccctaccaggacca

SEQ ID NO: 244615 - DNA, 20 bp, human
gaacaagctgcagagacagg

SEQ ID NO: 244616 - DNA, 20 bp, human
gaacctgagcactatcatcc

SEQ ID NO: 244617 - DNA, 20 bp, human
ggtcccggatgatagtgctc

SEQ ID NO: 244618 - DNA, 20 bp, human
gcgcccaggtggggacggta

SEQ ID NO: 244619 - DNA, 20 bp, human
gtcaaaatcctcggcatctc

SEQ ID NO: 244620 - DNA, 20 bp, human
gaacggtaaagcctgaaggg

SEQ ID NO: 244621 - DNA, 20 bp, human
ggacaaggactccgtcgtcc

SEQ ID NO: 244622 - DNA, 20 bp, human
ggagtccttgtcaaaatcct

SEQ ID NO: 244623 - DNA, 20 bp, human
ggggacggtagggagaccgg

SEQ ID NO: 244624 - DNA, 20 bp, human
gggcacacgcatgcgcacga

SEQ ID NO: 244625 - DNA, 20 bp, human
ggtggggacggtagggagac

SEQ ID NO: 244626 - DNA, 20 bp, human
gcactggcggctattcttag

SEQ ID NO: 244627 - DNA, 20 bp, human
gcaactgtgtgccagccacc

SEQ ID NO: 244628 - DNA, 20 bp, human
ggcctccttgccaaaataag

SEQ ID NO: 244629 - DNA, 20 bp, human
gttccctattctatgcctgg

SEQ ID NO: 244630 - DNA, 20 bp, human
gtgattggcccagagagggg

SEQ ID NO: 244631 - DNA, 20 bp, human
gttgccaaaataagaggcac

SEQ ID NO: 244632 - DNA, 20 bp, human
gtgtcctgtgcctcttattt

SEQ ID NO: 244633 - DNA, 20 bp, human
gagatgacctcaagccagtc

SEQ ID NO: 244634 - DNA, 20 bp, human
gtgtcctcgctccctttcct

SEQ ID NO: 244635 - DNA, 20 bp, human
ggccaatcacctgttgagtc

SEQ ID NO: 244636 - DNA, 20 bp, human
gactacgggagtcttgcgag

SEQ ID NO: 244637 - DNA, 20 bp, human
gagaactacgactttctatt

SEQ ID NO: 244638 - DNA, 20 bp, human
ggtggcttgaatgacttcag

SEQ ID NO: 244639 - DNA, 20 bp, human
ggccgcgcaagctcacgatt

SEQ ID NO: 244640 - DNA, 20 bp, human
gctggggctcgggcgcccgt

SEQ ID NO: 244641 - DNA, 20 bp, human
gtgagagaggtggggactac

SEQ ID NO: 244642 - DNA, 20 bp, human
ggagagtgttatagatcccg

SEQ ID NO: 244643 - DNA, 20 bp, human
gatgagatcgggtaacccac

SEQ ID NO: 244644 - DNA, 20 bp, human
gaagtcgtagttctcttgct

SEQ ID NO: 244645 - DNA, 20 bp, human
gaccagccggaagctgagag

SEQ ID NO: 244646 - DNA, 20 bp, human
gtcccccgacgccccctcgg

SEQ ID NO: 244647 - DNA, 20 bp, human
gcacgcgcaggcccccgagg

SEQ ID NO: 244648 - DNA, 20 bp, human
ggcccccgagggggcgtcgg

SEQ ID NO: 244649 - DNA, 20 bp, human
gcgtcgggggagcaaggggt

SEQ ID NO: 244650 - DNA, 20 bp, human
gccagccccgcggtgcacga

SEQ ID NO: 244651 - DNA, 20 bp, human
ggtgcaccgcggggctggta

SEQ ID NO: 244652 - DNA, 20 bp, human
ggtgcgactcgctgagtctc

SEQ ID NO: 244653 - DNA, 20 bp, human
gggagccgtcgtgcaccgcg

SEQ ID NO: 244654 - DNA, 20 bp, human
ggggggcgtcgggggagcaa

SEQ ID NO: 244655 - DNA, 20 bp, human
gggtgcgcacagaaccctcg

SEQ ID NO: 244656 - DNA, 20 bp, human
gcagaccacgaaatgaactt

SEQ ID NO: 244657 - DNA, 20 bp, human
gacagccgaagttcatttcg

SEQ ID NO: 244658 - DNA, 20 bp, human
gcacagcgagaacgcggcga

SEQ ID NO: 244659 - DNA, 20 bp, human
gagagtgcacagcgagaacg

SEQ ID NO: 244660 - DNA, 20 bp, human
gctgtgtgaccttgcaaaac

SEQ ID NO: 244661 - DNA, 20 bp, human
gaagaggtcgataaataagg

SEQ ID NO: 244662 - DNA, 20 bp, human
gcctctagtgcgcccaccgc

SEQ ID NO: 244663 - DNA, 20 bp, human
gccaaacggttattcgcgta

SEQ ID NO: 244664 - DNA, 20 bp, human
gaggtcaagcccgttttgca

SEQ ID NO: 244665 - DNA, 20 bp, human
gtcggtttgtgcacatggtt

SEQ ID NO: 244666 - DNA, 20 bp, human
gggcaagtgcaactcctccc

SEQ ID NO: 244667 - DNA, 20 bp, human
gccgcagcgcgcatccgttt

SEQ ID NO: 244668 - DNA, 20 bp, human
gggcagggagagatccgggg

SEQ ID NO: 244669 - DNA, 20 bp, human
ggcgcgcagcgtgacagctg

SEQ ID NO: 244670 - DNA, 20 bp, human
gtcctcggattcgtccacca

SEQ ID NO: 244671 - DNA, 20 bp, human
gcagcgggcagggagagatc

SEQ ID NO: 244672 - DNA, 20 bp, human
gggagcccaaagcggtacca

SEQ ID NO: 244673 - DNA, 20 bp, human
gtggaccgcctcctccgtgg

SEQ ID NO: 244674 - DNA, 20 bp, human
ggggctggggctgggttgcg

SEQ ID NO: 244675 - DNA, 20 bp, human
ggcggtccagacccgcaccc

SEQ ID NO: 244676 - DNA, 20 bp, human
gaaaaactagagcggcagta

SEQ ID NO: 244677 - DNA, 20 bp, human
gaggctggtccctggagcta

SEQ ID NO: 244678 - DNA, 20 bp, human
gggtccctggagctaaggct

SEQ ID NO: 244679 - DNA, 20 bp, human
gaaggtcaggaacgagatca

SEQ ID NO: 244680 - DNA, 20 bp, human
gcggctctatccgctctagc

SEQ ID NO: 244681 - DNA, 20 bp, human
gagcctactgaacatcgaaa

SEQ ID NO: 244682 - DNA, 20 bp, human
gaggagcgcaagcctctctt

SEQ ID NO: 244683 - DNA, 20 bp, human
ggacggcgagccggctagag

SEQ ID NO: 244684 - DNA, 20 bp, human
gcgggactgagacggcgagc

SEQ ID NO: 244685 - DNA, 20 bp, human
gccggcgtggccattttcgt

SEQ ID NO: 244686 - DNA, 20 bp, human
gggactaagcccggcagtgt

SEQ ID NO: 244687 - DNA, 20 bp, human
gagagcacgcaaagtcgctg

SEQ ID NO: 244688 - DNA, 20 bp, human
gggacccggtgctgggacta

SEQ ID NO: 244689 - DNA, 20 bp, human
gggcggggctacatcgaagc

SEQ ID NO: 244690 - DNA, 20 bp, human
ggcactgcccaaatctgaat

SEQ ID NO: 244691 - DNA, 20 bp, human
gggtccttgcgctgagtctc

SEQ ID NO: 244692 - DNA, 20 bp, human
gaagcccggcggactaagcc

SEQ ID NO: 244693 - DNA, 20 bp, human
gcggcagtgtcggagtcagg

SEQ ID NO: 244694 - DNA, 20 bp, human
ggggttctcaggaccacgaa

SEQ ID NO: 244695 - DNA, 20 bp, human
ggaccacagccggggaggcg

SEQ ID NO: 244696 - DNA, 20 bp, human
gcggtcgaagatctgtctct

SEQ ID NO: 244697 - DNA, 20 bp, human
gtaaaatgacgtatggtggg

SEQ ID NO: 244698 - DNA, 20 bp, human
gttcccgcgaggaaaaataa

SEQ ID NO: 244699 - DNA, 20 bp, human
gaggaaaaataaaggccttt

SEQ ID NO: 244700 - DNA, 20 bp, human
gagctctaaacctggcttca

SEQ ID NO: 244701 - DNA, 20 bp, human
gctctatagagctctaaacc

SEQ ID NO: 244702 - DNA, 20 bp, human
gttataaaatgacgtatggt

SEQ ID NO: 244703 - DNA, 20 bp, human
gtcttcgaccgaatcgtcta

SEQ ID NO: 244704 - DNA, 20 bp, human
gtaaggaactagcttcaaaa

SEQ ID NO: 244705 - DNA, 20 bp, human
gggcctttatttttcctcgc

SEQ ID NO: 244706 - DNA, 20 bp, human
gggaagaggcggtcacatga

SEQ ID NO: 244707 - DNA, 20 bp, human
gcaaacaaaagaattgagat

SEQ ID NO: 244708 - DNA, 20 bp, human
ggtgtcactaggaattatgt

SEQ ID NO: 244709 - DNA, 20 bp, human
gaggaattatgttggtaggt

SEQ ID NO: 244710 - DNA, 20 bp, human
gggaaggaaaagatcccaac

SEQ ID NO: 244711 - DNA, 20 bp, human
gtagatgattgctatctcca

SEQ ID NO: 244712 - DNA, 20 bp, human
ggatcccaacaggtgtcact

SEQ ID NO: 244713 - DNA, 20 bp, human
ggagatagctgcgacatgga

SEQ ID NO: 244714 - DNA, 20 bp, human
gtaaggcggaaactgctcac

SEQ ID NO: 244715 - DNA, 20 bp, human
gagtttccgccttaggtgaa

SEQ ID NO: 244716 - DNA, 20 bp, human
ggagccttatcagcccccga

SEQ ID NO: 244717 - DNA, 20 bp, human
ggattcctggggcctgttac

SEQ ID NO: 244718 - DNA, 20 bp, human
gtcaacagactagagtatac

SEQ ID NO: 244719 - DNA, 20 bp, human
gtcgcgccaggcttaggtct

SEQ ID NO: 244720 - DNA, 20 bp, human
gaatccttcgggggctgata

SEQ ID NO: 244721 - DNA, 20 bp, human
gggctgataaggctccgcaa

SEQ ID NO: 244722 - DNA, 20 bp, human
gtcagcccccgaaggattgt

SEQ ID NO: 244723 - DNA, 20 bp, human
ggacaaagcggaaatcgccc

SEQ ID NO: 244724 - DNA, 20 bp, human
gggaaatcgccctggattgt

SEQ ID NO: 244725 - DNA, 20 bp, human
gatttcccacaatccttcgg

SEQ ID NO: 244726 - DNA, 20 bp, human
gagcgtaggaaggtgtcaat

SEQ ID NO: 244727 - DNA, 20 bp, human
gtgtgctccgcccatagcgt

SEQ ID NO: 244728 - DNA, 20 bp, human
gctatgggcggagcacaaaa

SEQ ID NO: 244729 - DNA, 20 bp, human
ggaggagtcaagaacagttt

SEQ ID NO: 244730 - DNA, 20 bp, human
gtgacaccttcctacgctat

SEQ ID NO: 244731 - DNA, 20 bp, human
ggtgtcaattggctgtttcg

SEQ ID NO: 244732 - DNA, 20 bp, human
ggagttatgttccgcctcca

SEQ ID NO: 244733 - DNA, 20 bp, human
gacgcgccaaaaactgccaa

SEQ ID NO: 244734 - DNA, 20 bp, human
ggcttctcgcgtacatgatt

SEQ ID NO: 244735 - DNA, 20 bp, human
gtacttgtgaatgacatctg

SEQ ID NO: 244736 - DNA, 20 bp, human
gggtactgaactgaagagag

SEQ ID NO: 244737 - DNA, 20 bp, human
ggagtggtgagcggaagagg

SEQ ID NO: 244738 - DNA, 20 bp, human
ggagccctgagtggaaaagg

SEQ ID NO: 244739 - DNA, 20 bp, human
ggtgtgctgggtggaagggg

SEQ ID NO: 244740 - DNA, 20 bp, human
ggaaaaggcggggcagagca

SEQ ID NO: 244741 - DNA, 20 bp, human
ggagcagagcaggggtgtgc

SEQ ID NO: 244742 - DNA, 20 bp, human
gaatgccagggcatgttaag

SEQ ID NO: 244743 - DNA, 20 bp, human
gcaaagcacggactgctgag

SEQ ID NO: 244744 - DNA, 20 bp, human
gaaggagtggtgagcggaag

SEQ ID NO: 244745 - DNA, 20 bp, human
gagaggataggacacgtggg

SEQ ID NO: 244746 - DNA, 20 bp, human
gcattgtgtaaattccagga

SEQ ID NO: 244747 - DNA, 20 bp, human
gtgctgtgacatattgtcag

SEQ ID NO: 244748 - DNA, 20 bp, human
ggttattgttggaggcatta

SEQ ID NO: 244749 - DNA, 20 bp, human
gaaaacagttcttggttgcc

SEQ ID NO: 244750 - DNA, 20 bp, human
gtacgagaacttaactgaat

SEQ ID NO: 244751 - DNA, 20 bp, human
gcaaccaagaactgtttttt

SEQ ID NO: 244752 - DNA, 20 bp, human
gctggaatttacacaatgaa

SEQ ID NO: 244753 - DNA, 20 bp, human
gagtcaacagttattgttgg

SEQ ID NO: 244754 - DNA, 20 bp, human
gtgtgtcaatcaagcaaata

SEQ ID NO: 244755 - DNA, 20 bp, human
gctaaaagtgcactgtttgc

SEQ ID NO: 244756 - DNA, 20 bp, human
gggggcctgagggtcagcgg

SEQ ID NO: 244757 - DNA, 20 bp, human
gggccccagatggtcggggg

SEQ ID NO: 244758 - DNA, 20 bp, human
gcccgctggccccagatggt

SEQ ID NO: 244759 - DNA, 20 bp, human
gctccacccccgaccatctg

SEQ ID NO: 244760 - DNA, 20 bp, human
ggctggccccagatggtcgg

SEQ ID NO: 244761 - DNA, 20 bp, human
gtgggacaggacccaggtgc

SEQ ID NO: 244762 - DNA, 20 bp, human
gaggccccgctggccccaga

SEQ ID NO: 244763 - DNA, 20 bp, human
gccctccatgataaagtggc

SEQ ID NO: 244764 - DNA, 20 bp, human
gcgagcccccgctgaccctc

SEQ ID NO: 244765 - DNA, 20 bp, human
gctgtcccacggggaggctg

SEQ ID NO: 244766 - DNA, 20 bp, human
gggaatgggccacatctaca

SEQ ID NO: 244767 - DNA, 20 bp, human
ggcagctgagggtgatctgc

SEQ ID NO: 244768 - DNA, 20 bp, human
gcacattggtgatatcacac

SEQ ID NO: 244769 - DNA, 20 bp, human
gctcacgtgaattcccacat

SEQ ID NO: 244770 - DNA, 20 bp, human
gggtagctagtggcgtttta

SEQ ID NO: 244771 - DNA, 20 bp, human
ggtgtacatgttccattcct

SEQ ID NO: 244772 - DNA, 20 bp, human
gaaattgctagagcatacca

SEQ ID NO: 244773 - DNA, 20 bp, human
gaagtttgttatcttatcct

SEQ ID NO: 244774 - DNA, 20 bp, human
gattggtgatatcacacagg

SEQ ID NO: 244775 - DNA, 20 bp, human
gacctctaggtctattaatc

SEQ ID NO: 244776 - DNA, 20 bp, human
gataagtagcatgtgcttgg

SEQ ID NO: 244777 - DNA, 20 bp, human
gcagctgctcatcaagataa

SEQ ID NO: 244778 - DNA, 20 bp, human
ggggtatttcctattgcaaa

SEQ ID NO: 244779 - DNA, 20 bp, human
gtagataagtagcatgtgct

SEQ ID NO: 244780 - DNA, 20 bp, human
gaaagtatgttcacagagct

SEQ ID NO: 244781 - DNA, 20 bp, human
gtgtgcaacagaaccctaag

SEQ ID NO: 244782 - DNA, 20 bp, human
gtggccaagttatttgctaa

SEQ ID NO: 244783 - DNA, 20 bp, human
gagcagctgatttcctctta

SEQ ID NO: 244784 - DNA, 20 bp, human
gtttttttttccagctggag

SEQ ID NO: 244785 - DNA, 20 bp, human
gttctgcttgaattgaatga

SEQ ID NO: 244786 - DNA, 20 bp, human
gaatgggagaggcattggta

SEQ ID NO: 244787 - DNA, 20 bp, human
ggctgaaaaagtctgtgcca

SEQ ID NO: 244788 - DNA, 20 bp, human
gaactctgactgtgacaggc

SEQ ID NO: 244789 - DNA, 20 bp, human
gtgtcacagtcagagttgca

SEQ ID NO: 244790 - DNA, 20 bp, human
gtcagagttgcaagggtgct

SEQ ID NO: 244791 - DNA, 20 bp, human
gtcaacctttatcacttgaa

SEQ ID NO: 244792 - DNA, 20 bp, human
gcatctcaatttacaaggtc

SEQ ID NO: 244793 - DNA, 20 bp, human
gagaggtcagattataaacc

SEQ ID NO: 244794 - DNA, 20 bp, human
gaccagggcaggtcaggatg

SEQ ID NO: 244795 - DNA, 20 bp, human
gcattcctttcaagtgataa

SEQ ID NO: 244796 - DNA, 20 bp, human
gccttctcttagagccggaa

SEQ ID NO: 244797 - DNA, 20 bp, human
gggattcaggggaatttttt

SEQ ID NO: 244798 - DNA, 20 bp, human
gctagagcttgattggattc

SEQ ID NO: 244799 - DNA, 20 bp, human
gagctgctgtagaataaaag

SEQ ID NO: 244800 - DNA, 20 bp, human
ggattcaggcagtatctgac

SEQ ID NO: 244801 - DNA, 20 bp, human
ggccaggtctagagcttgat

SEQ ID NO: 244802 - DNA, 20 bp, human
ggctacatctattatcaccg

SEQ ID NO: 244803 - DNA, 20 bp, human
ggagagacaactgctcaatg

SEQ ID NO: 244804 - DNA, 20 bp, human
gtgcatgcgcagaccttgct

SEQ ID NO: 244805 - DNA, 20 bp, human
gagaggagtatttccccttc

SEQ ID NO: 244806 - DNA, 20 bp, human
gtagtggctatcctactggg

SEQ ID NO: 244807 - DNA, 20 bp, human
gccactaacctcttgaaatg

SEQ ID NO: 244808 - DNA, 20 bp, human
gtgtggttgaatattgattt

SEQ ID NO: 244809 - DNA, 20 bp, human
gaggttagtggctatcctac

SEQ ID NO: 244810 - DNA, 20 bp, human
gcttctaagttcatgttaga

SEQ ID NO: 244811 - DNA, 20 bp, human
ggctatcctactggggggtg

SEQ ID NO: 244812 - DNA, 20 bp, human
ggcaattatcagcttatggc

SEQ ID NO: 244813 - DNA, 20 bp, human
gaaagccaaaatgaggtatt

SEQ ID NO: 244814 - DNA, 20 bp, human
gttgacctaatacctcattt

SEQ ID NO: 244815 - DNA, 20 bp, human
gctgaaagcaccatctccaa

SEQ ID NO: 244816 - DNA, 20 bp, human
ggaattgccaggacaggatg

SEQ ID NO: 244817 - DNA, 20 bp, human
gatactgtgcagttgaagtc

SEQ ID NO: 244818 - DNA, 20 bp, human
gggggtaggggaccctagtg

SEQ ID NO: 244819 - DNA, 20 bp, human
gtggggcagggaggagcaaa

SEQ ID NO: 244820 - DNA, 20 bp, human
ggccctcctgcccttggtga

SEQ ID NO: 244821 - DNA, 20 bp, human
ggctcctccctgccccacta

SEQ ID NO: 244822 - DNA, 20 bp, human
gtagggtcccctacccccat

SEQ ID NO: 244823 - DNA, 20 bp, human
ggccaatagaggccttccct

SEQ ID NO: 244824 - DNA, 20 bp, human
ggggcacaggctgccaatag

SEQ ID NO: 244825 - DNA, 20 bp, human
gggctcccatccctgggaat

SEQ ID NO: 244826 - DNA, 20 bp, human
ggcagagaggagtcacccaa

SEQ ID NO: 244827 - DNA, 20 bp, human
gcctccctcgtgctgactca

SEQ ID NO: 244828 - DNA, 20 bp, human
gggaggcccagccctttcta

SEQ ID NO: 244829 - DNA, 20 bp, human
gactcacggcaggggttcac

SEQ ID NO: 244830 - DNA, 20 bp, human
gtcgtgctgactcacggcag

SEQ ID NO: 244831 - DNA, 20 bp, human
gcactgggtgctgcttcctt

SEQ ID NO: 244832 - DNA, 20 bp, human
ggaagccagctgttcggatc

SEQ ID NO: 244833 - DNA, 20 bp, human
gccgtttaggaatctgtcat

SEQ ID NO: 244834 - DNA, 20 bp, human
gtgggctaaacaagcagaca

SEQ ID NO: 244835 - DNA, 20 bp, human
ggggagcctgattaaagatc

SEQ ID NO: 244836 - DNA, 20 bp, human
gtggggggtcgggtccgagg

SEQ ID NO: 244837 - DNA, 20 bp, human
gaagggatcggggcgggtcg

SEQ ID NO: 244838 - DNA, 20 bp, human
gtaagtgaggggacgatccc

SEQ ID NO: 244839 - DNA, 20 bp, human
gccggggagggggccataag

SEQ ID NO: 244840 - DNA, 20 bp, human
gggagggggccataaggggc

SEQ ID NO: 244841 - DNA, 20 bp, human
ggggccataaggggctggct

SEQ ID NO: 244842 - DNA, 20 bp, human
gcccaggggcccctggtgag

SEQ ID NO: 244843 - DNA, 20 bp, human
ggggcactagatacaggcca

SEQ ID NO: 244844 - DNA, 20 bp, human
gggtccggtgagtaagtgag

SEQ ID NO: 244845 - DNA, 20 bp, human
gcggagcaggcgtcccggga

SEQ ID NO: 244846 - DNA, 20 bp, human
gtgctcaagggaacttgtta

SEQ ID NO: 244847 - DNA, 20 bp, human
gtagctgtgtaaagtctgag

SEQ ID NO: 244848 - DNA, 20 bp, human
gagactggaaaagtgctcaa

SEQ ID NO: 244849 - DNA, 20 bp, human
gaagaaagcaaagaacactc

SEQ ID NO: 244850 - DNA, 20 bp, human
ggaggagtacagaagtagac

SEQ ID NO: 244851 - DNA, 20 bp, human
gagactttacacagctacca

SEQ ID NO: 244852 - DNA, 20 bp, human
gtttcctggcattgttgcct

SEQ ID NO: 244853 - DNA, 20 bp, human
gatagttcctgtttgcaatc

SEQ ID NO: 244854 - DNA, 20 bp, human
gtcttctcctgattgcaaac

SEQ ID NO: 244855 - DNA, 20 bp, human
gcaaatgttactctgatttc

SEQ ID NO: 244856 - DNA, 20 bp, human
gtaactccttggggaaggta

SEQ ID NO: 244857 - DNA, 20 bp, human
gttgaaaaagtcagaggcaa

SEQ ID NO: 244858 - DNA, 20 bp, human
gaatacagtaggatcttgtc

SEQ ID NO: 244859 - DNA, 20 bp, human
gacaaactgcacttcaacat

SEQ ID NO: 244860 - DNA, 20 bp, human
gggtagggccaagaataaaa

SEQ ID NO: 244861 - DNA, 20 bp, human
gggtagatctccctcaacat

SEQ ID NO: 244862 - DNA, 20 bp, human
ggctaagttgattgacccac

SEQ ID NO: 244863 - DNA, 20 bp, human
gaaaagggtagtaatacagt

SEQ ID NO: 244864 - DNA, 20 bp, human
gagaaaatgtgtaactcctt

SEQ ID NO: 244865 - DNA, 20 bp, human
gatgttccctcttgttcctg

SEQ ID NO: 244866 - DNA, 20 bp, human
gaggcccgcccagagggaat

SEQ ID NO: 244867 - DNA, 20 bp, human
gtcactctcttccttcgcca

SEQ ID NO: 244868 - DNA, 20 bp, human
gagaagaagaaccttggcga

SEQ ID NO: 244869 - DNA, 20 bp, human
gagggaatcggctgctttaa

SEQ ID NO: 244870 - DNA, 20 bp, human
gcaaactcgtcccggacggg

SEQ ID NO: 244871 - DNA, 20 bp, human
gggcctgccctcctcccgtc

SEQ ID NO: 244872 - DNA, 20 bp, human
ggtggagcgtcaccaccagg

SEQ ID NO: 244873 - DNA, 20 bp, human
gaaagcagccgattccctct

SEQ ID NO: 244874 - DNA, 20 bp, human
gcaccaggcccgtccgcgat

SEQ ID NO: 244875 - DNA, 20 bp, human
ggccgcagccaatcgcggac

SEQ ID NO: 244876 - DNA, 20 bp, human
gggccggcgtggatctggga

SEQ ID NO: 244877 - DNA, 20 bp, human
gggctgctggcgttatttgc

SEQ ID NO: 244878 - DNA, 20 bp, human
gacagctaaggtccggggtt

SEQ ID NO: 244879 - DNA, 20 bp, human
gagccctcccagatccacgc

SEQ ID NO: 244880 - DNA, 20 bp, human
ggctccacgggctgcactac

SEQ ID NO: 244881 - DNA, 20 bp, human
gagggggccggcggagagac

SEQ ID NO: 244882 - DNA, 20 bp, human
ggacgggccggcgtggatct

SEQ ID NO: 244883 - DNA, 20 bp, human
gagaaaccactgcgaggagg

SEQ ID NO: 244884 - DNA, 20 bp, human
gaaatgacagctaaggtccg

SEQ ID NO: 244885 - DNA, 20 bp, human
gagtgacgtgggtgggtcat

SEQ ID NO: 244886 - DNA, 20 bp, human
gagcggatgtaaggagaagc

SEQ ID NO: 244887 - DNA, 20 bp, human
gaggatgtggagcggatgta

SEQ ID NO: 244888 - DNA, 20 bp, human
ggcactgaaactaacgcaaa

SEQ ID NO: 244889 - DNA, 20 bp, human
gtaacgcaaatggtggaatt

SEQ ID NO: 244890 - DNA, 20 bp, human
gacagacccttctattacac

SEQ ID NO: 244891 - DNA, 20 bp, human
gcatagatatttgactgtgg

SEQ ID NO: 244892 - DNA, 20 bp, human
ggatatttgactgtgggggt

SEQ ID NO: 244893 - DNA, 20 bp, human
gatacatagatatttgactg

SEQ ID NO: 244894 - DNA, 20 bp, human
gcaggggtggcaaaggtgga

SEQ ID NO: 244895 - DNA, 20 bp, human
gaaggtggaaggatgtggag

SEQ ID NO: 244896 - DNA, 20 bp, human
ggcagacagtgactcggcaa

SEQ ID NO: 244897 - DNA, 20 bp, human
gcgatcgccgccgctcgcag

SEQ ID NO: 244898 - DNA, 20 bp, human
ggcaagggtcacttaggtga

SEQ ID NO: 244899 - DNA, 20 bp, human
ggtgccctctttcgttaaga

SEQ ID NO: 244900 - DNA, 20 bp, human
gcggcctgctaggaggggcg

SEQ ID NO: 244901 - DNA, 20 bp, human
gctagcaggccgagccgagg

SEQ ID NO: 244902 - DNA, 20 bp, human
gctcgccctggagagatcac

SEQ ID NO: 244903 - DNA, 20 bp, human
gtacaagcccctgcgagcgg

SEQ ID NO: 244904 - DNA, 20 bp, human
gcccagggcagacagtgact

SEQ ID NO: 244905 - DNA, 20 bp, human
ggcccgggcggggccgacac

SEQ ID NO: 244906 - DNA, 20 bp, human
gggttcttaagcggccaggg

SEQ ID NO: 244907 - DNA, 20 bp, human
gcgccggcgctggggttgcg

SEQ ID NO: 244908 - DNA, 20 bp, human
gggcgctgacgcacgttccg

SEQ ID NO: 244909 - DNA, 20 bp, human
gcgctcccggggaaatggac

SEQ ID NO: 244910 - DNA, 20 bp, human
gagcgagcggcgtgtcccgt

SEQ ID NO: 244911 - DNA, 20 bp, human
ggggcggcgcgattgtgagg

SEQ ID NO: 244912 - DNA, 20 bp, human
gctcgcgctcccgggagggc

SEQ ID NO: 244913 - DNA, 20 bp, human
gagggcgcgctcgcgctccc

SEQ ID NO: 244914 - DNA, 20 bp, human
gtctgcatagtaatgagggg

SEQ ID NO: 244915 - DNA, 20 bp, human
gactatgcagacgcagccga

SEQ ID NO: 244916 - DNA, 20 bp, human
ggccgccgcccgggtgtgga

SEQ ID NO: 244917 - DNA, 20 bp, human
gcgcccgggtgtggaaggtc

SEQ ID NO: 244918 - DNA, 20 bp, human
gcgcggctggggtcttgcga

SEQ ID NO: 244919 - DNA, 20 bp, human
gctccgggcaggaggttact

SEQ ID NO: 244920 - DNA, 20 bp, human
gtggaaggtccgggctctgc

SEQ ID NO: 244921 - DNA, 20 bp, human
gccgccgagtcccccaatgc

SEQ ID NO: 244922 - DNA, 20 bp, human
ggggctctgcaggctgctga

SEQ ID NO: 244923 - DNA, 20 bp, human
gtactgggactgttgagcag

SEQ ID NO: 244924 - DNA, 20 bp, human
gagaccccagccgcgggcga

SEQ ID NO: 244925 - DNA, 20 bp, human
gacgcggtctgcaccgacca

SEQ ID NO: 244926 - DNA, 20 bp, human
ggaccggaacctcgggccga

SEQ ID NO: 244927 - DNA, 20 bp, human
ggtccatggaccggaacctc

SEQ ID NO: 244928 - DNA, 20 bp, human
gggaacctcgggccgacgga

SEQ ID NO: 244929 - DNA, 20 bp, human
gggcccgggttcccgtccgt

SEQ ID NO: 244930 - DNA, 20 bp, human
gtcctccgccggcagcaact

SEQ ID NO: 244931 - DNA, 20 bp, human
gggcagcaactcggcgcccg

SEQ ID NO: 244932 - DNA, 20 bp, human
ggttccggtccatggaccgc

SEQ ID NO: 244933 - DNA, 20 bp, human
gggcggggaggcggcgatcg

SEQ ID NO: 244934 - DNA, 20 bp, human
ggggccgacggacgggaacc

SEQ ID NO: 244935 - DNA, 20 bp, human
gccagggttacgacgcaggg

SEQ ID NO: 244936 - DNA, 20 bp, human
gttcagagctactcccagga

SEQ ID NO: 244937 - DNA, 20 bp, human
ggagcaatagggacgtgtca

SEQ ID NO: 244938 - DNA, 20 bp, human
gcagacggaagaggcgtctc

SEQ ID NO: 244939 - DNA, 20 bp, human
ggggagtagctctgaagcga

SEQ ID NO: 244940 - DNA, 20 bp, human
gtcactaggcgaggcgcaga

SEQ ID NO: 244941 - DNA, 20 bp, human
gggcgaggcgcagacggaag

SEQ ID NO: 244942 - DNA, 20 bp, human
ggtggcggcccgtgaaaccg

SEQ ID NO: 244943 - DNA, 20 bp, human
ggacacttccggttcgaaga

SEQ ID NO: 244944 - DNA, 20 bp, human
gcgccgggcctcactaggcg

SEQ ID NO: 244945 - DNA, 20 bp, human
ggtaacttttcgaccttcct

SEQ ID NO: 244946 - DNA, 20 bp, human
gcgggttcctctggccctgg

SEQ ID NO: 244947 - DNA, 20 bp, human
ggccctgtgtccgaaaccgt

SEQ ID NO: 244948 - DNA, 20 bp, human
ggcggggcggagctaaggcc

SEQ ID NO: 244949 - DNA, 20 bp, human
ggctcccgccgggcgtgcag

SEQ ID NO: 244950 - DNA, 20 bp, human
gtgggtgggcagcctcattt

SEQ ID NO: 244951 - DNA, 20 bp, human
gctagctgctgtttccaaag

SEQ ID NO: 244952 - DNA, 20 bp, human
ggcccacggtttcggacaca

SEQ ID NO: 244953 - DNA, 20 bp, human
gtcggcatcgcagccacccg

SEQ ID NO: 244954 - DNA, 20 bp, human
gaattgtggttactcttctg

SEQ ID NO: 244955 - DNA, 20 bp, human
gtttctaaattctgcagctc

SEQ ID NO: 244956 - DNA, 20 bp, human
gtccgagcgtgacgagcacg

SEQ ID NO: 244957 - DNA, 20 bp, human
gcccgggccgggttggaggg

SEQ ID NO: 244958 - DNA, 20 bp, human
gctgaagggcaccgcgagga

SEQ ID NO: 244959 - DNA, 20 bp, human
ggccccgcgcggaccctgta

SEQ ID NO: 244960 - DNA, 20 bp, human
ggagtgacgcgccctcctcg

SEQ ID NO: 244961 - DNA, 20 bp, human
ggggagcaggcccgcaccgt

SEQ ID NO: 244962 - DNA, 20 bp, human
gccgggggcgcccagatcag

SEQ ID NO: 244963 - DNA, 20 bp, human
gtgctcgtcacgctcggacg

SEQ ID NO: 244964 - DNA, 20 bp, human
ggagcgtgacgagcacgggg

SEQ ID NO: 244965 - DNA, 20 bp, human
gaggcgggggcgcgtcactc

SEQ ID NO: 244966 - DNA, 20 bp, human
gggcaggggcgtctgcgagg

SEQ ID NO: 244967 - DNA, 20 bp, human
gaacgtcagggcccggctga

SEQ ID NO: 244968 - DNA, 20 bp, human
gcccggctgaggggcgtgat

SEQ ID NO: 244969 - DNA, 20 bp, human
ggctgaggggcgtgattgga

SEQ ID NO: 244970 - DNA, 20 bp, human
gccgcccgcggcagaagccg

SEQ ID NO: 244971 - DNA, 20 bp, human
gctaccgctccccttccaga

SEQ ID NO: 244972 - DNA, 20 bp, human
gtgcctggagaaaccaagga

SEQ ID NO: 244973 - DNA, 20 bp, human
ggcggtagaacgtcagggcc

SEQ ID NO: 244974 - DNA, 20 bp, human
gacgggggtcgctgaggcaa

SEQ ID NO: 244975 - DNA, 20 bp, human
gggggagcggtagaacgtca

SEQ ID NO: 244976 - DNA, 20 bp, human
gttcccgagaaaggaggcgg

SEQ ID NO: 244977 - DNA, 20 bp, human
gtaagggcagacccgctccc

SEQ ID NO: 244978 - DNA, 20 bp, human
ggcagtcaggccagtgagtg

SEQ ID NO: 244979 - DNA, 20 bp, human
ggcagctcggcaggcattcg

SEQ ID NO: 244980 - DNA, 20 bp, human
ggaggcgctccctcctgcct

SEQ ID NO: 244981 - DNA, 20 bp, human
ggcaggagggagcgcctcgg

SEQ ID NO: 244982 - DNA, 20 bp, human
gcccttagggggaggcctct

SEQ ID NO: 244983 - DNA, 20 bp, human
gctagcacacgtgcacgcgg

SEQ ID NO: 244984 - DNA, 20 bp, human
gctggcggcggagatgagag

SEQ ID NO: 244985 - DNA, 20 bp, human
ggctcggcaggcattcgagg

SEQ ID NO: 244986 - DNA, 20 bp, human
gtccccaaacccctcctcac

SEQ ID NO: 244987 - DNA, 20 bp, human
gcggagctcggcgttgaagg

SEQ ID NO: 244988 - DNA, 20 bp, human
gcgttgaaggaggcacgtgg

SEQ ID NO: 244989 - DNA, 20 bp, human
gcactgctgacagaggatta

SEQ ID NO: 244990 - DNA, 20 bp, human
gcagcggagctcggcgttga

SEQ ID NO: 244991 - DNA, 20 bp, human
ggcgggcggtgccaagcgtg

SEQ ID NO: 244992 - DNA, 20 bp, human
gagagcgaccccaccaccgc

SEQ ID NO: 244993 - DNA, 20 bp, human
gagagcttgacgctggaaaa

SEQ ID NO: 244994 - DNA, 20 bp, human
gcggcgttgaaggaggcacg

SEQ ID NO: 244995 - DNA, 20 bp, human
gggttgagctcatacactcc

SEQ ID NO: 244996 - DNA, 20 bp, human
ggaaaggggtagatgatgtg

SEQ ID NO: 244997 - DNA, 20 bp, human
gtaccgaagcatacaatcag

SEQ ID NO: 244998 - DNA, 20 bp, human
gcatctgcctctatatacta

SEQ ID NO: 244999 - DNA, 20 bp, human
ggccgtaagctggattaaag

SEQ ID NO: 245000 - DNA, 20 bp, human
gaacaggatgttttgctcaa

SEQ ID NO: 245001 - DNA, 20 bp, human
gtacactcagctaatttcac

SEQ ID NO: 245002 - DNA, 20 bp, human
gtgaactccttagtatatag

SEQ ID NO: 245003 - DNA, 20 bp, human
gaccactttaatccagctta

SEQ ID NO: 245004 - DNA, 20 bp, human
gactgattatatagctgttg

SEQ ID NO: 245005 - DNA, 20 bp, human
gcaggtccttggtttacatc

SEQ ID NO: 245006 - DNA, 20 bp, human
gacccgcgcggctccggagt

SEQ ID NO: 245007 - DNA, 20 bp, human
gcgcgggcgccgtctctcct

SEQ ID NO: 245008 - DNA, 20 bp, human
gagccgcgcgggtgcctccc

SEQ ID NO: 245009 - DNA, 20 bp, human
gtctctcctaggtgcgaagg

SEQ ID NO: 245010 - DNA, 20 bp, human
gccgtctctcctaggtgcga

SEQ ID NO: 245011 - DNA, 20 bp, human
gcagcagccgcgccacgaaa

SEQ ID NO: 245012 - DNA, 20 bp, human
ggggccggagggacgtccgg

SEQ ID NO: 245013 - DNA, 20 bp, human
gccacagggcgctccaccga

SEQ ID NO: 245014 - DNA, 20 bp, human
gcggctccggagtgggccgg

SEQ ID NO: 245015 - DNA, 20 bp, human
gccgcccccggacgtccctc

SEQ ID NO: 245016 - DNA, 20 bp, human
gtaggcaggcagcagtacgt

SEQ ID NO: 245017 - DNA, 20 bp, human
ggtacgtgggatggatcaaa

SEQ ID NO: 245018 - DNA, 20 bp, human
gcaggcagcagtacgtggga

SEQ ID NO: 245019 - DNA, 20 bp, human
gtggactggtgtttacaagc

SEQ ID NO: 245020 - DNA, 20 bp, human
gtgtaaacaccagtccaaat

SEQ ID NO: 245021 - DNA, 20 bp, human
gtcctggattagagaaagaa

SEQ ID NO: 245022 - DNA, 20 bp, human
gtgggtagtttcactgattc

SEQ ID NO: 245023 - DNA, 20 bp, human
gctgggaacgtcttccaatt

SEQ ID NO: 245024 - DNA, 20 bp, human
ggaagaggctaggttgttta

SEQ ID NO: 245025 - DNA, 20 bp, human
ggaaaagattagcctcggac

SEQ ID NO: 245026 - DNA, 20 bp, human
ggcagggctctgtacatggg

SEQ ID NO: 245027 - DNA, 20 bp, human
gtgcctctgctcacaggtat

SEQ ID NO: 245028 - DNA, 20 bp, human
gcatgtacagagccctgccg

SEQ ID NO: 245029 - DNA, 20 bp, human
gcccccttctaattcaggaa

SEQ ID NO: 245030 - DNA, 20 bp, human
ggtgacattctgggacgctg

SEQ ID NO: 245031 - DNA, 20 bp, human
gcggggccaaaatcccaccg

SEQ ID NO: 245032 - DNA, 20 bp, human
gtgggattttggccccggca

SEQ ID NO: 245033 - DNA, 20 bp, human
gccaaccctgcaacctcggt

SEQ ID NO: 245034 - DNA, 20 bp, human
ggaggggaggaaccactgcc

SEQ ID NO: 245035 - DNA, 20 bp, human
gacgggagagggccttggca

SEQ ID NO: 245036 - DNA, 20 bp, human
gagggccactagcccaaggt

SEQ ID NO: 245037 - DNA, 20 bp, human
gcaagcgcgctgacggtctc

SEQ ID NO: 245038 - DNA, 20 bp, human
gggcgcacaggaccgacctt

SEQ ID NO: 245039 - DNA, 20 bp, human
gacggcgtggttgacgtcaa

SEQ ID NO: 245040 - DNA, 20 bp, human
ggctagtggccctggcgggt

SEQ ID NO: 245041 - DNA, 20 bp, human
gtgcgccaacagtcgcaagc

SEQ ID NO: 245042 - DNA, 20 bp, human
gggccgcgcaagcgcgctga

SEQ ID NO: 245043 - DNA, 20 bp, human
gagtccctgcttgcgactgt

SEQ ID NO: 245044 - DNA, 20 bp, human
ggcggctccgcgttccagaa

SEQ ID NO: 245045 - DNA, 20 bp, human
gaggaccgaccttgggctag

SEQ ID NO: 245046 - DNA, 20 bp, human
gtctcccacgggaggagcgg

SEQ ID NO: 245047 - DNA, 20 bp, human
gggggcgcgcgctctcccac

SEQ ID NO: 245048 - DNA, 20 bp, human
ggcgcccccgctcctcccgt

SEQ ID NO: 245049 - DNA, 20 bp, human
gcgctctcccacgggaggag

SEQ ID NO: 245050 - DNA, 20 bp, human
ggcgcgcgctctcccacggg

SEQ ID NO: 245051 - DNA, 20 bp, human
ggaggcgggagcttcctgga

SEQ ID NO: 245052 - DNA, 20 bp, human
ggccctcggggcaacaccca

SEQ ID NO: 245053 - DNA, 20 bp, human
gtcggggcgcctggcaccga

SEQ ID NO: 245054 - DNA, 20 bp, human
ggcgagggtccgaaggttcc

SEQ ID NO: 245055 - DNA, 20 bp, human
gtcctccctccggccgagga

SEQ ID NO: 245056 - DNA, 20 bp, human
gcctcgaagcgccagcctac

SEQ ID NO: 245057 - DNA, 20 bp, human
gaaggagctgacatgcagcc

SEQ ID NO: 245058 - DNA, 20 bp, human
ggatgggctgatcctcgcgc

SEQ ID NO: 245059 - DNA, 20 bp, human
ggagtcagctccctgcggat

SEQ ID NO: 245060 - DNA, 20 bp, human
gtggcgcttcgaggccattc

SEQ ID NO: 245061 - DNA, 20 bp, human
gcgcttcgaggccattctgg

SEQ ID NO: 245062 - DNA, 20 bp, human
gcgaggatcagcccatccgc

SEQ ID NO: 245063 - DNA, 20 bp, human
gaaactgactttaaggtaag

SEQ ID NO: 245064 - DNA, 20 bp, human
gggccagtcgcttactgaaa

SEQ ID NO: 245065 - DNA, 20 bp, human
ggcagaaggatcacgggctc

SEQ ID NO: 245066 - DNA, 20 bp, human
gcccgcccaggccttggcgg

SEQ ID NO: 245067 - DNA, 20 bp, human
gtcgctcaactgagctcctg

SEQ ID NO: 245068 - DNA, 20 bp, human
gagcgccgccgccaaggcct

SEQ ID NO: 245069 - DNA, 20 bp, human
gacggagagcgccgccgcca

SEQ ID NO: 245070 - DNA, 20 bp, human
gagcagaaagcccagactgc

SEQ ID NO: 245071 - DNA, 20 bp, human
gacggagacgagcattgccc

SEQ ID NO: 245072 - DNA, 20 bp, human
gcgaccgctccaccctagag

SEQ ID NO: 245073 - DNA, 20 bp, human
ggggtggagcggtcgtatcg

SEQ ID NO: 245074 - DNA, 20 bp, human
ggccgggttgctgggtgcat

SEQ ID NO: 245075 - DNA, 20 bp, human
gcagcaacccggcaagagac

SEQ ID NO: 245076 - DNA, 20 bp, human
gggacgcggtccagatgctg

SEQ ID NO: 245077 - DNA, 20 bp, human
ggagacccctgatgggagat

SEQ ID NO: 245078 - DNA, 20 bp, human
gccaggatggagacccctga

SEQ ID NO: 245079 - DNA, 20 bp, human
gcagatgctggggacgtggc

SEQ ID NO: 245080 - DNA, 20 bp, human
gccgcccgggaacgccagag

SEQ ID NO: 245081 - DNA, 20 bp, human
gctccccagaaggagatgta

SEQ ID NO: 245082 - DNA, 20 bp, human
ggctggcgggaaccacggat

SEQ ID NO: 245083 - DNA, 20 bp, human
ggggtctccatcctggggga

SEQ ID NO: 245084 - DNA, 20 bp, human
gtgtgcgcgcgtggcgggcc

SEQ ID NO: 245085 - DNA, 20 bp, human
gtctatgcagggttgagagg

SEQ ID NO: 245086 - DNA, 20 bp, human
gtctctgcgattctgggtgt

SEQ ID NO: 245087 - DNA, 20 bp, human
gccacagaaccgggggagga

SEQ ID NO: 245088 - DNA, 20 bp, human
gggtgtgggtgtagtgtgaa

SEQ ID NO: 245089 - DNA, 20 bp, human
ggggagggagccacagaacc

SEQ ID NO: 245090 - DNA, 20 bp, human
gtccccccgcgtggatggat

SEQ ID NO: 245091 - DNA, 20 bp, human
gtgcgcatctctgcgattct

SEQ ID NO: 245092 - DNA, 20 bp, human
gatgtgtgtcactgtgtctg

SEQ ID NO: 245093 - DNA, 20 bp, human
gccagctccccccgcgtgga

SEQ ID NO: 245094 - DNA, 20 bp, human
gcctcccaatccatccacgc

SEQ ID NO: 245095 - DNA, 20 bp, human
gcccccggcggatacacatt

SEQ ID NO: 245096 - DNA, 20 bp, human
ggtgcccctcggagatgccc

SEQ ID NO: 245097 - DNA, 20 bp, human
gtcctcccgggcatctccga

SEQ ID NO: 245098 - DNA, 20 bp, human
gcgcgcccggcaggcgttca

SEQ ID NO: 245099 - DNA, 20 bp, human
gggggcgcggcgggaaatga

SEQ ID NO: 245100 - DNA, 20 bp, human
gcggacccaggcagacacta

SEQ ID NO: 245101 - DNA, 20 bp, human
ggggatgcgcacagccgggg

SEQ ID NO: 245102 - DNA, 20 bp, human
gtgtgcgcatccccggccca

SEQ ID NO: 245103 - DNA, 20 bp, human
gtctgcctgggtccgaaccc

SEQ ID NO: 245104 - DNA, 20 bp, human
gtgagcccgggttcggaccc

SEQ ID NO: 245105 - DNA, 20 bp, human
gcggcgggaaatgagggcag

SEQ ID NO: 245106 - DNA, 20 bp, human
gcctccgcgcagagccacga

SEQ ID NO: 245107 - DNA, 20 bp, human
ggggctgctgcctgccggaa

SEQ ID NO: 245108 - DNA, 20 bp, human
gggaaccgctagccagtcct

SEQ ID NO: 245109 - DNA, 20 bp, human
gctgacccctccagccagga

SEQ ID NO: 245110 - DNA, 20 bp, human
gcggaggcagcgcgcgggat

SEQ ID NO: 245111 - DNA, 20 bp, human
gcaggaccgcaagccctcgc

SEQ ID NO: 245112 - DNA, 20 bp, human
gacactccgtgatcccctcc

SEQ ID NO: 245113 - DNA, 20 bp, human
gttcccagcccccttccggc

SEQ ID NO: 245114 - DNA, 20 bp, human
gcggtttcccagcccccttc

SEQ ID NO: 245115 - DNA, 20 bp, human
gctggaggggtcaggcttgg

SEQ ID NO: 245116 - DNA, 20 bp, human
gtctgccctgcgcaagtctc

SEQ ID NO: 245117 - DNA, 20 bp, human
gcatcatggacaactctagg

SEQ ID NO: 245118 - DNA, 20 bp, human
ggcagactctaccaaggtgt

SEQ ID NO: 245119 - DNA, 20 bp, human
gcctgcctaggtctctgaat

SEQ ID NO: 245120 - DNA, 20 bp, human
gacctaggcaggctgggagt

SEQ ID NO: 245121 - DNA, 20 bp, human
gccaaggtgtgggttggagt

SEQ ID NO: 245122 - DNA, 20 bp, human
gcaccccagagacttgcgca

SEQ ID NO: 245123 - DNA, 20 bp, human
gtctgtggctcaaccgtgaa

SEQ ID NO: 245124 - DNA, 20 bp, human
ggggttggagttgggagtcg

SEQ ID NO: 245125 - DNA, 20 bp, human
gggctccaggctgctccaat

SEQ ID NO: 245126 - DNA, 20 bp, human
gtgctcctgagcacgagtga

SEQ ID NO: 245127 - DNA, 20 bp, human
gtcctgagcacgagtgatgg

SEQ ID NO: 245128 - DNA, 20 bp, human
gctccaaggtgactttacat

SEQ ID NO: 245129 - DNA, 20 bp, human
gcgtggggtaaaatccacat

SEQ ID NO: 245130 - DNA, 20 bp, human
gcccctcacacaggttgaat

SEQ ID NO: 245131 - DNA, 20 bp, human
gacccccatcactcgtgctc

SEQ ID NO: 245132 - DNA, 20 bp, human
gtccctatgtaaagtcacct

SEQ ID NO: 245133 - DNA, 20 bp, human
gcaaagccttagattgaagg

SEQ ID NO: 245134 - DNA, 20 bp, human
gcctgctcttcccctcacac

SEQ ID NO: 245135 - DNA, 20 bp, human
ggatgagataaatcagttag

SEQ ID NO: 245136 - DNA, 20 bp, human
gccagaagggctggtccgaa

SEQ ID NO: 245137 - DNA, 20 bp, human
gaaggagagaagatagagta

SEQ ID NO: 245138 - DNA, 20 bp, human
gcgcctgcggcgtccctgcg

SEQ ID NO: 245139 - DNA, 20 bp, human
gcgcaggcggcgataggatc

SEQ ID NO: 245140 - DNA, 20 bp, human
gccgacgcgcccagaagggc

SEQ ID NO: 245141 - DNA, 20 bp, human
gagagaagatagagtagggc

SEQ ID NO: 245142 - DNA, 20 bp, human
gagaatccgacgcgcccaga

SEQ ID NO: 245143 - DNA, 20 bp, human
ggggaggctgagggcggact

SEQ ID NO: 245144 - DNA, 20 bp, human
gtgagtaaacagccgacccg

SEQ ID NO: 245145 - DNA, 20 bp, human
ggtcacgtacaacctcgggt

SEQ ID NO: 245146 - DNA, 20 bp, human
gcgcgcaggtcgatcccaga

SEQ ID NO: 245147 - DNA, 20 bp, human
gggcgagtggagactgtcta

SEQ ID NO: 245148 - DNA, 20 bp, human
gggcgccactagtgctgcct

SEQ ID NO: 245149 - DNA, 20 bp, human
gtccgcccaggcagcactag

SEQ ID NO: 245150 - DNA, 20 bp, human
ggccactagtgctgcctggg

SEQ ID NO: 245151 - DNA, 20 bp, human
ggacctgcgcgcctggcgag

SEQ ID NO: 245152 - DNA, 20 bp, human
ggcacgcgtgggcggggata

SEQ ID NO: 245153 - DNA, 20 bp, human
gtgggcggggataaggcttt

SEQ ID NO: 245154 - DNA, 20 bp, human
gggcgacgccctttgatctc

SEQ ID NO: 245155 - DNA, 20 bp, human
gtggcgcctccgctccgccc

SEQ ID NO: 245156 - DNA, 20 bp, human
ggcgtcgccttcagactggg

SEQ ID NO: 245157 - DNA, 20 bp, human
gcggggcaaagacctgactc

SEQ ID NO: 245158 - DNA, 20 bp, human
gaaccccccaggcgttccgg

SEQ ID NO: 245159 - DNA, 20 bp, human
gcagggctgcagtcacgggg

SEQ ID NO: 245160 - DNA, 20 bp, human
gcacctccggaacgcctggg

SEQ ID NO: 245161 - DNA, 20 bp, human
gcgggcgccgggttcgggct

SEQ ID NO: 245162 - DNA, 20 bp, human
gcaagcagggctgcagtcac

SEQ ID NO: 245163 - DNA, 20 bp, human
ggccctgaggtcgcccttgg

SEQ ID NO: 245164 - DNA, 20 bp, human
ggagggccccagcccagtca

SEQ ID NO: 245165 - DNA, 20 bp, human
gctgtcaaacgcctcccaaa

SEQ ID NO: 245166 - DNA, 20 bp, human
gaggaggggttaagagaagg

SEQ ID NO: 245167 - DNA, 20 bp, human
gcatctctggacattacctc

SEQ ID NO: 245168 - DNA, 20 bp, human
gtcctgctaaaataatgctg

SEQ ID NO: 245169 - DNA, 20 bp, human
gtgtggctgaagacatttaa

SEQ ID NO: 245170 - DNA, 20 bp, human
ggacattacctcaggaggag

SEQ ID NO: 245171 - DNA, 20 bp, human
gcatgcccatggaacatctc

SEQ ID NO: 245172 - DNA, 20 bp, human
gaaacaattcctttgatgga

SEQ ID NO: 245173 - DNA, 20 bp, human
gaccccagcattattttagc

SEQ ID NO: 245174 - DNA, 20 bp, human
gtggaatgacctagacatca

SEQ ID NO: 245175 - DNA, 20 bp, human
ggcaactttccaacatgcta

SEQ ID NO: 245176 - DNA, 20 bp, human
gcgccagccgcccgcatccc

SEQ ID NO: 245177 - DNA, 20 bp, human
gacagcgggccctagtggcc

SEQ ID NO: 245178 - DNA, 20 bp, human
gtagtggcccgggatgcggg

SEQ ID NO: 245179 - DNA, 20 bp, human
ggctgcagccggcgcccctg

SEQ ID NO: 245180 - DNA, 20 bp, human
gacttcgcgcgctaggggtt

SEQ ID NO: 245181 - DNA, 20 bp, human
gaagctgggcgggaaggttc

SEQ ID NO: 245182 - DNA, 20 bp, human
gcccgcacttcgcgcgctag

SEQ ID NO: 245183 - DNA, 20 bp, human
gccctagtggcccgggatgc

SEQ ID NO: 245184 - DNA, 20 bp, human
gtggcggctcggctccgggc

SEQ ID NO: 245185 - DNA, 20 bp, human
ggggttccggacgcccagcc

SEQ ID NO: 245186 - DNA, 20 bp, human
ggggcgagaccatctccggg

SEQ ID NO: 245187 - DNA, 20 bp, human
gccagtggaagctgcgacct

SEQ ID NO: 245188 - DNA, 20 bp, human
ggcgcccgcacggagcagag

SEQ ID NO: 245189 - DNA, 20 bp, human
gcggcgaatggcaggtcccg

SEQ ID NO: 245190 - DNA, 20 bp, human
gcggtgctgtcggaaggcga

SEQ ID NO: 245191 - DNA, 20 bp, human
gcacacatgcacagcaccga

SEQ ID NO: 245192 - DNA, 20 bp, human
gtgcgggcgcggcgaatggc

SEQ ID NO: 245193 - DNA, 20 bp, human
gtgggcacggtgctgtcgga

SEQ ID NO: 245194 - DNA, 20 bp, human
gccagggcgagaccatctcc

SEQ ID NO: 245195 - DNA, 20 bp, human
gacgaggatcacggcgacgg

SEQ ID NO: 245196 - DNA, 20 bp, human
ggaaccgggggtaggacgtc

SEQ ID NO: 245197 - DNA, 20 bp, human
gtcccccgaccggaagtcga

SEQ ID NO: 245198 - DNA, 20 bp, human
gcgcctgcgcatagtcttgg

SEQ ID NO: 245199 - DNA, 20 bp, human
gccggcggacgtgggcagga

SEQ ID NO: 245200 - DNA, 20 bp, human
ggggtcttggaaccgggggt

SEQ ID NO: 245201 - DNA, 20 bp, human
gtcggccccaagcgggacga

SEQ ID NO: 245202 - DNA, 20 bp, human
gcgaggcttcccaccacttg

SEQ ID NO: 245203 - DNA, 20 bp, human
gcctcccctcgacttccggt

SEQ ID NO: 245204 - DNA, 20 bp, human
gttccaagaccccaagtggt

SEQ ID NO: 245205 - DNA, 20 bp, human
gacttggggtcttggaaccg

SEQ ID NO: 245206 - DNA, 20 bp, human
ggggcagcatccaaccaatc

SEQ ID NO: 245207 - DNA, 20 bp, human
gtaggtgagcggctcggact

SEQ ID NO: 245208 - DNA, 20 bp, human
gggggcccgcacggcggcta

SEQ ID NO: 245209 - DNA, 20 bp, human
gggcgccgggcctcctgatt

SEQ ID NO: 245210 - DNA, 20 bp, human
gcaatcagggcggcgggcga

SEQ ID NO: 245211 - DNA, 20 bp, human
gcgcacggcggctacggcct

SEQ ID NO: 245212 - DNA, 20 bp, human
ggcccgccgccctgattggt

SEQ ID NO: 245213 - DNA, 20 bp, human
gcggtccggaagtcgccgag

SEQ ID NO: 245214 - DNA, 20 bp, human
gctagccggaaacgcgggtc

SEQ ID NO: 245215 - DNA, 20 bp, human
gcaacccaacccgcacggtc

SEQ ID NO: 245216 - DNA, 20 bp, human
gctagccgccagccgaacac

SEQ ID NO: 245217 - DNA, 20 bp, human
gaccgggcagggctccccgt

SEQ ID NO: 245218 - DNA, 20 bp, human
ggactcacgcggctggtttc

SEQ ID NO: 245219 - DNA, 20 bp, human
gcggcggcgaggcgaagcga

SEQ ID NO: 245220 - DNA, 20 bp, human
ggtcctgcgaccaaagggga

SEQ ID NO: 245221 - DNA, 20 bp, human
gttctggcgaggccggtgtt

SEQ ID NO: 245222 - DNA, 20 bp, human
gctagctgggactagcggaa

SEQ ID NO: 245223 - DNA, 20 bp, human
gggattgcgcctgcgcgctt

SEQ ID NO: 245224 - DNA, 20 bp, human
gggaacggcggagtctcgat

SEQ ID NO: 245225 - DNA, 20 bp, human
gccggcccttgcgcctgtcc

SEQ ID NO: 245226 - DNA, 20 bp, human
ggggtggccctgtggaatcc

SEQ ID NO: 245227 - DNA, 20 bp, human
gctcccagccaggattccac

SEQ ID NO: 245228 - DNA, 20 bp, human
gaagctggcgattgtgtgcg

SEQ ID NO: 245229 - DNA, 20 bp, human
gtagaggcaaggccagtttg

SEQ ID NO: 245230 - DNA, 20 bp, human
gcctggctgggaggccgccc

SEQ ID NO: 245231 - DNA, 20 bp, human
ggaaccgaccaaggccaggg

SEQ ID NO: 245232 - DNA, 20 bp, human
ggccctgtggaatcctggct

SEQ ID NO: 245233 - DNA, 20 bp, human
ggggagggcggaaccgacca

SEQ ID NO: 245234 - DNA, 20 bp, human
ggcggaaccgaccaaggcca

SEQ ID NO: 245235 - DNA, 20 bp, human
ggatctaggagcaacagcca

SEQ ID NO: 245236 - DNA, 20 bp, human
gcgctctgctggctgaggaa

SEQ ID NO: 245237 - DNA, 20 bp, human
gacggtgtgtggaaacaggt

SEQ ID NO: 245238 - DNA, 20 bp, human
gggaaaggctgcgcctctga

SEQ ID NO: 245239 - DNA, 20 bp, human
gggcgcttgcgtcacttccg

SEQ ID NO: 245240 - DNA, 20 bp, human
ggcgagtaggacaaaaaaat

SEQ ID NO: 245241 - DNA, 20 bp, human
gtgcagcccagccgctctgc

SEQ ID NO: 245242 - DNA, 20 bp, human
gacttccgaggcccgaggga

SEQ ID NO: 245243 - DNA, 20 bp, human
gaaaaattggcccccactcc

SEQ ID NO: 245244 - DNA, 20 bp, human
gcacgtgaaaagacggtgtg

SEQ ID NO: 245245 - DNA, 20 bp, human
ggcagcggatctagcggcgg

SEQ ID NO: 245246 - DNA, 20 bp, human
gtgcccgcgcagccggtttc

SEQ ID NO: 245247 - DNA, 20 bp, human
gccgcccggccagccgacca

SEQ ID NO: 245248 - DNA, 20 bp, human
gcagccgaccacggcagcca

SEQ ID NO: 245249 - DNA, 20 bp, human
gccccacctgcaccggaaac

SEQ ID NO: 245250 - DNA, 20 bp, human
ggtgttctcgacttcgtcgc

SEQ ID NO: 245251 - DNA, 20 bp, human
gtccctgcgcatgccggaag

SEQ ID NO: 245252 - DNA, 20 bp, human
gagctcctccgtggctgccg

SEQ ID NO: 245253 - DNA, 20 bp, human
gccggctgcgcgggcacttc

SEQ ID NO: 245254 - DNA, 20 bp, human
gccgggcggctaggagttcc

SEQ ID NO: 245255 - DNA, 20 bp, human
gcaccggaaaccggctgcgc

SEQ ID NO: 245256 - DNA, 20 bp, human
gggcgtccgcggggctagga

SEQ ID NO: 245257 - DNA, 20 bp, human
ggacgccggcagcagcggat

SEQ ID NO: 245258 - DNA, 20 bp, human
ggtgactcccggcgcgcgga

SEQ ID NO: 245259 - DNA, 20 bp, human
gctctgccggaatggggtct

SEQ ID NO: 245260 - DNA, 20 bp, human
gtcctcgacctctgccggaa

SEQ ID NO: 245261 - DNA, 20 bp, human
ggagaagcaaccgatccaca

SEQ ID NO: 245262 - DNA, 20 bp, human
gcccaccactccctgtggat

SEQ ID NO: 245263 - DNA, 20 bp, human
gtcaggggtgaataccatca

SEQ ID NO: 245264 - DNA, 20 bp, human
gccgggagtcacccgcctgc

SEQ ID NO: 245265 - DNA, 20 bp, human
gggattggctgaggcgggtc

SEQ ID NO: 245266 - DNA, 20 bp, human
gcggggtcggggaaaaacgt

SEQ ID NO: 245267 - DNA, 20 bp, human
ggggtatgaagacgaccctg

SEQ ID NO: 245268 - DNA, 20 bp, human
gagaacccacccaccttccg

SEQ ID NO: 245269 - DNA, 20 bp, human
ggggcggcatccccacctca

SEQ ID NO: 245270 - DNA, 20 bp, human
gtggggaggaggagagtgat

SEQ ID NO: 245271 - DNA, 20 bp, human
gcccaccgcggaaggtgggt

SEQ ID NO: 245272 - DNA, 20 bp, human
gagaaatccaaggagtggga

SEQ ID NO: 245273 - DNA, 20 bp, human
gggggccccagagtctcgtg

SEQ ID NO: 245274 - DNA, 20 bp, human
gaattcccaccgcggaaggt

SEQ ID NO: 245275 - DNA, 20 bp, human
gagggatgggggaccccaac

SEQ ID NO: 245276 - DNA, 20 bp, human
gggacgccgtggctcgaagg

SEQ ID NO: 245277 - DNA, 20 bp, human
gctggccgggtaaaaggaga

SEQ ID NO: 245278 - DNA, 20 bp, human
ggaacgcggggattggaagg

SEQ ID NO: 245279 - DNA, 20 bp, human
gggggcggggatagaacgcg

SEQ ID NO: 245280 - DNA, 20 bp, human
ggccgggtaaaaggagacgg

SEQ ID NO: 245281 - DNA, 20 bp, human
gggacctgaatacccggcta

SEQ ID NO: 245282 - DNA, 20 bp, human
gctccctccctggcgtgaaa

SEQ ID NO: 245283 - DNA, 20 bp, human
gatagaacgcggggattgga

SEQ ID NO: 245284 - DNA, 20 bp, human
gggggatcgaacggatgtag

SEQ ID NO: 245285 - DNA, 20 bp, human
gcggaggactggggatcgaa

SEQ ID NO: 245286 - DNA, 20 bp, human
gcgcctcctagggaagggaa

SEQ ID NO: 245287 - DNA, 20 bp, human
gacaggccccgcccactagt

SEQ ID NO: 245288 - DNA, 20 bp, human
gtttcccgcctcctagggaa

SEQ ID NO: 245289 - DNA, 20 bp, human
gtccgggcggggcctactag

SEQ ID NO: 245290 - DNA, 20 bp, human
gctcggtttcccgcctccta

SEQ ID NO: 245291 - DNA, 20 bp, human
gctggggcccccttccgggc

SEQ ID NO: 245292 - DNA, 20 bp, human
gaaggccatcggctccgccc

SEQ ID NO: 245293 - DNA, 20 bp, human
gcatcggctccgccccggac

SEQ ID NO: 245294 - DNA, 20 bp, human
gggaagggagacgagcagcg

SEQ ID NO: 245295 - DNA, 20 bp, human
gggagccgatggccttacag

SEQ ID NO: 245296 - DNA, 20 bp, human
ggggtcctcgtgactgggtg

SEQ ID NO: 245297 - DNA, 20 bp, human
ggggaagcgctgacttgatg

SEQ ID NO: 245298 - DNA, 20 bp, human
gtaaaggctcgagttctgca

SEQ ID NO: 245299 - DNA, 20 bp, human
gtcgtcgtgtcccaacctcc

SEQ ID NO: 245300 - DNA, 20 bp, human
gggcggggtgccattcaggt

SEQ ID NO: 245301 - DNA, 20 bp, human
gcatcggcggggtgccattc

SEQ ID NO: 245302 - DNA, 20 bp, human
gggtgctcctccctgagccg

SEQ ID NO: 245303 - DNA, 20 bp, human
gtctgcagggtcctcgtgac

SEQ ID NO: 245304 - DNA, 20 bp, human
gctgggtcatgtgagcctag

SEQ ID NO: 245305 - DNA, 20 bp, human
gagcctttaagcgctcctct

SEQ ID NO: 245306 - DNA, 20 bp, human
gaaccctcttcagactgtag

SEQ ID NO: 245307 - DNA, 20 bp, human
gggcaagagttataaactca

SEQ ID NO: 245308 - DNA, 20 bp, human
gctccccctacagtctgaag

SEQ ID NO: 245309 - DNA, 20 bp, human
ggcaggcaaagagttaaggc

SEQ ID NO: 245310 - DNA, 20 bp, human
ggaggctccggcgggaatca

SEQ ID NO: 245311 - DNA, 20 bp, human
ggggaatattgcatatagtt

SEQ ID NO: 245312 - DNA, 20 bp, human
gaagagggttctaggttgct

SEQ ID NO: 245313 - DNA, 20 bp, human
gtcacaatgcccacaaaaca

SEQ ID NO: 245314 - DNA, 20 bp, human
gattgaaacagtgtgaagac

SEQ ID NO: 245315 - DNA, 20 bp, human
gttcacactgtttcaatatt

SEQ ID NO: 245316 - DNA, 20 bp, human
gcccgcctcggacctcggag

SEQ ID NO: 245317 - DNA, 20 bp, human
gcgagcggggctgacctcca

SEQ ID NO: 245318 - DNA, 20 bp, human
gtggggccaacccgcctcgt

SEQ ID NO: 245319 - DNA, 20 bp, human
ggcgcagcgcgccaacgagg

SEQ ID NO: 245320 - DNA, 20 bp, human
ggcgggttggccccagacgg

SEQ ID NO: 245321 - DNA, 20 bp, human
ggaggcgggttggccccaga

SEQ ID NO: 245322 - DNA, 20 bp, human
gaggggccgccccaagtctc

SEQ ID NO: 245323 - DNA, 20 bp, human
gtcggcggtcctgagacttg

SEQ ID NO: 245324 - DNA, 20 bp, human
gaaggcgcagcgcgccaacg

SEQ ID NO: 245325 - DNA, 20 bp, human
ggcggtcctgagacttgggg

SEQ ID NO: 245326 - DNA, 20 bp, human
gaggggtcgccgggaaaggg

SEQ ID NO: 245327 - DNA, 20 bp, human
gtcggaggggtcgccgggaa

SEQ ID NO: 245328 - DNA, 20 bp, human
gagtgggaagtccacgtctg

SEQ ID NO: 245329 - DNA, 20 bp, human
gaaactcattagcgtctctg

SEQ ID NO: 245330 - DNA, 20 bp, human
gggcacggtttgagagctgg

SEQ ID NO: 245331 - DNA, 20 bp, human
gtccaaggaccggcctcgga

SEQ ID NO: 245332 - DNA, 20 bp, human
gtaaaacaggaatggaacag

SEQ ID NO: 245333 - DNA, 20 bp, human
gacaggggcgcgcagaggcg

SEQ ID NO: 245334 - DNA, 20 bp, human
gcccgcaggccagccagcgt

SEQ ID NO: 245335 - DNA, 20 bp, human
gatggtcagcacacggggca

SEQ ID NO: 245336 - DNA, 20 bp, human
ggtgccccgccccgtccaag

SEQ ID NO: 245337 - DNA, 20 bp, human
gtagagagaggatgccgctg

SEQ ID NO: 245338 - DNA, 20 bp, human
ggccggagtcgggttacagt

SEQ ID NO: 245339 - DNA, 20 bp, human
ggggcggggagccccttgga

SEQ ID NO: 245340 - DNA, 20 bp, human
ggtgcactcaggtggcagat

SEQ ID NO: 245341 - DNA, 20 bp, human
gcaaacgcaaatgccggagt

SEQ ID NO: 245342 - DNA, 20 bp, human
ggggagccccttggacgggg

SEQ ID NO: 245343 - DNA, 20 bp, human
gggggcaggacagcagataa

SEQ ID NO: 245344 - DNA, 20 bp, human
ggggacaagggtcaaaaggt

SEQ ID NO: 245345 - DNA, 20 bp, human
ggggaccaggggttttaggc

SEQ ID NO: 245346 - DNA, 20 bp, human
ggctccgcgcccagagtgtg

SEQ ID NO: 245347 - DNA, 20 bp, human
ggccctgcgcttccagacaa

SEQ ID NO: 245348 - DNA, 20 bp, human
ggaccacagcttccccttca

SEQ ID NO: 245349 - DNA, 20 bp, human
gccgcgcccagagtgtgggg

SEQ ID NO: 245350 - DNA, 20 bp, human
ggactgcgaagaccagtcag

SEQ ID NO: 245351 - DNA, 20 bp, human
ggcgatgtgtacggtgtaca

SEQ ID NO: 245352 - DNA, 20 bp, human
gggcatgacgtctcaattca

SEQ ID NO: 245353 - DNA, 20 bp, human
gcgcctttgtctggaagcgc

SEQ ID NO: 245354 - DNA, 20 bp, human
gtggaaggtagattagaata

SEQ ID NO: 245355 - DNA, 20 bp, human
gcggcaaaagctcccctgac

SEQ ID NO: 245356 - DNA, 20 bp, human
gcctggcagggggttatcgt

SEQ ID NO: 245357 - DNA, 20 bp, human
gtaaccccctgccagggctc

SEQ ID NO: 245358 - DNA, 20 bp, human
ggcgcgcaggggcagcccgt

SEQ ID NO: 245359 - DNA, 20 bp, human
ggcggggcctcggcgcgcag

SEQ ID NO: 245360 - DNA, 20 bp, human
ggccacgcccacctgtcatg

SEQ ID NO: 245361 - DNA, 20 bp, human
gcgttggccttcgaggagac

SEQ ID NO: 245362 - DNA, 20 bp, human
gcccacctgtcatgcggccc

SEQ ID NO: 245363 - DNA, 20 bp, human
gggcagcccgttggccttcg

SEQ ID NO: 245364 - DNA, 20 bp, human
gtccagggccgcatgacagg

SEQ ID NO: 245365 - DNA, 20 bp, human
gtgaaattgagtcttagcgc

SEQ ID NO: 245366 - DNA, 20 bp, human
gggacggcccggcacgaggt

SEQ ID NO: 245367 - DNA, 20 bp, human
ggagggtgggacaagcggga

SEQ ID NO: 245368 - DNA, 20 bp, human
gggctgacgcggcgccggtg

SEQ ID NO: 245369 - DNA, 20 bp, human
ggggaagccaccgcaacgag

SEQ ID NO: 245370 - DNA, 20 bp, human
gtccccgcccacctcgtgcc

SEQ ID NO: 245371 - DNA, 20 bp, human
gagaaacaagtgagtgtagt

SEQ ID NO: 245372 - DNA, 20 bp, human
gcgggcccttaaatagtgtc

SEQ ID NO: 245373 - DNA, 20 bp, human
ggactcacccctcgttgcgg

SEQ ID NO: 245374 - DNA, 20 bp, human
gttgcgtggtcaaaaaagtg

SEQ ID NO: 245375 - DNA, 20 bp, human
gtcagactcacccctcgttg

SEQ ID NO: 245376 - DNA, 20 bp, human
gcgggtgcccgcacctctgg

SEQ ID NO: 245377 - DNA, 20 bp, human
gggcacccgctctccaactg

SEQ ID NO: 245378 - DNA, 20 bp, human
ggaggtggaggctccccagt

SEQ ID NO: 245379 - DNA, 20 bp, human
gagagcgcccccaaccccgc

SEQ ID NO: 245380 - DNA, 20 bp, human
gaaacaagatgggcttggag

SEQ ID NO: 245381 - DNA, 20 bp, human
gagcggggccatcaggggat

SEQ ID NO: 245382 - DNA, 20 bp, human
gggctgaggcacaactgggc

SEQ ID NO: 245383 - DNA, 20 bp, human
ggttgagcgcataccgagta

SEQ ID NO: 245384 - DNA, 20 bp, human
ggccccccacaggacccatg

SEQ ID NO: 245385 - DNA, 20 bp, human
ggagcgggtgcccgcacctc

SEQ ID NO: 245386 - DNA, 20 bp, human
gctagcccgcgtgtgggtcc

SEQ ID NO: 245387 - DNA, 20 bp, human
gagacgtgaggaactcgggt

SEQ ID NO: 245388 - DNA, 20 bp, human
gcgcccccgccaccaacctc

SEQ ID NO: 245389 - DNA, 20 bp, human
ggaagcctggacccacacgc

SEQ ID NO: 245390 - DNA, 20 bp, human
gaatgcaccgagtcaggttg

SEQ ID NO: 245391 - DNA, 20 bp, human
ggatgctcagggctcgtgta

SEQ ID NO: 245392 - DNA, 20 bp, human
gaccgagtcaggttggggat

SEQ ID NO: 245393 - DNA, 20 bp, human
gccaagcccctctctgagta

SEQ ID NO: 245394 - DNA, 20 bp, human
ggctgcgggcgcagatgctc

SEQ ID NO: 245395 - DNA, 20 bp, human
gcctgcgctagtaagtggat

SEQ ID NO: 245396 - DNA, 20 bp, human
gttcccgccatgcttactgt

SEQ ID NO: 245397 - DNA, 20 bp, human
gcaattcaatagcggggaga

SEQ ID NO: 245398 - DNA, 20 bp, human
gtaatcagataggtcagaga

SEQ ID NO: 245399 - DNA, 20 bp, human
gtgggtaaacaattcaatag

SEQ ID NO: 245400 - DNA, 20 bp, human
gagagaaggcttctctacta

SEQ ID NO: 245401 - DNA, 20 bp, human
gttattgagcgttcaagggt

SEQ ID NO: 245402 - DNA, 20 bp, human
gttaaagggtatctaagtaa

SEQ ID NO: 245403 - DNA, 20 bp, human
gtaacacagtaactccatca

SEQ ID NO: 245404 - DNA, 20 bp, human
gtaccctttaagtgacacta

SEQ ID NO: 245405 - DNA, 20 bp, human
gtacccacagtaagcatggc

SEQ ID NO: 245406 - DNA, 20 bp, human
gcggggcggggcgacgaacg

SEQ ID NO: 245407 - DNA, 20 bp, human
ggggcccgaagaaacattgg

SEQ ID NO: 245408 - DNA, 20 bp, human
gccgcccagcgctagccaat

SEQ ID NO: 245409 - DNA, 20 bp, human
gcgggcccgtctccccaaaa

SEQ ID NO: 245410 - DNA, 20 bp, human
ggtagctcggagtgtggaat

SEQ ID NO: 245411 - DNA, 20 bp, human
gactgtgcgtctctttggat

SEQ ID NO: 245412 - DNA, 20 bp, human
gagcacgggccctggcctat

SEQ ID NO: 245413 - DNA, 20 bp, human
gaagtgtggaagcacgtctg

SEQ ID NO: 245414 - DNA, 20 bp, human
gccagggcccgtgctgtgat

SEQ ID NO: 245415 - DNA, 20 bp, human
gccggtggggacctcacgga

SEQ ID NO: 245416 - DNA, 20 bp, human
gcgcacggggaactccatgg

SEQ ID NO: 245417 - DNA, 20 bp, human
gcccgggacgggagaagcgc

SEQ ID NO: 245418 - DNA, 20 bp, human
gaggaggccggatccacccc

SEQ ID NO: 245419 - DNA, 20 bp, human
ggcccgcacggggaactcca

SEQ ID NO: 245420 - DNA, 20 bp, human
gcgggctcgcctgcccgcac

SEQ ID NO: 245421 - DNA, 20 bp, human
gcaggcgggccggcggcatt

SEQ ID NO: 245422 - DNA, 20 bp, human
gggccggatccaccccggga

SEQ ID NO: 245423 - DNA, 20 bp, human
ggcccgcgcttctcccgtcc

SEQ ID NO: 245424 - DNA, 20 bp, human
ggagccccgcgcctttcggg

SEQ ID NO: 245425 - DNA, 20 bp, human
gttaaaataagcaggcgggc

SEQ ID NO: 245426 - DNA, 20 bp, human
gcggggacggggcatcgatg

SEQ ID NO: 245427 - DNA, 20 bp, human
gtaggctggctgcgagtcgg

SEQ ID NO: 245428 - DNA, 20 bp, human
gggacggggcatcgatgggg

SEQ ID NO: 245429 - DNA, 20 bp, human
ggcggggcgtcgcccggtag

SEQ ID NO: 245430 - DNA, 20 bp, human
ggcgggcaacggtgcccggg

SEQ ID NO: 245431 - DNA, 20 bp, human
gcccggtagcgggtcgcagt

SEQ ID NO: 245432 - DNA, 20 bp, human
ggccccacagccaacctccc

SEQ ID NO: 245433 - DNA, 20 bp, human
gtagaagacatgtggggaca

SEQ ID NO: 245434 - DNA, 20 bp, human
ggtagcgggtcgcagtaggc

SEQ ID NO: 245435 - DNA, 20 bp, human
gatggggcggagtctccttg

SEQ ID NO: 245436 - DNA, 20 bp, human
gttgccacacaattatgatc

SEQ ID NO: 245437 - DNA, 20 bp, human
gagaagaaaactcgcagcaa

SEQ ID NO: 245438 - DNA, 20 bp, human
gaatgtaggcccttttgagg

SEQ ID NO: 245439 - DNA, 20 bp, human
gatcacttacacgggaggat

SEQ ID NO: 245440 - DNA, 20 bp, human
gactcgcagcaaaggcttga

SEQ ID NO: 245441 - DNA, 20 bp, human
gttagcatcacttacacggg

SEQ ID NO: 245442 - DNA, 20 bp, human
gagttctgaagatcattcag

SEQ ID NO: 245443 - DNA, 20 bp, human
gttgccagatcataattgtg

SEQ ID NO: 245444 - DNA, 20 bp, human
ggaagacactattctaatgt

SEQ ID NO: 245445 - DNA, 20 bp, human
gatgatctggcaacttttaa

SEQ ID NO: 245446 - DNA, 20 bp, human
gaagaccaggtcagccccac

SEQ ID NO: 245447 - DNA, 20 bp, human
ggacttggggctgatgtcta

SEQ ID NO: 245448 - DNA, 20 bp, human
gtctagggacgtccacgagg

SEQ ID NO: 245449 - DNA, 20 bp, human
gaggtcagccccacaggcta

SEQ ID NO: 245450 - DNA, 20 bp, human
gtcaggagggagaaaccagt

SEQ ID NO: 245451 - DNA, 20 bp, human
gctagggggcttgaggactt

SEQ ID NO: 245452 - DNA, 20 bp, human
gatgtctagggacgtccacg

SEQ ID NO: 245453 - DNA, 20 bp, human
gccaggagaggggataacta

SEQ ID NO: 245454 - DNA, 20 bp, human
gccaaccagcactaatgctg

SEQ ID NO: 245455 - DNA, 20 bp, human
ggtgctggttggagggacga

SEQ ID NO: 245456 - DNA, 20 bp, human
gagctggggtcccccctccc

SEQ ID NO: 245457 - DNA, 20 bp, human
gctgatagtggtgaacctgg

SEQ ID NO: 245458 - DNA, 20 bp, human
gcttacagctgagaggatga

SEQ ID NO: 245459 - DNA, 20 bp, human
gccgctgatagtggtgaacc

SEQ ID NO: 245460 - DNA, 20 bp, human
gtgggcccacacagcacgtc

SEQ ID NO: 245461 - DNA, 20 bp, human
gaccactatcagcgggaacc

SEQ ID NO: 245462 - DNA, 20 bp, human
gtcccagttgagctcactgt

SEQ ID NO: 245463 - DNA, 20 bp, human
gacctctgaggtcagagcca

SEQ ID NO: 245464 - DNA, 20 bp, human
ggccgggttcccgctgatag

SEQ ID NO: 245465 - DNA, 20 bp, human
gcagggagggcagacctctg

SEQ ID NO: 245466 - DNA, 20 bp, human
gggaccgagggttcgaggga

SEQ ID NO: 245467 - DNA, 20 bp, human
gcggaagcgcgcaggtgtga

SEQ ID NO: 245468 - DNA, 20 bp, human
gagagggcggagtcaagaag

SEQ ID NO: 245469 - DNA, 20 bp, human
gcacctgagcctcgctgaga

SEQ ID NO: 245470 - DNA, 20 bp, human
gctgtgggcgcacctgtaac

SEQ ID NO: 245471 - DNA, 20 bp, human
gacctgggagagcgcacttc

SEQ ID NO: 245472 - DNA, 20 bp, human
ggggaccccagtcccttaat

SEQ ID NO: 245473 - DNA, 20 bp, human
gtacaggtgcgcccacagcg

SEQ ID NO: 245474 - DNA, 20 bp, human
gtgacagggcggagccggtg

SEQ ID NO: 245475 - DNA, 20 bp, human
gcacaggtgtggagacgcac

SEQ ID NO: 245476 - DNA, 20 bp, human
gtacccaagcctgaaagtga

SEQ ID NO: 245477 - DNA, 20 bp, human
ggtgccgaagactccgaggg

SEQ ID NO: 245478 - DNA, 20 bp, human
gtgtccccgggacggagcgc

SEQ ID NO: 245479 - DNA, 20 bp, human
gagtgatggcctaggcggga

SEQ ID NO: 245480 - DNA, 20 bp, human
gaggcgggagggacaattac

SEQ ID NO: 245481 - DNA, 20 bp, human
ggcggtgccgaagactccga

SEQ ID NO: 245482 - DNA, 20 bp, human
gcgcctaggccatcactttc

SEQ ID NO: 245483 - DNA, 20 bp, human
gagggagggcccgtgtcgcg

SEQ ID NO: 245484 - DNA, 20 bp, human
gtacgccgggcactcagccg

SEQ ID NO: 245485 - DNA, 20 bp, human
gaagggctggaacaaagtga

SEQ ID NO: 245486 - DNA, 20 bp, human
gaacgcgcagcgcgaggttc

SEQ ID NO: 245487 - DNA, 20 bp, human
ggctgcgcgttccccttttt

SEQ ID NO: 245488 - DNA, 20 bp, human
ggcgcgttcccctttttcgg

SEQ ID NO: 245489 - DNA, 20 bp, human
ggtccctgcatccttccacc

SEQ ID NO: 245490 - DNA, 20 bp, human
gaccctgccccccgaaaaag

SEQ ID NO: 245491 - DNA, 20 bp, human
gcagtcttaaatcggcctgg

SEQ ID NO: 245492 - DNA, 20 bp, human
gtagcagtcttaaatcggcc

SEQ ID NO: 245493 - DNA, 20 bp, human
ggccgggagcttggcggacc

SEQ ID NO: 245494 - DNA, 20 bp, human
ggcatgcagcgcggcgatcc

SEQ ID NO: 245495 - DNA, 20 bp, human
gcttaaatcggcctggtgga

SEQ ID NO: 245496 - DNA, 20 bp, human
gtgtctgggcttttgagatt

SEQ ID NO: 245497 - DNA, 20 bp, human
gactaggaagatacagtcga

SEQ ID NO: 245498 - DNA, 20 bp, human
gactcaggtagcattgtagg

SEQ ID NO: 245499 - DNA, 20 bp, human
gaagtctcctagcagggtct

SEQ ID NO: 245500 - DNA, 20 bp, human
gagagggtgggatgagttga

SEQ ID NO: 245501 - DNA, 20 bp, human
gagaggtgccaggattgcta

SEQ ID NO: 245502 - DNA, 20 bp, human
gggaagatacagtcgaaggt

SEQ ID NO: 245503 - DNA, 20 bp, human
gtctggtaagtctcctagca

SEQ ID NO: 245504 - DNA, 20 bp, human
ggctcaaatgcagggaggtc

SEQ ID NO: 245505 - DNA, 20 bp, human
gtacataggaatggatgtgt

SEQ ID NO: 245506 - DNA, 20 bp, human
gcgacgagaaggggttccgc

SEQ ID NO: 245507 - DNA, 20 bp, human
gaggcccggagcagctcgag

SEQ ID NO: 245508 - DNA, 20 bp, human
gttcttcgggcgacgagaag

SEQ ID NO: 245509 - DNA, 20 bp, human
gaaggggttccgcggggaga

SEQ ID NO: 245510 - DNA, 20 bp, human
gtccaccgcggctttcgcat

SEQ ID NO: 245511 - DNA, 20 bp, human
gccagtgggggaattcccga

SEQ ID NO: 245512 - DNA, 20 bp, human
ggaagaaacccgaaggtctt

SEQ ID NO: 245513 - DNA, 20 bp, human
ggggccgctcgagctgctcc

SEQ ID NO: 245514 - DNA, 20 bp, human
gggaacttgccgaagacctt

SEQ ID NO: 245515 - DNA, 20 bp, human
ggccgctgcgcactcggcac

SEQ ID NO: 245516 - DNA, 20 bp, human
gtcccacagtgccacggggt

SEQ ID NO: 245517 - DNA, 20 bp, human
gcctccctggcaggaagcga

SEQ ID NO: 245518 - DNA, 20 bp, human
ggtgcagcgccacgtcccag

SEQ ID NO: 245519 - DNA, 20 bp, human
gaggggctatgcaaatgtag

SEQ ID NO: 245520 - DNA, 20 bp, human
gcccgagggcgggggttccg

SEQ ID NO: 245521 - DNA, 20 bp, human
gggtgcggcgcaatccggag

SEQ ID NO: 245522 - DNA, 20 bp, human
gccgccctcggggtgcgagg

SEQ ID NO: 245523 - DNA, 20 bp, human
gtctaccccaagctagaaaa

SEQ ID NO: 245524 - DNA, 20 bp, human
gggcccgcgctctatggtcg

SEQ ID NO: 245525 - DNA, 20 bp, human
ggtcgtcctggcgtcctctc

SEQ ID NO: 245526 - DNA, 20 bp, human
gggcagccacccagtctcgg

SEQ ID NO: 245527 - DNA, 20 bp, human
gccggctcccaccctgtccg

SEQ ID NO: 245528 - DNA, 20 bp, human
gctaagtgctcccccgagac

SEQ ID NO: 245529 - DNA, 20 bp, human
ggaaaccgggaacccctggc

SEQ ID NO: 245530 - DNA, 20 bp, human
ggaaccgataacagtgttcc

SEQ ID NO: 245531 - DNA, 20 bp, human
gggagccccccggacagggt

SEQ ID NO: 245532 - DNA, 20 bp, human
gctgtgaaaccgggaacccc

SEQ ID NO: 245533 - DNA, 20 bp, human
gctctgaatgctcaaggtgg

SEQ ID NO: 245534 - DNA, 20 bp, human
gttgaggggagatctgttga

SEQ ID NO: 245535 - DNA, 20 bp, human
gggttcccggtttcacagag

SEQ ID NO: 245536 - DNA, 20 bp, human
gactccccggctacattcca

SEQ ID NO: 245537 - DNA, 20 bp, human
gcggctacattccaaggcgt

SEQ ID NO: 245538 - DNA, 20 bp, human
gtcaagcaggaggagttcct

SEQ ID NO: 245539 - DNA, 20 bp, human
ggaagtctccgcccacgcct

SEQ ID NO: 245540 - DNA, 20 bp, human
gtgacgtcacagacactccc

SEQ ID NO: 245541 - DNA, 20 bp, human
gtccggaagtgatggactgg

SEQ ID NO: 245542 - DNA, 20 bp, human
ggggtccggaagtgatggac

SEQ ID NO: 245543 - DNA, 20 bp, human
gggcttgggtccggaagtga

SEQ ID NO: 245544 - DNA, 20 bp, human
gctacattccaaggcgtggg

SEQ ID NO: 245545 - DNA, 20 bp, human
ggagaatgagacttctgatt

SEQ ID NO: 245546 - DNA, 20 bp, human
ggagcaaaggtcgaagtctg

SEQ ID NO: 245547 - DNA, 20 bp, human
gggttgagggccagtgacac

SEQ ID NO: 245548 - DNA, 20 bp, human
gaggtgctgattggtggaca

SEQ ID NO: 245549 - DNA, 20 bp, human
ggggagggaagaccgttatc

SEQ ID NO: 245550 - DNA, 20 bp, human
ggggccagtgacactggggc

SEQ ID NO: 245551 - DNA, 20 bp, human
gtccaccaatcagcacctgg

SEQ ID NO: 245552 - DNA, 20 bp, human
gataagtagggcagaggtca

SEQ ID NO: 245553 - DNA, 20 bp, human
ggtggacagggtggagagac

SEQ ID NO: 245554 - DNA, 20 bp, human
gaagatgctgaagcggtcac

SEQ ID NO: 245555 - DNA, 20 bp, human
gttcgacctttgctcactga

SEQ ID NO: 245556 - DNA, 20 bp, human
gtgagagggtagtgtgccat

SEQ ID NO: 245557 - DNA, 20 bp, human
gcgaccagttacggaagagg

SEQ ID NO: 245558 - DNA, 20 bp, human
gggaagctccggtttcaccc

SEQ ID NO: 245559 - DNA, 20 bp, human
gtgaagacttaggtttcgga

SEQ ID NO: 245560 - DNA, 20 bp, human
gcaggagagtcaggccaatg

SEQ ID NO: 245561 - DNA, 20 bp, human
gaggccgcctcttccgtaac

SEQ ID NO: 245562 - DNA, 20 bp, human
gcggaagaggcggccttgag

SEQ ID NO: 245563 - DNA, 20 bp, human
gtaactggtcggagacagtt

SEQ ID NO: 245564 - DNA, 20 bp, human
ggggaagagcgccacgcggt

SEQ ID NO: 245565 - DNA, 20 bp, human
gggctgttgactccccgcct

SEQ ID NO: 245566 - DNA, 20 bp, human
gttcccatatccactagatg

SEQ ID NO: 245567 - DNA, 20 bp, human
ggggagttaagaacttgtca

SEQ ID NO: 245568 - DNA, 20 bp, human
gaatccacatctagtggata

SEQ ID NO: 245569 - DNA, 20 bp, human
gttcttcgaaagttgtccct

SEQ ID NO: 245570 - DNA, 20 bp, human
gtgcaatctccatgctagaa

SEQ ID NO: 245571 - DNA, 20 bp, human
gaatctccatgctagaaggg

SEQ ID NO: 245572 - DNA, 20 bp, human
ggttctctgctgcgtagcgc

SEQ ID NO: 245573 - DNA, 20 bp, human
ggatgtgtgcttctggtcag

SEQ ID NO: 245574 - DNA, 20 bp, human
gtgagataatccacatctag

SEQ ID NO: 245575 - DNA, 20 bp, human
gttgcagcttgctaactaga

SEQ ID NO: 245576 - DNA, 20 bp, human
ggaagggaactccctaggag

SEQ ID NO: 245577 - DNA, 20 bp, human
gcagatgtgtgattgtcagt

SEQ ID NO: 245578 - DNA, 20 bp, human
gcaaatgaagggaactccct

SEQ ID NO: 245579 - DNA, 20 bp, human
gagctagaggccactagagc

SEQ ID NO: 245580 - DNA, 20 bp, human
gccggccttaatatgaatga

SEQ ID NO: 245581 - DNA, 20 bp, human
gcagacgtttccagctctag

SEQ ID NO: 245582 - DNA, 20 bp, human
gctagttataggttgagtga

SEQ ID NO: 245583 - DNA, 20 bp, human
gatcgttaaaagccttgtgt

SEQ ID NO: 245584 - DNA, 20 bp, human
gatggccctcattcatatta

SEQ ID NO: 245585 - DNA, 20 bp, human
gcagccttgtaaattacaga

SEQ ID NO: 245586 - DNA, 20 bp, human
gccgccagcttccctacgct

SEQ ID NO: 245587 - DNA, 20 bp, human
gaggcgcggccgccaagcgt

SEQ ID NO: 245588 - DNA, 20 bp, human
gccgccaagcgtagggaagc

SEQ ID NO: 245589 - DNA, 20 bp, human
gacggccggcgcaggtggag

SEQ ID NO: 245590 - DNA, 20 bp, human
gcgagcgtgctcgggccgaa

SEQ ID NO: 245591 - DNA, 20 bp, human
ggaaagagccgagcgtgctc

SEQ ID NO: 245592 - DNA, 20 bp, human
gccacctgcgccggccgtgg

SEQ ID NO: 245593 - DNA, 20 bp, human
ggccgtgcgtggtgacgccg

SEQ ID NO: 245594 - DNA, 20 bp, human
gtccagagcctgaacgggga

SEQ ID NO: 245595 - DNA, 20 bp, human
gccggtgcgtcacccccccg

SEQ ID NO: 245596 - DNA, 20 bp, human
ggggagcgctgcacacggaa

SEQ ID NO: 245597 - DNA, 20 bp, human
ggcgctagctagtaggcaaa

SEQ ID NO: 245598 - DNA, 20 bp, human
ggtccacatagcctcattaa

SEQ ID NO: 245599 - DNA, 20 bp, human
gaaacagctgccccttaatg

SEQ ID NO: 245600 - DNA, 20 bp, human
gagctagcgctgaggaggcg

SEQ ID NO: 245601 - DNA, 20 bp, human
gctcctcagcgctagctagt

SEQ ID NO: 245602 - DNA, 20 bp, human
ggagagccgccgagaccgga

SEQ ID NO: 245603 - DNA, 20 bp, human
gcggaggcagccctgaaggc

SEQ ID NO: 245604 - DNA, 20 bp, human
gacccagagactgtcatgga

SEQ ID NO: 245605 - DNA, 20 bp, human
gcggcgaagggaggcgtttg

SEQ ID NO: 245606 - DNA, 20 bp, human
gcacccctgtcacgtgtcgc

SEQ ID NO: 245607 - DNA, 20 bp, human
gccctccggcgacacgtgac

SEQ ID NO: 245608 - DNA, 20 bp, human
gccggcagcacgcccaggat

SEQ ID NO: 245609 - DNA, 20 bp, human
gcgggttgccgggaaaaacc

SEQ ID NO: 245610 - DNA, 20 bp, human
gttccacagcccggccaatc

SEQ ID NO: 245611 - DNA, 20 bp, human
gcccctgattggccgggctg

SEQ ID NO: 245612 - DNA, 20 bp, human
gtcgccgcggcccacgtgag

SEQ ID NO: 245613 - DNA, 20 bp, human
gcacgtgtcgccggaggggc

SEQ ID NO: 245614 - DNA, 20 bp, human
ggtgccggcctctgcagtgt

SEQ ID NO: 245615 - DNA, 20 bp, human
gtcccggcaacccgcccctc

SEQ ID NO: 245616 - DNA, 20 bp, human
gcggggcagccatgttagat

SEQ ID NO: 245617 - DNA, 20 bp, human
gggggggccactaattggtt

SEQ ID NO: 245618 - DNA, 20 bp, human
gggtcccctcccatctaaca

SEQ ID NO: 245619 - DNA, 20 bp, human
gccgcgggggggccactaat

SEQ ID NO: 245620 - DNA, 20 bp, human
gctctggcgtccaatggagc

SEQ ID NO: 245621 - DNA, 20 bp, human
gagcctgccactcagctctg

SEQ ID NO: 245622 - DNA, 20 bp, human
gtctgcaccaatgggcgtgg

SEQ ID NO: 245623 - DNA, 20 bp, human
gtggagacttctgcaccaat

SEQ ID NO: 245624 - DNA, 20 bp, human
gggaggggaccagtggtggt

SEQ ID NO: 245625 - DNA, 20 bp, human
ggcaccaatgggcgtggggg

SEQ ID NO: 245626 - DNA, 20 bp, human
ggtggcgcgcgaaacgcggt

SEQ ID NO: 245627 - DNA, 20 bp, human
ggaaacgcggtgggcgggac

SEQ ID NO: 245628 - DNA, 20 bp, human
ggtagtgtcgcgagatttca

SEQ ID NO: 245629 - DNA, 20 bp, human
gcggcgtagccggaagtcag

SEQ ID NO: 245630 - DNA, 20 bp, human
gcctggtggcgcgcgaaacg

SEQ ID NO: 245631 - DNA, 20 bp, human
gacccagacaacggcgtagc

SEQ ID NO: 245632 - DNA, 20 bp, human
ggggtggtattgaattaggg

SEQ ID NO: 245633 - DNA, 20 bp, human
gtgcacactgaagtacgcag

SEQ ID NO: 245634 - DNA, 20 bp, human
ggcgcggtcgagtcatcgca

SEQ ID NO: 245635 - DNA, 20 bp, human
ggtgttgaactgttgagtct

SEQ ID NO: 245636 - DNA, 20 bp, human
gagagggcaggcagagcgat

SEQ ID NO: 245637 - DNA, 20 bp, human
gaagcacaatgcagggggcg

SEQ ID NO: 245638 - DNA, 20 bp, human
gctgcagctccgcaacctgc

SEQ ID NO: 245639 - DNA, 20 bp, human
gtctgattggcgcctcgcgg

SEQ ID NO: 245640 - DNA, 20 bp, human
gcaacagaaaagaggcgcat

SEQ ID NO: 245641 - DNA, 20 bp, human
gtgggaccctcgctgttctt

SEQ ID NO: 245642 - DNA, 20 bp, human
gttgacaggcggaaaaagaa

SEQ ID NO: 245643 - DNA, 20 bp, human
gtgtgcctgtgtaaagaggc

SEQ ID NO: 245644 - DNA, 20 bp, human
gtggcgcctcgcggaggggg

SEQ ID NO: 245645 - DNA, 20 bp, human
gtttcctagcagtacgattt

SEQ ID NO: 245646 - DNA, 20 bp, human
gcgcgcccggggatcctgca

SEQ ID NO: 245647 - DNA, 20 bp, human
gcggtcccccgcgcgagtcc

SEQ ID NO: 245648 - DNA, 20 bp, human
gtcctcgcgcgccaggtccc

SEQ ID NO: 245649 - DNA, 20 bp, human
ggcgcgaagctcagaagtcc

SEQ ID NO: 245650 - DNA, 20 bp, human
ggaggactccgcaggatgcg

SEQ ID NO: 245651 - DNA, 20 bp, human
ggcccggcagcgccccactg

SEQ ID NO: 245652 - DNA, 20 bp, human
gcagacgcgtgtattaagcc

SEQ ID NO: 245653 - DNA, 20 bp, human
ggattcgccgggactcgcgc

SEQ ID NO: 245654 - DNA, 20 bp, human
gaggatgcgcggcgtgtgcg

SEQ ID NO: 245655 - DNA, 20 bp, human
gctagcgctgctggcggccc

SEQ ID NO: 245656 - DNA, 20 bp, human
gctggcgtggggtgacgtaa

SEQ ID NO: 245657 - DNA, 20 bp, human
gttaaagggccgcggggcta

SEQ ID NO: 245658 - DNA, 20 bp, human
ggcacatggcccgtcgccat

SEQ ID NO: 245659 - DNA, 20 bp, human
gcacctgtccgggctttaaa

SEQ ID NO: 245660 - DNA, 20 bp, human
ggctcggtgccgcctctggt

SEQ ID NO: 245661 - DNA, 20 bp, human
ggcctctggttggctggcgt

SEQ ID NO: 245662 - DNA, 20 bp, human
ggcaccgagctgcacctgtc

SEQ ID NO: 245663 - DNA, 20 bp, human
ggggaggtgtccggaacccc

SEQ ID NO: 245664 - DNA, 20 bp, human
ggtcccggcgcgggagtccc

SEQ ID NO: 245665 - DNA, 20 bp, human
gccacccgcgccgcagtcca

SEQ ID NO: 245666 - DNA, 20 bp, human
gcccgcccccggactcctgg

SEQ ID NO: 245667 - DNA, 20 bp, human
gcgccacgagaggtgaccaa

SEQ ID NO: 245668 - DNA, 20 bp, human
gccgcgccggcctgtccccc

SEQ ID NO: 245669 - DNA, 20 bp, human
gtctcgtggcgaactcggat

SEQ ID NO: 245670 - DNA, 20 bp, human
gagggcacagagggtctctg

SEQ ID NO: 245671 - DNA, 20 bp, human
gtgggaaggccccggatcag

SEQ ID NO: 245672 - DNA, 20 bp, human
gcagcggccgccaggagtcc

SEQ ID NO: 245673 - DNA, 20 bp, human
ggggccatatcaggccgggg

SEQ ID NO: 245674 - DNA, 20 bp, human
gcctggcggccgctgatccg

SEQ ID NO: 245675 - DNA, 20 bp, human
gtcacctctcgtggcgaact

SEQ ID NO: 245676 - DNA, 20 bp, human
gtcgcccgctgctgggtctc

SEQ ID NO: 245677 - DNA, 20 bp, human
gcggacctcgtcactgatta

SEQ ID NO: 245678 - DNA, 20 bp, human
gcggcgggtaagtggtgcgt

SEQ ID NO: 245679 - DNA, 20 bp, human
gactgattacggacgcgagg

SEQ ID NO: 245680 - DNA, 20 bp, human
gcgggaggacgcggttcggt

SEQ ID NO: 245681 - DNA, 20 bp, human
ggcgccgccgcccagcaacc

SEQ ID NO: 245682 - DNA, 20 bp, human
ggtaagtggtgcgtcggctc

SEQ ID NO: 245683 - DNA, 20 bp, human
gctgacgtgaggactacgtg

SEQ ID NO: 245684 - DNA, 20 bp, human
gccgcccagcaacccggagc

SEQ ID NO: 245685 - DNA, 20 bp, human
ggtggggccgctgccggctc

SEQ ID NO: 245686 - DNA, 20 bp, human
ggggccctgccaaggaacga

SEQ ID NO: 245687 - DNA, 20 bp, human
gaacgagccctaaaatggaa

SEQ ID NO: 245688 - DNA, 20 bp, human
ggctgcgtggtttttgaaga

SEQ ID NO: 245689 - DNA, 20 bp, human
gcaaagagacagcgaatggg

SEQ ID NO: 245690 - DNA, 20 bp, human
ggtgcaaagagacagcgaat

SEQ ID NO: 245691 - DNA, 20 bp, human
gtgctcctgcataaatcata

SEQ ID NO: 245692 - DNA, 20 bp, human
gggtcagggaggttaggaga

SEQ ID NO: 245693 - DNA, 20 bp, human
ggggactctgtctctagcaa

SEQ ID NO: 245694 - DNA, 20 bp, human
gctatgaaaggccatattag

SEQ ID NO: 245695 - DNA, 20 bp, human
gagagacagcgaatgggagg

SEQ ID NO: 245696 - DNA, 20 bp, human
ggggccacgctgaaaatttg

SEQ ID NO: 245697 - DNA, 20 bp, human
ggaggcggagacaaagaata

SEQ ID NO: 245698 - DNA, 20 bp, human
gaatgagacagggtaaccca

SEQ ID NO: 245699 - DNA, 20 bp, human
gtgagctccgatcagttaag

SEQ ID NO: 245700 - DNA, 20 bp, human
ggatcggagctcagtaacca

SEQ ID NO: 245701 - DNA, 20 bp, human
ggtactctgtcaatgagaca

SEQ ID NO: 245702 - DNA, 20 bp, human
gtctctgccccttaactgat

SEQ ID NO: 245703 - DNA, 20 bp, human
gaaagtgttggagaatgagg

SEQ ID NO: 245704 - DNA, 20 bp, human
ggagtacgtggcgatgacga

SEQ ID NO: 245705 - DNA, 20 bp, human
gtctagcatggtttcatcca

SEQ ID NO: 245706 - DNA, 20 bp, human
gaaccccgggcgcagggaaa

SEQ ID NO: 245707 - DNA, 20 bp, human
gggaaaggggatcctggcgg

SEQ ID NO: 245708 - DNA, 20 bp, human
ggcgcggaggagggaccgaa

SEQ ID NO: 245709 - DNA, 20 bp, human
ggaggggacgagctgggcga

SEQ ID NO: 245710 - DNA, 20 bp, human
ggaaggggaggggacgagct

SEQ ID NO: 245711 - DNA, 20 bp, human
gagagagcgggccgggggaa

SEQ ID NO: 245712 - DNA, 20 bp, human
gtgggaagtcccagggatct

SEQ ID NO: 245713 - DNA, 20 bp, human
ggccgccgcggaacccagtg

SEQ ID NO: 245714 - DNA, 20 bp, human
gtccgcgccgctcctcgcct

SEQ ID NO: 245715 - DNA, 20 bp, human
gcggggagaagccgggaatg

SEQ ID NO: 245716 - DNA, 20 bp, human
ggcggtgggctggagagcgt

SEQ ID NO: 245717 - DNA, 20 bp, human
ggccgggcggctcctctcgg

SEQ ID NO: 245718 - DNA, 20 bp, human
ggcgtccagaggagggcggt

SEQ ID NO: 245719 - DNA, 20 bp, human
gctcctctggacgccgcgag

SEQ ID NO: 245720 - DNA, 20 bp, human
gcctgagcgaggacactgga

SEQ ID NO: 245721 - DNA, 20 bp, human
gtgacggaatgctctgtgcg

SEQ ID NO: 245722 - DNA, 20 bp, human
gccgcagctctgctaatcga

SEQ ID NO: 245723 - DNA, 20 bp, human
ggcggccaatggctgcgccg

SEQ ID NO: 245724 - DNA, 20 bp, human
gcgcagctccgtgcactcgg

SEQ ID NO: 245725 - DNA, 20 bp, human
gggaaggaaatgtatcgagg

SEQ ID NO: 245726 - DNA, 20 bp, human
gtccccctccccctctcggg

SEQ ID NO: 245727 - DNA, 20 bp, human
gagggcccggccgcccgaga

SEQ ID NO: 245728 - DNA, 20 bp, human
ggaagaggtggaggcgtgtg

SEQ ID NO: 245729 - DNA, 20 bp, human
gccccggccccgagcttctg

SEQ ID NO: 245730 - DNA, 20 bp, human
gggccagagccgcagctcgg

SEQ ID NO: 245731 - DNA, 20 bp, human
gggcgcagcccgagcggctg

SEQ ID NO: 245732 - DNA, 20 bp, human
gaactccaatctggccccga

SEQ ID NO: 245733 - DNA, 20 bp, human
gccgcgggtgcgctgcggat

SEQ ID NO: 245734 - DNA, 20 bp, human
gctccgggaaagggaagcaa

SEQ ID NO: 245735 - DNA, 20 bp, human
ggctcccaggccggccgctg

SEQ ID NO: 245736 - DNA, 20 bp, human
gccgggtcctgcctgaaggc

SEQ ID NO: 245737 - DNA, 20 bp, human
ggtaggacccagagacgggg

SEQ ID NO: 245738 - DNA, 20 bp, human
gaggcccgggtcctgcctga

SEQ ID NO: 245739 - DNA, 20 bp, human
gcctgcgggtcccccactca

SEQ ID NO: 245740 - DNA, 20 bp, human
gtgagagggcgcagctcttt

SEQ ID NO: 245741 - DNA, 20 bp, human
gacgcccggggcgcgatccc

SEQ ID NO: 245742 - DNA, 20 bp, human
gccatggggacttactgaga

SEQ ID NO: 245743 - DNA, 20 bp, human
ggaccgctcaggaggaccgg

SEQ ID NO: 245744 - DNA, 20 bp, human
gcgcccccggtcctcctgag

SEQ ID NO: 245745 - DNA, 20 bp, human
gacgaggctggggaccgctc

SEQ ID NO: 245746 - DNA, 20 bp, human
gcccccgcggcgcccccagg

SEQ ID NO: 245747 - DNA, 20 bp, human
gcgcgccccggctgtttcca

SEQ ID NO: 245748 - DNA, 20 bp, human
gcggcggcccggaggagaac

SEQ ID NO: 245749 - DNA, 20 bp, human
gggacatggagacccggaca

SEQ ID NO: 245750 - DNA, 20 bp, human
gcctcgataacccgtccccc

SEQ ID NO: 245751 - DNA, 20 bp, human
gcctggccgggccgtccccg

SEQ ID NO: 245752 - DNA, 20 bp, human
gataacccgtcccccgggct

SEQ ID NO: 245753 - DNA, 20 bp, human
ggggagcggagtcagattcc

SEQ ID NO: 245754 - DNA, 20 bp, human
gcaacaaagggaagcgggac

SEQ ID NO: 245755 - DNA, 20 bp, human
ggccggaggtggcgtctaca

SEQ ID NO: 245756 - DNA, 20 bp, human
ggaaccgcggattccgccca

SEQ ID NO: 245757 - DNA, 20 bp, human
gaaagcctcggtcagaccca

SEQ ID NO: 245758 - DNA, 20 bp, human
gcctccctgggcggaatccg

SEQ ID NO: 245759 - DNA, 20 bp, human
gaatgagcgccgaggaaccg

SEQ ID NO: 245760 - DNA, 20 bp, human
gggcggaatccgcggttcct

SEQ ID NO: 245761 - DNA, 20 bp, human
gctccccgtgggtctgaccg

SEQ ID NO: 245762 - DNA, 20 bp, human
gcactccacttgggagacaa

SEQ ID NO: 245763 - DNA, 20 bp, human
gagagaggatcttgaagccg

SEQ ID NO: 245764 - DNA, 20 bp, human
ggatcctctctcctccccgt

SEQ ID NO: 245765 - DNA, 20 bp, human
ggtaacgaagacacctggac

SEQ ID NO: 245766 - DNA, 20 bp, human
gattcacggcagagaccagc

SEQ ID NO: 245767 - DNA, 20 bp, human
gtgtttctcatctgtctttc

SEQ ID NO: 245768 - DNA, 20 bp, human
gtaatcaaaaaagagctaag

SEQ ID NO: 245769 - DNA, 20 bp, human
gctgggcagaagatcaataa

SEQ ID NO: 245770 - DNA, 20 bp, human
gagatacaatgaaagttaaa

SEQ ID NO: 245771 - DNA, 20 bp, human
gatactaataacatacaaaa

SEQ ID NO: 245772 - DNA, 20 bp, human
gcaaaagctgacaaaactga

SEQ ID NO: 245773 - DNA, 20 bp, human
gtatattgatattgaatgtg

SEQ ID NO: 245774 - DNA, 20 bp, human
gattcaatatcaatataact

SEQ ID NO: 245775 - DNA, 20 bp, human
gttttcactaaagacaaaga

SEQ ID NO: 245776 - DNA, 20 bp, human
gcagccctgcgcctgcgcgt

SEQ ID NO: 245777 - DNA, 20 bp, human
ggcgactggctgttaggcgt

SEQ ID NO: 245778 - DNA, 20 bp, human
ggcggcccaggcccacgcgc

SEQ ID NO: 245779 - DNA, 20 bp, human
ggcccgtcgtacctgatggt

SEQ ID NO: 245780 - DNA, 20 bp, human
gttggggtaggcgggagtat

SEQ ID NO: 245781 - DNA, 20 bp, human
gggtcggggcgccaaggctc

SEQ ID NO: 245782 - DNA, 20 bp, human
gctaacagccagtcgcagaa

SEQ ID NO: 245783 - DNA, 20 bp, human
gagccagtcgcagaaaggga

SEQ ID NO: 245784 - DNA, 20 bp, human
gccctcccgcggaagggaag

SEQ ID NO: 245785 - DNA, 20 bp, human
gagggaggggcgggcaaaag

SEQ ID NO: 245786 - DNA, 20 bp, human
gagccacaatcagataacaa

SEQ ID NO: 245787 - DNA, 20 bp, human
ggataacaaaggtcactgta

SEQ ID NO: 245788 - DNA, 20 bp, human
gtaacagatcaagggattta

SEQ ID NO: 245789 - DNA, 20 bp, human
gaggggagatttgttcaatg

SEQ ID NO: 245790 - DNA, 20 bp, human
ggtaagggaaaatgacttgc

SEQ ID NO: 245791 - DNA, 20 bp, human
gaatgcctataacagatcaa

SEQ ID NO: 245792 - DNA, 20 bp, human
ggggatttacggtggacacc

SEQ ID NO: 245793 - DNA, 20 bp, human
gcagatcaagggatttacgg

SEQ ID NO: 245794 - DNA, 20 bp, human
ggacctttgttatctgattg

SEQ ID NO: 245795 - DNA, 20 bp, human
gtccattgatgatgttgcct

SEQ ID NO: 245796 - DNA, 20 bp, human
gggaggagagcagctcacgt

SEQ ID NO: 245797 - DNA, 20 bp, human
ggcccccgcctcccctacta

SEQ ID NO: 245798 - DNA, 20 bp, human
gttctccgtagtaggggagg

SEQ ID NO: 245799 - DNA, 20 bp, human
gaaggattcgggttgcccag

SEQ ID NO: 245800 - DNA, 20 bp, human
gggaggagggaggtcatata

SEQ ID NO: 245801 - DNA, 20 bp, human
gcgcatacctgcgccgtact

SEQ ID NO: 245802 - DNA, 20 bp, human
gcctcctcctagtacggcgc

SEQ ID NO: 245803 - DNA, 20 bp, human
gccagggggtggcttgaaaa

SEQ ID NO: 245804 - DNA, 20 bp, human
gagctcacgtaggcagatag

SEQ ID NO: 245805 - DNA, 20 bp, human
gtgaacaatcgcggtgagag

SEQ ID NO: 245806 - DNA, 20 bp, human
gtagtctcaaatttcattgc

SEQ ID NO: 245807 - DNA, 20 bp, human
gctattggacattactgttt

SEQ ID NO: 245808 - DNA, 20 bp, human
gaataggtgtttcatatata

SEQ ID NO: 245809 - DNA, 20 bp, human
gtgagttctgaaagtcactg

SEQ ID NO: 245810 - DNA, 20 bp, human
gcaaacacaccataactcat

SEQ ID NO: 245811 - DNA, 20 bp, human
gaagtaactctagatcaaca

SEQ ID NO: 245812 - DNA, 20 bp, human
gtagaaataccaatgagtta

SEQ ID NO: 245813 - DNA, 20 bp, human
gatgttgtgatgctaataat

SEQ ID NO: 245814 - DNA, 20 bp, human
ggaattttcaaactattgac

SEQ ID NO: 245815 - DNA, 20 bp, human
ggatcaacaaggcctgaaac

SEQ ID NO: 245816 - DNA, 20 bp, human
gaggggcggggacacgaacg

SEQ ID NO: 245817 - DNA, 20 bp, human
gggacacgaacgaggctcgg

SEQ ID NO: 245818 - DNA, 20 bp, human
ggcagcccgccctgcttctc

SEQ ID NO: 245819 - DNA, 20 bp, human
gccacaaaggccgagcgccc

SEQ ID NO: 245820 - DNA, 20 bp, human
ggccagaggcccgccagatc

SEQ ID NO: 245821 - DNA, 20 bp, human
gccctggcttcgctgcgttc

SEQ ID NO: 245822 - DNA, 20 bp, human
ggggctgcttctcccggatc

SEQ ID NO: 245823 - DNA, 20 bp, human
ggacccaagcccggaaggtc

SEQ ID NO: 245824 - DNA, 20 bp, human
gcacgaacgaggctcggcgg

SEQ ID NO: 245825 - DNA, 20 bp, human
ggggcagcccctcgtctgta

SEQ ID NO: 245826 - DNA, 20 bp, human
gcttgtgtggccagtggcga

SEQ ID NO: 245827 - DNA, 20 bp, human
gggccacgcccccagatcgc

SEQ ID NO: 245828 - DNA, 20 bp, human
gtgtccctagccggccctgg

SEQ ID NO: 245829 - DNA, 20 bp, human
gtggcctccagggccggcta

SEQ ID NO: 245830 - DNA, 20 bp, human
gccagcgccgccagcgatct

SEQ ID NO: 245831 - DNA, 20 bp, human
ggggcggggccggtgatgct

SEQ ID NO: 245832 - DNA, 20 bp, human
ggccaagcgcttcccacaag

SEQ ID NO: 245833 - DNA, 20 bp, human
ggctccggggagcctacaag

SEQ ID NO: 245834 - DNA, 20 bp, human
gcagctctctgcagctcaac

SEQ ID NO: 245835 - DNA, 20 bp, human
gtggtaggaccgagcatcac

SEQ ID NO: 245836 - DNA, 20 bp, human
gactgcgcatgcggattcat

SEQ ID NO: 245837 - DNA, 20 bp, human
ggggtctagggcccgagggg

SEQ ID NO: 245838 - DNA, 20 bp, human
gcggcccgccattgggagaa

SEQ ID NO: 245839 - DNA, 20 bp, human
ggagacgcgcgcctgcgctg

SEQ ID NO: 245840 - DNA, 20 bp, human
ggggcccgcggcccgccatt

SEQ ID NO: 245841 - DNA, 20 bp, human
gtcgtctgggccccggttcc

SEQ ID NO: 245842 - DNA, 20 bp, human
gcgcaggcgcgcgtctctgc

SEQ ID NO: 245843 - DNA, 20 bp, human
gccaggtcgtccaggaaccg

SEQ ID NO: 245844 - DNA, 20 bp, human
gaggcggggtctagggcccg

SEQ ID NO: 245845 - DNA, 20 bp, human
ggcgcatgcggattcatggg

SEQ ID NO: 245846 - DNA, 20 bp, human
gagcaccgtcgcgacgatca

SEQ ID NO: 245847 - DNA, 20 bp, human
gcccgctcccgcgttccagg

SEQ ID NO: 245848 - DNA, 20 bp, human
gcccaccctgatcgtcgcga

SEQ ID NO: 245849 - DNA, 20 bp, human
gaaaacagctggagccgaga

SEQ ID NO: 245850 - DNA, 20 bp, human
gtcgcgacggtgctcctgat

SEQ ID NO: 245851 - DNA, 20 bp, human
gcagcctcctcctggaacgc

SEQ ID NO: 245852 - DNA, 20 bp, human
gtcacacagcgcagccaatc

SEQ ID NO: 245853 - DNA, 20 bp, human
ggcgcccgctcccgcgttcc

SEQ ID NO: 245854 - DNA, 20 bp, human
ggaggctgaagaggcgccgg

SEQ ID NO: 245855 - DNA, 20 bp, human
ggctgtgtgacgtaacggga

SEQ ID NO: 245856 - DNA, 20 bp, human
ggggcgcgcgcggttctcgg

SEQ ID NO: 245857 - DNA, 20 bp, human
ggccggtaggggttgagtta

SEQ ID NO: 245858 - DNA, 20 bp, human
gggtgccgggtcccagactg

SEQ ID NO: 245859 - DNA, 20 bp, human
ggttctcggtggggcggagg

SEQ ID NO: 245860 - DNA, 20 bp, human
gatagggcgcgcgcggttct

SEQ ID NO: 245861 - DNA, 20 bp, human
gaacccgcgcgccgagggcg

SEQ ID NO: 245862 - DNA, 20 bp, human
gcagcccagtgcctcttcag

SEQ ID NO: 245863 - DNA, 20 bp, human
gcattagcgccttgtcaatt

SEQ ID NO: 245864 - DNA, 20 bp, human
gggggccgagacagaagatt

SEQ ID NO: 245865 - DNA, 20 bp, human
gggactcaaggaccgctcgg

SEQ ID NO: 245866 - DNA, 20 bp, human
gtgcgtggcagtcctgatcc

SEQ ID NO: 245867 - DNA, 20 bp, human
gacacaatcaatccaggatc

SEQ ID NO: 245868 - DNA, 20 bp, human
gactcatgactcataagcag

SEQ ID NO: 245869 - DNA, 20 bp, human
gaaagtcagaaaggaaacta

SEQ ID NO: 245870 - DNA, 20 bp, human
gtgagtgatctgttcgttgt

SEQ ID NO: 245871 - DNA, 20 bp, human
gtctgactttttaaaatcga

SEQ ID NO: 245872 - DNA, 20 bp, human
gaaactagggaaatgattac

SEQ ID NO: 245873 - DNA, 20 bp, human
gacacacacacaatcaatcc

SEQ ID NO: 245874 - DNA, 20 bp, human
gtagggaaatgattacaggc

SEQ ID NO: 245875 - DNA, 20 bp, human
gtggggagggaatggagggg

SEQ ID NO: 245876 - DNA, 20 bp, human
gctgtgccgcagcacggaag

SEQ ID NO: 245877 - DNA, 20 bp, human
gtgccgcagcacggaagagg

SEQ ID NO: 245878 - DNA, 20 bp, human
gccgctggttgggcctcctt

SEQ ID NO: 245879 - DNA, 20 bp, human
gaagaggcggggtgagccgc

SEQ ID NO: 245880 - DNA, 20 bp, human
ggcctcgcgcgggtggcgtc

SEQ ID NO: 245881 - DNA, 20 bp, human
gcggcacagcgccgctggtt

SEQ ID NO: 245882 - DNA, 20 bp, human
ggccgtgcgcccgtcaatca

SEQ ID NO: 245883 - DNA, 20 bp, human
gcgtcaatcaaggtcgtcgt

SEQ ID NO: 245884 - DNA, 20 bp, human
ggagcaatggagatacaggt

SEQ ID NO: 245885 - DNA, 20 bp, human
gaaggtcgtcgtggggcatg

SEQ ID NO: 245886 - DNA, 20 bp, human
gccgggaagcccgacgacga

SEQ ID NO: 245887 - DNA, 20 bp, human
gcgcgcgcatcaggctcagt

SEQ ID NO: 245888 - DNA, 20 bp, human
gcagcggaggcgcgcgcatc

SEQ ID NO: 245889 - DNA, 20 bp, human
gcgcgcctccgctgtgccag

SEQ ID NO: 245890 - DNA, 20 bp, human
gggggagaaacgaacaagat

SEQ ID NO: 245891 - DNA, 20 bp, human
gggcgcccctggcacagcgg

SEQ ID NO: 245892 - DNA, 20 bp, human
gcgaaggcgtccgcccttgg

SEQ ID NO: 245893 - DNA, 20 bp, human
gttgggaagcagcgggtacg

SEQ ID NO: 245894 - DNA, 20 bp, human
gcatcaggctcagtgggttt

SEQ ID NO: 245895 - DNA, 20 bp, human
ggcagccgacgtagccgcga

SEQ ID NO: 245896 - DNA, 20 bp, human
ggcggggtgggagatcggaa

SEQ ID NO: 245897 - DNA, 20 bp, human
ggagccgagaggggcgaatc

SEQ ID NO: 245898 - DNA, 20 bp, human
gaagccggattcgcccctct

SEQ ID NO: 245899 - DNA, 20 bp, human
gcgaggccagggcccgccaa

SEQ ID NO: 245900 - DNA, 20 bp, human
ggcccctctcggctcgaacc

SEQ ID NO: 245901 - DNA, 20 bp, human
gtcctggttcgagccgagag

SEQ ID NO: 245902 - DNA, 20 bp, human
gggcctccccggaacatctg

SEQ ID NO: 245903 - DNA, 20 bp, human
gcctgcgcacacgcccttgg

SEQ ID NO: 245904 - DNA, 20 bp, human
gtgcagacagctcctcccgg

SEQ ID NO: 245905 - DNA, 20 bp, human
gccctgaaaaccatactctc

SEQ ID NO: 245906 - DNA, 20 bp, human
ggaggcggggatcgcggctg

SEQ ID NO: 245907 - DNA, 20 bp, human
ggaccaggaggcggggatcg

SEQ ID NO: 245908 - DNA, 20 bp, human
gcggccagctacaaaggacc

SEQ ID NO: 245909 - DNA, 20 bp, human
ggcggcgcggccagctacaa

SEQ ID NO: 245910 - DNA, 20 bp, human
gcctgcgctccgcctggggg

SEQ ID NO: 245911 - DNA, 20 bp, human
gcgccctccgcgctgcggct

SEQ ID NO: 245912 - DNA, 20 bp, human
gcggctgcgggctagcggcg

SEQ ID NO: 245913 - DNA, 20 bp, human
gctagcccgcagccgcccag

SEQ ID NO: 245914 - DNA, 20 bp, human
gcgcgccctgcgctccgcct

SEQ ID NO: 245915 - DNA, 20 bp, human
gctacaaaggaccaggaggc

SEQ ID NO: 245916 - DNA, 20 bp, human
gtgcggcagcgcgtggagtg

SEQ ID NO: 245917 - DNA, 20 bp, human
gcgtcctggagctgcggatg

SEQ ID NO: 245918 - DNA, 20 bp, human
gctcgagggcgggggaagaa

SEQ ID NO: 245919 - DNA, 20 bp, human
gggctcaagcgagaggtcaa

SEQ ID NO: 245920 - DNA, 20 bp, human
gagcagcgacgcaaggactg

SEQ ID NO: 245921 - DNA, 20 bp, human
gctccaatctggatgctcga

SEQ ID NO: 245922 - DNA, 20 bp, human
gctggagctgcggatgaggt

SEQ ID NO: 245923 - DNA, 20 bp, human
gctggtcatcccagttccgg

SEQ ID NO: 245924 - DNA, 20 bp, human
ggagccgtggcgccctgcaa

SEQ ID NO: 245925 - DNA, 20 bp, human
gacgcaaggactgcggtgca

SEQ ID NO: 245926 - DNA, 20 bp, human
ggtaccaaatgtggtaggag

SEQ ID NO: 245927 - DNA, 20 bp, human
gtagctgagtcctcttgaca

SEQ ID NO: 245928 - DNA, 20 bp, human
gacaggatatcctgccctat

SEQ ID NO: 245929 - DNA, 20 bp, human
gagaaggtaccaaatgtggt

SEQ ID NO: 245930 - DNA, 20 bp, human
ggacaagaggaggtgtggct

SEQ ID NO: 245931 - DNA, 20 bp, human
gaagagtcccataactttgt

SEQ ID NO: 245932 - DNA, 20 bp, human
gtatgagcctacaaagttat

SEQ ID NO: 245933 - DNA, 20 bp, human
gaagaggactcagctacaga

SEQ ID NO: 245934 - DNA, 20 bp, human
ggcagtgcttggtacaggct

SEQ ID NO: 245935 - DNA, 20 bp, human
gaagaagcttccctgtcaag

SEQ ID NO: 245936 - DNA, 20 bp, human
gaaacaggggagacacctgg

SEQ ID NO: 245937 - DNA, 20 bp, human
gggacccagcaacctgcgca

SEQ ID NO: 245938 - DNA, 20 bp, human
gcgcccccatgtgaccaccg

SEQ ID NO: 245939 - DNA, 20 bp, human
gaggaaacaggggagacacc

SEQ ID NO: 245940 - DNA, 20 bp, human
ggtgtgaggtcctgacctcc

SEQ ID NO: 245941 - DNA, 20 bp, human
gcccatgtgaccaccgcggt

SEQ ID NO: 245942 - DNA, 20 bp, human
gggggtcagtagccatgcgg

SEQ ID NO: 245943 - DNA, 20 bp, human
gggtggggtcagtagccatg

SEQ ID NO: 245944 - DNA, 20 bp, human
gagtagccatgcggcgggaa

SEQ ID NO: 245945 - DNA, 20 bp, human
gtcaccctgcgcaggttgct

SEQ ID NO: 245946 - DNA, 20 bp, human
ggccccgtgcctgacgtcgg

SEQ ID NO: 245947 - DNA, 20 bp, human
gactggacggacagctgcaa

SEQ ID NO: 245948 - DNA, 20 bp, human
gcgcccactggagacagggt

SEQ ID NO: 245949 - DNA, 20 bp, human
gtccggggaacgggactgga

SEQ ID NO: 245950 - DNA, 20 bp, human
gcccgcattcgccggggaac

SEQ ID NO: 245951 - DNA, 20 bp, human
gcccgccccgtgcctgacgt

SEQ ID NO: 245952 - DNA, 20 bp, human
gccctcactttccggggaac

SEQ ID NO: 245953 - DNA, 20 bp, human
gtcgggtcccactaccgcgc

SEQ ID NO: 245954 - DNA, 20 bp, human
gtcgcccccgacgtcaggca

SEQ ID NO: 245955 - DNA, 20 bp, human
gtcccactaccgcgcaggcc

SEQ ID NO: 245956 - DNA, 20 bp, human
ggctaccacgtgcacccaga

SEQ ID NO: 245957 - DNA, 20 bp, human
gatctatcctgcgaaaataa

SEQ ID NO: 245958 - DNA, 20 bp, human
gtattcggctgaaagttcag

SEQ ID NO: 245959 - DNA, 20 bp, human
ggcaggaggaggtagctcta

SEQ ID NO: 245960 - DNA, 20 bp, human
gcctgctgccagtgatacaa

SEQ ID NO: 245961 - DNA, 20 bp, human
gtgtcagagcttcgggaaga

SEQ ID NO: 245962 - DNA, 20 bp, human
gaagtggaggcacacagtga

SEQ ID NO: 245963 - DNA, 20 bp, human
gggggcaggtgtcagagctt

SEQ ID NO: 245964 - DNA, 20 bp, human
ggggtctgaaatattattcg

SEQ ID NO: 245965 - DNA, 20 bp, human
gctgccccaacaagcaatgt

SEQ ID NO: 245966 - DNA, 20 bp, human
gagcccggagagccgggcgt

SEQ ID NO: 245967 - DNA, 20 bp, human
ggcgcggcggccactggggt

SEQ ID NO: 245968 - DNA, 20 bp, human
gccggctcctaaatcagcgc

SEQ ID NO: 245969 - DNA, 20 bp, human
ggcgccggcgcggccaatcg

SEQ ID NO: 245970 - DNA, 20 bp, human
gcagggaaggaacgcgaagg

SEQ ID NO: 245971 - DNA, 20 bp, human
gttaggagccgggattgcgg

SEQ ID NO: 245972 - DNA, 20 bp, human
gcgcgcccggtcttatgtaa

SEQ ID NO: 245973 - DNA, 20 bp, human
gcccctgcgcgcaggaccga

SEQ ID NO: 245974 - DNA, 20 bp, human
gacgccagatcgctatcctg

SEQ ID NO: 245975 - DNA, 20 bp, human
gccaggccggagggaagcga

SEQ ID NO: 245976 - DNA, 20 bp, human
gcacagctctgagaaaacgg

SEQ ID NO: 245977 - DNA, 20 bp, human
gaacataattgcaaatggct

SEQ ID NO: 245978 - DNA, 20 bp, human
gcaccacagctctgagaaaa

SEQ ID NO: 245979 - DNA, 20 bp, human
gtggccttgaactgagcact

SEQ ID NO: 245980 - DNA, 20 bp, human
gtccctaataggcctgattc

SEQ ID NO: 245981 - DNA, 20 bp, human
gttgcaaacataattgcaaa

SEQ ID NO: 245982 - DNA, 20 bp, human
gaatgctgggctctagagtt

SEQ ID NO: 245983 - DNA, 20 bp, human
gtaaaacagagtttatgtat

SEQ ID NO: 245984 - DNA, 20 bp, human
gataccaagtgctcagttca

SEQ ID NO: 245985 - DNA, 20 bp, human
gtaaagaccttctccctaat

SEQ ID NO: 245986 - DNA, 20 bp, human
gccagctgccagcacctaga

SEQ ID NO: 245987 - DNA, 20 bp, human
ggctgcgcactggttcacgc

SEQ ID NO: 245988 - DNA, 20 bp, human
gcctagagggtgcccgggaa

SEQ ID NO: 245989 - DNA, 20 bp, human
ggggtctccaagtgaatgag

SEQ ID NO: 245990 - DNA, 20 bp, human
gggcgcccagatcccccggc

SEQ ID NO: 245991 - DNA, 20 bp, human
gcccctccccacccagccgg

SEQ ID NO: 245992 - DNA, 20 bp, human
ggtagattatatagaccgta

SEQ ID NO: 245993 - DNA, 20 bp, human
ggcggcgggcccagtgcttt

SEQ ID NO: 245994 - DNA, 20 bp, human
gccgggcaccctctaggtgc

SEQ ID NO: 245995 - DNA, 20 bp, human
gcccgcctgcaaggccgacg

SEQ ID NO: 245996 - DNA, 20 bp, human
gcgctcggggcccgcgggaa

SEQ ID NO: 245997 - DNA, 20 bp, human
gcggcgcaggcgcacaggag

SEQ ID NO: 245998 - DNA, 20 bp, human
gaggaggcggatcactgcgt

SEQ ID NO: 245999 - DNA, 20 bp, human
gaagcgccggctgggcccac

SEQ ID NO: 246000 - DNA, 20 bp, human
gaagggcggtggagcgcgag

SEQ ID NO: 246001 - DNA, 20 bp, human
ggcgccgcgctcacgaccgc

SEQ ID NO: 246002 - DNA, 20 bp, human
gcggtggcacgggcgagtgg

SEQ ID NO: 246003 - DNA, 20 bp, human
gaaggaccgcggatcggctg

SEQ ID NO: 246004 - DNA, 20 bp, human
gggctgttggacaaggaccg

SEQ ID NO: 246005 - DNA, 20 bp, human
gccaaacccaggttcaactt

SEQ ID NO: 246006 - DNA, 20 bp, human
gctacgaacggaaaggagag

SEQ ID NO: 246007 - DNA, 20 bp, human
gcctgagactacgaacggaa

SEQ ID NO: 246008 - DNA, 20 bp, human
gtctcagggagtagccgaga

SEQ ID NO: 246009 - DNA, 20 bp, human
gtccctgagaggtgcaagct

SEQ ID NO: 246010 - DNA, 20 bp, human
gcccccgcgcgcaacaggtc

SEQ ID NO: 246011 - DNA, 20 bp, human
gactccggaaactggggact

SEQ ID NO: 246012 - DNA, 20 bp, human
gccctgctgactccggaaac

SEQ ID NO: 246013 - DNA, 20 bp, human
ggccgcggctggtactggga

SEQ ID NO: 246014 - DNA, 20 bp, human
gcgcgcaacaggtcagggct

SEQ ID NO: 246015 - DNA, 20 bp, human
gacgcagcactaggaggaaa

SEQ ID NO: 246016 - DNA, 20 bp, human
gcccgagccagaccgggaag

SEQ ID NO: 246017 - DNA, 20 bp, human
gggcgggtcccgagccagac

SEQ ID NO: 246018 - DNA, 20 bp, human
gccccacgctcgcgggctga

SEQ ID NO: 246019 - DNA, 20 bp, human
ggccccggccccacgctcgc

SEQ ID NO: 246020 - DNA, 20 bp, human
gacgccggggccactttgtc

SEQ ID NO: 246021 - DNA, 20 bp, human
gcggccccggagccagcgag

SEQ ID NO: 246022 - DNA, 20 bp, human
gaaagtggccccggcgtacg

SEQ ID NO: 246023 - DNA, 20 bp, human
gggtccctccaggtggccgc

SEQ ID NO: 246024 - DNA, 20 bp, human
gctggctcgggacccgccgc

SEQ ID NO: 246025 - DNA, 20 bp, human
gagcccgcgagcgtggggcc

SEQ ID NO: 246026 - DNA, 20 bp, human
gccaaggtgggggactcgac

SEQ ID NO: 246027 - DNA, 20 bp, human
gaggaggggattaagcagac

SEQ ID NO: 246028 - DNA, 20 bp, human
ggtaatcccggccaaggtgg

SEQ ID NO: 246029 - DNA, 20 bp, human
gagggtaatcccggccaagg

SEQ ID NO: 246030 - DNA, 20 bp, human
gagtaggggcttatggtcac

SEQ ID NO: 246031 - DNA, 20 bp, human
gcataagcccctactcctca

SEQ ID NO: 246032 - DNA, 20 bp, human
gcatgacatcttggcaatta

SEQ ID NO: 246033 - DNA, 20 bp, human
gtggtcaccggcaggagctg

SEQ ID NO: 246034 - DNA, 20 bp, human
gaaggacttccctgaggagt

SEQ ID NO: 246035 - DNA, 20 bp, human
gccaggaggtgacattggct

SEQ ID NO: 246036 - DNA, 20 bp, human
gcccgcccccggctcctcat

SEQ ID NO: 246037 - DNA, 20 bp, human
gccaccagtcggcacaggaa

SEQ ID NO: 246038 - DNA, 20 bp, human
ggagttcagcgtgtggacga

SEQ ID NO: 246039 - DNA, 20 bp, human
gacaggccccttgtgaggga

SEQ ID NO: 246040 - DNA, 20 bp, human
gaggcagtgagttcagcgtg

SEQ ID NO: 246041 - DNA, 20 bp, human
ggaggtgccggtggtcacga

SEQ ID NO: 246042 - DNA, 20 bp, human
ggggagcgcgccctccaatg

SEQ ID NO: 246043 - DNA, 20 bp, human
ggaccacaggccccttgtga

SEQ ID NO: 246044 - DNA, 20 bp, human
gcagaaacgtgaggtgccgg

SEQ ID NO: 246045 - DNA, 20 bp, human
ggtggccgctcatggccctt

SEQ ID NO: 246046 - DNA, 20 bp, human
gggcccagaggcgccggaac

SEQ ID NO: 246047 - DNA, 20 bp, human
ggggcggacccacacatggt

SEQ ID NO: 246048 - DNA, 20 bp, human
ggggactaagggtggagttg

SEQ ID NO: 246049 - DNA, 20 bp, human
gccctgtgggcggggactaa

SEQ ID NO: 246050 - DNA, 20 bp, human
gcactcagccaatggcagag

SEQ ID NO: 246051 - DNA, 20 bp, human
gtggggctgtccgcaggctg

SEQ ID NO: 246052 - DNA, 20 bp, human
gcgcctctgggccaatcgcc

SEQ ID NO: 246053 - DNA, 20 bp, human
gcggacaagtgacgcaggct

SEQ ID NO: 246054 - DNA, 20 bp, human
gggcctgttccggcgcctct

SEQ ID NO: 246055 - DNA, 20 bp, human
gggtaggaacgtgagggggc

SEQ ID NO: 246056 - DNA, 20 bp, human
gactcagctgaggcccgcct

SEQ ID NO: 246057 - DNA, 20 bp, human
ggtcgccccaggcgagtatg

SEQ ID NO: 246058 - DNA, 20 bp, human
ggcgggcctcagctgagtcc

SEQ ID NO: 246059 - DNA, 20 bp, human
ggggcaggggctacgtgcca

SEQ ID NO: 246060 - DNA, 20 bp, human
gtgctcagtcagcagaaacg

SEQ ID NO: 246061 - DNA, 20 bp, human
gtaagtggtgagtgtaacgg

SEQ ID NO: 246062 - DNA, 20 bp, human
gaggcgtgagctcatgaaga

SEQ ID NO: 246063 - DNA, 20 bp, human
gtctgctggtggcatatata

SEQ ID NO: 246064 - DNA, 20 bp, human
gcgggagggcagacaaccca

SEQ ID NO: 246065 - DNA, 20 bp, human
gtactcgcctggggcgacaa

SEQ ID NO: 246066 - DNA, 20 bp, human
gggactcagcctgtggaatg

SEQ ID NO: 246067 - DNA, 20 bp, human
gctactggttatggtaggag

SEQ ID NO: 246068 - DNA, 20 bp, human
ggcagtaggcatcaacgcca

SEQ ID NO: 246069 - DNA, 20 bp, human
gctggctggtgatgcttggc

SEQ ID NO: 246070 - DNA, 20 bp, human
gaggaggggtcgttacgggt

SEQ ID NO: 246071 - DNA, 20 bp, human
gaagttggctggttatgggc

SEQ ID NO: 246072 - DNA, 20 bp, human
gcgggttggttggtccgtta

SEQ ID NO: 246073 - DNA, 20 bp, human
gtctctgagccacgggtgag

SEQ ID NO: 246074 - DNA, 20 bp, human
gatggtaggaggggtcgtta

SEQ ID NO: 246075 - DNA, 20 bp, human
gtccgttagggtcaatcgtc

SEQ ID NO: 246076 - DNA, 20 bp, human
gccaagcaggcacgcggggt

SEQ ID NO: 246077 - DNA, 20 bp, human
ggaggaggggcacactacgc

SEQ ID NO: 246078 - DNA, 20 bp, human
gctagctcaccagcagttca

SEQ ID NO: 246079 - DNA, 20 bp, human
ggacacaaacacgtctgagc

SEQ ID NO: 246080 - DNA, 20 bp, human
gtcttagctcagtgagtact

SEQ ID NO: 246081 - DNA, 20 bp, human
gaccatgacaagtcactggc

SEQ ID NO: 246082 - DNA, 20 bp, human
gcaagaccatgacaagtcac

SEQ ID NO: 246083 - DNA, 20 bp, human
gaatcccaagcaggcacgcg

SEQ ID NO: 246084 - DNA, 20 bp, human
gcacccctgttctctgaagc

SEQ ID NO: 246085 - DNA, 20 bp, human
ggctttctgtccacacccaa

SEQ ID NO: 246086 - DNA, 20 bp, human
ggctggcacaggggcgaaat

SEQ ID NO: 246087 - DNA, 20 bp, human
gaggccacactgtagctagg

SEQ ID NO: 246088 - DNA, 20 bp, human
ggagaaggcagctcggaaga

SEQ ID NO: 246089 - DNA, 20 bp, human
gaggaggagtagggaacggg

SEQ ID NO: 246090 - DNA, 20 bp, human
ggtcaggaggagtagggaac

SEQ ID NO: 246091 - DNA, 20 bp, human
gaggaggcaccaaacggcct

SEQ ID NO: 246092 - DNA, 20 bp, human
gtctcctcctagctacagtg

SEQ ID NO: 246093 - DNA, 20 bp, human
gcgaaatgggaaatctggag

SEQ ID NO: 246094 - DNA, 20 bp, human
gaggaggaggaggcaccaaa

SEQ ID NO: 246095 - DNA, 20 bp, human
ggtagccatggtagagtgtg

SEQ ID NO: 246096 - DNA, 20 bp, human
gcacaacagaggggcctctc

SEQ ID NO: 246097 - DNA, 20 bp, human
gcagccatgcccacaacaga

SEQ ID NO: 246098 - DNA, 20 bp, human
gggggcctttgtttaaacca

SEQ ID NO: 246099 - DNA, 20 bp, human
gggagagcagagtgctgaca

SEQ ID NO: 246100 - DNA, 20 bp, human
ggacaagagacaagtactca

SEQ ID NO: 246101 - DNA, 20 bp, human
gtggggatcatgaggaacaa

SEQ ID NO: 246102 - DNA, 20 bp, human
gcccagggtcttaaggtctt

SEQ ID NO: 246103 - DNA, 20 bp, human
gatatgacatggggtctccc

SEQ ID NO: 246104 - DNA, 20 bp, human
gaggtcttaggaagatccca

SEQ ID NO: 246105 - DNA, 20 bp, human
gaatctctcagagcagctag

SEQ ID NO: 246106 - DNA, 20 bp, human
gaagacaacagaaagtgctg

SEQ ID NO: 246107 - DNA, 20 bp, human
ggcacgcgagggaaatggac

SEQ ID NO: 246108 - DNA, 20 bp, human
gtcagcaggcaggctgcggt

SEQ ID NO: 246109 - DNA, 20 bp, human
gtcggctctggtctccgctg

SEQ ID NO: 246110 - DNA, 20 bp, human
gcgtccccgagggccgggac

SEQ ID NO: 246111 - DNA, 20 bp, human
gcccggccctcggggacgaa

SEQ ID NO: 246112 - DNA, 20 bp, human
gggcaggctgcggtcggctc

SEQ ID NO: 246113 - DNA, 20 bp, human
gcggtgaatgccctctgctg

SEQ ID NO: 246114 - DNA, 20 bp, human
gccgagggccgggacaggga

SEQ ID NO: 246115 - DNA, 20 bp, human
gtgtccgcaccctttccctc

SEQ ID NO: 246116 - DNA, 20 bp, human
ggctctggctttagcaggga

SEQ ID NO: 246117 - DNA, 20 bp, human
gccacctctctccttcttcg

SEQ ID NO: 246118 - DNA, 20 bp, human
gtcttcgtggctgatccctg

SEQ ID NO: 246119 - DNA, 20 bp, human
gcagccacgaagaaggagag

SEQ ID NO: 246120 - DNA, 20 bp, human
gtggcccagttgctgagtcg

SEQ ID NO: 246121 - DNA, 20 bp, human
gatccctgggggtggtgatc

SEQ ID NO: 246122 - DNA, 20 bp, human
gggagaatgagcactagatg

SEQ ID NO: 246123 - DNA, 20 bp, human
gagcagctctggctttagca

SEQ ID NO: 246124 - DNA, 20 bp, human
gtcggggctttgtctcccag

SEQ ID NO: 246125 - DNA, 20 bp, human
gtgccattggctcttcagcc

SEQ ID NO: 246126 - DNA, 20 bp, human
gctggggccctgacctcgcc

SEQ ID NO: 246127 - DNA, 20 bp, human
gaacaaccccagccagggat

SEQ ID NO: 246128 - DNA, 20 bp, human
gccagggatgggcccccaaa

SEQ ID NO: 246129 - DNA, 20 bp, human
gaaaggagtcagggtagggt

SEQ ID NO: 246130 - DNA, 20 bp, human
gcctgctggctgccaacatg

SEQ ID NO: 246131 - DNA, 20 bp, human
ggagtcagggtagggttgga

SEQ ID NO: 246132 - DNA, 20 bp, human
ggtgtgtgctggtctcacaa

SEQ ID NO: 246133 - DNA, 20 bp, human
ggttgttgagaaaggagtca

SEQ ID NO: 246134 - DNA, 20 bp, human
ggggactgaccgagataaca

SEQ ID NO: 246135 - DNA, 20 bp, human
gagccagcagggaccctttt

SEQ ID NO: 246136 - DNA, 20 bp, human
gccagggccaggggtacgct

SEQ ID NO: 246137 - DNA, 20 bp, human
gcctggccctggcagccgga

SEQ ID NO: 246138 - DNA, 20 bp, human
ggacagaggaacatctcagt

SEQ ID NO: 246139 - DNA, 20 bp, human
gcttggcaccggcacttctg

SEQ ID NO: 246140 - DNA, 20 bp, human
gaggggtacgctgggttcac

SEQ ID NO: 246141 - DNA, 20 bp, human
gtcagtcaggccgtgaggca

SEQ ID NO: 246142 - DNA, 20 bp, human
gccgcctgaccgccctggcg

SEQ ID NO: 246143 - DNA, 20 bp, human
ggcacagcggtcactcatct

SEQ ID NO: 246144 - DNA, 20 bp, human
gttcactggtacggtcagtc

SEQ ID NO: 246145 - DNA, 20 bp, human
gtacgctgggttcactggta

SEQ ID NO: 246146 - DNA, 20 bp, human
gaggaagtcatcagagacgg

SEQ ID NO: 246147 - DNA, 20 bp, human
gtccaatagcgggtccacgg

SEQ ID NO: 246148 - DNA, 20 bp, human
gaagtggcctggatggaatt

SEQ ID NO: 246149 - DNA, 20 bp, human
gagacggtggctgaggagac

SEQ ID NO: 246150 - DNA, 20 bp, human
ggcttcccacaaagccagtg

SEQ ID NO: 246151 - DNA, 20 bp, human
gggaaactggagagtgtctg

SEQ ID NO: 246152 - DNA, 20 bp, human
gcccaggaagtcatcagaga

SEQ ID NO: 246153 - DNA, 20 bp, human
gctgaggagacaggcactgg

SEQ ID NO: 246154 - DNA, 20 bp, human
gcactccaatagcgggtcca

SEQ ID NO: 246155 - DNA, 20 bp, human
gcagcaggctgggatgtgct

SEQ ID NO: 246156 - DNA, 20 bp, human
ggaagagcctacagaaataa

SEQ ID NO: 246157 - DNA, 20 bp, human
gaccacaagagtatgctgaa

SEQ ID NO: 246158 - DNA, 20 bp, human
gagatcgtggtgagaatatt

SEQ ID NO: 246159 - DNA, 20 bp, human
ggcacctgcccccttagaaa

SEQ ID NO: 246160 - DNA, 20 bp, human
gcacaaagtgttacccgcag

SEQ ID NO: 246161 - DNA, 20 bp, human
gtagaattgaccactaaaca

SEQ ID NO: 246162 - DNA, 20 bp, human
gtctcaatgtctaccactgc

SEQ ID NO: 246163 - DNA, 20 bp, human
gacaccctctgtgatagaaa

SEQ ID NO: 246164 - DNA, 20 bp, human
gttgaccactaaacaagggg

SEQ ID NO: 246165 - DNA, 20 bp, human
gttctcaccacgatcttctg

SEQ ID NO: 246166 - DNA, 20 bp, human
gggacctgggggtggtgcgt

SEQ ID NO: 246167 - DNA, 20 bp, human
gcatttctagtgagctgcat

SEQ ID NO: 246168 - DNA, 20 bp, human
gcctgggggtggtgcgtagg

SEQ ID NO: 246169 - DNA, 20 bp, human
gcctcactagctccagtgaa

SEQ ID NO: 246170 - DNA, 20 bp, human
ggcaaacattgcagaatgct

SEQ ID NO: 246171 - DNA, 20 bp, human
gaggttggtggttccatctg

SEQ ID NO: 246172 - DNA, 20 bp, human
gagaacacatgcgttccaga

SEQ ID NO: 246173 - DNA, 20 bp, human
gaaggacttgaagtgtgaag

SEQ ID NO: 246174 - DNA, 20 bp, human
gttatgaccttggagacaaa

SEQ ID NO: 246175 - DNA, 20 bp, human
gaacaacacaaaagggacct

SEQ ID NO: 246176 - DNA, 20 bp, human
ggtcactggggttggctgaa

SEQ ID NO: 246177 - DNA, 20 bp, human
gcacacaaaagggcccattt

SEQ ID NO: 246178 - DNA, 20 bp, human
gtttagttgagcaaaaggat

SEQ ID NO: 246179 - DNA, 20 bp, human
ggcccattttggtgagtaag

SEQ ID NO: 246180 - DNA, 20 bp, human
gggtttactctcattctttc

SEQ ID NO: 246181 - DNA, 20 bp, human
gccctgactgctgcctccac

SEQ ID NO: 246182 - DNA, 20 bp, human
gggttgctgtgtgggactgc

SEQ ID NO: 246183 - DNA, 20 bp, human
gaagtaatgaattctgctca

SEQ ID NO: 246184 - DNA, 20 bp, human
gatccccttactcaccaaaa

SEQ ID NO: 246185 - DNA, 20 bp, human
gtcattctttctggtaggtt

SEQ ID NO: 246186 - DNA, 20 bp, human
gaacacagagcagtatgtac

SEQ ID NO: 246187 - DNA, 20 bp, human
gacacaaaaggggccctcag

SEQ ID NO: 246188 - DNA, 20 bp, human
ggctctgtgttgcttttatt

SEQ ID NO: 246189 - DNA, 20 bp, human
gaggggccctcagcggtaag

SEQ ID NO: 246190 - DNA, 20 bp, human
gtagacgacgtgcccacgaa

SEQ ID NO: 246191 - DNA, 20 bp, human
gctaactagagatcagtccc

SEQ ID NO: 246192 - DNA, 20 bp, human
gagcaagggaaaggtttcta

SEQ ID NO: 246193 - DNA, 20 bp, human
gggaaatgagtcagtgcttg

SEQ ID NO: 246194 - DNA, 20 bp, human
gaaaatccccttaccgctga

SEQ ID NO: 246195 - DNA, 20 bp, human
gtcctggagcaattctataa

SEQ ID NO: 246196 - DNA, 20 bp, human
ggcgcggcgggctatatagc

SEQ ID NO: 246197 - DNA, 20 bp, human
ggtattcggattgctatcac

SEQ ID NO: 246198 - DNA, 20 bp, human
gtttgctgtgctagaccacg

SEQ ID NO: 246199 - DNA, 20 bp, human
ggcattctctctggagtatt

SEQ ID NO: 246200 - DNA, 20 bp, human
ggttttggtcgcattctctc

SEQ ID NO: 246201 - DNA, 20 bp, human
gaagagaacgtcatcatgaa

SEQ ID NO: 246202 - DNA, 20 bp, human
gtagaccacggggcttgttg

SEQ ID NO: 246203 - DNA, 20 bp, human
gcatgatgacgttctcttaa

SEQ ID NO: 246204 - DNA, 20 bp, human
gaaagcaacgactcttaata

SEQ ID NO: 246205 - DNA, 20 bp, human
gttgaatactgattgttaat

SEQ ID NO: 246206 - DNA, 20 bp, human
gccaggggaggggcggtcaa

SEQ ID NO: 246207 - DNA, 20 bp, human
gggaacaggccttgggaggg

SEQ ID NO: 246208 - DNA, 20 bp, human
ggggagctcggaacaggcct

SEQ ID NO: 246209 - DNA, 20 bp, human
gccaggtgagaaaggggagt

SEQ ID NO: 246210 - DNA, 20 bp, human
ggaggctcgggagctaaacg

SEQ ID NO: 246211 - DNA, 20 bp, human
gagttggagccggaggtcta

SEQ ID NO: 246212 - DNA, 20 bp, human
gagcgcaggggaagaaaggt

SEQ ID NO: 246213 - DNA, 20 bp, human
ggagccggaggtctaaggtg

SEQ ID NO: 246214 - DNA, 20 bp, human
gtggcacagggtggccgcgg

SEQ ID NO: 246215 - DNA, 20 bp, human
ggagctgggtgagttggagc

SEQ ID NO: 246216 - DNA, 20 bp, human
gcctgcttggtaagcattaa

SEQ ID NO: 246217 - DNA, 20 bp, human
gaactgggattataaaataa

SEQ ID NO: 246218 - DNA, 20 bp, human
gtttgcttagtcatgagaat

SEQ ID NO: 246219 - DNA, 20 bp, human
gcacttctgtccagaaatag

SEQ ID NO: 246220 - DNA, 20 bp, human
gcttcaacaaagcttgtgag

SEQ ID NO: 246221 - DNA, 20 bp, human
gcaatgcatgatcttgtgtt

SEQ ID NO: 246222 - DNA, 20 bp, human
gagaagactacctctatttc

SEQ ID NO: 246223 - DNA, 20 bp, human
ggtcatttagacgctattga

SEQ ID NO: 246224 - DNA, 20 bp, human
ggtcactataaagacactgc

SEQ ID NO: 246225 - DNA, 20 bp, human
gcaagctttgttgaagaaaa

SEQ ID NO: 246226 - DNA, 20 bp, human
gacggcgcgccgaccctcgt

SEQ ID NO: 246227 - DNA, 20 bp, human
gggccgcttggtccctgagt

SEQ ID NO: 246228 - DNA, 20 bp, human
gcgccgcgggcccgagacac

SEQ ID NO: 246229 - DNA, 20 bp, human
gccagcgcgggggcacgtcg

SEQ ID NO: 246230 - DNA, 20 bp, human
gctgcgcgcgcggaccggga

SEQ ID NO: 246231 - DNA, 20 bp, human
ggcggcgcgcaccccactca

SEQ ID NO: 246232 - DNA, 20 bp, human
gcgcgccgaccctcgtgggc

SEQ ID NO: 246233 - DNA, 20 bp, human
gtataggaggggacacgggc

SEQ ID NO: 246234 - DNA, 20 bp, human
gaggggcaggaccagcgcgg

SEQ ID NO: 246235 - DNA, 20 bp, human
gcacgtcggggggtggaaag

SEQ ID NO: 246236 - DNA, 20 bp, human
ggggtcgaggtgggcgaagg

SEQ ID NO: 246237 - DNA, 20 bp, human
gcacccttaggggtcgaggt

SEQ ID NO: 246238 - DNA, 20 bp, human
gcgcccacctcgacccctaa

SEQ ID NO: 246239 - DNA, 20 bp, human
gcgcccacccttaggggtcg

SEQ ID NO: 246240 - DNA, 20 bp, human
gcagcgggcgcgctcataaa

SEQ ID NO: 246241 - DNA, 20 bp, human
gcccaagatggacatcgcgg

SEQ ID NO: 246242 - DNA, 20 bp, human
gcccctaagggtgggcgaga

SEQ ID NO: 246243 - DNA, 20 bp, human
gttccccaagatggacatcg

SEQ ID NO: 246244 - DNA, 20 bp, human
gaggcggctccacagagcag

SEQ ID NO: 246245 - DNA, 20 bp, human
ggtcacagcccagcctccgg

SEQ ID NO: 246246 - DNA, 20 bp, human
gctgcccccagggagagacg

SEQ ID NO: 246247 - DNA, 20 bp, human
gagagacgaggctaccatga

SEQ ID NO: 246248 - DNA, 20 bp, human
gtctctccacccctaggcga

SEQ ID NO: 246249 - DNA, 20 bp, human
ggccaccgctcgcttcaata

SEQ ID NO: 246250 - DNA, 20 bp, human
gaccctgagtccgtcaccca

SEQ ID NO: 246251 - DNA, 20 bp, human
ggtagcctcgtctctccctg

SEQ ID NO: 246252 - DNA, 20 bp, human
gcggaagggcagtgttgacg

SEQ ID NO: 246253 - DNA, 20 bp, human
gactccgcgctgcgatccat

SEQ ID NO: 246254 - DNA, 20 bp, human
gcctcacccggtcaaggagt

SEQ ID NO: 246255 - DNA, 20 bp, human
gccggtcaaggagtaggatg

SEQ ID NO: 246256 - DNA, 20 bp, human
gcccccgagcggaacatgac

SEQ ID NO: 246257 - DNA, 20 bp, human
gccaaggactaccaataaat

SEQ ID NO: 246258 - DNA, 20 bp, human
gcgggcctatggttggaatg

SEQ ID NO: 246259 - DNA, 20 bp, human
gctcccgtcatgttccgctc

SEQ ID NO: 246260 - DNA, 20 bp, human
gcgctcgggggcggagaaag

SEQ ID NO: 246261 - DNA, 20 bp, human
ggccgctcgtcactcctgaa

SEQ ID NO: 246262 - DNA, 20 bp, human
gaggcccggccaaccccttt

SEQ ID NO: 246263 - DNA, 20 bp, human
gcactcctgaagggcggggt

SEQ ID NO: 246264 - DNA, 20 bp, human
ggggcgaagttggaatcgcc

SEQ ID NO: 246265 - DNA, 20 bp, human
gaagttggaatcgcccggat

SEQ ID NO: 246266 - DNA, 20 bp, human
ggacagcagttgtgacgggg

SEQ ID NO: 246267 - DNA, 20 bp, human
ggaagtgcgggtggctaaat

SEQ ID NO: 246268 - DNA, 20 bp, human
gccgggcccggccattggtc

SEQ ID NO: 246269 - DNA, 20 bp, human
gcctctcaagggactctccc

SEQ ID NO: 246270 - DNA, 20 bp, human
gcattggtccggtatggaag

SEQ ID NO: 246271 - DNA, 20 bp, human
gcttgacagcagttgtgacg

SEQ ID NO: 246272 - DNA, 20 bp, human
gcccggccattggtccggta

SEQ ID NO: 246273 - DNA, 20 bp, human
ggggctaattaagggtggat

SEQ ID NO: 246274 - DNA, 20 bp, human
gccggattagggctaattaa

SEQ ID NO: 246275 - DNA, 20 bp, human
gccgagcccgcccctctcaa

SEQ ID NO: 246276 - DNA, 20 bp, human
ggcagccgcggcggtggggt

SEQ ID NO: 246277 - DNA, 20 bp, human
gaggaggggcgcgtggcgaa

SEQ ID NO: 246278 - DNA, 20 bp, human
gggcgcgtggcgaagggagg

SEQ ID NO: 246279 - DNA, 20 bp, human
gaggggcgcgtggcgaaggg

SEQ ID NO: 246280 - DNA, 20 bp, human
ggaagggagggggatctccg

SEQ ID NO: 246281 - DNA, 20 bp, human
gcctgccaaccccaccgccg

SEQ ID NO: 246282 - DNA, 20 bp, human
gaagccgtggggtgccgcgc

SEQ ID NO: 246283 - DNA, 20 bp, human
gagggctctcggaggggacg

SEQ ID NO: 246284 - DNA, 20 bp, human
ggacgacgctgcggtctttg

SEQ ID NO: 246285 - DNA, 20 bp, human
ggctgcccccaccgggaccg

SEQ ID NO: 246286 - DNA, 20 bp, human
gacttccctgggttcacagc

SEQ ID NO: 246287 - DNA, 20 bp, human
ggatgggaatcggggtttgg

SEQ ID NO: 246288 - DNA, 20 bp, human
gccacccatcctggcagaat

SEQ ID NO: 246289 - DNA, 20 bp, human
ggcaaagctccgattctgcc

SEQ ID NO: 246290 - DNA, 20 bp, human
gatgtttgagcgatggtggt

SEQ ID NO: 246291 - DNA, 20 bp, human
gaccatcgctcaaacatcaa

SEQ ID NO: 246292 - DNA, 20 bp, human
gggggatgggaatcggggtt

SEQ ID NO: 246293 - DNA, 20 bp, human
gcccgttgatgtttgagcga

SEQ ID NO: 246294 - DNA, 20 bp, human
gtgaacccagggaagtcacg

SEQ ID NO: 246295 - DNA, 20 bp, human
gtgccaggatgggtggggat

SEQ ID NO: 246296 - DNA, 20 bp, human
ggggattggtagtgagggta

SEQ ID NO: 246297 - DNA, 20 bp, human
ggggtggggttggtgtttga

SEQ ID NO: 246298 - DNA, 20 bp, human
ggagatgggaatggggtttg

SEQ ID NO: 246299 - DNA, 20 bp, human
ggggttggtgtttgagggat

SEQ ID NO: 246300 - DNA, 20 bp, human
gggggatgggattggtagtg

SEQ ID NO: 246301 - DNA, 20 bp, human
gctgcaggggaagacttctc

SEQ ID NO: 246302 - DNA, 20 bp, human
gaggcagcgctggattattg

SEQ ID NO: 246303 - DNA, 20 bp, human
ggacgtcaggccgttgctca

SEQ ID NO: 246304 - DNA, 20 bp, human
gtattgggggccctctgtct

SEQ ID NO: 246305 - DNA, 20 bp, human
gagattctcgccctgagcaa

SEQ ID NO: 246306 - DNA, 20 bp, human
gtccaaatacagacaccctg

SEQ ID NO: 246307 - DNA, 20 bp, human
gtttggagatgaggcttcta

SEQ ID NO: 246308 - DNA, 20 bp, human
gaatgttaaaagaggccata

SEQ ID NO: 246309 - DNA, 20 bp, human
gaagtgattaatgttaaaag

SEQ ID NO: 246310 - DNA, 20 bp, human
ggatcaaggactggcggggt

SEQ ID NO: 246311 - DNA, 20 bp, human
gttatgtcttaagtcagctc

SEQ ID NO: 246312 - DNA, 20 bp, human
gagagagagaaaggtcatgt

SEQ ID NO: 246313 - DNA, 20 bp, human
ggttttagctactcactcaa

SEQ ID NO: 246314 - DNA, 20 bp, human
gagaatggacagattaataa

SEQ ID NO: 246315 - DNA, 20 bp, human
gtgacttaagacataacttc

SEQ ID NO: 246316 - DNA, 20 bp, human
ggggattggtagtgagggta

SEQ ID NO: 246317 - DNA, 20 bp, human
ggggtggggttggtgtttga

SEQ ID NO: 246318 - DNA, 20 bp, human
ggagatgggaatggggtttg

SEQ ID NO: 246319 - DNA, 20 bp, human
ggggttggtgtttgagggat

SEQ ID NO: 246320 - DNA, 20 bp, human
gggggatgggattggtagtg

SEQ ID NO: 246321 - DNA, 20 bp, human
gctgcaggggaagacttctc

SEQ ID NO: 246322 - DNA, 20 bp, human
gaggcagcgctggattattg

SEQ ID NO: 246323 - DNA, 20 bp, human
gagattctcgccctgagcaa

SEQ ID NO: 246324 - DNA, 20 bp, human
gtattgggggccctctgtct

SEQ ID NO: 246325 - DNA, 20 bp, human
ggacgtcaggccgttgctca

SEQ ID NO: 246326 - DNA, 20 bp, human
gtgactcaggaggtgatgtc

SEQ ID NO: 246327 - DNA, 20 bp, human
gccctgcttaaagggacacc

SEQ ID NO: 246328 - DNA, 20 bp, human
gctccctgacgtcagctgga

SEQ ID NO: 246329 - DNA, 20 bp, human
gacgccttccagctgacgtc

SEQ ID NO: 246330 - DNA, 20 bp, human
gtggcagtgcctgactcagg

SEQ ID NO: 246331 - DNA, 20 bp, human
gtgtctgtgtgtgctcgcgc

SEQ ID NO: 246332 - DNA, 20 bp, human
gggcagggcaaattataccg

SEQ ID NO: 246333 - DNA, 20 bp, human
gggtgggtgggcatgagtgg

SEQ ID NO: 246334 - DNA, 20 bp, human
gccaagaggagccccccaga

SEQ ID NO: 246335 - DNA, 20 bp, human
ggaccactgagcgtccggag

SEQ ID NO: 246336 - DNA, 20 bp, human
gcgggcgcgtgcacgagaag

SEQ ID NO: 246337 - DNA, 20 bp, human
ggccacccctagtgtccagg

SEQ ID NO: 246338 - DNA, 20 bp, human
gttacattacattccttctt

SEQ ID NO: 246339 - DNA, 20 bp, human
gtcaacacgcttgcgcagca

SEQ ID NO: 246340 - DNA, 20 bp, human
ggactcctcctggacactag

SEQ ID NO: 246341 - DNA, 20 bp, human
ggtgctgcgggaagcaatct

SEQ ID NO: 246342 - DNA, 20 bp, human
gtcctcctggacactagggg

SEQ ID NO: 246343 - DNA, 20 bp, human
gcacttaaccacaaccaaca

SEQ ID NO: 246344 - DNA, 20 bp, human
gttccttcttgggtgtgctg

SEQ ID NO: 246345 - DNA, 20 bp, human
gtcgcgagagttgcgggctc

SEQ ID NO: 246346 - DNA, 20 bp, human
gtggcccttcgaacttgggt

SEQ ID NO: 246347 - DNA, 20 bp, human
gtggccccacccaagttcga

SEQ ID NO: 246348 - DNA, 20 bp, human
gcacaagtgacaatgctctt

SEQ ID NO: 246349 - DNA, 20 bp, human
gaacagagcggggccccgat

SEQ ID NO: 246350 - DNA, 20 bp, human
gtcagcgcagaaacagagcg

SEQ ID NO: 246351 - DNA, 20 bp, human
gtggctctgaccatgccagc

SEQ ID NO: 246352 - DNA, 20 bp, human
gggcggggccaggaatgctc

SEQ ID NO: 246353 - DNA, 20 bp, human
gtcagggcttggcacgtagg

SEQ ID NO: 246354 - DNA, 20 bp, human
ggccagagcgcatgagcgag

SEQ ID NO: 246355 - DNA, 20 bp, human
gaccatgccagcaggcttca

SEQ ID NO: 246356 - DNA, 20 bp, human
ggtgcagcgcagaagacaga

SEQ ID NO: 246357 - DNA, 20 bp, human
gaggcagggtggggacgcgg

SEQ ID NO: 246358 - DNA, 20 bp, human
gcgggggaaggcggctgagt

SEQ ID NO: 246359 - DNA, 20 bp, human
ggcccgcgctcgtttgctga

SEQ ID NO: 246360 - DNA, 20 bp, human
gtggagagcgcggaaggaaa

SEQ ID NO: 246361 - DNA, 20 bp, human
gctggccggccggcgggtgg

SEQ ID NO: 246362 - DNA, 20 bp, human
ggaaagggtcggtccgcaga

SEQ ID NO: 246363 - DNA, 20 bp, human
ggaagacgcgcgagcggggc

SEQ ID NO: 246364 - DNA, 20 bp, human
gtcggtccgcagagggcgcg

SEQ ID NO: 246365 - DNA, 20 bp, human
gactaggaagacgcgcgagc

SEQ ID NO: 246366 - DNA, 20 bp, human
gagggaggggtcgcagtctg

SEQ ID NO: 246367 - DNA, 20 bp, human
ggccttgaacccaagaggga

SEQ ID NO: 246368 - DNA, 20 bp, human
ggtgctactgactaacggtc

SEQ ID NO: 246369 - DNA, 20 bp, human
gcagagtgatcaggtggctc

SEQ ID NO: 246370 - DNA, 20 bp, human
gggtcttcagagtgatcagg

SEQ ID NO: 246371 - DNA, 20 bp, human
ggagggtcttcagagtgatc

SEQ ID NO: 246372 - DNA, 20 bp, human
ggttgccttgcctagctaaa

SEQ ID NO: 246373 - DNA, 20 bp, human
ggaagaagaggatcagccca

SEQ ID NO: 246374 - DNA, 20 bp, human
gtagtcagtagcacaaatga

SEQ ID NO: 246375 - DNA, 20 bp, human
ggttgtaagccaggacatca

SEQ ID NO: 246376 - DNA, 20 bp, human
ggggctgtcggttcttggaa

SEQ ID NO: 246377 - DNA, 20 bp, human
gcacccacccgccttcctga

SEQ ID NO: 246378 - DNA, 20 bp, human
gtggagagccctcaggaagg

SEQ ID NO: 246379 - DNA, 20 bp, human
gtgggtgggctgtcggttct

SEQ ID NO: 246380 - DNA, 20 bp, human
ggctgccccctccctctgag

SEQ ID NO: 246381 - DNA, 20 bp, human
gcattcagactgcccaggga

SEQ ID NO: 246382 - DNA, 20 bp, human
gggctcaccgttcccatgtg

SEQ ID NO: 246383 - DNA, 20 bp, human
gcctaggtggtcaggcttgg

SEQ ID NO: 246384 - DNA, 20 bp, human
gtcctggcctggaatggctg

SEQ ID NO: 246385 - DNA, 20 bp, human
gggcagtctgaatgggcctg

SEQ ID NO: 246386 - DNA, 20 bp, human
gggagtgtatgatgacacag

SEQ ID NO: 246387 - DNA, 20 bp, human
gtgttccacgggccagtctt

SEQ ID NO: 246388 - DNA, 20 bp, human
gcacgtgtgtgcgggcgtgt

SEQ ID NO: 246389 - DNA, 20 bp, human
gtcacacttgagctgttcca

SEQ ID NO: 246390 - DNA, 20 bp, human
gccctgcttcctcatttcat

SEQ ID NO: 246391 - DNA, 20 bp, human
gtcaggagccaatgaactca

SEQ ID NO: 246392 - DNA, 20 bp, human
ggggccagtctttggagacg

SEQ ID NO: 246393 - DNA, 20 bp, human
ggaactcacggagcaattac

SEQ ID NO: 246394 - DNA, 20 bp, human
gttcccaatcctatgaaatg

SEQ ID NO: 246395 - DNA, 20 bp, human
gcttcctcatttcataggat

SEQ ID NO: 246396 - DNA, 20 bp, human
gaggaggcctaggagtttat

SEQ ID NO: 246397 - DNA, 20 bp, human
gtcaagcctcagctgacgca

SEQ ID NO: 246398 - DNA, 20 bp, human
gggcctaggagtttatagga

SEQ ID NO: 246399 - DNA, 20 bp, human
gccttccctgactgcttgat

SEQ ID NO: 246400 - DNA, 20 bp, human
gtaccttcctataaactcct

SEQ ID NO: 246401 - DNA, 20 bp, human
gtggctgcaataaccatagc

SEQ ID NO: 246402 - DNA, 20 bp, human
gccaccagctaccacttgta

SEQ ID NO: 246403 - DNA, 20 bp, human
gtagcaaagtaggcctgggc

SEQ ID NO: 246404 - DNA, 20 bp, human
gtaggaaggtaaattggagt

SEQ ID NO: 246405 - DNA, 20 bp, human
gatatgacacatggtggggt

SEQ ID NO: 246406 - DNA, 20 bp, human
ggggggcaaggcgacgtcaa

SEQ ID NO: 246407 - DNA, 20 bp, human
gcgggaggaagggagtttga

SEQ ID NO: 246408 - DNA, 20 bp, human
gggcaaggcgacgtcaaagg

SEQ ID NO: 246409 - DNA, 20 bp, human
gggtggggcagcgggaggaa

SEQ ID NO: 246410 - DNA, 20 bp, human
ggcttccaggcgtctatcag

SEQ ID NO: 246411 - DNA, 20 bp, human
ggaggaagggagtttgaggg

SEQ ID NO: 246412 - DNA, 20 bp, human
gtgccccacccaggcctgaa

SEQ ID NO: 246413 - DNA, 20 bp, human
gctacccccaaactctccgg

SEQ ID NO: 246414 - DNA, 20 bp, human
ggtgtccaagacaatgcagg

SEQ ID NO: 246415 - DNA, 20 bp, human
gcctgggaggaaattacctg

SEQ ID NO: 246416 - DNA, 20 bp, human
gctgccttgggggtcttaaa

SEQ ID NO: 246417 - DNA, 20 bp, human
gtcccaggaaggagcctgtg

SEQ ID NO: 246418 - DNA, 20 bp, human
gccctcccttgcgccttcga

SEQ ID NO: 246419 - DNA, 20 bp, human
gtaagacccccaaggcagga

SEQ ID NO: 246420 - DNA, 20 bp, human
gcagcccccgggcctgtcag

SEQ ID NO: 246421 - DNA, 20 bp, human
gtgtgccctcgaaggcgcaa

SEQ ID NO: 246422 - DNA, 20 bp, human
gttgagctcaggaaatccgg

SEQ ID NO: 246423 - DNA, 20 bp, human
gcagcctctgacaggcccgg

SEQ ID NO: 246424 - DNA, 20 bp, human
ggagggaagctggtgaggcc

SEQ ID NO: 246425 - DNA, 20 bp, human
gcagccctttaagaccccca

SEQ ID NO: 246426 - DNA, 20 bp, human
gccccgccgcagggtaggtc

SEQ ID NO: 246427 - DNA, 20 bp, human
gcgcagggtaggtccggcgg

SEQ ID NO: 246428 - DNA, 20 bp, human
gacgcactgcagagaggccg

SEQ ID NO: 246429 - DNA, 20 bp, human
ggggcgggcgggcgcaacag

SEQ ID NO: 246430 - DNA, 20 bp, human
gaagcctggcgccccgccgc

SEQ ID NO: 246431 - DNA, 20 bp, human
ggggccgcgctcggacacca

SEQ ID NO: 246432 - DNA, 20 bp, human
gggcagccgcggagcctcca

SEQ ID NO: 246433 - DNA, 20 bp, human
gcgcgctcggacaccagggg

SEQ ID NO: 246434 - DNA, 20 bp, human
gcgccgcagggtaggtccgg

SEQ ID NO: 246435 - DNA, 20 bp, human
gtgggtgacgcggaggtacg

SEQ ID NO: 246436 - DNA, 20 bp, human
ggctccccagggagaacggt

SEQ ID NO: 246437 - DNA, 20 bp, human
gcgcacacgctggaaaacgg

SEQ ID NO: 246438 - DNA, 20 bp, human
gtgcgctcttaccttctctg

SEQ ID NO: 246439 - DNA, 20 bp, human
gggcgcggctggggcgctgt

SEQ ID NO: 246440 - DNA, 20 bp, human
gaaggtaagagcgcacacgc

SEQ ID NO: 246441 - DNA, 20 bp, human
gctggaaaacggtgggagca

SEQ ID NO: 246442 - DNA, 20 bp, human
gttccaggttggggtcagga

SEQ ID NO: 246443 - DNA, 20 bp, human
gaccctgcggtgcttcggga

SEQ ID NO: 246444 - DNA, 20 bp, human
gagggagcgggtcacccggt

SEQ ID NO: 246445 - DNA, 20 bp, human
gcctgcaaggcgcaatctcc

SEQ ID NO: 246446 - DNA, 20 bp, human
gccgaggcaggaaaccgctc

SEQ ID NO: 246447 - DNA, 20 bp, human
gcggcccgaagccctcgact

SEQ ID NO: 246448 - DNA, 20 bp, human
ggggcgcctccaggccggag

SEQ ID NO: 246449 - DNA, 20 bp, human
ggcgccggaagtggcctctc

SEQ ID NO: 246450 - DNA, 20 bp, human
gagtccacgagtccgggcag

SEQ ID NO: 246451 - DNA, 20 bp, human
ggccagtggcggagcttcct

SEQ ID NO: 246452 - DNA, 20 bp, human
gtgcgtggcagccgagtcga

SEQ ID NO: 246453 - DNA, 20 bp, human
ggcgcccctgcccggactcg

SEQ ID NO: 246454 - DNA, 20 bp, human
gccgctcggactcccaggat

SEQ ID NO: 246455 - DNA, 20 bp, human
gcgctgcagtccacgagtcc

SEQ ID NO: 246456 - DNA, 20 bp, human
gactgacgggcttgtgctag

SEQ ID NO: 246457 - DNA, 20 bp, human
gaacatggcctgcagccaga

SEQ ID NO: 246458 - DNA, 20 bp, human
ggacagccttccccgcgttc

SEQ ID NO: 246459 - DNA, 20 bp, human
gatgttggtcaacctgaacg

SEQ ID NO: 246460 - DNA, 20 bp, human
ggtgggtgccctctggctgc

SEQ ID NO: 246461 - DNA, 20 bp, human
ggaaacaggtggggtcaagc

SEQ ID NO: 246462 - DNA, 20 bp, human
gacactggtgatggtgagaa

SEQ ID NO: 246463 - DNA, 20 bp, human
gagggagagagaactggcca

SEQ ID NO: 246464 - DNA, 20 bp, human
ggtcaacctgaacgcgggga

SEQ ID NO: 246465 - DNA, 20 bp, human
gcaggagtcatcagcaaaag

SEQ ID NO: 246466 - DNA, 20 bp, human
ggaaaccggagggcaatgga

SEQ ID NO: 246467 - DNA, 20 bp, human
ggaaacaggtggggtcaagc

SEQ ID NO: 246468 - DNA, 20 bp, human
ggcgctggcctcttcctctc

SEQ ID NO: 246469 - DNA, 20 bp, human
gagggagagagaactggcca

SEQ ID NO: 246470 - DNA, 20 bp, human
gggctccctccattgccctc

SEQ ID NO: 246471 - DNA, 20 bp, human
gcccacaagagaccggctct

SEQ ID NO: 246472 - DNA, 20 bp, human
gtgcccccgtcccatctaca

SEQ ID NO: 246473 - DNA, 20 bp, human
ggggagaaaccggagggcaa

SEQ ID NO: 246474 - DNA, 20 bp, human
gcagagattggccaaatatc

SEQ ID NO: 246475 - DNA, 20 bp, human
gacaaacagctcctggagca

SEQ ID NO: 246476 - DNA, 20 bp, human
gaaaggggagagcaatgtgt

SEQ ID NO: 246477 - DNA, 20 bp, human
gccccaaggttcagggaaag

SEQ ID NO: 246478 - DNA, 20 bp, human
gctcccctttccctgaacct

SEQ ID NO: 246479 - DNA, 20 bp, human
gaacatggcctgcagccaga

SEQ ID NO: 246480 - DNA, 20 bp, human
ggacagccttccccgcgttc

SEQ ID NO: 246481 - DNA, 20 bp, human
gatgttggtcaacctgaacg

SEQ ID NO: 246482 - DNA, 20 bp, human
gactgacgggcttgtgctag

SEQ ID NO: 246483 - DNA, 20 bp, human
ggtgggtgccctctggctgc

SEQ ID NO: 246484 - DNA, 20 bp, human
ggtcaacctgaacgcgggga

SEQ ID NO: 246485 - DNA, 20 bp, human
gacactggtgatggtgagaa

SEQ ID NO: 246486 - DNA, 20 bp, human
ggagtgggatgtggtcgata

SEQ ID NO: 246487 - DNA, 20 bp, human
gtgtgcacagaaacaggtgg

SEQ ID NO: 246488 - DNA, 20 bp, human
gatgctggcatcatgtcccc

SEQ ID NO: 246489 - DNA, 20 bp, human
ggtggtcgataggggtctca

SEQ ID NO: 246490 - DNA, 20 bp, human
ggacatgatgccagcatgtg

SEQ ID NO: 246491 - DNA, 20 bp, human
gctctctttaaggttcaggt

SEQ ID NO: 246492 - DNA, 20 bp, human
gtgtcctctctttaaggttc

SEQ ID NO: 246493 - DNA, 20 bp, human
ggacatccttctccgcattc

SEQ ID NO: 246494 - DNA, 20 bp, human
gcacttctgctgacgactcc

SEQ ID NO: 246495 - DNA, 20 bp, human
gggcaacagcgagagagaag

SEQ ID NO: 246496 - DNA, 20 bp, human
gacaagttgggtggtatctc

SEQ ID NO: 246497 - DNA, 20 bp, human
gaacaggtggggtcaacagt

SEQ ID NO: 246498 - DNA, 20 bp, human
gtggtcggtagggggtctca

SEQ ID NO: 246499 - DNA, 20 bp, human
gaagggataggatagagaat

SEQ ID NO: 246500 - DNA, 20 bp, human
ggccaacctgcacgcggcga

SEQ ID NO: 246501 - DNA, 20 bp, human
gggtagggggtctcaaggac

SEQ ID NO: 246502 - DNA, 20 bp, human
gggtcaacagtgggagagaa

SEQ ID NO: 246503 - DNA, 20 bp, human
gtgggtcagcctgagtcagc

SEQ ID NO: 246504 - DNA, 20 bp, human
gatgggatgtggtcggtagg

SEQ ID NO: 246505 - DNA, 20 bp, human
gtccttcgccgcgtgcaggt

SEQ ID NO: 246506 - DNA, 20 bp, human
gggaaagctgcgtccagaga

SEQ ID NO: 246507 - DNA, 20 bp, human
ggcaagtgggggcagggcgt

SEQ ID NO: 246508 - DNA, 20 bp, human
ggcagcgcgcctgcgcgagg

SEQ ID NO: 246509 - DNA, 20 bp, human
gtgccgcctggctgcgttga

SEQ ID NO: 246510 - DNA, 20 bp, human
gacgcagccaggcggcaagt

SEQ ID NO: 246511 - DNA, 20 bp, human
gccgctgggaggaagctcgc

SEQ ID NO: 246512 - DNA, 20 bp, human
gcgggcaggccccctcgcgc

SEQ ID NO: 246513 - DNA, 20 bp, human
gcctgcccccacttgccgcc

SEQ ID NO: 246514 - DNA, 20 bp, human
ggctgcgttgaaggctccga

SEQ ID NO: 246515 - DNA, 20 bp, human
gaggctgggaggttgctccc

SEQ ID NO: 246516 - DNA, 20 bp, human
gtggagaaaggagacttgtt

SEQ ID NO: 246517 - DNA, 20 bp, human
gaactggagggtttctgcag

SEQ ID NO: 246518 - DNA, 20 bp, human
gggcggagagcgcagaagaa

SEQ ID NO: 246519 - DNA, 20 bp, human
gcctgcgcgctgctgcgctg

SEQ ID NO: 246520 - DNA, 20 bp, human
gctcacgccgcacaccgggg

SEQ ID NO: 246521 - DNA, 20 bp, human
gacccacagagaggggaccg

SEQ ID NO: 246522 - DNA, 20 bp, human
gggctgggctctgtctgtct

SEQ ID NO: 246523 - DNA, 20 bp, human
gggaagctcacgccgcacac

SEQ ID NO: 246524 - DNA, 20 bp, human
ggctctctggtcagcaagga

SEQ ID NO: 246525 - DNA, 20 bp, human
gaagggctgctagtggcaca

SEQ ID NO: 246526 - DNA, 20 bp, human
gggagggggtgaattatccc

SEQ ID NO: 246527 - DNA, 20 bp, human
gatccccggattaatcactc

SEQ ID NO: 246528 - DNA, 20 bp, human
gctccggagtgattaatccg

SEQ ID NO: 246529 - DNA, 20 bp, human
gtccgccgctccaaatgctg

SEQ ID NO: 246530 - DNA, 20 bp, human
gagcgcagcgcgcctctccc

SEQ ID NO: 246531 - DNA, 20 bp, human
gggcgcgaaccccgcgaagc

SEQ ID NO: 246532 - DNA, 20 bp, human
ggggggtggaggcgcagcta

SEQ ID NO: 246533 - DNA, 20 bp, human
gagcggcggagaagcggctc

SEQ ID NO: 246534 - DNA, 20 bp, human
gccccggccgggcggacact

SEQ ID NO: 246535 - DNA, 20 bp, human
ggctaaggataaaatattgg

SEQ ID NO: 246536 - DNA, 20 bp, human
gagcagaggtgggctttaag

SEQ ID NO: 246537 - DNA, 20 bp, human
gttagtgagctctccgttgc

SEQ ID NO: 246538 - DNA, 20 bp, human
gctataacgagccagaattg

SEQ ID NO: 246539 - DNA, 20 bp, human
gtgtgcccccgttggagaga

SEQ ID NO: 246540 - DNA, 20 bp, human
gccaaaatctaccccaattc

SEQ ID NO: 246541 - DNA, 20 bp, human
gtcaaccatctctccaacgg

SEQ ID NO: 246542 - DNA, 20 bp, human
ggctcactagtggtttctgg

SEQ ID NO: 246543 - DNA, 20 bp, human
gtgtcccattataacgacgt

SEQ ID NO: 246544 - DNA, 20 bp, human
ggctttaagaggctcactag

SEQ ID NO: 246545 - DNA, 20 bp, human
ggatgcccacgtcgttataa

SEQ ID NO: 246546 - DNA, 20 bp, human
gaaatcctggggacaaaata

SEQ ID NO: 246547 - DNA, 20 bp, human
gtccccaggatttccattat

SEQ ID NO: 246548 - DNA, 20 bp, human
gattctgagaattttcaaca

SEQ ID NO: 246549 - DNA, 20 bp, human
ggaaaattctcagaatttcc

SEQ ID NO: 246550 - DNA, 20 bp, human
gtggtttcagttcaaccaat

SEQ ID NO: 246551 - DNA, 20 bp, human
gtcctataatggaaatcctg

SEQ ID NO: 246552 - DNA, 20 bp, human
ggttgaagggataatttgac

SEQ ID NO: 246553 - DNA, 20 bp, human
gaaatgatgaattcttttaa

SEQ ID NO: 246554 - DNA, 20 bp, human
gaacatgattttatgttgaa

SEQ ID NO: 246555 - DNA, 20 bp, human
gtagtcacaataaataatag

SEQ ID NO: 246556 - DNA, 20 bp, human
gaggaggtcaaaatccattc

SEQ ID NO: 246557 - DNA, 20 bp, human
gtgagaatcgcaagccagaa

SEQ ID NO: 246558 - DNA, 20 bp, human
gtagaagttatatcacatga

SEQ ID NO: 246559 - DNA, 20 bp, human
gtggatatactttcttatgt

SEQ ID NO: 246560 - DNA, 20 bp, human
gaagttatatcacatgaagg

SEQ ID NO: 246561 - DNA, 20 bp, human
ggctgaaaaatctgaatagc

SEQ ID NO: 246562 - DNA, 20 bp, human
gaaaaattcaatactgtaaa

SEQ ID NO: 246563 - DNA, 20 bp, human
gtgggacttttttaaaagtg

SEQ ID NO: 246564 - DNA, 20 bp, human
gcagtattgaatttttcaaa

SEQ ID NO: 246565 - DNA, 20 bp, human
gatactttcttatgtaggta

SEQ ID NO: 246566 - DNA, 20 bp, human
gtcacctttgggtcagtctg

SEQ ID NO: 246567 - DNA, 20 bp, human
gccaccacagactgacccaa

SEQ ID NO: 246568 - DNA, 20 bp, human
gatgatagcagggtcacctt

SEQ ID NO: 246569 - DNA, 20 bp, human
gctgctatcatcatcttatt

SEQ ID NO: 246570 - DNA, 20 bp, human
gaatagaatagcgtgactca

SEQ ID NO: 246571 - DNA, 20 bp, human
gggtactaataccctttaat

SEQ ID NO: 246572 - DNA, 20 bp, human
gtattgggtaaaaagtagga

SEQ ID NO: 246573 - DNA, 20 bp, human
gatcttattgggtaaaaagt

SEQ ID NO: 246574 - DNA, 20 bp, human
gtaaaaaagaaatgcagaga

SEQ ID NO: 246575 - DNA, 20 bp, human
gttaaaatgtgaaagtattg

SEQ ID NO: 246576 - DNA, 20 bp, human
ggacccgccgggtctctgga

SEQ ID NO: 246577 - DNA, 20 bp, human
gagccgccgccgaccggaag

SEQ ID NO: 246578 - DNA, 20 bp, human
gcgggtccgaggcgagtaac

SEQ ID NO: 246579 - DNA, 20 bp, human
ggccccccggccttgatatt

SEQ ID NO: 246580 - DNA, 20 bp, human
gggcagcgagagggcggaac

SEQ ID NO: 246581 - DNA, 20 bp, human
ggctctcttccacttccggt

SEQ ID NO: 246582 - DNA, 20 bp, human
gcgaaggatcggcagcgaga

SEQ ID NO: 246583 - DNA, 20 bp, human
ggcgcagctgggcggtgaca

SEQ ID NO: 246584 - DNA, 20 bp, human
gcaactcctgctgactgcgc

SEQ ID NO: 246585 - DNA, 20 bp, human
gcagagacccggcgggtccg

SEQ ID NO: 246586 - DNA, 20 bp, human
gtcccccacatgcactggta

SEQ ID NO: 246587 - DNA, 20 bp, human
gtcctcccctagaggggtca

SEQ ID NO: 246588 - DNA, 20 bp, human
gagggaaatacaaactggtg

SEQ ID NO: 246589 - DNA, 20 bp, human
gtgggcatcaccaccaccaa

SEQ ID NO: 246590 - DNA, 20 bp, human
ggctgtcgtggcgatgtcgt

SEQ ID NO: 246591 - DNA, 20 bp, human
gcccgactcgcattaaccca

SEQ ID NO: 246592 - DNA, 20 bp, human
gtcagccctgacccctctag

SEQ ID NO: 246593 - DNA, 20 bp, human
gttaacccagggagacatga

SEQ ID NO: 246594 - DNA, 20 bp, human
gaggctgagtctcaggtaag

SEQ ID NO: 246595 - DNA, 20 bp, human
gctaaggttgcaagagattg

SEQ ID NO: 246596 - DNA, 20 bp, human
gagggcaagcgggaccggta

SEQ ID NO: 246597 - DNA, 20 bp, human
gaggtcccggggtaacagga

SEQ ID NO: 246598 - DNA, 20 bp, human
gccgccccgccgggttgcta

SEQ ID NO: 246599 - DNA, 20 bp, human
gccagcgcctcaatacgggg

SEQ ID NO: 246600 - DNA, 20 bp, human
ggctcccagcgcctcaatac

SEQ ID NO: 246601 - DNA, 20 bp, human
gcggggccgcggcgctccag

SEQ ID NO: 246602 - DNA, 20 bp, human
gctgaaaggggatttaggcc

SEQ ID NO: 246603 - DNA, 20 bp, human
gtgacgtcacagcgcgatgg

SEQ ID NO: 246604 - DNA, 20 bp, human
ggtgaaagcggggccgtgag

SEQ ID NO: 246605 - DNA, 20 bp, human
gcgtcacagcgcgatggcgg

SEQ ID NO: 246606 - DNA, 20 bp, human
gagcccgcgcgcctgcactg

SEQ ID NO: 246607 - DNA, 20 bp, human
ggggccggggatgacatcag

SEQ ID NO: 246608 - DNA, 20 bp, human
gcgcgcgcctgcactgaggc

SEQ ID NO: 246609 - DNA, 20 bp, human
ggaactgcgtctcgcagctg

SEQ ID NO: 246610 - DNA, 20 bp, human
gggcgcgcgggcttacgcgt

SEQ ID NO: 246611 - DNA, 20 bp, human
gccgccccggaggatttaaa

SEQ ID NO: 246612 - DNA, 20 bp, human
gcgggcttacgcgtgggggt

SEQ ID NO: 246613 - DNA, 20 bp, human
gcgcccgctgatgtcatccc

SEQ ID NO: 246614 - DNA, 20 bp, human
gcacaaaaagcggaggtgag

SEQ ID NO: 246615 - DNA, 20 bp, human
gcccggggctcaatgggagc

SEQ ID NO: 246616 - DNA, 20 bp, human
gccctccttagcaaccgcgt

SEQ ID NO: 246617 - DNA, 20 bp, human
ggagtcgcagagtaccctgg

SEQ ID NO: 246618 - DNA, 20 bp, human
gggcagccgtggggataacc

SEQ ID NO: 246619 - DNA, 20 bp, human
gtgtcctattaggcccgcca

SEQ ID NO: 246620 - DNA, 20 bp, human
gaccgcgtggggttgctaag

SEQ ID NO: 246621 - DNA, 20 bp, human
ggtaccctggcgggcctaat

SEQ ID NO: 246622 - DNA, 20 bp, human
gcaaccccacgcggttgcta

SEQ ID NO: 246623 - DNA, 20 bp, human
gaaactgacaccatcacttc

SEQ ID NO: 246624 - DNA, 20 bp, human
gcgcgctagtggttccggtt

SEQ ID NO: 246625 - DNA, 20 bp, human
gtgcgactccgggacgaggg

SEQ ID NO: 246626 - DNA, 20 bp, human
ggcccgcccctagaagggtg

SEQ ID NO: 246627 - DNA, 20 bp, human
gggaaggcccgcccctagaa

SEQ ID NO: 246628 - DNA, 20 bp, human
gcggcccggcggcctcgtag

SEQ ID NO: 246629 - DNA, 20 bp, human
gccccgcgctgtgacgtcgg

SEQ ID NO: 246630 - DNA, 20 bp, human
gccgccccgcgctgtgacgt

SEQ ID NO: 246631 - DNA, 20 bp, human
gcgaaagcgcgtggccgcga

SEQ ID NO: 246632 - DNA, 20 bp, human
ggcggggccaacacccggct

SEQ ID NO: 246633 - DNA, 20 bp, human
ggaaacgcccagccgggtgt

SEQ ID NO: 246634 - DNA, 20 bp, human
ggcggggcggggccaacacc

SEQ ID NO: 246635 - DNA, 20 bp, human
ggccccccgctggcagacgc

SEQ ID NO: 246636 - DNA, 20 bp, human
gaaggagacggcgcggtcat

SEQ ID NO: 246637 - DNA, 20 bp, human
gagacggcgcggtcattggc

SEQ ID NO: 246638 - DNA, 20 bp, human
ggccgtgcgtgagggaaagt

SEQ ID NO: 246639 - DNA, 20 bp, human
ggaaagcgtctgtttagcgg

SEQ ID NO: 246640 - DNA, 20 bp, human
gtcgccgaccggaaaggaga

SEQ ID NO: 246641 - DNA, 20 bp, human
gccgaccaatccaagaaggt

SEQ ID NO: 246642 - DNA, 20 bp, human
gggacccggaagtgaacaca

SEQ ID NO: 246643 - DNA, 20 bp, human
ggaccgcgccgtctcctttc

SEQ ID NO: 246644 - DNA, 20 bp, human
gcgatccgaccaatccaaga

SEQ ID NO: 246645 - DNA, 20 bp, human
gctctagaaagacggggata

SEQ ID NO: 246646 - DNA, 20 bp, human
gacaataggacatcccagca

SEQ ID NO: 246647 - DNA, 20 bp, human
ggatgtcctattgtaacctt

SEQ ID NO: 246648 - DNA, 20 bp, human
ggaaaccccctcctaccagg

SEQ ID NO: 246649 - DNA, 20 bp, human
gggccagctgggtgaagtgt

SEQ ID NO: 246650 - DNA, 20 bp, human
ggccccgcctcctggtagga

SEQ ID NO: 246651 - DNA, 20 bp, human
gcccaacgcaaagcagaata

SEQ ID NO: 246652 - DNA, 20 bp, human
gtctctgaatgcggccatgc

SEQ ID NO: 246653 - DNA, 20 bp, human
gcaactgttcacctaatggg

SEQ ID NO: 246654 - DNA, 20 bp, human
gccccctcctaccaggaggc

SEQ ID NO: 246655 - DNA, 20 bp, human
gttgacccaagttaagatgg

SEQ ID NO: 246656 - DNA, 20 bp, human
ggtcgcgggcgagggctcta

SEQ ID NO: 246657 - DNA, 20 bp, human
ggctggggatagggtctcca

SEQ ID NO: 246658 - DNA, 20 bp, human
gagggcgcgaggtaggcggc

SEQ ID NO: 246659 - DNA, 20 bp, human
gtggacagtccgacctgtgg

SEQ ID NO: 246660 - DNA, 20 bp, human
gccctcccgccgccacaggt

SEQ ID NO: 246661 - DNA, 20 bp, human
ggggtccccccgcgctccag

SEQ ID NO: 246662 - DNA, 20 bp, human
gcaacggccagtggaagggg

SEQ ID NO: 246663 - DNA, 20 bp, human
gaaggaggggtatgtctcgg

SEQ ID NO: 246664 - DNA, 20 bp, human
ggtctccaaggacagtgaaa

SEQ ID NO: 246665 - DNA, 20 bp, human
gtgacaggagggtcagaata

SEQ ID NO: 246666 - DNA, 20 bp, human
ggggacttaacccccaaaaa

SEQ ID NO: 246667 - DNA, 20 bp, human
ggtgcctcacagcaattgaa

SEQ ID NO: 246668 - DNA, 20 bp, human
ggtgaggcaccgtctccttg

SEQ ID NO: 246669 - DNA, 20 bp, human
ggtccctttcaattgctgtg

SEQ ID NO: 246670 - DNA, 20 bp, human
gtagcacaagcatgtccaca

SEQ ID NO: 246671 - DNA, 20 bp, human
gtgactctcagattagagat

SEQ ID NO: 246672 - DNA, 20 bp, human
gaatactttaagtgagtaag

SEQ ID NO: 246673 - DNA, 20 bp, human
gatattcagagccctttttg

SEQ ID NO: 246674 - DNA, 20 bp, human
gagatgggaaggtttttatt

SEQ ID NO: 246675 - DNA, 20 bp, human
ggggccagtgttatcctttt

SEQ ID NO: 246676 - DNA, 20 bp, human
ggtcgtgcgcgggtcatcct

SEQ ID NO: 246677 - DNA, 20 bp, human
ggggtgaagaggctgactta

SEQ ID NO: 246678 - DNA, 20 bp, human
gcacgacctggctgtcacga

SEQ ID NO: 246679 - DNA, 20 bp, human
gtgccgggacacggagtccc

SEQ ID NO: 246680 - DNA, 20 bp, human
gccccggtagagaaagaaac

SEQ ID NO: 246681 - DNA, 20 bp, human
gaaagcgaactaccaatccc

SEQ ID NO: 246682 - DNA, 20 bp, human
gtgtcacgaaggcccggagg

SEQ ID NO: 246683 - DNA, 20 bp, human
ggtgacagccaggtcgtgcg

SEQ ID NO: 246684 - DNA, 20 bp, human
gaagaggctgacttagggcg

SEQ ID NO: 246685 - DNA, 20 bp, human
gaacgagaagccaccggaag

SEQ ID NO: 246686 - DNA, 20 bp, human
ggcggggctgttcctctctg

SEQ ID NO: 246687 - DNA, 20 bp, human
ggggccctttaagaaggttg

SEQ ID NO: 246688 - DNA, 20 bp, human
gcaccctcaaccttcttaaa

SEQ ID NO: 246689 - DNA, 20 bp, human
gtgtccgcgcacttaactcc

SEQ ID NO: 246690 - DNA, 20 bp, human
gagcccgggagaccccctca

SEQ ID NO: 246691 - DNA, 20 bp, human
gtctcccgggctcggctctt

SEQ ID NO: 246692 - DNA, 20 bp, human
ggcgcgcccgctcgggtttc

SEQ ID NO: 246693 - DNA, 20 bp, human
ggagaggaacagccccgcac

SEQ ID NO: 246694 - DNA, 20 bp, human
gctggagtgtgcctgtggag

SEQ ID NO: 246695 - DNA, 20 bp, human
gcccgctcgggtttcaggct

SEQ ID NO: 246696 - DNA, 20 bp, human
gccggccccgccgcacgtag

SEQ ID NO: 246697 - DNA, 20 bp, human
gcccctggcaggctgaccaa

SEQ ID NO: 246698 - DNA, 20 bp, human
gactaggagacacacggacg

SEQ ID NO: 246699 - DNA, 20 bp, human
gcacacggacggggagtgcg

SEQ ID NO: 246700 - DNA, 20 bp, human
gtctcctagtccccagcgag

SEQ ID NO: 246701 - DNA, 20 bp, human
ggccccttggtcagcctgcc

SEQ ID NO: 246702 - DNA, 20 bp, human
gtgcacgggcgggagacctg

SEQ ID NO: 246703 - DNA, 20 bp, human
gacagacagacccctcgctg

SEQ ID NO: 246704 - DNA, 20 bp, human
gcaggcggacggggagcgcg

SEQ ID NO: 246705 - DNA, 20 bp, human
ggggtccagaagagccgcag

SEQ ID NO: 246706 - DNA, 20 bp, human
ggtacccggcggttggcgaa

SEQ ID NO: 246707 - DNA, 20 bp, human
gagagcagcgggcagctatg

SEQ ID NO: 246708 - DNA, 20 bp, human
gaagtccccggccagcgtac

SEQ ID NO: 246709 - DNA, 20 bp, human
gggggcggggccgtacccgg

SEQ ID NO: 246710 - DNA, 20 bp, human
gctggcgaaccgagagcagc

SEQ ID NO: 246711 - DNA, 20 bp, human
gaacgagttgaccaagtccc

SEQ ID NO: 246712 - DNA, 20 bp, human
ggggcagctatgcggcctcc

SEQ ID NO: 246713 - DNA, 20 bp, human
ggcgcggccgcctgcagtgg

SEQ ID NO: 246714 - DNA, 20 bp, human
gcccaggggctattaaactg

SEQ ID NO: 246715 - DNA, 20 bp, human
gggggaggggtggtagtgag

SEQ ID NO: 246716 - DNA, 20 bp, human
gaaggtagaatggaatcctg

SEQ ID NO: 246717 - DNA, 20 bp, human
ggctccgccctcctcgtcag

SEQ ID NO: 246718 - DNA, 20 bp, human
gtgcgccaggctccaggcgg

SEQ ID NO: 246719 - DNA, 20 bp, human
gtcgccgggtcacagtccgc

SEQ ID NO: 246720 - DNA, 20 bp, human
ggagcctggcgcagcggcct

SEQ ID NO: 246721 - DNA, 20 bp, human
gctccctgcggactgtgacc

SEQ ID NO: 246722 - DNA, 20 bp, human
gtcgtcagtggaaaactccg

SEQ ID NO: 246723 - DNA, 20 bp, human
ggcccccaggccgctgcgcc

SEQ ID NO: 246724 - DNA, 20 bp, human
gcttccagcacggtccctaa

SEQ ID NO: 246725 - DNA, 20 bp, human
gaggtggggatctctacgct

SEQ ID NO: 246726 - DNA, 20 bp, human
gcgcaaaccggctcccgagg

SEQ ID NO: 246727 - DNA, 20 bp, human
gacgtcctgaccgagacccg

SEQ ID NO: 246728 - DNA, 20 bp, human
gccagccccgggtctcggtc

SEQ ID NO: 246729 - DNA, 20 bp, human
ggcatgccgggagttgtagg

SEQ ID NO: 246730 - DNA, 20 bp, human
gccgaagccggcgcgcaaac

SEQ ID NO: 246731 - DNA, 20 bp, human
gcaactcccggcatgctgct

SEQ ID NO: 246732 - DNA, 20 bp, human
gctgctgcaaccttttaatg

SEQ ID NO: 246733 - DNA, 20 bp, human
gactgctgcaaagccgaagc

SEQ ID NO: 246734 - DNA, 20 bp, human
gcgggagccggtttgcgcgc

SEQ ID NO: 246735 - DNA, 20 bp, human
gggtctcggtcaggacgtgc

SEQ ID NO: 246736 - DNA, 20 bp, human
gccgcctgatggatagacga

SEQ ID NO: 246737 - DNA, 20 bp, human
gtcctctaaaagagtggagg

SEQ ID NO: 246738 - DNA, 20 bp, human
ggattcgtcctctaaaagag

SEQ ID NO: 246739 - DNA, 20 bp, human
ggcagacattttccatagtt

SEQ ID NO: 246740 - DNA, 20 bp, human
gtcgtcctctaaaagagtgg

SEQ ID NO: 246741 - DNA, 20 bp, human
ggaggacgaatccctgcagc

SEQ ID NO: 246742 - DNA, 20 bp, human
gcccacctccactcttttag

SEQ ID NO: 246743 - DNA, 20 bp, human
gaataacaaaagccagatcc

SEQ ID NO: 246744 - DNA, 20 bp, human
ggaagtaaaaagtcttgctt

SEQ ID NO: 246745 - DNA, 20 bp, human
gaaaaaatagctcccaacta

SEQ ID NO: 246746 - DNA, 20 bp, human
ggaggaaggaataacagata

SEQ ID NO: 246747 - DNA, 20 bp, human
gctgaggtctactaggagga

SEQ ID NO: 246748 - DNA, 20 bp, human
gatagacacagtgaagtcag

SEQ ID NO: 246749 - DNA, 20 bp, human
ggtgaagtcagtggcacgcc

SEQ ID NO: 246750 - DNA, 20 bp, human
gtggatatttttatcatctg

SEQ ID NO: 246751 - DNA, 20 bp, human
gtcatctgaggtctactagg

SEQ ID NO: 246752 - DNA, 20 bp, human
gattaatgcagcacaactta

SEQ ID NO: 246753 - DNA, 20 bp, human
gagaaatgccagcaatctaa

SEQ ID NO: 246754 - DNA, 20 bp, human
gcttgcgctactgaatgatt

SEQ ID NO: 246755 - DNA, 20 bp, human
gaaatctagttaacttcttt

SEQ ID NO: 246756 - DNA, 20 bp, human
gcgcgccatgacatcagccc

SEQ ID NO: 246757 - DNA, 20 bp, human
gcctgccggccggccttccc

SEQ ID NO: 246758 - DNA, 20 bp, human
gggcaggagtcgccgactct

SEQ ID NO: 246759 - DNA, 20 bp, human
gcctaggagggcagcaccgc

SEQ ID NO: 246760 - DNA, 20 bp, human
ggccctcctaggccccggga

SEQ ID NO: 246761 - DNA, 20 bp, human
gggccttcccggggcctagg

SEQ ID NO: 246762 - DNA, 20 bp, human
gtccgcggaaggcgtgtccc

SEQ ID NO: 246763 - DNA, 20 bp, human
gtgggaccgcagcacgagct

SEQ ID NO: 246764 - DNA, 20 bp, human
ggtcatggcgcgaagcccgg

SEQ ID NO: 246765 - DNA, 20 bp, human
ggcccgggacacgccttccg

SEQ ID NO: 246766 - DNA, 20 bp, human
ggacgtgggaagatgccggg

SEQ ID NO: 246767 - DNA, 20 bp, human
gccgggctggggcgtgtagc

SEQ ID NO: 246768 - DNA, 20 bp, human
ggggaccgctccctcccaaa

SEQ ID NO: 246769 - DNA, 20 bp, human
gctggtggctagcccggagc

SEQ ID NO: 246770 - DNA, 20 bp, human
gtcttcgcggagacagtcat

SEQ ID NO: 246771 - DNA, 20 bp, human
ggcacagcacgcgatgctga

SEQ ID NO: 246772 - DNA, 20 bp, human
gggcccccgccgccctgcgt

SEQ ID NO: 246773 - DNA, 20 bp, human
gggctggggcgtgtagcggg

SEQ ID NO: 246774 - DNA, 20 bp, human
gtggaactgccgggtccctt

SEQ ID NO: 246775 - DNA, 20 bp, human
ggggaagagcgaaacacttt

SEQ ID NO: 246776 - DNA, 20 bp, human
gaccccgcccggggtgaggt

SEQ ID NO: 246777 - DNA, 20 bp, human
gtggccccggcaccttacca

SEQ ID NO: 246778 - DNA, 20 bp, human
ggcggcgcacgcgacggctg

SEQ ID NO: 246779 - DNA, 20 bp, human
ggaactcttggcttcactag

SEQ ID NO: 246780 - DNA, 20 bp, human
gaaggtgccggggccagttt

SEQ ID NO: 246781 - DNA, 20 bp, human
gcgcctgcggggtgtgcagg

SEQ ID NO: 246782 - DNA, 20 bp, human
gcccaggctctacgaactct

SEQ ID NO: 246783 - DNA, 20 bp, human
gcgagcatagagcggcgccc

SEQ ID NO: 246784 - DNA, 20 bp, human
ggactcctagaatttgaatc

SEQ ID NO: 246785 - DNA, 20 bp, human
ggctggggctctgcgctcga

SEQ ID NO: 246786 - DNA, 20 bp, human
gttgggggagacaaaactca

SEQ ID NO: 246787 - DNA, 20 bp, human
ggagtaacacaactgctatc

SEQ ID NO: 246788 - DNA, 20 bp, human
ggagacaaaactcagggctt

SEQ ID NO: 246789 - DNA, 20 bp, human
gaagaggctcacagctggct

SEQ ID NO: 246790 - DNA, 20 bp, human
gtctccaagaggctcacagc

SEQ ID NO: 246791 - DNA, 20 bp, human
gttggagaaccgaatcactt

SEQ ID NO: 246792 - DNA, 20 bp, human
gctgatcaagtggttggaac

SEQ ID NO: 246793 - DNA, 20 bp, human
gggaacaggaacaagagcta

SEQ ID NO: 246794 - DNA, 20 bp, human
gtcacgagtgtggtgacctg

SEQ ID NO: 246795 - DNA, 20 bp, human
gttgcactgccaattgctta

SEQ ID NO: 246796 - DNA, 20 bp, human
gagggagcttgtagtagcgg

SEQ ID NO: 246797 - DNA, 20 bp, human
gcaggccagggccacagcta

SEQ ID NO: 246798 - DNA, 20 bp, human
gctgctggccaccctagctg

SEQ ID NO: 246799 - DNA, 20 bp, human
gcagcagggtactcagatac

SEQ ID NO: 246800 - DNA, 20 bp, human
ggtactcagatactgggcca

SEQ ID NO: 246801 - DNA, 20 bp, human
gcccagggtcttcagatatc

SEQ ID NO: 246802 - DNA, 20 bp, human
ggggagggagcttgtagtag

SEQ ID NO: 246803 - DNA, 20 bp, human
ggccagggccacagctaggg

SEQ ID NO: 246804 - DNA, 20 bp, human
gagggtgagagcccgaggca

SEQ ID NO: 246805 - DNA, 20 bp, human
gggagcccagaccagcaggc

SEQ ID NO: 246806 - DNA, 20 bp, human
gcatcagcagctgaactcga

SEQ ID NO: 246807 - DNA, 20 bp, human
ggagttcagctgctgatgaa

SEQ ID NO: 246808 - DNA, 20 bp, human
gactcccaggggccctcgcc

SEQ ID NO: 246809 - DNA, 20 bp, human
gtgctccctcagcaacacac

SEQ ID NO: 246810 - DNA, 20 bp, human
gcagctgctgatgaaggggg

SEQ ID NO: 246811 - DNA, 20 bp, human
ggctggagacacggggagat

SEQ ID NO: 246812 - DNA, 20 bp, human
ggttcatgccacacacacac

SEQ ID NO: 246813 - DNA, 20 bp, human
gttagaggacaaaggagcag

SEQ ID NO: 246814 - DNA, 20 bp, human
gtacagaaaggtgtgaaggg

SEQ ID NO: 246815 - DNA, 20 bp, human
gaaatcctgccagggcaggt

SEQ ID NO: 246816 - DNA, 20 bp, human
gggggaggaggggtagatag

SEQ ID NO: 246817 - DNA, 20 bp, human
gtaggcagggagggatcttg

SEQ ID NO: 246818 - DNA, 20 bp, human
gaggagaagtgtcatctctg

SEQ ID NO: 246819 - DNA, 20 bp, human
ggcaggtcatggaggggggt

SEQ ID NO: 246820 - DNA, 20 bp, human
gagacctggtgactcaagct

SEQ ID NO: 246821 - DNA, 20 bp, human
gaggttaattcccttgaatt

SEQ ID NO: 246822 - DNA, 20 bp, human
gacattgttttcatagccaa

SEQ ID NO: 246823 - DNA, 20 bp, human
gcttttttgaaaaggtcact

SEQ ID NO: 246824 - DNA, 20 bp, human
gagggatcttgtggtttctg

SEQ ID NO: 246825 - DNA, 20 bp, human
gtcagaaaagtgaaaaatac

SEQ ID NO: 246826 - DNA, 20 bp, human
ggggaggagactgataggga

SEQ ID NO: 246827 - DNA, 20 bp, human
gggatgggaggagactgata

SEQ ID NO: 246828 - DNA, 20 bp, human
gcatggaggggcccgaagtg

SEQ ID NO: 246829 - DNA, 20 bp, human
gagactgatagggagggacc

SEQ ID NO: 246830 - DNA, 20 bp, human
ggacgaggcgttccggaaaa

SEQ ID NO: 246831 - DNA, 20 bp, human
gtgaagagtggcggcatgga

SEQ ID NO: 246832 - DNA, 20 bp, human
gggaaggccagggagactgg

SEQ ID NO: 246833 - DNA, 20 bp, human
gggggcggcgaaggccggaa

SEQ ID NO: 246834 - DNA, 20 bp, human
gtgggagggacgaggcgttc

SEQ ID NO: 246835 - DNA, 20 bp, human
ggaaggagcctgaagagtgg

SEQ ID NO: 246836 - DNA, 20 bp, human
gggagggagcttgtagtggt

SEQ ID NO: 246837 - DNA, 20 bp, human
gtgtaccctgctactcctga

SEQ ID NO: 246838 - DNA, 20 bp, human
ggtagccatcaggagtagca

SEQ ID NO: 246839 - DNA, 20 bp, human
gctactcctgatggctaccc

SEQ ID NO: 246840 - DNA, 20 bp, human
gctgatggctaccctggctg

SEQ ID NO: 246841 - DNA, 20 bp, human
ggctaccctggctggggctc

SEQ ID NO: 246842 - DNA, 20 bp, human
gggagtagcagggtacacag

SEQ ID NO: 246843 - DNA, 20 bp, human
gtagcagggtacacagaggc

SEQ ID NO: 246844 - DNA, 20 bp, human
gggaagagaggcatggctca

SEQ ID NO: 246845 - DNA, 20 bp, human
ggtacacagaggccgggcca

SEQ ID NO: 246846 - DNA, 20 bp, human
ggggaggttgcggtcaggac

SEQ ID NO: 246847 - DNA, 20 bp, human
gggaggagcgaagggaactt

SEQ ID NO: 246848 - DNA, 20 bp, human
gagcgaagggaacttaggga

SEQ ID NO: 246849 - DNA, 20 bp, human
ggaggcatgggaggagcgaa

SEQ ID NO: 246850 - DNA, 20 bp, human
ggaagaggaggggtagaaag

SEQ ID NO: 246851 - DNA, 20 bp, human
gttgcggtcaggacaggagt

SEQ ID NO: 246852 - DNA, 20 bp, human
gctccctgggctgtgaaacc

SEQ ID NO: 246853 - DNA, 20 bp, human
ggaagggaacttagggaggg

SEQ ID NO: 246854 - DNA, 20 bp, human
gcaccaggtttcacagccca

SEQ ID NO: 246855 - DNA, 20 bp, human
gagaggtgacaccgctccct

SEQ ID NO: 246856 - DNA, 20 bp, human
gtacagggacggttcacggg

SEQ ID NO: 246857 - DNA, 20 bp, human
gctgccctccaggacacacc

SEQ ID NO: 246858 - DNA, 20 bp, human
gaccaaccgcagctcttcgt

SEQ ID NO: 246859 - DNA, 20 bp, human
gcgcccgcgatgcgcccccg

SEQ ID NO: 246860 - DNA, 20 bp, human
gtgggctccctgaacctcgc

SEQ ID NO: 246861 - DNA, 20 bp, human
ggggcggggctcgaagttgc

SEQ ID NO: 246862 - DNA, 20 bp, human
gcggggtcctgcgaggttca

SEQ ID NO: 246863 - DNA, 20 bp, human
gaagttgccggggtcctgcg

SEQ ID NO: 246864 - DNA, 20 bp, human
gggggcgcatcgcgggcgtc

SEQ ID NO: 246865 - DNA, 20 bp, human
ggtactggcacttgttgctg

SEQ ID NO: 246866 - DNA, 20 bp, human
gaaaggaagcggttgctttg

SEQ ID NO: 246867 - DNA, 20 bp, human
gttgtggctgatagatctga

SEQ ID NO: 246868 - DNA, 20 bp, human
ggggctgcctgcgtggtgct

SEQ ID NO: 246869 - DNA, 20 bp, human
gcctgcaaaccactgtggga

SEQ ID NO: 246870 - DNA, 20 bp, human
gaggggtagaacattgcatc

SEQ ID NO: 246871 - DNA, 20 bp, human
gagcagccgtcatttgctgg

SEQ ID NO: 246872 - DNA, 20 bp, human
gctcctcccccagcaaatga

SEQ ID NO: 246873 - DNA, 20 bp, human
gcccaccctgcaaaccactg

SEQ ID NO: 246874 - DNA, 20 bp, human
gcttgggcagcatggaacag

SEQ ID NO: 246875 - DNA, 20 bp, human
gacacaccaaggactatctg

SEQ ID NO: 246876 - DNA, 20 bp, human
gaagtgggagatgtcctcac

SEQ ID NO: 246877 - DNA, 20 bp, human
gctgcagggcgtggactcag

SEQ ID NO: 246878 - DNA, 20 bp, human
gcctcactgggacaagacac

SEQ ID NO: 246879 - DNA, 20 bp, human
gtggtctaaacagctctcac

SEQ ID NO: 246880 - DNA, 20 bp, human
gaaagcgtaacctccctgca

SEQ ID NO: 246881 - DNA, 20 bp, human
gctgctgtgccctcagagtc

SEQ ID NO: 246882 - DNA, 20 bp, human
gtagaccaaaggccggaggc

SEQ ID NO: 246883 - DNA, 20 bp, human
gtgtttagaccaaaggccgg

SEQ ID NO: 246884 - DNA, 20 bp, human
gcaggctgtctgccaaactg

SEQ ID NO: 246885 - DNA, 20 bp, human
gagctgtttagaccaaaggc

SEQ ID NO: 246886 - DNA, 20 bp, human
gactctggggcgcccagtag

SEQ ID NO: 246887 - DNA, 20 bp, human
gagacagggtgtaactgcag

SEQ ID NO: 246888 - DNA, 20 bp, human
gggaacagcacccaggcagg

SEQ ID NO: 246889 - DNA, 20 bp, human
gggttggaaaagactagcaa

SEQ ID NO: 246890 - DNA, 20 bp, human
gagaggaacagcacccaggc

SEQ ID NO: 246891 - DNA, 20 bp, human
gcccctcccgagaccctcgg

SEQ ID NO: 246892 - DNA, 20 bp, human
ggtgccgggctctgactctg

SEQ ID NO: 246893 - DNA, 20 bp, human
gacccccactgctgagtcca

SEQ ID NO: 246894 - DNA, 20 bp, human
gaagaagggaggccatgtgt

SEQ ID NO: 246895 - DNA, 20 bp, human
gcaggtgtctgctcccccga

SEQ ID NO: 246896 - DNA, 20 bp, human
gtggcaacaggcactcctac

SEQ ID NO: 246897 - DNA, 20 bp, human
gtgctggcctagagagtata

SEQ ID NO: 246898 - DNA, 20 bp, human
gtcttcgacggggtgaagga

SEQ ID NO: 246899 - DNA, 20 bp, human
ggagacaagtttgtcccaca

SEQ ID NO: 246900 - DNA, 20 bp, human
gctagagagtatagggcaga

SEQ ID NO: 246901 - DNA, 20 bp, human
gggacaggatcctggattaa

SEQ ID NO: 246902 - DNA, 20 bp, human
ggaggacaaccagaacctgt

SEQ ID NO: 246903 - DNA, 20 bp, human
gtctgctcagacagccctgt

SEQ ID NO: 246904 - DNA, 20 bp, human
ggcactcctacaggacagga

SEQ ID NO: 246905 - DNA, 20 bp, human
gagttcgctgtgggaggcga

SEQ ID NO: 246906 - DNA, 20 bp, human
ggggttggaggatgaacaaa

SEQ ID NO: 246907 - DNA, 20 bp, human
gtgaacaaatgggcaagtac

SEQ ID NO: 246908 - DNA, 20 bp, human
gggaaaatgagtatgccgcc

SEQ ID NO: 246909 - DNA, 20 bp, human
ggagactcgtgttttaaaag

SEQ ID NO: 246910 - DNA, 20 bp, human
gcattgtcaaagagaatgca

SEQ ID NO: 246911 - DNA, 20 bp, human
gggaagcaagaagacttgcc

SEQ ID NO: 246912 - DNA, 20 bp, human
gctggagagaatatgctaca

SEQ ID NO: 246913 - DNA, 20 bp, human
ggaaagcaaaaggatctatc

SEQ ID NO: 246914 - DNA, 20 bp, human
ggaatatgctacatggaatt

SEQ ID NO: 246915 - DNA, 20 bp, human
gagcaaaaggatctatctgg

SEQ ID NO: 246916 - DNA, 20 bp, human
gagggagcgcccccctcccg

SEQ ID NO: 246917 - DNA, 20 bp, human
gcgcggtggccccgcaagaa

SEQ ID NO: 246918 - DNA, 20 bp, human
gcgggcggaaccaaggggcg

SEQ ID NO: 246919 - DNA, 20 bp, human
gcgcgcccagcgctggtgtc

SEQ ID NO: 246920 - DNA, 20 bp, human
gccctcccgacaccagcgct

SEQ ID NO: 246921 - DNA, 20 bp, human
ggggtgggacgatagggaag

SEQ ID NO: 246922 - DNA, 20 bp, human
ggcccagcgctggtgtcggg

SEQ ID NO: 246923 - DNA, 20 bp, human
gacgataccagccccgggag

SEQ ID NO: 246924 - DNA, 20 bp, human
gcgcgcagggtgggacgata

SEQ ID NO: 246925 - DNA, 20 bp, human
gcccgcgcgtcccttcttgc

SEQ ID NO: 246926 - DNA, 20 bp, human
ggaccgcggagagcaccctg

SEQ ID NO: 246927 - DNA, 20 bp, human
ggcgtcaagcttgacgtcaa

SEQ ID NO: 246928 - DNA, 20 bp, human
gagcgaggctgccttgtgat

SEQ ID NO: 246929 - DNA, 20 bp, human
gagccccagggtgctctccg

SEQ ID NO: 246930 - DNA, 20 bp, human
gtacttactggcacgttcaa

SEQ ID NO: 246931 - DNA, 20 bp, human
ggctgggactgccacaggtc

SEQ ID NO: 246932 - DNA, 20 bp, human
ggcattggagataaagtcca

SEQ ID NO: 246933 - DNA, 20 bp, human
gccaccacttccgggttctt

SEQ ID NO: 246934 - DNA, 20 bp, human
gccgacgggtgggtagaccg

SEQ ID NO: 246935 - DNA, 20 bp, human
gtgcgctcggagcggtagat

SEQ ID NO: 246936 - DNA, 20 bp, human
gtggacgcaactcgcgcctg

SEQ ID NO: 246937 - DNA, 20 bp, human
gcgcgagttgcgtccaccgg

SEQ ID NO: 246938 - DNA, 20 bp, human
ggctaacagaatgtctccag

SEQ ID NO: 246939 - DNA, 20 bp, human
gtacggcgcgtgagccggaa

SEQ ID NO: 246940 - DNA, 20 bp, human
ggcgtgagccggaagggcct

SEQ ID NO: 246941 - DNA, 20 bp, human
ggagtccaggctaatttgaa

SEQ ID NO: 246942 - DNA, 20 bp, human
ggccagatgcaggcgagtcc

SEQ ID NO: 246943 - DNA, 20 bp, human
gaacagaatgtctccagggg

SEQ ID NO: 246944 - DNA, 20 bp, human
gtgagaatatagccctccgg

SEQ ID NO: 246945 - DNA, 20 bp, human
gtcaagggagggaaatgctt

SEQ ID NO: 246946 - DNA, 20 bp, human
ggtaccaagcgtgtcgtagt

SEQ ID NO: 246947 - DNA, 20 bp, human
gagtcagcggaacgtgaaat

SEQ ID NO: 246948 - DNA, 20 bp, human
gagtcccctcccagttacta

SEQ ID NO: 246949 - DNA, 20 bp, human
gaaaccgcctttgacgtcaa

SEQ ID NO: 246950 - DNA, 20 bp, human
ggacagaaccatgaaggatc

SEQ ID NO: 246951 - DNA, 20 bp, human
gttcaccgtagtaactggga

SEQ ID NO: 246952 - DNA, 20 bp, human
gcggaagtgtcggtcgcaag

SEQ ID NO: 246953 - DNA, 20 bp, human
ggtgtcgtagtggggctgtt

SEQ ID NO: 246954 - DNA, 20 bp, human
gggaaaccgccaaccgaaag

SEQ ID NO: 246955 - DNA, 20 bp, human
gtactacggtgaagtctatg

SEQ ID NO: 246956 - DNA, 20 bp, human
gcggggcgggcccaattcct

SEQ ID NO: 246957 - DNA, 20 bp, human
gtgggctgacgtcactaccc

SEQ ID NO: 246958 - DNA, 20 bp, human
gaagcagcgagatcccgggg

SEQ ID NO: 246959 - DNA, 20 bp, human
gcagaaagcagcgagatccc

SEQ ID NO: 246960 - DNA, 20 bp, human
gtcactaccctggcttggag

SEQ ID NO: 246961 - DNA, 20 bp, human
gacttccggggcagtgggcg

SEQ ID NO: 246962 - DNA, 20 bp, human
ggtgacgtcagcccaggaat

SEQ ID NO: 246963 - DNA, 20 bp, human
gactgccccggaagttaatg

SEQ ID NO: 246964 - DNA, 20 bp, human
ggcttccgcattaacttccg

SEQ ID NO: 246965 - DNA, 20 bp, human
gtgagccggctccaaccggc

SEQ ID NO: 246966 - DNA, 20 bp, human
ggatcaccaaagaactgaat

SEQ ID NO: 246967 - DNA, 20 bp, human
ggggtagaaaatgaactggc

SEQ ID NO: 246968 - DNA, 20 bp, human
gactgaatgggtggtgtaaa

SEQ ID NO: 246969 - DNA, 20 bp, human
gccaacataggctttcctgg

SEQ ID NO: 246970 - DNA, 20 bp, human
gaaactgagtgacaaggttc

SEQ ID NO: 246971 - DNA, 20 bp, human
gtgttggtgagggttatgat

SEQ ID NO: 246972 - DNA, 20 bp, human
gtgctctgcaataagagctg

SEQ ID NO: 246973 - DNA, 20 bp, human
gcaccaaagaactgaatggg

SEQ ID NO: 246974 - DNA, 20 bp, human
gttattgcagagcactgtag

SEQ ID NO: 246975 - DNA, 20 bp, human
gatagagaagcatcacttac

SEQ ID NO: 246976 - DNA, 20 bp, human
gacctcacaaagctccacta

SEQ ID NO: 246977 - DNA, 20 bp, human
gcctaatcttcaggggtctg

SEQ ID NO: 246978 - DNA, 20 bp, human
gaattgcagcctccctatga

SEQ ID NO: 246979 - DNA, 20 bp, human
gaagtgacacctaatcttca

SEQ ID NO: 246980 - DNA, 20 bp, human
ggggcattcatgggcttttg

SEQ ID NO: 246981 - DNA, 20 bp, human
gagtttattcctccctcata

SEQ ID NO: 246982 - DNA, 20 bp, human
gctgcggataatttctaaat

SEQ ID NO: 246983 - DNA, 20 bp, human
gttattcctccctcataggg

SEQ ID NO: 246984 - DNA, 20 bp, human
ggagtgcagcggcaccctcc

SEQ ID NO: 246985 - DNA, 20 bp, human
gtatcttgttgtgaccctag

SEQ ID NO: 246986 - DNA, 20 bp, human
gagggcgccagtcagcgaag

SEQ ID NO: 246987 - DNA, 20 bp, human
gagccctccccttcgctgac

SEQ ID NO: 246988 - DNA, 20 bp, human
ggtctcctctatggccaggc

SEQ ID NO: 246989 - DNA, 20 bp, human
gtagagtctcctctatggcc

SEQ ID NO: 246990 - DNA, 20 bp, human
ggctgactggcgccctctac

SEQ ID NO: 246991 - DNA, 20 bp, human
gtactccagcctggccatag

SEQ ID NO: 246992 - DNA, 20 bp, human
gtgagatagagtctcctcta

SEQ ID NO: 246993 - DNA, 20 bp, human
ggcgccagtcagcgaagggg

SEQ ID NO: 246994 - DNA, 20 bp, human
gcagaaccttctcacacagt

SEQ ID NO: 246995 - DNA, 20 bp, human
gtgcacagcaacataagcag

SEQ ID NO: 246996 - DNA, 20 bp, human
gcatccattttttctaataa

SEQ ID NO: 246997 - DNA, 20 bp, human
gctaataagggttcctaata

SEQ ID NO: 246998 - DNA, 20 bp, human
gtaacccttattagaaaaaa

SEQ ID NO: 246999 - DNA, 20 bp, human
gaataagggttaatacacgt

SEQ ID NO: 247000 - DNA, 20 bp, human
gctgataacaacatctgaca

SEQ ID NO: 247001 - DNA, 20 bp, human
gtgtatcaatcttctaataa

SEQ ID NO: 247002 - DNA, 20 bp, human
gcaacaaacactctgttctc

SEQ ID NO: 247003 - DNA, 20 bp, human
gcagagtgtttgttgagact

SEQ ID NO: 247004 - DNA, 20 bp, human
gggcttatacatcttcaaat

SEQ ID NO: 247005 - DNA, 20 bp, human
ggttgagacttggtaaatct

SEQ ID NO: 247006 - DNA, 20 bp, human
gcagaagcaccaatccggaa

SEQ ID NO: 247007 - DNA, 20 bp, human
gaaggctcaaggcggatgga

SEQ ID NO: 247008 - DNA, 20 bp, human
gtgtgtggggcgccagagtc

SEQ ID NO: 247009 - DNA, 20 bp, human
gtaacactgggaacctgtgt

SEQ ID NO: 247010 - DNA, 20 bp, human
gcggaaaggctcaaggcgga

SEQ ID NO: 247011 - DNA, 20 bp, human
gccctcccccagcctaacac

SEQ ID NO: 247012 - DNA, 20 bp, human
gagcaccagagtcagctaag

SEQ ID NO: 247013 - DNA, 20 bp, human
ggttcccagtgttaggctgg

SEQ ID NO: 247014 - DNA, 20 bp, human
ggggggagggcacgcgaaag

SEQ ID NO: 247015 - DNA, 20 bp, human
gtggcgccagcgggagaacc

SEQ ID NO: 247016 - DNA, 20 bp, human
gtcttctgtatggtctggga

SEQ ID NO: 247017 - DNA, 20 bp, human
gggagtcttctgtatggtct

SEQ ID NO: 247018 - DNA, 20 bp, human
gtttgatggagtcttctgta

SEQ ID NO: 247019 - DNA, 20 bp, human
gtttaaagtcaaccccgacc

SEQ ID NO: 247020 - DNA, 20 bp, human
gtctgggatggagagtgcac

SEQ ID NO: 247021 - DNA, 20 bp, human
gggcgccagagtcaacgaag

SEQ ID NO: 247022 - DNA, 20 bp, human
gccctccccttcgttgactc

SEQ ID NO: 247023 - DNA, 20 bp, human
gactgaaggtcgcctgcaga

SEQ ID NO: 247024 - DNA, 20 bp, human
gcccagtgttcggctgggac

SEQ ID NO: 247025 - DNA, 20 bp, human
gtgcacagcaacataagcag

SEQ ID NO: 247026 - DNA, 20 bp, human
gcccggcgccgggaaccacg

SEQ ID NO: 247027 - DNA, 20 bp, human
gggcgccgggaaccacgcgg

SEQ ID NO: 247028 - DNA, 20 bp, human
gctggcgcgggctacccagt

SEQ ID NO: 247029 - DNA, 20 bp, human
gccgagcgccgccgcatgga

SEQ ID NO: 247030 - DNA, 20 bp, human
ggcagcccgacgcggaatcg

SEQ ID NO: 247031 - DNA, 20 bp, human
ggcgccccggacacacccac

SEQ ID NO: 247032 - DNA, 20 bp, human
gcgcccgcgcggccccgacc

SEQ ID NO: 247033 - DNA, 20 bp, human
ggtggcggccgtccatgcgg

SEQ ID NO: 247034 - DNA, 20 bp, human
gaggcggccgccggtcgctc

SEQ ID NO: 247035 - DNA, 20 bp, human
gcacagcgggagcccgtgca

SEQ ID NO: 247036 - DNA, 20 bp, human
gccaaggtctcccaggcgcc

SEQ ID NO: 247037 - DNA, 20 bp, human
gactgcatgtctggtgggcg

SEQ ID NO: 247038 - DNA, 20 bp, human
gcgtggcctcgcgccagcca

SEQ ID NO: 247039 - DNA, 20 bp, human
ggcgccagccaaggtctccc

SEQ ID NO: 247040 - DNA, 20 bp, human
ggagccccggagcacgtgac

SEQ ID NO: 247041 - DNA, 20 bp, human
ggggcagcccgggatcctca

SEQ ID NO: 247042 - DNA, 20 bp, human
gtctcccagggccggaagta

SEQ ID NO: 247043 - DNA, 20 bp, human
gggagaccccgagtgagccc

SEQ ID NO: 247044 - DNA, 20 bp, human
gcaggcgccctgaggatccc

SEQ ID NO: 247045 - DNA, 20 bp, human
ggctcactcggggtctccca

SEQ ID NO: 247046 - DNA, 20 bp, human
gccaaggtctcccaggcgcc

SEQ ID NO: 247047 - DNA, 20 bp, human
gactgcatgtctggtgggcg

SEQ ID NO: 247048 - DNA, 20 bp, human
gcgtggcctcgcgccagcca

SEQ ID NO: 247049 - DNA, 20 bp, human
ggcgccagccaaggtctccc

SEQ ID NO: 247050 - DNA, 20 bp, human
ggagccccggagcacgtgac

SEQ ID NO: 247051 - DNA, 20 bp, human
ggggcagcccgggatcctca

SEQ ID NO: 247052 - DNA, 20 bp, human
gtctcccagggccggaagta

SEQ ID NO: 247053 - DNA, 20 bp, human
gggagaccccgagtgagccc

SEQ ID NO: 247054 - DNA, 20 bp, human
gcaggcgccctgaggatccc

SEQ ID NO: 247055 - DNA, 20 bp, human
ggctcactcggggtctccca

SEQ ID NO: 247056 - DNA, 20 bp, human
gccaaggtctcccaggcgcc

SEQ ID NO: 247057 - DNA, 20 bp, human
gactgcatgtctggtgggcg

SEQ ID NO: 247058 - DNA, 20 bp, human
gcgtggcctcgcgccagcca

SEQ ID NO: 247059 - DNA, 20 bp, human
gcggacagccggctgctcac

SEQ ID NO: 247060 - DNA, 20 bp, human
gagccggctgctcacgggtg

SEQ ID NO: 247061 - DNA, 20 bp, human
ggcgccagccaaggtctccc

SEQ ID NO: 247062 - DNA, 20 bp, human
ggagccccggagcacgtgac

SEQ ID NO: 247063 - DNA, 20 bp, human
ggggcagcccgggatcctca

SEQ ID NO: 247064 - DNA, 20 bp, human
gtctcccagggccggaagta

SEQ ID NO: 247065 - DNA, 20 bp, human
gggagaccccgagtgagccc

SEQ ID NO: 247066 - DNA, 20 bp, human
ggtaacaaaggtaccggggt

SEQ ID NO: 247067 - DNA, 20 bp, human
ggtaccggggtgggcagtgt

SEQ ID NO: 247068 - DNA, 20 bp, human
gcggctgcggggggagttag

SEQ ID NO: 247069 - DNA, 20 bp, human
gtaaagtgtaacaaaggtac

SEQ ID NO: 247070 - DNA, 20 bp, human
gaggggacgcgggcacccgt

SEQ ID NO: 247071 - DNA, 20 bp, human
gagacccacactgcccaccc

SEQ ID NO: 247072 - DNA, 20 bp, human
ggaagacgcagcattccgtt

SEQ ID NO: 247073 - DNA, 20 bp, human
gtagggtgtcagcttgggat

SEQ ID NO: 247074 - DNA, 20 bp, human
gagcttgggatgggcatagc

SEQ ID NO: 247075 - DNA, 20 bp, human
gacgctccggttgcccgtta

SEQ ID NO: 247076 - DNA, 20 bp, human
gcgaggacagggtacgtcgc

SEQ ID NO: 247077 - DNA, 20 bp, human
gataacaagagggtcgggat

SEQ ID NO: 247078 - DNA, 20 bp, human
gcggccgaaaccaaaccgag

SEQ ID NO: 247079 - DNA, 20 bp, human
gtcgcaggcttgtgcgggtc

SEQ ID NO: 247080 - DNA, 20 bp, human
gcgaaaccaaaccgaggggt

SEQ ID NO: 247081 - DNA, 20 bp, human
gtaaagtataacaagagggt

SEQ ID NO: 247082 - DNA, 20 bp, human
ggcgcctccccgccttctcg

SEQ ID NO: 247083 - DNA, 20 bp, human
gcaagcttcgcagacgtgtc

SEQ ID NO: 247084 - DNA, 20 bp, human
gggtacgtcgcaggcttgtg

SEQ ID NO: 247085 - DNA, 20 bp, human
gccaagcctctccactacca

SEQ ID NO: 247086 - DNA, 20 bp, human
ggccccgcgagcttcccgcc

SEQ ID NO: 247087 - DNA, 20 bp, human
gtccccgcccgcgcggtcgt

SEQ ID NO: 247088 - DNA, 20 bp, human
ggccgctcgcgcctctcgat

SEQ ID NO: 247089 - DNA, 20 bp, human
ggcgcacggactcacgcggg

SEQ ID NO: 247090 - DNA, 20 bp, human
gcgggcccgcagggtcctcg

SEQ ID NO: 247091 - DNA, 20 bp, human
ggcggcgcacggactcacgc

SEQ ID NO: 247092 - DNA, 20 bp, human
ggactcacgcgggcggctca

SEQ ID NO: 247093 - DNA, 20 bp, human
ggcctggcgggaagctcgcg

SEQ ID NO: 247094 - DNA, 20 bp, human
ggggcccggaagccgagaca

SEQ ID NO: 247095 - DNA, 20 bp, human
gcggacggcgctcccgccag

SEQ ID NO: 247096 - DNA, 20 bp, human
gaaagtgcacacaagcgcgg

SEQ ID NO: 247097 - DNA, 20 bp, human
gtacaaatcggctctctcgg

SEQ ID NO: 247098 - DNA, 20 bp, human
gtgtagtgaggagtatctga

SEQ ID NO: 247099 - DNA, 20 bp, human
ggggcgaggccggcccatgt

SEQ ID NO: 247100 - DNA, 20 bp, human
gggctctctcgggggattag

SEQ ID NO: 247101 - DNA, 20 bp, human
gagagagccgatttgtagtg

SEQ ID NO: 247102 - DNA, 20 bp, human
ggatactcctcactacaaat

SEQ ID NO: 247103 - DNA, 20 bp, human
gtaggcgggaggcgaggtga

SEQ ID NO: 247104 - DNA, 20 bp, human
gctcccgagggcctcccggg

SEQ ID NO: 247105 - DNA, 20 bp, human
gtggctgcgcaggagctagg

SEQ ID NO: 247106 - DNA, 20 bp, human
ggtccccgggcgctacaggt

SEQ ID NO: 247107 - DNA, 20 bp, human
ggggcggggagagtcgggaa

SEQ ID NO: 247108 - DNA, 20 bp, human
ggggaggactataaacggta

SEQ ID NO: 247109 - DNA, 20 bp, human
ggggggacagccagtgtctg

SEQ ID NO: 247110 - DNA, 20 bp, human
ggtcgggcttcgagcgtccc

SEQ ID NO: 247111 - DNA, 20 bp, human
gggctgctggagcgtctcgg

SEQ ID NO: 247112 - DNA, 20 bp, human
ggggagagtcgggaagggcg

SEQ ID NO: 247113 - DNA, 20 bp, human
gagtgtctgcggcgccgaga

SEQ ID NO: 247114 - DNA, 20 bp, human
gcacccacctgtagcgcccg

SEQ ID NO: 247115 - DNA, 20 bp, human
gtacaaggggatccccaaaa

SEQ ID NO: 247116 - DNA, 20 bp, human
ggagtctctaggaagcgagg

SEQ ID NO: 247117 - DNA, 20 bp, human
gagacaggggtgtcgggagt

SEQ ID NO: 247118 - DNA, 20 bp, human
gagaaaagagacaggggtgt

SEQ ID NO: 247119 - DNA, 20 bp, human
ggcggagtctctaggaagcg

SEQ ID NO: 247120 - DNA, 20 bp, human
gggcgaggaaacccgctcac

SEQ ID NO: 247121 - DNA, 20 bp, human
ggagggggtgagcagcgaga

SEQ ID NO: 247122 - DNA, 20 bp, human
ggagttgggatggtgcaccg

SEQ ID NO: 247123 - DNA, 20 bp, human
gcggtgacgtcaccggtgag

SEQ ID NO: 247124 - DNA, 20 bp, human
gcaggtgctcgcttgggggt

SEQ ID NO: 247125 - DNA, 20 bp, human
gggtgcaccgaggcgcctcg

SEQ ID NO: 247126 - DNA, 20 bp, human
gccctcgccgggtcgctcgt

SEQ ID NO: 247127 - DNA, 20 bp, human
gcgggcggcgagtagagggc

SEQ ID NO: 247128 - DNA, 20 bp, human
gcggccgggcggcgagtaga

SEQ ID NO: 247129 - DNA, 20 bp, human
gtgaggggaggggttggcgc

SEQ ID NO: 247130 - DNA, 20 bp, human
gtcctggctcccgctgggtg

SEQ ID NO: 247131 - DNA, 20 bp, human
gcgcagggcagcatgggagg

SEQ ID NO: 247132 - DNA, 20 bp, human
ggcgggtgctgataagggaa

SEQ ID NO: 247133 - DNA, 20 bp, human
gcggcaccgcccaggggcgg

SEQ ID NO: 247134 - DNA, 20 bp, human
ggccccggcagcgccgacgc

SEQ ID NO: 247135 - DNA, 20 bp, human
gataagggaagggacgggtg

SEQ ID NO: 247136 - DNA, 20 bp, human
gcaggcgcggagcggaaaag

SEQ ID NO: 247137 - DNA, 20 bp, human
ggggcactggtggacctggg

SEQ ID NO: 247138 - DNA, 20 bp, human
gctggcgcgagagtggaggg

SEQ ID NO: 247139 - DNA, 20 bp, human
ggcgcggagcggaaaagagg

SEQ ID NO: 247140 - DNA, 20 bp, human
gaaaagagggggcgtgaagg

SEQ ID NO: 247141 - DNA, 20 bp, human
gggacctgggggggtggatg

SEQ ID NO: 247142 - DNA, 20 bp, human
gagggggtgatgtactgtgg

SEQ ID NO: 247143 - DNA, 20 bp, human
gacccgggggggaagtaagg

SEQ ID NO: 247144 - DNA, 20 bp, human
gagggggagcacggatgagg

SEQ ID NO: 247145 - DNA, 20 bp, human
gatgaggaggaccccagagg

SEQ ID NO: 247146 - DNA, 20 bp, human
ggccccgcctcaaactgcgt

SEQ ID NO: 247147 - DNA, 20 bp, human
gcacgcgcagaaggtggccg

SEQ ID NO: 247148 - DNA, 20 bp, human
gcctcctgcgcggtctatgg

SEQ ID NO: 247149 - DNA, 20 bp, human
gcagttggggcagttgtcag

SEQ ID NO: 247150 - DNA, 20 bp, human
gtctatggcgggtaggtata

SEQ ID NO: 247151 - DNA, 20 bp, human
gaccggaagtagtgtcaaag

SEQ ID NO: 247152 - DNA, 20 bp, human
ggcggggcctgcttcgcctc

SEQ ID NO: 247153 - DNA, 20 bp, human
gccgcgagggccctaagcgc

SEQ ID NO: 247154 - DNA, 20 bp, human
ggcggggcctgaggcgaagc

SEQ ID NO: 247155 - DNA, 20 bp, human
gggactaagttcctcctgcg

SEQ ID NO: 247156 - DNA, 20 bp, human
gtcagcgcgtgatggggtaa

SEQ ID NO: 247157 - DNA, 20 bp, human
gtcacagtgcgcgatgggag

SEQ ID NO: 247158 - DNA, 20 bp, human
gcccgcgccgacttcctgga

SEQ ID NO: 247159 - DNA, 20 bp, human
gggcacgcagggttggtccc

SEQ ID NO: 247160 - DNA, 20 bp, human
ggcgactcacagtgcgcgat

SEQ ID NO: 247161 - DNA, 20 bp, human
gggcgcgtgacgtcacgcaa

SEQ ID NO: 247162 - DNA, 20 bp, human
gcgctcggaactacgtatcc

SEQ ID NO: 247163 - DNA, 20 bp, human
gtcccgccatgctctgtccg

SEQ ID NO: 247164 - DNA, 20 bp, human
gctgggtctcagcgcgtgat

SEQ ID NO: 247165 - DNA, 20 bp, human
gcggcgctccgaggaaaagt

SEQ ID NO: 247166 - DNA, 20 bp, human
ggggttcctgccgcgctcca

SEQ ID NO: 247167 - DNA, 20 bp, human
gccttcctgccgcccgccgg

SEQ ID NO: 247168 - DNA, 20 bp, human
ggccgcgccggtcccagaag

SEQ ID NO: 247169 - DNA, 20 bp, human
ggcacccggctcaccgttcc

SEQ ID NO: 247170 - DNA, 20 bp, human
gagagactcagccccgccgg

SEQ ID NO: 247171 - DNA, 20 bp, human
gcggcctggaacggtgagcc

SEQ ID NO: 247172 - DNA, 20 bp, human
gcggcgcggctaggcggact

SEQ ID NO: 247173 - DNA, 20 bp, human
ggccggggagtgcccgagtg

SEQ ID NO: 247174 - DNA, 20 bp, human
ggccacttctgggaccggcg

SEQ ID NO: 247175 - DNA, 20 bp, human
gcgcggctaggcggactggg

SEQ ID NO: 247176 - DNA, 20 bp, human
gaaaaagcgaatcctcaagg

SEQ ID NO: 247177 - DNA, 20 bp, human
gaagaggccgagtcgagagc

SEQ ID NO: 247178 - DNA, 20 bp, human
gcgcctcccggctctcgact

SEQ ID NO: 247179 - DNA, 20 bp, human
gccggccgctcacagatgga

SEQ ID NO: 247180 - DNA, 20 bp, human
gggggtgggcgctgcagccg

SEQ ID NO: 247181 - DNA, 20 bp, human
gagccccggccgctcacaga

SEQ ID NO: 247182 - DNA, 20 bp, human
gagggcgcactcggggaagg

SEQ ID NO: 247183 - DNA, 20 bp, human
gagctggagcttcccgctgg

SEQ ID NO: 247184 - DNA, 20 bp, human
gggaggccgcagtctggcgc

SEQ ID NO: 247185 - DNA, 20 bp, human
gcgccaccccaccccccttg

SEQ ID NO: 247186 - DNA, 20 bp, human
gtcgcctgctcgcctggtgg

SEQ ID NO: 247187 - DNA, 20 bp, human
gggcccggggcagttgagtg

SEQ ID NO: 247188 - DNA, 20 bp, human
gccgacacagggtgagtgga

SEQ ID NO: 247189 - DNA, 20 bp, human
gggggagcggggccgacaca

SEQ ID NO: 247190 - DNA, 20 bp, human
gtctcccccaccaggcgagc

SEQ ID NO: 247191 - DNA, 20 bp, human
ggcactggaaggattcggaa

SEQ ID NO: 247192 - DNA, 20 bp, human
ggcccgctcgcctgctcgcc

SEQ ID NO: 247193 - DNA, 20 bp, human
gggggaccggcctccgccgc

SEQ ID NO: 247194 - DNA, 20 bp, human
ggggagagccgcgcacgggg

SEQ ID NO: 247195 - DNA, 20 bp, human
gagtctgaggcagatgggtg

SEQ ID NO: 247196 - DNA, 20 bp, human
gctggaggaggtagttcgta

SEQ ID NO: 247197 - DNA, 20 bp, human
gtgtgggcgcgctgggtagg

SEQ ID NO: 247198 - DNA, 20 bp, human
gggaatgcgggcagccacaa

SEQ ID NO: 247199 - DNA, 20 bp, human
gctgcccaagcagttccgtt

SEQ ID NO: 247200 - DNA, 20 bp, human
gctggaaagggaaccttcaa

SEQ ID NO: 247201 - DNA, 20 bp, human
gaacacaaggccttagtact

SEQ ID NO: 247202 - DNA, 20 bp, human
gtaaagcgttaggagtggag

SEQ ID NO: 247203 - DNA, 20 bp, human
gcggctgtgtagtggtcgca

SEQ ID NO: 247204 - DNA, 20 bp, human
ggaaagcggcctctccgcgc

SEQ ID NO: 247205 - DNA, 20 bp, human
ggagtagggagtaaagcgtt

SEQ ID NO: 247206 - DNA, 20 bp, human
ggagcccgcggcagaacatt

SEQ ID NO: 247207 - DNA, 20 bp, human
gctgtctcaaaagggggggt

SEQ ID NO: 247208 - DNA, 20 bp, human
ggcgccccagactagagaga

SEQ ID NO: 247209 - DNA, 20 bp, human
ggtggggcctagtgggggaa

SEQ ID NO: 247210 - DNA, 20 bp, human
gccactaggccccacggacg

SEQ ID NO: 247211 - DNA, 20 bp, human
gggaaggcaagttgtctgcc

SEQ ID NO: 247212 - DNA, 20 bp, human
gaaggaatcctgtctcaaaa

SEQ ID NO: 247213 - DNA, 20 bp, human
gtggcaggacaggaatgcgc

SEQ ID NO: 247214 - DNA, 20 bp, human
gaggccctctctctagtctg

SEQ ID NO: 247215 - DNA, 20 bp, human
gcacgcccccctttcgaggg

SEQ ID NO: 247216 - DNA, 20 bp, human
gaggaatgctgagtgtcaag

SEQ ID NO: 247217 - DNA, 20 bp, human
ggagtggtgcgaagaggata

SEQ ID NO: 247218 - DNA, 20 bp, human
ggagcgctggcggtggtcgg

SEQ ID NO: 247219 - DNA, 20 bp, human
gtggctgtctcctctcagcg

SEQ ID NO: 247220 - DNA, 20 bp, human
gcggacggggcccatactgg

SEQ ID NO: 247221 - DNA, 20 bp, human
gaggaagtaggtagctgaag

SEQ ID NO: 247222 - DNA, 20 bp, human
gctggagggtggagtcgcac

SEQ ID NO: 247223 - DNA, 20 bp, human
gcgcgccgggctgtcgtctc

SEQ ID NO: 247224 - DNA, 20 bp, human
gcggctgccgtcgagctgga

SEQ ID NO: 247225 - DNA, 20 bp, human
gtgccagctttttcagacgg

SEQ ID NO: 247226 - DNA, 20 bp, human
gcgcgtctcccgctccttat

SEQ ID NO: 247227 - DNA, 20 bp, human
gaaggagcgggagacgcgtc

SEQ ID NO: 247228 - DNA, 20 bp, human
ggcacaaagcggagtgaagc

SEQ ID NO: 247229 - DNA, 20 bp, human
gctaacaccacttggaccca

SEQ ID NO: 247230 - DNA, 20 bp, human
ggcggtcgcggtgacgtttc

SEQ ID NO: 247231 - DNA, 20 bp, human
gctgtcagccaataaggagc

SEQ ID NO: 247232 - DNA, 20 bp, human
gtggagtccctgggtccaag

SEQ ID NO: 247233 - DNA, 20 bp, human
gccgctttgtgcactgggtg

SEQ ID NO: 247234 - DNA, 20 bp, human
gagacgcccgggtggctctc

SEQ ID NO: 247235 - DNA, 20 bp, human
gagcgcggcccattgagcgc

SEQ ID NO: 247236 - DNA, 20 bp, human
gcccaccccgagcccggcgt

SEQ ID NO: 247237 - DNA, 20 bp, human
gcgagcgactgcagtaggag

SEQ ID NO: 247238 - DNA, 20 bp, human
gggagcttccatcccgtaat

SEQ ID NO: 247239 - DNA, 20 bp, human
ggaagctccgggtgtcgcgg

SEQ ID NO: 247240 - DNA, 20 bp, human
ggcaggcgggctctccacga

SEQ ID NO: 247241 - DNA, 20 bp, human
gccccacgccgggctcgggg

SEQ ID NO: 247242 - DNA, 20 bp, human
gggtcaggagccgcaggtcg

SEQ ID NO: 247243 - DNA, 20 bp, human
gagagaggcgcgcgggtgaa

SEQ ID NO: 247244 - DNA, 20 bp, human
gcaggccgagcgactgcagt

SEQ ID NO: 247245 - DNA, 20 bp, human
gtctcggtccgcccccacgc

SEQ ID NO: 247246 - DNA, 20 bp, human
gagggtggccccaggacgct

SEQ ID NO: 247247 - DNA, 20 bp, human
ggcgacatcccgagcgtcct

SEQ ID NO: 247248 - DNA, 20 bp, human
gacacagggaaagagaatgt

SEQ ID NO: 247249 - DNA, 20 bp, human
gagggctgcgccagcgccgt

SEQ ID NO: 247250 - DNA, 20 bp, human
gcctctgcggtgggagaact

SEQ ID NO: 247251 - DNA, 20 bp, human
gccacgtgcaaagacttgaa

SEQ ID NO: 247252 - DNA, 20 bp, human
gtcgctagactgggctgtct

SEQ ID NO: 247253 - DNA, 20 bp, human
ggcgaactacattacccagc

SEQ ID NO: 247254 - DNA, 20 bp, human
gccgccgcccagcgacccca

SEQ ID NO: 247255 - DNA, 20 bp, human
gcccagcgaccccacggcgc

SEQ ID NO: 247256 - DNA, 20 bp, human
gaaacaagccaatccatgga

SEQ ID NO: 247257 - DNA, 20 bp, human
gaatcctgccattagcccaa

SEQ ID NO: 247258 - DNA, 20 bp, human
ggaggatctggataactaag

SEQ ID NO: 247259 - DNA, 20 bp, human
gggagacttggagaatttcc

SEQ ID NO: 247260 - DNA, 20 bp, human
gaggaggacccttgtactcc

SEQ ID NO: 247261 - DNA, 20 bp, human
gctgtcaagggaccattaga

SEQ ID NO: 247262 - DNA, 20 bp, human
ggagcccttgggctaatggc

SEQ ID NO: 247263 - DNA, 20 bp, human
gcacatgtgtaatacatatc

SEQ ID NO: 247264 - DNA, 20 bp, human
gggataactaagtggagact

SEQ ID NO: 247265 - DNA, 20 bp, human
gagaatttcctggagtacaa

SEQ ID NO: 247266 - DNA, 20 bp, human
gccggcctaagctcccacta

SEQ ID NO: 247267 - DNA, 20 bp, human
gccgggaagagcgagtcgga

SEQ ID NO: 247268 - DNA, 20 bp, human
gggaggaagaggtccctcgg

SEQ ID NO: 247269 - DNA, 20 bp, human
gggcggagagggctgcgcga

SEQ ID NO: 247270 - DNA, 20 bp, human
gcggggaggaaggaattctg

SEQ ID NO: 247271 - DNA, 20 bp, human
gggaagagcgagtcggaggg

SEQ ID NO: 247272 - DNA, 20 bp, human
gcggagggaggtgccaggaa

SEQ ID NO: 247273 - DNA, 20 bp, human
gggcgccgggaagagcgagt

SEQ ID NO: 247274 - DNA, 20 bp, human
ggactcctggaacagcccgc

SEQ ID NO: 247275 - DNA, 20 bp, human
gtccctcgggggtcccggtc

SEQ ID NO: 247276 - DNA, 20 bp, human
ggaaaggcaccgggcatcga

SEQ ID NO: 247277 - DNA, 20 bp, human
ggcctggggagcgcccgaaa

SEQ ID NO: 247278 - DNA, 20 bp, human
ggcggcccggatcgccgcta

SEQ ID NO: 247279 - DNA, 20 bp, human
ggcgaaggggcaccgccgta

SEQ ID NO: 247280 - DNA, 20 bp, human
ggggcaccgccgtagggcgc

SEQ ID NO: 247281 - DNA, 20 bp, human
ggctcggcgccgcaggtggg

SEQ ID NO: 247282 - DNA, 20 bp, human
gcccggatcgccgctagggg

SEQ ID NO: 247283 - DNA, 20 bp, human
ggcccaagcgcgagcggcag

SEQ ID NO: 247284 - DNA, 20 bp, human
gcgggcatcgaggggtggct

SEQ ID NO: 247285 - DNA, 20 bp, human
ggcggagccacggggaccgc

SEQ ID NO: 247286 - DNA, 20 bp, human
ggtggcccaagcaagaaggg

SEQ ID NO: 247287 - DNA, 20 bp, human
gaagcaccctagtgtatttc

SEQ ID NO: 247288 - DNA, 20 bp, human
gccaagcaagaaggggggat

SEQ ID NO: 247289 - DNA, 20 bp, human
gacagtggcccaagcaagaa

SEQ ID NO: 247290 - DNA, 20 bp, human
gtaaagcaacatgccagtga

SEQ ID NO: 247291 - DNA, 20 bp, human
gcccaccactggacactacc

SEQ ID NO: 247292 - DNA, 20 bp, human
gtgaaagcttgatcgcttca

SEQ ID NO: 247293 - DNA, 20 bp, human
ggatgactgacaggacacag

SEQ ID NO: 247294 - DNA, 20 bp, human
gatacactagggtgcttgtc

SEQ ID NO: 247295 - DNA, 20 bp, human
ggtttgatgttacccttcac

SEQ ID NO: 247296 - DNA, 20 bp, human
ggcgcagtccagcctggtgt

SEQ ID NO: 247297 - DNA, 20 bp, human
ggtgcctggaacccatggaa

SEQ ID NO: 247298 - DNA, 20 bp, human
ggggcgggacccggcttagg

SEQ ID NO: 247299 - DNA, 20 bp, human
ggggcggggacatacggtga

SEQ ID NO: 247300 - DNA, 20 bp, human
gtgggggcgggacccggctt

SEQ ID NO: 247301 - DNA, 20 bp, human
gggacccggcttagggggtg

SEQ ID NO: 247302 - DNA, 20 bp, human
gaggacgggaagctttgctg

SEQ ID NO: 247303 - DNA, 20 bp, human
gccaggctggactgcgcggg

SEQ ID NO: 247304 - DNA, 20 bp, human
gataagggcggggccatgtg

SEQ ID NO: 247305 - DNA, 20 bp, human
ggtcggggacgcagggttgg

SEQ ID NO: 247306 - DNA, 20 bp, human
gcagccgccagccgtcaccc

SEQ ID NO: 247307 - DNA, 20 bp, human
gccggcccggggcgctcaga

SEQ ID NO: 247308 - DNA, 20 bp, human
gaccccggggagcgtccgtg

SEQ ID NO: 247309 - DNA, 20 bp, human
ggccgcgcgaggacaagggg

SEQ ID NO: 247310 - DNA, 20 bp, human
gcagacggcagcagactgct

SEQ ID NO: 247311 - DNA, 20 bp, human
ggggcgggggcgtcgggctt

SEQ ID NO: 247312 - DNA, 20 bp, human
ggcccccgcggcctgggttg

SEQ ID NO: 247313 - DNA, 20 bp, human
gttccgccgcgcgaggacaa

SEQ ID NO: 247314 - DNA, 20 bp, human
gcaccccacggacgctcccc

SEQ ID NO: 247315 - DNA, 20 bp, human
gggaacgctccgcgctgcgc

SEQ ID NO: 247316 - DNA, 20 bp, human
gggccccgtccctatgtcgc

SEQ ID NO: 247317 - DNA, 20 bp, human
gacacggcgccggtagtgag

SEQ ID NO: 247318 - DNA, 20 bp, human
gggggcgagaccagcgacat

SEQ ID NO: 247319 - DNA, 20 bp, human
gagaccagcgacatagggac

SEQ ID NO: 247320 - DNA, 20 bp, human
ggcggtgggcgggtggaaca

SEQ ID NO: 247321 - DNA, 20 bp, human
ggcggcggcaacgccccgga

SEQ ID NO: 247322 - DNA, 20 bp, human
gggcgggtggaacacggcgc

SEQ ID NO: 247323 - DNA, 20 bp, human
gggggcccggggccgcgaat

SEQ ID NO: 247324 - DNA, 20 bp, human
gggactcggccactcactac

SEQ ID NO: 247325 - DNA, 20 bp, human
gcggagggaggcgggcgcgt

SEQ ID NO: 247326 - DNA, 20 bp, human
gtgcgcgtccctagtgtcca

SEQ ID NO: 247327 - DNA, 20 bp, human
gaaagggggcggagacttag

SEQ ID NO: 247328 - DNA, 20 bp, human
gaacacccggcactccgccc

SEQ ID NO: 247329 - DNA, 20 bp, human
gccggccacaccgcggtaaa

SEQ ID NO: 247330 - DNA, 20 bp, human
gaccgcgggcccgtcagccg

SEQ ID NO: 247331 - DNA, 20 bp, human
gcggagccgcagagccaata

SEQ ID NO: 247332 - DNA, 20 bp, human
ggcgcgctgcatttggaaca

SEQ ID NO: 247333 - DNA, 20 bp, human
ggcggcgcgtccttttaccg

SEQ ID NO: 247334 - DNA, 20 bp, human
gaagcgagccggccacaccg

SEQ ID NO: 247335 - DNA, 20 bp, human
ggtgcgagcgacaagcgagc

SEQ ID NO: 247336 - DNA, 20 bp, human
gaggaaccaggcataaatca

SEQ ID NO: 247337 - DNA, 20 bp, human
gggagctgaccttatccaat

SEQ ID NO: 247338 - DNA, 20 bp, human
ggggtggtgacaaactgatc

SEQ ID NO: 247339 - DNA, 20 bp, human
gtaggaaagcgaagggggta

SEQ ID NO: 247340 - DNA, 20 bp, human
gtgagcttccaataggaacc

SEQ ID NO: 247341 - DNA, 20 bp, human
gagagactgtacaatctctg

SEQ ID NO: 247342 - DNA, 20 bp, human
gactgcagagctgagggggg

SEQ ID NO: 247343 - DNA, 20 bp, human
gaggaattactgcagagctg

SEQ ID NO: 247344 - DNA, 20 bp, human
gcactgggatagtacagaag

SEQ ID NO: 247345 - DNA, 20 bp, human
gacatcacttaggaaagcga

SEQ ID NO: 247346 - DNA, 20 bp, human
gccgggcgcccggctagtga

SEQ ID NO: 247347 - DNA, 20 bp, human
gcacccggggccggtttcgg

SEQ ID NO: 247348 - DNA, 20 bp, human
gcggacgctccctcactagc

SEQ ID NO: 247349 - DNA, 20 bp, human
ggaggccgcgggttgggaga

SEQ ID NO: 247350 - DNA, 20 bp, human
gccgcacccggggccggttt

SEQ ID NO: 247351 - DNA, 20 bp, human
ggggccggccgccgaggttt

SEQ ID NO: 247352 - DNA, 20 bp, human
gacaaaggaccagggtgcga

SEQ ID NO: 247353 - DNA, 20 bp, human
ggggcgctgcgcactcgcgt

SEQ ID NO: 247354 - DNA, 20 bp, human
ggcggcagccgcgggagaga

SEQ ID NO: 247355 - DNA, 20 bp, human
gccggccgccgaggtttagg

SEQ ID NO: 247356 - DNA, 20 bp, human
gggccggggcgcagagatcg

SEQ ID NO: 247357 - DNA, 20 bp, human
gggcgcagagatcggggctc

SEQ ID NO: 247358 - DNA, 20 bp, human
ggactcgtggggccggatct

SEQ ID NO: 247359 - DNA, 20 bp, human
gggcggaggtcaggtgacag

SEQ ID NO: 247360 - DNA, 20 bp, human
ggcggaaggcgggacctaaa

SEQ ID NO: 247361 - DNA, 20 bp, human
gggacagagcgcagctgggt

SEQ ID NO: 247362 - DNA, 20 bp, human
ggggcggaaatcagagcccg

SEQ ID NO: 247363 - DNA, 20 bp, human
gaagatgaggtccgctgcca

SEQ ID NO: 247364 - DNA, 20 bp, human
gggccccacgagtcaggtgg

SEQ ID NO: 247365 - DNA, 20 bp, human
gccggctataggcggagagg

SEQ ID NO: 247366 - DNA, 20 bp, human
gaactccaggagaccgctgt

SEQ ID NO: 247367 - DNA, 20 bp, human
gcggcggcacagttcagcgg

SEQ ID NO: 247368 - DNA, 20 bp, human
gcggcacagttcagcggagg

SEQ ID NO: 247369 - DNA, 20 bp, human
gtgcgcacgcagaggttgga

SEQ ID NO: 247370 - DNA, 20 bp, human
gcaggctgggacggaagcag

SEQ ID NO: 247371 - DNA, 20 bp, human
gggcgcgggacaggaccgct

SEQ ID NO: 247372 - DNA, 20 bp, human
gcatctctgcctccgggcga

SEQ ID NO: 247373 - DNA, 20 bp, human
ggctgtgcgcacgcagaggt

SEQ ID NO: 247374 - DNA, 20 bp, human
gctgtgccgccgtaggttcg

SEQ ID NO: 247375 - DNA, 20 bp, human
ggaaggggaggaggctgttt

SEQ ID NO: 247376 - DNA, 20 bp, human
gtgggcggtgggaagatccc

SEQ ID NO: 247377 - DNA, 20 bp, human
gtcacctgtcgggctgggga

SEQ ID NO: 247378 - DNA, 20 bp, human
gcaaaggcacttcgagtgcg

SEQ ID NO: 247379 - DNA, 20 bp, human
gtgcaaagtgagccacggga

SEQ ID NO: 247380 - DNA, 20 bp, human
ggggcccagtgcgtccagag

SEQ ID NO: 247381 - DNA, 20 bp, human
ggggagggaggagcggtccc

SEQ ID NO: 247382 - DNA, 20 bp, human
ggaggggaggaaggcaatta

SEQ ID NO: 247383 - DNA, 20 bp, human
gctgtgagctagctcctcaa

SEQ ID NO: 247384 - DNA, 20 bp, human
gaggacccgagcgagggtct

SEQ ID NO: 247385 - DNA, 20 bp, human
ggggaggtccacccgtctgt

SEQ ID NO: 247386 - DNA, 20 bp, human
gtgtcccggaagcactcccg

SEQ ID NO: 247387 - DNA, 20 bp, human
ggacacgccaacaaaagctt

SEQ ID NO: 247388 - DNA, 20 bp, human
gtagccgcttggtcccgcgg

SEQ ID NO: 247389 - DNA, 20 bp, human
gtggccaggcccatcccgag

SEQ ID NO: 247390 - DNA, 20 bp, human
gtgttggcgtgtcggctgta

SEQ ID NO: 247391 - DNA, 20 bp, human
gcgcccaccgcgggaccaag

SEQ ID NO: 247392 - DNA, 20 bp, human
ggacgtggacctctcgggat

SEQ ID NO: 247393 - DNA, 20 bp, human
ggtttccgttttggggttgg

SEQ ID NO: 247394 - DNA, 20 bp, human
gagacgccagatggttccga

SEQ ID NO: 247395 - DNA, 20 bp, human
gctcccccgggagtgcttcc

SEQ ID NO: 247396 - DNA, 20 bp, human
gcccagggactggggttgtc

SEQ ID NO: 247397 - DNA, 20 bp, human
gcaaccccagtccctgggaa

SEQ ID NO: 247398 - DNA, 20 bp, human
gtgcccctttcccagggact

SEQ ID NO: 247399 - DNA, 20 bp, human
ggtgacttgcagtgacactc

SEQ ID NO: 247400 - DNA, 20 bp, human
gtggtcctccacgagccctg

SEQ ID NO: 247401 - DNA, 20 bp, human
gaggctcttctgttcccaga

SEQ ID NO: 247402 - DNA, 20 bp, human
gaactcaggctctcagtgaa

SEQ ID NO: 247403 - DNA, 20 bp, human
gtgtctggtagagagccagg

SEQ ID NO: 247404 - DNA, 20 bp, human
gtaacagggagggtgggctc

SEQ ID NO: 247405 - DNA, 20 bp, human
ggacatcaccggtcagcctt

SEQ ID NO: 247406 - DNA, 20 bp, human
gggagaaaggcaatggtcga

SEQ ID NO: 247407 - DNA, 20 bp, human
ggggctgagtccagcatccc

SEQ ID NO: 247408 - DNA, 20 bp, human
gtgagccgggctaacccagg

SEQ ID NO: 247409 - DNA, 20 bp, human
gcagctggggctcaaacccg

SEQ ID NO: 247410 - DNA, 20 bp, human
gggcaagatgtgtcggtgca

SEQ ID NO: 247411 - DNA, 20 bp, human
gagcacaagagactcagctg

SEQ ID NO: 247412 - DNA, 20 bp, human
gggctcaaacccggggatgc

SEQ ID NO: 247413 - DNA, 20 bp, human
gggcacacagggctataacg

SEQ ID NO: 247414 - DNA, 20 bp, human
gataatcccttccctgggag

SEQ ID NO: 247415 - DNA, 20 bp, human
ggggcgataatcccttccct

SEQ ID NO: 247416 - DNA, 20 bp, human
ggggtggttactgtttaatt

SEQ ID NO: 247417 - DNA, 20 bp, human
ggaaagggccttatcagagc

SEQ ID NO: 247418 - DNA, 20 bp, human
gcagggctttcttagaagta

SEQ ID NO: 247419 - DNA, 20 bp, human
gcacacacgtcaaacagagt

SEQ ID NO: 247420 - DNA, 20 bp, human
gccctttccctgaccttggg

SEQ ID NO: 247421 - DNA, 20 bp, human
gagagaaacctgctctgata

SEQ ID NO: 247422 - DNA, 20 bp, human
gagagcaggtttctctccaa

SEQ ID NO: 247423 - DNA, 20 bp, human
gcacacttataggcaggagc

SEQ ID NO: 247424 - DNA, 20 bp, human
gtcaaggccaaaccgcccct

SEQ ID NO: 247425 - DNA, 20 bp, human
gaggtgagtgcacctggtca

SEQ ID NO: 247426 - DNA, 20 bp, human
gagcccacggggaaaggggt

SEQ ID NO: 247427 - DNA, 20 bp, human
gccagaagaaccagtgaata

SEQ ID NO: 247428 - DNA, 20 bp, human
gaaaacaaggcctagagacc

SEQ ID NO: 247429 - DNA, 20 bp, human
ggtgaagaatcacactaatg

SEQ ID NO: 247430 - DNA, 20 bp, human
gtcacgggggtaagccaccc

SEQ ID NO: 247431 - DNA, 20 bp, human
gtggtagcccacggggaaag

SEQ ID NO: 247432 - DNA, 20 bp, human
gaatagggctggtagcccac

SEQ ID NO: 247433 - DNA, 20 bp, human
gctgggcaccccacagctgg

SEQ ID NO: 247434 - DNA, 20 bp, human
gatattttactgtgtcacgg

SEQ ID NO: 247435 - DNA, 20 bp, human
gttgatattttactgtgtca

SEQ ID NO: 247436 - DNA, 20 bp, human
gcaggggaccttggcctaaa

SEQ ID NO: 247437 - DNA, 20 bp, human
gccaaagcctggcctctaat

SEQ ID NO: 247438 - DNA, 20 bp, human
gaagtctaggtctcggtcag

SEQ ID NO: 247439 - DNA, 20 bp, human
gagggctcaacatttggaat

SEQ ID NO: 247440 - DNA, 20 bp, human
ggtaccgagggctcaacatt

SEQ ID NO: 247441 - DNA, 20 bp, human
gggttctgggagccaattag

SEQ ID NO: 247442 - DNA, 20 bp, human
gtgggagccaattagaggcc

SEQ ID NO: 247443 - DNA, 20 bp, human
gggggctgagtctacacagc

SEQ ID NO: 247444 - DNA, 20 bp, human
gcaacatttggaatgggagg

SEQ ID NO: 247445 - DNA, 20 bp, human
ggcgtccagggtgttctgac

SEQ ID NO: 247446 - DNA, 20 bp, human
gaatgccgggtcaaggtccg

SEQ ID NO: 247447 - DNA, 20 bp, human
gaggcccgcggaccttgacc

SEQ ID NO: 247448 - DNA, 20 bp, human
ggggcggtggcggtcaatgc

SEQ ID NO: 247449 - DNA, 20 bp, human
gtggacggctaagttgtagg

SEQ ID NO: 247450 - DNA, 20 bp, human
gacccccgggcagaggctcg

SEQ ID NO: 247451 - DNA, 20 bp, human
gaccgccccccaggtccgta

SEQ ID NO: 247452 - DNA, 20 bp, human
gcgggaggaagactgtcacg

SEQ ID NO: 247453 - DNA, 20 bp, human
gtccgtagggaccaaagaag

SEQ ID NO: 247454 - DNA, 20 bp, human
ggcctcgcagatcgtagccc

SEQ ID NO: 247455 - DNA, 20 bp, human
gggaccaaagaaggggcggg

SEQ ID NO: 247456 - DNA, 20 bp, human
gggtggccccggaccccgag

SEQ ID NO: 247457 - DNA, 20 bp, human
gggtccggggccaccgccgg

SEQ ID NO: 247458 - DNA, 20 bp, human
ggctgcgcggtggtcacgtg

SEQ ID NO: 247459 - DNA, 20 bp, human
gcccggaccccgagcggaag

SEQ ID NO: 247460 - DNA, 20 bp, human
gccacccccgccaactcggc

SEQ ID NO: 247461 - DNA, 20 bp, human
gggggccgggagggtactta

SEQ ID NO: 247462 - DNA, 20 bp, human
ggggaagcaccgtgcgcggg

SEQ ID NO: 247463 - DNA, 20 bp, human
ggcgcggtggtcacgtgggg

SEQ ID NO: 247464 - DNA, 20 bp, human
gccctcccgccgcccgcgca

SEQ ID NO: 247465 - DNA, 20 bp, human
gacgctgcgaattggggcca

SEQ ID NO: 247466 - DNA, 20 bp, human
ggcaactggacccagaacta

SEQ ID NO: 247467 - DNA, 20 bp, human
gcgcgtgcgcgtctctgaaa

SEQ ID NO: 247468 - DNA, 20 bp, human
gtccagttgcagccaagtga

SEQ ID NO: 247469 - DNA, 20 bp, human
gtggcctcttccctagttct

SEQ ID NO: 247470 - DNA, 20 bp, human
ggtctctgaaacggggactt

SEQ ID NO: 247471 - DNA, 20 bp, human
gggcccggaaacccgtgggc

SEQ ID NO: 247472 - DNA, 20 bp, human
gtcactgagcagcaggggat

SEQ ID NO: 247473 - DNA, 20 bp, human
ggggaataagggagtgggtc

SEQ ID NO: 247474 - DNA, 20 bp, human
gcgccggcccggaaacccgt

SEQ ID NO: 247475 - DNA, 20 bp, human
gaggtgaaagagcgcgacag

SEQ ID NO: 247476 - DNA, 20 bp, human
gcgcgagcggcgggaactgt

SEQ ID NO: 247477 - DNA, 20 bp, human
gcaccccgcggggccctcca

SEQ ID NO: 247478 - DNA, 20 bp, human
gcgcgcccacgtgaccggtc

SEQ ID NO: 247479 - DNA, 20 bp, human
gggtccgggtgcaaacacgc

SEQ ID NO: 247480 - DNA, 20 bp, human
gccggccgcgcccacgtgac

SEQ ID NO: 247481 - DNA, 20 bp, human
ggcggcgggaactgtaggcg

SEQ ID NO: 247482 - DNA, 20 bp, human
ggaccctccgctcctctaca

SEQ ID NO: 247483 - DNA, 20 bp, human
ggcacccggaccggtcacgt

SEQ ID NO: 247484 - DNA, 20 bp, human
gcgggacaggggtcaccccg

SEQ ID NO: 247485 - DNA, 20 bp, human
gaccccaggccaggccgaaa

SEQ ID NO: 247486 - DNA, 20 bp, human
ggccatgcccagagtaaata

SEQ ID NO: 247487 - DNA, 20 bp, human
ggagtctgcggggagaactt

SEQ ID NO: 247488 - DNA, 20 bp, human
gtaaatacggcatgtggaac

SEQ ID NO: 247489 - DNA, 20 bp, human
gtggggcttggcttctctca

SEQ ID NO: 247490 - DNA, 20 bp, human
gtgggcaggtctgagagtta

SEQ ID NO: 247491 - DNA, 20 bp, human
gggcatggctaatgactcca

SEQ ID NO: 247492 - DNA, 20 bp, human
gctagctggagactctggag

SEQ ID NO: 247493 - DNA, 20 bp, human
gccagagtaaatacggcatg

SEQ ID NO: 247494 - DNA, 20 bp, human
gaagaggaatatgagtctgc

SEQ ID NO: 247495 - DNA, 20 bp, human
gggtgggagctgacttgtca

SEQ ID NO: 247496 - DNA, 20 bp, human
gttggagagattaaatggcg

SEQ ID NO: 247497 - DNA, 20 bp, human
gcacgtggggcgcgcagggt

SEQ ID NO: 247498 - DNA, 20 bp, human
ggaggcacgtggggcgcgca

SEQ ID NO: 247499 - DNA, 20 bp, human
ggtgccgtcgccccgctgga

SEQ ID NO: 247500 - DNA, 20 bp, human
gcaaaccagcgcccattggt

SEQ ID NO: 247501 - DNA, 20 bp, human
gtgtttacaggaggcacgtg

SEQ ID NO: 247502 - DNA, 20 bp, human
gcgacggcacgccgaccaat

SEQ ID NO: 247503 - DNA, 20 bp, human
gtataacaagcacgtgatag

SEQ ID NO: 247504 - DNA, 20 bp, human
ggcgttctcttgtttacagg

SEQ ID NO: 247505 - DNA, 20 bp, human
gtgtaaacaagagaacgcgc

SEQ ID NO: 247506 - DNA, 20 bp, human
ggctcaagagctcactatgt

SEQ ID NO: 247507 - DNA, 20 bp, human
gacaacaaggaaggggcttg

SEQ ID NO: 247508 - DNA, 20 bp, human
gcacaaactgccggagatgt

SEQ ID NO: 247509 - DNA, 20 bp, human
ggaacccagcacaacaagga

SEQ ID NO: 247510 - DNA, 20 bp, human
gcagtgccgagagcagaaat

SEQ ID NO: 247511 - DNA, 20 bp, human
gcaaacttcctgagcagcct

SEQ ID NO: 247512 - DNA, 20 bp, human
ggggacaaggatgaatgaaa

SEQ ID NO: 247513 - DNA, 20 bp, human
gtatgttggcttggattaca

SEQ ID NO: 247514 - DNA, 20 bp, human
gttcatggtagcaggagaat

SEQ ID NO: 247515 - DNA, 20 bp, human
gcagggccttaaagtctagg

SEQ ID NO: 247516 - DNA, 20 bp, human
gcacgagcgtggaggagcgg

SEQ ID NO: 247517 - DNA, 20 bp, human
gcggcacgagcgtggaggag

SEQ ID NO: 247518 - DNA, 20 bp, human
gctagagctggcgagttagt

SEQ ID NO: 247519 - DNA, 20 bp, human
gggtgggcggtactcccccg

SEQ ID NO: 247520 - DNA, 20 bp, human
gtcgctcccttatctcctct

SEQ ID NO: 247521 - DNA, 20 bp, human
gaggagcggcgggagcgcga

SEQ ID NO: 247522 - DNA, 20 bp, human
ggggagcggcacgagcgtgg

SEQ ID NO: 247523 - DNA, 20 bp, human
gccgacaggtgaactagagc

SEQ ID NO: 247524 - DNA, 20 bp, human
gttatctcctctgggaggaa

SEQ ID NO: 247525 - DNA, 20 bp, human
gaggagataagggagcgacg

SEQ ID NO: 247526 - DNA, 20 bp, human
ggctgagagaaggaagggta

SEQ ID NO: 247527 - DNA, 20 bp, human
gcagcatgtgtgccagggta

SEQ ID NO: 247528 - DNA, 20 bp, human
gctcacaagactgtctttgg

SEQ ID NO: 247529 - DNA, 20 bp, human
gtgtatgcagcatgtgtgcc

SEQ ID NO: 247530 - DNA, 20 bp, human
gctgacttccgcaatcccga

SEQ ID NO: 247531 - DNA, 20 bp, human
gggaagtcagctccagtgat

SEQ ID NO: 247532 - DNA, 20 bp, human
ggtaaatcctaacaggaaag

SEQ ID NO: 247533 - DNA, 20 bp, human
gcaaagaattctggagccta

SEQ ID NO: 247534 - DNA, 20 bp, human
ggctggaaaatttgggtaag

SEQ ID NO: 247535 - DNA, 20 bp, human
gtggagaggtaaatcctaac

SEQ ID NO: 247536 - DNA, 20 bp, human
ggggcggcgcagagtagggt

SEQ ID NO: 247537 - DNA, 20 bp, human
gtcgcagcgcagccaggcgg

SEQ ID NO: 247538 - DNA, 20 bp, human
gcctgcctcagtggacctgg

SEQ ID NO: 247539 - DNA, 20 bp, human
gtgatccctggcgcggttcg

SEQ ID NO: 247540 - DNA, 20 bp, human
gcaagccacgaaccgcgcca

SEQ ID NO: 247541 - DNA, 20 bp, human
gaagcagagctggtgccccg

SEQ ID NO: 247542 - DNA, 20 bp, human
ggtgcctgcctcagtggacc

SEQ ID NO: 247543 - DNA, 20 bp, human
gccccggggcggcgcagagt

SEQ ID NO: 247544 - DNA, 20 bp, human
gaaaacctcgggtctgggtt

SEQ ID NO: 247545 - DNA, 20 bp, human
gccggccgaacccagacccg

SEQ ID NO: 247546 - DNA, 20 bp, human
gggcacgtggaggtactgga

SEQ ID NO: 247547 - DNA, 20 bp, human
gactgccccctgaaaaatta

SEQ ID NO: 247548 - DNA, 20 bp, human
gggtggccctaatttttcag

SEQ ID NO: 247549 - DNA, 20 bp, human
gtctcccaagcatttaccca

SEQ ID NO: 247550 - DNA, 20 bp, human
gttttcagggggcagtaaga

SEQ ID NO: 247551 - DNA, 20 bp, human
gtgaaggcctcctaactctt

SEQ ID NO: 247552 - DNA, 20 bp, human
gaaagagatccccaagagtt

SEQ ID NO: 247553 - DNA, 20 bp, human
gcaactaggaaaccgggaaa

SEQ ID NO: 247554 - DNA, 20 bp, human
gacgtgccctgtttttctcc

SEQ ID NO: 247555 - DNA, 20 bp, human
gaaggcaacaactaggaaac

SEQ ID NO: 247556 - DNA, 20 bp, human
gcctcccagcctgggctcga

SEQ ID NO: 247557 - DNA, 20 bp, human
ggctacggacctccttgctg

SEQ ID NO: 247558 - DNA, 20 bp, human
gaacaccggggacctaaaaa

SEQ ID NO: 247559 - DNA, 20 bp, human
gccttccgcccctcgagccc

SEQ ID NO: 247560 - DNA, 20 bp, human
gtgaaaatccggtcagctgg

SEQ ID NO: 247561 - DNA, 20 bp, human
gtgttctgtgactgaaaatc

SEQ ID NO: 247562 - DNA, 20 bp, human
gacacaaaagaatgactctc

SEQ ID NO: 247563 - DNA, 20 bp, human
gtccgtagcctccagctgac

SEQ ID NO: 247564 - DNA, 20 bp, human
ggaactaggtcttgaactta

SEQ ID NO: 247565 - DNA, 20 bp, human
ggactgaaaatccggtcagc

SEQ ID NO: 247566 - DNA, 20 bp, human
gaccatagggaaatgactag

SEQ ID NO: 247567 - DNA, 20 bp, human
gacctctagtcatttcccta

SEQ ID NO: 247568 - DNA, 20 bp, human
gactttgtccccaagaccat

SEQ ID NO: 247569 - DNA, 20 bp, human
gacatgaggtactcaaaatg

SEQ ID NO: 247570 - DNA, 20 bp, human
gccagctgagggggagggtg

SEQ ID NO: 247571 - DNA, 20 bp, human
gagtcatttccctatggtct

SEQ ID NO: 247572 - DNA, 20 bp, human
gagacaagggctcttcttga

SEQ ID NO: 247573 - DNA, 20 bp, human
gtagtcccagctgaggggga

SEQ ID NO: 247574 - DNA, 20 bp, human
gaattggaacttgtcacatg

SEQ ID NO: 247575 - DNA, 20 bp, human
ggggtcttgatatgtcatcc

SEQ ID NO: 247576 - DNA, 20 bp, human
gcccagacctgagacgggtt

SEQ ID NO: 247577 - DNA, 20 bp, human
ggggacgggactagctgata

SEQ ID NO: 247578 - DNA, 20 bp, human
gcccagtcccaacccgtctc

SEQ ID NO: 247579 - DNA, 20 bp, human
gacctgagacgggttgggac

SEQ ID NO: 247580 - DNA, 20 bp, human
gcgcctacctcaatacaccc

SEQ ID NO: 247581 - DNA, 20 bp, human
gggggaggcgcctccctcaa

SEQ ID NO: 247582 - DNA, 20 bp, human
ggcccagcttcccgcagcca

SEQ ID NO: 247583 - DNA, 20 bp, human
ggcagcgcgggaaggcggtg

SEQ ID NO: 247584 - DNA, 20 bp, human
gcctcaatacaccctggctg

SEQ ID NO: 247585 - DNA, 20 bp, human
gactgggctgcgtcacgcgc

SEQ ID NO: 247586 - DNA, 20 bp, human
gggggctggagaaaccacga

SEQ ID NO: 247587 - DNA, 20 bp, human
gacgaaggggaagacaggct

SEQ ID NO: 247588 - DNA, 20 bp, human
ggcagggactgaaagcctga

SEQ ID NO: 247589 - DNA, 20 bp, human
ggaggaggacggtgtgaggg

SEQ ID NO: 247590 - DNA, 20 bp, human
gagcaacttgtgggttctag

SEQ ID NO: 247591 - DNA, 20 bp, human
gtgagcaagagtggttccct

SEQ ID NO: 247592 - DNA, 20 bp, human
gacaagttgctcaggccttc

SEQ ID NO: 247593 - DNA, 20 bp, human
gatcgaggaggacggtgtga

SEQ ID NO: 247594 - DNA, 20 bp, human
gtgagctgactgagcttcat

SEQ ID NO: 247595 - DNA, 20 bp, human
gccgtcctcctcgatctgcg

SEQ ID NO: 247596 - DNA, 20 bp, human
gcggccgccgccctgagcgc

SEQ ID NO: 247597 - DNA, 20 bp, human
gccggggcacctgaactcgc

SEQ ID NO: 247598 - DNA, 20 bp, human
gggtgccccggagccaggga

SEQ ID NO: 247599 - DNA, 20 bp, human
ggcgcctggcccgcgagttc

SEQ ID NO: 247600 - DNA, 20 bp, human
gaggccgggacactcccccg

SEQ ID NO: 247601 - DNA, 20 bp, human
gttcaggtgccccggagcca

SEQ ID NO: 247602 - DNA, 20 bp, human
gtcccctaggaagggatcct

SEQ ID NO: 247603 - DNA, 20 bp, human
gggccaggcgcgaggtcgcc

SEQ ID NO: 247604 - DNA, 20 bp, human
gtcccaggatcccttcctag

SEQ ID NO: 247605 - DNA, 20 bp, human
gccggcccttaaggctgcgg

SEQ ID NO: 247606 - DNA, 20 bp, human
gtggcccgcaagagtcccgg

SEQ ID NO: 247607 - DNA, 20 bp, human
gtggccggggctcgcgtccc

SEQ ID NO: 247608 - DNA, 20 bp, human
ggatcctgagaccccgccgc

SEQ ID NO: 247609 - DNA, 20 bp, human
gggacccccgggactcttgc

SEQ ID NO: 247610 - DNA, 20 bp, human
gcatggtgagcggacgagga

SEQ ID NO: 247611 - DNA, 20 bp, human
ggctccccgctcccggactc

SEQ ID NO: 247612 - DNA, 20 bp, human
gtcttggcccgcaagagtcc

SEQ ID NO: 247613 - DNA, 20 bp, human
gtaagcgctagcccggcctg

SEQ ID NO: 247614 - DNA, 20 bp, human
gagctctgcagactcgccac

SEQ ID NO: 247615 - DNA, 20 bp, human
gcgttgcgcgcgcagaggat

SEQ ID NO: 247616 - DNA, 20 bp, human
gcggcgcgcagcgggttaag

SEQ ID NO: 247617 - DNA, 20 bp, human
ggcagcgggttaagcggcga

SEQ ID NO: 247618 - DNA, 20 bp, human
gtcgtggaggtgcgagaaat

SEQ ID NO: 247619 - DNA, 20 bp, human
ggccagccgcgggctcgtgg

SEQ ID NO: 247620 - DNA, 20 bp, human
gtgaaggcagaaagcgcccg

SEQ ID NO: 247621 - DNA, 20 bp, human
gcggctggcgccaccgggcg

SEQ ID NO: 247622 - DNA, 20 bp, human
gcggcttggttggggttctg

SEQ ID NO: 247623 - DNA, 20 bp, human
gtcgcacctccacgagcccg

SEQ ID NO: 247624 - DNA, 20 bp, human
gacctccacgagcccgcggc

SEQ ID NO: 247625 - DNA, 20 bp, human
gggatcaaagaccacggaag

SEQ ID NO: 247626 - DNA, 20 bp, human
ggagaagccccgcctccagc

SEQ ID NO: 247627 - DNA, 20 bp, human
gcctcggccccaatccgcgc

SEQ ID NO: 247628 - DNA, 20 bp, human
ggggtcctgggcttcagggt

SEQ ID NO: 247629 - DNA, 20 bp, human
gaatccgcgccggctggagg

SEQ ID NO: 247630 - DNA, 20 bp, human
gtccccatccacagcggctg

SEQ ID NO: 247631 - DNA, 20 bp, human
ggcctcagccgctgtggatg

SEQ ID NO: 247632 - DNA, 20 bp, human
gttgctcttcccaaacaaaa

SEQ ID NO: 247633 - DNA, 20 bp, human
gccaggagggcgcttcctcc

SEQ ID NO: 247634 - DNA, 20 bp, human
gcccaaacaaaagggatctt

SEQ ID NO: 247635 - DNA, 20 bp, human
gagtcattcaggctcctccc

SEQ ID NO: 247636 - DNA, 20 bp, human
gtgtaggccaagcgggaccc

SEQ ID NO: 247637 - DNA, 20 bp, human
ggagccgtaggcgcatccag

SEQ ID NO: 247638 - DNA, 20 bp, human
ggagcagtgtattttgggag

SEQ ID NO: 247639 - DNA, 20 bp, human
gtccagcggaagtgtcgcat

SEQ ID NO: 247640 - DNA, 20 bp, human
gcaggcgcagaaagtaaacg

SEQ ID NO: 247641 - DNA, 20 bp, human
ggcgcagaaagtaaacgcgg

SEQ ID NO: 247642 - DNA, 20 bp, human
gagggggagcagtgtatttt

SEQ ID NO: 247643 - DNA, 20 bp, human
gctgtcacccggcaggttgc

SEQ ID NO: 247644 - DNA, 20 bp, human
gcagcgcgctgtcacccggc

SEQ ID NO: 247645 - DNA, 20 bp, human
gacccggcaggttgctggat

SEQ ID NO: 247646 - DNA, 20 bp, human
gcgtcagcgcggcgcagtag

SEQ ID NO: 247647 - DNA, 20 bp, human
gcgccccgatgacgtcggag

SEQ ID NO: 247648 - DNA, 20 bp, human
ggtgactagcgggccggccc

SEQ ID NO: 247649 - DNA, 20 bp, human
gccgcgctgacgtcatcgta

SEQ ID NO: 247650 - DNA, 20 bp, human
gagtagcggctgtgactagc

SEQ ID NO: 247651 - DNA, 20 bp, human
ggggcgcgccccgatgacgt

SEQ ID NO: 247652 - DNA, 20 bp, human
ggcggaacatagccatcccg

SEQ ID NO: 247653 - DNA, 20 bp, human
gggcgccactccgacgtcat

SEQ ID NO: 247654 - DNA, 20 bp, human
gtgtggcggcgacagcgcga

SEQ ID NO: 247655 - DNA, 20 bp, human
gctgcctggaggtctatcac

SEQ ID NO: 247656 - DNA, 20 bp, human
gagcacccacgacctcgccg

SEQ ID NO: 247657 - DNA, 20 bp, human
gcactccccggcgaggtcgt

SEQ ID NO: 247658 - DNA, 20 bp, human
ggtggcagctgcccactccc

SEQ ID NO: 247659 - DNA, 20 bp, human
gaaacagggagtctcgagtg

SEQ ID NO: 247660 - DNA, 20 bp, human
ggcaaggcgtccacccactg

SEQ ID NO: 247661 - DNA, 20 bp, human
gtctcgagtggggtctatcg

SEQ ID NO: 247662 - DNA, 20 bp, human
gctatcgcggaggagaatgc

SEQ ID NO: 247663 - DNA, 20 bp, human
gggggggcccgaagtgccag

SEQ ID NO: 247664 - DNA, 20 bp, human
gtgggtgctcgcgggtcctc

SEQ ID NO: 247665 - DNA, 20 bp, human
gcgagtggggtctatcgcgg

SEQ ID NO: 247666 - DNA, 20 bp, human
gcgcgcgcgcacacgtactt

SEQ ID NO: 247667 - DNA, 20 bp, human
gggaacctgcgtagagtcac

SEQ ID NO: 247668 - DNA, 20 bp, human
gtgtatgtgagactgaaagg

SEQ ID NO: 247669 - DNA, 20 bp, human
gtgtgagactgaaaggaggt

SEQ ID NO: 247670 - DNA, 20 bp, human
gttggtgagacagaggacgt

SEQ ID NO: 247671 - DNA, 20 bp, human
gcgcgcacacgtacttcggc

SEQ ID NO: 247672 - DNA, 20 bp, human
gctggcagccgcatcagcag

SEQ ID NO: 247673 - DNA, 20 bp, human
gtgcatggatttcttcggtg

SEQ ID NO: 247674 - DNA, 20 bp, human
gaatcagctccagcagcaac

SEQ ID NO: 247675 - DNA, 20 bp, human
ggggccctgtgactctacgc

SEQ ID NO: 247676 - DNA, 20 bp, human
gcagagcactggtagattta

SEQ ID NO: 247677 - DNA, 20 bp, human
gcaaaaggagtacggggttg

SEQ ID NO: 247678 - DNA, 20 bp, human
gaacattcaaaaggagtacg

SEQ ID NO: 247679 - DNA, 20 bp, human
gtgttgacactattcctctt

SEQ ID NO: 247680 - DNA, 20 bp, human
gagggcatcaacttagcatt

SEQ ID NO: 247681 - DNA, 20 bp, human
gcaacttagcatttgggaga

SEQ ID NO: 247682 - DNA, 20 bp, human
gctaattgacactcccaaag

SEQ ID NO: 247683 - DNA, 20 bp, human
ggtgtcaacaatcaataaag

SEQ ID NO: 247684 - DNA, 20 bp, human
gcacctgcttgtaaattagc

SEQ ID NO: 247685 - DNA, 20 bp, human
gacaggaagacttctgggga

SEQ ID NO: 247686 - DNA, 20 bp, human
gtggaactcctctgcaaggg

SEQ ID NO: 247687 - DNA, 20 bp, human
gttaagttgcgcatcactta

SEQ ID NO: 247688 - DNA, 20 bp, human
ggtactcttcaacttgtgag

SEQ ID NO: 247689 - DNA, 20 bp, human
gtcctagcgctgggtaaagg

SEQ ID NO: 247690 - DNA, 20 bp, human
gaggtggaactcctctgcaa

SEQ ID NO: 247691 - DNA, 20 bp, human
ggcaggtgtactttgaacca

SEQ ID NO: 247692 - DNA, 20 bp, human
gaaaataacatagccttcta

SEQ ID NO: 247693 - DNA, 20 bp, human
gttttcctagcgctgggtaa

SEQ ID NO: 247694 - DNA, 20 bp, human
gtaagcaaagattgtttaag

SEQ ID NO: 247695 - DNA, 20 bp, human
gtccacctttacccagcgct

SEQ ID NO: 247696 - DNA, 20 bp, human
ggacccctttccagagagga

SEQ ID NO: 247697 - DNA, 20 bp, human
gggggagggaggtacacgga

SEQ ID NO: 247698 - DNA, 20 bp, human
ggggagcacccagtgaaggc

SEQ ID NO: 247699 - DNA, 20 bp, human
ggaggagggaagcggacctg

SEQ ID NO: 247700 - DNA, 20 bp, human
gggccggggagggaggtaca

SEQ ID NO: 247701 - DNA, 20 bp, human
gaaacctacatggttgccgg

SEQ ID NO: 247702 - DNA, 20 bp, human
gtggaaaggggtcggccata

SEQ ID NO: 247703 - DNA, 20 bp, human
ggcaagctagggagtcactg

SEQ ID NO: 247704 - DNA, 20 bp, human
ggccggcagggccacaagtg

SEQ ID NO: 247705 - DNA, 20 bp, human
gcccctcccagctgcggaga

SEQ ID NO: 247706 - DNA, 20 bp, human
gaggcgtgaaggtcttgaga

SEQ ID NO: 247707 - DNA, 20 bp, human
ggggtggagtcgaagtgggt

SEQ ID NO: 247708 - DNA, 20 bp, human
gtccctacgcgcaacaaaac

SEQ ID NO: 247709 - DNA, 20 bp, human
gggagcccgtccatagccct

SEQ ID NO: 247710 - DNA, 20 bp, human
gagagggggtggagtcgaag

SEQ ID NO: 247711 - DNA, 20 bp, human
gagggaggcgttaggcgtga

SEQ ID NO: 247712 - DNA, 20 bp, human
gcagcccgggagacagtgcg

SEQ ID NO: 247713 - DNA, 20 bp, human
gtggcggccatgtttgagaa

SEQ ID NO: 247714 - DNA, 20 bp, human
gcaacaaaactggccgccaa

SEQ ID NO: 247715 - DNA, 20 bp, human
gtatggacgggctcccttgg

SEQ ID NO: 247716 - DNA, 20 bp, human
gggagccggtgaggccgaga

SEQ ID NO: 247717 - DNA, 20 bp, human
gcccgccctctcggcctcac

SEQ ID NO: 247718 - DNA, 20 bp, human
gtcaccggctccggcgaccg

SEQ ID NO: 247719 - DNA, 20 bp, human
gccgccatcggcgtccgggg

SEQ ID NO: 247720 - DNA, 20 bp, human
gcccccgccccggacgccga

SEQ ID NO: 247721 - DNA, 20 bp, human
gggccggaacgcaccgccat

SEQ ID NO: 247722 - DNA, 20 bp, human
gggcggggcgatggcgacga

SEQ ID NO: 247723 - DNA, 20 bp, human
gcccaacagcttctcccccg

SEQ ID NO: 247724 - DNA, 20 bp, human
gaggtccgaagtggcgggaa

SEQ ID NO: 247725 - DNA, 20 bp, human
gccctctcgccttccctgcg

SEQ ID NO: 247726 - DNA, 20 bp, human
gcgggacaggggcggtaggg

SEQ ID NO: 247727 - DNA, 20 bp, human
gacccggaaagcaatggtac

SEQ ID NO: 247728 - DNA, 20 bp, human
gagaaggacgggccgatcac

SEQ ID NO: 247729 - DNA, 20 bp, human
ggcggaagaaggagaccgga

SEQ ID NO: 247730 - DNA, 20 bp, human
gcggcgggacaggggcggta

SEQ ID NO: 247731 - DNA, 20 bp, human
ggccgctccccggcgggaca

SEQ ID NO: 247732 - DNA, 20 bp, human
gttgcccaacacacaccctc

SEQ ID NO: 247733 - DNA, 20 bp, human
gggcctgtaccattgctttc

SEQ ID NO: 247734 - DNA, 20 bp, human
ggccgcgttacggcaagcgc

SEQ ID NO: 247735 - DNA, 20 bp, human
ggtgtgttgggcaaagccgg

SEQ ID NO: 247736 - DNA, 20 bp, human
gagggtgggcgccaccggag

SEQ ID NO: 247737 - DNA, 20 bp, human
gagacgagatccggcccaga

SEQ ID NO: 247738 - DNA, 20 bp, human
gagtgagagatgccggggga

SEQ ID NO: 247739 - DNA, 20 bp, human
gcggagagtgagagatgccg

SEQ ID NO: 247740 - DNA, 20 bp, human
ggcgctgcccccctggtggg

SEQ ID NO: 247741 - DNA, 20 bp, human
ggcctgagcgagacgagatc

SEQ ID NO: 247742 - DNA, 20 bp, human
ggcttcgccccgcccaccag

SEQ ID NO: 247743 - DNA, 20 bp, human
gagcgggagcgggatggtag

SEQ ID NO: 247744 - DNA, 20 bp, human
ggtgggcgccaccggagggg

SEQ ID NO: 247745 - DNA, 20 bp, human
gggcgagcgcgctgcccccc

SEQ ID NO: 247746 - DNA, 20 bp, human
gcgcgcccggctactcctga

SEQ ID NO: 247747 - DNA, 20 bp, human
ggcgcgccctcgagccagga

SEQ ID NO: 247748 - DNA, 20 bp, human
gacaccccctcctggctcga

SEQ ID NO: 247749 - DNA, 20 bp, human
gcgcggcggcggttgggctc

SEQ ID NO: 247750 - DNA, 20 bp, human
ggcgccgggaatccctcctg

SEQ ID NO: 247751 - DNA, 20 bp, human
gggtcccgatccctcaggac

SEQ ID NO: 247752 - DNA, 20 bp, human
ggggcgtgagaccacctcga

SEQ ID NO: 247753 - DNA, 20 bp, human
gggggtgtccgaatctctta

SEQ ID NO: 247754 - DNA, 20 bp, human
gcgcgcgttcctaagccctc

SEQ ID NO: 247755 - DNA, 20 bp, human
gggaatccctcctgagggat

SEQ ID NO: 247756 - DNA, 20 bp, human
gagggtttgggaaggcggat

SEQ ID NO: 247757 - DNA, 20 bp, human
gctacaccgggggaatggga

SEQ ID NO: 247758 - DNA, 20 bp, human
gaggggcggtgtcaacctca

SEQ ID NO: 247759 - DNA, 20 bp, human
ggtgtcaacctcagggagtg

SEQ ID NO: 247760 - DNA, 20 bp, human
gaagcgctgcagccgcccgg

SEQ ID NO: 247761 - DNA, 20 bp, human
gtccggtcacgcggcgccga

SEQ ID NO: 247762 - DNA, 20 bp, human
ggagtcgctcctgcagaaag

SEQ ID NO: 247763 - DNA, 20 bp, human
gccaggagtgagcagaacga

SEQ ID NO: 247764 - DNA, 20 bp, human
ggagctcgcgcgtgaggggg

SEQ ID NO: 247765 - DNA, 20 bp, human
gggcgccgcgtgaccggaaa

SEQ ID NO: 247766 - DNA, 20 bp, human
ggccacgtcacgtgacgcga

SEQ ID NO: 247767 - DNA, 20 bp, human
ggcggcgggtgcaaccacaa

SEQ ID NO: 247768 - DNA, 20 bp, human
gccggactcggtgttaaggg

SEQ ID NO: 247769 - DNA, 20 bp, human
gccagcagagggcacggtcc

SEQ ID NO: 247770 - DNA, 20 bp, human
ggcagcctcgggacccaccg

SEQ ID NO: 247771 - DNA, 20 bp, human
ggccaggtcccgccagcaga

SEQ ID NO: 247772 - DNA, 20 bp, human
gacaccgagtccgggatttg

SEQ ID NO: 247773 - DNA, 20 bp, human
ggaagcctcggtgggtcccg

SEQ ID NO: 247774 - DNA, 20 bp, human
gtaatccgaaggagtcgggg

SEQ ID NO: 247775 - DNA, 20 bp, human
gggccgcggaacctgagctg

SEQ ID NO: 247776 - DNA, 20 bp, human
gccgcaggagggaggactaa

SEQ ID NO: 247777 - DNA, 20 bp, human
gcgacccagcggaaagctag

SEQ ID NO: 247778 - DNA, 20 bp, human
gaggtgctgcgtcgccaagg

SEQ ID NO: 247779 - DNA, 20 bp, human
gccgccccggcgctctccca

SEQ ID NO: 247780 - DNA, 20 bp, human
gggaaagggcggcgcaaaga

SEQ ID NO: 247781 - DNA, 20 bp, human
gaagggcggcgcaaagaagg

SEQ ID NO: 247782 - DNA, 20 bp, human
ggtcgccaaggtggcatcct

SEQ ID NO: 247783 - DNA, 20 bp, human
gaggaggtgctgcgtcgcca

SEQ ID NO: 247784 - DNA, 20 bp, human
gctgactttgggaaacgggg

SEQ ID NO: 247785 - DNA, 20 bp, human
gacggggagggcacttccgc

SEQ ID NO: 247786 - DNA, 20 bp, human
ggcaacgtgacctcgatccc

SEQ ID NO: 247787 - DNA, 20 bp, human
gctaccgcgggcggctgcac

SEQ ID NO: 247788 - DNA, 20 bp, human
ggcactggaagaggggcgtg

SEQ ID NO: 247789 - DNA, 20 bp, human
gtggagcatgcgtgctaccg

SEQ ID NO: 247790 - DNA, 20 bp, human
gtggcggaacagcgcgcgag

SEQ ID NO: 247791 - DNA, 20 bp, human
gcgcgctaccggaggagcct

SEQ ID NO: 247792 - DNA, 20 bp, human
ggttccgccacgctcggcgt

SEQ ID NO: 247793 - DNA, 20 bp, human
gccggaggagcctgggatcg

SEQ ID NO: 247794 - DNA, 20 bp, human
gcggcccacgccgagcgtgg

SEQ ID NO: 247795 - DNA, 20 bp, human
gcgtgggggcgcgctaccgg

SEQ ID NO: 247796 - DNA, 20 bp, human
gaggctaggaaggaatgtcg

SEQ ID NO: 247797 - DNA, 20 bp, human
gtgtgcggggtgcatttgga

SEQ ID NO: 247798 - DNA, 20 bp, human
gccagtggaagaggctagga

SEQ ID NO: 247799 - DNA, 20 bp, human
ggcagggcccactcctgata

SEQ ID NO: 247800 - DNA, 20 bp, human
gtagccaggtgtgtatctga

SEQ ID NO: 247801 - DNA, 20 bp, human
ggcccactcctgataaggga

SEQ ID NO: 247802 - DNA, 20 bp, human
ggcaccctcagatacacacc

SEQ ID NO: 247803 - DNA, 20 bp, human
ggaaaatctggcaggggtgt

SEQ ID NO: 247804 - DNA, 20 bp, human
gtcttccactggtgttggtg

SEQ ID NO: 247805 - DNA, 20 bp, human
ggcgccccagatctatgctt

SEQ ID NO: 247806 - DNA, 20 bp, human
gcgtaggccgcatgagtggg

SEQ ID NO: 247807 - DNA, 20 bp, human
gagcccgccccccactcatg

SEQ ID NO: 247808 - DNA, 20 bp, human
gctcccgcggtcctgctcgg

SEQ ID NO: 247809 - DNA, 20 bp, human
gtgacagtggaacgccgcag

SEQ ID NO: 247810 - DNA, 20 bp, human
gcggcctcttcttacctggg

SEQ ID NO: 247811 - DNA, 20 bp, human
gtgcagatgcggtagtcgat

SEQ ID NO: 247812 - DNA, 20 bp, human
ggccatgatagggtcgggat

SEQ ID NO: 247813 - DNA, 20 bp, human
gggcaaaccgcgccatgata

SEQ ID NO: 247814 - DNA, 20 bp, human
gacgccaagtggccaatcac

SEQ ID NO: 247815 - DNA, 20 bp, human
gagaagaggccgctcttcct

SEQ ID NO: 247816 - DNA, 20 bp, human
gtggtctccctcctccgcca

SEQ ID NO: 247817 - DNA, 20 bp, human
gccacctcttccacaaccca

SEQ ID NO: 247818 - DNA, 20 bp, human
gcgggagccccgccttctct

SEQ ID NO: 247819 - DNA, 20 bp, human
gctgccctaggagccaggag

SEQ ID NO: 247820 - DNA, 20 bp, human
ggaaagcggagtcgcaacgc

SEQ ID NO: 247821 - DNA, 20 bp, human
gggcgcacttctgttcgctc

SEQ ID NO: 247822 - DNA, 20 bp, human
gccttcaaggccctcaacgg

SEQ ID NO: 247823 - DNA, 20 bp, human
ggctgctggggcgtaggtgt

SEQ ID NO: 247824 - DNA, 20 bp, human
gtcgctccggtccccagaga

SEQ ID NO: 247825 - DNA, 20 bp, human
gtgcgactccgctttcgcgg

SEQ ID NO: 247826 - DNA, 20 bp, human
gcgccctggggctgcgactc

SEQ ID NO: 247827 - DNA, 20 bp, human
ggtcgcgccggccacagacc

SEQ ID NO: 247828 - DNA, 20 bp, human
gtggctgcggcggtgccgtg

SEQ ID NO: 247829 - DNA, 20 bp, human
gctccggctcgggctcgcca

SEQ ID NO: 247830 - DNA, 20 bp, human
ggccgccgccaccgaggacg

SEQ ID NO: 247831 - DNA, 20 bp, human
ggaggaggagtccgcgtcct

SEQ ID NO: 247832 - DNA, 20 bp, human
gccaaaacccggcctggagc

SEQ ID NO: 247833 - DNA, 20 bp, human
gctcgggctcgccatggctg

SEQ ID NO: 247834 - DNA, 20 bp, human
gcacctggggagggctgcgg

SEQ ID NO: 247835 - DNA, 20 bp, human
gggcaccgcgcacctgggga

SEQ ID NO: 247836 - DNA, 20 bp, human
gtcccccccaagtccggggt

SEQ ID NO: 247837 - DNA, 20 bp, human
gcacaccgaccccggacttg

SEQ ID NO: 247838 - DNA, 20 bp, human
gtctacgcagccccaagtgc

SEQ ID NO: 247839 - DNA, 20 bp, human
gggtagacaggtgcaagcgg

SEQ ID NO: 247840 - DNA, 20 bp, human
gcgccggccggagggagggt

SEQ ID NO: 247841 - DNA, 20 bp, human
gccgggagctgggggtagac

SEQ ID NO: 247842 - DNA, 20 bp, human
gcatctcccccccaagtccg

SEQ ID NO: 247843 - DNA, 20 bp, human
ggcgccggcgcctctcggag

SEQ ID NO: 247844 - DNA, 20 bp, human
gatatctggcgatggagcgg

SEQ ID NO: 247845 - DNA, 20 bp, human
ggacaggtgcaagcgggggt

SEQ ID NO: 247846 - DNA, 20 bp, human
gaatagagcagctgtgtgac

SEQ ID NO: 247847 - DNA, 20 bp, human
gcactgggggcaacccttcc

SEQ ID NO: 247848 - DNA, 20 bp, human
gtgtagggatctccagcagc

SEQ ID NO: 247849 - DNA, 20 bp, human
gtacagagagcttccactgg

SEQ ID NO: 247850 - DNA, 20 bp, human
gccctacagagagcttccac

SEQ ID NO: 247851 - DNA, 20 bp, human
ggtcagttccagccacgcaa

SEQ ID NO: 247852 - DNA, 20 bp, human
gctggacccagattttgccc

SEQ ID NO: 247853 - DNA, 20 bp, human
ggacttcaatgatgtcaatg

SEQ ID NO: 247854 - DNA, 20 bp, human
gaatctaccccttgcgtggc

SEQ ID NO: 247855 - DNA, 20 bp, human
gtggttagaaatcgctgtgg

SEQ ID NO: 247856 - DNA, 20 bp, human
ggtagccgacaccacgtccc

SEQ ID NO: 247857 - DNA, 20 bp, human
gtcggcgtaacggcactaag

SEQ ID NO: 247858 - DNA, 20 bp, human
ggtaacggcactaaggggcg

SEQ ID NO: 247859 - DNA, 20 bp, human
gcagtggccgaagtggaagt

SEQ ID NO: 247860 - DNA, 20 bp, human
ggggtcggggacggaaaaga

SEQ ID NO: 247861 - DNA, 20 bp, human
gacaccacgtccccggctag

SEQ ID NO: 247862 - DNA, 20 bp, human
gcccgccccctgggccgctt

SEQ ID NO: 247863 - DNA, 20 bp, human
ggaagtggaagtcggcgtaa

SEQ ID NO: 247864 - DNA, 20 bp, human
ggcggggccgaagcggccca

SEQ ID NO: 247865 - DNA, 20 bp, human
gcaaaatccaagcgcttcgg

SEQ ID NO: 247866 - DNA, 20 bp, human
gaaatggcgcggtgtacgat

SEQ ID NO: 247867 - DNA, 20 bp, human
gagcaccgacggtaggaaga

SEQ ID NO: 247868 - DNA, 20 bp, human
ggcctgtgctgacggaaatg

SEQ ID NO: 247869 - DNA, 20 bp, human
gggcgacaaaaaagagaagt

SEQ ID NO: 247870 - DNA, 20 bp, human
gagcgtggatgttaactcgc

SEQ ID NO: 247871 - DNA, 20 bp, human
gtggcagcctagtagtgttc

SEQ ID NO: 247872 - DNA, 20 bp, human
ggagtcaaagtagtcgatcc

SEQ ID NO: 247873 - DNA, 20 bp, human
gaccgtcggtgctcgggaag

SEQ ID NO: 247874 - DNA, 20 bp, human
gtaacatccacgctgctcac

SEQ ID NO: 247875 - DNA, 20 bp, human
gtcctcatttccgtcagcac

SEQ ID NO: 247876 - DNA, 20 bp, human
gacagcaaaggcctcgacag

SEQ ID NO: 247877 - DNA, 20 bp, human
gtcgcggaacgatgacgtac

SEQ ID NO: 247878 - DNA, 20 bp, human
ggcaacacagccgtgggcac

SEQ ID NO: 247879 - DNA, 20 bp, human
gaacgatgacgtacagggct

SEQ ID NO: 247880 - DNA, 20 bp, human
gcggtcgcgctttgtgacgt

SEQ ID NO: 247881 - DNA, 20 bp, human
gacagagagtctgggacatc

SEQ ID NO: 247882 - DNA, 20 bp, human
ggcagattttgcaaaggtcc

SEQ ID NO: 247883 - DNA, 20 bp, human
ggggcgtcatctcaccgcgt

SEQ ID NO: 247884 - DNA, 20 bp, human
gcggtgagatgacgccctcc

SEQ ID NO: 247885 - DNA, 20 bp, human
gctagaggtcacttccggga

SEQ ID NO: 247886 - DNA, 20 bp, human
gcgcagcagcaccctcgcta

SEQ ID NO: 247887 - DNA, 20 bp, human
gccctcgctacggtcgggaa

SEQ ID NO: 247888 - DNA, 20 bp, human
gacggcagaaccagtagatg

SEQ ID NO: 247889 - DNA, 20 bp, human
gcctccaaaactatcagtaa

SEQ ID NO: 247890 - DNA, 20 bp, human
gtagatgcggatgcagtttc

SEQ ID NO: 247891 - DNA, 20 bp, human
gcgcaagggagggtagggta

SEQ ID NO: 247892 - DNA, 20 bp, human
gcagcaccctcgctacggtc

SEQ ID NO: 247893 - DNA, 20 bp, human
ggcaccgctaaccctgagaa

SEQ ID NO: 247894 - DNA, 20 bp, human
gcctccgcctaaatccccat

SEQ ID NO: 247895 - DNA, 20 bp, human
gagggacacttcataagtgt

SEQ ID NO: 247896 - DNA, 20 bp, human
gagaggcttctgtccctcgg

SEQ ID NO: 247897 - DNA, 20 bp, human
gagggaaagggaggaacgaa

SEQ ID NO: 247898 - DNA, 20 bp, human
gtacttacggagaccgccga

SEQ ID NO: 247899 - DNA, 20 bp, human
gtgaaccgttattggctgga

SEQ ID NO: 247900 - DNA, 20 bp, human
ggaaagagaaagtgaccgaa

SEQ ID NO: 247901 - DNA, 20 bp, human
gtaagtaagtgaaccgttat

SEQ ID NO: 247902 - DNA, 20 bp, human
gagcacttgaagcgaatgaa

SEQ ID NO: 247903 - DNA, 20 bp, human
ggcctcaaggaagaatcaag

SEQ ID NO: 247904 - DNA, 20 bp, human
gtaagtgaaccgttattggc

SEQ ID NO: 247905 - DNA, 20 bp, human
gccactagaccgatatggtt

SEQ ID NO: 247906 - DNA, 20 bp, human
ggagcacggctccaccaaca

SEQ ID NO: 247907 - DNA, 20 bp, human
ggcacatctgaggtcgctta

SEQ ID NO: 247908 - DNA, 20 bp, human
gcagggcatgcgcacatctg

SEQ ID NO: 247909 - DNA, 20 bp, human
gttaaagacccgaagggtgt

SEQ ID NO: 247910 - DNA, 20 bp, human
gtctgaggtcgcttagggct

SEQ ID NO: 247911 - DNA, 20 bp, human
gggacttccggacccgagga

SEQ ID NO: 247912 - DNA, 20 bp, human
gaagacccgaagggtgttgg

SEQ ID NO: 247913 - DNA, 20 bp, human
gtaaaccctccaacaccctt

SEQ ID NO: 247914 - DNA, 20 bp, human
gacaaacaaaccgggacttc

SEQ ID NO: 247915 - DNA, 20 bp, human
gcagattttaaagacccgaa

SEQ ID NO: 247916 - DNA, 20 bp, human
gaggcaaaggcggggaccag

SEQ ID NO: 247917 - DNA, 20 bp, human
ggtgcaggggacatgcgtct

SEQ ID NO: 247918 - DNA, 20 bp, human
gtcctcgcagagcaccccgt

SEQ ID NO: 247919 - DNA, 20 bp, human
ggaccgctggagacccagat

SEQ ID NO: 247920 - DNA, 20 bp, human
gcggcacccttggccggtgc

SEQ ID NO: 247921 - DNA, 20 bp, human
gcgcgccaaggaggcaaagg

SEQ ID NO: 247922 - DNA, 20 bp, human
ggaggcggcgcaacgcgcac

SEQ ID NO: 247923 - DNA, 20 bp, human
ggcatccccggggttgcttc

SEQ ID NO: 247924 - DNA, 20 bp, human
gtggtcccctaaggcttcca

SEQ ID NO: 247925 - DNA, 20 bp, human
gaggcggggaccagaggcgc

SEQ ID NO: 247926 - DNA, 20 bp, human
gggccccaggccagatccta

SEQ ID NO: 247927 - DNA, 20 bp, human
ggggaacatgccctaggatc

SEQ ID NO: 247928 - DNA, 20 bp, human
gtgcagccgctggattcctc

SEQ ID NO: 247929 - DNA, 20 bp, human
ggaatccagcggctgcacac

SEQ ID NO: 247930 - DNA, 20 bp, human
gtgttgccaaggaaccaagc

SEQ ID NO: 247931 - DNA, 20 bp, human
gcaagccggctttgtgtccc

SEQ ID NO: 247932 - DNA, 20 bp, human
gtggggcccttgatcctaag

SEQ ID NO: 247933 - DNA, 20 bp, human
gaggccgtggaatagagagc

SEQ ID NO: 247934 - DNA, 20 bp, human
gcgccccgctctctattcca

SEQ ID NO: 247935 - DNA, 20 bp, human
gtgggcctgcctgggtacaa

SEQ ID NO: 247936 - DNA, 20 bp, human
gtcgtgggcagggaagctga

SEQ ID NO: 247937 - DNA, 20 bp, human
gactctgggctccctctcgt

SEQ ID NO: 247938 - DNA, 20 bp, human
ggtggaggccagctgccaac

SEQ ID NO: 247939 - DNA, 20 bp, human
ggaggccagctgccaacagg

SEQ ID NO: 247940 - DNA, 20 bp, human
ggggcctgactttataaacc

SEQ ID NO: 247941 - DNA, 20 bp, human
gagcttccctgcccacgaga

SEQ ID NO: 247942 - DNA, 20 bp, human
gctggaagatctaaacctca

SEQ ID NO: 247943 - DNA, 20 bp, human
ggccacttaccccaacctgg

SEQ ID NO: 247944 - DNA, 20 bp, human
ggggctccctctcgtgggca

SEQ ID NO: 247945 - DNA, 20 bp, human
gcagtcagctctcattaatg

SEQ ID NO: 247946 - DNA, 20 bp, human
gcccctggggcaaaccgcga

SEQ ID NO: 247947 - DNA, 20 bp, human
gtcccggcgcgcggcgtcgt

SEQ ID NO: 247948 - DNA, 20 bp, human
gccggcttctccagccgcgt

SEQ ID NO: 247949 - DNA, 20 bp, human
gcgaggcgctcttctgtccc

SEQ ID NO: 247950 - DNA, 20 bp, human
gcaaaccgcgaggggtggga

SEQ ID NO: 247951 - DNA, 20 bp, human
gccaggggccgccactaggg

SEQ ID NO: 247952 - DNA, 20 bp, human
ggaggctgagagttcggcgc

SEQ ID NO: 247953 - DNA, 20 bp, human
gttgccaaggcaaccccacg

SEQ ID NO: 247954 - DNA, 20 bp, human
gtgagagttcggcgccggga

SEQ ID NO: 247955 - DNA, 20 bp, human
ggacagaagagcgcctcgcc

SEQ ID NO: 247956 - DNA, 20 bp, human
gccccagggtggagcgcttg

SEQ ID NO: 247957 - DNA, 20 bp, human
gggtggagcgcttggggtgc

SEQ ID NO: 247958 - DNA, 20 bp, human
ggaggcgcgggctgcatcag

SEQ ID NO: 247959 - DNA, 20 bp, human
gaccccaagcgctccaccct

SEQ ID NO: 247960 - DNA, 20 bp, human
gcagcccccctccagggatc

SEQ ID NO: 247961 - DNA, 20 bp, human
gtccacaggagttactctga

SEQ ID NO: 247962 - DNA, 20 bp, human
gtactctgaagggcgaggcg

SEQ ID NO: 247963 - DNA, 20 bp, human
gctggtgatcccagtgtgtg

SEQ ID NO: 247964 - DNA, 20 bp, human
gtaacaaggtgctgggagat

SEQ ID NO: 247965 - DNA, 20 bp, human
gacctgagaggtgggatctt

SEQ ID NO: 247966 - DNA, 20 bp, human
gtcccatgttgcagactcga

SEQ ID NO: 247967 - DNA, 20 bp, human
ggggaaattccgtaacttgg

SEQ ID NO: 247968 - DNA, 20 bp, human
gtgcaacatgggacttcccc

SEQ ID NO: 247969 - DNA, 20 bp, human
gaaaacctgctggctgttcc

SEQ ID NO: 247970 - DNA, 20 bp, human
gttccccaggaacagccagc

SEQ ID NO: 247971 - DNA, 20 bp, human
gcccttatccaatcagaatt

SEQ ID NO: 247972 - DNA, 20 bp, human
gttgacttagcaaaacctgc

SEQ ID NO: 247973 - DNA, 20 bp, human
gagagggaaattccgtaact

SEQ ID NO: 247974 - DNA, 20 bp, human
gttccctccctaattctgat

SEQ ID NO: 247975 - DNA, 20 bp, human
gtattgtagcctccaagtta

SEQ ID NO: 247976 - DNA, 20 bp, human
gaacactactgcaaatagga

SEQ ID NO: 247977 - DNA, 20 bp, human
gagaaggctggttaccatct

SEQ ID NO: 247978 - DNA, 20 bp, human
gtgtgccataaaaggattgc

SEQ ID NO: 247979 - DNA, 20 bp, human
gatggtaaccagccttctta

SEQ ID NO: 247980 - DNA, 20 bp, human
gagcactgtgaaaacccaga

SEQ ID NO: 247981 - DNA, 20 bp, human
ggaaattcctgtgccataaa

SEQ ID NO: 247982 - DNA, 20 bp, human
gaacagaaactcttggaagc

SEQ ID NO: 247983 - DNA, 20 bp, human
gtacaccagcaatcctttta

SEQ ID NO: 247984 - DNA, 20 bp, human
gaaagctaccttaagaaggc

SEQ ID NO: 247985 - DNA, 20 bp, human
gcaaactcttataatagata

SEQ ID NO: 247986 - DNA, 20 bp, human
gtgcgcctcgggagcacaga

SEQ ID NO: 247987 - DNA, 20 bp, human
gcctccagccggcgtcgctc

SEQ ID NO: 247988 - DNA, 20 bp, human
gccagcggtgcggggcccag

SEQ ID NO: 247989 - DNA, 20 bp, human
gccggagcgcactgcgcctc

SEQ ID NO: 247990 - DNA, 20 bp, human
gtgacgcgcgactccctcgg

SEQ ID NO: 247991 - DNA, 20 bp, human
gggcccagcggagcctgaga

SEQ ID NO: 247992 - DNA, 20 bp, human
gcgctccctctgtgctcccg

SEQ ID NO: 247993 - DNA, 20 bp, human
gaggaccttaggcgtaaagt

SEQ ID NO: 247994 - DNA, 20 bp, human
ggctcggctggtggcgccgt

SEQ ID NO: 247995 - DNA, 20 bp, human
gcgggcccggagccgagtgc

SEQ ID NO: 247996 - DNA, 20 bp, human
gtagacttggtatgtctctg

SEQ ID NO: 247997 - DNA, 20 bp, human
gtatctctaacttcagactg

SEQ ID NO: 247998 - DNA, 20 bp, human
gcatgctaggaacagaactt

SEQ ID NO: 247999 - DNA, 20 bp, human
gactgctataaatattctgc

SEQ ID NO: 248000 - DNA, 20 bp, human
gctgggaccctgaaatgctc

SEQ ID NO: 248001 - DNA, 20 bp, human
gggattggacaagttgacga

SEQ ID NO: 248002 - DNA, 20 bp, human
gacattaccctgagcatttc

SEQ ID NO: 248003 - DNA, 20 bp, human
gaactttggattctcttgat

SEQ ID NO: 248004 - DNA, 20 bp, human
gattttacaagggtgacaac

SEQ ID NO: 248005 - DNA, 20 bp, human
gcctacatgttgaagagaga

SEQ ID NO: 248006 - DNA, 20 bp, human
gaaaggacccgctatcgcag

SEQ ID NO: 248007 - DNA, 20 bp, human
gtgtgtgagcgagagggtag

SEQ ID NO: 248008 - DNA, 20 bp, human
ggcgtgttgtgtgagcgaga

SEQ ID NO: 248009 - DNA, 20 bp, human
gtgggtgtgcaagtgtgcga

SEQ ID NO: 248010 - DNA, 20 bp, human
gtgtgcgccgctgcgatagc

SEQ ID NO: 248011 - DNA, 20 bp, human
ggggagcccagacggtggag

SEQ ID NO: 248012 - DNA, 20 bp, human
gtgtgtgcgcgctgtggtat

SEQ ID NO: 248013 - DNA, 20 bp, human
ggtgtgcaagtgtgcgaagg

SEQ ID NO: 248014 - DNA, 20 bp, human
gcctttcccggggcgggcga

SEQ ID NO: 248015 - DNA, 20 bp, human
ggcgatagcgggtcctttcc

SEQ ID NO: 248016 - DNA, 20 bp, human
gtggtggcggctgcaggtac

SEQ ID NO: 248017 - DNA, 20 bp, human
gcgggtgcggttgtgacgtc

SEQ ID NO: 248018 - DNA, 20 bp, human
ggggctaatcctatcgggaa

SEQ ID NO: 248019 - DNA, 20 bp, human
gtggcggctgcaggtaccgg

SEQ ID NO: 248020 - DNA, 20 bp, human
ggggctgcccgagccctcgc

SEQ ID NO: 248021 - DNA, 20 bp, human
gggaagtgaaagtgcctcgg

SEQ ID NO: 248022 - DNA, 20 bp, human
gggaggggctaggtctaccg

SEQ ID NO: 248023 - DNA, 20 bp, human
gcccgggctcggtgcgtccg

SEQ ID NO: 248024 - DNA, 20 bp, human
gtcccgcggcgcccggatcg

SEQ ID NO: 248025 - DNA, 20 bp, human
gagccgccaccacttttcga

SEQ ID NO: 248026 - DNA, 20 bp, human
gtgctttatgggaatctggg

SEQ ID NO: 248027 - DNA, 20 bp, human
gttgagggcgagaacaggtg

SEQ ID NO: 248028 - DNA, 20 bp, human
ggactaaagcatagaccacc

SEQ ID NO: 248029 - DNA, 20 bp, human
gcgccctcaaatgggaacgc

SEQ ID NO: 248030 - DNA, 20 bp, human
gaggccagcgttcccatttg

SEQ ID NO: 248031 - DNA, 20 bp, human
gtggtctatgctttagtccc

SEQ ID NO: 248032 - DNA, 20 bp, human
gggtagaagagactttgaca

SEQ ID NO: 248033 - DNA, 20 bp, human
gcctgttctcgccctcaaat

SEQ ID NO: 248034 - DNA, 20 bp, human
ggccaaatattcagatagag

SEQ ID NO: 248035 - DNA, 20 bp, human
gccctctctatctgaatatt

SEQ ID NO: 248036 - DNA, 20 bp, human
gctcccgctccagggattcg

SEQ ID NO: 248037 - DNA, 20 bp, human
gggcactcacgagtgacgtc

SEQ ID NO: 248038 - DNA, 20 bp, human
gggctctcgctcccgctcca

SEQ ID NO: 248039 - DNA, 20 bp, human
gggcgatggccccgcctctg

SEQ ID NO: 248040 - DNA, 20 bp, human
gggtccctacgtgggtctaa

SEQ ID NO: 248041 - DNA, 20 bp, human
gtacgcaagacagtcagacc

SEQ ID NO: 248042 - DNA, 20 bp, human
gcgtaactcccgccaactgt

SEQ ID NO: 248043 - DNA, 20 bp, human
ggatggccccgcctctgggg

SEQ ID NO: 248044 - DNA, 20 bp, human
ggacccacgacgcactgcac

SEQ ID NO: 248045 - DNA, 20 bp, human
ggagaacatcccacagttgg

SEQ ID NO: 248046 - DNA, 20 bp, human
gaggcgtaggcgtcaccagt

SEQ ID NO: 248047 - DNA, 20 bp, human
ggtggagtcggatacgggta

SEQ ID NO: 248048 - DNA, 20 bp, human
gcccgcccccggggtggagt

SEQ ID NO: 248049 - DNA, 20 bp, human
gcccggggtggagtcggata

SEQ ID NO: 248050 - DNA, 20 bp, human
ggatccggagtcccgaagga

SEQ ID NO: 248051 - DNA, 20 bp, human
gtgcacgggggttactctgg

SEQ ID NO: 248052 - DNA, 20 bp, human
ggaccccccgcgtacggggt

SEQ ID NO: 248053 - DNA, 20 bp, human
gagtaacccccgtgcactct

SEQ ID NO: 248054 - DNA, 20 bp, human
gcgggaagctgtgcgagaag

SEQ ID NO: 248055 - DNA, 20 bp, human
gaaagtcccagagtgcacgg

SEQ ID NO: 248056 - DNA, 20 bp, human
gacaacgtccctctcggtag

SEQ ID NO: 248057 - DNA, 20 bp, human
gggggccagacaatgggaac

SEQ ID NO: 248058 - DNA, 20 bp, human
ggggaggggggccagacaat

SEQ ID NO: 248059 - DNA, 20 bp, human
gacgttgtaaccctgctccg

SEQ ID NO: 248060 - DNA, 20 bp, human
gcccaccagttcccattgtc

SEQ ID NO: 248061 - DNA, 20 bp, human
gtgcgtgcacctctaccgag

SEQ ID NO: 248062 - DNA, 20 bp, human
gtaaccctgctccgcggtgg

SEQ ID NO: 248063 - DNA, 20 bp, human
gagggttacaacgtccctct

SEQ ID NO: 248064 - DNA, 20 bp, human
gcgctctggcacaggccatg

SEQ ID NO: 248065 - DNA, 20 bp, human
gagggatgccggcttttctg

SEQ ID NO: 248066 - DNA, 20 bp, human
ggagctgcctgctcccttaa

SEQ ID NO: 248067 - DNA, 20 bp, human
gcgggaggatgggaattggt

SEQ ID NO: 248068 - DNA, 20 bp, human
ggctaacccctcaagcccag

SEQ ID NO: 248069 - DNA, 20 bp, human
gtcctcccccttaagggagc

SEQ ID NO: 248070 - DNA, 20 bp, human
gtagccccgccccgcggtgg

SEQ ID NO: 248071 - DNA, 20 bp, human
gaaaatgtcctcccccttaa

SEQ ID NO: 248072 - DNA, 20 bp, human
gcagcagggtctcatcccct

SEQ ID NO: 248073 - DNA, 20 bp, human
gagatgctcctcctctccaa

SEQ ID NO: 248074 - DNA, 20 bp, human
ggagggatgaatgcagataa

SEQ ID NO: 248075 - DNA, 20 bp, human
gcttgaggggttagcgaggc

SEQ ID NO: 248076 - DNA, 20 bp, human
gaccctagtctcagatccaa

SEQ ID NO: 248077 - DNA, 20 bp, human
gtcccttggatctgagacta

SEQ ID NO: 248078 - DNA, 20 bp, human
gaatgggtggtttatagtaa

SEQ ID NO: 248079 - DNA, 20 bp, human
ggcaactgtgaatgtgccaa

SEQ ID NO: 248080 - DNA, 20 bp, human
gtagcaacactgatagcctt

SEQ ID NO: 248081 - DNA, 20 bp, human
gttctctcctaaactctgat

SEQ ID NO: 248082 - DNA, 20 bp, human
gaccacaaacttgattgtgc

SEQ ID NO: 248083 - DNA, 20 bp, human
gacaaacttgattgtgctgg

SEQ ID NO: 248084 - DNA, 20 bp, human
gaatatgccataaatagtaa

SEQ ID NO: 248085 - DNA, 20 bp, human
gaccacccatttatgtgaaa

SEQ ID NO: 248086 - DNA, 20 bp, human
gggtgtgaagctggggttga

SEQ ID NO: 248087 - DNA, 20 bp, human
gccaaatgtagacatgggtg

SEQ ID NO: 248088 - DNA, 20 bp, human
ggcccccaagtccctcctat

SEQ ID NO: 248089 - DNA, 20 bp, human
gcacacctgggacccccact

SEQ ID NO: 248090 - DNA, 20 bp, human
ggacatgggtggggctcaga

SEQ ID NO: 248091 - DNA, 20 bp, human
gcttccccaaatgtagacat

SEQ ID NO: 248092 - DNA, 20 bp, human
gagggtccatatgaccaagt

SEQ ID NO: 248093 - DNA, 20 bp, human
ggggcaatccagtgggaaag

SEQ ID NO: 248094 - DNA, 20 bp, human
gttcagaaggagtcccccat

SEQ ID NO: 248095 - DNA, 20 bp, human
ggaagaacagtttaagtcaa

SEQ ID NO: 248096 - DNA, 20 bp, human
gcagacaagtccgttggcgg

SEQ ID NO: 248097 - DNA, 20 bp, human
gaatccccgcacctgactgt

SEQ ID NO: 248098 - DNA, 20 bp, human
gagcagctgtggtggctgaa

SEQ ID NO: 248099 - DNA, 20 bp, human
gggtcccacagtcaggtgcg

SEQ ID NO: 248100 - DNA, 20 bp, human
gcactctgaccccggaaaga

SEQ ID NO: 248101 - DNA, 20 bp, human
gagagaaagcaggatcctca

SEQ ID NO: 248102 - DNA, 20 bp, human
gggatcctcaaggaccagag

SEQ ID NO: 248103 - DNA, 20 bp, human
gggcagtgggtcccacagtc

SEQ ID NO: 248104 - DNA, 20 bp, human
ggcatcccagcccccgccaa

SEQ ID NO: 248105 - DNA, 20 bp, human
gtgaagggtgctaggacaga

SEQ ID NO: 248106 - DNA, 20 bp, human
ggcaaccctactgcctgcac

SEQ ID NO: 248107 - DNA, 20 bp, human
gcctaccagtgcaggcagta

SEQ ID NO: 248108 - DNA, 20 bp, human
gcccagtcacggaaactctg

SEQ ID NO: 248109 - DNA, 20 bp, human
gccagacctccctaaacctc

SEQ ID NO: 248110 - DNA, 20 bp, human
gagaggtaactccctggaag

SEQ ID NO: 248111 - DNA, 20 bp, human
ggaggagctggctacaagct

SEQ ID NO: 248112 - DNA, 20 bp, human
ggggtcagtgctccatagat

SEQ ID NO: 248113 - DNA, 20 bp, human
gtggaaacctgcagtcacag

SEQ ID NO: 248114 - DNA, 20 bp, human
ggcagaggatgactggctgg

SEQ ID NO: 248115 - DNA, 20 bp, human
gcacaagcaccaaagcagag

SEQ ID NO: 248116 - DNA, 20 bp, human
ggggcagacgcgaggaagga

SEQ ID NO: 248117 - DNA, 20 bp, human
gggaccctgctgtttgcggg

SEQ ID NO: 248118 - DNA, 20 bp, human
ggcctctgggaggtcctgtc

SEQ ID NO: 248119 - DNA, 20 bp, human
gctaggaacgcgtctctctg

SEQ ID NO: 248120 - DNA, 20 bp, human
gaaagcgcggggaatggcgt

SEQ ID NO: 248121 - DNA, 20 bp, human
ggggaggtcctgtccggctc

SEQ ID NO: 248122 - DNA, 20 bp, human
gcgcggcgcatgcgccgctg

SEQ ID NO: 248123 - DNA, 20 bp, human
ggggtggtcggtagtgagtc

SEQ ID NO: 248124 - DNA, 20 bp, human
gcgaccacccgcaaacagca

SEQ ID NO: 248125 - DNA, 20 bp, human
gagtgagtccggagccggac

SEQ ID NO: 248126 - DNA, 20 bp, human
ggtcgcggccctactgcctc

SEQ ID NO: 248127 - DNA, 20 bp, human
gttgactagcactgatgctg

SEQ ID NO: 248128 - DNA, 20 bp, human
gtctctagaggcacctggcg

SEQ ID NO: 248129 - DNA, 20 bp, human
gagctgcgcatcgtctcctg

SEQ ID NO: 248130 - DNA, 20 bp, human
gcctccctatacccccaata

SEQ ID NO: 248131 - DNA, 20 bp, human
gatcgtctcctgaggcagta

SEQ ID NO: 248132 - DNA, 20 bp, human
gactagcactgatgctgtgg

SEQ ID NO: 248133 - DNA, 20 bp, human
ggggcctatgactagtttaa

SEQ ID NO: 248134 - DNA, 20 bp, human
gctagtggtgaggaaaatga

SEQ ID NO: 248135 - DNA, 20 bp, human
gcagcctttaaactagtcat

SEQ ID NO: 248136 - DNA, 20 bp, human
gccgcccctgtgtaacgcgt

SEQ ID NO: 248137 - DNA, 20 bp, human
gagccccaaagcagaatgaa

SEQ ID NO: 248138 - DNA, 20 bp, human
ggatctgaaggacgggagta

SEQ ID NO: 248139 - DNA, 20 bp, human
gtgacccacgcgttacacag

SEQ ID NO: 248140 - DNA, 20 bp, human
gctaaaggggaacaataagg

SEQ ID NO: 248141 - DNA, 20 bp, human
gaatgctgagtccatggtat

SEQ ID NO: 248142 - DNA, 20 bp, human
ggcgttacacaggggcgggt

SEQ ID NO: 248143 - DNA, 20 bp, human
ggtacaaatgccaccatctt

SEQ ID NO: 248144 - DNA, 20 bp, human
gcactcccttcattctgctt

SEQ ID NO: 248145 - DNA, 20 bp, human
gtctggccatccaccgaaga

SEQ ID NO: 248146 - DNA, 20 bp, human
ggcggcgcctgaggggtctt

SEQ ID NO: 248147 - DNA, 20 bp, human
gtatgaggaagtcacgcagt

SEQ ID NO: 248148 - DNA, 20 bp, human
ggatacgataagcaagatgg

SEQ ID NO: 248149 - DNA, 20 bp, human
gggaaagccacattagagcg

SEQ ID NO: 248150 - DNA, 20 bp, human
ggactctactgacaaggtgg

SEQ ID NO: 248151 - DNA, 20 bp, human
gcccggcgaacatatggatt

SEQ ID NO: 248152 - DNA, 20 bp, human
gcctcgacgtacaggcaaca

SEQ ID NO: 248153 - DNA, 20 bp, human
gtagagcgcggccatgttcc

SEQ ID NO: 248154 - DNA, 20 bp, human
gcgtacggactctactgaca

SEQ ID NO: 248155 - DNA, 20 bp, human
ggaatcggattccaagatga

SEQ ID NO: 248156 - DNA, 20 bp, human
gcccccagagagcatccctg

SEQ ID NO: 248157 - DNA, 20 bp, human
gcatccctgtggcagcaccg

SEQ ID NO: 248158 - DNA, 20 bp, human
gaataccaagtgttcagcaa

SEQ ID NO: 248159 - DNA, 20 bp, human
gtacacgcacgggtctgggg

SEQ ID NO: 248160 - DNA, 20 bp, human
gccctgtggcagcaccgtgg

SEQ ID NO: 248161 - DNA, 20 bp, human
gaccaccacggtgctgccac

SEQ ID NO: 248162 - DNA, 20 bp, human
ggaccatgctgttgtcaagg

SEQ ID NO: 248163 - DNA, 20 bp, human
gcccgggcctctacacgcac

SEQ ID NO: 248164 - DNA, 20 bp, human
ggatgcggggacgtttcctt

SEQ ID NO: 248165 - DNA, 20 bp, human
ggttcagcaagggatgagtg

SEQ ID NO: 248166 - DNA, 20 bp, human
ggagccacagagaaaggcga

SEQ ID NO: 248167 - DNA, 20 bp, human
gcctccctcgcctttctctg

SEQ ID NO: 248168 - DNA, 20 bp, human
gaggagggagggcgatccgc

SEQ ID NO: 248169 - DNA, 20 bp, human
gcaggcgagcagggaaaacg

SEQ ID NO: 248170 - DNA, 20 bp, human
gggtgattggcgccgaggtg

SEQ ID NO: 248171 - DNA, 20 bp, human
gtgcgagtgtgcggttgctg

SEQ ID NO: 248172 - DNA, 20 bp, human
gagccgggcgcgaggaggga

SEQ ID NO: 248173 - DNA, 20 bp, human
gggcgatccgcaggcgagca

SEQ ID NO: 248174 - DNA, 20 bp, human
ggtgggggtgattggcgccg

SEQ ID NO: 248175 - DNA, 20 bp, human
ggtggacacctactgatgat

SEQ ID NO: 248176 - DNA, 20 bp, human
gcgccgcggctggcccgagg

SEQ ID NO: 248177 - DNA, 20 bp, human
ggccgtggcccgacacctac

SEQ ID NO: 248178 - DNA, 20 bp, human
gctccctcccagcgcagctc

SEQ ID NO: 248179 - DNA, 20 bp, human
ggaggggagccgaggtggag

SEQ ID NO: 248180 - DNA, 20 bp, human
gagcctgggtggaccgcgtc

SEQ ID NO: 248181 - DNA, 20 bp, human
ggacgactcggagagccggt

SEQ ID NO: 248182 - DNA, 20 bp, human
ggccgcgcaccgaaccccgg

SEQ ID NO: 248183 - DNA, 20 bp, human
gcaagtggcccgagctgcgc

SEQ ID NO: 248184 - DNA, 20 bp, human
gagagcccgcggcgtccaag

SEQ ID NO: 248185 - DNA, 20 bp, human
gagctatgaacgctgcccgg

SEQ ID NO: 248186 - DNA, 20 bp, human
ggggaagaaacaccattctg

SEQ ID NO: 248187 - DNA, 20 bp, human
gggcagtgggaagtcccggg

SEQ ID NO: 248188 - DNA, 20 bp, human
ggtgggaagtcccgggaggt

SEQ ID NO: 248189 - DNA, 20 bp, human
gaagaggcagtgggaagtcc

SEQ ID NO: 248190 - DNA, 20 bp, human
ggccacatcaagccacagaa

SEQ ID NO: 248191 - DNA, 20 bp, human
gaggtttcatttttcgaaaa

SEQ ID NO: 248192 - DNA, 20 bp, human
gagtccgatttgtgctaaag

SEQ ID NO: 248193 - DNA, 20 bp, human
gaagagacagtttcgtagat

SEQ ID NO: 248194 - DNA, 20 bp, human
gaccattctgtggcttgatg

SEQ ID NO: 248195 - DNA, 20 bp, human
gatttgtgctaaagaggcag

SEQ ID NO: 248196 - DNA, 20 bp, human
ggtaactgaaaaacacgctg

SEQ ID NO: 248197 - DNA, 20 bp, human
ggggaggcgccaatgagagc

SEQ ID NO: 248198 - DNA, 20 bp, human
gtgaggtgcctctgacgttt

SEQ ID NO: 248199 - DNA, 20 bp, human
gggtcgtcgacgctaatcct

SEQ ID NO: 248200 - DNA, 20 bp, human
ggccaggccatggcaaagtg

SEQ ID NO: 248201 - DNA, 20 bp, human
gttagcaactcgcgcgggtt

SEQ ID NO: 248202 - DNA, 20 bp, human
gagcgtcgacgaccgtcgct

SEQ ID NO: 248203 - DNA, 20 bp, human
ggcaactcgcgcgggttggg

SEQ ID NO: 248204 - DNA, 20 bp, human
ggtgcccacgtggtctatta

SEQ ID NO: 248205 - DNA, 20 bp, human
gagaataaccctcaggtcac

SEQ ID NO: 248206 - DNA, 20 bp, human
gtggttgctgaactggtctc

SEQ ID NO: 248207 - DNA, 20 bp, human
gggtccccatccaagagctt

SEQ ID NO: 248208 - DNA, 20 bp, human
gagaactcagaagtactgta

SEQ ID NO: 248209 - DNA, 20 bp, human
gttggggcccaaggttccac

SEQ ID NO: 248210 - DNA, 20 bp, human
gtcctcttggtaaggtggga

SEQ ID NO: 248211 - DNA, 20 bp, human
ggatactttggttgctgaac

SEQ ID NO: 248212 - DNA, 20 bp, human
gggtctgtgtcctcttggta

SEQ ID NO: 248213 - DNA, 20 bp, human
gaacgtcctaagctcttgga

SEQ ID NO: 248214 - DNA, 20 bp, human
gaagacctaaagacgtggag

SEQ ID NO: 248215 - DNA, 20 bp, human
gacacagaccagtggaacct

SEQ ID NO: 248216 - DNA, 20 bp, human
gctagctccctgaccaataa

SEQ ID NO: 248217 - DNA, 20 bp, human
gctaggctgaggtctgataa

SEQ ID NO: 248218 - DNA, 20 bp, human
gtggagcagagggatacaat

SEQ ID NO: 248219 - DNA, 20 bp, human
gaggtctgataagggaccag

SEQ ID NO: 248220 - DNA, 20 bp, human
gaatgaaatcacaaagtcta

SEQ ID NO: 248221 - DNA, 20 bp, human
gtccctgaccaataagggcc

SEQ ID NO: 248222 - DNA, 20 bp, human
gcagtgtcatagacatttct

SEQ ID NO: 248223 - DNA, 20 bp, human
ggactgaaccttgattttga

SEQ ID NO: 248224 - DNA, 20 bp, human
gaataagggcctggagcaga

SEQ ID NO: 248225 - DNA, 20 bp, human
gttcacagataatgtaaggc

SEQ ID NO: 248226 - DNA, 20 bp, human
gagaataaatatcgatgtgc

SEQ ID NO: 248227 - DNA, 20 bp, human
gaacaaatatgactttccac

SEQ ID NO: 248228 - DNA, 20 bp, human
gtgaattacatatgaattct

SEQ ID NO: 248229 - DNA, 20 bp, human
gatttccaaggaatcaccag

SEQ ID NO: 248230 - DNA, 20 bp, human
gcgccatttttttaagcctg

SEQ ID NO: 248231 - DNA, 20 bp, human
gcaatactgcgcttttccac

SEQ ID NO: 248232 - DNA, 20 bp, human
gcgatgtgctggagccaaga

SEQ ID NO: 248233 - DNA, 20 bp, human
gctttccactggtgattcct

SEQ ID NO: 248234 - DNA, 20 bp, human
gatttttaattgtatttcca

SEQ ID NO: 248235 - DNA, 20 bp, human
gtaggaccctccgagccagg

SEQ ID NO: 248236 - DNA, 20 bp, human
ggaggagcttggggctaatg

SEQ ID NO: 248237 - DNA, 20 bp, human
gaagcagccacccccggcaa

SEQ ID NO: 248238 - DNA, 20 bp, human
gagcttggggctaatgaggc

SEQ ID NO: 248239 - DNA, 20 bp, human
ggggcaggaaaggtccatgc

SEQ ID NO: 248240 - DNA, 20 bp, human
gtgaggatgctgaggagctt

SEQ ID NO: 248241 - DNA, 20 bp, human
gccaaagaggaagctgtcag

SEQ ID NO: 248242 - DNA, 20 bp, human
gtcgctggcagatttcggga

SEQ ID NO: 248243 - DNA, 20 bp, human
gggggctcgctggcagattt

SEQ ID NO: 248244 - DNA, 20 bp, human
gcctcccaggtttctctttg

SEQ ID NO: 248245 - DNA, 20 bp, human
gcatcctcaaagagaaacct

SEQ ID NO: 248246 - DNA, 20 bp, human
gtgccccgccccgggatcgg

SEQ ID NO: 248247 - DNA, 20 bp, human
gcggggcatcttgacttccg

SEQ ID NO: 248248 - DNA, 20 bp, human
ggtcagacgtcacccaagtg

SEQ ID NO: 248249 - DNA, 20 bp, human
ggggtggagccgacgtgccc

SEQ ID NO: 248250 - DNA, 20 bp, human
ggcgcggtgccaccgatccc

SEQ ID NO: 248251 - DNA, 20 bp, human
gggtgccaccgatcccgggg

SEQ ID NO: 248252 - DNA, 20 bp, human
ggctgcctcgggtacttccc

SEQ ID NO: 248253 - DNA, 20 bp, human
gcaacctcctggttccaagt

SEQ ID NO: 248254 - DNA, 20 bp, human
gaagtcaagatgccccgccc

SEQ ID NO: 248255 - DNA, 20 bp, human
gcttgacttccggggcacgt

SEQ ID NO: 248256 - DNA, 20 bp, human
ggggactgacagaaacaatt

SEQ ID NO: 248257 - DNA, 20 bp, human
gtagcagccagggcgtgcgt

SEQ ID NO: 248258 - DNA, 20 bp, human
gtaagtggaagggtgggacg

SEQ ID NO: 248259 - DNA, 20 bp, human
gggccaggggacctcgagac

SEQ ID NO: 248260 - DNA, 20 bp, human
ggacgggagctgtatgaaag

SEQ ID NO: 248261 - DNA, 20 bp, human
gggggctgagataagaggcg

SEQ ID NO: 248262 - DNA, 20 bp, human
gtgcacaccacgcacgtacg

SEQ ID NO: 248263 - DNA, 20 bp, human
ggactcttgagaatcagcag

SEQ ID NO: 248264 - DNA, 20 bp, human
gcacgcacctacgcacgccc

SEQ ID NO: 248265 - DNA, 20 bp, human
gggagctgggagaaaccgct

SEQ ID NO: 248266 - DNA, 20 bp, human
gtataggcgtggctgaatac

SEQ ID NO: 248267 - DNA, 20 bp, human
gaggccggggagctcgagac

SEQ ID NO: 248268 - DNA, 20 bp, human
ggcgtggcttcgtgaatacg

SEQ ID NO: 248269 - DNA, 20 bp, human
gggatggggcggggactcga

SEQ ID NO: 248270 - DNA, 20 bp, human
gtccccggccttgtcctggt

SEQ ID NO: 248271 - DNA, 20 bp, human
ggctggcgcgggacaggatc

SEQ ID NO: 248272 - DNA, 20 bp, human
ggggagtgaggaaaccgctg

SEQ ID NO: 248273 - DNA, 20 bp, human
ggaactgggagaaaccaatg

SEQ ID NO: 248274 - DNA, 20 bp, human
ggagctccccggccttgtcc

SEQ ID NO: 248275 - DNA, 20 bp, human
gagtgaggaaaccgctgggg

SEQ ID NO: 248276 - DNA, 20 bp, human
gctgacgagcgcatgctcag

SEQ ID NO: 248277 - DNA, 20 bp, human
gccactgcacgcccattggt

SEQ ID NO: 248278 - DNA, 20 bp, human
gaagctgggagctcctttgg

SEQ ID NO: 248279 - DNA, 20 bp, human
gccacccactgcacgcccat

SEQ ID NO: 248280 - DNA, 20 bp, human
gctactaaaaggcgatgggt

SEQ ID NO: 248281 - DNA, 20 bp, human
gggttcttgtggctactaaa

SEQ ID NO: 248282 - DNA, 20 bp, human
gtgtggctactaaaaggcga

SEQ ID NO: 248283 - DNA, 20 bp, human
gctgaggggggctcactaac

SEQ ID NO: 248284 - DNA, 20 bp, human
gagaagtcagcggagaagct

SEQ ID NO: 248285 - DNA, 20 bp, human
gggtgtccctgactctcctg

SEQ ID NO: 248286 - DNA, 20 bp, human
ggagaagggcctactcactt

SEQ ID NO: 248287 - DNA, 20 bp, human
gtggggggaggagggtaaag

SEQ ID NO: 248288 - DNA, 20 bp, human
ggaggagggtaaagagggag

SEQ ID NO: 248289 - DNA, 20 bp, human
ggtgggttgggcaacagcta

SEQ ID NO: 248290 - DNA, 20 bp, human
ggggatactgagatagcccg

SEQ ID NO: 248291 - DNA, 20 bp, human
gccggggccgcctgccaggt

SEQ ID NO: 248292 - DNA, 20 bp, human
ggggtgatgccttaaagtgt

SEQ ID NO: 248293 - DNA, 20 bp, human
ggccagccagggaaaacact

SEQ ID NO: 248294 - DNA, 20 bp, human
gagtgtgggctgcaaagctg

SEQ ID NO: 248295 - DNA, 20 bp, human
gagctagggaaggaggaatc

SEQ ID NO: 248296 - DNA, 20 bp, human
gaaccagcacgccctttgtg

SEQ ID NO: 248297 - DNA, 20 bp, human
gctgtaaggtggggattaag

SEQ ID NO: 248298 - DNA, 20 bp, human
gcggccagaggcagaaggac

SEQ ID NO: 248299 - DNA, 20 bp, human
ggtgcccggccagaggcaga

SEQ ID NO: 248300 - DNA, 20 bp, human
gaagaggtgatcgagagcta

SEQ ID NO: 248301 - DNA, 20 bp, human
gtgcacagaggaggtctcat

SEQ ID NO: 248302 - DNA, 20 bp, human
gtgcgctctggtcgggtctt

SEQ ID NO: 248303 - DNA, 20 bp, human
gtcccccagctcatcagctt

SEQ ID NO: 248304 - DNA, 20 bp, human
gcagacggggaccaatgaga

SEQ ID NO: 248305 - DNA, 20 bp, human
gcagaaggacaggaagaaag

SEQ ID NO: 248306 - DNA, 20 bp, human
ggagaagggcctactcactt

SEQ ID NO: 248307 - DNA, 20 bp, human
gtggggggaggagggtaaag

SEQ ID NO: 248308 - DNA, 20 bp, human
ggaggagggtaaagagggag

SEQ ID NO: 248309 - DNA, 20 bp, human
ggtgggttgggcaacagcta

SEQ ID NO: 248310 - DNA, 20 bp, human
ggggatactgagatagcccg

SEQ ID NO: 248311 - DNA, 20 bp, human
ggggtgatgccttaaagtgt

SEQ ID NO: 248312 - DNA, 20 bp, human
ggccagccagggaaaacact

SEQ ID NO: 248313 - DNA, 20 bp, human
gagtgtgggctgcaaagctg

SEQ ID NO: 248314 - DNA, 20 bp, human
gccggggccgcctgccaggt

SEQ ID NO: 248315 - DNA, 20 bp, human
gctggcctgaggctgactga

SEQ ID NO: 248316 - DNA, 20 bp, human
gaaccagcacgccctttgtg

SEQ ID NO: 248317 - DNA, 20 bp, human
gtgcacagaggaggtctcat

SEQ ID NO: 248318 - DNA, 20 bp, human
gctgtaaggtggggattaag

SEQ ID NO: 248319 - DNA, 20 bp, human
gcggccagaggcagaaggac

SEQ ID NO: 248320 - DNA, 20 bp, human
gaggcacctcgccccacaaa

SEQ ID NO: 248321 - DNA, 20 bp, human
gcagacggggaccaatgaga

SEQ ID NO: 248322 - DNA, 20 bp, human
ggtgcccggccagaggcaga

SEQ ID NO: 248323 - DNA, 20 bp, human
gtcccccagctcatcagctt

SEQ ID NO: 248324 - DNA, 20 bp, human
gtgcgctctggtcgggtctt

SEQ ID NO: 248325 - DNA, 20 bp, human
gcggcgccgagccttctcat

SEQ ID NO: 248326 - DNA, 20 bp, human
gggctgtctttcaatgtcag

SEQ ID NO: 248327 - DNA, 20 bp, human
gtctttcaatgtcagtggag

SEQ ID NO: 248328 - DNA, 20 bp, human
gaatcccactaaaaacaata

SEQ ID NO: 248329 - DNA, 20 bp, human
gcagccatattgtttttagt

SEQ ID NO: 248330 - DNA, 20 bp, human
gttgtttttagtgggatttt

SEQ ID NO: 248331 - DNA, 20 bp, human
gtgctgggaggggtatacat

SEQ ID NO: 248332 - DNA, 20 bp, human
gaggggtggtagttcatgat

SEQ ID NO: 248333 - DNA, 20 bp, human
ggcccagccaatgagagcta

SEQ ID NO: 248334 - DNA, 20 bp, human
ggtcacttctatgtgagaga

SEQ ID NO: 248335 - DNA, 20 bp, human
gagaggggtggggaggtacc

SEQ ID NO: 248336 - DNA, 20 bp, human
gaatcccactaaaaacaata

SEQ ID NO: 248337 - DNA, 20 bp, human
gggctgtctttcaatgtcag

SEQ ID NO: 248338 - DNA, 20 bp, human
gtctttcaatgtcagtggag

SEQ ID NO: 248339 - DNA, 20 bp, human
gcagccatattgtttttagt

SEQ ID NO: 248340 - DNA, 20 bp, human
gttgtttttagtgggatttt

SEQ ID NO: 248341 - DNA, 20 bp, human
gtgctgggaggggtatacat

SEQ ID NO: 248342 - DNA, 20 bp, human
ggcccagccaatgagagcta

SEQ ID NO: 248343 - DNA, 20 bp, human
gaggggtggtagttcatgat

SEQ ID NO: 248344 - DNA, 20 bp, human
gctgaccaatcaaagttgaa

SEQ ID NO: 248345 - DNA, 20 bp, human
ggaacatgggtatatgagga

SEQ ID NO: 248346 - DNA, 20 bp, human
gaacttggccaagacaaagt

SEQ ID NO: 248347 - DNA, 20 bp, human
gtatcaggctaagatatacg

SEQ ID NO: 248348 - DNA, 20 bp, human
gagacaaagtaggttctggg

SEQ ID NO: 248349 - DNA, 20 bp, human
gacttccgggctgtcctatc

SEQ ID NO: 248350 - DNA, 20 bp, human
gttgtcttggccaagttagc

SEQ ID NO: 248351 - DNA, 20 bp, human
ggccaagacaaagtaggttc

SEQ ID NO: 248352 - DNA, 20 bp, human
ggaagtgactcccagatcac

SEQ ID NO: 248353 - DNA, 20 bp, human
gagctgggactcctgtgatc

SEQ ID NO: 248354 - DNA, 20 bp, human
gttagcctgataggacagcc

SEQ ID NO: 248355 - DNA, 20 bp, human
gagaagtcttataaacttcc

SEQ ID NO: 248356 - DNA, 20 bp, human
gcgggttgccgtctggggga

SEQ ID NO: 248357 - DNA, 20 bp, human
ggaaggggagggggaatcgg

SEQ ID NO: 248358 - DNA, 20 bp, human
gaacccggcgggcacaaggt

SEQ ID NO: 248359 - DNA, 20 bp, human
gcccgccgggttgccgtctg

SEQ ID NO: 248360 - DNA, 20 bp, human
gcggaagcgctcggagcgag

SEQ ID NO: 248361 - DNA, 20 bp, human
ggggagggatgacaggggaa

SEQ ID NO: 248362 - DNA, 20 bp, human
ggagtcttgcctgtcagcag

SEQ ID NO: 248363 - DNA, 20 bp, human
gcacgcgcgagttacgtagc

SEQ ID NO: 248364 - DNA, 20 bp, human
gggggaatcggtggttgtca

SEQ ID NO: 248365 - DNA, 20 bp, human
gcgcttgtggtcccctggaa

SEQ ID NO: 248366 - DNA, 20 bp, human
ggcgacgcggcttctagaac

SEQ ID NO: 248367 - DNA, 20 bp, human
gtatagagaggtgactacgg

SEQ ID NO: 248368 - DNA, 20 bp, human
gtgactacggaggcccggta

SEQ ID NO: 248369 - DNA, 20 bp, human
gtgcaaactcggtgcggcga

SEQ ID NO: 248370 - DNA, 20 bp, human
gctaggcggcaagaaagcgc

SEQ ID NO: 248371 - DNA, 20 bp, human
ggcaaaccccgccctccagg

SEQ ID NO: 248372 - DNA, 20 bp, human
ggtacgcggaggcgcgagga

SEQ ID NO: 248373 - DNA, 20 bp, human
gaacatgtcgctggcagcgg

SEQ ID NO: 248374 - DNA, 20 bp, human
gtcgctggcagcggaggctc

SEQ ID NO: 248375 - DNA, 20 bp, human
gccccaagagagcgcgggga

SEQ ID NO: 248376 - DNA, 20 bp, human
gtagaaggacaggctgtaaa

SEQ ID NO: 248377 - DNA, 20 bp, human
gcgaaaggtagtagaaggac

SEQ ID NO: 248378 - DNA, 20 bp, human
gggcgcgagacctcacaatt

SEQ ID NO: 248379 - DNA, 20 bp, human
ggaagccgaaaggtagtaga

SEQ ID NO: 248380 - DNA, 20 bp, human
gcccgctttatgtacggctg

SEQ ID NO: 248381 - DNA, 20 bp, human
gccctcagccgtacataaag

SEQ ID NO: 248382 - DNA, 20 bp, human
gggacaggctgtaaatggat

SEQ ID NO: 248383 - DNA, 20 bp, human
gcaattgggcacgcaagcgg

SEQ ID NO: 248384 - DNA, 20 bp, human
gtaaggacttgaaactaacc

SEQ ID NO: 248385 - DNA, 20 bp, human
ggcacttagtaccgcctacc

SEQ ID NO: 248386 - DNA, 20 bp, human
gttgcacagtagtagatgga

SEQ ID NO: 248387 - DNA, 20 bp, human
ggaaagaagcagttggtccc

SEQ ID NO: 248388 - DNA, 20 bp, human
gaattctgatgcagggcagt

SEQ ID NO: 248389 - DNA, 20 bp, human
gaccagttgctaaggaaggg

SEQ ID NO: 248390 - DNA, 20 bp, human
ggttaccagttgctaaggaa

SEQ ID NO: 248391 - DNA, 20 bp, human
gctggggttaccagttgcta

SEQ ID NO: 248392 - DNA, 20 bp, human
gggcaactagaatgaagcca

SEQ ID NO: 248393 - DNA, 20 bp, human
gagtagtagatggatggtaa

SEQ ID NO: 248394 - DNA, 20 bp, human
ggtcccacatttaagttcaa

SEQ ID NO: 248395 - DNA, 20 bp, human
ggatataactgcaacgtgag

SEQ ID NO: 248396 - DNA, 20 bp, human
gtaaccagtatccccagggg

SEQ ID NO: 248397 - DNA, 20 bp, human
gggcaggtgtggccaaaaag

SEQ ID NO: 248398 - DNA, 20 bp, human
gtggccaaaaagtggagtaa

SEQ ID NO: 248399 - DNA, 20 bp, human
gaaaaagtggagtaagggta

SEQ ID NO: 248400 - DNA, 20 bp, human
ggggcctgagactgcagtta

SEQ ID NO: 248401 - DNA, 20 bp, human
gttggaaaggggggacaaca

SEQ ID NO: 248402 - DNA, 20 bp, human
ggtgccctgcactcattcca

SEQ ID NO: 248403 - DNA, 20 bp, human
ggggtatgttaaagattagt

SEQ ID NO: 248404 - DNA, 20 bp, human
gagtctcaggccccacccct

SEQ ID NO: 248405 - DNA, 20 bp, human
ggggattatgaggtcagaag

SEQ ID NO: 248406 - DNA, 20 bp, human
ggggctgccccgcacgtgcc

SEQ ID NO: 248407 - DNA, 20 bp, human
ggggccgcgtacgccacttc

SEQ ID NO: 248408 - DNA, 20 bp, human
gccggggcccccatgatcgg

SEQ ID NO: 248409 - DNA, 20 bp, human
gggaccggaagtggcgtacg

SEQ ID NO: 248410 - DNA, 20 bp, human
gcccgcacgtgggcgaaccg

SEQ ID NO: 248411 - DNA, 20 bp, human
gcacgtgcggggcagccccg

SEQ ID NO: 248412 - DNA, 20 bp, human
gtgccaggtccccgcggttg

SEQ ID NO: 248413 - DNA, 20 bp, human
ggcctcgcgacctccctccg

SEQ ID NO: 248414 - DNA, 20 bp, human
gttgcggccacgctcgggac

SEQ ID NO: 248415 - DNA, 20 bp, human
gcagctccgggcccgcacgt

SEQ ID NO: 248416 - DNA, 20 bp, human
gaggccgtgcgcagtgtggg

SEQ ID NO: 248417 - DNA, 20 bp, human
gaggaggaacgggagttagg

SEQ ID NO: 248418 - DNA, 20 bp, human
gggagccctaagtcagctag

SEQ ID NO: 248419 - DNA, 20 bp, human
gtggaccctgacttcggact

SEQ ID NO: 248420 - DNA, 20 bp, human
gggatgggggatgagaggcg

SEQ ID NO: 248421 - DNA, 20 bp, human
gctgagggccggctcgtagt

SEQ ID NO: 248422 - DNA, 20 bp, human
gagggccggctcgtagtggg

SEQ ID NO: 248423 - DNA, 20 bp, human
gaagaaacgccgaggaggaa

SEQ ID NO: 248424 - DNA, 20 bp, human
gtccggagaccaggggtggc

SEQ ID NO: 248425 - DNA, 20 bp, human
gtacgagccggccctcagca

SEQ ID NO: 248426 - DNA, 20 bp, human
gcgagagcccggaggcagaa

SEQ ID NO: 248427 - DNA, 20 bp, human
gaaacgcgagtgccccggag

SEQ ID NO: 248428 - DNA, 20 bp, human
gtcgcgggagcgggcctctc

SEQ ID NO: 248429 - DNA, 20 bp, human
gcacagatacaaatgaaggt

SEQ ID NO: 248430 - DNA, 20 bp, human
gagcccccagagggcgctgt

SEQ ID NO: 248431 - DNA, 20 bp, human
gatacaaatgaaggtgggct

SEQ ID NO: 248432 - DNA, 20 bp, human
ggcctccgcgatcgcaaacc

SEQ ID NO: 248433 - DNA, 20 bp, human
gtccgggctctcgcgggagc

SEQ ID NO: 248434 - DNA, 20 bp, human
gagtggcccacagcgccctc

SEQ ID NO: 248435 - DNA, 20 bp, human
gcactccgccgcactgccgg

SEQ ID NO: 248436 - DNA, 20 bp, human
gcgccattgggcagagggat

SEQ ID NO: 248437 - DNA, 20 bp, human
ggtctctgacaagtgttcac

SEQ ID NO: 248438 - DNA, 20 bp, human
gttgcgtgccccagcgacac

SEQ ID NO: 248439 - DNA, 20 bp, human
ggtcgcacccggaagtaaag

SEQ ID NO: 248440 - DNA, 20 bp, human
gagcccgggtggcacctgat

SEQ ID NO: 248441 - DNA, 20 bp, human
gcctgcgcagcgcgactcag

SEQ ID NO: 248442 - DNA, 20 bp, human
gaagtaaagcggctccgtga

SEQ ID NO: 248443 - DNA, 20 bp, human
gacaagtgttcacaggaggt

SEQ ID NO: 248444 - DNA, 20 bp, human
ggctcgtcccaggaagtcct

SEQ ID NO: 248445 - DNA, 20 bp, human
gccgcagcgcagatctgatg

SEQ ID NO: 248446 - DNA, 20 bp, human
ggcagccgggagattgtgaa

SEQ ID NO: 248447 - DNA, 20 bp, human
gactgggcgggaccacgctt

SEQ ID NO: 248448 - DNA, 20 bp, human
ggcgggactaactgtggcga

SEQ ID NO: 248449 - DNA, 20 bp, human
gccagtatgcgggtgttaat

SEQ ID NO: 248450 - DNA, 20 bp, human
gcgtggtcccgcccagtatg

SEQ ID NO: 248451 - DNA, 20 bp, human
gagagcgtgacaggactcca

SEQ ID NO: 248452 - DNA, 20 bp, human
gcggggacttttgagtgaca

SEQ ID NO: 248453 - DNA, 20 bp, human
gagattgtgaagggcacctc

SEQ ID NO: 248454 - DNA, 20 bp, human
gggggcggggcgcagtagaa

SEQ ID NO: 248455 - DNA, 20 bp, human
gcggccgcccagcccccagt

SEQ ID NO: 248456 - DNA, 20 bp, human
gggggctgaacgaccctaat

SEQ ID NO: 248457 - DNA, 20 bp, human
gtggaggatcgggcgaggag

SEQ ID NO: 248458 - DNA, 20 bp, human
gtgattggcgaggttggagg

SEQ ID NO: 248459 - DNA, 20 bp, human
gcacacttccgaatagttcc

SEQ ID NO: 248460 - DNA, 20 bp, human
gtcatctggaggatcgggcg

SEQ ID NO: 248461 - DNA, 20 bp, human
gggagaccctaaaggcccac

SEQ ID NO: 248462 - DNA, 20 bp, human
gactgagccactcccttcat

SEQ ID NO: 248463 - DNA, 20 bp, human
gtccgtaaccagggcccata

SEQ ID NO: 248464 - DNA, 20 bp, human
gggtgaaaagaaaacgaacc

SEQ ID NO: 248465 - DNA, 20 bp, human
gaaacgaaccaggaactatt

SEQ ID NO: 248466 - DNA, 20 bp, human
ggtcccgcgtggggcatata

SEQ ID NO: 248467 - DNA, 20 bp, human
gtgccgaggagactaggagg

SEQ ID NO: 248468 - DNA, 20 bp, human
ggagataaatatcaggggcg

SEQ ID NO: 248469 - DNA, 20 bp, human
gtcggaccacccaacctgaa

SEQ ID NO: 248470 - DNA, 20 bp, human
gggatctcgcgaaaggaaag

SEQ ID NO: 248471 - DNA, 20 bp, human
gttggactgcacgtgttcac

SEQ ID NO: 248472 - DNA, 20 bp, human
ggtagtatgagtcccgcgtg

SEQ ID NO: 248473 - DNA, 20 bp, human
gtcactgaagcgtactacgc

SEQ ID NO: 248474 - DNA, 20 bp, human
gggagagcgcgaggactcgg

SEQ ID NO: 248475 - DNA, 20 bp, human
gtgtaagaaaccagaggtaa

SEQ ID NO: 248476 - DNA, 20 bp, human
gacgccgagcgtgacgtcat

SEQ ID NO: 248477 - DNA, 20 bp, human
gatggcggcagcggaggcta

SEQ ID NO: 248478 - DNA, 20 bp, human
ggcgccgtcacgtagatagg

SEQ ID NO: 248479 - DNA, 20 bp, human
ggacgcggaggagacgacgg

SEQ ID NO: 248480 - DNA, 20 bp, human
gaaggcgccgtcacgtagat

SEQ ID NO: 248481 - DNA, 20 bp, human
ggataaaacgagagagacta

SEQ ID NO: 248482 - DNA, 20 bp, human
ggcggggagcgccgcctcaa

SEQ ID NO: 248483 - DNA, 20 bp, human
gaacgagagagactaaggga

SEQ ID NO: 248484 - DNA, 20 bp, human
gaagccaagaagtacgagaa

SEQ ID NO: 248485 - DNA, 20 bp, human
gaggccgcctatctacgtga

SEQ ID NO: 248486 - DNA, 20 bp, human
ggggggggggtgtctgtcgg

SEQ ID NO: 248487 - DNA, 20 bp, human
gggaaagggtggcgcgcaga

SEQ ID NO: 248488 - DNA, 20 bp, human
gtgggggcggggtccggcag

SEQ ID NO: 248489 - DNA, 20 bp, human
gaggcaggacctcgcggctg

SEQ ID NO: 248490 - DNA, 20 bp, human
gggcaggaggcaggacctcg

SEQ ID NO: 248491 - DNA, 20 bp, human
ggccggaccccgcccccaaa

SEQ ID NO: 248492 - DNA, 20 bp, human
gaccctgagccaccgagtag

SEQ ID NO: 248493 - DNA, 20 bp, human
ggggcggggtccggcagagg

SEQ ID NO: 248494 - DNA, 20 bp, human
gaccgagtagcggagggaaa

SEQ ID NO: 248495 - DNA, 20 bp, human
gtgagccaccgagtagcgga

SEQ ID NO: 248496 - DNA, 20 bp, human
gcggaggggagcagaatagt

SEQ ID NO: 248497 - DNA, 20 bp, human
gaggcgtggggagaggtcgt

SEQ ID NO: 248498 - DNA, 20 bp, human
ggggacggccggaaggaaag

SEQ ID NO: 248499 - DNA, 20 bp, human
gggccggctcggattccgga

SEQ ID NO: 248500 - DNA, 20 bp, human
gcggcccccaacctcccggt

SEQ ID NO: 248501 - DNA, 20 bp, human
gccgcggcggggtgtattta

SEQ ID NO: 248502 - DNA, 20 bp, human
gaacgtccgaccgggaggtt

SEQ ID NO: 248503 - DNA, 20 bp, human
gagccccgcgccgatcggag

SEQ ID NO: 248504 - DNA, 20 bp, human
gccggtcggacgttcgttcc

SEQ ID NO: 248505 - DNA, 20 bp, human
gtcgaactggggttggccgg

SEQ ID NO: 248506 - DNA, 20 bp, human
gtctgccggggatggagact

SEQ ID NO: 248507 - DNA, 20 bp, human
gccggcccctgcagtctcgg

SEQ ID NO: 248508 - DNA, 20 bp, human
ggcgcggggcagcacagcgg

SEQ ID NO: 248509 - DNA, 20 bp, human
gcccgcgcggggcagcacag

SEQ ID NO: 248510 - DNA, 20 bp, human
gagaggccaccgtcccgcgc

SEQ ID NO: 248511 - DNA, 20 bp, human
ggcacagcggcgggagagct

SEQ ID NO: 248512 - DNA, 20 bp, human
gcgctccgcctgcttctgcc

SEQ ID NO: 248513 - DNA, 20 bp, human
gctccatccccggcagaagc

SEQ ID NO: 248514 - DNA, 20 bp, human
gtgggagcgagaataagagg

SEQ ID NO: 248515 - DNA, 20 bp, human
gcaagatggcgccccccgga

SEQ ID NO: 248516 - DNA, 20 bp, human
gtgctccggtgctgaagttc

SEQ ID NO: 248517 - DNA, 20 bp, human
ggaccccggaagtgggtcgg

SEQ ID NO: 248518 - DNA, 20 bp, human
ggagggcggagccaacggga

SEQ ID NO: 248519 - DNA, 20 bp, human
gaatagctgtcaccttgctc

SEQ ID NO: 248520 - DNA, 20 bp, human
gagccaacgggacggaggga

SEQ ID NO: 248521 - DNA, 20 bp, human
ggcggagccaacgggacgga

SEQ ID NO: 248522 - DNA, 20 bp, human
gcaaggtgacagctatttcg

SEQ ID NO: 248523 - DNA, 20 bp, human
ggcatcccgaacttcagcac

SEQ ID NO: 248524 - DNA, 20 bp, human
gcccacttccggggtcgcca

SEQ ID NO: 248525 - DNA, 20 bp, human
gtcggtcagcaccaaggcta

SEQ ID NO: 248526 - DNA, 20 bp, human
gtgctgggaacgaatgagac

SEQ ID NO: 248527 - DNA, 20 bp, human
gcctgcgcgcggcaacatgg

SEQ ID NO: 248528 - DNA, 20 bp, human
ggacgcggggcgtatgagtg

SEQ ID NO: 248529 - DNA, 20 bp, human
gggccctgcgcgcggcaaca

SEQ ID NO: 248530 - DNA, 20 bp, human
gccaaagctcgttttgggaa

SEQ ID NO: 248531 - DNA, 20 bp, human
ggggcgccaaagctcgtttt

SEQ ID NO: 248532 - DNA, 20 bp, human
gtgactgtgattggttgaat

SEQ ID NO: 248533 - DNA, 20 bp, human
gagaaaatgagaatgggttg

SEQ ID NO: 248534 - DNA, 20 bp, human
gggtccaggtggaggtcttg

SEQ ID NO: 248535 - DNA, 20 bp, human
gtgccgcgcgcagggcctgc

SEQ ID NO: 248536 - DNA, 20 bp, human
ggccacgccgaggcatagga

SEQ ID NO: 248537 - DNA, 20 bp, human
gaactgtgactgagactcga

SEQ ID NO: 248538 - DNA, 20 bp, human
ggcctcggcgtggctagaga

SEQ ID NO: 248539 - DNA, 20 bp, human
ggcgtggctagagagggcgg

SEQ ID NO: 248540 - DNA, 20 bp, human
gcccagccgcggtcacctgg

SEQ ID NO: 248541 - DNA, 20 bp, human
ggcgcaggaactccccgcct

SEQ ID NO: 248542 - DNA, 20 bp, human
ggggtccggagcattgggca

SEQ ID NO: 248543 - DNA, 20 bp, human
ggccctctctagccacgccg

SEQ ID NO: 248544 - DNA, 20 bp, human
gtctagccacgccgaggcat

SEQ ID NO: 248545 - DNA, 20 bp, human
gtgacacgggaccctcggtt

SEQ ID NO: 248546 - DNA, 20 bp, human
gcagtcacaattaaacatag

SEQ ID NO: 248547 - DNA, 20 bp, human
ggaagtcatgtctagttgag

SEQ ID NO: 248548 - DNA, 20 bp, human
gaaggaaaccgattgcccca

SEQ ID NO: 248549 - DNA, 20 bp, human
gaaagtagtaacaattgtaa

SEQ ID NO: 248550 - DNA, 20 bp, human
ggaaattggctaataatcat

SEQ ID NO: 248551 - DNA, 20 bp, human
ggaagcatagtatagaagaa

SEQ ID NO: 248552 - DNA, 20 bp, human
ggctgttttcatttcctcat

SEQ ID NO: 248553 - DNA, 20 bp, human
gtgggtaaaacacattaaac

SEQ ID NO: 248554 - DNA, 20 bp, human
gcctttttttgtagttgttg

SEQ ID NO: 248555 - DNA, 20 bp, human
gctagacatgacttcgtgct

SEQ ID NO: 248556 - DNA, 20 bp, human
gcgcccggccactacccaga

SEQ ID NO: 248557 - DNA, 20 bp, human
gcggcggccgcgtgatcccg

SEQ ID NO: 248558 - DNA, 20 bp, human
gccggggcgtcgacttcttg

SEQ ID NO: 248559 - DNA, 20 bp, human
gcgagcttggatgctggacg

SEQ ID NO: 248560 - DNA, 20 bp, human
gcctctgcgagcttggatgc

SEQ ID NO: 248561 - DNA, 20 bp, human
gcctgcggggagggactttc

SEQ ID NO: 248562 - DNA, 20 bp, human
gctggccccaactcagaaat

SEQ ID NO: 248563 - DNA, 20 bp, human
ggagggcgctcattgcctgg

SEQ ID NO: 248564 - DNA, 20 bp, human
ggccgagggcgctcattgcc

SEQ ID NO: 248565 - DNA, 20 bp, human
ggccgcgtgatcccgggggt

SEQ ID NO: 248566 - DNA, 20 bp, human
gcctgcctccccacgctctt

SEQ ID NO: 248567 - DNA, 20 bp, human
gggtcccggtcgcgtcagtc

SEQ ID NO: 248568 - DNA, 20 bp, human
gcaacccgaagagcgtgggg

SEQ ID NO: 248569 - DNA, 20 bp, human
gacgacaacccgaagagcgt

SEQ ID NO: 248570 - DNA, 20 bp, human
gaggacctccagagaaaggg

SEQ ID NO: 248571 - DNA, 20 bp, human
ggcaacagagagacgcgacg

SEQ ID NO: 248572 - DNA, 20 bp, human
gggacgaagcgcgctggtcc

SEQ ID NO: 248573 - DNA, 20 bp, human
gggcccctgactgacgcgac

SEQ ID NO: 248574 - DNA, 20 bp, human
gccccaggggccgacgggag

SEQ ID NO: 248575 - DNA, 20 bp, human
gaggagcgtcggggtctcgg

SEQ ID NO: 248576 - DNA, 20 bp, human
gcatgctggcgagcatgtta

SEQ ID NO: 248577 - DNA, 20 bp, human
ggaccaaaggcctgtcgtaa

SEQ ID NO: 248578 - DNA, 20 bp, human
gtgtgctggaggagcgggga

SEQ ID NO: 248579 - DNA, 20 bp, human
gtaacgtcgccgcacctcat

SEQ ID NO: 248580 - DNA, 20 bp, human
ggggaaaagcctcgagaaga

SEQ ID NO: 248581 - DNA, 20 bp, human
gaacgaggtggtgtcgggag

SEQ ID NO: 248582 - DNA, 20 bp, human
gacgacaacgaggtggtgtc

SEQ ID NO: 248583 - DNA, 20 bp, human
gtggtcgtacgacaacgagg

SEQ ID NO: 248584 - DNA, 20 bp, human
ggcgagcatgttagggtgta

SEQ ID NO: 248585 - DNA, 20 bp, human
gcgggagcgcggagcgagtt

SEQ ID NO: 248586 - DNA, 20 bp, human
gcctgggaggacaccttcgg

SEQ ID NO: 248587 - DNA, 20 bp, human
gcggccggggatgccccgcc

SEQ ID NO: 248588 - DNA, 20 bp, human
gcctcctggcggggcatccc

SEQ ID NO: 248589 - DNA, 20 bp, human
gggcggctggcgtggggaaa

SEQ ID NO: 248590 - DNA, 20 bp, human
gtccccacgccagccgccga

SEQ ID NO: 248591 - DNA, 20 bp, human
gccggtggagccccgggaca

SEQ ID NO: 248592 - DNA, 20 bp, human
gctgcctgggaggacacctt

SEQ ID NO: 248593 - DNA, 20 bp, human
gagagcccctggctacctgc

SEQ ID NO: 248594 - DNA, 20 bp, human
ggggaaaggggccgcccggc

SEQ ID NO: 248595 - DNA, 20 bp, human
gccagcccgagtgactcact

SEQ ID NO: 248596 - DNA, 20 bp, human
ggcagcggctgtcacacaaa

SEQ ID NO: 248597 - DNA, 20 bp, human
gcggccgaagctctcgtcct

SEQ ID NO: 248598 - DNA, 20 bp, human
gaaaccgagaggcaggtcct

SEQ ID NO: 248599 - DNA, 20 bp, human
gagccgctgcggcgaagggg

SEQ ID NO: 248600 - DNA, 20 bp, human
ggcccgccccttcgccgcag

SEQ ID NO: 248601 - DNA, 20 bp, human
ggcacccaggacctgcctct

SEQ ID NO: 248602 - DNA, 20 bp, human
gcggctgtcacacaaagggc

SEQ ID NO: 248603 - DNA, 20 bp, human
gaggcaggtcctgggtgcgc

SEQ ID NO: 248604 - DNA, 20 bp, human
gaacccgaggacgagagctt

SEQ ID NO: 248605 - DNA, 20 bp, human
ggggtgcgccggcggtacag

SEQ ID NO: 248606 - DNA, 20 bp, human
gccgcggtgcaactccgccg

SEQ ID NO: 248607 - DNA, 20 bp, human
gaggtgaaggctgcgcgggg

SEQ ID NO: 248608 - DNA, 20 bp, human
ggggctcgggtaggtgtggc

SEQ ID NO: 248609 - DNA, 20 bp, human
ggcaactccgccgtggcctg

SEQ ID NO: 248610 - DNA, 20 bp, human
ggccaatgccggcaaggtga

SEQ ID NO: 248611 - DNA, 20 bp, human
gcaaacccccagccccgtgt

SEQ ID NO: 248612 - DNA, 20 bp, human
gtgggggtcccgggaggaat

SEQ ID NO: 248613 - DNA, 20 bp, human
gtgtgggtaagagccaatgc

SEQ ID NO: 248614 - DNA, 20 bp, human
ggggacagccagcggtgggg

SEQ ID NO: 248615 - DNA, 20 bp, human
gcgaacaggagcccctccgg

SEQ ID NO: 248616 - DNA, 20 bp, human
ggcccgcccctgcagaaggt

SEQ ID NO: 248617 - DNA, 20 bp, human
gcggcctgcgagagtcgcgg

SEQ ID NO: 248618 - DNA, 20 bp, human
gcacgtgacggggaagacga

SEQ ID NO: 248619 - DNA, 20 bp, human
gccggcgccacagctcgcgt

SEQ ID NO: 248620 - DNA, 20 bp, human
gtgcaggggcgggccttcgg

SEQ ID NO: 248621 - DNA, 20 bp, human
ggcgcggcctgcgagagtcg

SEQ ID NO: 248622 - DNA, 20 bp, human
gtggcggccgccgaccccta

SEQ ID NO: 248623 - DNA, 20 bp, human
gggggccctcgctctcccat

SEQ ID NO: 248624 - DNA, 20 bp, human
ggtccctccgcgactctcgc

SEQ ID NO: 248625 - DNA, 20 bp, human
gcggagggactcgcacctgg

SEQ ID NO: 248626 - DNA, 20 bp, human
gagaggagcggaggctagag

SEQ ID NO: 248627 - DNA, 20 bp, human
gggtgcgtgcgtgggcatag

SEQ ID NO: 248628 - DNA, 20 bp, human
ggaggccgtaggagcgggtg

SEQ ID NO: 248629 - DNA, 20 bp, human
gggtctcgaccctctccccc

SEQ ID NO: 248630 - DNA, 20 bp, human
gtagagcggctgggggggga

SEQ ID NO: 248631 - DNA, 20 bp, human
gcctgggcgaggatgcgatg

SEQ ID NO: 248632 - DNA, 20 bp, human
ggagagcggcgggtctgaga

SEQ ID NO: 248633 - DNA, 20 bp, human
ggggagagggtcgagacctg

SEQ ID NO: 248634 - DNA, 20 bp, human
gcctccaaccggcccccccc

SEQ ID NO: 248635 - DNA, 20 bp, human
gttggaaggagcgtgatgag

SEQ ID NO: 248636 - DNA, 20 bp, human
gtcaaagttagtgttaaaat

SEQ ID NO: 248637 - DNA, 20 bp, human
gtgagtgatgacatcataaa

SEQ ID NO: 248638 - DNA, 20 bp, human
gccactataaatgtacaaaa

SEQ ID NO: 248639 - DNA, 20 bp, human
gttaattgaatctacctgtt

SEQ ID NO: 248640 - DNA, 20 bp, human
gctaccactgctctttttag

SEQ ID NO: 248641 - DNA, 20 bp, human
gatgtacaaaaaggttgtag

SEQ ID NO: 248642 - DNA, 20 bp, human
gcttgaagatgtcttattct

SEQ ID NO: 248643 - DNA, 20 bp, human
ggtcatattttaaagtgcac

SEQ ID NO: 248644 - DNA, 20 bp, human
ggaaacctatttttaaattg

SEQ ID NO: 248645 - DNA, 20 bp, human
gacatcttcaagttatttta

SEQ ID NO: 248646 - DNA, 20 bp, human
gcaggaatgaaagggaattt

SEQ ID NO: 248647 - DNA, 20 bp, human
gttgatttaacaaaagttac

SEQ ID NO: 248648 - DNA, 20 bp, human
gtaaagaagccaagagcact

SEQ ID NO: 248649 - DNA, 20 bp, human
gttactgactaaatctagct

SEQ ID NO: 248650 - DNA, 20 bp, human
gcaaaagttacaggaatgaa

SEQ ID NO: 248651 - DNA, 20 bp, human
gactagtattcatttattag

SEQ ID NO: 248652 - DNA, 20 bp, human
gatactagtactatatagag

SEQ ID NO: 248653 - DNA, 20 bp, human
gctttaattccaagtgctct

SEQ ID NO: 248654 - DNA, 20 bp, human
gattgactgatatggaaaaa

SEQ ID NO: 248655 - DNA, 20 bp, human
gattaaaggggtaaaacaaa

SEQ ID NO: 248656 - DNA, 20 bp, human
ggcggggcagagaagagcgg

SEQ ID NO: 248657 - DNA, 20 bp, human
ggctggcagccattggagga

SEQ ID NO: 248658 - DNA, 20 bp, human
gccgggctggcagccattgg

SEQ ID NO: 248659 - DNA, 20 bp, human
gtcacagggaggcccaatca

SEQ ID NO: 248660 - DNA, 20 bp, human
gtggaggaaggtctgtcaca

SEQ ID NO: 248661 - DNA, 20 bp, human
ggaaccaaagggaaagcgaa

SEQ ID NO: 248662 - DNA, 20 bp, human
gtcaagctcggtggaaccaa

SEQ ID NO: 248663 - DNA, 20 bp, human
gctcctgagcgggccgtgat

SEQ ID NO: 248664 - DNA, 20 bp, human
gcgggcccaggtagcaggtt

SEQ ID NO: 248665 - DNA, 20 bp, human
gccgagctgcgctcctgagc

SEQ ID NO: 248666 - DNA, 20 bp, human
gactgagggcagagacagag

SEQ ID NO: 248667 - DNA, 20 bp, human
ggcagcgtgaggttctccaa

SEQ ID NO: 248668 - DNA, 20 bp, human
gcctcccctactcggtatga

SEQ ID NO: 248669 - DNA, 20 bp, human
gagacagctcctcccctact

SEQ ID NO: 248670 - DNA, 20 bp, human
gtgtctgcagtcttgaccaa

SEQ ID NO: 248671 - DNA, 20 bp, human
ggtgaggttctccaaaggac

SEQ ID NO: 248672 - DNA, 20 bp, human
gtctgctagggctggcactg

SEQ ID NO: 248673 - DNA, 20 bp, human
gggtttgagcctgcagcagg

SEQ ID NO: 248674 - DNA, 20 bp, human
gtgaaccttcataccgagta

SEQ ID NO: 248675 - DNA, 20 bp, human
gtcggtatgaaggttcagtc

SEQ ID NO: 248676 - DNA, 20 bp, human
gaacctcctcggtctgagga

SEQ ID NO: 248677 - DNA, 20 bp, human
gaaacaacctcctcggtctg

SEQ ID NO: 248678 - DNA, 20 bp, human
gtcccctcctcagaccgagg

SEQ ID NO: 248679 - DNA, 20 bp, human
ggtcactgcactcccgccct

SEQ ID NO: 248680 - DNA, 20 bp, human
ggtcgcagcgtggtcaagtt

SEQ ID NO: 248681 - DNA, 20 bp, human
ggagtgaaaaggtcgcagcg

SEQ ID NO: 248682 - DNA, 20 bp, human
ggtctcccctcctcagaccg

SEQ ID NO: 248683 - DNA, 20 bp, human
gcaaaacaaaacaacctcct

SEQ ID NO: 248684 - DNA, 20 bp, human
gaggctaagttttgaattcc

SEQ ID NO: 248685 - DNA, 20 bp, human
gtaaaaattgggagaaggcc

SEQ ID NO: 248686 - DNA, 20 bp, human
ggcctggggatgggacacgt

SEQ ID NO: 248687 - DNA, 20 bp, human
gcgtgggcgccgtgtgacat

SEQ ID NO: 248688 - DNA, 20 bp, human
ggtgtcccatccccaggcta

SEQ ID NO: 248689 - DNA, 20 bp, human
ggaaccccccattccaacca

SEQ ID NO: 248690 - DNA, 20 bp, human
ggcggagctcctgttgaatg

SEQ ID NO: 248691 - DNA, 20 bp, human
gtcccagcaccaaagtctga

SEQ ID NO: 248692 - DNA, 20 bp, human
ggctggtgtactgttgaggg

SEQ ID NO: 248693 - DNA, 20 bp, human
gggaggcagccctcagactt

SEQ ID NO: 248694 - DNA, 20 bp, human
gaatggggggttcctttctg

SEQ ID NO: 248695 - DNA, 20 bp, human
gggcgccgtgtgacattggc

SEQ ID NO: 248696 - DNA, 20 bp, human
gctggaggcagggactcatt

SEQ ID NO: 248697 - DNA, 20 bp, human
ggatctgcctgagagaccga

SEQ ID NO: 248698 - DNA, 20 bp, human
gggtgcatgagcgtagacag

SEQ ID NO: 248699 - DNA, 20 bp, human
gttgctcctctcagccctgg

SEQ ID NO: 248700 - DNA, 20 bp, human
gaggcaccaggcaagataaa

SEQ ID NO: 248701 - DNA, 20 bp, human
gtcgagagggatcacgtcat

SEQ ID NO: 248702 - DNA, 20 bp, human
gtggtgccttgccttcgaga

SEQ ID NO: 248703 - DNA, 20 bp, human
gaaaaaacgagggaatgagt

SEQ ID NO: 248704 - DNA, 20 bp, human
gaggctcttggataagataa

SEQ ID NO: 248705 - DNA, 20 bp, human
gatgaataatccaaggctct

SEQ ID NO: 248706 - DNA, 20 bp, human
gcccagccaaaggtagatga

SEQ ID NO: 248707 - DNA, 20 bp, human
gtggaaacatatcacgtcat

SEQ ID NO: 248708 - DNA, 20 bp, human
gggtagatgaaggagaagtc

SEQ ID NO: 248709 - DNA, 20 bp, human
ggatgctgagaaaaggcgtg

SEQ ID NO: 248710 - DNA, 20 bp, human
gccagcaggacttgcagcaa

SEQ ID NO: 248711 - DNA, 20 bp, human
gggcgtggggtctggactgg

SEQ ID NO: 248712 - DNA, 20 bp, human
gtgtttccagagcaggttcc

SEQ ID NO: 248713 - DNA, 20 bp, human
gcatgctggtggaaggtggt

SEQ ID NO: 248714 - DNA, 20 bp, human
gaaaggcgtggggtctggac

SEQ ID NO: 248715 - DNA, 20 bp, human
gctgagaggagtaaaatgga

SEQ ID NO: 248716 - DNA, 20 bp, human
gggagtgaaggcctcctcaa

SEQ ID NO: 248717 - DNA, 20 bp, human
ggcctgagctcatatccaga

SEQ ID NO: 248718 - DNA, 20 bp, human
gcaactccagggcaaacctc

SEQ ID NO: 248719 - DNA, 20 bp, human
gcccttctggatatgagctc

SEQ ID NO: 248720 - DNA, 20 bp, human
gcggaggaggagctaggtaa

SEQ ID NO: 248721 - DNA, 20 bp, human
gtgaaggcctcctcaagggc

SEQ ID NO: 248722 - DNA, 20 bp, human
gaagggctggctcaactcca

SEQ ID NO: 248723 - DNA, 20 bp, human
gaggaggagctaggtaaggg

SEQ ID NO: 248724 - DNA, 20 bp, human
gtatctgggctcaggagtca

SEQ ID NO: 248725 - DNA, 20 bp, human
gtcatatccagaagggagag

SEQ ID NO: 248726 - DNA, 20 bp, human
gactcccatgacacttgctg

SEQ ID NO: 248727 - DNA, 20 bp, human
gaggaatgctgcacaaagag

SEQ ID NO: 248728 - DNA, 20 bp, human
ggcaagtgtcatgggagtta

SEQ ID NO: 248729 - DNA, 20 bp, human
gggactctataatctgattg

SEQ ID NO: 248730 - DNA, 20 bp, human
ggaactgtgctatgtgttgg

SEQ ID NO: 248731 - DNA, 20 bp, human
ggaacaatgtggtgtgtggt

SEQ ID NO: 248732 - DNA, 20 bp, human
ggtatgatctaatctcagca

SEQ ID NO: 248733 - DNA, 20 bp, human
gagacctcagcaagtgtcat

SEQ ID NO: 248734 - DNA, 20 bp, human
gtatagagtcccgccttggg

SEQ ID NO: 248735 - DNA, 20 bp, human
gtcctttcatccacccaagg

SEQ ID NO: 248736 - DNA, 20 bp, human
gcgtcactctacccactcaa

SEQ ID NO: 248737 - DNA, 20 bp, human
gaagcccaagaaagatcttt

SEQ ID NO: 248738 - DNA, 20 bp, human
gactcaagggcaagatgata

SEQ ID NO: 248739 - DNA, 20 bp, human
gcaatagacaaactgatgga

SEQ ID NO: 248740 - DNA, 20 bp, human
gttggtcaaaaaggggagtt

SEQ ID NO: 248741 - DNA, 20 bp, human
gcaagccaaaagatctttct

SEQ ID NO: 248742 - DNA, 20 bp, human
gtatcagaccaagcgtctaa

SEQ ID NO: 248743 - DNA, 20 bp, human
gaattcaatagacaaactga

SEQ ID NO: 248744 - DNA, 20 bp, human
gaaaataaagctcattccag

SEQ ID NO: 248745 - DNA, 20 bp, human
gcatttcttgggcatcgttg

SEQ ID NO: 248746 - DNA, 20 bp, human
gcctgtacatagaggggtga

SEQ ID NO: 248747 - DNA, 20 bp, human
gtgaaccgggctggtctctc

SEQ ID NO: 248748 - DNA, 20 bp, human
gacagcccgaagagagggta

SEQ ID NO: 248749 - DNA, 20 bp, human
gtggagagaaaggtggcgga

SEQ ID NO: 248750 - DNA, 20 bp, human
ggtgcagaacccagccgagg

SEQ ID NO: 248751 - DNA, 20 bp, human
ggcagtgcagaacccagccg

SEQ ID NO: 248752 - DNA, 20 bp, human
gctccctcaagccccctcct

SEQ ID NO: 248753 - DNA, 20 bp, human
ggaagcagcctgaaccgggc

SEQ ID NO: 248754 - DNA, 20 bp, human
gctcggtgcctgtacataga

SEQ ID NO: 248755 - DNA, 20 bp, human
gtacatagaggggtgagggc

SEQ ID NO: 248756 - DNA, 20 bp, human
gaccctgggtcttaggtagt

SEQ ID NO: 248757 - DNA, 20 bp, human
gaagacccagggtgactctt

SEQ ID NO: 248758 - DNA, 20 bp, human
gctgggtcttaggtagtagg

SEQ ID NO: 248759 - DNA, 20 bp, human
gtttggggataggccagaag

SEQ ID NO: 248760 - DNA, 20 bp, human
ggaggggccgtgagcctggt

SEQ ID NO: 248761 - DNA, 20 bp, human
gtatccccaaagagtcaccc

SEQ ID NO: 248762 - DNA, 20 bp, human
gacaaccaggccaatctgat

SEQ ID NO: 248763 - DNA, 20 bp, human
gaggtggagctgagggataa

SEQ ID NO: 248764 - DNA, 20 bp, human
gtggcctagactgagtgccc

SEQ ID NO: 248765 - DNA, 20 bp, human
gcagctgtctttagggttca

SEQ ID NO: 248766 - DNA, 20 bp, human
ggtgcggcctcgattggagg

SEQ ID NO: 248767 - DNA, 20 bp, human
gtctaccagcaggctttcat

SEQ ID NO: 248768 - DNA, 20 bp, human
gtcaagtcgcggagagggaa

SEQ ID NO: 248769 - DNA, 20 bp, human
ggactcccgtccaggcgcac

SEQ ID NO: 248770 - DNA, 20 bp, human
gttgacccggactcccgtcc

SEQ ID NO: 248771 - DNA, 20 bp, human
gaagggaggtcgtgcgctcg

SEQ ID NO: 248772 - DNA, 20 bp, human
gtaccgcacaatggaaacgt

SEQ ID NO: 248773 - DNA, 20 bp, human
gacgggagtccgggtcaaag

SEQ ID NO: 248774 - DNA, 20 bp, human
ggcctcggagctctaccagc

SEQ ID NO: 248775 - DNA, 20 bp, human
gcaagctcaagtcgcggaga

SEQ ID NO: 248776 - DNA, 20 bp, human
gaacccgcgccccggctcct

SEQ ID NO: 248777 - DNA, 20 bp, human
gcgctcaggaacccgcgccc

SEQ ID NO: 248778 - DNA, 20 bp, human
gtcctgagcgcagcaggccg

SEQ ID NO: 248779 - DNA, 20 bp, human
gcaccgcaaggcggggattt

SEQ ID NO: 248780 - DNA, 20 bp, human
ggcctcggcctgctgcgctc

SEQ ID NO: 248781 - DNA, 20 bp, human
ggaaaccaacgggccgctgg

SEQ ID NO: 248782 - DNA, 20 bp, human
gaaagagcaatggatcgccg

SEQ ID NO: 248783 - DNA, 20 bp, human
gttaaggcatagcgtgtggg

SEQ ID NO: 248784 - DNA, 20 bp, human
gcaacccggtccgaagtcgc

SEQ ID NO: 248785 - DNA, 20 bp, human
gatggatcgccgaggagccg

SEQ ID NO: 248786 - DNA, 20 bp, human
ggggagggtacctgaaggtg

SEQ ID NO: 248787 - DNA, 20 bp, human
gatagtgtccgcccccacct

SEQ ID NO: 248788 - DNA, 20 bp, human
gattgcctgcacagttgatg

SEQ ID NO: 248789 - DNA, 20 bp, human
gggttccacatcaactgtgc

SEQ ID NO: 248790 - DNA, 20 bp, human
gtcggtgggagggtacctga

SEQ ID NO: 248791 - DNA, 20 bp, human
gaggaagtggtttcccgctg

SEQ ID NO: 248792 - DNA, 20 bp, human
gaaaagtgcccagaagacaa

SEQ ID NO: 248793 - DNA, 20 bp, human
gactgctctaagtgctttgt

SEQ ID NO: 248794 - DNA, 20 bp, human
gcacttttgtgagtgaaagg

SEQ ID NO: 248795 - DNA, 20 bp, human
gacatgctattactccgcag

SEQ ID NO: 248796 - DNA, 20 bp, human
ggagtcagcgaggtgagcga

SEQ ID NO: 248797 - DNA, 20 bp, human
gacgcgggacccaggggagg

SEQ ID NO: 248798 - DNA, 20 bp, human
gtccgcaaggctgacctcta

SEQ ID NO: 248799 - DNA, 20 bp, human
ggagccacggggaggtgtca

SEQ ID NO: 248800 - DNA, 20 bp, human
gccggctggccagactccga

SEQ ID NO: 248801 - DNA, 20 bp, human
ggtccctgggcataggaaca

SEQ ID NO: 248802 - DNA, 20 bp, human
gaaggaggatggagtcagcg

SEQ ID NO: 248803 - DNA, 20 bp, human
gagcgagggcgtccgggcct

SEQ ID NO: 248804 - DNA, 20 bp, human
gaggagggcggagtggcccc

SEQ ID NO: 248805 - DNA, 20 bp, human
gccgagggacgcgggaccca

SEQ ID NO: 248806 - DNA, 20 bp, human
gcccaggaggcgcgctcgga

SEQ ID NO: 248807 - DNA, 20 bp, human
ggtaacgtgggcagcaacct

SEQ ID NO: 248808 - DNA, 20 bp, human
gtgcctcggcgcggaacaaa

SEQ ID NO: 248809 - DNA, 20 bp, human
gttccgcgccgaggcagagg

SEQ ID NO: 248810 - DNA, 20 bp, human
gtccctccgagcgcgcctcc

SEQ ID NO: 248811 - DNA, 20 bp, human
gaggctagagcttggaattc

SEQ ID NO: 248812 - DNA, 20 bp, human
ggccagcgcttcaaacccca

SEQ ID NO: 248813 - DNA, 20 bp, human
gattttgggcagcgcctcgc

SEQ ID NO: 248814 - DNA, 20 bp, human
gcctggctcctccccccgcg

SEQ ID NO: 248815 - DNA, 20 bp, human
gtataaagcggcagcgccgt

SEQ ID NO: 248816 - DNA, 20 bp, human
gcacacccgggtctctctca

SEQ ID NO: 248817 - DNA, 20 bp, human
gtgcaccctgagagagaccc

SEQ ID NO: 248818 - DNA, 20 bp, human
gccctgcgggagccacaccc

SEQ ID NO: 248819 - DNA, 20 bp, human
gtcagggtgcacttctgcag

SEQ ID NO: 248820 - DNA, 20 bp, human
gttctgcagagggcccgcga

SEQ ID NO: 248821 - DNA, 20 bp, human
gtgcacaagaactgcgaagt

SEQ ID NO: 248822 - DNA, 20 bp, human
gcggacagctggacccgaag

SEQ ID NO: 248823 - DNA, 20 bp, human
gtgttcaagacgcatttgtt

SEQ ID NO: 248824 - DNA, 20 bp, human
gggtgactgtaccccgggtt

SEQ ID NO: 248825 - DNA, 20 bp, human
gacgtgcgcaagatcctcat

SEQ ID NO: 248826 - DNA, 20 bp, human
gcccagaaactttgggggcg

SEQ ID NO: 248827 - DNA, 20 bp, human
gggggaggggagggcccgac

SEQ ID NO: 248828 - DNA, 20 bp, human
gtgcgaggggagcggagaga

SEQ ID NO: 248829 - DNA, 20 bp, human
ggaggggagggcccgacggg

SEQ ID NO: 248830 - DNA, 20 bp, human
gcgctccggtcccctcccgt

SEQ ID NO: 248831 - DNA, 20 bp, human
ggccaagggaaagggagtgg

SEQ ID NO: 248832 - DNA, 20 bp, human
gggcttaggggctgctcaag

SEQ ID NO: 248833 - DNA, 20 bp, human
gaggaaacacgaggcgactg

SEQ ID NO: 248834 - DNA, 20 bp, human
ggcacagccaatcccccgag

SEQ ID NO: 248835 - DNA, 20 bp, human
gcctccagccgaaacagaga

SEQ ID NO: 248836 - DNA, 20 bp, human
gcgcgcgtgatcagcgctgg

SEQ ID NO: 248837 - DNA, 20 bp, human
gcacgcgcgccaggacctgt

SEQ ID NO: 248838 - DNA, 20 bp, human
ggcgcaaggtgagtggaaac

SEQ ID NO: 248839 - DNA, 20 bp, human
gcagacctagaaaggggcca

SEQ ID NO: 248840 - DNA, 20 bp, human
gaggaccggaactggccttc

SEQ ID NO: 248841 - DNA, 20 bp, human
ggtctgggccgcttggaaga

SEQ ID NO: 248842 - DNA, 20 bp, human
gagggagaaaggaccggaac

SEQ ID NO: 248843 - DNA, 20 bp, human
ggtagccagaaggccagttc

SEQ ID NO: 248844 - DNA, 20 bp, human
gcgcgcgctcccacaggtcc

SEQ ID NO: 248845 - DNA, 20 bp, human
gggcccagacctaaacttcc

SEQ ID NO: 248846 - DNA, 20 bp, human
gggtgactcggggatatcca

SEQ ID NO: 248847 - DNA, 20 bp, human
gaccgggcgaggacctatcc

SEQ ID NO: 248848 - DNA, 20 bp, human
ggagagggacgcggtgactc

SEQ ID NO: 248849 - DNA, 20 bp, human
gggaagccccacaccgggat

SEQ ID NO: 248850 - DNA, 20 bp, human
gaggacgcgagggtcgcctt

SEQ ID NO: 248851 - DNA, 20 bp, human
ggggccagtcatctgatccc

SEQ ID NO: 248852 - DNA, 20 bp, human
ggcgtcgctgggaggagcga

SEQ ID NO: 248853 - DNA, 20 bp, human
gtgggtggggaaccgcgacc

SEQ ID NO: 248854 - DNA, 20 bp, human
gtcgtggcggaggccttggt

SEQ ID NO: 248855 - DNA, 20 bp, human
gcagctcccgcgtcgctggg

SEQ ID NO: 248856 - DNA, 20 bp, human
gagcacccaggaacagtagg

SEQ ID NO: 248857 - DNA, 20 bp, human
gggaacagtaggcggggctg

SEQ ID NO: 248858 - DNA, 20 bp, human
gaccactcaggaggagggat

SEQ ID NO: 248859 - DNA, 20 bp, human
gctgacttcacaactccctt

SEQ ID NO: 248860 - DNA, 20 bp, human
gtgcaatgaccctcatggga

SEQ ID NO: 248861 - DNA, 20 bp, human
gtgggctcactggtagaagt

SEQ ID NO: 248862 - DNA, 20 bp, human
ggtgctggggattagcaccc

SEQ ID NO: 248863 - DNA, 20 bp, human
gtagacaaaggcactctccc

SEQ ID NO: 248864 - DNA, 20 bp, human
ggggcctaagattttcctcc

SEQ ID NO: 248865 - DNA, 20 bp, human
gatgttgcaatgaccctcat

SEQ ID NO: 248866 - DNA, 20 bp, human
ggggagggagcctttaataa

SEQ ID NO: 248867 - DNA, 20 bp, human
gttacacagacccttattaa

SEQ ID NO: 248868 - DNA, 20 bp, human
gcgccccggcggcaggagta

SEQ ID NO: 248869 - DNA, 20 bp, human
gattaaaggctccctcccct

SEQ ID NO: 248870 - DNA, 20 bp, human
gttggccatggttggaagtg

SEQ ID NO: 248871 - DNA, 20 bp, human
gtctgtgtaaactgacgccc

SEQ ID NO: 248872 - DNA, 20 bp, human
gttaaaacttggtggtttca

SEQ ID NO: 248873 - DNA, 20 bp, human
gtggggttgaccttaaaact

SEQ ID NO: 248874 - DNA, 20 bp, human
gaaactgacgccccggcggc

SEQ ID NO: 248875 - DNA, 20 bp, human
ggtgtaaactgacgccccgg

SEQ ID NO: 248876 - DNA, 20 bp, human
ggaccccagggaagctgaac

SEQ ID NO: 248877 - DNA, 20 bp, human
gtcagggttggggtgtagtt

SEQ ID NO: 248878 - DNA, 20 bp, human
ggggaactccagactaaatc

SEQ ID NO: 248879 - DNA, 20 bp, human
ggctgtgtgggattcagggt

SEQ ID NO: 248880 - DNA, 20 bp, human
gtaaatctggtacttcagga

SEQ ID NO: 248881 - DNA, 20 bp, human
ggcgggcaacagataaactg

SEQ ID NO: 248882 - DNA, 20 bp, human
gagactaaatctggtacttc

SEQ ID NO: 248883 - DNA, 20 bp, human
ggctgtgtcctaagctgtgt

SEQ ID NO: 248884 - DNA, 20 bp, human
gcctaagctgtgtgggattc

SEQ ID NO: 248885 - DNA, 20 bp, human
gatatggacttgaaagtctt

SEQ ID NO: 248886 - DNA, 20 bp, human
gcatgaatcctgcctagctt

SEQ ID NO: 248887 - DNA, 20 bp, human
gctaggcaggattcatggtg

SEQ ID NO: 248888 - DNA, 20 bp, human
ggctgtgtcccaagctaggc

SEQ ID NO: 248889 - DNA, 20 bp, human
gtgtggatctgggggttcca

SEQ ID NO: 248890 - DNA, 20 bp, human
gaagtgtggctgtgcattta

SEQ ID NO: 248891 - DNA, 20 bp, human
gtcggggctaggaagaccca

SEQ ID NO: 248892 - DNA, 20 bp, human
gtgggtgtggagtttctggg

SEQ ID NO: 248893 - DNA, 20 bp, human
gacccccagatccacaactt

SEQ ID NO: 248894 - DNA, 20 bp, human
ggctgtgggtgtggagtttc

SEQ ID NO: 248895 - DNA, 20 bp, human
gcagataagctgtagaactg

SEQ ID NO: 248896 - DNA, 20 bp, human
gcatgaatgccacctagctt

SEQ ID NO: 248897 - DNA, 20 bp, human
ggctaggtggcattcatggt

SEQ ID NO: 248898 - DNA, 20 bp, human
gtctcaggaggggggactcc

SEQ ID NO: 248899 - DNA, 20 bp, human
gtggaggtcttctgttgcgg

SEQ ID NO: 248900 - DNA, 20 bp, human
gcttcagttctacagtttat

SEQ ID NO: 248901 - DNA, 20 bp, human
gtcggggctaggaagaccca

SEQ ID NO: 248902 - DNA, 20 bp, human
gtgggtgtggagtttctggg

SEQ ID NO: 248903 - DNA, 20 bp, human
gtatggacttgaaagtctcg

SEQ ID NO: 248904 - DNA, 20 bp, human
gactgtagaactgaagagtt

SEQ ID NO: 248905 - DNA, 20 bp, human
ggctgtgggtgtggagtttc

SEQ ID NO: 248906 - DNA, 20 bp, human
gtatctacagagtgggtaaa

SEQ ID NO: 248907 - DNA, 20 bp, human
ggggtaaagggataggcatc

SEQ ID NO: 248908 - DNA, 20 bp, human
gctgccaatatctacagagt

SEQ ID NO: 248909 - DNA, 20 bp, human
ggtactggcgtatatttctg

SEQ ID NO: 248910 - DNA, 20 bp, human
gcacatacagggatgcaagc

SEQ ID NO: 248911 - DNA, 20 bp, human
gggtagagatatcaaagtcc

SEQ ID NO: 248912 - DNA, 20 bp, human
gtggatgaaattttataaca

SEQ ID NO: 248913 - DNA, 20 bp, human
gggaagctcatacacatgca

SEQ ID NO: 248914 - DNA, 20 bp, human
ggggataggcatcaggtcac

SEQ ID NO: 248915 - DNA, 20 bp, human
gacagagtgggtaaagggat

SEQ ID NO: 248916 - DNA, 20 bp, human
gaatcacaggtggattagta

SEQ ID NO: 248917 - DNA, 20 bp, human
gtgccccaccctggagattc

SEQ ID NO: 248918 - DNA, 20 bp, human
gtctgcctcagcttctggcg

SEQ ID NO: 248919 - DNA, 20 bp, human
gtctttccggtgccccaccc

SEQ ID NO: 248920 - DNA, 20 bp, human
gggaatgcacaactacgccc

SEQ ID NO: 248921 - DNA, 20 bp, human
ggggctgtttgaaaaaacct

SEQ ID NO: 248922 - DNA, 20 bp, human
gaccgtgcctggctaggcct

SEQ ID NO: 248923 - DNA, 20 bp, human
gaaaaaacctaggcctagcc

SEQ ID NO: 248924 - DNA, 20 bp, human
gacctaggcctagccaggca

SEQ ID NO: 248925 - DNA, 20 bp, human
gttttagattgatgagcagt

SEQ ID NO: 248926 - DNA, 20 bp, human
gaaaccagaatgtacagagt

SEQ ID NO: 248927 - DNA, 20 bp, human
gaatgtacagagtgggcact

SEQ ID NO: 248928 - DNA, 20 bp, human
gctcaattatgacggtgcat

SEQ ID NO: 248929 - DNA, 20 bp, human
gacggtgcattggaaccact

SEQ ID NO: 248930 - DNA, 20 bp, human
gttgtactaggttgaagcct

SEQ ID NO: 248931 - DNA, 20 bp, human
ggtctcctaatcttcgatat

SEQ ID NO: 248932 - DNA, 20 bp, human
ggcctctttgatggataaag

SEQ ID NO: 248933 - DNA, 20 bp, human
gagtaggctatattaaatag

SEQ ID NO: 248934 - DNA, 20 bp, human
gcaatcctatatcgaagatt

SEQ ID NO: 248935 - DNA, 20 bp, human
gttgggaatttatgatttaa

SEQ ID NO: 248936 - DNA, 20 bp, human
gggcactggaaagaaggagt

SEQ ID NO: 248937 - DNA, 20 bp, human
gacagcacattggaacaacc

SEQ ID NO: 248938 - DNA, 20 bp, human
ggattctggtttaattgtat

SEQ ID NO: 248939 - DNA, 20 bp, human
gtgggaatttatgaccttga

SEQ ID NO: 248940 - DNA, 20 bp, human
gaaaccagaatctcctagat

SEQ ID NO: 248941 - DNA, 20 bp, human
ggaaaggcttttgttatcaa

SEQ ID NO: 248942 - DNA, 20 bp, human
gctccatcatcacagcacat

SEQ ID NO: 248943 - DNA, 20 bp, human
ggaatctcctagattggcac

SEQ ID NO: 248944 - DNA, 20 bp, human
gtggtttaattgtattggat

SEQ ID NO: 248945 - DNA, 20 bp, human
gtctcagattaatgaccagt

SEQ ID NO: 248946 - DNA, 20 bp, human
gagagtggacaatggaacga

SEQ ID NO: 248947 - DNA, 20 bp, human
gcaaccaagtacagtgaaac

SEQ ID NO: 248948 - DNA, 20 bp, human
ggaatgtacagagtggacaa

SEQ ID NO: 248949 - DNA, 20 bp, human
gggcacacaccgaattagca

SEQ ID NO: 248950 - DNA, 20 bp, human
gatggtgcattagaaccatc

SEQ ID NO: 248951 - DNA, 20 bp, human
gctgtacttggttggagcct

SEQ ID NO: 248952 - DNA, 20 bp, human
gattccagtttcactgtact

SEQ ID NO: 248953 - DNA, 20 bp, human
gcaatgctatatcaaagatt

SEQ ID NO: 248954 - DNA, 20 bp, human
gaaacaaatgttaacccaga

SEQ ID NO: 248955 - DNA, 20 bp, human
gatatatgatttaacagaaa

SEQ ID NO: 248956 - DNA, 20 bp, human
gaagcaggggcaagaacctc

SEQ ID NO: 248957 - DNA, 20 bp, human
gaaaccctggttatcccaga

SEQ ID NO: 248958 - DNA, 20 bp, human
gacccagggtaggccggtgg

SEQ ID NO: 248959 - DNA, 20 bp, human
gcccctccaccggcctaccc

SEQ ID NO: 248960 - DNA, 20 bp, human
gcttacccagggtaggccgg

SEQ ID NO: 248961 - DNA, 20 bp, human
gtccgaccaggcccctccac

SEQ ID NO: 248962 - DNA, 20 bp, human
ggtaggccggtggaggggcc

SEQ ID NO: 248963 - DNA, 20 bp, human
gcaacccctcctccagaaca

SEQ ID NO: 248964 - DNA, 20 bp, human
gaggcttcaggagcttggag

SEQ ID NO: 248965 - DNA, 20 bp, human
ggcccttacccagggtaggc

SEQ ID NO: 248966 - DNA, 20 bp, human
gcccgcaatggtggccccca

SEQ ID NO: 248967 - DNA, 20 bp, human
gtccatcctcaccaggtcac

SEQ ID NO: 248968 - DNA, 20 bp, human
gtgacaggtgctagcaacca

SEQ ID NO: 248969 - DNA, 20 bp, human
gctgttggccatcgtttcaa

SEQ ID NO: 248970 - DNA, 20 bp, human
gacgagtagcaagagggcat

SEQ ID NO: 248971 - DNA, 20 bp, human
gttggactgtgtcaacaccc

SEQ ID NO: 248972 - DNA, 20 bp, human
gaccccacgttcttaactat

SEQ ID NO: 248973 - DNA, 20 bp, human
ggtctagaggtggtcggcat

SEQ ID NO: 248974 - DNA, 20 bp, human
gctactccaaacaaatgcat

SEQ ID NO: 248975 - DNA, 20 bp, human
gaggctgattcccgcaatgg

SEQ ID NO: 248976 - DNA, 20 bp, human
gagccctagggccgcaggaa

SEQ ID NO: 248977 - DNA, 20 bp, human
gccagctggaaaggtgccgt

SEQ ID NO: 248978 - DNA, 20 bp, human
gcagctggctgtgagcccta

SEQ ID NO: 248979 - DNA, 20 bp, human
gggggctgtcgcaaaatgat

SEQ ID NO: 248980 - DNA, 20 bp, human
gtggaaaggtgccgtgggag

SEQ ID NO: 248981 - DNA, 20 bp, human
ggaaaggtatggcaagatga

SEQ ID NO: 248982 - DNA, 20 bp, human
gctggttttggggtagtcat

SEQ ID NO: 248983 - DNA, 20 bp, human
ggaaagctttgccccatccc

SEQ ID NO: 248984 - DNA, 20 bp, human
gaaaatgatgggccagggat

SEQ ID NO: 248985 - DNA, 20 bp, human
gtagggccgcaggaaaggta

SEQ ID NO: 248986 - DNA, 20 bp, human
gcagggtgctgcgaaggggc

SEQ ID NO: 248987 - DNA, 20 bp, human
gcagcgcctggcatcttcgc

SEQ ID NO: 248988 - DNA, 20 bp, human
gttcgcagggtgctgcgaag

SEQ ID NO: 248989 - DNA, 20 bp, human
gtgctgcgaaggggcgggct

SEQ ID NO: 248990 - DNA, 20 bp, human
gtgccaggcgctggattccc

SEQ ID NO: 248991 - DNA, 20 bp, human
gcggcggtcccagcaggcga

SEQ ID NO: 248992 - DNA, 20 bp, human
gcacgcaccggtctcagaaa

SEQ ID NO: 248993 - DNA, 20 bp, human
gtgggaggcggggcacggct

SEQ ID NO: 248994 - DNA, 20 bp, human
gacagaggctcaaatgtctg

SEQ ID NO: 248995 - DNA, 20 bp, human
gcggtgattgaaccgaacag

SEQ ID NO: 248996 - DNA, 20 bp, human
ggagctagggcgggacctga

SEQ ID NO: 248997 - DNA, 20 bp, human
gacgccgtgcccccttgcag

SEQ ID NO: 248998 - DNA, 20 bp, human
gtcggcccggagtgggtcac

SEQ ID NO: 248999 - DNA, 20 bp, human
gctgccaatgggagtatggc

SEQ ID NO: 249000 - DNA, 20 bp, human
gcggagtgggtcaccggcag

SEQ ID NO: 249001 - DNA, 20 bp, human
ggaagcgggtgtccctcaaa

SEQ ID NO: 249002 - DNA, 20 bp, human
gcgggccgatgtggaagctt

SEQ ID NO: 249003 - DNA, 20 bp, human
gcggggctccccctgcaagg

SEQ ID NO: 249004 - DNA, 20 bp, human
gagtgggtcaccggcagggg

SEQ ID NO: 249005 - DNA, 20 bp, human
ggcaggagcaagagctcgag

SEQ ID NO: 249006 - DNA, 20 bp, human
gtggtccgggagaaacccgg

SEQ ID NO: 249007 - DNA, 20 bp, human
gcggtggtccgggagaaacc

SEQ ID NO: 249008 - DNA, 20 bp, human
gtgacctcggagacatccgt

SEQ ID NO: 249009 - DNA, 20 bp, human
gcggctgggctagttagggg

SEQ ID NO: 249010 - DNA, 20 bp, human
ggccccgcgcctgacttcgt

SEQ ID NO: 249011 - DNA, 20 bp, human
gcaccgccgccgcctgatgt

SEQ ID NO: 249012 - DNA, 20 bp, human
gcggggagataagcctgccc

SEQ ID NO: 249013 - DNA, 20 bp, human
gggagataagcctgcccagg

SEQ ID NO: 249014 - DNA, 20 bp, human
gttacgcggggcttgggcgg

SEQ ID NO: 249015 - DNA, 20 bp, human
gccaagccccgcgtaaacct

SEQ ID NO: 249016 - DNA, 20 bp, human
gacgcctgggcggaacctgg

SEQ ID NO: 249017 - DNA, 20 bp, human
gctctgctctggaaggtcgg

SEQ ID NO: 249018 - DNA, 20 bp, human
gccactcagcgacgcctggg

SEQ ID NO: 249019 - DNA, 20 bp, human
ggggttggcgggctagcagg

SEQ ID NO: 249020 - DNA, 20 bp, human
gttggcgggctagcaggcgg

SEQ ID NO: 249021 - DNA, 20 bp, human
gtgtaggaacgcccccggat

SEQ ID NO: 249022 - DNA, 20 bp, human
gagggcgggtcctcggccgg

SEQ ID NO: 249023 - DNA, 20 bp, human
gaggcgtcgctgagtggcgg

SEQ ID NO: 249024 - DNA, 20 bp, human
gggtgactgtccctgaaact

SEQ ID NO: 249025 - DNA, 20 bp, human
gcgcggcgcagccaatccgg

SEQ ID NO: 249026 - DNA, 20 bp, human
gcaggcctgcgtggaatgtg

SEQ ID NO: 249027 - DNA, 20 bp, human
ggaggcctataagggtgcgg

SEQ ID NO: 249028 - DNA, 20 bp, human
gctcccgcggaggcctataa

SEQ ID NO: 249029 - DNA, 20 bp, human
gtcagccccacattccacgc

SEQ ID NO: 249030 - DNA, 20 bp, human
gcagcagggccatgaggacg

SEQ ID NO: 249031 - DNA, 20 bp, human
ggtggaacgagcagtttgca

SEQ ID NO: 249032 - DNA, 20 bp, human
gtataagggtgcggggggga

SEQ ID NO: 249033 - DNA, 20 bp, human
gacgggggccctctggggtc

SEQ ID NO: 249034 - DNA, 20 bp, human
gcacccttataggcctccgc

SEQ ID NO: 249035 - DNA, 20 bp, human
gggggctcccctccaagcca

SEQ ID NO: 249036 - DNA, 20 bp, human
gccggccgcgggtccctctg

SEQ ID NO: 249037 - DNA, 20 bp, human
gcccggcctccatggcaacg

SEQ ID NO: 249038 - DNA, 20 bp, human
gcggccaatcagagacgtag

SEQ ID NO: 249039 - DNA, 20 bp, human
ggggccgggctaggactgac

SEQ ID NO: 249040 - DNA, 20 bp, human
gagaaccagccgcgttgcca

SEQ ID NO: 249041 - DNA, 20 bp, human
gaaaaatgcaaggaggggca

SEQ ID NO: 249042 - DNA, 20 bp, human
ggggactgctaggaaggttg

SEQ ID NO: 249043 - DNA, 20 bp, human
ggcggagcccaggaggttac

SEQ ID NO: 249044 - DNA, 20 bp, human
gcgcggaaaaaatgcaagga

SEQ ID NO: 249045 - DNA, 20 bp, human
gaggtgggagggagcgacaa

SEQ ID NO: 249046 - DNA, 20 bp, human
ggcttctccaccttggaagt

SEQ ID NO: 249047 - DNA, 20 bp, human
gtctttgccaacttccaagg

SEQ ID NO: 249048 - DNA, 20 bp, human
ggaggacagccatagagaca

SEQ ID NO: 249049 - DNA, 20 bp, human
ggacaataggattgcatgaa

SEQ ID NO: 249050 - DNA, 20 bp, human
gtctcctgcccttgtctcta

SEQ ID NO: 249051 - DNA, 20 bp, human
gaacaggcgtggaaacacaa

SEQ ID NO: 249052 - DNA, 20 bp, human
gaggagctcacctctgttca

SEQ ID NO: 249053 - DNA, 20 bp, human
gtctgtaggtgtggcttgtt

SEQ ID NO: 249054 - DNA, 20 bp, human
gcacctctgttcagggaaac

SEQ ID NO: 249055 - DNA, 20 bp, human
gtacatctgtgtgaggagtt

SEQ ID NO: 249056 - DNA, 20 bp, human
ggaaggaggtgggtctacag

SEQ ID NO: 249057 - DNA, 20 bp, human
ggacaattggcaaataatta

SEQ ID NO: 249058 - DNA, 20 bp, human
gcagaataggaaatcaaagg

SEQ ID NO: 249059 - DNA, 20 bp, human
gatgctactcctcatatgga

SEQ ID NO: 249060 - DNA, 20 bp, human
gccaaaggttatagattctc

SEQ ID NO: 249061 - DNA, 20 bp, human
gacccaaatccctccatatg

SEQ ID NO: 249062 - DNA, 20 bp, human
gtcctcatatggagggattt

SEQ ID NO: 249063 - DNA, 20 bp, human
gcccttttcaaattgacaat

SEQ ID NO: 249064 - DNA, 20 bp, human
gatatgaggagtagcataag

SEQ ID NO: 249065 - DNA, 20 bp, human
ggttgccaaatcatgcctcc

SEQ ID NO: 249066 - DNA, 20 bp, human
gcaggcagagggaatttcgt

SEQ ID NO: 249067 - DNA, 20 bp, human
gaaggcagccatggaggggc

SEQ ID NO: 249068 - DNA, 20 bp, human
gtgggcttggaaggatacgt

SEQ ID NO: 249069 - DNA, 20 bp, human
gagcttaatcagtgttatcg

SEQ ID NO: 249070 - DNA, 20 bp, human
gaatgaaggcagccatggag

SEQ ID NO: 249071 - DNA, 20 bp, human
ggtgttatcggggagtccaa

SEQ ID NO: 249072 - DNA, 20 bp, human
gactcaaaagaggtcagcaa

SEQ ID NO: 249073 - DNA, 20 bp, human
gtacgtaggagtcatctaga

SEQ ID NO: 249074 - DNA, 20 bp, human
gttcgtgggtaaagatgtgt

SEQ ID NO: 249075 - DNA, 20 bp, human
gtagaacatgaactcaaaag

SEQ ID NO: 249076 - DNA, 20 bp, human
gtctgtaggcatggcttgtt

SEQ ID NO: 249077 - DNA, 20 bp, human
gctgtctggctgggtatgaa

SEQ ID NO: 249078 - DNA, 20 bp, human
gtatttgccaactgccgagg

SEQ ID NO: 249079 - DNA, 20 bp, human
ggcttctccacctcggcagt

SEQ ID NO: 249080 - DNA, 20 bp, human
gcgactgcaggcagagcacg

SEQ ID NO: 249081 - DNA, 20 bp, human
ggacaatagaactgcatgaa

SEQ ID NO: 249082 - DNA, 20 bp, human
gaggtaaagatctgtaggca

SEQ ID NO: 249083 - DNA, 20 bp, human
gtagaatattaactcaatgg

SEQ ID NO: 249084 - DNA, 20 bp, human
gtacttctgtgtgagggggt

SEQ ID NO: 249085 - DNA, 20 bp, human
ggattatttgccaactgccg

SEQ ID NO: 249086 - DNA, 20 bp, human
gtctgtaggcatggcttgtt

SEQ ID NO: 249087 - DNA, 20 bp, human
gctgtctggctgggtatgaa

SEQ ID NO: 249088 - DNA, 20 bp, human
gtatttgccaactgccgagg

SEQ ID NO: 249089 - DNA, 20 bp, human
ggcttctccacctcggcagt

SEQ ID NO: 249090 - DNA, 20 bp, human
gcgactgcaggcagagcacg

SEQ ID NO: 249091 - DNA, 20 bp, human
ggacaatagaactgcatgaa

SEQ ID NO: 249092 - DNA, 20 bp, human
gaggtaaagatctgtaggca

SEQ ID NO: 249093 - DNA, 20 bp, human
gtagaatattaactcaatgg

SEQ ID NO: 249094 - DNA, 20 bp, human
gtacttctgtgtgagggggt

SEQ ID NO: 249095 - DNA, 20 bp, human
ggattatttgccaactgccg

SEQ ID NO: 249096 - DNA, 20 bp, human
ggggccagagcgctgaggat

SEQ ID NO: 249097 - DNA, 20 bp, human
ggacctgagtctgaagaggt

SEQ ID NO: 249098 - DNA, 20 bp, human
gctggggcggtgtggaggtt

SEQ ID NO: 249099 - DNA, 20 bp, human
gaggttggggcggagctctg

SEQ ID NO: 249100 - DNA, 20 bp, human
gccggaggcggagacgtggt

SEQ ID NO: 249101 - DNA, 20 bp, human
gagggacaacgcgttctggg

SEQ ID NO: 249102 - DNA, 20 bp, human
ggccagggacaacgcgttct

SEQ ID NO: 249103 - DNA, 20 bp, human
gcggcggcgcgaagtcctgc

SEQ ID NO: 249104 - DNA, 20 bp, human
gccgactccgacccctccca

SEQ ID NO: 249105 - DNA, 20 bp, human
gggtgaagaccacatgctcg

SEQ ID NO: 249106 - DNA, 20 bp, human
ggttcagaatcaattgacta

SEQ ID NO: 249107 - DNA, 20 bp, human
ggatttgagcacagggggac

SEQ ID NO: 249108 - DNA, 20 bp, human
gcctgtgctcaaatccaggg

SEQ ID NO: 249109 - DNA, 20 bp, human
gccccctgtgctcaaatcca

SEQ ID NO: 249110 - DNA, 20 bp, human
gtttctcccactgttgccct

SEQ ID NO: 249111 - DNA, 20 bp, human
gtagtaactggatgatgata

SEQ ID NO: 249112 - DNA, 20 bp, human
gattatgtctttctagtaac

SEQ ID NO: 249113 - DNA, 20 bp, human
gaggcagtatgctaggtgtg

SEQ ID NO: 249114 - DNA, 20 bp, human
gatccacctagggcaacagt

SEQ ID NO: 249115 - DNA, 20 bp, human
ggagcacagggggacggggg

SEQ ID NO: 249116 - DNA, 20 bp, human
gccacctgtgcttaagtcat

SEQ ID NO: 249117 - DNA, 20 bp, human
ggacttaagcacaggtggac

SEQ ID NO: 249118 - DNA, 20 bp, human
gcctcccatgacttaagcac

SEQ ID NO: 249119 - DNA, 20 bp, human
gaagcacaggtggacagggg

SEQ ID NO: 249120 - DNA, 20 bp, human
ggttctcccactgttcccct

SEQ ID NO: 249121 - DNA, 20 bp, human
ggttcagaatcgattgactt

SEQ ID NO: 249122 - DNA, 20 bp, human
gctttggatgatccacctag

SEQ ID NO: 249123 - DNA, 20 bp, human
gggacaaacagatgctaaca

SEQ ID NO: 249124 - DNA, 20 bp, human
gtattaactggatgatgata

SEQ ID NO: 249125 - DNA, 20 bp, human
gattatgtctttctattaac

SEQ ID NO: 249126 - DNA, 20 bp, human
gtgggctgagtgccataagg

SEQ ID NO: 249127 - DNA, 20 bp, human
gggacgctgacaagatgcat

SEQ ID NO: 249128 - DNA, 20 bp, human
gggctgggctgagtgccata

SEQ ID NO: 249129 - DNA, 20 bp, human
gtgttctaaggaatcaaggt

SEQ ID NO: 249130 - DNA, 20 bp, human
gccagagtataaaggaaccc

SEQ ID NO: 249131 - DNA, 20 bp, human
gtaaatgccagctctcttaa

SEQ ID NO: 249132 - DNA, 20 bp, human
gagtggactccaaaaaaaac

SEQ ID NO: 249133 - DNA, 20 bp, human
ggcatgggtccagagtataa

SEQ ID NO: 249134 - DNA, 20 bp, human
gtgcttgtatgagaagacag

SEQ ID NO: 249135 - DNA, 20 bp, human
gggttgctgtctccgcctta

SEQ ID NO: 249136 - DNA, 20 bp, human
gtgggtgggcatacgggaac

SEQ ID NO: 249137 - DNA, 20 bp, human
gtgggcatacgggaactggt

SEQ ID NO: 249138 - DNA, 20 bp, human
ggaactgtccgaaccagagt

SEQ ID NO: 249139 - DNA, 20 bp, human
gtctggttcggacagttcat

SEQ ID NO: 249140 - DNA, 20 bp, human
gccaaagctgtgtacagccg

SEQ ID NO: 249141 - DNA, 20 bp, human
gaagctgtgtacagccgtgg

SEQ ID NO: 249142 - DNA, 20 bp, human
gcccgtatgcccacccactc

SEQ ID NO: 249143 - DNA, 20 bp, human
ggagagaggatggggatctc

SEQ ID NO: 249144 - DNA, 20 bp, human
gatgcccacccactctggtt

SEQ ID NO: 249145 - DNA, 20 bp, human
gaggatggggatctcaggag

SEQ ID NO: 249146 - DNA, 20 bp, human
gtgagtgggaggggatcttg

SEQ ID NO: 249147 - DNA, 20 bp, human
gacacccagtccatggggat

SEQ ID NO: 249148 - DNA, 20 bp, human
gtgtgagatgttgagacctg

SEQ ID NO: 249149 - DNA, 20 bp, human
gggcaaagacctcctagcag

SEQ ID NO: 249150 - DNA, 20 bp, human
gctggtcgagccaatcccca

SEQ ID NO: 249151 - DNA, 20 bp, human
ggagccaatccccatggact

SEQ ID NO: 249152 - DNA, 20 bp, human
gacctggcgtagggccagct

SEQ ID NO: 249153 - DNA, 20 bp, human
gcccttccaaggcaagagtg

SEQ ID NO: 249154 - DNA, 20 bp, human
gaccaaccaaaacctggcgt

SEQ ID NO: 249155 - DNA, 20 bp, human
gcggaaggctgtgggaggcg

SEQ ID NO: 249156 - DNA, 20 bp, human
gtgggcccaaccccaggttt

SEQ ID NO: 249157 - DNA, 20 bp, human
gggcagccagccaaaacctg

SEQ ID NO: 249158 - DNA, 20 bp, human
gggccctggcccctgatcta

SEQ ID NO: 249159 - DNA, 20 bp, human
gaagttggagggtggttaga

SEQ ID NO: 249160 - DNA, 20 bp, human
ggggaaggccgtaggaggcg

SEQ ID NO: 249161 - DNA, 20 bp, human
gctcaggggtgagtaaacga

SEQ ID NO: 249162 - DNA, 20 bp, human
gacctggggttgggcccact

SEQ ID NO: 249163 - DNA, 20 bp, human
gaggcacggaagacacaccc

SEQ ID NO: 249164 - DNA, 20 bp, human
ggccagccaaaacctggggt

SEQ ID NO: 249165 - DNA, 20 bp, human
ggcccactgggtgcagctca

SEQ ID NO: 249166 - DNA, 20 bp, human
gggtgcagaggaatcagctc

SEQ ID NO: 249167 - DNA, 20 bp, human
ggctcagggtccagatggat

SEQ ID NO: 249168 - DNA, 20 bp, human
gccaatcaacacctggcgtc

SEQ ID NO: 249169 - DNA, 20 bp, human
ggagacacatccaggctgca

SEQ ID NO: 249170 - DNA, 20 bp, human
ggataaacgtacagctaaga

SEQ ID NO: 249171 - DNA, 20 bp, human
gacctggcgtcaggccagct

SEQ ID NO: 249172 - DNA, 20 bp, human
gtgggcagccaatcaacacc

SEQ ID NO: 249173 - DNA, 20 bp, human
gacccagctggcctgacgcc

SEQ ID NO: 249174 - DNA, 20 bp, human
gacatccaggctgcagggat

SEQ ID NO: 249175 - DNA, 20 bp, human
ggtgcatctacccatccatc

SEQ ID NO: 249176 - DNA, 20 bp, human
gagcccggggcgggatgtcc

SEQ ID NO: 249177 - DNA, 20 bp, human
gcgggctcccgcagggttct

SEQ ID NO: 249178 - DNA, 20 bp, human
gtccccgcccagaaccctgc

SEQ ID NO: 249179 - DNA, 20 bp, human
gagaacaagaaataggcgtg

SEQ ID NO: 249180 - DNA, 20 bp, human
gtggaagtaagggccatggg

SEQ ID NO: 249181 - DNA, 20 bp, human
gacggccgggcggggttaaa

SEQ ID NO: 249182 - DNA, 20 bp, human
gaaataggcgtgtggagggg

SEQ ID NO: 249183 - DNA, 20 bp, human
gcaagaaataggcgtgtgga

SEQ ID NO: 249184 - DNA, 20 bp, human
gaatgcggcccagcagtggc

SEQ ID NO: 249185 - DNA, 20 bp, human
gaggagggcggggagcctga

SEQ ID NO: 249186 - DNA, 20 bp, human
ggggcactgggcaagggatt

SEQ ID NO: 249187 - DNA, 20 bp, human
gtgggtgccgctcccatgtc

SEQ ID NO: 249188 - DNA, 20 bp, human
gtcccctggcccctgatgta

SEQ ID NO: 249189 - DNA, 20 bp, human
gctggccaaaacctgggtgt

SEQ ID NO: 249190 - DNA, 20 bp, human
gaacagggatggataaacag

SEQ ID NO: 249191 - DNA, 20 bp, human
gtgggcagcaatggagaatg

SEQ ID NO: 249192 - DNA, 20 bp, human
gggcaacgtcctaatgattc

SEQ ID NO: 249193 - DNA, 20 bp, human
ggtctcccacacccaggttt

SEQ ID NO: 249194 - DNA, 20 bp, human
gacagccttccctacatcag

SEQ ID NO: 249195 - DNA, 20 bp, human
gtctcaatctaagtgcttac

SEQ ID NO: 249196 - DNA, 20 bp, human
gcaaaacccggggactggtg

SEQ ID NO: 249197 - DNA, 20 bp, human
gccaaccaaaacccggggac

SEQ ID NO: 249198 - DNA, 20 bp, human
gggcagccaaccaaaacccg

SEQ ID NO: 249199 - DNA, 20 bp, human
gcaccagccaacttgacctc

SEQ ID NO: 249200 - DNA, 20 bp, human
gaccaggggaaggtaggtaa

SEQ ID NO: 249201 - DNA, 20 bp, human
gtggcagggctggataggga

SEQ ID NO: 249202 - DNA, 20 bp, human
gggtgcttgcaggtaaccag

SEQ ID NO: 249203 - DNA, 20 bp, human
gtggctggtggttctagatg

SEQ ID NO: 249204 - DNA, 20 bp, human
gagcaaaaacctcctggcaa

SEQ ID NO: 249205 - DNA, 20 bp, human
gggctgccctggcacaaagg

SEQ ID NO: 249206 - DNA, 20 bp, human
gaggaggccggcgacacttc

SEQ ID NO: 249207 - DNA, 20 bp, human
ggcagcccggcgcgccccag

SEQ ID NO: 249208 - DNA, 20 bp, human
gcctccggatgcggggtcag

SEQ ID NO: 249209 - DNA, 20 bp, human
gagagcacgcaggggcgggt

SEQ ID NO: 249210 - DNA, 20 bp, human
gcctcagaacagccccgctg

SEQ ID NO: 249211 - DNA, 20 bp, human
gaggcggccggaagtgtcgc

SEQ ID NO: 249212 - DNA, 20 bp, human
gcggggaagtgggcggtgtg

SEQ ID NO: 249213 - DNA, 20 bp, human
gggcgtcggaaaggtcaccg

SEQ ID NO: 249214 - DNA, 20 bp, human
gggcgtagtgattgcactgg

SEQ ID NO: 249215 - DNA, 20 bp, human
gcgggcgggaaacgtcgttc

SEQ ID NO: 249216 - DNA, 20 bp, human
gttcccaggtggtagaggta

SEQ ID NO: 249217 - DNA, 20 bp, human
gagacccaagcagccacacg

SEQ ID NO: 249218 - DNA, 20 bp, human
gaaagcgcgcacgcttcgtt

SEQ ID NO: 249219 - DNA, 20 bp, human
gtgggtctcatgcccatgaa

SEQ ID NO: 249220 - DNA, 20 bp, human
gtaccggaacaccactaggc

SEQ ID NO: 249221 - DNA, 20 bp, human
gcgcgtgcgggatttctagc

SEQ ID NO: 249222 - DNA, 20 bp, human
gtaggcaggccacaggataa

SEQ ID NO: 249223 - DNA, 20 bp, human
gggcctgcctagtggtgttc

SEQ ID NO: 249224 - DNA, 20 bp, human
gagggcactgaacactgaac

SEQ ID NO: 249225 - DNA, 20 bp, human
gccactatacaggtacagtc

SEQ ID NO: 249226 - DNA, 20 bp, human
gaacaagtgttatactctgg

SEQ ID NO: 249227 - DNA, 20 bp, human
gataatcagggaagctggaa

SEQ ID NO: 249228 - DNA, 20 bp, human
gtatcgtcacccaaaatctt

SEQ ID NO: 249229 - DNA, 20 bp, human
gggaacttttagattctgga

SEQ ID NO: 249230 - DNA, 20 bp, human
gaagtgttatactctggtgg

SEQ ID NO: 249231 - DNA, 20 bp, human
gatgtatagaggtgtgacaa

SEQ ID NO: 249232 - DNA, 20 bp, human
gggtatatacctaagatttt

SEQ ID NO: 249233 - DNA, 20 bp, human
ggcatcctgtaggagctttt

SEQ ID NO: 249234 - DNA, 20 bp, human
gtcatccaaaaagctcctac

SEQ ID NO: 249235 - DNA, 20 bp, human
ggatgggaacttttagattc

SEQ ID NO: 249236 - DNA, 20 bp, human
gaccccgtgcgtcacagaat

SEQ ID NO: 249237 - DNA, 20 bp, human
gggccccgctgacgcgatgt

SEQ ID NO: 249238 - DNA, 20 bp, human
gcgtgcgtcacagaatgggg

SEQ ID NO: 249239 - DNA, 20 bp, human
gcacccgggcacacaaaaaa

SEQ ID NO: 249240 - DNA, 20 bp, human
ggggtcgcccgcgattctca

SEQ ID NO: 249241 - DNA, 20 bp, human
gaagccgtggtcttcttgcg

SEQ ID NO: 249242 - DNA, 20 bp, human
gtcggcctacatcgcgtcag

SEQ ID NO: 249243 - DNA, 20 bp, human
gtgccgggacacggcgttga

SEQ ID NO: 249244 - DNA, 20 bp, human
gcgagcgcctgaggtgatct

SEQ ID NO: 249245 - DNA, 20 bp, human
gcgcgtgggacccgaggggt

SEQ ID NO: 249246 - DNA, 20 bp, human
gagtccacaggtatcagaag

SEQ ID NO: 249247 - DNA, 20 bp, human
ggaaccacttctgatacctg

SEQ ID NO: 249248 - DNA, 20 bp, human
gggccttgaactaagtccac

SEQ ID NO: 249249 - DNA, 20 bp, human
gtacctgtggacttagttca

SEQ ID NO: 249250 - DNA, 20 bp, human
gagacggtgatcaagttcag

SEQ ID NO: 249251 - DNA, 20 bp, human
gtgcaggtctctgattgctt

SEQ ID NO: 249252 - DNA, 20 bp, human
gacagctaatattaagagtt

SEQ ID NO: 249253 - DNA, 20 bp, human
gttgacttaacattcggacc

SEQ ID NO: 249254 - DNA, 20 bp, human
gtcaacttatcaagtattgc

SEQ ID NO: 249255 - DNA, 20 bp, human
gaagctcaagttaatggatc

SEQ ID NO: 249256 - DNA, 20 bp, human
gggaacggggcggtacgcgt

SEQ ID NO: 249257 - DNA, 20 bp, human
gtcctcccgggcaggaagaa

SEQ ID NO: 249258 - DNA, 20 bp, human
ggggcgcgggctaagaagtg

SEQ ID NO: 249259 - DNA, 20 bp, human
ggtacgcgtgggtggaggat

SEQ ID NO: 249260 - DNA, 20 bp, human
ggggcggtacgcgtgggtgg

SEQ ID NO: 249261 - DNA, 20 bp, human
gggcggcgccccctagtcca

SEQ ID NO: 249262 - DNA, 20 bp, human
gacagcgcccttgatcctcc

SEQ ID NO: 249263 - DNA, 20 bp, human
gacggggcggtacgcgtggg

SEQ ID NO: 249264 - DNA, 20 bp, human
gtaagaagtgaggaacccaa

SEQ ID NO: 249265 - DNA, 20 bp, human
ggccgggtcggaaacggtgg

SEQ ID NO: 249266 - DNA, 20 bp, human
gttcccctggacttaacact

SEQ ID NO: 249267 - DNA, 20 bp, human
gtggctgactggtcacgtag

SEQ ID NO: 249268 - DNA, 20 bp, human
gctgactggtcacgtagggg

SEQ ID NO: 249269 - DNA, 20 bp, human
gggtcacgtaggggaggagg

SEQ ID NO: 249270 - DNA, 20 bp, human
gcggccacagggcaaggtcc

SEQ ID NO: 249271 - DNA, 20 bp, human
gactggtcacgtaggggagg

SEQ ID NO: 249272 - DNA, 20 bp, human
gacactagtgagacagtact

SEQ ID NO: 249273 - DNA, 20 bp, human
ggagcagctgtgaccatagc

SEQ ID NO: 249274 - DNA, 20 bp, human
gcaaggcaggcttagagaga

SEQ ID NO: 249275 - DNA, 20 bp, human
ggtgggagtgggctcaaggc

SEQ ID NO: 249276 - DNA, 20 bp, human
gcaggaatgctggttggcgc

SEQ ID NO: 249277 - DNA, 20 bp, human
gccgcgtgttgcagtgacgt

SEQ ID NO: 249278 - DNA, 20 bp, human
gaaaggtgcaatggagccag

SEQ ID NO: 249279 - DNA, 20 bp, human
gtgctgccaagcgcctcccc

SEQ ID NO: 249280 - DNA, 20 bp, human
gcgtcaagaaaacagttcgg

SEQ ID NO: 249281 - DNA, 20 bp, human
gcgccggcccgtataaaagg

SEQ ID NO: 249282 - DNA, 20 bp, human
gcacacacacaaaggtgcaa

SEQ ID NO: 249283 - DNA, 20 bp, human
gctccgccggcccgtataaa

SEQ ID NO: 249284 - DNA, 20 bp, human
gcagaattctcaaacatctc

SEQ ID NO: 249285 - DNA, 20 bp, human
ggtagttggagggtcgtgag

SEQ ID NO: 249286 - DNA, 20 bp, human
gcgaccgcggccaggggcta

SEQ ID NO: 249287 - DNA, 20 bp, human
ggccgggggcggggacgcta

SEQ ID NO: 249288 - DNA, 20 bp, human
ggcgccgccgcctcagagtc

SEQ ID NO: 249289 - DNA, 20 bp, human
ggccccgcggggaggctctc

SEQ ID NO: 249290 - DNA, 20 bp, human
gacgctagggggtgcggccg

SEQ ID NO: 249291 - DNA, 20 bp, human
ggggacccgtgggcgggagt

SEQ ID NO: 249292 - DNA, 20 bp, human
gcccggccgcgccccctcat

SEQ ID NO: 249293 - DNA, 20 bp, human
gaggggctagggttcccggg

SEQ ID NO: 249294 - DNA, 20 bp, human
gcagccggactctgaggcgg

SEQ ID NO: 249295 - DNA, 20 bp, human
ggaggtccgggaagcgaccg

SEQ ID NO: 249296 - DNA, 20 bp, human
gaagatgatctggaatgact

SEQ ID NO: 249297 - DNA, 20 bp, human
gtttaagaggggagagagca

SEQ ID NO: 249298 - DNA, 20 bp, human
gtattcagctgctctaagat

SEQ ID NO: 249299 - DNA, 20 bp, human
gctgctctaagatgggaagc

SEQ ID NO: 249300 - DNA, 20 bp, human
gaggtcattagactatttgt

SEQ ID NO: 249301 - DNA, 20 bp, human
ggacttctctggtgcaaagt

SEQ ID NO: 249302 - DNA, 20 bp, human
gaccagagaagtcagactcc

SEQ ID NO: 249303 - DNA, 20 bp, human
gagagccacaagtgtcatta

SEQ ID NO: 249304 - DNA, 20 bp, human
gcttcaggaatagaattctc

SEQ ID NO: 249305 - DNA, 20 bp, human
gttgaaggctaatctgaaag

SEQ ID NO: 249306 - DNA, 20 bp, human
gaggctgcaatatcatagta

SEQ ID NO: 249307 - DNA, 20 bp, human
gtaaggtattcatgtcaaca

SEQ ID NO: 249308 - DNA, 20 bp, human
gcttcaaccaaacaaattaa

SEQ ID NO: 249309 - DNA, 20 bp, human
gttaaaagaatgactaggct

SEQ ID NO: 249310 - DNA, 20 bp, human
gtcatgtcaacagggtcagt

SEQ ID NO: 249311 - DNA, 20 bp, human
gtggacatagaatactagtt

SEQ ID NO: 249312 - DNA, 20 bp, human
ggaatagccattaatttgtt

SEQ ID NO: 249313 - DNA, 20 bp, human
gctctaggttttaatgaaac

SEQ ID NO: 249314 - DNA, 20 bp, human
gaagttgagttttaaaacac

SEQ ID NO: 249315 - DNA, 20 bp, human
gcatagaatactagtttggc

SEQ ID NO: 249316 - DNA, 20 bp, human
ggaggcccacgttgggaagt

SEQ ID NO: 249317 - DNA, 20 bp, human
gggaagcgctctcttgcagt

SEQ ID NO: 249318 - DNA, 20 bp, human
gagaaccaatccaatctgag

SEQ ID NO: 249319 - DNA, 20 bp, human
gcagctgggaggcccacgtt

SEQ ID NO: 249320 - DNA, 20 bp, human
gtgcaagagagcgcttccgg

SEQ ID NO: 249321 - DNA, 20 bp, human
gtcggcgcagtcgggaggcg

SEQ ID NO: 249322 - DNA, 20 bp, human
gtgcagtcggcgcagtcggg

SEQ ID NO: 249323 - DNA, 20 bp, human
ggtctccgacttcccaacgt

SEQ ID NO: 249324 - DNA, 20 bp, human
gctagcggagttggggtatc

SEQ ID NO: 249325 - DNA, 20 bp, human
gtggcatgaggggtcggctg

SEQ ID NO: 249326 - DNA, 20 bp, human
ggggcgtggtctagaggcgg

SEQ ID NO: 249327 - DNA, 20 bp, human
ggggaggaggccgggtaccc

SEQ ID NO: 249328 - DNA, 20 bp, human
ggcgccgcaccccgggtacc

SEQ ID NO: 249329 - DNA, 20 bp, human
ggaagggcggtgcaagtccc

SEQ ID NO: 249330 - DNA, 20 bp, human
gtctcccggtccgcctcctg

SEQ ID NO: 249331 - DNA, 20 bp, human
gtgtgtgtgtctcgggacgg

SEQ ID NO: 249332 - DNA, 20 bp, human
ggtgcgcaggccggagcctc

SEQ ID NO: 249333 - DNA, 20 bp, human
gcgcaggccggagcctcggg

SEQ ID NO: 249334 - DNA, 20 bp, human
gggaccgggagaaggggggg

SEQ ID NO: 249335 - DNA, 20 bp, human
gcggggtggcggactcgacc

SEQ ID NO: 249336 - DNA, 20 bp, human
ggccctgcctgcactccgat

SEQ ID NO: 249337 - DNA, 20 bp, human
gaggggcggtccctactgaa

SEQ ID NO: 249338 - DNA, 20 bp, human
gaggacgaaagcgcccactg

SEQ ID NO: 249339 - DNA, 20 bp, human
gcagaggtagacggcccgcg

SEQ ID NO: 249340 - DNA, 20 bp, human
gacaacagaaagcacttgac

SEQ ID NO: 249341 - DNA, 20 bp, human
gtccgcgcgacacttttccg

SEQ ID NO: 249342 - DNA, 20 bp, human
gtggccggacatacctacac

SEQ ID NO: 249343 - DNA, 20 bp, human
ggccaatcggagtgcaggca

SEQ ID NO: 249344 - DNA, 20 bp, human
gatgtccggccagaggtaga

SEQ ID NO: 249345 - DNA, 20 bp, human
ggcggtccctactgaagggg

SEQ ID NO: 249346 - DNA, 20 bp, human
gcggcccggccggttcccga

SEQ ID NO: 249347 - DNA, 20 bp, human
gctggggaaggctgtagacc

SEQ ID NO: 249348 - DNA, 20 bp, human
gcagacgccgccggcccggc

SEQ ID NO: 249349 - DNA, 20 bp, human
gcgggcggggcctcgctggt

SEQ ID NO: 249350 - DNA, 20 bp, human
gcccggccggttcccgaggg

SEQ ID NO: 249351 - DNA, 20 bp, human
gcgctccacgcacaccggat

SEQ ID NO: 249352 - DNA, 20 bp, human
gggatcggcctgcacttcag

SEQ ID NO: 249353 - DNA, 20 bp, human
ggcaggctactggaatgctg

SEQ ID NO: 249354 - DNA, 20 bp, human
gagggagcgcgcaggcgacc

SEQ ID NO: 249355 - DNA, 20 bp, human
gcatgccccgcctctgcccg

SEQ ID NO: 249356 - DNA, 20 bp, human
ggccgacccagctgctgttc

SEQ ID NO: 249357 - DNA, 20 bp, human
gctgcacacgagacccccgt

SEQ ID NO: 249358 - DNA, 20 bp, human
gcaaacaaacagatgaagtg

SEQ ID NO: 249359 - DNA, 20 bp, human
ggccagcccgaacagcagct

SEQ ID NO: 249360 - DNA, 20 bp, human
ggcagcagggacttttgcca

SEQ ID NO: 249361 - DNA, 20 bp, human
ggcgtcaccttgactgtaac

SEQ ID NO: 249362 - DNA, 20 bp, human
gagctgggtcggcaagcgac

SEQ ID NO: 249363 - DNA, 20 bp, human
ggaagtcagtcctggcccac

SEQ ID NO: 249364 - DNA, 20 bp, human
gactgacttcctccccacac

SEQ ID NO: 249365 - DNA, 20 bp, human
gcagggacttttgccaggga

SEQ ID NO: 249366 - DNA, 20 bp, human
gagagcccatgtgacctctg

SEQ ID NO: 249367 - DNA, 20 bp, human
ggggagtgaatagcaagata

SEQ ID NO: 249368 - DNA, 20 bp, human
gcaaaccacagaggtcacat

SEQ ID NO: 249369 - DNA, 20 bp, human
ggaaacaaatggtagcactt

SEQ ID NO: 249370 - DNA, 20 bp, human
gcataaaagcgtaagaattc

SEQ ID NO: 249371 - DNA, 20 bp, human
gtaagaattctggctgtttg

SEQ ID NO: 249372 - DNA, 20 bp, human
gctaatgttaagtaagagaa

SEQ ID NO: 249373 - DNA, 20 bp, human
gattagctccaggttctctc

SEQ ID NO: 249374 - DNA, 20 bp, human
gtgaatggttacaacctcag

SEQ ID NO: 249375 - DNA, 20 bp, human
gttgagtggccttgcaggat

SEQ ID NO: 249376 - DNA, 20 bp, human
gtgtcccgaccctgcccggt

SEQ ID NO: 249377 - DNA, 20 bp, human
gtggggctttcgtgtctgag

SEQ ID NO: 249378 - DNA, 20 bp, human
gagccccaggttaagaggag

SEQ ID NO: 249379 - DNA, 20 bp, human
ggcaggctgcggtccatcca

SEQ ID NO: 249380 - DNA, 20 bp, human
gggctgcggtccatccaggg

SEQ ID NO: 249381 - DNA, 20 bp, human
gcacgcccaccgggcagggt

SEQ ID NO: 249382 - DNA, 20 bp, human
ggagggaaagggactagcag

SEQ ID NO: 249383 - DNA, 20 bp, human
gaggaagccagcacgcccac

SEQ ID NO: 249384 - DNA, 20 bp, human
ggcgctggccccacaggaag

SEQ ID NO: 249385 - DNA, 20 bp, human
gcagcccctcctcttaacct

SEQ ID NO: 249386 - DNA, 20 bp, human
ggggaagtacagaaagtgta

SEQ ID NO: 249387 - DNA, 20 bp, human
gaaaggaaaaattgtagtgg

SEQ ID NO: 249388 - DNA, 20 bp, human
gccgcgggtggcaacgactg

SEQ ID NO: 249389 - DNA, 20 bp, human
ggaaggaagaacccgggctt

SEQ ID NO: 249390 - DNA, 20 bp, human
gtagcaatcgccaaagcaag

SEQ ID NO: 249391 - DNA, 20 bp, human
gtctttagaaggaagaaccc

SEQ ID NO: 249392 - DNA, 20 bp, human
gccttctaaagagtgactag

SEQ ID NO: 249393 - DNA, 20 bp, human
gggtggcaacgactgcgggc

SEQ ID NO: 249394 - DNA, 20 bp, human
ggtgacagtgaagaaaactc

SEQ ID NO: 249395 - DNA, 20 bp, human
gaaggaattttcagggttga

SEQ ID NO: 249396 - DNA, 20 bp, human
gactgggccacctctggcgt

SEQ ID NO: 249397 - DNA, 20 bp, human
gtggtccagggctctcctaa

SEQ ID NO: 249398 - DNA, 20 bp, human
gctatgacatataggtttca

SEQ ID NO: 249399 - DNA, 20 bp, human
gaaaccccttaggagagccc

SEQ ID NO: 249400 - DNA, 20 bp, human
gaataattattgattaggca

SEQ ID NO: 249401 - DNA, 20 bp, human
gcttttctagcctacgccag

SEQ ID NO: 249402 - DNA, 20 bp, human
gatgctttctaatagaaaac

SEQ ID NO: 249403 - DNA, 20 bp, human
gttcgtgatgtactggtcca

SEQ ID NO: 249404 - DNA, 20 bp, human
gggtttgtccccatgaaagc

SEQ ID NO: 249405 - DNA, 20 bp, human
gtcatggggacaaacccctt

SEQ ID NO: 249406 - DNA, 20 bp, human
gcggggcggggcttggacgg

SEQ ID NO: 249407 - DNA, 20 bp, human
gctgtcgggcgcatccctcc

SEQ ID NO: 249408 - DNA, 20 bp, human
gccgccccgactggcaccgg

SEQ ID NO: 249409 - DNA, 20 bp, human
ggaaacgcaggacgaggcgg

SEQ ID NO: 249410 - DNA, 20 bp, human
ggagcctccggtgccagtcg

SEQ ID NO: 249411 - DNA, 20 bp, human
gactggcaccggaggctcga

SEQ ID NO: 249412 - DNA, 20 bp, human
ggccccgccccgactggcac

SEQ ID NO: 249413 - DNA, 20 bp, human
gactgtaggcgcgcagggct

SEQ ID NO: 249414 - DNA, 20 bp, human
gaaccctccagctgctgctt

SEQ ID NO: 249415 - DNA, 20 bp, human
gcctcaggaaacgcaggacg

SEQ ID NO: 249416 - DNA, 20 bp, human
gaataagaggcggggcagaa

SEQ ID NO: 249417 - DNA, 20 bp, human
gaagaggcggggcagaaggg

SEQ ID NO: 249418 - DNA, 20 bp, human
ggtcgggcgcgcagactcct

SEQ ID NO: 249419 - DNA, 20 bp, human
gccactgcgcatggacgctc

SEQ ID NO: 249420 - DNA, 20 bp, human
gcgcctgataggatacaaag

SEQ ID NO: 249421 - DNA, 20 bp, human
ggattgggaccactactccc

SEQ ID NO: 249422 - DNA, 20 bp, human
gccggctccgctaatagatt

SEQ ID NO: 249423 - DNA, 20 bp, human
gcaaggctgtaaggctggga

SEQ ID NO: 249424 - DNA, 20 bp, human
ggcgcatggacgctccggtc

SEQ ID NO: 249425 - DNA, 20 bp, human
gcaggggctgctcaggtaag

SEQ ID NO: 249426 - DNA, 20 bp, human
gagggcgaggcgtacaatga

SEQ ID NO: 249427 - DNA, 20 bp, human
gagaacgctccctgccaaag

SEQ ID NO: 249428 - DNA, 20 bp, human
gtctccccggctcctcctct

SEQ ID NO: 249429 - DNA, 20 bp, human
ggtacgcctcgccctgccgg

SEQ ID NO: 249430 - DNA, 20 bp, human
gtgggcagcgggtttctccc

SEQ ID NO: 249431 - DNA, 20 bp, human
gtcagaccgaacgcaggcgg

SEQ ID NO: 249432 - DNA, 20 bp, human
ggagcgggatatttatggca

SEQ ID NO: 249433 - DNA, 20 bp, human
ggcaatcagaagtctaccta

SEQ ID NO: 249434 - DNA, 20 bp, human
gttggcagggagcgttctca

SEQ ID NO: 249435 - DNA, 20 bp, human
gggcggcggcgccgtacctc

SEQ ID NO: 249436 - DNA, 20 bp, human
ggagaagggagtctgcgagt

SEQ ID NO: 249437 - DNA, 20 bp, human
ggaggggctcccctattcgg

SEQ ID NO: 249438 - DNA, 20 bp, human
ggctgcaggaagaggtggcg

SEQ ID NO: 249439 - DNA, 20 bp, human
gggcctgaatgtgagctctg

SEQ ID NO: 249440 - DNA, 20 bp, human
gctccgctacggtcacagtg

SEQ ID NO: 249441 - DNA, 20 bp, human
gtggcgcggcctgaccgacc

SEQ ID NO: 249442 - DNA, 20 bp, human
gcagactcccttctccgcta

SEQ ID NO: 249443 - DNA, 20 bp, human
gaatgcggtagtgatgtata

SEQ ID NO: 249444 - DNA, 20 bp, human
gtaggtggcgaaatgctgag

SEQ ID NO: 249445 - DNA, 20 bp, human
gtaccgcattcccccgaata

SEQ ID NO: 249446 - DNA, 20 bp, human
gtgcgcagagagcgccccgg

SEQ ID NO: 249447 - DNA, 20 bp, human
gggccccgcgtcagagtagg

SEQ ID NO: 249448 - DNA, 20 bp, human
gcggcctcgcggctccctcc

SEQ ID NO: 249449 - DNA, 20 bp, human
gcggggagctagcaggtgag

SEQ ID NO: 249450 - DNA, 20 bp, human
gagcgtggagagggtaaggg

SEQ ID NO: 249451 - DNA, 20 bp, human
gaccggccccgcgtcagagt

SEQ ID NO: 249452 - DNA, 20 bp, human
gcggcggccggggagctagc

SEQ ID NO: 249453 - DNA, 20 bp, human
gcgccagcgtggagagggta

SEQ ID NO: 249454 - DNA, 20 bp, human
gctctccatcccagcgtgga

SEQ ID NO: 249455 - DNA, 20 bp, human
gagagacgagccgagagcga

SEQ ID NO: 249456 - DNA, 20 bp, human
gcgatcgcccccagctggtg

SEQ ID NO: 249457 - DNA, 20 bp, human
gccgcgagccccaccagctg

SEQ ID NO: 249458 - DNA, 20 bp, human
ggggaggggaaatgtgttcg

SEQ ID NO: 249459 - DNA, 20 bp, human
gccccgcccgcgtcggtctg

SEQ ID NO: 249460 - DNA, 20 bp, human
gcggggggcgggtgcaaata

SEQ ID NO: 249461 - DNA, 20 bp, human
gcagggacccagcgacggga

SEQ ID NO: 249462 - DNA, 20 bp, human
gggtggggctcgcggagctc

SEQ ID NO: 249463 - DNA, 20 bp, human
gctcgcggagctcaggggag

SEQ ID NO: 249464 - DNA, 20 bp, human
gatcgcagggacccagcgac

SEQ ID NO: 249465 - DNA, 20 bp, human
gcggctccgaagctcccggc

SEQ ID NO: 249466 - DNA, 20 bp, human
gcctcgggacgacccgtctg

SEQ ID NO: 249467 - DNA, 20 bp, human
gggtgggagccagaaccctc

SEQ ID NO: 249468 - DNA, 20 bp, human
gacgacccgtctggggtccc

SEQ ID NO: 249469 - DNA, 20 bp, human
gcggcccggaaagtcagtgc

SEQ ID NO: 249470 - DNA, 20 bp, human
gtggggtcccggggaaactc

SEQ ID NO: 249471 - DNA, 20 bp, human
ggcctcgccccgccgattcc

SEQ ID NO: 249472 - DNA, 20 bp, human
gtctcccgcactgactttcc

SEQ ID NO: 249473 - DNA, 20 bp, human
gaatcccggcctggaatcgg

SEQ ID NO: 249474 - DNA, 20 bp, human
gtggtgcgccctcaggtcga

SEQ ID NO: 249475 - DNA, 20 bp, human
gtgcgggagaaatcccggcc

SEQ ID NO: 249476 - DNA, 20 bp, human
ggggagcgtgcgaggaaagg

SEQ ID NO: 249477 - DNA, 20 bp, human
gactggagagggagcgtgcg

SEQ ID NO: 249478 - DNA, 20 bp, human
gtctgctccgagttcctggt

SEQ ID NO: 249479 - DNA, 20 bp, human
ggggacacagaagtggcgat

SEQ ID NO: 249480 - DNA, 20 bp, human
gctccgagagcgcgagacac

SEQ ID NO: 249481 - DNA, 20 bp, human
gtacggaaagaaactgtggg

SEQ ID NO: 249482 - DNA, 20 bp, human
ggtcacacggtgcagagggg

SEQ ID NO: 249483 - DNA, 20 bp, human
gcagaagtggcgatcggaaa

SEQ ID NO: 249484 - DNA, 20 bp, human
ggttcctggttggataattt

SEQ ID NO: 249485 - DNA, 20 bp, human
gccagtccccgcggacgaaa

SEQ ID NO: 249486 - DNA, 20 bp, human
gcagaagggctggggcccat

SEQ ID NO: 249487 - DNA, 20 bp, human
gggagcgctcgggcgcagaa

SEQ ID NO: 249488 - DNA, 20 bp, human
ggcagccattcggagcgctc

SEQ ID NO: 249489 - DNA, 20 bp, human
gaggggatctagaggagtca

SEQ ID NO: 249490 - DNA, 20 bp, human
gtgcgcccgagcgctccgaa

SEQ ID NO: 249491 - DNA, 20 bp, human
gtgaggaggtggagactccc

SEQ ID NO: 249492 - DNA, 20 bp, human
gagtgagggagtgagtgcga

SEQ ID NO: 249493 - DNA, 20 bp, human
gagtcagggcgagaaagcga

SEQ ID NO: 249494 - DNA, 20 bp, human
gatggctgccgctggtgagg

SEQ ID NO: 249495 - DNA, 20 bp, human
ggaggtggagactccctggc

SEQ ID NO: 249496 - DNA, 20 bp, human
gaggcccgcgaagagagcgg

SEQ ID NO: 249497 - DNA, 20 bp, human
ggggtgcagtaaacccgaaa

SEQ ID NO: 249498 - DNA, 20 bp, human
ggcggcgcgcctgacagagg

SEQ ID NO: 249499 - DNA, 20 bp, human
gcgggcggcgcgcctgacag

SEQ ID NO: 249500 - DNA, 20 bp, human
gaggaggcccgcgaagagag

SEQ ID NO: 249501 - DNA, 20 bp, human
ggaggagcgagggcaaaatc

SEQ ID NO: 249502 - DNA, 20 bp, human
gcgactgtaacaggatgctg

SEQ ID NO: 249503 - DNA, 20 bp, human
gggcgcaagcgtcgcagccg

SEQ ID NO: 249504 - DNA, 20 bp, human
gaaacctaactcggtgtgag

SEQ ID NO: 249505 - DNA, 20 bp, human
gcccgcgaagagagcggggg

SEQ ID NO: 249506 - DNA, 20 bp, human
gaccccccagggcccctcgc

SEQ ID NO: 249507 - DNA, 20 bp, human
gagaggcgcaagtggaacaa

SEQ ID NO: 249508 - DNA, 20 bp, human
gggaggccgcggtgacctcg

SEQ ID NO: 249509 - DNA, 20 bp, human
gccgccccgccgacccccca

SEQ ID NO: 249510 - DNA, 20 bp, human
gggcgcaagtggaacaaagg

SEQ ID NO: 249511 - DNA, 20 bp, human
ggctccgcaggtcgccaagg

SEQ ID NO: 249512 - DNA, 20 bp, human
gaggggcaaagaggcgcaag

SEQ ID NO: 249513 - DNA, 20 bp, human
gagcgcctccgtgacttcag

SEQ ID NO: 249514 - DNA, 20 bp, human
gcctgcccgcagccggcgag

SEQ ID NO: 249515 - DNA, 20 bp, human
ggtcggcggggcgggtccgg

SEQ ID NO: 249516 - DNA, 20 bp, human
gcttcctgacgaagactctc

SEQ ID NO: 249517 - DNA, 20 bp, human
gcccctccgtgcaactgcct

SEQ ID NO: 249518 - DNA, 20 bp, human
gccccgaggcagttgcacgg

SEQ ID NO: 249519 - DNA, 20 bp, human
gtgcgagcatgcgtcgtgtt

SEQ ID NO: 249520 - DNA, 20 bp, human
gccggccaggcacagaccaa

SEQ ID NO: 249521 - DNA, 20 bp, human
gcgtggcgagcggagtgagt

SEQ ID NO: 249522 - DNA, 20 bp, human
gcacccgcgccttatctgca

SEQ ID NO: 249523 - DNA, 20 bp, human
gccgagcaacagccgcctat

SEQ ID NO: 249524 - DNA, 20 bp, human
ggggcgtggccatgcagata

SEQ ID NO: 249525 - DNA, 20 bp, human
ggggccccgaggcagttgca

SEQ ID NO: 249526 - DNA, 20 bp, human
gcaaattggcacaccgggga

SEQ ID NO: 249527 - DNA, 20 bp, human
gccggtgtgccaatttgcgc

SEQ ID NO: 249528 - DNA, 20 bp, human
gaacaactaatgcgcagacg

SEQ ID NO: 249529 - DNA, 20 bp, human
gaggggaataagctttactg

SEQ ID NO: 249530 - DNA, 20 bp, human
ggggcggagttaggtcacga

SEQ ID NO: 249531 - DNA, 20 bp, human
ggtgacgcccacagttgctc

SEQ ID NO: 249532 - DNA, 20 bp, human
gtgggcgtcaccgagctgac

SEQ ID NO: 249533 - DNA, 20 bp, human
gcgtccccagctcattgata

SEQ ID NO: 249534 - DNA, 20 bp, human
ggccgcgccgggtctcactg

SEQ ID NO: 249535 - DNA, 20 bp, human
ggcgtcaccgagctgacggg

SEQ ID NO: 249536 - DNA, 20 bp, human
gtgaccgggaccgaccgccg

SEQ ID NO: 249537 - DNA, 20 bp, human
gggccagggaagtccgtccc

SEQ ID NO: 249538 - DNA, 20 bp, human
gcgaccgccggggtgtgtcc

SEQ ID NO: 249539 - DNA, 20 bp, human
gggggcgaggcttccataat

SEQ ID NO: 249540 - DNA, 20 bp, human
gtatggaagcctcgccccca

SEQ ID NO: 249541 - DNA, 20 bp, human
ggtcccgggacggacttccc

SEQ ID NO: 249542 - DNA, 20 bp, human
gacaccccggcggtcggtcc

SEQ ID NO: 249543 - DNA, 20 bp, human
gcggggcttgcgcgcgggtg

SEQ ID NO: 249544 - DNA, 20 bp, human
gagggctgaacgcagtcgac

SEQ ID NO: 249545 - DNA, 20 bp, human
gcacgtaccgggcggtgaga

SEQ ID NO: 249546 - DNA, 20 bp, human
ggggagcggcgtcgaggcca

SEQ ID NO: 249547 - DNA, 20 bp, human
gtgaccatggcgacggtcgt

SEQ ID NO: 249548 - DNA, 20 bp, human
gcggaagactcggctctccc

SEQ ID NO: 249549 - DNA, 20 bp, human
gcgccccctggcgccaggga

SEQ ID NO: 249550 - DNA, 20 bp, human
gcatggcgacggtcgtgggg

SEQ ID NO: 249551 - DNA, 20 bp, human
gtcgccatggtcaccgctgg

SEQ ID NO: 249552 - DNA, 20 bp, human
gggcgccggccctgcgcgtg

SEQ ID NO: 249553 - DNA, 20 bp, human
gccgccgccagcggtgacca

SEQ ID NO: 249554 - DNA, 20 bp, human
gctcccctccctggcgccag

SEQ ID NO: 249555 - DNA, 20 bp, human
gcggagaggggtttacgtaa

SEQ ID NO: 249556 - DNA, 20 bp, human
gcaggcgcagacagctccgg

SEQ ID NO: 249557 - DNA, 20 bp, human
gcgctggctgagtcgattgc

SEQ ID NO: 249558 - DNA, 20 bp, human
gacgctgatccggaaggcgc

SEQ ID NO: 249559 - DNA, 20 bp, human
gcagacagctccggcggaag

SEQ ID NO: 249560 - DNA, 20 bp, human
ggagtcgattgcaggtctgc

SEQ ID NO: 249561 - DNA, 20 bp, human
gcggatcagcgtttctgcgc

SEQ ID NO: 249562 - DNA, 20 bp, human
gctcacgctgaggccgagat

SEQ ID NO: 249563 - DNA, 20 bp, human
gagcgcaaacgcagcgaggg

SEQ ID NO: 249564 - DNA, 20 bp, human
gtcaagcgcaaacgcagcga

SEQ ID NO: 249565 - DNA, 20 bp, human
gcgactcagccagcgccttc

SEQ ID NO: 249566 - DNA, 20 bp, human
gggcctgcaacgtgtctctg

SEQ ID NO: 249567 - DNA, 20 bp, human
gcaacgtgtctctggggcgg

SEQ ID NO: 249568 - DNA, 20 bp, human
gaacggctgcgtgaccggtg

SEQ ID NO: 249569 - DNA, 20 bp, human
ggccggggcgcggggcatca

SEQ ID NO: 249570 - DNA, 20 bp, human
ggcttcgggagtcctccaag

SEQ ID NO: 249571 - DNA, 20 bp, human
gcgagcgcgacactagaaag

SEQ ID NO: 249572 - DNA, 20 bp, human
gctggcggaaagaggcgagg

SEQ ID NO: 249573 - DNA, 20 bp, human
gcgaggccgccaaccgaagg

SEQ ID NO: 249574 - DNA, 20 bp, human
ggttcgctgcgcgctgttgg

SEQ ID NO: 249575 - DNA, 20 bp, human
ggtcgcgctcgagtcccgac

SEQ ID NO: 249576 - DNA, 20 bp, human
gcggcggtggtccccgtaag

SEQ ID NO: 249577 - DNA, 20 bp, human
gaggtcgaaagcagccgaca

SEQ ID NO: 249578 - DNA, 20 bp, human
gggaaaggaccgactagctg

SEQ ID NO: 249579 - DNA, 20 bp, human
gcaggtggaccacgcggaag

SEQ ID NO: 249580 - DNA, 20 bp, human
gaaatctcggggccctccct

SEQ ID NO: 249581 - DNA, 20 bp, human
gcgaaagaaccctaggccca

SEQ ID NO: 249582 - DNA, 20 bp, human
gacccggtgggcgcttagac

SEQ ID NO: 249583 - DNA, 20 bp, human
gccccggatctgaaatctcg

SEQ ID NO: 249584 - DNA, 20 bp, human
gaagtggacaggtgcgccag

SEQ ID NO: 249585 - DNA, 20 bp, human
gcccggtctaagcgcccacc

SEQ ID NO: 249586 - DNA, 20 bp, human
ggtcgcgcgggtgacggtta

SEQ ID NO: 249587 - DNA, 20 bp, human
gcagccggctcaagtttctc

SEQ ID NO: 249588 - DNA, 20 bp, human
ggagaggccaacggtcgcgc

SEQ ID NO: 249589 - DNA, 20 bp, human
gccaacggtcgcgcgggtga

SEQ ID NO: 249590 - DNA, 20 bp, human
gtagccggagaaacttgagc

SEQ ID NO: 249591 - DNA, 20 bp, human
ggcgggtgacggttagggcg

SEQ ID NO: 249592 - DNA, 20 bp, human
gacggtgcccgaagccccaa

SEQ ID NO: 249593 - DNA, 20 bp, human
gcgcgctgcggagaggccaa

SEQ ID NO: 249594 - DNA, 20 bp, human
gcccttgcccatagtcccgg

SEQ ID NO: 249595 - DNA, 20 bp, human
gtctccgcagcgcgcggaga

SEQ ID NO: 249596 - DNA, 20 bp, human
ggggccctgcctacaggctc

SEQ ID NO: 249597 - DNA, 20 bp, human
gtctcctcgacctcagtcct

SEQ ID NO: 249598 - DNA, 20 bp, human
ggggccaagagattaaaagc

SEQ ID NO: 249599 - DNA, 20 bp, human
gttagcggggccctgcctac

SEQ ID NO: 249600 - DNA, 20 bp, human
gctccctgagcctgtaggca

SEQ ID NO: 249601 - DNA, 20 bp, human
ggactgaggtcgaggagact

SEQ ID NO: 249602 - DNA, 20 bp, human
gttctgtagacccacagcgg

SEQ ID NO: 249603 - DNA, 20 bp, human
gcagcccaggactgaggtcg

SEQ ID NO: 249604 - DNA, 20 bp, human
gcggacaagcagatgctcct

SEQ ID NO: 249605 - DNA, 20 bp, human
gtactctcctcccccgctgt

SEQ ID NO: 249606 - DNA, 20 bp, human
gccccaaggcctgtccacag

SEQ ID NO: 249607 - DNA, 20 bp, human
gacaagaaggtctgtctctc

SEQ ID NO: 249608 - DNA, 20 bp, human
ggagggagggcaggcattct

SEQ ID NO: 249609 - DNA, 20 bp, human
ggggtcaaagtctggagcta

SEQ ID NO: 249610 - DNA, 20 bp, human
gagggcacggcttgaggggt

SEQ ID NO: 249611 - DNA, 20 bp, human
gggagtgcagggtcaaagtc

SEQ ID NO: 249612 - DNA, 20 bp, human
gaagtctggagctatggaca

SEQ ID NO: 249613 - DNA, 20 bp, human
gtggacagggcacggcttga

SEQ ID NO: 249614 - DNA, 20 bp, human
gggagggtcaggacgttcca

SEQ ID NO: 249615 - DNA, 20 bp, human
gtctgtccgccagcccggac

SEQ ID NO: 249616 - DNA, 20 bp, human
gtgtgtgtgtgagtagtcat

SEQ ID NO: 249617 - DNA, 20 bp, human
ggagctacaccccaaattag

SEQ ID NO: 249618 - DNA, 20 bp, human
gcttgcttcactctactttc

SEQ ID NO: 249619 - DNA, 20 bp, human
gaagaagtttgggtcttttg

SEQ ID NO: 249620 - DNA, 20 bp, human
gattctgttggtccaggatt

SEQ ID NO: 249621 - DNA, 20 bp, human
gaagtttatcagctcctgca

SEQ ID NO: 249622 - DNA, 20 bp, human
gaaatgaaaatgttattcgt

SEQ ID NO: 249623 - DNA, 20 bp, human
gatgaaagactgttgaagtt

SEQ ID NO: 249624 - DNA, 20 bp, human
ggttggtccaggatttggaa

SEQ ID NO: 249625 - DNA, 20 bp, human
ggtgtatatgatgattctgt

SEQ ID NO: 249626 - DNA, 20 bp, human
ggggccgcgagccaagcata

SEQ ID NO: 249627 - DNA, 20 bp, human
gtcagtgcgcatgccgtcgg

SEQ ID NO: 249628 - DNA, 20 bp, human
ggggctcggctgcgccacgt

SEQ ID NO: 249629 - DNA, 20 bp, human
gtgagtgccactgccgttaa

SEQ ID NO: 249630 - DNA, 20 bp, human
gcggccgccgcgcgccgacg

SEQ ID NO: 249631 - DNA, 20 bp, human
gcgcatgccgtcggtgggct

SEQ ID NO: 249632 - DNA, 20 bp, human
gcgcgcccccttaacggcag

SEQ ID NO: 249633 - DNA, 20 bp, human
gaacggcagtggcactcacc

SEQ ID NO: 249634 - DNA, 20 bp, human
gggcggccgcgcccccttaa

SEQ ID NO: 249635 - DNA, 20 bp, human
gacgtcagtgcgcatgccgt

SEQ ID NO: 249636 - DNA, 20 bp, human
gaccgcggcgaggggatcga

SEQ ID NO: 249637 - DNA, 20 bp, human
gcgcgcgaggagtgtagggt

SEQ ID NO: 249638 - DNA, 20 bp, human
gcgcacgcgcgaggagtgta

SEQ ID NO: 249639 - DNA, 20 bp, human
gcgcggcgacgaacccaggg

SEQ ID NO: 249640 - DNA, 20 bp, human
ggcgccgcggcgacgaaccc

SEQ ID NO: 249641 - DNA, 20 bp, human
gcctcgccgcggtcccatgg

SEQ ID NO: 249642 - DNA, 20 bp, human
ggggaccggcaaagcgagtc

SEQ ID NO: 249643 - DNA, 20 bp, human
ggcggcgaggggatcgaggg

SEQ ID NO: 249644 - DNA, 20 bp, human
gccctctgccggccggtggt

SEQ ID NO: 249645 - DNA, 20 bp, human
gtccaaccaccggccggcag

SEQ ID NO: 249646 - DNA, 20 bp, human
gtagcaatgtgtcacaggtg

SEQ ID NO: 249647 - DNA, 20 bp, human
gctggctccccggccggcgt

SEQ ID NO: 249648 - DNA, 20 bp, human
ggccctctgactgggttcta

SEQ ID NO: 249649 - DNA, 20 bp, human
gaccgtgcccggcacaagct

SEQ ID NO: 249650 - DNA, 20 bp, human
gcggcgctgcgggttctgcg

SEQ ID NO: 249651 - DNA, 20 bp, human
gagaacccgcagcgccggcc

SEQ ID NO: 249652 - DNA, 20 bp, human
gtagagcgcgccagcgagcc

SEQ ID NO: 249653 - DNA, 20 bp, human
ggcgtgggtgtggggcgagt

SEQ ID NO: 249654 - DNA, 20 bp, human
gaggtggggcgcccgcgttc

SEQ ID NO: 249655 - DNA, 20 bp, human
gtccctagaacccagtcaga

SEQ ID NO: 249656 - DNA, 20 bp, human
gccgggtaggggacacctca

SEQ ID NO: 249657 - DNA, 20 bp, human
ggccccctccggacagtccc

SEQ ID NO: 249658 - DNA, 20 bp, human
gtcgccccgggactgtccgg

SEQ ID NO: 249659 - DNA, 20 bp, human
gcccctgctggagccccctc

SEQ ID NO: 249660 - DNA, 20 bp, human
ggaagctgggctctcgcccc

SEQ ID NO: 249661 - DNA, 20 bp, human
gcccgctctcccgggagtct

SEQ ID NO: 249662 - DNA, 20 bp, human
gctctcgccccgggactgtc

SEQ ID NO: 249663 - DNA, 20 bp, human
gccgggagagcggggagagt

SEQ ID NO: 249664 - DNA, 20 bp, human
gcagcttcccggccgggtag

SEQ ID NO: 249665 - DNA, 20 bp, human
ggagcggccagccccgtccc

SEQ ID NO: 249666 - DNA, 20 bp, human
gaggcgggcggggcgatgaa

SEQ ID NO: 249667 - DNA, 20 bp, human
gggtgccgaaaaggcagctg

SEQ ID NO: 249668 - DNA, 20 bp, human
gtgaggctgcatccgggtgt

SEQ ID NO: 249669 - DNA, 20 bp, human
ggggcgcaccggccaatagg

SEQ ID NO: 249670 - DNA, 20 bp, human
ggctgaagctgcgagaagtg

SEQ ID NO: 249671 - DNA, 20 bp, human
gaaccccgccgcctattggc

SEQ ID NO: 249672 - DNA, 20 bp, human
gccggatgcagcctcaccac

SEQ ID NO: 249673 - DNA, 20 bp, human
gtcgacgctggtcaagcgga

SEQ ID NO: 249674 - DNA, 20 bp, human
gcagccaatgaaatcaggga

SEQ ID NO: 249675 - DNA, 20 bp, human
gggtcaagcggacggaaaaa

SEQ ID NO: 249676 - DNA, 20 bp, human
gtgggaaacctgcatctcct

SEQ ID NO: 249677 - DNA, 20 bp, human
gaggcaaggtagatgtctgc

SEQ ID NO: 249678 - DNA, 20 bp, human
gtacacacttgagggatcaa

SEQ ID NO: 249679 - DNA, 20 bp, human
gaccttgccttcccagatga

SEQ ID NO: 249680 - DNA, 20 bp, human
gtgcaggtttcccagagagc

SEQ ID NO: 249681 - DNA, 20 bp, human
ggcttgtcatccagctctct

SEQ ID NO: 249682 - DNA, 20 bp, human
gtctaagagaaaacttgcca

SEQ ID NO: 249683 - DNA, 20 bp, human
gcaaaagcctgttacattgc

SEQ ID NO: 249684 - DNA, 20 bp, human
gcacttgagggatcaacggt

SEQ ID NO: 249685 - DNA, 20 bp, human
gatattctggcatgacaagg

SEQ ID NO: 249686 - DNA, 20 bp, human
ggtagtgtgggtgtcctcag

SEQ ID NO: 249687 - DNA, 20 bp, human
gaacaggcggttgctatcaa

SEQ ID NO: 249688 - DNA, 20 bp, human
gctgttgcgtgatgtagtgt

SEQ ID NO: 249689 - DNA, 20 bp, human
gaagaggcaaccaccccacc

SEQ ID NO: 249690 - DNA, 20 bp, human
gtgcactgttgtccaatccc

SEQ ID NO: 249691 - DNA, 20 bp, human
gagcctctggtttgtagtgg

SEQ ID NO: 249692 - DNA, 20 bp, human
gacttaggtagctacctctg

SEQ ID NO: 249693 - DNA, 20 bp, human
gcactcctgccagtgcctcc

SEQ ID NO: 249694 - DNA, 20 bp, human
gatcctccactacaaaccag

SEQ ID NO: 249695 - DNA, 20 bp, human
gccctaatgctatcagcctc

SEQ ID NO: 249696 - DNA, 20 bp, human
ggggggctgggtgacttgtg

SEQ ID NO: 249697 - DNA, 20 bp, human
ggggactacactcaggaaaa

SEQ ID NO: 249698 - DNA, 20 bp, human
gcacaagcctcaggcctatg

SEQ ID NO: 249699 - DNA, 20 bp, human
gtacactcaggaaaaaggtg

SEQ ID NO: 249700 - DNA, 20 bp, human
gccaaatccaacctcaaaac

SEQ ID NO: 249701 - DNA, 20 bp, human
gtaagagccaaggactaatg

SEQ ID NO: 249702 - DNA, 20 bp, human
ggctggttgggactacactc

SEQ ID NO: 249703 - DNA, 20 bp, human
ggcttccaagataagagcca

SEQ ID NO: 249704 - DNA, 20 bp, human
gctgaggggtgtgtgcacgt

SEQ ID NO: 249705 - DNA, 20 bp, human
gcggtaaaatgcccactttc

SEQ ID NO: 249706 - DNA, 20 bp, human
gcgcgtgtgctgagacccca

SEQ ID NO: 249707 - DNA, 20 bp, human
gggaggggcggggcaagagt

SEQ ID NO: 249708 - DNA, 20 bp, human
gcagccgagcggagttgaaa

SEQ ID NO: 249709 - DNA, 20 bp, human
gcggactccgcgtggaggtg

SEQ ID NO: 249710 - DNA, 20 bp, human
gtgagaccccagggtcggga

SEQ ID NO: 249711 - DNA, 20 bp, human
gtctccgccctcccgaccct

SEQ ID NO: 249712 - DNA, 20 bp, human
ggggagggcggagactggga

SEQ ID NO: 249713 - DNA, 20 bp, human
ggcaggggttaccaggtggc

SEQ ID NO: 249714 - DNA, 20 bp, human
gggcgggggcaggggttacc

SEQ ID NO: 249715 - DNA, 20 bp, human
ggaaaactcccggaggggcg

SEQ ID NO: 249716 - DNA, 20 bp, human
gaatcggcgaggcgccaagg

SEQ ID NO: 249717 - DNA, 20 bp, human
gtggggccgcagagcgagtc

SEQ ID NO: 249718 - DNA, 20 bp, human
gcaaccgagcacgattggaa

SEQ ID NO: 249719 - DNA, 20 bp, human
gaggagcaaccgagcacgat

SEQ ID NO: 249720 - DNA, 20 bp, human
gcgcaccggtaggaaaactg

SEQ ID NO: 249721 - DNA, 20 bp, human
ggggccctgcgacttcactc

SEQ ID NO: 249722 - DNA, 20 bp, human
gttggaaaggttgacgatag

SEQ ID NO: 249723 - DNA, 20 bp, human
gttgagagaaagcttcgcac

SEQ ID NO: 249724 - DNA, 20 bp, human
ggggcccgccccgcgtctga

SEQ ID NO: 249725 - DNA, 20 bp, human
gaaactgaagaggcggcgga

SEQ ID NO: 249726 - DNA, 20 bp, human
ggcacctcgtgtcctcacta

SEQ ID NO: 249727 - DNA, 20 bp, human
gcggggggcgagtgttctgg

SEQ ID NO: 249728 - DNA, 20 bp, human
ggccatgcctagctcctctg

SEQ ID NO: 249729 - DNA, 20 bp, human
gaaaaaagtgcatgcagccc

SEQ ID NO: 249730 - DNA, 20 bp, human
ggcgcggggggcgagtgttc

SEQ ID NO: 249731 - DNA, 20 bp, human
gtcactaagggcgacctcag

SEQ ID NO: 249732 - DNA, 20 bp, human
gaggctgtggcctaggccgt

SEQ ID NO: 249733 - DNA, 20 bp, human
gaggcatggccgggaaccga

SEQ ID NO: 249734 - DNA, 20 bp, human
ggacgcgggtgcgcatgcgc

SEQ ID NO: 249735 - DNA, 20 bp, human
gctaaacagcagcgggacgc

SEQ ID NO: 249736 - DNA, 20 bp, human
gcccgcgaacacctccagtg

SEQ ID NO: 249737 - DNA, 20 bp, human
ggtgcggcccacatagtcag

SEQ ID NO: 249738 - DNA, 20 bp, human
gaagagaccgctgactatgt

SEQ ID NO: 249739 - DNA, 20 bp, human
ggcggcgcttagttgcatga

SEQ ID NO: 249740 - DNA, 20 bp, human
gtggctgcgcaccggagtcc

SEQ ID NO: 249741 - DNA, 20 bp, human
gaacacaggcttcctgtggc

SEQ ID NO: 249742 - DNA, 20 bp, human
gggggagacaaactccgacc

SEQ ID NO: 249743 - DNA, 20 bp, human
gactggctacgcccggactc

SEQ ID NO: 249744 - DNA, 20 bp, human
gactatgtgggccgcactgg

SEQ ID NO: 249745 - DNA, 20 bp, human
gggcggagtcgtagaagcac

SEQ ID NO: 249746 - DNA, 20 bp, human
ggcagggtcaacgcctacgt

SEQ ID NO: 249747 - DNA, 20 bp, human
gcaaactccggttttcccga

SEQ ID NO: 249748 - DNA, 20 bp, human
gactcttctagtcccttcaa

SEQ ID NO: 249749 - DNA, 20 bp, human
ggaaggcgccgggccaacac

SEQ ID NO: 249750 - DNA, 20 bp, human
gccgactcatggccaaactc

SEQ ID NO: 249751 - DNA, 20 bp, human
gacctcatccagccgactca

SEQ ID NO: 249752 - DNA, 20 bp, human
gcacaggatctgatagtgca

SEQ ID NO: 249753 - DNA, 20 bp, human
ggagctggagctgctgtcgg

SEQ ID NO: 249754 - DNA, 20 bp, human
gatgactataggccaggtag

SEQ ID NO: 249755 - DNA, 20 bp, human
gccacctcacagatgactat

SEQ ID NO: 249756 - DNA, 20 bp, human
gcaggagcctccgaggagaa

SEQ ID NO: 249757 - DNA, 20 bp, human
gtcccgcacggggtctccgg

SEQ ID NO: 249758 - DNA, 20 bp, human
gcgctcccgcacggggtctc

SEQ ID NO: 249759 - DNA, 20 bp, human
gggaaatggagtccctgcgc

SEQ ID NO: 249760 - DNA, 20 bp, human
ggcaaggggaggatgcgcgc

SEQ ID NO: 249761 - DNA, 20 bp, human
gaggatcccgagggtccgag

SEQ ID NO: 249762 - DNA, 20 bp, human
gcccgggcgcgctcccgcac

SEQ ID NO: 249763 - DNA, 20 bp, human
ggcggcgcgaaatccgcctc

SEQ ID NO: 249764 - DNA, 20 bp, human
gcgcgcgacggccccgactg

SEQ ID NO: 249765 - DNA, 20 bp, human
gcgcacgcacgcacgtggct

SEQ ID NO: 249766 - DNA, 20 bp, human
gcggtcccgcccactcgcct

SEQ ID NO: 249767 - DNA, 20 bp, human
ggggaggacagaaacgagca

SEQ ID NO: 249768 - DNA, 20 bp, human
gtgagggacaccggtagggg

SEQ ID NO: 249769 - DNA, 20 bp, human
gcagctgagggacaccggta

SEQ ID NO: 249770 - DNA, 20 bp, human
ggggtggggccaaggcgagt

SEQ ID NO: 249771 - DNA, 20 bp, human
gtggggccaaggcgagtggg

SEQ ID NO: 249772 - DNA, 20 bp, human
ggacaccggtaggggggggg

SEQ ID NO: 249773 - DNA, 20 bp, human
gcctccagtcggccgcggga

SEQ ID NO: 249774 - DNA, 20 bp, human
gccgactggaggcccggagc

SEQ ID NO: 249775 - DNA, 20 bp, human
gcgggcctccagtcggccgc

SEQ ID NO: 249776 - DNA, 20 bp, human
gggtccggtgcctcagtccc

SEQ ID NO: 249777 - DNA, 20 bp, human
gggggggctgcgggggacga

SEQ ID NO: 249778 - DNA, 20 bp, human
gcccacgcggcgggggcgta

SEQ ID NO: 249779 - DNA, 20 bp, human
ggacgacggcgcccacgcgg

SEQ ID NO: 249780 - DNA, 20 bp, human
ggtacgcagcgcgtgtgcgc

SEQ ID NO: 249781 - DNA, 20 bp, human
ggcggggcgctgccacccat

SEQ ID NO: 249782 - DNA, 20 bp, human
gcgccccgccccctgcgtgg

SEQ ID NO: 249783 - DNA, 20 bp, human
gtgtgagcgcggcgccttcc

SEQ ID NO: 249784 - DNA, 20 bp, human
ggacggcgcccacgcggcgg

SEQ ID NO: 249785 - DNA, 20 bp, human
gggggacgacggcgcccacg

SEQ ID NO: 249786 - DNA, 20 bp, human
gttcccagacgtccgaccag

SEQ ID NO: 249787 - DNA, 20 bp, human
gcgggaataaccctggtgac

SEQ ID NO: 249788 - DNA, 20 bp, human
gcgaggcgcgagaaggacgg

SEQ ID NO: 249789 - DNA, 20 bp, human
ggctgcgccaagacctgaag

SEQ ID NO: 249790 - DNA, 20 bp, human
gagaaggacggcggcgtgag

SEQ ID NO: 249791 - DNA, 20 bp, human
ggcgcaaagcacaaacgagt

SEQ ID NO: 249792 - DNA, 20 bp, human
gaatggaggcggggtagagg

SEQ ID NO: 249793 - DNA, 20 bp, human
ggagcgaggcgcgagaagga

SEQ ID NO: 249794 - DNA, 20 bp, human
gtgagagagcaacggaatgg

SEQ ID NO: 249795 - DNA, 20 bp, human
ggcgagaaggcaggcacgag

SEQ ID NO: 249796 - DNA, 20 bp, human
gagacggtttgagaagacgt

SEQ ID NO: 249797 - DNA, 20 bp, human
gtgagaagacgtaggcggtg

SEQ ID NO: 249798 - DNA, 20 bp, human
gcagctacggcgttctttta

SEQ ID NO: 249799 - DNA, 20 bp, human
gcggtttgagaagacgtagg

SEQ ID NO: 249800 - DNA, 20 bp, human
gtccttccaaggacaccgta

SEQ ID NO: 249801 - DNA, 20 bp, human
ggcggtgggggaacggaaag

SEQ ID NO: 249802 - DNA, 20 bp, human
gtcaacttgagggccattaa

SEQ ID NO: 249803 - DNA, 20 bp, human
gagggcggatctcgcagcta

SEQ ID NO: 249804 - DNA, 20 bp, human
gagacggctttgccccttaa

SEQ ID NO: 249805 - DNA, 20 bp, human
ggccctacggtgtccttgga

SEQ ID NO: 249806 - DNA, 20 bp, human
gtgtcattagtgccaattag

SEQ ID NO: 249807 - DNA, 20 bp, human
gcctgctgccctcctctaat

SEQ ID NO: 249808 - DNA, 20 bp, human
ggcctggggcgcaagcttgt

SEQ ID NO: 249809 - DNA, 20 bp, human
ggacacatggacgtcatcag

SEQ ID NO: 249810 - DNA, 20 bp, human
ggggagttgaagtagacagg

SEQ ID NO: 249811 - DNA, 20 bp, human
gagtgggagttgaagtagac

SEQ ID NO: 249812 - DNA, 20 bp, human
gccctggtcctgaatggggt

SEQ ID NO: 249813 - DNA, 20 bp, human
ggcccagtccccagtgggat

SEQ ID NO: 249814 - DNA, 20 bp, human
gtcctgaatggggtgggtcc

SEQ ID NO: 249815 - DNA, 20 bp, human
ggtctggcccagtccccagt

SEQ ID NO: 249816 - DNA, 20 bp, human
ggggacgccgggaacaggtg

SEQ ID NO: 249817 - DNA, 20 bp, human
gtgcgcaagcggtcccacgt

SEQ ID NO: 249818 - DNA, 20 bp, human
ggccccgcccgagcccacgt

SEQ ID NO: 249819 - DNA, 20 bp, human
gaacgccgggagtagccgaa

SEQ ID NO: 249820 - DNA, 20 bp, human
gcgaaggggacgccgggaac

SEQ ID NO: 249821 - DNA, 20 bp, human
gcacgcccctagcgcatagc

SEQ ID NO: 249822 - DNA, 20 bp, human
gagaagccagctatgcgcta

SEQ ID NO: 249823 - DNA, 20 bp, human
gtcccacgtgggctcgggcg

SEQ ID NO: 249824 - DNA, 20 bp, human
gggtggggacaacggaagta

SEQ ID NO: 249825 - DNA, 20 bp, human
ggctcgcccgagcagggttg

SEQ ID NO: 249826 - DNA, 20 bp, human
ggaggggcagacacacttca

SEQ ID NO: 249827 - DNA, 20 bp, human
ggacagcccagttacgggga

SEQ ID NO: 249828 - DNA, 20 bp, human
ggggaaaggtggcacccttc

SEQ ID NO: 249829 - DNA, 20 bp, human
gctgatgacagcccagttac

SEQ ID NO: 249830 - DNA, 20 bp, human
gaaactcagcctaaatggaa

SEQ ID NO: 249831 - DNA, 20 bp, human
gtagctgccctgttggggca

SEQ ID NO: 249832 - DNA, 20 bp, human
gaggggctgcattgcccgaa

SEQ ID NO: 249833 - DNA, 20 bp, human
gggaggggaccaacgggctc

SEQ ID NO: 249834 - DNA, 20 bp, human
gaagccttcgcccccagtgg

SEQ ID NO: 249835 - DNA, 20 bp, human
gggacccccactgggggcga

SEQ ID NO: 249836 - DNA, 20 bp, human
gcgcaggggcggtgggtgag

SEQ ID NO: 249837 - DNA, 20 bp, human
gtcggctcgcgacgctgcag

SEQ ID NO: 249838 - DNA, 20 bp, human
ggcccctgcgcgccgctcca

SEQ ID NO: 249839 - DNA, 20 bp, human
gtggggacgggactgggttc

SEQ ID NO: 249840 - DNA, 20 bp, human
gctaggaccgagcgagcgga

SEQ ID NO: 249841 - DNA, 20 bp, human
gttacggacggggcaggtga

SEQ ID NO: 249842 - DNA, 20 bp, human
gaggtgggacgcaccaggaa

SEQ ID NO: 249843 - DNA, 20 bp, human
gtagcgccgaggttacggac

SEQ ID NO: 249844 - DNA, 20 bp, human
gtgagggttcgggacgtggg

SEQ ID NO: 249845 - DNA, 20 bp, human
gggtggggcggaaccggatt

SEQ ID NO: 249846 - DNA, 20 bp, human
gcggggccgcacctgtcctg

SEQ ID NO: 249847 - DNA, 20 bp, human
gggcgcggcccgcgagggaa

SEQ ID NO: 249848 - DNA, 20 bp, human
gaggctggaaggggcgggat

SEQ ID NO: 249849 - DNA, 20 bp, human
ggccccgccgcggacaccac

SEQ ID NO: 249850 - DNA, 20 bp, human
gcaggtcccggtggtgtccg

SEQ ID NO: 249851 - DNA, 20 bp, human
gcatcggggcagcaaccggg

SEQ ID NO: 249852 - DNA, 20 bp, human
ggtcccggtggtgtccgcgg

SEQ ID NO: 249853 - DNA, 20 bp, human
gatggcgcgaattaacgcgg

SEQ ID NO: 249854 - DNA, 20 bp, human
gggggcgagggcgtgtgctt

SEQ ID NO: 249855 - DNA, 20 bp, human
gcgccccacacgcaagtacc

SEQ ID NO: 249856 - DNA, 20 bp, human
gggctgcagcactggaggaa

SEQ ID NO: 249857 - DNA, 20 bp, human
ggcaagcggggccaattaag

SEQ ID NO: 249858 - DNA, 20 bp, human
gcccgcctctgcatgagact

SEQ ID NO: 249859 - DNA, 20 bp, human
ggatatggagagttgggcat

SEQ ID NO: 249860 - DNA, 20 bp, human
ggcctcagaaggccagggac

SEQ ID NO: 249861 - DNA, 20 bp, human
ggggcatgatatggagagtt

SEQ ID NO: 249862 - DNA, 20 bp, human
gcgtgtgtacgtgtttgtgt

SEQ ID NO: 249863 - DNA, 20 bp, human
gccctcctgagaggggttgg

SEQ ID NO: 249864 - DNA, 20 bp, human
gcgcttgcctcagaaggcca

SEQ ID NO: 249865 - DNA, 20 bp, human
gctctcaggagggcatgata

SEQ ID NO: 249866 - DNA, 20 bp, human
ggagactagcgcaccggcgt

SEQ ID NO: 249867 - DNA, 20 bp, human
gagggtggtgcagaggagtc

SEQ ID NO: 249868 - DNA, 20 bp, human
gggtgcagaggagtccggct

SEQ ID NO: 249869 - DNA, 20 bp, human
ggaggcagcccctgcgagcg

SEQ ID NO: 249870 - DNA, 20 bp, human
gcgagcggagactagcgcac

SEQ ID NO: 249871 - DNA, 20 bp, human
ggcggctactggtacttcca

SEQ ID NO: 249872 - DNA, 20 bp, human
gaggagtccggctgggcgga

SEQ ID NO: 249873 - DNA, 20 bp, human
ggctactggtacttccaagg

SEQ ID NO: 249874 - DNA, 20 bp, human
gtcgctcgcagctcgcccgg

SEQ ID NO: 249875 - DNA, 20 bp, human
gccagtagccgcgctcgcag

SEQ ID NO: 249876 - DNA, 20 bp, human
ggcaggaagcggaaatggta

SEQ ID NO: 249877 - DNA, 20 bp, human
gccacggcaggaagcggaaa

SEQ ID NO: 249878 - DNA, 20 bp, human
gtcgctaggacccgcgggtg

SEQ ID NO: 249879 - DNA, 20 bp, human
gtgtcggaggcgaggcttgt

SEQ ID NO: 249880 - DNA, 20 bp, human
gacagctcgctaggacccgc

SEQ ID NO: 249881 - DNA, 20 bp, human
gcgaaggacaagcgggagaa

SEQ ID NO: 249882 - DNA, 20 bp, human
gcaggtcccgcgaatgccga

SEQ ID NO: 249883 - DNA, 20 bp, human
gtaggggccagccgcacccg

SEQ ID NO: 249884 - DNA, 20 bp, human
gaagcctcgcctccgacaac

SEQ ID NO: 249885 - DNA, 20 bp, human
ggggcggggtttccggttgt

SEQ ID NO: 249886 - DNA, 20 bp, human
gcagccccgccagcctctat

SEQ ID NO: 249887 - DNA, 20 bp, human
ggcccaggagggcgcgtgag

SEQ ID NO: 249888 - DNA, 20 bp, human
gccagccgcgtgcctccctc

SEQ ID NO: 249889 - DNA, 20 bp, human
gctgggttgcatgcccatag

SEQ ID NO: 249890 - DNA, 20 bp, human
gtcaaggtgtcggagacgat

SEQ ID NO: 249891 - DNA, 20 bp, human
gggggcgcgcgctgtggcgt

SEQ ID NO: 249892 - DNA, 20 bp, human
gctggcggggctggacgcgc

SEQ ID NO: 249893 - DNA, 20 bp, human
gcatgcccatagaggctggc

SEQ ID NO: 249894 - DNA, 20 bp, human
ggcggacccagaggccccat

SEQ ID NO: 249895 - DNA, 20 bp, human
ggcagccggagggaggcacg

SEQ ID NO: 249896 - DNA, 20 bp, human
gtctcgcgagatctggaaac

SEQ ID NO: 249897 - DNA, 20 bp, human
gtccctgggatcccagaatt

SEQ ID NO: 249898 - DNA, 20 bp, human
ggaaggtcaaacctaattct

SEQ ID NO: 249899 - DNA, 20 bp, human
gatctcgcgagagagggacc

SEQ ID NO: 249900 - DNA, 20 bp, human
gggagtctacacccaggcgg

SEQ ID NO: 249901 - DNA, 20 bp, human
gttccagatctcgcgagaga

SEQ ID NO: 249902 - DNA, 20 bp, human
gataagtatagccaccgcct

SEQ ID NO: 249903 - DNA, 20 bp, human
gctgcaaaataattcacttc

SEQ ID NO: 249904 - DNA, 20 bp, human
gaaaaaaattaatctgtcgt

SEQ ID NO: 249905 - DNA, 20 bp, human
gtttgcaggagtctacaccc

SEQ ID NO: 249906 - DNA, 20 bp, human
gtccccctgggcgaccaata

SEQ ID NO: 249907 - DNA, 20 bp, human
gcctgggcgaccaataggga

SEQ ID NO: 249908 - DNA, 20 bp, human
gggagcctgagctaaaccct

SEQ ID NO: 249909 - DNA, 20 bp, human
gagccaaccaaggagtaggg

SEQ ID NO: 249910 - DNA, 20 bp, human
ggcgcggcctatcaggagat

SEQ ID NO: 249911 - DNA, 20 bp, human
gaacagccaaccaaggagta

SEQ ID NO: 249912 - DNA, 20 bp, human
gcggggagtgaaaagagcct

SEQ ID NO: 249913 - DNA, 20 bp, human
gcaggctccgccctactcct

SEQ ID NO: 249914 - DNA, 20 bp, human
ggggaaacgcgcctccccct

SEQ ID NO: 249915 - DNA, 20 bp, human
gccgctgggtcccagatcct

SEQ ID NO: 249916 - DNA, 20 bp, human
gtaagcatggcccgcacaat

SEQ ID NO: 249917 - DNA, 20 bp, human
ggcgcgcgggcctttgttgc

SEQ ID NO: 249918 - DNA, 20 bp, human
gcatggcccgcacaatgggc

SEQ ID NO: 249919 - DNA, 20 bp, human
gttgttgccggcccattgtg

SEQ ID NO: 249920 - DNA, 20 bp, human
gtcagctggagtaacggata

SEQ ID NO: 249921 - DNA, 20 bp, human
gcccccaaagctctcgccaa

SEQ ID NO: 249922 - DNA, 20 bp, human
gccactcgagcttcattcgc

SEQ ID NO: 249923 - DNA, 20 bp, human
gctcgagcttcattcgccgg

SEQ ID NO: 249924 - DNA, 20 bp, human
gttgttccgaagcaacaccc

SEQ ID NO: 249925 - DNA, 20 bp, human
gggcgcactgtattgcaaag

SEQ ID NO: 249926 - DNA, 20 bp, human
gactcgtagtgggaggaggt

SEQ ID NO: 249927 - DNA, 20 bp, human
gaggggaggggactcgtagt

SEQ ID NO: 249928 - DNA, 20 bp, human
ggggaagctgtgagtttctc

SEQ ID NO: 249929 - DNA, 20 bp, human
gggaggggactcgtagtggg

SEQ ID NO: 249930 - DNA, 20 bp, human
gctcccagagcctacgctgt

SEQ ID NO: 249931 - DNA, 20 bp, human
ggtagtgctgtggcaagggg

SEQ ID NO: 249932 - DNA, 20 bp, human
gagggtagtgctgtggcaag

SEQ ID NO: 249933 - DNA, 20 bp, human
gggctggtgacatgaatgga

SEQ ID NO: 249934 - DNA, 20 bp, human
ggtggggctggtgacatgaa

SEQ ID NO: 249935 - DNA, 20 bp, human
gcgtaggctctgggagcgca

SEQ ID NO: 249936 - DNA, 20 bp, human
gcagtcccgggaacggaggt

SEQ ID NO: 249937 - DNA, 20 bp, human
ggccgcagtcccgggaacgg

SEQ ID NO: 249938 - DNA, 20 bp, human
gggcgccgcagtcccgggaa

SEQ ID NO: 249939 - DNA, 20 bp, human
gtgcagcggcctaaccccac

SEQ ID NO: 249940 - DNA, 20 bp, human
gagcatctgggcacctgatc

SEQ ID NO: 249941 - DNA, 20 bp, human
ggctccctacctccgttccc

SEQ ID NO: 249942 - DNA, 20 bp, human
ggccaccgtccgccggggac

SEQ ID NO: 249943 - DNA, 20 bp, human
gcgactctgccacccagatc

SEQ ID NO: 249944 - DNA, 20 bp, human
ggactgcggcgccccaaacc

SEQ ID NO: 249945 - DNA, 20 bp, human
gccggaagtggcagctgaac

SEQ ID NO: 249946 - DNA, 20 bp, human
gaatgcgcgaggtgcctgag

SEQ ID NO: 249947 - DNA, 20 bp, human
gacagccgaactaggcgtaa

SEQ ID NO: 249948 - DNA, 20 bp, human
ggggctgttagctcttgctg

SEQ ID NO: 249949 - DNA, 20 bp, human
gagaaagtgcacacccaagg

SEQ ID NO: 249950 - DNA, 20 bp, human
gaggagaaagtgcacaccca

SEQ ID NO: 249951 - DNA, 20 bp, human
gaggcgtaacggctgagagg

SEQ ID NO: 249952 - DNA, 20 bp, human
gtcagccgttacgcctagtt

SEQ ID NO: 249953 - DNA, 20 bp, human
ggcggagcacgatgattgat

SEQ ID NO: 249954 - DNA, 20 bp, human
gcacccccggcgcaccacgt

SEQ ID NO: 249955 - DNA, 20 bp, human
ggcggccagcgacagaagaa

SEQ ID NO: 249956 - DNA, 20 bp, human
gacgagatgggcgggatcta

SEQ ID NO: 249957 - DNA, 20 bp, human
ggggttggaagatagttctc

SEQ ID NO: 249958 - DNA, 20 bp, human
gaccgccggaacgagatggg

SEQ ID NO: 249959 - DNA, 20 bp, human
gaaacaccgccggaacgaga

SEQ ID NO: 249960 - DNA, 20 bp, human
gctacccagcggtgggaaga

SEQ ID NO: 249961 - DNA, 20 bp, human
ggatcccgcccatctcgttc

SEQ ID NO: 249962 - DNA, 20 bp, human
ggttgaaaatggcctggcgg

SEQ ID NO: 249963 - DNA, 20 bp, human
gaggaccaccagtgctgctg

SEQ ID NO: 249964 - DNA, 20 bp, human
gccgaagtgcggctgcgcaa

SEQ ID NO: 249965 - DNA, 20 bp, human
gggcgcgcgagcaaggggga

SEQ ID NO: 249966 - DNA, 20 bp, human
gagctgcaagggcagagtct

SEQ ID NO: 249967 - DNA, 20 bp, human
gtgcaagggcagagtctagg

SEQ ID NO: 249968 - DNA, 20 bp, human
gggccgggcggggtgaaggc

SEQ ID NO: 249969 - DNA, 20 bp, human
gctactgccacagtcccttg

SEQ ID NO: 249970 - DNA, 20 bp, human
gctaggagggcccgcaagcc

SEQ ID NO: 249971 - DNA, 20 bp, human
gaggcggttgtgagcgcgtg

SEQ ID NO: 249972 - DNA, 20 bp, human
ggcggggggccgagtgggag

SEQ ID NO: 249973 - DNA, 20 bp, human
gtgcggcgagatcgacgcgg

SEQ ID NO: 249974 - DNA, 20 bp, human
gtcgacgcggggggccgagt

SEQ ID NO: 249975 - DNA, 20 bp, human
gtaaacttggcaagggatgg

SEQ ID NO: 249976 - DNA, 20 bp, human
ggcaggggcagagtcgcgga

SEQ ID NO: 249977 - DNA, 20 bp, human
gagctgcaggggcagagtcg

SEQ ID NO: 249978 - DNA, 20 bp, human
gacaacgcatgtctgatact

SEQ ID NO: 249979 - DNA, 20 bp, human
gcgcggagggccagcaccct

SEQ ID NO: 249980 - DNA, 20 bp, human
gtggggtgcctgccgggtag

SEQ ID NO: 249981 - DNA, 20 bp, human
gggtgcctgccgggtagcgg

SEQ ID NO: 249982 - DNA, 20 bp, human
ggagctgctgggctggcgtg

SEQ ID NO: 249983 - DNA, 20 bp, human
gcaagcacggggctagaagg

SEQ ID NO: 249984 - DNA, 20 bp, human
ggtctgatactggggaccta

SEQ ID NO: 249985 - DNA, 20 bp, human
gggggcccgagtgtgaaggg

SEQ ID NO: 249986 - DNA, 20 bp, human
gggaaagcgcgatggagggg

SEQ ID NO: 249987 - DNA, 20 bp, human
gcggcggaaagcgcgatgga

SEQ ID NO: 249988 - DNA, 20 bp, human
gcacgtgactcgcggagcgg

SEQ ID NO: 249989 - DNA, 20 bp, human
gcagggcggagactcgggag

SEQ ID NO: 249990 - DNA, 20 bp, human
ggctccgcgagtcacgtgac

SEQ ID NO: 249991 - DNA, 20 bp, human
gggagactctagtactgagg

SEQ ID NO: 249992 - DNA, 20 bp, human
gtgccggcaaacgttagcaa

SEQ ID NO: 249993 - DNA, 20 bp, human
gcgaggcagggcggagactc

SEQ ID NO: 249994 - DNA, 20 bp, human
gtgccggcaaaactacggag

SEQ ID NO: 249995 - DNA, 20 bp, human
gtactgagggggcaagaacg

SEQ ID NO: 249996 - DNA, 20 bp, human
gcggggcgggaatacggcaa

SEQ ID NO: 249997 - DNA, 20 bp, human
gttaaggcggggcgggaata

SEQ ID NO: 249998 - DNA, 20 bp, human
ggaaacccgccagccacagg

SEQ ID NO: 249999 - DNA, 20 bp, human
gatacggcaacgggccgcgg

SEQ ID NO: 250000 - DNA, 20 bp, human
gaacaaacgggacctccgag

SEQ ID NO: 250001 - DNA, 20 bp, human
gttaaggacgtaccactcgg

SEQ ID NO: 250002 - DNA, 20 bp, human
ggagtggtacgtccttaagg

SEQ ID NO: 250003 - DNA, 20 bp, human
gtaccaatcaagagtcgaga

SEQ ID NO: 250004 - DNA, 20 bp, human
gcaagggcctggaccgcctg

SEQ ID NO: 250005 - DNA, 20 bp, human
gggaatacggcaacgggccg

SEQ ID NO: 250006 - DNA, 20 bp, human
gcaaagcgcggggtgcgagg

SEQ ID NO: 250007 - DNA, 20 bp, human
gcgcatgcgcccaaagcgcg

SEQ ID NO: 250008 - DNA, 20 bp, human
gagaagagagcgggaagcga

SEQ ID NO: 250009 - DNA, 20 bp, human
gagactgccgtaagcgcttt

SEQ ID NO: 250010 - DNA, 20 bp, human
gactcggccggaagtagcgt

SEQ ID NO: 250011 - DNA, 20 bp, human
ggagcggtaaatactccctg

SEQ ID NO: 250012 - DNA, 20 bp, human
gcccgcgccgacgctacttc

SEQ ID NO: 250013 - DNA, 20 bp, human
ggagggaagtggcgtttcta

SEQ ID NO: 250014 - DNA, 20 bp, human
gtgccagcccgccaacccag

SEQ ID NO: 250015 - DNA, 20 bp, human
ggctacttccggccgagtca

SEQ ID NO: 250016 - DNA, 20 bp, human
ggcagggcgcacacacgggg

SEQ ID NO: 250017 - DNA, 20 bp, human
gagtgcagggcgcacacacg

SEQ ID NO: 250018 - DNA, 20 bp, human
gggaggctgcgctgtcttgc

SEQ ID NO: 250019 - DNA, 20 bp, human
gcctcccagggcgaaggtcg

SEQ ID NO: 250020 - DNA, 20 bp, human
gccgagaagcttgtgagtac

SEQ ID NO: 250021 - DNA, 20 bp, human
ggtgctgcgagtggctagct

SEQ ID NO: 250022 - DNA, 20 bp, human
gcgcttctctgtgctgcgag

SEQ ID NO: 250023 - DNA, 20 bp, human
ggtgagtaccggggcagtga

SEQ ID NO: 250024 - DNA, 20 bp, human
gaggcagcccggcttctccc

SEQ ID NO: 250025 - DNA, 20 bp, human
gcgggaggggcgctgtgtcg

SEQ ID NO: 250026 - DNA, 20 bp, human
gctgtctgtcgacgtcaata

SEQ ID NO: 250027 - DNA, 20 bp, human
gacggccgctatagccctat

SEQ ID NO: 250028 - DNA, 20 bp, human
gctggggcggatgcacgtgg

SEQ ID NO: 250029 - DNA, 20 bp, human
gaggcctggcctgtctgggg

SEQ ID NO: 250030 - DNA, 20 bp, human
ggcagccgatagggctatag

SEQ ID NO: 250031 - DNA, 20 bp, human
gtggggccaggcgcacgcgg

SEQ ID NO: 250032 - DNA, 20 bp, human
ggtagcgtcagccagttagg

SEQ ID NO: 250033 - DNA, 20 bp, human
gtgtctggggcggatgcacg

SEQ ID NO: 250034 - DNA, 20 bp, human
ggaagccgcgtccagtgaga

SEQ ID NO: 250035 - DNA, 20 bp, human
gggtgttgtagcagccgata

SEQ ID NO: 250036 - DNA, 20 bp, human
gcggacggaacttcctgtca

SEQ ID NO: 250037 - DNA, 20 bp, human
gtcagtggtgtcttgatgaa

SEQ ID NO: 250038 - DNA, 20 bp, human
gggttgtcgtattctctcag

SEQ ID NO: 250039 - DNA, 20 bp, human
gaatctcttttcctactctg

SEQ ID NO: 250040 - DNA, 20 bp, human
gggaaaagaacatcctgtca

SEQ ID NO: 250041 - DNA, 20 bp, human
gagttccgtccgggtgcaag

SEQ ID NO: 250042 - DNA, 20 bp, human
gacttccgcttgcacccgga

SEQ ID NO: 250043 - DNA, 20 bp, human
gacttcctcctagaatagag

SEQ ID NO: 250044 - DNA, 20 bp, human
gaaatacaggcagggcgcgt

SEQ ID NO: 250045 - DNA, 20 bp, human
gttatcctctctattctagg

SEQ ID NO: 250046 - DNA, 20 bp, human
gtctaacgagagttatgtca

SEQ ID NO: 250047 - DNA, 20 bp, human
gaaagcagctgtctgagtag

SEQ ID NO: 250048 - DNA, 20 bp, human
gtgtgcgtatgaggtcgacc

SEQ ID NO: 250049 - DNA, 20 bp, human
ggaaaactcgagagaagcag

SEQ ID NO: 250050 - DNA, 20 bp, human
gagggcacctcagagcattc

SEQ ID NO: 250051 - DNA, 20 bp, human
ggcgacgaagaatctcgtcc

SEQ ID NO: 250052 - DNA, 20 bp, human
ggcattcgggatttgggcca

SEQ ID NO: 250053 - DNA, 20 bp, human
gcggaaaagaatctctaaac

SEQ ID NO: 250054 - DNA, 20 bp, human
gacctcatacgcacaggcgc

SEQ ID NO: 250055 - DNA, 20 bp, human
gcctcagagcattcgggatt

SEQ ID NO: 250056 - DNA, 20 bp, human
gggccccgagaacgcggcgt

SEQ ID NO: 250057 - DNA, 20 bp, human
ggggctggccggaagaacgc

SEQ ID NO: 250058 - DNA, 20 bp, human
gctgcggggccccgagaacg

SEQ ID NO: 250059 - DNA, 20 bp, human
gccggccgcccgcgttcttc

SEQ ID NO: 250060 - DNA, 20 bp, human
gggcgccgacgccgcgttct

SEQ ID NO: 250061 - DNA, 20 bp, human
gccggccagccccccgcgga

SEQ ID NO: 250062 - DNA, 20 bp, human
gagccggcgcccgtggtctc

SEQ ID NO: 250063 - DNA, 20 bp, human
ggaggtgtgcagacactcgg

SEQ ID NO: 250064 - DNA, 20 bp, human
gggcccttccgccggctgcg

SEQ ID NO: 250065 - DNA, 20 bp, human
gctggccggaagaacgcggg

SEQ ID NO: 250066 - DNA, 20 bp, human
ggcccgaatgcattcttcca

SEQ ID NO: 250067 - DNA, 20 bp, human
gtccgcctcctcctgttgga

SEQ ID NO: 250068 - DNA, 20 bp, human
gtcatctcgcgagaaagggt

SEQ ID NO: 250069 - DNA, 20 bp, human
gtcgcgagaaagggttggcg

SEQ ID NO: 250070 - DNA, 20 bp, human
gggtatccaggacgaggaga

SEQ ID NO: 250071 - DNA, 20 bp, human
gcctcggggcgggccaatca

SEQ ID NO: 250072 - DNA, 20 bp, human
gggggagggtatccaggacg

SEQ ID NO: 250073 - DNA, 20 bp, human
ggcgagatgacgaccaccct

SEQ ID NO: 250074 - DNA, 20 bp, human
gcccctccaacaggaggagg

SEQ ID NO: 250075 - DNA, 20 bp, human
gggtcgtcatctcgcgagaa

SEQ ID NO: 250076 - DNA, 20 bp, human
gcgccccgcccaactctcgg

SEQ ID NO: 250077 - DNA, 20 bp, human
ggcggggcggcgtcccaaaa

SEQ ID NO: 250078 - DNA, 20 bp, human
gtaacccggaagcggggatg

SEQ ID NO: 250079 - DNA, 20 bp, human
gtgcctccgagagttgggcg

SEQ ID NO: 250080 - DNA, 20 bp, human
gccgccccgccctctcggaa

SEQ ID NO: 250081 - DNA, 20 bp, human
gcggcgacaaacaacgacga

SEQ ID NO: 250082 - DNA, 20 bp, human
ggaggagatttcagacgcta

SEQ ID NO: 250083 - DNA, 20 bp, human
gtggcagccccaaaggtcat

SEQ ID NO: 250084 - DNA, 20 bp, human
gactcgccccgcccaactct

SEQ ID NO: 250085 - DNA, 20 bp, human
gcagaacagcagcagcggag

SEQ ID NO: 250086 - DNA, 20 bp, human
gcggaaccgccatttttaaa

SEQ ID NO: 250087 - DNA, 20 bp, human
gaaaaatggcggttccgcac

SEQ ID NO: 250088 - DNA, 20 bp, human
gctcctgtgaaacagaatta

SEQ ID NO: 250089 - DNA, 20 bp, human
gggttacccgaggcagaaga

SEQ ID NO: 250090 - DNA, 20 bp, human
ggaaggggtggagggcgtgt

SEQ ID NO: 250091 - DNA, 20 bp, human
gcactggtcaacaataccat

SEQ ID NO: 250092 - DNA, 20 bp, human
gagaagagggcgggagcgaa

SEQ ID NO: 250093 - DNA, 20 bp, human
gttctgcctcgggtaaccaa

SEQ ID NO: 250094 - DNA, 20 bp, human
ggggcgtgtcggcaccgagg

SEQ ID NO: 250095 - DNA, 20 bp, human
gggagggcgtgtcggcaccg

SEQ ID NO: 250096 - DNA, 20 bp, human
gtcgaaggacgcacaagggg

SEQ ID NO: 250097 - DNA, 20 bp, human
gggctcgcaaccctcctcga

SEQ ID NO: 250098 - DNA, 20 bp, human
ggggcggggcttaaggccaa

SEQ ID NO: 250099 - DNA, 20 bp, human
gcttgtgcgtccttcgagga

SEQ ID NO: 250100 - DNA, 20 bp, human
gatgtgctcgagaagactga

SEQ ID NO: 250101 - DNA, 20 bp, human
gcgcctgcgcattaccgaag

SEQ ID NO: 250102 - DNA, 20 bp, human
ggggactctcaggggaaaat

SEQ ID NO: 250103 - DNA, 20 bp, human
gcaggcgcaagcgcagagag

SEQ ID NO: 250104 - DNA, 20 bp, human
gcaacggaaaacagagcgag

SEQ ID NO: 250105 - DNA, 20 bp, human
ggagtggtcgcgcgagctca

SEQ ID NO: 250106 - DNA, 20 bp, human
gtagagcagtcgacactgag

SEQ ID NO: 250107 - DNA, 20 bp, human
gagcagtcgacactgagagg

SEQ ID NO: 250108 - DNA, 20 bp, human
gacagtgaggtctctactat

SEQ ID NO: 250109 - DNA, 20 bp, human
gtaagatgcccgtgggggtg

SEQ ID NO: 250110 - DNA, 20 bp, human
gacagtgtaagatgcccgtg

SEQ ID NO: 250111 - DNA, 20 bp, human
gcccatactgacgtcagcat

SEQ ID NO: 250112 - DNA, 20 bp, human
ggaagtcttctgaacctcac

SEQ ID NO: 250113 - DNA, 20 bp, human
gatactgacgtcagcattgg

SEQ ID NO: 250114 - DNA, 20 bp, human
ggtcgcccccttcagccaat

SEQ ID NO: 250115 - DNA, 20 bp, human
ggggaagacagcggacgcca

SEQ ID NO: 250116 - DNA, 20 bp, human
gctaatctaattttgataat

SEQ ID NO: 250117 - DNA, 20 bp, human
gtatcaaaattagattagga

SEQ ID NO: 250118 - DNA, 20 bp, human
gcatggagcgcttgataaaa

SEQ ID NO: 250119 - DNA, 20 bp, human
gacaaatcccaaacaattac

SEQ ID NO: 250120 - DNA, 20 bp, human
gtttcaaaatatcctgcctc

SEQ ID NO: 250121 - DNA, 20 bp, human
gaagtttgtggctaaagttg

SEQ ID NO: 250122 - DNA, 20 bp, human
gcgctccatggtccagaggc

SEQ ID NO: 250123 - DNA, 20 bp, human
gactgaatcactgtaaaaat

SEQ ID NO: 250124 - DNA, 20 bp, human
gtggattccagtaattgttt

SEQ ID NO: 250125 - DNA, 20 bp, human
gctttacttgcttacagcgt

SEQ ID NO: 250126 - DNA, 20 bp, human
ggggagaggttggacgggcg

SEQ ID NO: 250127 - DNA, 20 bp, human
gggagcgcgcgcctgcagac

SEQ ID NO: 250128 - DNA, 20 bp, human
gcgcctgcagaccggacgtc

SEQ ID NO: 250129 - DNA, 20 bp, human
ggacgtccggccagcaggcg

SEQ ID NO: 250130 - DNA, 20 bp, human
gaggttgggcgggagaggtt

SEQ ID NO: 250131 - DNA, 20 bp, human
gagggcggccggacggacgc

SEQ ID NO: 250132 - DNA, 20 bp, human
gagcgggcgaggcgggacct

SEQ ID NO: 250133 - DNA, 20 bp, human
gcgcttacaggccggctcag

SEQ ID NO: 250134 - DNA, 20 bp, human
gagagctcggccccggagca

SEQ ID NO: 250135 - DNA, 20 bp, human
gggcctctcccgcgtccgtc

SEQ ID NO: 250136 - DNA, 20 bp, human
ggagacagcagtgaagccgc

SEQ ID NO: 250137 - DNA, 20 bp, human
ggggggttcctattggacaa

SEQ ID NO: 250138 - DNA, 20 bp, human
gctctcgcaactcaagatgg

SEQ ID NO: 250139 - DNA, 20 bp, human
gaggaaccccccatgtagtg

SEQ ID NO: 250140 - DNA, 20 bp, human
gcctccgctgccgcagatga

SEQ ID NO: 250141 - DNA, 20 bp, human
ggctccgcgccccactacat

SEQ ID NO: 250142 - DNA, 20 bp, human
gccgcgccccactacatggg

SEQ ID NO: 250143 - DNA, 20 bp, human
gctgctctcgcaactcaaga

SEQ ID NO: 250144 - DNA, 20 bp, human
gacccaggaatcacgaggga

SEQ ID NO: 250145 - DNA, 20 bp, human
ggaatcacgagggacggctc

SEQ ID NO: 250146 - DNA, 20 bp, human
gaggaggaagtcgcgttccc

SEQ ID NO: 250147 - DNA, 20 bp, human
ggcagggcgcgccagatacg

SEQ ID NO: 250148 - DNA, 20 bp, human
gtgtactggtgcaggtgggg

SEQ ID NO: 250149 - DNA, 20 bp, human
gtgaccgacggcgaagccgg

SEQ ID NO: 250150 - DNA, 20 bp, human
gtcgcctccggcttcgccgt

SEQ ID NO: 250151 - DNA, 20 bp, human
gtcgccgtcggtcactgcct

SEQ ID NO: 250152 - DNA, 20 bp, human
gcagtgaccgacggcgaagc

SEQ ID NO: 250153 - DNA, 20 bp, human
ggcggcgcctcgctcgcctc

SEQ ID NO: 250154 - DNA, 20 bp, human
gcccgcacgtcggcccctag

SEQ ID NO: 250155 - DNA, 20 bp, human
gtcctctaggggccgacgtg

SEQ ID NO: 250156 - DNA, 20 bp, human
gacgcctccaaaggccgaag

SEQ ID NO: 250157 - DNA, 20 bp, human
gggcggtggagctcgaggaa

SEQ ID NO: 250158 - DNA, 20 bp, human
gagaactagcgggtcgagcg

SEQ ID NO: 250159 - DNA, 20 bp, human
gtggagctcgaggaatgggc

SEQ ID NO: 250160 - DNA, 20 bp, human
gaatgggccggagaactagc

SEQ ID NO: 250161 - DNA, 20 bp, human
gtccaaaggccgaaggggat

SEQ ID NO: 250162 - DNA, 20 bp, human
gtaaggggcggtggagctcg

SEQ ID NO: 250163 - DNA, 20 bp, human
ggattggaagagggaggtaa

SEQ ID NO: 250164 - DNA, 20 bp, human
gggccgcggggatccgaagc

SEQ ID NO: 250165 - DNA, 20 bp, human
gaggcaccgcggccaatcct

SEQ ID NO: 250166 - DNA, 20 bp, human
gggtgggggcagacagacta

SEQ ID NO: 250167 - DNA, 20 bp, human
gggaaaatgtggagaccgga

SEQ ID NO: 250168 - DNA, 20 bp, human
ggcaaagattccacgggaag

SEQ ID NO: 250169 - DNA, 20 bp, human
gaaaaaagagcggaccgagg

SEQ ID NO: 250170 - DNA, 20 bp, human
ggcaaaacctccagacgctc

SEQ ID NO: 250171 - DNA, 20 bp, human
gagaccggagggaaacgaac

SEQ ID NO: 250172 - DNA, 20 bp, human
ggggaagtcacttttgtcaa

SEQ ID NO: 250173 - DNA, 20 bp, human
ggagggaaacgaactggatc

SEQ ID NO: 250174 - DNA, 20 bp, human
gtgcgcagggatgccctctg

SEQ ID NO: 250175 - DNA, 20 bp, human
gggcagacagactatggctt

SEQ ID NO: 250176 - DNA, 20 bp, human
gggacaagcgagatgggaag

SEQ ID NO: 250177 - DNA, 20 bp, human
gagcccagggacaagcgaga

SEQ ID NO: 250178 - DNA, 20 bp, human
gctgtccaggacctacctgc

SEQ ID NO: 250179 - DNA, 20 bp, human
gcccagatgcaatcagagat

SEQ ID NO: 250180 - DNA, 20 bp, human
gcaggagggctgtgcccaga

SEQ ID NO: 250181 - DNA, 20 bp, human
gcaggaaaaggatgccagtc

SEQ ID NO: 250182 - DNA, 20 bp, human
ggaagactgtgagaggtttc

SEQ ID NO: 250183 - DNA, 20 bp, human
gtggggatcccacctgacta

SEQ ID NO: 250184 - DNA, 20 bp, human
ggagttggcactgtcctgac

SEQ ID NO: 250185 - DNA, 20 bp, human
ggaacacaccactggaagac

SEQ ID NO: 250186 - DNA, 20 bp, human
ggcagcgcctatgtgaagtt

SEQ ID NO: 250187 - DNA, 20 bp, human
gagggtgcccgccaatggct

SEQ ID NO: 250188 - DNA, 20 bp, human
gccgacagcaggcgaggagt

SEQ ID NO: 250189 - DNA, 20 bp, human
gcgcctatgtgaagttaggt

SEQ ID NO: 250190 - DNA, 20 bp, human
gacgtcggaacagtgacttc

SEQ ID NO: 250191 - DNA, 20 bp, human
ggacctacctaacttcacat

SEQ ID NO: 250192 - DNA, 20 bp, human
gtcggaacagtgacttccgg

SEQ ID NO: 250193 - DNA, 20 bp, human
ggccagaaacgcgaacacgt

SEQ ID NO: 250194 - DNA, 20 bp, human
gagaagccggtccggagttc

SEQ ID NO: 250195 - DNA, 20 bp, human
ggtcgtataaagcgcggaga

SEQ ID NO: 250196 - DNA, 20 bp, human
ggctacgggcagaatcaagg

SEQ ID NO: 250197 - DNA, 20 bp, human
gcaaacaggcacgcctagtg

SEQ ID NO: 250198 - DNA, 20 bp, human
gaggcacgcctagtgagggc

SEQ ID NO: 250199 - DNA, 20 bp, human
gtgcccgtagcaggtgaacc

SEQ ID NO: 250200 - DNA, 20 bp, human
gacgcgcggggccttcaaac

SEQ ID NO: 250201 - DNA, 20 bp, human
gcctgctacgggcagaatca

SEQ ID NO: 250202 - DNA, 20 bp, human
gagcaggagccggaaacgcg

SEQ ID NO: 250203 - DNA, 20 bp, human
ggcgcactgcgggtcctgat

SEQ ID NO: 250204 - DNA, 20 bp, human
gacagcttctgagcaggagc

SEQ ID NO: 250205 - DNA, 20 bp, human
gtgtgcaaagccagatgcgg

SEQ ID NO: 250206 - DNA, 20 bp, human
gaaggaggctctggagagta

SEQ ID NO: 250207 - DNA, 20 bp, human
gttgccaggcaaccaaggaa

SEQ ID NO: 250208 - DNA, 20 bp, human
gtttaagtgtgatctcccca

SEQ ID NO: 250209 - DNA, 20 bp, human
gtgggaacattgccaatcag

SEQ ID NO: 250210 - DNA, 20 bp, human
ggaacattgccaatcagagg

SEQ ID NO: 250211 - DNA, 20 bp, human
ggtcaatgccccatgccagt

SEQ ID NO: 250212 - DNA, 20 bp, human
gtctcacccaggaaggcaga

SEQ ID NO: 250213 - DNA, 20 bp, human
gctcaattggggatcagctt

SEQ ID NO: 250214 - DNA, 20 bp, human
gtggctaaggagttacctgg

SEQ ID NO: 250215 - DNA, 20 bp, human
gcagtaggaagtgaacggca

SEQ ID NO: 250216 - DNA, 20 bp, human
gacagggcggagacaggtga

SEQ ID NO: 250217 - DNA, 20 bp, human
ggggcgtggcggcagagctc

SEQ ID NO: 250218 - DNA, 20 bp, human
gggaaggcggcgagtgtagg

SEQ ID NO: 250219 - DNA, 20 bp, human
gtgccgcgcctcacctgctt

SEQ ID NO: 250220 - DNA, 20 bp, human
gggaacccgggcaggtgagc

SEQ ID NO: 250221 - DNA, 20 bp, human
gcagagctcaggaaaagagg

SEQ ID NO: 250222 - DNA, 20 bp, human
gtgagcaggcggcacggggc

SEQ ID NO: 250223 - DNA, 20 bp, human
ggggacaggtgattgggtaa

SEQ ID NO: 250224 - DNA, 20 bp, human
gacggggcgacggggaaccc

SEQ ID NO: 250225 - DNA, 20 bp, human
gcgcggcacagggcggagac

SEQ ID NO: 250226 - DNA, 20 bp, human
gggagaaagccaggttgtgg

SEQ ID NO: 250227 - DNA, 20 bp, human
gatcctcagcaggtctcaga

SEQ ID NO: 250228 - DNA, 20 bp, human
ggtgtctctcagtaccatca

SEQ ID NO: 250229 - DNA, 20 bp, human
gactgtaaagatacatggag

SEQ ID NO: 250230 - DNA, 20 bp, human
gtgggggcaccagctataac

SEQ ID NO: 250231 - DNA, 20 bp, human
gaagactaatattgacagtc

SEQ ID NO: 250232 - DNA, 20 bp, human
gtaccttctgagacctgctg

SEQ ID NO: 250233 - DNA, 20 bp, human
gcagcaaatcaccatggtga

SEQ ID NO: 250234 - DNA, 20 bp, human
gataccagatgtctagactt

SEQ ID NO: 250235 - DNA, 20 bp, human
ggtttcttcagtttacatag

SEQ ID NO: 250236 - DNA, 20 bp, human
gagggcgtagagaaccgaat

SEQ ID NO: 250237 - DNA, 20 bp, human
gagaaggggaagagacgaga

SEQ ID NO: 250238 - DNA, 20 bp, human
ggagaaccgaatgggaggag

SEQ ID NO: 250239 - DNA, 20 bp, human
gagatcaagcagaaggggta

SEQ ID NO: 250240 - DNA, 20 bp, human
ggggaagggaaccgggacgg

SEQ ID NO: 250241 - DNA, 20 bp, human
ggcgtagagaaccgaatggg

SEQ ID NO: 250242 - DNA, 20 bp, human
ggcagcggagctcgcatcct

SEQ ID NO: 250243 - DNA, 20 bp, human
ggggaatggagatgacggtt

SEQ ID NO: 250244 - DNA, 20 bp, human
gcagcagggagcggcgagaa

SEQ ID NO: 250245 - DNA, 20 bp, human
gcggagctcgcatcctcggc

SEQ ID NO: 250246 - DNA, 20 bp, human
gaacctgtagcacaaggaaa

SEQ ID NO: 250247 - DNA, 20 bp, human
gaaggcgatgggccacgtga

SEQ ID NO: 250248 - DNA, 20 bp, human
ggtgactttcaatgttttgg

SEQ ID NO: 250249 - DNA, 20 bp, human
gggaagagttaaaaagactg

SEQ ID NO: 250250 - DNA, 20 bp, human
gcaacccataaggtgtcgag

SEQ ID NO: 250251 - DNA, 20 bp, human
gaggcaaaaagacaaggcga

SEQ ID NO: 250252 - DNA, 20 bp, human
gacaccctctcgacacctta

SEQ ID NO: 250253 - DNA, 20 bp, human
ggttaaaaagactgaggcaa

SEQ ID NO: 250254 - DNA, 20 bp, human
gaaccctttccttgtgctac

SEQ ID NO: 250255 - DNA, 20 bp, human
ggagagggaccatatgcaaa

SEQ ID NO: 250256 - DNA, 20 bp, human
ggggccgcgcgtgtggcgga

SEQ ID NO: 250257 - DNA, 20 bp, human
gagggagcgcggcttgagga

SEQ ID NO: 250258 - DNA, 20 bp, human
ggggaagaggttccggagtc

SEQ ID NO: 250259 - DNA, 20 bp, human
gaagaggttccggagtcggg

SEQ ID NO: 250260 - DNA, 20 bp, human
ggaggcctgagggcgctgga

SEQ ID NO: 250261 - DNA, 20 bp, human
gcttcctccccacccgactc

SEQ ID NO: 250262 - DNA, 20 bp, human
gtcacgtgaaggccggggcg

SEQ ID NO: 250263 - DNA, 20 bp, human
ggaaaacccgcctctctagt

SEQ ID NO: 250264 - DNA, 20 bp, human
gcccaagcagccaggcgccc

SEQ ID NO: 250265 - DNA, 20 bp, human
gcgccaggtcacgtgaaggc

SEQ ID NO: 250266 - DNA, 20 bp, human
gagtccccacaagtagtctt

SEQ ID NO: 250267 - DNA, 20 bp, human
gtggcagggcgcacccacca

SEQ ID NO: 250268 - DNA, 20 bp, human
gtgcgccctgccaagaaggg

SEQ ID NO: 250269 - DNA, 20 bp, human
ggggtgcgccctgccaagaa

SEQ ID NO: 250270 - DNA, 20 bp, human
gtctcccaaagactacttgt

SEQ ID NO: 250271 - DNA, 20 bp, human
ggtggaagagaacgtggaca

SEQ ID NO: 250272 - DNA, 20 bp, human
ggcaccgaggttgctgcggt

SEQ ID NO: 250273 - DNA, 20 bp, human
gatgaggcccccaccgtcgg

SEQ ID NO: 250274 - DNA, 20 bp, human
gtggggactagggaggttta

SEQ ID NO: 250275 - DNA, 20 bp, human
gcacccacgcagtgcctctt

SEQ ID NO: 250276 - DNA, 20 bp, human
gccaaaccgcggagaagggg

SEQ ID NO: 250277 - DNA, 20 bp, human
gatgccaaaccgcggagaag

SEQ ID NO: 250278 - DNA, 20 bp, human
ggacaggctgtcagcgctgg

SEQ ID NO: 250279 - DNA, 20 bp, human
gccccggggatgccaaaccg

SEQ ID NO: 250280 - DNA, 20 bp, human
gacagcctgtcggcggcgga

SEQ ID NO: 250281 - DNA, 20 bp, human
ggcctccctccgccgccgac

SEQ ID NO: 250282 - DNA, 20 bp, human
gcaggagccgtcaggcgggc

SEQ ID NO: 250283 - DNA, 20 bp, human
gagcagctcctgcgggtccc

SEQ ID NO: 250284 - DNA, 20 bp, human
gccgggcaggagccgtcagg

SEQ ID NO: 250285 - DNA, 20 bp, human
ggctgacagcctgtcggcgg

SEQ ID NO: 250286 - DNA, 20 bp, human
ggcgaagaggttatggtcac

SEQ ID NO: 250287 - DNA, 20 bp, human
ggcagtatgcgaagaggtta

SEQ ID NO: 250288 - DNA, 20 bp, human
gactttgaactcactcaagg

SEQ ID NO: 250289 - DNA, 20 bp, human
gggtggagcagtatgcgaag

SEQ ID NO: 250290 - DNA, 20 bp, human
gttgactttgaactcactca

SEQ ID NO: 250291 - DNA, 20 bp, human
gtggacccacatgatgtggt

SEQ ID NO: 250292 - DNA, 20 bp, human
gttaaatcctggcatggcca

SEQ ID NO: 250293 - DNA, 20 bp, human
ggcaaagagatgggtaagat

SEQ ID NO: 250294 - DNA, 20 bp, human
gacaggatttgagacagatc

SEQ ID NO: 250295 - DNA, 20 bp, human
gcccatgaaacaccaacaag

SEQ ID NO: 250296 - DNA, 20 bp, human
ggcggcgtggggaccgaaaa

SEQ ID NO: 250297 - DNA, 20 bp, human
gaagaccctaaaggtaaagc

SEQ ID NO: 250298 - DNA, 20 bp, human
gcgtggggaccgaaaagggg

SEQ ID NO: 250299 - DNA, 20 bp, human
gcctacccgctttaccttta

SEQ ID NO: 250300 - DNA, 20 bp, human
gaattcccaatgtggagggt

SEQ ID NO: 250301 - DNA, 20 bp, human
gtgccagtgccgtgtcgaat

SEQ ID NO: 250302 - DNA, 20 bp, human
gccaaatcggcgcagttccc

SEQ ID NO: 250303 - DNA, 20 bp, human
gcgggagcccggcggaaaca

SEQ ID NO: 250304 - DNA, 20 bp, human
gagcgtcccagaggcgctaa

SEQ ID NO: 250305 - DNA, 20 bp, human
gcgctaattcccaatgtgga

SEQ ID NO: 250306 - DNA, 20 bp, human
ggggaagggcatcctaaggt

SEQ ID NO: 250307 - DNA, 20 bp, human
ggctccctctggtggagctg

SEQ ID NO: 250308 - DNA, 20 bp, human
gtagtcccgactccgacctt

SEQ ID NO: 250309 - DNA, 20 bp, human
ggcggcgggcaatcggaaat

SEQ ID NO: 250310 - DNA, 20 bp, human
gggcctatccgcgatgagaa

SEQ ID NO: 250311 - DNA, 20 bp, human
gcgctcgctcgcggggagac

SEQ ID NO: 250312 - DNA, 20 bp, human
gccgccgcagctccaccaga

SEQ ID NO: 250313 - DNA, 20 bp, human
gggacgcggcgctggaaatc

SEQ ID NO: 250314 - DNA, 20 bp, human
ggcgatgagaacggcgtgga

SEQ ID NO: 250315 - DNA, 20 bp, human
gacaccgcgagccccaccct

SEQ ID NO: 250316 - DNA, 20 bp, human
gcgggcgcctagaacccgac

SEQ ID NO: 250317 - DNA, 20 bp, human
gaagtcaaggagcatccggt

SEQ ID NO: 250318 - DNA, 20 bp, human
gtctgtggaggtgcagtcgc

SEQ ID NO: 250319 - DNA, 20 bp, human
gcagaggagtccggagaccg

SEQ ID NO: 250320 - DNA, 20 bp, human
gcaggtggccccagccgacg

SEQ ID NO: 250321 - DNA, 20 bp, human
gcccagccgacgaggtgagt

SEQ ID NO: 250322 - DNA, 20 bp, human
gacgtccaatcagaggagtc

SEQ ID NO: 250323 - DNA, 20 bp, human
gcgcagccacgtccaatcag

SEQ ID NO: 250324 - DNA, 20 bp, human
gggcaaagtcaaggagcatc

SEQ ID NO: 250325 - DNA, 20 bp, human
ggcgcttcgctgcacgcgat

SEQ ID NO: 250326 - DNA, 20 bp, human
gtaaacaaggctagaaaggg

SEQ ID NO: 250327 - DNA, 20 bp, human
gacacccacattagatcata

SEQ ID NO: 250328 - DNA, 20 bp, human
gcctttagttacaatatctt

SEQ ID NO: 250329 - DNA, 20 bp, human
gaaaaggccgataaagtttc

SEQ ID NO: 250330 - DNA, 20 bp, human
gaactgcttatgcagtatag

SEQ ID NO: 250331 - DNA, 20 bp, human
gttgtaaacaaggctagaaa

SEQ ID NO: 250332 - DNA, 20 bp, human
gagccggattgtgttcattg

SEQ ID NO: 250333 - DNA, 20 bp, human
gaaaaccatgactttctttc

SEQ ID NO: 250334 - DNA, 20 bp, human
gttaccatatgatctaatgt

SEQ ID NO: 250335 - DNA, 20 bp, human
gtaaatgctacttgtaaaca

SEQ ID NO: 250336 - DNA, 20 bp, human
gtagacgatgtactccttca

SEQ ID NO: 250337 - DNA, 20 bp, human
gggagtacatcgtctagtga

SEQ ID NO: 250338 - DNA, 20 bp, human
gcgtcttgtcaataaagtga

SEQ ID NO: 250339 - DNA, 20 bp, human
gataataagacacgccctga

SEQ ID NO: 250340 - DNA, 20 bp, human
gaaaatattgtgcaaggccc

SEQ ID NO: 250341 - DNA, 20 bp, human
gaacttggtataagcaagat

SEQ ID NO: 250342 - DNA, 20 bp, human
gtattccttgttctgtaccc

SEQ ID NO: 250343 - DNA, 20 bp, human
gaaaaatcagactgattgct

SEQ ID NO: 250344 - DNA, 20 bp, human
gcagattgaaaacctcaact

SEQ ID NO: 250345 - DNA, 20 bp, human
ggcaatttgttttgcgtgct

SEQ ID NO: 250346 - DNA, 20 bp, human
gtgcgcgcggcggaccagaa

SEQ ID NO: 250347 - DNA, 20 bp, human
gggacaccgcccacatcgta

SEQ ID NO: 250348 - DNA, 20 bp, human
ggtccgcggccctacgatgt

SEQ ID NO: 250349 - DNA, 20 bp, human
gtctacgcgggcctcgcggc

SEQ ID NO: 250350 - DNA, 20 bp, human
gcgcccacatcgtagggccg

SEQ ID NO: 250351 - DNA, 20 bp, human
ggcgtagaggcggaagttga

SEQ ID NO: 250352 - DNA, 20 bp, human
gccggcgttgtcagggtccg

SEQ ID NO: 250353 - DNA, 20 bp, human
gtgaggggactgacgcagat

SEQ ID NO: 250354 - DNA, 20 bp, human
ggctgcgtagtggagcttgc

SEQ ID NO: 250355 - DNA, 20 bp, human
gccctgacaacgccggaacc

SEQ ID NO: 250356 - DNA, 20 bp, human
ggcaaggcctcactaatcga

SEQ ID NO: 250357 - DNA, 20 bp, human
ggaggccttgcgtctgtcgg

SEQ ID NO: 250358 - DNA, 20 bp, human
gggcaacgatcctcagtggg

SEQ ID NO: 250359 - DNA, 20 bp, human
gcgtctgtcggcgggcagga

SEQ ID NO: 250360 - DNA, 20 bp, human
gcacggcgaccacacggccc

SEQ ID NO: 250361 - DNA, 20 bp, human
gctgcccgccgacagacgca

SEQ ID NO: 250362 - DNA, 20 bp, human
gagtggcaacgatcctcagt

SEQ ID NO: 250363 - DNA, 20 bp, human
gtgtggtcgccgtgggttct

SEQ ID NO: 250364 - DNA, 20 bp, human
gagaaagaaacgggatgcag

SEQ ID NO: 250365 - DNA, 20 bp, human
ggcgcggccatcgattagtg

SEQ ID NO: 250366 - DNA, 20 bp, human
ggggcctttcaagcgagcag

SEQ ID NO: 250367 - DNA, 20 bp, human
gagcaggggcgtgactccgg

SEQ ID NO: 250368 - DNA, 20 bp, human
gctcgcttgaaaggcccaat

SEQ ID NO: 250369 - DNA, 20 bp, human
gactgggccaaggctcgggg

SEQ ID NO: 250370 - DNA, 20 bp, human
ggagcagcttgaagacggat

SEQ ID NO: 250371 - DNA, 20 bp, human
gggaccccaagactgggcca

SEQ ID NO: 250372 - DNA, 20 bp, human
ggtagccacctcaaaggcgg

SEQ ID NO: 250373 - DNA, 20 bp, human
ggggaagttcagaggggtcg

SEQ ID NO: 250374 - DNA, 20 bp, human
gcgtgtagccacctcaaagg

SEQ ID NO: 250375 - DNA, 20 bp, human
gggagcgggacggaagtgag

SEQ ID NO: 250376 - DNA, 20 bp, human
gcaggcccacgccccggggt

SEQ ID NO: 250377 - DNA, 20 bp, human
gggcacgcatcccgcaggag

SEQ ID NO: 250378 - DNA, 20 bp, human
ggagcccgctgacctgtccc

SEQ ID NO: 250379 - DNA, 20 bp, human
gcgtggcccaagggcgtctt

SEQ ID NO: 250380 - DNA, 20 bp, human
gctctggcacccgctcctgc

SEQ ID NO: 250381 - DNA, 20 bp, human
gaggctgagagtcccgaaag

SEQ ID NO: 250382 - DNA, 20 bp, human
ggggccggccggcaccacaa

SEQ ID NO: 250383 - DNA, 20 bp, human
ggggagccgaagacgccctt

SEQ ID NO: 250384 - DNA, 20 bp, human
gggtggctgcgcagtgaaga

SEQ ID NO: 250385 - DNA, 20 bp, human
gggggccaaaggcagtaact

SEQ ID NO: 250386 - DNA, 20 bp, human
gaatccttgacccagttccg

SEQ ID NO: 250387 - DNA, 20 bp, human
gaggatgttgtgcacccctt

SEQ ID NO: 250388 - DNA, 20 bp, human
gagtcctcggaactgggtca

SEQ ID NO: 250389 - DNA, 20 bp, human
ggcccctggggttgcctggt

SEQ ID NO: 250390 - DNA, 20 bp, human
gaggctcctctccccccaag

SEQ ID NO: 250391 - DNA, 20 bp, human
ggaagtcagcgggcatctcc

SEQ ID NO: 250392 - DNA, 20 bp, human
gagttccgaggactggagag

SEQ ID NO: 250393 - DNA, 20 bp, human
gatgttgtgcaccccttggg

SEQ ID NO: 250394 - DNA, 20 bp, human
gctgctccgagaagtgggga

SEQ ID NO: 250395 - DNA, 20 bp, human
gagtagctccagaagcccgt

SEQ ID NO: 250396 - DNA, 20 bp, human
gaaggtcatcttagatatgg

SEQ ID NO: 250397 - DNA, 20 bp, human
gtggggcctgacctcagttc

SEQ ID NO: 250398 - DNA, 20 bp, human
ggtggagcagcgcaggtcat

SEQ ID NO: 250399 - DNA, 20 bp, human
gactggccccatggtccaac

SEQ ID NO: 250400 - DNA, 20 bp, human
ggtcctaggagccagaactg

SEQ ID NO: 250401 - DNA, 20 bp, human
ggacaccagtaccacccagt

SEQ ID NO: 250402 - DNA, 20 bp, human
ggacctcagttctggctcct

SEQ ID NO: 250403 - DNA, 20 bp, human
gtgactcagacccttggctg

SEQ ID NO: 250404 - DNA, 20 bp, human
gtgggggcctctgatgcctc

SEQ ID NO: 250405 - DNA, 20 bp, human
ggccccatggtccaactggg

SEQ ID NO: 250406 - DNA, 20 bp, human
ggggaagcaccactcatccc

SEQ ID NO: 250407 - DNA, 20 bp, human
gaatccttgacccagttccg

SEQ ID NO: 250408 - DNA, 20 bp, human
gcctgtctcttccgcttcat

SEQ ID NO: 250409 - DNA, 20 bp, human
gctgctccgagaagtgggga

SEQ ID NO: 250410 - DNA, 20 bp, human
gtctctgctgagtgactcac

SEQ ID NO: 250411 - DNA, 20 bp, human
gacacccataccacttcctc

SEQ ID NO: 250412 - DNA, 20 bp, human
gagttccgaggactggagag

SEQ ID NO: 250413 - DNA, 20 bp, human
gggatgagagtggaggtcaa

SEQ ID NO: 250414 - DNA, 20 bp, human
gggagcctgaggaagtggta

SEQ ID NO: 250415 - DNA, 20 bp, human
gtccgcttcatgggaagcct

SEQ ID NO: 250416 - DNA, 20 bp, human
gggaaccagaagtgtcgaga

SEQ ID NO: 250417 - DNA, 20 bp, human
gtgagttgtgaaagcttgga

SEQ ID NO: 250418 - DNA, 20 bp, human
ggaagaggcagatggttcgt

SEQ ID NO: 250419 - DNA, 20 bp, human
gaaatggctcagtcacttta

SEQ ID NO: 250420 - DNA, 20 bp, human
ggaaagtcacatgtatgagt

SEQ ID NO: 250421 - DNA, 20 bp, human
gttcaagtgtggatgagagg

SEQ ID NO: 250422 - DNA, 20 bp, human
gaatggctcgagtggatgtg

SEQ ID NO: 250423 - DNA, 20 bp, human
gtggctcagtcactttatgg

SEQ ID NO: 250424 - DNA, 20 bp, human
gagagtgagttgtgaaagct

SEQ ID NO: 250425 - DNA, 20 bp, human
ggtgaccctctcgacacttc

SEQ ID NO: 250426 - DNA, 20 bp, human
ggggagaagccttcattagg

SEQ ID NO: 250427 - DNA, 20 bp, human
ggccttgggggcttgtgtaa

SEQ ID NO: 250428 - DNA, 20 bp, human
gccaagccacggggccttgg

SEQ ID NO: 250429 - DNA, 20 bp, human
gatactaatccccctaatga

SEQ ID NO: 250430 - DNA, 20 bp, human
gtgactccccaggatgtctg

SEQ ID NO: 250431 - DNA, 20 bp, human
gttgtgacctcagacatcct

SEQ ID NO: 250432 - DNA, 20 bp, human
gtgagcccagataaagaaga

SEQ ID NO: 250433 - DNA, 20 bp, human
gtcacttctggctttatttc

SEQ ID NO: 250434 - DNA, 20 bp, human
gcaataaaggagatcacttc

SEQ ID NO: 250435 - DNA, 20 bp, human
gctgcgtagatgtgctgaat

SEQ ID NO: 250436 - DNA, 20 bp, human
gggcccgaagccctgagggg

SEQ ID NO: 250437 - DNA, 20 bp, human
gggaccgcgggctgcgtcac

SEQ ID NO: 250438 - DNA, 20 bp, human
ggctcagggaaggaagtcgg

SEQ ID NO: 250439 - DNA, 20 bp, human
gggcgggtcgcacgccgcaa

SEQ ID NO: 250440 - DNA, 20 bp, human
ggggctgcgtcacggggacc

SEQ ID NO: 250441 - DNA, 20 bp, human
gccgcgcgttcgcaggacgg

SEQ ID NO: 250442 - DNA, 20 bp, human
gccgctgcccgggtcacgcg

SEQ ID NO: 250443 - DNA, 20 bp, human
gaacaccgccggccggaccg

SEQ ID NO: 250444 - DNA, 20 bp, human
gacgcggagcagcgcctttg

SEQ ID NO: 250445 - DNA, 20 bp, human
ggcgccgcgcgttcgcagga

SEQ ID NO: 250446 - DNA, 20 bp, human
ggctggactgcgggaaaaga

SEQ ID NO: 250447 - DNA, 20 bp, human
gccgccctccccgccctcgt

SEQ ID NO: 250448 - DNA, 20 bp, human
gaaagctggacacctgggac

SEQ ID NO: 250449 - DNA, 20 bp, human
gtgtgcctgggaagccgatt

SEQ ID NO: 250450 - DNA, 20 bp, human
gcgagtcgggcagcccacga

SEQ ID NO: 250451 - DNA, 20 bp, human
gggcgagcgccctctttcgg

SEQ ID NO: 250452 - DNA, 20 bp, human
gtgcctgattgatgtaatcc

SEQ ID NO: 250453 - DNA, 20 bp, human
gggtgcgcagttttcagtca

SEQ ID NO: 250454 - DNA, 20 bp, human
gcagcccacgagggcgggga

SEQ ID NO: 250455 - DNA, 20 bp, human
gaggcacaaagctggacacc

SEQ ID NO: 250456 - DNA, 20 bp, human
gggacgccgcctaggattgt

SEQ ID NO: 250457 - DNA, 20 bp, human
gattggggagaacgaggcca

SEQ ID NO: 250458 - DNA, 20 bp, human
ggccgggattggggagaacg

SEQ ID NO: 250459 - DNA, 20 bp, human
gagaacgaggccagggaatg

SEQ ID NO: 250460 - DNA, 20 bp, human
ggggaatgaggtaatggcca

SEQ ID NO: 250461 - DNA, 20 bp, human
gccaatcccggcctctccag

SEQ ID NO: 250462 - DNA, 20 bp, human
gcacatcccacaatcctagg

SEQ ID NO: 250463 - DNA, 20 bp, human
gaatcctaggcggcgtcccc

SEQ ID NO: 250464 - DNA, 20 bp, human
gagcgacaataacgaacctt

SEQ ID NO: 250465 - DNA, 20 bp, human
gaagggagcggcagatgagc

SEQ ID NO: 250466 - DNA, 20 bp, human
gagtgccggaagttactcct

SEQ ID NO: 250467 - DNA, 20 bp, human
gagtaacttccggcactgaa

SEQ ID NO: 250468 - DNA, 20 bp, human
ggccgctcgtgcactcggat

SEQ ID NO: 250469 - DNA, 20 bp, human
ggcactgaagggctgaatca

SEQ ID NO: 250470 - DNA, 20 bp, human
gagctccgaggagtaacttc

SEQ ID NO: 250471 - DNA, 20 bp, human
gtatcttgacaaccaggcac

SEQ ID NO: 250472 - DNA, 20 bp, human
gcaaactcagggaatggcgt

SEQ ID NO: 250473 - DNA, 20 bp, human
gcaaccaggcactggaagcc

SEQ ID NO: 250474 - DNA, 20 bp, human
gtgggacagagccgttgcca

SEQ ID NO: 250475 - DNA, 20 bp, human
gtggaacacgtgcaaactca

SEQ ID NO: 250476 - DNA, 20 bp, human
ggcgcagagccggacgaggt

SEQ ID NO: 250477 - DNA, 20 bp, human
ggaggaagacgctggctctc

SEQ ID NO: 250478 - DNA, 20 bp, human
gtggacgctcacaaaagcgc

SEQ ID NO: 250479 - DNA, 20 bp, human
gcacaaaagcgctgggggac

SEQ ID NO: 250480 - DNA, 20 bp, human
gaaggcagcgaggaagacgc

SEQ ID NO: 250481 - DNA, 20 bp, human
ggggttctctatctagtcca

SEQ ID NO: 250482 - DNA, 20 bp, human
ggcgcgctctggttttcgac

SEQ ID NO: 250483 - DNA, 20 bp, human
gagtctacgtaggaagtcgt

SEQ ID NO: 250484 - DNA, 20 bp, human
gctaatggcagtaagggcag

SEQ ID NO: 250485 - DNA, 20 bp, human
gctaacgtcaaagtctacgt

SEQ ID NO: 250486 - DNA, 20 bp, human
gccaagcgcgccctaaactc

SEQ ID NO: 250487 - DNA, 20 bp, human
gtccactgctcggccgtcta

SEQ ID NO: 250488 - DNA, 20 bp, human
gaggcgccccaggaaggaat

SEQ ID NO: 250489 - DNA, 20 bp, human
gtcagctgatcgcgcactga

SEQ ID NO: 250490 - DNA, 20 bp, human
gacggccgagcagtggagcg

SEQ ID NO: 250491 - DNA, 20 bp, human
ggccaactgggtcccggtgt

SEQ ID NO: 250492 - DNA, 20 bp, human
gaccccaggcctgccgacac

SEQ ID NO: 250493 - DNA, 20 bp, human
gtccgctccaggtggcccac

SEQ ID NO: 250494 - DNA, 20 bp, human
ggccgtagacggccgagcag

SEQ ID NO: 250495 - DNA, 20 bp, human
gtctacggctgcgcgtgcgc

SEQ ID NO: 250496 - DNA, 20 bp, human
gtatcgctctacccaggcgg

SEQ ID NO: 250497 - DNA, 20 bp, human
gtatgcagggctaaagtccg

SEQ ID NO: 250498 - DNA, 20 bp, human
gcagggctaaagtccgcggg

SEQ ID NO: 250499 - DNA, 20 bp, human
gaacaagagtcgcaagcttc

SEQ ID NO: 250500 - DNA, 20 bp, human
gagggcataatgacgcggac

SEQ ID NO: 250501 - DNA, 20 bp, human
gtttagccctgcatagagat

SEQ ID NO: 250502 - DNA, 20 bp, human
gtggaattatcgctctaccc

SEQ ID NO: 250503 - DNA, 20 bp, human
gggtctacccatctctatgc

SEQ ID NO: 250504 - DNA, 20 bp, human
gtcttgtttgcgtcgcgtct

SEQ ID NO: 250505 - DNA, 20 bp, human
gagatgggtagaccctaatt

SEQ ID NO: 250506 - DNA, 20 bp, human
gccctcactggaccaatctg

SEQ ID NO: 250507 - DNA, 20 bp, human
gcgacctggggaagagacga

SEQ ID NO: 250508 - DNA, 20 bp, human
gccctcagattggtccagtg

SEQ ID NO: 250509 - DNA, 20 bp, human
ggagaactcccgtaattggt

SEQ ID NO: 250510 - DNA, 20 bp, human
gcaaactccacaaaagtcat

SEQ ID NO: 250511 - DNA, 20 bp, human
ggaggtaccaattcgacctg

SEQ ID NO: 250512 - DNA, 20 bp, human
ggcctagcggaagaattcca

SEQ ID NO: 250513 - DNA, 20 bp, human
ggccctggaattcttccgct

SEQ ID NO: 250514 - DNA, 20 bp, human
ggccctgtgtctaaaggtag

SEQ ID NO: 250515 - DNA, 20 bp, human
gagcgcgcgtttctagtctt

SEQ ID NO: 250516 - DNA, 20 bp, human
gaccgcgtaggaaacggagg

SEQ ID NO: 250517 - DNA, 20 bp, human
ggccgggcggtctctggtgg

SEQ ID NO: 250518 - DNA, 20 bp, human
gtggaagcgggcacgagcgg

SEQ ID NO: 250519 - DNA, 20 bp, human
gcggcgcggcaggaggatgt

SEQ ID NO: 250520 - DNA, 20 bp, human
ggaggcagccccggacctcg

SEQ ID NO: 250521 - DNA, 20 bp, human
gcgtccggaaggaaccgcgt

SEQ ID NO: 250522 - DNA, 20 bp, human
gagccgggcaagcccgtgag

SEQ ID NO: 250523 - DNA, 20 bp, human
gcccgcgcggggcttccccc

SEQ ID NO: 250524 - DNA, 20 bp, human
gcggggcttcccccgggcgc

SEQ ID NO: 250525 - DNA, 20 bp, human
gagacccggccgtggtcgtc

SEQ ID NO: 250526 - DNA, 20 bp, human
gcgcgtccagccctctgcga

SEQ ID NO: 250527 - DNA, 20 bp, human
gcgagccaaggccctcgcag

SEQ ID NO: 250528 - DNA, 20 bp, human
gccgcggggactcccactcc

SEQ ID NO: 250529 - DNA, 20 bp, human
ggggcgtgggcgggtcccgt

SEQ ID NO: 250530 - DNA, 20 bp, human
ggcagagggctggacgcgca

SEQ ID NO: 250531 - DNA, 20 bp, human
ggtggggcgcgagctcccgt

SEQ ID NO: 250532 - DNA, 20 bp, human
ggggccttggctcgcccctg

SEQ ID NO: 250533 - DNA, 20 bp, human
gggggtccaacgccagcctg

SEQ ID NO: 250534 - DNA, 20 bp, human
gcgcggccgtccgaggacga

SEQ ID NO: 250535 - DNA, 20 bp, human
gaggaagtgctcgccgcccg

SEQ ID NO: 250536 - DNA, 20 bp, human
gctgacgcagagtgagtgta

SEQ ID NO: 250537 - DNA, 20 bp, human
gcgaagccgtcgccaagtaa

SEQ ID NO: 250538 - DNA, 20 bp, human
gttaccggaagtgatgatgc

SEQ ID NO: 250539 - DNA, 20 bp, human
gcaaagacctagcaacccgg

SEQ ID NO: 250540 - DNA, 20 bp, human
gatgcaggaggcgatggagg

SEQ ID NO: 250541 - DNA, 20 bp, human
gtggcggccggcggggttac

SEQ ID NO: 250542 - DNA, 20 bp, human
gtgggccgcagatgaagagg

SEQ ID NO: 250543 - DNA, 20 bp, human
gtagcaacccggagggagct

SEQ ID NO: 250544 - DNA, 20 bp, human
ggcgggctgcgcgcttctgt

SEQ ID NO: 250545 - DNA, 20 bp, human
gcggtgggccgcagatgaag

SEQ ID NO: 250546 - DNA, 20 bp, human
gccccactggccaatacgat

SEQ ID NO: 250547 - DNA, 20 bp, human
gaggccatgctccggagcag

SEQ ID NO: 250548 - DNA, 20 bp, human
gagtgcccatagcgccggtc

SEQ ID NO: 250549 - DNA, 20 bp, human
ggggtccgagagcgcgtgta

SEQ ID NO: 250550 - DNA, 20 bp, human
ggccccaggaccaatcgtat

SEQ ID NO: 250551 - DNA, 20 bp, human
gacgcgctctcggacccctg

SEQ ID NO: 250552 - DNA, 20 bp, human
ggcctccgccaggggcgtta

SEQ ID NO: 250553 - DNA, 20 bp, human
gcaggggcgttacggagaca

SEQ ID NO: 250554 - DNA, 20 bp, human
gtggccaatacgattggtcc

SEQ ID NO: 250555 - DNA, 20 bp, human
gccaatggagaaggcgagat

SEQ ID NO: 250556 - DNA, 20 bp, human
gcggagccggtcccgggaag

SEQ ID NO: 250557 - DNA, 20 bp, human
gacccggaggcgaatcgctg

SEQ ID NO: 250558 - DNA, 20 bp, human
gacaggatacaagaattccg

SEQ ID NO: 250559 - DNA, 20 bp, human
gtgcctggcctacctacgag

SEQ ID NO: 250560 - DNA, 20 bp, human
gctgtctgacccgtcgactg

SEQ ID NO: 250561 - DNA, 20 bp, human
gtacggggtgggaacacttc

SEQ ID NO: 250562 - DNA, 20 bp, human
ggcctacctacgagtggcag

SEQ ID NO: 250563 - DNA, 20 bp, human
ggagaaaggtcaggataccc

SEQ ID NO: 250564 - DNA, 20 bp, human
gcccggaagtgacgcaatcg

SEQ ID NO: 250565 - DNA, 20 bp, human
gagtgacgcaatcgcggagc

SEQ ID NO: 250566 - DNA, 20 bp, human
gctaccccgcaatttcctgt

SEQ ID NO: 250567 - DNA, 20 bp, human
gcactaagcctgagttacat

SEQ ID NO: 250568 - DNA, 20 bp, human
gcaaggcactaggacctaga

SEQ ID NO: 250569 - DNA, 20 bp, human
gtaattaatcataggaggtt

SEQ ID NO: 250570 - DNA, 20 bp, human
gataaccaacaggaaattgc

SEQ ID NO: 250571 - DNA, 20 bp, human
gccccaggcagattaggcca

SEQ ID NO: 250572 - DNA, 20 bp, human
gagcttctcccatgtaactc

SEQ ID NO: 250573 - DNA, 20 bp, human
gtctggcccccaggcagatt

SEQ ID NO: 250574 - DNA, 20 bp, human
gagaagctggacaaggcact

SEQ ID NO: 250575 - DNA, 20 bp, human
gaaagcatgtaattaatcat

SEQ ID NO: 250576 - DNA, 20 bp, human
gccggcgcgcccactccttt

SEQ ID NO: 250577 - DNA, 20 bp, human
gagggcggccttcagatagg

SEQ ID NO: 250578 - DNA, 20 bp, human
gggcagggcggccttcagat

SEQ ID NO: 250579 - DNA, 20 bp, human
ggcggccttcagataggcgg

SEQ ID NO: 250580 - DNA, 20 bp, human
ggtgattggccgaaaggagt

SEQ ID NO: 250581 - DNA, 20 bp, human
gtgctccccgctgcagtgat

SEQ ID NO: 250582 - DNA, 20 bp, human
ggctgcggaacttgaagctc

SEQ ID NO: 250583 - DNA, 20 bp, human
ggcggggtctccgctgcctc

SEQ ID NO: 250584 - DNA, 20 bp, human
ggctgcagtgattggccgaa

SEQ ID NO: 250585 - DNA, 20 bp, human
gttcaaaagacccgtccctg

SEQ ID NO: 250586 - DNA, 20 bp, human
gaggaggcgtggcaaccaat

SEQ ID NO: 250587 - DNA, 20 bp, human
gcgaacttgaccacaatggg

SEQ ID NO: 250588 - DNA, 20 bp, human
gctcggccgcgaagtctctt

SEQ ID NO: 250589 - DNA, 20 bp, human
ggaaagtgagatccggaagt

SEQ ID NO: 250590 - DNA, 20 bp, human
gcaaccgaacttgaccacaa

SEQ ID NO: 250591 - DNA, 20 bp, human
gcaaagcacctcccggtact

SEQ ID NO: 250592 - DNA, 20 bp, human
ggtggtggcgccatcagtgt

SEQ ID NO: 250593 - DNA, 20 bp, human
ggccacgcctcctcccattg

SEQ ID NO: 250594 - DNA, 20 bp, human
ggccaccacctccctgtcat

SEQ ID NO: 250595 - DNA, 20 bp, human
gcgcatgagttagctggatg

SEQ ID NO: 250596 - DNA, 20 bp, human
ggcggccggggaagcagcga

SEQ ID NO: 250597 - DNA, 20 bp, human
ggacccgcgagcgccggagt

SEQ ID NO: 250598 - DNA, 20 bp, human
gagcgagggcaagaagtatg

SEQ ID NO: 250599 - DNA, 20 bp, human
gggtctcgcgccagcccagg

SEQ ID NO: 250600 - DNA, 20 bp, human
gtcggtctggacagagcagc

SEQ ID NO: 250601 - DNA, 20 bp, human
gggtacctgtgttctgtcgc

SEQ ID NO: 250602 - DNA, 20 bp, human
gcggctctccaagtccgcgc

SEQ ID NO: 250603 - DNA, 20 bp, human
gggcaagaagtatgcggagg

SEQ ID NO: 250604 - DNA, 20 bp, human
gagtccgcgctggggacgat

SEQ ID NO: 250605 - DNA, 20 bp, human
gtaccgccaggtccgggtag

SEQ ID NO: 250606 - DNA, 20 bp, human
ggggccggccagatctgggt

SEQ ID NO: 250607 - DNA, 20 bp, human
gcaccccccgaggacagagt

SEQ ID NO: 250608 - DNA, 20 bp, human
gctggccggccctggcgacg

SEQ ID NO: 250609 - DNA, 20 bp, human
gggcgcagtctggatgtaat

SEQ ID NO: 250610 - DNA, 20 bp, human
gtgtgggcgacatggaatga

SEQ ID NO: 250611 - DNA, 20 bp, human
gggacggggcggggcttctt

SEQ ID NO: 250612 - DNA, 20 bp, human
ggggcaggggcgcgacggtc

SEQ ID NO: 250613 - DNA, 20 bp, human
gccgccgttgcgctgttctg

SEQ ID NO: 250614 - DNA, 20 bp, human
ggccagggccggccagatct

SEQ ID NO: 250615 - DNA, 20 bp, human
gccgcgacccgcaggggtta

SEQ ID NO: 250616 - DNA, 20 bp, human
gctggcggaaagaggcgagg

SEQ ID NO: 250617 - DNA, 20 bp, human
gaaagggcgcggaacggggt

SEQ ID NO: 250618 - DNA, 20 bp, human
gcgccagcgcccgcaggacc

SEQ ID NO: 250619 - DNA, 20 bp, human
gcgaggccgccaaccgaagg

SEQ ID NO: 250620 - DNA, 20 bp, human
gctcctggagcaacggaagg

SEQ ID NO: 250621 - DNA, 20 bp, human
gccttcggatgtggcggatg

SEQ ID NO: 250622 - DNA, 20 bp, human
gggcctgcaacgtgtctctg

SEQ ID NO: 250623 - DNA, 20 bp, human
gggaacgggaaggactgcgg

SEQ ID NO: 250624 - DNA, 20 bp, human
gcggaggcatagagagggaa

SEQ ID NO: 250625 - DNA, 20 bp, human
ggggctcctggagcaacgga

SEQ ID NO: 250626 - DNA, 20 bp, human
gagccgagatgtccgtccag

SEQ ID NO: 250627 - DNA, 20 bp, human
gaggccaatggcacaaagag

SEQ ID NO: 250628 - DNA, 20 bp, human
gacagagatggaacatgaag

SEQ ID NO: 250629 - DNA, 20 bp, human
gtgtgccattggcctctgga

SEQ ID NO: 250630 - DNA, 20 bp, human
gtggaggtatgtgtcattta

SEQ ID NO: 250631 - DNA, 20 bp, human
gtactgcacaaggagatgct

SEQ ID NO: 250632 - DNA, 20 bp, human
gccccattaggagacagcaa

SEQ ID NO: 250633 - DNA, 20 bp, human
gtggtcatcaggatggagcg

SEQ ID NO: 250634 - DNA, 20 bp, human
gactctcaaaggtggtcatc

SEQ ID NO: 250635 - DNA, 20 bp, human
gttgggacagagtcaaaatg

SEQ ID NO: 250636 - DNA, 20 bp, human
gggtgccagcgctcccggga

SEQ ID NO: 250637 - DNA, 20 bp, human
gaggggcgggaactgcgcca

SEQ ID NO: 250638 - DNA, 20 bp, human
gcgcccccgccttccaggaa

SEQ ID NO: 250639 - DNA, 20 bp, human
gctggagcaaagatggtccc

SEQ ID NO: 250640 - DNA, 20 bp, human
gcggggtctccgagacgggt

SEQ ID NO: 250641 - DNA, 20 bp, human
gcccgccccttcctggaagg

SEQ ID NO: 250642 - DNA, 20 bp, human
ggccccttcctggaaggcgg

SEQ ID NO: 250643 - DNA, 20 bp, human
gggggcggggtctccgagac

SEQ ID NO: 250644 - DNA, 20 bp, human
gggcatgtttggcgggaagt

SEQ ID NO: 250645 - DNA, 20 bp, human
gtcaaaccagcttggagctc

SEQ ID NO: 250646 - DNA, 20 bp, human
ggggctgcttagtaaaagat

SEQ ID NO: 250647 - DNA, 20 bp, human
ggcaagaagagggaaacgtg

SEQ ID NO: 250648 - DNA, 20 bp, human
ggaagtgcaggcttactttg

SEQ ID NO: 250649 - DNA, 20 bp, human
gggctccaaacttgaaatca

SEQ ID NO: 250650 - DNA, 20 bp, human
gggctggaaatgcaagaaga

SEQ ID NO: 250651 - DNA, 20 bp, human
ggcaggcatcacctggtgca

SEQ ID NO: 250652 - DNA, 20 bp, human
ggtgcagcactcagcaatat

SEQ ID NO: 250653 - DNA, 20 bp, human
gaggaggctgtgtgcaatgc

SEQ ID NO: 250654 - DNA, 20 bp, human
ggtgctgcaccgggaagtgc

SEQ ID NO: 250655 - DNA, 20 bp, human
gttgagaaatagctcgcctc

SEQ ID NO: 250656 - DNA, 20 bp, human
gccgaagcaccgcctacgtc

SEQ ID NO: 250657 - DNA, 20 bp, human
ggcagcccgggcttccgggg

SEQ ID NO: 250658 - DNA, 20 bp, human
gagacctggaagcccttcat

SEQ ID NO: 250659 - DNA, 20 bp, human
gcggcagaacgcagctgcgg

SEQ ID NO: 250660 - DNA, 20 bp, human
gggtgcagcccgggcttccg

SEQ ID NO: 250661 - DNA, 20 bp, human
gtcacgcagcccgacgtagg

SEQ ID NO: 250662 - DNA, 20 bp, human
gcggcggctgcgggtctcgt

SEQ ID NO: 250663 - DNA, 20 bp, human
ggtaaagcctatccacatct

SEQ ID NO: 250664 - DNA, 20 bp, human
gttgtcacgcagcccgacgt

SEQ ID NO: 250665 - DNA, 20 bp, human
ggcgacaggagggtcccccg

SEQ ID NO: 250666 - DNA, 20 bp, human
gggctgctgaggtctaacag

SEQ ID NO: 250667 - DNA, 20 bp, human
gggcaagtgtcgcgagaggt

SEQ ID NO: 250668 - DNA, 20 bp, human
gtgctgaggtctaacagtgg

SEQ ID NO: 250669 - DNA, 20 bp, human
gtgctcctggcgcactagta

SEQ ID NO: 250670 - DNA, 20 bp, human
ggggcggcaagtgtcgcgag

SEQ ID NO: 250671 - DNA, 20 bp, human
gaagtgtcgcgagaggtggg

SEQ ID NO: 250672 - DNA, 20 bp, human
gttcccgccccgtacgtgag

SEQ ID NO: 250673 - DNA, 20 bp, human
gaggcggcccctcacgtacg

SEQ ID NO: 250674 - DNA, 20 bp, human
gcggcgcgcgaccgcgggtg

SEQ ID NO: 250675 - DNA, 20 bp, human
ggctgcagctccctgcccgc

SEQ ID NO: 250676 - DNA, 20 bp, human
gtactcccatggatacacga

SEQ ID NO: 250677 - DNA, 20 bp, human
gttgagccatcgtgtatcca

SEQ ID NO: 250678 - DNA, 20 bp, human
gacgatggctcaaagctgtc

SEQ ID NO: 250679 - DNA, 20 bp, human
gcacacttagaaatggactt

SEQ ID NO: 250680 - DNA, 20 bp, human
gtaaataggctttgaagggc

SEQ ID NO: 250681 - DNA, 20 bp, human
gcctagaatgcctactccca

SEQ ID NO: 250682 - DNA, 20 bp, human
gaacacaacgtgctacctca

SEQ ID NO: 250683 - DNA, 20 bp, human
ggttgaaaaactaggcatgg

SEQ ID NO: 250684 - DNA, 20 bp, human
gcatttctaagtgtgctgtt

SEQ ID NO: 250685 - DNA, 20 bp, human
gtgtgttaaataggctttga

SEQ ID NO: 250686 - DNA, 20 bp, human
ggccccccgctgcgttgcga

SEQ ID NO: 250687 - DNA, 20 bp, human
gccccgctgcgttgcgaagg

SEQ ID NO: 250688 - DNA, 20 bp, human
gagccaggagaggataggag

SEQ ID NO: 250689 - DNA, 20 bp, human
gtgcgttgcgaaggcgggga

SEQ ID NO: 250690 - DNA, 20 bp, human
gactcgcaggcgtgtggcgg

SEQ ID NO: 250691 - DNA, 20 bp, human
gcggccgtgcttgctagtga

SEQ ID NO: 250692 - DNA, 20 bp, human
gcccgccttcgcaacgcagc

SEQ ID NO: 250693 - DNA, 20 bp, human
ggaaggaaatctctgctgac

SEQ ID NO: 250694 - DNA, 20 bp, human
gccgccctcactagcaagca

SEQ ID NO: 250695 - DNA, 20 bp, human
gactcactgagcgtgtgtga

SEQ ID NO: 250696 - DNA, 20 bp, human
gccctagcgagagggagcga

SEQ ID NO: 250697 - DNA, 20 bp, human
gtagcgagagggagcgacgg

SEQ ID NO: 250698 - DNA, 20 bp, human
ggggtcacgaggcttcacgg

SEQ ID NO: 250699 - DNA, 20 bp, human
gcgagagggagcgacggggg

SEQ ID NO: 250700 - DNA, 20 bp, human
gcggaggggagtgtagcggg

SEQ ID NO: 250701 - DNA, 20 bp, human
gcgcgcggaggggagtgtag

SEQ ID NO: 250702 - DNA, 20 bp, human
gcgtcgaccccctagcgaga

SEQ ID NO: 250703 - DNA, 20 bp, human
gcgcgtgcgcgtgcagacac

SEQ ID NO: 250704 - DNA, 20 bp, human
ggaccgactaggggcgacca

SEQ ID NO: 250705 - DNA, 20 bp, human
ggtggcggatgcgagggacg

SEQ ID NO: 250706 - DNA, 20 bp, human
ggttcgactgcgagctttct

SEQ ID NO: 250707 - DNA, 20 bp, human
ggctttctggggctcaatgg

SEQ ID NO: 250708 - DNA, 20 bp, human
ggggcccggccgctgtcacc

SEQ ID NO: 250709 - DNA, 20 bp, human
gtcgcggcaggggaggatca

SEQ ID NO: 250710 - DNA, 20 bp, human
gggggcgtggcggtgggtcg

SEQ ID NO: 250711 - DNA, 20 bp, human
gctagggcgcagcaggccaa

SEQ ID NO: 250712 - DNA, 20 bp, human
gcagctgccaaggtccccga

SEQ ID NO: 250713 - DNA, 20 bp, human
gccggccgctgtcaccgggc

SEQ ID NO: 250714 - DNA, 20 bp, human
gctggggctcaatggaggcg

SEQ ID NO: 250715 - DNA, 20 bp, human
gtcgccgcgctagtccttat

SEQ ID NO: 250716 - DNA, 20 bp, human
ggggctccctggaagtgtag

SEQ ID NO: 250717 - DNA, 20 bp, human
gcggacacctgttgcttcca

SEQ ID NO: 250718 - DNA, 20 bp, human
ggagcccgagcctagccaca

SEQ ID NO: 250719 - DNA, 20 bp, human
gtggaagtgtagaggttgaa

SEQ ID NO: 250720 - DNA, 20 bp, human
gggagttgaggataagcctg

SEQ ID NO: 250721 - DNA, 20 bp, human
gttgaaaggggaccagactc

SEQ ID NO: 250722 - DNA, 20 bp, human
ggaccagactctggagggga

SEQ ID NO: 250723 - DNA, 20 bp, human
gaaaggggaccagactctgg

SEQ ID NO: 250724 - DNA, 20 bp, human
gcgtccgcgctttcacactc

SEQ ID NO: 250725 - DNA, 20 bp, human
gtgcttccagggtagatctc

SEQ ID NO: 250726 - DNA, 20 bp, human
gccactcgtgcgatcccatc

SEQ ID NO: 250727 - DNA, 20 bp, human
gggaaggggcgtccaatccc

SEQ ID NO: 250728 - DNA, 20 bp, human
gggatcgcacgagtgggcgg

SEQ ID NO: 250729 - DNA, 20 bp, human
gggggcggccgtgcacatgg

SEQ ID NO: 250730 - DNA, 20 bp, human
ggtgcgatcccatcaggctt

SEQ ID NO: 250731 - DNA, 20 bp, human
ggttgtcccccaagcctgat

SEQ ID NO: 250732 - DNA, 20 bp, human
ggggcagaaccctggtggtc

SEQ ID NO: 250733 - DNA, 20 bp, human
gaaggttgaagaaatagggg

SEQ ID NO: 250734 - DNA, 20 bp, human
ggctacctcccccatgtgca

SEQ ID NO: 250735 - DNA, 20 bp, human
gtgtgcacggccgccccctg

SEQ ID NO: 250736 - DNA, 20 bp, human
gcggccagacagagggctcg

SEQ ID NO: 250737 - DNA, 20 bp, human
gagacagccatgcaggccaa

SEQ ID NO: 250738 - DNA, 20 bp, human
gctcgtgggccagaaaggga

SEQ ID NO: 250739 - DNA, 20 bp, human
gtgtaggtatggtgaataat

SEQ ID NO: 250740 - DNA, 20 bp, human
ggctcctttctccggggcaa

SEQ ID NO: 250741 - DNA, 20 bp, human
gccatggagatgacaggttg

SEQ ID NO: 250742 - DNA, 20 bp, human
gcaggcacccggctaactgt

SEQ ID NO: 250743 - DNA, 20 bp, human
ggtgggcagccaaacgaggt

SEQ ID NO: 250744 - DNA, 20 bp, human
gaagcgaaactgattcccat

SEQ ID NO: 250745 - DNA, 20 bp, human
ggagggctcgtgggccagaa

SEQ ID NO: 250746 - DNA, 20 bp, human
gcagccgcggccaatcaacg

SEQ ID NO: 250747 - DNA, 20 bp, human
gagcgccgccggaagtgccc

SEQ ID NO: 250748 - DNA, 20 bp, human
gcccaccagggcacttccgg

SEQ ID NO: 250749 - DNA, 20 bp, human
ggaagtgggctccagactag

SEQ ID NO: 250750 - DNA, 20 bp, human
gaagtgatcgggatacgccg

SEQ ID NO: 250751 - DNA, 20 bp, human
gccggcctgggcggagcaaa

SEQ ID NO: 250752 - DNA, 20 bp, human
gcctcccaccagggcacttc

SEQ ID NO: 250753 - DNA, 20 bp, human
gtattggtgggagtgaatca

SEQ ID NO: 250754 - DNA, 20 bp, human
gcgccttatcgccaaagctg

SEQ ID NO: 250755 - DNA, 20 bp, human
gggcgctcggcctcgttgat

SEQ ID NO: 250756 - DNA, 20 bp, human
gcggcgagaaggccgagggg

SEQ ID NO: 250757 - DNA, 20 bp, human
ggggactactgggtccggga

SEQ ID NO: 250758 - DNA, 20 bp, human
gcgcgcggcgagaaggccga

SEQ ID NO: 250759 - DNA, 20 bp, human
gccggacccagtagtcccag

SEQ ID NO: 250760 - DNA, 20 bp, human
ggggcgctagcgcgcggggt

SEQ ID NO: 250761 - DNA, 20 bp, human
ggccttctcgccgcgcgttc

SEQ ID NO: 250762 - DNA, 20 bp, human
gtggcgggcgggttacctgg

SEQ ID NO: 250763 - DNA, 20 bp, human
gtcccgagagcagctgtcgg

SEQ ID NO: 250764 - DNA, 20 bp, human
gagcgcccaggcgggcttgg

SEQ ID NO: 250765 - DNA, 20 bp, human
gggctgcgagcccgaacgcg

SEQ ID NO: 250766 - DNA, 20 bp, human
gccagacagaggggtccact

SEQ ID NO: 250767 - DNA, 20 bp, human
gtggggtcagcgtgggcctg

SEQ ID NO: 250768 - DNA, 20 bp, human
gacagcccgtcataccctgg

SEQ ID NO: 250769 - DNA, 20 bp, human
gctgccaggtgaggtgactt

SEQ ID NO: 250770 - DNA, 20 bp, human
gcctagagctggggcgaggt

SEQ ID NO: 250771 - DNA, 20 bp, human
ggctctgggaaagccccaac

SEQ ID NO: 250772 - DNA, 20 bp, human
gcacgctgaccccagctaag

SEQ ID NO: 250773 - DNA, 20 bp, human
gactgccatgccacttagct

SEQ ID NO: 250774 - DNA, 20 bp, human
gccagctggaatgcgggact

SEQ ID NO: 250775 - DNA, 20 bp, human
ggggtgtggaatgtcccacc

SEQ ID NO: 250776 - DNA, 20 bp, human
gaaggggatcaagtcttaga

SEQ ID NO: 250777 - DNA, 20 bp, human
gaggaagtggagatggatat

SEQ ID NO: 250778 - DNA, 20 bp, human
gggatcaagtcttagatgga

SEQ ID NO: 250779 - DNA, 20 bp, human
ggctttgcccatagtccctt

SEQ ID NO: 250780 - DNA, 20 bp, human
ggacagttggggcacacacg

SEQ ID NO: 250781 - DNA, 20 bp, human
ggattcctgggaaagcgcca

SEQ ID NO: 250782 - DNA, 20 bp, human
gtggtggggggagccgtggt

SEQ ID NO: 250783 - DNA, 20 bp, human
gcaggaatcctcagaatgtg

SEQ ID NO: 250784 - DNA, 20 bp, human
gttggtttcaattaggaagg

SEQ ID NO: 250785 - DNA, 20 bp, human
gttttgacccaagggactat

SEQ ID NO: 250786 - DNA, 20 bp, human
ggggcggggctccgagtagt

SEQ ID NO: 250787 - DNA, 20 bp, human
gtagtgggcggagtctagat

SEQ ID NO: 250788 - DNA, 20 bp, human
gtactcggagccccgcccag

SEQ ID NO: 250789 - DNA, 20 bp, human
gcctgaggccgggatctcat

SEQ ID NO: 250790 - DNA, 20 bp, human
gctagactccgcccactact

SEQ ID NO: 250791 - DNA, 20 bp, human
gggcggggcctatgagatcc

SEQ ID NO: 250792 - DNA, 20 bp, human
gagacattaaaatgagtttg

SEQ ID NO: 250793 - DNA, 20 bp, human
gtgtgatgtgccgctgggcg

SEQ ID NO: 250794 - DNA, 20 bp, human
gaagaggaaattatagcaga

SEQ ID NO: 250795 - DNA, 20 bp, human
gggagtctagattgggaaat

SEQ ID NO: 250796 - DNA, 20 bp, human
gtagggacgcacggatctgg

SEQ ID NO: 250797 - DNA, 20 bp, human
gccggcgcgccgggaaatag

SEQ ID NO: 250798 - DNA, 20 bp, human
gggactggacaggaaccgaa

SEQ ID NO: 250799 - DNA, 20 bp, human
gtatgaacgcacagctggga

SEQ ID NO: 250800 - DNA, 20 bp, human
gacagcggggatggcagtga

SEQ ID NO: 250801 - DNA, 20 bp, human
gcctggggacagcacccaat

SEQ ID NO: 250802 - DNA, 20 bp, human
gccgtgcgtccctacaggga

SEQ ID NO: 250803 - DNA, 20 bp, human
gcgaaggggcgaggcgggtc

SEQ ID NO: 250804 - DNA, 20 bp, human
gtgcgtccctacagggaggg

SEQ ID NO: 250805 - DNA, 20 bp, human
gggttcctgtccagtcctgc

SEQ ID NO: 250806 - DNA, 20 bp, human
gctacacaggcagatgtcaa

SEQ ID NO: 250807 - DNA, 20 bp, human
ggagatgtggttactcgcgg

SEQ ID NO: 250808 - DNA, 20 bp, human
ggcagatgtcaatggggacc

SEQ ID NO: 250809 - DNA, 20 bp, human
ggtgagccactgtccaccag

SEQ ID NO: 250810 - DNA, 20 bp, human
gccggcacaagaggctacac

SEQ ID NO: 250811 - DNA, 20 bp, human
gcaggagatgtggttactcg

SEQ ID NO: 250812 - DNA, 20 bp, human
ggtggacagtggctcaccac

SEQ ID NO: 250813 - DNA, 20 bp, human
gggctcaccaccggcacaag

SEQ ID NO: 250814 - DNA, 20 bp, human
gtgtcaatggggaccaggca

SEQ ID NO: 250815 - DNA, 20 bp, human
gtggttactcgcgggggcgc

SEQ ID NO: 250816 - DNA, 20 bp, human
ggagatgtggttactcgcgg

SEQ ID NO: 250817 - DNA, 20 bp, human
gcaggagatgtggttactcg

SEQ ID NO: 250818 - DNA, 20 bp, human
gtggttactcgcgggggcgc

SEQ ID NO: 250819 - DNA, 20 bp, human
gcagaagcgggaggtaccct

SEQ ID NO: 250820 - DNA, 20 bp, human
gcacgtagggcggagacgat

SEQ ID NO: 250821 - DNA, 20 bp, human
ggggacttccggaaatcagc

SEQ ID NO: 250822 - DNA, 20 bp, human
ggcggagacgatgggacttc

SEQ ID NO: 250823 - DNA, 20 bp, human
ggctcgcggaccagggagga

SEQ ID NO: 250824 - DNA, 20 bp, human
ggcgccaggcaggagggtcg

SEQ ID NO: 250825 - DNA, 20 bp, human
gctcctgcctggcgccaggt

SEQ ID NO: 250826 - DNA, 20 bp, human
gcagcggcaggcgcataagg

SEQ ID NO: 250827 - DNA, 20 bp, human
gcatcggaaccgttctcccg

SEQ ID NO: 250828 - DNA, 20 bp, human
gagcggacctctgggaccta

SEQ ID NO: 250829 - DNA, 20 bp, human
ggtcccagaggtccgctcag

SEQ ID NO: 250830 - DNA, 20 bp, human
gagggtcatccagtgggctc

SEQ ID NO: 250831 - DNA, 20 bp, human
ggttctgggcaccatgtgtt

SEQ ID NO: 250832 - DNA, 20 bp, human
gtggacgccgccttcgttct

SEQ ID NO: 250833 - DNA, 20 bp, human
gggagaacggttccgatgga

SEQ ID NO: 250834 - DNA, 20 bp, human
gcacatggtgcccagaacga

SEQ ID NO: 250835 - DNA, 20 bp, human
gcagaagccctaggtcccag

SEQ ID NO: 250836 - DNA, 20 bp, human
ggggcgcagcactccacgga

SEQ ID NO: 250837 - DNA, 20 bp, human
gagggctgtgattggcgaat

SEQ ID NO: 250838 - DNA, 20 bp, human
gggcacgcgccaatgacgtc

SEQ ID NO: 250839 - DNA, 20 bp, human
gcgcagcactccacggaagg

SEQ ID NO: 250840 - DNA, 20 bp, human
ggctgcgcccccgtttcccc

SEQ ID NO: 250841 - DNA, 20 bp, human
gcgccaatgacgtcaggaaa

SEQ ID NO: 250842 - DNA, 20 bp, human
gagccggcgtgctcccggct

SEQ ID NO: 250843 - DNA, 20 bp, human
gcgcactgttgttgttacta

SEQ ID NO: 250844 - DNA, 20 bp, human
gagccgagccgggagcacgc

SEQ ID NO: 250845 - DNA, 20 bp, human
gtggcgaattggctcctgct

SEQ ID NO: 250846 - DNA, 20 bp, human
gcagcagcgagaatctacag

SEQ ID NO: 250847 - DNA, 20 bp, human
gtgtggggacgggtaggcct

SEQ ID NO: 250848 - DNA, 20 bp, human
ggggacgggtaggcctagga

SEQ ID NO: 250849 - DNA, 20 bp, human
gaggtgtactaagcgctgga

SEQ ID NO: 250850 - DNA, 20 bp, human
gtgcctgcggtggaactggg

SEQ ID NO: 250851 - DNA, 20 bp, human
gggctctagtcggcctctgg

SEQ ID NO: 250852 - DNA, 20 bp, human
gccactgagttagaaactgg

SEQ ID NO: 250853 - DNA, 20 bp, human
ggtttgcgcacgcgggaact

SEQ ID NO: 250854 - DNA, 20 bp, human
gggggcgtggtttgcgcacg

SEQ ID NO: 250855 - DNA, 20 bp, human
gcgccaggtgtactaagcgc

SEQ ID NO: 250856 - DNA, 20 bp, human
ggcggggtctgtaccgagat

SEQ ID NO: 250857 - DNA, 20 bp, human
gctgtaccgagatcggaatc

SEQ ID NO: 250858 - DNA, 20 bp, human
ggccacccgaactagaacgt

SEQ ID NO: 250859 - DNA, 20 bp, human
gcgaactagaacgtgggatg

SEQ ID NO: 250860 - DNA, 20 bp, human
ggggctccgcggggaactac

SEQ ID NO: 250861 - DNA, 20 bp, human
ggagccctcgggctattccg

SEQ ID NO: 250862 - DNA, 20 bp, human
ggcgcctcggaatagcccga

SEQ ID NO: 250863 - DNA, 20 bp, human
gaatagcccgagggctccgc

SEQ ID NO: 250864 - DNA, 20 bp, human
gaggtgggaggaagcgcctc

SEQ ID NO: 250865 - DNA, 20 bp, human
gactagaacgtgggatgagg

SEQ ID NO: 250866 - DNA, 20 bp, human
ggcgcgcaccgtgatatctt

SEQ ID NO: 250867 - DNA, 20 bp, human
gccaacaggaaacgcgtcac

SEQ ID NO: 250868 - DNA, 20 bp, human
gtctcgcttccacttctcca

SEQ ID NO: 250869 - DNA, 20 bp, human
gtctggaagcatttccgctc

SEQ ID NO: 250870 - DNA, 20 bp, human
gactgaagaaagaacgtgga

SEQ ID NO: 250871 - DNA, 20 bp, human
ggaagactgaagaaagaacg

SEQ ID NO: 250872 - DNA, 20 bp, human
gtggaagcgagacgctgcac

SEQ ID NO: 250873 - DNA, 20 bp, human
gggaggggaaggaggcctta

SEQ ID NO: 250874 - DNA, 20 bp, human
gtcacaggaacgctggcacc

SEQ ID NO: 250875 - DNA, 20 bp, human
ggaacgaaaatgctccagag

SEQ ID NO: 250876 - DNA, 20 bp, human
gaggaggccgcgtcctggaa

SEQ ID NO: 250877 - DNA, 20 bp, human
gcggaagcggcggtgagcac

SEQ ID NO: 250878 - DNA, 20 bp, human
gagggtgagcaaaaagcgcg

SEQ ID NO: 250879 - DNA, 20 bp, human
gcgaggcccgaggagagacc

SEQ ID NO: 250880 - DNA, 20 bp, human
gaagcgaggaggccgcgtcc

SEQ ID NO: 250881 - DNA, 20 bp, human
gaagtaaggcaataaacgga

SEQ ID NO: 250882 - DNA, 20 bp, human
gcgcgaggtttgcgcacgaa

SEQ ID NO: 250883 - DNA, 20 bp, human
gggtttgcgcacgaagggaa

SEQ ID NO: 250884 - DNA, 20 bp, human
gatgatgtcgcacgctgggt

SEQ ID NO: 250885 - DNA, 20 bp, human
ggcggcgccaggtctctcct

SEQ ID NO: 250886 - DNA, 20 bp, human
gacagcctcaagtgggcaaa

SEQ ID NO: 250887 - DNA, 20 bp, human
ggacccgtacccctcaaccc

SEQ ID NO: 250888 - DNA, 20 bp, human
ggttgaggggtacgggtctg

SEQ ID NO: 250889 - DNA, 20 bp, human
gtgctctgcccggggttgag

SEQ ID NO: 250890 - DNA, 20 bp, human
gaagggtggccaaacaggag

SEQ ID NO: 250891 - DNA, 20 bp, human
gcggtctgcagccttgtagt

SEQ ID NO: 250892 - DNA, 20 bp, human
gttaaccaaatgggttgtca

SEQ ID NO: 250893 - DNA, 20 bp, human
gcaaggctgcagaccggaag

SEQ ID NO: 250894 - DNA, 20 bp, human
ggcctactctgccactgtgt

SEQ ID NO: 250895 - DNA, 20 bp, human
gggaaagcttgctctgcccg

SEQ ID NO: 250896 - DNA, 20 bp, human
gcacgcgccccaggaactct

SEQ ID NO: 250897 - DNA, 20 bp, human
gaaacaaagccctctgcggg

SEQ ID NO: 250898 - DNA, 20 bp, human
gtgagactgggaactccatg

SEQ ID NO: 250899 - DNA, 20 bp, human
gagcgcaagcctcccgcaga

SEQ ID NO: 250900 - DNA, 20 bp, human
gtggccagtgccaagagcag

SEQ ID NO: 250901 - DNA, 20 bp, human
gcaggaaacaaagccctctg

SEQ ID NO: 250902 - DNA, 20 bp, human
gaggggacggtacagcgctc

SEQ ID NO: 250903 - DNA, 20 bp, human
gttggcccccagagttcctg

SEQ ID NO: 250904 - DNA, 20 bp, human
gggccaagccggagcctcat

SEQ ID NO: 250905 - DNA, 20 bp, human
gaggaagccagacatttagc

SEQ ID NO: 250906 - DNA, 20 bp, human
gggcggctccgcccagaaga

SEQ ID NO: 250907 - DNA, 20 bp, human
gacaaagaacggcgagaggg

SEQ ID NO: 250908 - DNA, 20 bp, human
gtacggagcgggtagcgttg

SEQ ID NO: 250909 - DNA, 20 bp, human
gccctcttggggctttcctc

SEQ ID NO: 250910 - DNA, 20 bp, human
gccgcctctcggccctcttc

SEQ ID NO: 250911 - DNA, 20 bp, human
ggcgaagcgagacaggccag

SEQ ID NO: 250912 - DNA, 20 bp, human
ggaaaacggaagcacgagac

SEQ ID NO: 250913 - DNA, 20 bp, human
gaaggggaggcggggatctt

SEQ ID NO: 250914 - DNA, 20 bp, human
gctctcggccctcttctggg

SEQ ID NO: 250915 - DNA, 20 bp, human
gagagcgcgcagaacgtagc

SEQ ID NO: 250916 - DNA, 20 bp, human
gcgagagccgggtggaccca

SEQ ID NO: 250917 - DNA, 20 bp, human
gcgtagcaaggcacttccgg

SEQ ID NO: 250918 - DNA, 20 bp, human
gctagaaggcacctacggaa

SEQ ID NO: 250919 - DNA, 20 bp, human
ggctggggctagggaaaatc

SEQ ID NO: 250920 - DNA, 20 bp, human
ggaaccgcaaggaattgcaa

SEQ ID NO: 250921 - DNA, 20 bp, human
gtacgggaagtgacgagagc

SEQ ID NO: 250922 - DNA, 20 bp, human
gtcccgtagcaaggcacttc

SEQ ID NO: 250923 - DNA, 20 bp, human
gttgcggcccttggtctaga

SEQ ID NO: 250924 - DNA, 20 bp, human
gtaggtgccttctagaccaa

SEQ ID NO: 250925 - DNA, 20 bp, human
gcgggggaagcaggaagcac

SEQ ID NO: 250926 - DNA, 20 bp, human
gtctggcaaaccacattgcc

SEQ ID NO: 250927 - DNA, 20 bp, human
gcgagcacccttcttggaat

SEQ ID NO: 250928 - DNA, 20 bp, human
gccaggctgcggggtctgcc

SEQ ID NO: 250929 - DNA, 20 bp, human
gcagacgttagcgtccggga

SEQ ID NO: 250930 - DNA, 20 bp, human
gtccaagaagggtgctcggc

SEQ ID NO: 250931 - DNA, 20 bp, human
ggagcgccggccccaggctg

SEQ ID NO: 250932 - DNA, 20 bp, human
ggccgcgaggcaagctggga

SEQ ID NO: 250933 - DNA, 20 bp, human
gcggggtctgccgggcaatg

SEQ ID NO: 250934 - DNA, 20 bp, human
ggcggcacaggccgacactg

SEQ ID NO: 250935 - DNA, 20 bp, human
gttgccagacgttagcgtcc

SEQ ID NO: 250936 - DNA, 20 bp, human
ggcagtgccggcgggagagc

SEQ ID NO: 250937 - DNA, 20 bp, human
gagctgacaaagtctctcgc

SEQ ID NO: 250938 - DNA, 20 bp, human
gagcaactgcagttccgggg

SEQ ID NO: 250939 - DNA, 20 bp, human
gcgcacgagtacgtgcgtgg

SEQ ID NO: 250940 - DNA, 20 bp, human
ggacaaagtctctcgccgga

SEQ ID NO: 250941 - DNA, 20 bp, human
gcggcgggagagctggcttg

SEQ ID NO: 250942 - DNA, 20 bp, human
gcacgtactcgtgcgcgctg

SEQ ID NO: 250943 - DNA, 20 bp, human
gggcactgctgcggtccgcg

SEQ ID NO: 250944 - DNA, 20 bp, human
ggagagctggcttggggcgc

SEQ ID NO: 250945 - DNA, 20 bp, human
ggtactcgtgcgcgctgggg

SEQ ID NO: 250946 - DNA, 20 bp, human
gtccgcgcccgcgaccaccg

SEQ ID NO: 250947 - DNA, 20 bp, human
ggcggcgcgcaggcgctgga

SEQ ID NO: 250948 - DNA, 20 bp, human
gggcagagagcggggcgaaa

SEQ ID NO: 250949 - DNA, 20 bp, human
ggctgggtggcgcgcggaag

SEQ ID NO: 250950 - DNA, 20 bp, human
ggggggcgctctccactctg

SEQ ID NO: 250951 - DNA, 20 bp, human
gcgaaagggcgcggaccgga

SEQ ID NO: 250952 - DNA, 20 bp, human
gagagcggggcgaaagggcg

SEQ ID NO: 250953 - DNA, 20 bp, human
gtggagggctgtgtgagcgg

SEQ ID NO: 250954 - DNA, 20 bp, human
gcgacacggggcgtaaagcg

SEQ ID NO: 250955 - DNA, 20 bp, human
ggccgcaccgcggtggtcgc

SEQ ID NO: 250956 - DNA, 20 bp, human
gcaggcgcccgagccctcat

SEQ ID NO: 250957 - DNA, 20 bp, human
ggcgcccgagccctcatggg

SEQ ID NO: 250958 - DNA, 20 bp, human
ggctgccggaaagtaagtgt

SEQ ID NO: 250959 - DNA, 20 bp, human
gtggactacacctcccatga

SEQ ID NO: 250960 - DNA, 20 bp, human
gacacctcccatgagggctc

SEQ ID NO: 250961 - DNA, 20 bp, human
gaaagtaagtgtgggatttt

SEQ ID NO: 250962 - DNA, 20 bp, human
gtactttctgggttccacag

SEQ ID NO: 250963 - DNA, 20 bp, human
gttggagtgggttactttct

SEQ ID NO: 250964 - DNA, 20 bp, human
ggaggtgtagtccaagtttg

SEQ ID NO: 250965 - DNA, 20 bp, human
ggaccaaagtatgtgaaaga

SEQ ID NO: 250966 - DNA, 20 bp, human
gtgaccagaacccatgccat

SEQ ID NO: 250967 - DNA, 20 bp, human
gagggacttgggcgaaccct

SEQ ID NO: 250968 - DNA, 20 bp, human
gtaaaggagaatcctagcga

SEQ ID NO: 250969 - DNA, 20 bp, human
gagagacggcgctcagtctg

SEQ ID NO: 250970 - DNA, 20 bp, human
gtcattagatgacaggacta

SEQ ID NO: 250971 - DNA, 20 bp, human
gagatgacaggactagggga

SEQ ID NO: 250972 - DNA, 20 bp, human
gggttcaaacttcaactccc

SEQ ID NO: 250973 - DNA, 20 bp, human
ggtcacatggtgccgatggt

SEQ ID NO: 250974 - DNA, 20 bp, human
gccattggctgccaattatg

SEQ ID NO: 250975 - DNA, 20 bp, human
gggcatgggttctggtcaca

SEQ ID NO: 250976 - DNA, 20 bp, human
gcggcaatatggggcgtggt

SEQ ID NO: 250977 - DNA, 20 bp, human
gcatgcggcaatatggggcg

SEQ ID NO: 250978 - DNA, 20 bp, human
gttaagaggtcgaacgggga

SEQ ID NO: 250979 - DNA, 20 bp, human
gagtgcgcatgcggcaatat

SEQ ID NO: 250980 - DNA, 20 bp, human
gcactcttaagaggtcgaac

SEQ ID NO: 250981 - DNA, 20 bp, human
gcggtggcagtatttgagga

SEQ ID NO: 250982 - DNA, 20 bp, human
gccgcatgcgcactcttaag

SEQ ID NO: 250983 - DNA, 20 bp, human
ggtctccggcctcaaaacgg

SEQ ID NO: 250984 - DNA, 20 bp, human
ggtgtgacgccatcaagggg

SEQ ID NO: 250985 - DNA, 20 bp, human
gaggaggctgcgaaaagtta

SEQ ID NO: 250986 - DNA, 20 bp, human
gaggtctgtagctccgaata

SEQ ID NO: 250987 - DNA, 20 bp, human
gtggctggcgaggctcagta

SEQ ID NO: 250988 - DNA, 20 bp, human
gggaggctggcgatacgagg

SEQ ID NO: 250989 - DNA, 20 bp, human
gtgtagctccgaatagggga

SEQ ID NO: 250990 - DNA, 20 bp, human
gcagtggggccttgacccaa

SEQ ID NO: 250991 - DNA, 20 bp, human
gaggcctaggggccgagaca

SEQ ID NO: 250992 - DNA, 20 bp, human
gcgaggctcagtacggtgtg

SEQ ID NO: 250993 - DNA, 20 bp, human
gttgacccaatggaccatga

SEQ ID NO: 250994 - DNA, 20 bp, human
ggccgcgacctcgcgtacgg

SEQ ID NO: 250995 - DNA, 20 bp, human
gcagaagccctccgccctca

SEQ ID NO: 250996 - DNA, 20 bp, human
gcggcggcaccgggcgggta

SEQ ID NO: 250997 - DNA, 20 bp, human
gggggacggcggcaccgggc

SEQ ID NO: 250998 - DNA, 20 bp, human
ggaaacgcacggggcggtaa

SEQ ID NO: 250999 - DNA, 20 bp, human
gcggtaaaggggaggctcgt

SEQ ID NO: 251000 - DNA, 20 bp, human
gtgtacggactcgtcccgag

SEQ ID NO: 251001 - DNA, 20 bp, human
ggagccggggacggcggcac

SEQ ID NO: 251002 - DNA, 20 bp, human
ggactcgtcccgaggggagc

SEQ ID NO: 251003 - DNA, 20 bp, human
gggcctggcaaaattacatt

SEQ ID NO: 251004 - DNA, 20 bp, human
ggcacggggcggtaaagggg

SEQ ID NO: 251005 - DNA, 20 bp, human
gtcctcgcgcgtcccacgtg

SEQ ID NO: 251006 - DNA, 20 bp, human
ggaagggaccgggagattat

SEQ ID NO: 251007 - DNA, 20 bp, human
gccagtctgtcggctcactg

SEQ ID NO: 251008 - DNA, 20 bp, human
ggcggagacgggaagaaaga

SEQ ID NO: 251009 - DNA, 20 bp, human
ggggaccgggagattattgg

SEQ ID NO: 251010 - DNA, 20 bp, human
gagtactgataactgaagac

SEQ ID NO: 251011 - DNA, 20 bp, human
ggggtcctgtggaagggacc

SEQ ID NO: 251012 - DNA, 20 bp, human
gagcgcgcggtctcgtgatc

SEQ ID NO: 251013 - DNA, 20 bp, human
ggtgattgggtcctgtggaa

SEQ ID NO: 251014 - DNA, 20 bp, human
gagaggccgaagcggtgatt

SEQ ID NO: 251015 - DNA, 20 bp, human
gggagattattggcggagac

SEQ ID NO: 251016 - DNA, 20 bp, human
gtgcaagagcgcaggcgcaa

SEQ ID NO: 251017 - DNA, 20 bp, human
ggcggcagcaacagcgacga

SEQ ID NO: 251018 - DNA, 20 bp, human
ggatgcgcgaggaacgagtg

SEQ ID NO: 251019 - DNA, 20 bp, human
gcgaggaacgagtgtggcga

SEQ ID NO: 251020 - DNA, 20 bp, human
gggaacccatgtgacgggat

SEQ ID NO: 251021 - DNA, 20 bp, human
ggcagcaacagcgacgaagg

SEQ ID NO: 251022 - DNA, 20 bp, human
gcggtagtgaaggtgacctg

SEQ ID NO: 251023 - DNA, 20 bp, human
gtaaacagggagagcgcgta

SEQ ID NO: 251024 - DNA, 20 bp, human
gtcctcgcgcatccatggag

SEQ ID NO: 251025 - DNA, 20 bp, human
gagcctgcaaccggaagtga

SEQ ID NO: 251026 - DNA, 20 bp, human
ggctgagactagggttttag

SEQ ID NO: 251027 - DNA, 20 bp, human
ggctacccgcggaagagcga

SEQ ID NO: 251028 - DNA, 20 bp, human
gccctcaggtctaagctcaa

SEQ ID NO: 251029 - DNA, 20 bp, human
gaggggcgacaggactaagt

SEQ ID NO: 251030 - DNA, 20 bp, human
gtcgccgcgacagggaattg

SEQ ID NO: 251031 - DNA, 20 bp, human
gaaaaccctagtctcagcct

SEQ ID NO: 251032 - DNA, 20 bp, human
gaattgcggtgtgagaggga

SEQ ID NO: 251033 - DNA, 20 bp, human
gaatgcgtaaggttggaaag

SEQ ID NO: 251034 - DNA, 20 bp, human
gtgcgtctcccgctttccac

SEQ ID NO: 251035 - DNA, 20 bp, human
gagtgtagctcgagagaact

SEQ ID NO: 251036 - DNA, 20 bp, human
gctgtcgtatagctgtggga

SEQ ID NO: 251037 - DNA, 20 bp, human
gaggagggagcgggagttag

SEQ ID NO: 251038 - DNA, 20 bp, human
gtagcgataaagggattggg

SEQ ID NO: 251039 - DNA, 20 bp, human
gactaaacgaacgcgattta

SEQ ID NO: 251040 - DNA, 20 bp, human
gctaatgccttcgaattcta

SEQ ID NO: 251041 - DNA, 20 bp, human
gaagtaacggtagcgataaa

SEQ ID NO: 251042 - DNA, 20 bp, human
ggcacaacgtgcgtaatcgt

SEQ ID NO: 251043 - DNA, 20 bp, human
gaaggcattaggagagggcg

SEQ ID NO: 251044 - DNA, 20 bp, human
gaattcgaaggcattaggag

SEQ ID NO: 251045 - DNA, 20 bp, human
gacggtagcgataaagggat

SEQ ID NO: 251046 - DNA, 20 bp, human
gaggccagagcgtcgccata

SEQ ID NO: 251047 - DNA, 20 bp, human
ggcaggctagaagtggaggc

SEQ ID NO: 251048 - DNA, 20 bp, human
gagagaacgtggacacaagt

SEQ ID NO: 251049 - DNA, 20 bp, human
gtagcgtttagggaatccgc

SEQ ID NO: 251050 - DNA, 20 bp, human
gtggtcgtctgagcgctgat

SEQ ID NO: 251051 - DNA, 20 bp, human
gggcccctatggcgacgctc

SEQ ID NO: 251052 - DNA, 20 bp, human
ggcccgaacgctagcgttta

SEQ ID NO: 251053 - DNA, 20 bp, human
gtccctaaacgctagcgttc

SEQ ID NO: 251054 - DNA, 20 bp, human
gccagagcgtctccagaata

SEQ ID NO: 251055 - DNA, 20 bp, human
gagcttgcgaagcttgcaca

SEQ ID NO: 251056 - DNA, 20 bp, human
ggcaaggcattgtgggacat

SEQ ID NO: 251057 - DNA, 20 bp, human
gcgacagttgccaggaccga

SEQ ID NO: 251058 - DNA, 20 bp, human
gaggaacgacctcggagttc

SEQ ID NO: 251059 - DNA, 20 bp, human
gaatccaagcccattggaag

SEQ ID NO: 251060 - DNA, 20 bp, human
gtgcgcgatccggaactccg

SEQ ID NO: 251061 - DNA, 20 bp, human
ggaggcatggacgctttcat

SEQ ID NO: 251062 - DNA, 20 bp, human
ggatgtgaagaggcgaacga

SEQ ID NO: 251063 - DNA, 20 bp, human
gcagagggacaaatttgttc

SEQ ID NO: 251064 - DNA, 20 bp, human
gaggcattgtgggacattgg

SEQ ID NO: 251065 - DNA, 20 bp, human
ggagttccggatcgcgcaga

SEQ ID NO: 251066 - DNA, 20 bp, human
ggctcctcagatactctgac

SEQ ID NO: 251067 - DNA, 20 bp, human
gctgacgggaaactgcagtt

SEQ ID NO: 251068 - DNA, 20 bp, human
gacgggaaactgcagttggg

SEQ ID NO: 251069 - DNA, 20 bp, human
gcggggctacggctcccgga

SEQ ID NO: 251070 - DNA, 20 bp, human
gaaaggtggccatgctgtgt

SEQ ID NO: 251071 - DNA, 20 bp, human
gaggtctcgcgctttccccg

SEQ ID NO: 251072 - DNA, 20 bp, human
gaagctccagaacgcctcac

SEQ ID NO: 251073 - DNA, 20 bp, human
gcatgacccatctagaaagt

SEQ ID NO: 251074 - DNA, 20 bp, human
ggaggaacgcgcgggcagaa

SEQ ID NO: 251075 - DNA, 20 bp, human
gaacgcgcgggcagaagggc

SEQ ID NO: 251076 - DNA, 20 bp, human
ggggcacatcgactacttca

SEQ ID NO: 251077 - DNA, 20 bp, human
gcacaacgctcactggccaa

SEQ ID NO: 251078 - DNA, 20 bp, human
ggaaaggaatacacagtggg

SEQ ID NO: 251079 - DNA, 20 bp, human
gatagagagcgtgggcgggg

SEQ ID NO: 251080 - DNA, 20 bp, human
gtgggcgggatagagagcgt

SEQ ID NO: 251081 - DNA, 20 bp, human
gccctactggacacacacct

SEQ ID NO: 251082 - DNA, 20 bp, human
gtcccgcccacaacgctcac

SEQ ID NO: 251083 - DNA, 20 bp, human
gctggaaaggaatacacagt

SEQ ID NO: 251084 - DNA, 20 bp, human
ggaaatcagtgcgaagtggg

SEQ ID NO: 251085 - DNA, 20 bp, human
ggcgtgaaatcagtgcgaag

SEQ ID NO: 251086 - DNA, 20 bp, human
gccaaagaggcgtcctgggc

SEQ ID NO: 251087 - DNA, 20 bp, human
gtggcgcgaaacaccctcac

SEQ ID NO: 251088 - DNA, 20 bp, human
gtcagcctcgccggcccgtg

SEQ ID NO: 251089 - DNA, 20 bp, human
gagagccaaagaggcgtcct

SEQ ID NO: 251090 - DNA, 20 bp, human
ggcccggctgattagtgcga

SEQ ID NO: 251091 - DNA, 20 bp, human
gcagcgccggccccatcgaa

SEQ ID NO: 251092 - DNA, 20 bp, human
ggtgcgggcgccgggaagac

SEQ ID NO: 251093 - DNA, 20 bp, human
ggctgtgcgtcctccagtcg

SEQ ID NO: 251094 - DNA, 20 bp, human
ggcgaaacaccctcacgggc

SEQ ID NO: 251095 - DNA, 20 bp, human
gcacagcgccccacctcgac

SEQ ID NO: 251096 - DNA, 20 bp, human
ggatctaagtctaccctgag

SEQ ID NO: 251097 - DNA, 20 bp, human
gcatatatacaaacccctca

SEQ ID NO: 251098 - DNA, 20 bp, human
gaacttactggaatgtcact

SEQ ID NO: 251099 - DNA, 20 bp, human
ggttcttcaaagtataaaga

SEQ ID NO: 251100 - DNA, 20 bp, human
ggtgtttgaaatctatcttt

SEQ ID NO: 251101 - DNA, 20 bp, human
ggcaattttggaggcgttta

SEQ ID NO: 251102 - DNA, 20 bp, human
ggattaaaattgagaataac

SEQ ID NO: 251103 - DNA, 20 bp, human
gttcatagaggcaattttgg

SEQ ID NO: 251104 - DNA, 20 bp, human
gcttttcatagaggcaattt

SEQ ID NO: 251105 - DNA, 20 bp, human
ggtataaagaaggggaaaaa

SEQ ID NO: 251106 - DNA, 20 bp, human
gggtggggcccagtgaatat

SEQ ID NO: 251107 - DNA, 20 bp, human
gccagtgaatatgggcgcgt

SEQ ID NO: 251108 - DNA, 20 bp, human
ggccccctgcgggcttgccg

SEQ ID NO: 251109 - DNA, 20 bp, human
ggtctccggaagtgggtctg

SEQ ID NO: 251110 - DNA, 20 bp, human
gcccgtccgctaggcaggtg

SEQ ID NO: 251111 - DNA, 20 bp, human
ggcgcagagcacgtcgtccg

SEQ ID NO: 251112 - DNA, 20 bp, human
gatagatccgagtgcagaag

SEQ ID NO: 251113 - DNA, 20 bp, human
gagcggacgggtgcaatccc

SEQ ID NO: 251114 - DNA, 20 bp, human
gataactggcgacacacgta

SEQ ID NO: 251115 - DNA, 20 bp, human
gcgcgccgcagacccacttc

SEQ ID NO: 251116 - DNA, 20 bp, human
gtgcaagccaatgggatccg

SEQ ID NO: 251117 - DNA, 20 bp, human
gggaaggcgtaagtgcgtca

SEQ ID NO: 251118 - DNA, 20 bp, human
ggggaaacatgataaggatg

SEQ ID NO: 251119 - DNA, 20 bp, human
ggcgtcacggagagcatctc

SEQ ID NO: 251120 - DNA, 20 bp, human
gcggcggcgaagtaagccaa

SEQ ID NO: 251121 - DNA, 20 bp, human
ggatccggggaaacatgata

SEQ ID NO: 251122 - DNA, 20 bp, human
gcatgataaggatgcggtcg

SEQ ID NO: 251123 - DNA, 20 bp, human
ggaggctgggaataggctga

SEQ ID NO: 251124 - DNA, 20 bp, human
gcgtgcccgtgtcttgcttc

SEQ ID NO: 251125 - DNA, 20 bp, human
gtaaggatgcggtcgaggct

SEQ ID NO: 251126 - DNA, 20 bp, human
ggtcagggcccacccaccat

SEQ ID NO: 251127 - DNA, 20 bp, human
gaggcattccaatggtgggt

SEQ ID NO: 251128 - DNA, 20 bp, human
ggggcgattaggtcatagag

SEQ ID NO: 251129 - DNA, 20 bp, human
ggtgtggaaagaccagaaga

SEQ ID NO: 251130 - DNA, 20 bp, human
ggggcggggtggcttgcttg

SEQ ID NO: 251131 - DNA, 20 bp, human
gctgacctgagagagtggcg

SEQ ID NO: 251132 - DNA, 20 bp, human
gggtgaaagcgcggcgatcc

SEQ ID NO: 251133 - DNA, 20 bp, human
gcgcgaggggcggggcgatt

SEQ ID NO: 251134 - DNA, 20 bp, human
gctgagagagtggcgcgggg

SEQ ID NO: 251135 - DNA, 20 bp, human
gttccctgcggcgtaggagg

SEQ ID NO: 251136 - DNA, 20 bp, human
gttcccagtacgcactgcta

SEQ ID NO: 251137 - DNA, 20 bp, human
ggaggccgaggagacccgtt

SEQ ID NO: 251138 - DNA, 20 bp, human
gctgggaagcccttcaacgg

SEQ ID NO: 251139 - DNA, 20 bp, human
ggcctggcgtcggtggagag

SEQ ID NO: 251140 - DNA, 20 bp, human
gtgatatctctcacactcat

SEQ ID NO: 251141 - DNA, 20 bp, human
ggagtgtgagagatatcaac

SEQ ID NO: 251142 - DNA, 20 bp, human
gaggagacccgttcggagtg

SEQ ID NO: 251143 - DNA, 20 bp, human
gccctggccaatctccataa

SEQ ID NO: 251144 - DNA, 20 bp, human
gggttactagagtaaaaccc

SEQ ID NO: 251145 - DNA, 20 bp, human
gaacggcggtagacagggtc

SEQ ID NO: 251146 - DNA, 20 bp, human
ggggctccgcgcaaaagatg

SEQ ID NO: 251147 - DNA, 20 bp, human
ggggcgccgcgggagttcgc

SEQ ID NO: 251148 - DNA, 20 bp, human
gaatccgcgttgttccgtgt

SEQ ID NO: 251149 - DNA, 20 bp, human
gcacgggagcgggacttgaa

SEQ ID NO: 251150 - DNA, 20 bp, human
gagagcccggcgaactcccg

SEQ ID NO: 251151 - DNA, 20 bp, human
gcgcgcaaaagatggggttg

SEQ ID NO: 251152 - DNA, 20 bp, human
gggcgcgtagagatgacgtc

SEQ ID NO: 251153 - DNA, 20 bp, human
gtgcgcggagcccgagtcgc

SEQ ID NO: 251154 - DNA, 20 bp, human
gcccccaacacggaacaacg

SEQ ID NO: 251155 - DNA, 20 bp, human
ggggagcgggacttgaatgg

SEQ ID NO: 251156 - DNA, 20 bp, human
gcccgggcagcgtcggaaga

SEQ ID NO: 251157 - DNA, 20 bp, human
gcctgcgcagactacttccc

SEQ ID NO: 251158 - DNA, 20 bp, human
gaagagggcgtgagcataat

SEQ ID NO: 251159 - DNA, 20 bp, human
gcctggctgggtgagaaacg

SEQ ID NO: 251160 - DNA, 20 bp, human
ggaacagtgcccaacataag

SEQ ID NO: 251161 - DNA, 20 bp, human
gcataattggctcctgtagg

SEQ ID NO: 251162 - DNA, 20 bp, human
ggagcataattggctcctgt

SEQ ID NO: 251163 - DNA, 20 bp, human
ggccctcttccgacgctgcc

SEQ ID NO: 251164 - DNA, 20 bp, human
ggcactgttctagactttga

SEQ ID NO: 251165 - DNA, 20 bp, human
gtatcagtatcctcttatgt

SEQ ID NO: 251166 - DNA, 20 bp, human
gaagaggcactcactctcac

SEQ ID NO: 251167 - DNA, 20 bp, human
gtgaccctgccagcacttac

SEQ ID NO: 251168 - DNA, 20 bp, human
ggggtcctgtaagtgctggc

SEQ ID NO: 251169 - DNA, 20 bp, human
ggatggcctgaccaatcaca

SEQ ID NO: 251170 - DNA, 20 bp, human
gtaaggaggcagttactcct

SEQ ID NO: 251171 - DNA, 20 bp, human
gctgtgacgcaaatttaaag

SEQ ID NO: 251172 - DNA, 20 bp, human
ggtagggggcgaggctttga

SEQ ID NO: 251173 - DNA, 20 bp, human
gccaagccctgtgattggtc

SEQ ID NO: 251174 - DNA, 20 bp, human
gtcgaattccgggtcgtgta

SEQ ID NO: 251175 - DNA, 20 bp, human
gacgccaacactggtttctg

SEQ ID NO: 251176 - DNA, 20 bp, human
gaggtccctaaacatggaga

SEQ ID NO: 251177 - DNA, 20 bp, human
gaggagcgcaccaactgcgt

SEQ ID NO: 251178 - DNA, 20 bp, human
gggcactggcgaaagctcag

SEQ ID NO: 251179 - DNA, 20 bp, human
ggccgcgtccgcagtgctgc

SEQ ID NO: 251180 - DNA, 20 bp, human
ggccagcagcactgcggacg

SEQ ID NO: 251181 - DNA, 20 bp, human
gtcacccgaggagccggcac

SEQ ID NO: 251182 - DNA, 20 bp, human
gcgccacgctcctgaggccc

SEQ ID NO: 251183 - DNA, 20 bp, human
gcctgagtgagtggcaccag

SEQ ID NO: 251184 - DNA, 20 bp, human
gggcggactccccccatccg

SEQ ID NO: 251185 - DNA, 20 bp, human
gactttgcacccagcaacca

SEQ ID NO: 251186 - DNA, 20 bp, human
ggcagcatctccagtaagtg

SEQ ID NO: 251187 - DNA, 20 bp, human
gcagcacaggccccacttac

SEQ ID NO: 251188 - DNA, 20 bp, human
gggccgagcagcttcagctg

SEQ ID NO: 251189 - DNA, 20 bp, human
gagcaccaggtcccacttat

SEQ ID NO: 251190 - DNA, 20 bp, human
ggtcccatctattggagatg

SEQ ID NO: 251191 - DNA, 20 bp, human
gtcagctgcggctgggataa

SEQ ID NO: 251192 - DNA, 20 bp, human
gagcagcatctcgaactagt

SEQ ID NO: 251193 - DNA, 20 bp, human
gcagccgcatctccaataga

SEQ ID NO: 251194 - DNA, 20 bp, human
gaactagtgggacctgtgct

SEQ ID NO: 251195 - DNA, 20 bp, human
gatctccaataagtgggacc

SEQ ID NO: 251196 - DNA, 20 bp, human
gggaagcggaagtgctcgtt

SEQ ID NO: 251197 - DNA, 20 bp, human
ggctgccacctgcctccgag

SEQ ID NO: 251198 - DNA, 20 bp, human
gaggctcccacgccgcggga

SEQ ID NO: 251199 - DNA, 20 bp, human
gagggaggaaaggcgtccgc

SEQ ID NO: 251200 - DNA, 20 bp, human
gggccggccgggaacttcgc

SEQ ID NO: 251201 - DNA, 20 bp, human
gaggaaaggcgtccgcggga

SEQ ID NO: 251202 - DNA, 20 bp, human
gtccaggccgaaggacagcg

SEQ ID NO: 251203 - DNA, 20 bp, human
gagccagccccgctgtcctt

SEQ ID NO: 251204 - DNA, 20 bp, human
gctccagcgaagttcccggc

SEQ ID NO: 251205 - DNA, 20 bp, human
gggcgaaggctcccacgccg

SEQ ID NO: 251206 - DNA, 20 bp, human
gcctactagacccagtccta

SEQ ID NO: 251207 - DNA, 20 bp, human
gtaggcttccggtactcgga

SEQ ID NO: 251208 - DNA, 20 bp, human
gcggtggagcggccgtgctg

SEQ ID NO: 251209 - DNA, 20 bp, human
gactgcgcagtccctaggac

SEQ ID NO: 251210 - DNA, 20 bp, human
gcggccgtgctggggtcgac

SEQ ID NO: 251211 - DNA, 20 bp, human
gctagtaggaggcggtggag

SEQ ID NO: 251212 - DNA, 20 bp, human
ggactgggtctagtaggagg

SEQ ID NO: 251213 - DNA, 20 bp, human
gcagcggcgtccgggaacgc

SEQ ID NO: 251214 - DNA, 20 bp, human
gtaccccgtcgaccccagca

SEQ ID NO: 251215 - DNA, 20 bp, human
gtgggtctagtaggaggcgg

SEQ ID NO: 251216 - DNA, 20 bp, human
gcaccgaggaagcccgggaa

SEQ ID NO: 251217 - DNA, 20 bp, human
gaggaagcccgggaacggag

SEQ ID NO: 251218 - DNA, 20 bp, human
gcggcgggcggggttcgcgg

SEQ ID NO: 251219 - DNA, 20 bp, human
ggtgggagaactgggtacac

SEQ ID NO: 251220 - DNA, 20 bp, human
gcgggcttcctcggtgcgga

SEQ ID NO: 251221 - DNA, 20 bp, human
gggaaagcagggattttccg

SEQ ID NO: 251222 - DNA, 20 bp, human
gtactggagctctcctactg

SEQ ID NO: 251223 - DNA, 20 bp, human
gcgaaagtgcaactagcggc

SEQ ID NO: 251224 - DNA, 20 bp, human
gaggggtcctctccgttccc

SEQ ID NO: 251225 - DNA, 20 bp, human
gaggaactttaataactaaa

SEQ ID NO: 251226 - DNA, 20 bp, human
gccgcagcccgctttccggg

SEQ ID NO: 251227 - DNA, 20 bp, human
gtgggcgagttctggacgga

SEQ ID NO: 251228 - DNA, 20 bp, human
gagccggcagtggcttggga

SEQ ID NO: 251229 - DNA, 20 bp, human
gcgggggcgtggaaaacgcg

SEQ ID NO: 251230 - DNA, 20 bp, human
gctcggctgggagccggcag

SEQ ID NO: 251231 - DNA, 20 bp, human
ggggccgcagcccgctttcc

SEQ ID NO: 251232 - DNA, 20 bp, human
gtggacggaggggcacgttt

SEQ ID NO: 251233 - DNA, 20 bp, human
ggtaaatctcggaactggtc

SEQ ID NO: 251234 - DNA, 20 bp, human
gctccccgccgcccggaaag

SEQ ID NO: 251235 - DNA, 20 bp, human
gtggtggtaaatctcggaac

SEQ ID NO: 251236 - DNA, 20 bp, human
ggtttcgccatcttgagtgg

SEQ ID NO: 251237 - DNA, 20 bp, human
gctcgaagctcccaaaatgg

SEQ ID NO: 251238 - DNA, 20 bp, human
gcaggaaggcagtgacgccg

SEQ ID NO: 251239 - DNA, 20 bp, human
ggctcctcctccactcaaga

SEQ ID NO: 251240 - DNA, 20 bp, human
gcgggcgaacgggcgagcga

SEQ ID NO: 251241 - DNA, 20 bp, human
ggggccgcgaaagcttcctg

SEQ ID NO: 251242 - DNA, 20 bp, human
ggcggcgaatatagccgcgg

SEQ ID NO: 251243 - DNA, 20 bp, human
gaccgacgagaaaagttcga

SEQ ID NO: 251244 - DNA, 20 bp, human
gcccctcgaacttttctcgt

SEQ ID NO: 251245 - DNA, 20 bp, human
gttcctgaggagaaaatgga

SEQ ID NO: 251246 - DNA, 20 bp, human
gtggcgagacgttagttaaa

SEQ ID NO: 251247 - DNA, 20 bp, human
gcagaatagaataccagaac

SEQ ID NO: 251248 - DNA, 20 bp, human
gcgccggatgcataaaagac

SEQ ID NO: 251249 - DNA, 20 bp, human
gtcgcctaattcgtgctgaa

SEQ ID NO: 251250 - DNA, 20 bp, human
gaatcttaagaaggggagca

SEQ ID NO: 251251 - DNA, 20 bp, human
gatgcatccggcgggagttt

SEQ ID NO: 251252 - DNA, 20 bp, human
gaggaaaccgaaactcccgc

SEQ ID NO: 251253 - DNA, 20 bp, human
gaaacctaagtgcttctgag

SEQ ID NO: 251254 - DNA, 20 bp, human
gcaatcagaatcttaagaag

SEQ ID NO: 251255 - DNA, 20 bp, human
gggtattctattctgcagta

SEQ ID NO: 251256 - DNA, 20 bp, human
ggaagcgatgatatgctatc

SEQ ID NO: 251257 - DNA, 20 bp, human
gactatgaaagtctgcggtg

SEQ ID NO: 251258 - DNA, 20 bp, human
gaaatctgggactctaaaca

SEQ ID NO: 251259 - DNA, 20 bp, human
ggacatgcatgtaattgtaa

SEQ ID NO: 251260 - DNA, 20 bp, human
gggaaatcgaaaaggcctcg

SEQ ID NO: 251261 - DNA, 20 bp, human
gaaaactgcggaaatcgaaa

SEQ ID NO: 251262 - DNA, 20 bp, human
ggatttccgcagttttctgg

SEQ ID NO: 251263 - DNA, 20 bp, human
gaatcgaaaaggcctcgcgg

SEQ ID NO: 251264 - DNA, 20 bp, human
gttttctggaggtagaatat

SEQ ID NO: 251265 - DNA, 20 bp, human
gggtttactctgagaatctt

SEQ ID NO: 251266 - DNA, 20 bp, human
gcgaagccgccgcccgaata

SEQ ID NO: 251267 - DNA, 20 bp, human
ggcccgaatagggaccgaaa

SEQ ID NO: 251268 - DNA, 20 bp, human
ggagaccgagtcctgaaccg

SEQ ID NO: 251269 - DNA, 20 bp, human
ggggcagcctctgttcgcct

SEQ ID NO: 251270 - DNA, 20 bp, human
gccgagtcctgaaccgagga

SEQ ID NO: 251271 - DNA, 20 bp, human
gtctctcggaagccctcgtg

SEQ ID NO: 251272 - DNA, 20 bp, human
ggcggagccgaggcgaacag

SEQ ID NO: 251273 - DNA, 20 bp, human
gggactcggtctcggctcgg

SEQ ID NO: 251274 - DNA, 20 bp, human
gcggcggcttcgtgcaggtt

SEQ ID NO: 251275 - DNA, 20 bp, human
ggaacagaggctgcccgagt

SEQ ID NO: 251276 - DNA, 20 bp, human
ggtgcaatttgataagagga

SEQ ID NO: 251277 - DNA, 20 bp, human
gtccacagtgaattattgcc

SEQ ID NO: 251278 - DNA, 20 bp, human
ggtcttagttccctctccaa

SEQ ID NO: 251279 - DNA, 20 bp, human
gtcagtctcttcataattga

SEQ ID NO: 251280 - DNA, 20 bp, human
ggggatgttttagagctgga

SEQ ID NO: 251281 - DNA, 20 bp, human
gtcctgagctccctttggag

SEQ ID NO: 251282 - DNA, 20 bp, human
gtttggggatgttttagagc

SEQ ID NO: 251283 - DNA, 20 bp, human
gtttgataagaggagggaat

SEQ ID NO: 251284 - DNA, 20 bp, human
ggatctgctcttgcccccct

SEQ ID NO: 251285 - DNA, 20 bp, human
gctctgtgcaatttgataag

SEQ ID NO: 251286 - DNA, 20 bp, human
gggccctgaccttcagagtc

SEQ ID NO: 251287 - DNA, 20 bp, human
ggccctcggccggactctga

SEQ ID NO: 251288 - DNA, 20 bp, human
gggccggactctgaaggtca

SEQ ID NO: 251289 - DNA, 20 bp, human
ggggccaggagtgctttgta

SEQ ID NO: 251290 - DNA, 20 bp, human
gaccttcagagtccggccga

SEQ ID NO: 251291 - DNA, 20 bp, human
ggaaaccccgcgccctgcaa

SEQ ID NO: 251292 - DNA, 20 bp, human
ggccgccgggggatgggacg

SEQ ID NO: 251293 - DNA, 20 bp, human
gacgctgcctaggccgccgg

SEQ ID NO: 251294 - DNA, 20 bp, human
gccgagggcgccgcctagct

SEQ ID NO: 251295 - DNA, 20 bp, human
gtgcatccggcgacaggggg

SEQ ID NO: 251296 - DNA, 20 bp, human
ggggcctccggggagaattc

SEQ ID NO: 251297 - DNA, 20 bp, human
gtcccgcggcagaagctcgg

SEQ ID NO: 251298 - DNA, 20 bp, human
gtacctgtgaaaaagactcg

SEQ ID NO: 251299 - DNA, 20 bp, human
ggcagaagctcggcggtctg

SEQ ID NO: 251300 - DNA, 20 bp, human
gggcctccgggaagcaatca

SEQ ID NO: 251301 - DNA, 20 bp, human
ggcccgcggcctgctgggac

SEQ ID NO: 251302 - DNA, 20 bp, human
ggctgcgcgccgggtcctgg

SEQ ID NO: 251303 - DNA, 20 bp, human
ggaggcgcaggcgcattgcg

SEQ ID NO: 251304 - DNA, 20 bp, human
gcgcaggcgcattgcggggc

SEQ ID NO: 251305 - DNA, 20 bp, human
gaagtcggcgcgcgaggcgc

SEQ ID NO: 251306 - DNA, 20 bp, human
ggaacccggccggttagtgg

SEQ ID NO: 251307 - DNA, 20 bp, human
gctggcagcggcattaatcg

SEQ ID NO: 251308 - DNA, 20 bp, human
gaagccgccactaaccggcc

SEQ ID NO: 251309 - DNA, 20 bp, human
gtaaccggccgggttccggg

SEQ ID NO: 251310 - DNA, 20 bp, human
gggggtggctgcatcctgaa

SEQ ID NO: 251311 - DNA, 20 bp, human
gcgggaggagagatagagat

SEQ ID NO: 251312 - DNA, 20 bp, human
gggagtggatagcttcactt

SEQ ID NO: 251313 - DNA, 20 bp, human
gagcggcattaatcggggag

SEQ ID NO: 251314 - DNA, 20 bp, human
gcctcgaagccgccactaac

SEQ ID NO: 251315 - DNA, 20 bp, human
gtccggctcatgtctcacta

SEQ ID NO: 251316 - DNA, 20 bp, human
gaggtcaagcggcccaggaa

SEQ ID NO: 251317 - DNA, 20 bp, human
gaaccaagatgcttcggttg

SEQ ID NO: 251318 - DNA, 20 bp, human
ggccccggtggcttgagtca

SEQ ID NO: 251319 - DNA, 20 bp, human
gcgagagcacgccgcctctt

SEQ ID NO: 251320 - DNA, 20 bp, human
ggtaccagatacagcccaag

SEQ ID NO: 251321 - DNA, 20 bp, human
gtggcgctacatggccccgg

SEQ ID NO: 251322 - DNA, 20 bp, human
gccgcctcttgggctgtatc

SEQ ID NO: 251323 - DNA, 20 bp, human
gtgcgaccgccacgcccctt

SEQ ID NO: 251324 - DNA, 20 bp, human
gaggaggggcgaggtgacgc

SEQ ID NO: 251325 - DNA, 20 bp, human
gggggcaggtcaagcggccc

SEQ ID NO: 251326 - DNA, 20 bp, human
gtgggcggtgcccttacccg

SEQ ID NO: 251327 - DNA, 20 bp, human
gtctgtgtcaagagcggcag

SEQ ID NO: 251328 - DNA, 20 bp, human
ggtgaggggtcccacacgcc

SEQ ID NO: 251329 - DNA, 20 bp, human
gcgagggtctgtgtcaagag

SEQ ID NO: 251330 - DNA, 20 bp, human
ggacacagaccctcggctcc

SEQ ID NO: 251331 - DNA, 20 bp, human
gcgcctgcgtgttgccacac

SEQ ID NO: 251332 - DNA, 20 bp, human
ggattggtcgccacgggtaa

SEQ ID NO: 251333 - DNA, 20 bp, human
gaccctcggctccaggcgtg

SEQ ID NO: 251334 - DNA, 20 bp, human
ggggcggaaggaaaactaag

SEQ ID NO: 251335 - DNA, 20 bp, human
ggtggcaacacgcaggcgca

SEQ ID NO: 251336 - DNA, 20 bp, human
gcctgcctgcacattgcgtg

SEQ ID NO: 251337 - DNA, 20 bp, human
gactgccagaacaacaggca

SEQ ID NO: 251338 - DNA, 20 bp, human
gctccaccacggcacctctg

SEQ ID NO: 251339 - DNA, 20 bp, human
ggaggctccactccctgcat

SEQ ID NO: 251340 - DNA, 20 bp, human
gagaaccctgcctgttgttc

SEQ ID NO: 251341 - DNA, 20 bp, human
gacggctgcagagaccgcag

SEQ ID NO: 251342 - DNA, 20 bp, human
gtggtgctctcgctccacca

SEQ ID NO: 251343 - DNA, 20 bp, human
ggggaccaactctccgagag

SEQ ID NO: 251344 - DNA, 20 bp, human
gagagaccgcagaggtgccg

SEQ ID NO: 251345 - DNA, 20 bp, human
gagagcctcacgcaatgtgc

SEQ ID NO: 251346 - DNA, 20 bp, human
gagtccgcccggctgttccg

SEQ ID NO: 251347 - DNA, 20 bp, human
ggttccgcgggcctgacctg

SEQ ID NO: 251348 - DNA, 20 bp, human
gaacagccgggcggactccg

SEQ ID NO: 251349 - DNA, 20 bp, human
gacctggggctgcgcgtcct

SEQ ID NO: 251350 - DNA, 20 bp, human
gtcaggcccgcggaacagcc

SEQ ID NO: 251351 - DNA, 20 bp, human
ggggctggatccagcgtagc

SEQ ID NO: 251352 - DNA, 20 bp, human
ggcggaggttcatggcacgc

SEQ ID NO: 251353 - DNA, 20 bp, human
ggtcgcgagtctgcgagccc

SEQ ID NO: 251354 - DNA, 20 bp, human
ggctgccgcctccggcgcgg

SEQ ID NO: 251355 - DNA, 20 bp, human
ggtgccatgaacctccgcgc

SEQ ID NO: 251356 - DNA, 20 bp, human
gaccctgctatgttactcgt

SEQ ID NO: 251357 - DNA, 20 bp, human
gaacctagcacagacattaa

SEQ ID NO: 251358 - DNA, 20 bp, human
gggtgtgcattttataagag

SEQ ID NO: 251359 - DNA, 20 bp, human
gcctcaatctcagtgagagg

SEQ ID NO: 251360 - DNA, 20 bp, human
gtgtatactagcatgaaact

SEQ ID NO: 251361 - DNA, 20 bp, human
ggagcaaccttgagaccaat

SEQ ID NO: 251362 - DNA, 20 bp, human
gtagtctcctgtaggaatca

SEQ ID NO: 251363 - DNA, 20 bp, human
gaacccacgagtaacatagc

SEQ ID NO: 251364 - DNA, 20 bp, human
ggagaggcccattggtctca

SEQ ID NO: 251365 - DNA, 20 bp, human
gcttcctcaatctcagtgag

SEQ ID NO: 251366 - DNA, 20 bp, human
ggtagcactcagtctcacct

SEQ ID NO: 251367 - DNA, 20 bp, human
ggtgagactgagtgctacct

SEQ ID NO: 251368 - DNA, 20 bp, human
gctgggcttctgttgctatg

SEQ ID NO: 251369 - DNA, 20 bp, human
gatgtggaacagacattttt

SEQ ID NO: 251370 - DNA, 20 bp, human
gagggaatatttaaggcctc

SEQ ID NO: 251371 - DNA, 20 bp, human
gcctgcaaagagattgggat

SEQ ID NO: 251372 - DNA, 20 bp, human
gtaaggcctctgggacagcc

SEQ ID NO: 251373 - DNA, 20 bp, human
gatacgccctgcaaagagat

SEQ ID NO: 251374 - DNA, 20 bp, human
gaagcagtgtcccgaggacc

SEQ ID NO: 251375 - DNA, 20 bp, human
gtggctttcattagttttta

SEQ ID NO: 251376 - DNA, 20 bp, human
gcctatcctagtctctttgc

SEQ ID NO: 251377 - DNA, 20 bp, human
ggtagcactcagtctcacct

SEQ ID NO: 251378 - DNA, 20 bp, human
ggtgagactgagtgctacct

SEQ ID NO: 251379 - DNA, 20 bp, human
gctgggcttctgttgctatg

SEQ ID NO: 251380 - DNA, 20 bp, human
gatgtggaacagacattttt

SEQ ID NO: 251381 - DNA, 20 bp, human
gtaaagcctctgggacaacc

SEQ ID NO: 251382 - DNA, 20 bp, human
gtacgccctgcaaagagact

SEQ ID NO: 251383 - DNA, 20 bp, human
ggtttttatggttagacctc

SEQ ID NO: 251384 - DNA, 20 bp, human
gtggctttcattagttttta

SEQ ID NO: 251385 - DNA, 20 bp, human
ggctgaccaaggtagatgag

SEQ ID NO: 251386 - DNA, 20 bp, human
gcctatcctagtctctttgc

SEQ ID NO: 251387 - DNA, 20 bp, human
ggtagcactcagtctcacct

SEQ ID NO: 251388 - DNA, 20 bp, human
ggtgagactgagtgctacct

SEQ ID NO: 251389 - DNA, 20 bp, human
gctgggcttctgttgctatg

SEQ ID NO: 251390 - DNA, 20 bp, human
gatgtggaacagacattttt

SEQ ID NO: 251391 - DNA, 20 bp, human
gtaaagcctctgggacaacc

SEQ ID NO: 251392 - DNA, 20 bp, human
gtacgccctgcaaagagact

SEQ ID NO: 251393 - DNA, 20 bp, human
ggtttttatggttagacctc

SEQ ID NO: 251394 - DNA, 20 bp, human
gtggctttcattagttttta

SEQ ID NO: 251395 - DNA, 20 bp, human
ggctgaccaaggtagatgag

SEQ ID NO: 251396 - DNA, 20 bp, human
gttcaagcaggagtccacgg

SEQ ID NO: 251397 - DNA, 20 bp, human
gggctgaccaaagtagacga

SEQ ID NO: 251398 - DNA, 20 bp, human
gcaccagcataggtatcatg

SEQ ID NO: 251399 - DNA, 20 bp, human
gcgaggggtcggtacctccg

SEQ ID NO: 251400 - DNA, 20 bp, human
gaccaaagtagacgaggggt

SEQ ID NO: 251401 - DNA, 20 bp, human
ggaccccatgatacctatgc

SEQ ID NO: 251402 - DNA, 20 bp, human
gagaaagctggagttcaagc

SEQ ID NO: 251403 - DNA, 20 bp, human
gaccgacccctcgtctactt

SEQ ID NO: 251404 - DNA, 20 bp, human
gttaagggtcttttggtatc

SEQ ID NO: 251405 - DNA, 20 bp, human
gccgcctgggcttgtgttgc

SEQ ID NO: 251406 - DNA, 20 bp, human
gaggaggtgggcatgtgatt

SEQ ID NO: 251407 - DNA, 20 bp, human
gggagaaagaggagcatcaa

SEQ ID NO: 251408 - DNA, 20 bp, human
gtctcccgctggtgccagta

SEQ ID NO: 251409 - DNA, 20 bp, human
gaacaccttggatcaagaag

SEQ ID NO: 251410 - DNA, 20 bp, human
ggatgaaagctgggagaaag

SEQ ID NO: 251411 - DNA, 20 bp, human
gtctctggatgactctctgg

SEQ ID NO: 251412 - DNA, 20 bp, human
gcgctggtgccagtatggag

SEQ ID NO: 251413 - DNA, 20 bp, human
gaggtgggcatgtgattggg

SEQ ID NO: 251414 - DNA, 20 bp, human
ggatggtccctggtactctc

SEQ ID NO: 251415 - DNA, 20 bp, human
gagtaaatactcaagcagat

SEQ ID NO: 251416 - DNA, 20 bp, human
gcggggagtgcatgtgattg

SEQ ID NO: 251417 - DNA, 20 bp, human
gagcatcaaagggacatgga

SEQ ID NO: 251418 - DNA, 20 bp, human
ggagaacaaaggagcatcaa

SEQ ID NO: 251419 - DNA, 20 bp, human
ggggtgaataggctcttgtg

SEQ ID NO: 251420 - DNA, 20 bp, human
gaaggagcatcaaagggaca

SEQ ID NO: 251421 - DNA, 20 bp, human
gcaagcttcattgtagtgtg

SEQ ID NO: 251422 - DNA, 20 bp, human
gaatgaagcttggagaacaa

SEQ ID NO: 251423 - DNA, 20 bp, human
gtaagggaaaagaactcagt

SEQ ID NO: 251424 - DNA, 20 bp, human
ggacagatgttgcggtgaga

SEQ ID NO: 251425 - DNA, 20 bp, human
gaaggaggctttgagattat

SEQ ID NO: 251426 - DNA, 20 bp, human
gaaaaccaaacaggaggagc

SEQ ID NO: 251427 - DNA, 20 bp, human
gaggttaggcagttctgatg

SEQ ID NO: 251428 - DNA, 20 bp, human
gagggaggtgccacagtcaa

SEQ ID NO: 251429 - DNA, 20 bp, human
gcataaggggagagatgaga

SEQ ID NO: 251430 - DNA, 20 bp, human
gcctgctcagagcttccctg

SEQ ID NO: 251431 - DNA, 20 bp, human
gagaagttcacccttgactg

SEQ ID NO: 251432 - DNA, 20 bp, human
gacaggaggagctggcacca

SEQ ID NO: 251433 - DNA, 20 bp, human
gtcccaggaacacgtctagt

SEQ ID NO: 251434 - DNA, 20 bp, human
gaaatccagcggcagccaga

SEQ ID NO: 251435 - DNA, 20 bp, human
gctaacctagaaaaccaaac

SEQ ID NO: 251436 - DNA, 20 bp, human
gtgggttgtgggtacagata

SEQ ID NO: 251437 - DNA, 20 bp, human
gggtaaggcagagctcccta

SEQ ID NO: 251438 - DNA, 20 bp, human
gtggctgtccgggtgctctc

SEQ ID NO: 251439 - DNA, 20 bp, human
gcggacagccacaaatccat

SEQ ID NO: 251440 - DNA, 20 bp, human
gaattaggaacccaatggta

SEQ ID NO: 251441 - DNA, 20 bp, human
gcccactcactcagttaatt

SEQ ID NO: 251442 - DNA, 20 bp, human
ggggagctctgccttaccat

SEQ ID NO: 251443 - DNA, 20 bp, human
gtctcagggcatgtggctgg

SEQ ID NO: 251444 - DNA, 20 bp, human
gtgagtgggtgtgttctgca

SEQ ID NO: 251445 - DNA, 20 bp, human
gtggactccaggggcttgtc

SEQ ID NO: 251446 - DNA, 20 bp, human
ggtgtggaggtatgcgtttg

SEQ ID NO: 251447 - DNA, 20 bp, human
gtgggttgtgggtacagata

SEQ ID NO: 251448 - DNA, 20 bp, human
gtctcagggcatgtggctgg

SEQ ID NO: 251449 - DNA, 20 bp, human
gggagagtctaagaccctcc

SEQ ID NO: 251450 - DNA, 20 bp, human
gtagactctcccagcatttt

SEQ ID NO: 251451 - DNA, 20 bp, human
gtggcccttggcctatgatg

SEQ ID NO: 251452 - DNA, 20 bp, human
ggcaccccatcataggccaa

SEQ ID NO: 251453 - DNA, 20 bp, human
gggaatagtctcagggcatg

SEQ ID NO: 251454 - DNA, 20 bp, human
gtgtgggtcagattgggttg

SEQ ID NO: 251455 - DNA, 20 bp, human
gagcaagtatgccccctttg

SEQ ID NO: 251456 - DNA, 20 bp, human
gtaaatgcgtgaaaggtccc

SEQ ID NO: 251457 - DNA, 20 bp, human
gtctatcacagaaatgtcct

SEQ ID NO: 251458 - DNA, 20 bp, human
gatagaaagagtgtaggatg

SEQ ID NO: 251459 - DNA, 20 bp, human
gtctgtgatagaaagagtgt

SEQ ID NO: 251460 - DNA, 20 bp, human
ggaggtcataaatgcgtgaa

SEQ ID NO: 251461 - DNA, 20 bp, human
gttgcttcagaaacgattca

SEQ ID NO: 251462 - DNA, 20 bp, human
ggccagctgggcagtgttga

SEQ ID NO: 251463 - DNA, 20 bp, human
ggctgggcagtgttgagggt

SEQ ID NO: 251464 - DNA, 20 bp, human
gtcaccaaggcacagtgtgg

SEQ ID NO: 251465 - DNA, 20 bp, human
gggggagagagtattaccat

SEQ ID NO: 251466 - DNA, 20 bp, human
gtctgtgatagaaaaagtat

SEQ ID NO: 251467 - DNA, 20 bp, human
gtctatcacagaaatgtgct

SEQ ID NO: 251468 - DNA, 20 bp, human
gatagaaaaagtataggatg

SEQ ID NO: 251469 - DNA, 20 bp, human
gttgcttcagaaacgattcg

SEQ ID NO: 251470 - DNA, 20 bp, human
gaaacaaacatacaacgtca

SEQ ID NO: 251471 - DNA, 20 bp, human
ggccagctgggcagtgttga

SEQ ID NO: 251472 - DNA, 20 bp, human
ggctgggcagtgttgagggt

SEQ ID NO: 251473 - DNA, 20 bp, human
gtcaccaaggcacagtgtgg

SEQ ID NO: 251474 - DNA, 20 bp, human
gaggctgctcttgattactg

SEQ ID NO: 251475 - DNA, 20 bp, human
ggcagggcaggtgtatttat

SEQ ID NO: 251476 - DNA, 20 bp, human
ggtgatatcttacaggaaag

SEQ ID NO: 251477 - DNA, 20 bp, human
gctagaggttgaaagagcag

SEQ ID NO: 251478 - DNA, 20 bp, human
gggaaagaacaccaggctag

SEQ ID NO: 251479 - DNA, 20 bp, human
gctccatttcccaggataaa

SEQ ID NO: 251480 - DNA, 20 bp, human
ggaagctggaagagatgaaa

SEQ ID NO: 251481 - DNA, 20 bp, human
gggcccctgcattagtatgg

SEQ ID NO: 251482 - DNA, 20 bp, human
ggggagtctaactggtgtag

SEQ ID NO: 251483 - DNA, 20 bp, human
gtctggcccctgcattagta

SEQ ID NO: 251484 - DNA, 20 bp, human
gttattttggggagtctaac

SEQ ID NO: 251485 - DNA, 20 bp, human
ggaaaggggtcactatcttc

SEQ ID NO: 251486 - DNA, 20 bp, human
gggtgatatcttacaggaaa

SEQ ID NO: 251487 - DNA, 20 bp, human
gctagaggttgaaagagcag

SEQ ID NO: 251488 - DNA, 20 bp, human
ggaagctggaagagatgaaa

SEQ ID NO: 251489 - DNA, 20 bp, human
ggggagtctaactggtgtag

SEQ ID NO: 251490 - DNA, 20 bp, human
gggaaagaacaccaggctag

SEQ ID NO: 251491 - DNA, 20 bp, human
gctccatttcccaggataaa

SEQ ID NO: 251492 - DNA, 20 bp, human
gttattttggggagtctaac

SEQ ID NO: 251493 - DNA, 20 bp, human
gtctcccagaaaacagaagc

SEQ ID NO: 251494 - DNA, 20 bp, human
ggaaaggggtcactatcttc

SEQ ID NO: 251495 - DNA, 20 bp, human
gggcccctgcattagtatgg

SEQ ID NO: 251496 - DNA, 20 bp, human
gtacaggtgagcagcatggc

SEQ ID NO: 251497 - DNA, 20 bp, human
ggctgcacgcttttcgtgct

SEQ ID NO: 251498 - DNA, 20 bp, human
gacacccactgaggttgggt

SEQ ID NO: 251499 - DNA, 20 bp, human
gagagcccacccaacctcag

SEQ ID NO: 251500 - DNA, 20 bp, human
gagtgacacccactgaggtt

SEQ ID NO: 251501 - DNA, 20 bp, human
ggactgagtgacacccactg

SEQ ID NO: 251502 - DNA, 20 bp, human
ggatgaagggaggacagagt

SEQ ID NO: 251503 - DNA, 20 bp, human
gggaaagtggggatgaaggg

SEQ ID NO: 251504 - DNA, 20 bp, human
gatcaagatgttacttggtc

SEQ ID NO: 251505 - DNA, 20 bp, human
gctgaggaaccgtagtgagg

SEQ ID NO: 251506 - DNA, 20 bp, human
gtacaggtgagcagcatggc

SEQ ID NO: 251507 - DNA, 20 bp, human
gatgctgctcacctgtacca

SEQ ID NO: 251508 - DNA, 20 bp, human
gacctgtaccatggcactgt

SEQ ID NO: 251509 - DNA, 20 bp, human
ggctgcacgcttttcgtgct

SEQ ID NO: 251510 - DNA, 20 bp, human
gacacccactgaggttgggt

SEQ ID NO: 251511 - DNA, 20 bp, human
gagagcccacccaacctcag

SEQ ID NO: 251512 - DNA, 20 bp, human
ggagtgacacccactgaggt

SEQ ID NO: 251513 - DNA, 20 bp, human
ggactgagtgacacccactg

SEQ ID NO: 251514 - DNA, 20 bp, human
ggatgaagggaggacagagt

SEQ ID NO: 251515 - DNA, 20 bp, human
gggaaagtggggatgaaggg

SEQ ID NO: 251516 - DNA, 20 bp, human
gctatcagttgctgagagag

SEQ ID NO: 251517 - DNA, 20 bp, human
gcagcccacacattaatcag

SEQ ID NO: 251518 - DNA, 20 bp, human
gacacagaatagaatattcc

SEQ ID NO: 251519 - DNA, 20 bp, human
ggctccactgattaatgtgt

SEQ ID NO: 251520 - DNA, 20 bp, human
gagaaccctgcctttctgcc

SEQ ID NO: 251521 - DNA, 20 bp, human
gtagaatattccaggcagaa

SEQ ID NO: 251522 - DNA, 20 bp, human
gttaactaaaccacatttgt

SEQ ID NO: 251523 - DNA, 20 bp, human
gtgtactaggaaaagcgtgg

SEQ ID NO: 251524 - DNA, 20 bp, human
gcgtttgtctcccacaaatg

SEQ ID NO: 251525 - DNA, 20 bp, human
gatattccaggcagaaaggc

SEQ ID NO: 251526 - DNA, 20 bp, human
gcagcccacacattagtcag

SEQ ID NO: 251527 - DNA, 20 bp, human
ggctccactgactaatgtgt

SEQ ID NO: 251528 - DNA, 20 bp, human
gacacagaatagaatattcc

SEQ ID NO: 251529 - DNA, 20 bp, human
gagaaccctgcctttctgcc

SEQ ID NO: 251530 - DNA, 20 bp, human
gttaactaaaccacatttgt

SEQ ID NO: 251531 - DNA, 20 bp, human
gtagaatattccaggcagaa

SEQ ID NO: 251532 - DNA, 20 bp, human
gtgtactaggaaaagcgtgg

SEQ ID NO: 251533 - DNA, 20 bp, human
gcgtttgtctcccacaaatg

SEQ ID NO: 251534 - DNA, 20 bp, human
gatattccaggcagaaaggc

SEQ ID NO: 251535 - DNA, 20 bp, human
ggctatatatcttatagaca

SEQ ID NO: 251536 - DNA, 20 bp, human
ggtggttaaaagtacttccc

SEQ ID NO: 251537 - DNA, 20 bp, human
ggaagtacttttaaccactg

SEQ ID NO: 251538 - DNA, 20 bp, human
gagttcatgttctttgaggg

SEQ ID NO: 251539 - DNA, 20 bp, human
gaaaacaaaactgatctcaa

SEQ ID NO: 251540 - DNA, 20 bp, human
gtgctcttgataagcctcag

SEQ ID NO: 251541 - DNA, 20 bp, human
gtttataggggatatgtgtt

SEQ ID NO: 251542 - DNA, 20 bp, human
ggcaagaacatttgtatgct

SEQ ID NO: 251543 - DNA, 20 bp, human
gtgataaaacaatgagaacc

SEQ ID NO: 251544 - DNA, 20 bp, human
gggagaatccacaaataaaa

SEQ ID NO: 251545 - DNA, 20 bp, human
gctagttaaggttacacagc

SEQ ID NO: 251546 - DNA, 20 bp, human
gaccttgcatggctattgtt

SEQ ID NO: 251547 - DNA, 20 bp, human
gttctcaccaaaaggggaca

SEQ ID NO: 251548 - DNA, 20 bp, human
gttaataagttcaccttgca

SEQ ID NO: 251549 - DNA, 20 bp, human
gtcctaacaatagccatgca

SEQ ID NO: 251550 - DNA, 20 bp, human
gtcacctccttgtccccttt

SEQ ID NO: 251551 - DNA, 20 bp, human
gtatttatgtttaaatgtta

SEQ ID NO: 251552 - DNA, 20 bp, human
gtgtagttgcctctatttaa

SEQ ID NO: 251553 - DNA, 20 bp, human
ggatttcaataaacactgat

SEQ ID NO: 251554 - DNA, 20 bp, human
gaataatttctcaccaaaag

SEQ ID NO: 251555 - DNA, 20 bp, human
gatataggaccattaaatag

SEQ ID NO: 251556 - DNA, 20 bp, human
gaattgtaatcacgccaaga

SEQ ID NO: 251557 - DNA, 20 bp, human
gacgcagacagaatatgtaa

SEQ ID NO: 251558 - DNA, 20 bp, human
gaatggggttaaagtattct

SEQ ID NO: 251559 - DNA, 20 bp, human
gtcagagttgtgctagtctt

SEQ ID NO: 251560 - DNA, 20 bp, human
gggagtagagattaattatc

SEQ ID NO: 251561 - DNA, 20 bp, human
gcttgtttttacagccttct

SEQ ID NO: 251562 - DNA, 20 bp, human
gatgacaaattctataacat

SEQ ID NO: 251563 - DNA, 20 bp, human
ggcgtcacagttttctcaat

SEQ ID NO: 251564 - DNA, 20 bp, human
gattcatgtttggctcaccg

SEQ ID NO: 251565 - DNA, 20 bp, human
gagtatttattatgtaccag

SEQ ID NO: 251566 - DNA, 20 bp, human
gtgcccacagccatagtcat

SEQ ID NO: 251567 - DNA, 20 bp, human
gcaatgcaaaggggcatcca

SEQ ID NO: 251568 - DNA, 20 bp, human
gtacagctatcattcacaga

SEQ ID NO: 251569 - DNA, 20 bp, human
gcatccatggaataaattta

SEQ ID NO: 251570 - DNA, 20 bp, human
gctccaatgactatggctgt

SEQ ID NO: 251571 - DNA, 20 bp, human
gatctctgctccaatgacta

SEQ ID NO: 251572 - DNA, 20 bp, human
gaaagtaatcagcagattaa

SEQ ID NO: 251573 - DNA, 20 bp, human
gattaatgatcaatgcaaag

SEQ ID NO: 251574 - DNA, 20 bp, human
gttaattaattagcaatgat

SEQ ID NO: 251575 - DNA, 20 bp, human
gaagagaaactctcgttatc

SEQ ID NO: 251576 - DNA, 20 bp, human
gtcctgctctagatatcctt

SEQ ID NO: 251577 - DNA, 20 bp, human
gaattctgaaggagagggac

SEQ ID NO: 251578 - DNA, 20 bp, human
gagtggcaggctgatgttct

SEQ ID NO: 251579 - DNA, 20 bp, human
gctggccagtgcaacagcct

SEQ ID NO: 251580 - DNA, 20 bp, human
gggagaagggatctgttctc

SEQ ID NO: 251581 - DNA, 20 bp, human
gagcagctgtgagaatgtag

SEQ ID NO: 251582 - DNA, 20 bp, human
gtggtgaaaggcacgagcag

SEQ ID NO: 251583 - DNA, 20 bp, human
gttagggtatcattctgaat

SEQ ID NO: 251584 - DNA, 20 bp, human
gctctagatatccttgggga

SEQ ID NO: 251585 - DNA, 20 bp, human
gactgattatccggtgttca

SEQ ID NO: 251586 - DNA, 20 bp, human
gatgggagatacctgatgtc

SEQ ID NO: 251587 - DNA, 20 bp, human
gggatactctgtgtaagcgt

SEQ ID NO: 251588 - DNA, 20 bp, human
gtgcagtgaactaaaaggga

SEQ ID NO: 251589 - DNA, 20 bp, human
ggagatacctgatgtcaggc

SEQ ID NO: 251590 - DNA, 20 bp, human
gttctgtgcagtgaactaaa

SEQ ID NO: 251591 - DNA, 20 bp, human
ggcagtgctcatgtctgtgt

SEQ ID NO: 251592 - DNA, 20 bp, human
ggtatacacgtgcctcacat

SEQ ID NO: 251593 - DNA, 20 bp, human
gtagttttggaaatgcgtca

SEQ ID NO: 251594 - DNA, 20 bp, human
gagcccgcctttattagttt

SEQ ID NO: 251595 - DNA, 20 bp, human
ggtgttctgtgggcacagca

SEQ ID NO: 251596 - DNA, 20 bp, human
ggagagatcggggaaagcta

SEQ ID NO: 251597 - DNA, 20 bp, human
ggcagagggttacaagtcac

SEQ ID NO: 251598 - DNA, 20 bp, human
gcactgggagggcatgcaga

SEQ ID NO: 251599 - DNA, 20 bp, human
ggagccctaatgagagatcg

SEQ ID NO: 251600 - DNA, 20 bp, human
ggagagggaagattcacact

SEQ ID NO: 251601 - DNA, 20 bp, human
ggtgtttggagcaatggaga

SEQ ID NO: 251602 - DNA, 20 bp, human
ggtttatgctagagtgagag

SEQ ID NO: 251603 - DNA, 20 bp, human
gataacatcagtctagtgtg

SEQ ID NO: 251604 - DNA, 20 bp, human
gtgggcacatatgtaagaga

SEQ ID NO: 251605 - DNA, 20 bp, human
gctactctcaggaatttcac

SEQ ID NO: 251606 - DNA, 20 bp, human
gtggcctgtgagacccacaa

SEQ ID NO: 251607 - DNA, 20 bp, human
ggtgggcagtgaattagaac

SEQ ID NO: 251608 - DNA, 20 bp, human
gtctgctacacactgtcctt

SEQ ID NO: 251609 - DNA, 20 bp, human
gcagtgaattagaacaggag

SEQ ID NO: 251610 - DNA, 20 bp, human
ggtgggtctcacaggccaaa

SEQ ID NO: 251611 - DNA, 20 bp, human
gacaggaggggatttatatg

SEQ ID NO: 251612 - DNA, 20 bp, human
gagatgagagtgtgggaaac

SEQ ID NO: 251613 - DNA, 20 bp, human
ggcattaattaattcctttg

SEQ ID NO: 251614 - DNA, 20 bp, human
gtacacactgtcctttggcc

SEQ ID NO: 251615 - DNA, 20 bp, human
gcctgtccctttactggcat

SEQ ID NO: 251616 - DNA, 20 bp, human
ggtatcaaccacactgcctg

SEQ ID NO: 251617 - DNA, 20 bp, human
gtacagctggagaaccaaga

SEQ ID NO: 251618 - DNA, 20 bp, human
gcaaatgactgttcccgttc

SEQ ID NO: 251619 - DNA, 20 bp, human
gccagcaacaaggacatctt

SEQ ID NO: 251620 - DNA, 20 bp, human
gaaggcaataaataccagtc

SEQ ID NO: 251621 - DNA, 20 bp, human
ggaacaagtagcaccctcat

SEQ ID NO: 251622 - DNA, 20 bp, human
gaagatcagtgaaccagaac

SEQ ID NO: 251623 - DNA, 20 bp, human
gcaaatgaagggcagagcag

SEQ ID NO: 251624 - DNA, 20 bp, human
gaatgtcagtattcatggag

SEQ ID NO: 251625 - DNA, 20 bp, human
gtgttgctgggaagaaccca

SEQ ID NO: 251626 - DNA, 20 bp, human
gagggagaggacagccaaca

SEQ ID NO: 251627 - DNA, 20 bp, human
gggacagccaacaaggtcca

SEQ ID NO: 251628 - DNA, 20 bp, human
ggcgccacaaacaccggctc

SEQ ID NO: 251629 - DNA, 20 bp, human
gtggaggaatgtctgtacaa

SEQ ID NO: 251630 - DNA, 20 bp, human
gcaggaggcgccacaaacac

SEQ ID NO: 251631 - DNA, 20 bp, human
gcctgaacccagtgaccagc

SEQ ID NO: 251632 - DNA, 20 bp, human
ggtgtccagtcagagtgtga

SEQ ID NO: 251633 - DNA, 20 bp, human
ggaagcggaaggatgaccct

SEQ ID NO: 251634 - DNA, 20 bp, human
ggggtagtatattaagtctt

SEQ ID NO: 251635 - DNA, 20 bp, human
gcaccggctccggaaggtca

SEQ ID NO: 251636 - DNA, 20 bp, human
ggtgggcagcaggcctaagt

SEQ ID NO: 251637 - DNA, 20 bp, human
ggagcctgttgagctcggaa

SEQ ID NO: 251638 - DNA, 20 bp, human
gaggcctaagtgggagtatg

SEQ ID NO: 251639 - DNA, 20 bp, human
gggggaggtagaattttctg

SEQ ID NO: 251640 - DNA, 20 bp, human
gctgttgagctcggaagggg

SEQ ID NO: 251641 - DNA, 20 bp, human
ggagctcaacaggctccgga

SEQ ID NO: 251642 - DNA, 20 bp, human
gatgaggccatgtggtcccc

SEQ ID NO: 251643 - DNA, 20 bp, human
gcagttagggggagatgcgg

SEQ ID NO: 251644 - DNA, 20 bp, human
gtgtggtccccaggctgctt

SEQ ID NO: 251645 - DNA, 20 bp, human
gttttccactctcttaggtg

SEQ ID NO: 251646 - DNA, 20 bp, human
gacccatgatagaccagtaa

SEQ ID NO: 251647 - DNA, 20 bp, human
gtgcatacagacagaggaga

SEQ ID NO: 251648 - DNA, 20 bp, human
gggaaagaaacagccccaag

SEQ ID NO: 251649 - DNA, 20 bp, human
gactcagtgttgcaaattaa

SEQ ID NO: 251650 - DNA, 20 bp, human
ggataatagcttatctcata

SEQ ID NO: 251651 - DNA, 20 bp, human
gacaccattctgctgtcatt

SEQ ID NO: 251652 - DNA, 20 bp, human
gggtgatcactcagaagaaa

SEQ ID NO: 251653 - DNA, 20 bp, human
gtcagaccttacagttctac

SEQ ID NO: 251654 - DNA, 20 bp, human
ggtgttgcaaattaatggtc

SEQ ID NO: 251655 - DNA, 20 bp, human
gcacctttactggtctatca

SEQ ID NO: 251656 - DNA, 20 bp, human
gtccagtgttagttctatca

SEQ ID NO: 251657 - DNA, 20 bp, human
gcccaaggcatgcctagcac

SEQ ID NO: 251658 - DNA, 20 bp, human
gctacatcctcccgatctac

SEQ ID NO: 251659 - DNA, 20 bp, human
gtgttcaagagtcctgtgct

SEQ ID NO: 251660 - DNA, 20 bp, human
gtggctagcaactctaattg

SEQ ID NO: 251661 - DNA, 20 bp, human
gaaattatgctgctctacca

SEQ ID NO: 251662 - DNA, 20 bp, human
ggtccttcttaggtggggtt

SEQ ID NO: 251663 - DNA, 20 bp, human
gcaaactctgctgaagtgta

SEQ ID NO: 251664 - DNA, 20 bp, human
gaggctgtgaaaaaactgct

SEQ ID NO: 251665 - DNA, 20 bp, human
ggctgaagtgtatggcaatt

SEQ ID NO: 251666 - DNA, 20 bp, human
ggcaccaaatgccgctgtgt

SEQ ID NO: 251667 - DNA, 20 bp, human
gacagcggcatttggtgcga

SEQ ID NO: 251668 - DNA, 20 bp, human
ggcactgaaccagaacagat

SEQ ID NO: 251669 - DNA, 20 bp, human
ggtgtaggctgtagactgct

SEQ ID NO: 251670 - DNA, 20 bp, human
gctgccacattcattcttgg

SEQ ID NO: 251671 - DNA, 20 bp, human
gctgcgcagagagtcaaagc

SEQ ID NO: 251672 - DNA, 20 bp, human
gcatatcatcccatctgttc

SEQ ID NO: 251673 - DNA, 20 bp, human
gtgtagttgggtctgatctg

SEQ ID NO: 251674 - DNA, 20 bp, human
gaaagaaggtatgatgtagt

SEQ ID NO: 251675 - DNA, 20 bp, human
gggcatttggtgcgatggga

SEQ ID NO: 251676 - DNA, 20 bp, human
ggggcgcatatcctgaggaa

SEQ ID NO: 251677 - DNA, 20 bp, human
gtctaggggcgcatatcctg

SEQ ID NO: 251678 - DNA, 20 bp, human
gtgatatggtggaacattct

SEQ ID NO: 251679 - DNA, 20 bp, human
gagggggaggagggatgata

SEQ ID NO: 251680 - DNA, 20 bp, human
gttggttggtcgtgggcctt

SEQ ID NO: 251681 - DNA, 20 bp, human
gactgtgagctccatatttg

SEQ ID NO: 251682 - DNA, 20 bp, human
gatatgcgcccctagagagc

SEQ ID NO: 251683 - DNA, 20 bp, human
gaaccttgacccaaatgggt

SEQ ID NO: 251684 - DNA, 20 bp, human
gttccaacccatttgggtca

SEQ ID NO: 251685 - DNA, 20 bp, human
gttaacccacacagacagag

SEQ ID NO: 251686 - DNA, 20 bp, human
gctggaggaaaacataagat

SEQ ID NO: 251687 - DNA, 20 bp, human
ggcagcatacaaacctgctt

SEQ ID NO: 251688 - DNA, 20 bp, human
ggcatagaggtgttcaagaa

SEQ ID NO: 251689 - DNA, 20 bp, human
gaattccttgctcttgatcc

SEQ ID NO: 251690 - DNA, 20 bp, human
ggccacgaagaggccaataa

SEQ ID NO: 251691 - DNA, 20 bp, human
gcttcactgctcatggcata

SEQ ID NO: 251692 - DNA, 20 bp, human
gcaaggaatttgttgcatag

SEQ ID NO: 251693 - DNA, 20 bp, human
gtcctccaggatcaagagca

SEQ ID NO: 251694 - DNA, 20 bp, human
gatggcataaggccacgaag

SEQ ID NO: 251695 - DNA, 20 bp, human
gcgaagaggccaataaaggc

SEQ ID NO: 251696 - DNA, 20 bp, human
ggggaacccataatacactt

SEQ ID NO: 251697 - DNA, 20 bp, human
ggctttccgaagtgtattat

SEQ ID NO: 251698 - DNA, 20 bp, human
ggtgtattatgggttcccta

SEQ ID NO: 251699 - DNA, 20 bp, human
ggaaagaaaagtgggcctta

SEQ ID NO: 251700 - DNA, 20 bp, human
gcagttatgtgtaatatgag

SEQ ID NO: 251701 - DNA, 20 bp, human
gagtaatatatacaaagaaa

SEQ ID NO: 251702 - DNA, 20 bp, human
gtttatctcatttgatcgat

SEQ ID NO: 251703 - DNA, 20 bp, human
gcatttatcaaaggtcaaga

SEQ ID NO: 251704 - DNA, 20 bp, human
ggtagtagaaagcacagcca

SEQ ID NO: 251705 - DNA, 20 bp, human
ggtcaagagggtgtgtgcaa

SEQ ID NO: 251706 - DNA, 20 bp, human
gggtagagcaaacagtgcgt

SEQ ID NO: 251707 - DNA, 20 bp, human
ggcgctcaataaatcaatcc

SEQ ID NO: 251708 - DNA, 20 bp, human
gatactgggcagtgaaccaa

SEQ ID NO: 251709 - DNA, 20 bp, human
gtcctaacagtctagaacac

SEQ ID NO: 251710 - DNA, 20 bp, human
gatcagaatgtctactggac

SEQ ID NO: 251711 - DNA, 20 bp, human
gtgatctaatctgactgctc

SEQ ID NO: 251712 - DNA, 20 bp, human
ggtaacagaaaagtctccct

SEQ ID NO: 251713 - DNA, 20 bp, human
ggcctgtgttctagactgtt

SEQ ID NO: 251714 - DNA, 20 bp, human
gattagatcagaatgtctac

SEQ ID NO: 251715 - DNA, 20 bp, human
gggttcactgcccagtatcc

SEQ ID NO: 251716 - DNA, 20 bp, human
gttcaataggagattctcag

SEQ ID NO: 251717 - DNA, 20 bp, human
gctcctgtttagcagtgcct

SEQ ID NO: 251718 - DNA, 20 bp, human
gtgtcctgcatttttgcccc

SEQ ID NO: 251719 - DNA, 20 bp, human
gctaaattcgtacaactgca

SEQ ID NO: 251720 - DNA, 20 bp, human
gtaattatctttttaataac

SEQ ID NO: 251721 - DNA, 20 bp, human
ggccccaggcactgctaaac

SEQ ID NO: 251722 - DNA, 20 bp, human
ggtgcctggggcaaaaatgc

SEQ ID NO: 251723 - DNA, 20 bp, human
gcagtgtttgaataagagaa

SEQ ID NO: 251724 - DNA, 20 bp, human
gtgtacgaatttagaaactg

SEQ ID NO: 251725 - DNA, 20 bp, human
gattacttttcttttatctt

SEQ ID NO: 251726 - DNA, 20 bp, human
gctggggtatgcctcgcttc

SEQ ID NO: 251727 - DNA, 20 bp, human
ggtaagagcacatagttctc

SEQ ID NO: 251728 - DNA, 20 bp, human
ggccaacacggctgcctcag

SEQ ID NO: 251729 - DNA, 20 bp, human
gtacttttggaaaacctggg

SEQ ID NO: 251730 - DNA, 20 bp, human
ggaacagtgtctttgtcaat

SEQ ID NO: 251731 - DNA, 20 bp, human
gtacaaacctctcagggctg

SEQ ID NO: 251732 - DNA, 20 bp, human
gtgttggcaatgctcatctg

SEQ ID NO: 251733 - DNA, 20 bp, human
gacccctgaggcagccgtgt

SEQ ID NO: 251734 - DNA, 20 bp, human
gcaggttttccaaaagtaca

SEQ ID NO: 251735 - DNA, 20 bp, human
ggttttccaaaagtacatgg

SEQ ID NO: 251736 - DNA, 20 bp, human
gcctacacagcaccctacca

SEQ ID NO: 251737 - DNA, 20 bp, human
gccctaccagggcctagaat

SEQ ID NO: 251738 - DNA, 20 bp, human
ggcagccctattctaggccc

SEQ ID NO: 251739 - DNA, 20 bp, human
gaggaagtgtgctttaatga

SEQ ID NO: 251740 - DNA, 20 bp, human
gaactgcatgaacactgtgt

SEQ ID NO: 251741 - DNA, 20 bp, human
ggaagagacggggagctgca

SEQ ID NO: 251742 - DNA, 20 bp, human
ggtgtaggcagccctattct

SEQ ID NO: 251743 - DNA, 20 bp, human
gacacacacgaagtccaggt

SEQ ID NO: 251744 - DNA, 20 bp, human
ggcagttgctagcatgcatg

SEQ ID NO: 251745 - DNA, 20 bp, human
gttggattgctcagtggagc

SEQ ID NO: 251746 - DNA, 20 bp, human
ggcccagcccagctctataa

SEQ ID NO: 251747 - DNA, 20 bp, human
gggcagactgaggagatcac

SEQ ID NO: 251748 - DNA, 20 bp, human
gcctcccaggcagacaccac

SEQ ID NO: 251749 - DNA, 20 bp, human
gtggcctcactcttcctgga

SEQ ID NO: 251750 - DNA, 20 bp, human
gcagggttctgcagaattcg

SEQ ID NO: 251751 - DNA, 20 bp, human
gtgagtctctggttttcccg

SEQ ID NO: 251752 - DNA, 20 bp, human
ggaccaggatccccatgcct

SEQ ID NO: 251753 - DNA, 20 bp, human
gaggtagcactgaaaggcca

SEQ ID NO: 251754 - DNA, 20 bp, human
gagcgctcaggcctaggcat

SEQ ID NO: 251755 - DNA, 20 bp, human
gaaagggtgttatgaaacac

SEQ ID NO: 251756 - DNA, 20 bp, human
ggcagcaccgggagcatggt

SEQ ID NO: 251757 - DNA, 20 bp, human
gatgctcccggtgctgccag

SEQ ID NO: 251758 - DNA, 20 bp, human
gtcagggcctctggcagcac

SEQ ID NO: 251759 - DNA, 20 bp, human
gaggaggaagggattttctg

SEQ ID NO: 251760 - DNA, 20 bp, human
gtacctggtgagtcagagaa

SEQ ID NO: 251761 - DNA, 20 bp, human
gcaggtgagtggcaggttat

SEQ ID NO: 251762 - DNA, 20 bp, human
gctctgactcaccaggtaag

SEQ ID NO: 251763 - DNA, 20 bp, human
gagctcctggggatgataca

SEQ ID NO: 251764 - DNA, 20 bp, human
gcttatgcaaatctggactc

SEQ ID NO: 251765 - DNA, 20 bp, human
gtggtgggccccatcctcac

SEQ ID NO: 251766 - DNA, 20 bp, human
gaaacccagggaccctggga

SEQ ID NO: 251767 - DNA, 20 bp, human
gagcccctcccagggtccct

SEQ ID NO: 251768 - DNA, 20 bp, human
ggcagcaccgggagcatggt

SEQ ID NO: 251769 - DNA, 20 bp, human
gggaccctgggaggggctca

SEQ ID NO: 251770 - DNA, 20 bp, human
gtcagggcctctggcagcac

SEQ ID NO: 251771 - DNA, 20 bp, human
gatgctcccggtgctgccag

SEQ ID NO: 251772 - DNA, 20 bp, human
gtacctggtgagtcagagaa

SEQ ID NO: 251773 - DNA, 20 bp, human
gaggaggaagggattttctg

SEQ ID NO: 251774 - DNA, 20 bp, human
gtggtgggccccatcctcac

SEQ ID NO: 251775 - DNA, 20 bp, human
gcaggtgagtggcaggttat

SEQ ID NO: 251776 - DNA, 20 bp, human
ggcgggcactcgcaagaacg

SEQ ID NO: 251777 - DNA, 20 bp, human
gaacgcggcatcctggatgg

SEQ ID NO: 251778 - DNA, 20 bp, human
gcccctgcggcctgctgcgc

SEQ ID NO: 251779 - DNA, 20 bp, human
gtccccggctggtgtggtgt

SEQ ID NO: 251780 - DNA, 20 bp, human
gccaggcccccgtgcggggc

SEQ ID NO: 251781 - DNA, 20 bp, human
ggccggctctcagcgattct

SEQ ID NO: 251782 - DNA, 20 bp, human
ggcgctcccaggcccccgtg

SEQ ID NO: 251783 - DNA, 20 bp, human
gtcccagaatcgctgagagc

SEQ ID NO: 251784 - DNA, 20 bp, human
gggtgactcggccaccatcc

SEQ ID NO: 251785 - DNA, 20 bp, human
gctccccatggcgacagcgg

SEQ ID NO: 251786 - DNA, 20 bp, human
gctccccggcaggaccgagg

SEQ ID NO: 251787 - DNA, 20 bp, human
gggcgctctccagaccccgg

SEQ ID NO: 251788 - DNA, 20 bp, human
ggactcgcgcagatggcacg

SEQ ID NO: 251789 - DNA, 20 bp, human
gggccggggtaaaaacccga

SEQ ID NO: 251790 - DNA, 20 bp, human
gccgcgcatcgagggaccca

SEQ ID NO: 251791 - DNA, 20 bp, human
gggactgcggaggatcggcg

SEQ ID NO: 251792 - DNA, 20 bp, human
gaagcgccagctacccgccg

SEQ ID NO: 251793 - DNA, 20 bp, human
gcgtctgcagcaacctcaca

SEQ ID NO: 251794 - DNA, 20 bp, human
gtggcaggatagggggactg

SEQ ID NO: 251795 - DNA, 20 bp, human
ggagcggctggcaggatagg

SEQ ID NO: 251796 - DNA, 20 bp, human
gcgggcgggcgggaccgcga

SEQ ID NO: 251797 - DNA, 20 bp, human
gggaatgcggcgaccaatca

SEQ ID NO: 251798 - DNA, 20 bp, human
gcctccgcgggaagctcggg

SEQ ID NO: 251799 - DNA, 20 bp, human
gcggccgaggcgacccctcg

SEQ ID NO: 251800 - DNA, 20 bp, human
gggaccgcgaggggtcgcct

SEQ ID NO: 251801 - DNA, 20 bp, human
gcccgccaactcccagctcg

SEQ ID NO: 251802 - DNA, 20 bp, human
gcgagcgccgaccacactcc

SEQ ID NO: 251803 - DNA, 20 bp, human
gggcccgcgcgccttctcct

SEQ ID NO: 251804 - DNA, 20 bp, human
gcggaacggaaggacgctag

SEQ ID NO: 251805 - DNA, 20 bp, human
gcccggctgcgcctggagtg

SEQ ID NO: 251806 - DNA, 20 bp, human
ggtcacccgcacgtctccca

SEQ ID NO: 251807 - DNA, 20 bp, human
gggaacgccagagtcctccg

SEQ ID NO: 251808 - DNA, 20 bp, human
gtgggtgggaggcctccaat

SEQ ID NO: 251809 - DNA, 20 bp, human
gcagccccagcgggcagcgg

SEQ ID NO: 251810 - DNA, 20 bp, human
gtcagggcggctgtgagtgg

SEQ ID NO: 251811 - DNA, 20 bp, human
ggctggggcccgcccgctcg

SEQ ID NO: 251812 - DNA, 20 bp, human
gctacaggaaagccacctgg

SEQ ID NO: 251813 - DNA, 20 bp, human
gtgagtggaggtttccagcg

SEQ ID NO: 251814 - DNA, 20 bp, human
gaagtgtagtccgctcgcgg

SEQ ID NO: 251815 - DNA, 20 bp, human
gcggcgaacgccatggtcgc

SEQ ID NO: 251816 - DNA, 20 bp, human
gaagtcggagactgtggagg

SEQ ID NO: 251817 - DNA, 20 bp, human
gcgcaagtcggagactgtgg

SEQ ID NO: 251818 - DNA, 20 bp, human
ggctcgcaagtcggagactg

SEQ ID NO: 251819 - DNA, 20 bp, human
gcgaccggggccgcccgctg

SEQ ID NO: 251820 - DNA, 20 bp, human
ggccccgacgccctggaatc

SEQ ID NO: 251821 - DNA, 20 bp, human
gaggtggcaaagcggtacgt

SEQ ID NO: 251822 - DNA, 20 bp, human
ggcgcccagcggcttcacct

SEQ ID NO: 251823 - DNA, 20 bp, human
ggtacgtgggccatcccagc

SEQ ID NO: 251824 - DNA, 20 bp, human
gctaccggcggagacggggg

SEQ ID NO: 251825 - DNA, 20 bp, human
gaatcaggaagtcgccggga

SEQ ID NO: 251826 - DNA, 20 bp, human
gagggcccaggcacgatggg

SEQ ID NO: 251827 - DNA, 20 bp, human
gggtccaccagtgaccgtcc

SEQ ID NO: 251828 - DNA, 20 bp, human
gctgcctgctaattatgttg

SEQ ID NO: 251829 - DNA, 20 bp, human
gtccaggccaaatggaccaa

SEQ ID NO: 251830 - DNA, 20 bp, human
gacctgtaaagtggacggtg

SEQ ID NO: 251831 - DNA, 20 bp, human
gatgagggcccaggcacgat

SEQ ID NO: 251832 - DNA, 20 bp, human
ggggatgggtgggcaataag

SEQ ID NO: 251833 - DNA, 20 bp, human
ggagccacctgtaaagtgga

SEQ ID NO: 251834 - DNA, 20 bp, human
gtggcctggacggtcactgg

SEQ ID NO: 251835 - DNA, 20 bp, human
gagacacagtccagcctggc

SEQ ID NO: 251836 - DNA, 20 bp, human
gccctcgcctctcggggtgg

SEQ ID NO: 251837 - DNA, 20 bp, human
gaggtggcttaacccttcct

SEQ ID NO: 251838 - DNA, 20 bp, human
ggcgcggcggggacccccag

SEQ ID NO: 251839 - DNA, 20 bp, human
gagaggcgagggggcgagtc

SEQ ID NO: 251840 - DNA, 20 bp, human
gtcactgggccgggcgggat

SEQ ID NO: 251841 - DNA, 20 bp, human
gggcgcccggccggttgcca

SEQ ID NO: 251842 - DNA, 20 bp, human
gcctgggagaggggttgccg

SEQ ID NO: 251843 - DNA, 20 bp, human
ggcacctcgcgaatccgccc

SEQ ID NO: 251844 - DNA, 20 bp, human
gctcccagaccgggcgggaa

SEQ ID NO: 251845 - DNA, 20 bp, human
gagggggcgagtccggcaga

SEQ ID NO: 251846 - DNA, 20 bp, human
gggaggcgggcatagcgtga

SEQ ID NO: 251847 - DNA, 20 bp, human
gtggccatacagcggacttg

SEQ ID NO: 251848 - DNA, 20 bp, human
gccgccggccggggcggtgt

SEQ ID NO: 251849 - DNA, 20 bp, human
gcaaggttctggccatacag

SEQ ID NO: 251850 - DNA, 20 bp, human
gcctgccgaaggccccgtcc

SEQ ID NO: 251851 - DNA, 20 bp, human
gatacagcggacttgaggcg

SEQ ID NO: 251852 - DNA, 20 bp, human
gcagcggacttgaggcgtgg

SEQ ID NO: 251853 - DNA, 20 bp, human
ggcgggcatagcgtgagggg

SEQ ID NO: 251854 - DNA, 20 bp, human
gtggtggttcccctcaccgc

SEQ ID NO: 251855 - DNA, 20 bp, human
gggcaaggctcagttcttat

SEQ ID NO: 251856 - DNA, 20 bp, human
ggggctaagggttttgaatc

SEQ ID NO: 251857 - DNA, 20 bp, human
gacaccctggggctcttggg

SEQ ID NO: 251858 - DNA, 20 bp, human
gtggctgaaagtagccggaa

SEQ ID NO: 251859 - DNA, 20 bp, human
gggtcatgagcaaacacctc

SEQ ID NO: 251860 - DNA, 20 bp, human
gctggctacttatgggctaa

SEQ ID NO: 251861 - DNA, 20 bp, human
gctggaaaccggctggtctc

SEQ ID NO: 251862 - DNA, 20 bp, human
ggactgtgggcactggaaac

SEQ ID NO: 251863 - DNA, 20 bp, human
gaaccggctggtctcaggat

SEQ ID NO: 251864 - DNA, 20 bp, human
ggaaagtagccggaaaggcc

SEQ ID NO: 251865 - DNA, 20 bp, human
gacctctggctgaaagtagc

SEQ ID NO: 251866 - DNA, 20 bp, human
gtcgctaagtcaagcctccc

SEQ ID NO: 251867 - DNA, 20 bp, human
gagacctggagatggtcgaa

SEQ ID NO: 251868 - DNA, 20 bp, human
gtccccgggagccccacgga

SEQ ID NO: 251869 - DNA, 20 bp, human
gagggctaaagcagttgcaa

SEQ ID NO: 251870 - DNA, 20 bp, human
gcccaaacgaatcccaaaag

SEQ ID NO: 251871 - DNA, 20 bp, human
gtccgcaaaagcgcatgtcc

SEQ ID NO: 251872 - DNA, 20 bp, human
gtagcccttcgaccatctcc

SEQ ID NO: 251873 - DNA, 20 bp, human
gacggagggtgggaacgagg

SEQ ID NO: 251874 - DNA, 20 bp, human
gccgggagccccacggaggg

SEQ ID NO: 251875 - DNA, 20 bp, human
gtgaaaagggaggagcggaa

SEQ ID NO: 251876 - DNA, 20 bp, human
gtctccccgcggtatcctct

SEQ ID NO: 251877 - DNA, 20 bp, human
ggcggggagacagagtttgg

SEQ ID NO: 251878 - DNA, 20 bp, human
gaccgcggggagacagagtt

SEQ ID NO: 251879 - DNA, 20 bp, human
gagccccagaggataccgcg

SEQ ID NO: 251880 - DNA, 20 bp, human
gcctagggaccgggacttgg

SEQ ID NO: 251881 - DNA, 20 bp, human
ggactgggcggggaggttct

SEQ ID NO: 251882 - DNA, 20 bp, human
ggcgctgcgagcgccgtctg

SEQ ID NO: 251883 - DNA, 20 bp, human
ggggcctggagtggcgtgcc

SEQ ID NO: 251884 - DNA, 20 bp, human
ggcagcacccgccctaggac

SEQ ID NO: 251885 - DNA, 20 bp, human
ggacctaccctggagagcgt

SEQ ID NO: 251886 - DNA, 20 bp, human
gtggccgcggaggctagagt

SEQ ID NO: 251887 - DNA, 20 bp, human
gaggctagagtcggagaaag

SEQ ID NO: 251888 - DNA, 20 bp, human
ggggccgagttgagggtcgt

SEQ ID NO: 251889 - DNA, 20 bp, human
gataatggggcggtgaaggt

SEQ ID NO: 251890 - DNA, 20 bp, human
gttggcaatgacggaagggg

SEQ ID NO: 251891 - DNA, 20 bp, human
gtctccgactctagcctccg

SEQ ID NO: 251892 - DNA, 20 bp, human
gctagagtcggagaaagagg

SEQ ID NO: 251893 - DNA, 20 bp, human
ggcccgcgagcaccaatcga

SEQ ID NO: 251894 - DNA, 20 bp, human
gcatcttggcaatgacggaa

SEQ ID NO: 251895 - DNA, 20 bp, human
gctgacccgacggggaacca

SEQ ID NO: 251896 - DNA, 20 bp, human
gcgccaccacacacacccat

SEQ ID NO: 251897 - DNA, 20 bp, human
gaggggaagctgcaactcag

SEQ ID NO: 251898 - DNA, 20 bp, human
ggtggtggggttaccattga

SEQ ID NO: 251899 - DNA, 20 bp, human
gtcagaggaagtcagcctat

SEQ ID NO: 251900 - DNA, 20 bp, human
ggctgtgctggcaccttcaa

SEQ ID NO: 251901 - DNA, 20 bp, human
gccccagagaacagggaata

SEQ ID NO: 251902 - DNA, 20 bp, human
gacttcctgaaacagtggag

SEQ ID NO: 251903 - DNA, 20 bp, human
gagttggaatctcagactat

SEQ ID NO: 251904 - DNA, 20 bp, human
gggtgcgcaggtcctgcgga

SEQ ID NO: 251905 - DNA, 20 bp, human
gtaaggaatctcatagagcc

SEQ ID NO: 251906 - DNA, 20 bp, human
gcggccctctgggtcgcctg

SEQ ID NO: 251907 - DNA, 20 bp, human
ggaggcacgggctggatggt

SEQ ID NO: 251908 - DNA, 20 bp, human
gtgggtcctgcagtcagatg

SEQ ID NO: 251909 - DNA, 20 bp, human
gtgcaggacccaggcgggaa

SEQ ID NO: 251910 - DNA, 20 bp, human
ggagcgcgccgcggccctct

SEQ ID NO: 251911 - DNA, 20 bp, human
gtcctgaggcacgggctgga

SEQ ID NO: 251912 - DNA, 20 bp, human
gtagtctacggggacccagg

SEQ ID NO: 251913 - DNA, 20 bp, human
gggcgcaggtgaagtcccga

SEQ ID NO: 251914 - DNA, 20 bp, human
gctgaccccaggcgacccag

SEQ ID NO: 251915 - DNA, 20 bp, human
gtgggaagctacctgggtgc

SEQ ID NO: 251916 - DNA, 20 bp, human
gacgctgaggaggggatcgg

SEQ ID NO: 251917 - DNA, 20 bp, human
gccgcgcgaacgctgaggag

SEQ ID NO: 251918 - DNA, 20 bp, human
gcagactggcggtgtgatgt

SEQ ID NO: 251919 - DNA, 20 bp, human
gaggggatcggaggcccgca

SEQ ID NO: 251920 - DNA, 20 bp, human
gctcggccgcgcgaacgctg

SEQ ID NO: 251921 - DNA, 20 bp, human
ggacccctgtgcgacccccg

SEQ ID NO: 251922 - DNA, 20 bp, human
gtgtggaaaggggcggaagg

SEQ ID NO: 251923 - DNA, 20 bp, human
ggccccgcgggggtcgcaca

SEQ ID NO: 251924 - DNA, 20 bp, human
gccgcccccgcaggaggaaa

SEQ ID NO: 251925 - DNA, 20 bp, human
gtggggagaaagcgctctgg

SEQ ID NO: 251926 - DNA, 20 bp, human
gtgcgctgcggcgacctccc

SEQ ID NO: 251927 - DNA, 20 bp, human
ggcgacctcccgggaagctg

SEQ ID NO: 251928 - DNA, 20 bp, human
gcgggcgaccaagcagtcac

SEQ ID NO: 251929 - DNA, 20 bp, human
ggagcccgccccctcccaga

SEQ ID NO: 251930 - DNA, 20 bp, human
gccgggggagtggcagttgc

SEQ ID NO: 251931 - DNA, 20 bp, human
gtgcgcaggcgccgtctggg

SEQ ID NO: 251932 - DNA, 20 bp, human
gaaggccgcgctaagatctc

SEQ ID NO: 251933 - DNA, 20 bp, human
gctaaaggagtctcaatccc

SEQ ID NO: 251934 - DNA, 20 bp, human
gcctgcgcaggcgcggtagg

SEQ ID NO: 251935 - DNA, 20 bp, human
gaggatgacgtgatgctctt

SEQ ID NO: 251936 - DNA, 20 bp, human
ggacccgcgggcgccagacg

SEQ ID NO: 251937 - DNA, 20 bp, human
gtcggcgcgtgcgacggaga

SEQ ID NO: 251938 - DNA, 20 bp, human
ggccccggctgcggcatcga

SEQ ID NO: 251939 - DNA, 20 bp, human
gcgcccgcgggtcagctgag

SEQ ID NO: 251940 - DNA, 20 bp, human
gcgcgtgcgacggagagggg

SEQ ID NO: 251941 - DNA, 20 bp, human
gccgccgcgtctggcgcccg

SEQ ID NO: 251942 - DNA, 20 bp, human
gcgcgcgcgcctagcgggtt

SEQ ID NO: 251943 - DNA, 20 bp, human
gcggggctcggcgcgtgcga

SEQ ID NO: 251944 - DNA, 20 bp, human
gagcgcagctgcggctgcga

SEQ ID NO: 251945 - DNA, 20 bp, human
ggtggggggcgcgctcgcga

SEQ ID NO: 251946 - DNA, 20 bp, human
ggaccctgggagcggacgtg

SEQ ID NO: 251947 - DNA, 20 bp, human
ggggacccactcagtccggg

SEQ ID NO: 251948 - DNA, 20 bp, human
gagccccgcccggactgagt

SEQ ID NO: 251949 - DNA, 20 bp, human
gctgcgggtcacgtgaccct

SEQ ID NO: 251950 - DNA, 20 bp, human
gcggaggcaagcgcgctctg

SEQ ID NO: 251951 - DNA, 20 bp, human
ggtccccacgtccgctccca

SEQ ID NO: 251952 - DNA, 20 bp, human
gtggtcgttgactgcgaacg

SEQ ID NO: 251953 - DNA, 20 bp, human
ggtcacgctgccgcttgtct

SEQ ID NO: 251954 - DNA, 20 bp, human
gaggcggcgcgaacggtcag

SEQ ID NO: 251955 - DNA, 20 bp, human
gagcgcgcttgcctccgcgc

SEQ ID NO: 251956 - DNA, 20 bp, human
gtccccggaagtcccccagt

SEQ ID NO: 251957 - DNA, 20 bp, human
gcggccgctcgactgttctg

SEQ ID NO: 251958 - DNA, 20 bp, human
ggggccgaaccgactctctc

SEQ ID NO: 251959 - DNA, 20 bp, human
ggagccgcactgggccgcgg

SEQ ID NO: 251960 - DNA, 20 bp, human
gccggccgctggcgcttctc

SEQ ID NO: 251961 - DNA, 20 bp, human
gaggcccgagagagtcggtt

SEQ ID NO: 251962 - DNA, 20 bp, human
gagccgggatccgcgaacac

SEQ ID NO: 251963 - DNA, 20 bp, human
ggcccactgggggacttccg

SEQ ID NO: 251964 - DNA, 20 bp, human
gagagcggccggagcccact

SEQ ID NO: 251965 - DNA, 20 bp, human
gagacggcgtggaccctgga

SEQ ID NO: 251966 - DNA, 20 bp, human
ggcgagaagccggaagacgg

SEQ ID NO: 251967 - DNA, 20 bp, human
gtggccacgccccccaccgg

SEQ ID NO: 251968 - DNA, 20 bp, human
gggcggtgctcgtcacccgt

SEQ ID NO: 251969 - DNA, 20 bp, human
gcgtgcgccttgccctccgg

SEQ ID NO: 251970 - DNA, 20 bp, human
gctgccggcggcccgcctct

SEQ ID NO: 251971 - DNA, 20 bp, human
gcgggggcggagaaaaattg

SEQ ID NO: 251972 - DNA, 20 bp, human
ggcgtggccaagaggccgag

SEQ ID NO: 251973 - DNA, 20 bp, human
gatcctcggactcattaata

SEQ ID NO: 251974 - DNA, 20 bp, human
ggaggatgaatcctcgagat

SEQ ID NO: 251975 - DNA, 20 bp, human
ggagcgtgcgccttgccctc

SEQ ID NO: 251976 - DNA, 20 bp, human
gctcgggaaggagtcggcga

SEQ ID NO: 251977 - DNA, 20 bp, human
gggagggagaaacagcgcca

SEQ ID NO: 251978 - DNA, 20 bp, human
gtggcctgggaccgcctcga

SEQ ID NO: 251979 - DNA, 20 bp, human
gcgagcctgtcccatcgagg

SEQ ID NO: 251980 - DNA, 20 bp, human
ggggaccgcctcgatgggac

SEQ ID NO: 251981 - DNA, 20 bp, human
ggccgctcggctgcgtcctg

SEQ ID NO: 251982 - DNA, 20 bp, human
gcagtagctggcgcgggctg

SEQ ID NO: 251983 - DNA, 20 bp, human
ggccacagccaggctcggga

SEQ ID NO: 251984 - DNA, 20 bp, human
gccgcctcgccgtagaccgc

SEQ ID NO: 251985 - DNA, 20 bp, human
ggtcctggggctccagtagc

SEQ ID NO: 251986 - DNA, 20 bp, human
gcggcgcggcagcacgtcac

SEQ ID NO: 251987 - DNA, 20 bp, human
gtgctcgcacggtgggacca

SEQ ID NO: 251988 - DNA, 20 bp, human
gtcaccggaaatgcgcgggg

SEQ ID NO: 251989 - DNA, 20 bp, human
ggcgtcttctccgagacccg

SEQ ID NO: 251990 - DNA, 20 bp, human
gctcccagcgccgcgggtct

SEQ ID NO: 251991 - DNA, 20 bp, human
gcacgtcaccggaaatgcgc

SEQ ID NO: 251992 - DNA, 20 bp, human
gtccgcgtgcgaacttgccc

SEQ ID NO: 251993 - DNA, 20 bp, human
gcggaaatgcgcggggaggc

SEQ ID NO: 251994 - DNA, 20 bp, human
gcggacgcagaaatctggga

SEQ ID NO: 251995 - DNA, 20 bp, human
gcgcacggtgggaccagggt

SEQ ID NO: 251996 - DNA, 20 bp, human
ggaccggggacgaagagtaa

SEQ ID NO: 251997 - DNA, 20 bp, human
gcggggacgaagagtaaggg

SEQ ID NO: 251998 - DNA, 20 bp, human
gccgccccacctgacacccg

SEQ ID NO: 251999 - DNA, 20 bp, human
gcccccgcggccgcaaacgt

SEQ ID NO: 252000 - DNA, 20 bp, human
gccggggcggagagaagtac

SEQ ID NO: 252001 - DNA, 20 bp, human
gacgtcacttcctgccggtt

SEQ ID NO: 252002 - DNA, 20 bp, human
gcgcaaacgtcggagctaga

SEQ ID NO: 252003 - DNA, 20 bp, human
gtccgccccgggtgtcaggt

SEQ ID NO: 252004 - DNA, 20 bp, human
gctcccggagccggcgagga

SEQ ID NO: 252005 - DNA, 20 bp, human
ggcatgacgtcacttcctgc

SEQ ID NO: 252006 - DNA, 20 bp, human
gaacgccaggaggtggccca

SEQ ID NO: 252007 - DNA, 20 bp, human
gggcctccgtctcgtctcgg

SEQ ID NO: 252008 - DNA, 20 bp, human
gagaacccgcgccgctccgg

SEQ ID NO: 252009 - DNA, 20 bp, human
gcgctccggtggctccgccc

SEQ ID NO: 252010 - DNA, 20 bp, human
gggctctagtgctcgagggc

SEQ ID NO: 252011 - DNA, 20 bp, human
gcgggaggctctagtgctcg

SEQ ID NO: 252012 - DNA, 20 bp, human
ggacggaggcccggcgagag

SEQ ID NO: 252013 - DNA, 20 bp, human
gcatccggggctcgagccgg

SEQ ID NO: 252014 - DNA, 20 bp, human
gccgggcctccgtctcgtct

SEQ ID NO: 252015 - DNA, 20 bp, human
gtgcggccaccgagacgaga

SEQ ID NO: 252016 - DNA, 20 bp, human
ggcggtggtcggggacaaag

SEQ ID NO: 252017 - DNA, 20 bp, human
gtgccggtcacgtgtctctc

SEQ ID NO: 252018 - DNA, 20 bp, human
ggggcgcgatgccacgcgag

SEQ ID NO: 252019 - DNA, 20 bp, human
gccagcgatccaagtttcct

SEQ ID NO: 252020 - DNA, 20 bp, human
gctggtcccgagttaatcta

SEQ ID NO: 252021 - DNA, 20 bp, human
gatgccacgcgagcggtggt

SEQ ID NO: 252022 - DNA, 20 bp, human
gacaaagcggttccctgggc

SEQ ID NO: 252023 - DNA, 20 bp, human
ggcctgccgtagattaactc

SEQ ID NO: 252024 - DNA, 20 bp, human
gcgccgcgggctacgttcag

SEQ ID NO: 252025 - DNA, 20 bp, human
ggccgcggttcgaatcccgc

SEQ ID NO: 252026 - DNA, 20 bp, human
gtagagcccctcatggtcgg

SEQ ID NO: 252027 - DNA, 20 bp, human
gagagggaatccctatgggt

SEQ ID NO: 252028 - DNA, 20 bp, human
ggagctgccccgaacaaaga

SEQ ID NO: 252029 - DNA, 20 bp, human
gcccgccccccgaccatgag

SEQ ID NO: 252030 - DNA, 20 bp, human
gctggagagggaatccctat

SEQ ID NO: 252031 - DNA, 20 bp, human
ggaggaaaatataaacatct

SEQ ID NO: 252032 - DNA, 20 bp, human
gcagacgcgctgggctagtc

SEQ ID NO: 252033 - DNA, 20 bp, human
ggcagctccgctgctctgac

SEQ ID NO: 252034 - DNA, 20 bp, human
gcccagaaacttgagcttgg

SEQ ID NO: 252035 - DNA, 20 bp, human
gcggggggcggggccgatgg

SEQ ID NO: 252036 - DNA, 20 bp, human
gtacctcgtggagaagacgg

SEQ ID NO: 252037 - DNA, 20 bp, human
ggctacgaggtctgtaccct

SEQ ID NO: 252038 - DNA, 20 bp, human
gttgcggagcaatattccta

SEQ ID NO: 252039 - DNA, 20 bp, human
gcggtacctcgtggagaaga

SEQ ID NO: 252040 - DNA, 20 bp, human
ggtcgcgggcccgggctacg

SEQ ID NO: 252041 - DNA, 20 bp, human
gtctccacgaggtaccgaac

SEQ ID NO: 252042 - DNA, 20 bp, human
gcgggcccgcgactccgccc

SEQ ID NO: 252043 - DNA, 20 bp, human
gtcgtggagaagacggggga

SEQ ID NO: 252044 - DNA, 20 bp, human
gcgctcccggggcggagtcg

SEQ ID NO: 252045 - DNA, 20 bp, human
gagcgctccagctggcggga

SEQ ID NO: 252046 - DNA, 20 bp, human
gttaccgcccggccgaggct

SEQ ID NO: 252047 - DNA, 20 bp, human
gccgaggctcggcgtcctgg

SEQ ID NO: 252048 - DNA, 20 bp, human
gagagcgactacacgactgg

SEQ ID NO: 252049 - DNA, 20 bp, human
gctcggccgggcggtaaaat

SEQ ID NO: 252050 - DNA, 20 bp, human
gacgccgagcctcggccggg

SEQ ID NO: 252051 - DNA, 20 bp, human
gctacctggctccgcccccc

SEQ ID NO: 252052 - DNA, 20 bp, human
gccacctggagggtatttaa

SEQ ID NO: 252053 - DNA, 20 bp, human
gagaagtcccgccgcttaaa

SEQ ID NO: 252054 - DNA, 20 bp, human
gggtagagcgactacacgac

SEQ ID NO: 252055 - DNA, 20 bp, human
gtcgtccgcggtcgccggaa

SEQ ID NO: 252056 - DNA, 20 bp, human
gtggcgacgcaactcgtgat

SEQ ID NO: 252057 - DNA, 20 bp, human
gcgggcgggaaagttagctg

SEQ ID NO: 252058 - DNA, 20 bp, human
gcgggaaagttagctgtggc

SEQ ID NO: 252059 - DNA, 20 bp, human
gatgacagaaaggggccggg

SEQ ID NO: 252060 - DNA, 20 bp, human
gcggttgcttggcgttgatt

SEQ ID NO: 252061 - DNA, 20 bp, human
gatactctcgcgttcctgat

SEQ ID NO: 252062 - DNA, 20 bp, human
ggggaaaaacgagtaagtac

SEQ ID NO: 252063 - DNA, 20 bp, human
ggccggcggggattggcaga

SEQ ID NO: 252064 - DNA, 20 bp, human
gcgacgcaactcgtgattgg

SEQ ID NO: 252065 - DNA, 20 bp, human
gtggcggatgtgcgttcctt

SEQ ID NO: 252066 - DNA, 20 bp, human
gaggggcggaaagggagagt

SEQ ID NO: 252067 - DNA, 20 bp, human
gagagtgggcgggtagaggc

SEQ ID NO: 252068 - DNA, 20 bp, human
ggagcccgacagccaatgga

SEQ ID NO: 252069 - DNA, 20 bp, human
gagggaaattaggggcggaa

SEQ ID NO: 252070 - DNA, 20 bp, human
ggtagaggctggtggccaat

SEQ ID NO: 252071 - DNA, 20 bp, human
gaggaagaagagggaaatta

SEQ ID NO: 252072 - DNA, 20 bp, human
gggccaatgggcaggcgcca

SEQ ID NO: 252073 - DNA, 20 bp, human
gaaccttggcgcctgcccat

SEQ ID NO: 252074 - DNA, 20 bp, human
gcccgcccccgtggtgtcgt

SEQ ID NO: 252075 - DNA, 20 bp, human
gggcggggctaagatcgtat

SEQ ID NO: 252076 - DNA, 20 bp, human
ggacccccgctggctgactc

SEQ ID NO: 252077 - DNA, 20 bp, human
gcccctgagtcagccagcgg

SEQ ID NO: 252078 - DNA, 20 bp, human
gaggccagctcccccgcaag

SEQ ID NO: 252079 - DNA, 20 bp, human
gccagcgggggtcctgtgac

SEQ ID NO: 252080 - DNA, 20 bp, human
gctggctgactcaggggcgc

SEQ ID NO: 252081 - DNA, 20 bp, human
ggcctgccctggcgaaggat

SEQ ID NO: 252082 - DNA, 20 bp, human
gccaggacgaggagataacc

SEQ ID NO: 252083 - DNA, 20 bp, human
gtggcaggcttgcccgtcac

SEQ ID NO: 252084 - DNA, 20 bp, human
ggggatcttgcagctgtcag

SEQ ID NO: 252085 - DNA, 20 bp, human
ggccctggcgaaggattggc

SEQ ID NO: 252086 - DNA, 20 bp, human
gggaggtcacacagtctggt

SEQ ID NO: 252087 - DNA, 20 bp, human
gggtggggacatagacttca

SEQ ID NO: 252088 - DNA, 20 bp, human
gacccacccagggagggcac

SEQ ID NO: 252089 - DNA, 20 bp, human
gggtccaggacagagcggga

SEQ ID NO: 252090 - DNA, 20 bp, human
gagtggcccaatctctgccc

SEQ ID NO: 252091 - DNA, 20 bp, human
gcttcaagggtgtggctcct

SEQ ID NO: 252092 - DNA, 20 bp, human
gactggccgggggctgacca

SEQ ID NO: 252093 - DNA, 20 bp, human
ggacacagtttctaacccca

SEQ ID NO: 252094 - DNA, 20 bp, human
gcgggtgataaagctggcag

SEQ ID NO: 252095 - DNA, 20 bp, human
gcgggggctgaccagggggt

SEQ ID NO: 252096 - DNA, 20 bp, human
ggtgcgcactatatcgcgtc

SEQ ID NO: 252097 - DNA, 20 bp, human
gacataggtagaagctggtt

SEQ ID NO: 252098 - DNA, 20 bp, human
gggggcggggctctcgctga

SEQ ID NO: 252099 - DNA, 20 bp, human
gcatgcgcgggccctgtact

SEQ ID NO: 252100 - DNA, 20 bp, human
gacatgcgtgatgacgtaga

SEQ ID NO: 252101 - DNA, 20 bp, human
gagggcccacacggaagagg

SEQ ID NO: 252102 - DNA, 20 bp, human
ggacgtagagggcgttgatt

SEQ ID NO: 252103 - DNA, 20 bp, human
gcagggacataggtagaagc

SEQ ID NO: 252104 - DNA, 20 bp, human
gtccctgcgccaaaggtaag

SEQ ID NO: 252105 - DNA, 20 bp, human
ggatgggttggctttcgtca

SEQ ID NO: 252106 - DNA, 20 bp, human
gcggccgagaaccagagcgc

SEQ ID NO: 252107 - DNA, 20 bp, human
ggcagggagttgtagtcgaa

SEQ ID NO: 252108 - DNA, 20 bp, human
gcgggcgccaggcgccccgg

SEQ ID NO: 252109 - DNA, 20 bp, human
ggcggcagacacgtggggaa

SEQ ID NO: 252110 - DNA, 20 bp, human
gtctgcacttatagtagcaa

SEQ ID NO: 252111 - DNA, 20 bp, human
gtccccgttcctccaggacg

SEQ ID NO: 252112 - DNA, 20 bp, human
gacctcgggacctaaaatgg

SEQ ID NO: 252113 - DNA, 20 bp, human
ggccgacaggagcgtctgtg

SEQ ID NO: 252114 - DNA, 20 bp, human
ggacggggccggaccgttgg

SEQ ID NO: 252115 - DNA, 20 bp, human
gagacacgtggggaaaggcg

SEQ ID NO: 252116 - DNA, 20 bp, human
gggaaggatcgaagccgtag

SEQ ID NO: 252117 - DNA, 20 bp, human
ggggactcacagagattgcc

SEQ ID NO: 252118 - DNA, 20 bp, human
gctgccggggagggtctgac

SEQ ID NO: 252119 - DNA, 20 bp, human
gcacccttgtgcccggagga

SEQ ID NO: 252120 - DNA, 20 bp, human
gaactgcggcccagcaaaaa

SEQ ID NO: 252121 - DNA, 20 bp, human
gccagcaaaaagggaagtag

SEQ ID NO: 252122 - DNA, 20 bp, human
ggcgcgcacagaacaggctg

SEQ ID NO: 252123 - DNA, 20 bp, human
gggggaggcgcgcacagaac

SEQ ID NO: 252124 - DNA, 20 bp, human
ggagtcctggggcatggcgg

SEQ ID NO: 252125 - DNA, 20 bp, human
gagggaggagcctgccgggg

SEQ ID NO: 252126 - DNA, 20 bp, human
gcagacgctagggccccgag

SEQ ID NO: 252127 - DNA, 20 bp, human
ggaaagcaactcagacgcta

SEQ ID NO: 252128 - DNA, 20 bp, human
gcccgaggggcggagcgaag

SEQ ID NO: 252129 - DNA, 20 bp, human
gctgagggcagacccgaacc

SEQ ID NO: 252130 - DNA, 20 bp, human
gtcgctctgcgtatcgaata

SEQ ID NO: 252131 - DNA, 20 bp, human
gcggccggagccaatcagcg

SEQ ID NO: 252132 - DNA, 20 bp, human
gcgaagcggtacccgccccc

SEQ ID NO: 252133 - DNA, 20 bp, human
ggggccccgagctcattggc

SEQ ID NO: 252134 - DNA, 20 bp, human
gctaaggccgcaaaagccga

SEQ ID NO: 252135 - DNA, 20 bp, human
gaatgagctcggggcccctc

SEQ ID NO: 252136 - DNA, 20 bp, human
gctcccggcaggctgcggaa

SEQ ID NO: 252137 - DNA, 20 bp, human
gcgacgccacacgtgattag

SEQ ID NO: 252138 - DNA, 20 bp, human
ggtgtggcgtcgaagcatgc

SEQ ID NO: 252139 - DNA, 20 bp, human
gtcgcgcgatagaacgaaag

SEQ ID NO: 252140 - DNA, 20 bp, human
gtgccggaaactgtagtctc

SEQ ID NO: 252141 - DNA, 20 bp, human
gacgtgagaccagggcacgc

SEQ ID NO: 252142 - DNA, 20 bp, human
gcaaatcacacgtgagacca

SEQ ID NO: 252143 - DNA, 20 bp, human
gagttgccgctaatcacgtg

SEQ ID NO: 252144 - DNA, 20 bp, human
gcggaagggggtcgagtaga

SEQ ID NO: 252145 - DNA, 20 bp, human
gcaactagaactacatttcc

SEQ ID NO: 252146 - DNA, 20 bp, human
gcgcgcctgcgcacaagggg

SEQ ID NO: 252147 - DNA, 20 bp, human
gaccctgagggccagagtag

SEQ ID NO: 252148 - DNA, 20 bp, human
gctggtgtgcccaggtgccg

SEQ ID NO: 252149 - DNA, 20 bp, human
gtccgctactctggccctca

SEQ ID NO: 252150 - DNA, 20 bp, human
gaggccgcgcctgcgcacaa

SEQ ID NO: 252151 - DNA, 20 bp, human
gggaaactacacaaccctga

SEQ ID NO: 252152 - DNA, 20 bp, human
gcggggtcgcgcacgcgcag

SEQ ID NO: 252153 - DNA, 20 bp, human
gcctgcgcacaagaccgcgt

SEQ ID NO: 252154 - DNA, 20 bp, human
gaggctgcggccggggctat

SEQ ID NO: 252155 - DNA, 20 bp, human
gtaaggtaatgtggtgtccg

SEQ ID NO: 252156 - DNA, 20 bp, human
gaggggaagcggctctctct

SEQ ID NO: 252157 - DNA, 20 bp, human
gtagcggcaggcctaagtgt

SEQ ID NO: 252158 - DNA, 20 bp, human
ggaaaagcgcgcggggactc

SEQ ID NO: 252159 - DNA, 20 bp, human
gcctccggcggccagtcccg

SEQ ID NO: 252160 - DNA, 20 bp, human
ggactggccgccggaggctg

SEQ ID NO: 252161 - DNA, 20 bp, human
ggggcgcccggaccgagcaa

SEQ ID NO: 252162 - DNA, 20 bp, human
ggcagcccactcttcccgag

SEQ ID NO: 252163 - DNA, 20 bp, human
gcccctcccgcagcctccgg

SEQ ID NO: 252164 - DNA, 20 bp, human
gcgctgggccgtcagcaacc

SEQ ID NO: 252165 - DNA, 20 bp, human
gcgtgcctggagtagtatct

SEQ ID NO: 252166 - DNA, 20 bp, human
gtgaacgcggcggtaggggt

SEQ ID NO: 252167 - DNA, 20 bp, human
gaagaaaggggtgaacgcgg

SEQ ID NO: 252168 - DNA, 20 bp, human
gagacggcgtcggaactcgc

SEQ ID NO: 252169 - DNA, 20 bp, human
gtggccgttgcctggagacg

SEQ ID NO: 252170 - DNA, 20 bp, human
gaggggtgaacgcggcggta

SEQ ID NO: 252171 - DNA, 20 bp, human
gccggcggggtaggggacgc

SEQ ID NO: 252172 - DNA, 20 bp, human
ggggaagaaaggggtgaacg

SEQ ID NO: 252173 - DNA, 20 bp, human
gcggctctgccggcggggta

SEQ ID NO: 252174 - DNA, 20 bp, human
gcctgaggagcccgtgggga

SEQ ID NO: 252175 - DNA, 20 bp, human
gacggccaggcgcaccgggc

SEQ ID NO: 252176 - DNA, 20 bp, human
ggacaggggcggagttgggc

SEQ ID NO: 252177 - DNA, 20 bp, human
gaagggacaggggcggagtt

SEQ ID NO: 252178 - DNA, 20 bp, human
gaagggggcggaccctggaa

SEQ ID NO: 252179 - DNA, 20 bp, human
gcccgcagaggagcagcgag

SEQ ID NO: 252180 - DNA, 20 bp, human
gctgaccagcctgtagtaac

SEQ ID NO: 252181 - DNA, 20 bp, human
gagcagcgagggggcgtagc

SEQ ID NO: 252182 - DNA, 20 bp, human
gccgggacggaggcccgcag

SEQ ID NO: 252183 - DNA, 20 bp, human
gaccctgcctgccccctcgc

SEQ ID NO: 252184 - DNA, 20 bp, human
gcggagttgggccgggacgg

SEQ ID NO: 252185 - DNA, 20 bp, human
gagccttggtgccgtagctc

SEQ ID NO: 252186 - DNA, 20 bp, human
gcaccggcgcagaacaccct

SEQ ID NO: 252187 - DNA, 20 bp, human
gcgccggcgcagagcaccct

SEQ ID NO: 252188 - DNA, 20 bp, human
gacggggcgcagggcaccct

SEQ ID NO: 252189 - DNA, 20 bp, human
gccgcggccgacctgaggcg

SEQ ID NO: 252190 - DNA, 20 bp, human
ggggccgcaagtgcgcgcag

SEQ ID NO: 252191 - DNA, 20 bp, human
gaccacgcgggagcgatgca

SEQ ID NO: 252192 - DNA, 20 bp, human
gaccccgtgtgtacacaagt

SEQ ID NO: 252193 - DNA, 20 bp, human
ggtcggccgcggactacaaa

SEQ ID NO: 252194 - DNA, 20 bp, human
gttctgcgccggtgcggccg

SEQ ID NO: 252195 - DNA, 20 bp, human
gtgtacacaagtgggacgag

SEQ ID NO: 252196 - DNA, 20 bp, human
ggatccggggaatgcgtgag

SEQ ID NO: 252197 - DNA, 20 bp, human
gcacgtgcggtgcaggcaga

SEQ ID NO: 252198 - DNA, 20 bp, human
gcgggccgtaccaatctccg

SEQ ID NO: 252199 - DNA, 20 bp, human
gagggagcgaggggaataac

SEQ ID NO: 252200 - DNA, 20 bp, human
gcccgcgccacttgcttgtg

SEQ ID NO: 252201 - DNA, 20 bp, human
ggcgcccggggtcggactga

SEQ ID NO: 252202 - DNA, 20 bp, human
gcctgctccgcgcggatccg

SEQ ID NO: 252203 - DNA, 20 bp, human
gggcgcgccccttggaagca

SEQ ID NO: 252204 - DNA, 20 bp, human
gtatcacctcacaacggggc

SEQ ID NO: 252205 - DNA, 20 bp, human
gccggcggccagtacccggg

SEQ ID NO: 252206 - DNA, 20 bp, human
gagacaaagggtaaccacta

SEQ ID NO: 252207 - DNA, 20 bp, human
gtggagaaaggatactactg

SEQ ID NO: 252208 - DNA, 20 bp, human
gctggggcggctctagctgt

SEQ ID NO: 252209 - DNA, 20 bp, human
gcgcaggaagagagtatctt

SEQ ID NO: 252210 - DNA, 20 bp, human
gttaagcagggaaaggtagt

SEQ ID NO: 252211 - DNA, 20 bp, human
ggtagtggggtgcttttcgg

SEQ ID NO: 252212 - DNA, 20 bp, human
gtgtgggtaggaagttgggg

SEQ ID NO: 252213 - DNA, 20 bp, human
gtggggctgtttttctgcac

SEQ ID NO: 252214 - DNA, 20 bp, human
gaagtcccttttcttaagca

SEQ ID NO: 252215 - DNA, 20 bp, human
gtgcaacctgatgtgtgggt

SEQ ID NO: 252216 - DNA, 20 bp, human
gaatagcgcggggcaggaca

SEQ ID NO: 252217 - DNA, 20 bp, human
gtggcggggaggatgctata

SEQ ID NO: 252218 - DNA, 20 bp, human
ggtcaatgctgtgaacacga

SEQ ID NO: 252219 - DNA, 20 bp, human
gtgacgtcagaacggagcgc

SEQ ID NO: 252220 - DNA, 20 bp, human
ggacaagcatgaatagcgcg

SEQ ID NO: 252221 - DNA, 20 bp, human
gcgcaggcgcctccaatagt

SEQ ID NO: 252222 - DNA, 20 bp, human
gaggcgcgtcacagggtgga

SEQ ID NO: 252223 - DNA, 20 bp, human
gagcatgaatagcgcggggc

SEQ ID NO: 252224 - DNA, 20 bp, human
ggggactgcaccatttgcgc

SEQ ID NO: 252225 - DNA, 20 bp, human
ggcctccaatagttggccaa

SEQ ID NO: 252226 - DNA, 20 bp, human
ggcggagggcggggacctaa

SEQ ID NO: 252227 - DNA, 20 bp, human
gactgaggggcgggctctaa

SEQ ID NO: 252228 - DNA, 20 bp, human
gaggcctaaggtcgcgacgg

SEQ ID NO: 252229 - DNA, 20 bp, human
gctaaggtcgcgacggcgga

SEQ ID NO: 252230 - DNA, 20 bp, human
gagggcggggacctaagggc

SEQ ID NO: 252231 - DNA, 20 bp, human
ggtgaggcctaaggtcgcga

SEQ ID NO: 252232 - DNA, 20 bp, human
gaggggcgggctctaaggga

SEQ ID NO: 252233 - DNA, 20 bp, human
gagccaaagccctccgaaga

SEQ ID NO: 252234 - DNA, 20 bp, human
gaggcctcaccctcttcgga

SEQ ID NO: 252235 - DNA, 20 bp, human
gacctaagggcggggactga

SEQ ID NO: 252236 - DNA, 20 bp, human
gcagccaccacggagggacg

SEQ ID NO: 252237 - DNA, 20 bp, human
ggacgcgccccgtccctccg

SEQ ID NO: 252238 - DNA, 20 bp, human
gtctgaatgacgcaaggggc

SEQ ID NO: 252239 - DNA, 20 bp, human
gtccttgcagccaccacgga

SEQ ID NO: 252240 - DNA, 20 bp, human
gtccctccgtggtggctgca

SEQ ID NO: 252241 - DNA, 20 bp, human
ggcgaggcgcgccgcgatcg

SEQ ID NO: 252242 - DNA, 20 bp, human
gggcggggcgcgctgcgcta

SEQ ID NO: 252243 - DNA, 20 bp, human
gtctccttctgaatgacgca

SEQ ID NO: 252244 - DNA, 20 bp, human
gatcggggactgtcctaaga

SEQ ID NO: 252245 - DNA, 20 bp, human
gcggccgagcagtggtgttg

SEQ ID NO: 252246 - DNA, 20 bp, human
gggcgcgccccgctcctctg

SEQ ID NO: 252247 - DNA, 20 bp, human
gctcctctgcggagactcca

SEQ ID NO: 252248 - DNA, 20 bp, human
gagcaggcaggtgcgagcct

SEQ ID NO: 252249 - DNA, 20 bp, human
ggctccccgcgcgacattaa

SEQ ID NO: 252250 - DNA, 20 bp, human
ggagtctccgcagaggagcg

SEQ ID NO: 252251 - DNA, 20 bp, human
gtggtcctgcgatatccaga

SEQ ID NO: 252252 - DNA, 20 bp, human
gccccgccgcctgcttattc

SEQ ID NO: 252253 - DNA, 20 bp, human
gctcctgaataagcaggcgg

SEQ ID NO: 252254 - DNA, 20 bp, human
gctccttggagtctccgcag

SEQ ID NO: 252255 - DNA, 20 bp, human
ggcgtgggacaatcgtaaaa

SEQ ID NO: 252256 - DNA, 20 bp, human
ggcggggctcgctggactga

SEQ ID NO: 252257 - DNA, 20 bp, human
gagtccagcgagccccgcct

SEQ ID NO: 252258 - DNA, 20 bp, human
gcgggagggaccaggcgccc

SEQ ID NO: 252259 - DNA, 20 bp, human
gctaacagtcgctgcccagg

SEQ ID NO: 252260 - DNA, 20 bp, human
ggccgggagcaggggagcgc

SEQ ID NO: 252261 - DNA, 20 bp, human
gcgcgcgcggcccaatagcg

SEQ ID NO: 252262 - DNA, 20 bp, human
gcgcggccgccccgcattgg

SEQ ID NO: 252263 - DNA, 20 bp, human
gcccaatagcgcggccgcgc

SEQ ID NO: 252264 - DNA, 20 bp, human
gggggagcgcgggaagctcg

SEQ ID NO: 252265 - DNA, 20 bp, human
gtgcggaggccgccaatcgg

SEQ ID NO: 252266 - DNA, 20 bp, human
gaagccccggacatattcga

SEQ ID NO: 252267 - DNA, 20 bp, human
gtcgggcataggttgaagag

SEQ ID NO: 252268 - DNA, 20 bp, human
ggggagacctctgactagaa

SEQ ID NO: 252269 - DNA, 20 bp, human
ggcccggcgcccccgactct

SEQ ID NO: 252270 - DNA, 20 bp, human
gcctccctcgaatatgtccg

SEQ ID NO: 252271 - DNA, 20 bp, human
gaatacatgaggccctctag

SEQ ID NO: 252272 - DNA, 20 bp, human
gtcgaagttcccagagtcgg

SEQ ID NO: 252273 - DNA, 20 bp, human
gcccacccccaggtgtaaga

SEQ ID NO: 252274 - DNA, 20 bp, human
gctgctgagtaatagggttt

SEQ ID NO: 252275 - DNA, 20 bp, human
gggtaggagggagttagaca

SEQ ID NO: 252276 - DNA, 20 bp, human
ggctcaggggaaaatgagac

SEQ ID NO: 252277 - DNA, 20 bp, human
gtaacctcggagcaggtgac

SEQ ID NO: 252278 - DNA, 20 bp, human
gaccactcactatacatctc

SEQ ID NO: 252279 - DNA, 20 bp, human
gagaggagcggggatgaagt

SEQ ID NO: 252280 - DNA, 20 bp, human
gcggcagccagagataggca

SEQ ID NO: 252281 - DNA, 20 bp, human
gccctgagatgtatagtgag

SEQ ID NO: 252282 - DNA, 20 bp, human
gtacttccaggcagcaacac

SEQ ID NO: 252283 - DNA, 20 bp, human
gtacaactgtagtccttggt

SEQ ID NO: 252284 - DNA, 20 bp, human
gcctccagtcacctgctccg

SEQ ID NO: 252285 - DNA, 20 bp, human
gtgcaactaaaaaacagcgg

SEQ ID NO: 252286 - DNA, 20 bp, human
ggggcccgggacgcttcagg

SEQ ID NO: 252287 - DNA, 20 bp, human
gggggggcccgggacgcttc

SEQ ID NO: 252288 - DNA, 20 bp, human
gcccgggacgcttcaggtgg

SEQ ID NO: 252289 - DNA, 20 bp, human
gagccacggcccggagaggt

SEQ ID NO: 252290 - DNA, 20 bp, human
ggctgcgcgcatggccggca

SEQ ID NO: 252291 - DNA, 20 bp, human
gcacggcccggagaggtggg

SEQ ID NO: 252292 - DNA, 20 bp, human
gctgcagctgcgcgcatggc

SEQ ID NO: 252293 - DNA, 20 bp, human
gaatgtaggtaacctcaggc

SEQ ID NO: 252294 - DNA, 20 bp, human
ggcccccacctgaagcgtcc

SEQ ID NO: 252295 - DNA, 20 bp, human
ggggatgcaccgctccatct

SEQ ID NO: 252296 - DNA, 20 bp, human
gcggagccagggctgacggg

SEQ ID NO: 252297 - DNA, 20 bp, human
gccgccccgcccgtcagccc

SEQ ID NO: 252298 - DNA, 20 bp, human
ggggcgtttgagaggatgga

SEQ ID NO: 252299 - DNA, 20 bp, human
gtaacagtggggcgtttgag

SEQ ID NO: 252300 - DNA, 20 bp, human
gggaggaggctggagacgga

SEQ ID NO: 252301 - DNA, 20 bp, human
gctggctccgcccagccacg

SEQ ID NO: 252302 - DNA, 20 bp, human
gcctccacccgcgcgaggta

SEQ ID NO: 252303 - DNA, 20 bp, human
gcgggcgccctcagtgaagg

SEQ ID NO: 252304 - DNA, 20 bp, human
gtaagccgactgggaagcga

SEQ ID NO: 252305 - DNA, 20 bp, human
gggcgagccccgtggctggg

SEQ ID NO: 252306 - DNA, 20 bp, human
gaccccctttggtgcaacta

SEQ ID NO: 252307 - DNA, 20 bp, human
ggggtcaggttcccatcgag

SEQ ID NO: 252308 - DNA, 20 bp, human
ggccctagttgcaccaaagg

SEQ ID NO: 252309 - DNA, 20 bp, human
gcgcgccctagttgcaccaa

SEQ ID NO: 252310 - DNA, 20 bp, human
gcgaatgtggatccgctcga

SEQ ID NO: 252311 - DNA, 20 bp, human
gaggacgctttttactgaca

SEQ ID NO: 252312 - DNA, 20 bp, human
ggcgtgcgcacacacgaatg

SEQ ID NO: 252313 - DNA, 20 bp, human
gactgcggagccctgccccc

SEQ ID NO: 252314 - DNA, 20 bp, human
ggagaggatgcaacagtggt

SEQ ID NO: 252315 - DNA, 20 bp, human
gtggacttgccaggctgcga

SEQ ID NO: 252316 - DNA, 20 bp, human
gctagggacccagaccgtaa

SEQ ID NO: 252317 - DNA, 20 bp, human
gcccgcgctggtcctatccg

SEQ ID NO: 252318 - DNA, 20 bp, human
ggacccagaccgtaagggag

SEQ ID NO: 252319 - DNA, 20 bp, human
gaggaccagcgcgggtagag

SEQ ID NO: 252320 - DNA, 20 bp, human
gactacggggtgggctgcag

SEQ ID NO: 252321 - DNA, 20 bp, human
gagcgcgggtagagaggatg

SEQ ID NO: 252322 - DNA, 20 bp, human
ggggcatcgccactacgggg

SEQ ID NO: 252323 - DNA, 20 bp, human
gcaggggcaacgccgatccc

SEQ ID NO: 252324 - DNA, 20 bp, human
gcgctccggcgggaaccgag

SEQ ID NO: 252325 - DNA, 20 bp, human
gcggccacggtgggacgcag

SEQ ID NO: 252326 - DNA, 20 bp, human
gcaggagaggttaaacttga

SEQ ID NO: 252327 - DNA, 20 bp, human
gtcatggaaagaaccggcta

SEQ ID NO: 252328 - DNA, 20 bp, human
gcgaacctgaaagtccagga

SEQ ID NO: 252329 - DNA, 20 bp, human
ggggttaccaactacaggag

SEQ ID NO: 252330 - DNA, 20 bp, human
gttgagtctagggataaaac

SEQ ID NO: 252331 - DNA, 20 bp, human
gatccgaaacgctttttcaa

SEQ ID NO: 252332 - DNA, 20 bp, human
ggacatgatggcatgattga

SEQ ID NO: 252333 - DNA, 20 bp, human
gctcaaattaggacatgggc

SEQ ID NO: 252334 - DNA, 20 bp, human
gcagatgggttaccaactac

SEQ ID NO: 252335 - DNA, 20 bp, human
ggacagatcgactccttagc

SEQ ID NO: 252336 - DNA, 20 bp, human
gaactctgcccggaggcgac

SEQ ID NO: 252337 - DNA, 20 bp, human
gtcgctcgggatttaggaag

SEQ ID NO: 252338 - DNA, 20 bp, human
ggggagcggcggcctctgat

SEQ ID NO: 252339 - DNA, 20 bp, human
gccccggtgcggtgcagccg

SEQ ID NO: 252340 - DNA, 20 bp, human
ggggacagcgagcatcagga

SEQ ID NO: 252341 - DNA, 20 bp, human
gagcgtccggggaactcgag

SEQ ID NO: 252342 - DNA, 20 bp, human
gtcaggaaggagagcgtccg

SEQ ID NO: 252343 - DNA, 20 bp, human
ggaggacaggctgcgacccc

SEQ ID NO: 252344 - DNA, 20 bp, human
gacaggctgcgaccccgggc

SEQ ID NO: 252345 - DNA, 20 bp, human
gtcagcttgggctttcgctc

SEQ ID NO: 252346 - DNA, 20 bp, human
gcagtccggcagcccctcgc

SEQ ID NO: 252347 - DNA, 20 bp, human
gtcctagcgacgcgcgggag

SEQ ID NO: 252348 - DNA, 20 bp, human
gtaagcagccacgggtccga

SEQ ID NO: 252349 - DNA, 20 bp, human
ggggcttgcgaacgcggact

SEQ ID NO: 252350 - DNA, 20 bp, human
gcagccacgggtccgatggg

SEQ ID NO: 252351 - DNA, 20 bp, human
ggaggtgtgcgcacactgag

SEQ ID NO: 252352 - DNA, 20 bp, human
gtgacctcctagcgacgcgc

SEQ ID NO: 252353 - DNA, 20 bp, human
ggctctgaggtctaacccgt

SEQ ID NO: 252354 - DNA, 20 bp, human
ggcagaggggcttgcgaacg

SEQ ID NO: 252355 - DNA, 20 bp, human
gaggggcgtgttccagcata

SEQ ID NO: 252356 - DNA, 20 bp, human
ggtggggaactggtccacgt

SEQ ID NO: 252357 - DNA, 20 bp, human
gccccagccccgctcatcga

SEQ ID NO: 252358 - DNA, 20 bp, human
gcgaaccagccgtggggaac

SEQ ID NO: 252359 - DNA, 20 bp, human
gcggggcggggcctgctaag

SEQ ID NO: 252360 - DNA, 20 bp, human
gcccgctcatcgacggggca

SEQ ID NO: 252361 - DNA, 20 bp, human
ggccgtgccccgtcgatgag

SEQ ID NO: 252362 - DNA, 20 bp, human
gggggcggggcgctgctggt

SEQ ID NO: 252363 - DNA, 20 bp, human
gtggaccagttccccacggc

SEQ ID NO: 252364 - DNA, 20 bp, human
gctgctggtgggcggatctg

SEQ ID NO: 252365 - DNA, 20 bp, human
gccccgccccgcccgatcac

SEQ ID NO: 252366 - DNA, 20 bp, human
gccgcggcggcggtcacatg

SEQ ID NO: 252367 - DNA, 20 bp, human
gcacgcgtgctcggggactg

SEQ ID NO: 252368 - DNA, 20 bp, human
gtccgacccggaggcggaac

SEQ ID NO: 252369 - DNA, 20 bp, human
ggcccctgcggcgcttctgg

SEQ ID NO: 252370 - DNA, 20 bp, human
ggcactgccggttccgcctc

SEQ ID NO: 252371 - DNA, 20 bp, human
gggcgcttctggaggagcac

SEQ ID NO: 252372 - DNA, 20 bp, human
gctcggggactgcggggctt

SEQ ID NO: 252373 - DNA, 20 bp, human
ggggcgatggccgggtggga

SEQ ID NO: 252374 - DNA, 20 bp, human
gcggggcggggccttggtga

SEQ ID NO: 252375 - DNA, 20 bp, human
gtgcggccagggggtcccgg

SEQ ID NO: 252376 - DNA, 20 bp, human
ggggcggggcgacgaatggg

SEQ ID NO: 252377 - DNA, 20 bp, human
ggcgctgcagcccgctgggg

SEQ ID NO: 252378 - DNA, 20 bp, human
gcgggcccggtgccaccgtg

SEQ ID NO: 252379 - DNA, 20 bp, human
gcggcccggcccgcctggat

SEQ ID NO: 252380 - DNA, 20 bp, human
ggaggggcggggcgacgaat

SEQ ID NO: 252381 - DNA, 20 bp, human
gcccgctggggcggtccgag

SEQ ID NO: 252382 - DNA, 20 bp, human
gctgcagcgcagcgggcgtc

SEQ ID NO: 252383 - DNA, 20 bp, human
gtgccaccgtgcggccgagg

SEQ ID NO: 252384 - DNA, 20 bp, human
gcacaagtgtacactcgcga

SEQ ID NO: 252385 - DNA, 20 bp, human
gcgctgcgctgcagcccgct

SEQ ID NO: 252386 - DNA, 20 bp, human
gagatcgtcagacaggaagt

SEQ ID NO: 252387 - DNA, 20 bp, human
gggtggggttgaacatgcgg

SEQ ID NO: 252388 - DNA, 20 bp, human
ggatagcggagcggtctctt

SEQ ID NO: 252389 - DNA, 20 bp, human
gagggcggaagtgctctcgg

SEQ ID NO: 252390 - DNA, 20 bp, human
gcgtcagacaggaagtgggt

SEQ ID NO: 252391 - DNA, 20 bp, human
gagtgaaggaagttttgcaa

SEQ ID NO: 252392 - DNA, 20 bp, human
gccagcgcaccgttgacgta

SEQ ID NO: 252393 - DNA, 20 bp, human
ggtaaagaagcgttgagtga

SEQ ID NO: 252394 - DNA, 20 bp, human
ggtgggtggggttgaacatg

SEQ ID NO: 252395 - DNA, 20 bp, human
gtgagcagcgatacctaggg

SEQ ID NO: 252396 - DNA, 20 bp, human
gccccggcgcggctcgccat

SEQ ID NO: 252397 - DNA, 20 bp, human
gagacccgggcggcgaccaa

SEQ ID NO: 252398 - DNA, 20 bp, human
gaggaacccgcagctttcat

SEQ ID NO: 252399 - DNA, 20 bp, human
gccgcagccaatgaaagctg

SEQ ID NO: 252400 - DNA, 20 bp, human
gcgagccaatcgcgaggcgg

SEQ ID NO: 252401 - DNA, 20 bp, human
gcggtgggccgagacccggg

SEQ ID NO: 252402 - DNA, 20 bp, human
gtattcgcagcggaccccac

SEQ ID NO: 252403 - DNA, 20 bp, human
ggaccaatggcgagccgcgc

SEQ ID NO: 252404 - DNA, 20 bp, human
gtccccgggctgtgggctac

SEQ ID NO: 252405 - DNA, 20 bp, human
ggtctcggcccaccgaacct

SEQ ID NO: 252406 - DNA, 20 bp, human
gaggctgcgcccacccacta

SEQ ID NO: 252407 - DNA, 20 bp, human
gcgcgcccgccattcggcag

SEQ ID NO: 252408 - DNA, 20 bp, human
gcggctccgcgccccgtgat

SEQ ID NO: 252409 - DNA, 20 bp, human
ggtgggcccggagtcagctc

SEQ ID NO: 252410 - DNA, 20 bp, human
gcaggctcctcgaccaatca

SEQ ID NO: 252411 - DNA, 20 bp, human
gcgcccgggccctagtgggt

SEQ ID NO: 252412 - DNA, 20 bp, human
ggggccgtcaatctcgagtc

SEQ ID NO: 252413 - DNA, 20 bp, human
gcggccggactcgagattga

SEQ ID NO: 252414 - DNA, 20 bp, human
gcgcgccccgtgattggtcg

SEQ ID NO: 252415 - DNA, 20 bp, human
gcccgccattcggcagcggc

SEQ ID NO: 252416 - DNA, 20 bp, human
gcgcctgcgagctagtggga

SEQ ID NO: 252417 - DNA, 20 bp, human
gggcggttctcagtcccgcg

SEQ ID NO: 252418 - DNA, 20 bp, human
gcctgcgcctgcgagctagt

SEQ ID NO: 252419 - DNA, 20 bp, human
ggcctggctctcacccgcgc

SEQ ID NO: 252420 - DNA, 20 bp, human
gccgctcggtcacgtgagcc

SEQ ID NO: 252421 - DNA, 20 bp, human
gctcacgtgaccgagcgggg

SEQ ID NO: 252422 - DNA, 20 bp, human
ggccggcttccacaccccgc

SEQ ID NO: 252423 - DNA, 20 bp, human
gtggcagaacacgtcatctt

SEQ ID NO: 252424 - DNA, 20 bp, human
ggggcagggtcccctcagtt

SEQ ID NO: 252425 - DNA, 20 bp, human
gggtctcccagcacgtggcc

SEQ ID NO: 252426 - DNA, 20 bp, human
gggcgtaggcgcaatacggg

SEQ ID NO: 252427 - DNA, 20 bp, human
gcgcctacgccgattctcgt

SEQ ID NO: 252428 - DNA, 20 bp, human
gtgtggttccctctgtaagg

SEQ ID NO: 252429 - DNA, 20 bp, human
ggactggagccaacgagaat

SEQ ID NO: 252430 - DNA, 20 bp, human
gtctgtaaggcggagctaaa

SEQ ID NO: 252431 - DNA, 20 bp, human
gaaacggtgcattcgcccag

SEQ ID NO: 252432 - DNA, 20 bp, human
gtagaagcgacgtcaaggtg

SEQ ID NO: 252433 - DNA, 20 bp, human
ggtaggcgcaatacgggcgg

SEQ ID NO: 252434 - DNA, 20 bp, human
gatctgtagaagcgacgtca

SEQ ID NO: 252435 - DNA, 20 bp, human
gaatcggcgtaggcgcaata

SEQ ID NO: 252436 - DNA, 20 bp, human
gccagccggggctacaaatt

SEQ ID NO: 252437 - DNA, 20 bp, human
gggaccctccgcccgatgat

SEQ ID NO: 252438 - DNA, 20 bp, human
gggtgggaagagcccagccg

SEQ ID NO: 252439 - DNA, 20 bp, human
ggactcccattctgatgagg

SEQ ID NO: 252440 - DNA, 20 bp, human
gcgcccgatgatagggctgg

SEQ ID NO: 252441 - DNA, 20 bp, human
gcctcctccagccctatcat

SEQ ID NO: 252442 - DNA, 20 bp, human
gcgtttgaggagataggcaa

SEQ ID NO: 252443 - DNA, 20 bp, human
gcaaattgggtgaagcgctg

SEQ ID NO: 252444 - DNA, 20 bp, human
ggcggggcttgtgggtaagg

SEQ ID NO: 252445 - DNA, 20 bp, human
gggcttgtgggtaaggcggg

SEQ ID NO: 252446 - DNA, 20 bp, human
gctcgcgaggggacgaacaa

SEQ ID NO: 252447 - DNA, 20 bp, human
gctgacccaggtgagacctg

SEQ ID NO: 252448 - DNA, 20 bp, human
gcagtatcaaaaagcctcca

SEQ ID NO: 252449 - DNA, 20 bp, human
ggacgcggccgaggtggcga

SEQ ID NO: 252450 - DNA, 20 bp, human
gtctgacttccgggattcgc

SEQ ID NO: 252451 - DNA, 20 bp, human
gatctcgcgagaaattgaag

SEQ ID NO: 252452 - DNA, 20 bp, human
gagtctgcgagctggacgga

SEQ ID NO: 252453 - DNA, 20 bp, human
gagtggatgcccgcgaatcc

SEQ ID NO: 252454 - DNA, 20 bp, human
gtagaagtctgcgagctgga

SEQ ID NO: 252455 - DNA, 20 bp, human
ggaaacgctgatctcgcgag

SEQ ID NO: 252456 - DNA, 20 bp, human
gggccaggggccacttaagg

SEQ ID NO: 252457 - DNA, 20 bp, human
gtgggacggtcttgggagaa

SEQ ID NO: 252458 - DNA, 20 bp, human
gtggaggtagaaggatgttt

SEQ ID NO: 252459 - DNA, 20 bp, human
gtggggaggactacagagaa

SEQ ID NO: 252460 - DNA, 20 bp, human
gctagatcccccgcccgggt

SEQ ID NO: 252461 - DNA, 20 bp, human
gatcccccgcccgggtggga

SEQ ID NO: 252462 - DNA, 20 bp, human
gggatctagccggtcactgc

SEQ ID NO: 252463 - DNA, 20 bp, human
gggccacttaaggcggagtc

SEQ ID NO: 252464 - DNA, 20 bp, human
gaccggctagatcccccgcc

SEQ ID NO: 252465 - DNA, 20 bp, human
gactgaagtgtgtcccatcc

SEQ ID NO: 252466 - DNA, 20 bp, human
gccacccccaggttctggtt

SEQ ID NO: 252467 - DNA, 20 bp, human
gcaccagtcgccgggcagaa

SEQ ID NO: 252468 - DNA, 20 bp, human
gagcctgcccgcttgatcgc

SEQ ID NO: 252469 - DNA, 20 bp, human
ggtgcacccaaccagaacct

SEQ ID NO: 252470 - DNA, 20 bp, human
gctaaggggcggagacaaga

SEQ ID NO: 252471 - DNA, 20 bp, human
gagccggcgatcaagcgggc

SEQ ID NO: 252472 - DNA, 20 bp, human
ggggtgcacgtgcgcagtag

SEQ ID NO: 252473 - DNA, 20 bp, human
gtggtgggttggcggctaag

SEQ ID NO: 252474 - DNA, 20 bp, human
gccgccaacccaccagtcgc

SEQ ID NO: 252475 - DNA, 20 bp, human
gcaacagccggcgatcaagc

SEQ ID NO: 252476 - DNA, 20 bp, human
gtccttggggagatttcgat

SEQ ID NO: 252477 - DNA, 20 bp, human
ggcccatcgaaatctcccca

SEQ ID NO: 252478 - DNA, 20 bp, human
gtacaggtccgtctcccagg

SEQ ID NO: 252479 - DNA, 20 bp, human
ggcagctggtccaaagggag

SEQ ID NO: 252480 - DNA, 20 bp, human
ggcggccagcaggcttgtat

SEQ ID NO: 252481 - DNA, 20 bp, human
gcccagggatgacaaaggga

SEQ ID NO: 252482 - DNA, 20 bp, human
gatttcgatgggcatctttg

SEQ ID NO: 252483 - DNA, 20 bp, human
gctgtagtaaaaattgccca

SEQ ID NO: 252484 - DNA, 20 bp, human
gccccagcctttagcaaaca

SEQ ID NO: 252485 - DNA, 20 bp, human
gggccaagtaaatgtcctac

SEQ ID NO: 252486 - DNA, 20 bp, human
gcgcaagagcacaggaagta

SEQ ID NO: 252487 - DNA, 20 bp, human
gcctcgcggcttccgtatta

SEQ ID NO: 252488 - DNA, 20 bp, human
gtgggcgaaagaccggaagt

SEQ ID NO: 252489 - DNA, 20 bp, human
ggcggcgacctggtttacag

SEQ ID NO: 252490 - DNA, 20 bp, human
gcggaacacacgcacaaaaa

SEQ ID NO: 252491 - DNA, 20 bp, human
gcgcgtctccgcaagagcac

SEQ ID NO: 252492 - DNA, 20 bp, human
gcacaaaaatggcggcgacc

SEQ ID NO: 252493 - DNA, 20 bp, human
ggaagccgcgaggagccttt

SEQ ID NO: 252494 - DNA, 20 bp, human
gagggcctaaaggctcctcg

SEQ ID NO: 252495 - DNA, 20 bp, human
gggaagtagggaacgtgctt

SEQ ID NO: 252496 - DNA, 20 bp, human
gaggtcgcgaagcacacatg

SEQ ID NO: 252497 - DNA, 20 bp, human
ggcacgcttggcgacgtcga

SEQ ID NO: 252498 - DNA, 20 bp, human
ggatgggggcggagcgatct

SEQ ID NO: 252499 - DNA, 20 bp, human
ggaagcttttgcagccggac

SEQ ID NO: 252500 - DNA, 20 bp, human
gtccacacaaggtggggcgc

SEQ ID NO: 252501 - DNA, 20 bp, human
gtctggataaggcgcacgct

SEQ ID NO: 252502 - DNA, 20 bp, human
ggtgacacacccaccccgcc

SEQ ID NO: 252503 - DNA, 20 bp, human
ggtgtgcttcgcgacctgtc

SEQ ID NO: 252504 - DNA, 20 bp, human
gcgcgtttctaaactttgtc

SEQ ID NO: 252505 - DNA, 20 bp, human
gtcccagctggtggcaaacg

SEQ ID NO: 252506 - DNA, 20 bp, human
ggcagcgctcactggggaag

SEQ ID NO: 252507 - DNA, 20 bp, human
gcgccccggcgtagggaaac

SEQ ID NO: 252508 - DNA, 20 bp, human
gaaaccgaggtttagcgggg

SEQ ID NO: 252509 - DNA, 20 bp, human
gcagcccggtttccctacgc

SEQ ID NO: 252510 - DNA, 20 bp, human
ggccaccggcgggtttggga

SEQ ID NO: 252511 - DNA, 20 bp, human
gaaagccaagggatcaggta

SEQ ID NO: 252512 - DNA, 20 bp, human
gatccgccgtatccagtcgg

SEQ ID NO: 252513 - DNA, 20 bp, human
ggaggttccttcagccccaa

SEQ ID NO: 252514 - DNA, 20 bp, human
ggcgatccgccgtatccagt

SEQ ID NO: 252515 - DNA, 20 bp, human
gccaaagggcagcgctcact

SEQ ID NO: 252516 - DNA, 20 bp, human
gagactgcggacctcgactg

SEQ ID NO: 252517 - DNA, 20 bp, human
gtcgaggtccgcagtctcct

SEQ ID NO: 252518 - DNA, 20 bp, human
gtcgactgcggcccccacca

SEQ ID NO: 252519 - DNA, 20 bp, human
ggactccgccccagcctcag

SEQ ID NO: 252520 - DNA, 20 bp, human
gaggctggggcggagtcgac

SEQ ID NO: 252521 - DNA, 20 bp, human
gtctcctcggggtcgaaatc

SEQ ID NO: 252522 - DNA, 20 bp, human
gaaccgggatgatgtcaggg

SEQ ID NO: 252523 - DNA, 20 bp, human
gagaccccttgccttaccgg

SEQ ID NO: 252524 - DNA, 20 bp, human
ggccctcactccaccctctg

SEQ ID NO: 252525 - DNA, 20 bp, human
gtcagggcgggcgactcccg

SEQ ID NO: 252526 - DNA, 20 bp, human
gcgggcgcgtcagcctccga

SEQ ID NO: 252527 - DNA, 20 bp, human
ggacgccgacgcacgcctag

SEQ ID NO: 252528 - DNA, 20 bp, human
gcgtcagcctccgaaggcgg

SEQ ID NO: 252529 - DNA, 20 bp, human
ggcgccccctaggcgtgcgt

SEQ ID NO: 252530 - DNA, 20 bp, human
ggcgcgtcagcctccgaagg

SEQ ID NO: 252531 - DNA, 20 bp, human
ggcgtgcgtcggcgtcctgg

SEQ ID NO: 252532 - DNA, 20 bp, human
gtgtgcctgtgtgaactcct

SEQ ID NO: 252533 - DNA, 20 bp, human
gctgccgatccgccctgcac

SEQ ID NO: 252534 - DNA, 20 bp, human
ggaggtgagtgtgtgcgctt

SEQ ID NO: 252535 - DNA, 20 bp, human
ggcgcacacactcacctcaa

SEQ ID NO: 252536 - DNA, 20 bp, human
gaatctgtgtctagccaatc

SEQ ID NO: 252537 - DNA, 20 bp, human
ggccagctgggcctgactgg

SEQ ID NO: 252538 - DNA, 20 bp, human
gcaggagcccacactgtaca

SEQ ID NO: 252539 - DNA, 20 bp, human
gcggccagcaggggctccgt

SEQ ID NO: 252540 - DNA, 20 bp, human
gggtgccagctgggcctgac

SEQ ID NO: 252541 - DNA, 20 bp, human
ggggccggccggtgccagct

SEQ ID NO: 252542 - DNA, 20 bp, human
gcagcaggggctccgtgggc

SEQ ID NO: 252543 - DNA, 20 bp, human
gtctcaatggcacacactgc

SEQ ID NO: 252544 - DNA, 20 bp, human
ggtgagtgccctgtacagtg

SEQ ID NO: 252545 - DNA, 20 bp, human
gagggcactcaccggccagc

SEQ ID NO: 252546 - DNA, 20 bp, human
gagagaggggagccagtccc

SEQ ID NO: 252547 - DNA, 20 bp, human
gggacaccggcggcaagtcc

SEQ ID NO: 252548 - DNA, 20 bp, human
gttgccgccggtgtccctga

SEQ ID NO: 252549 - DNA, 20 bp, human
gaagtcccggcttgcagaga

SEQ ID NO: 252550 - DNA, 20 bp, human
ggacagttaaagttgttggg

SEQ ID NO: 252551 - DNA, 20 bp, human
ggtcgcggggagcgcgcata

SEQ ID NO: 252552 - DNA, 20 bp, human
gcccggggagcgaatgaata

SEQ ID NO: 252553 - DNA, 20 bp, human
gccgcgacggcgcaggggga

SEQ ID NO: 252554 - DNA, 20 bp, human
ggagccctcagggacaccgg

SEQ ID NO: 252555 - DNA, 20 bp, human
gggcagccgcgtcgcggaga

SEQ ID NO: 252556 - DNA, 20 bp, human
ggctcacagcggtaccgggg

SEQ ID NO: 252557 - DNA, 20 bp, human
gtgggcacctccatccgccg

SEQ ID NO: 252558 - DNA, 20 bp, human
gcggaaggtagatggtggag

SEQ ID NO: 252559 - DNA, 20 bp, human
gctcacccgccagcccggaa

SEQ ID NO: 252560 - DNA, 20 bp, human
gtaccgctgtgagcggtctg

SEQ ID NO: 252561 - DNA, 20 bp, human
ggtgagcggtctgtggccct

SEQ ID NO: 252562 - DNA, 20 bp, human
gggcccttgcaggaacccgc

SEQ ID NO: 252563 - DNA, 20 bp, human
gttcctgcaagggccagggg

SEQ ID NO: 252564 - DNA, 20 bp, human
gaccgctcacagcggtaccg

SEQ ID NO: 252565 - DNA, 20 bp, human
gagcagggcgggcagggaat

SEQ ID NO: 252566 - DNA, 20 bp, human
ggcagaaaggcagcagccaa

SEQ ID NO: 252567 - DNA, 20 bp, human
gcagctggctgagggcgggg

SEQ ID NO: 252568 - DNA, 20 bp, human
ggtcacctcgctggaaggag

SEQ ID NO: 252569 - DNA, 20 bp, human
gtttgatcacccgccagccc

SEQ ID NO: 252570 - DNA, 20 bp, human
ggtctgcaacatggagacct

SEQ ID NO: 252571 - DNA, 20 bp, human
gtgttgcagacaatgatcat

SEQ ID NO: 252572 - DNA, 20 bp, human
gcatggagaccttgggcaga

SEQ ID NO: 252573 - DNA, 20 bp, human
gccagcgaggtgacagagta

SEQ ID NO: 252574 - DNA, 20 bp, human
gacgactcccagctggctga

SEQ ID NO: 252575 - DNA, 20 bp, human
gatcacccgccagcccggga

SEQ ID NO: 252576 - DNA, 20 bp, human
ggggcagcagccaaagtctg

SEQ ID NO: 252577 - DNA, 20 bp, human
gaccgtagtctgccctccaa

SEQ ID NO: 252578 - DNA, 20 bp, human
gagctggccgagggcgggaa

SEQ ID NO: 252579 - DNA, 20 bp, human
gatcttcacgggcccttgga

SEQ ID NO: 252580 - DNA, 20 bp, human
gtttgatcactcaccagccc

SEQ ID NO: 252581 - DNA, 20 bp, human
gttccatcttcacgggccct

SEQ ID NO: 252582 - DNA, 20 bp, human
ggaggaagtccctttggcga

SEQ ID NO: 252583 - DNA, 20 bp, human
ggtaaaggaggaagtccctt

SEQ ID NO: 252584 - DNA, 20 bp, human
gctacggtcattggcaaaac

SEQ ID NO: 252585 - DNA, 20 bp, human
gctcctttacaggggctaag

SEQ ID NO: 252586 - DNA, 20 bp, human
gcgcccaaggaccgcgagtg

SEQ ID NO: 252587 - DNA, 20 bp, human
gcctcatgcggcacacccgg

SEQ ID NO: 252588 - DNA, 20 bp, human
gggcggcccgcgccctcatg

SEQ ID NO: 252589 - DNA, 20 bp, human
gggccccactcgcggtcctt

SEQ ID NO: 252590 - DNA, 20 bp, human
gcgccctcatgcggcacacc

SEQ ID NO: 252591 - DNA, 20 bp, human
ggtggcgctgcgatcccgca

SEQ ID NO: 252592 - DNA, 20 bp, human
ggatcgcagcgccacccctt

SEQ ID NO: 252593 - DNA, 20 bp, human
gagccggggcagtgcggctc

SEQ ID NO: 252594 - DNA, 20 bp, human
gcggctctgggctggccgaa

SEQ ID NO: 252595 - DNA, 20 bp, human
ggcactcgcggccccactcg

SEQ ID NO: 252596 - DNA, 20 bp, human
gcgtccctcaaggtgtacac

SEQ ID NO: 252597 - DNA, 20 bp, human
ggggtcctgtgtacaccttg

SEQ ID NO: 252598 - DNA, 20 bp, human
ggtggaccctatcagatctc

SEQ ID NO: 252599 - DNA, 20 bp, human
gcatgcgcagcctcaatgct

SEQ ID NO: 252600 - DNA, 20 bp, human
gatggacccgagatctgata

SEQ ID NO: 252601 - DNA, 20 bp, human
ggaacaccaaccacgacctt

SEQ ID NO: 252602 - DNA, 20 bp, human
ggaggctgcgcatgcgcgtt

SEQ ID NO: 252603 - DNA, 20 bp, human
ggaaggcactgtagttatgc

SEQ ID NO: 252604 - DNA, 20 bp, human
ggaccttcggaatttccctc

SEQ ID NO: 252605 - DNA, 20 bp, human
ggacgtgtacgcagccggcg

SEQ ID NO: 252606 - DNA, 20 bp, human
gctggccgggtctgatttca

SEQ ID NO: 252607 - DNA, 20 bp, human
gggaagctacctgattacga

SEQ ID NO: 252608 - DNA, 20 bp, human
gcgagggttaccggaagtga

SEQ ID NO: 252609 - DNA, 20 bp, human
ggctcagtcccaaactgcag

SEQ ID NO: 252610 - DNA, 20 bp, human
gaggtagcttccaggtagtt

SEQ ID NO: 252611 - DNA, 20 bp, human
gacctgattacgagggttac

SEQ ID NO: 252612 - DNA, 20 bp, human
gcacatgcatccaaactacc

SEQ ID NO: 252613 - DNA, 20 bp, human
gtccggtaaccctcgtaatc

SEQ ID NO: 252614 - DNA, 20 bp, human
gtgtttgtgctgaaaatccc

SEQ ID NO: 252615 - DNA, 20 bp, human
gtggcttgcctgagtattag

SEQ ID NO: 252616 - DNA, 20 bp, human
gcaggcacctcgacctcaag

SEQ ID NO: 252617 - DNA, 20 bp, human
gcatcacgttgtgtcacaat

SEQ ID NO: 252618 - DNA, 20 bp, human
gagaccgctgagaataggaa

SEQ ID NO: 252619 - DNA, 20 bp, human
ggtaggtcgcatgtttcaaa

SEQ ID NO: 252620 - DNA, 20 bp, human
ggggagtgactcacagagca

SEQ ID NO: 252621 - DNA, 20 bp, human
gccaaggcatgctaacagga

SEQ ID NO: 252622 - DNA, 20 bp, human
gaactgagaccgctgagaat

SEQ ID NO: 252623 - DNA, 20 bp, human
gaggagtgttaaataagcca

SEQ ID NO: 252624 - DNA, 20 bp, human
gccctcctaagagaataagt

SEQ ID NO: 252625 - DNA, 20 bp, human
gcagagctctacggaaaccc

SEQ ID NO: 252626 - DNA, 20 bp, human
gtgcccgccccgaaccgccc

SEQ ID NO: 252627 - DNA, 20 bp, human
gcgcccgcccggacggacgg

SEQ ID NO: 252628 - DNA, 20 bp, human
gggcggtgcgggatcccaga

SEQ ID NO: 252629 - DNA, 20 bp, human
ggaccccgcccgggccctct

SEQ ID NO: 252630 - DNA, 20 bp, human
gcctaccgcgtagacccgca

SEQ ID NO: 252631 - DNA, 20 bp, human
gggcgggcgcagagtcccgc

SEQ ID NO: 252632 - DNA, 20 bp, human
ggccgcagacaatggcgaca

SEQ ID NO: 252633 - DNA, 20 bp, human
gcggacaaccgaccccagcc

SEQ ID NO: 252634 - DNA, 20 bp, human
ggccatgtcgccattgtctg

SEQ ID NO: 252635 - DNA, 20 bp, human
ggcggccctgcgggtctacg

SEQ ID NO: 252636 - DNA, 20 bp, human
ggcttccagggcggttccgg

SEQ ID NO: 252637 - DNA, 20 bp, human
gcgaagcgacgcccaggatt

SEQ ID NO: 252638 - DNA, 20 bp, human
gtcacagcgaagcgacgccc

SEQ ID NO: 252639 - DNA, 20 bp, human
gggaagcccgccccaatcct

SEQ ID NO: 252640 - DNA, 20 bp, human
ggaccctggaagccaatccg

SEQ ID NO: 252641 - DNA, 20 bp, human
gcctgctcccagtacgaaac

SEQ ID NO: 252642 - DNA, 20 bp, human
gtggccgacgggccggaccc

SEQ ID NO: 252643 - DNA, 20 bp, human
ggggcaagtaagtgttccgc

SEQ ID NO: 252644 - DNA, 20 bp, human
gccgtcggccaatcaggcgc

SEQ ID NO: 252645 - DNA, 20 bp, human
ggatgggtaaacactcctgg

SEQ ID NO: 252646 - DNA, 20 bp, human
gccgaggaggggaaagctac

SEQ ID NO: 252647 - DNA, 20 bp, human
gtaacagccgctccgaggag

SEQ ID NO: 252648 - DNA, 20 bp, human
ggaggagacccaagaaaggt

SEQ ID NO: 252649 - DNA, 20 bp, human
gaagaaaggtcggaccaatg

SEQ ID NO: 252650 - DNA, 20 bp, human
gcgcgcacgacgcccaaagg

SEQ ID NO: 252651 - DNA, 20 bp, human
ggtcccgcccgctgcctcat

SEQ ID NO: 252652 - DNA, 20 bp, human
gcttcctaacagccgctccg

SEQ ID NO: 252653 - DNA, 20 bp, human
ggacaggagttcccgccttt

SEQ ID NO: 252654 - DNA, 20 bp, human
gggaccaatgaggcagcggg

SEQ ID NO: 252655 - DNA, 20 bp, human
ggcgcgcgcacgacgcccaa

SEQ ID NO: 252656 - DNA, 20 bp, human
gctcacagactgaccatcag

SEQ ID NO: 252657 - DNA, 20 bp, human
gcggcctctaagcactacgg

SEQ ID NO: 252658 - DNA, 20 bp, human
gcgtccctgggatatagcag

SEQ ID NO: 252659 - DNA, 20 bp, human
gcagggggcgtcagagaaac

SEQ ID NO: 252660 - DNA, 20 bp, human
gcggccaccgtagtgcttag

SEQ ID NO: 252661 - DNA, 20 bp, human
ggaaccatacctgaaaactc

SEQ ID NO: 252662 - DNA, 20 bp, human
gggaaggggctgtacttttt

SEQ ID NO: 252663 - DNA, 20 bp, human
gccaccgcaaaatgtaaatt

SEQ ID NO: 252664 - DNA, 20 bp, human
gtacattttgcggtggggga

SEQ ID NO: 252665 - DNA, 20 bp, human
gcgagcgagttcaaacctcg

SEQ ID NO: 252666 - DNA, 20 bp, human
ggcggggcatcgtgggtagg

SEQ ID NO: 252667 - DNA, 20 bp, human
ggtcgcggggcatcgtgggt

SEQ ID NO: 252668 - DNA, 20 bp, human
gccaccctgcgcttcgatcc

SEQ ID NO: 252669 - DNA, 20 bp, human
gttcggtcgcggggcatcgt

SEQ ID NO: 252670 - DNA, 20 bp, human
gggcagctggcgactcaagg

SEQ ID NO: 252671 - DNA, 20 bp, human
ggcgaccgctgcctcgcaat

SEQ ID NO: 252672 - DNA, 20 bp, human
gcacgagacgtcactgtctt

SEQ ID NO: 252673 - DNA, 20 bp, human
gagggtctgcagacaaggca

SEQ ID NO: 252674 - DNA, 20 bp, human
ggaagcccggatcgaagcgc

SEQ ID NO: 252675 - DNA, 20 bp, human
gagtggataaagagcgaggg

SEQ ID NO: 252676 - DNA, 20 bp, human
gcccgcctactgaaggccca

SEQ ID NO: 252677 - DNA, 20 bp, human
ggggctgtggtgagcgagga

SEQ ID NO: 252678 - DNA, 20 bp, human
ggccctgggccttcagtagg

SEQ ID NO: 252679 - DNA, 20 bp, human
ggatgccctcgcctaggctt

SEQ ID NO: 252680 - DNA, 20 bp, human
ggaagcccaagcctaggcga

SEQ ID NO: 252681 - DNA, 20 bp, human
ggctgctgatgccctcgcct

SEQ ID NO: 252682 - DNA, 20 bp, human
gcgggcgaagagaacgggag

SEQ ID NO: 252683 - DNA, 20 bp, human
gcgccgagcccgcctactga

SEQ ID NO: 252684 - DNA, 20 bp, human
ggggaccgggcgaagagaac

SEQ ID NO: 252685 - DNA, 20 bp, human
gctggagagtgagctctgca

SEQ ID NO: 252686 - DNA, 20 bp, human
ggctacgacgagtcccaggt

SEQ ID NO: 252687 - DNA, 20 bp, human
ggaaggggacgggttggcgc

SEQ ID NO: 252688 - DNA, 20 bp, human
gccgccacgggactcggaag

SEQ ID NO: 252689 - DNA, 20 bp, human
gacgccgggtggggaacgcc

SEQ ID NO: 252690 - DNA, 20 bp, human
ggggcgctgggtgccccgag

SEQ ID NO: 252691 - DNA, 20 bp, human
gagcggctacgacgagtccc

SEQ ID NO: 252692 - DNA, 20 bp, human
ggggctccgtgacgccgggt

SEQ ID NO: 252693 - DNA, 20 bp, human
gcacccggcccaatggggcg

SEQ ID NO: 252694 - DNA, 20 bp, human
gggagccgtgcgccgcaggc

SEQ ID NO: 252695 - DNA, 20 bp, human
ggcacggctccgctcccccg

SEQ ID NO: 252696 - DNA, 20 bp, human
gccgggcctcccttactctg

SEQ ID NO: 252697 - DNA, 20 bp, human
gagaggcgttaggagtccgg

SEQ ID NO: 252698 - DNA, 20 bp, human
ggctccccgggaacgagtgt

SEQ ID NO: 252699 - DNA, 20 bp, human
gctgagaggcgttaggagtc

SEQ ID NO: 252700 - DNA, 20 bp, human
ggggcgcccacactcgttcc

SEQ ID NO: 252701 - DNA, 20 bp, human
ggcctccgcgggcgaacccc

SEQ ID NO: 252702 - DNA, 20 bp, human
gagggcaaccgtagcgacgc

SEQ ID NO: 252703 - DNA, 20 bp, human
gtacggttgccctgacaacc

SEQ ID NO: 252704 - DNA, 20 bp, human
ggggagggaccaaaagccgc

SEQ ID NO: 252705 - DNA, 20 bp, human
ggccctggctgagaggcgtt

SEQ ID NO: 252706 - DNA, 20 bp, human
gacaggatgtaaggttccgt

SEQ ID NO: 252707 - DNA, 20 bp, human
gccgggaaacacaggatgta

SEQ ID NO: 252708 - DNA, 20 bp, human
gggaaggctttcacttcctg

SEQ ID NO: 252709 - DNA, 20 bp, human
ggcggccgtgaggtcatcgg

SEQ ID NO: 252710 - DNA, 20 bp, human
gaaaggcccggagctacaac

SEQ ID NO: 252711 - DNA, 20 bp, human
gagcacgtggcggcgaggaa

SEQ ID NO: 252712 - DNA, 20 bp, human
gcagggcctgaggtacaacc

SEQ ID NO: 252713 - DNA, 20 bp, human
gggggcggccgtgaggtcat

SEQ ID NO: 252714 - DNA, 20 bp, human
gagctacaaccgggaaacac

SEQ ID NO: 252715 - DNA, 20 bp, human
gaaccaagactacagtccca

SEQ ID NO: 252716 - DNA, 20 bp, human
ggggcggggtcagaacgaga

SEQ ID NO: 252717 - DNA, 20 bp, human
gtagagggcgcaatcactcg

SEQ ID NO: 252718 - DNA, 20 bp, human
gcaggcgcaagatgggtctt

SEQ ID NO: 252719 - DNA, 20 bp, human
ggccacgtgcgcctcagctc

SEQ ID NO: 252720 - DNA, 20 bp, human
ggcagcccagagcttccgat

SEQ ID NO: 252721 - DNA, 20 bp, human
gttccgccccgcctcgcttg

SEQ ID NO: 252722 - DNA, 20 bp, human
ggcgcacgtggctatgcttg

SEQ ID NO: 252723 - DNA, 20 bp, human
ggctgtgcacaggcgcaaga

SEQ ID NO: 252724 - DNA, 20 bp, human
gctccgccccaagcgaggcg

SEQ ID NO: 252725 - DNA, 20 bp, human
gtgtaccgcaatgcctctac

SEQ ID NO: 252726 - DNA, 20 bp, human
ggggtcacgtggctcagacg

SEQ ID NO: 252727 - DNA, 20 bp, human
gcgtctgggcagcggctctt

SEQ ID NO: 252728 - DNA, 20 bp, human
gacgctcaagaggtaggcgg

SEQ ID NO: 252729 - DNA, 20 bp, human
ggacacgccacgctcgtaaa

SEQ ID NO: 252730 - DNA, 20 bp, human
gcacgtggctcagacggggg

SEQ ID NO: 252731 - DNA, 20 bp, human
gctgggcagcggctcttcgg

SEQ ID NO: 252732 - DNA, 20 bp, human
gccctccacgctcaagaggt

SEQ ID NO: 252733 - DNA, 20 bp, human
gagacgggggcggtagctgt

SEQ ID NO: 252734 - DNA, 20 bp, human
gggggcctagcgcgcgacgg

SEQ ID NO: 252735 - DNA, 20 bp, human
gtaggcccccagggcccgga

SEQ ID NO: 252736 - DNA, 20 bp, human
gcacgggaggacgaccccgg

SEQ ID NO: 252737 - DNA, 20 bp, human
gacgaccccggtggtctgga

SEQ ID NO: 252738 - DNA, 20 bp, human
ggaggacgaccccggtggtc

SEQ ID NO: 252739 - DNA, 20 bp, human
gcgtcacgggaggacgaccc

SEQ ID NO: 252740 - DNA, 20 bp, human
gacaaagataaacaactcgg

SEQ ID NO: 252741 - DNA, 20 bp, human
ggtagcaccgcacaagaggg

SEQ ID NO: 252742 - DNA, 20 bp, human
ggccaccctccagaccaccg

SEQ ID NO: 252743 - DNA, 20 bp, human
gcgtcacaagcagtggtttc

SEQ ID NO: 252744 - DNA, 20 bp, human
gaatggcccgccctcttgtg

SEQ ID NO: 252745 - DNA, 20 bp, human
gacggaagcaaaacggaagt

SEQ ID NO: 252746 - DNA, 20 bp, human
ggaaacccagcgaagaggag

SEQ ID NO: 252747 - DNA, 20 bp, human
gcggcctccgctgggacctc

SEQ ID NO: 252748 - DNA, 20 bp, human
gaggccggagtttaagtcct

SEQ ID NO: 252749 - DNA, 20 bp, human
ggtggtctgggaacccacgt

SEQ ID NO: 252750 - DNA, 20 bp, human
gttaaactccggcctccgct

SEQ ID NO: 252751 - DNA, 20 bp, human
gtccgcctctcctcttcgct

SEQ ID NO: 252752 - DNA, 20 bp, human
ggttcccagaccaccaactc

SEQ ID NO: 252753 - DNA, 20 bp, human
gcagcccaggacttaaactc

SEQ ID NO: 252754 - DNA, 20 bp, human
gcaagagaaacccagcgaag

SEQ ID NO: 252755 - DNA, 20 bp, human
gactccggccgtgagacttc

SEQ ID NO: 252756 - DNA, 20 bp, human
gacatcccgcctctagtctg

SEQ ID NO: 252757 - DNA, 20 bp, human
gcctgcccccagactagagg

SEQ ID NO: 252758 - DNA, 20 bp, human
gggtcagagccgagcaaggt

SEQ ID NO: 252759 - DNA, 20 bp, human
gcccgctagcggggccacga

SEQ ID NO: 252760 - DNA, 20 bp, human
gcctccgcccgtattaaaga

SEQ ID NO: 252761 - DNA, 20 bp, human
ggtagctttgggcggataga

SEQ ID NO: 252762 - DNA, 20 bp, human
gccggcttggggctgatgaa

SEQ ID NO: 252763 - DNA, 20 bp, human
gtgtggaacggtacgccaac

SEQ ID NO: 252764 - DNA, 20 bp, human
gttattgggctgttgagcgg

SEQ ID NO: 252765 - DNA, 20 bp, human
gttgagcgggggccgaccga

SEQ ID NO: 252766 - DNA, 20 bp, human
ggcgacttgtagcaagggga

SEQ ID NO: 252767 - DNA, 20 bp, human
gccggagaggcgaaacaaga

SEQ ID NO: 252768 - DNA, 20 bp, human
ggcgaagcgcacgtggcagt

SEQ ID NO: 252769 - DNA, 20 bp, human
ggccgaggctccacccccca

SEQ ID NO: 252770 - DNA, 20 bp, human
gccactgtggcgttgaaaag

SEQ ID NO: 252771 - DNA, 20 bp, human
ggcggccggacctcgagccg

SEQ ID NO: 252772 - DNA, 20 bp, human
ggccacgtgcgcttcgcctt

SEQ ID NO: 252773 - DNA, 20 bp, human
gtgctcgatgacgtggtacg

SEQ ID NO: 252774 - DNA, 20 bp, human
gggagcctcggctcgaggtc

SEQ ID NO: 252775 - DNA, 20 bp, human
ggcagttggcgggaaatccc

SEQ ID NO: 252776 - DNA, 20 bp, human
gctgcggccgggagagaact

SEQ ID NO: 252777 - DNA, 20 bp, human
gagtcccggcgccttctgat

SEQ ID NO: 252778 - DNA, 20 bp, human
gccgcagagctggccgccca

SEQ ID NO: 252779 - DNA, 20 bp, human
gcagggggagtcgcagagtt

SEQ ID NO: 252780 - DNA, 20 bp, human
gcccggaagcgaatacgcga

SEQ ID NO: 252781 - DNA, 20 bp, human
gcccctcgcgtattcgcttc

SEQ ID NO: 252782 - DNA, 20 bp, human
gcgggagagaactaggcgct

SEQ ID NO: 252783 - DNA, 20 bp, human
gaggtgcgacttggttgctg

SEQ ID NO: 252784 - DNA, 20 bp, human
gtgcggtggcccagctgcag

SEQ ID NO: 252785 - DNA, 20 bp, human
ggctcccggtaactcctgtg

SEQ ID NO: 252786 - DNA, 20 bp, human
gcagaagggccagagcgtag

SEQ ID NO: 252787 - DNA, 20 bp, human
gggccaaggtgagcctgcta

SEQ ID NO: 252788 - DNA, 20 bp, human
gctcgcctgcaccaccacgt

SEQ ID NO: 252789 - DNA, 20 bp, human
gaccacatccacccaggtta

SEQ ID NO: 252790 - DNA, 20 bp, human
gtccacccaggttaaggtga

SEQ ID NO: 252791 - DNA, 20 bp, human
gagaaccacgtgtgctaaca

SEQ ID NO: 252792 - DNA, 20 bp, human
gaggtaggacccatcacccc

SEQ ID NO: 252793 - DNA, 20 bp, human
gctgctgtggccaaaaggtg

SEQ ID NO: 252794 - DNA, 20 bp, human
gaagcagggccgccttgggc

SEQ ID NO: 252795 - DNA, 20 bp, human
gggataggagattcgtaagt

SEQ ID NO: 252796 - DNA, 20 bp, human
gaggaagggacaactagagt

SEQ ID NO: 252797 - DNA, 20 bp, human
gcgaccccggcctgcacaag

SEQ ID NO: 252798 - DNA, 20 bp, human
gtcccgccctgggtcggcag

SEQ ID NO: 252799 - DNA, 20 bp, human
gatcaaacaggaagtgctta

SEQ ID NO: 252800 - DNA, 20 bp, human
ggtcgccctctgccgaccca

SEQ ID NO: 252801 - DNA, 20 bp, human
gtgaacgtttccaggcctga

SEQ ID NO: 252802 - DNA, 20 bp, human
gctgcacaagaggcgccggg

SEQ ID NO: 252803 - DNA, 20 bp, human
gtggatcatagagatcaaac

SEQ ID NO: 252804 - DNA, 20 bp, human
gaaaatctccgcccgccctc

SEQ ID NO: 252805 - DNA, 20 bp, human
gcgcgcgtcccctttgttta

SEQ ID NO: 252806 - DNA, 20 bp, human
ggtctggcgcgatgcccgcc

SEQ ID NO: 252807 - DNA, 20 bp, human
gcgcgccagacctgctactc

SEQ ID NO: 252808 - DNA, 20 bp, human
gcggaagggtttcgttgcta

SEQ ID NO: 252809 - DNA, 20 bp, human
ggcaacctcgcggcgcggaa

SEQ ID NO: 252810 - DNA, 20 bp, human
ggagggcgcgccaatggagg

SEQ ID NO: 252811 - DNA, 20 bp, human
gagagcgcgtgccagggcgg

SEQ ID NO: 252812 - DNA, 20 bp, human
gcgcagagcgcgtgccaggg

SEQ ID NO: 252813 - DNA, 20 bp, human
ggagaggaggttcccttcga

SEQ ID NO: 252814 - DNA, 20 bp, human
gggcgcgccaatggaggggg

SEQ ID NO: 252815 - DNA, 20 bp, human
gtctggataatccactctcc

SEQ ID NO: 252816 - DNA, 20 bp, human
gcaaggaagcagtcgggatt

SEQ ID NO: 252817 - DNA, 20 bp, human
ggaagcagtcgggattgggc

SEQ ID NO: 252818 - DNA, 20 bp, human
gtatggggcgaggcgctctc

SEQ ID NO: 252819 - DNA, 20 bp, human
ggcgaggcgctctcaggtgg

SEQ ID NO: 252820 - DNA, 20 bp, human
ggggtcgcggcgtctcgctc

SEQ ID NO: 252821 - DNA, 20 bp, human
gtagaggggacaggaccaga

SEQ ID NO: 252822 - DNA, 20 bp, human
gggtgggcggggactcagtt

SEQ ID NO: 252823 - DNA, 20 bp, human
gcacgaagctgcgtcacttc

SEQ ID NO: 252824 - DNA, 20 bp, human
gcgcggggcggggcatatgc

SEQ ID NO: 252825 - DNA, 20 bp, human
ggggaaagggggcgaggctt

SEQ ID NO: 252826 - DNA, 20 bp, human
gtgggcggtgcagctctccg

SEQ ID NO: 252827 - DNA, 20 bp, human
gcattcggacccacgtgggg

SEQ ID NO: 252828 - DNA, 20 bp, human
gccgcagcccctaccaatgg

SEQ ID NO: 252829 - DNA, 20 bp, human
ggacccgcagcccctaccaa

SEQ ID NO: 252830 - DNA, 20 bp, human
gtcccttcccccattggtag

SEQ ID NO: 252831 - DNA, 20 bp, human
gtaaccattcggacccacgt

SEQ ID NO: 252832 - DNA, 20 bp, human
gtgcgctgctccaaccgcca

SEQ ID NO: 252833 - DNA, 20 bp, human
gaagcgcgctacctgcccag

SEQ ID NO: 252834 - DNA, 20 bp, human
ggcagcccggcatgctaatg

SEQ ID NO: 252835 - DNA, 20 bp, human
ggcccctaccaatgggggaa

SEQ ID NO: 252836 - DNA, 20 bp, human
gtggcccagcgagaacaggg

SEQ ID NO: 252837 - DNA, 20 bp, human
ggccctcagggcggtgttta

SEQ ID NO: 252838 - DNA, 20 bp, human
gtcagtagctggggccggct

SEQ ID NO: 252839 - DNA, 20 bp, human
gtagtggcccagcgagaaca

SEQ ID NO: 252840 - DNA, 20 bp, human
gcgcgcccgggcggccgatg

SEQ ID NO: 252841 - DNA, 20 bp, human
ggcagctttgcgcgcccggg

SEQ ID NO: 252842 - DNA, 20 bp, human
ggctggggccggctcggctg

SEQ ID NO: 252843 - DNA, 20 bp, human
gtgaagaatcacgtgtgttg

SEQ ID NO: 252844 - DNA, 20 bp, human
gagcactttcagctgcggtt

SEQ ID NO: 252845 - DNA, 20 bp, human
gctcagggcggtgtttaggg

SEQ ID NO: 252846 - DNA, 20 bp, human
ggaccgccggaagggttgag

SEQ ID NO: 252847 - DNA, 20 bp, human
ggaagcgccggggaccgtgg

SEQ ID NO: 252848 - DNA, 20 bp, human
gggaccgtggaggaagtcat

SEQ ID NO: 252849 - DNA, 20 bp, human
ggggcactgcgaaacatgat

SEQ ID NO: 252850 - DNA, 20 bp, human
gcgcagagtggcgtcagatt

SEQ ID NO: 252851 - DNA, 20 bp, human
ggcggcctggaccgccggaa

SEQ ID NO: 252852 - DNA, 20 bp, human
gtcgcagtgcccggaagggg

SEQ ID NO: 252853 - DNA, 20 bp, human
gcgaaacatgattggccttg

SEQ ID NO: 252854 - DNA, 20 bp, human
gtgcagccgctcaacccttc

SEQ ID NO: 252855 - DNA, 20 bp, human
ggctgcggccccgacttcag

SEQ ID NO: 252856 - DNA, 20 bp, human
gagcgcacggcccgcggcaa

SEQ ID NO: 252857 - DNA, 20 bp, human
gccaggccctgtccaatcac

SEQ ID NO: 252858 - DNA, 20 bp, human
gacggggcgagcggagcgtg

SEQ ID NO: 252859 - DNA, 20 bp, human
gcaactgcggcccaacgcca

SEQ ID NO: 252860 - DNA, 20 bp, human
ggacagggcctggcggtgaa

SEQ ID NO: 252861 - DNA, 20 bp, human
gcgctccgctcgccccgtgg

SEQ ID NO: 252862 - DNA, 20 bp, human
gagactgcgcagcgcccggc

SEQ ID NO: 252863 - DNA, 20 bp, human
gtgggccgcaaacgcctctc

SEQ ID NO: 252864 - DNA, 20 bp, human
ggccagtgggattctccaag

SEQ ID NO: 252865 - DNA, 20 bp, human
ggcaacggcgcacagccgct

SEQ ID NO: 252866 - DNA, 20 bp, human
gcagacccgaagggcgcgtc

SEQ ID NO: 252867 - DNA, 20 bp, human
gtagccccgcagcgtctcgg

SEQ ID NO: 252868 - DNA, 20 bp, human
gggagtgcaggtatgaaaga

SEQ ID NO: 252869 - DNA, 20 bp, human
gcactccggacgcgcccttc

SEQ ID NO: 252870 - DNA, 20 bp, human
gtagccccgcgccatctcgg

SEQ ID NO: 252871 - DNA, 20 bp, human
ggcagggcgcaggcggaacg

SEQ ID NO: 252872 - DNA, 20 bp, human
gggcgcatgcgcgcagtccg

SEQ ID NO: 252873 - DNA, 20 bp, human
gactccaagagtgaaagctg

SEQ ID NO: 252874 - DNA, 20 bp, human
gaggggcgaggtccaggtgt

SEQ ID NO: 252875 - DNA, 20 bp, human
gaccggccaccgagacgctg

SEQ ID NO: 252876 - DNA, 20 bp, human
gggggcgcttcattggtcat

SEQ ID NO: 252877 - DNA, 20 bp, human
gggggcgcccgagtagaagg

SEQ ID NO: 252878 - DNA, 20 bp, human
gagcgggagggcaggcgcac

SEQ ID NO: 252879 - DNA, 20 bp, human
gctgtcgcgagaggtgctga

SEQ ID NO: 252880 - DNA, 20 bp, human
ggggagggcaggcgcaccgg

SEQ ID NO: 252881 - DNA, 20 bp, human
ggctctcttgctgtcgcgag

SEQ ID NO: 252882 - DNA, 20 bp, human
gcggctccgcagcctctcct

SEQ ID NO: 252883 - DNA, 20 bp, human
ggccggggcgcccgagtaga

SEQ ID NO: 252884 - DNA, 20 bp, human
gtgcgcaagtacggaagctg

SEQ ID NO: 252885 - DNA, 20 bp, human
gcaatgaagcgcccccgcga

SEQ ID NO: 252886 - DNA, 20 bp, human
gcccagctgcccacgttcta

SEQ ID NO: 252887 - DNA, 20 bp, human
gtacgtcgcgctcgtacgac

SEQ ID NO: 252888 - DNA, 20 bp, human
gacgacaggcttagaacatc

SEQ ID NO: 252889 - DNA, 20 bp, human
gcccgggttgcgtgagtcgg

SEQ ID NO: 252890 - DNA, 20 bp, human
gtctcagagccctagaacgt

SEQ ID NO: 252891 - DNA, 20 bp, human
ggcccccgactcacgcaacc

SEQ ID NO: 252892 - DNA, 20 bp, human
gctgcggtagggggcagaac

SEQ ID NO: 252893 - DNA, 20 bp, human
ggtacgagcgcgacgtaaag

SEQ ID NO: 252894 - DNA, 20 bp, human
gcttcccgggttgcgtgagt

SEQ ID NO: 252895 - DNA, 20 bp, human
ggtaaagcggatctgcttta

SEQ ID NO: 252896 - DNA, 20 bp, human
gagggaggaaggccgaaccg

SEQ ID NO: 252897 - DNA, 20 bp, human
gggagcccttgtcccaacca

SEQ ID NO: 252898 - DNA, 20 bp, human
ggggctggataagaaggtgt

SEQ ID NO: 252899 - DNA, 20 bp, human
gcggtagcgcggtgtcttct

SEQ ID NO: 252900 - DNA, 20 bp, human
gccagccctggttgggacaa

SEQ ID NO: 252901 - DNA, 20 bp, human
ggagctcagagcgtacggga

SEQ ID NO: 252902 - DNA, 20 bp, human
gagctcctcctccagaaaaa

SEQ ID NO: 252903 - DNA, 20 bp, human
gtccaattcccggcagtcag

SEQ ID NO: 252904 - DNA, 20 bp, human
ggctaccgaggactgcagtc

SEQ ID NO: 252905 - DNA, 20 bp, human
gaggcacgtgaatacttctt

SEQ ID NO: 252906 - DNA, 20 bp, human
gactgggcggagctgaatga

SEQ ID NO: 252907 - DNA, 20 bp, human
gccaaccccgggtcagggga

SEQ ID NO: 252908 - DNA, 20 bp, human
gggtaggagcagccaacccc

SEQ ID NO: 252909 - DNA, 20 bp, human
gggagctgaatgaaggtgca

SEQ ID NO: 252910 - DNA, 20 bp, human
ggactccttcccctgacccg

SEQ ID NO: 252911 - DNA, 20 bp, human
gttcctaaccaggtgcacaa

SEQ ID NO: 252912 - DNA, 20 bp, human
gagagggagaatttaagatg

SEQ ID NO: 252913 - DNA, 20 bp, human
ggctgcagccaggcaacact

SEQ ID NO: 252914 - DNA, 20 bp, human
gaagaatctctcaaaagctc

SEQ ID NO: 252915 - DNA, 20 bp, human
ggacctttgtgcacctggtt

SEQ ID NO: 252916 - DNA, 20 bp, human
gacaagggaactgactcagg

SEQ ID NO: 252917 - DNA, 20 bp, human
gcgcacaagggaactgactc

SEQ ID NO: 252918 - DNA, 20 bp, human
gaggcgtcagggagactcac

SEQ ID NO: 252919 - DNA, 20 bp, human
ggagaaagagggctttactt

SEQ ID NO: 252920 - DNA, 20 bp, human
gagaagtgaaagcctaatct

SEQ ID NO: 252921 - DNA, 20 bp, human
gttgacgtcattgagaaaga

SEQ ID NO: 252922 - DNA, 20 bp, human
gggcgcatgctgacctcaga

SEQ ID NO: 252923 - DNA, 20 bp, human
gtggaaggcaggtagaaaaa

SEQ ID NO: 252924 - DNA, 20 bp, human
gctcaggaggcagagaagat

SEQ ID NO: 252925 - DNA, 20 bp, human
gcaccctcttatttaaaagg

SEQ ID NO: 252926 - DNA, 20 bp, human
ggggaccgggagcccgacca

SEQ ID NO: 252927 - DNA, 20 bp, human
gcctcagcccaagatttcta

SEQ ID NO: 252928 - DNA, 20 bp, human
ggaaatcttgggctgagggc

SEQ ID NO: 252929 - DNA, 20 bp, human
gccacgtcgcggttggtggt

SEQ ID NO: 252930 - DNA, 20 bp, human
ggagggatcacccagcagcg

SEQ ID NO: 252931 - DNA, 20 bp, human
gcctccgggctcaagttgca

SEQ ID NO: 252932 - DNA, 20 bp, human
gtccgcggccgccgcttcgg

SEQ ID NO: 252933 - DNA, 20 bp, human
gccgggctcaagttgcaagg

SEQ ID NO: 252934 - DNA, 20 bp, human
ggcctcgccaggccacgtcg

SEQ ID NO: 252935 - DNA, 20 bp, human
gcccccgagagctggctgcg

SEQ ID NO: 252936 - DNA, 20 bp, human
gagcgcgtgcgcggcgggaa

SEQ ID NO: 252937 - DNA, 20 bp, human
gaggctctggtgttgctggg

SEQ ID NO: 252938 - DNA, 20 bp, human
ggcgcacgcgctcccgtgta

SEQ ID NO: 252939 - DNA, 20 bp, human
gctctcccgcctctcccaat

SEQ ID NO: 252940 - DNA, 20 bp, human
gggagagcgccgctcccgac

SEQ ID NO: 252941 - DNA, 20 bp, human
gggcccgaggcgcctaagtg

SEQ ID NO: 252942 - DNA, 20 bp, human
ggcccagcgcagagcctgtc

SEQ ID NO: 252943 - DNA, 20 bp, human
gcggcatcgacgcgtcttcg

SEQ ID NO: 252944 - DNA, 20 bp, human
ggggtcagcgccaacgccca

SEQ ID NO: 252945 - DNA, 20 bp, human
ggacgcgtcttcggggccaa

SEQ ID NO: 252946 - DNA, 20 bp, human
gtcgcgcagggaaattcgag

SEQ ID NO: 252947 - DNA, 20 bp, human
gaaattcgagtggtgggctt

SEQ ID NO: 252948 - DNA, 20 bp, human
ggggaagctaccagaacgac

SEQ ID NO: 252949 - DNA, 20 bp, human
ggggcttgggcccgtcgttc

SEQ ID NO: 252950 - DNA, 20 bp, human
ggcagggaaattcgagtggt

SEQ ID NO: 252951 - DNA, 20 bp, human
gccgccgccgccatgagcaa

SEQ ID NO: 252952 - DNA, 20 bp, human
gtatgcgtcttcagcctgac

SEQ ID NO: 252953 - DNA, 20 bp, human
gctggtagcttcccagtaga

SEQ ID NO: 252954 - DNA, 20 bp, human
ggcttacggcgccctctact

SEQ ID NO: 252955 - DNA, 20 bp, human
ggcgaaatgggctcatggta

SEQ ID NO: 252956 - DNA, 20 bp, human
gcctcagcgcggccccgcca

SEQ ID NO: 252957 - DNA, 20 bp, human
gtgaggaggcgccgagggga

SEQ ID NO: 252958 - DNA, 20 bp, human
gtctctgcgcgcgcgcgtca

SEQ ID NO: 252959 - DNA, 20 bp, human
gcccgcaggcgctgcggacc

SEQ ID NO: 252960 - DNA, 20 bp, human
gcccctccccgcaggcgctg

SEQ ID NO: 252961 - DNA, 20 bp, human
gcagtgccccgggtcttgga

SEQ ID NO: 252962 - DNA, 20 bp, human
ggcgcgtcacggggccgcgg

SEQ ID NO: 252963 - DNA, 20 bp, human
gcggcggaaccgcaccgagg

SEQ ID NO: 252964 - DNA, 20 bp, human
gcgcgcagagacgctcccgc

SEQ ID NO: 252965 - DNA, 20 bp, human
ggccggggccgagagcagca

SEQ ID NO: 252966 - DNA, 20 bp, human
ggccccagctcccaccccga

SEQ ID NO: 252967 - DNA, 20 bp, human
gcccggggaaccccgagtgg

SEQ ID NO: 252968 - DNA, 20 bp, human
gccggcgcgccgcccggcca

SEQ ID NO: 252969 - DNA, 20 bp, human
gtggctacgtggcagggcgg

SEQ ID NO: 252970 - DNA, 20 bp, human
gcgggcaggggtcccgcgtg

SEQ ID NO: 252971 - DNA, 20 bp, human
gcgcaggtggctacgtggca

SEQ ID NO: 252972 - DNA, 20 bp, human
gtggggcccggtcacacgca

SEQ ID NO: 252973 - DNA, 20 bp, human
gggagctggggccgcttccc

SEQ ID NO: 252974 - DNA, 20 bp, human
gggctcctggcccccactcg

SEQ ID NO: 252975 - DNA, 20 bp, human
gcggggtgggagaggtcgcc

SEQ ID NO: 252976 - DNA, 20 bp, human
ggcagttggcacatctgaga

SEQ ID NO: 252977 - DNA, 20 bp, human
ggagcggctcaggccagcgc

SEQ ID NO: 252978 - DNA, 20 bp, human
ggacagcatcgtcacggcgg

SEQ ID NO: 252979 - DNA, 20 bp, human
ggcagctgacagcatcgtca

SEQ ID NO: 252980 - DNA, 20 bp, human
ggctgctgctcctgcttaaa

SEQ ID NO: 252981 - DNA, 20 bp, human
gggcagagattgaagagagt

SEQ ID NO: 252982 - DNA, 20 bp, human
gacggccggtgggcggtgca

SEQ ID NO: 252983 - DNA, 20 bp, human
gcgcagggagcacggccggt

SEQ ID NO: 252984 - DNA, 20 bp, human
gggtggagcgcgagggcgct

SEQ ID NO: 252985 - DNA, 20 bp, human
ggtggcacctaaaagctctt

SEQ ID NO: 252986 - DNA, 20 bp, human
gtcaaggcggggttacaggt

SEQ ID NO: 252987 - DNA, 20 bp, human
ggggctggcccaacgcagag

SEQ ID NO: 252988 - DNA, 20 bp, human
gtggcatctacaacaatcga

SEQ ID NO: 252989 - DNA, 20 bp, human
ggggctagtccagaagttca

SEQ ID NO: 252990 - DNA, 20 bp, human
gggtaagaaaccagctgtga

SEQ ID NO: 252991 - DNA, 20 bp, human
gcgcagggagtgtgggtaac

SEQ ID NO: 252992 - DNA, 20 bp, human
gaagttcaaggcggggttac

SEQ ID NO: 252993 - DNA, 20 bp, human
gacctcgcgccgctctgcgt

SEQ ID NO: 252994 - DNA, 20 bp, human
gcccgctcctgtgcgcaagt

SEQ ID NO: 252995 - DNA, 20 bp, human
ggattgttgtagatgccaag

SEQ ID NO: 252996 - DNA, 20 bp, human
gaaaggactactgagttata

SEQ ID NO: 252997 - DNA, 20 bp, human
gctgaagcccaagatttgga

SEQ ID NO: 252998 - DNA, 20 bp, human
gccaagatttggaaggagag

SEQ ID NO: 252999 - DNA, 20 bp, human
gtagttgtgtctcttgacat

SEQ ID NO: 253000 - DNA, 20 bp, human
ggaatctgaagcccaagatt

SEQ ID NO: 253001 - DNA, 20 bp, human
ggaaggagagagggaacttt

SEQ ID NO: 253002 - DNA, 20 bp, human
gagagatttacactgccaaa

SEQ ID NO: 253003 - DNA, 20 bp, human
gcttagtgtgaatcagttta

SEQ ID NO: 253004 - DNA, 20 bp, human
gagagtttctataagtagtt

SEQ ID NO: 253005 - DNA, 20 bp, human
gcttcagattccgatcatgt

SEQ ID NO: 253006 - DNA, 20 bp, human
gagggcaggtagcgctgaaa

SEQ ID NO: 253007 - DNA, 20 bp, human
ggagccaggtcccagacgga

SEQ ID NO: 253008 - DNA, 20 bp, human
gctcccctccgcgggtggcg

SEQ ID NO: 253009 - DNA, 20 bp, human
ggaccagcgcggctgagtcg

SEQ ID NO: 253010 - DNA, 20 bp, human
gtattcgaggaggttgggca

SEQ ID NO: 253011 - DNA, 20 bp, human
ggcgggtggcgaggaaacac

SEQ ID NO: 253012 - DNA, 20 bp, human
gaaaggagccaggtcccaga

SEQ ID NO: 253013 - DNA, 20 bp, human
gctgccctccgtctgggacc

SEQ ID NO: 253014 - DNA, 20 bp, human
ggtttcctcgccacccgcgg

SEQ ID NO: 253015 - DNA, 20 bp, human
ggaaacaccggcgagaggaa

SEQ ID NO: 253016 - DNA, 20 bp, human
gtccgcccgtggcctaggcg

SEQ ID NO: 253017 - DNA, 20 bp, human
gcctaggccacgggcggaaa

SEQ ID NO: 253018 - DNA, 20 bp, human
gccagaaggaagccccgcct

SEQ ID NO: 253019 - DNA, 20 bp, human
gcgggagagttgacttccgg

SEQ ID NO: 253020 - DNA, 20 bp, human
ggcggggattgggcgagagt

SEQ ID NO: 253021 - DNA, 20 bp, human
ggaagccccgcctaggccac

SEQ ID NO: 253022 - DNA, 20 bp, human
ggaaagcaacacacgttgtg

SEQ ID NO: 253023 - DNA, 20 bp, human
gaactctcccggatgttccg

SEQ ID NO: 253024 - DNA, 20 bp, human
gggggaggggcggcaaagca

SEQ ID NO: 253025 - DNA, 20 bp, human
gccttgaaatcccttgttga

SEQ ID NO: 253026 - DNA, 20 bp, human
gccctggtccaggccactga

SEQ ID NO: 253027 - DNA, 20 bp, human
gtaactgccgcgcccggggg

SEQ ID NO: 253028 - DNA, 20 bp, human
ggaagaaactaaggccggga

SEQ ID NO: 253029 - DNA, 20 bp, human
gaaactaaggccgggagggc

SEQ ID NO: 253030 - DNA, 20 bp, human
ggcccggagctacacgctcc

SEQ ID NO: 253031 - DNA, 20 bp, human
gtggcctggaccagggcgga

SEQ ID NO: 253032 - DNA, 20 bp, human
gccgcggcgcctagggccga

SEQ ID NO: 253033 - DNA, 20 bp, human
gtccggagccgcggcgccta

SEQ ID NO: 253034 - DNA, 20 bp, human
gccgggcgcggcagttacgg

SEQ ID NO: 253035 - DNA, 20 bp, human
gagcctggagcgtgtagctc

SEQ ID NO: 253036 - DNA, 20 bp, human
gcggtgcaggagctcgtagt

SEQ ID NO: 253037 - DNA, 20 bp, human
gtgcaggagctcgtagtcgg

SEQ ID NO: 253038 - DNA, 20 bp, human
ggctccttccggtggaagag

SEQ ID NO: 253039 - DNA, 20 bp, human
gggcggttcagctgcgacaa

SEQ ID NO: 253040 - DNA, 20 bp, human
gcggggacaactggctgcaa

SEQ ID NO: 253041 - DNA, 20 bp, human
gagcctggaggttcaggagc

SEQ ID NO: 253042 - DNA, 20 bp, human
gggaaggagccttccagacc

SEQ ID NO: 253043 - DNA, 20 bp, human
gagcgaggccggagaaggcg

SEQ ID NO: 253044 - DNA, 20 bp, human
ggacaactggctgcaacggt

SEQ ID NO: 253045 - DNA, 20 bp, human
gaggccgagagcgaagcgcg

SEQ ID NO: 253046 - DNA, 20 bp, human
gtcaggggccaatgctggaa

SEQ ID NO: 253047 - DNA, 20 bp, human
gagtgaaagcaaactttctg

SEQ ID NO: 253048 - DNA, 20 bp, human
gtccaggatggggtacagga

SEQ ID NO: 253049 - DNA, 20 bp, human
ggactcgctgaggagaagaa

SEQ ID NO: 253050 - DNA, 20 bp, human
gagcctgtctccgggatctc

SEQ ID NO: 253051 - DNA, 20 bp, human
ggtcctgagatcccggagac

SEQ ID NO: 253052 - DNA, 20 bp, human
gatcccggagacaggctgtg

SEQ ID NO: 253053 - DNA, 20 bp, human
ggcgcgtcaggggccaatgc

SEQ ID NO: 253054 - DNA, 20 bp, human
gggaaacagcggactcgctg

SEQ ID NO: 253055 - DNA, 20 bp, human
gcacacacacgctgctggag

SEQ ID NO: 253056 - DNA, 20 bp, human
gtcagcaagccaggatatga

SEQ ID NO: 253057 - DNA, 20 bp, human
gagcacaaggtcagcaagcc

SEQ ID NO: 253058 - DNA, 20 bp, human
gtggggcaaggtcttaataa

SEQ ID NO: 253059 - DNA, 20 bp, human
gggtaacagctggcatacag

SEQ ID NO: 253060 - DNA, 20 bp, human
gaaaaactctcctgtcctat

SEQ ID NO: 253061 - DNA, 20 bp, human
gggggcttgatctgagcaca

SEQ ID NO: 253062 - DNA, 20 bp, human
gacatgtcaccttcatatcc

SEQ ID NO: 253063 - DNA, 20 bp, human
gtctcctacttaaccccttg

SEQ ID NO: 253064 - DNA, 20 bp, human
gcagaaagcaatgagttggc

SEQ ID NO: 253065 - DNA, 20 bp, human
gtacttaaccccttggggca

SEQ ID NO: 253066 - DNA, 20 bp, human
ggaggaggagcccagccaat

SEQ ID NO: 253067 - DNA, 20 bp, human
gaaggccgaggccgctagga

SEQ ID NO: 253068 - DNA, 20 bp, human
gggtgctcgtgcgcatgcgt

SEQ ID NO: 253069 - DNA, 20 bp, human
gcggcctcggccttcccgta

SEQ ID NO: 253070 - DNA, 20 bp, human
gcgcatgcgtaggctctgag

SEQ ID NO: 253071 - DNA, 20 bp, human
gactcctaacagcggctctc

SEQ ID NO: 253072 - DNA, 20 bp, human
gaggccagagagccgctgtt

SEQ ID NO: 253073 - DNA, 20 bp, human
ggccgctaggaagggttgca

SEQ ID NO: 253074 - DNA, 20 bp, human
gcaacccttcctagcggcct

SEQ ID NO: 253075 - DNA, 20 bp, human
gctctgagcgggccggtcgc

SEQ ID NO: 253076 - DNA, 20 bp, human
gcggccaggcgggctggcga

SEQ ID NO: 253077 - DNA, 20 bp, human
gcccgcccgggccgcagcac

SEQ ID NO: 253078 - DNA, 20 bp, human
gtgcaggcgggtgtgcccgt

SEQ ID NO: 253079 - DNA, 20 bp, human
ggaggggcccggcgcggtcg

SEQ ID NO: 253080 - DNA, 20 bp, human
ggaaagccgcacggccaggc

SEQ ID NO: 253081 - DNA, 20 bp, human
gcgcacacacgcccgtgctg

SEQ ID NO: 253082 - DNA, 20 bp, human
gaaacggcccaccagaaggt

SEQ ID NO: 253083 - DNA, 20 bp, human
ggcgggtgtgcccgtgggga

SEQ ID NO: 253084 - DNA, 20 bp, human
gggcccaccagaaggtgggt

SEQ ID NO: 253085 - DNA, 20 bp, human
ggcacacccgcctgcaagcc

SEQ ID NO: 253086 - DNA, 20 bp, human
gccgacagcccggagtctgt

SEQ ID NO: 253087 - DNA, 20 bp, human
gcttccagcctgggccaacc

SEQ ID NO: 253088 - DNA, 20 bp, human
ggcggtctcgccctccgtac

SEQ ID NO: 253089 - DNA, 20 bp, human
ggaggctcgaagcgcatgcg

SEQ ID NO: 253090 - DNA, 20 bp, human
gcggcctgacgggaccaagg

SEQ ID NO: 253091 - DNA, 20 bp, human
gaggaggcggggccatcccg

SEQ ID NO: 253092 - DNA, 20 bp, human
gagactccgggctgtcgggg

SEQ ID NO: 253093 - DNA, 20 bp, human
ggctggctcggccagtacgg

SEQ ID NO: 253094 - DNA, 20 bp, human
gccgcggcaaggcacgcaca

SEQ ID NO: 253095 - DNA, 20 bp, human
gggcactcgcgcttccagcc

SEQ ID NO: 253096 - DNA, 20 bp, human
ggcggggtgaagagtgtcaa

SEQ ID NO: 253097 - DNA, 20 bp, human
gcgagcgactaagcaaggga

SEQ ID NO: 253098 - DNA, 20 bp, human
gcagccgagcgactaagcaa

SEQ ID NO: 253099 - DNA, 20 bp, human
gtacccgccctcttggaccc

SEQ ID NO: 253100 - DNA, 20 bp, human
ggggtcctatctggagacga

SEQ ID NO: 253101 - DNA, 20 bp, human
ggggagcagtgggcagtaac

SEQ ID NO: 253102 - DNA, 20 bp, human
gcggctcaccttcggggtga

SEQ ID NO: 253103 - DNA, 20 bp, human
gaccttgaaagggtcctatc

SEQ ID NO: 253104 - DNA, 20 bp, human
gtcccagagtcctgactgca

SEQ ID NO: 253105 - DNA, 20 bp, human
gctggcccggctcaccttcg

SEQ ID NO: 253106 - DNA, 20 bp, human
ggagacagagcgggaggatg

SEQ ID NO: 253107 - DNA, 20 bp, human
gtggaggggtctttggaaac

SEQ ID NO: 253108 - DNA, 20 bp, human
gggagtcaggggctgaagat

SEQ ID NO: 253109 - DNA, 20 bp, human
gggaggggggcggaagcggt

SEQ ID NO: 253110 - DNA, 20 bp, human
gagtcaggggacaacgcttc

SEQ ID NO: 253111 - DNA, 20 bp, human
ggggtgggaagatctaagaa

SEQ ID NO: 253112 - DNA, 20 bp, human
gtccctaggcatcgctgcgc

SEQ ID NO: 253113 - DNA, 20 bp, human
gcccacaactactggaaaag

SEQ ID NO: 253114 - DNA, 20 bp, human
ggccagcgcagcgatgccta

SEQ ID NO: 253115 - DNA, 20 bp, human
gttagcaggcgctttagtag

SEQ ID NO: 253116 - DNA, 20 bp, human
ggcgagggctccagcatcac

SEQ ID NO: 253117 - DNA, 20 bp, human
gcggggtcctggggcgatcg

SEQ ID NO: 253118 - DNA, 20 bp, human
gggctccagcatcacaggtg

SEQ ID NO: 253119 - DNA, 20 bp, human
gcgggcgggtgcgggaaaga

SEQ ID NO: 253120 - DNA, 20 bp, human
gacccgacgccaaggggagg

SEQ ID NO: 253121 - DNA, 20 bp, human
gatcccaggcccgtcttctc

SEQ ID NO: 253122 - DNA, 20 bp, human
gggtggggtcgcgtcttttc

SEQ ID NO: 253123 - DNA, 20 bp, human
ggatgggggtgcggggtcct

SEQ ID NO: 253124 - DNA, 20 bp, human
gtcagcttgtgctcgaggat

SEQ ID NO: 253125 - DNA, 20 bp, human
gaggacccgacgccaagggg

SEQ ID NO: 253126 - DNA, 20 bp, human
gcaaagggccacggcagagc

SEQ ID NO: 253127 - DNA, 20 bp, human
gttaagagggattgaacccc

SEQ ID NO: 253128 - DNA, 20 bp, human
gtgagtaaggtgcgtgaaat

SEQ ID NO: 253129 - DNA, 20 bp, human
gactccctccctacccccaa

SEQ ID NO: 253130 - DNA, 20 bp, human
gagagggattgaacccctgg

SEQ ID NO: 253131 - DNA, 20 bp, human
gagctgtgaaaacagatctt

SEQ ID NO: 253132 - DNA, 20 bp, human
gagcaggatgtctgtatcaa

SEQ ID NO: 253133 - DNA, 20 bp, human
gtgatatgcaataattaaga

SEQ ID NO: 253134 - DNA, 20 bp, human
gaggatgccaaaaactaatg

SEQ ID NO: 253135 - DNA, 20 bp, human
gaactgggcttcagatagtg

SEQ ID NO: 253136 - DNA, 20 bp, human
gtggccagggaatgaactca

SEQ ID NO: 253137 - DNA, 20 bp, human
ggggaatgaactcacggctc

SEQ ID NO: 253138 - DNA, 20 bp, human
ggactgaggtcaactgacgt

SEQ ID NO: 253139 - DNA, 20 bp, human
ggggcgggactccgaaacga

SEQ ID NO: 253140 - DNA, 20 bp, human
gtaaggggtgtggtgaacga

SEQ ID NO: 253141 - DNA, 20 bp, human
ggggcgtggtctgactgtgt

SEQ ID NO: 253142 - DNA, 20 bp, human
gctcacggctctggcttaag

SEQ ID NO: 253143 - DNA, 20 bp, human
ggtgtggtgaacgaaggatg

SEQ ID NO: 253144 - DNA, 20 bp, human
gtggtctgactgtgtgggcg

SEQ ID NO: 253145 - DNA, 20 bp, human
gggctctggcttaaggggtg

SEQ ID NO: 253146 - DNA, 20 bp, human
gtctaggggaggcatccgaa

SEQ ID NO: 253147 - DNA, 20 bp, human
gcagagacgcgggttaattg

SEQ ID NO: 253148 - DNA, 20 bp, human
gtctacggagcggggacgag

SEQ ID NO: 253149 - DNA, 20 bp, human
ggggcaggagtgttccagag

SEQ ID NO: 253150 - DNA, 20 bp, human
gcggggacgaggggcactac

SEQ ID NO: 253151 - DNA, 20 bp, human
gacgaggggcactacggggc

SEQ ID NO: 253152 - DNA, 20 bp, human
ggaaaggggtggaaagtggt

SEQ ID NO: 253153 - DNA, 20 bp, human
gagcgggtggagtaaacctg

SEQ ID NO: 253154 - DNA, 20 bp, human
gaacgtgcggctgtgcggtg

SEQ ID NO: 253155 - DNA, 20 bp, human
gaggccccgtctcacccttt

SEQ ID NO: 253156 - DNA, 20 bp, human
ggccacgaggaagaggggcg

SEQ ID NO: 253157 - DNA, 20 bp, human
ggggtcgcaggccttagcga

SEQ ID NO: 253158 - DNA, 20 bp, human
gctgcggccacgaggaagag

SEQ ID NO: 253159 - DNA, 20 bp, human
gcccgcgcctcctccgccga

SEQ ID NO: 253160 - DNA, 20 bp, human
gttagcgacgggctgttctc

SEQ ID NO: 253161 - DNA, 20 bp, human
ggggaacgtggaggcccgtg

SEQ ID NO: 253162 - DNA, 20 bp, human
ggggcccaccccccgagggg

SEQ ID NO: 253163 - DNA, 20 bp, human
gtccccgctgtctgggtcgc

SEQ ID NO: 253164 - DNA, 20 bp, human
gcccccgcccctcttcctcg

SEQ ID NO: 253165 - DNA, 20 bp, human
gcgctgggcccaccccccga

SEQ ID NO: 253166 - DNA, 20 bp, human
gtggtggtgggaatgcttta

SEQ ID NO: 253167 - DNA, 20 bp, human
gcgcacgaggcgttcctgtc

SEQ ID NO: 253168 - DNA, 20 bp, human
gggcgtcgtacgctgtcgta

SEQ ID NO: 253169 - DNA, 20 bp, human
gcagggctttgtcgcagcgg

SEQ ID NO: 253170 - DNA, 20 bp, human
gtgctcccgggtgatgacgt

SEQ ID NO: 253171 - DNA, 20 bp, human
gcacccgggagcagcgcgat

SEQ ID NO: 253172 - DNA, 20 bp, human
gacgctgtcgtaaggagcgc

SEQ ID NO: 253173 - DNA, 20 bp, human
ggaggcgttcctgtcaggct

SEQ ID NO: 253174 - DNA, 20 bp, human
ggtacgacgccgagcctgac

SEQ ID NO: 253175 - DNA, 20 bp, human
ggcgcagggctttgtcgcag

SEQ ID NO: 253176 - DNA, 20 bp, human
gtgtgaggacccatgaagaa

SEQ ID NO: 253177 - DNA, 20 bp, human
gaagtgccgcagggagttag

SEQ ID NO: 253178 - DNA, 20 bp, human
gatgacgggatccgagagaa

SEQ ID NO: 253179 - DNA, 20 bp, human
gacaatgaccacagcgatga

SEQ ID NO: 253180 - DNA, 20 bp, human
gagacgccgctaactccctg

SEQ ID NO: 253181 - DNA, 20 bp, human
gcggaagccgaagtgccgca

SEQ ID NO: 253182 - DNA, 20 bp, human
gccaaggtggagataaatat

SEQ ID NO: 253183 - DNA, 20 bp, human
gtcggatcccgtcatcgctg

SEQ ID NO: 253184 - DNA, 20 bp, human
gaagcagcatcatacttctt

SEQ ID NO: 253185 - DNA, 20 bp, human
ggagagaaaggcaaggcgga

SEQ ID NO: 253186 - DNA, 20 bp, human
ggggccgccagcggaggcga

SEQ ID NO: 253187 - DNA, 20 bp, human
gcccgcccccggctctgaat

SEQ ID NO: 253188 - DNA, 20 bp, human
ggccagccctgcgcccttag

SEQ ID NO: 253189 - DNA, 20 bp, human
gttcgcctgaagtccgaatc

SEQ ID NO: 253190 - DNA, 20 bp, human
gctgtgagacccagaggccg

SEQ ID NO: 253191 - DNA, 20 bp, human
gctgcagagccaccatttgg

SEQ ID NO: 253192 - DNA, 20 bp, human
gggctggccatcgcctccgc

SEQ ID NO: 253193 - DNA, 20 bp, human
gtgggtcccgcgggttcccg

SEQ ID NO: 253194 - DNA, 20 bp, human
gcacgcctgattcggacttc

SEQ ID NO: 253195 - DNA, 20 bp, human
gaccactgaggtctgggagg

SEQ ID NO: 253196 - DNA, 20 bp, human
gagggagagggaggagttcg

SEQ ID NO: 253197 - DNA, 20 bp, human
gcccccaagcctattactaa

SEQ ID NO: 253198 - DNA, 20 bp, human
gtacccggggagcatcctaa

SEQ ID NO: 253199 - DNA, 20 bp, human
ggtggaaggcaatgcagagt

SEQ ID NO: 253200 - DNA, 20 bp, human
gagtaacttaacaatcagcc

SEQ ID NO: 253201 - DNA, 20 bp, human
ggcactgctgagtgaggttg

SEQ ID NO: 253202 - DNA, 20 bp, human
ggagagggaggagttcgggg

SEQ ID NO: 253203 - DNA, 20 bp, human
gcgccaggccgggaaggctc

SEQ ID NO: 253204 - DNA, 20 bp, human
gggaacggaaggggtacccg

SEQ ID NO: 253205 - DNA, 20 bp, human
gactccgggtgagttcttaa

SEQ ID NO: 253206 - DNA, 20 bp, human
ggtagggctccatccaaaaa

SEQ ID NO: 253207 - DNA, 20 bp, human
ggtggggatcggcaaggaaa

SEQ ID NO: 253208 - DNA, 20 bp, human
gagcctagatgcatcctttc

SEQ ID NO: 253209 - DNA, 20 bp, human
ggttacaaaccctttttgga

SEQ ID NO: 253210 - DNA, 20 bp, human
gttccagaaaggatgcatct

SEQ ID NO: 253211 - DNA, 20 bp, human
gctgtgttacaaaccctttt

SEQ ID NO: 253212 - DNA, 20 bp, human
ggattgcttctgcctagagc

SEQ ID NO: 253213 - DNA, 20 bp, human
gagagttattctttactgta

SEQ ID NO: 253214 - DNA, 20 bp, human
gagattcttatgagattagt

SEQ ID NO: 253215 - DNA, 20 bp, human
gtgcatcctttctggaaaga

SEQ ID NO: 253216 - DNA, 20 bp, human
gcggccaatggccactccac

SEQ ID NO: 253217 - DNA, 20 bp, human
gtccactggcccgcaggcta

SEQ ID NO: 253218 - DNA, 20 bp, human
ggctagggcgcgccttcccg

SEQ ID NO: 253219 - DNA, 20 bp, human
ggaaggcgcgccctagcctg

SEQ ID NO: 253220 - DNA, 20 bp, human
ggctggaggccgccctcagc

SEQ ID NO: 253221 - DNA, 20 bp, human
ggggcggggcatgcggctgg

SEQ ID NO: 253222 - DNA, 20 bp, human
gacgcctgaggcgcgcgatg

SEQ ID NO: 253223 - DNA, 20 bp, human
ggcgcgcgatggggggaagg

SEQ ID NO: 253224 - DNA, 20 bp, human
ggccgccctcagccggccaa

SEQ ID NO: 253225 - DNA, 20 bp, human
gacaaagaaggccccccgga

SEQ ID NO: 253226 - DNA, 20 bp, human
ggggacaagctctaccatca

SEQ ID NO: 253227 - DNA, 20 bp, human
gcactcggcactccccctga

SEQ ID NO: 253228 - DNA, 20 bp, human
gccaaagccgggagtgatga

SEQ ID NO: 253229 - DNA, 20 bp, human
gataaggccctcatcactcc

SEQ ID NO: 253230 - DNA, 20 bp, human
gaggccctctctcaggcctt

SEQ ID NO: 253231 - DNA, 20 bp, human
gccacaggctccttgtagta

SEQ ID NO: 253232 - DNA, 20 bp, human
gggcctcggaccccaaagcc

SEQ ID NO: 253233 - DNA, 20 bp, human
gctcccggctttggggtccg

SEQ ID NO: 253234 - DNA, 20 bp, human
ggtccctctctaggtcccca

SEQ ID NO: 253235 - DNA, 20 bp, human
gtcaatctacccagaaattg

SEQ ID NO: 253236 - DNA, 20 bp, human
gggaacccggataatgggaa

SEQ ID NO: 253237 - DNA, 20 bp, human
ggatgacagcaaagacgatg

SEQ ID NO: 253238 - DNA, 20 bp, human
ggctaggagccagaatgggg

SEQ ID NO: 253239 - DNA, 20 bp, human
gagggagctaggagccagaa

SEQ ID NO: 253240 - DNA, 20 bp, human
ggaaggaagcatctatagtt

SEQ ID NO: 253241 - DNA, 20 bp, human
gtggcaggaacccggataat

SEQ ID NO: 253242 - DNA, 20 bp, human
gtgaaggaggcaatccctgg

SEQ ID NO: 253243 - DNA, 20 bp, human
gacagcaaagacgatgaggc

SEQ ID NO: 253244 - DNA, 20 bp, human
gtcggcaggcggtagggggt

SEQ ID NO: 253245 - DNA, 20 bp, human
gcctctcggcaggcggtagg

SEQ ID NO: 253246 - DNA, 20 bp, human
ggaccaggcgattgacgtca

SEQ ID NO: 253247 - DNA, 20 bp, human
ggtccctgacgtcaatcgcc

SEQ ID NO: 253248 - DNA, 20 bp, human
gcccccacttcattcgggaa

SEQ ID NO: 253249 - DNA, 20 bp, human
ggctaaagcgggccccgcct

SEQ ID NO: 253250 - DNA, 20 bp, human
gtctctatggcaatgggggg

SEQ ID NO: 253251 - DNA, 20 bp, human
ggtctctagactcccaggcg

SEQ ID NO: 253252 - DNA, 20 bp, human
gcgctttagcccggtcctag

SEQ ID NO: 253253 - DNA, 20 bp, human
gttcgggaaagggttaaagt

SEQ ID NO: 253254 - DNA, 20 bp, human
gcccggaaggaggctcttgg

SEQ ID NO: 253255 - DNA, 20 bp, human
ggcaaaggacgtcaggaact

SEQ ID NO: 253256 - DNA, 20 bp, human
ggcgcgcggcccggctttcg

SEQ ID NO: 253257 - DNA, 20 bp, human
gcggagggacggcctgggga

SEQ ID NO: 253258 - DNA, 20 bp, human
gagcctgggaaacacggccc

SEQ ID NO: 253259 - DNA, 20 bp, human
gcgcctgggccgtgtttccc

SEQ ID NO: 253260 - DNA, 20 bp, human
gtcggggcgagttttctcgc

SEQ ID NO: 253261 - DNA, 20 bp, human
gcggcgcgcgcggaggctga

SEQ ID NO: 253262 - DNA, 20 bp, human
gtcccgggagaaagtcgcct

SEQ ID NO: 253263 - DNA, 20 bp, human
ggctcccgacagctccggcc

SEQ ID NO: 253264 - DNA, 20 bp, human
gggcccaggcgactttctcc

SEQ ID NO: 253265 - DNA, 20 bp, human
gccggctcaccggggccccg

SEQ ID NO: 253266 - DNA, 20 bp, human
gcgcgccgtagtagctgggg

SEQ ID NO: 253267 - DNA, 20 bp, human
gggcctgggcgcacgtgcct

SEQ ID NO: 253268 - DNA, 20 bp, human
gagaggcggccacccgtgag

SEQ ID NO: 253269 - DNA, 20 bp, human
ggcgccgcgccgtagtagct

SEQ ID NO: 253270 - DNA, 20 bp, human
ggccaggagcgcgttccggg

SEQ ID NO: 253271 - DNA, 20 bp, human
gggctccggtggttgggcgg

SEQ ID NO: 253272 - DNA, 20 bp, human
ggctgcgcaagggaaccaat

SEQ ID NO: 253273 - DNA, 20 bp, human
ggtgctgcccgctcagtctc

SEQ ID NO: 253274 - DNA, 20 bp, human
gggtgggagcggctggctcc

SEQ ID NO: 253275 - DNA, 20 bp, human
gcgtagtagctggggcgggt

SEQ ID NO: 253276 - DNA, 20 bp, human
gcaggctccagacccgtctt

SEQ ID NO: 253277 - DNA, 20 bp, human
gtccctgcccaagacgggtc

SEQ ID NO: 253278 - DNA, 20 bp, human
gccgtcttgggcagggatct

SEQ ID NO: 253279 - DNA, 20 bp, human
gcctgatagccctttcatgg

SEQ ID NO: 253280 - DNA, 20 bp, human
gtccagacccgtcttgggca

SEQ ID NO: 253281 - DNA, 20 bp, human
gtcatggacacccggaagtc

SEQ ID NO: 253282 - DNA, 20 bp, human
gggaccggaagcagccgcca

SEQ ID NO: 253283 - DNA, 20 bp, human
gcttccggtccgccatgaaa

SEQ ID NO: 253284 - DNA, 20 bp, human
gtagccctttcatggcggac

SEQ ID NO: 253285 - DNA, 20 bp, human
gagagctctgtcacctctgt

SEQ ID NO: 253286 - DNA, 20 bp, human
gcccacctagacacggacat

SEQ ID NO: 253287 - DNA, 20 bp, human
gggagaaatacgtgcatctg

SEQ ID NO: 253288 - DNA, 20 bp, human
gaaaacactggttgttcctg

SEQ ID NO: 253289 - DNA, 20 bp, human
ggttattggcacaaaatgct

SEQ ID NO: 253290 - DNA, 20 bp, human
gacccagctggaaggaaccg

SEQ ID NO: 253291 - DNA, 20 bp, human
gggcgatgcagggccctcat

SEQ ID NO: 253292 - DNA, 20 bp, human
gcagctgggtgagtcccatg

SEQ ID NO: 253293 - DNA, 20 bp, human
ggctgctttacagaaaacac

SEQ ID NO: 253294 - DNA, 20 bp, human
ggcctatgtccgtgtctagg

SEQ ID NO: 253295 - DNA, 20 bp, human
gagttaaagctgagaatcat

SEQ ID NO: 253296 - DNA, 20 bp, human
gcccccgcgcggacccagga

SEQ ID NO: 253297 - DNA, 20 bp, human
gcggcgacctcggccctcct

SEQ ID NO: 253298 - DNA, 20 bp, human
gcgcgcagggcagccgagca

SEQ ID NO: 253299 - DNA, 20 bp, human
gcgctcctccgggaccccgg

SEQ ID NO: 253300 - DNA, 20 bp, human
ggggcgctcctccgggaccc

SEQ ID NO: 253301 - DNA, 20 bp, human
ggggcgagacccggtccgtg

SEQ ID NO: 253302 - DNA, 20 bp, human
gcgggcggccgccggggtcc

SEQ ID NO: 253303 - DNA, 20 bp, human
ggggctgtgtgtgacattca

SEQ ID NO: 253304 - DNA, 20 bp, human
ggggcgcccagcgtaggggc

SEQ ID NO: 253305 - DNA, 20 bp, human
gtacccaggtcggctgtgcg

SEQ ID NO: 253306 - DNA, 20 bp, human
gcagccggccggcccaggaa

SEQ ID NO: 253307 - DNA, 20 bp, human
gcacgcgcatgcccgagcat

SEQ ID NO: 253308 - DNA, 20 bp, human
gaaggagcgcgcgcccacgt

SEQ ID NO: 253309 - DNA, 20 bp, human
gcgccgggccacatgccaag

SEQ ID NO: 253310 - DNA, 20 bp, human
gtgggcgcgcgctcctttcc

SEQ ID NO: 253311 - DNA, 20 bp, human
ggggccggccggctgggcgt

SEQ ID NO: 253312 - DNA, 20 bp, human
gcgcgtcgtcagggactccc

SEQ ID NO: 253313 - DNA, 20 bp, human
gcccctcgggcgtacaaaac

SEQ ID NO: 253314 - DNA, 20 bp, human
gcgcatgcccgagcatgggg

SEQ ID NO: 253315 - DNA, 20 bp, human
gtgactatgcaggggtgaga

SEQ ID NO: 253316 - DNA, 20 bp, human
gcagtcggggcgctcacgtc

SEQ ID NO: 253317 - DNA, 20 bp, human
gagaaggagtggagcagtcg

SEQ ID NO: 253318 - DNA, 20 bp, human
gaccgcgacgcgggatgaga

SEQ ID NO: 253319 - DNA, 20 bp, human
ggacgcgggatgagaaggag

SEQ ID NO: 253320 - DNA, 20 bp, human
gaataggcgggaccgcgacg

SEQ ID NO: 253321 - DNA, 20 bp, human
ggaagggccagttcaaaaga

SEQ ID NO: 253322 - DNA, 20 bp, human
gccaccccttccactcaacg

SEQ ID NO: 253323 - DNA, 20 bp, human
gggcgctcacgtcaggtgaa

SEQ ID NO: 253324 - DNA, 20 bp, human
ggcaagcctcgttgagtgga

SEQ ID NO: 253325 - DNA, 20 bp, human
gctcacgtcaggtgaagggc

SEQ ID NO: 253326 - DNA, 20 bp, human
ggggacgccgccgtggtcgg

SEQ ID NO: 253327 - DNA, 20 bp, human
gggccccgtgcgcacggagg

SEQ ID NO: 253328 - DNA, 20 bp, human
ggtcgggggcggccctgcga

SEQ ID NO: 253329 - DNA, 20 bp, human
ggcagggccgcccccgacca

SEQ ID NO: 253330 - DNA, 20 bp, human
ggcgcacacgggtgcactct

SEQ ID NO: 253331 - DNA, 20 bp, human
ggggtgcactcttggctaga

SEQ ID NO: 253332 - DNA, 20 bp, human
gccgcgtgctgtacagtgtg

SEQ ID NO: 253333 - DNA, 20 bp, human
gcctgcctaggacaagtcgc

SEQ ID NO: 253334 - DNA, 20 bp, human
gacgccgccgtggtcggggg

SEQ ID NO: 253335 - DNA, 20 bp, human
gtgtgcgcgagcgggcttct

SEQ ID NO: 253336 - DNA, 20 bp, human
ggcgtcgcggggggggggat

SEQ ID NO: 253337 - DNA, 20 bp, human
gtgggctggtgacaggcgga

SEQ ID NO: 253338 - DNA, 20 bp, human
gtgtgcgccgtgcgtcgcgg

SEQ ID NO: 253339 - DNA, 20 bp, human
ggagcgctggtcgggaaagt

SEQ ID NO: 253340 - DNA, 20 bp, human
ggggtagccgcggagggccg

SEQ ID NO: 253341 - DNA, 20 bp, human
gtggaaggaagctgggttcg

SEQ ID NO: 253342 - DNA, 20 bp, human
gtggtcgggaaagtgggcat

SEQ ID NO: 253343 - DNA, 20 bp, human
ggggccgcggagcgctggtc

SEQ ID NO: 253344 - DNA, 20 bp, human
gaagctgggttcggggcgtt

SEQ ID NO: 253345 - DNA, 20 bp, human
gtcggggcgttgggtagccg

SEQ ID NO: 253346 - DNA, 20 bp, human
gtggcgatccattgagagga

SEQ ID NO: 253347 - DNA, 20 bp, human
gcgggtgcgcgcagaggatc

SEQ ID NO: 253348 - DNA, 20 bp, human
gggcggccggctgaatataa

SEQ ID NO: 253349 - DNA, 20 bp, human
gctggcgagagctgtcacaa

SEQ ID NO: 253350 - DNA, 20 bp, human
gcggtcctgcgcgtgtgtac

SEQ ID NO: 253351 - DNA, 20 bp, human
gggagacccgacccggccga

SEQ ID NO: 253352 - DNA, 20 bp, human
gcacacgcgcaggaccggag

SEQ ID NO: 253353 - DNA, 20 bp, human
gccatccagtacacacgcgc

SEQ ID NO: 253354 - DNA, 20 bp, human
gcggccgagggcagagcgca

SEQ ID NO: 253355 - DNA, 20 bp, human
gacagctctcgccagattgg

SEQ ID NO: 253356 - DNA, 20 bp, human
gggggggcggtcacagggga

SEQ ID NO: 253357 - DNA, 20 bp, human
gcacgagcgaggtcatgcgt

SEQ ID NO: 253358 - DNA, 20 bp, human
gagattccgtctgtggtcgt

SEQ ID NO: 253359 - DNA, 20 bp, human
ggatcccgcgactttttgtg

SEQ ID NO: 253360 - DNA, 20 bp, human
ggggccgggtagctgcctga

SEQ ID NO: 253361 - DNA, 20 bp, human
gccccgcccttggtcccttg

SEQ ID NO: 253362 - DNA, 20 bp, human
gctagccacacaaaaagtcg

SEQ ID NO: 253363 - DNA, 20 bp, human
ggtgcaccctccggtagctc

SEQ ID NO: 253364 - DNA, 20 bp, human
gtggtatgaaccagagctac

SEQ ID NO: 253365 - DNA, 20 bp, human
gaacagcgagattccgtctg

SEQ ID NO: 253366 - DNA, 20 bp, human
gcccgactggctgacgggga

SEQ ID NO: 253367 - DNA, 20 bp, human
ggggacctagaggttgggag

SEQ ID NO: 253368 - DNA, 20 bp, human
ggcggggacctgcgcccgac

SEQ ID NO: 253369 - DNA, 20 bp, human
gtgcgcccgactggctgacg

SEQ ID NO: 253370 - DNA, 20 bp, human
gagtcccagcgccgcccgga

SEQ ID NO: 253371 - DNA, 20 bp, human
gtagcagctagaggccggga

SEQ ID NO: 253372 - DNA, 20 bp, human
gtccgtgatggcggggttaa

SEQ ID NO: 253373 - DNA, 20 bp, human
ggcagagctgggggacctag

SEQ ID NO: 253374 - DNA, 20 bp, human
gactgtagcagctagaggcc

SEQ ID NO: 253375 - DNA, 20 bp, human
gctggccgccggaggataga

SEQ ID NO: 253376 - DNA, 20 bp, human
ggcgcaggagtcccgctctc

SEQ ID NO: 253377 - DNA, 20 bp, human
ggggccccaagagcgcctta

SEQ ID NO: 253378 - DNA, 20 bp, human
gtctggagcaggcaacccta

SEQ ID NO: 253379 - DNA, 20 bp, human
ggagtcccgctctctggagc

SEQ ID NO: 253380 - DNA, 20 bp, human
gcggagcgaaccactggcag

SEQ ID NO: 253381 - DNA, 20 bp, human
ggcagggggtgggcgcacgg

SEQ ID NO: 253382 - DNA, 20 bp, human
gacggcggcgcccagtatcc

SEQ ID NO: 253383 - DNA, 20 bp, human
ggcaaccctaaggcgctctt

SEQ ID NO: 253384 - DNA, 20 bp, human
ggtacccgccgcccgacgag

SEQ ID NO: 253385 - DNA, 20 bp, human
gacaacaaccggaagtgggg

SEQ ID NO: 253386 - DNA, 20 bp, human
gcgcgcatggggagtggaga

SEQ ID NO: 253387 - DNA, 20 bp, human
gtctcggggcgagtgagccc

SEQ ID NO: 253388 - DNA, 20 bp, human
gcccatgcgcggagagcccc

SEQ ID NO: 253389 - DNA, 20 bp, human
ggggctccgctggactagag

SEQ ID NO: 253390 - DNA, 20 bp, human
gtggaggtgaggaagatcct

SEQ ID NO: 253391 - DNA, 20 bp, human
gaggtgaggaagatcctggg

SEQ ID NO: 253392 - DNA, 20 bp, human
gaggccggaaaatgaccacc

SEQ ID NO: 253393 - DNA, 20 bp, human
gctcactcgccccgagagcg

SEQ ID NO: 253394 - DNA, 20 bp, human
gcccctaagccccgactcca

SEQ ID NO: 253395 - DNA, 20 bp, human
gcggtgcagccgcctttcct

SEQ ID NO: 253396 - DNA, 20 bp, human
gcgtcacatggtgggcgctg

SEQ ID NO: 253397 - DNA, 20 bp, human
gatgtgagcagcgaggcgag

SEQ ID NO: 253398 - DNA, 20 bp, human
gggggcgggcgtcacatggt

SEQ ID NO: 253399 - DNA, 20 bp, human
gccaaggggcgggcgtcaca

SEQ ID NO: 253400 - DNA, 20 bp, human
gcgggcccagaggccgaaag

SEQ ID NO: 253401 - DNA, 20 bp, human
gcacacttcaggagcccgcc

SEQ ID NO: 253402 - DNA, 20 bp, human
gaatcagaagcaaacggccg

SEQ ID NO: 253403 - DNA, 20 bp, human
gtcgaggtagcgaggagtca

SEQ ID NO: 253404 - DNA, 20 bp, human
ggggtggctgggccgggtcg

SEQ ID NO: 253405 - DNA, 20 bp, human
ggaacgcccggccaaggggc

SEQ ID NO: 253406 - DNA, 20 bp, human
gggagctacaagagtagcga

SEQ ID NO: 253407 - DNA, 20 bp, human
ggaggggaagggttgctctg

SEQ ID NO: 253408 - DNA, 20 bp, human
gagcgcgtaggagcctccct

SEQ ID NO: 253409 - DNA, 20 bp, human
ggaggctcctacgcgctgat

SEQ ID NO: 253410 - DNA, 20 bp, human
gtcaatagtggagtcgccga

SEQ ID NO: 253411 - DNA, 20 bp, human
gttgcagccaatcagcgcgt

SEQ ID NO: 253412 - DNA, 20 bp, human
gagcaaaagcgtgttttgcc

SEQ ID NO: 253413 - DNA, 20 bp, human
ggaggacccggccgcgtctg

SEQ ID NO: 253414 - DNA, 20 bp, human
gatagtggagtcgccgaggg

SEQ ID NO: 253415 - DNA, 20 bp, human
ggcgcgcagcgaccgcctga

SEQ ID NO: 253416 - DNA, 20 bp, human
gggcccccgaggctgaagaa

SEQ ID NO: 253417 - DNA, 20 bp, human
gtccggcaggggccctggtt

SEQ ID NO: 253418 - DNA, 20 bp, human
ggtaaggcggggcaccgcac

SEQ ID NO: 253419 - DNA, 20 bp, human
gacagcccgctgtagagaag

SEQ ID NO: 253420 - DNA, 20 bp, human
gaggagaccccgaggtagac

SEQ ID NO: 253421 - DNA, 20 bp, human
gatcccttcttcagcctcgg

SEQ ID NO: 253422 - DNA, 20 bp, human
gcaaccccagcacctctcgg

SEQ ID NO: 253423 - DNA, 20 bp, human
gaagccagcacgcagggcgg

SEQ ID NO: 253424 - DNA, 20 bp, human
gccccctgcggcgccaggta

SEQ ID NO: 253425 - DNA, 20 bp, human
gagctccttgcaggcccccg

SEQ ID NO: 253426 - DNA, 20 bp, human
gggggtggggggtactgagg

SEQ ID NO: 253427 - DNA, 20 bp, human
gaaaacacacacaagcgcgc

SEQ ID NO: 253428 - DNA, 20 bp, human
gaaaactagttggacgagtt

SEQ ID NO: 253429 - DNA, 20 bp, human
gcaaggctctgtgatgtctg

SEQ ID NO: 253430 - DNA, 20 bp, human
ggatctggttctattggcca

SEQ ID NO: 253431 - DNA, 20 bp, human
gcattgcttaaaaagggggt

SEQ ID NO: 253432 - DNA, 20 bp, human
gacgcacagcggggtggatc

SEQ ID NO: 253433 - DNA, 20 bp, human
gcccccgtgggctgcaccaa

SEQ ID NO: 253434 - DNA, 20 bp, human
gacaaagcattgcttaaaaa

SEQ ID NO: 253435 - DNA, 20 bp, human
gtgcgcgcttacgcacagcg

SEQ ID NO: 253436 - DNA, 20 bp, human
gctgcggcgggaagcatcgg

SEQ ID NO: 253437 - DNA, 20 bp, human
gcccccagttggctgtttca

SEQ ID NO: 253438 - DNA, 20 bp, human
ggagctgcggcgggaagcat

SEQ ID NO: 253439 - DNA, 20 bp, human
gcagggggcgactgaccaat

SEQ ID NO: 253440 - DNA, 20 bp, human
ggccgtgcgcctgtgacgtc

SEQ ID NO: 253441 - DNA, 20 bp, human
gcagcccccaaaaaatccaa

SEQ ID NO: 253442 - DNA, 20 bp, human
gtccccccttggattttttg

SEQ ID NO: 253443 - DNA, 20 bp, human
gggggccttgttaactcaaa

SEQ ID NO: 253444 - DNA, 20 bp, human
ggggcctggatttaatgcgg

SEQ ID NO: 253445 - DNA, 20 bp, human
ggcagacgccacgagtcgaa

SEQ ID NO: 253446 - DNA, 20 bp, human
gcccgcgagcctgttttcat

SEQ ID NO: 253447 - DNA, 20 bp, human
gggctcgcgggagaaccaaa

SEQ ID NO: 253448 - DNA, 20 bp, human
gtcgcgggagaaccaaaggg

SEQ ID NO: 253449 - DNA, 20 bp, human
gacgcaacggagcatcgtag

SEQ ID NO: 253450 - DNA, 20 bp, human
gccgcggcagaaacttccgg

SEQ ID NO: 253451 - DNA, 20 bp, human
gaagccgcggcagaaacttc

SEQ ID NO: 253452 - DNA, 20 bp, human
gttcaccctcggttgccagt

SEQ ID NO: 253453 - DNA, 20 bp, human
ggaagccgactggcaaccga

SEQ ID NO: 253454 - DNA, 20 bp, human
gcggctgccaaaatggagta

SEQ ID NO: 253455 - DNA, 20 bp, human
gcgatgctccgttgcgtctc

SEQ ID NO: 253456 - DNA, 20 bp, human
gaaaaggaggtgtgtcctct

SEQ ID NO: 253457 - DNA, 20 bp, human
gttggggaagaacaggatgt

SEQ ID NO: 253458 - DNA, 20 bp, human
gaacgaggatgacatgagtg

SEQ ID NO: 253459 - DNA, 20 bp, human
gaaacacttgggagtccttg

SEQ ID NO: 253460 - DNA, 20 bp, human
gcttggggcagacttcccac

SEQ ID NO: 253461 - DNA, 20 bp, human
gtccttgaggttcaccgaga

SEQ ID NO: 253462 - DNA, 20 bp, human
gtagaaatataccaccctag

SEQ ID NO: 253463 - DNA, 20 bp, human
gggaagtctgccccaaggtt

SEQ ID NO: 253464 - DNA, 20 bp, human
gtccctctcggtgaacctca

SEQ ID NO: 253465 - DNA, 20 bp, human
gtaaaatcaagcccgtattc

SEQ ID NO: 253466 - DNA, 20 bp, human
gagtgggcctcaatggatat

SEQ ID NO: 253467 - DNA, 20 bp, human
gtctgatcttggctccaagt

SEQ ID NO: 253468 - DNA, 20 bp, human
gagagctagactgcccactg

SEQ ID NO: 253469 - DNA, 20 bp, human
gtctcttcgttcaattactc

SEQ ID NO: 253470 - DNA, 20 bp, human
gaatgagataaacccagggc

SEQ ID NO: 253471 - DNA, 20 bp, human
gtttgaaatgagataaaccc

SEQ ID NO: 253472 - DNA, 20 bp, human
gtgtgtgagtgaatcaatga

SEQ ID NO: 253473 - DNA, 20 bp, human
gggcagtctagctctgatct

SEQ ID NO: 253474 - DNA, 20 bp, human
gggctccaagtgggcctcaa

SEQ ID NO: 253475 - DNA, 20 bp, human
gttcaaagcaaatgcctcag

SEQ ID NO: 253476 - DNA, 20 bp, human
ggggcggggcgaagaccgaa

SEQ ID NO: 253477 - DNA, 20 bp, human
gaacgagcgggctcacaggt

SEQ ID NO: 253478 - DNA, 20 bp, human
gacgaggggcggggagcaat

SEQ ID NO: 253479 - DNA, 20 bp, human
gtacagagggcgacgagggg

SEQ ID NO: 253480 - DNA, 20 bp, human
gcgaagggcggggaacgagc

SEQ ID NO: 253481 - DNA, 20 bp, human
gggcctacagagggcgacga

SEQ ID NO: 253482 - DNA, 20 bp, human
gagggcggggcgaggaccaa

SEQ ID NO: 253483 - DNA, 20 bp, human
ggggcgaagaccgaagggcg

SEQ ID NO: 253484 - DNA, 20 bp, human
gtggcgagctgggatgacgg

SEQ ID NO: 253485 - DNA, 20 bp, human
gaagggagaccgttgagctg

SEQ ID NO: 253486 - DNA, 20 bp, human
gcccctacaggactcagatc

SEQ ID NO: 253487 - DNA, 20 bp, human
gccactgtgctattctggtt

SEQ ID NO: 253488 - DNA, 20 bp, human
gtccatggtcactacatata

SEQ ID NO: 253489 - DNA, 20 bp, human
gccttcggagaaaaacgaat

SEQ ID NO: 253490 - DNA, 20 bp, human
gtctgggaggcaattacctt

SEQ ID NO: 253491 - DNA, 20 bp, human
ggggggcctctacagaatcc

SEQ ID NO: 253492 - DNA, 20 bp, human
gtgttgactcactcagtgtt

SEQ ID NO: 253493 - DNA, 20 bp, human
gtaaaagtcaattttgaatc

SEQ ID NO: 253494 - DNA, 20 bp, human
gcccagatctgagtcctgta

SEQ ID NO: 253495 - DNA, 20 bp, human
gcccataataggactgtcca

SEQ ID NO: 253496 - DNA, 20 bp, human
ggatggacgccgggtgtgaa

SEQ ID NO: 253497 - DNA, 20 bp, human
gaggagctccgcgaggatcg

SEQ ID NO: 253498 - DNA, 20 bp, human
gggcgcaggcgcctgctccg

SEQ ID NO: 253499 - DNA, 20 bp, human
gggacgcccgggggccaaga

SEQ ID NO: 253500 - DNA, 20 bp, human
gccgtgacaggggaaaattg

SEQ ID NO: 253501 - DNA, 20 bp, human
gggagtcgctcgcagcccag

SEQ ID NO: 253502 - DNA, 20 bp, human
gcttggctagggatggacgc

SEQ ID NO: 253503 - DNA, 20 bp, human
ggcgggcgagggtcggttga

SEQ ID NO: 253504 - DNA, 20 bp, human
gctgtgggcgccgggttccc

SEQ ID NO: 253505 - DNA, 20 bp, human
gcgcggagctcctggccgct

SEQ ID NO: 253506 - DNA, 20 bp, human
ggaccctagagccctcacct

SEQ ID NO: 253507 - DNA, 20 bp, human
gccccctggtggcaggatcg

SEQ ID NO: 253508 - DNA, 20 bp, human
gctcccaggtgagggctcta

SEQ ID NO: 253509 - DNA, 20 bp, human
gaggaggatcatacggggag

SEQ ID NO: 253510 - DNA, 20 bp, human
gagccgcgatcctgccacca

SEQ ID NO: 253511 - DNA, 20 bp, human
ggagagcagctcaggttatt

SEQ ID NO: 253512 - DNA, 20 bp, human
gggggagaggaggatcatac

SEQ ID NO: 253513 - DNA, 20 bp, human
gccacatctggcttcctcgg

SEQ ID NO: 253514 - DNA, 20 bp, human
ggtcgggaaaagtgtcagac

SEQ ID NO: 253515 - DNA, 20 bp, human
gggagcggccgtagctgcct

SEQ ID NO: 253516 - DNA, 20 bp, human
gtgccagctggaggaagtgt

SEQ ID NO: 253517 - DNA, 20 bp, human
gtctgctgggatctgtcggt

SEQ ID NO: 253518 - DNA, 20 bp, human
gaggaagtgtgggtgtaccg

SEQ ID NO: 253519 - DNA, 20 bp, human
gtgggtctgctgggatctgt

SEQ ID NO: 253520 - DNA, 20 bp, human
ggccaatcaacctcaggctg

SEQ ID NO: 253521 - DNA, 20 bp, human
gggaaccacaagagcttttt

SEQ ID NO: 253522 - DNA, 20 bp, human
ggaaactagtctagtcattt

SEQ ID NO: 253523 - DNA, 20 bp, human
ggcagacccaaggatgggaa

SEQ ID NO: 253524 - DNA, 20 bp, human
ggatgggaaaggcggaggca

SEQ ID NO: 253525 - DNA, 20 bp, human
gcccccagcctgaggttgat

SEQ ID NO: 253526 - DNA, 20 bp, human
ggctgaaacagggccaattg

SEQ ID NO: 253527 - DNA, 20 bp, human
gctagagtagggggaatgca

SEQ ID NO: 253528 - DNA, 20 bp, human
gaacccttcagtgctagagt

SEQ ID NO: 253529 - DNA, 20 bp, human
gcccctactctagcactgaa

SEQ ID NO: 253530 - DNA, 20 bp, human
gtggggggctggcttgtgag

SEQ ID NO: 253531 - DNA, 20 bp, human
ggctggcttgtgaggggtta

SEQ ID NO: 253532 - DNA, 20 bp, human
gagcactgaagggttctgaa

SEQ ID NO: 253533 - DNA, 20 bp, human
gaaggggaggaggcctcggc

SEQ ID NO: 253534 - DNA, 20 bp, human
gcttgtgaggggttaaggct

SEQ ID NO: 253535 - DNA, 20 bp, human
gcctgcccattgctgaaaca

SEQ ID NO: 253536 - DNA, 20 bp, human
gggaccctgcagcaaagccc

SEQ ID NO: 253537 - DNA, 20 bp, human
gcgcaccgagagatacagag

SEQ ID NO: 253538 - DNA, 20 bp, human
gagagcggtggctggagtcg

SEQ ID NO: 253539 - DNA, 20 bp, human
gcacgccacgcccggagtgg

SEQ ID NO: 253540 - DNA, 20 bp, human
ggcaagcagctggagagcgg

SEQ ID NO: 253541 - DNA, 20 bp, human
gtctcggaggcgccaagacc

SEQ ID NO: 253542 - DNA, 20 bp, human
gggagctagaagaccccata

SEQ ID NO: 253543 - DNA, 20 bp, human
gtatctctcggtgcgcttgc

SEQ ID NO: 253544 - DNA, 20 bp, human
ggctccctcccaggcagtcc

SEQ ID NO: 253545 - DNA, 20 bp, human
gtcttggcgcctccgagagc

SEQ ID NO: 253546 - DNA, 20 bp, human
ggcaccgaaggcccggtagg

SEQ ID NO: 253547 - DNA, 20 bp, human
gaggcccggtaggcggactc

SEQ ID NO: 253548 - DNA, 20 bp, human
gcccggtaggcggactctgg

SEQ ID NO: 253549 - DNA, 20 bp, human
gaggcggtgtgaatactgat

SEQ ID NO: 253550 - DNA, 20 bp, human
ggctgcaccgaaggcccggt

SEQ ID NO: 253551 - DNA, 20 bp, human
gcccgcctggctcagatcgc

SEQ ID NO: 253552 - DNA, 20 bp, human
gggcctgagcggacagtact

SEQ ID NO: 253553 - DNA, 20 bp, human
gtaaagctccggggcctgag

SEQ ID NO: 253554 - DNA, 20 bp, human
gtgagcggacagtactagga

SEQ ID NO: 253555 - DNA, 20 bp, human
ggaagagtgtagaccgcggg

SEQ ID NO: 253556 - DNA, 20 bp, human
gcaaaggaggaggaaggcgt

SEQ ID NO: 253557 - DNA, 20 bp, human
ggtgaagtgcaggcacccga

SEQ ID NO: 253558 - DNA, 20 bp, human
ggcgagcgcccccgcgagag

SEQ ID NO: 253559 - DNA, 20 bp, human
gcggccagatctggactgga

SEQ ID NO: 253560 - DNA, 20 bp, human
ggggtccggccggctcacga

SEQ ID NO: 253561 - DNA, 20 bp, human
gcgcccccgcgagagtggcc

SEQ ID NO: 253562 - DNA, 20 bp, human
ggcggagagggcttggagga

SEQ ID NO: 253563 - DNA, 20 bp, human
gggcaaggaaggtgaagtgc

SEQ ID NO: 253564 - DNA, 20 bp, human
gggagggcggcggaggtgtt

SEQ ID NO: 253565 - DNA, 20 bp, human
gggaggaccagcgggagtga

SEQ ID NO: 253566 - DNA, 20 bp, human
gccgccacctcgggaagcgg

SEQ ID NO: 253567 - DNA, 20 bp, human
gagagcggggtaggcgcggt

SEQ ID NO: 253568 - DNA, 20 bp, human
ggtaccggcaacgccgggga

SEQ ID NO: 253569 - DNA, 20 bp, human
ggcgcccgctgtcgtaacca

SEQ ID NO: 253570 - DNA, 20 bp, human
gggccgctgctcgcagaaag

SEQ ID NO: 253571 - DNA, 20 bp, human
gggcggccgcaggaacgctg

SEQ ID NO: 253572 - DNA, 20 bp, human
ggtgtggtgtcagcgctcaa

SEQ ID NO: 253573 - DNA, 20 bp, human
gctgccgccacctcgggaag

SEQ ID NO: 253574 - DNA, 20 bp, human
ggggcagcctccgcttcccg

SEQ ID NO: 253575 - DNA, 20 bp, human
ggagcgctgacaccacacca

SEQ ID NO: 253576 - DNA, 20 bp, human
ggaaaggagtggaaaaaagt

SEQ ID NO: 253577 - DNA, 20 bp, human
gcagagaggcgcaccggaca

SEQ ID NO: 253578 - DNA, 20 bp, human
gtgcgtgcctctgggagggg

SEQ ID NO: 253579 - DNA, 20 bp, human
ggcagaatgcggggctcccc

SEQ ID NO: 253580 - DNA, 20 bp, human
gggagggggcgcgccaggaa

SEQ ID NO: 253581 - DNA, 20 bp, human
gcgccccaggccagtaagag

SEQ ID NO: 253582 - DNA, 20 bp, human
gagctccactgcgtgcctct

SEQ ID NO: 253583 - DNA, 20 bp, human
ggagccctgaggcgggatgg

SEQ ID NO: 253584 - DNA, 20 bp, human
gtccactgcgtgcctctggg

SEQ ID NO: 253585 - DNA, 20 bp, human
gaggcagacggcgctctgat

SEQ ID NO: 253586 - DNA, 20 bp, human
gcggccctcgggtcccgggt

SEQ ID NO: 253587 - DNA, 20 bp, human
gctcgcggccgggacgggga

SEQ ID NO: 253588 - DNA, 20 bp, human
ggcttcctggtgcccgtcaa

SEQ ID NO: 253589 - DNA, 20 bp, human
gtgtgcgcaggggcccaagc

SEQ ID NO: 253590 - DNA, 20 bp, human
gcccacaagtccctcgttct

SEQ ID NO: 253591 - DNA, 20 bp, human
gtgcccgcgtgtcccttgac

SEQ ID NO: 253592 - DNA, 20 bp, human
ggaggcggccctgtgtgcgc

SEQ ID NO: 253593 - DNA, 20 bp, human
ggctcgagatgcaggaacca

SEQ ID NO: 253594 - DNA, 20 bp, human
gcctccggagacgccgaccc

SEQ ID NO: 253595 - DNA, 20 bp, human
gggggcccaagcaggcctcc

SEQ ID NO: 253596 - DNA, 20 bp, human
ggaagggcgtgtagtaatgg

SEQ ID NO: 253597 - DNA, 20 bp, human
gcaagaagggcgtgtagtaa

SEQ ID NO: 253598 - DNA, 20 bp, human
gtaatggtggaagagggcag

SEQ ID NO: 253599 - DNA, 20 bp, human
gcgtgtagtaatggtggaag

SEQ ID NO: 253600 - DNA, 20 bp, human
gcatgtgcatgcctgaaagt

SEQ ID NO: 253601 - DNA, 20 bp, human
gcacgggatccatgcttcta

SEQ ID NO: 253602 - DNA, 20 bp, human
gggcagaggaagtacgttgg

SEQ ID NO: 253603 - DNA, 20 bp, human
gtcaggagcggaggtcagaa

SEQ ID NO: 253604 - DNA, 20 bp, human
gctcagatagggttttccaa

SEQ ID NO: 253605 - DNA, 20 bp, human
gtacatccatagggaaatgg

SEQ ID NO: 253606 - DNA, 20 bp, human
ggggaaacaagtgacctcca

SEQ ID NO: 253607 - DNA, 20 bp, human
gagatgtggaggaaggaccc

SEQ ID NO: 253608 - DNA, 20 bp, human
ggtcatctagatgtggagga

SEQ ID NO: 253609 - DNA, 20 bp, human
gtgtggtcatctagatgtgg

SEQ ID NO: 253610 - DNA, 20 bp, human
gtttatgatcagtggatctg

SEQ ID NO: 253611 - DNA, 20 bp, human
gacattgcttgcaccctgtg

SEQ ID NO: 253612 - DNA, 20 bp, human
gctgtgtggtcatctagatg

SEQ ID NO: 253613 - DNA, 20 bp, human
gacacatcttcagttctcca

SEQ ID NO: 253614 - DNA, 20 bp, human
gcatcttcagttctccatgg

SEQ ID NO: 253615 - DNA, 20 bp, human
gataactttccagactgtgt

SEQ ID NO: 253616 - DNA, 20 bp, human
gaggggcgggacatcagttc

SEQ ID NO: 253617 - DNA, 20 bp, human
gggccacctgcctcgaaagg

SEQ ID NO: 253618 - DNA, 20 bp, human
gccgaggcagacgaccaatg

SEQ ID NO: 253619 - DNA, 20 bp, human
gaactcgaagcgctattggt

SEQ ID NO: 253620 - DNA, 20 bp, human
ggccagcctcggtccaataa

SEQ ID NO: 253621 - DNA, 20 bp, human
gtcgaggcaggtggccaatg

SEQ ID NO: 253622 - DNA, 20 bp, human
gcaggcgggccgttcctggg

SEQ ID NO: 253623 - DNA, 20 bp, human
gggcgggcaggacgtgcgga

SEQ ID NO: 253624 - DNA, 20 bp, human
gagtaccccttattggaccg

SEQ ID NO: 253625 - DNA, 20 bp, human
gggcaacccgtgcacagacc

SEQ ID NO: 253626 - DNA, 20 bp, human
gggcgcgcgaaaaaaggtcc

SEQ ID NO: 253627 - DNA, 20 bp, human
gggtctgtggcggtggttgt

SEQ ID NO: 253628 - DNA, 20 bp, human
gtggctgtacgcgtcacttc

SEQ ID NO: 253629 - DNA, 20 bp, human
gtgtgtcggcgcgcgaaaaa

SEQ ID NO: 253630 - DNA, 20 bp, human
ggagccgcggtgtggaacgg

SEQ ID NO: 253631 - DNA, 20 bp, human
gcgccagcgggacagacgag

SEQ ID NO: 253632 - DNA, 20 bp, human
gcgcgacgagccaccggaaa

SEQ ID NO: 253633 - DNA, 20 bp, human
gccctcggctcggagccaca

SEQ ID NO: 253634 - DNA, 20 bp, human
gcagcacgctgggccgccag

SEQ ID NO: 253635 - DNA, 20 bp, human
gagccgagggagccgcggtg

SEQ ID NO: 253636 - DNA, 20 bp, human
ggggacagcttcaggagcta

SEQ ID NO: 253637 - DNA, 20 bp, human
gagggtgggtcctcagtgct

SEQ ID NO: 253638 - DNA, 20 bp, human
gaggttgtcttggcaacagg

SEQ ID NO: 253639 - DNA, 20 bp, human
ggagccttatgaaaggaagt

SEQ ID NO: 253640 - DNA, 20 bp, human
ggctctccagccctgaatta

SEQ ID NO: 253641 - DNA, 20 bp, human
ggggggatggggtacttggt

SEQ ID NO: 253642 - DNA, 20 bp, human
gtggagctcgggacaatgac

SEQ ID NO: 253643 - DNA, 20 bp, human
ggagaaccctaattcagggc

SEQ ID NO: 253644 - DNA, 20 bp, human
gcctgaattagggttctcct

SEQ ID NO: 253645 - DNA, 20 bp, human
ggctgcatactcttcaagac

SEQ ID NO: 253646 - DNA, 20 bp, human
gtggacgcgcccgcctcccg

SEQ ID NO: 253647 - DNA, 20 bp, human
gaaacgagcctgcccgtccc

SEQ ID NO: 253648 - DNA, 20 bp, human
ggacgggcaggctcgtttcc

SEQ ID NO: 253649 - DNA, 20 bp, human
gccgtggccacgcccggccg

SEQ ID NO: 253650 - DNA, 20 bp, human
ggcctgggtcgtggaatgtg

SEQ ID NO: 253651 - DNA, 20 bp, human
gtccgaccaccgaacacccc

SEQ ID NO: 253652 - DNA, 20 bp, human
gtccaggggtgttcggtggt

SEQ ID NO: 253653 - DNA, 20 bp, human
gaggctggtggcctgagatc

SEQ ID NO: 253654 - DNA, 20 bp, human
ggccgagcccgcggcctcct

SEQ ID NO: 253655 - DNA, 20 bp, human
ggaaacccgagcccgcgcca

SEQ ID NO: 253656 - DNA, 20 bp, human
gccaaccacaagtcggtcac

SEQ ID NO: 253657 - DNA, 20 bp, human
gggcccgcgccggaaaaggt

SEQ ID NO: 253658 - DNA, 20 bp, human
gcggagcccgcaatggaaag

SEQ ID NO: 253659 - DNA, 20 bp, human
gcccgcagccaaccacaagt

SEQ ID NO: 253660 - DNA, 20 bp, human
ggtcgctcgggtaacggtgc

SEQ ID NO: 253661 - DNA, 20 bp, human
gaagtcggtcacaggctcaa

SEQ ID NO: 253662 - DNA, 20 bp, human
ggtgggcggggcgagaaggt

SEQ ID NO: 253663 - DNA, 20 bp, human
gcccgcaatggaaagaggcg

SEQ ID NO: 253664 - DNA, 20 bp, human
ggggttggctgtgacttcat

SEQ ID NO: 253665 - DNA, 20 bp, human
ggagagaccagggtcacttg

SEQ ID NO: 253666 - DNA, 20 bp, human
gccgacccccggtccaccta

SEQ ID NO: 253667 - DNA, 20 bp, human
gggagccctaggtggaccgg

SEQ ID NO: 253668 - DNA, 20 bp, human
gctagcccaggtgaagctca

SEQ ID NO: 253669 - DNA, 20 bp, human
gcgacccggggccgactcac

SEQ ID NO: 253670 - DNA, 20 bp, human
gagggggcgggtcggcgaga

SEQ ID NO: 253671 - DNA, 20 bp, human
gtccagaggcgcgtagtgag

SEQ ID NO: 253672 - DNA, 20 bp, human
ggggagtgacaggtgcgcga

SEQ ID NO: 253673 - DNA, 20 bp, human
gagtgagtggcggaggactg

SEQ ID NO: 253674 - DNA, 20 bp, human
gagaggcgcgtagtgagtgg

SEQ ID NO: 253675 - DNA, 20 bp, human
gcgggaagggacaggtcagg

SEQ ID NO: 253676 - DNA, 20 bp, human
gagccgggagcgtgcagcaa

SEQ ID NO: 253677 - DNA, 20 bp, human
gcgcaaacgcgggtgatggg

SEQ ID NO: 253678 - DNA, 20 bp, human
gacagcccgggaggctccaa

SEQ ID NO: 253679 - DNA, 20 bp, human
gtgcgcgcgcaatcacggga

SEQ ID NO: 253680 - DNA, 20 bp, human
ggtggcgcgcgcaattgccc

SEQ ID NO: 253681 - DNA, 20 bp, human
gcgcgcaatcacgggacggc

SEQ ID NO: 253682 - DNA, 20 bp, human
gaggtagagccctccccccg

SEQ ID NO: 253683 - DNA, 20 bp, human
gagcgcgcgcgcccaccgcg

SEQ ID NO: 253684 - DNA, 20 bp, human
gagttcccttggagcctccc

SEQ ID NO: 253685 - DNA, 20 bp, human
gtgcgcgcgccgtggtttcc

SEQ ID NO: 253686 - DNA, 20 bp, human
ggcgccggcgcgttccacgt

SEQ ID NO: 253687 - DNA, 20 bp, human
gggacagagccctgctgctc

SEQ ID NO: 253688 - DNA, 20 bp, human
gggccccacgtggaacgcgc

SEQ ID NO: 253689 - DNA, 20 bp, human
gtattcccagtcctaagcaa

SEQ ID NO: 253690 - DNA, 20 bp, human
gtgctcccttgcttaggact

SEQ ID NO: 253691 - DNA, 20 bp, human
gcggcctggcgcaggtcatt

SEQ ID NO: 253692 - DNA, 20 bp, human
gaagcaagggagcaaaggca

SEQ ID NO: 253693 - DNA, 20 bp, human
gtcaggtgaggggccccacg

SEQ ID NO: 253694 - DNA, 20 bp, human
gacccgggaggtttcggaca

SEQ ID NO: 253695 - DNA, 20 bp, human
gaggtcatttgggacatctg

SEQ ID NO: 253696 - DNA, 20 bp, human
gcgcgcgggtctggcgggac

SEQ ID NO: 253697 - DNA, 20 bp, human
gccgcccccggcgcgtacgc

SEQ ID NO: 253698 - DNA, 20 bp, human
ggggtctggcgggaccggtt

SEQ ID NO: 253699 - DNA, 20 bp, human
gcgcgtacgcgggtcacgtg

SEQ ID NO: 253700 - DNA, 20 bp, human
gcagctccggcggccgagac

SEQ ID NO: 253701 - DNA, 20 bp, human
ggcggccgcgcgggtctggc

SEQ ID NO: 253702 - DNA, 20 bp, human
gtgacccgcgtacgcgccgg

SEQ ID NO: 253703 - DNA, 20 bp, human
ggaccgcgagagggcgccca

SEQ ID NO: 253704 - DNA, 20 bp, human
gtctgagacggctccgcccc

SEQ ID NO: 253705 - DNA, 20 bp, human
gtgcgcacgcgcactcggga

SEQ ID NO: 253706 - DNA, 20 bp, human
gggctgccgggtactggtaa

SEQ ID NO: 253707 - DNA, 20 bp, human
gaggcctgacggggagccga

SEQ ID NO: 253708 - DNA, 20 bp, human
gcgcaacagcggcagttcga

SEQ ID NO: 253709 - DNA, 20 bp, human
gagagccgcagccggtagtc

SEQ ID NO: 253710 - DNA, 20 bp, human
gaggccgcttccggagggga

SEQ ID NO: 253711 - DNA, 20 bp, human
ggccgcgccggaagagtccg

SEQ ID NO: 253712 - DNA, 20 bp, human
gccgggtactggtaagggta

SEQ ID NO: 253713 - DNA, 20 bp, human
gcatccccgcaaggcctgac

SEQ ID NO: 253714 - DNA, 20 bp, human
ggaaacctgactaccggctg

SEQ ID NO: 253715 - DNA, 20 bp, human
gctgtagcgaggctcggtgg

SEQ ID NO: 253716 - DNA, 20 bp, human
ggggcctcgctcactctcat

SEQ ID NO: 253717 - DNA, 20 bp, human
ggcggtgctagaacaggttg

SEQ ID NO: 253718 - DNA, 20 bp, human
ggacgcggttgtcatgacga

SEQ ID NO: 253719 - DNA, 20 bp, human
gcccccacacctaggagaag

SEQ ID NO: 253720 - DNA, 20 bp, human
gccagccttcccccacacct

SEQ ID NO: 253721 - DNA, 20 bp, human
ggaaggggcggtgctagaac

SEQ ID NO: 253722 - DNA, 20 bp, human
gccccgccccagcacaacgt

SEQ ID NO: 253723 - DNA, 20 bp, human
gcgccctcttctcctaggtg

SEQ ID NO: 253724 - DNA, 20 bp, human
gacaggttggggcggagtca

SEQ ID NO: 253725 - DNA, 20 bp, human
gttggccaatgggagcactg

SEQ ID NO: 253726 - DNA, 20 bp, human
gaactcccgcagctgcttgg

SEQ ID NO: 253727 - DNA, 20 bp, human
gaaggggcgtggccagacgt

SEQ ID NO: 253728 - DNA, 20 bp, human
ggggcggggcttagaacgct

SEQ ID NO: 253729 - DNA, 20 bp, human
ggggacctatcccgcgggga

SEQ ID NO: 253730 - DNA, 20 bp, human
gacgtcggggccaggatggc

SEQ ID NO: 253731 - DNA, 20 bp, human
gttagaacgctgggagtcct

SEQ ID NO: 253732 - DNA, 20 bp, human
gggccgtctaacagtagaag

SEQ ID NO: 253733 - DNA, 20 bp, human
gaccccgcccgtcgcttggt

SEQ ID NO: 253734 - DNA, 20 bp, human
gagaacaggccccatccccg

SEQ ID NO: 253735 - DNA, 20 bp, human
gtctaacagtagaaggggcg

SEQ ID NO: 253736 - DNA, 20 bp, human
gcggccctaatcctgccgat

SEQ ID NO: 253737 - DNA, 20 bp, human
gtacttccgcccaggacagt

SEQ ID NO: 253738 - DNA, 20 bp, human
ggccccgatcggcaggatta

SEQ ID NO: 253739 - DNA, 20 bp, human
gagacctggagttggtgggt

SEQ ID NO: 253740 - DNA, 20 bp, human
gagtaaccgagacctggagt

SEQ ID NO: 253741 - DNA, 20 bp, human
gttccagcatatgccccgat

SEQ ID NO: 253742 - DNA, 20 bp, human
gacgctaggccgttgctaag

SEQ ID NO: 253743 - DNA, 20 bp, human
gggcaggattagggccgacc

SEQ ID NO: 253744 - DNA, 20 bp, human
gggtgggtaggtaagggttc

SEQ ID NO: 253745 - DNA, 20 bp, human
gactctaaaagggcacagga

SEQ ID NO: 253746 - DNA, 20 bp, human
gcccggccccgggatctcgg

SEQ ID NO: 253747 - DNA, 20 bp, human
gagcaaccagcctacctcgg

SEQ ID NO: 253748 - DNA, 20 bp, human
ggggctgcggctcgcgggtt

SEQ ID NO: 253749 - DNA, 20 bp, human
gctcgcgggttcgggatcga

SEQ ID NO: 253750 - DNA, 20 bp, human
ggcgcgcctccgagatcccg

SEQ ID NO: 253751 - DNA, 20 bp, human
ggcctccgagatcccggggc

SEQ ID NO: 253752 - DNA, 20 bp, human
gtccggggcgcccattgcta

SEQ ID NO: 253753 - DNA, 20 bp, human
ggggtcccgctccgcatcca

SEQ ID NO: 253754 - DNA, 20 bp, human
gcgccccggccccgggatct

SEQ ID NO: 253755 - DNA, 20 bp, human
ggcaacggcggccctagcaa

SEQ ID NO: 253756 - DNA, 20 bp, human
ggggctctaggtcccgaaca

SEQ ID NO: 253757 - DNA, 20 bp, human
gagaagccgcgtgtccgggg

SEQ ID NO: 253758 - DNA, 20 bp, human
gacgccaaggccaaggccga

SEQ ID NO: 253759 - DNA, 20 bp, human
gggccgagaagccgcgtgtc

SEQ ID NO: 253760 - DNA, 20 bp, human
gggagaggccctcgggctct

SEQ ID NO: 253761 - DNA, 20 bp, human
gcaccgcccagtatacgcca

SEQ ID NO: 253762 - DNA, 20 bp, human
gagcgcgtcccgtttcccgg

SEQ ID NO: 253763 - DNA, 20 bp, human
gcagacccaccccggacacg

SEQ ID NO: 253764 - DNA, 20 bp, human
ggcagtggagcgagcgcact

SEQ ID NO: 253765 - DNA, 20 bp, human
gccagtatacgccaaggcca

SEQ ID NO: 253766 - DNA, 20 bp, human
ggtggcggccccagctggag

SEQ ID NO: 253767 - DNA, 20 bp, human
gtgccaagctgcaaggggtt

SEQ ID NO: 253768 - DNA, 20 bp, human
ggtcgtcgccatggaaactg

SEQ ID NO: 253769 - DNA, 20 bp, human
gattcgttactcaagtaaat

SEQ ID NO: 253770 - DNA, 20 bp, human
ggcagttgccaagctgcaag

SEQ ID NO: 253771 - DNA, 20 bp, human
gcgacgacgttgtttccaac

SEQ ID NO: 253772 - DNA, 20 bp, human
gactggaaatttagatctgt

SEQ ID NO: 253773 - DNA, 20 bp, human
gggaaacaacgtcgtcgcca

SEQ ID NO: 253774 - DNA, 20 bp, human
gtggcacatagtattctcgt

SEQ ID NO: 253775 - DNA, 20 bp, human
gtatttacagggtgtcacta

SEQ ID NO: 253776 - DNA, 20 bp, human
ggcccccgatgtgacaccga

SEQ ID NO: 253777 - DNA, 20 bp, human
gggccgccgcgtacccgcgg

SEQ ID NO: 253778 - DNA, 20 bp, human
gtggaatctcgcaagagcca

SEQ ID NO: 253779 - DNA, 20 bp, human
gaccgtcggtgtcacatcgg

SEQ ID NO: 253780 - DNA, 20 bp, human
gaacgcggcgcaagggatcc

SEQ ID NO: 253781 - DNA, 20 bp, human
gctggcgaagaggccacaat

SEQ ID NO: 253782 - DNA, 20 bp, human
ggggtcccgaacgcggcgca

SEQ ID NO: 253783 - DNA, 20 bp, human
gaagagccacgcctgcgccc

SEQ ID NO: 253784 - DNA, 20 bp, human
ggctcttggtcaggcggtta

SEQ ID NO: 253785 - DNA, 20 bp, human
gagcaccgtcggtgtcacat

SEQ ID NO: 253786 - DNA, 20 bp, human
gattggttacttgggtccca

SEQ ID NO: 253787 - DNA, 20 bp, human
gttggagcccctcgagggaa

SEQ ID NO: 253788 - DNA, 20 bp, human
gagaagccccaggtaccgtg

SEQ ID NO: 253789 - DNA, 20 bp, human
gtccactgtggggtgacggt

SEQ ID NO: 253790 - DNA, 20 bp, human
gaatgatagcgcagcaaatg

SEQ ID NO: 253791 - DNA, 20 bp, human
gtacttgggtcccaagggga

SEQ ID NO: 253792 - DNA, 20 bp, human
gaatggctcccttccctcga

SEQ ID NO: 253793 - DNA, 20 bp, human
gaccaaccgtcaccccacag

SEQ ID NO: 253794 - DNA, 20 bp, human
gcaactgccacataacttct

SEQ ID NO: 253795 - DNA, 20 bp, human
gtcttcctttccactttggg

SEQ ID NO: 253796 - DNA, 20 bp, human
gtctacccctcagggaccca

SEQ ID NO: 253797 - DNA, 20 bp, human
ggtccctgaggggtagacct

SEQ ID NO: 253798 - DNA, 20 bp, human
gccgcccaggtctacccctc

SEQ ID NO: 253799 - DNA, 20 bp, human
gcaagccctgggtccctgag

SEQ ID NO: 253800 - DNA, 20 bp, human
ggccgcgaagcagggatcca

SEQ ID NO: 253801 - DNA, 20 bp, human
ggcgagccgaagggtgcggg

SEQ ID NO: 253802 - DNA, 20 bp, human
gctggcgagccgaagggtgc

SEQ ID NO: 253803 - DNA, 20 bp, human
gcccttcggctcgccagatg

SEQ ID NO: 253804 - DNA, 20 bp, human
ggccctggatccctgcttcg

SEQ ID NO: 253805 - DNA, 20 bp, human
gcggctggggcgcacagacc

SEQ ID NO: 253806 - DNA, 20 bp, human
gggaagtgttggtgacagaa

SEQ ID NO: 253807 - DNA, 20 bp, human
gtctcagcgtctgttgctaa

SEQ ID NO: 253808 - DNA, 20 bp, human
gtggtgacagaagggaacat

SEQ ID NO: 253809 - DNA, 20 bp, human
gctgttgcctctgttattcc

SEQ ID NO: 253810 - DNA, 20 bp, human
gctgttgctaagggaaggag

SEQ ID NO: 253811 - DNA, 20 bp, human
gaacagcaataaaagacctt

SEQ ID NO: 253812 - DNA, 20 bp, human
gggtgcctacatacaagact

SEQ ID NO: 253813 - DNA, 20 bp, human
gagctggtgtctccctttgc

SEQ ID NO: 253814 - DNA, 20 bp, human
gcatgcccagtcttgtatgt

SEQ ID NO: 253815 - DNA, 20 bp, human
gtggtgtctccctttgctgg

SEQ ID NO: 253816 - DNA, 20 bp, human
ggacaatatattcagagctg

SEQ ID NO: 253817 - DNA, 20 bp, human
gtgactcaatgcttattatt

SEQ ID NO: 253818 - DNA, 20 bp, human
gaagactgagtttctcgaca

SEQ ID NO: 253819 - DNA, 20 bp, human
gttaactgtgaagatgtaat

SEQ ID NO: 253820 - DNA, 20 bp, human
ggggtcacaattagcctatc

SEQ ID NO: 253821 - DNA, 20 bp, human
ggtggagaaaatggctccta

SEQ ID NO: 253822 - DNA, 20 bp, human
gtcacaattagtcacaatgc

SEQ ID NO: 253823 - DNA, 20 bp, human
gacagacttcttgttctttg

SEQ ID NO: 253824 - DNA, 20 bp, human
gcacaagtaatttatggaca

SEQ ID NO: 253825 - DNA, 20 bp, human
gcaaggtaatttatcctatg

SEQ ID NO: 253826 - DNA, 20 bp, human
ggaggaggaaccaggctgtg

SEQ ID NO: 253827 - DNA, 20 bp, human
gtggcgcagtgcttccgtag

SEQ ID NO: 253828 - DNA, 20 bp, human
ggggaattgagtactgtgcc

SEQ ID NO: 253829 - DNA, 20 bp, human
ggctcctggaccgaaagctg

SEQ ID NO: 253830 - DNA, 20 bp, human
gctggcgacgtgttactcag

SEQ ID NO: 253831 - DNA, 20 bp, human
gcagccacagctttcggtcc

SEQ ID NO: 253832 - DNA, 20 bp, human
gctcaaccagccacagcttt

SEQ ID NO: 253833 - DNA, 20 bp, human
gttcctacttcgctgattgt

SEQ ID NO: 253834 - DNA, 20 bp, human
gctccaacaatcagcgaagt

SEQ ID NO: 253835 - DNA, 20 bp, human
gactaattggctcgattgcc

SEQ ID NO: 253836 - DNA, 20 bp, human
ggccagtgttgtgaggtcta

SEQ ID NO: 253837 - DNA, 20 bp, human
gccgcaagaggagctttctg

SEQ ID NO: 253838 - DNA, 20 bp, human
gaccggaaatggaacctgcg

SEQ ID NO: 253839 - DNA, 20 bp, human
gggaccgcgcgccagcttcc

SEQ ID NO: 253840 - DNA, 20 bp, human
gcggtcatctgttccttctg

SEQ ID NO: 253841 - DNA, 20 bp, human
gcccgcgcaggttccatttc

SEQ ID NO: 253842 - DNA, 20 bp, human
gttccgggtccagccccaga

SEQ ID NO: 253843 - DNA, 20 bp, human
gaccttagacctcacaacac

SEQ ID NO: 253844 - DNA, 20 bp, human
ggggaagagtcaacagcaca

SEQ ID NO: 253845 - DNA, 20 bp, human
gctaaataagccggatgccc

SEQ ID NO: 253846 - DNA, 20 bp, human
ggggcagcctcttccgtaga

SEQ ID NO: 253847 - DNA, 20 bp, human
ggcacgacgggggatggaga

SEQ ID NO: 253848 - DNA, 20 bp, human
gaagatggcgccccttctga

SEQ ID NO: 253849 - DNA, 20 bp, human
ggctcctccctctacggaag

SEQ ID NO: 253850 - DNA, 20 bp, human
ggcccctccccgttcagaag

SEQ ID NO: 253851 - DNA, 20 bp, human
gaaacctagaattataacat

SEQ ID NO: 253852 - DNA, 20 bp, human
gaaagcattccgcacgacgg

SEQ ID NO: 253853 - DNA, 20 bp, human
gaaaaagctcccaggtgggt

SEQ ID NO: 253854 - DNA, 20 bp, human
gcagcctcttccgtagaggg

SEQ ID NO: 253855 - DNA, 20 bp, human
gcattccgcacgacggggga

SEQ ID NO: 253856 - DNA, 20 bp, human
gaacccgcccttcagtgcct

SEQ ID NO: 253857 - DNA, 20 bp, human
gcccccgcgctccccaataa

SEQ ID NO: 253858 - DNA, 20 bp, human
gaggactgaaacattgttta

SEQ ID NO: 253859 - DNA, 20 bp, human
gaaccgtactagagagggga

SEQ ID NO: 253860 - DNA, 20 bp, human
gcctacggggagcgactgga

SEQ ID NO: 253861 - DNA, 20 bp, human
gggagcgactggaggggcac

SEQ ID NO: 253862 - DNA, 20 bp, human
ggcagtgcgcagctccctac

SEQ ID NO: 253863 - DNA, 20 bp, human
ggcactgaagggcgggttcc

SEQ ID NO: 253864 - DNA, 20 bp, human
ggatgcacccaccgagcccg

SEQ ID NO: 253865 - DNA, 20 bp, human
gggaccgctcacatcatgtc

SEQ ID NO: 253866 - DNA, 20 bp, human
gggtccgtgcccaataggaa

SEQ ID NO: 253867 - DNA, 20 bp, human
ggggtcgcgtcgctgttgct

SEQ ID NO: 253868 - DNA, 20 bp, human
gagtgtctgcctggtgtatt

SEQ ID NO: 253869 - DNA, 20 bp, human
gagacactgagtacgagtct

SEQ ID NO: 253870 - DNA, 20 bp, human
gaggaggtgtacgcgggaag

SEQ ID NO: 253871 - DNA, 20 bp, human
gccttccaggctaataaggt

SEQ ID NO: 253872 - DNA, 20 bp, human
gccaggggtccgtgcccaat

SEQ ID NO: 253873 - DNA, 20 bp, human
ggagtgctgaagtgtgaccg

SEQ ID NO: 253874 - DNA, 20 bp, human
gactgagtacgagtctcggc

SEQ ID NO: 253875 - DNA, 20 bp, human
gataaggtaggaggtgtacg

SEQ ID NO: 253876 - DNA, 20 bp, human
gggaactcccgcatgtgggt

SEQ ID NO: 253877 - DNA, 20 bp, human
gcccagccggcccggaaagg

SEQ ID NO: 253878 - DNA, 20 bp, human
ggcccagctgtgattcctga

SEQ ID NO: 253879 - DNA, 20 bp, human
gcattcggaactcccgcatg

SEQ ID NO: 253880 - DNA, 20 bp, human
ggaggccggcgtgactccgt

SEQ ID NO: 253881 - DNA, 20 bp, human
gggaggcgaggcaagacctg

SEQ ID NO: 253882 - DNA, 20 bp, human
ggcacggggacccacaacga

SEQ ID NO: 253883 - DNA, 20 bp, human
gtcgcccgccggcaccatga

SEQ ID NO: 253884 - DNA, 20 bp, human
gggcttgcctagcactaccg

SEQ ID NO: 253885 - DNA, 20 bp, human
gagccaaggcgcaggcgctt

SEQ ID NO: 253886 - DNA, 20 bp, human
ggagacctccaaaaagaaga

SEQ ID NO: 253887 - DNA, 20 bp, human
gtgcaaatgcatacaaacgt

SEQ ID NO: 253888 - DNA, 20 bp, human
ggggcgacgcggaaggaccc

SEQ ID NO: 253889 - DNA, 20 bp, human
gcctgcgcttccgacgtggc

SEQ ID NO: 253890 - DNA, 20 bp, human
ggaaggcaggacaacacagt

SEQ ID NO: 253891 - DNA, 20 bp, human
gcgcgtccggagccaggccg

SEQ ID NO: 253892 - DNA, 20 bp, human
ggaaaggagtcacgtgctcc

SEQ ID NO: 253893 - DNA, 20 bp, human
gaggagaagaattaaccaat

SEQ ID NO: 253894 - DNA, 20 bp, human
gatggcctgcgcttccgacg

SEQ ID NO: 253895 - DNA, 20 bp, human
gatccctgggtggtgatggc

SEQ ID NO: 253896 - DNA, 20 bp, human
gcgaaaggccttgtgggtgt

SEQ ID NO: 253897 - DNA, 20 bp, human
ggcgcgggggcgcacgggtc

SEQ ID NO: 253898 - DNA, 20 bp, human
ggttacctgggcaacggcgc

SEQ ID NO: 253899 - DNA, 20 bp, human
gcgggaggagctgcgccgaa

SEQ ID NO: 253900 - DNA, 20 bp, human
gtggcagcggccgagaaggg

SEQ ID NO: 253901 - DNA, 20 bp, human
gcggtggcagcggccgagaa

SEQ ID NO: 253902 - DNA, 20 bp, human
gcggagacttccgcactctc

SEQ ID NO: 253903 - DNA, 20 bp, human
gcggaagtctccggctggtg

SEQ ID NO: 253904 - DNA, 20 bp, human
gctgcgccgaaaggccttgt

SEQ ID NO: 253905 - DNA, 20 bp, human
gcggcgctcgtggaatcttc

SEQ ID NO: 253906 - DNA, 20 bp, human
gaatagaaatactatacgtc

SEQ ID NO: 253907 - DNA, 20 bp, human
gcacttgatcttagctaaaa

SEQ ID NO: 253908 - DNA, 20 bp, human
ggtcaaacccaatgctactc

SEQ ID NO: 253909 - DNA, 20 bp, human
gcaccttctctccttcattt

SEQ ID NO: 253910 - DNA, 20 bp, human
gatattagatactcgatttc

SEQ ID NO: 253911 - DNA, 20 bp, human
ggatcaagtgtaatgtagct

SEQ ID NO: 253912 - DNA, 20 bp, human
gactttaaccggctttcaac

SEQ ID NO: 253913 - DNA, 20 bp, human
gaaagctaccagttgaaagc

SEQ ID NO: 253914 - DNA, 20 bp, human
gtttatagctgaattatcgc

SEQ ID NO: 253915 - DNA, 20 bp, human
gaaggtggtgttcttataat

SEQ ID NO: 253916 - DNA, 20 bp, human
ggggtcgaagtattgaagag

SEQ ID NO: 253917 - DNA, 20 bp, human
gcgcccgaggcgcggccact

SEQ ID NO: 253918 - DNA, 20 bp, human
gggctgctgagggaattaac

SEQ ID NO: 253919 - DNA, 20 bp, human
ggctctgcacagcgacgtca

SEQ ID NO: 253920 - DNA, 20 bp, human
gcctccaggtccaggcggct

SEQ ID NO: 253921 - DNA, 20 bp, human
gaccccagtggccgcgcctc

SEQ ID NO: 253922 - DNA, 20 bp, human
gcgcgtgtttaacctcgcac

SEQ ID NO: 253923 - DNA, 20 bp, human
gtggccgcgcctcgggcgct

SEQ ID NO: 253924 - DNA, 20 bp, human
gtcggtggaccctctgggtc

SEQ ID NO: 253925 - DNA, 20 bp, human
gtccctcagcagccagtgcg

SEQ ID NO: 253926 - DNA, 20 bp, human
gccctcggaccacttaagtt

SEQ ID NO: 253927 - DNA, 20 bp, human
gtcggcgatggctacccgga

SEQ ID NO: 253928 - DNA, 20 bp, human
gactgcggccaggattctga

SEQ ID NO: 253929 - DNA, 20 bp, human
gcatgctgggagcggcgcga

SEQ ID NO: 253930 - DNA, 20 bp, human
gctaagagacagtgagactg

SEQ ID NO: 253931 - DNA, 20 bp, human
gttaagtggtccgaggggtc

SEQ ID NO: 253932 - DNA, 20 bp, human
gggtagccatcgccgaaacg

SEQ ID NO: 253933 - DNA, 20 bp, human
ggctcccagcatgtagtgcg

SEQ ID NO: 253934 - DNA, 20 bp, human
gccggaaggcgcgttggctg

SEQ ID NO: 253935 - DNA, 20 bp, human
gtgctctgaagagtgttgtt

SEQ ID NO: 253936 - DNA, 20 bp, human
gcggctggctggagagtagg

SEQ ID NO: 253937 - DNA, 20 bp, human
ggagctccggggaatcagac

SEQ ID NO: 253938 - DNA, 20 bp, human
ggggccggagaaggcggctt

SEQ ID NO: 253939 - DNA, 20 bp, human
gtgcggcctaaggtgtgcct

SEQ ID NO: 253940 - DNA, 20 bp, human
gggtgtggccgccgtctgtt

SEQ ID NO: 253941 - DNA, 20 bp, human
ggaatcagacgggcagccaa

SEQ ID NO: 253942 - DNA, 20 bp, human
gacacccccggggagaggcc

SEQ ID NO: 253943 - DNA, 20 bp, human
ggctccacggacccacggaa

SEQ ID NO: 253944 - DNA, 20 bp, human
gaggcccaagccgccttctc

SEQ ID NO: 253945 - DNA, 20 bp, human
gctcaccttgagggacttaa

SEQ ID NO: 253946 - DNA, 20 bp, human
gagggaaagaaggtcgcgat

SEQ ID NO: 253947 - DNA, 20 bp, human
gcgcggggaggtgttgccga

SEQ ID NO: 253948 - DNA, 20 bp, human
gcgcgcgcacaggtcggagg

SEQ ID NO: 253949 - DNA, 20 bp, human
gatgtcgcgtgtcgctgaaa

SEQ ID NO: 253950 - DNA, 20 bp, human
gcgacacgcgacatccgggg

SEQ ID NO: 253951 - DNA, 20 bp, human
gcagcgacacgcgacatccg

SEQ ID NO: 253952 - DNA, 20 bp, human
ggcggcgcgcgcgcacaggt

SEQ ID NO: 253953 - DNA, 20 bp, human
ggcctcccggggaaaggact

SEQ ID NO: 253954 - DNA, 20 bp, human
gtcgcgtgtcgctgaaaggg

SEQ ID NO: 253955 - DNA, 20 bp, human
ggaggccccgcccacctttc

SEQ ID NO: 253956 - DNA, 20 bp, human
ggcggcacgggcaaccagtt

SEQ ID NO: 253957 - DNA, 20 bp, human
gtagaagcggagacgtcaga

SEQ ID NO: 253958 - DNA, 20 bp, human
gcggccgcgtgtgatgtccc

SEQ ID NO: 253959 - DNA, 20 bp, human
ggttgcccgtgccgcctcgg

SEQ ID NO: 253960 - DNA, 20 bp, human
gtgacgtctccgcttctaat

SEQ ID NO: 253961 - DNA, 20 bp, human
gagggggccggtcagagtga

SEQ ID NO: 253962 - DNA, 20 bp, human
gcgcggtagctcaggcagag

SEQ ID NO: 253963 - DNA, 20 bp, human
ggaggtacacgaaatccctc

SEQ ID NO: 253964 - DNA, 20 bp, human
gttcacctccgaggcggcac

SEQ ID NO: 253965 - DNA, 20 bp, human
gggaggaagctcctgattgg

SEQ ID NO: 253966 - DNA, 20 bp, human
gcctccggaacatggaatct

SEQ ID NO: 253967 - DNA, 20 bp, human
gctggtgtaggtgtcaataa

SEQ ID NO: 253968 - DNA, 20 bp, human
gccacccgccggcgcgtcgc

SEQ ID NO: 253969 - DNA, 20 bp, human
gccaccctcgctcaaaactc

SEQ ID NO: 253970 - DNA, 20 bp, human
gtcaaaactcgggaaaggag

SEQ ID NO: 253971 - DNA, 20 bp, human
ggggaggccgggcgagcgaa

SEQ ID NO: 253972 - DNA, 20 bp, human
gtcgggaaaggaggggcgga

SEQ ID NO: 253973 - DNA, 20 bp, human
gtactcaactctaagacctc

SEQ ID NO: 253974 - DNA, 20 bp, human
gcaaccctctaatcttccgg

SEQ ID NO: 253975 - DNA, 20 bp, human
gctcgctcaaaactcgggaa

SEQ ID NO: 253976 - DNA, 20 bp, human
ggagtcagtgaaaggactgg

SEQ ID NO: 253977 - DNA, 20 bp, human
gaaaggactgggggagagct

SEQ ID NO: 253978 - DNA, 20 bp, human
ggaggagtcagtgaaaggac

SEQ ID NO: 253979 - DNA, 20 bp, human
gcggttgtcaggagcaacca

SEQ ID NO: 253980 - DNA, 20 bp, human
ggattctgcgaccctgtgaa

SEQ ID NO: 253981 - DNA, 20 bp, human
ggcagagctgaaatttgttt

SEQ ID NO: 253982 - DNA, 20 bp, human
gcggaaattgaagactcaca

SEQ ID NO: 253983 - DNA, 20 bp, human
ggagttgagtgacctttcac

SEQ ID NO: 253984 - DNA, 20 bp, human
gttgctcctgacaaccgcac

SEQ ID NO: 253985 - DNA, 20 bp, human
ggtgcacctgtgcggttgtc

SEQ ID NO: 253986 - DNA, 20 bp, human
gcggggaggccgccgtgagg

SEQ ID NO: 253987 - DNA, 20 bp, human
gggcccaggaccaacctcct

SEQ ID NO: 253988 - DNA, 20 bp, human
ggatgcggatcgcgccctag

SEQ ID NO: 253989 - DNA, 20 bp, human
gcgccccccgcgggccccta

SEQ ID NO: 253990 - DNA, 20 bp, human
gcggcagcggggaggagcgc

SEQ ID NO: 253991 - DNA, 20 bp, human
gggcgccagcaggctcgaag

SEQ ID NO: 253992 - DNA, 20 bp, human
ggcgcgatccgcatccgtcc

SEQ ID NO: 253993 - DNA, 20 bp, human
gcggaacccctccccgcgat

SEQ ID NO: 253994 - DNA, 20 bp, human
gacggcccgggcggacgggc

SEQ ID NO: 253995 - DNA, 20 bp, human
gtgcgacggcccgggcggac

SEQ ID NO: 253996 - DNA, 20 bp, human
gaggggctgccgggagaaga

SEQ ID NO: 253997 - DNA, 20 bp, human
gcaggcatgcgtcagcggtg

SEQ ID NO: 253998 - DNA, 20 bp, human
ggggcggagccggctatttt

SEQ ID NO: 253999 - DNA, 20 bp, human
gggtgtgtgcccaaaatagc

SEQ ID NO: 254000 - DNA, 20 bp, human
gagcgctcgcacggaggctg

SEQ ID NO: 254001 - DNA, 20 bp, human
gcgagcgcttctcgcttgga

SEQ ID NO: 254002 - DNA, 20 bp, human
gcaagcgagaagcgctcgca

SEQ ID NO: 254003 - DNA, 20 bp, human
ggctccgcctgtcccctggg

SEQ ID NO: 254004 - DNA, 20 bp, human
gtctcgcttggatggaggcg

SEQ ID NO: 254005 - DNA, 20 bp, human
ggtgcggaaactactagaga

SEQ ID NO: 254006 - DNA, 20 bp, human
gaatgggaggatctagaagg

SEQ ID NO: 254007 - DNA, 20 bp, human
ggacacgtagtgaaaatggg

SEQ ID NO: 254008 - DNA, 20 bp, human
gctagaacagcaaatgctac

SEQ ID NO: 254009 - DNA, 20 bp, human
gaatgaatagttaatcgtgg

SEQ ID NO: 254010 - DNA, 20 bp, human
gagagacacgtagtgaaaat

SEQ ID NO: 254011 - DNA, 20 bp, human
gagctcagtactttgactag

SEQ ID NO: 254012 - DNA, 20 bp, human
ggaatagttaatcgtggagg

SEQ ID NO: 254013 - DNA, 20 bp, human
gactttgactagaggcagct

SEQ ID NO: 254014 - DNA, 20 bp, human
ggaaaatgaatagttaatcg

SEQ ID NO: 254015 - DNA, 20 bp, human
gacattctgtgttgaaatat

SEQ ID NO: 254016 - DNA, 20 bp, human
ggacaggggcggaggatggg

SEQ ID NO: 254017 - DNA, 20 bp, human
gccacacgcgcacacattcc

SEQ ID NO: 254018 - DNA, 20 bp, human
gacaagatggcaaagaggcg

SEQ ID NO: 254019 - DNA, 20 bp, human
ggcacgacaagatggcaaag

SEQ ID NO: 254020 - DNA, 20 bp, human
gtggtgaaaaagacagaggg

SEQ ID NO: 254021 - DNA, 20 bp, human
gacacattccaggcagtgat

SEQ ID NO: 254022 - DNA, 20 bp, human
gcgtggttgagtgatcccag

SEQ ID NO: 254023 - DNA, 20 bp, human
gaatgtgtgcgcgtgtggcc

SEQ ID NO: 254024 - DNA, 20 bp, human
gcgcgtgtggccgggtgaca

SEQ ID NO: 254025 - DNA, 20 bp, human
gttccaggcagtgattggtg

SEQ ID NO: 254026 - DNA, 20 bp, human
gttagcatcgtcagaggggt

SEQ ID NO: 254027 - DNA, 20 bp, human
gcacgtgtgactcagatcac

SEQ ID NO: 254028 - DNA, 20 bp, human
gggccagccagactgagtca

SEQ ID NO: 254029 - DNA, 20 bp, human
gaaggtcagtgtaacgggtg

SEQ ID NO: 254030 - DNA, 20 bp, human
gccaactccctcattagcag

SEQ ID NO: 254031 - DNA, 20 bp, human
gcaggcctgttcccggtcct

SEQ ID NO: 254032 - DNA, 20 bp, human
ggaagacccaggcctgttcc

SEQ ID NO: 254033 - DNA, 20 bp, human
gtcgccccccctgctaatga

SEQ ID NO: 254034 - DNA, 20 bp, human
ggaactgttgccctggttgg

SEQ ID NO: 254035 - DNA, 20 bp, human
gggggtctccgatggcagac

SEQ ID NO: 254036 - DNA, 20 bp, human
gaccgcgggcccaacctcgg

SEQ ID NO: 254037 - DNA, 20 bp, human
gcatgcgcggcgtcagggtc

SEQ ID NO: 254038 - DNA, 20 bp, human
gcgcgcggaaggcacagaga

SEQ ID NO: 254039 - DNA, 20 bp, human
ggcggggaagcccagggcga

SEQ ID NO: 254040 - DNA, 20 bp, human
gctccccggtaccgtagacc

SEQ ID NO: 254041 - DNA, 20 bp, human
gcataccgcgggcccaacct

SEQ ID NO: 254042 - DNA, 20 bp, human
gaaccttcgcgaaggtgggg

SEQ ID NO: 254043 - DNA, 20 bp, human
ggagccgagaaccttcgcga

SEQ ID NO: 254044 - DNA, 20 bp, human
ggggcccgcggtatgggcag

SEQ ID NO: 254045 - DNA, 20 bp, human
ggcccgccccaccttcgcga

SEQ ID NO: 254046 - DNA, 20 bp, human
gtcattctggggtcagtgta

SEQ ID NO: 254047 - DNA, 20 bp, human
gctggggtcagtgtagggac

SEQ ID NO: 254048 - DNA, 20 bp, human
ggcactgcctgaagcttcca

SEQ ID NO: 254049 - DNA, 20 bp, human
gggatggtctggtacgactc

SEQ ID NO: 254050 - DNA, 20 bp, human
gaagagctgggaagcaatta

SEQ ID NO: 254051 - DNA, 20 bp, human
gtggactagctctatttgga

SEQ ID NO: 254052 - DNA, 20 bp, human
gttaaggcgcagtaatctag

SEQ ID NO: 254053 - DNA, 20 bp, human
gtcccagctcttctatgctt

SEQ ID NO: 254054 - DNA, 20 bp, human
ggttacaaatatgtcagaga

SEQ ID NO: 254055 - DNA, 20 bp, human
gtagaggtcatattatgcaa

SEQ ID NO: 254056 - DNA, 20 bp, human
ggacacaatgctgacacggg

SEQ ID NO: 254057 - DNA, 20 bp, human
gtgtgagtggttgatactgg

SEQ ID NO: 254058 - DNA, 20 bp, human
gtctgtgacccaggtggtgt

SEQ ID NO: 254059 - DNA, 20 bp, human
ggggcctgcccctgctggtg

SEQ ID NO: 254060 - DNA, 20 bp, human
gcaccaaggctggaatcccg

SEQ ID NO: 254061 - DNA, 20 bp, human
gaggtggccacaacggtgtg

SEQ ID NO: 254062 - DNA, 20 bp, human
gggggcaggcccatatgccc

SEQ ID NO: 254063 - DNA, 20 bp, human
gccacaacggtgtgtgggaa

SEQ ID NO: 254064 - DNA, 20 bp, human
ggtggccacctcaccagcag

SEQ ID NO: 254065 - DNA, 20 bp, human
gggactcagcccacaccacc

SEQ ID NO: 254066 - DNA, 20 bp, human
gtagggcgccgggatcacgt

SEQ ID NO: 254067 - DNA, 20 bp, human
gaatgctagcgcaggcgcag

SEQ ID NO: 254068 - DNA, 20 bp, human
gccggcttcaacccccgaaa

SEQ ID NO: 254069 - DNA, 20 bp, human
ggaaaaggcggtgcttaaac

SEQ ID NO: 254070 - DNA, 20 bp, human
ggcggtgcttaaaccggagg

SEQ ID NO: 254071 - DNA, 20 bp, human
ggtgcttaaaccggaggagg

SEQ ID NO: 254072 - DNA, 20 bp, human
gaaggcggtgcttaaaccgg

SEQ ID NO: 254073 - DNA, 20 bp, human
gcgggggttgaagccggaag

SEQ ID NO: 254074 - DNA, 20 bp, human
ggcgccgggatcacgtgggg

SEQ ID NO: 254075 - DNA, 20 bp, human
gagtgagtcgacagacgagg

SEQ ID NO: 254076 - DNA, 20 bp, human
gcgcctggcgccccagatct

SEQ ID NO: 254077 - DNA, 20 bp, human
ggcgccccagatctgggcct

SEQ ID NO: 254078 - DNA, 20 bp, human
gctaggagacatgatgtcac

SEQ ID NO: 254079 - DNA, 20 bp, human
ggctgtacctgcgcccacat

SEQ ID NO: 254080 - DNA, 20 bp, human
gttcacccaggcccagatct

SEQ ID NO: 254081 - DNA, 20 bp, human
gtgggataggctgaggcgaa

SEQ ID NO: 254082 - DNA, 20 bp, human
gcctagcaaccgcgggaagg

SEQ ID NO: 254083 - DNA, 20 bp, human
gtgaaatgcctctcaatcac

SEQ ID NO: 254084 - DNA, 20 bp, human
gcgaggcctgggataggctg

SEQ ID NO: 254085 - DNA, 20 bp, human
gattgagaggcatttcaccc

SEQ ID NO: 254086 - DNA, 20 bp, human
ggcgccggccgcattggtga

SEQ ID NO: 254087 - DNA, 20 bp, human
gtggcggtgtgcgcgggatc

SEQ ID NO: 254088 - DNA, 20 bp, human
gtccggctccggctccaacc

SEQ ID NO: 254089 - DNA, 20 bp, human
ggcctggcgcggagcattgt

SEQ ID NO: 254090 - DNA, 20 bp, human
gtgcctggggagacccgctg

SEQ ID NO: 254091 - DNA, 20 bp, human
gggggtggagagggcggtgt

SEQ ID NO: 254092 - DNA, 20 bp, human
gggtgacggggaaacccaga

SEQ ID NO: 254093 - DNA, 20 bp, human
ggagagggcggtgtaggttt

SEQ ID NO: 254094 - DNA, 20 bp, human
gtcaccctggcaacggaagc

SEQ ID NO: 254095 - DNA, 20 bp, human
gttgacgtggcggtgtgcgc

SEQ ID NO: 254096 - DNA, 20 bp, human
gccgcgtggtcaccccgcca

SEQ ID NO: 254097 - DNA, 20 bp, human
gtgtccctgacgcggatcac

SEQ ID NO: 254098 - DNA, 20 bp, human
gcagcccggctgcgccacag

SEQ ID NO: 254099 - DNA, 20 bp, human
gtcccgccctaggccgcgcg

SEQ ID NO: 254100 - DNA, 20 bp, human
gagcgcaggcgcactcccgc

SEQ ID NO: 254101 - DNA, 20 bp, human
ggcaaggccgtgctcaagag

SEQ ID NO: 254102 - DNA, 20 bp, human
gtgcgcccccgcgcggccta

SEQ ID NO: 254103 - DNA, 20 bp, human
gtgcgctttgcgcccccgcg

SEQ ID NO: 254104 - DNA, 20 bp, human
gaggcgccgcgtcccgccct

SEQ ID NO: 254105 - DNA, 20 bp, human
gatccagccaggactcccta

SEQ ID NO: 254106 - DNA, 20 bp, human
gacatctggtgtattgactg

SEQ ID NO: 254107 - DNA, 20 bp, human
ggcagagtttacaaaggtct

SEQ ID NO: 254108 - DNA, 20 bp, human
gtctgtaaacagccaatgag

SEQ ID NO: 254109 - DNA, 20 bp, human
gcactgcaataatagacacg

SEQ ID NO: 254110 - DNA, 20 bp, human
gaactcaaactacagatccc

SEQ ID NO: 254111 - DNA, 20 bp, human
gaaaggtctaggatgacatc

SEQ ID NO: 254112 - DNA, 20 bp, human
ggatagagacaaaaatatat

SEQ ID NO: 254113 - DNA, 20 bp, human
gctattattgcagtgctgcc

SEQ ID NO: 254114 - DNA, 20 bp, human
gaaaaaaatgtgaagcaatg

SEQ ID NO: 254115 - DNA, 20 bp, human
ggatggagaagtggctaatg

SEQ ID NO: 254116 - DNA, 20 bp, human
ggaggccgccatcttcgctc

SEQ ID NO: 254117 - DNA, 20 bp, human
gaaagcctgagcgaagatgg

SEQ ID NO: 254118 - DNA, 20 bp, human
gggtctcgtgacagcctggg

SEQ ID NO: 254119 - DNA, 20 bp, human
ggccctaaggcacacgccgg

SEQ ID NO: 254120 - DNA, 20 bp, human
gcccctccgcttatgtcctg

SEQ ID NO: 254121 - DNA, 20 bp, human
gtgcgcatgtgtagctgctg

SEQ ID NO: 254122 - DNA, 20 bp, human
gaagaacgatcgggacgggg

SEQ ID NO: 254123 - DNA, 20 bp, human
gagggaaagaacgatcggga

SEQ ID NO: 254124 - DNA, 20 bp, human
gcccctccggcgtgtgcctt

SEQ ID NO: 254125 - DNA, 20 bp, human
gtccagagtgaaactctgag

SEQ ID NO: 254126 - DNA, 20 bp, human
gtccacttccggggtcacca

SEQ ID NO: 254127 - DNA, 20 bp, human
gaggcaagccaatccagcta

SEQ ID NO: 254128 - DNA, 20 bp, human
ggcggggccagtacttcctt

SEQ ID NO: 254129 - DNA, 20 bp, human
ggacgcagccctagctggat

SEQ ID NO: 254130 - DNA, 20 bp, human
ggggtcaccagggaagagac

SEQ ID NO: 254131 - DNA, 20 bp, human
gtagggctgcgtcgactcca

SEQ ID NO: 254132 - DNA, 20 bp, human
ggggcctacttccacttccg

SEQ ID NO: 254133 - DNA, 20 bp, human
ggaagcagagcgtgagcggg

SEQ ID NO: 254134 - DNA, 20 bp, human
ggagtcgacgcagccctagc

SEQ ID NO: 254135 - DNA, 20 bp, human
gtccctccgcgtgtgggaat

SEQ ID NO: 254136 - DNA, 20 bp, human
gtacccagctcgggtgagaa

SEQ ID NO: 254137 - DNA, 20 bp, human
gtaagcccagtcccttacgg

SEQ ID NO: 254138 - DNA, 20 bp, human
gcctccccaggccgccgtaa

SEQ ID NO: 254139 - DNA, 20 bp, human
ggggtgagaagggtatcttc

SEQ ID NO: 254140 - DNA, 20 bp, human
gaagccctgcgaactgatgt

SEQ ID NO: 254141 - DNA, 20 bp, human
gcacggggtcacactccgaa

SEQ ID NO: 254142 - DNA, 20 bp, human
gcgggacacgttacccagct

SEQ ID NO: 254143 - DNA, 20 bp, human
gtacccttctcacccgagct

SEQ ID NO: 254144 - DNA, 20 bp, human
gcaggccgccgtaagggact

SEQ ID NO: 254145 - DNA, 20 bp, human
gcgaaaggagccaagggcac

SEQ ID NO: 254146 - DNA, 20 bp, human
gcctagacggcgagtggcaa

SEQ ID NO: 254147 - DNA, 20 bp, human
gtctaggcgtggacctgggg

SEQ ID NO: 254148 - DNA, 20 bp, human
gtccacgcctagacggcgag

SEQ ID NO: 254149 - DNA, 20 bp, human
gcgaagtcgctatgcatgat

SEQ ID NO: 254150 - DNA, 20 bp, human
gcaggtcgagggcgtctact

SEQ ID NO: 254151 - DNA, 20 bp, human
gctgaaggcgaggaccgaac

SEQ ID NO: 254152 - DNA, 20 bp, human
gtaaaggtctatcgcactga

SEQ ID NO: 254153 - DNA, 20 bp, human
gtagacgccctcgacctgtt

SEQ ID NO: 254154 - DNA, 20 bp, human
ggccgtctaggcgtggacct

SEQ ID NO: 254155 - DNA, 20 bp, human
gaggaggggacaagcccgag

SEQ ID NO: 254156 - DNA, 20 bp, human
gtacggcagcggcggcaacg

SEQ ID NO: 254157 - DNA, 20 bp, human
gctctcctgcagccagcgta

SEQ ID NO: 254158 - DNA, 20 bp, human
gagccagcgtacggcagcgg

SEQ ID NO: 254159 - DNA, 20 bp, human
gcgacctagagcagggaatc

SEQ ID NO: 254160 - DNA, 20 bp, human
ggggaattgtgttctgggtc

SEQ ID NO: 254161 - DNA, 20 bp, human
gtgcagccagcgtacggcag

SEQ ID NO: 254162 - DNA, 20 bp, human
gtgccgccgctgccgtacgc

SEQ ID NO: 254163 - DNA, 20 bp, human
gacagtgccagtgggcgtgt

SEQ ID NO: 254164 - DNA, 20 bp, human
gcaggcttgactgactctga

SEQ ID NO: 254165 - DNA, 20 bp, human
gtccctgctctaggtcgcgg

SEQ ID NO: 254166 - DNA, 20 bp, human
gaccttcgtcaggagatctg

SEQ ID NO: 254167 - DNA, 20 bp, human
gagtgccccgggagctcata

SEQ ID NO: 254168 - DNA, 20 bp, human
ggctctgcgccagaggccgt

SEQ ID NO: 254169 - DNA, 20 bp, human
gctaaccctagggacatcca

SEQ ID NO: 254170 - DNA, 20 bp, human
gtcagcctcgggcacggggg

SEQ ID NO: 254171 - DNA, 20 bp, human
gcacttctctgcgtctccca

SEQ ID NO: 254172 - DNA, 20 bp, human
gccgaggctgaaagagaagg

SEQ ID NO: 254173 - DNA, 20 bp, human
gcccgggagctcatatggac

SEQ ID NO: 254174 - DNA, 20 bp, human
gtcggccctgcctaacccta

SEQ ID NO: 254175 - DNA, 20 bp, human
gctgcgtctcccacggcctc

SEQ ID NO: 254176 - DNA, 20 bp, human
gagagcggagaaagcgactt

SEQ ID NO: 254177 - DNA, 20 bp, human
gggagaaagcgacttcgggt

SEQ ID NO: 254178 - DNA, 20 bp, human
ggcgacttcgggttggttga

SEQ ID NO: 254179 - DNA, 20 bp, human
ggcgccctacgcaacacggc

SEQ ID NO: 254180 - DNA, 20 bp, human
gaaaggggacgcggaggaga

SEQ ID NO: 254181 - DNA, 20 bp, human
gccggaaaactgtcgtaaaa

SEQ ID NO: 254182 - DNA, 20 bp, human
ggggcggatctctttatttc

SEQ ID NO: 254183 - DNA, 20 bp, human
ggagcagccgcaaactaggc

SEQ ID NO: 254184 - DNA, 20 bp, human
ggctcctgccgtgttgcgta

SEQ ID NO: 254185 - DNA, 20 bp, human
ggaaaaaatcggtctgagta

SEQ ID NO: 254186 - DNA, 20 bp, human
gccacccccgccaacgtgtg

SEQ ID NO: 254187 - DNA, 20 bp, human
gaccaagtcgcacgagagaa

SEQ ID NO: 254188 - DNA, 20 bp, human
gttaccgcacacgttggcgg

SEQ ID NO: 254189 - DNA, 20 bp, human
ggcacgagagaatggttcct

SEQ ID NO: 254190 - DNA, 20 bp, human
gtctcagtcagtatagaact

SEQ ID NO: 254191 - DNA, 20 bp, human
gatactgactgagatccggc

SEQ ID NO: 254192 - DNA, 20 bp, human
gttctatactgactgagatc

SEQ ID NO: 254193 - DNA, 20 bp, human
gttccgggatggatctttcg

SEQ ID NO: 254194 - DNA, 20 bp, human
ggtgcgacttggtctccagc

SEQ ID NO: 254195 - DNA, 20 bp, human
gaggttaccgcacacgttgg

SEQ ID NO: 254196 - DNA, 20 bp, human
gggaaagaggcgggccgcgt

SEQ ID NO: 254197 - DNA, 20 bp, human
gggcggccgccgcttcgcat

SEQ ID NO: 254198 - DNA, 20 bp, human
gggaaagggccgcgcgggag

SEQ ID NO: 254199 - DNA, 20 bp, human
ggcttggcggggaaagaggc

SEQ ID NO: 254200 - DNA, 20 bp, human
gtgagtggcagccgacctga

SEQ ID NO: 254201 - DNA, 20 bp, human
gagaaaggcgggagcttggc

SEQ ID NO: 254202 - DNA, 20 bp, human
ggtgggctctgtgccggaaa

SEQ ID NO: 254203 - DNA, 20 bp, human
ggcttcgcatgggctagggg

SEQ ID NO: 254204 - DNA, 20 bp, human
ggtgccggaaagggccgcgc

SEQ ID NO: 254205 - DNA, 20 bp, human
gcccgcctctctcctcgcca

SEQ ID NO: 254206 - DNA, 20 bp, human
gtctcccggctcaggtggtg

SEQ ID NO: 254207 - DNA, 20 bp, human
ggggggcggcagccatacaa

SEQ ID NO: 254208 - DNA, 20 bp, human
gcaaacagcgtgggcggcgg

SEQ ID NO: 254209 - DNA, 20 bp, human
gtaagctttgcaaacagcgt

SEQ ID NO: 254210 - DNA, 20 bp, human
gggcagccatacaagggaga

SEQ ID NO: 254211 - DNA, 20 bp, human
gacctcttagggctcactga

SEQ ID NO: 254212 - DNA, 20 bp, human
gtgaggggcctaggctggga

SEQ ID NO: 254213 - DNA, 20 bp, human
gttgcaaacagcgtgggcgg

SEQ ID NO: 254214 - DNA, 20 bp, human
ggcgacgcctcagactgctg

SEQ ID NO: 254215 - DNA, 20 bp, human
ggctttgcaaacagcgtggg

SEQ ID NO: 254216 - DNA, 20 bp, human
gcaccccgacgcggtctcta

SEQ ID NO: 254217 - DNA, 20 bp, human
gtaaccggtcaccgcttcta

SEQ ID NO: 254218 - DNA, 20 bp, human
gggaaagcctgggatggcga

SEQ ID NO: 254219 - DNA, 20 bp, human
gactccatagaagcggtgac

SEQ ID NO: 254220 - DNA, 20 bp, human
ggccagaaacgcgaacacgt

SEQ ID NO: 254221 - DNA, 20 bp, human
gacgtcggaacagtgacttc

SEQ ID NO: 254222 - DNA, 20 bp, human
ggttaccatagagaccgcgt

SEQ ID NO: 254223 - DNA, 20 bp, human
gaaaaaggcggggaaagcct

SEQ ID NO: 254224 - DNA, 20 bp, human
gtcggaacagtgacttccgg

SEQ ID NO: 254225 - DNA, 20 bp, human
gtgaactctggggtgagaga

SEQ ID NO: 254226 - DNA, 20 bp, human
gccagctgctggtacgggga

SEQ ID NO: 254227 - DNA, 20 bp, human
gcaacccgttggtagggaga

SEQ ID NO: 254228 - DNA, 20 bp, human
gtgtcccgggcgcacttagg

SEQ ID NO: 254229 - DNA, 20 bp, human
gccttcgcaacccgttggta

SEQ ID NO: 254230 - DNA, 20 bp, human
gagcccgcctaagtgcgccc

SEQ ID NO: 254231 - DNA, 20 bp, human
gtcctccagctgctggtacg

SEQ ID NO: 254232 - DNA, 20 bp, human
gcgtccttctccctaccaac

SEQ ID NO: 254233 - DNA, 20 bp, human
gtgggggatggctctgtccc

SEQ ID NO: 254234 - DNA, 20 bp, human
ggggccagacgggactagcc

SEQ ID NO: 254235 - DNA, 20 bp, human
gtacttccttcgcaacccgt

SEQ ID NO: 254236 - DNA, 20 bp, human
gccagctgctggtacgggga

SEQ ID NO: 254237 - DNA, 20 bp, human
gcaacccgttggtagggaga

SEQ ID NO: 254238 - DNA, 20 bp, human
gtgtcccgggcgcacttagg

SEQ ID NO: 254239 - DNA, 20 bp, human
gccttcgcaacccgttggta

SEQ ID NO: 254240 - DNA, 20 bp, human
gagcccgcctaagtgcgccc

SEQ ID NO: 254241 - DNA, 20 bp, human
gtcctccagctgctggtacg

SEQ ID NO: 254242 - DNA, 20 bp, human
gcgtccttctccctaccaac

SEQ ID NO: 254243 - DNA, 20 bp, human
gtgggggatggctctgtccc

SEQ ID NO: 254244 - DNA, 20 bp, human
ggggccagacgggactagcc

SEQ ID NO: 254245 - DNA, 20 bp, human
gtacttccttcgcaacccgt

SEQ ID NO: 254246 - DNA, 20 bp, human
gcgcgcctgctgccaggcag

SEQ ID NO: 254247 - DNA, 20 bp, human
gaactgcagtcgcgtctcca

SEQ ID NO: 254248 - DNA, 20 bp, human
ggcgagcagcggaggcgagg

SEQ ID NO: 254249 - DNA, 20 bp, human
gcgcgggcggttgggagcgt

SEQ ID NO: 254250 - DNA, 20 bp, human
ggcagcaggcgcgggcggtt

SEQ ID NO: 254251 - DNA, 20 bp, human
ggacgggaaggcggcgttgg

SEQ ID NO: 254252 - DNA, 20 bp, human
gaacgccgccttcccgtcag

SEQ ID NO: 254253 - DNA, 20 bp, human
gaggcctcctcgtccaatgg

SEQ ID NO: 254254 - DNA, 20 bp, human
ggactcccgtctccctcccc

SEQ ID NO: 254255 - DNA, 20 bp, human
gcggcggggatggcgagcag

SEQ ID NO: 254256 - DNA, 20 bp, human
gtgcgcctgcgcctctcggg

SEQ ID NO: 254257 - DNA, 20 bp, human
gctctcgggagggacttagg

SEQ ID NO: 254258 - DNA, 20 bp, human
gtggggagttgtggctcgga

SEQ ID NO: 254259 - DNA, 20 bp, human
gagggcgagggtaactttct

SEQ ID NO: 254260 - DNA, 20 bp, human
gggccggaccacctccgctc

SEQ ID NO: 254261 - DNA, 20 bp, human
ggatgtaaagaccgagttgg

SEQ ID NO: 254262 - DNA, 20 bp, human
ggccccgagcggaggtggtc

SEQ ID NO: 254263 - DNA, 20 bp, human
gggcgtggggagttgtggct

SEQ ID NO: 254264 - DNA, 20 bp, human
gaccccgaataaacctgttc

SEQ ID NO: 254265 - DNA, 20 bp, human
gggagccttcgtcccgaccg

SEQ ID NO: 254266 - DNA, 20 bp, human
ggccccgccccgtccctgat

SEQ ID NO: 254267 - DNA, 20 bp, human
gggttcgcgctgataggctg

SEQ ID NO: 254268 - DNA, 20 bp, human
gtatcctatcagggacgggg

SEQ ID NO: 254269 - DNA, 20 bp, human
gagggaagcagacggggagt

SEQ ID NO: 254270 - DNA, 20 bp, human
gtcagcgcgaaccacgaccc

SEQ ID NO: 254271 - DNA, 20 bp, human
gaggaaagccgccagaaaga

SEQ ID NO: 254272 - DNA, 20 bp, human
gaaagaaggcgattggatgg

SEQ ID NO: 254273 - DNA, 20 bp, human
gcctgcgcatgcggactcgg

SEQ ID NO: 254274 - DNA, 20 bp, human
ggcttccacgttatcctatc

SEQ ID NO: 254275 - DNA, 20 bp, human
gcgtccctgataggataacg

SEQ ID NO: 254276 - DNA, 20 bp, human
ggggctgatgacataaaaac

SEQ ID NO: 254277 - DNA, 20 bp, human
ggccggcaggcgccagtcgc

SEQ ID NO: 254278 - DNA, 20 bp, human
ggcgtcccgcggccggcgtc

SEQ ID NO: 254279 - DNA, 20 bp, human
gacgcggtggccgcagaagt

SEQ ID NO: 254280 - DNA, 20 bp, human
gctgtggccagtcacgtaaa

SEQ ID NO: 254281 - DNA, 20 bp, human
ggggcctgcagcaacctcca

SEQ ID NO: 254282 - DNA, 20 bp, human
gtggccagtcacgtaaaggg

SEQ ID NO: 254283 - DNA, 20 bp, human
gaccaaccgactcctctcat

SEQ ID NO: 254284 - DNA, 20 bp, human
gtggggagaggggtgtccgc

SEQ ID NO: 254285 - DNA, 20 bp, human
gtcagcagcacacctgcgac

SEQ ID NO: 254286 - DNA, 20 bp, human
gctgcagaggggagcaacag

SEQ ID NO: 254287 - DNA, 20 bp, human
gcccgccctcacattctcat

SEQ ID NO: 254288 - DNA, 20 bp, human
gaaggccaatagacatgtag

SEQ ID NO: 254289 - DNA, 20 bp, human
ggggggaccggaggcaccaa

SEQ ID NO: 254290 - DNA, 20 bp, human
gcaggcgcgggcgcccacct

SEQ ID NO: 254291 - DNA, 20 bp, human
gtcccgcccgctccccaggt

SEQ ID NO: 254292 - DNA, 20 bp, human
gcccgcccctacatgtctat

SEQ ID NO: 254293 - DNA, 20 bp, human
gccgcaggctgggggaccgg

SEQ ID NO: 254294 - DNA, 20 bp, human
gccccagcctgcggactcgc

SEQ ID NO: 254295 - DNA, 20 bp, human
ggaggggagcaacagcggaa

SEQ ID NO: 254296 - DNA, 20 bp, human
gggaggctccgtccatgaag

SEQ ID NO: 254297 - DNA, 20 bp, human
gcggccccgggctgtcactc

SEQ ID NO: 254298 - DNA, 20 bp, human
gggaggctccgcccatgagt

SEQ ID NO: 254299 - DNA, 20 bp, human
gcgcgctcccggaaggacgt

SEQ ID NO: 254300 - DNA, 20 bp, human
ggactccgccccttcatgga

SEQ ID NO: 254301 - DNA, 20 bp, human
gagtcccgagtgacagcccg

SEQ ID NO: 254302 - DNA, 20 bp, human
gggctccgtccatgaagggg

SEQ ID NO: 254303 - DNA, 20 bp, human
gctgcggccacctgaagact

SEQ ID NO: 254304 - DNA, 20 bp, human
ggtccccgcccactcatggg

SEQ ID NO: 254305 - DNA, 20 bp, human
gcatggacggagcctccgct

SEQ ID NO: 254306 - DNA, 20 bp, human
gttccctgagggccctcaca

SEQ ID NO: 254307 - DNA, 20 bp, human
gcaaagggattcttccctga

SEQ ID NO: 254308 - DNA, 20 bp, human
gagaggaagtgttgtccaag

SEQ ID NO: 254309 - DNA, 20 bp, human
ggggcctcagctggaccatc

SEQ ID NO: 254310 - DNA, 20 bp, human
gcctccagatggtccagctg

SEQ ID NO: 254311 - DNA, 20 bp, human
ggccctcacaaggttttgaa

SEQ ID NO: 254312 - DNA, 20 bp, human
gccttcccaacctcccacca

SEQ ID NO: 254313 - DNA, 20 bp, human
gaactgacctgcagaattat

SEQ ID NO: 254314 - DNA, 20 bp, human
gggtccagctgaggccctct

SEQ ID NO: 254315 - DNA, 20 bp, human
gggggagagacctagaagac

SEQ ID NO: 254316 - DNA, 20 bp, human
ggacctgcttaaccctgcat

SEQ ID NO: 254317 - DNA, 20 bp, human
gtaagcaggtcaatagagtc

SEQ ID NO: 254318 - DNA, 20 bp, human
gtaaccctgcatggggggga

SEQ ID NO: 254319 - DNA, 20 bp, human
gcctgcatgggggggaagga

SEQ ID NO: 254320 - DNA, 20 bp, human
gttccagagggataaccaat

SEQ ID NO: 254321 - DNA, 20 bp, human
gtcaacaaaggatcaaaagt

SEQ ID NO: 254322 - DNA, 20 bp, human
gagccaattggttatccctc

SEQ ID NO: 254323 - DNA, 20 bp, human
gtgcctccagcgtctccacc

SEQ ID NO: 254324 - DNA, 20 bp, human
gccaccgggactctccatta

SEQ ID NO: 254325 - DNA, 20 bp, human
gcccccatgcagggttaagc

SEQ ID NO: 254326 - DNA, 20 bp, human
gtggggaagaggggctcggt

SEQ ID NO: 254327 - DNA, 20 bp, human
ggtaacacacctcttaagaa

SEQ ID NO: 254328 - DNA, 20 bp, human
gatgggtggtgccctcctgc

SEQ ID NO: 254329 - DNA, 20 bp, human
gagggcaccacccatcttga

SEQ ID NO: 254330 - DNA, 20 bp, human
ggcagggaagcgagagcgga

SEQ ID NO: 254331 - DNA, 20 bp, human
ggtgagttgggccatcaaga

SEQ ID NO: 254332 - DNA, 20 bp, human
gccgtggcggatgagaggta

SEQ ID NO: 254333 - DNA, 20 bp, human
gcagttgtcttcaggactta

SEQ ID NO: 254334 - DNA, 20 bp, human
ggtcctgaagacaactggga

SEQ ID NO: 254335 - DNA, 20 bp, human
gtgcgcgcgaaataagtccc

SEQ ID NO: 254336 - DNA, 20 bp, human
gcccgcgccgctcactcggg

SEQ ID NO: 254337 - DNA, 20 bp, human
gcgggcccgcgccgctcact

SEQ ID NO: 254338 - DNA, 20 bp, human
gtaaacatcgtcagagtcta

SEQ ID NO: 254339 - DNA, 20 bp, human
gtggctggcgccgacagggg

SEQ ID NO: 254340 - DNA, 20 bp, human
gaggactcctgtgttaataa

SEQ ID NO: 254341 - DNA, 20 bp, human
gcccggctccgcccacacgg

SEQ ID NO: 254342 - DNA, 20 bp, human
gttaacacaggagtcctagg

SEQ ID NO: 254343 - DNA, 20 bp, human
gaaacgggtgagagccccct

SEQ ID NO: 254344 - DNA, 20 bp, human
gcgcgcgcacccgcacgcct

SEQ ID NO: 254345 - DNA, 20 bp, human
gacggtgccccccgagtgag

SEQ ID NO: 254346 - DNA, 20 bp, human
gcccaagcggagcctctctc

SEQ ID NO: 254347 - DNA, 20 bp, human
gggaaggcggggtgtaccgg

SEQ ID NO: 254348 - DNA, 20 bp, human
ggggctcgtctaccagagag

SEQ ID NO: 254349 - DNA, 20 bp, human
gcgcccagaagggctccctc

SEQ ID NO: 254350 - DNA, 20 bp, human
ggcggagtgcgatgtggtaa

SEQ ID NO: 254351 - DNA, 20 bp, human
gcgcccccggatgtccacgg

SEQ ID NO: 254352 - DNA, 20 bp, human
gggtcccggcggtaagatgg

SEQ ID NO: 254353 - DNA, 20 bp, human
gggtgaagagcacttccggt

SEQ ID NO: 254354 - DNA, 20 bp, human
ggaccaccgtggacatccgg

SEQ ID NO: 254355 - DNA, 20 bp, human
gtacccgtgggtgggaaggc

SEQ ID NO: 254356 - DNA, 20 bp, human
gcgtctgagaggttcttaaa

SEQ ID NO: 254357 - DNA, 20 bp, human
ggccccgcctcccgtctgag

SEQ ID NO: 254358 - DNA, 20 bp, human
ggcgcagaagggtcacgtgg

SEQ ID NO: 254359 - DNA, 20 bp, human
gcctgcgcagaagggtcacg

SEQ ID NO: 254360 - DNA, 20 bp, human
gtaagaacctctcagacggg

SEQ ID NO: 254361 - DNA, 20 bp, human
gaggcactttaaaagtaggt

SEQ ID NO: 254362 - DNA, 20 bp, human
gaacctctcagacgggaggc

SEQ ID NO: 254363 - DNA, 20 bp, human
gatgtgcttaagttattgtt

SEQ ID NO: 254364 - DNA, 20 bp, human
gaagggctcgcagcccagcc

SEQ ID NO: 254365 - DNA, 20 bp, human
gtggaaccaggtagacatgg

SEQ ID NO: 254366 - DNA, 20 bp, human
ggggcccgggtaagtaacgc

SEQ ID NO: 254367 - DNA, 20 bp, human
gaaatgaggtgtggcgagtc

SEQ ID NO: 254368 - DNA, 20 bp, human
gttacggcggccgcaaaatg

SEQ ID NO: 254369 - DNA, 20 bp, human
gtagctcctgcgcgcggccg

SEQ ID NO: 254370 - DNA, 20 bp, human
gcagggaagtgatgttgctc

SEQ ID NO: 254371 - DNA, 20 bp, human
gaagacctagctcctgcgcg

SEQ ID NO: 254372 - DNA, 20 bp, human
gcacaagcactgaaggggcg

SEQ ID NO: 254373 - DNA, 20 bp, human
gggactgtgactccacatgc

SEQ ID NO: 254374 - DNA, 20 bp, human
gggtgtggcgagtcaggcgc

SEQ ID NO: 254375 - DNA, 20 bp, human
gcatgccggcgttacttacc

SEQ ID NO: 254376 - DNA, 20 bp, human
gggtgcgagcggggcattgt

SEQ ID NO: 254377 - DNA, 20 bp, human
gcggacgaggggagaataag

SEQ ID NO: 254378 - DNA, 20 bp, human
gcagccagcaacagccggac

SEQ ID NO: 254379 - DNA, 20 bp, human
gtggctccctggaggatccg

SEQ ID NO: 254380 - DNA, 20 bp, human
gtcggcggaagccctatccc

SEQ ID NO: 254381 - DNA, 20 bp, human
gcctcccgtccggctgttgc

SEQ ID NO: 254382 - DNA, 20 bp, human
gaggaccgctgccggggata

SEQ ID NO: 254383 - DNA, 20 bp, human
gtgtgcggggttaagaccta

SEQ ID NO: 254384 - DNA, 20 bp, human
gcacttctcggcgctctcgg

SEQ ID NO: 254385 - DNA, 20 bp, human
ggcattgtgggactgcgtgg

SEQ ID NO: 254386 - DNA, 20 bp, human
ggggcgtggtttagaggcca

SEQ ID NO: 254387 - DNA, 20 bp, human
gaagtgaagtcccgcctccc

SEQ ID NO: 254388 - DNA, 20 bp, human
gaagcgtgcccgaggagcag

SEQ ID NO: 254389 - DNA, 20 bp, human
gaatgtgtcccctgctcctc

SEQ ID NO: 254390 - DNA, 20 bp, human
gggacaggggcgtggtttag

SEQ ID NO: 254391 - DNA, 20 bp, human
gcgtggtttagaggccaggg

SEQ ID NO: 254392 - DNA, 20 bp, human
gtgaaaggcccttataagtc

SEQ ID NO: 254393 - DNA, 20 bp, human
gctcgtcaacgtccggtgag

SEQ ID NO: 254394 - DNA, 20 bp, human
ggcaaacgcctgacttataa

SEQ ID NO: 254395 - DNA, 20 bp, human
gtcagatcccaataaagtag

SEQ ID NO: 254396 - DNA, 20 bp, human
gggtgcggaggagttaagat

SEQ ID NO: 254397 - DNA, 20 bp, human
gtggccagcaagtctgcaga

SEQ ID NO: 254398 - DNA, 20 bp, human
gcagcaagtctgcagacggc

SEQ ID NO: 254399 - DNA, 20 bp, human
gcggaggagttaagatgggg

SEQ ID NO: 254400 - DNA, 20 bp, human
gtgagtcaacacgagatgct

SEQ ID NO: 254401 - DNA, 20 bp, human
ggtcttgataatgacagtgt

SEQ ID NO: 254402 - DNA, 20 bp, human
ggaagcaggccctgccaact

SEQ ID NO: 254403 - DNA, 20 bp, human
gaacacgagatgctgggacc

SEQ ID NO: 254404 - DNA, 20 bp, human
gcatttggaaaagggtgcgg

SEQ ID NO: 254405 - DNA, 20 bp, human
gcctgcttcctgaatctcct

SEQ ID NO: 254406 - DNA, 20 bp, human
gtgggcggagcttcgaagtg

SEQ ID NO: 254407 - DNA, 20 bp, human
gccgcccaggccaagaagcg

SEQ ID NO: 254408 - DNA, 20 bp, human
gcccccgcgcttcttggcct

SEQ ID NO: 254409 - DNA, 20 bp, human
gcaagagtacagggacgaac

SEQ ID NO: 254410 - DNA, 20 bp, human
gggagcttcgaagtggggcg

SEQ ID NO: 254411 - DNA, 20 bp, human
gctagctagcgatttgaagt

SEQ ID NO: 254412 - DNA, 20 bp, human
gtcctcgcctccaagagtac

SEQ ID NO: 254413 - DNA, 20 bp, human
gggacgaaccggtgagcaga

SEQ ID NO: 254414 - DNA, 20 bp, human
gaacaaggcccacactggac

SEQ ID NO: 254415 - DNA, 20 bp, human
ggcagaaggcctaagaagtc

SEQ ID NO: 254416 - DNA, 20 bp, human
ggggcccccagacaagagac

SEQ ID NO: 254417 - DNA, 20 bp, human
ggggccaggtatgtgcggga

SEQ ID NO: 254418 - DNA, 20 bp, human
gtgcaaatggagccccctgg

SEQ ID NO: 254419 - DNA, 20 bp, human
gccaccctcccgcacatacc

SEQ ID NO: 254420 - DNA, 20 bp, human
gggggccaccacacgtgcaa

SEQ ID NO: 254421 - DNA, 20 bp, human
gctgccctatcctggaagat

SEQ ID NO: 254422 - DNA, 20 bp, human
gaccacacgtgcaagggaca

SEQ ID NO: 254423 - DNA, 20 bp, human
gggcccccatcttccaggat

SEQ ID NO: 254424 - DNA, 20 bp, human
gtcggaacaagcagtggtgg

SEQ ID NO: 254425 - DNA, 20 bp, human
gttccaggatagggcaggga

SEQ ID NO: 254426 - DNA, 20 bp, human
gcgggcctgcctgttggcaa

SEQ ID NO: 254427 - DNA, 20 bp, human
gaacaaggaggaccagcacc

SEQ ID NO: 254428 - DNA, 20 bp, human
gtgagccacccggccaggaa

SEQ ID NO: 254429 - DNA, 20 bp, human
gtggcggcgaggcggagacg

SEQ ID NO: 254430 - DNA, 20 bp, human
gtgctggtcctccttgttgg

SEQ ID NO: 254431 - DNA, 20 bp, human
ggctgactggggacccagac

SEQ ID NO: 254432 - DNA, 20 bp, human
gcgcctcgccgccaacaagg

SEQ ID NO: 254433 - DNA, 20 bp, human
gctgcctgttggcaagggtg

SEQ ID NO: 254434 - DNA, 20 bp, human
gacgccccacccttgccaac

SEQ ID NO: 254435 - DNA, 20 bp, human
gctccgcctcgccgccaaca

SEQ ID NO: 254436 - DNA, 20 bp, human
ggtgccagggctccatgaaa

SEQ ID NO: 254437 - DNA, 20 bp, human
gaaaggcgaggattcgggac

SEQ ID NO: 254438 - DNA, 20 bp, human
ggtacccgggccagtgtgct

SEQ ID NO: 254439 - DNA, 20 bp, human
gcccggaaaccggagtgcca

SEQ ID NO: 254440 - DNA, 20 bp, human
gtggacgaccctcatctctg

SEQ ID NO: 254441 - DNA, 20 bp, human
gcaggactggtgattggaca

SEQ ID NO: 254442 - DNA, 20 bp, human
ggggaggaaaggcgaggatt

SEQ ID NO: 254443 - DNA, 20 bp, human
gagccctggggcagaacgcc

SEQ ID NO: 254444 - DNA, 20 bp, human
ggggcagaacgcccggaaac

SEQ ID NO: 254445 - DNA, 20 bp, human
ggaaggggtttgttctgacg

SEQ ID NO: 254446 - DNA, 20 bp, human
gaggcacccagctgagtcga

SEQ ID NO: 254447 - DNA, 20 bp, human
gttaccctgggggtctccat

SEQ ID NO: 254448 - DNA, 20 bp, human
gcgtctacctccctcctagg

SEQ ID NO: 254449 - DNA, 20 bp, human
gtgggtgcctgatgaactcc

SEQ ID NO: 254450 - DNA, 20 bp, human
gggggcaccagaaccggctc

SEQ ID NO: 254451 - DNA, 20 bp, human
gggtcagccacatcccggtg

SEQ ID NO: 254452 - DNA, 20 bp, human
ggtctcccaccccttaccct

SEQ ID NO: 254453 - DNA, 20 bp, human
gacacagccgcaccgggatg

SEQ ID NO: 254454 - DNA, 20 bp, human
gcctgagcagaatcccttca

SEQ ID NO: 254455 - DNA, 20 bp, human
gtgccagccccctaggaggg

SEQ ID NO: 254456 - DNA, 20 bp, human
gtcagagctggctcccggtt

SEQ ID NO: 254457 - DNA, 20 bp, human
ggaacataagggctccttaa

SEQ ID NO: 254458 - DNA, 20 bp, human
gtcaccccaggtgccctcta

SEQ ID NO: 254459 - DNA, 20 bp, human
gccaccctagagggcacctg

SEQ ID NO: 254460 - DNA, 20 bp, human
gggaagtggtccaccctaga

SEQ ID NO: 254461 - DNA, 20 bp, human
gcatgccaatttctgcacca

SEQ ID NO: 254462 - DNA, 20 bp, human
ggccctggtggtgtaaagta

SEQ ID NO: 254463 - DNA, 20 bp, human
gtcagtggagcctgcggaag

SEQ ID NO: 254464 - DNA, 20 bp, human
ggatatgagtgactttgtgg

SEQ ID NO: 254465 - DNA, 20 bp, human
gggaggatggcgcctaaatg

SEQ ID NO: 254466 - DNA, 20 bp, human
gctaccacgaaaaggaacgg

SEQ ID NO: 254467 - DNA, 20 bp, human
gggagcgccgggcccgtcgt

SEQ ID NO: 254468 - DNA, 20 bp, human
ggggtcagacagaagagcgt

SEQ ID NO: 254469 - DNA, 20 bp, human
gcggggcggggacatcacga

SEQ ID NO: 254470 - DNA, 20 bp, human
ggagttggacccaggttgta

SEQ ID NO: 254471 - DNA, 20 bp, human
ggggattagctaccacgaaa

SEQ ID NO: 254472 - DNA, 20 bp, human
gtagctaccacgaaaaggaa

SEQ ID NO: 254473 - DNA, 20 bp, human
gtggccaccgttccttttcg

SEQ ID NO: 254474 - DNA, 20 bp, human
gccaggagacgctggagcgc

SEQ ID NO: 254475 - DNA, 20 bp, human
gacgcagcatcgcgtctcgg

SEQ ID NO: 254476 - DNA, 20 bp, human
ggatggggaagctgcctatt

SEQ ID NO: 254477 - DNA, 20 bp, human
gcacaggcttcatattgatg

SEQ ID NO: 254478 - DNA, 20 bp, human
gaagtaggaacaaccaacca

SEQ ID NO: 254479 - DNA, 20 bp, human
ggaagggagagcagataatg

SEQ ID NO: 254480 - DNA, 20 bp, human
gcattgtgatctgtgtgtga

SEQ ID NO: 254481 - DNA, 20 bp, human
gcaaccaaggattacatctg

SEQ ID NO: 254482 - DNA, 20 bp, human
gtataggcacagtgcagaac

SEQ ID NO: 254483 - DNA, 20 bp, human
ggcctgtgacatgaaagaca

SEQ ID NO: 254484 - DNA, 20 bp, human
gtagctggtagaaatgttgt

SEQ ID NO: 254485 - DNA, 20 bp, human
gcctctcataatgggaggaa

SEQ ID NO: 254486 - DNA, 20 bp, human
gcgcgggtgcgtatgtacgg

SEQ ID NO: 254487 - DNA, 20 bp, human
gccaccccgcaagctctcat

SEQ ID NO: 254488 - DNA, 20 bp, human
gttccccagcagaccaatgt

SEQ ID NO: 254489 - DNA, 20 bp, human
gccgggcggcgcacgtgcag

SEQ ID NO: 254490 - DNA, 20 bp, human
gcaagccgcagggtggacgc

SEQ ID NO: 254491 - DNA, 20 bp, human
gcggcttgggagctcctcct

SEQ ID NO: 254492 - DNA, 20 bp, human
ggaggagctcccaagccgca

SEQ ID NO: 254493 - DNA, 20 bp, human
ggtgaaagctgcaaagtcgc

SEQ ID NO: 254494 - DNA, 20 bp, human
gggtctgagcgaagcccggg

SEQ ID NO: 254495 - DNA, 20 bp, human
ggggcttcgctcagaccttc

SEQ ID NO: 254496 - DNA, 20 bp, human
gggccccggctctggagcat

SEQ ID NO: 254497 - DNA, 20 bp, human
gcccgcagggagttgggatg

SEQ ID NO: 254498 - DNA, 20 bp, human
ggctctggagcatcggggag

SEQ ID NO: 254499 - DNA, 20 bp, human
gccccgatgctccagagccg

SEQ ID NO: 254500 - DNA, 20 bp, human
gaggagtgggtcgaagtcac

SEQ ID NO: 254501 - DNA, 20 bp, human
gcgcctggctccctgtacca

SEQ ID NO: 254502 - DNA, 20 bp, human
gtggagaggtccacgagtga

SEQ ID NO: 254503 - DNA, 20 bp, human
gggttgcaggaagacgatgc

SEQ ID NO: 254504 - DNA, 20 bp, human
gaggcggcagggcgcctcaa

SEQ ID NO: 254505 - DNA, 20 bp, human
gagggagccaggcgacgctg

SEQ ID NO: 254506 - DNA, 20 bp, human
gctaaggcttgcctgggaca

SEQ ID NO: 254507 - DNA, 20 bp, human
gaggttcaacctgtgggcta

SEQ ID NO: 254508 - DNA, 20 bp, human
gaggggccagggtccgatat

SEQ ID NO: 254509 - DNA, 20 bp, human
gagggtagatggatacgttg

SEQ ID NO: 254510 - DNA, 20 bp, human
ggggagactagcaatccaga

SEQ ID NO: 254511 - DNA, 20 bp, human
gctgaactgcacgtgcagta

SEQ ID NO: 254512 - DNA, 20 bp, human
gggccagggtccgatatggg

SEQ ID NO: 254513 - DNA, 20 bp, human
gtaaactagtgccaggtctt

SEQ ID NO: 254514 - DNA, 20 bp, human
gggcagagcccaagcctgga

SEQ ID NO: 254515 - DNA, 20 bp, human
gtgtgggctaaggcttgcct

SEQ ID NO: 254516 - DNA, 20 bp, human
gctgcggcccgcggtgtcct

SEQ ID NO: 254517 - DNA, 20 bp, human
ggcgcagcgcgcccccgacc

SEQ ID NO: 254518 - DNA, 20 bp, human
ggggcggaagcggcgttctt

SEQ ID NO: 254519 - DNA, 20 bp, human
gccgcgggccgcagcgagga

SEQ ID NO: 254520 - DNA, 20 bp, human
gtcgcaccccgaggacaccg

SEQ ID NO: 254521 - DNA, 20 bp, human
gcggccgtccctcctcgctg

SEQ ID NO: 254522 - DNA, 20 bp, human
gcgagctgcacgtggacgca

SEQ ID NO: 254523 - DNA, 20 bp, human
ggggccccctcaggccgcca

SEQ ID NO: 254524 - DNA, 20 bp, human
gtgcgcgcgagtgtccgagc

SEQ ID NO: 254525 - DNA, 20 bp, human
gagtgtccgagcgggaatgc

SEQ ID NO: 254526 - DNA, 20 bp, human
ggcgccgtccggggcatcat

SEQ ID NO: 254527 - DNA, 20 bp, human
gacacccatgatgccccgga

SEQ ID NO: 254528 - DNA, 20 bp, human
ggctccccctagcggcgtcc

SEQ ID NO: 254529 - DNA, 20 bp, human
gcgccgcgggctccccctag

SEQ ID NO: 254530 - DNA, 20 bp, human
ggctcccggacgccgctagg

SEQ ID NO: 254531 - DNA, 20 bp, human
gtaccaggcctcttggagag

SEQ ID NO: 254532 - DNA, 20 bp, human
gtagcagtgtctggggtgcg

SEQ ID NO: 254533 - DNA, 20 bp, human
gtgctcgctccgatccccga

SEQ ID NO: 254534 - DNA, 20 bp, human
gggtgctttagcagtgtctg

SEQ ID NO: 254535 - DNA, 20 bp, human
gtcaccttctgcggcttttg

SEQ ID NO: 254536 - DNA, 20 bp, human
gctgcgcaggctctagtcaa

SEQ ID NO: 254537 - DNA, 20 bp, human
gcaccggtgggccctagcct

SEQ ID NO: 254538 - DNA, 20 bp, human
gtgggccctagcctgggact

SEQ ID NO: 254539 - DNA, 20 bp, human
gggcaggccatgcgctgcga

SEQ ID NO: 254540 - DNA, 20 bp, human
gagttgtagttctggagcgg

SEQ ID NO: 254541 - DNA, 20 bp, human
gctagtcaaaggctaggagc

SEQ ID NO: 254542 - DNA, 20 bp, human
gcgcatggcctgccgggagg

SEQ ID NO: 254543 - DNA, 20 bp, human
gggcccggtccaatgggtgc

SEQ ID NO: 254544 - DNA, 20 bp, human
gagccggcacccattggacc

SEQ ID NO: 254545 - DNA, 20 bp, human
gccggcgggcccggtccaat

SEQ ID NO: 254546 - DNA, 20 bp, human
gggctgttgcacaacagtga

SEQ ID NO: 254547 - DNA, 20 bp, human
gaaaactaggcacgggccta

SEQ ID NO: 254548 - DNA, 20 bp, human
gtcagcaagacggtccccag

SEQ ID NO: 254549 - DNA, 20 bp, human
gcactcgcgccgcacgcgac

SEQ ID NO: 254550 - DNA, 20 bp, human
ggtcgcctgagaaccggatg

SEQ ID NO: 254551 - DNA, 20 bp, human
gaagacggtccccaggggga

SEQ ID NO: 254552 - DNA, 20 bp, human
ggttgagtaaaccttccccc

SEQ ID NO: 254553 - DNA, 20 bp, human
gcgtctgcctgccaataaga

SEQ ID NO: 254554 - DNA, 20 bp, human
gggcctgctgcaccgccact

SEQ ID NO: 254555 - DNA, 20 bp, human
ggcgggaggtcgctcgggtc

SEQ ID NO: 254556 - DNA, 20 bp, human
gcctctgcgttctgtggcca

SEQ ID NO: 254557 - DNA, 20 bp, human
gacgcactgcagcccagctg

SEQ ID NO: 254558 - DNA, 20 bp, human
gacagcgccgggtcaggaaa

SEQ ID NO: 254559 - DNA, 20 bp, human
gccacggcctctgcgttctg

SEQ ID NO: 254560 - DNA, 20 bp, human
gaccctgggaggagtcatcg

SEQ ID NO: 254561 - DNA, 20 bp, human
gctgacccggcgctgtaact

SEQ ID NO: 254562 - DNA, 20 bp, human
gggcggggcgtcgcggagat

SEQ ID NO: 254563 - DNA, 20 bp, human
gccgccgccagcccgccgct

SEQ ID NO: 254564 - DNA, 20 bp, human
gcccatcggaccaccaggcc

SEQ ID NO: 254565 - DNA, 20 bp, human
ggcctggcctggtggtccga

SEQ ID NO: 254566 - DNA, 20 bp, human
gtctgccggcgcggtccgcg

SEQ ID NO: 254567 - DNA, 20 bp, human
ggacccgcccgccgcttcca

SEQ ID NO: 254568 - DNA, 20 bp, human
ggcggcgcgctgactcacac

SEQ ID NO: 254569 - DNA, 20 bp, human
gtgacgtcgcgaggcgagca

SEQ ID NO: 254570 - DNA, 20 bp, human
gtcgcctcgcgacgtcagag

SEQ ID NO: 254571 - DNA, 20 bp, human
ggtcgcgaggcgagcagggc

SEQ ID NO: 254572 - DNA, 20 bp, human
ggaggcccgacgagccgtgt

SEQ ID NO: 254573 - DNA, 20 bp, human
ggctcccagaacggccaccg

SEQ ID NO: 254574 - DNA, 20 bp, human
gccaggggcggaggtgacag

SEQ ID NO: 254575 - DNA, 20 bp, human
gaggcggaagcctgagcggg

SEQ ID NO: 254576 - DNA, 20 bp, human
gtgggctcgtccaagctcca

SEQ ID NO: 254577 - DNA, 20 bp, human
gcgagcccactgctccgcgt

SEQ ID NO: 254578 - DNA, 20 bp, human
gcccccccacgcggagcagt

SEQ ID NO: 254579 - DNA, 20 bp, human
gcctgtgcagaaggatggaa

SEQ ID NO: 254580 - DNA, 20 bp, human
gttgcgcatgcgtgttccct

SEQ ID NO: 254581 - DNA, 20 bp, human
gggcacacaccccccccacg

SEQ ID NO: 254582 - DNA, 20 bp, human
ggaacacgcatgcgcaaggc

SEQ ID NO: 254583 - DNA, 20 bp, human
gcgtgttccctgggcatggc

SEQ ID NO: 254584 - DNA, 20 bp, human
gaggcgataccctgtgcaga

SEQ ID NO: 254585 - DNA, 20 bp, human
gaccaccccagtccgggcgt

SEQ ID NO: 254586 - DNA, 20 bp, human
gcccctcggaccggagaaga

SEQ ID NO: 254587 - DNA, 20 bp, human
gcagcggggcccacgtgacc

SEQ ID NO: 254588 - DNA, 20 bp, human
gtcacgtgggccccgctgga

SEQ ID NO: 254589 - DNA, 20 bp, human
gccccgctggagggcctggt

SEQ ID NO: 254590 - DNA, 20 bp, human
gtctccccggggctccgtcc

SEQ ID NO: 254591 - DNA, 20 bp, human
gtgggccagcccctcttctc

SEQ ID NO: 254592 - DNA, 20 bp, human
gccctccgggcaggcggctc

SEQ ID NO: 254593 - DNA, 20 bp, human
gtctccggtccgaggggcgc

SEQ ID NO: 254594 - DNA, 20 bp, human
gggccaggcggtcttcccga

SEQ ID NO: 254595 - DNA, 20 bp, human
gctaatctcttccagagctg

SEQ ID NO: 254596 - DNA, 20 bp, human
gaacgggggggcggggacga

SEQ ID NO: 254597 - DNA, 20 bp, human
gttagggcttctgatccccc

SEQ ID NO: 254598 - DNA, 20 bp, human
gcactggcccggggttggga

SEQ ID NO: 254599 - DNA, 20 bp, human
ggccagtgaaatcaccctgg

SEQ ID NO: 254600 - DNA, 20 bp, human
gggggcggagcccgcggaga

SEQ ID NO: 254601 - DNA, 20 bp, human
gagccctaagcgggaggggt

SEQ ID NO: 254602 - DNA, 20 bp, human
gcgaacggagacacacacac

SEQ ID NO: 254603 - DNA, 20 bp, human
gcagaagccctaagcgggag

SEQ ID NO: 254604 - DNA, 20 bp, human
gcgggccagtgaaatcaccc

SEQ ID NO: 254605 - DNA, 20 bp, human
ggccactcagatccccgccc

SEQ ID NO: 254606 - DNA, 20 bp, human
gggccccaggatgcattctt

SEQ ID NO: 254607 - DNA, 20 bp, human
ggacagtgttcccccgccat

SEQ ID NO: 254608 - DNA, 20 bp, human
ggcagcctgggtggggtact

SEQ ID NO: 254609 - DNA, 20 bp, human
gcaccctaagaatgcatcct

SEQ ID NO: 254610 - DNA, 20 bp, human
ggagacaccaggcatctcaa

SEQ ID NO: 254611 - DNA, 20 bp, human
gtccccctcaccaagcttgg

SEQ ID NO: 254612 - DNA, 20 bp, human
ggtgagggggaggctatggg

SEQ ID NO: 254613 - DNA, 20 bp, human
gccattctggcttctcccac

SEQ ID NO: 254614 - DNA, 20 bp, human
ggggacaggcaggtcctaaa

SEQ ID NO: 254615 - DNA, 20 bp, human
gaagactcgatcctcgtcaa

SEQ ID NO: 254616 - DNA, 20 bp, human
ggcagggaaagggaaccctc

SEQ ID NO: 254617 - DNA, 20 bp, human
ggagctgcggggggtcactt

SEQ ID NO: 254618 - DNA, 20 bp, human
gtggggagctaggaagctgg

SEQ ID NO: 254619 - DNA, 20 bp, human
ggattggggttcagaggatg

SEQ ID NO: 254620 - DNA, 20 bp, human
ggggaaagggaaccctcagg

SEQ ID NO: 254621 - DNA, 20 bp, human
ggcggggggtcacttggggt

SEQ ID NO: 254622 - DNA, 20 bp, human
gtgccggtttgcagtgggag

SEQ ID NO: 254623 - DNA, 20 bp, human
gcttaaccctccccacctga

SEQ ID NO: 254624 - DNA, 20 bp, human
gcgcccctcccactgcaaac

SEQ ID NO: 254625 - DNA, 20 bp, human
gtgggacagcgggtggccag

SEQ ID NO: 254626 - DNA, 20 bp, human
gggtgcggccaagctagggg

SEQ ID NO: 254627 - DNA, 20 bp, human
ggggacctgcaaagctagtg

SEQ ID NO: 254628 - DNA, 20 bp, human
ggggcggtgcggccaagcta

SEQ ID NO: 254629 - DNA, 20 bp, human
gcaagctaggggcggggcaa

SEQ ID NO: 254630 - DNA, 20 bp, human
ggggcggtgcagccctgcga

SEQ ID NO: 254631 - DNA, 20 bp, human
ggacagggtaagcccgccga

SEQ ID NO: 254632 - DNA, 20 bp, human
gcaggccgcgccgcactcgt

SEQ ID NO: 254633 - DNA, 20 bp, human
gggccggggaagcgtgatga

SEQ ID NO: 254634 - DNA, 20 bp, human
gggacgaggaagcttgacga

SEQ ID NO: 254635 - DNA, 20 bp, human
ggagtagtggggtacagcga

SEQ ID NO: 254636 - DNA, 20 bp, human
gggaatggggacgacgaact

SEQ ID NO: 254637 - DNA, 20 bp, human
gcgaacgtcaagtccaggaa

SEQ ID NO: 254638 - DNA, 20 bp, human
gatccagccgggaccctttc

SEQ ID NO: 254639 - DNA, 20 bp, human
ggaagggtgtgttcccgaaa

SEQ ID NO: 254640 - DNA, 20 bp, human
ggcatccgaacgtcaagtcc

SEQ ID NO: 254641 - DNA, 20 bp, human
gtcaagttaaggtgcgtgtt

SEQ ID NO: 254642 - DNA, 20 bp, human
gcctggacaaggtcaagtta

SEQ ID NO: 254643 - DNA, 20 bp, human
gttcgtcgtccccattccac

SEQ ID NO: 254644 - DNA, 20 bp, human
ggcagctggggaagacggcg

SEQ ID NO: 254645 - DNA, 20 bp, human
gtgctcaggcccaagaccct

SEQ ID NO: 254646 - DNA, 20 bp, human
ggcttcctgccaaagtgtga

SEQ ID NO: 254647 - DNA, 20 bp, human
gagactctgaagccaggcca

SEQ ID NO: 254648 - DNA, 20 bp, human
gtgccaccctcctacacgaa

SEQ ID NO: 254649 - DNA, 20 bp, human
gtaacctcgtgaggaaggta

SEQ ID NO: 254650 - DNA, 20 bp, human
gtcctcacgaggttactctg

SEQ ID NO: 254651 - DNA, 20 bp, human
ggcctggcttcagagtctgc

SEQ ID NO: 254652 - DNA, 20 bp, human
gagccaggccagggcttcac

SEQ ID NO: 254653 - DNA, 20 bp, human
gacatcaaaacccttcgtgt

SEQ ID NO: 254654 - DNA, 20 bp, human
gtcctcagagtaacctcgtg

SEQ ID NO: 254655 - DNA, 20 bp, human
gaaaattccccatcacactt

SEQ ID NO: 254656 - DNA, 20 bp, human
gggagctgcggggttaccat

SEQ ID NO: 254657 - DNA, 20 bp, human
ggaggcgcagccctcccgag

SEQ ID NO: 254658 - DNA, 20 bp, human
ggtcgttggggcttcctctc

SEQ ID NO: 254659 - DNA, 20 bp, human
gccaacgacctccacctaca

SEQ ID NO: 254660 - DNA, 20 bp, human
gcctctaagtgtaactgtcc

SEQ ID NO: 254661 - DNA, 20 bp, human
gttggggcttcctctcggga

SEQ ID NO: 254662 - DNA, 20 bp, human
gccgcccggaagcgcgacgc

SEQ ID NO: 254663 - DNA, 20 bp, human
gttagaggccttgtaggtgg

SEQ ID NO: 254664 - DNA, 20 bp, human
ggactgcggggtaggaggaa

SEQ ID NO: 254665 - DNA, 20 bp, human
ggggatgactgcggggtagg

SEQ ID NO: 254666 - DNA, 20 bp, human
gccagggcggtcagagacaa

SEQ ID NO: 254667 - DNA, 20 bp, human
gcagccagttcaggccaggg

SEQ ID NO: 254668 - DNA, 20 bp, human
gtgaccgccctggcctgaac

SEQ ID NO: 254669 - DNA, 20 bp, human
ggcccagccagttcaggcca

SEQ ID NO: 254670 - DNA, 20 bp, human
ggaagtcgtggtggtcgcga

SEQ ID NO: 254671 - DNA, 20 bp, human
gtgctgggaaagaccttcat

SEQ ID NO: 254672 - DNA, 20 bp, human
gggtcagagacaaagggcct

SEQ ID NO: 254673 - DNA, 20 bp, human
ggggaagagggaagtcgtgg

SEQ ID NO: 254674 - DNA, 20 bp, human
ggaaatgcacacttaaaccc

SEQ ID NO: 254675 - DNA, 20 bp, human
gtccggagcgccagggaaga

SEQ ID NO: 254676 - DNA, 20 bp, human
gagggagcgccgagaaagtg

SEQ ID NO: 254677 - DNA, 20 bp, human
gtcccacccggggcccgctc

SEQ ID NO: 254678 - DNA, 20 bp, human
gggtgtgagcgtgcacacgt

SEQ ID NO: 254679 - DNA, 20 bp, human
gtcccgagcgggccccgggt

SEQ ID NO: 254680 - DNA, 20 bp, human
gcgagaaagtgcggggagga

SEQ ID NO: 254681 - DNA, 20 bp, human
gaagcagccgccagaatcgc

SEQ ID NO: 254682 - DNA, 20 bp, human
ggcgcgctggcacacttacc

SEQ ID NO: 254683 - DNA, 20 bp, human
ggcgccgagaaagtgcgggg

SEQ ID NO: 254684 - DNA, 20 bp, human
ggaggggcgtgaagacgcgc

SEQ ID NO: 254685 - DNA, 20 bp, human
gcacgcactcgcaaacacgc

SEQ ID NO: 254686 - DNA, 20 bp, human
gggtaagattaggtggtgtt

SEQ ID NO: 254687 - DNA, 20 bp, human
gtggagcggctgattcatct

SEQ ID NO: 254688 - DNA, 20 bp, human
gttcgtgccaggcccagttt

SEQ ID NO: 254689 - DNA, 20 bp, human
gatcctctcgccgcagtccc

SEQ ID NO: 254690 - DNA, 20 bp, human
gaaagtcaacaacactgagg

SEQ ID NO: 254691 - DNA, 20 bp, human
gcaacaacactgagggggcg

SEQ ID NO: 254692 - DNA, 20 bp, human
gcagtggaactccctgctgg

SEQ ID NO: 254693 - DNA, 20 bp, human
ggagatgccgacttcgtgcc

SEQ ID NO: 254694 - DNA, 20 bp, human
gctccagggactgcggcgag

SEQ ID NO: 254695 - DNA, 20 bp, human
ggcgtggtggtatgtgtctt

SEQ ID NO: 254696 - DNA, 20 bp, human
gagcgagcggagcccagcgt

SEQ ID NO: 254697 - DNA, 20 bp, human
gggcacgcgcgggaacgtgt

SEQ ID NO: 254698 - DNA, 20 bp, human
gcacaggcgcgcacacctga

SEQ ID NO: 254699 - DNA, 20 bp, human
gcgtcctgcgggtccctgcc

SEQ ID NO: 254700 - DNA, 20 bp, human
ggggctccgctcgctctctc

SEQ ID NO: 254701 - DNA, 20 bp, human
gcccgggccggcgtgcacgc

SEQ ID NO: 254702 - DNA, 20 bp, human
gtgccgcgggcgtgcatgag

SEQ ID NO: 254703 - DNA, 20 bp, human
gcacccggcagcaaccaagc

SEQ ID NO: 254704 - DNA, 20 bp, human
gtgtgtcccgagagagcgag

SEQ ID NO: 254705 - DNA, 20 bp, human
gtgcatgagcggaaggcgcc

SEQ ID NO: 254706 - DNA, 20 bp, human
gaccctgggccccgaccccg

SEQ ID NO: 254707 - DNA, 20 bp, human
gggcccagggtccgcgccga

SEQ ID NO: 254708 - DNA, 20 bp, human
gagaggggtgcgcccttagg

SEQ ID NO: 254709 - DNA, 20 bp, human
gcgccctcggcgcggaccct

SEQ ID NO: 254710 - DNA, 20 bp, human
ggtcgcgggccggatgggaa

SEQ ID NO: 254711 - DNA, 20 bp, human
ggggagccccggcgaccgcg

SEQ ID NO: 254712 - DNA, 20 bp, human
gggagcgtcgcgggccggat

SEQ ID NO: 254713 - DNA, 20 bp, human
ggaactcaggagaaccccgc

SEQ ID NO: 254714 - DNA, 20 bp, human
gcgcacccgggcacccccgc

SEQ ID NO: 254715 - DNA, 20 bp, human
gacgggaggtaggaaacggg

SEQ ID NO: 254716 - DNA, 20 bp, human
gcgcgcgcggccaactcggc

SEQ ID NO: 254717 - DNA, 20 bp, human
gtcgcgggacgcgtgtgggg

SEQ ID NO: 254718 - DNA, 20 bp, human
gcatctggagcgggcgtcgc

SEQ ID NO: 254719 - DNA, 20 bp, human
ggcccggccgccagccgagt

SEQ ID NO: 254720 - DNA, 20 bp, human
ggcgtcgcgggacgcgtgtg

SEQ ID NO: 254721 - DNA, 20 bp, human
gagcctgcagttcccccggg

SEQ ID NO: 254722 - DNA, 20 bp, human
gcggcgtggacagccccggc

SEQ ID NO: 254723 - DNA, 20 bp, human
gtccgggcggggcctgtcca

SEQ ID NO: 254724 - DNA, 20 bp, human
ggcgagttgagcgaggaaga

SEQ ID NO: 254725 - DNA, 20 bp, human
ggagcccgtgtgggcggcgc

SEQ ID NO: 254726 - DNA, 20 bp, human
ggccaccagccgaagcagga

SEQ ID NO: 254727 - DNA, 20 bp, human
gatggggaagggtgtgtaga

SEQ ID NO: 254728 - DNA, 20 bp, human
gtcggagctcgggccctcta

SEQ ID NO: 254729 - DNA, 20 bp, human
ggctcgggccctctagggga

SEQ ID NO: 254730 - DNA, 20 bp, human
gctgtcctgccccacggcgt

SEQ ID NO: 254731 - DNA, 20 bp, human
gcgaagcgagcgagaaaagg

SEQ ID NO: 254732 - DNA, 20 bp, human
gctggtggcgatcggagctc

SEQ ID NO: 254733 - DNA, 20 bp, human
ggtgggggcgagggtcacga

SEQ ID NO: 254734 - DNA, 20 bp, human
gcatccgggaggggagatct

SEQ ID NO: 254735 - DNA, 20 bp, human
ggtgcagccgcatccgggag

SEQ ID NO: 254736 - DNA, 20 bp, human
gtgggcaggggcacactaga

SEQ ID NO: 254737 - DNA, 20 bp, human
gtagaaggctggtgccccgt

SEQ ID NO: 254738 - DNA, 20 bp, human
gcctggggaggagacaaagt

SEQ ID NO: 254739 - DNA, 20 bp, human
ggcgcccagccaccccctga

SEQ ID NO: 254740 - DNA, 20 bp, human
gcctccctcccgttgggcag

SEQ ID NO: 254741 - DNA, 20 bp, human
gcaggggcacactagaaggc

SEQ ID NO: 254742 - DNA, 20 bp, human
ggtctggcgagccccaggtg

SEQ ID NO: 254743 - DNA, 20 bp, human
ggcctctgctccctcgcctg

SEQ ID NO: 254744 - DNA, 20 bp, human
gctccctcctccctcccgtt

SEQ ID NO: 254745 - DNA, 20 bp, human
gtccccaggcgagggagcag

SEQ ID NO: 254746 - DNA, 20 bp, human
ggggagcagcggcgacggac

SEQ ID NO: 254747 - DNA, 20 bp, human
ggcgtcctgcgagcccgctg

SEQ ID NO: 254748 - DNA, 20 bp, human
gaagaagcaagcggcggcac

SEQ ID NO: 254749 - DNA, 20 bp, human
ggtggcggcggcatcccgga

SEQ ID NO: 254750 - DNA, 20 bp, human
gccttcgcccgcgccgccag

SEQ ID NO: 254751 - DNA, 20 bp, human
gcgaccgggcgacaacgcgg

SEQ ID NO: 254752 - DNA, 20 bp, human
ggctgtgaagaagcaagcgg

SEQ ID NO: 254753 - DNA, 20 bp, human
gggagctgtgaagaagcaag

SEQ ID NO: 254754 - DNA, 20 bp, human
gtctggaccgcgaggctccg

SEQ ID NO: 254755 - DNA, 20 bp, human
gcatccctcacaggccgtcc

SEQ ID NO: 254756 - DNA, 20 bp, human
ggggcgcggcaaatgtggtt

SEQ ID NO: 254757 - DNA, 20 bp, human
gaacacgccggggcactctc

SEQ ID NO: 254758 - DNA, 20 bp, human
ggccgcgcccacttccggga

SEQ ID NO: 254759 - DNA, 20 bp, human
ggaagtgggcgcggcaaatg

SEQ ID NO: 254760 - DNA, 20 bp, human
gggcaaatgtggttcggggc

SEQ ID NO: 254761 - DNA, 20 bp, human
gggagctgcagcacagtcgg

SEQ ID NO: 254762 - DNA, 20 bp, human
gaaaagggagggccgcaggg

SEQ ID NO: 254763 - DNA, 20 bp, human
gttggtccagagcgcggcgt

SEQ ID NO: 254764 - DNA, 20 bp, human
gccagagcgcggcgtaggtg

SEQ ID NO: 254765 - DNA, 20 bp, human
ggcaccagtagaaacgctac

SEQ ID NO: 254766 - DNA, 20 bp, human
gtctgcgctctgccgggcgg

SEQ ID NO: 254767 - DNA, 20 bp, human
gggcccaggaagccgctcca

SEQ ID NO: 254768 - DNA, 20 bp, human
gctcgcgcgcttccctggag

SEQ ID NO: 254769 - DNA, 20 bp, human
gtccgcctcgcgcgcttccc

SEQ ID NO: 254770 - DNA, 20 bp, human
gccgcccgcggtcacctgct

SEQ ID NO: 254771 - DNA, 20 bp, human
ggccgggcgggggccgactg

SEQ ID NO: 254772 - DNA, 20 bp, human
gcacccggctgataccccgg

SEQ ID NO: 254773 - DNA, 20 bp, human
gggcgcgcgccggacacttg

SEQ ID NO: 254774 - DNA, 20 bp, human
gcagagcgcagagagcggcg

SEQ ID NO: 254775 - DNA, 20 bp, human
gctccagcgcagccctctgt

SEQ ID NO: 254776 - DNA, 20 bp, human
gaggctgaggagggaagtta

SEQ ID NO: 254777 - DNA, 20 bp, human
gccgcccagcctggatcccg

SEQ ID NO: 254778 - DNA, 20 bp, human
gcggcccgggccacccggaa

SEQ ID NO: 254779 - DNA, 20 bp, human
gccggctgcccagaaccggg

SEQ ID NO: 254780 - DNA, 20 bp, human
ggggacgctctttctaccct

SEQ ID NO: 254781 - DNA, 20 bp, human
gctgcaggggcagcacggag

SEQ ID NO: 254782 - DNA, 20 bp, human
gggcgctgggacccagactg

SEQ ID NO: 254783 - DNA, 20 bp, human
gggggtcgcctggagtcctg

SEQ ID NO: 254784 - DNA, 20 bp, human
ggcgacccctccggcctgca

SEQ ID NO: 254785 - DNA, 20 bp, human
gaaagagcgtccccccagcc

SEQ ID NO: 254786 - DNA, 20 bp, human
gtcaatcccggcgggaaccc

SEQ ID NO: 254787 - DNA, 20 bp, human
gcccagcgcgtcaatcccgg

SEQ ID NO: 254788 - DNA, 20 bp, human
gcaggtcgctggcctgtctc

SEQ ID NO: 254789 - DNA, 20 bp, human
gcccgccgggattgacgcgc

SEQ ID NO: 254790 - DNA, 20 bp, human
gtctaaggaacattacggca

SEQ ID NO: 254791 - DNA, 20 bp, human
gaggctccgcggcagcgaag

SEQ ID NO: 254792 - DNA, 20 bp, human
gtcccccagcgcgtcaatcc

SEQ ID NO: 254793 - DNA, 20 bp, human
gcgggaaccccggctgcgga

SEQ ID NO: 254794 - DNA, 20 bp, human
gcctccgccagtccgggctc

SEQ ID NO: 254795 - DNA, 20 bp, human
gttctcgttgcgcgcctcta

SEQ ID NO: 254796 - DNA, 20 bp, human
ggcccggggccgccgacctc

SEQ ID NO: 254797 - DNA, 20 bp, human
gaactggcctcccgatactg

SEQ ID NO: 254798 - DNA, 20 bp, human
gtgcgcgccaggccgggtgg

SEQ ID NO: 254799 - DNA, 20 bp, human
gccctcccccggggtgattt

SEQ ID NO: 254800 - DNA, 20 bp, human
gcgtctgccccagtatcggg

SEQ ID NO: 254801 - DNA, 20 bp, human
ggctcccttcggccggaggt

SEQ ID NO: 254802 - DNA, 20 bp, human
gtccgagctcggagcagcga

SEQ ID NO: 254803 - DNA, 20 bp, human
gcccttcggccggaggtcgg

SEQ ID NO: 254804 - DNA, 20 bp, human
gcagacggcgcgctctgccc

SEQ ID NO: 254805 - DNA, 20 bp, human
gcgtgggcccagcgcggaac

SEQ ID NO: 254806 - DNA, 20 bp, human
gtgggaaggcatgacagcaa

SEQ ID NO: 254807 - DNA, 20 bp, human
gctactccatgcaaaagggg

SEQ ID NO: 254808 - DNA, 20 bp, human
gggagtagtaacacccctgg

SEQ ID NO: 254809 - DNA, 20 bp, human
gttactactccatgcaaaag

SEQ ID NO: 254810 - DNA, 20 bp, human
gggaacagacacaataaagc

SEQ ID NO: 254811 - DNA, 20 bp, human
gcatggagtagtaacacccc

SEQ ID NO: 254812 - DNA, 20 bp, human
gaccttaaatctgaagctcg

SEQ ID NO: 254813 - DNA, 20 bp, human
gtgtctgttccacacagcgt

SEQ ID NO: 254814 - DNA, 20 bp, human
gaagccggtctttatcagag

SEQ ID NO: 254815 - DNA, 20 bp, human
gctgcctctctgataaagac

SEQ ID NO: 254816 - DNA, 20 bp, human
gcccaggcagggcgctgaat

SEQ ID NO: 254817 - DNA, 20 bp, human
gtgcatgagggaggcccgga

SEQ ID NO: 254818 - DNA, 20 bp, human
ggggaggcgtacgagggtaa

SEQ ID NO: 254819 - DNA, 20 bp, human
ggggagctcgaaccttaagt

SEQ ID NO: 254820 - DNA, 20 bp, human
ggcggtacaagaagtgagac

SEQ ID NO: 254821 - DNA, 20 bp, human
gtgcctgggctggctagcaa

SEQ ID NO: 254822 - DNA, 20 bp, human
ggagcatgcgcagtgtttct

SEQ ID NO: 254823 - DNA, 20 bp, human
gtctcactaggtctcacccg

SEQ ID NO: 254824 - DNA, 20 bp, human
gggtcagactccagaggtgt

SEQ ID NO: 254825 - DNA, 20 bp, human
gttcttgtaccgcagtgggg

SEQ ID NO: 254826 - DNA, 20 bp, human
ggcaccggagagacccacac

SEQ ID NO: 254827 - DNA, 20 bp, human
gcagctcccggctaatccgg

SEQ ID NO: 254828 - DNA, 20 bp, human
gaagccccggaggcccgtgt

SEQ ID NO: 254829 - DNA, 20 bp, human
gcccgccggcagccgctggg

SEQ ID NO: 254830 - DNA, 20 bp, human
gcactggcgcgcccccacga

SEQ ID NO: 254831 - DNA, 20 bp, human
gccgctgggggggtcgcggt

SEQ ID NO: 254832 - DNA, 20 bp, human
gcccccacgacggcgggtag

SEQ ID NO: 254833 - DNA, 20 bp, human
gcaaaaccgaggactttcgg

SEQ ID NO: 254834 - DNA, 20 bp, human
gtgggagggacgaacggaga

SEQ ID NO: 254835 - DNA, 20 bp, human
gcgcgagggccctggcctct

SEQ ID NO: 254836 - DNA, 20 bp, human
gtagtctgctcgatgacgac

SEQ ID NO: 254837 - DNA, 20 bp, human
gcttcagtgagcaacaattc

SEQ ID NO: 254838 - DNA, 20 bp, human
gcaggtacagaagttggcac

SEQ ID NO: 254839 - DNA, 20 bp, human
ggacaggctgataggccctg

SEQ ID NO: 254840 - DNA, 20 bp, human
gtctaactcactggaaatgc

SEQ ID NO: 254841 - DNA, 20 bp, human
gaacttgcgtacagcttgga

SEQ ID NO: 254842 - DNA, 20 bp, human
gtgggccagccactctttgc

SEQ ID NO: 254843 - DNA, 20 bp, human
gacactcagaagaaaccgca

SEQ ID NO: 254844 - DNA, 20 bp, human
gtcgatgacgacaggctgat

SEQ ID NO: 254845 - DNA, 20 bp, human
gacaattcaggtacagaagt

SEQ ID NO: 254846 - DNA, 20 bp, human
ggggcgggaactcatgactc

SEQ ID NO: 254847 - DNA, 20 bp, human
gtagcaagatgccaatagcg

SEQ ID NO: 254848 - DNA, 20 bp, human
ggacagcgtggagtggtcaa

SEQ ID NO: 254849 - DNA, 20 bp, human
gccagggtgcgcagctgccc

SEQ ID NO: 254850 - DNA, 20 bp, human
gctcctcagcccaacactca

SEQ ID NO: 254851 - DNA, 20 bp, human
gggtggtgctgaatgacctg

SEQ ID NO: 254852 - DNA, 20 bp, human
gctgaggtggacggagctta

SEQ ID NO: 254853 - DNA, 20 bp, human
gccagggagtgtcaggccca

SEQ ID NO: 254854 - DNA, 20 bp, human
ggccccaaccacgtgagtgt

SEQ ID NO: 254855 - DNA, 20 bp, human
gtgacctctccggggccccc

SEQ ID NO: 254856 - DNA, 20 bp, human
ggggacgcgcgattctgccc

SEQ ID NO: 254857 - DNA, 20 bp, human
gcccgcggctcggaggaata

SEQ ID NO: 254858 - DNA, 20 bp, human
gaatgagctgggggtaccgg

SEQ ID NO: 254859 - DNA, 20 bp, human
ggggcgacctgaagcgggtg

SEQ ID NO: 254860 - DNA, 20 bp, human
gtaccgggggcgacctgaag

SEQ ID NO: 254861 - DNA, 20 bp, human
gtgaaggggttgagatgtgg

SEQ ID NO: 254862 - DNA, 20 bp, human
ggcacccccgcacccgcttc

SEQ ID NO: 254863 - DNA, 20 bp, human
gggctcggaggaatacggcg

SEQ ID NO: 254864 - DNA, 20 bp, human
ggggagctgatgtggcgtat

SEQ ID NO: 254865 - DNA, 20 bp, human
ggcgcagcggcgagacctgg

SEQ ID NO: 254866 - DNA, 20 bp, human
gagccccagccgtgagggag

SEQ ID NO: 254867 - DNA, 20 bp, human
gtggcagttaaccccttcct

SEQ ID NO: 254868 - DNA, 20 bp, human
gtggctcctactgtggaggt

SEQ ID NO: 254869 - DNA, 20 bp, human
gcagtcccctccctcacggc

SEQ ID NO: 254870 - DNA, 20 bp, human
ggagccagtcctcccaggaa

SEQ ID NO: 254871 - DNA, 20 bp, human
gggttctgtcgtcctggggt

SEQ ID NO: 254872 - DNA, 20 bp, human
gcaggacgacagaaccattc

SEQ ID NO: 254873 - DNA, 20 bp, human
gcccaggaagggaagtggca

SEQ ID NO: 254874 - DNA, 20 bp, human
gagagttatcacagttgatg

SEQ ID NO: 254875 - DNA, 20 bp, human
gaacaggtagaggaccgggt

SEQ ID NO: 254876 - DNA, 20 bp, human
gaggcgcggggagcgttcca

SEQ ID NO: 254877 - DNA, 20 bp, human
gcacccgtgagcagccgccc

SEQ ID NO: 254878 - DNA, 20 bp, human
gttccagggcggctgctcac

SEQ ID NO: 254879 - DNA, 20 bp, human
gctcctcccggccgagaagg

SEQ ID NO: 254880 - DNA, 20 bp, human
gtgcctcctcccggccgaga

SEQ ID NO: 254881 - DNA, 20 bp, human
gggggtggggggctaagagg

SEQ ID NO: 254882 - DNA, 20 bp, human
gcccagtgctgggactcgcg

SEQ ID NO: 254883 - DNA, 20 bp, human
gggtggccgcagcccagtgc

SEQ ID NO: 254884 - DNA, 20 bp, human
gggcacgctccgggtccgcc

SEQ ID NO: 254885 - DNA, 20 bp, human
gcgctccgggtccgccagga

SEQ ID NO: 254886 - DNA, 20 bp, human
gccacccgcgcggagaggga

SEQ ID NO: 254887 - DNA, 20 bp, human
gctccctccccctggcccgt

SEQ ID NO: 254888 - DNA, 20 bp, human
gaagctgtgcagcggggaaa

SEQ ID NO: 254889 - DNA, 20 bp, human
ggacacggcgcctcattccc

SEQ ID NO: 254890 - DNA, 20 bp, human
gtcccgctggccttccgcgt

SEQ ID NO: 254891 - DNA, 20 bp, human
gcgctcccacccgcgcggag

SEQ ID NO: 254892 - DNA, 20 bp, human
gcgcgcccggggagcgctga

SEQ ID NO: 254893 - DNA, 20 bp, human
gtggccggagcgcaccaccg

SEQ ID NO: 254894 - DNA, 20 bp, human
gcccagccaccccacgggcc

SEQ ID NO: 254895 - DNA, 20 bp, human
ggagccgcggtggtgcgctc

SEQ ID NO: 254896 - DNA, 20 bp, human
gtggccccaccgtcccgcgg

SEQ ID NO: 254897 - DNA, 20 bp, human
gtggccgccgcgggacggtg

SEQ ID NO: 254898 - DNA, 20 bp, human
gtggagcaagcgcaccatct

SEQ ID NO: 254899 - DNA, 20 bp, human
ggcgggacggtggggccaga

SEQ ID NO: 254900 - DNA, 20 bp, human
gtggggccagaggggcccgt

SEQ ID NO: 254901 - DNA, 20 bp, human
ggggctccttctcctgcggg

SEQ ID NO: 254902 - DNA, 20 bp, human
ggggagcagtgcccagagcg

SEQ ID NO: 254903 - DNA, 20 bp, human
ggggagccgcccgcaggaga

SEQ ID NO: 254904 - DNA, 20 bp, human
gacaccggcgactccagggc

SEQ ID NO: 254905 - DNA, 20 bp, human
ggcgccggccctggagtcgc

SEQ ID NO: 254906 - DNA, 20 bp, human
gcgggtcgaatggaccgggg

SEQ ID NO: 254907 - DNA, 20 bp, human
gcgccggcgggccgtgtgtg

SEQ ID NO: 254908 - DNA, 20 bp, human
gcacgtgggcatggcgtctg

SEQ ID NO: 254909 - DNA, 20 bp, human
ggcgggccgtgtgtgaggtg

SEQ ID NO: 254910 - DNA, 20 bp, human
gcgtgtgtgaggtgcggagc

SEQ ID NO: 254911 - DNA, 20 bp, human
ggcgtctgggggcggggtta

SEQ ID NO: 254912 - DNA, 20 bp, human
gaggtgcggagcgggtcgaa

SEQ ID NO: 254913 - DNA, 20 bp, human
ggcgagcgggcgcgcgaaga

SEQ ID NO: 254914 - DNA, 20 bp, human
gcgggggcgagcggtcacgt

SEQ ID NO: 254915 - DNA, 20 bp, human
gggagcgggtcgaatggacc

SEQ ID NO: 254916 - DNA, 20 bp, human
ggcgccgtgcacccaatcgg

SEQ ID NO: 254917 - DNA, 20 bp, human
ggaggcgccgtgcacccaat

SEQ ID NO: 254918 - DNA, 20 bp, human
gtgggtgcacggcgcctccc

SEQ ID NO: 254919 - DNA, 20 bp, human
gcgagcggcgaatcagagag

SEQ ID NO: 254920 - DNA, 20 bp, human
gcccagctggcgcccaatct

SEQ ID NO: 254921 - DNA, 20 bp, human
gaatcagagagcggggcccc

SEQ ID NO: 254922 - DNA, 20 bp, human
ggcggctcgttggctcccag

SEQ ID NO: 254923 - DNA, 20 bp, human
gagggttccagcaccgaaca

SEQ ID NO: 254924 - DNA, 20 bp, human
ggccagctggggcggctcgt

SEQ ID NO: 254925 - DNA, 20 bp, human
ggctgcgccgctacctatat

SEQ ID NO: 254926 - DNA, 20 bp, human
gtcaacgcccactgtcccag

SEQ ID NO: 254927 - DNA, 20 bp, human
gccgcagcggcgatcccggg

SEQ ID NO: 254928 - DNA, 20 bp, human
gcgcccccgccggttccgag

SEQ ID NO: 254929 - DNA, 20 bp, human
gcgcgcgggaagtctctgta

SEQ ID NO: 254930 - DNA, 20 bp, human
gagcccgcagcggcgatccc

SEQ ID NO: 254931 - DNA, 20 bp, human
ggctgcgggctgcgtctcgc

SEQ ID NO: 254932 - DNA, 20 bp, human
gcggcgaggcgccacgtcag

SEQ ID NO: 254933 - DNA, 20 bp, human
gctccgctcggaaccggcgg

SEQ ID NO: 254934 - DNA, 20 bp, human
ggaacctggcgactggactc

SEQ ID NO: 254935 - DNA, 20 bp, human
gtgggcgttgacggccaccc

SEQ ID NO: 254936 - DNA, 20 bp, human
ggaggcaggaagccgatcgg

SEQ ID NO: 254937 - DNA, 20 bp, human
gccctcaagtggactgtcgc

SEQ ID NO: 254938 - DNA, 20 bp, human
gtcaggagtggctagaaagg

SEQ ID NO: 254939 - DNA, 20 bp, human
gtcccgcgacagtccacttg

SEQ ID NO: 254940 - DNA, 20 bp, human
gctgtcgcgggaagcggcca

SEQ ID NO: 254941 - DNA, 20 bp, human
gttgccacagcgccctcaag

SEQ ID NO: 254942 - DNA, 20 bp, human
gggccatggctaccaatttc

SEQ ID NO: 254943 - DNA, 20 bp, human
ggatcgggggcggggatcga

SEQ ID NO: 254944 - DNA, 20 bp, human
gctgtggcaacagctagcgc

SEQ ID NO: 254945 - DNA, 20 bp, human
gcgggaggcaggaagccgat

SEQ ID NO: 254946 - DNA, 20 bp, human
gcggggcggaactagaagac

SEQ ID NO: 254947 - DNA, 20 bp, human
gaagggcggggcctggaagt

SEQ ID NO: 254948 - DNA, 20 bp, human
gccgaaggaggcgggatcaa

SEQ ID NO: 254949 - DNA, 20 bp, human
gggacctggaggtgggccat

SEQ ID NO: 254950 - DNA, 20 bp, human
ggaagacggggcctgaccga

SEQ ID NO: 254951 - DNA, 20 bp, human
ggatcccgcctccttcggtc

SEQ ID NO: 254952 - DNA, 20 bp, human
ggggcctgaccgaaggaggc

SEQ ID NO: 254953 - DNA, 20 bp, human
ggaggcgggccataacaaca

SEQ ID NO: 254954 - DNA, 20 bp, human
gccgaggccccgcccctgta

SEQ ID NO: 254955 - DNA, 20 bp, human
gcgggccataacaacagggg

SEQ ID NO: 254956 - DNA, 20 bp, human
gactacaaagagggagtcgg

SEQ ID NO: 254957 - DNA, 20 bp, human
gggcgggcgagtccacgggg

SEQ ID NO: 254958 - DNA, 20 bp, human
gcccgcgcgcgccaccccct

SEQ ID NO: 254959 - DNA, 20 bp, human
gttcgtgcgtgcgtggattc

SEQ ID NO: 254960 - DNA, 20 bp, human
ggagcccggagcgaagacgc

SEQ ID NO: 254961 - DNA, 20 bp, human
ggggccggcgagtgggggaa

SEQ ID NO: 254962 - DNA, 20 bp, human
gtcacgccggcccaagatgg

SEQ ID NO: 254963 - DNA, 20 bp, human
ggggtcggcccgctgggcgg

SEQ ID NO: 254964 - DNA, 20 bp, human
gggcgggcgggcgagtccac

SEQ ID NO: 254965 - DNA, 20 bp, human
gacgtacgcacgcacgtcct

SEQ ID NO: 254966 - DNA, 20 bp, human
ggtgcagcggggcagaacat

SEQ ID NO: 254967 - DNA, 20 bp, human
gaatatgggcattagagggt

SEQ ID NO: 254968 - DNA, 20 bp, human
ggtgtcagacacgtggtaca

SEQ ID NO: 254969 - DNA, 20 bp, human
gcggaggcatcccagattaa

SEQ ID NO: 254970 - DNA, 20 bp, human
ggacggagctaaaactgacg

SEQ ID NO: 254971 - DNA, 20 bp, human
gtccataggtcaagcttaaa

SEQ ID NO: 254972 - DNA, 20 bp, human
ggtgagcggtgtcagacacg

SEQ ID NO: 254973 - DNA, 20 bp, human
gtaagcttgacctatggagg

SEQ ID NO: 254974 - DNA, 20 bp, human
gggcggaaacagtagatagg

SEQ ID NO: 254975 - DNA, 20 bp, human
gttagggaagtatccgttct

SEQ ID NO: 254976 - DNA, 20 bp, human
gcccgggtggggtcgactac

SEQ ID NO: 254977 - DNA, 20 bp, human
gggccaagctagtcacccgg

SEQ ID NO: 254978 - DNA, 20 bp, human
gcacccccgggtgactagct

SEQ ID NO: 254979 - DNA, 20 bp, human
gagagcggacgaagggggga

SEQ ID NO: 254980 - DNA, 20 bp, human
gccacccggggaccgactct

SEQ ID NO: 254981 - DNA, 20 bp, human
gtcagccggaagtgaccctc

SEQ ID NO: 254982 - DNA, 20 bp, human
gcaatgagagcggacgaagg

SEQ ID NO: 254983 - DNA, 20 bp, human
gctcggggctagaagaaagc

SEQ ID NO: 254984 - DNA, 20 bp, human
gcctgcgccagctgcgtaca

SEQ ID NO: 254985 - DNA, 20 bp, human
gcggaagtgaccctctggaa

SEQ ID NO: 254986 - DNA, 20 bp, human
gtgggtgcctgccgaggggt

SEQ ID NO: 254987 - DNA, 20 bp, human
ggcacctgggtgcctgccga

SEQ ID NO: 254988 - DNA, 20 bp, human
gctgccgaggggtgggatct

SEQ ID NO: 254989 - DNA, 20 bp, human
gacaggggagccctgataag

SEQ ID NO: 254990 - DNA, 20 bp, human
gctgcggtctcctcttatca

SEQ ID NO: 254991 - DNA, 20 bp, human
ggcccccagatcccacccct

SEQ ID NO: 254992 - DNA, 20 bp, human
gagggctcccctgtgggttg

SEQ ID NO: 254993 - DNA, 20 bp, human
ggctgctgcgtcatggagcc

SEQ ID NO: 254994 - DNA, 20 bp, human
gagtgagggtggcgcctcca

SEQ ID NO: 254995 - DNA, 20 bp, human
ggaccgcagctgctgcgtca

SEQ ID NO: 254996 - DNA, 20 bp, human
ggagctagagcccagatgaa

SEQ ID NO: 254997 - DNA, 20 bp, human
gggaggcatagtaagaagct

SEQ ID NO: 254998 - DNA, 20 bp, human
gtgactgggcgttgctgtct

SEQ ID NO: 254999 - DNA, 20 bp, human
ggcccagatgaaaggacagc

SEQ ID NO: 255000 - DNA, 20 bp, human
gtgctgtctgggctaggcgg

SEQ ID NO: 255001 - DNA, 20 bp, human
gagccactcaccactcatct

SEQ ID NO: 255002 - DNA, 20 bp, human
gtgggctctagctccacccc

SEQ ID NO: 255003 - DNA, 20 bp, human
ggggcgttgctgtctgggct

SEQ ID NO: 255004 - DNA, 20 bp, human
gctaggcccccgggtcctga

SEQ ID NO: 255005 - DNA, 20 bp, human
gagcacattccccaccaggg

SEQ ID NO: 255006 - DNA, 20 bp, human
gaaactgccccatttcctgc

SEQ ID NO: 255007 - DNA, 20 bp, human
ggacatctcagggcactctc

SEQ ID NO: 255008 - DNA, 20 bp, human
gtgcacgcacccccctggct

SEQ ID NO: 255009 - DNA, 20 bp, human
ggagaagtttctagccttgg

SEQ ID NO: 255010 - DNA, 20 bp, human
gacactgccaggacatctca

SEQ ID NO: 255011 - DNA, 20 bp, human
gggaactttgctccaggaga

SEQ ID NO: 255012 - DNA, 20 bp, human
gaagacatataggtgttggg

SEQ ID NO: 255013 - DNA, 20 bp, human
gggcagcaggtggccgggta

SEQ ID NO: 255014 - DNA, 20 bp, human
gcaacaagacatataggtgt

SEQ ID NO: 255015 - DNA, 20 bp, human
gagctgtgcacgcacccccc

SEQ ID NO: 255016 - DNA, 20 bp, human
gggaacaggccaggcatcgt

SEQ ID NO: 255017 - DNA, 20 bp, human
gagggcacagagatggcttt

SEQ ID NO: 255018 - DNA, 20 bp, human
gatggctttgggtgaggtta

SEQ ID NO: 255019 - DNA, 20 bp, human
gaaagtctggtaggacatgg

SEQ ID NO: 255020 - DNA, 20 bp, human
gtaacacttgtttacttctg

SEQ ID NO: 255021 - DNA, 20 bp, human
gcctcgaccttcaaattact

SEQ ID NO: 255022 - DNA, 20 bp, human
ggtgaggttagggggaggat

SEQ ID NO: 255023 - DNA, 20 bp, human
gagggggaggataggcctcc

SEQ ID NO: 255024 - DNA, 20 bp, human
gcaagtgttagccaaccagg

SEQ ID NO: 255025 - DNA, 20 bp, human
gaaacaagtgttagccaacc

SEQ ID NO: 255026 - DNA, 20 bp, human
gtggcggggtaggggttggt

SEQ ID NO: 255027 - DNA, 20 bp, human
gcagagaggctggcggggta

SEQ ID NO: 255028 - DNA, 20 bp, human
ggtggcttcagcttggtgat

SEQ ID NO: 255029 - DNA, 20 bp, human
ggcttcagcttggtgattgg

SEQ ID NO: 255030 - DNA, 20 bp, human
gttggacagagaggctggcg

SEQ ID NO: 255031 - DNA, 20 bp, human
gcagtggccaggctgctttc

SEQ ID NO: 255032 - DNA, 20 bp, human
gcctctctgtccaacattcc

SEQ ID NO: 255033 - DNA, 20 bp, human
gggaggatgtttgtctacag

SEQ ID NO: 255034 - DNA, 20 bp, human
ggaaggttctagatgcattc

SEQ ID NO: 255035 - DNA, 20 bp, human
gcaggagataaagatgcatt

SEQ ID NO: 255036 - DNA, 20 bp, human
gcctacccaggcccacgtgg

SEQ ID NO: 255037 - DNA, 20 bp, human
ggccaggcagggaactagta

SEQ ID NO: 255038 - DNA, 20 bp, human
gcggcagctaaccgccacgt

SEQ ID NO: 255039 - DNA, 20 bp, human
gcctcctcccccactcgtgt

SEQ ID NO: 255040 - DNA, 20 bp, human
gcgtagacccccacacgagt

SEQ ID NO: 255041 - DNA, 20 bp, human
gctaaccgccacgtgggcct

SEQ ID NO: 255042 - DNA, 20 bp, human
gggtctacggagccagcgct

SEQ ID NO: 255043 - DNA, 20 bp, human
gagggaactagtaggggccc

SEQ ID NO: 255044 - DNA, 20 bp, human
gaaccgccgctgcagcgtcg

SEQ ID NO: 255045 - DNA, 20 bp, human
ggtgagatcaggaagatccc

SEQ ID NO: 255046 - DNA, 20 bp, human
gcgacgggacgtggagtcta

SEQ ID NO: 255047 - DNA, 20 bp, human
ggggacgtgtagtccgggca

SEQ ID NO: 255048 - DNA, 20 bp, human
gtggagaccgagcactccca

SEQ ID NO: 255049 - DNA, 20 bp, human
gaggaggaccgcgctcccat

SEQ ID NO: 255050 - DNA, 20 bp, human
gggtcctcctgacgccccct

SEQ ID NO: 255051 - DNA, 20 bp, human
gagtgctcggtctccaactc

SEQ ID NO: 255052 - DNA, 20 bp, human
gagaccgagcactcccaggg

SEQ ID NO: 255053 - DNA, 20 bp, human
ggggaggaaagatgctctgg

SEQ ID NO: 255054 - DNA, 20 bp, human
gcgtcccagggggcgtcagg

SEQ ID NO: 255055 - DNA, 20 bp, human
gaacccctgtgcttgttcac

SEQ ID NO: 255056 - DNA, 20 bp, human
gggaccccgcggggacggga

SEQ ID NO: 255057 - DNA, 20 bp, human
ggccaatcgcggcgacgggg

SEQ ID NO: 255058 - DNA, 20 bp, human
gcccccgggaatgaatggat

SEQ ID NO: 255059 - DNA, 20 bp, human
gactcccagcatggcccggg

SEQ ID NO: 255060 - DNA, 20 bp, human
gaccgctgggaggaccgacc

SEQ ID NO: 255061 - DNA, 20 bp, human
gccacggccaatcgcggcga

SEQ ID NO: 255062 - DNA, 20 bp, human
gcgtgggcgtgtgcgagtcc

SEQ ID NO: 255063 - DNA, 20 bp, human
ggggagagacagccccgggt

SEQ ID NO: 255064 - DNA, 20 bp, human
gcgagggccacggccaatcg

SEQ ID NO: 255065 - DNA, 20 bp, human
gcccgccccgtcgccgcgat

SEQ ID NO: 255066 - DNA, 20 bp, human
gcctgcgcgtcgggctcccg

SEQ ID NO: 255067 - DNA, 20 bp, human
gcgcaggcgcaaccggagat

SEQ ID NO: 255068 - DNA, 20 bp, human
ggggaccgcaccggggtacc

SEQ ID NO: 255069 - DNA, 20 bp, human
gaagcctcgaaccggagctc

SEQ ID NO: 255070 - DNA, 20 bp, human
gaggaaatgcgtggacccca

SEQ ID NO: 255071 - DNA, 20 bp, human
ggctttacgcctgttcgcgg

SEQ ID NO: 255072 - DNA, 20 bp, human
gcgggatgcatgccaatctc

SEQ ID NO: 255073 - DNA, 20 bp, human
gggcaaggaacctggtaccc

SEQ ID NO: 255074 - DNA, 20 bp, human
gggttccttgccctctgcgc

SEQ ID NO: 255075 - DNA, 20 bp, human
gttagaggcaagcctcgaac

SEQ ID NO: 255076 - DNA, 20 bp, human
gctagggtgtcttaattcct

SEQ ID NO: 255077 - DNA, 20 bp, human
gtatggtgccaagtgaacta

SEQ ID NO: 255078 - DNA, 20 bp, human
gtaatgctggggcttaccaa

SEQ ID NO: 255079 - DNA, 20 bp, human
gtctagactgaggtccttaa

SEQ ID NO: 255080 - DNA, 20 bp, human
ggaaagtcgtggatcctcag

SEQ ID NO: 255081 - DNA, 20 bp, human
gtaagacaccctagttcact

SEQ ID NO: 255082 - DNA, 20 bp, human
gtaggagtacagctgtccgg

SEQ ID NO: 255083 - DNA, 20 bp, human
gccttacctggcttaataga

SEQ ID NO: 255084 - DNA, 20 bp, human
gtgtccggaggccaatcctg

SEQ ID NO: 255085 - DNA, 20 bp, human
gcctggcttaatagatggga

SEQ ID NO: 255086 - DNA, 20 bp, human
ggctctcgggctctacaaaa

SEQ ID NO: 255087 - DNA, 20 bp, human
gagagccagcaggtcttaaa

SEQ ID NO: 255088 - DNA, 20 bp, human
gacaaaagggagtgacctct

SEQ ID NO: 255089 - DNA, 20 bp, human
gctgcgccgtggtagttatt

SEQ ID NO: 255090 - DNA, 20 bp, human
gtaaaggggcagtacagcgc

SEQ ID NO: 255091 - DNA, 20 bp, human
gggcgctgctggtagctagg

SEQ ID NO: 255092 - DNA, 20 bp, human
ggacgggccaatcacagcgc

SEQ ID NO: 255093 - DNA, 20 bp, human
gttcgctcaggggaagcgac

SEQ ID NO: 255094 - DNA, 20 bp, human
ggctggtagctaggtgggcg

SEQ ID NO: 255095 - DNA, 20 bp, human
gagttctaaaggttcgctca

SEQ ID NO: 255096 - DNA, 20 bp, human
ggcatagtcggggacctcta

SEQ ID NO: 255097 - DNA, 20 bp, human
gccgctgggcggggccataa

SEQ ID NO: 255098 - DNA, 20 bp, human
ggggccataaaggaggagat

SEQ ID NO: 255099 - DNA, 20 bp, human
gataggggcggggctgtagt

SEQ ID NO: 255100 - DNA, 20 bp, human
ggggactcaggattccctag

SEQ ID NO: 255101 - DNA, 20 bp, human
gccaccccagcccagaatgc

SEQ ID NO: 255102 - DNA, 20 bp, human
gagactaagtcgcagggcaa

SEQ ID NO: 255103 - DNA, 20 bp, human
gtaaaggaggagataggggc

SEQ ID NO: 255104 - DNA, 20 bp, human
ggagtgggagactaagtcgc

SEQ ID NO: 255105 - DNA, 20 bp, human
gcaagggcaactgcatagtc

SEQ ID NO: 255106 - DNA, 20 bp, human
gcaccggcaggccctgaaaa

SEQ ID NO: 255107 - DNA, 20 bp, human
gagggctagctaagatgcct

SEQ ID NO: 255108 - DNA, 20 bp, human
gtatttctatgcttgagcgg

SEQ ID NO: 255109 - DNA, 20 bp, human
gcttgagcgggggcaccggc

SEQ ID NO: 255110 - DNA, 20 bp, human
gccgacctagaatggatata

SEQ ID NO: 255111 - DNA, 20 bp, human
gcatctcgtgactctgactt

SEQ ID NO: 255112 - DNA, 20 bp, human
gctgagttggtgtctgtctt

SEQ ID NO: 255113 - DNA, 20 bp, human
gcgaggggcccgacctagaa

SEQ ID NO: 255114 - DNA, 20 bp, human
gtatgcttgagcgggggcac

SEQ ID NO: 255115 - DNA, 20 bp, human
gcagactgaagccagaaaat

SEQ ID NO: 255116 - DNA, 20 bp, human
ggccagccggaagtacatcg

SEQ ID NO: 255117 - DNA, 20 bp, human
ggggaactacaatgcccaca

SEQ ID NO: 255118 - DNA, 20 bp, human
ggccggaagtacatcgagga

SEQ ID NO: 255119 - DNA, 20 bp, human
gcggactcccagcgcccgag

SEQ ID NO: 255120 - DNA, 20 bp, human
gtgaacattggttctctgtg

SEQ ID NO: 255121 - DNA, 20 bp, human
gacacgtgggactaccgggg

SEQ ID NO: 255122 - DNA, 20 bp, human
ggttcctgatggccgcgggt

SEQ ID NO: 255123 - DNA, 20 bp, human
gaacccggaagtaacctccc

SEQ ID NO: 255124 - DNA, 20 bp, human
gaagtacatcgaggaaggcg

SEQ ID NO: 255125 - DNA, 20 bp, human
gtaccggggaggttacttcc

SEQ ID NO: 255126 - DNA, 20 bp, human
ggagatggctgaactagggg

SEQ ID NO: 255127 - DNA, 20 bp, human
gaactaggggcggagacact

SEQ ID NO: 255128 - DNA, 20 bp, human
gcaccgctcctcctattggg

SEQ ID NO: 255129 - DNA, 20 bp, human
gatggagatggctgaactag

SEQ ID NO: 255130 - DNA, 20 bp, human
gtgccgcccaataggaggag

SEQ ID NO: 255131 - DNA, 20 bp, human
gggcgagccccacattctat

SEQ ID NO: 255132 - DNA, 20 bp, human
ggtcgctgccgcccaatagg

SEQ ID NO: 255133 - DNA, 20 bp, human
ggcgcggccaaatggataac

SEQ ID NO: 255134 - DNA, 20 bp, human
gcgcgcaccgctcctcctat

SEQ ID NO: 255135 - DNA, 20 bp, human
gccaaatggataaccggtag

SEQ ID NO: 255136 - DNA, 20 bp, human
gtggctccacggactcctct

SEQ ID NO: 255137 - DNA, 20 bp, human
gagccggcgggtttcttcag

SEQ ID NO: 255138 - DNA, 20 bp, human
gacgcccgatcctttccctg

SEQ ID NO: 255139 - DNA, 20 bp, human
gagggcggcgaaaggtcagt

SEQ ID NO: 255140 - DNA, 20 bp, human
gctccactgaagaaacccgc

SEQ ID NO: 255141 - DNA, 20 bp, human
gccctgaggctatgaaacgg

SEQ ID NO: 255142 - DNA, 20 bp, human
ggaaaggtcagtcggccgag

SEQ ID NO: 255143 - DNA, 20 bp, human
ggccgggctagcgggctact

SEQ ID NO: 255144 - DNA, 20 bp, human
ggagccacgtggaagagagt

SEQ ID NO: 255145 - DNA, 20 bp, human
gctatgaaacggtggctcca

SEQ ID NO: 255146 - DNA, 20 bp, human
gggctcgcagcgccgatccg

SEQ ID NO: 255147 - DNA, 20 bp, human
gcctgcgggacacctgagcg

SEQ ID NO: 255148 - DNA, 20 bp, human
gccgccgcctgtccgcggat

SEQ ID NO: 255149 - DNA, 20 bp, human
gtgtcccgcaggcagccgcg

SEQ ID NO: 255150 - DNA, 20 bp, human
ggcaccttgaccctgtggca

SEQ ID NO: 255151 - DNA, 20 bp, human
gaggcggcggagcgaacacc

SEQ ID NO: 255152 - DNA, 20 bp, human
gggcctaaccacctaagtga

SEQ ID NO: 255153 - DNA, 20 bp, human
gagggcactgaagctgccgg

SEQ ID NO: 255154 - DNA, 20 bp, human
gcgggacacctgagcgcgga

SEQ ID NO: 255155 - DNA, 20 bp, human
gccacagagggcctagaggt

SEQ ID NO: 255156 - DNA, 20 bp, human
gtcccacgccccctgtcggc

SEQ ID NO: 255157 - DNA, 20 bp, human
ggcggtcagccggccgacag

SEQ ID NO: 255158 - DNA, 20 bp, human
ggaagcccgccgcggtcagc

SEQ ID NO: 255159 - DNA, 20 bp, human
gcagacgcgctgctccctgc

SEQ ID NO: 255160 - DNA, 20 bp, human
gtggccaggagtaaccggga

SEQ ID NO: 255161 - DNA, 20 bp, human
ggcggggccgtagagaccga

SEQ ID NO: 255162 - DNA, 20 bp, human
gggcctccgtggacgcccct

SEQ ID NO: 255163 - DNA, 20 bp, human
gcccgcgctgacggtgtccc

SEQ ID NO: 255164 - DNA, 20 bp, human
gggtgccggggcgggacatc

SEQ ID NO: 255165 - DNA, 20 bp, human
ggagaggcggcccgcgctga

SEQ ID NO: 255166 - DNA, 20 bp, human
gggcgcggaaaaggacgggt

SEQ ID NO: 255167 - DNA, 20 bp, human
gaaggcgagtacctcctccc

SEQ ID NO: 255168 - DNA, 20 bp, human
gacgtaatgtggcgcggaaa

SEQ ID NO: 255169 - DNA, 20 bp, human
gaatgtggcgcggaaaagga

SEQ ID NO: 255170 - DNA, 20 bp, human
ggtaccaaattcggaagcgg

SEQ ID NO: 255171 - DNA, 20 bp, human
ggtcgccatggcttcccggg

SEQ ID NO: 255172 - DNA, 20 bp, human
gcatcccccgcttccgaatt

SEQ ID NO: 255173 - DNA, 20 bp, human
gaccgtaccaaattcggaag

SEQ ID NO: 255174 - DNA, 20 bp, human
gacaccggaaccagccgttc

SEQ ID NO: 255175 - DNA, 20 bp, human
gggtcggaccgtaccaaatt

SEQ ID NO: 255176 - DNA, 20 bp, human
gctgctcgggcccacctcgt

SEQ ID NO: 255177 - DNA, 20 bp, human
gtgctgcccgaatctctcta

SEQ ID NO: 255178 - DNA, 20 bp, human
gagagtcccggggccagagt

SEQ ID NO: 255179 - DNA, 20 bp, human
ggtagtccccaggcctgctc

SEQ ID NO: 255180 - DNA, 20 bp, human
gtgctcgtctccgacgaggt

SEQ ID NO: 255181 - DNA, 20 bp, human
gtagttctcaagagcattgt

SEQ ID NO: 255182 - DNA, 20 bp, human
ggtgctccgcagtccaaagc

SEQ ID NO: 255183 - DNA, 20 bp, human
ggtggacccggaaccggatg

SEQ ID NO: 255184 - DNA, 20 bp, human
gtagggaatgggaccgagtt

SEQ ID NO: 255185 - DNA, 20 bp, human
gcccgaatctctctagggaa

SEQ ID NO: 255186 - DNA, 20 bp, human
gcggaagcggaacgtgaacc

SEQ ID NO: 255187 - DNA, 20 bp, human
gagcgcctcaatctaggcgg

SEQ ID NO: 255188 - DNA, 20 bp, human
gctggagcgtagcccaaggt

SEQ ID NO: 255189 - DNA, 20 bp, human
gaatctaggcgggggtacag

SEQ ID NO: 255190 - DNA, 20 bp, human
gctggccagcgcctcaatct

SEQ ID NO: 255191 - DNA, 20 bp, human
gagaggtaagtgtaggttga

SEQ ID NO: 255192 - DNA, 20 bp, human
ggggctgtgctccgcaaacg

SEQ ID NO: 255193 - DNA, 20 bp, human
gcggcccggatgttggcgtc

SEQ ID NO: 255194 - DNA, 20 bp, human
ggcggcgcctggtgtactcc

SEQ ID NO: 255195 - DNA, 20 bp, human
gccccgcgcggcccggatgt

SEQ ID NO: 255196 - DNA, 20 bp, human
gaacacctgtcgggacccga

SEQ ID NO: 255197 - DNA, 20 bp, human
ggacgcccgctgccccggat

SEQ ID NO: 255198 - DNA, 20 bp, human
ggggagagcggggagtcaga

SEQ ID NO: 255199 - DNA, 20 bp, human
gaggaagcgagcgccagcgc

SEQ ID NO: 255200 - DNA, 20 bp, human
gcgggcgggctccccgtcgt

SEQ ID NO: 255201 - DNA, 20 bp, human
gagggagggaccctacgacg

SEQ ID NO: 255202 - DNA, 20 bp, human
gctggcgctcgcttcctcgc

SEQ ID NO: 255203 - DNA, 20 bp, human
gcggcggaccaggtgagagt

SEQ ID NO: 255204 - DNA, 20 bp, human
gcgcgggccgccggcgatga

SEQ ID NO: 255205 - DNA, 20 bp, human
ggctcccggaatcggcggaa

SEQ ID NO: 255206 - DNA, 20 bp, human
gacccggtccggcgcgtgtg

SEQ ID NO: 255207 - DNA, 20 bp, human
gcccgcccccaggcgctacg

SEQ ID NO: 255208 - DNA, 20 bp, human
gcgccaccccgtagcgcctg

SEQ ID NO: 255209 - DNA, 20 bp, human
gtgtgcggcctgctgacaaa

SEQ ID NO: 255210 - DNA, 20 bp, human
gacaaaaggccgagcccgca

SEQ ID NO: 255211 - DNA, 20 bp, human
ggcccccaggcgctacgggg

SEQ ID NO: 255212 - DNA, 20 bp, human
gccggcagacgggactgacg

SEQ ID NO: 255213 - DNA, 20 bp, human
gggcacagcggtacccggtc

SEQ ID NO: 255214 - DNA, 20 bp, human
ggcagagccccaatgaatgg

SEQ ID NO: 255215 - DNA, 20 bp, human
ggtggctccaccttcctctc

SEQ ID NO: 255216 - DNA, 20 bp, human
ggccccctgagggcggtgta

SEQ ID NO: 255217 - DNA, 20 bp, human
gagcccgcgagggccccctg

SEQ ID NO: 255218 - DNA, 20 bp, human
ggcagccggggcgcagagtg

SEQ ID NO: 255219 - DNA, 20 bp, human
ggccctcagggggccctcgc

SEQ ID NO: 255220 - DNA, 20 bp, human
gggcactggcatcccggccg

SEQ ID NO: 255221 - DNA, 20 bp, human
gaccctgggccggcgactcg

SEQ ID NO: 255222 - DNA, 20 bp, human
gccgagcccgctgggtataa

SEQ ID NO: 255223 - DNA, 20 bp, human
gtccccgagtcgccggccca

SEQ ID NO: 255224 - DNA, 20 bp, human
gcggggcccggaggagccgt

SEQ ID NO: 255225 - DNA, 20 bp, human
gcgccctacaccgccctcag

SEQ ID NO: 255226 - DNA, 20 bp, human
gggaatgtgtgccggtctct

SEQ ID NO: 255227 - DNA, 20 bp, human
gcccgggactggcacctggg

SEQ ID NO: 255228 - DNA, 20 bp, human
ggtcgcacaaaagggtgcga

SEQ ID NO: 255229 - DNA, 20 bp, human
gtcgcagcactaccttcggt

SEQ ID NO: 255230 - DNA, 20 bp, human
gtttggcaccacctagagac

SEQ ID NO: 255231 - DNA, 20 bp, human
gcgcgcccgggactggcacc

SEQ ID NO: 255232 - DNA, 20 bp, human
gggggagtcccgggagctca

SEQ ID NO: 255233 - DNA, 20 bp, human
gtggaggaggagctgcgcga

SEQ ID NO: 255234 - DNA, 20 bp, human
gtaggtggtgccaaattctg

SEQ ID NO: 255235 - DNA, 20 bp, human
gcttcgcgagccgccgggga

SEQ ID NO: 255236 - DNA, 20 bp, human
gcgggcgcccgaaacacgtg

SEQ ID NO: 255237 - DNA, 20 bp, human
gcgcccgcggaaggcgacat

SEQ ID NO: 255238 - DNA, 20 bp, human
ggaaacacgtggggcctgga

SEQ ID NO: 255239 - DNA, 20 bp, human
gaagcagcgacggtctccgt

SEQ ID NO: 255240 - DNA, 20 bp, human
ggtaggaggacgagccagtg

SEQ ID NO: 255241 - DNA, 20 bp, human
gggcccccgggccatctccg

SEQ ID NO: 255242 - DNA, 20 bp, human
gcgcggcgctgaagcagcga

SEQ ID NO: 255243 - DNA, 20 bp, human
ggccgcggggcgcggggtgt

SEQ ID NO: 255244 - DNA, 20 bp, human
gcccatccggagctgcgcta

SEQ ID NO: 255245 - DNA, 20 bp, human
gcacggcgcggggaagcaga

SEQ ID NO: 255246 - DNA, 20 bp, human
gtcccagcggaccgtgtcgt

SEQ ID NO: 255247 - DNA, 20 bp, human
gtcaggcagtgggaggcggt

SEQ ID NO: 255248 - DNA, 20 bp, human
ggtcgtaggctgcgtggaag

SEQ ID NO: 255249 - DNA, 20 bp, human
gaacgcttcccgcacaccct

SEQ ID NO: 255250 - DNA, 20 bp, human
gagcgcccccgccaccaggt

SEQ ID NO: 255251 - DNA, 20 bp, human
gggtcctccaggccccctaa

SEQ ID NO: 255252 - DNA, 20 bp, human
gacgtcccggaagaactggt

SEQ ID NO: 255253 - DNA, 20 bp, human
gacacggtccgctgggagtt

SEQ ID NO: 255254 - DNA, 20 bp, human
gagagtcccaaatgcaccca

SEQ ID NO: 255255 - DNA, 20 bp, human
gcgggcgaacatgaagagct

SEQ ID NO: 255256 - DNA, 20 bp, human
ggaggagccaaggaggcgcg

SEQ ID NO: 255257 - DNA, 20 bp, human
gtggagactgggccgagcag

SEQ ID NO: 255258 - DNA, 20 bp, human
ggcgccgctgtctgctgggt

SEQ ID NO: 255259 - DNA, 20 bp, human
gatagagatgaactccagaa

SEQ ID NO: 255260 - DNA, 20 bp, human
gaaagcggatcgcaacgaac

SEQ ID NO: 255261 - DNA, 20 bp, human
gctagactgcgctgtggtgt

SEQ ID NO: 255262 - DNA, 20 bp, human
gcacagcgcagtctagtggc

SEQ ID NO: 255263 - DNA, 20 bp, human
ggaagggcgccgctgtctgc

SEQ ID NO: 255264 - DNA, 20 bp, human
gcggctgcgccttcgccagt

SEQ ID NO: 255265 - DNA, 20 bp, human
gagacgctgggagcaaacca

SEQ ID NO: 255266 - DNA, 20 bp, human
ggcgtccgcggcgcttgggg

SEQ ID NO: 255267 - DNA, 20 bp, human
ggtgtctctccctaacccac

SEQ ID NO: 255268 - DNA, 20 bp, human
gcccgcggcgcggcggccta

SEQ ID NO: 255269 - DNA, 20 bp, human
gcaccggaagatgtcgttca

SEQ ID NO: 255270 - DNA, 20 bp, human
gcttaatagtgggggatcat

SEQ ID NO: 255271 - DNA, 20 bp, human
gatggggcgttacgcacctt

SEQ ID NO: 255272 - DNA, 20 bp, human
ggggtcccctgtgtccgccg

SEQ ID NO: 255273 - DNA, 20 bp, human
gccccatgaacgacatcttc

SEQ ID NO: 255274 - DNA, 20 bp, human
ggcggacacaggggacccgc

SEQ ID NO: 255275 - DNA, 20 bp, human
gccaggcggcggcctgggat

SEQ ID NO: 255276 - DNA, 20 bp, human
ggggaagctgggagcctcag

SEQ ID NO: 255277 - DNA, 20 bp, human
gaacatggcccaggcgctaa

SEQ ID NO: 255278 - DNA, 20 bp, human
gccaaacccgtgtggaatca

SEQ ID NO: 255279 - DNA, 20 bp, human
gcacatgcttaggggaggac

SEQ ID NO: 255280 - DNA, 20 bp, human
gcccgtgtggaatcagggct

SEQ ID NO: 255281 - DNA, 20 bp, human
gtgccaggaaggaagcctgt

SEQ ID NO: 255282 - DNA, 20 bp, human
gccactgctggggccggtcc

SEQ ID NO: 255283 - DNA, 20 bp, human
gagcgcctgggccatgttcc

SEQ ID NO: 255284 - DNA, 20 bp, human
gggccgaagagtcagtgaag

SEQ ID NO: 255285 - DNA, 20 bp, human
gtccttcctggcacatgctt

SEQ ID NO: 255286 - DNA, 20 bp, human
ggggccacacccaaccgggt

SEQ ID NO: 255287 - DNA, 20 bp, human
ggcactccgcctacccggtt

SEQ ID NO: 255288 - DNA, 20 bp, human
gccaggggccacacccaacc

SEQ ID NO: 255289 - DNA, 20 bp, human
gggaaagcactccgcctacc

SEQ ID NO: 255290 - DNA, 20 bp, human
gccacacccaaccgggtagg

SEQ ID NO: 255291 - DNA, 20 bp, human
gttcctggctgcatcttaga

SEQ ID NO: 255292 - DNA, 20 bp, human
gctttgaatgggcaatttag

SEQ ID NO: 255293 - DNA, 20 bp, human
gaacaaagggctttggagac

SEQ ID NO: 255294 - DNA, 20 bp, human
gagcttaagaatcgtccgga

SEQ ID NO: 255295 - DNA, 20 bp, human
gggcccctggtgctttgaat

SEQ ID NO: 255296 - DNA, 20 bp, human
ggagacagaaccacaaaaag

SEQ ID NO: 255297 - DNA, 20 bp, human
gtatatgtaaggcaacctca

SEQ ID NO: 255298 - DNA, 20 bp, human
gggtgtagtttagactcata

SEQ ID NO: 255299 - DNA, 20 bp, human
gcccatgattagaggattaa

SEQ ID NO: 255300 - DNA, 20 bp, human
gctgacgtaaactataggtc

SEQ ID NO: 255301 - DNA, 20 bp, human
gcaaaacagaagccatctcc

SEQ ID NO: 255302 - DNA, 20 bp, human
gatctccaggagtagagttt

SEQ ID NO: 255303 - DNA, 20 bp, human
gcttaagtgttctagtgcag

SEQ ID NO: 255304 - DNA, 20 bp, human
gaagaactgacgtaaactat

SEQ ID NO: 255305 - DNA, 20 bp, human
gttgctgctactaagaagag

SEQ ID NO: 255306 - DNA, 20 bp, human
gtcttcgggcggcaggaagt

SEQ ID NO: 255307 - DNA, 20 bp, human
gcatggggtgacttttgtct

SEQ ID NO: 255308 - DNA, 20 bp, human
gtgtctccggaaccatactt

SEQ ID NO: 255309 - DNA, 20 bp, human
gcacatcctgctcaagtctc

SEQ ID NO: 255310 - DNA, 20 bp, human
gcttgagcaggatgtgtgaa

SEQ ID NO: 255311 - DNA, 20 bp, human
gccccgtagaatcgttctga

SEQ ID NO: 255312 - DNA, 20 bp, human
gcaaatagcaatcttggggc

SEQ ID NO: 255313 - DNA, 20 bp, human
gtagcatttacaaattgtgg

SEQ ID NO: 255314 - DNA, 20 bp, human
ggtgtgaagggatttaataa

SEQ ID NO: 255315 - DNA, 20 bp, human
gtccttcagaacgattctac

SEQ ID NO: 255316 - DNA, 20 bp, human
ggaggctctcccgaagtcgc

SEQ ID NO: 255317 - DNA, 20 bp, human
ggcggcggggcatggactca

SEQ ID NO: 255318 - DNA, 20 bp, human
gtcgcgggaagcggaagagt

SEQ ID NO: 255319 - DNA, 20 bp, human
gagtccatgccccgccgccc

SEQ ID NO: 255320 - DNA, 20 bp, human
gcttccgcttcccgcgactt

SEQ ID NO: 255321 - DNA, 20 bp, human
gggaagagttggcaacctgc

SEQ ID NO: 255322 - DNA, 20 bp, human
ggcgacccggacaacgtccc

SEQ ID NO: 255323 - DNA, 20 bp, human
ggctgtctccaagttaacta

SEQ ID NO: 255324 - DNA, 20 bp, human
gagcctcggccggcgtgatt

SEQ ID NO: 255325 - DNA, 20 bp, human
ggggcatggactcagggtcc

SEQ ID NO: 255326 - DNA, 20 bp, human
gactcccaggagtgttagtg

SEQ ID NO: 255327 - DNA, 20 bp, human
gcagccccactaacactcct

SEQ ID NO: 255328 - DNA, 20 bp, human
gaggcagatagggcagagaa

SEQ ID NO: 255329 - DNA, 20 bp, human
ggaccgagggatcatattgg

SEQ ID NO: 255330 - DNA, 20 bp, human
ggggggctctggaggaccga

SEQ ID NO: 255331 - DNA, 20 bp, human
ggaggaccgagggatcatat

SEQ ID NO: 255332 - DNA, 20 bp, human
gttatctaatattgattgag

SEQ ID NO: 255333 - DNA, 20 bp, human
ggcggagaccaacgactcaa

SEQ ID NO: 255334 - DNA, 20 bp, human
gctgcattttaacaactccc

SEQ ID NO: 255335 - DNA, 20 bp, human
gttagataaaatgacagtat

SEQ ID NO: 255336 - DNA, 20 bp, human
ggggtagggtaggacagaaa

SEQ ID NO: 255337 - DNA, 20 bp, human
gcaaagttgttctttctcca

SEQ ID NO: 255338 - DNA, 20 bp, human
gaacaagctgaatgtcctta

SEQ ID NO: 255339 - DNA, 20 bp, human
gggacattcagcttgtttta

SEQ ID NO: 255340 - DNA, 20 bp, human
ggacatgtggcttccagatg

SEQ ID NO: 255341 - DNA, 20 bp, human
ggggtttgctagtagcgggt

SEQ ID NO: 255342 - DNA, 20 bp, human
gtacccgcgcttatactcaa

SEQ ID NO: 255343 - DNA, 20 bp, human
gtctggaagccacatgtcag

SEQ ID NO: 255344 - DNA, 20 bp, human
gtacagggtagagcagcagt

SEQ ID NO: 255345 - DNA, 20 bp, human
gcattcagcttgttttaagg

SEQ ID NO: 255346 - DNA, 20 bp, human
gtctcatggggagctgataa

SEQ ID NO: 255347 - DNA, 20 bp, human
gcaggctgaaggtgatagga

SEQ ID NO: 255348 - DNA, 20 bp, human
gcagctccccatgagattcc

SEQ ID NO: 255349 - DNA, 20 bp, human
gtgcggggagtaaacggaga

SEQ ID NO: 255350 - DNA, 20 bp, human
ggaagaccagggtaggagcc

SEQ ID NO: 255351 - DNA, 20 bp, human
gcactcaccgacaagaagaa

SEQ ID NO: 255352 - DNA, 20 bp, human
gtgaaggtgataggatggat

SEQ ID NO: 255353 - DNA, 20 bp, human
gagcagcctggaatctcatg

SEQ ID NO: 255354 - DNA, 20 bp, human
gcaagtgtaaactgaagacc

SEQ ID NO: 255355 - DNA, 20 bp, human
gcgcgcgcttcacatcggtg

SEQ ID NO: 255356 - DNA, 20 bp, human
gccgtccggggctgtacatg

SEQ ID NO: 255357 - DNA, 20 bp, human
gggggctgggagcccgtccg

SEQ ID NO: 255358 - DNA, 20 bp, human
ggcagccccatgtacagccc

SEQ ID NO: 255359 - DNA, 20 bp, human
gacagtcgccgcaaggttat

SEQ ID NO: 255360 - DNA, 20 bp, human
ggcttggggcctgcgcgcac

SEQ ID NO: 255361 - DNA, 20 bp, human
gtggtgcaggggcggcgccc

SEQ ID NO: 255362 - DNA, 20 bp, human
ggctctgccagtcgcttccc

SEQ ID NO: 255363 - DNA, 20 bp, human
gtcttcagacagtcgccgca

SEQ ID NO: 255364 - DNA, 20 bp, human
gcggcgcccggggaagcgac

SEQ ID NO: 255365 - DNA, 20 bp, human
gtatgggccgaagtggtgca

SEQ ID NO: 255366 - DNA, 20 bp, human
gcggccgcgctcagagtctc

SEQ ID NO: 255367 - DNA, 20 bp, human
gtgcgctggccggaaggaag

SEQ ID NO: 255368 - DNA, 20 bp, human
gcccccgcgcccataggccc

SEQ ID NO: 255369 - DNA, 20 bp, human
gagacgaggcggggaaccgc

SEQ ID NO: 255370 - DNA, 20 bp, human
gcgcgccgcgggtacaagga

SEQ ID NO: 255371 - DNA, 20 bp, human
ggccagcgcagcacgagacg

SEQ ID NO: 255372 - DNA, 20 bp, human
ggcctggtccgcattgagtc

SEQ ID NO: 255373 - DNA, 20 bp, human
ggaacagaccggactcaatg

SEQ ID NO: 255374 - DNA, 20 bp, human
gcgcggccgcggagctgcag

SEQ ID NO: 255375 - DNA, 20 bp, human
gagcgcagcacgagacgagg

SEQ ID NO: 255376 - DNA, 20 bp, human
gcggccaggagctacagctg

SEQ ID NO: 255377 - DNA, 20 bp, human
ggcccgggaaccagagtgtt

SEQ ID NO: 255378 - DNA, 20 bp, human
gccgcctgcggggacgcggt

SEQ ID NO: 255379 - DNA, 20 bp, human
gtaaaatggggcgggaatgg

SEQ ID NO: 255380 - DNA, 20 bp, human
gcgcggagtcacaaaagtgg

SEQ ID NO: 255381 - DNA, 20 bp, human
gctgccctggaaagcgagac

SEQ ID NO: 255382 - DNA, 20 bp, human
ggtgggctgcactcccggcg

SEQ ID NO: 255383 - DNA, 20 bp, human
gttggcggcgacaccggagg

SEQ ID NO: 255384 - DNA, 20 bp, human
gcctggaaagcgagactggt

SEQ ID NO: 255385 - DNA, 20 bp, human
gtcaggaagtgggggcgcgg

SEQ ID NO: 255386 - DNA, 20 bp, human
gcctgcgcagaacctcccgg

SEQ ID NO: 255387 - DNA, 20 bp, human
gctggggtggcgctcttcgt

SEQ ID NO: 255388 - DNA, 20 bp, human
ggggtggcgctcttcgtggg

SEQ ID NO: 255389 - DNA, 20 bp, human
ggaaccatcgtcagtccccg

SEQ ID NO: 255390 - DNA, 20 bp, human
ggagcctcggggactgacga

SEQ ID NO: 255391 - DNA, 20 bp, human
gtgaccagcccagttagaag

SEQ ID NO: 255392 - DNA, 20 bp, human
gaccttggccaggactcacg

SEQ ID NO: 255393 - DNA, 20 bp, human
ggcggactgcagagagcctc

SEQ ID NO: 255394 - DNA, 20 bp, human
gtccgcgtgagtcctggcca

SEQ ID NO: 255395 - DNA, 20 bp, human
ggcgcctgcgcagaacctcc

SEQ ID NO: 255396 - DNA, 20 bp, human
ggcgcggagcgggctgaact

SEQ ID NO: 255397 - DNA, 20 bp, human
gcaggcggggccagatagga

SEQ ID NO: 255398 - DNA, 20 bp, human
ggggagtagagcacccgctc

SEQ ID NO: 255399 - DNA, 20 bp, human
gcggagcgcgagtcgaaaac

SEQ ID NO: 255400 - DNA, 20 bp, human
gggctgcgctctcggtcctg

SEQ ID NO: 255401 - DNA, 20 bp, human
gggcggcaacgcccccgggg

SEQ ID NO: 255402 - DNA, 20 bp, human
gaggcacggcagccgcagcc

SEQ ID NO: 255403 - DNA, 20 bp, human
gcctggggatccctcctatc

SEQ ID NO: 255404 - DNA, 20 bp, human
gaaaacaggcagactagggc

SEQ ID NO: 255405 - DNA, 20 bp, human
ggagcacccgctctggggac

SEQ ID NO: 255406 - DNA, 20 bp, human
gaggctgggctggagcccaa

SEQ ID NO: 255407 - DNA, 20 bp, human
gccaaaggccgggattgaac

SEQ ID NO: 255408 - DNA, 20 bp, human
gtgttctgcgccctgagttg

SEQ ID NO: 255409 - DNA, 20 bp, human
gtgagtgtgcaaggaccatg

SEQ ID NO: 255410 - DNA, 20 bp, human
ggggtggatacctcaactca

SEQ ID NO: 255411 - DNA, 20 bp, human
gtcctccccccgggaaggct

SEQ ID NO: 255412 - DNA, 20 bp, human
gacacccccaaccaagggaa

SEQ ID NO: 255413 - DNA, 20 bp, human
gccaaccaagggaaagggtg

SEQ ID NO: 255414 - DNA, 20 bp, human
gcgcgcagcccgggccgagt

SEQ ID NO: 255415 - DNA, 20 bp, human
gagctcgggggctgtcggtg

SEQ ID NO: 255416 - DNA, 20 bp, human
gggcgcgagagcgcgaaatg

SEQ ID NO: 255417 - DNA, 20 bp, human
gcgcgaaatgcggcagtgaa

SEQ ID NO: 255418 - DNA, 20 bp, human
ggccacgcggggacaatgga

SEQ ID NO: 255419 - DNA, 20 bp, human
ggagagagacgagcagcgat

SEQ ID NO: 255420 - DNA, 20 bp, human
gaaaggcgcgctcccagcgc

SEQ ID NO: 255421 - DNA, 20 bp, human
gaaatgcggcagtgaacggc

SEQ ID NO: 255422 - DNA, 20 bp, human
gcggtggggaccgggtttgg

SEQ ID NO: 255423 - DNA, 20 bp, human
gctggggccgccgccaaacc

SEQ ID NO: 255424 - DNA, 20 bp, human
ggggatatgcaaatttaggc

SEQ ID NO: 255425 - DNA, 20 bp, human
gcgccgcggcagccccgcgt

SEQ ID NO: 255426 - DNA, 20 bp, human
gggaccccataagacaagaa

SEQ ID NO: 255427 - DNA, 20 bp, human
gcgtgaacgcgggtggagga

SEQ ID NO: 255428 - DNA, 20 bp, human
gaaaacccgggcgtgaacgc

SEQ ID NO: 255429 - DNA, 20 bp, human
ggcaaagaggaaaatcaata

SEQ ID NO: 255430 - DNA, 20 bp, human
ggggtgaggcagatgcaaag

SEQ ID NO: 255431 - DNA, 20 bp, human
gtccacccgcgttcacgccc

SEQ ID NO: 255432 - DNA, 20 bp, human
gatagggataagagagaaga

SEQ ID NO: 255433 - DNA, 20 bp, human
gcgggggtgaaagggggacc

SEQ ID NO: 255434 - DNA, 20 bp, human
gcccccagccagctcctcgt

SEQ ID NO: 255435 - DNA, 20 bp, human
gtcgcgagtgctgcggagtc

SEQ ID NO: 255436 - DNA, 20 bp, human
gctggggcgggccctatcgg

SEQ ID NO: 255437 - DNA, 20 bp, human
ggggccgcacggctccgttc

SEQ ID NO: 255438 - DNA, 20 bp, human
ggggctttaaagcgaaggag

SEQ ID NO: 255439 - DNA, 20 bp, human
gcagacccgcggacgagcgc

SEQ ID NO: 255440 - DNA, 20 bp, human
ggcaggccccgcccccgata

SEQ ID NO: 255441 - DNA, 20 bp, human
gctgatgggcggggtgaggc

SEQ ID NO: 255442 - DNA, 20 bp, human
gcccacccagcgctcgtccg

SEQ ID NO: 255443 - DNA, 20 bp, human
gctcgtccgcgggtctgcgc

SEQ ID NO: 255444 - DNA, 20 bp, human
gggaccggaacggagccgtg

SEQ ID NO: 255445 - DNA, 20 bp, human
ggggcgggccctatcggggg

SEQ ID NO: 255446 - DNA, 20 bp, human
gcagctagcaggttaagggg

SEQ ID NO: 255447 - DNA, 20 bp, human
gcgcgcggcgccaaggatgc

SEQ ID NO: 255448 - DNA, 20 bp, human
ggggagttgtagtccccagg

SEQ ID NO: 255449 - DNA, 20 bp, human
gaggcggcgtcccgcatcct

SEQ ID NO: 255450 - DNA, 20 bp, human
gagttgtagtccccaggcgg

SEQ ID NO: 255451 - DNA, 20 bp, human
gaaggggaggcggggacagg

SEQ ID NO: 255452 - DNA, 20 bp, human
gagcaggttaaggggaggcg

SEQ ID NO: 255453 - DNA, 20 bp, human
ggctccccacctcagctagc

SEQ ID NO: 255454 - DNA, 20 bp, human
gtagctgaggtggggagcgg

SEQ ID NO: 255455 - DNA, 20 bp, human
ggttaaggggaggcggggac

SEQ ID NO: 255456 - DNA, 20 bp, human
gtaacctagtcaggaaccta

SEQ ID NO: 255457 - DNA, 20 bp, human
gtgaactgaagacccagctt

SEQ ID NO: 255458 - DNA, 20 bp, human
gtgtgtagtgtgcttgtgaa

SEQ ID NO: 255459 - DNA, 20 bp, human
ggggtgatcagcccaggttt

SEQ ID NO: 255460 - DNA, 20 bp, human
gcccccgcagccaaggaata

SEQ ID NO: 255461 - DNA, 20 bp, human
gccggctctacctcagggat

SEQ ID NO: 255462 - DNA, 20 bp, human
gtgcttgtgaaaggcatgct

SEQ ID NO: 255463 - DNA, 20 bp, human
gcagcttgggtgatcagccc

SEQ ID NO: 255464 - DNA, 20 bp, human
ggatgggtgggtggtaaaaa

SEQ ID NO: 255465 - DNA, 20 bp, human
ggcccccagtctccgtcctg

SEQ ID NO: 255466 - DNA, 20 bp, human
gaagctgctggcagcgcgaa

SEQ ID NO: 255467 - DNA, 20 bp, human
gcggacgctacatctgggaa

SEQ ID NO: 255468 - DNA, 20 bp, human
ggggcggctcccgccggcgt

SEQ ID NO: 255469 - DNA, 20 bp, human
gccacacccggaagtcggtc

SEQ ID NO: 255470 - DNA, 20 bp, human
gtgctggcagcgcgaacggg

SEQ ID NO: 255471 - DNA, 20 bp, human
gtgcttgccaggaccgtagc

SEQ ID NO: 255472 - DNA, 20 bp, human
gctggctagggtccctgtga

SEQ ID NO: 255473 - DNA, 20 bp, human
gggctcccgccggcgtgggt

SEQ ID NO: 255474 - DNA, 20 bp, human
gccctcccggaccgacttcc

SEQ ID NO: 255475 - DNA, 20 bp, human
ggcgcaaagggtgtcgggag

SEQ ID NO: 255476 - DNA, 20 bp, human
ggcgcccggcgagctccaag

SEQ ID NO: 255477 - DNA, 20 bp, human
gagcggcccggcagggtcgg

SEQ ID NO: 255478 - DNA, 20 bp, human
gcgggcgcctccgaccctgc

SEQ ID NO: 255479 - DNA, 20 bp, human
gctgccgggccagagtgggt

SEQ ID NO: 255480 - DNA, 20 bp, human
gcgactacggagccgccgga

SEQ ID NO: 255481 - DNA, 20 bp, human
gacgggcggcgtggggtcac

SEQ ID NO: 255482 - DNA, 20 bp, human
gcaaagcggcccggcagggt

SEQ ID NO: 255483 - DNA, 20 bp, human
ggacgcgactacggagccgc

SEQ ID NO: 255484 - DNA, 20 bp, human
ggaaatcccccgggagggag

SEQ ID NO: 255485 - DNA, 20 bp, human
ggccgggcctcgcaccccga

SEQ ID NO: 255486 - DNA, 20 bp, human
gcctccgactccagccgact

SEQ ID NO: 255487 - DNA, 20 bp, human
gtctaggggtgtacttgttg

SEQ ID NO: 255488 - DNA, 20 bp, human
ggtcggaggcgatatttcta

SEQ ID NO: 255489 - DNA, 20 bp, human
ggcaccgaggagcgcgcctg

SEQ ID NO: 255490 - DNA, 20 bp, human
gcgccgatcagtcacccagt

SEQ ID NO: 255491 - DNA, 20 bp, human
ggatcagtcacccagtcggc

SEQ ID NO: 255492 - DNA, 20 bp, human
gggcgcgctcccgagcagac

SEQ ID NO: 255493 - DNA, 20 bp, human
gcgctcccgagcagaccggc

SEQ ID NO: 255494 - DNA, 20 bp, human
gccaccctgcgccaggaaga

SEQ ID NO: 255495 - DNA, 20 bp, human
gcggacgtgaaggatttgaa

SEQ ID NO: 255496 - DNA, 20 bp, human
ggggagcggcggtccagact

SEQ ID NO: 255497 - DNA, 20 bp, human
gactggggagggacgcgcac

SEQ ID NO: 255498 - DNA, 20 bp, human
gactccgcgggaaacggcgg

SEQ ID NO: 255499 - DNA, 20 bp, human
gccggccaggaggcttcaag

SEQ ID NO: 255500 - DNA, 20 bp, human
gcggggaggtgctgactcgg

SEQ ID NO: 255501 - DNA, 20 bp, human
ggggacgcgcaccggccagg

SEQ ID NO: 255502 - DNA, 20 bp, human
gggacccaggggaaccgcga

SEQ ID NO: 255503 - DNA, 20 bp, human
ggccaggaggcttcaagagg

SEQ ID NO: 255504 - DNA, 20 bp, human
gcgagcggcgtcttaaccgg

SEQ ID NO: 255505 - DNA, 20 bp, human
ggcggcggtccagactgggg

SEQ ID NO: 255506 - DNA, 20 bp, human
gagggcgcgtgggacgggag

SEQ ID NO: 255507 - DNA, 20 bp, human
gcttacgcaccgggaggagt

SEQ ID NO: 255508 - DNA, 20 bp, human
gcggcggcgcctaggcctct

SEQ ID NO: 255509 - DNA, 20 bp, human
gcggcccagggcgcgtggga

SEQ ID NO: 255510 - DNA, 20 bp, human
gctcagagcgcagctggcga

SEQ ID NO: 255511 - DNA, 20 bp, human
ggagggcgcggggcagacaa

SEQ ID NO: 255512 - DNA, 20 bp, human
gccagctgcgctctgagttc

SEQ ID NO: 255513 - DNA, 20 bp, human
ggggacggaagaaatgccca

SEQ ID NO: 255514 - DNA, 20 bp, human
gccggggctgcccctcggct

SEQ ID NO: 255515 - DNA, 20 bp, human
gctcgactgcccccagccga

SEQ ID NO: 255516 - DNA, 20 bp, human
gctcccgcccgtgggatgtc

SEQ ID NO: 255517 - DNA, 20 bp, human
gaacacgaccgggccttcgt

SEQ ID NO: 255518 - DNA, 20 bp, human
ggaaggcccggtcgtgttag

SEQ ID NO: 255519 - DNA, 20 bp, human
gcgggagaggcgtcagcccg

SEQ ID NO: 255520 - DNA, 20 bp, human
ggctgcgcgcgcaaccactc

SEQ ID NO: 255521 - DNA, 20 bp, human
gagaggcgtcagcccgaggc

SEQ ID NO: 255522 - DNA, 20 bp, human
gggatgtcaggtctgttgtc

SEQ ID NO: 255523 - DNA, 20 bp, human
gtgacgcctctcccgcccgt

SEQ ID NO: 255524 - DNA, 20 bp, human
gaacagacctgacatcccac

SEQ ID NO: 255525 - DNA, 20 bp, human
gagacctgacatcccacggg

SEQ ID NO: 255526 - DNA, 20 bp, human
gggagggcaagcactcaccg

SEQ ID NO: 255527 - DNA, 20 bp, human
gtcgcccgcagaaccatcca

SEQ ID NO: 255528 - DNA, 20 bp, human
ggagactggcgaggtaacca

SEQ ID NO: 255529 - DNA, 20 bp, human
gcatccagggggaccacgtg

SEQ ID NO: 255530 - DNA, 20 bp, human
gctggcgaggtaaccaggga

SEQ ID NO: 255531 - DNA, 20 bp, human
ggtccccctggatggttctg

SEQ ID NO: 255532 - DNA, 20 bp, human
gaccgcccccagggcagggg

SEQ ID NO: 255533 - DNA, 20 bp, human
gtccccgcgcagcacgcgca

SEQ ID NO: 255534 - DNA, 20 bp, human
gcgcgtgctgcgcggggatc

SEQ ID NO: 255535 - DNA, 20 bp, human
gcgcttgacaggcagagttg

SEQ ID NO: 255536 - DNA, 20 bp, human
gccggcctgaacgggtagga

SEQ ID NO: 255537 - DNA, 20 bp, human
gatccccggcctgaacgggt

SEQ ID NO: 255538 - DNA, 20 bp, human
gggagcgcagtgggcggtcg

SEQ ID NO: 255539 - DNA, 20 bp, human
gcgttcccgcctcaaaacaa

SEQ ID NO: 255540 - DNA, 20 bp, human
ggtacctcctcggcgatccc

SEQ ID NO: 255541 - DNA, 20 bp, human
gcccgcctcaaaacaaggga

SEQ ID NO: 255542 - DNA, 20 bp, human
gaccacccatccagcaagtc

SEQ ID NO: 255543 - DNA, 20 bp, human
gagtaataagctgtgattgc

SEQ ID NO: 255544 - DNA, 20 bp, human
gcggcgatccccggcctgaa

SEQ ID NO: 255545 - DNA, 20 bp, human
ggtgtgggtgggagcgcagt

SEQ ID NO: 255546 - DNA, 20 bp, human
gtggaaaggcaattaaactg

SEQ ID NO: 255547 - DNA, 20 bp, human
gagagggatggagtaggcat

SEQ ID NO: 255548 - DNA, 20 bp, human
gcgctcagaggttctgtcct

SEQ ID NO: 255549 - DNA, 20 bp, human
gccaagcaacgctcagttta

SEQ ID NO: 255550 - DNA, 20 bp, human
gaaggcaattaaactgagga

SEQ ID NO: 255551 - DNA, 20 bp, human
ggcttgggtcagccgctcag

SEQ ID NO: 255552 - DNA, 20 bp, human
gtggaggtgtaagcctgtct

SEQ ID NO: 255553 - DNA, 20 bp, human
gcatccctctttcagcacca

SEQ ID NO: 255554 - DNA, 20 bp, human
gtgataccacaattggttaa

SEQ ID NO: 255555 - DNA, 20 bp, human
gtggcgtataactggcaata

SEQ ID NO: 255556 - DNA, 20 bp, human
gcccgaggggagggactccc

SEQ ID NO: 255557 - DNA, 20 bp, human
gccggccggggcgtgcccga

SEQ ID NO: 255558 - DNA, 20 bp, human
ggacccgccccggctcaggg

SEQ ID NO: 255559 - DNA, 20 bp, human
ggggcccccctgagccgggg

SEQ ID NO: 255560 - DNA, 20 bp, human
gcggggcgtgcccgagggga

SEQ ID NO: 255561 - DNA, 20 bp, human
gggcacgtggacgaatgcgg

SEQ ID NO: 255562 - DNA, 20 bp, human
gtcacggtggagcgccgcgg

SEQ ID NO: 255563 - DNA, 20 bp, human
gtgcggcggcccaaagagac

SEQ ID NO: 255564 - DNA, 20 bp, human
gcgggggcccccctgagccg

SEQ ID NO: 255565 - DNA, 20 bp, human
gtgcgacccggcgttgtccg

SEQ ID NO: 255566 - DNA, 20 bp, human
gggcgatcccgcaggtccga

SEQ ID NO: 255567 - DNA, 20 bp, human
gcgggatcgcccctacactc

SEQ ID NO: 255568 - DNA, 20 bp, human
gttccccggcccggggacta

SEQ ID NO: 255569 - DNA, 20 bp, human
gcgggtctgtgggtaatcca

SEQ ID NO: 255570 - DNA, 20 bp, human
gggggcgcccctcggacctg

SEQ ID NO: 255571 - DNA, 20 bp, human
ggtggggcgggagtcgagcg

SEQ ID NO: 255572 - DNA, 20 bp, human
ggtagcgcgccggacggcag

SEQ ID NO: 255573 - DNA, 20 bp, human
ggtcgagcgcggaggctcgg

SEQ ID NO: 255574 - DNA, 20 bp, human
gcgctgagggcggtgagcga

SEQ ID NO: 255575 - DNA, 20 bp, human
ggcgccagaccctagtcccc

SEQ ID NO: 255576 - DNA, 20 bp, human
ggggctctatgacaccgcac

SEQ ID NO: 255577 - DNA, 20 bp, human
gcagacaggggtggcctctc

SEQ ID NO: 255578 - DNA, 20 bp, human
ggctcggggaggcccagaca

SEQ ID NO: 255579 - DNA, 20 bp, human
gcccgtcccgcgagccagtg

SEQ ID NO: 255580 - DNA, 20 bp, human
ggcgaccctcggcgcgctcg

SEQ ID NO: 255581 - DNA, 20 bp, human
ggcctccccgagcgcgccga

SEQ ID NO: 255582 - DNA, 20 bp, human
gaccgcgagtcgcaaagcgt

SEQ ID NO: 255583 - DNA, 20 bp, human
gcctacgcggaactctctcg

SEQ ID NO: 255584 - DNA, 20 bp, human
gatagagcccgcgggagcgg

SEQ ID NO: 255585 - DNA, 20 bp, human
gtgacaccgcactggctcgc

SEQ ID NO: 255586 - DNA, 20 bp, human
gctgtactggcccacggctg

SEQ ID NO: 255587 - DNA, 20 bp, human
gccgccccggctctttccag

SEQ ID NO: 255588 - DNA, 20 bp, human
ggcctggccggcccagcggg

SEQ ID NO: 255589 - DNA, 20 bp, human
ggggcggaaccgatagtgtc

SEQ ID NO: 255590 - DNA, 20 bp, human
gcggccaggctgcggacctc

SEQ ID NO: 255591 - DNA, 20 bp, human
ggccgtgggccagtacagca

SEQ ID NO: 255592 - DNA, 20 bp, human
gggacctctggaaagagccg

SEQ ID NO: 255593 - DNA, 20 bp, human
ggactggcagtgtaaggaaa

SEQ ID NO: 255594 - DNA, 20 bp, human
gtcctgccagccgcagccgt

SEQ ID NO: 255595 - DNA, 20 bp, human
ggcagctgactggcagtgta

SEQ ID NO: 255596 - DNA, 20 bp, human
gtctgaggggacatgaggtg

SEQ ID NO: 255597 - DNA, 20 bp, human
ggtggggcctagtgtgtttt

SEQ ID NO: 255598 - DNA, 20 bp, human
ggggaggtggacacacccga

SEQ ID NO: 255599 - DNA, 20 bp, human
ggggcgggagcgctggcaga

SEQ ID NO: 255600 - DNA, 20 bp, human
gcgccctcatctcactgcgg

SEQ ID NO: 255601 - DNA, 20 bp, human
gagggcttgcggatcggagg

SEQ ID NO: 255602 - DNA, 20 bp, human
gtataaaggcgagtgctgag

SEQ ID NO: 255603 - DNA, 20 bp, human
gaggaccaaagaagtgactc

SEQ ID NO: 255604 - DNA, 20 bp, human
gtacagcgagtaacttggat

SEQ ID NO: 255605 - DNA, 20 bp, human
gccccccaaaacccatccgg

SEQ ID NO: 255606 - DNA, 20 bp, human
gggcgcgtcaacgaaagcga

SEQ ID NO: 255607 - DNA, 20 bp, human
gcgaaaacgcaaccgggtga

SEQ ID NO: 255608 - DNA, 20 bp, human
gtcggattggaggacgtagg

SEQ ID NO: 255609 - DNA, 20 bp, human
ggggccttgtgcgcggtgat

SEQ ID NO: 255610 - DNA, 20 bp, human
ggaaagccggcgcctcatcc

SEQ ID NO: 255611 - DNA, 20 bp, human
gcgcgcacaaggccctgcgg

SEQ ID NO: 255612 - DNA, 20 bp, human
gtggcagctggagaagaccc

SEQ ID NO: 255613 - DNA, 20 bp, human
gagggggcgcgggctccaaa

SEQ ID NO: 255614 - DNA, 20 bp, human
gggctctggggcagaatcag

SEQ ID NO: 255615 - DNA, 20 bp, human
ggcggaagcgctccctcacc

SEQ ID NO: 255616 - DNA, 20 bp, human
ggggctagatcggtgtaagt

SEQ ID NO: 255617 - DNA, 20 bp, human
gccaagagccgccacatctc

SEQ ID NO: 255618 - DNA, 20 bp, human
gccaaagttggttttgtctg

SEQ ID NO: 255619 - DNA, 20 bp, human
ggggggagaggcttccactg

SEQ ID NO: 255620 - DNA, 20 bp, human
gtgagatctaagagggtgtg

SEQ ID NO: 255621 - DNA, 20 bp, human
gggtactcaaggtacagttt

SEQ ID NO: 255622 - DNA, 20 bp, human
gcctgcgtttgcccagtcaa

SEQ ID NO: 255623 - DNA, 20 bp, human
gtctacacgtgagatctaag

SEQ ID NO: 255624 - DNA, 20 bp, human
gcagaagcagaatcctggac

SEQ ID NO: 255625 - DNA, 20 bp, human
ggatgagacttaggggtgac

SEQ ID NO: 255626 - DNA, 20 bp, human
gtgggagtgggtaataactg

SEQ ID NO: 255627 - DNA, 20 bp, human
gtgaggaggagctactgact

SEQ ID NO: 255628 - DNA, 20 bp, human
ggagactggccagggaatag

SEQ ID NO: 255629 - DNA, 20 bp, human
gagggcaagacaggttaata

SEQ ID NO: 255630 - DNA, 20 bp, human
gggagctactgactgggttt

SEQ ID NO: 255631 - DNA, 20 bp, human
ggacttcacagcatcaacct

SEQ ID NO: 255632 - DNA, 20 bp, human
gcaggttaataaggccaaga

SEQ ID NO: 255633 - DNA, 20 bp, human
gtaaagcagcaacttcataa

SEQ ID NO: 255634 - DNA, 20 bp, human
gcttctgcctatgtgttaag

SEQ ID NO: 255635 - DNA, 20 bp, human
gttgccaatggcagttgagg

SEQ ID NO: 255636 - DNA, 20 bp, human
gggaccacggccgtcgccga

SEQ ID NO: 255637 - DNA, 20 bp, human
gacaacaaggaggggccgat

SEQ ID NO: 255638 - DNA, 20 bp, human
gtcgccgagggcagcgggca

SEQ ID NO: 255639 - DNA, 20 bp, human
gacggccgtggtccctgccc

SEQ ID NO: 255640 - DNA, 20 bp, human
gcctggcggagcggacaccg

SEQ ID NO: 255641 - DNA, 20 bp, human
gtaaaagggtggcggcgaga

SEQ ID NO: 255642 - DNA, 20 bp, human
gtgcgcaggtaaaagggtgg

SEQ ID NO: 255643 - DNA, 20 bp, human
ggcggacaccggggcgtggt

SEQ ID NO: 255644 - DNA, 20 bp, human
ggcgtccaaaagacaccgat

SEQ ID NO: 255645 - DNA, 20 bp, human
ggagagggagttcccacccg

SEQ ID NO: 255646 - DNA, 20 bp, human
gaacgcccgggtggctgctg

SEQ ID NO: 255647 - DNA, 20 bp, human
ggggccgccctgggacgatc

SEQ ID NO: 255648 - DNA, 20 bp, human
gttcccgagcgcgaacgccc

SEQ ID NO: 255649 - DNA, 20 bp, human
ggggatccctgcctcgacac

SEQ ID NO: 255650 - DNA, 20 bp, human
gtggcagcccagatcgtccc

SEQ ID NO: 255651 - DNA, 20 bp, human
gccgagcgcgaacgcccggg

SEQ ID NO: 255652 - DNA, 20 bp, human
ggcgtcctctgggtccaatc

SEQ ID NO: 255653 - DNA, 20 bp, human
ggaaaccggattggacccag

SEQ ID NO: 255654 - DNA, 20 bp, human
ggcgttcgcgctcgggaaag

SEQ ID NO: 255655 - DNA, 20 bp, human
gcgctcgggaaagcggtctc

SEQ ID NO: 255656 - DNA, 20 bp, human
gactgtgcgtgactgtgcgg

SEQ ID NO: 255657 - DNA, 20 bp, human
gccgaactgaggcaggaccg

SEQ ID NO: 255658 - DNA, 20 bp, human
ggtcacgcacagtcatcagg

SEQ ID NO: 255659 - DNA, 20 bp, human
gtgctaataagggatggccg

SEQ ID NO: 255660 - DNA, 20 bp, human
gatggccggggtgactattg

SEQ ID NO: 255661 - DNA, 20 bp, human
gccggggtgactattgcgga

SEQ ID NO: 255662 - DNA, 20 bp, human
gatgactgtgcgtgactgtg

SEQ ID NO: 255663 - DNA, 20 bp, human
gttcctgccggttgctaata

SEQ ID NO: 255664 - DNA, 20 bp, human
gaaggtggccagccacggag

SEQ ID NO: 255665 - DNA, 20 bp, human
ggccccagcggccagaggca

SEQ ID NO: 255666 - DNA, 20 bp, human
gaccacccggggtgccgcgg

SEQ ID NO: 255667 - DNA, 20 bp, human
gaccacaggctccaagccgg

SEQ ID NO: 255668 - DNA, 20 bp, human
ggcgcggcgctcaccacccg

SEQ ID NO: 255669 - DNA, 20 bp, human
gagcccaggaacaggagcgg

SEQ ID NO: 255670 - DNA, 20 bp, human
gtccgctgtctgagaggcga

SEQ ID NO: 255671 - DNA, 20 bp, human
gctcaccacccggggtgccg

SEQ ID NO: 255672 - DNA, 20 bp, human
gccgcggatgacaggagccg

SEQ ID NO: 255673 - DNA, 20 bp, human
ggggtggctggactcatctg

SEQ ID NO: 255674 - DNA, 20 bp, human
ggagccgggtcggggcggtc

SEQ ID NO: 255675 - DNA, 20 bp, human
gcgcgagcccggagcccaga

SEQ ID NO: 255676 - DNA, 20 bp, human
gtggggcaagtgctgtacct

SEQ ID NO: 255677 - DNA, 20 bp, human
gtcgccgttccccaggagtt

SEQ ID NO: 255678 - DNA, 20 bp, human
ggaagatgtgtagatcacgt

SEQ ID NO: 255679 - DNA, 20 bp, human
gtcaagcagggacgtttgta

SEQ ID NO: 255680 - DNA, 20 bp, human
gggctcctgaatggtccgcc

SEQ ID NO: 255681 - DNA, 20 bp, human
gctggggtaattcttggctg

SEQ ID NO: 255682 - DNA, 20 bp, human
ggagcccctcctcccggcaa

SEQ ID NO: 255683 - DNA, 20 bp, human
gggcaccgggcggaccattc

SEQ ID NO: 255684 - DNA, 20 bp, human
gagggcctttgccgggagga

SEQ ID NO: 255685 - DNA, 20 bp, human
gagaggcgtcgccgttcccc

SEQ ID NO: 255686 - DNA, 20 bp, human
gaaggggacagcggaaaggg

SEQ ID NO: 255687 - DNA, 20 bp, human
gaaaccagggacggagatcg

SEQ ID NO: 255688 - DNA, 20 bp, human
gcagcggaaagggtgggcga

SEQ ID NO: 255689 - DNA, 20 bp, human
ggacggagatcggggatggg

SEQ ID NO: 255690 - DNA, 20 bp, human
gtctcggcggaagctcgcag

SEQ ID NO: 255691 - DNA, 20 bp, human
gccggaccgcgactgcagga

SEQ ID NO: 255692 - DNA, 20 bp, human
gaggaaacgcggcttcccgg

SEQ ID NO: 255693 - DNA, 20 bp, human
ggtccggcgtggggcacgga

SEQ ID NO: 255694 - DNA, 20 bp, human
gcgcccgcgggaaggcctgc

SEQ ID NO: 255695 - DNA, 20 bp, human
gtccgccgagaccgcccccc

SEQ ID NO: 255696 - DNA, 20 bp, human
gcattcgcccctcggagcta

SEQ ID NO: 255697 - DNA, 20 bp, human
gtagccccaccccttccgta

SEQ ID NO: 255698 - DNA, 20 bp, human
gtaagactgtccctacggaa

SEQ ID NO: 255699 - DNA, 20 bp, human
gctaaggccggctcttgtgc

SEQ ID NO: 255700 - DNA, 20 bp, human
gcaggctgcaaccgacagac

SEQ ID NO: 255701 - DNA, 20 bp, human
gcctctgggcgtgaaagacg

SEQ ID NO: 255702 - DNA, 20 bp, human
gcttcggcccgcactaaggc

SEQ ID NO: 255703 - DNA, 20 bp, human
gaggtcacgtgagccactgc

SEQ ID NO: 255704 - DNA, 20 bp, human
gcacactccctagctccgag

SEQ ID NO: 255705 - DNA, 20 bp, human
ggccggaaggaggaaggcgt

SEQ ID NO: 255706 - DNA, 20 bp, human
gccagagattggttcgacca

SEQ ID NO: 255707 - DNA, 20 bp, human
gaagacggcccctgccaagt

SEQ ID NO: 255708 - DNA, 20 bp, human
ggctacgtaaacgtcacccc

SEQ ID NO: 255709 - DNA, 20 bp, human
ggacgtttacgtagcgcgca

SEQ ID NO: 255710 - DNA, 20 bp, human
gataggcttcccacttggca

SEQ ID NO: 255711 - DNA, 20 bp, human
gcactcgtttctgtaaacat

SEQ ID NO: 255712 - DNA, 20 bp, human
gctgttgtcgctttttgagt

SEQ ID NO: 255713 - DNA, 20 bp, human
gggttttacgggcaggcttg

SEQ ID NO: 255714 - DNA, 20 bp, human
gtcgtttctgtaaacatggg

SEQ ID NO: 255715 - DNA, 20 bp, human
gagcttgcacaggcaaatac

SEQ ID NO: 255716 - DNA, 20 bp, human
ggctgcgagcggcgagtccc

SEQ ID NO: 255717 - DNA, 20 bp, human
ggagcgggagaaagcggggc

SEQ ID NO: 255718 - DNA, 20 bp, human
ggcgctgaggctccgctgga

SEQ ID NO: 255719 - DNA, 20 bp, human
gtgtgggcgaaaggggcgga

SEQ ID NO: 255720 - DNA, 20 bp, human
gtaggtgtgggcgaaagggg

SEQ ID NO: 255721 - DNA, 20 bp, human
gcctgcggtcggggttcggc

SEQ ID NO: 255722 - DNA, 20 bp, human
ggggaggaggcagactggag

SEQ ID NO: 255723 - DNA, 20 bp, human
gcggggcgggcctgcggtcg

SEQ ID NO: 255724 - DNA, 20 bp, human
gtattcgggaggaggcagac

SEQ ID NO: 255725 - DNA, 20 bp, human
ggccagaggagacgaggatg

SEQ ID NO: 255726 - DNA, 20 bp, human
ggtagcaccgccgagagtaa

SEQ ID NO: 255727 - DNA, 20 bp, human
ggggtggtgctagacgtttc

SEQ ID NO: 255728 - DNA, 20 bp, human
ggcaccgccgagagtaaagg

SEQ ID NO: 255729 - DNA, 20 bp, human
ggggcagagctcggccgctg

SEQ ID NO: 255730 - DNA, 20 bp, human
gttggaagaagtcagactag

SEQ ID NO: 255731 - DNA, 20 bp, human
gtccctctcgcccaaaccgg

SEQ ID NO: 255732 - DNA, 20 bp, human
gactctcggcggtgctacca

SEQ ID NO: 255733 - DNA, 20 bp, human
gagcagccaggccgccggtt

SEQ ID NO: 255734 - DNA, 20 bp, human
gcatggcaactggtgatgtc

SEQ ID NO: 255735 - DNA, 20 bp, human
ggaagtcagactagtgggag

SEQ ID NO: 255736 - DNA, 20 bp, human
gcagcccggggagggtgaga

SEQ ID NO: 255737 - DNA, 20 bp, human
gcgtggggcgggacggagac

SEQ ID NO: 255738 - DNA, 20 bp, human
gagacagcgacgctggctgg

SEQ ID NO: 255739 - DNA, 20 bp, human
gaggcgagagacagcgacgc

SEQ ID NO: 255740 - DNA, 20 bp, human
ggcggggccgaaagcaggtg

SEQ ID NO: 255741 - DNA, 20 bp, human
ggacgctggctggcgggcgt

SEQ ID NO: 255742 - DNA, 20 bp, human
gaggcggggccaagcgcccc

SEQ ID NO: 255743 - DNA, 20 bp, human
gggcgggacggagacaggac

SEQ ID NO: 255744 - DNA, 20 bp, human
gggagccgtgagcaggccgg

SEQ ID NO: 255745 - DNA, 20 bp, human
ggagggtgagacggcgacgc

SEQ ID NO: 255746 - DNA, 20 bp, human
gctgaaaagcgactcttgat

SEQ ID NO: 255747 - DNA, 20 bp, human
gaaagtgaacagaaataccg

SEQ ID NO: 255748 - DNA, 20 bp, human
gtgctcccaggtaaaaactt

SEQ ID NO: 255749 - DNA, 20 bp, human
gagcgactcttgatggggca

SEQ ID NO: 255750 - DNA, 20 bp, human
gccgagggttatacaggtga

SEQ ID NO: 255751 - DNA, 20 bp, human
ggaaataccgagggttatac

SEQ ID NO: 255752 - DNA, 20 bp, human
ggatccccaccctaaaaact

SEQ ID NO: 255753 - DNA, 20 bp, human
gaaggtacgtataaccagtc

SEQ ID NO: 255754 - DNA, 20 bp, human
gggaattgtgacttatgcag

SEQ ID NO: 255755 - DNA, 20 bp, human
ggtgtccccaagtttttacc

SEQ ID NO: 255756 - DNA, 20 bp, human
gggaagacagccctcggggc

SEQ ID NO: 255757 - DNA, 20 bp, human
gtgggccgcgcaaccgccac

SEQ ID NO: 255758 - DNA, 20 bp, human
gcacgggaagacagccctcg

SEQ ID NO: 255759 - DNA, 20 bp, human
gtggggagttcagcagagga

SEQ ID NO: 255760 - DNA, 20 bp, human
gccaaggacgtcacggtccc

SEQ ID NO: 255761 - DNA, 20 bp, human
gtctccagagagtagggggt

SEQ ID NO: 255762 - DNA, 20 bp, human
gtcccaggtgcgagtgcgag

SEQ ID NO: 255763 - DNA, 20 bp, human
gccccggctccattttctcg

SEQ ID NO: 255764 - DNA, 20 bp, human
gggagccgcgcctttgggtt

SEQ ID NO: 255765 - DNA, 20 bp, human
gccgtgacgtccttgggttg

SEQ ID NO: 255766 - DNA, 20 bp, human
ggagacctacccttggttta

SEQ ID NO: 255767 - DNA, 20 bp, human
ggatctacccacacatactc

SEQ ID NO: 255768 - DNA, 20 bp, human
gcccaccctaaaccaagggt

SEQ ID NO: 255769 - DNA, 20 bp, human
gcctccccaccctaaaccaa

SEQ ID NO: 255770 - DNA, 20 bp, human
gacactgacaaagtgtagtc

SEQ ID NO: 255771 - DNA, 20 bp, human
gaaggtgatgcaagcgtttc

SEQ ID NO: 255772 - DNA, 20 bp, human
gctacagatggtctgttatg

SEQ ID NO: 255773 - DNA, 20 bp, human
gttccgaaggagtctacaga

SEQ ID NO: 255774 - DNA, 20 bp, human
gggaagtgcaaaagctagtc

SEQ ID NO: 255775 - DNA, 20 bp, human
gtttcagcctgagtatgtgt

SEQ ID NO: 255776 - DNA, 20 bp, human
gagcgaggacaagatttaca

SEQ ID NO: 255777 - DNA, 20 bp, human
gtggaagactggcattgttt

SEQ ID NO: 255778 - DNA, 20 bp, human
gccaggctggtctggaagac

SEQ ID NO: 255779 - DNA, 20 bp, human
gcaggactcaagtatggtat

SEQ ID NO: 255780 - DNA, 20 bp, human
gccaccccaaactcccaggc

SEQ ID NO: 255781 - DNA, 20 bp, human
gtgagtaatttattattcac

SEQ ID NO: 255782 - DNA, 20 bp, human
gagaaaaaccttacagagcg

SEQ ID NO: 255783 - DNA, 20 bp, human
gcatgctgaataaaattaga

SEQ ID NO: 255784 - DNA, 20 bp, human
gttcattgcaataagaatca

SEQ ID NO: 255785 - DNA, 20 bp, human
gttctttggtgtccaacaaa

SEQ ID NO: 255786 - DNA, 20 bp, human
gtggcaggagcgttggacgg

SEQ ID NO: 255787 - DNA, 20 bp, human
ggtgtggcgggtcccggaaa

SEQ ID NO: 255788 - DNA, 20 bp, human
ggcggtgaccgtgacgtaga

SEQ ID NO: 255789 - DNA, 20 bp, human
gagctggcaggagcgttgga

SEQ ID NO: 255790 - DNA, 20 bp, human
ggcggtgtacgcatgcgcgt

SEQ ID NO: 255791 - DNA, 20 bp, human
gtgtacgcatgcgcgtcggg

SEQ ID NO: 255792 - DNA, 20 bp, human
gcaccctgatcagggagtat

SEQ ID NO: 255793 - DNA, 20 bp, human
gagacaggacctaaaggact

SEQ ID NO: 255794 - DNA, 20 bp, human
ggcggagctggcaggagcgt

SEQ ID NO: 255795 - DNA, 20 bp, human
gtacgcatgtgcatcgccgg

SEQ ID NO: 255796 - DNA, 20 bp, human
gactccgccctgcgccaccg

SEQ ID NO: 255797 - DNA, 20 bp, human
gtggcgcagggcggagtcgc

SEQ ID NO: 255798 - DNA, 20 bp, human
ggccctgggcgaagccaccg

SEQ ID NO: 255799 - DNA, 20 bp, human
gagcgcgtcggtgacacccg

SEQ ID NO: 255800 - DNA, 20 bp, human
ggggctgctgcgctctgcgc

SEQ ID NO: 255801 - DNA, 20 bp, human
ggggtgttggtgttggtcgg

SEQ ID NO: 255802 - DNA, 20 bp, human
ggccccgcccggtgttactc

SEQ ID NO: 255803 - DNA, 20 bp, human
ggtccccgggcggaaatagc

SEQ ID NO: 255804 - DNA, 20 bp, human
ggggaggacctgcgctcgcg

SEQ ID NO: 255805 - DNA, 20 bp, human
gaggcctcggtggcgcaggg

SEQ ID NO: 255806 - DNA, 20 bp, human
gaacacgagaagacatacga

SEQ ID NO: 255807 - DNA, 20 bp, human
ggtccagaacatacctggtg

SEQ ID NO: 255808 - DNA, 20 bp, human
gcgatggtccagaacatacc

SEQ ID NO: 255809 - DNA, 20 bp, human
gaaccacaccaggtatgttc

SEQ ID NO: 255810 - DNA, 20 bp, human
gacatacctggtgtggttat

SEQ ID NO: 255811 - DNA, 20 bp, human
gtggttatgggggcatcacc

SEQ ID NO: 255812 - DNA, 20 bp, human
gcacaggcagaaaaaaatct

SEQ ID NO: 255813 - DNA, 20 bp, human
gcgctagtggaaagaatacg

SEQ ID NO: 255814 - DNA, 20 bp, human
gatgagggagcctacgctag

SEQ ID NO: 255815 - DNA, 20 bp, human
gtaagcatttgcccttttcc

SEQ ID NO: 255816 - DNA, 20 bp, human
gatcaccaagtgaaggaagt

SEQ ID NO: 255817 - DNA, 20 bp, human
gtgaaccgttcggttccaaa

SEQ ID NO: 255818 - DNA, 20 bp, human
gggtaagacaagaaatgtca

SEQ ID NO: 255819 - DNA, 20 bp, human
gagggatcctaaacagtgat

SEQ ID NO: 255820 - DNA, 20 bp, human
gagtttaagtggctcttttc

SEQ ID NO: 255821 - DNA, 20 bp, human
gagatgtgaaacagcctcat

SEQ ID NO: 255822 - DNA, 20 bp, human
gggcaatctaagaaaactct

SEQ ID NO: 255823 - DNA, 20 bp, human
gaagacccctatcattcttg

SEQ ID NO: 255824 - DNA, 20 bp, human
gtgtttaggatccctgatat

SEQ ID NO: 255825 - DNA, 20 bp, human
gcctacctcaagaatgatag

SEQ ID NO: 255826 - DNA, 20 bp, human
gcgggcgcccggaccctctg

SEQ ID NO: 255827 - DNA, 20 bp, human
ggcagcgccacgccaagcgg

SEQ ID NO: 255828 - DNA, 20 bp, human
gcgcccccgctctgcgtctt

SEQ ID NO: 255829 - DNA, 20 bp, human
ggagccgggcggcccaccat

SEQ ID NO: 255830 - DNA, 20 bp, human
gaggaaggagcagcacgctg

SEQ ID NO: 255831 - DNA, 20 bp, human
ggggagcccgagtccctctc

SEQ ID NO: 255832 - DNA, 20 bp, human
ggccacgccaagcggaggag

SEQ ID NO: 255833 - DNA, 20 bp, human
gccctctcgggtttcagcag

SEQ ID NO: 255834 - DNA, 20 bp, human
gcctccgggcaggccgatgg

SEQ ID NO: 255835 - DNA, 20 bp, human
gcgagcagcgccacgccaag

SEQ ID NO: 255836 - DNA, 20 bp, human
gcgacgaggctgcgactcgg

SEQ ID NO: 255837 - DNA, 20 bp, human
ggcgctacgcgagtgatcca

SEQ ID NO: 255838 - DNA, 20 bp, human
ggggatgctgaggtcggcgg

SEQ ID NO: 255839 - DNA, 20 bp, human
ggccgggcgcacgtgggtcg

SEQ ID NO: 255840 - DNA, 20 bp, human
gccgccggggacgcggcgag

SEQ ID NO: 255841 - DNA, 20 bp, human
ggggggctgcgcacggacgg

SEQ ID NO: 255842 - DNA, 20 bp, human
gtccccactcgccgcgtccc

SEQ ID NO: 255843 - DNA, 20 bp, human
gcccgggggctgcgcacgga

SEQ ID NO: 255844 - DNA, 20 bp, human
gcccacgtgcgcccggcttc

SEQ ID NO: 255845 - DNA, 20 bp, human
ggactcagcagacagcgacg

SEQ ID NO: 255846 - DNA, 20 bp, human
gcgcgcctcaggacggaacg

SEQ ID NO: 255847 - DNA, 20 bp, human
gcggccaggcaacgcccccc

SEQ ID NO: 255848 - DNA, 20 bp, human
ggctacgcaaccagccggcc

SEQ ID NO: 255849 - DNA, 20 bp, human
gagactctggatagccgccg

SEQ ID NO: 255850 - DNA, 20 bp, human
ggcggcgcgagcttaccccg

SEQ ID NO: 255851 - DNA, 20 bp, human
gtggtctgcaggaggctaga

SEQ ID NO: 255852 - DNA, 20 bp, human
gaagctcccctccgagactc

SEQ ID NO: 255853 - DNA, 20 bp, human
gctgaggcgcgcccgccccg

SEQ ID NO: 255854 - DNA, 20 bp, human
gccagaaagtgtttaggggt

SEQ ID NO: 255855 - DNA, 20 bp, human
gaggggcgggcaaaagatga

SEQ ID NO: 255856 - DNA, 20 bp, human
gggacgctcatagagggatt

SEQ ID NO: 255857 - DNA, 20 bp, human
ggccaggctgactgcaggcg

SEQ ID NO: 255858 - DNA, 20 bp, human
gcaacggcagtgacggaggt

SEQ ID NO: 255859 - DNA, 20 bp, human
gaaaacacaagaacgagtga

SEQ ID NO: 255860 - DNA, 20 bp, human
gaaacctcaaggctggagaa

SEQ ID NO: 255861 - DNA, 20 bp, human
gaccaaacgccaaaacctca

SEQ ID NO: 255862 - DNA, 20 bp, human
gcccccgcctgcagtcagcc

SEQ ID NO: 255863 - DNA, 20 bp, human
gccaggagaccccgcggcga

SEQ ID NO: 255864 - DNA, 20 bp, human
gctcctgggacttgcagtcc

SEQ ID NO: 255865 - DNA, 20 bp, human
gttctggatagtggagagaa

SEQ ID NO: 255866 - DNA, 20 bp, human
gagtgggcgtggccgacgtg

SEQ ID NO: 255867 - DNA, 20 bp, human
ggcggagtcaatctatgagt

SEQ ID NO: 255868 - DNA, 20 bp, human
gagtgggtgggcctatcgcc

SEQ ID NO: 255869 - DNA, 20 bp, human
gtgggcgtggcaggcatagg

SEQ ID NO: 255870 - DNA, 20 bp, human
ggacgggcggggttacggtt

SEQ ID NO: 255871 - DNA, 20 bp, human
gctggccggtccgactcggt

SEQ ID NO: 255872 - DNA, 20 bp, human
gccaactggccggtccgact

SEQ ID NO: 255873 - DNA, 20 bp, human
gaggtgggcgtggcaggcat

SEQ ID NO: 255874 - DNA, 20 bp, human
gagtcaatctatgagtgggt

SEQ ID NO: 255875 - DNA, 20 bp, human
ggcgggacccagatgtggat

SEQ ID NO: 255876 - DNA, 20 bp, human
gcgaggccccgccctcctaa

SEQ ID NO: 255877 - DNA, 20 bp, human
gacgaggcggggcacgacga

SEQ ID NO: 255878 - DNA, 20 bp, human
gtgccccgccagcgcgtcga

SEQ ID NO: 255879 - DNA, 20 bp, human
ggcctccaagaccgcacatc

SEQ ID NO: 255880 - DNA, 20 bp, human
gacattcgagagtcagtccg

SEQ ID NO: 255881 - DNA, 20 bp, human
ggccactgggcaatcggcgc

SEQ ID NO: 255882 - DNA, 20 bp, human
gctcctaagggcggggccac

SEQ ID NO: 255883 - DNA, 20 bp, human
gctcgaatgtcccggatgtg

SEQ ID NO: 255884 - DNA, 20 bp, human
gcccggatgtgcggtcttgg

SEQ ID NO: 255885 - DNA, 20 bp, human
gtgtcccggatgtgcggtct

SEQ ID NO: 255886 - DNA, 20 bp, human
gaatcagggagcataggggt

SEQ ID NO: 255887 - DNA, 20 bp, human
gtaaaacttacacagagagt

SEQ ID NO: 255888 - DNA, 20 bp, human
gtacaggaacgccccttctt

SEQ ID NO: 255889 - DNA, 20 bp, human
gctaaataatcagggagcat

SEQ ID NO: 255890 - DNA, 20 bp, human
gaaggggcgttcctgtacca

SEQ ID NO: 255891 - DNA, 20 bp, human
gttactaggtgaccgaagaa

SEQ ID NO: 255892 - DNA, 20 bp, human
gtacagaatacattaatcac

SEQ ID NO: 255893 - DNA, 20 bp, human
gggagcagagcctattgcat

SEQ ID NO: 255894 - DNA, 20 bp, human
gaaaatacagattccaggta

SEQ ID NO: 255895 - DNA, 20 bp, human
gacagtagcacccatggtac

SEQ ID NO: 255896 - DNA, 20 bp, human
gcctctgctaccccctgcgc

SEQ ID NO: 255897 - DNA, 20 bp, human
gacaaaccgcggggtgacca

SEQ ID NO: 255898 - DNA, 20 bp, human
ggaggcgcggacaaaccgcg

SEQ ID NO: 255899 - DNA, 20 bp, human
gaggaggcggggatccgaag

SEQ ID NO: 255900 - DNA, 20 bp, human
gcttggactccaggttcccg

SEQ ID NO: 255901 - DNA, 20 bp, human
gaaaaccagcaagaaggcgg

SEQ ID NO: 255902 - DNA, 20 bp, human
gaccagggcgcatgcgtaac

SEQ ID NO: 255903 - DNA, 20 bp, human
gatgcgccctggtcaccccg

SEQ ID NO: 255904 - DNA, 20 bp, human
gagagagcgtgacgtcagtt

SEQ ID NO: 255905 - DNA, 20 bp, human
gccccctgcgcaggcgctca

SEQ ID NO: 255906 - DNA, 20 bp, human
gctgactttgtcagggtggg

SEQ ID NO: 255907 - DNA, 20 bp, human
gggtaacggaccacatgatg

SEQ ID NO: 255908 - DNA, 20 bp, human
gaatctgactttgtcagggt

SEQ ID NO: 255909 - DNA, 20 bp, human
gcactacatcagtgtatgaa

SEQ ID NO: 255910 - DNA, 20 bp, human
ggctggattcattgctacca

SEQ ID NO: 255911 - DNA, 20 bp, human
gaaaaaaatctgactttgtc

SEQ ID NO: 255912 - DNA, 20 bp, human
gtctaatcacagcttagatg

SEQ ID NO: 255913 - DNA, 20 bp, human
gtaaataacagttaaacaca

SEQ ID NO: 255914 - DNA, 20 bp, human
ggatatttcattagttagtt

SEQ ID NO: 255915 - DNA, 20 bp, human
gaatgtttctaaaggagctg

SEQ ID NO: 255916 - DNA, 20 bp, human
ggaacccgccggcgaccggt

SEQ ID NO: 255917 - DNA, 20 bp, human
gcccgcccaccggtcgccgg

SEQ ID NO: 255918 - DNA, 20 bp, human
gggcttccgcgcgcggggag

SEQ ID NO: 255919 - DNA, 20 bp, human
ggggccgggcaccccgccga

SEQ ID NO: 255920 - DNA, 20 bp, human
gcgcgtgccgggcggagaag

SEQ ID NO: 255921 - DNA, 20 bp, human
gcgagcgggagaagcctgga

SEQ ID NO: 255922 - DNA, 20 bp, human
ggggcacaggcttgtgaccc

SEQ ID NO: 255923 - DNA, 20 bp, human
gtccatccgcaggtatccgt

SEQ ID NO: 255924 - DNA, 20 bp, human
gggcgggcgctgcgcgtgcc

SEQ ID NO: 255925 - DNA, 20 bp, human
gcggcccgacgccagcgagc

SEQ ID NO: 255926 - DNA, 20 bp, human
gtactggccctctcggtcgg

SEQ ID NO: 255927 - DNA, 20 bp, human
gtcgggctgcggaaaagggg

SEQ ID NO: 255928 - DNA, 20 bp, human
gccaacacttccctcaaagg

SEQ ID NO: 255929 - DNA, 20 bp, human
gagctactggccctctcggt

SEQ ID NO: 255930 - DNA, 20 bp, human
gggctcgggctgcggaaaag

SEQ ID NO: 255931 - DNA, 20 bp, human
gagcccggcgcagtccactg

SEQ ID NO: 255932 - DNA, 20 bp, human
gggtcttcccccgaccgaga

SEQ ID NO: 255933 - DNA, 20 bp, human
ggcgggataggaatgagccg

SEQ ID NO: 255934 - DNA, 20 bp, human
gcaggctcgcgcagccgcag

SEQ ID NO: 255935 - DNA, 20 bp, human
gcagccgcagtggactgcgc

SEQ ID NO: 255936 - DNA, 20 bp, human
gcaacaggctgggacgacag

SEQ ID NO: 255937 - DNA, 20 bp, human
ggtgtcgcacttctcccgag

SEQ ID NO: 255938 - DNA, 20 bp, human
ggacaccgccgctgattgag

SEQ ID NO: 255939 - DNA, 20 bp, human
ggcggcttaagcaacaggct

SEQ ID NO: 255940 - DNA, 20 bp, human
gcaggctgggacgacagcgg

SEQ ID NO: 255941 - DNA, 20 bp, human
gtgggacgacagcggggggg

SEQ ID NO: 255942 - DNA, 20 bp, human
gtcagcctctcaatcagcgg

SEQ ID NO: 255943 - DNA, 20 bp, human
ggggcagggccgcgttcgtc

SEQ ID NO: 255944 - DNA, 20 bp, human
gaggctgcgaggcttgaggc

SEQ ID NO: 255945 - DNA, 20 bp, human
gcagcggggggggggttaga

SEQ ID NO: 255946 - DNA, 20 bp, human
gcccgcacgccacgtacggg

SEQ ID NO: 255947 - DNA, 20 bp, human
gccactgggcacggaccaat

SEQ ID NO: 255948 - DNA, 20 bp, human
gtctaggtgaacggtcccac

SEQ ID NO: 255949 - DNA, 20 bp, human
ggggaccgttcacctagaac

SEQ ID NO: 255950 - DNA, 20 bp, human
gtgaacggtcccactgggca

SEQ ID NO: 255951 - DNA, 20 bp, human
ggagacccgccccccgtacg

SEQ ID NO: 255952 - DNA, 20 bp, human
ggggtctccgaagcccaggc

SEQ ID NO: 255953 - DNA, 20 bp, human
gcgttcacctagaactgggt

SEQ ID NO: 255954 - DNA, 20 bp, human
gccccctgccggggagtcgg

SEQ ID NO: 255955 - DNA, 20 bp, human
gtgggaaggaacgagcccat

SEQ ID NO: 255956 - DNA, 20 bp, human
gaaggggaggagacagatct

SEQ ID NO: 255957 - DNA, 20 bp, human
gtcggggcgccccaaatcct

SEQ ID NO: 255958 - DNA, 20 bp, human
ggggcctggccgaggatttg

SEQ ID NO: 255959 - DNA, 20 bp, human
gcccacccgcgagatcccgg

SEQ ID NO: 255960 - DNA, 20 bp, human
ggccctcccgagaccccaag

SEQ ID NO: 255961 - DNA, 20 bp, human
gggcggccgccgggatctcg

SEQ ID NO: 255962 - DNA, 20 bp, human
gggccccttggggtctcggg

SEQ ID NO: 255963 - DNA, 20 bp, human
gtcagcgccggtggcgctca

SEQ ID NO: 255964 - DNA, 20 bp, human
gtctcggccctgagcgccac

SEQ ID NO: 255965 - DNA, 20 bp, human
gcccaagcagagcgtgaggc

SEQ ID NO: 255966 - DNA, 20 bp, human
gcccacacggccacagccgc

SEQ ID NO: 255967 - DNA, 20 bp, human
gcgtgtgggaatggcaggac

SEQ ID NO: 255968 - DNA, 20 bp, human
ggtggccgtgtgggaatggc

SEQ ID NO: 255969 - DNA, 20 bp, human
gtacaccagccccgcggctg

SEQ ID NO: 255970 - DNA, 20 bp, human
gtcgatgaagctgcagacgg

SEQ ID NO: 255971 - DNA, 20 bp, human
ggcgctgaggctgattctgc

SEQ ID NO: 255972 - DNA, 20 bp, human
gggtcattgcccagcgcctc

SEQ ID NO: 255973 - DNA, 20 bp, human
ggaaagcagcgggactcctt

SEQ ID NO: 255974 - DNA, 20 bp, human
gggcgctgggcaatgacccc

SEQ ID NO: 255975 - DNA, 20 bp, human
ggtacacctgcaccagggaa

SEQ ID NO: 255976 - DNA, 20 bp, human
gcgggagcggggagcgagta

SEQ ID NO: 255977 - DNA, 20 bp, human
ggcgtcatggaactgagggt

SEQ ID NO: 255978 - DNA, 20 bp, human
gaaaagggagagtgctccgc

SEQ ID NO: 255979 - DNA, 20 bp, human
gcaggggcttgcggatagaa

SEQ ID NO: 255980 - DNA, 20 bp, human
gggtggcgtcatggaactga

SEQ ID NO: 255981 - DNA, 20 bp, human
ggagcggggagcgagtaggg

SEQ ID NO: 255982 - DNA, 20 bp, human
ggagggagggggtggcgtca

SEQ ID NO: 255983 - DNA, 20 bp, human
ggggagaccccgaaaggtgg

SEQ ID NO: 255984 - DNA, 20 bp, human
gtatcacctgtgaggggaaa

SEQ ID NO: 255985 - DNA, 20 bp, human
gagagtgctccgccgggagc

SEQ ID NO: 255986 - DNA, 20 bp, human
ggctctgccgggaacaggga

SEQ ID NO: 255987 - DNA, 20 bp, human
gggcaccggacctactcacc

SEQ ID NO: 255988 - DNA, 20 bp, human
gcccggcaggccgctctcct

SEQ ID NO: 255989 - DNA, 20 bp, human
gcctgccgggtgagtaggtc

SEQ ID NO: 255990 - DNA, 20 bp, human
gctgtctgcaccgaggagag

SEQ ID NO: 255991 - DNA, 20 bp, human
gcggtgcctctgggccctcg

SEQ ID NO: 255992 - DNA, 20 bp, human
gtgagtaggtccggtgcctc

SEQ ID NO: 255993 - DNA, 20 bp, human
gtcctcggtgcagacagcac

SEQ ID NO: 255994 - DNA, 20 bp, human
gaagcggctctgccgggaac

SEQ ID NO: 255995 - DNA, 20 bp, human
gggaggcagctgggcggtaa

SEQ ID NO: 255996 - DNA, 20 bp, human
gtgggaggggtggttcattc

SEQ ID NO: 255997 - DNA, 20 bp, human
ggcggggactgcaattcgtg

SEQ ID NO: 255998 - DNA, 20 bp, human
ggcagggggagctctcccag

SEQ ID NO: 255999 - DNA, 20 bp, human
gttgccttagcgccctgctt

SEQ ID NO: 256000 - DNA, 20 bp, human
gcctcccaagcagggcgcta

SEQ ID NO: 256001 - DNA, 20 bp, human
gactgcaattcgtgcggcga

SEQ ID NO: 256002 - DNA, 20 bp, human
ggggagctctcccagcggcg

SEQ ID NO: 256003 - DNA, 20 bp, human
gcccaccccggcgtctgcag

SEQ ID NO: 256004 - DNA, 20 bp, human
gcgggagaggatgaggtaat

SEQ ID NO: 256005 - DNA, 20 bp, human
gtctctgcatcaaggaacca

SEQ ID NO: 256006 - DNA, 20 bp, human
ggcttccggggcggaaactg

SEQ ID NO: 256007 - DNA, 20 bp, human
ggccactggagccgtgtcct

SEQ ID NO: 256008 - DNA, 20 bp, human
ggggcgaggacgacgcgcgg

SEQ ID NO: 256009 - DNA, 20 bp, human
ggtgtcctgggcttccgggg

SEQ ID NO: 256010 - DNA, 20 bp, human
gccagtggcggcgcggccca

SEQ ID NO: 256011 - DNA, 20 bp, human
gcgagcagggcccttcgctc

SEQ ID NO: 256012 - DNA, 20 bp, human
ggggcggtggacagtcatgg

SEQ ID NO: 256013 - DNA, 20 bp, human
gggccctgctcgcccgagga

SEQ ID NO: 256014 - DNA, 20 bp, human
gcggcctcggccaaattcga

SEQ ID NO: 256015 - DNA, 20 bp, human
gcgaggacggaggcccgcac

SEQ ID NO: 256016 - DNA, 20 bp, human
ggcgcgaggtgagacggcga

SEQ ID NO: 256017 - DNA, 20 bp, human
ggccgaaggcccggctagtg

SEQ ID NO: 256018 - DNA, 20 bp, human
gacggtgtcgagaggatctg

SEQ ID NO: 256019 - DNA, 20 bp, human
gccacggggcggggcgcagt

SEQ ID NO: 256020 - DNA, 20 bp, human
gacctcacgaggatccccgg

SEQ ID NO: 256021 - DNA, 20 bp, human
ggagacggcgagggctcccg

SEQ ID NO: 256022 - DNA, 20 bp, human
gtgggaggcggagagggtat

SEQ ID NO: 256023 - DNA, 20 bp, human
gttcacaagtcccatggggc

SEQ ID NO: 256024 - DNA, 20 bp, human
gccgccttcacaagtcccat

SEQ ID NO: 256025 - DNA, 20 bp, human
ggccgggccttcggcaccga

SEQ ID NO: 256026 - DNA, 20 bp, human
gtacaaggctgggaccgagt

SEQ ID NO: 256027 - DNA, 20 bp, human
gcccaggggctggtctgagc

SEQ ID NO: 256028 - DNA, 20 bp, human
gaccccttttatagcagcgt

SEQ ID NO: 256029 - DNA, 20 bp, human
gcgcccacgctgctataaaa

SEQ ID NO: 256030 - DNA, 20 bp, human
gcgcagaaccaggaaagtaa

SEQ ID NO: 256031 - DNA, 20 bp, human
ggggctgctctcaacgctct

SEQ ID NO: 256032 - DNA, 20 bp, human
gagcgccaacccgcagaacc

SEQ ID NO: 256033 - DNA, 20 bp, human
gccggctagaaaaactctgt

SEQ ID NO: 256034 - DNA, 20 bp, human
ggtcctgcacctctccgtta

SEQ ID NO: 256035 - DNA, 20 bp, human
gctgagtttggaagtcgcgc

SEQ ID NO: 256036 - DNA, 20 bp, human
gcgggactgcaacttgtctc

SEQ ID NO: 256037 - DNA, 20 bp, human
gccgggggagggagctccaa

SEQ ID NO: 256038 - DNA, 20 bp, human
gcacggcgtcaccagagccc

SEQ ID NO: 256039 - DNA, 20 bp, human
gcgcggagccctctctcgtc

SEQ ID NO: 256040 - DNA, 20 bp, human
gcagaggcaccggacgagag

SEQ ID NO: 256041 - DNA, 20 bp, human
gccacggggcggggcgcagt

SEQ ID NO: 256042 - DNA, 20 bp, human
gccctcccaaatctgacctg

SEQ ID NO: 256043 - DNA, 20 bp, human
gaggaggggaaggcacggcc

SEQ ID NO: 256044 - DNA, 20 bp, human
gagtggggcgggatggagtc

SEQ ID NO: 256045 - DNA, 20 bp, human
gaagttgcagtcccgggctc

SEQ ID NO: 256046 - DNA, 20 bp, human
gcccaggggctggtctgagc

SEQ ID NO: 256047 - DNA, 20 bp, human
gcggcaggagggtgagccct

SEQ ID NO: 256048 - DNA, 20 bp, human
gtacaaggctgggaccgagt

SEQ ID NO: 256049 - DNA, 20 bp, human
gcggggaggctgaggatcgg

SEQ ID NO: 256050 - DNA, 20 bp, human
gactgtgcaggtgtcggctc

SEQ ID NO: 256051 - DNA, 20 bp, human
gagggccccacctccacggc

SEQ ID NO: 256052 - DNA, 20 bp, human
gaccccttttatagcagcgt

SEQ ID NO: 256053 - DNA, 20 bp, human
ggggctgctctcaacgctct

SEQ ID NO: 256054 - DNA, 20 bp, human
gcacgggtgtcccagcccag

SEQ ID NO: 256055 - DNA, 20 bp, human
gcgcccacgctgctataaaa

SEQ ID NO: 256056 - DNA, 20 bp, human
gccgccttggcccacgtcca

SEQ ID NO: 256057 - DNA, 20 bp, human
gagctggggtccttggacgt

SEQ ID NO: 256058 - DNA, 20 bp, human
gccacacaggtaaacaagga

SEQ ID NO: 256059 - DNA, 20 bp, human
gtgagagagaagcaggatgg

SEQ ID NO: 256060 - DNA, 20 bp, human
gagccggggcatagcaggtt

SEQ ID NO: 256061 - DNA, 20 bp, human
gaagcaggatgggggttagc

SEQ ID NO: 256062 - DNA, 20 bp, human
ggaggaagccggggcatagc

SEQ ID NO: 256063 - DNA, 20 bp, human
gggccctctcagtgtctgca

SEQ ID NO: 256064 - DNA, 20 bp, human
ggcctgggaagaggaagccg

SEQ ID NO: 256065 - DNA, 20 bp, human
gtctagaaagattggaacat

SEQ ID NO: 256066 - DNA, 20 bp, human
gcgtggctagagaggggtcg

SEQ ID NO: 256067 - DNA, 20 bp, human
gagccacggcctgacgggta

SEQ ID NO: 256068 - DNA, 20 bp, human
ggctccgcgccgccaccgga

SEQ ID NO: 256069 - DNA, 20 bp, human
gcacggcctgacgggtacgg

SEQ ID NO: 256070 - DNA, 20 bp, human
ggaccggcgacgagaggtcg

SEQ ID NO: 256071 - DNA, 20 bp, human
gcgggccgcgggtagaccgt

SEQ ID NO: 256072 - DNA, 20 bp, human
gcgacagctcgctggaaacg

SEQ ID NO: 256073 - DNA, 20 bp, human
gggtcaccaccgtacccgtc

SEQ ID NO: 256074 - DNA, 20 bp, human
ggagaggggtcggggctcgc

SEQ ID NO: 256075 - DNA, 20 bp, human
gcgccgcgacctctcgtcgc

SEQ ID NO: 256076 - DNA, 20 bp, human
gaggagcaaccgagtcacga

SEQ ID NO: 256077 - DNA, 20 bp, human
ggggatgcgcaccaccggca

SEQ ID NO: 256078 - DNA, 20 bp, human
gaccaccggcaggggttcgt

SEQ ID NO: 256079 - DNA, 20 bp, human
gcatcccagtggctctacag

SEQ ID NO: 256080 - DNA, 20 bp, human
ggcgccgcgacggggcctca

SEQ ID NO: 256081 - DNA, 20 bp, human
gagtcccgacgaacccctgc

SEQ ID NO: 256082 - DNA, 20 bp, human
gccggtggtgcgcatcccag

SEQ ID NO: 256083 - DNA, 20 bp, human
gccgaaaccagcagcggtcc

SEQ ID NO: 256084 - DNA, 20 bp, human
gggctctaacgcggccggtg

SEQ ID NO: 256085 - DNA, 20 bp, human
gggaccgtgaggccccgtcg

SEQ ID NO: 256086 - DNA, 20 bp, human
gagcctggccaattgcgaac

SEQ ID NO: 256087 - DNA, 20 bp, human
gcacttccccagcacaatca

SEQ ID NO: 256088 - DNA, 20 bp, human
gtggcgtcacgagcgagcaa

SEQ ID NO: 256089 - DNA, 20 bp, human
gggcggtgcctgcacatggg

SEQ ID NO: 256090 - DNA, 20 bp, human
ggccaggctctagtttatat

SEQ ID NO: 256091 - DNA, 20 bp, human
ggctcgctcgtgacgccacg

SEQ ID NO: 256092 - DNA, 20 bp, human
gtctacagacatgcaccaat

SEQ ID NO: 256093 - DNA, 20 bp, human
ggagcgagcaatggcgtcat

SEQ ID NO: 256094 - DNA, 20 bp, human
gtgaggctccacccatgtgc

SEQ ID NO: 256095 - DNA, 20 bp, human
gaagacacgcgtgacccgga

SEQ ID NO: 256096 - DNA, 20 bp, human
gctgcaggacggtaaggaga

SEQ ID NO: 256097 - DNA, 20 bp, human
gcggcacctgccaacatgga

SEQ ID NO: 256098 - DNA, 20 bp, human
gaacccggcacctgccaaca

SEQ ID NO: 256099 - DNA, 20 bp, human
gccgccgccaccttccatgt

SEQ ID NO: 256100 - DNA, 20 bp, human
gggggtctgaccaggtcgtg

SEQ ID NO: 256101 - DNA, 20 bp, human
gtagctggcctcggagctcg

SEQ ID NO: 256102 - DNA, 20 bp, human
gtgaccaggtcgtggggttg

SEQ ID NO: 256103 - DNA, 20 bp, human
ggcggctgcagctacagtcc

SEQ ID NO: 256104 - DNA, 20 bp, human
ggacccccaaccccacgacc

SEQ ID NO: 256105 - DNA, 20 bp, human
ggcctcggagctcgaggctc

SEQ ID NO: 256106 - DNA, 20 bp, human
ggcgagcggacccagctccg

SEQ ID NO: 256107 - DNA, 20 bp, human
gcaggcgccgccgagccaga

SEQ ID NO: 256108 - DNA, 20 bp, human
gggggagacgtcatcagcct

SEQ ID NO: 256109 - DNA, 20 bp, human
ggtctccccctctggctcgg

SEQ ID NO: 256110 - DNA, 20 bp, human
gcggggagcgcgtttatatg

SEQ ID NO: 256111 - DNA, 20 bp, human
ggggccagacccgcgcgcag

SEQ ID NO: 256112 - DNA, 20 bp, human
gtgaatggtgatcacgtgac

SEQ ID NO: 256113 - DNA, 20 bp, human
gggcgcgggtccggtccctg

SEQ ID NO: 256114 - DNA, 20 bp, human
ggcaggtggggcgatccccc

SEQ ID NO: 256115 - DNA, 20 bp, human
gagccctcctcctccccgct

SEQ ID NO: 256116 - DNA, 20 bp, human
gccaacccgccgtcggtcgg

SEQ ID NO: 256117 - DNA, 20 bp, human
gggcccaacccgccgtcggt

SEQ ID NO: 256118 - DNA, 20 bp, human
gaggctgcccattggtcgcg

SEQ ID NO: 256119 - DNA, 20 bp, human
gacacgggcggtgatgtcat

SEQ ID NO: 256120 - DNA, 20 bp, human
gcggactcgccgccgaccga

SEQ ID NO: 256121 - DNA, 20 bp, human
gggcctcatctctttaagga

SEQ ID NO: 256122 - DNA, 20 bp, human
gggctctgtgaggtagcggt

SEQ ID NO: 256123 - DNA, 20 bp, human
gtaccaggctgaagtgtcag

SEQ ID NO: 256124 - DNA, 20 bp, human
gcgaccaatgggcagcctag

SEQ ID NO: 256125 - DNA, 20 bp, human
gacagagccccgcgaccaat

SEQ ID NO: 256126 - DNA, 20 bp, human
gcagtagcacaggtcaataa

SEQ ID NO: 256127 - DNA, 20 bp, human
gagccagaggccagtagcac

SEQ ID NO: 256128 - DNA, 20 bp, human
gactggcctctggctaaaga

SEQ ID NO: 256129 - DNA, 20 bp, human
gcgtgatggcgtagccacgc

SEQ ID NO: 256130 - DNA, 20 bp, human
gagacgctggagcgcggcgt

SEQ ID NO: 256131 - DNA, 20 bp, human
gcacaaggaaccggggcgtg

SEQ ID NO: 256132 - DNA, 20 bp, human
gaattcaaacagtgaggcac

SEQ ID NO: 256133 - DNA, 20 bp, human
gacgccatcacgaccggcgg

SEQ ID NO: 256134 - DNA, 20 bp, human
ggctacgccatcacgaccgg

SEQ ID NO: 256135 - DNA, 20 bp, human
gcagcgccctctttagccag

SEQ ID NO: 256136 - DNA, 20 bp, human
gtggacttatcgctgagggg

SEQ ID NO: 256137 - DNA, 20 bp, human
gctccctcggaggaccacgt

SEQ ID NO: 256138 - DNA, 20 bp, human
gtggaaaggccgcgctgaat

SEQ ID NO: 256139 - DNA, 20 bp, human
gtgggactcgccagcctcgg

SEQ ID NO: 256140 - DNA, 20 bp, human
gggccgacgtggtcctccga

SEQ ID NO: 256141 - DNA, 20 bp, human
ggaatctggacttatcgctg

SEQ ID NO: 256142 - DNA, 20 bp, human
gggaggaccacgtcggccgc

SEQ ID NO: 256143 - DNA, 20 bp, human
gcacgtcggccgcaggaatc

SEQ ID NO: 256144 - DNA, 20 bp, human
gaggggaaggatgttctagc

SEQ ID NO: 256145 - DNA, 20 bp, human
gctagccggagtctactcga

SEQ ID NO: 256146 - DNA, 20 bp, human
ggggtgggcgggctggccca

SEQ ID NO: 256147 - DNA, 20 bp, human
gggtggtagctgacttgcag

SEQ ID NO: 256148 - DNA, 20 bp, human
gacctgtccctgtcaatctc

SEQ ID NO: 256149 - DNA, 20 bp, human
gtgggaaggagaaatgacac

SEQ ID NO: 256150 - DNA, 20 bp, human
gcccagagattgacagggac

SEQ ID NO: 256151 - DNA, 20 bp, human
gaaggtcttgtccactccag

SEQ ID NO: 256152 - DNA, 20 bp, human
ggggagagaggtctcagcca

SEQ ID NO: 256153 - DNA, 20 bp, human
ggtgttctcatggagtttgg

SEQ ID NO: 256154 - DNA, 20 bp, human
gagccctgcctaaggctatt

SEQ ID NO: 256155 - DNA, 20 bp, human
gctaaggctattaggttctg

SEQ ID NO: 256156 - DNA, 20 bp, human
gcggaggagcgctctagggg

SEQ ID NO: 256157 - DNA, 20 bp, human
gtgcacggaggagcgctcta

SEQ ID NO: 256158 - DNA, 20 bp, human
ggcgcccggaccacaccgca

SEQ ID NO: 256159 - DNA, 20 bp, human
ggaccaggggacctgcacgg

SEQ ID NO: 256160 - DNA, 20 bp, human
ggccgccctctcccgaggtg

SEQ ID NO: 256161 - DNA, 20 bp, human
ggctgctgcctcgggagcta

SEQ ID NO: 256162 - DNA, 20 bp, human
gacgctgactggggaagcga

SEQ ID NO: 256163 - DNA, 20 bp, human
ggctgggcttctgcgccgtg

SEQ ID NO: 256164 - DNA, 20 bp, human
ggggcgcgccctagctcccg

SEQ ID NO: 256165 - DNA, 20 bp, human
ggaggggtcgccggtgtgtg

SEQ ID NO: 256166 - DNA, 20 bp, human
gggcagagaccctgacctga

SEQ ID NO: 256167 - DNA, 20 bp, human
gttgccacgaggaggtagga

SEQ ID NO: 256168 - DNA, 20 bp, human
ggtgtcaagcctcctgtgca

SEQ ID NO: 256169 - DNA, 20 bp, human
gtcacatcagggacaggccg

SEQ ID NO: 256170 - DNA, 20 bp, human
gctcgtccctccctcaggtc

SEQ ID NO: 256171 - DNA, 20 bp, human
gagggacgagggttgccacg

SEQ ID NO: 256172 - DNA, 20 bp, human
gcacaggaggcttgacacat

SEQ ID NO: 256173 - DNA, 20 bp, human
gagggttgccacgaggaggt

SEQ ID NO: 256174 - DNA, 20 bp, human
gtcagaagatgagtcagagc

SEQ ID NO: 256175 - DNA, 20 bp, human
ggctccttcctacctcctcg

SEQ ID NO: 256176 - DNA, 20 bp, human
ggggccccacatgaccgaag

SEQ ID NO: 256177 - DNA, 20 bp, human
gccgccgcccccgggatcat

SEQ ID NO: 256178 - DNA, 20 bp, human
gcgccgcccgggaagcgatc

SEQ ID NO: 256179 - DNA, 20 bp, human
gtggtagggtgtctctgcac

SEQ ID NO: 256180 - DNA, 20 bp, human
gtgtgaccggatcgcttccc

SEQ ID NO: 256181 - DNA, 20 bp, human
gccattgcccatgatcccgg

SEQ ID NO: 256182 - DNA, 20 bp, human
gccgtcagggcagctgtgac

SEQ ID NO: 256183 - DNA, 20 bp, human
ggaccggatcgcttcccggg

SEQ ID NO: 256184 - DNA, 20 bp, human
ggcagcctggcggggaacgg

SEQ ID NO: 256185 - DNA, 20 bp, human
gggggcccgcagggacgtcc

SEQ ID NO: 256186 - DNA, 20 bp, human
gcgcgcgctcgcccatcccg

SEQ ID NO: 256187 - DNA, 20 bp, human
gtccgctgagttcattcact

SEQ ID NO: 256188 - DNA, 20 bp, human
gggaaacagctcaaggagga

SEQ ID NO: 256189 - DNA, 20 bp, human
ggctgcgccccaacaggtat

SEQ ID NO: 256190 - DNA, 20 bp, human
ggactctgaggcaggttccg

SEQ ID NO: 256191 - DNA, 20 bp, human
gccgcgagcccgggggtagg

SEQ ID NO: 256192 - DNA, 20 bp, human
ggaaaggaggagacaggcga

SEQ ID NO: 256193 - DNA, 20 bp, human
gcgccccaacaggtatcgga

SEQ ID NO: 256194 - DNA, 20 bp, human
gtccccgagcggccggaacg

SEQ ID NO: 256195 - DNA, 20 bp, human
gtgttggggcgcagcactgg

SEQ ID NO: 256196 - DNA, 20 bp, human
gcagacctggagttagtccc

SEQ ID NO: 256197 - DNA, 20 bp, human
gccgcccagggactaactcc

SEQ ID NO: 256198 - DNA, 20 bp, human
gtcctggcgcccaacgacca

SEQ ID NO: 256199 - DNA, 20 bp, human
ggggctccaggttccgccca

SEQ ID NO: 256200 - DNA, 20 bp, human
gggcagggctggatggagtg

SEQ ID NO: 256201 - DNA, 20 bp, human
gttgcctgggagacgcataa

SEQ ID NO: 256202 - DNA, 20 bp, human
gtgcgcgcgtccaacgagca

SEQ ID NO: 256203 - DNA, 20 bp, human
gcacagagcccgggcggcta

SEQ ID NO: 256204 - DNA, 20 bp, human
gaacgggccgggtcgcacca

SEQ ID NO: 256205 - DNA, 20 bp, human
gaacgagcacggctctcaac

SEQ ID NO: 256206 - DNA, 20 bp, human
gaggctcgagggatccactg

SEQ ID NO: 256207 - DNA, 20 bp, human
gtcaagcgggagcgatacac

SEQ ID NO: 256208 - DNA, 20 bp, human
ggctcccgcttgaaagagac

SEQ ID NO: 256209 - DNA, 20 bp, human
ggtaaaatataagacttcgt

SEQ ID NO: 256210 - DNA, 20 bp, human
gataagacttcgttggagag

SEQ ID NO: 256211 - DNA, 20 bp, human
gaataagaaatcttccccag

SEQ ID NO: 256212 - DNA, 20 bp, human
gaaacctgcattttcccgaa

SEQ ID NO: 256213 - DNA, 20 bp, human
ggcagtgaccatggacgatc

SEQ ID NO: 256214 - DNA, 20 bp, human
gtcacttacggcagtgacca

SEQ ID NO: 256215 - DNA, 20 bp, human
gggtcagcccggatcgtcca

SEQ ID NO: 256216 - DNA, 20 bp, human
ggggaccagcgactaaggga

SEQ ID NO: 256217 - DNA, 20 bp, human
gggcggggaccagcgactaa

SEQ ID NO: 256218 - DNA, 20 bp, human
ggcgcggggaccaacacacc

SEQ ID NO: 256219 - DNA, 20 bp, human
gcggggaccaacacaccggg

SEQ ID NO: 256220 - DNA, 20 bp, human
gggaccaacacaccgggagg

SEQ ID NO: 256221 - DNA, 20 bp, human
gggtgggcgcaaaaacggag

SEQ ID NO: 256222 - DNA, 20 bp, human
gtctacactggatgatgggg

SEQ ID NO: 256223 - DNA, 20 bp, human
gcagactgcgccccacgtga

SEQ ID NO: 256224 - DNA, 20 bp, human
gcctccggggcaccatacaa

SEQ ID NO: 256225 - DNA, 20 bp, human
gggctgacctggagacttcg

SEQ ID NO: 256226 - DNA, 20 bp, human
ggcttgccgcaaggaggaca

SEQ ID NO: 256227 - DNA, 20 bp, human
ggccgcagggctatctgtcc

SEQ ID NO: 256228 - DNA, 20 bp, human
ggcaatggccgcttgccgca

SEQ ID NO: 256229 - DNA, 20 bp, human
gcatctgggcgtcacaatcc

SEQ ID NO: 256230 - DNA, 20 bp, human
ggaggacagggcctctaagc

SEQ ID NO: 256231 - DNA, 20 bp, human
gcctgcggctccggtttcca

SEQ ID NO: 256232 - DNA, 20 bp, human
gtcccggacagatagccctg

SEQ ID NO: 256233 - DNA, 20 bp, human
gaaagataagaattaggcct

SEQ ID NO: 256234 - DNA, 20 bp, human
gatggccgcttgccgcaagg

SEQ ID NO: 256235 - DNA, 20 bp, human
gctctgaagaccctgcttag

SEQ ID NO: 256236 - DNA, 20 bp, human
ggggaccggccgggcaaccc

SEQ ID NO: 256237 - DNA, 20 bp, human
ggggcctgcccggtgcgcac

SEQ ID NO: 256238 - DNA, 20 bp, human
gcagcctcgggtgtcccggc

SEQ ID NO: 256239 - DNA, 20 bp, human
gtcccctggggcgactccgg

SEQ ID NO: 256240 - DNA, 20 bp, human
gaggcgctgccctgaccggg

SEQ ID NO: 256241 - DNA, 20 bp, human
gaacccgactacgaatccca

SEQ ID NO: 256242 - DNA, 20 bp, human
ggagcgcagccgcccggtca

SEQ ID NO: 256243 - DNA, 20 bp, human
gaaagccctgccctccacgc

SEQ ID NO: 256244 - DNA, 20 bp, human
gggagtcgccccaggggaaa

SEQ ID NO: 256245 - DNA, 20 bp, human
gtccagagacccggcgtgga

SEQ ID NO: 256246 - DNA, 20 bp, human
ggctgggcagagcgacccga

SEQ ID NO: 256247 - DNA, 20 bp, human
ggggcagagcgacccgaggg

SEQ ID NO: 256248 - DNA, 20 bp, human
gtgatctgctcggacggggc

SEQ ID NO: 256249 - DNA, 20 bp, human
ggatggaacaacccggggtc

SEQ ID NO: 256250 - DNA, 20 bp, human
ggagcagatcacgcggtgat

SEQ ID NO: 256251 - DNA, 20 bp, human
ggtgcagcagagcccgaccc

SEQ ID NO: 256252 - DNA, 20 bp, human
gaccgcgtgatctgctcgga

SEQ ID NO: 256253 - DNA, 20 bp, human
gggaagacctggagcgagtt

SEQ ID NO: 256254 - DNA, 20 bp, human
gagatcacgcggtgattggc

SEQ ID NO: 256255 - DNA, 20 bp, human
gggcggggggttacttccac

SEQ ID NO: 256256 - DNA, 20 bp, human
gtaattagttaattctgtct

SEQ ID NO: 256257 - DNA, 20 bp, human
gaggcgcgcgggctcgtggg

SEQ ID NO: 256258 - DNA, 20 bp, human
gacacggtttcttgagaccg

SEQ ID NO: 256259 - DNA, 20 bp, human
gtcgcctcctccctaaaatt

SEQ ID NO: 256260 - DNA, 20 bp, human
gccacgctgcctggcgactc

SEQ ID NO: 256261 - DNA, 20 bp, human
gtagacacgattctgtgcac

SEQ ID NO: 256262 - DNA, 20 bp, human
gcacacgcatgcattccagg

SEQ ID NO: 256263 - DNA, 20 bp, human
gcactggcttgtacatgcct

SEQ ID NO: 256264 - DNA, 20 bp, human
gtggtcacacagctcgttac

SEQ ID NO: 256265 - DNA, 20 bp, human
gactccccacaagtctatga

SEQ ID NO: 256266 - DNA, 20 bp, human
gtctggagaatcagccagga

SEQ ID NO: 256267 - DNA, 20 bp, human
ggggcaggacagctgttaac

SEQ ID NO: 256268 - DNA, 20 bp, human
gaggctggcagatttctggg

SEQ ID NO: 256269 - DNA, 20 bp, human
gtaacagctgtcctgcccct

SEQ ID NO: 256270 - DNA, 20 bp, human
gtgccagcctatggggccag

SEQ ID NO: 256271 - DNA, 20 bp, human
gcacttaactctttccctcc

SEQ ID NO: 256272 - DNA, 20 bp, human
gttctgggaggaaggaatgc

SEQ ID NO: 256273 - DNA, 20 bp, human
gagcctctggccccataggc

SEQ ID NO: 256274 - DNA, 20 bp, human
ggctgctaaatgtaagcgtc

SEQ ID NO: 256275 - DNA, 20 bp, human
gggccagaggctaaatttag

SEQ ID NO: 256276 - DNA, 20 bp, human
gcgtccgcgtcgttcggcta

SEQ ID NO: 256277 - DNA, 20 bp, human
ggggccctagccgaacgacg

SEQ ID NO: 256278 - DNA, 20 bp, human
gaacgcagtcactagggaaa

SEQ ID NO: 256279 - DNA, 20 bp, human
gacccggtgcacgtggacgg

SEQ ID NO: 256280 - DNA, 20 bp, human
ggccgacaacgcagtcacta

SEQ ID NO: 256281 - DNA, 20 bp, human
gtagggaaagggtgaagaca

SEQ ID NO: 256282 - DNA, 20 bp, human
ggacgcggacgcgaagtggg

SEQ ID NO: 256283 - DNA, 20 bp, human
gcacgtgcaccgggtagcca

SEQ ID NO: 256284 - DNA, 20 bp, human
gtccctagtgactgcgttgt

SEQ ID NO: 256285 - DNA, 20 bp, human
gccagacgccgcagtagagc

SEQ ID NO: 256286 - DNA, 20 bp, human
gactcctgggcgcgtcccgg

SEQ ID NO: 256287 - DNA, 20 bp, human
ggggccccgcgcgccactcc

SEQ ID NO: 256288 - DNA, 20 bp, human
gggggaagacgccaccgccc

SEQ ID NO: 256289 - DNA, 20 bp, human
ggcggtggcgtcttcccccc

SEQ ID NO: 256290 - DNA, 20 bp, human
gcaccgccctggagtctcag

SEQ ID NO: 256291 - DNA, 20 bp, human
gagcgcgggcgccgtgacgc

SEQ ID NO: 256292 - DNA, 20 bp, human
gaaacggcctggaccgggat

SEQ ID NO: 256293 - DNA, 20 bp, human
gtctgagaagccctactctg

SEQ ID NO: 256294 - DNA, 20 bp, human
ggcgcggggcccccgcgtca

SEQ ID NO: 256295 - DNA, 20 bp, human
gcgtggcggaggtacaccta

SEQ ID NO: 256296 - DNA, 20 bp, human
gcgcggggcccggaatggaa

SEQ ID NO: 256297 - DNA, 20 bp, human
ggccgctggctcccggtcac

SEQ ID NO: 256298 - DNA, 20 bp, human
ggcgccgggtgctcgccatc

SEQ ID NO: 256299 - DNA, 20 bp, human
gcccctccccggagcttgaa

SEQ ID NO: 256300 - DNA, 20 bp, human
ggacggcgcggggcccggaa

SEQ ID NO: 256301 - DNA, 20 bp, human
gggggcggggagtcagcgcg

SEQ ID NO: 256302 - DNA, 20 bp, human
gaggcccattcataaaaccg

SEQ ID NO: 256303 - DNA, 20 bp, human
gtcccgtgaccgggagccag

SEQ ID NO: 256304 - DNA, 20 bp, human
gccggagcttgaatggagcg

SEQ ID NO: 256305 - DNA, 20 bp, human
gacaaagagcggagtaaaca

SEQ ID NO: 256306 - DNA, 20 bp, human
gtgagtccctcagcgaagcg

SEQ ID NO: 256307 - DNA, 20 bp, human
ggccccagaggagtccggaa

SEQ ID NO: 256308 - DNA, 20 bp, human
ggctgccggtcgagtgtccc

SEQ ID NO: 256309 - DNA, 20 bp, human
gggcgtggccacggcccgag

SEQ ID NO: 256310 - DNA, 20 bp, human
gtggccacggcccgaggggc

SEQ ID NO: 256311 - DNA, 20 bp, human
ggccgtggccacgccctgca

SEQ ID NO: 256312 - DNA, 20 bp, human
gtgggcagccgcgtcacgga

SEQ ID NO: 256313 - DNA, 20 bp, human
ggcgttagagcgagaggaag

SEQ ID NO: 256314 - DNA, 20 bp, human
gagcgcctgggacactcgac

SEQ ID NO: 256315 - DNA, 20 bp, human
ggtgccggcgttagagcgag

SEQ ID NO: 256316 - DNA, 20 bp, human
ggggacgggccggctggaac

SEQ ID NO: 256317 - DNA, 20 bp, human
gaatgagcgtgctgcggaag

SEQ ID NO: 256318 - DNA, 20 bp, human
gttgcagcttgtttgcactg

SEQ ID NO: 256319 - DNA, 20 bp, human
ggcgcgaggcagctcctcaa

SEQ ID NO: 256320 - DNA, 20 bp, human
gtctcaatggatacattctc

SEQ ID NO: 256321 - DNA, 20 bp, human
gcaacagcgggctcggcggg

SEQ ID NO: 256322 - DNA, 20 bp, human
gcaagctgcaacagcgggct

SEQ ID NO: 256323 - DNA, 20 bp, human
ggaggagctgcctcgcgcag

SEQ ID NO: 256324 - DNA, 20 bp, human
gtgcaaacaagctgcaacag

SEQ ID NO: 256325 - DNA, 20 bp, human
gctgcaacagcgggctcggc

SEQ ID NO: 256326 - DNA, 20 bp, human
gccgctggtctcccgggctc

SEQ ID NO: 256327 - DNA, 20 bp, human
gagcgcgcccgcataccccg

SEQ ID NO: 256328 - DNA, 20 bp, human
gcgtctaggccggggtccct

SEQ ID NO: 256329 - DNA, 20 bp, human
gcccgcataccccgtgggga

SEQ ID NO: 256330 - DNA, 20 bp, human
gcaacggtgcggaggcggtg

SEQ ID NO: 256331 - DNA, 20 bp, human
gctaggccggggtccctagg

SEQ ID NO: 256332 - DNA, 20 bp, human
gcgccgaggcgttctccggg

SEQ ID NO: 256333 - DNA, 20 bp, human
gggccggcgcccgggcttaa

SEQ ID NO: 256334 - DNA, 20 bp, human
gagctccgagctagtccagg

SEQ ID NO: 256335 - DNA, 20 bp, human
gcctccgcaccgttgccccc

SEQ ID NO: 256336 - DNA, 20 bp, human
gcctgcgggccctgccccca

SEQ ID NO: 256337 - DNA, 20 bp, human
gtgggcacaggtgacatctg

SEQ ID NO: 256338 - DNA, 20 bp, human
gagaaaggagcgtcctggac

SEQ ID NO: 256339 - DNA, 20 bp, human
gagcgcccctcaccatcctt

SEQ ID NO: 256340 - DNA, 20 bp, human
gtgcccccaaggatggtgag

SEQ ID NO: 256341 - DNA, 20 bp, human
ggccacgtgtccaagagccg

SEQ ID NO: 256342 - DNA, 20 bp, human
gtcagcagaaaggagcgtcc

SEQ ID NO: 256343 - DNA, 20 bp, human
gggcccaggctgatcggtgt

SEQ ID NO: 256344 - DNA, 20 bp, human
gccagggcctcatcctgtcc

SEQ ID NO: 256345 - DNA, 20 bp, human
gctcttggacacgtggcttt

SEQ ID NO: 256346 - DNA, 20 bp, human
ggctcggggtgaagctgagg

SEQ ID NO: 256347 - DNA, 20 bp, human
ggccccgggcctgtcactcg

SEQ ID NO: 256348 - DNA, 20 bp, human
gccggggtgagggcggaagg

SEQ ID NO: 256349 - DNA, 20 bp, human
gaagctgaggcggctgccgc

SEQ ID NO: 256350 - DNA, 20 bp, human
gaatcagcgcgcgcggctcg

SEQ ID NO: 256351 - DNA, 20 bp, human
ggccgcgagtgacaggcccg

SEQ ID NO: 256352 - DNA, 20 bp, human
ggtgacaggcccggggcgga

SEQ ID NO: 256353 - DNA, 20 bp, human
gaagagccggtcccggggtg

SEQ ID NO: 256354 - DNA, 20 bp, human
ggcgtcgcacagaccccgga

SEQ ID NO: 256355 - DNA, 20 bp, human
gggggggcctgggtgacgcg

SEQ ID NO: 256356 - DNA, 20 bp, human
gggcgggccggtgagccaac

SEQ ID NO: 256357 - DNA, 20 bp, human
ggctagccgaagcagtcggg

SEQ ID NO: 256358 - DNA, 20 bp, human
gtcgggtgggacctgcgagt

SEQ ID NO: 256359 - DNA, 20 bp, human
gaggtcccacccgactgctt

SEQ ID NO: 256360 - DNA, 20 bp, human
gggtgctagccgaagcagtc

SEQ ID NO: 256361 - DNA, 20 bp, human
ggaggccaagggcaggtcag

SEQ ID NO: 256362 - DNA, 20 bp, human
gctggggcttccaccgaggc

SEQ ID NO: 256363 - DNA, 20 bp, human
gccaactcacagggtgatac

SEQ ID NO: 256364 - DNA, 20 bp, human
gcgaccccgtcccgcctcgg

SEQ ID NO: 256365 - DNA, 20 bp, human
ggcctccagcccaactcaca

SEQ ID NO: 256366 - DNA, 20 bp, human
gagaacagaggcttgcaggt

SEQ ID NO: 256367 - DNA, 20 bp, human
gagggcgcgtcgggcaggac

SEQ ID NO: 256368 - DNA, 20 bp, human
gggactggcctagagaacag

SEQ ID NO: 256369 - DNA, 20 bp, human
gccaggaggggcactgtagc

SEQ ID NO: 256370 - DNA, 20 bp, human
gtagctggcggctcgcgggg

SEQ ID NO: 256371 - DNA, 20 bp, human
gcgccggagcccccactcat

SEQ ID NO: 256372 - DNA, 20 bp, human
gcagtggcgccaatgagtgg

SEQ ID NO: 256373 - DNA, 20 bp, human
ggggcggagaagacggcgac

SEQ ID NO: 256374 - DNA, 20 bp, human
gctagagaacagaggcttgc

SEQ ID NO: 256375 - DNA, 20 bp, human
gccccagtggcgccaatgag

SEQ ID NO: 256376 - DNA, 20 bp, human
gcacgcccctcgtccggcgg

SEQ ID NO: 256377 - DNA, 20 bp, human
gcgggacgagtccacagttc

SEQ ID NO: 256378 - DNA, 20 bp, human
ggcagccgccgccggacgag

SEQ ID NO: 256379 - DNA, 20 bp, human
gggggtggggtggtccatta

SEQ ID NO: 256380 - DNA, 20 bp, human
gcgggcctggcgtacactct

SEQ ID NO: 256381 - DNA, 20 bp, human
gcctcgccaggggaccctaa

SEQ ID NO: 256382 - DNA, 20 bp, human
ggaaagccgccccctcgcca

SEQ ID NO: 256383 - DNA, 20 bp, human
gcgcgtggggccaactttga

SEQ ID NO: 256384 - DNA, 20 bp, human
gggccgggtaggaaaggcgg

SEQ ID NO: 256385 - DNA, 20 bp, human
ggcccgcagccatgactccc

SEQ ID NO: 256386 - DNA, 20 bp, human
gaggagtgatacaattacta

SEQ ID NO: 256387 - DNA, 20 bp, human
gtggaggatacatgtttcta

SEQ ID NO: 256388 - DNA, 20 bp, human
gcatctaaaaaggactagat

SEQ ID NO: 256389 - DNA, 20 bp, human
gttgtgatggcttaggtgta

SEQ ID NO: 256390 - DNA, 20 bp, human
ggctcccccaacccccttgt

SEQ ID NO: 256391 - DNA, 20 bp, human
gaaaagtgggcgggaccacc

SEQ ID NO: 256392 - DNA, 20 bp, human
gcgaaatgttcttcttgtga

SEQ ID NO: 256393 - DNA, 20 bp, human
gggccactatgtcaaaagat

SEQ ID NO: 256394 - DNA, 20 bp, human
gtaaatatcaattgacggaa

SEQ ID NO: 256395 - DNA, 20 bp, human
ggtaaatggtttaaaaaagt

SEQ ID NO: 256396 - DNA, 20 bp, human
gcccgcgctccattatgatc

SEQ ID NO: 256397 - DNA, 20 bp, human
gcgcgcggcgttgacgtcac

SEQ ID NO: 256398 - DNA, 20 bp, human
gccgctggctgtgggcccgt

SEQ ID NO: 256399 - DNA, 20 bp, human
gcgcatgcgccggatcataa

SEQ ID NO: 256400 - DNA, 20 bp, human
gcccccccgcggccacgctc

SEQ ID NO: 256401 - DNA, 20 bp, human
ggacgcgcgccgctggctgt

SEQ ID NO: 256402 - DNA, 20 bp, human
gtcgctctgcgccaccgcga

SEQ ID NO: 256403 - DNA, 20 bp, human
gcggcgcgcgtcgcatgcgc

SEQ ID NO: 256404 - DNA, 20 bp, human
gaccccgtgggacccggcag

SEQ ID NO: 256405 - DNA, 20 bp, human
ggcgccggggcgctcgggtc

SEQ ID NO: 256406 - DNA, 20 bp, human
gggctggggtacacgtttgg

SEQ ID NO: 256407 - DNA, 20 bp, human
gggcactaggcggagtcaga

SEQ ID NO: 256408 - DNA, 20 bp, human
gggaggggatcacgtgacgg

SEQ ID NO: 256409 - DNA, 20 bp, human
ggctgaaggcagcgatcatg

SEQ ID NO: 256410 - DNA, 20 bp, human
gaaggcagcgatcatgtggc

SEQ ID NO: 256411 - DNA, 20 bp, human
gacggtcacgtgattgggag

SEQ ID NO: 256412 - DNA, 20 bp, human
gagtcagacggtcacgtgat

SEQ ID NO: 256413 - DNA, 20 bp, human
gttgcttcgtgctccatcgt

SEQ ID NO: 256414 - DNA, 20 bp, human
ggggatcacgtgacggaggg

SEQ ID NO: 256415 - DNA, 20 bp, human
gaaagcggggtgggagccga

SEQ ID NO: 256416 - DNA, 20 bp, human
ggcgccgcggcccggccagt

SEQ ID NO: 256417 - DNA, 20 bp, human
gggcgtcgcggcagatggca

SEQ ID NO: 256418 - DNA, 20 bp, human
gaacggaaggggagattcac

SEQ ID NO: 256419 - DNA, 20 bp, human
gggtcccgggtccctagaaa

SEQ ID NO: 256420 - DNA, 20 bp, human
gcagtccagtcgggagagtg

SEQ ID NO: 256421 - DNA, 20 bp, human
gcgacgccggcgcctctccg

SEQ ID NO: 256422 - DNA, 20 bp, human
gccggcccagggcttcgtcc

SEQ ID NO: 256423 - DNA, 20 bp, human
ggggtccctagaaacggaag

SEQ ID NO: 256424 - DNA, 20 bp, human
gcgggcccggacgaagccct

SEQ ID NO: 256425 - DNA, 20 bp, human
gtctgactctggatccctgg

SEQ ID NO: 256426 - DNA, 20 bp, human
gacgcccggggactcgttgg

SEQ ID NO: 256427 - DNA, 20 bp, human
gcgcacgcccggggactcgt

SEQ ID NO: 256428 - DNA, 20 bp, human
gccccacgccggccgcggat

SEQ ID NO: 256429 - DNA, 20 bp, human
gggtgtgagcttcacgaagg

SEQ ID NO: 256430 - DNA, 20 bp, human
ggactcgttggcggcgtgga

SEQ ID NO: 256431 - DNA, 20 bp, human
gggcgcagagcagtgacgta

SEQ ID NO: 256432 - DNA, 20 bp, human
gcacgccgccaacgagtccc

SEQ ID NO: 256433 - DNA, 20 bp, human
gcgaccctgggcagataaat

SEQ ID NO: 256434 - DNA, 20 bp, human
gcgggcgtccctcctagacc

SEQ ID NO: 256435 - DNA, 20 bp, human
gggaggtgtgagcttcacga

SEQ ID NO: 256436 - DNA, 20 bp, human
gctcgtgaggggtcgaggaa

SEQ ID NO: 256437 - DNA, 20 bp, human
gtaggcgccgcaaagcggaa

SEQ ID NO: 256438 - DNA, 20 bp, human
gtgagcagagggcacgcggt

SEQ ID NO: 256439 - DNA, 20 bp, human
ggagcccgccgcagagtaga

SEQ ID NO: 256440 - DNA, 20 bp, human
gggggagcgtaggatcgggg

SEQ ID NO: 256441 - DNA, 20 bp, human
ggagcaggcggcagagtaga

SEQ ID NO: 256442 - DNA, 20 bp, human
gacgcggtgggcagcgaagg

SEQ ID NO: 256443 - DNA, 20 bp, human
gagaaggggtcgtgcggaag

SEQ ID NO: 256444 - DNA, 20 bp, human
gcagaaacctggaggagtag

SEQ ID NO: 256445 - DNA, 20 bp, human
gcgcgcggataggtgagcag

SEQ ID NO: 256446 - DNA, 20 bp, human
gcgcctggggctcccgaaag

SEQ ID NO: 256447 - DNA, 20 bp, human
ggcgagcaggcgcgtgtgta

SEQ ID NO: 256448 - DNA, 20 bp, human
ggggagccccaggcgcgaag

SEQ ID NO: 256449 - DNA, 20 bp, human
ggcaacgggacgccgctcct

SEQ ID NO: 256450 - DNA, 20 bp, human
gcccacccgggagtctggaa

SEQ ID NO: 256451 - DNA, 20 bp, human
gacgcagcgctccccgctca

SEQ ID NO: 256452 - DNA, 20 bp, human
gagaggccgcttcgcgcctg

SEQ ID NO: 256453 - DNA, 20 bp, human
gaaaggcccgaactgttttt

SEQ ID NO: 256454 - DNA, 20 bp, human
ggggagcgctgcgtctcctg

SEQ ID NO: 256455 - DNA, 20 bp, human
gcagaggcggttctgaccgt

SEQ ID NO: 256456 - DNA, 20 bp, human
gagcccaggaggtactagga

SEQ ID NO: 256457 - DNA, 20 bp, human
gcgccctcctagtacctcct

SEQ ID NO: 256458 - DNA, 20 bp, human
ggggctaccgcaaagccacg

SEQ ID NO: 256459 - DNA, 20 bp, human
gaggcacgaataacacccaa

SEQ ID NO: 256460 - DNA, 20 bp, human
gcgcgtgccacgtgaccacc

SEQ ID NO: 256461 - DNA, 20 bp, human
gtctggaaactgtagtcctt

SEQ ID NO: 256462 - DNA, 20 bp, human
gtggctggcgcgcgcgcctg

SEQ ID NO: 256463 - DNA, 20 bp, human
gggctttgcggtagcccagg

SEQ ID NO: 256464 - DNA, 20 bp, human
gaaaagtagctgtttgagac

SEQ ID NO: 256465 - DNA, 20 bp, human
ggagcggtgtagcatgagcg

SEQ ID NO: 256466 - DNA, 20 bp, human
gtaagaggtggtgccaacaa

SEQ ID NO: 256467 - DNA, 20 bp, human
gaccaacccagggactgaaa

SEQ ID NO: 256468 - DNA, 20 bp, human
ggagacggaacaataatgta

SEQ ID NO: 256469 - DNA, 20 bp, human
gataatgtaaggttttcaga

SEQ ID NO: 256470 - DNA, 20 bp, human
gctgaatgatgggactaaag

SEQ ID NO: 256471 - DNA, 20 bp, human
gaaaaggtgaagtgtcccta

SEQ ID NO: 256472 - DNA, 20 bp, human
ggaagtgtccctaaggtcat

SEQ ID NO: 256473 - DNA, 20 bp, human
gaaggtcatgggtacctaag

SEQ ID NO: 256474 - DNA, 20 bp, human
ggtcatgggtacctaagagg

SEQ ID NO: 256475 - DNA, 20 bp, human
gaagctttcagaggaagtac

SEQ ID NO: 256476 - DNA, 20 bp, human
gcactgcgagtcctaggaga

SEQ ID NO: 256477 - DNA, 20 bp, human
ggggacttggctcaacgtcc

SEQ ID NO: 256478 - DNA, 20 bp, human
ggcgcggcgccgtgacgcta

SEQ ID NO: 256479 - DNA, 20 bp, human
gatgtcgccgcgcgcccttc

SEQ ID NO: 256480 - DNA, 20 bp, human
ggctcgcggccttagcgtca

SEQ ID NO: 256481 - DNA, 20 bp, human
ggcttggcgaggttggtcag

SEQ ID NO: 256482 - DNA, 20 bp, human
gcccgccccccgcgcacgcg

SEQ ID NO: 256483 - DNA, 20 bp, human
gcctccgcactgcgagtcct

SEQ ID NO: 256484 - DNA, 20 bp, human
gggagccggctccgccctaa

SEQ ID NO: 256485 - DNA, 20 bp, human
gtaaggccgcgagcgagcgc

SEQ ID NO: 256486 - DNA, 20 bp, human
ggcgcccggtctcgccagga

SEQ ID NO: 256487 - DNA, 20 bp, human
gagaccgggcgcggaagacg

SEQ ID NO: 256488 - DNA, 20 bp, human
gaccccctcctggcgagacc

SEQ ID NO: 256489 - DNA, 20 bp, human
gccgcgcccctcctgaggga

SEQ ID NO: 256490 - DNA, 20 bp, human
gcacgcccgcgcccctcctg

SEQ ID NO: 256491 - DNA, 20 bp, human
gcggaggccctccctcagga

SEQ ID NO: 256492 - DNA, 20 bp, human
ggggcgcggaagacgcggag

SEQ ID NO: 256493 - DNA, 20 bp, human
gggagcggaggccctccctc

SEQ ID NO: 256494 - DNA, 20 bp, human
ggtggcgccgctccgtaggc

SEQ ID NO: 256495 - DNA, 20 bp, human
gccggggagctgtcagtgtc

SEQ ID NO: 256496 - DNA, 20 bp, human
ggcgacgagcagtgcgttct

SEQ ID NO: 256497 - DNA, 20 bp, human
ggtgtcagtttgtaaggcga

SEQ ID NO: 256498 - DNA, 20 bp, human
gagggcggaagttggattcc

SEQ ID NO: 256499 - DNA, 20 bp, human
ggagtgggaaatctaaagga

SEQ ID NO: 256500 - DNA, 20 bp, human
gcgacaggtaagtcacggag

SEQ ID NO: 256501 - DNA, 20 bp, human
ggggccccaccttttatttc

SEQ ID NO: 256502 - DNA, 20 bp, human
ggtggtcgctgggcgtcgca

SEQ ID NO: 256503 - DNA, 20 bp, human
ggtaaggcgagggcggaagt

SEQ ID NO: 256504 - DNA, 20 bp, human
gcgctcccagaaataaaagg

SEQ ID NO: 256505 - DNA, 20 bp, human
gcttggagtgggaaatctaa

SEQ ID NO: 256506 - DNA, 20 bp, human
gagaacggactgcgcgtgcg

SEQ ID NO: 256507 - DNA, 20 bp, human
gcagcccctcagcgccggcc

SEQ ID NO: 256508 - DNA, 20 bp, human
gtggggacctgtctgaaggg

SEQ ID NO: 256509 - DNA, 20 bp, human
gcggcgggaacccggatatg

SEQ ID NO: 256510 - DNA, 20 bp, human
ggccggcccacccactgttc

SEQ ID NO: 256511 - DNA, 20 bp, human
gtcagcgcacgggagcgggg

SEQ ID NO: 256512 - DNA, 20 bp, human
gggtttggggacctgtctga

SEQ ID NO: 256513 - DNA, 20 bp, human
ggcccagggccgcggatgag

SEQ ID NO: 256514 - DNA, 20 bp, human
ggcgctgaacgccccatatc

SEQ ID NO: 256515 - DNA, 20 bp, human
ggacctgtctgaagggtggg

SEQ ID NO: 256516 - DNA, 20 bp, human
gccgcgcatggctgccccgg

SEQ ID NO: 256517 - DNA, 20 bp, human
gagcgcgccctcggtccgga

SEQ ID NO: 256518 - DNA, 20 bp, human
gcgccagcgcgccctcggtc

SEQ ID NO: 256519 - DNA, 20 bp, human
gtgaccgccgcccgccacct

SEQ ID NO: 256520 - DNA, 20 bp, human
gcgggcaccgtccggaccga

SEQ ID NO: 256521 - DNA, 20 bp, human
gcggcggcctcgcaacccgt

SEQ ID NO: 256522 - DNA, 20 bp, human
gcccctgcgccgtcgcgggt

SEQ ID NO: 256523 - DNA, 20 bp, human
gcgcgacggcgcaggggaat

SEQ ID NO: 256524 - DNA, 20 bp, human
ggcgcgctggcggcctctgc

SEQ ID NO: 256525 - DNA, 20 bp, human
gggtcctcgcgggtcctcgg

SEQ ID NO: 256526 - DNA, 20 bp, human
gtggcgacggagcactacgg

SEQ ID NO: 256527 - DNA, 20 bp, human
gccgcctcggagctcttcag

SEQ ID NO: 256528 - DNA, 20 bp, human
gcacgcgcacgcaaagctcg

SEQ ID NO: 256529 - DNA, 20 bp, human
gttgccaggggtagtcgcta

SEQ ID NO: 256530 - DNA, 20 bp, human
gcagtccggagggaagtgaa

SEQ ID NO: 256531 - DNA, 20 bp, human
gcggtcccgcggtcgggcta

SEQ ID NO: 256532 - DNA, 20 bp, human
gcggtgggcgttgccctctc

SEQ ID NO: 256533 - DNA, 20 bp, human
gctatggcgacggagcacta

SEQ ID NO: 256534 - DNA, 20 bp, human
gggttcggacaagtttatgt

SEQ ID NO: 256535 - DNA, 20 bp, human
gagcactacggcggcgtcgc

SEQ ID NO: 256536 - DNA, 20 bp, human
ggccgagaatgagatgtaaa

SEQ ID NO: 256537 - DNA, 20 bp, human
gcgcggttgcgtggggagac

SEQ ID NO: 256538 - DNA, 20 bp, human
ggtggggagacgggcatcat

SEQ ID NO: 256539 - DNA, 20 bp, human
ggtcgcggccgcggttgcgt

SEQ ID NO: 256540 - DNA, 20 bp, human
ggggagcgacgtcgcggccg

SEQ ID NO: 256541 - DNA, 20 bp, human
ggctcccatggcaacccaga

SEQ ID NO: 256542 - DNA, 20 bp, human
gggatctaaaagcaatccta

SEQ ID NO: 256543 - DNA, 20 bp, human
gaggccttctgggttgccat

SEQ ID NO: 256544 - DNA, 20 bp, human
ggcgagctccgcaaggagtc

SEQ ID NO: 256545 - DNA, 20 bp, human
gcctagaacgagatgataag

SEQ ID NO: 256546 - DNA, 20 bp, human
gcaatgggccgcacgctacg

SEQ ID NO: 256547 - DNA, 20 bp, human
ggcgtcggttgcccgggcaa

SEQ ID NO: 256548 - DNA, 20 bp, human
ggagccccggccgggttacg

SEQ ID NO: 256549 - DNA, 20 bp, human
ggaccaatggaagaatgccg

SEQ ID NO: 256550 - DNA, 20 bp, human
gcctcgccgcgcgaccctat

SEQ ID NO: 256551 - DNA, 20 bp, human
gagcgtgcggcccattgccc

SEQ ID NO: 256552 - DNA, 20 bp, human
gtgcaggagaaagatcctga

SEQ ID NO: 256553 - DNA, 20 bp, human
ggggctgcgtcaagccaata

SEQ ID NO: 256554 - DNA, 20 bp, human
ggcccacggcattcttccat

SEQ ID NO: 256555 - DNA, 20 bp, human
ggggcctgagcactaggcgg

SEQ ID NO: 256556 - DNA, 20 bp, human
ggtgggaggaaacaagatgt

SEQ ID NO: 256557 - DNA, 20 bp, human
gcgccccgaggcattgtggg

SEQ ID NO: 256558 - DNA, 20 bp, human
gggagccgtggccttaagaa

SEQ ID NO: 256559 - DNA, 20 bp, human
ggggcggggcactatttcag

SEQ ID NO: 256560 - DNA, 20 bp, human
ggggagaagcccgcagtgcg

SEQ ID NO: 256561 - DNA, 20 bp, human
gctccgccccgaggcattgt

SEQ ID NO: 256562 - DNA, 20 bp, human
gccgcccggccccgcactgc

SEQ ID NO: 256563 - DNA, 20 bp, human
ggcggccggcgaaactccaa

SEQ ID NO: 256564 - DNA, 20 bp, human
gcggggcactatttcagcgg

SEQ ID NO: 256565 - DNA, 20 bp, human
gttcctcccacaatgcctcg

SEQ ID NO: 256566 - DNA, 20 bp, human
gttggctccgccaggattct

SEQ ID NO: 256567 - DNA, 20 bp, human
ggtggcaaagcgaaaagcta

SEQ ID NO: 256568 - DNA, 20 bp, human
gcctcacgctggctcctgat

SEQ ID NO: 256569 - DNA, 20 bp, human
gcaggagccagcgtgaggcg

SEQ ID NO: 256570 - DNA, 20 bp, human
gttgacagaaacctttgcgc

SEQ ID NO: 256571 - DNA, 20 bp, human
ggcagaaaagatgctggttc

SEQ ID NO: 256572 - DNA, 20 bp, human
gagccgatcttggctccgcc

SEQ ID NO: 256573 - DNA, 20 bp, human
gtttctgcacggctggagtt

SEQ ID NO: 256574 - DNA, 20 bp, human
ggcagattttccaagaatcc

SEQ ID NO: 256575 - DNA, 20 bp, human
gagccgtgcagaaaagatgc

SEQ ID NO: 256576 - DNA, 20 bp, human
gcacaccctcaaagttcccc

SEQ ID NO: 256577 - DNA, 20 bp, human
gcccaacagctgaggagggt

SEQ ID NO: 256578 - DNA, 20 bp, human
ggagcagccctgtcctgcgt

SEQ ID NO: 256579 - DNA, 20 bp, human
gtgggataatagtgcctggt

SEQ ID NO: 256580 - DNA, 20 bp, human
gcacacccccacgcaggaca

SEQ ID NO: 256581 - DNA, 20 bp, human
gagggtgggataatagtgcc

SEQ ID NO: 256582 - DNA, 20 bp, human
gctgatctgacgtgctcctc

SEQ ID NO: 256583 - DNA, 20 bp, human
gagcacgtcagatcagcctg

SEQ ID NO: 256584 - DNA, 20 bp, human
gggggtgtgagcggatgctc

SEQ ID NO: 256585 - DNA, 20 bp, human
gacccagaaactgctctggt

SEQ ID NO: 256586 - DNA, 20 bp, human
ggcgaaggttcgcggaagag

SEQ ID NO: 256587 - DNA, 20 bp, human
gtcgcccaatcctggagcag

SEQ ID NO: 256588 - DNA, 20 bp, human
gcgccgtaggcgaaggttcg

SEQ ID NO: 256589 - DNA, 20 bp, human
gggagcagtgggtcccggga

SEQ ID NO: 256590 - DNA, 20 bp, human
gcctgaggttcgcccaatcc

SEQ ID NO: 256591 - DNA, 20 bp, human
gtggccccacggaagcgtca

SEQ ID NO: 256592 - DNA, 20 bp, human
gcgcctgcgcgctcgcgagt

SEQ ID NO: 256593 - DNA, 20 bp, human
gcagccctgacgcttccgtg

SEQ ID NO: 256594 - DNA, 20 bp, human
gatcctggagcagtgggtcc

SEQ ID NO: 256595 - DNA, 20 bp, human
gaggcatcaggagcgcggtc

SEQ ID NO: 256596 - DNA, 20 bp, human
gaggaggagaggcgaattca

SEQ ID NO: 256597 - DNA, 20 bp, human
ggatggggtcactgagggtc

SEQ ID NO: 256598 - DNA, 20 bp, human
gggaaactaccacctcccag

SEQ ID NO: 256599 - DNA, 20 bp, human
ggggaggtggtagtttccat

SEQ ID NO: 256600 - DNA, 20 bp, human
gatccctgggcggggcccgt

SEQ ID NO: 256601 - DNA, 20 bp, human
gtgagggtccgggcagcgaa

SEQ ID NO: 256602 - DNA, 20 bp, human
gccctcagtgaccccatccc

SEQ ID NO: 256603 - DNA, 20 bp, human
gctaccctcacggattccca

SEQ ID NO: 256604 - DNA, 20 bp, human
gggtccgggcagcgaagggc

SEQ ID NO: 256605 - DNA, 20 bp, human
ggaggggcgtggcaggtccg

SEQ ID NO: 256606 - DNA, 20 bp, human
ggaagcgaggaaaaagtgcg

SEQ ID NO: 256607 - DNA, 20 bp, human
ggcgccagtgtggatcagat

SEQ ID NO: 256608 - DNA, 20 bp, human
gcaaaggcggggattgcgta

SEQ ID NO: 256609 - DNA, 20 bp, human
gcaacgccaggcgtcacttc

SEQ ID NO: 256610 - DNA, 20 bp, human
gcgcggccgcggtgctctac

SEQ ID NO: 256611 - DNA, 20 bp, human
ggcggggattgcgtagggaa

SEQ ID NO: 256612 - DNA, 20 bp, human
gggcagcgctgggcgggctt

SEQ ID NO: 256613 - DNA, 20 bp, human
gactgggaatggcgccagtg

SEQ ID NO: 256614 - DNA, 20 bp, human
ggggcactcaaccactagtg

SEQ ID NO: 256615 - DNA, 20 bp, human
gtgacgccactgcgacacaa

SEQ ID NO: 256616 - DNA, 20 bp, human
gatatcatcctgatggggtg

SEQ ID NO: 256617 - DNA, 20 bp, human
gaagacaattaccccaactg

SEQ ID NO: 256618 - DNA, 20 bp, human
gccaccatttactttatctg

SEQ ID NO: 256619 - DNA, 20 bp, human
ggtctcatatcatcctgatg

SEQ ID NO: 256620 - DNA, 20 bp, human
gatgttagatattcctcagt

SEQ ID NO: 256621 - DNA, 20 bp, human
gtgaaattttccgtggtaat

SEQ ID NO: 256622 - DNA, 20 bp, human
gcatcagttcacaaatcaag

SEQ ID NO: 256623 - DNA, 20 bp, human
gtttccccagataaagtaaa

SEQ ID NO: 256624 - DNA, 20 bp, human
gtagtttactattaagacag

SEQ ID NO: 256625 - DNA, 20 bp, human
gagaggtaaagttactttat

SEQ ID NO: 256626 - DNA, 20 bp, human
gtcagtgtgggtcacgtgag

SEQ ID NO: 256627 - DNA, 20 bp, human
gtggatttcggttcttgggt

SEQ ID NO: 256628 - DNA, 20 bp, human
ggagcagcagacatgggaga

SEQ ID NO: 256629 - DNA, 20 bp, human
ggcaggcggagtgtcagtgt

SEQ ID NO: 256630 - DNA, 20 bp, human
ggtaagcggccatctcgcgc

SEQ ID NO: 256631 - DNA, 20 bp, human
ggcgcatgcgtgcaggtaag

SEQ ID NO: 256632 - DNA, 20 bp, human
gtctagctgcctttgcgcag

SEQ ID NO: 256633 - DNA, 20 bp, human
gacactccgcctgcgcgaga

SEQ ID NO: 256634 - DNA, 20 bp, human
gaggaatgagcagcagacat

SEQ ID NO: 256635 - DNA, 20 bp, human
ggggatgggggcggagtcca

SEQ ID NO: 256636 - DNA, 20 bp, human
ggcggctgcgcgcaaaccgg

SEQ ID NO: 256637 - DNA, 20 bp, human
gggggcggctgcgcgcaaac

SEQ ID NO: 256638 - DNA, 20 bp, human
ggaggccgccgagttttccg

SEQ ID NO: 256639 - DNA, 20 bp, human
ggtcgccggagtggagccga

SEQ ID NO: 256640 - DNA, 20 bp, human
gcgcaaaccgggggactgag

SEQ ID NO: 256641 - DNA, 20 bp, human
gaggagccgggcgggaggtt

SEQ ID NO: 256642 - DNA, 20 bp, human
ggcagagaaggggcgccgcg

SEQ ID NO: 256643 - DNA, 20 bp, human
gggggaggggaaaaggtcgc

SEQ ID NO: 256644 - DNA, 20 bp, human
gtgagctgtagggcagagaa

SEQ ID NO: 256645 - DNA, 20 bp, human
gccccacccaacctcccgcc

SEQ ID NO: 256646 - DNA, 20 bp, human
ggcgccgaggcgtttcccgg

SEQ ID NO: 256647 - DNA, 20 bp, human
ggccacgcggcgctcctagc

SEQ ID NO: 256648 - DNA, 20 bp, human
gcgggctgacgcacaggggc

SEQ ID NO: 256649 - DNA, 20 bp, human
gcagctacgggctgacgcac

SEQ ID NO: 256650 - DNA, 20 bp, human
gcgggtgctagtactggcgc

SEQ ID NO: 256651 - DNA, 20 bp, human
gaaacgcctcggcgcagcta

SEQ ID NO: 256652 - DNA, 20 bp, human
gcggggcccgtggccggtaa

SEQ ID NO: 256653 - DNA, 20 bp, human
ggccagtactagcacccgct

SEQ ID NO: 256654 - DNA, 20 bp, human
gacgcccccgggaaacgcct

SEQ ID NO: 256655 - DNA, 20 bp, human
gagaggggtccggagaagga

SEQ ID NO: 256656 - DNA, 20 bp, human
gcgcccccgctggcagtgaa

SEQ ID NO: 256657 - DNA, 20 bp, human
ggatgctgtgatggtgtaat

SEQ ID NO: 256658 - DNA, 20 bp, human
gccaacgtgggcactgtcgt

SEQ ID NO: 256659 - DNA, 20 bp, human
gctaactgagaagttgtcct

SEQ ID NO: 256660 - DNA, 20 bp, human
gtaatgggagttctaagtgc

SEQ ID NO: 256661 - DNA, 20 bp, human
gaaagtaagagaaacctcgt

SEQ ID NO: 256662 - DNA, 20 bp, human
gtgggggagagcgttctgga

SEQ ID NO: 256663 - DNA, 20 bp, human
gggcggatttgatgctgtga

SEQ ID NO: 256664 - DNA, 20 bp, human
ggccagcaacctgattataa

SEQ ID NO: 256665 - DNA, 20 bp, human
gtccctttcactgccagcgg

SEQ ID NO: 256666 - DNA, 20 bp, human
ggggtcagacgggcgcctgt

SEQ ID NO: 256667 - DNA, 20 bp, human
gggcagggcggatctgggta

SEQ ID NO: 256668 - DNA, 20 bp, human
ggtcagcggcgcctcgttcc

SEQ ID NO: 256669 - DNA, 20 bp, human
gtgggcggaccctccccctc

SEQ ID NO: 256670 - DNA, 20 bp, human
gcagctcccggccaggaacg

SEQ ID NO: 256671 - DNA, 20 bp, human
gaacgaggcgccgctgacgc

SEQ ID NO: 256672 - DNA, 20 bp, human
gagagcgcacaaggcgccgt

SEQ ID NO: 256673 - DNA, 20 bp, human
gtgctggtccctagctccgc

SEQ ID NO: 256674 - DNA, 20 bp, human
ggatctgggtaggggccgga

SEQ ID NO: 256675 - DNA, 20 bp, human
gagctgcgcgcccgcgtcag

SEQ ID NO: 256676 - DNA, 20 bp, human
gaccgcccggggtaggacgg

SEQ ID NO: 256677 - DNA, 20 bp, human
gccgaccgcccggggtagga

SEQ ID NO: 256678 - DNA, 20 bp, human
ggggcggtcgggttgagttc

SEQ ID NO: 256679 - DNA, 20 bp, human
gttggcgcagcactcagcca

SEQ ID NO: 256680 - DNA, 20 bp, human
ggctgagtgctgcgccaaat

SEQ ID NO: 256681 - DNA, 20 bp, human
ggagactgctccaatccccg

SEQ ID NO: 256682 - DNA, 20 bp, human
gtcccccgtcctaccccggg

SEQ ID NO: 256683 - DNA, 20 bp, human
gactgctccaatccccgagg

SEQ ID NO: 256684 - DNA, 20 bp, human
ggtagcccagatctcgctct

SEQ ID NO: 256685 - DNA, 20 bp, human
gtcgctcttggacaggagaa

SEQ ID NO: 256686 - DNA, 20 bp, human
gtcatcatggtattagtttc

SEQ ID NO: 256687 - DNA, 20 bp, human
gagtgactgcaaggtgttca

SEQ ID NO: 256688 - DNA, 20 bp, human
gcaaggtgactgaaatatct

SEQ ID NO: 256689 - DNA, 20 bp, human
gcacacacacaagaggtttg

SEQ ID NO: 256690 - DNA, 20 bp, human
gctcagttttctgagaagcg

SEQ ID NO: 256691 - DNA, 20 bp, human
gtgatgacttagaggctttg

SEQ ID NO: 256692 - DNA, 20 bp, human
ggtgactgaaatatcttggg

SEQ ID NO: 256693 - DNA, 20 bp, human
ggagaagcgtggtcagtatc

SEQ ID NO: 256694 - DNA, 20 bp, human
ggggagaaacatagaagcag

SEQ ID NO: 256695 - DNA, 20 bp, human
gtaataccatgatgacttag

SEQ ID NO: 256696 - DNA, 20 bp, human
gcaccaggcagtctgtttac

SEQ ID NO: 256697 - DNA, 20 bp, human
gaaaaagaattttgtcagta

SEQ ID NO: 256698 - DNA, 20 bp, human
gaggaaactactagagcacc

SEQ ID NO: 256699 - DNA, 20 bp, human
gttctggctcacagttggag

SEQ ID NO: 256700 - DNA, 20 bp, human
gcctgaactcagcttttcat

SEQ ID NO: 256701 - DNA, 20 bp, human
gaagcccattatccagtatc

SEQ ID NO: 256702 - DNA, 20 bp, human
gcaaaaaatacctatcgggc

SEQ ID NO: 256703 - DNA, 20 bp, human
ggtctccagatactggataa

SEQ ID NO: 256704 - DNA, 20 bp, human
gaactcagcttttcatggga

SEQ ID NO: 256705 - DNA, 20 bp, human
gccactgcgcccggcccgat

SEQ ID NO: 256706 - DNA, 20 bp, human
gcatctgcccagcacccagt

SEQ ID NO: 256707 - DNA, 20 bp, human
gtaccaggctccctgcggag

SEQ ID NO: 256708 - DNA, 20 bp, human
ggaacccggggaaccagtgg

SEQ ID NO: 256709 - DNA, 20 bp, human
gagggagcctggtacccgcc

SEQ ID NO: 256710 - DNA, 20 bp, human
gccggcccctgccgctccgc

SEQ ID NO: 256711 - DNA, 20 bp, human
ggtgctgggcagatgattgg

SEQ ID NO: 256712 - DNA, 20 bp, human
gcccatcggacgcacaagcc

SEQ ID NO: 256713 - DNA, 20 bp, human
gccgaaaggcaaggaaggac

SEQ ID NO: 256714 - DNA, 20 bp, human
ggccgcgtctgtggtaaccc

SEQ ID NO: 256715 - DNA, 20 bp, human
gcctgctccggcccacttac

SEQ ID NO: 256716 - DNA, 20 bp, human
gtgggaaattagcttgctga

SEQ ID NO: 256717 - DNA, 20 bp, human
gggcgcagacacgtggttcg

SEQ ID NO: 256718 - DNA, 20 bp, human
gtctgcgccagctgccggat

SEQ ID NO: 256719 - DNA, 20 bp, human
gaaccgggtaggagcgaatc

SEQ ID NO: 256720 - DNA, 20 bp, human
gagaggccggagggagatcg

SEQ ID NO: 256721 - DNA, 20 bp, human
gggtcccgcccagttgccag

SEQ ID NO: 256722 - DNA, 20 bp, human
gagggagatcgcggagggga

SEQ ID NO: 256723 - DNA, 20 bp, human
ggccggagggagatcgcgga

SEQ ID NO: 256724 - DNA, 20 bp, human
gctggatgctaaccctagga

SEQ ID NO: 256725 - DNA, 20 bp, human
gtgagggccagaccaacaac

SEQ ID NO: 256726 - DNA, 20 bp, human
ggcttcctggccttgctgag

SEQ ID NO: 256727 - DNA, 20 bp, human
gtgtaccggaggcagggtgt

SEQ ID NO: 256728 - DNA, 20 bp, human
gggcagggctatctgcccgg

SEQ ID NO: 256729 - DNA, 20 bp, human
gaggggcggccgcacccccc

SEQ ID NO: 256730 - DNA, 20 bp, human
gcaagtccagcctctcagca

SEQ ID NO: 256731 - DNA, 20 bp, human
ggccctgcccaccctcctaa

SEQ ID NO: 256732 - DNA, 20 bp, human
gcctagcttgggatccggtc

SEQ ID NO: 256733 - DNA, 20 bp, human
gccaagctaggagagttctt

SEQ ID NO: 256734 - DNA, 20 bp, human
gcctcctaaagggaccgtcc

SEQ ID NO: 256735 - DNA, 20 bp, human
gacggtccctttaggagggt

SEQ ID NO: 256736 - DNA, 20 bp, human
gcggaagcttctgagagcga

SEQ ID NO: 256737 - DNA, 20 bp, human
gcaccctaggggaccgttct

SEQ ID NO: 256738 - DNA, 20 bp, human
gcaccgagaacggtccccta

SEQ ID NO: 256739 - DNA, 20 bp, human
gcggcctctcagacgagggt

SEQ ID NO: 256740 - DNA, 20 bp, human
gaggggtcgaggtgatttgt

SEQ ID NO: 256741 - DNA, 20 bp, human
gaagtccctaggcaccctag

SEQ ID NO: 256742 - DNA, 20 bp, human
ggggacttccggagcccgac

SEQ ID NO: 256743 - DNA, 20 bp, human
ggacgagggtgggttagcgg

SEQ ID NO: 256744 - DNA, 20 bp, human
gtaacccaccctcgtctgag

SEQ ID NO: 256745 - DNA, 20 bp, human
gccccggccgtcaccgagaa

SEQ ID NO: 256746 - DNA, 20 bp, human
gtgtccccacgcctccagca

SEQ ID NO: 256747 - DNA, 20 bp, human
ggtccggatggtaccaggcg

SEQ ID NO: 256748 - DNA, 20 bp, human
ggtacggccaatggcggggc

SEQ ID NO: 256749 - DNA, 20 bp, human
ggtgacgggaacaacggcgg

SEQ ID NO: 256750 - DNA, 20 bp, human
gccggggcagccaattgtgg

SEQ ID NO: 256751 - DNA, 20 bp, human
gcggcggcgaggggcgggat

SEQ ID NO: 256752 - DNA, 20 bp, human
ggcggcggcgcggggcggta

SEQ ID NO: 256753 - DNA, 20 bp, human
gcctccagcaggggacgccc

SEQ ID NO: 256754 - DNA, 20 bp, human
ggggcggtacggccaatggc

SEQ ID NO: 256755 - DNA, 20 bp, human
gccggccgtgacgggaacaa

SEQ ID NO: 256756 - DNA, 20 bp, human
gaggacgcgttctttccggg

SEQ ID NO: 256757 - DNA, 20 bp, human
gcggaaagaacgcgtcctcg

SEQ ID NO: 256758 - DNA, 20 bp, human
gctagcttcgctgcttaaag

SEQ ID NO: 256759 - DNA, 20 bp, human
gaaagaacgcgtcctcgagg

SEQ ID NO: 256760 - DNA, 20 bp, human
gccggcgagacggagacaga

SEQ ID NO: 256761 - DNA, 20 bp, human
ggaaaatgccgcgctccggt

SEQ ID NO: 256762 - DNA, 20 bp, human
gcggagcgcggcattttccg

SEQ ID NO: 256763 - DNA, 20 bp, human
gttggctgctgcgacagtac

SEQ ID NO: 256764 - DNA, 20 bp, human
ggcacagcgccccgagaaat

SEQ ID NO: 256765 - DNA, 20 bp, human
gcggagacagagggtggttc

SEQ ID NO: 256766 - DNA, 20 bp, human
ggggctgtgggaacggtcct

SEQ ID NO: 256767 - DNA, 20 bp, human
ggcccaatgggctgtgggaa

SEQ ID NO: 256768 - DNA, 20 bp, human
gaaggaggtagcggcccaat

SEQ ID NO: 256769 - DNA, 20 bp, human
gcgcggccctgctccatgat

SEQ ID NO: 256770 - DNA, 20 bp, human
gctgtgggaacggtcctcgg

SEQ ID NO: 256771 - DNA, 20 bp, human
gaccgttcccacagcccatt

SEQ ID NO: 256772 - DNA, 20 bp, human
ggagcagggccgcgacttgc

SEQ ID NO: 256773 - DNA, 20 bp, human
gtagcggcccaatgggctgt

SEQ ID NO: 256774 - DNA, 20 bp, human
gccccggtaaccatgatgca

SEQ ID NO: 256775 - DNA, 20 bp, human
ggggccggcgctactgacct

SEQ ID NO: 256776 - DNA, 20 bp, human
gcacgtgtgcgaaacgtcac

SEQ ID NO: 256777 - DNA, 20 bp, human
gtgcccccgccctccgtcgc

SEQ ID NO: 256778 - DNA, 20 bp, human
gtccgccccccggcgacgga

SEQ ID NO: 256779 - DNA, 20 bp, human
ggcggggaaggaaggggcaa

SEQ ID NO: 256780 - DNA, 20 bp, human
gaaggggagaggcgggtcaa

SEQ ID NO: 256781 - DNA, 20 bp, human
gcagacccaggcggcgggac

SEQ ID NO: 256782 - DNA, 20 bp, human
gaaacgtcaccggcgggtcc

SEQ ID NO: 256783 - DNA, 20 bp, human
gggagaggcgggtcaagggc

SEQ ID NO: 256784 - DNA, 20 bp, human
ggacgcgcctgtgactgggg

SEQ ID NO: 256785 - DNA, 20 bp, human
gacggagggcgggggcagct

SEQ ID NO: 256786 - DNA, 20 bp, human
gcgccctggcagtagagaag

SEQ ID NO: 256787 - DNA, 20 bp, human
gccgtcccgtgcgccttcca

SEQ ID NO: 256788 - DNA, 20 bp, human
gaaggcgcacgggacggaag

SEQ ID NO: 256789 - DNA, 20 bp, human
gggtgcagccgcaaaacttc

SEQ ID NO: 256790 - DNA, 20 bp, human
gcggggagttgggatgaagt

SEQ ID NO: 256791 - DNA, 20 bp, human
gcggcggccaggaacggaag

SEQ ID NO: 256792 - DNA, 20 bp, human
gtctgcctagtccccatctt

SEQ ID NO: 256793 - DNA, 20 bp, human
ggaagcggaagcagtaacgc

SEQ ID NO: 256794 - DNA, 20 bp, human
gccaactccccggtctaccc

SEQ ID NO: 256795 - DNA, 20 bp, human
gaaactacctgggtagaccg

SEQ ID NO: 256796 - DNA, 20 bp, human
gggtcagctcgcgaacgcca

SEQ ID NO: 256797 - DNA, 20 bp, human
ggggtggaaacgaggagaag

SEQ ID NO: 256798 - DNA, 20 bp, human
gcagctcgcgaacgccaggg

SEQ ID NO: 256799 - DNA, 20 bp, human
ggcgttcgcgagctgacccg

SEQ ID NO: 256800 - DNA, 20 bp, human
gaatctcacgcggcaaagca

SEQ ID NO: 256801 - DNA, 20 bp, human
gcgcgagctgacccgaggag

SEQ ID NO: 256802 - DNA, 20 bp, human
ggagaaacgtgtagagggag

SEQ ID NO: 256803 - DNA, 20 bp, human
gcgtgagattaccactcctc

SEQ ID NO: 256804 - DNA, 20 bp, human
ggtggggacctgagtttaaa

SEQ ID NO: 256805 - DNA, 20 bp, human
gtctaggcaacggcgggcgg

SEQ ID NO: 256806 - DNA, 20 bp, human
gaggtggagccgaattccag

SEQ ID NO: 256807 - DNA, 20 bp, human
ggcagccgccgggagaggat

SEQ ID NO: 256808 - DNA, 20 bp, human
gcgggagaggatcggtgcgt

SEQ ID NO: 256809 - DNA, 20 bp, human
gggcaaccgggaaaacccag

SEQ ID NO: 256810 - DNA, 20 bp, human
gggcgggcatgcgcagaggg

SEQ ID NO: 256811 - DNA, 20 bp, human
ggggcggtgtactgcgcatg

SEQ ID NO: 256812 - DNA, 20 bp, human
gtttcccgggcggcagccgc

SEQ ID NO: 256813 - DNA, 20 bp, human
gagcggcgggcatgcgcaga

SEQ ID NO: 256814 - DNA, 20 bp, human
gcgtgggagcgctccggcag

SEQ ID NO: 256815 - DNA, 20 bp, human
gggctgccgcccgggaaacc

SEQ ID NO: 256816 - DNA, 20 bp, human
gcgggtgagggcaaaacgcg

SEQ ID NO: 256817 - DNA, 20 bp, human
gggagcgccaagactccgag

SEQ ID NO: 256818 - DNA, 20 bp, human
gggccgaggcggcaacaatt

SEQ ID NO: 256819 - DNA, 20 bp, human
ggcaacaattgggcgggtga

SEQ ID NO: 256820 - DNA, 20 bp, human
ggcgccaagactccgagggg

SEQ ID NO: 256821 - DNA, 20 bp, human
ggaggcggcaacaattgggc

SEQ ID NO: 256822 - DNA, 20 bp, human
gtcaccgcccctcggagtct

SEQ ID NO: 256823 - DNA, 20 bp, human
gtacctggaaacctcgggcc

SEQ ID NO: 256824 - DNA, 20 bp, human
gtccgaggggcggtgagccc

SEQ ID NO: 256825 - DNA, 20 bp, human
gcccgggagccaattcctgc

SEQ ID NO: 256826 - DNA, 20 bp, human
gccctccactcccgcctcta

SEQ ID NO: 256827 - DNA, 20 bp, human
gcccgcctctacggcagagt

SEQ ID NO: 256828 - DNA, 20 bp, human
ggccccaagcggggaatcgc

SEQ ID NO: 256829 - DNA, 20 bp, human
gggtgcctgcaccgattcgc

SEQ ID NO: 256830 - DNA, 20 bp, human
ggcctctacggcagagttgg

SEQ ID NO: 256831 - DNA, 20 bp, human
gtggcccgtccggggctcgc

SEQ ID NO: 256832 - DNA, 20 bp, human
gacggtcgggaggctcggat

SEQ ID NO: 256833 - DNA, 20 bp, human
ggccgccggcgaatcggtgc

SEQ ID NO: 256834 - DNA, 20 bp, human
gccaactttgagcaagggga

SEQ ID NO: 256835 - DNA, 20 bp, human
gtcccccaactctgccgtag

SEQ ID NO: 256836 - DNA, 20 bp, human
gtgagggaacggcaagagga

SEQ ID NO: 256837 - DNA, 20 bp, human
gcagaaccggagcggattga

SEQ ID NO: 256838 - DNA, 20 bp, human
ggctgagagcgaagatgggg

SEQ ID NO: 256839 - DNA, 20 bp, human
gaagatggggcgggactgtg

SEQ ID NO: 256840 - DNA, 20 bp, human
ggcgcgctgagagcgaagat

SEQ ID NO: 256841 - DNA, 20 bp, human
gccggagcggattgacggac

SEQ ID NO: 256842 - DNA, 20 bp, human
ggcaacgcgccgcaggaaga

SEQ ID NO: 256843 - DNA, 20 bp, human
gatagcggtgtggccttaaa

SEQ ID NO: 256844 - DNA, 20 bp, human
gtgagagccagagaacgcga

SEQ ID NO: 256845 - DNA, 20 bp, human
ggaacggcaagaggagggcg

SEQ ID NO: 256846 - DNA, 20 bp, human
gctgcctccgaggcccagtg

SEQ ID NO: 256847 - DNA, 20 bp, human
ggggcctcggaggcagaata

SEQ ID NO: 256848 - DNA, 20 bp, human
gcagccccactgggcctcgg

SEQ ID NO: 256849 - DNA, 20 bp, human
gacgccctcctcagggtcta

SEQ ID NO: 256850 - DNA, 20 bp, human
gttcctagcggaagtggcgg

SEQ ID NO: 256851 - DNA, 20 bp, human
gggtcctcagaattggttta

SEQ ID NO: 256852 - DNA, 20 bp, human
ggggacttccggcgtcgggt

SEQ ID NO: 256853 - DNA, 20 bp, human
ggcagcctagtctatcctga

SEQ ID NO: 256854 - DNA, 20 bp, human
ggccatggcaaaagaactcc

SEQ ID NO: 256855 - DNA, 20 bp, human
gggaacttccgggttcctag

SEQ ID NO: 256856 - DNA, 20 bp, human
ggctccgccccttgactccg

SEQ ID NO: 256857 - DNA, 20 bp, human
gtgcgtcgcgacgcgggaag

SEQ ID NO: 256858 - DNA, 20 bp, human
ggcagcgtgcgtcgcgacgc

SEQ ID NO: 256859 - DNA, 20 bp, human
gtaggagcctcggagtcaag

SEQ ID NO: 256860 - DNA, 20 bp, human
gcgagcgcggggtggagtct

SEQ ID NO: 256861 - DNA, 20 bp, human
gaacgtgagacgctccggtg

SEQ ID NO: 256862 - DNA, 20 bp, human
ggagcctcggagtcaagggg

SEQ ID NO: 256863 - DNA, 20 bp, human
gtcgacgcgcaccgccccac

SEQ ID NO: 256864 - DNA, 20 bp, human
gaggccgcggcgctgtagtg

SEQ ID NO: 256865 - DNA, 20 bp, human
ggggcggtgcgcgtcgagcg

SEQ ID NO: 256866 - DNA, 20 bp, human
gggcggagcaggagcgaaaa

SEQ ID NO: 256867 - DNA, 20 bp, human
gaccgagggaggcaggtaga

SEQ ID NO: 256868 - DNA, 20 bp, human
gagaccgacagcaccgaggg

SEQ ID NO: 256869 - DNA, 20 bp, human
gcgcagaccgacagcaccga

SEQ ID NO: 256870 - DNA, 20 bp, human
gggtctgcgcgggcgcgcaa

SEQ ID NO: 256871 - DNA, 20 bp, human
gcaggcggaagtggcgtcag

SEQ ID NO: 256872 - DNA, 20 bp, human
gtgggacgttcaggcggaag

SEQ ID NO: 256873 - DNA, 20 bp, human
gtggcgtcaggggcgcttta

SEQ ID NO: 256874 - DNA, 20 bp, human
gaagggggactgggacgttc

SEQ ID NO: 256875 - DNA, 20 bp, human
gtcaggggcgctttagggac

SEQ ID NO: 256876 - DNA, 20 bp, human
gaatcccacgcccccctgga

SEQ ID NO: 256877 - DNA, 20 bp, human
gcgtggcaggggccggacct

SEQ ID NO: 256878 - DNA, 20 bp, human
gttaaggggcaaggctgcgc

SEQ ID NO: 256879 - DNA, 20 bp, human
gtgcggccgcagccgtccag

SEQ ID NO: 256880 - DNA, 20 bp, human
gcccggccggaaacaggtgg

SEQ ID NO: 256881 - DNA, 20 bp, human
gcggccgcactcgccaccag

SEQ ID NO: 256882 - DNA, 20 bp, human
gtgccccctggtggcgagtg

SEQ ID NO: 256883 - DNA, 20 bp, human
gacgcccccctggacggctg

SEQ ID NO: 256884 - DNA, 20 bp, human
gccttgccccttaaagtcac

SEQ ID NO: 256885 - DNA, 20 bp, human
ggccgggctgtgagagatta

SEQ ID NO: 256886 - DNA, 20 bp, human
gaggcggagtgcagaagcga

SEQ ID NO: 256887 - DNA, 20 bp, human
gagcagctgtcgggcgtcga

SEQ ID NO: 256888 - DNA, 20 bp, human
gtgggagggcgggaagtgcg

SEQ ID NO: 256889 - DNA, 20 bp, human
gaagtgcgcggctaggcgga

SEQ ID NO: 256890 - DNA, 20 bp, human
gcggctaggcggagggccga

SEQ ID NO: 256891 - DNA, 20 bp, human
ggcggagggccgacggcgaa

SEQ ID NO: 256892 - DNA, 20 bp, human
gcgggtcagggtgacctctg

SEQ ID NO: 256893 - DNA, 20 bp, human
gggcacgccaggttcggtga

SEQ ID NO: 256894 - DNA, 20 bp, human
gcgagggaggtctggtggaa

SEQ ID NO: 256895 - DNA, 20 bp, human
gagggcagacaatgccccag

SEQ ID NO: 256896 - DNA, 20 bp, human
gcaaaggaaagaaacatctt

SEQ ID NO: 256897 - DNA, 20 bp, human
gtctctggtgtatctgtcta

SEQ ID NO: 256898 - DNA, 20 bp, human
gcctcctcatctacacgcaa

SEQ ID NO: 256899 - DNA, 20 bp, human
ggaaagaaacatctttggtt

SEQ ID NO: 256900 - DNA, 20 bp, human
ggctctggggaaagtcaaac

SEQ ID NO: 256901 - DNA, 20 bp, human
gagatacaccagagagggtg

SEQ ID NO: 256902 - DNA, 20 bp, human
gccggctcccgggccgcgat

SEQ ID NO: 256903 - DNA, 20 bp, human
gaggcggggcccgcgcatcg

SEQ ID NO: 256904 - DNA, 20 bp, human
gctggagtttccttttgtag

SEQ ID NO: 256905 - DNA, 20 bp, human
ggcacactaaccccaaaggg

SEQ ID NO: 256906 - DNA, 20 bp, human
ggggactccgggaggtgaaa

SEQ ID NO: 256907 - DNA, 20 bp, human
gaagccgggccgacgtcctc

SEQ ID NO: 256908 - DNA, 20 bp, human
gccgggccgacgtcctccgg

SEQ ID NO: 256909 - DNA, 20 bp, human
ggcgcgcgggccccatgaat

SEQ ID NO: 256910 - DNA, 20 bp, human
ggcgcgccgccggaggacgt

SEQ ID NO: 256911 - DNA, 20 bp, human
gagcacacggggttcgtgct

SEQ ID NO: 256912 - DNA, 20 bp, human
gtctgcgttgccgggactcc

SEQ ID NO: 256913 - DNA, 20 bp, human
gggccggcgcctggcaagcc

SEQ ID NO: 256914 - DNA, 20 bp, human
ggtcccggcaacgcagagcg

SEQ ID NO: 256915 - DNA, 20 bp, human
ggctccgcctcccgcagcca

SEQ ID NO: 256916 - DNA, 20 bp, human
gtgtcagagggtgacgtcgg

SEQ ID NO: 256917 - DNA, 20 bp, human
gagtcagtcggcgagcgcgg

SEQ ID NO: 256918 - DNA, 20 bp, human
ggggcggccgctcccatata

SEQ ID NO: 256919 - DNA, 20 bp, human
gtcgccgactgactgcctga

SEQ ID NO: 256920 - DNA, 20 bp, human
gcgggagcggcgctgtcaga

SEQ ID NO: 256921 - DNA, 20 bp, human
gggggctcgcggggctcgcg

SEQ ID NO: 256922 - DNA, 20 bp, human
ggccggctcgcggcgccgtc

SEQ ID NO: 256923 - DNA, 20 bp, human
gaggagccgcggtgcgtggc

SEQ ID NO: 256924 - DNA, 20 bp, human
ggggaaagggtccattcctc

SEQ ID NO: 256925 - DNA, 20 bp, human
gcggtgcctgcgccatatat

SEQ ID NO: 256926 - DNA, 20 bp, human
gggggacgtgacatcatcgg

SEQ ID NO: 256927 - DNA, 20 bp, human
ggccggggacgtgacatcat

SEQ ID NO: 256928 - DNA, 20 bp, human
gggggcggaccctggcgagt

SEQ ID NO: 256929 - DNA, 20 bp, human
gaagacgccggggcttcgtc

SEQ ID NO: 256930 - DNA, 20 bp, human
gccaggcgaccgactcgcca

SEQ ID NO: 256931 - DNA, 20 bp, human
ggacgtgacatcatcggggg

SEQ ID NO: 256932 - DNA, 20 bp, human
gaacccgcgcagggaggatc

SEQ ID NO: 256933 - DNA, 20 bp, human
gggccacggaaacccgcgca

SEQ ID NO: 256934 - DNA, 20 bp, human
gcgagggagcccggcccgag

SEQ ID NO: 256935 - DNA, 20 bp, human
gtgcgcgccccgctgcgctc

SEQ ID NO: 256936 - DNA, 20 bp, human
ggccgctagggagatgaatt

SEQ ID NO: 256937 - DNA, 20 bp, human
gcctgctcggaaggccccga

SEQ ID NO: 256938 - DNA, 20 bp, human
gggggctcgtggggccgcta

SEQ ID NO: 256939 - DNA, 20 bp, human
gacctgaaggaagtcgggga

SEQ ID NO: 256940 - DNA, 20 bp, human
gctcactggtggggctcgtg

SEQ ID NO: 256941 - DNA, 20 bp, human
gcaggtctgactcactggtg

SEQ ID NO: 256942 - DNA, 20 bp, human
gctcggaaggccccgagggt

SEQ ID NO: 256943 - DNA, 20 bp, human
gaaggccccgagggtggggg

SEQ ID NO: 256944 - DNA, 20 bp, human
gggggccttccgagcagggg

SEQ ID NO: 256945 - DNA, 20 bp, human
gagggggcgggccttgaccc

SEQ ID NO: 256946 - DNA, 20 bp, human
gttagtgcagctgcacattt

SEQ ID NO: 256947 - DNA, 20 bp, human
gtggtgttcacagttgacag

SEQ ID NO: 256948 - DNA, 20 bp, human
gctctctataggcatagctc

SEQ ID NO: 256949 - DNA, 20 bp, human
gggttgactcttctctctat

SEQ ID NO: 256950 - DNA, 20 bp, human
gcagttttttagtctagtaa

SEQ ID NO: 256951 - DNA, 20 bp, human
gcaaaaaggctccttattta

SEQ ID NO: 256952 - DNA, 20 bp, human
gattttgtgctcgaaatgag

SEQ ID NO: 256953 - DNA, 20 bp, human
gaaattatgttgtgtaatta

SEQ ID NO: 256954 - DNA, 20 bp, human
gttaagctttcctcgacata

SEQ ID NO: 256955 - DNA, 20 bp, human
gatgattgagtttaaattta

SEQ ID NO: 256956 - DNA, 20 bp, human
ggaacactactggcataagt

SEQ ID NO: 256957 - DNA, 20 bp, human
ggtgtcctggggattataag

SEQ ID NO: 256958 - DNA, 20 bp, human
gttggagaggggaacactac

SEQ ID NO: 256959 - DNA, 20 bp, human
gcctggaaaggcatctagaa

SEQ ID NO: 256960 - DNA, 20 bp, human
gagataattctgttgtgagt

SEQ ID NO: 256961 - DNA, 20 bp, human
ggcatctagaatggcatctc

SEQ ID NO: 256962 - DNA, 20 bp, human
gcttggagatgtgaaaggca

SEQ ID NO: 256963 - DNA, 20 bp, human
gatggcttttctctttatga

SEQ ID NO: 256964 - DNA, 20 bp, human
gagggcataattcccatgtt

SEQ ID NO: 256965 - DNA, 20 bp, human
gcacatctccaagagacatt

SEQ ID NO: 256966 - DNA, 20 bp, human
gtccagaggcgctacctgta

SEQ ID NO: 256967 - DNA, 20 bp, human
gacggcgtttgaaagtgtcc

SEQ ID NO: 256968 - DNA, 20 bp, human
ggaaagtgtccgggttgctt

SEQ ID NO: 256969 - DNA, 20 bp, human
gtgacccagagagaaacgaa

SEQ ID NO: 256970 - DNA, 20 bp, human
gggaggagcaaagggcgggg

SEQ ID NO: 256971 - DNA, 20 bp, human
gcggcggcaaaccatacttc

SEQ ID NO: 256972 - DNA, 20 bp, human
gggttgcttaggatccctac

SEQ ID NO: 256973 - DNA, 20 bp, human
gtccctacaggtagcgcctc

SEQ ID NO: 256974 - DNA, 20 bp, human
gcggaggaggaccccggggg

SEQ ID NO: 256975 - DNA, 20 bp, human
gcaacgacaaaccggaagta

SEQ ID NO: 256976 - DNA, 20 bp, human
gtacaatcctgtctgttaac

SEQ ID NO: 256977 - DNA, 20 bp, human
gggtgcctggcctttagtca

SEQ ID NO: 256978 - DNA, 20 bp, human
gtggtcttaaaacagaatgt

SEQ ID NO: 256979 - DNA, 20 bp, human
ggcactggaattacctgcca

SEQ ID NO: 256980 - DNA, 20 bp, human
gaattacctgccacggtgcc

SEQ ID NO: 256981 - DNA, 20 bp, human
ggttttaagaccatgactaa

SEQ ID NO: 256982 - DNA, 20 bp, human
ggatgcaggagcagcacctg

SEQ ID NO: 256983 - DNA, 20 bp, human
ggtctgttaactggtaaatt

SEQ ID NO: 256984 - DNA, 20 bp, human
gaagaccatgactaaaggcc

SEQ ID NO: 256985 - DNA, 20 bp, human
gttatcatgagaaatgtaaa

SEQ ID NO: 256986 - DNA, 20 bp, human
ggggacgcgccaaggttagt

SEQ ID NO: 256987 - DNA, 20 bp, human
ggtacaaagagagtgtctat

SEQ ID NO: 256988 - DNA, 20 bp, human
gaggggatgagcccgaacta

SEQ ID NO: 256989 - DNA, 20 bp, human
gttcacctgagttaggtttg

SEQ ID NO: 256990 - DNA, 20 bp, human
gtcaaaacggggactcatta

SEQ ID NO: 256991 - DNA, 20 bp, human
gactcgatgcagattggcta

SEQ ID NO: 256992 - DNA, 20 bp, human
gaaaatggcgccacgcgcgg

SEQ ID NO: 256993 - DNA, 20 bp, human
gccaaaacgcccactaacct

SEQ ID NO: 256994 - DNA, 20 bp, human
gtccaccccaaacctaactc

SEQ ID NO: 256995 - DNA, 20 bp, human
gacctgagttaggtttgggg

SEQ ID NO: 256996 - DNA, 20 bp, human
gggccaaggcggtccgggga

SEQ ID NO: 256997 - DNA, 20 bp, human
ggggcggagccggatggcca

SEQ ID NO: 256998 - DNA, 20 bp, human
gcggagccggatggccaagg

SEQ ID NO: 256999 - DNA, 20 bp, human
ggggcacggaatcctcgctc

SEQ ID NO: 257000 - DNA, 20 bp, human
gaaggaggagcggagctgat

SEQ ID NO: 257001 - DNA, 20 bp, human
gggctggccagggtgcgagg

SEQ ID NO: 257002 - DNA, 20 bp, human
gaaagcagggagagaaacga

SEQ ID NO: 257003 - DNA, 20 bp, human
ggattggccaaggcggtccg

SEQ ID NO: 257004 - DNA, 20 bp, human
gcggagctgattggccaagg

SEQ ID NO: 257005 - DNA, 20 bp, human
ggggagagaaacgacggggc

SEQ ID NO: 257006 - DNA, 20 bp, human
ggggccggtaggtggcggga

SEQ ID NO: 257007 - DNA, 20 bp, human
gcggaagtgacgaaggcccc

SEQ ID NO: 257008 - DNA, 20 bp, human
gtccgcccccgcggcaaagc

SEQ ID NO: 257009 - DNA, 20 bp, human
gcctccctgctttgccgcgg

SEQ ID NO: 257010 - DNA, 20 bp, human
gtgctcggagtctaggtgac

SEQ ID NO: 257011 - DNA, 20 bp, human
gggcaggcacgccagggtgg

SEQ ID NO: 257012 - DNA, 20 bp, human
gtaggtgacggggcgagacg

SEQ ID NO: 257013 - DNA, 20 bp, human
ggcgagacggggccggtagg

SEQ ID NO: 257014 - DNA, 20 bp, human
gggccggggcaggcacgcca

SEQ ID NO: 257015 - DNA, 20 bp, human
gtcctcctcagccgcggccg

SEQ ID NO: 257016 - DNA, 20 bp, human
gcgcgcgggcccttaaccct

SEQ ID NO: 257017 - DNA, 20 bp, human
gccagcgcgccaagggttaa

SEQ ID NO: 257018 - DNA, 20 bp, human
gccgactcccagcgcgccaa

SEQ ID NO: 257019 - DNA, 20 bp, human
ggcgcggggagtgcagcctc

SEQ ID NO: 257020 - DNA, 20 bp, human
gtgggtggcgcagccaatca

SEQ ID NO: 257021 - DNA, 20 bp, human
gtgcagcctcaggccgtgat

SEQ ID NO: 257022 - DNA, 20 bp, human
gtcggcgccgagtgccggag

SEQ ID NO: 257023 - DNA, 20 bp, human
ggcgccgagtgccggagggg

SEQ ID NO: 257024 - DNA, 20 bp, human
ggggccaatggcagggcgcg

SEQ ID NO: 257025 - DNA, 20 bp, human
gaagccgcgagctcgcccgc

SEQ ID NO: 257026 - DNA, 20 bp, human
gcgctcttcgaagaatcctc

SEQ ID NO: 257027 - DNA, 20 bp, human
ggtccagaccctgaatcctc

SEQ ID NO: 257028 - DNA, 20 bp, human
gttgagcaactgcaggtggt

SEQ ID NO: 257029 - DNA, 20 bp, human
gagtacagccggaggattca

SEQ ID NO: 257030 - DNA, 20 bp, human
gtgagagcatggcctctcca

SEQ ID NO: 257031 - DNA, 20 bp, human
gagggcgcctccggagttac

SEQ ID NO: 257032 - DNA, 20 bp, human
gacggaaggcaggatgcaga

SEQ ID NO: 257033 - DNA, 20 bp, human
gagccggaggattcagggtc

SEQ ID NO: 257034 - DNA, 20 bp, human
ggccggcccttcagccaata

SEQ ID NO: 257035 - DNA, 20 bp, human
gcaaggtgtcagactcacgt

SEQ ID NO: 257036 - DNA, 20 bp, human
ggggagtggggacactggat

SEQ ID NO: 257037 - DNA, 20 bp, human
gctgccgccccactgccagg

SEQ ID NO: 257038 - DNA, 20 bp, human
gtgtctgccggcacagtccc

SEQ ID NO: 257039 - DNA, 20 bp, human
ggatcggaggggacccttca

SEQ ID NO: 257040 - DNA, 20 bp, human
gcgcgttccgagacgagtga

SEQ ID NO: 257041 - DNA, 20 bp, human
gcgcggagacaggctcccgg

SEQ ID NO: 257042 - DNA, 20 bp, human
gggctgcggtcggggactcc

SEQ ID NO: 257043 - DNA, 20 bp, human
gaccgcccccagcccttcgg

SEQ ID NO: 257044 - DNA, 20 bp, human
gagccgaggactcctccgaa

SEQ ID NO: 257045 - DNA, 20 bp, human
gtcgctgccctcactcgtct

SEQ ID NO: 257046 - DNA, 20 bp, human
gaggccgccatgttgagcga

SEQ ID NO: 257047 - DNA, 20 bp, human
gatagagccaggctcagaaa

SEQ ID NO: 257048 - DNA, 20 bp, human
gactaagggcagtcgatttc

SEQ ID NO: 257049 - DNA, 20 bp, human
gtggctctatgtaaggcaac

SEQ ID NO: 257050 - DNA, 20 bp, human
ggtgccctcgctcaacatgg

SEQ ID NO: 257051 - DNA, 20 bp, human
gaggttcccactggggcaaa

SEQ ID NO: 257052 - DNA, 20 bp, human
ggtaacgtgcccgttagcgg

SEQ ID NO: 257053 - DNA, 20 bp, human
gtctttggccaggttcccac

SEQ ID NO: 257054 - DNA, 20 bp, human
gaacggcgtcattgcctgtc

SEQ ID NO: 257055 - DNA, 20 bp, human
gaccgatgccgcaacctgac

SEQ ID NO: 257056 - DNA, 20 bp, human
gagaaaggaaaggagagcgt

SEQ ID NO: 257057 - DNA, 20 bp, human
gaggagaggacctacaagaa

SEQ ID NO: 257058 - DNA, 20 bp, human
gtggctccctcgtgacacga

SEQ ID NO: 257059 - DNA, 20 bp, human
gcggcaggagcgggatttcc

SEQ ID NO: 257060 - DNA, 20 bp, human
ggggtcacgggaaccggcag

SEQ ID NO: 257061 - DNA, 20 bp, human
gcgagggagcgcgaagcgga

SEQ ID NO: 257062 - DNA, 20 bp, human
ggggaacgggataaagttcc

SEQ ID NO: 257063 - DNA, 20 bp, human
gagaggacctacaagaacgg

SEQ ID NO: 257064 - DNA, 20 bp, human
ggcgctccctcgtgtcacga

SEQ ID NO: 257065 - DNA, 20 bp, human
gggcgcctcgcggcaggagc

SEQ ID NO: 257066 - DNA, 20 bp, human
ggacagggagacttgagcgg

SEQ ID NO: 257067 - DNA, 20 bp, human
gagggagacttgagcggagg

SEQ ID NO: 257068 - DNA, 20 bp, human
gtgtccccgggaggtgcgga

SEQ ID NO: 257069 - DNA, 20 bp, human
gagacttgagcggaggaggt

SEQ ID NO: 257070 - DNA, 20 bp, human
gcctccttccgcacctcccg

SEQ ID NO: 257071 - DNA, 20 bp, human
gcttgagcggaggaggtcgg

SEQ ID NO: 257072 - DNA, 20 bp, human
gttaaaacactgacgctggg

SEQ ID NO: 257073 - DNA, 20 bp, human
gtaggtggagcaattggcga

SEQ ID NO: 257074 - DNA, 20 bp, human
gctcaagtctccctgtcccc

SEQ ID NO: 257075 - DNA, 20 bp, human
gcaagtgtagacacgctcaa

SEQ ID NO: 257076 - DNA, 20 bp, human
gccgcgccccgcacggtgaa

SEQ ID NO: 257077 - DNA, 20 bp, human
ggcggggcgtagtacggact

SEQ ID NO: 257078 - DNA, 20 bp, human
gtttaagcgaggggaggagt

SEQ ID NO: 257079 - DNA, 20 bp, human
ggaaacgccccgagcctgga

SEQ ID NO: 257080 - DNA, 20 bp, human
gctccaggggttgtttgaca

SEQ ID NO: 257081 - DNA, 20 bp, human
gcaggctcggggcgtttccc

SEQ ID NO: 257082 - DNA, 20 bp, human
gtggagggcgagcacgtggg

SEQ ID NO: 257083 - DNA, 20 bp, human
ggccggggcggggcgtagta

SEQ ID NO: 257084 - DNA, 20 bp, human
ggcgcgcattgaaaacctgc

SEQ ID NO: 257085 - DNA, 20 bp, human
ggccgggggcgggcctcgtg

SEQ ID NO: 257086 - DNA, 20 bp, human
ggctgccgctcgcggatcta

SEQ ID NO: 257087 - DNA, 20 bp, human
gtcagcccgggcagagtgag

SEQ ID NO: 257088 - DNA, 20 bp, human
ggtccccgggaccccgccct

SEQ ID NO: 257089 - DNA, 20 bp, human
ggggtcccggggacgcccct

SEQ ID NO: 257090 - DNA, 20 bp, human
gcctccgcgcggtctccccg

SEQ ID NO: 257091 - DNA, 20 bp, human
gccagcgccgcgagaccagg

SEQ ID NO: 257092 - DNA, 20 bp, human
gctcgcggatctaaggccga

SEQ ID NO: 257093 - DNA, 20 bp, human
ggcccgggctgatctcgcga

SEQ ID NO: 257094 - DNA, 20 bp, human
gtctcgcggcgctggcctgt

SEQ ID NO: 257095 - DNA, 20 bp, human
gcgggaccccgccctgggct

SEQ ID NO: 257096 - DNA, 20 bp, human
gtgcccggggtgaagccgga

SEQ ID NO: 257097 - DNA, 20 bp, human
gctggcctacaaggaggcgc

SEQ ID NO: 257098 - DNA, 20 bp, human
gagctcgcggtcacgaacac

SEQ ID NO: 257099 - DNA, 20 bp, human
gggcacctggatctgggcca

SEQ ID NO: 257100 - DNA, 20 bp, human
ggggcagccgcgcgcttccg

SEQ ID NO: 257101 - DNA, 20 bp, human
ggggcccggccgagagctcg

SEQ ID NO: 257102 - DNA, 20 bp, human
gtgggcctgcgcctccttgt

SEQ ID NO: 257103 - DNA, 20 bp, human
gccgccctccggcttcaccc

SEQ ID NO: 257104 - DNA, 20 bp, human
gtgcctgccccggaagcgcg

SEQ ID NO: 257105 - DNA, 20 bp, human
gggggcaggcacctggatct

SEQ ID NO: 257106 - DNA, 20 bp, human
ggggcggggcctaggctccc

SEQ ID NO: 257107 - DNA, 20 bp, human
gccggggcttgggtgcgggg

SEQ ID NO: 257108 - DNA, 20 bp, human
gctagcccgtggcctcctct

SEQ ID NO: 257109 - DNA, 20 bp, human
ggggctagcgatggcgaatg

SEQ ID NO: 257110 - DNA, 20 bp, human
ggggccggggcttgggtgcg

SEQ ID NO: 257111 - DNA, 20 bp, human
gtaactgcgagctggaggcg

SEQ ID NO: 257112 - DNA, 20 bp, human
gggcctagctcggtctgcgg

SEQ ID NO: 257113 - DNA, 20 bp, human
gctggccccgcccatgcccc

SEQ ID NO: 257114 - DNA, 20 bp, human
gggaggccacgggctagcga

SEQ ID NO: 257115 - DNA, 20 bp, human
gtctaggcggttaggagtcg

SEQ ID NO: 257116 - DNA, 20 bp, human
gaaactgaggcacaaactag

SEQ ID NO: 257117 - DNA, 20 bp, human
gagcagctgggactgagtca

SEQ ID NO: 257118 - DNA, 20 bp, human
gaatcctctgaggaggcttc

SEQ ID NO: 257119 - DNA, 20 bp, human
ggagcaggaaacctatccaa

SEQ ID NO: 257120 - DNA, 20 bp, human
gtccagacctcacactggta

SEQ ID NO: 257121 - DNA, 20 bp, human
gctcagaggattgagaagaa

SEQ ID NO: 257122 - DNA, 20 bp, human
gccaaccccagttcatgagt

SEQ ID NO: 257123 - DNA, 20 bp, human
gaaactgattcagagaatcc

SEQ ID NO: 257124 - DNA, 20 bp, human
gactggtaggggagatccct

SEQ ID NO: 257125 - DNA, 20 bp, human
gacagaaggcagcctgtaga

SEQ ID NO: 257126 - DNA, 20 bp, human
gccttggtaaccattttccc

SEQ ID NO: 257127 - DNA, 20 bp, human
gttttccctggttactttct

SEQ ID NO: 257128 - DNA, 20 bp, human
gaatgtgaaagggagctgtg

SEQ ID NO: 257129 - DNA, 20 bp, human
gtgaaaggcatttatcccca

SEQ ID NO: 257130 - DNA, 20 bp, human
gatcagccaagaaagtaacc

SEQ ID NO: 257131 - DNA, 20 bp, human
gttgtgtgtgagatcgaggt

SEQ ID NO: 257132 - DNA, 20 bp, human
ggctaaaggctgtgtatatc

SEQ ID NO: 257133 - DNA, 20 bp, human
gtgatattctcgtcagctaa

SEQ ID NO: 257134 - DNA, 20 bp, human
gagtattgtgtgtgagatcg

SEQ ID NO: 257135 - DNA, 20 bp, human
gttgagctttatcagattat

SEQ ID NO: 257136 - DNA, 20 bp, human
gcctcagaagggaagagaat

SEQ ID NO: 257137 - DNA, 20 bp, human
gtcacatcctcatctggaca

SEQ ID NO: 257138 - DNA, 20 bp, human
ggggagtgctggggcgggat

SEQ ID NO: 257139 - DNA, 20 bp, human
gacctgatggaccctcagaa

SEQ ID NO: 257140 - DNA, 20 bp, human
gggcttccaggctgaatcat

SEQ ID NO: 257141 - DNA, 20 bp, human
ggggagcatgggtgactggt

SEQ ID NO: 257142 - DNA, 20 bp, human
gagagagggagtgctggggc

SEQ ID NO: 257143 - DNA, 20 bp, human
gatggttggtcattgtgcat

SEQ ID NO: 257144 - DNA, 20 bp, human
gacattgggaccagctccag

SEQ ID NO: 257145 - DNA, 20 bp, human
ggtggagaattcagggtcca

SEQ ID NO: 257146 - DNA, 20 bp, human
gcccgcccacaacgcgaggt

SEQ ID NO: 257147 - DNA, 20 bp, human
gccaggcccagcctctaatg

SEQ ID NO: 257148 - DNA, 20 bp, human
ggggccaataggaaggcgga

SEQ ID NO: 257149 - DNA, 20 bp, human
gaaccttgaaatggcccggg

SEQ ID NO: 257150 - DNA, 20 bp, human
gggcctggctcgttatgagg

SEQ ID NO: 257151 - DNA, 20 bp, human
ggcaagacgcactccagacc

SEQ ID NO: 257152 - DNA, 20 bp, human
ggcgaggtgggccaatagga

SEQ ID NO: 257153 - DNA, 20 bp, human
gagcctcccgggccatttca

SEQ ID NO: 257154 - DNA, 20 bp, human
ggggaaccttgaaatggccc

SEQ ID NO: 257155 - DNA, 20 bp, human
gtaggaaggcggaaggatct

SEQ ID NO: 257156 - DNA, 20 bp, human
gtcccgacgcccgagtcgtt

SEQ ID NO: 257157 - DNA, 20 bp, human
gtctccagaggggcggtgat

SEQ ID NO: 257158 - DNA, 20 bp, human
gcaaataagcccaacgactc

SEQ ID NO: 257159 - DNA, 20 bp, human
gccggcaggcgccgcttgat

SEQ ID NO: 257160 - DNA, 20 bp, human
gcataggcaggagtctccag

SEQ ID NO: 257161 - DNA, 20 bp, human
ggtcgacgctctccaagtcc

SEQ ID NO: 257162 - DNA, 20 bp, human
gacgctctccaagtcccggc

SEQ ID NO: 257163 - DNA, 20 bp, human
gagcccaacgactcgggcgt

SEQ ID NO: 257164 - DNA, 20 bp, human
ggcagagaagtgcccggatg

SEQ ID NO: 257165 - DNA, 20 bp, human
gacacgcacaaccaatcaag

SEQ ID NO: 257166 - DNA, 20 bp, human
ggtgggagaaagcttccgtg

SEQ ID NO: 257167 - DNA, 20 bp, human
gcccaccgcaagctccctgg

SEQ ID NO: 257168 - DNA, 20 bp, human
gagccaccgcccttctcttg

SEQ ID NO: 257169 - DNA, 20 bp, human
ggtgccagacccaaggccgt

SEQ ID NO: 257170 - DNA, 20 bp, human
gagcttccgtggggtcccgt

SEQ ID NO: 257171 - DNA, 20 bp, human
ggagacgtgccgcgacccac

SEQ ID NO: 257172 - DNA, 20 bp, human
ggcggtggctcgcacggcgc

SEQ ID NO: 257173 - DNA, 20 bp, human
gcctagctggcctcaagaga

SEQ ID NO: 257174 - DNA, 20 bp, human
ggtggctcgcacggcgcggg

SEQ ID NO: 257175 - DNA, 20 bp, human
gagaagggcggtggctcgca

SEQ ID NO: 257176 - DNA, 20 bp, human
ggcgccagtacggggaggaa

SEQ ID NO: 257177 - DNA, 20 bp, human
gggcccggctggaacggcac

SEQ ID NO: 257178 - DNA, 20 bp, human
gcggcccgccgagggaatga

SEQ ID NO: 257179 - DNA, 20 bp, human
gcgtcccggcagccgcttga

SEQ ID NO: 257180 - DNA, 20 bp, human
gcggctggaacggcacgggg

SEQ ID NO: 257181 - DNA, 20 bp, human
ggcgctatagggttaaactg

SEQ ID NO: 257182 - DNA, 20 bp, human
ggcggggcgccaaggcttgg

SEQ ID NO: 257183 - DNA, 20 bp, human
ggcttggcggccccgtggtt

SEQ ID NO: 257184 - DNA, 20 bp, human
ggggaggctcggcccgccga

SEQ ID NO: 257185 - DNA, 20 bp, human
gctgccgggacgcccaacca

SEQ ID NO: 257186 - DNA, 20 bp, human
gtaagcttaccgtgaaagga

SEQ ID NO: 257187 - DNA, 20 bp, human
gttaccgtgaaaggagggtt

SEQ ID NO: 257188 - DNA, 20 bp, human
ggatgggcgggtctgagggg

SEQ ID NO: 257189 - DNA, 20 bp, human
gtgagtgtgtatgcaggctg

SEQ ID NO: 257190 - DNA, 20 bp, human
gtgctctaggaacttcacgg

SEQ ID NO: 257191 - DNA, 20 bp, human
gaacttcacgggggcggaag

SEQ ID NO: 257192 - DNA, 20 bp, human
gaggggcgcggggtgaaggg

SEQ ID NO: 257193 - DNA, 20 bp, human
ggctgatgggcgggtctgag

SEQ ID NO: 257194 - DNA, 20 bp, human
gagctgctctaggaacttca

SEQ ID NO: 257195 - DNA, 20 bp, human
ggggctgttgttgctacacg

SEQ ID NO: 257196 - DNA, 20 bp, human
gtgccccttaagagatctgt

SEQ ID NO: 257197 - DNA, 20 bp, human
gcaggtgtgccagggaccta

SEQ ID NO: 257198 - DNA, 20 bp, human
gctcttaaggggcagacggc

SEQ ID NO: 257199 - DNA, 20 bp, human
gcggtcaaggaagagttccc

SEQ ID NO: 257200 - DNA, 20 bp, human
gttagcactcccacgcctaa

SEQ ID NO: 257201 - DNA, 20 bp, human
ggctgggagagacctctaga

SEQ ID NO: 257202 - DNA, 20 bp, human
gaaccctgagggatgtgcgg

SEQ ID NO: 257203 - DNA, 20 bp, human
ggaaggaccccccactgaga

SEQ ID NO: 257204 - DNA, 20 bp, human
gtatcagagcctttaggcgt

SEQ ID NO: 257205 - DNA, 20 bp, human
gctggtggctcaaaccctga

SEQ ID NO: 257206 - DNA, 20 bp, human
gtatagcaatgcttgaggtt

SEQ ID NO: 257207 - DNA, 20 bp, human
gctctggggaatttgtaggt

SEQ ID NO: 257208 - DNA, 20 bp, human
ggatggaattattctgacgt

SEQ ID NO: 257209 - DNA, 20 bp, human
gtatccgaaggcagaccaag

SEQ ID NO: 257210 - DNA, 20 bp, human
gggtctgccttcggatagga

SEQ ID NO: 257211 - DNA, 20 bp, human
ggggaggataaacttcctct

SEQ ID NO: 257212 - DNA, 20 bp, human
gaatttggaggtttggtttg

SEQ ID NO: 257213 - DNA, 20 bp, human
gtattctgacgttggccgtc

SEQ ID NO: 257214 - DNA, 20 bp, human
gggggatcgttgcaattcat

SEQ ID NO: 257215 - DNA, 20 bp, human
gagctttatagcaatgcttg

SEQ ID NO: 257216 - DNA, 20 bp, human
ggggacgcccgggacactcg

SEQ ID NO: 257217 - DNA, 20 bp, human
gccccgctaggacccgccca

SEQ ID NO: 257218 - DNA, 20 bp, human
gccccctgggcgggtcctag

SEQ ID NO: 257219 - DNA, 20 bp, human
gactccccttacacaggcct

SEQ ID NO: 257220 - DNA, 20 bp, human
ggcggggccccgagtgtccc

SEQ ID NO: 257221 - DNA, 20 bp, human
gcagcccaggcctgtgtaag

SEQ ID NO: 257222 - DNA, 20 bp, human
gtcagctgagggcgtgagta

SEQ ID NO: 257223 - DNA, 20 bp, human
gagccggggtgccgcgaccc

SEQ ID NO: 257224 - DNA, 20 bp, human
gccggtacccacgtccccct

SEQ ID NO: 257225 - DNA, 20 bp, human
ggctcgcagtctgtcccggg

SEQ ID NO: 257226 - DNA, 20 bp, human
gtggcgctggggtaacagga

SEQ ID NO: 257227 - DNA, 20 bp, human
gggcccaggcatcgaggctg

SEQ ID NO: 257228 - DNA, 20 bp, human
gggacataagtaagcgtgga

SEQ ID NO: 257229 - DNA, 20 bp, human
ggccggaagtgacctcacgg

SEQ ID NO: 257230 - DNA, 20 bp, human
gatcgaggctggggagtcgt

SEQ ID NO: 257231 - DNA, 20 bp, human
gctggagcggaggactttca

SEQ ID NO: 257232 - DNA, 20 bp, human
gcgattggcgctggggtaac

SEQ ID NO: 257233 - DNA, 20 bp, human
gggcgtcttggctggaatcg

SEQ ID NO: 257234 - DNA, 20 bp, human
gaatccagggccgtcaattg

SEQ ID NO: 257235 - DNA, 20 bp, human
ggccaatcgcagagctggag

SEQ ID NO: 257236 - DNA, 20 bp, human
gaggtcaggaaagtcccacg

SEQ ID NO: 257237 - DNA, 20 bp, human
gcccctgtgtccgcgaggtc

SEQ ID NO: 257238 - DNA, 20 bp, human
ggaccccgtcccaggaccat

SEQ ID NO: 257239 - DNA, 20 bp, human
gtgccagggccggagaagaa

SEQ ID NO: 257240 - DNA, 20 bp, human
gcgcagccagtccccctcgg

SEQ ID NO: 257241 - DNA, 20 bp, human
gccccgcccctgtgtccgcg

SEQ ID NO: 257242 - DNA, 20 bp, human
gtcctgacctcgcggacaca

SEQ ID NO: 257243 - DNA, 20 bp, human
gagaagaaaggttccgggct

SEQ ID NO: 257244 - DNA, 20 bp, human
ggctaagttgaccccgtccc

SEQ ID NO: 257245 - DNA, 20 bp, human
gaggctcccggaacctgcca

SEQ ID NO: 257246 - DNA, 20 bp, human
gaaacagtagcctcgagcaa

SEQ ID NO: 257247 - DNA, 20 bp, human
ggagagcagagctaagtctc

SEQ ID NO: 257248 - DNA, 20 bp, human
gcctaggtgaccccagaaaa

SEQ ID NO: 257249 - DNA, 20 bp, human
ggttccagatgaaacgatac

SEQ ID NO: 257250 - DNA, 20 bp, human
gaaaatgattgcaagaccct

SEQ ID NO: 257251 - DNA, 20 bp, human
gagctgattggtagccgagg

SEQ ID NO: 257252 - DNA, 20 bp, human
ggggttatgctatgttacat

SEQ ID NO: 257253 - DNA, 20 bp, human
ggtccctgtatcgtttcatc

SEQ ID NO: 257254 - DNA, 20 bp, human
gtgcaatcattttgtaccca

SEQ ID NO: 257255 - DNA, 20 bp, human
gctgttccccatcaccacct

SEQ ID NO: 257256 - DNA, 20 bp, human
gagtgaggtgaccccagaaa

SEQ ID NO: 257257 - DNA, 20 bp, human
gagtgcaagaccctagagtg

SEQ ID NO: 257258 - DNA, 20 bp, human
gctggggtcacctcactcta

SEQ ID NO: 257259 - DNA, 20 bp, human
gaacatcaaaggctgactcc

SEQ ID NO: 257260 - DNA, 20 bp, human
gcagtagacaacgagagacc

SEQ ID NO: 257261 - DNA, 20 bp, human
ggttcctgtatcttctcatc

SEQ ID NO: 257262 - DNA, 20 bp, human
gtggccagatagttatgatt

SEQ ID NO: 257263 - DNA, 20 bp, human
gtcgatgaaacgagtcagct

SEQ ID NO: 257264 - DNA, 20 bp, human
gctacctaatcataactatc

SEQ ID NO: 257265 - DNA, 20 bp, human
gaaagagtatctagtgaaac

SEQ ID NO: 257266 - DNA, 20 bp, human
gcacgtctgtgtccagcgtc

SEQ ID NO: 257267 - DNA, 20 bp, human
ggtcctggcggcctactgcg

SEQ ID NO: 257268 - DNA, 20 bp, human
gcccaggccgggccaatccc

SEQ ID NO: 257269 - DNA, 20 bp, human
gcggcccgccggagagcctg

SEQ ID NO: 257270 - DNA, 20 bp, human
gccactgggcgggcgaccgt

SEQ ID NO: 257271 - DNA, 20 bp, human
gcagtggcccgggattggcc

SEQ ID NO: 257272 - DNA, 20 bp, human
ggggctacggaccgcccagg

SEQ ID NO: 257273 - DNA, 20 bp, human
gtggctggaagttccctcgc

SEQ ID NO: 257274 - DNA, 20 bp, human
ggagccgcgccggcccgcga

SEQ ID NO: 257275 - DNA, 20 bp, human
ggggcggtccgtagcccgat

SEQ ID NO: 257276 - DNA, 20 bp, human
gtacatccgaagttgctctt

SEQ ID NO: 257277 - DNA, 20 bp, human
gacaagcccctgaatgcaat

SEQ ID NO: 257278 - DNA, 20 bp, human
gcattcaggggcttgtagtc

SEQ ID NO: 257279 - DNA, 20 bp, human
gcttgtagtccggaagtgag

SEQ ID NO: 257280 - DNA, 20 bp, human
gcgctgcccattgcattcag

SEQ ID NO: 257281 - DNA, 20 bp, human
gcgcggccgaagagcaactt

SEQ ID NO: 257282 - DNA, 20 bp, human
gtgcaatgggcagcgaaacg

SEQ ID NO: 257283 - DNA, 20 bp, human
gaacttcggatgtacggttt

SEQ ID NO: 257284 - DNA, 20 bp, human
ggaaatcagcctctcacttc

SEQ ID NO: 257285 - DNA, 20 bp, human
ggcgcagtggcgcggattcc

SEQ ID NO: 257286 - DNA, 20 bp, human
gggccaggagaagtgagacg

SEQ ID NO: 257287 - DNA, 20 bp, human
gggaccaatggagacctcat

SEQ ID NO: 257288 - DNA, 20 bp, human
gaggcgctccgggatactga

SEQ ID NO: 257289 - DNA, 20 bp, human
gggaagaagcagtgcacact

SEQ ID NO: 257290 - DNA, 20 bp, human
gtctcccatgaggtctccat

SEQ ID NO: 257291 - DNA, 20 bp, human
gcggcgactggagagggcat

SEQ ID NO: 257292 - DNA, 20 bp, human
gactggagagggcattggcc

SEQ ID NO: 257293 - DNA, 20 bp, human
ggtggacaaaaggcgggact

SEQ ID NO: 257294 - DNA, 20 bp, human
ggggcaactccgcgggtcgg

SEQ ID NO: 257295 - DNA, 20 bp, human
gcaactccgcgggtcggagg

SEQ ID NO: 257296 - DNA, 20 bp, human
ggacgtagggaaggcgacgt

SEQ ID NO: 257297 - DNA, 20 bp, human
gggcgccggcgacgtaggga

SEQ ID NO: 257298 - DNA, 20 bp, human
ggccgggcgccggcgacgta

SEQ ID NO: 257299 - DNA, 20 bp, human
gtcggcgttcggctcgtctg

SEQ ID NO: 257300 - DNA, 20 bp, human
ggtcgccttccctacgtcgc

SEQ ID NO: 257301 - DNA, 20 bp, human
gggacgtcgtggccgggcgc

SEQ ID NO: 257302 - DNA, 20 bp, human
gcgaggcgcggtagccgctg

SEQ ID NO: 257303 - DNA, 20 bp, human
gaaagcggggaggtgccgag

SEQ ID NO: 257304 - DNA, 20 bp, human
gctcggggccattcggcgtt

SEQ ID NO: 257305 - DNA, 20 bp, human
gcccgctttcggcgtcccat

SEQ ID NO: 257306 - DNA, 20 bp, human
gggtgctaggtgctagggtg

SEQ ID NO: 257307 - DNA, 20 bp, human
gtagcagaaggagctgaaag

SEQ ID NO: 257308 - DNA, 20 bp, human
gacccggggagtgaataaca

SEQ ID NO: 257309 - DNA, 20 bp, human
gagtggggagcgcgcctgcc

SEQ ID NO: 257310 - DNA, 20 bp, human
gcgccctgttattcactccc

SEQ ID NO: 257311 - DNA, 20 bp, human
gggcaatgcaggaacttcag

SEQ ID NO: 257312 - DNA, 20 bp, human
ggcgcactgtgtacaaacag

SEQ ID NO: 257313 - DNA, 20 bp, human
gtgagctggaggggagcgag

SEQ ID NO: 257314 - DNA, 20 bp, human
gtctccagcatgtgcggaga

SEQ ID NO: 257315 - DNA, 20 bp, human
gcactgtgtacaaacagagg

SEQ ID NO: 257316 - DNA, 20 bp, human
gtctggggctggaataaagt

SEQ ID NO: 257317 - DNA, 20 bp, human
gccgccgtctgacaattcgg

SEQ ID NO: 257318 - DNA, 20 bp, human
gtgcagccggagataaggcc

SEQ ID NO: 257319 - DNA, 20 bp, human
gagtagtggggcagtgacga

SEQ ID NO: 257320 - DNA, 20 bp, human
ggcacgggcaggtttagcaa

SEQ ID NO: 257321 - DNA, 20 bp, human
gctgcccccgaattgtcaga

SEQ ID NO: 257322 - DNA, 20 bp, human
gcaacgtgcagccggagata

SEQ ID NO: 257323 - DNA, 20 bp, human
gggggctggcagcttgcaaa

SEQ ID NO: 257324 - DNA, 20 bp, human
gtcgggcctggccttatctc

SEQ ID NO: 257325 - DNA, 20 bp, human
gcgcccgccgtctgacaatt

SEQ ID NO: 257326 - DNA, 20 bp, human
gacccagcctctgcagtgaa

SEQ ID NO: 257327 - DNA, 20 bp, human
ggctccctggcagtccccag

SEQ ID NO: 257328 - DNA, 20 bp, human
gaagtccagctggactgcga

SEQ ID NO: 257329 - DNA, 20 bp, human
gtggactgcgaggggcccct

SEQ ID NO: 257330 - DNA, 20 bp, human
gctctgcagtgaagggggga

SEQ ID NO: 257331 - DNA, 20 bp, human
gtcccagcccgccggtgcag

SEQ ID NO: 257332 - DNA, 20 bp, human
gctgtgcctggagcacctct

SEQ ID NO: 257333 - DNA, 20 bp, human
ggcagccgccaacagagtga

SEQ ID NO: 257334 - DNA, 20 bp, human
gccctccctcactctgttgg

SEQ ID NO: 257335 - DNA, 20 bp, human
gcagccctgccccgctgcac

SEQ ID NO: 257336 - DNA, 20 bp, human
gacagctgccagctgccgga

SEQ ID NO: 257337 - DNA, 20 bp, human
gggcgcacccaggacagcga

SEQ ID NO: 257338 - DNA, 20 bp, human
ggcactgggggtcgcctccc

SEQ ID NO: 257339 - DNA, 20 bp, human
gggtcgcctcccaggcgctg

SEQ ID NO: 257340 - DNA, 20 bp, human
gtggcgtggcgcggctgggt

SEQ ID NO: 257341 - DNA, 20 bp, human
gcaaggggaaggtgtcactc

SEQ ID NO: 257342 - DNA, 20 bp, human
ggggggctgctactccggag

SEQ ID NO: 257343 - DNA, 20 bp, human
gtcgccgggcctttgaaccc

SEQ ID NO: 257344 - DNA, 20 bp, human
gggcaagcaggctcttcaag

SEQ ID NO: 257345 - DNA, 20 bp, human
gtgttcttgctcttggatgg

SEQ ID NO: 257346 - DNA, 20 bp, human
gcgctcttgcggtcccagag

SEQ ID NO: 257347 - DNA, 20 bp, human
ggcgtcccaggatagctgga

SEQ ID NO: 257348 - DNA, 20 bp, human
gctaaccttccagctatcct

SEQ ID NO: 257349 - DNA, 20 bp, human
gaaagctgccgcccccttcc

SEQ ID NO: 257350 - DNA, 20 bp, human
ggaacccatcctcttagtgc

SEQ ID NO: 257351 - DNA, 20 bp, human
ggcagctttgtgctttttag

SEQ ID NO: 257352 - DNA, 20 bp, human
gttgcggtcccagagtggag

SEQ ID NO: 257353 - DNA, 20 bp, human
gggagctttgggaggagacg

SEQ ID NO: 257354 - DNA, 20 bp, human
gcttcctgaaagaaaaggtg

SEQ ID NO: 257355 - DNA, 20 bp, human
gctgcctgcactaagaggat

SEQ ID NO: 257356 - DNA, 20 bp, human
ggatgaaagccgctactccc

SEQ ID NO: 257357 - DNA, 20 bp, human
gaaagccgctactccctggc

SEQ ID NO: 257358 - DNA, 20 bp, human
ggaactcgaaagactcctcc

SEQ ID NO: 257359 - DNA, 20 bp, human
gttctggaaggggtgtgcca

SEQ ID NO: 257360 - DNA, 20 bp, human
gcgtgggaaccgcggaatta

SEQ ID NO: 257361 - DNA, 20 bp, human
ggccagggagggaatgatgg

SEQ ID NO: 257362 - DNA, 20 bp, human
gagggaatgatgggggtccc

SEQ ID NO: 257363 - DNA, 20 bp, human
gtctaggtgccttaattccg

SEQ ID NO: 257364 - DNA, 20 bp, human
gagtctttcgagttcaatcg

SEQ ID NO: 257365 - DNA, 20 bp, human
gacccctcctggccacgcgg

SEQ ID NO: 257366 - DNA, 20 bp, human
ggaagcggtggcaacgtggg

SEQ ID NO: 257367 - DNA, 20 bp, human
gcgcgggcgcggccctctga

SEQ ID NO: 257368 - DNA, 20 bp, human
gcggctgcgtgacagacagg

SEQ ID NO: 257369 - DNA, 20 bp, human
gcccgcgaatggacaggcga

SEQ ID NO: 257370 - DNA, 20 bp, human
gaccgcttccgattggtcgc

SEQ ID NO: 257371 - DNA, 20 bp, human
gccgcctcccgcgaatggac

SEQ ID NO: 257372 - DNA, 20 bp, human
gcggccctctgacggagccc

SEQ ID NO: 257373 - DNA, 20 bp, human
ggggcggctgcgtgacagac

SEQ ID NO: 257374 - DNA, 20 bp, human
gcagccccgcctcccgcgaa

SEQ ID NO: 257375 - DNA, 20 bp, human
gctgtcgccgcagcttcttc

SEQ ID NO: 257376 - DNA, 20 bp, human
ggctagggagcgaaagtctg

SEQ ID NO: 257377 - DNA, 20 bp, human
ggcagcgggtcggagatcga

SEQ ID NO: 257378 - DNA, 20 bp, human
gtacccgtcaggggatgcgc

SEQ ID NO: 257379 - DNA, 20 bp, human
gcgcctgcgcatcccctgac

SEQ ID NO: 257380 - DNA, 20 bp, human
ggagaattcaaacagaggag

SEQ ID NO: 257381 - DNA, 20 bp, human
gccagcgcaagagtacgcca

SEQ ID NO: 257382 - DNA, 20 bp, human
gggtcggagatcgaaggaac

SEQ ID NO: 257383 - DNA, 20 bp, human
ggcttcccccatctggcgaa

SEQ ID NO: 257384 - DNA, 20 bp, human
ggctacaccaccaatgtccc

SEQ ID NO: 257385 - DNA, 20 bp, human
ggatctccgacccgctgcta

SEQ ID NO: 257386 - DNA, 20 bp, human
gaggtggcgcggggtaaact

SEQ ID NO: 257387 - DNA, 20 bp, human
gaagagcatgcgtgaggctc

SEQ ID NO: 257388 - DNA, 20 bp, human
gccacagtccccgagaagtt

SEQ ID NO: 257389 - DNA, 20 bp, human
gccctccccccaacttctcg

SEQ ID NO: 257390 - DNA, 20 bp, human
ggtggagaagagcatgcgtg

SEQ ID NO: 257391 - DNA, 20 bp, human
gaggctccggtgcccgtcag

SEQ ID NO: 257392 - DNA, 20 bp, human
ggaggggtcggcaattgaac

SEQ ID NO: 257393 - DNA, 20 bp, human
ggtgcgctctgcccactgac

SEQ ID NO: 257394 - DNA, 20 bp, human
gcccgctctcgtcatcactg

SEQ ID NO: 257395 - DNA, 20 bp, human
gaaccggtgcctagagaagg

SEQ ID NO: 257396 - DNA, 20 bp, human
gctcccgcgcggttccgcat

SEQ ID NO: 257397 - DNA, 20 bp, human
ggaggcgcgggctgcaaaga

SEQ ID NO: 257398 - DNA, 20 bp, human
ggggctgcaaagacggacgc

SEQ ID NO: 257399 - DNA, 20 bp, human
ggggcaggcacgtgaggaca

SEQ ID NO: 257400 - DNA, 20 bp, human
gcaaagacggacgcgggagg

SEQ ID NO: 257401 - DNA, 20 bp, human
gctgcaaagacggacgcggg

SEQ ID NO: 257402 - DNA, 20 bp, human
gcgggcgccacggggacgcg

SEQ ID NO: 257403 - DNA, 20 bp, human
ggccctgcagcacgccaatg

SEQ ID NO: 257404 - DNA, 20 bp, human
gcgccaatgcggaaccgcgc

SEQ ID NO: 257405 - DNA, 20 bp, human
gcggggacgcgaggcgatgc

SEQ ID NO: 257406 - DNA, 20 bp, human
gaggctggggccacttccgg

SEQ ID NO: 257407 - DNA, 20 bp, human
ggtcatctccggcgcttcta

SEQ ID NO: 257408 - DNA, 20 bp, human
gcacggctcccgaagatgac

SEQ ID NO: 257409 - DNA, 20 bp, human
gggaacgctgtcacgaatgt

SEQ ID NO: 257410 - DNA, 20 bp, human
gcgaccagagggcggagctg

SEQ ID NO: 257411 - DNA, 20 bp, human
ggctggttcccgtcatcttc

SEQ ID NO: 257412 - DNA, 20 bp, human
gcctcgaggccgggcgtctt

SEQ ID NO: 257413 - DNA, 20 bp, human
ggcgccggaccgaaggttaa

SEQ ID NO: 257414 - DNA, 20 bp, human
ggacgcccggcctcgaggct

SEQ ID NO: 257415 - DNA, 20 bp, human
gggaagtggccccagcctcg

SEQ ID NO: 257416 - DNA, 20 bp, human
gcctccgcggtcatctccaa

SEQ ID NO: 257417 - DNA, 20 bp, human
gtggccgcgaagcgcagggg

SEQ ID NO: 257418 - DNA, 20 bp, human
gccgtgccccgacacttcaa

SEQ ID NO: 257419 - DNA, 20 bp, human
gcccccaccggcgacaccac

SEQ ID NO: 257420 - DNA, 20 bp, human
gtcggggcacggcgcgtcga

SEQ ID NO: 257421 - DNA, 20 bp, human
gtcgcggccagtggtgtcgc

SEQ ID NO: 257422 - DNA, 20 bp, human
gcacaagtgctgggaacggg

SEQ ID NO: 257423 - DNA, 20 bp, human
ggcccccggcccgtggctct

SEQ ID NO: 257424 - DNA, 20 bp, human
gccaggcggggcgtgtgcaa

SEQ ID NO: 257425 - DNA, 20 bp, human
gcactggccgcgaagcgcag

SEQ ID NO: 257426 - DNA, 20 bp, human
gtgagggcggggtgtgagac

SEQ ID NO: 257427 - DNA, 20 bp, human
ggcgattggctgaacggaag

SEQ ID NO: 257428 - DNA, 20 bp, human
gagagcgcgcgccaaagcac

SEQ ID NO: 257429 - DNA, 20 bp, human
gtggctgaacggaaggggcg

SEQ ID NO: 257430 - DNA, 20 bp, human
gaggagctacggccggaaga

SEQ ID NO: 257431 - DNA, 20 bp, human
gggctgcagtagactggatc

SEQ ID NO: 257432 - DNA, 20 bp, human
gggccccgcctcctgtgctt

SEQ ID NO: 257433 - DNA, 20 bp, human
gggaggcggggccggtggaa

SEQ ID NO: 257434 - DNA, 20 bp, human
gcgcgccaaagcacaggagg

SEQ ID NO: 257435 - DNA, 20 bp, human
gcggaggggaagaggtggac

SEQ ID NO: 257436 - DNA, 20 bp, human
gtggaggtagacagcgtgga

SEQ ID NO: 257437 - DNA, 20 bp, human
gtccacgtctagactccgat

SEQ ID NO: 257438 - DNA, 20 bp, human
gacgacagttcggtatccag

SEQ ID NO: 257439 - DNA, 20 bp, human
gtaagccgcccgggagagaa

SEQ ID NO: 257440 - DNA, 20 bp, human
gggccagcgcggaaaaagct

SEQ ID NO: 257441 - DNA, 20 bp, human
gtggaaaagccgcgagttct

SEQ ID NO: 257442 - DNA, 20 bp, human
ggtatccagtggcgctgaat

SEQ ID NO: 257443 - DNA, 20 bp, human
gaactcgcggcttttccagc

SEQ ID NO: 257444 - DNA, 20 bp, human
gggaagttgtgagaacccgc

SEQ ID NO: 257445 - DNA, 20 bp, human
ggcccgagctttttccgcgc

SEQ ID NO: 257446 - DNA, 20 bp, human
gacgccgcgcaagcgcacgg

SEQ ID NO: 257447 - DNA, 20 bp, human
gccggcgccgaatgggttaa

SEQ ID NO: 257448 - DNA, 20 bp, human
gaatagaagctgggcatctc

SEQ ID NO: 257449 - DNA, 20 bp, human
ggggacgccgcgcaagcgca

SEQ ID NO: 257450 - DNA, 20 bp, human
gtgactgcgctgcgaaggcg

SEQ ID NO: 257451 - DNA, 20 bp, human
ggcgctctagaatagaagct

SEQ ID NO: 257452 - DNA, 20 bp, human
gcgccgcgccggcgccgaat

SEQ ID NO: 257453 - DNA, 20 bp, human
gaagctgggcatctcggggg

SEQ ID NO: 257454 - DNA, 20 bp, human
gcgccgaatgggttaacggg

SEQ ID NO: 257455 - DNA, 20 bp, human
gtacccctgggagaagccga

SEQ ID NO: 257456 - DNA, 20 bp, human
gtcacctgggcaagacaagg

SEQ ID NO: 257457 - DNA, 20 bp, human
gcgcgccatcatggacaaga

SEQ ID NO: 257458 - DNA, 20 bp, human
gttggccttcttgtccatga

SEQ ID NO: 257459 - DNA, 20 bp, human
gtaggctggcaagattcggt

SEQ ID NO: 257460 - DNA, 20 bp, human
gtccacgctgacagactccc

SEQ ID NO: 257461 - DNA, 20 bp, human
ggaccagatccgcgccatca

SEQ ID NO: 257462 - DNA, 20 bp, human
gggcgatgacagacatgttg

SEQ ID NO: 257463 - DNA, 20 bp, human
gagccaccccgcaatctcca

SEQ ID NO: 257464 - DNA, 20 bp, human
ggtccatgatggcgcggatc

SEQ ID NO: 257465 - DNA, 20 bp, human
gtggcccggtgacaacgtgg

SEQ ID NO: 257466 - DNA, 20 bp, human
gcagcgagggggcaattcga

SEQ ID NO: 257467 - DNA, 20 bp, human
gagccaggaggcccgctagg

SEQ ID NO: 257468 - DNA, 20 bp, human
gcagccttgagcaggagaac

SEQ ID NO: 257469 - DNA, 20 bp, human
gaggcccgctaggcggctgc

SEQ ID NO: 257470 - DNA, 20 bp, human
ggcgctaaccattgcacctg

SEQ ID NO: 257471 - DNA, 20 bp, human
gtcacgtggccgcccccagg

SEQ ID NO: 257472 - DNA, 20 bp, human
ggcacggcgtggcgctcacg

SEQ ID NO: 257473 - DNA, 20 bp, human
gctcccagccccaggtgcaa

SEQ ID NO: 257474 - DNA, 20 bp, human
gtgtccggttctcctgctca

SEQ ID NO: 257475 - DNA, 20 bp, human
gcggacactgtgtactcagc

SEQ ID NO: 257476 - DNA, 20 bp, human
gccgagcgccgtgctccgag

SEQ ID NO: 257477 - DNA, 20 bp, human
ggcgctgtgcacacccgttc

SEQ ID NO: 257478 - DNA, 20 bp, human
gggaccgcggcgactaccga

SEQ ID NO: 257479 - DNA, 20 bp, human
ggagtgggtggtctaggaac

SEQ ID NO: 257480 - DNA, 20 bp, human
gcccgtgagcctcaggaggg

SEQ ID NO: 257481 - DNA, 20 bp, human
gtcaggagggcggaagcttc

SEQ ID NO: 257482 - DNA, 20 bp, human
ggaagcttccgggccggaac

SEQ ID NO: 257483 - DNA, 20 bp, human
gtgggtggtctaggaactgg

SEQ ID NO: 257484 - DNA, 20 bp, human
gtacgggggggcaacttaac

SEQ ID NO: 257485 - DNA, 20 bp, human
gaacatgggggggcgaaggg

SEQ ID NO: 257486 - DNA, 20 bp, human
ggcggcatcaaggctcaaga

SEQ ID NO: 257487 - DNA, 20 bp, human
gaacccgagagcgcaagggc

SEQ ID NO: 257488 - DNA, 20 bp, human
gggcgtggcctggcacaaat

SEQ ID NO: 257489 - DNA, 20 bp, human
gaggcggggtcatagagtgt

SEQ ID NO: 257490 - DNA, 20 bp, human
gtcctccccgggactcccga

SEQ ID NO: 257491 - DNA, 20 bp, human
ggactcccgagggcacgtgg

SEQ ID NO: 257492 - DNA, 20 bp, human
ggaggaacccgagagcgcaa

SEQ ID NO: 257493 - DNA, 20 bp, human
gccgcgcggcaactcctccc

SEQ ID NO: 257494 - DNA, 20 bp, human
gggcggggccatggaagagg

SEQ ID NO: 257495 - DNA, 20 bp, human
gggaagagggggcggcatca

SEQ ID NO: 257496 - DNA, 20 bp, human
gacagctgggccccgcccat

SEQ ID NO: 257497 - DNA, 20 bp, human
gtcccagctggccgccttga

SEQ ID NO: 257498 - DNA, 20 bp, human
gcagcctgggagccaatccg

SEQ ID NO: 257499 - DNA, 20 bp, human
ggtagctttggctacgtcgc

SEQ ID NO: 257500 - DNA, 20 bp, human
gcagaatacagccctcaagg

SEQ ID NO: 257501 - DNA, 20 bp, human
gacactgcaatcaagcaaag

SEQ ID NO: 257502 - DNA, 20 bp, human
gctaacagacggtgtagcca

SEQ ID NO: 257503 - DNA, 20 bp, human
ggctacgtcgcgggcagcct

SEQ ID NO: 257504 - DNA, 20 bp, human
ggacggtgtagccaaggcaa

SEQ ID NO: 257505 - DNA, 20 bp, human
gcgtgagcgtcacgcctcaa

SEQ ID NO: 257506 - DNA, 20 bp, human
ggggcgcctcactgccaggg

SEQ ID NO: 257507 - DNA, 20 bp, human
gtggagccgccctggcagtg

SEQ ID NO: 257508 - DNA, 20 bp, human
gggctggcaggttgtccaat

SEQ ID NO: 257509 - DNA, 20 bp, human
gaaagcggtggtagctggtt

SEQ ID NO: 257510 - DNA, 20 bp, human
gacgagttaagggacagtca

SEQ ID NO: 257511 - DNA, 20 bp, human
gttaagggacagtcaggggg

SEQ ID NO: 257512 - DNA, 20 bp, human
gcctgcgggattaacgcgag

SEQ ID NO: 257513 - DNA, 20 bp, human
gcgggattaacgcgagtggc

SEQ ID NO: 257514 - DNA, 20 bp, human
gactctggccaatagccctg

SEQ ID NO: 257515 - DNA, 20 bp, human
gagccaggctgggaaagcgg

SEQ ID NO: 257516 - DNA, 20 bp, human
gcagttctgggcttggtgaa

SEQ ID NO: 257517 - DNA, 20 bp, human
gtctgggcttggtgaaaggc

SEQ ID NO: 257518 - DNA, 20 bp, human
gtcgctgcccctcccagaat

SEQ ID NO: 257519 - DNA, 20 bp, human
gtgcttgcgtaggggtaccg

SEQ ID NO: 257520 - DNA, 20 bp, human
gaattggacgaaaacgaggt

SEQ ID NO: 257521 - DNA, 20 bp, human
gccaagcccagaactgggcg

SEQ ID NO: 257522 - DNA, 20 bp, human
ggggccagcaggcgctcggc

SEQ ID NO: 257523 - DNA, 20 bp, human
gccagaattggacgaaaacg

SEQ ID NO: 257524 - DNA, 20 bp, human
gttttcgtccaattctggga

SEQ ID NO: 257525 - DNA, 20 bp, human
gcgccctgccgagcgcctgc

SEQ ID NO: 257526 - DNA, 20 bp, human
gtgcctgccccacctcgtaa

SEQ ID NO: 257527 - DNA, 20 bp, human
gccccggagcccctgggcgg

SEQ ID NO: 257528 - DNA, 20 bp, human
gaccctatcggctgtcgagc

SEQ ID NO: 257529 - DNA, 20 bp, human
gtccgctcggggtggtcggt

SEQ ID NO: 257530 - DNA, 20 bp, human
gggccaccgccaccgcccag

SEQ ID NO: 257531 - DNA, 20 bp, human
gccgcgcggcgcgggatcct

SEQ ID NO: 257532 - DNA, 20 bp, human
gcacaggcccttacgaggtg

SEQ ID NO: 257533 - DNA, 20 bp, human
gcgacagccgatagggtcct

SEQ ID NO: 257534 - DNA, 20 bp, human
gggagaatgaacagcgatta

SEQ ID NO: 257535 - DNA, 20 bp, human
gtgtcgagccggtgctgccg

SEQ ID NO: 257536 - DNA, 20 bp, human
gggggcggggccaccctaat

SEQ ID NO: 257537 - DNA, 20 bp, human
gcacgccggggcgaaagtcg

SEQ ID NO: 257538 - DNA, 20 bp, human
gcggagaggtggggcgttaa

SEQ ID NO: 257539 - DNA, 20 bp, human
ggggtcccacctgccgatta

SEQ ID NO: 257540 - DNA, 20 bp, human
gcggggccaccctaatcggc

SEQ ID NO: 257541 - DNA, 20 bp, human
gcccgcgctccgcaggatgc

SEQ ID NO: 257542 - DNA, 20 bp, human
gcgggcgaccaatgggagtg

SEQ ID NO: 257543 - DNA, 20 bp, human
gaaagtcgtggcggagaggt

SEQ ID NO: 257544 - DNA, 20 bp, human
gcgttaaaggggccctgccc

SEQ ID NO: 257545 - DNA, 20 bp, human
gcaggtcccggaagccctcc

SEQ ID NO: 257546 - DNA, 20 bp, human
ggggccgctctgaatcccgg

SEQ ID NO: 257547 - DNA, 20 bp, human
gcgcgcgtgctgtccccaaa

SEQ ID NO: 257548 - DNA, 20 bp, human
gtctggagggacaaggccgg

SEQ ID NO: 257549 - DNA, 20 bp, human
ggaggggccgctctgaatcc

SEQ ID NO: 257550 - DNA, 20 bp, human
gagggtcgtggcgcgaaacg

SEQ ID NO: 257551 - DNA, 20 bp, human
gggaggaagacccttgggcg

SEQ ID NO: 257552 - DNA, 20 bp, human
gccggagccggacttgtccc

SEQ ID NO: 257553 - DNA, 20 bp, human
gccgctctgaatcccggggg

SEQ ID NO: 257554 - DNA, 20 bp, human
ggtggcgcgaaacggggaca

SEQ ID NO: 257555 - DNA, 20 bp, human
gctccggcctcgggtctgga

SEQ ID NO: 257556 - DNA, 20 bp, human
gataccctcatatacaccaa

SEQ ID NO: 257557 - DNA, 20 bp, human
ggcacccttggtgtatatga

SEQ ID NO: 257558 - DNA, 20 bp, human
gtgagcctgagcagtgaatg

SEQ ID NO: 257559 - DNA, 20 bp, human
gagcaagtgtgttttcagtg

SEQ ID NO: 257560 - DNA, 20 bp, human
ggtgacctcattcactgctc

SEQ ID NO: 257561 - DNA, 20 bp, human
gctgctcaggctcaagccta

SEQ ID NO: 257562 - DNA, 20 bp, human
gaacacacttgctgtaaggt

SEQ ID NO: 257563 - DNA, 20 bp, human
ggtggttcattcagcaccct

SEQ ID NO: 257564 - DNA, 20 bp, human
gtgaggtcacagttgtgtga

SEQ ID NO: 257565 - DNA, 20 bp, human
gctgttggaatttcagggaa

SEQ ID NO: 257566 - DNA, 20 bp, human
ggcccgaggcccacctgact

SEQ ID NO: 257567 - DNA, 20 bp, human
gaggcccaatcccacctcgc

SEQ ID NO: 257568 - DNA, 20 bp, human
ggggtcgcccggtcccccga

SEQ ID NO: 257569 - DNA, 20 bp, human
ggaggtgcgcgctctgtacg

SEQ ID NO: 257570 - DNA, 20 bp, human
gagccggcgcccgccgagtc

SEQ ID NO: 257571 - DNA, 20 bp, human
gcgaggcccacctgactcgg

SEQ ID NO: 257572 - DNA, 20 bp, human
gctgccctgaggccctccat

SEQ ID NO: 257573 - DNA, 20 bp, human
gcacctgactcggcgggcgc

SEQ ID NO: 257574 - DNA, 20 bp, human
gggagggattaattcagaga

SEQ ID NO: 257575 - DNA, 20 bp, human
gctcgctctcgcgccttcgg

SEQ ID NO: 257576 - DNA, 20 bp, human
gcgacctgaggccgccaggg

SEQ ID NO: 257577 - DNA, 20 bp, human
ggaagcccgaccagtcaggc

SEQ ID NO: 257578 - DNA, 20 bp, human
gttagccggcctgactggtc

SEQ ID NO: 257579 - DNA, 20 bp, human
gcccggaagcccgaccagtc

SEQ ID NO: 257580 - DNA, 20 bp, human
ggggcggctgccgacttagc

SEQ ID NO: 257581 - DNA, 20 bp, human
ggcgccaagcggtggggtcc

SEQ ID NO: 257582 - DNA, 20 bp, human
gggcgcgcgcacgtcccgga

SEQ ID NO: 257583 - DNA, 20 bp, human
gggagcctgaatcggggcaa

SEQ ID NO: 257584 - DNA, 20 bp, human
gccagtcaggccggctaagt

SEQ ID NO: 257585 - DNA, 20 bp, human
gacgtgcgcgcgccaagcgg

SEQ ID NO: 257586 - DNA, 20 bp, human
ggctaggtgctcagggtgat

SEQ ID NO: 257587 - DNA, 20 bp, human
gaggaagtgctcaagccata

SEQ ID NO: 257588 - DNA, 20 bp, human
gcaacagagggtaaaagaag

SEQ ID NO: 257589 - DNA, 20 bp, human
gcatgccacaggggatttca

SEQ ID NO: 257590 - DNA, 20 bp, human
gctcgccctgaaatcccctg

SEQ ID NO: 257591 - DNA, 20 bp, human
gaagtgctcaagccataggg

SEQ ID NO: 257592 - DNA, 20 bp, human
ggtgaggagctaggtgctca

SEQ ID NO: 257593 - DNA, 20 bp, human
gcctgtggcatgcctcccta

SEQ ID NO: 257594 - DNA, 20 bp, human
gccctggcgagtacgaagaa

SEQ ID NO: 257595 - DNA, 20 bp, human
gcgtgcgcagtggcgttcgg

SEQ ID NO: 257596 - DNA, 20 bp, human
gcggtcccaccgaactgcat

SEQ ID NO: 257597 - DNA, 20 bp, human
gcggaggcgcgggactgacc

SEQ ID NO: 257598 - DNA, 20 bp, human
gaaacccgctcccatgacac

SEQ ID NO: 257599 - DNA, 20 bp, human
gccccagagaacgggacttc

SEQ ID NO: 257600 - DNA, 20 bp, human
gttcccgctccccagagaac

SEQ ID NO: 257601 - DNA, 20 bp, human
gccctggcgacccgtgtcat

SEQ ID NO: 257602 - DNA, 20 bp, human
gcggccctatgcagttcggt

SEQ ID NO: 257603 - DNA, 20 bp, human
gaaggcgcaggatgcggtag

SEQ ID NO: 257604 - DNA, 20 bp, human
gcgacccgtgtcatgggagc

SEQ ID NO: 257605 - DNA, 20 bp, human
gtacacggccctatgcagtt

SEQ ID NO: 257606 - DNA, 20 bp, human
gtccccgcgacgaaggatcc

SEQ ID NO: 257607 - DNA, 20 bp, human
gcacccggatccttcgtcgc

SEQ ID NO: 257608 - DNA, 20 bp, human
gagcggggagttctaggccc

SEQ ID NO: 257609 - DNA, 20 bp, human
gggagcgagcggggagttct

SEQ ID NO: 257610 - DNA, 20 bp, human
gagcccttctccaaacgatc

SEQ ID NO: 257611 - DNA, 20 bp, human
gtggccagagtagtgagaga

SEQ ID NO: 257612 - DNA, 20 bp, human
gtccgggtgtgcgcgagcaa

SEQ ID NO: 257613 - DNA, 20 bp, human
gtgctcctctatcgcggggg

SEQ ID NO: 257614 - DNA, 20 bp, human
gcctggggaggagataccta

SEQ ID NO: 257615 - DNA, 20 bp, human
ggcgtcaagcccaccgcggc

SEQ ID NO: 257616 - DNA, 20 bp, human
gtggcagacaagttggtgaa

SEQ ID NO: 257617 - DNA, 20 bp, human
gccactgcaatcttggtcca

SEQ ID NO: 257618 - DNA, 20 bp, human
gctaggcctgccctgaagtc

SEQ ID NO: 257619 - DNA, 20 bp, human
ggatgcagccactgcaatct

SEQ ID NO: 257620 - DNA, 20 bp, human
gcttacaaatccagacttca

SEQ ID NO: 257621 - DNA, 20 bp, human
gtaagtcccccatttcaaat

SEQ ID NO: 257622 - DNA, 20 bp, human
gcttctgccccatttgaaat

SEQ ID NO: 257623 - DNA, 20 bp, human
gccagggagaatgttttgtt

SEQ ID NO: 257624 - DNA, 20 bp, human
gctggctccaggacagcgaa

SEQ ID NO: 257625 - DNA, 20 bp, human
gtgcaatttggcagacaagt

SEQ ID NO: 257626 - DNA, 20 bp, human
ggtgaaggtaaacacgtcag

SEQ ID NO: 257627 - DNA, 20 bp, human
gaatgctctgaaaaccactt

SEQ ID NO: 257628 - DNA, 20 bp, human
gtgagatctggcagcagtga

SEQ ID NO: 257629 - DNA, 20 bp, human
gagttctaaaggagatccac

SEQ ID NO: 257630 - DNA, 20 bp, human
gatgagagaatgtgctacat

SEQ ID NO: 257631 - DNA, 20 bp, human
gtctgctgtccgaaacctct

SEQ ID NO: 257632 - DNA, 20 bp, human
gtatctatctatagcatagc

SEQ ID NO: 257633 - DNA, 20 bp, human
gaactgctacacagcccaag

SEQ ID NO: 257634 - DNA, 20 bp, human
gtgcctcagaagtagaatgt

SEQ ID NO: 257635 - DNA, 20 bp, human
gattgtattttagtgacata

SEQ ID NO: 257636 - DNA, 20 bp, human
gacgccccgtgagtgaggag

SEQ ID NO: 257637 - DNA, 20 bp, human
gagtgaggagaggagagcgt

SEQ ID NO: 257638 - DNA, 20 bp, human
gaagagtgacgcttgggtgt

SEQ ID NO: 257639 - DNA, 20 bp, human
gttcccggaaggcctttcga

SEQ ID NO: 257640 - DNA, 20 bp, human
gagggggaagagtgacgctt

SEQ ID NO: 257641 - DNA, 20 bp, human
gctgggcgaggggttggcgc

SEQ ID NO: 257642 - DNA, 20 bp, human
gccccacccccaacagggat

SEQ ID NO: 257643 - DNA, 20 bp, human
gcaggaacgccccgtgagtg

SEQ ID NO: 257644 - DNA, 20 bp, human
gagagtggacggccgggagt

SEQ ID NO: 257645 - DNA, 20 bp, human
gcgggatccgaagcccagga

SEQ ID NO: 257646 - DNA, 20 bp, human
gagtctgggaaacgaggagc

SEQ ID NO: 257647 - DNA, 20 bp, human
gtccgcgccccctgctccag

SEQ ID NO: 257648 - DNA, 20 bp, human
ggagagtgggagcatcccca

SEQ ID NO: 257649 - DNA, 20 bp, human
gaaagagggcccctggagca

SEQ ID NO: 257650 - DNA, 20 bp, human
gcaagcgggggcggcaaaga

SEQ ID NO: 257651 - DNA, 20 bp, human
ggagcccagcgttgcgagcc

SEQ ID NO: 257652 - DNA, 20 bp, human
ggcgctgcgcgctctaccgc

SEQ ID NO: 257653 - DNA, 20 bp, human
ggtggggtccccgcgagtct

SEQ ID NO: 257654 - DNA, 20 bp, human
gcccagcgttgcgagcccgg

SEQ ID NO: 257655 - DNA, 20 bp, human
gggtctgatctggcgaagtc

SEQ ID NO: 257656 - DNA, 20 bp, human
gggggcctgtggctggccgg

SEQ ID NO: 257657 - DNA, 20 bp, human
gccccaggatcgagcactgg

SEQ ID NO: 257658 - DNA, 20 bp, human
ggcccctacccggtcccccg

SEQ ID NO: 257659 - DNA, 20 bp, human
gtgagccagcgccaggggga

SEQ ID NO: 257660 - DNA, 20 bp, human
gtcccccagtgctcgatcct

SEQ ID NO: 257661 - DNA, 20 bp, human
gcgccgcgggggaccgggta

SEQ ID NO: 257662 - DNA, 20 bp, human
gtacccaggacgatctcggg

SEQ ID NO: 257663 - DNA, 20 bp, human
gggctcaggaatccgccgaa

SEQ ID NO: 257664 - DNA, 20 bp, human
gtggccgggggcggagaagc

SEQ ID NO: 257665 - DNA, 20 bp, human
gggctccaggattacggtgt

SEQ ID NO: 257666 - DNA, 20 bp, human
gcaggcggactggcgatgat

SEQ ID NO: 257667 - DNA, 20 bp, human
gcggcaccgggcagcggaag

SEQ ID NO: 257668 - DNA, 20 bp, human
gagccggcggctggccttag

SEQ ID NO: 257669 - DNA, 20 bp, human
ggcagcggaagtggctccgg

SEQ ID NO: 257670 - DNA, 20 bp, human
ggcgtgcagcgacgtggcgg

SEQ ID NO: 257671 - DNA, 20 bp, human
gatgatgggaagtgacgaag

SEQ ID NO: 257672 - DNA, 20 bp, human
ggcgaggaagcggaaggagc

SEQ ID NO: 257673 - DNA, 20 bp, human
ggaaggggcgaggaagcgga

SEQ ID NO: 257674 - DNA, 20 bp, human
gctcccctaaggccagccgc

SEQ ID NO: 257675 - DNA, 20 bp, human
gccgtggtgccgcccctgtc

SEQ ID NO: 257676 - DNA, 20 bp, human
ggggccgcggccttggagcg

SEQ ID NO: 257677 - DNA, 20 bp, human
gctcccggaggatgagacgt

SEQ ID NO: 257678 - DNA, 20 bp, human
ggaggcgcaggcatcacagg

SEQ ID NO: 257679 - DNA, 20 bp, human
gtagccgcgctccaaggccg

SEQ ID NO: 257680 - DNA, 20 bp, human
gcggggcgaagcggaagagg

SEQ ID NO: 257681 - DNA, 20 bp, human
gcccacttaccgcgagaacg

SEQ ID NO: 257682 - DNA, 20 bp, human
ggccttggagcgcggctagt

SEQ ID NO: 257683 - DNA, 20 bp, human
ggggaaaggcgggtgtagcg

SEQ ID NO: 257684 - DNA, 20 bp, human
gctagtgggcgtggttgtgt

SEQ ID NO: 257685 - DNA, 20 bp, human
gcggaactcccacgagcgga

SEQ ID NO: 257686 - DNA, 20 bp, human
gtggcgagaaggatcgtggg

SEQ ID NO: 257687 - DNA, 20 bp, human
gggttggcgagaaggatcgt

SEQ ID NO: 257688 - DNA, 20 bp, human
gcgggaagcggcgtcacgga

SEQ ID NO: 257689 - DNA, 20 bp, human
gcggcgtcacggagggagga

SEQ ID NO: 257690 - DNA, 20 bp, human
gttaaaccagaaagcggcgg

SEQ ID NO: 257691 - DNA, 20 bp, human
ggaagcgggtggaggggaac

SEQ ID NO: 257692 - DNA, 20 bp, human
ggggttaaaccagaaagcgg

SEQ ID NO: 257693 - DNA, 20 bp, human
gtcccgtctccaggcaacgt

SEQ ID NO: 257694 - DNA, 20 bp, human
gggggcgggggacacctccg

SEQ ID NO: 257695 - DNA, 20 bp, human
gagggggttaaaccagaaag

SEQ ID NO: 257696 - DNA, 20 bp, human
gcggagctgcggctttaagg

SEQ ID NO: 257697 - DNA, 20 bp, human
gggaagcaggtcggggtctc

SEQ ID NO: 257698 - DNA, 20 bp, human
gggaggaggccgccggtgtc

SEQ ID NO: 257699 - DNA, 20 bp, human
gcagcgactgccagcctggt

SEQ ID NO: 257700 - DNA, 20 bp, human
gcaaggtcggagttgatccg

SEQ ID NO: 257701 - DNA, 20 bp, human
gtgaccgtccccccgggacc

SEQ ID NO: 257702 - DNA, 20 bp, human
gtacttctgggggacaagaa

SEQ ID NO: 257703 - DNA, 20 bp, human
ggcagacacccagacaccgg

SEQ ID NO: 257704 - DNA, 20 bp, human
gggaggctgaccgtcccccc

SEQ ID NO: 257705 - DNA, 20 bp, human
gcggctttaaggaggcgcca

SEQ ID NO: 257706 - DNA, 20 bp, human
ggcccccgaaggtgggactt

SEQ ID NO: 257707 - DNA, 20 bp, human
ggcccaagtcccaccttcgg

SEQ ID NO: 257708 - DNA, 20 bp, human
ggcctggcccggggagtgtc

SEQ ID NO: 257709 - DNA, 20 bp, human
gtgatcgctcccggccgccg

SEQ ID NO: 257710 - DNA, 20 bp, human
gggctcctcccccgcggctt

SEQ ID NO: 257711 - DNA, 20 bp, human
gaggagcggggcttgccggg

SEQ ID NO: 257712 - DNA, 20 bp, human
ggagtacactcgacccccgg

SEQ ID NO: 257713 - DNA, 20 bp, human
ggctacagtgggcacgaaga

SEQ ID NO: 257714 - DNA, 20 bp, human
gctcccccgcggcttgggtg

SEQ ID NO: 257715 - DNA, 20 bp, human
ggggcagacgacggcgggcg

SEQ ID NO: 257716 - DNA, 20 bp, human
ggcaagcccaccaccgggac

SEQ ID NO: 257717 - DNA, 20 bp, human
gtctctgagcagatctgcgg

SEQ ID NO: 257718 - DNA, 20 bp, human
gaacgcgggcgcccgagcct

SEQ ID NO: 257719 - DNA, 20 bp, human
ggcggcgccggcccaaaagg

SEQ ID NO: 257720 - DNA, 20 bp, human
gcagagtccgggaaggggat

SEQ ID NO: 257721 - DNA, 20 bp, human
gaacgcgggggtgcgggaca

SEQ ID NO: 257722 - DNA, 20 bp, human
gagtgcgagtctgcgaacgc

SEQ ID NO: 257723 - DNA, 20 bp, human
gaggcggagtcgctaggcga

SEQ ID NO: 257724 - DNA, 20 bp, human
gcgggcggcgccggcccaaa

SEQ ID NO: 257725 - DNA, 20 bp, human
gaagcgcagagtccgggaag

SEQ ID NO: 257726 - DNA, 20 bp, human
gcggccgggtcctgcgcccg

SEQ ID NO: 257727 - DNA, 20 bp, human
gcctgcgcccggggcgaccc

SEQ ID NO: 257728 - DNA, 20 bp, human
gtcgccccgggcgcaggacc

SEQ ID NO: 257729 - DNA, 20 bp, human
gccgccgccgcctgacttct

SEQ ID NO: 257730 - DNA, 20 bp, human
gacccggccgcgcggactgt

SEQ ID NO: 257731 - DNA, 20 bp, human
gtcccgcccgagcgtcggga

SEQ ID NO: 257732 - DNA, 20 bp, human
gcgggcgccgagaagtcagg

SEQ ID NO: 257733 - DNA, 20 bp, human
ggccctcccgacgctcgggc

SEQ ID NO: 257734 - DNA, 20 bp, human
gcccgaggtcgcgcgcgcgg

SEQ ID NO: 257735 - DNA, 20 bp, human
gcgcgctccgacagtccgcg

SEQ ID NO: 257736 - DNA, 20 bp, human
ggcgcgctgcggtgcacaga

SEQ ID NO: 257737 - DNA, 20 bp, human
gaggctgcaccgcactgcga

SEQ ID NO: 257738 - DNA, 20 bp, human
gttcgccaaagcttccactg

SEQ ID NO: 257739 - DNA, 20 bp, human
ggcagcctcagtggaagctt

SEQ ID NO: 257740 - DNA, 20 bp, human
gcggtgcacagagggttaac

SEQ ID NO: 257741 - DNA, 20 bp, human
gggaggagacgcgctcccat

SEQ ID NO: 257742 - DNA, 20 bp, human
ggttaactggagttggcgct

SEQ ID NO: 257743 - DNA, 20 bp, human
ggcgaacctggcgcgcgctg

SEQ ID NO: 257744 - DNA, 20 bp, human
gataggggaaagtgaggcgc

SEQ ID NO: 257745 - DNA, 20 bp, human
gggcccccagcccggaacga

SEQ ID NO: 257746 - DNA, 20 bp, human
ggcgcgacgcgtgggaggtg

SEQ ID NO: 257747 - DNA, 20 bp, human
ggacaggccccgtcccgctc

SEQ ID NO: 257748 - DNA, 20 bp, human
ggccccgtcccgctccggtc

SEQ ID NO: 257749 - DNA, 20 bp, human
gtcgggagcgcgcgacgcgt

SEQ ID NO: 257750 - DNA, 20 bp, human
gcgcgcgctcccgaccggag

SEQ ID NO: 257751 - DNA, 20 bp, human
gaactcaagaaggagagacg

SEQ ID NO: 257752 - DNA, 20 bp, human
ggggaccgtactgccccctc

SEQ ID NO: 257753 - DNA, 20 bp, human
ggggaagcccaatcatctct

SEQ ID NO: 257754 - DNA, 20 bp, human
gcacgcgctggtctttcccg

SEQ ID NO: 257755 - DNA, 20 bp, human
gtcccgaccggagcgggacg

SEQ ID NO: 257756 - DNA, 20 bp, human
ggcgcgctgcggtgcacaga

SEQ ID NO: 257757 - DNA, 20 bp, human
gaggctgcaccgcactgcga

SEQ ID NO: 257758 - DNA, 20 bp, human
gttcgccaaagcttccactg

SEQ ID NO: 257759 - DNA, 20 bp, human
ggcagcctcagtggaagctt

SEQ ID NO: 257760 - DNA, 20 bp, human
gcggtgcacagagggttaac

SEQ ID NO: 257761 - DNA, 20 bp, human
ggcgaacctggcgcgcgctg

SEQ ID NO: 257762 - DNA, 20 bp, human
ggttaactggagttggcgct

SEQ ID NO: 257763 - DNA, 20 bp, human
gggaggagacgcgctcccat

SEQ ID NO: 257764 - DNA, 20 bp, human
gataggggaaagtgaggcgc

SEQ ID NO: 257765 - DNA, 20 bp, human
gggcccccagcccggaacga

SEQ ID NO: 257766 - DNA, 20 bp, human
gcggtgcgccgagaagggtg

SEQ ID NO: 257767 - DNA, 20 bp, human
gcgacccccagaaatctcag

SEQ ID NO: 257768 - DNA, 20 bp, human
gtctgggggtcgccccgcta

SEQ ID NO: 257769 - DNA, 20 bp, human
gagggcgacgtgctgataga

SEQ ID NO: 257770 - DNA, 20 bp, human
ggccgcggggagacatacac

SEQ ID NO: 257771 - DNA, 20 bp, human
ggcggcaggccggtcacccc

SEQ ID NO: 257772 - DNA, 20 bp, human
gagccgcaacccagccttgt

SEQ ID NO: 257773 - DNA, 20 bp, human
gttctcctgcagtttcccac

SEQ ID NO: 257774 - DNA, 20 bp, human
gaccgggcggtgcgccgaga

SEQ ID NO: 257775 - DNA, 20 bp, human
gaggccggtcaccccgggag

SEQ ID NO: 257776 - DNA, 20 bp, human
gccaatagcaagctcagtgg

SEQ ID NO: 257777 - DNA, 20 bp, human
gtgtgcggctcgtgcggtta

SEQ ID NO: 257778 - DNA, 20 bp, human
ggggtttcagggagctctta

SEQ ID NO: 257779 - DNA, 20 bp, human
gtagccaatagcaagctcag

SEQ ID NO: 257780 - DNA, 20 bp, human
ggctctgggggcgtggtatg

SEQ ID NO: 257781 - DNA, 20 bp, human
gtctgggaacaggactgaga

SEQ ID NO: 257782 - DNA, 20 bp, human
gagctcaacccgtgggaagt

SEQ ID NO: 257783 - DNA, 20 bp, human
gaaggacgccgcgcgcccga

SEQ ID NO: 257784 - DNA, 20 bp, human
gtggcaccaatctgagtgtg

SEQ ID NO: 257785 - DNA, 20 bp, human
gacgagccgcacactcagat

SEQ ID NO: 257786 - DNA, 20 bp, human
ggcgccggacgcagctcgga

SEQ ID NO: 257787 - DNA, 20 bp, human
gcggacggccgactcccgtg

SEQ ID NO: 257788 - DNA, 20 bp, human
ggcactggatctatagtcac

SEQ ID NO: 257789 - DNA, 20 bp, human
ggcccccagggcaggaaaga

SEQ ID NO: 257790 - DNA, 20 bp, human
gccgcgctgactctcctcgg

SEQ ID NO: 257791 - DNA, 20 bp, human
ggcggcacccaatgtcggga

SEQ ID NO: 257792 - DNA, 20 bp, human
gtcggcgcggttccatgtcc

SEQ ID NO: 257793 - DNA, 20 bp, human
gcggcggactcggggttccg

SEQ ID NO: 257794 - DNA, 20 bp, human
gcgactcccgtgcggctcca

SEQ ID NO: 257795 - DNA, 20 bp, human
gcctcgcggcacccaatgtc

SEQ ID NO: 257796 - DNA, 20 bp, human
gcgggaggtgcgcgaggtga

SEQ ID NO: 257797 - DNA, 20 bp, human
gaggaagattccagcagctt

SEQ ID NO: 257798 - DNA, 20 bp, human
ggcgtgacagcccgcgccgg

SEQ ID NO: 257799 - DNA, 20 bp, human
gcagcagcttgggcgatcgg

SEQ ID NO: 257800 - DNA, 20 bp, human
gagcgggcggcagcatcccg

SEQ ID NO: 257801 - DNA, 20 bp, human
gcccaggaggggggagttaa

SEQ ID NO: 257802 - DNA, 20 bp, human
gctgcgggagcgaaaggggt

SEQ ID NO: 257803 - DNA, 20 bp, human
ggggagcagcggtgttgttt

SEQ ID NO: 257804 - DNA, 20 bp, human
ggagccgggcagaactcagc

SEQ ID NO: 257805 - DNA, 20 bp, human
ggggcgatcggagggcagga

SEQ ID NO: 257806 - DNA, 20 bp, human
ggcgccgcccggcgaggagt

SEQ ID NO: 257807 - DNA, 20 bp, human
gcgagcccggccatccgcgg

SEQ ID NO: 257808 - DNA, 20 bp, human
gcggcggcgcgctgacgtaa

SEQ ID NO: 257809 - DNA, 20 bp, human
gcattccacccgctcgacaa

SEQ ID NO: 257810 - DNA, 20 bp, human
gcacccgaagttgttctacg

SEQ ID NO: 257811 - DNA, 20 bp, human
gcccaggatcccttgtcgag

SEQ ID NO: 257812 - DNA, 20 bp, human
gcccgcccccgcggatggcc

SEQ ID NO: 257813 - DNA, 20 bp, human
gtcctcgccgggcggcgcga

SEQ ID NO: 257814 - DNA, 20 bp, human
ggaatgccacgcaggtcacc

SEQ ID NO: 257815 - DNA, 20 bp, human
gcagccacgtagaacaactt

SEQ ID NO: 257816 - DNA, 20 bp, human
gccggctgtgggtttctcgg

SEQ ID NO: 257817 - DNA, 20 bp, human
gggtgcacgctgcggccctt

SEQ ID NO: 257818 - DNA, 20 bp, human
gctgcagcccggcgctgaat

SEQ ID NO: 257819 - DNA, 20 bp, human
gctcggaaaaggcgcatctc

SEQ ID NO: 257820 - DNA, 20 bp, human
ggggtcctcgaggtcagccg

SEQ ID NO: 257821 - DNA, 20 bp, human
gggggagggagcagacgcgg

SEQ ID NO: 257822 - DNA, 20 bp, human
ggcccttagggcgacagcct

SEQ ID NO: 257823 - DNA, 20 bp, human
gccgccagcccattcagcgc

SEQ ID NO: 257824 - DNA, 20 bp, human
gggcgcaaggatgggaattg

SEQ ID NO: 257825 - DNA, 20 bp, human
ggggcactgctgcgcgcagg

SEQ ID NO: 257826 - DNA, 20 bp, human
gccgctcaggagagcctcga

SEQ ID NO: 257827 - DNA, 20 bp, human
gtgcccgccctaggccgcgg

SEQ ID NO: 257828 - DNA, 20 bp, human
gagctgcccgccctaggccg

SEQ ID NO: 257829 - DNA, 20 bp, human
ggcgaccccgctgggaggaa

SEQ ID NO: 257830 - DNA, 20 bp, human
gctcccgggcgccaccggct

SEQ ID NO: 257831 - DNA, 20 bp, human
gcaccggctcggccaggccc

SEQ ID NO: 257832 - DNA, 20 bp, human
gagaagccgccggggcggtt

SEQ ID NO: 257833 - DNA, 20 bp, human
ggcgctgcgtgctgtccccg

SEQ ID NO: 257834 - DNA, 20 bp, human
gggcccgggaagggaatttt

SEQ ID NO: 257835 - DNA, 20 bp, human
ggcggcctcccgggcgccac

SEQ ID NO: 257836 - DNA, 20 bp, human
ggcgcggtggaggaaagcat

SEQ ID NO: 257837 - DNA, 20 bp, human
gtcagagacgtgcgggtgaa

SEQ ID NO: 257838 - DNA, 20 bp, human
gacggcgggcgctgtgggag

SEQ ID NO: 257839 - DNA, 20 bp, human
gcgacccgagagaaggagcg

SEQ ID NO: 257840 - DNA, 20 bp, human
gcgaaagtccgagagctctg

SEQ ID NO: 257841 - DNA, 20 bp, human
gtgtagctgcgggtaagaaa

SEQ ID NO: 257842 - DNA, 20 bp, human
gacgcccgcgcgccaggggg

SEQ ID NO: 257843 - DNA, 20 bp, human
gtgaaaggtcgagcgacagc

SEQ ID NO: 257844 - DNA, 20 bp, human
gggcggcgtcagagacgtgc

SEQ ID NO: 257845 - DNA, 20 bp, human
gccctggcgcgcgggcgtgt

SEQ ID NO: 257846 - DNA, 20 bp, human
gcagaccacgcccgcagctg

SEQ ID NO: 257847 - DNA, 20 bp, human
gtcgggaccaccctgaaaat

SEQ ID NO: 257848 - DNA, 20 bp, human
gttggagcagcccacgtctt

SEQ ID NO: 257849 - DNA, 20 bp, human
gcctccccccattttcaggg

SEQ ID NO: 257850 - DNA, 20 bp, human
ggacgagtagcccaagacgt

SEQ ID NO: 257851 - DNA, 20 bp, human
gactccgccttgccagtccg

SEQ ID NO: 257852 - DNA, 20 bp, human
gaccaaggccgggactgctg

SEQ ID NO: 257853 - DNA, 20 bp, human
gcggggttgccctcctgttc

SEQ ID NO: 257854 - DNA, 20 bp, human
gtgcctgaggaccagttccg

SEQ ID NO: 257855 - DNA, 20 bp, human
gtgcccgccgcggactggca

SEQ ID NO: 257856 - DNA, 20 bp, human
gaactgggagagaggagttg

SEQ ID NO: 257857 - DNA, 20 bp, human
gctcactcaagtgtcactaa

SEQ ID NO: 257858 - DNA, 20 bp, human
ggtgggcaattcctccacac

SEQ ID NO: 257859 - DNA, 20 bp, human
gtggaggtgctcatggtgaa

SEQ ID NO: 257860 - DNA, 20 bp, human
gggcgggaactgctaaatat

SEQ ID NO: 257861 - DNA, 20 bp, human
gtagcgagttatctcctctt

SEQ ID NO: 257862 - DNA, 20 bp, human
gtcaagtgtcactaaaggaa

SEQ ID NO: 257863 - DNA, 20 bp, human
gtactcaccataaatatcct

SEQ ID NO: 257864 - DNA, 20 bp, human
gtgtttgcaaatgcgaatgt

SEQ ID NO: 257865 - DNA, 20 bp, human
ggcagggatgactgccaaag

SEQ ID NO: 257866 - DNA, 20 bp, human
ggatgcgcgggtcatgctgg

SEQ ID NO: 257867 - DNA, 20 bp, human
ggggtgaacagagagcgcgg

SEQ ID NO: 257868 - DNA, 20 bp, human
gtctgcggatgaagctggac

SEQ ID NO: 257869 - DNA, 20 bp, human
ggggctgtgcacatctggct

SEQ ID NO: 257870 - DNA, 20 bp, human
ggccccatgcctgaaataca

SEQ ID NO: 257871 - DNA, 20 bp, human
gagagagcgcggaggatgcg

SEQ ID NO: 257872 - DNA, 20 bp, human
ggaggatgcgcgggtcatgc

SEQ ID NO: 257873 - DNA, 20 bp, human
gagctggacggggtgagcga

SEQ ID NO: 257874 - DNA, 20 bp, human
gtcggtgatacctgcactcc

SEQ ID NO: 257875 - DNA, 20 bp, human
ggcaggggcgctcgcggcct

SEQ ID NO: 257876 - DNA, 20 bp, human
gtccaggccccctcacacgg

SEQ ID NO: 257877 - DNA, 20 bp, human
gaaccagggctggaccctgc

SEQ ID NO: 257878 - DNA, 20 bp, human
ggggcctggacaaactgccc

SEQ ID NO: 257879 - DNA, 20 bp, human
gggtggggaagccgtcccct

SEQ ID NO: 257880 - DNA, 20 bp, human
ggataacggggacgtgtcgt

SEQ ID NO: 257881 - DNA, 20 bp, human
ggacacgtccccgttatcag

SEQ ID NO: 257882 - DNA, 20 bp, human
gtggacaaactgcccagggg

SEQ ID NO: 257883 - DNA, 20 bp, human
ggtgtcgtcggacaaacagg

SEQ ID NO: 257884 - DNA, 20 bp, human
gtgggggccaccgtgtgagg

SEQ ID NO: 257885 - DNA, 20 bp, human
gcggacaaacaggaggctga

SEQ ID NO: 257886 - DNA, 20 bp, human
ggggccccaggattcccgga

SEQ ID NO: 257887 - DNA, 20 bp, human
gaccccctccgggaatcctg

SEQ ID NO: 257888 - DNA, 20 bp, human
gcagggcgcccacactgacg

SEQ ID NO: 257889 - DNA, 20 bp, human
gagccaggagaggccgccca

SEQ ID NO: 257890 - DNA, 20 bp, human
ggctcgctgcgcggtcgctg

SEQ ID NO: 257891 - DNA, 20 bp, human
ggtgactctgctggaacccg

SEQ ID NO: 257892 - DNA, 20 bp, human
gcaaacgcgcctctgagccg

SEQ ID NO: 257893 - DNA, 20 bp, human
ggccccccagcggctgagat

SEQ ID NO: 257894 - DNA, 20 bp, human
gcgcagcgagcgccctgccg

SEQ ID NO: 257895 - DNA, 20 bp, human
gcggcggacgagctgccccc

SEQ ID NO: 257896 - DNA, 20 bp, human
gacacagacccaggacagga

SEQ ID NO: 257897 - DNA, 20 bp, human
gtaggtgctggggaggaaac

SEQ ID NO: 257898 - DNA, 20 bp, human
gagagagcgcaggggaatga

SEQ ID NO: 257899 - DNA, 20 bp, human
gtgagggtgggtcgcttata

SEQ ID NO: 257900 - DNA, 20 bp, human
gggtcacaggcggagaggtg

SEQ ID NO: 257901 - DNA, 20 bp, human
gagcgcaggggaatgacgga

SEQ ID NO: 257902 - DNA, 20 bp, human
gttaggggtcacaggcggag

SEQ ID NO: 257903 - DNA, 20 bp, human
gggcactagggtgtcggtta

SEQ ID NO: 257904 - DNA, 20 bp, human
gtgacctggggcggactgga

SEQ ID NO: 257905 - DNA, 20 bp, human
gcgcaaatccgtcacgtccg

SEQ ID NO: 257906 - DNA, 20 bp, human
gggacgccgggtggagatta

SEQ ID NO: 257907 - DNA, 20 bp, human
gaagagaggcgggaccgtcc

SEQ ID NO: 257908 - DNA, 20 bp, human
gctaggtcaccagcggggaa

SEQ ID NO: 257909 - DNA, 20 bp, human
ggggatgcgaggggtagacg

SEQ ID NO: 257910 - DNA, 20 bp, human
ggcaacttgagaccctcctg

SEQ ID NO: 257911 - DNA, 20 bp, human
gtcagggtgaggaccgcgga

SEQ ID NO: 257912 - DNA, 20 bp, human
gcctcccaggtccccaatct

SEQ ID NO: 257913 - DNA, 20 bp, human
gctgtgatttgcaagtgggg

SEQ ID NO: 257914 - DNA, 20 bp, human
gggggcgccccaagatttca

SEQ ID NO: 257915 - DNA, 20 bp, human
gccccgctggtgacctagat

SEQ ID NO: 257916 - DNA, 20 bp, human
gaaccagcagcggggaccca

SEQ ID NO: 257917 - DNA, 20 bp, human
gccccgcgggacctagtctc

SEQ ID NO: 257918 - DNA, 20 bp, human
gcgccggaggcggtggacag

SEQ ID NO: 257919 - DNA, 20 bp, human
ggaggagaatgcgaggagga

SEQ ID NO: 257920 - DNA, 20 bp, human
gcccactcccgccggagact

SEQ ID NO: 257921 - DNA, 20 bp, human
gagtggggcggcgcatggga

SEQ ID NO: 257922 - DNA, 20 bp, human
gtcgagccaaatctgtgcca

SEQ ID NO: 257923 - DNA, 20 bp, human
gtccggcggccgctggcctt

SEQ ID NO: 257924 - DNA, 20 bp, human
ggaggtggggacccgaataa

SEQ ID NO: 257925 - DNA, 20 bp, human
gcccgcgcgagctagacgtc

SEQ ID NO: 257926 - DNA, 20 bp, human
gggcgtcccagtccggtccc

SEQ ID NO: 257927 - DNA, 20 bp, human
ggtcccgggcggagggaaag

SEQ ID NO: 257928 - DNA, 20 bp, human
gcctccgcccgggaccggac

SEQ ID NO: 257929 - DNA, 20 bp, human
gagcgaaggcggcgtaatca

SEQ ID NO: 257930 - DNA, 20 bp, human
ggcctctcggcgtcccagtc

SEQ ID NO: 257931 - DNA, 20 bp, human
ggcgggctgaggtagcgcac

SEQ ID NO: 257932 - DNA, 20 bp, human
gcgggcctcggcttctgcct

SEQ ID NO: 257933 - DNA, 20 bp, human
gcggcagcgcctacacctgc

SEQ ID NO: 257934 - DNA, 20 bp, human
gagcgggcgacccacctccg

SEQ ID NO: 257935 - DNA, 20 bp, human
gtgcgctcctccgcactcgg

SEQ ID NO: 257936 - DNA, 20 bp, human
ggagcggggcgaggaagttc

SEQ ID NO: 257937 - DNA, 20 bp, human
gagggggaacgcagtgtgag

SEQ ID NO: 257938 - DNA, 20 bp, human
gccctcccgcgcaaaggggg

SEQ ID NO: 257939 - DNA, 20 bp, human
gtgaggggccgggtctggga

SEQ ID NO: 257940 - DNA, 20 bp, human
gcgggacaacccccctacca

SEQ ID NO: 257941 - DNA, 20 bp, human
gcagcgcggggcaccgagtt

SEQ ID NO: 257942 - DNA, 20 bp, human
gtggaatcaagtggcgtcgg

SEQ ID NO: 257943 - DNA, 20 bp, human
ggtcacgtgcccaccgggcg

SEQ ID NO: 257944 - DNA, 20 bp, human
gtccccctcccgcgcaaagg

SEQ ID NO: 257945 - DNA, 20 bp, human
gacccccctaccaaggagaa

SEQ ID NO: 257946 - DNA, 20 bp, human
ggggggcgggacaagaggcg

SEQ ID NO: 257947 - DNA, 20 bp, human
ggacaagaggcgcggattgg

SEQ ID NO: 257948 - DNA, 20 bp, human
gcgggacaagaggcgcggat

SEQ ID NO: 257949 - DNA, 20 bp, human
ggggggcagagtcgagtctc

SEQ ID NO: 257950 - DNA, 20 bp, human
gtgagaaggaccaagcccaa

SEQ ID NO: 257951 - DNA, 20 bp, human
gccaggcgacgctttccgaa

SEQ ID NO: 257952 - DNA, 20 bp, human
gggagcgggtcgcgccggag

SEQ ID NO: 257953 - DNA, 20 bp, human
gttccgaagggcgggattgg

SEQ ID NO: 257954 - DNA, 20 bp, human
gcagagtcgagtctccggat

SEQ ID NO: 257955 - DNA, 20 bp, human
ggatacaaatgcaaagaagg

SEQ ID NO: 257956 - DNA, 20 bp, human
gctgctctgcccctccgcga

SEQ ID NO: 257957 - DNA, 20 bp, human
ggtgactggcagcggggcgg

SEQ ID NO: 257958 - DNA, 20 bp, human
gtctctgggatccttcgcgg

SEQ ID NO: 257959 - DNA, 20 bp, human
gccctggtcacaaacaacta

SEQ ID NO: 257960 - DNA, 20 bp, human
gagcccgtgacgcgcggagt

SEQ ID NO: 257961 - DNA, 20 bp, human
gcagagcaggcgggggtgac

SEQ ID NO: 257962 - DNA, 20 bp, human
gaacaactaaggttggcgcc

SEQ ID NO: 257963 - DNA, 20 bp, human
gggctctctgggatccttcg

SEQ ID NO: 257964 - DNA, 20 bp, human
gagtcggccggcttaagggc

SEQ ID NO: 257965 - DNA, 20 bp, human
gggccgactccgcgcgtcac

SEQ ID NO: 257966 - DNA, 20 bp, human
ggaagcggccgggccatatc

SEQ ID NO: 257967 - DNA, 20 bp, human
gaggggcaacgcgggaactc

SEQ ID NO: 257968 - DNA, 20 bp, human
ggtgccgggcgctgtcggat

SEQ ID NO: 257969 - DNA, 20 bp, human
gagccctaatatggcaggac

SEQ ID NO: 257970 - DNA, 20 bp, human
gggcgcgggcgcgggcccta

SEQ ID NO: 257971 - DNA, 20 bp, human
gggccggtcctgccatatta

SEQ ID NO: 257972 - DNA, 20 bp, human
ggcggagggaggggcaacgc

SEQ ID NO: 257973 - DNA, 20 bp, human
gccgggcgctgtcggatggg

SEQ ID NO: 257974 - DNA, 20 bp, human
ggaagggtctggaacggcac

SEQ ID NO: 257975 - DNA, 20 bp, human
ggggaactccggagctgcgc

SEQ ID NO: 257976 - DNA, 20 bp, human
gtggagttaggtcctcactt

SEQ ID NO: 257977 - DNA, 20 bp, human
gacacatgctctgagaatac

SEQ ID NO: 257978 - DNA, 20 bp, human
gccaagaaaaacgaaatcca

SEQ ID NO: 257979 - DNA, 20 bp, human
gatggcacagacactgtaca

SEQ ID NO: 257980 - DNA, 20 bp, human
gcaaggggtcaggcatatga

SEQ ID NO: 257981 - DNA, 20 bp, human
gtcaggcagctgaagtcaaa

SEQ ID NO: 257982 - DNA, 20 bp, human
ggagttggcaaaatggggtt

SEQ ID NO: 257983 - DNA, 20 bp, human
gggaatagtaattggggaag

SEQ ID NO: 257984 - DNA, 20 bp, human
gtcaaagggaatagtaattg

SEQ ID NO: 257985 - DNA, 20 bp, human
gccatgcaaatcaagttctt

SEQ ID NO: 257986 - DNA, 20 bp, human
gcggccgcgcggactccgcc

SEQ ID NO: 257987 - DNA, 20 bp, human
ggagcccggcggagtccgcg

SEQ ID NO: 257988 - DNA, 20 bp, human
gctggaagtcgcgagcccgg

SEQ ID NO: 257989 - DNA, 20 bp, human
gccggggcggggaggaattc

SEQ ID NO: 257990 - DNA, 20 bp, human
ggagctggaagtcgcgagcc

SEQ ID NO: 257991 - DNA, 20 bp, human
ggctgcccatatatggactg

SEQ ID NO: 257992 - DNA, 20 bp, human
gcatatatggactgaggaac

SEQ ID NO: 257993 - DNA, 20 bp, human
ggtccggggcgcagggatcg

SEQ ID NO: 257994 - DNA, 20 bp, human
ggcgacttccagctcgcagg

SEQ ID NO: 257995 - DNA, 20 bp, human
gatatgggcagcgacgtcac

SEQ ID NO: 257996 - DNA, 20 bp, human
ggggcgccgcacgttggctg

SEQ ID NO: 257997 - DNA, 20 bp, human
gagcttgctaggaagcggcg

SEQ ID NO: 257998 - DNA, 20 bp, human
gacgtcgcgccccttcggct

SEQ ID NO: 257999 - DNA, 20 bp, human
gaaggggcgcgacgtcacaa

SEQ ID NO: 258000 - DNA, 20 bp, human
gtcccggggctcagataaat

SEQ ID NO: 258001 - DNA, 20 bp, human
gacagacaaagcccagccga

SEQ ID NO: 258002 - DNA, 20 bp, human
gaactgctggggaacccgga

SEQ ID NO: 258003 - DNA, 20 bp, human
gacgtcacggagctttcccg

SEQ ID NO: 258004 - DNA, 20 bp, human
ggcggcgcccgcaccgctcg

SEQ ID NO: 258005 - DNA, 20 bp, human
ggcgggccgcagccaacgtg

SEQ ID NO: 258006 - DNA, 20 bp, human
ggggccggggcctcccaaaa

SEQ ID NO: 258007 - DNA, 20 bp, human
ggtgccggggactcccgaaa

SEQ ID NO: 258008 - DNA, 20 bp, human
gccgccgcagctatataagt

SEQ ID NO: 258009 - DNA, 20 bp, human
ggaggcgcagcgccccagac

SEQ ID NO: 258010 - DNA, 20 bp, human
ggggaagcgcatctaccgga

SEQ ID NO: 258011 - DNA, 20 bp, human
gcgcgcgcgctccccaggcg

SEQ ID NO: 258012 - DNA, 20 bp, human
gccccagactggcgcatccg

SEQ ID NO: 258013 - DNA, 20 bp, human
gccccagcgctccacgcctg

SEQ ID NO: 258014 - DNA, 20 bp, human
gctccccaggcgtggagcgc

SEQ ID NO: 258015 - DNA, 20 bp, human
gcgcagctatataagtgggg

SEQ ID NO: 258016 - DNA, 20 bp, human
gctcccgagcaagggcaagg

SEQ ID NO: 258017 - DNA, 20 bp, human
gaagccggaatgcgacgcac

SEQ ID NO: 258018 - DNA, 20 bp, human
gcacctcccgagcaagggca

SEQ ID NO: 258019 - DNA, 20 bp, human
gtagcctgtgcgtcgcattc

SEQ ID NO: 258020 - DNA, 20 bp, human
gcggagcccctgtgatgggc

SEQ ID NO: 258021 - DNA, 20 bp, human
gtcctggcggagatgagaac

SEQ ID NO: 258022 - DNA, 20 bp, human
ggggcgggatcgtccttagt

SEQ ID NO: 258023 - DNA, 20 bp, human
gaaaaagaaggaaccgacta

SEQ ID NO: 258024 - DNA, 20 bp, human
gaactgcctgcccatcacag

SEQ ID NO: 258025 - DNA, 20 bp, human
gaaaaccacctcccgagcaa

SEQ ID NO: 258026 - DNA, 20 bp, human
gactactggccccctttcaa

SEQ ID NO: 258027 - DNA, 20 bp, human
gaccgagcgggcactgcggt

SEQ ID NO: 258028 - DNA, 20 bp, human
gaacctgactctgctgtcaa

SEQ ID NO: 258029 - DNA, 20 bp, human
gggcccgggcagcgctctct

SEQ ID NO: 258030 - DNA, 20 bp, human
ggccccgcccgccttccgac

SEQ ID NO: 258031 - DNA, 20 bp, human
gcagtagtacgtacctccca

SEQ ID NO: 258032 - DNA, 20 bp, human
gcgctcccgctcccgggtcg

SEQ ID NO: 258033 - DNA, 20 bp, human
gaaggcgtcagtaacctcgg

SEQ ID NO: 258034 - DNA, 20 bp, human
gggcgcgaggccccggaagc

SEQ ID NO: 258035 - DNA, 20 bp, human
gtttcccagccgttgaaagg

SEQ ID NO: 258036 - DNA, 20 bp, human
gaaggcgaggagcgggcgtt

SEQ ID NO: 258037 - DNA, 20 bp, human
gagcgggcgttcggcggaga

SEQ ID NO: 258038 - DNA, 20 bp, human
ggggcggggcgaaacaggtg

SEQ ID NO: 258039 - DNA, 20 bp, human
gaagacgtggcaccagtcgg

SEQ ID NO: 258040 - DNA, 20 bp, human
ggtctcgtggagccatcccg

SEQ ID NO: 258041 - DNA, 20 bp, human
ggaggctcgcgaaagtgctg

SEQ ID NO: 258042 - DNA, 20 bp, human
gtggaatcagccaatggggg

SEQ ID NO: 258043 - DNA, 20 bp, human
gcggcagagggcgcttcgac

SEQ ID NO: 258044 - DNA, 20 bp, human
gggtgcgcagcattcggcag

SEQ ID NO: 258045 - DNA, 20 bp, human
ggcggcgctagccgccactg

SEQ ID NO: 258046 - DNA, 20 bp, human
ggggagcagcccaacgctgg

SEQ ID NO: 258047 - DNA, 20 bp, human
gagctccagcgtccagcctg

SEQ ID NO: 258048 - DNA, 20 bp, human
ggctctcgcccgccgtgcta

SEQ ID NO: 258049 - DNA, 20 bp, human
gggaagacgccttagcacgg

SEQ ID NO: 258050 - DNA, 20 bp, human
gctggggagcagcccaacgc

SEQ ID NO: 258051 - DNA, 20 bp, human
gcgcctccacctccagcgtt

SEQ ID NO: 258052 - DNA, 20 bp, human
ggcctctggcgcccccttgt

SEQ ID NO: 258053 - DNA, 20 bp, human
gcggaattcgaaccccaggc

SEQ ID NO: 258054 - DNA, 20 bp, human
ggccgggcgcccggttttga

SEQ ID NO: 258055 - DNA, 20 bp, human
gggcgcccccttgtggggag

SEQ ID NO: 258056 - DNA, 20 bp, human
gagggcgccgccatgtttgt

SEQ ID NO: 258057 - DNA, 20 bp, human
gtgggaacagcgccctctca

SEQ ID NO: 258058 - DNA, 20 bp, human
ggatgctgacccagtccagt

SEQ ID NO: 258059 - DNA, 20 bp, human
gcgcctctggggcttcgatt

SEQ ID NO: 258060 - DNA, 20 bp, human
gggccccacggttgcggcga

SEQ ID NO: 258061 - DNA, 20 bp, human
gagggccggccccacggttg

SEQ ID NO: 258062 - DNA, 20 bp, human
gcggcactctcccactggac

SEQ ID NO: 258063 - DNA, 20 bp, human
gaagtcccctagtactggca

SEQ ID NO: 258064 - DNA, 20 bp, human
gtcccgtcgccgcaaccgtg

SEQ ID NO: 258065 - DNA, 20 bp, human
gctagacctgcggccgcgcg

SEQ ID NO: 258066 - DNA, 20 bp, human
gcggggagatggtgtcttcc

SEQ ID NO: 258067 - DNA, 20 bp, human
gagagagctcgtctgaatag

SEQ ID NO: 258068 - DNA, 20 bp, human
ggcgtcagccaattgagagg

SEQ ID NO: 258069 - DNA, 20 bp, human
gtgacgccttcagccctctc

SEQ ID NO: 258070 - DNA, 20 bp, human
gtgacgtagcggccgaagac

SEQ ID NO: 258071 - DNA, 20 bp, human
gaaggcgtcagccaattgag

SEQ ID NO: 258072 - DNA, 20 bp, human
gcggtcagtgccacccggcc

SEQ ID NO: 258073 - DNA, 20 bp, human
gagggggccctgagcatgac

SEQ ID NO: 258074 - DNA, 20 bp, human
ggaggcaccggcaaccagaa

SEQ ID NO: 258075 - DNA, 20 bp, human
gtgctgccacagccagtctt

SEQ ID NO: 258076 - DNA, 20 bp, human
ggggtagccaatcagaagag

SEQ ID NO: 258077 - DNA, 20 bp, human
gaagagggggaagtgactta

SEQ ID NO: 258078 - DNA, 20 bp, human
gtaagtaccaggctctgaag

SEQ ID NO: 258079 - DNA, 20 bp, human
gtgaacactaacgtgtgagt

SEQ ID NO: 258080 - DNA, 20 bp, human
gagtagaagtccaaatctgg

SEQ ID NO: 258081 - DNA, 20 bp, human
gttagggaattcccggttgg

SEQ ID NO: 258082 - DNA, 20 bp, human
gcctggagagggaacttgct

SEQ ID NO: 258083 - DNA, 20 bp, human
gcacttccccctcttctgat

SEQ ID NO: 258084 - DNA, 20 bp, human
gaagtgacttagggaattcc

SEQ ID NO: 258085 - DNA, 20 bp, human
gaaagacaccatcgggaaga

SEQ ID NO: 258086 - DNA, 20 bp, human
gccgggtggggtctcgggag

SEQ ID NO: 258087 - DNA, 20 bp, human
gacaagcgtctgtagagcgc

SEQ ID NO: 258088 - DNA, 20 bp, human
gtcctccagaggagggacgc

SEQ ID NO: 258089 - DNA, 20 bp, human
ggcggcgccccggctcgcat

SEQ ID NO: 258090 - DNA, 20 bp, human
gggtggggtctcgggagagg

SEQ ID NO: 258091 - DNA, 20 bp, human
ggtctgtagagcgccgggtg

SEQ ID NO: 258092 - DNA, 20 bp, human
gcggctgggccaatgcgagc

SEQ ID NO: 258093 - DNA, 20 bp, human
gggtacagcaaggagaatga

SEQ ID NO: 258094 - DNA, 20 bp, human
gtgtaaccccttggcccata

SEQ ID NO: 258095 - DNA, 20 bp, human
gccagcccctatgggccaag

SEQ ID NO: 258096 - DNA, 20 bp, human
ggcgcctgcgcactggaacc

SEQ ID NO: 258097 - DNA, 20 bp, human
gaccccgcgggcgcgcgttc

SEQ ID NO: 258098 - DNA, 20 bp, human
gtgcgcccgcgcctgcgcgt

SEQ ID NO: 258099 - DNA, 20 bp, human
gcaggcgcaggcgcagacgt

SEQ ID NO: 258100 - DNA, 20 bp, human
gggcctgcggcggccggaac

SEQ ID NO: 258101 - DNA, 20 bp, human
gcgttggagctcgaccggtg

SEQ ID NO: 258102 - DNA, 20 bp, human
gcggtcgagctccaacgcgc

SEQ ID NO: 258103 - DNA, 20 bp, human
ggcccgcggggtaggagacc

SEQ ID NO: 258104 - DNA, 20 bp, human
gcagagtcgtagtagtggat

SEQ ID NO: 258105 - DNA, 20 bp, human
gcgtgcggcgccccaggcgc

SEQ ID NO: 258106 - DNA, 20 bp, human
gcggccgccccgggtcacgt

SEQ ID NO: 258107 - DNA, 20 bp, human
gcggccgccgaggtgcggaa

SEQ ID NO: 258108 - DNA, 20 bp, human
gcctaagctgggagctgcaa

SEQ ID NO: 258109 - DNA, 20 bp, human
gcccccagcgcaagcggcga

SEQ ID NO: 258110 - DNA, 20 bp, human
gtctccgaggccgctctcag

SEQ ID NO: 258111 - DNA, 20 bp, human
gacagtcacagccatctccg

SEQ ID NO: 258112 - DNA, 20 bp, human
gtcgcccacgtgacccgggg

SEQ ID NO: 258113 - DNA, 20 bp, human
gcccaggcgtgtctcgccct

SEQ ID NO: 258114 - DNA, 20 bp, human
ggcgagacacgcctgggccc

SEQ ID NO: 258115 - DNA, 20 bp, human
gctccctcgcccacgtgacc

SEQ ID NO: 258116 - DNA, 20 bp, human
ggccaggcggagttgggagc

SEQ ID NO: 258117 - DNA, 20 bp, human
ggggaaatgtagtcagtccg

SEQ ID NO: 258118 - DNA, 20 bp, human
gaggcggggcccagagccga

SEQ ID NO: 258119 - DNA, 20 bp, human
gagatctgtgagaacgggat

SEQ ID NO: 258120 - DNA, 20 bp, human
gggcccagagccgaaggggt

SEQ ID NO: 258121 - DNA, 20 bp, human
gcgctgcgtgcgggatcgtc

SEQ ID NO: 258122 - DNA, 20 bp, human
gtccgcgcggcccacccctt

SEQ ID NO: 258123 - DNA, 20 bp, human
gaggagagatctgtgagaac

SEQ ID NO: 258124 - DNA, 20 bp, human
gcccgcctcgcgctgcgtgc

SEQ ID NO: 258125 - DNA, 20 bp, human
gcgcgcggagcgacggagac

SEQ ID NO: 258126 - DNA, 20 bp, human
gtggcgcgccaagtaggagg

SEQ ID NO: 258127 - DNA, 20 bp, human
ggatacgaagttcgaatcga

SEQ ID NO: 258128 - DNA, 20 bp, human
gcagtggcgcgccaagtagg

SEQ ID NO: 258129 - DNA, 20 bp, human
ggattcgaacttcgtatcta

SEQ ID NO: 258130 - DNA, 20 bp, human
gagtagctcagtgttttctc

SEQ ID NO: 258131 - DNA, 20 bp, human
gcgttcgtgcgcgtgcgcaa

SEQ ID NO: 258132 - DNA, 20 bp, human
gacatcggtaaattgcccag

SEQ ID NO: 258133 - DNA, 20 bp, human
gtgagctactccaaccacag

SEQ ID NO: 258134 - DNA, 20 bp, human
gcttgcgtaaccccgcgcgc

SEQ ID NO: 258135 - DNA, 20 bp, human
gcttggcgcgccactgtggt

SEQ ID NO: 258136 - DNA, 20 bp, human
ggtcccccgcccttcgtcgt

SEQ ID NO: 258137 - DNA, 20 bp, human
gtggcgcttcccggcctcga

SEQ ID NO: 258138 - DNA, 20 bp, human
gtgaaacatcccaacgacga

SEQ ID NO: 258139 - DNA, 20 bp, human
gcgcatgcgcactgctccca

SEQ ID NO: 258140 - DNA, 20 bp, human
ggggggcatctggagaacgg

SEQ ID NO: 258141 - DNA, 20 bp, human
gttctccagatgccccctcg

SEQ ID NO: 258142 - DNA, 20 bp, human
ggattcttaccgcaaaccct

SEQ ID NO: 258143 - DNA, 20 bp, human
gcagatgccccctcgaggcc

SEQ ID NO: 258144 - DNA, 20 bp, human
gtctggagaacggcgggcgc

SEQ ID NO: 258145 - DNA, 20 bp, human
gtaaatgcagtgtgcgtaac

SEQ ID NO: 258146 - DNA, 20 bp, human
ggaccgctagggaacgctag

SEQ ID NO: 258147 - DNA, 20 bp, human
ggcgcagtccgcaggtcctc

SEQ ID NO: 258148 - DNA, 20 bp, human
ggaggcggctacagacgtaa

SEQ ID NO: 258149 - DNA, 20 bp, human
gtggctactcaggaccgcta

SEQ ID NO: 258150 - DNA, 20 bp, human
gtgcgcatgcgtaagcacgg

SEQ ID NO: 258151 - DNA, 20 bp, human
gctagggaacgctagaggat

SEQ ID NO: 258152 - DNA, 20 bp, human
gcttacgcatgcgcacactc

SEQ ID NO: 258153 - DNA, 20 bp, human
ggtgtgcgcatgcgtaagca

SEQ ID NO: 258154 - DNA, 20 bp, human
gaagataccgcgcagtccgc

SEQ ID NO: 258155 - DNA, 20 bp, human
ggctggaaaatgaccgtata

SEQ ID NO: 258156 - DNA, 20 bp, human
gccggccacgggtatctctg

SEQ ID NO: 258157 - DNA, 20 bp, human
gcgggcattagtcgcgtgtg

SEQ ID NO: 258158 - DNA, 20 bp, human
gcgcccccagcacgctccgc

SEQ ID NO: 258159 - DNA, 20 bp, human
gttcccgcggagcgtgctgg

SEQ ID NO: 258160 - DNA, 20 bp, human
gggtctatgagcgagcgcct

SEQ ID NO: 258161 - DNA, 20 bp, human
gcctcccagcgtgtggaaag

SEQ ID NO: 258162 - DNA, 20 bp, human
gttagtcgcgtgtgaggtca

SEQ ID NO: 258163 - DNA, 20 bp, human
ggcccatcattgcgcgtgtt

SEQ ID NO: 258164 - DNA, 20 bp, human
gagcgcctcggcttgtggct

SEQ ID NO: 258165 - DNA, 20 bp, human
gccgggccgctagtgcgcat

SEQ ID NO: 258166 - DNA, 20 bp, human
ggtaggcgcgctcgaaacct

SEQ ID NO: 258167 - DNA, 20 bp, human
gcgcttgcgcaggaagtctg

SEQ ID NO: 258168 - DNA, 20 bp, human
gtccccgcctccaaaccaat

SEQ ID NO: 258169 - DNA, 20 bp, human
gagggcgtcctcttgactct

SEQ ID NO: 258170 - DNA, 20 bp, human
gtgggtggggtcaggacgtg

SEQ ID NO: 258171 - DNA, 20 bp, human
ggggcacgacgctgtgggtg

SEQ ID NO: 258172 - DNA, 20 bp, human
gacaacgggtggtgacgtaa

SEQ ID NO: 258173 - DNA, 20 bp, human
gaggcggcgccgcttccaat

SEQ ID NO: 258174 - DNA, 20 bp, human
ggcgccgcttccaattggtt

SEQ ID NO: 258175 - DNA, 20 bp, human
gggtttggaggcggggacat

SEQ ID NO: 258176 - DNA, 20 bp, human
gacccggaactcaaggactt

SEQ ID NO: 258177 - DNA, 20 bp, human
gagaaaggaagtcctctccc

SEQ ID NO: 258178 - DNA, 20 bp, human
gcggaagtacggttttcgga

SEQ ID NO: 258179 - DNA, 20 bp, human
gcgagaagcgagaccttaga

SEQ ID NO: 258180 - DNA, 20 bp, human
gaaggcagggcttcccgcga

SEQ ID NO: 258181 - DNA, 20 bp, human
gtgagggagataggcctcca

SEQ ID NO: 258182 - DNA, 20 bp, human
ggaggcgccccggacctcga

SEQ ID NO: 258183 - DNA, 20 bp, human
gtagaagacggacaagggag

SEQ ID NO: 258184 - DNA, 20 bp, human
ggcgcagttctgagggagat

SEQ ID NO: 258185 - DNA, 20 bp, human
gagagttagaagacggacaa

SEQ ID NO: 258186 - DNA, 20 bp, human
ggcaagccagagaggacgcg

SEQ ID NO: 258187 - DNA, 20 bp, human
gctccctcggctctaacaat

SEQ ID NO: 258188 - DNA, 20 bp, human
gagggagacgcgttgtggga

SEQ ID NO: 258189 - DNA, 20 bp, human
ggactctgcgtcatagaaaa

SEQ ID NO: 258190 - DNA, 20 bp, human
ggaaaaggcggagtcaggga

SEQ ID NO: 258191 - DNA, 20 bp, human
gagagaggacgcgaggggca

SEQ ID NO: 258192 - DNA, 20 bp, human
gctcctattgttagagccga

SEQ ID NO: 258193 - DNA, 20 bp, human
ggggcccagccggcgacggg

SEQ ID NO: 258194 - DNA, 20 bp, human
ggcagggaaaaggcggagtc

SEQ ID NO: 258195 - DNA, 20 bp, human
ggccgagggagacgcgttgt

SEQ ID NO: 258196 - DNA, 20 bp, human
gcatcctgcagcaaactctc

SEQ ID NO: 258197 - DNA, 20 bp, human
ggcgggactcagcatggaga

SEQ ID NO: 258198 - DNA, 20 bp, human
ggtggagtcaaggatgaaat

SEQ ID NO: 258199 - DNA, 20 bp, human
gacacctagtagactccatc

SEQ ID NO: 258200 - DNA, 20 bp, human
ggagtcaaggatgaaatggg

SEQ ID NO: 258201 - DNA, 20 bp, human
gataccggagagtttgctgc

SEQ ID NO: 258202 - DNA, 20 bp, human
gcctcagccgaagagaggcg

SEQ ID NO: 258203 - DNA, 20 bp, human
ggatgaataaacaggaagcg

SEQ ID NO: 258204 - DNA, 20 bp, human
gccgtgcctcagccgaagag

SEQ ID NO: 258205 - DNA, 20 bp, human
gagcaaaggagaatactcca

SEQ ID NO: 258206 - DNA, 20 bp, human
gcgtaggggaggacagtcaa

SEQ ID NO: 258207 - DNA, 20 bp, human
ggtcccgcgccgagcatcct

SEQ ID NO: 258208 - DNA, 20 bp, human
gagcccggaaagcctgaggc

SEQ ID NO: 258209 - DNA, 20 bp, human
ggagaccgcaattcccgtca

SEQ ID NO: 258210 - DNA, 20 bp, human
ggcagagcccggaaagcctg

SEQ ID NO: 258211 - DNA, 20 bp, human
gcggccgcttgaacacttcg

SEQ ID NO: 258212 - DNA, 20 bp, human
gcactccgtgacgggaattg

SEQ ID NO: 258213 - DNA, 20 bp, human
gtgttcaagcggccgcagag

SEQ ID NO: 258214 - DNA, 20 bp, human
gcccagagttcgcaggtctg

SEQ ID NO: 258215 - DNA, 20 bp, human
gcgaactctgggccgctctg

SEQ ID NO: 258216 - DNA, 20 bp, human
gccctcccgctggagaagga

SEQ ID NO: 258217 - DNA, 20 bp, human
gttacggagtgacgcggaaa

SEQ ID NO: 258218 - DNA, 20 bp, human
gggaggggcgcgcacttccg

SEQ ID NO: 258219 - DNA, 20 bp, human
gacgcgcacgcgcaaatcta

SEQ ID NO: 258220 - DNA, 20 bp, human
ggcgacgcttgacagagctt

SEQ ID NO: 258221 - DNA, 20 bp, human
gacgcttgacagagcttggg

SEQ ID NO: 258222 - DNA, 20 bp, human
gccgccgcctcgatctactt

SEQ ID NO: 258223 - DNA, 20 bp, human
gggagaaggagggcgaaagc

SEQ ID NO: 258224 - DNA, 20 bp, human
gtccgtaaccggaagtgaat

SEQ ID NO: 258225 - DNA, 20 bp, human
gctcggggccaattcacttc

SEQ ID NO: 258226 - DNA, 20 bp, human
gctctggtgggctcgtctac

SEQ ID NO: 258227 - DNA, 20 bp, human
gggctcgtctaccggcggct

SEQ ID NO: 258228 - DNA, 20 bp, human
gactaggccagggttcacct

SEQ ID NO: 258229 - DNA, 20 bp, human
gacagccccgcccccagtga

SEQ ID NO: 258230 - DNA, 20 bp, human
gccggcgcatgcgctctggt

SEQ ID NO: 258231 - DNA, 20 bp, human
gtggtgggctcgtctaccgg

SEQ ID NO: 258232 - DNA, 20 bp, human
ggccacgcgcgcaccttcac

SEQ ID NO: 258233 - DNA, 20 bp, human
gtccggccccggcgtacccc

SEQ ID NO: 258234 - DNA, 20 bp, human
ggtagctgggaactaggcca

SEQ ID NO: 258235 - DNA, 20 bp, human
gacgcgcgcaccttcactgg

SEQ ID NO: 258236 - DNA, 20 bp, human
gagaaccctaggagccccgg

SEQ ID NO: 258237 - DNA, 20 bp, human
ggggtcctgccgctcgtaag

SEQ ID NO: 258238 - DNA, 20 bp, human
gcccgcccccggggctccta

SEQ ID NO: 258239 - DNA, 20 bp, human
gacaagccctcgtctgctac

SEQ ID NO: 258240 - DNA, 20 bp, human
gctacgggattggggtaaat

SEQ ID NO: 258241 - DNA, 20 bp, human
gccgtgcaggggcagcacgt

SEQ ID NO: 258242 - DNA, 20 bp, human
gccctcgtctgctacgggat

SEQ ID NO: 258243 - DNA, 20 bp, human
ggattggggtaaattggcgc

SEQ ID NO: 258244 - DNA, 20 bp, human
gggctcctagggttctccgc

SEQ ID NO: 258245 - DNA, 20 bp, human
ggacgagggcttgtgcgaga

SEQ ID NO: 258246 - DNA, 20 bp, human
ggcgaggccaaccaccgcga

SEQ ID NO: 258247 - DNA, 20 bp, human
gagcggcacttactacgtgg

SEQ ID NO: 258248 - DNA, 20 bp, human
gccagcctgggaacatggag

SEQ ID NO: 258249 - DNA, 20 bp, human
gggtaattgcgtccggaaga

SEQ ID NO: 258250 - DNA, 20 bp, human
ggtaaaaagacgtcggggaa

SEQ ID NO: 258251 - DNA, 20 bp, human
gtctcattggtaattgcgtc

SEQ ID NO: 258252 - DNA, 20 bp, human
ggaaggtggactttccctgg

SEQ ID NO: 258253 - DNA, 20 bp, human
gaatgggcgatgtccgagat

SEQ ID NO: 258254 - DNA, 20 bp, human
ggcgatggccaatctgttgt

SEQ ID NO: 258255 - DNA, 20 bp, human
ggcgcggaaagtttgctcaa

SEQ ID NO: 258256 - DNA, 20 bp, human
gtccgcctacggcccgtccc

SEQ ID NO: 258257 - DNA, 20 bp, human
gccgcgccgggagctagctc

SEQ ID NO: 258258 - DNA, 20 bp, human
gacgctggaaacgggctcgt

SEQ ID NO: 258259 - DNA, 20 bp, human
gcgccgggagctagctccgg

SEQ ID NO: 258260 - DNA, 20 bp, human
ggccggggacgggccgtagg

SEQ ID NO: 258261 - DNA, 20 bp, human
gccaggcgaaggaagaaggc

SEQ ID NO: 258262 - DNA, 20 bp, human
gagcctccggagctagctcc

SEQ ID NO: 258263 - DNA, 20 bp, human
gccttcccccagcaggatgt

SEQ ID NO: 258264 - DNA, 20 bp, human
gcggcgcggagctccgccta

SEQ ID NO: 258265 - DNA, 20 bp, human
gtcccgcactagccatgcca

SEQ ID NO: 258266 - DNA, 20 bp, human
gcagagcaagtggtggtcag

SEQ ID NO: 258267 - DNA, 20 bp, human
gcacctcgtgcgtcacttgg

SEQ ID NO: 258268 - DNA, 20 bp, human
ggggcgggacttcgactccg

SEQ ID NO: 258269 - DNA, 20 bp, human
gtccacttccgcagattagg

SEQ ID NO: 258270 - DNA, 20 bp, human
ggtgccagccccctaatctg

SEQ ID NO: 258271 - DNA, 20 bp, human
ggggctcggctgtctcggtc

SEQ ID NO: 258272 - DNA, 20 bp, human
gacttggcggcgccggacgt

SEQ ID NO: 258273 - DNA, 20 bp, human
gcgccgccaagtgacgcacg

SEQ ID NO: 258274 - DNA, 20 bp, human
gaatctgcggaagtggagtg

SEQ ID NO: 258275 - DNA, 20 bp, human
gagtcgaagtcccgccctgc

SEQ ID NO: 258276 - DNA, 20 bp, human
gtgagccaatcagagacgtg

SEQ ID NO: 258277 - DNA, 20 bp, human
gccgtcaggcctgtagaggg

SEQ ID NO: 258278 - DNA, 20 bp, human
ggggaccagccaccctctac

SEQ ID NO: 258279 - DNA, 20 bp, human
ggcgggagatcggcaacgaa

SEQ ID NO: 258280 - DNA, 20 bp, human
gcggcaacgaagggcgtagc

SEQ ID NO: 258281 - DNA, 20 bp, human
gtaacccgtcaggcctgtag

SEQ ID NO: 258282 - DNA, 20 bp, human
gaatcagagacgtggggctc

SEQ ID NO: 258283 - DNA, 20 bp, human
gggggctggaggatcggaag

SEQ ID NO: 258284 - DNA, 20 bp, human
gggttacttccgttcaccgt

SEQ ID NO: 258285 - DNA, 20 bp, human
ggggttgttcagttataacc

SEQ ID NO: 258286 - DNA, 20 bp, human
gggaggggaagcacactcag

SEQ ID NO: 258287 - DNA, 20 bp, human
gaccgccgagcgatggatga

SEQ ID NO: 258288 - DNA, 20 bp, human
gccgagcgatggatgacgga

SEQ ID NO: 258289 - DNA, 20 bp, human
gactcagcggagaggaggga

SEQ ID NO: 258290 - DNA, 20 bp, human
gaacgcgcagagcagaccca

SEQ ID NO: 258291 - DNA, 20 bp, human
gcaatggcgcaggcgcgcga

SEQ ID NO: 258292 - DNA, 20 bp, human
ggcacactcagcggagagga

SEQ ID NO: 258293 - DNA, 20 bp, human
gcgatggccgagaaactcga

SEQ ID NO: 258294 - DNA, 20 bp, human
gactgacagcccaatggcgc

SEQ ID NO: 258295 - DNA, 20 bp, human
gagagaagaccgccgagcga

SEQ ID NO: 258296 - DNA, 20 bp, human
gctgggaactgtagtctaaa

SEQ ID NO: 258297 - DNA, 20 bp, human
ggcaacccgtagtgcggggc

SEQ ID NO: 258298 - DNA, 20 bp, human
gagggagcccaaagtggagt

SEQ ID NO: 258299 - DNA, 20 bp, human
gggaaattgtagtccgattg

SEQ ID NO: 258300 - DNA, 20 bp, human
ggcactacgggttgcaatga

SEQ ID NO: 258301 - DNA, 20 bp, human
ggaggccccgccccgcacta

SEQ ID NO: 258302 - DNA, 20 bp, human
gagagccacctgtccggata

SEQ ID NO: 258303 - DNA, 20 bp, human
ggctgcgcgcttcgcttctg

SEQ ID NO: 258304 - DNA, 20 bp, human
gttctgggacgcaatcgcct

SEQ ID NO: 258305 - DNA, 20 bp, human
ggctcccaaaatggcgagtg

SEQ ID NO: 258306 - DNA, 20 bp, human
gatcaacctcagacccctgt

SEQ ID NO: 258307 - DNA, 20 bp, human
ggaggcgcgaggagtcggta

SEQ ID NO: 258308 - DNA, 20 bp, human
gtcttccccgggagcccaca

SEQ ID NO: 258309 - DNA, 20 bp, human
gggtctgaggttgatcccgg

SEQ ID NO: 258310 - DNA, 20 bp, human
gcacgcagtaggggacaaaa

SEQ ID NO: 258311 - DNA, 20 bp, human
gaggtggcaggcatatagta

SEQ ID NO: 258312 - DNA, 20 bp, human
ggtgcgcatgcgtcttcccc

SEQ ID NO: 258313 - DNA, 20 bp, human
gacgaaggggccagctccat

SEQ ID NO: 258314 - DNA, 20 bp, human
ggaggagtcggtacgggtca

SEQ ID NO: 258315 - DNA, 20 bp, human
ggaggcgcagggtaggagtg

SEQ ID NO: 258316 - DNA, 20 bp, human
ggaacccgagccgctcgcgc

SEQ ID NO: 258317 - DNA, 20 bp, human
gcgcagagccaggcccgcga

SEQ ID NO: 258318 - DNA, 20 bp, human
ggcggcctccccagcggcaa

SEQ ID NO: 258319 - DNA, 20 bp, human
gaactaaagcagggcaggga

SEQ ID NO: 258320 - DNA, 20 bp, human
gtggcgtggccgagtcgcta

SEQ ID NO: 258321 - DNA, 20 bp, human
gtggccgagtcgctacggac

SEQ ID NO: 258322 - DNA, 20 bp, human
ggccaggccctcagccgtgg

SEQ ID NO: 258323 - DNA, 20 bp, human
gtggggcccggccgcgaaaa

SEQ ID NO: 258324 - DNA, 20 bp, human
gtggctgcccccacggctga

SEQ ID NO: 258325 - DNA, 20 bp, human
gcgcccccagtggcggtacc

SEQ ID NO: 258326 - DNA, 20 bp, human
ggacgaatgtagatcatgga

SEQ ID NO: 258327 - DNA, 20 bp, human
ggggaggcgaaccggaattg

SEQ ID NO: 258328 - DNA, 20 bp, human
gtcggaggacccagactcta

SEQ ID NO: 258329 - DNA, 20 bp, human
gttgtcacaggcgacgaagg

SEQ ID NO: 258330 - DNA, 20 bp, human
gcgaggaggttccgcatgcg

SEQ ID NO: 258331 - DNA, 20 bp, human
gtctgggtcctccgagaaca

SEQ ID NO: 258332 - DNA, 20 bp, human
ggcaagcgctgaacgaatag

SEQ ID NO: 258333 - DNA, 20 bp, human
gagcgcacgctgaggaggat

SEQ ID NO: 258334 - DNA, 20 bp, human
ggaggggttgggaggcgaac

SEQ ID NO: 258335 - DNA, 20 bp, human
gaaccagctgactcccgtag

SEQ ID NO: 258336 - DNA, 20 bp, human
gacgccgcgcacaggtcgct

SEQ ID NO: 258337 - DNA, 20 bp, human
gtaccctaacccaggaggaa

SEQ ID NO: 258338 - DNA, 20 bp, human
gcacacgaagcgcgctaggt

SEQ ID NO: 258339 - DNA, 20 bp, human
gccgcccagcgacctgtgcg

SEQ ID NO: 258340 - DNA, 20 bp, human
gccgcgtcgccaggcatgcc

SEQ ID NO: 258341 - DNA, 20 bp, human
gagcgcaaccctcttataaa

SEQ ID NO: 258342 - DNA, 20 bp, human
gtcgtgtggcgcgagttacc

SEQ ID NO: 258343 - DNA, 20 bp, human
gtaacccactaccctaaccc

SEQ ID NO: 258344 - DNA, 20 bp, human
gctgcagccggaagaacatt

SEQ ID NO: 258345 - DNA, 20 bp, human
gcctcctgggttagggtagt

SEQ ID NO: 258346 - DNA, 20 bp, human
gcccgccggcccgtgcgagg

SEQ ID NO: 258347 - DNA, 20 bp, human
gcggggaagcggagacggga

SEQ ID NO: 258348 - DNA, 20 bp, human
ggaaacctgggaatcagcta

SEQ ID NO: 258349 - DNA, 20 bp, human
gcgcgcggaagtttggtgaa

SEQ ID NO: 258350 - DNA, 20 bp, human
gagacgggaaggccgagtag

SEQ ID NO: 258351 - DNA, 20 bp, human
gtgggaatcagctagggtgt

SEQ ID NO: 258352 - DNA, 20 bp, human
gcaagagccccgtcataggt

SEQ ID NO: 258353 - DNA, 20 bp, human
gcgaggcgggtgatgcaacc

SEQ ID NO: 258354 - DNA, 20 bp, human
gggtcggcgcccacctatga

SEQ ID NO: 258355 - DNA, 20 bp, human
gcgccccgccggcccgtgcg

SEQ ID NO: 258356 - DNA, 20 bp, human
ggccaagacaggcgattccc

SEQ ID NO: 258357 - DNA, 20 bp, human
gccggcgccgccacgtctgt

SEQ ID NO: 258358 - DNA, 20 bp, human
gaaggtccagttcccgtctt

SEQ ID NO: 258359 - DNA, 20 bp, human
gcgcacgccgacagacgtgg

SEQ ID NO: 258360 - DNA, 20 bp, human
gttcgagcgagaattagggt

SEQ ID NO: 258361 - DNA, 20 bp, human
gacaggcccaagacgggaac

SEQ ID NO: 258362 - DNA, 20 bp, human
gatccaggacaggcccaaga

SEQ ID NO: 258363 - DNA, 20 bp, human
gcccaggccccggatgtagg

SEQ ID NO: 258364 - DNA, 20 bp, human
gccgcccaggccccggatgt

SEQ ID NO: 258365 - DNA, 20 bp, human
ggcctgtcctggatagcgtt

SEQ ID NO: 258366 - DNA, 20 bp, human
gccgcagcgtccgacgggaa

SEQ ID NO: 258367 - DNA, 20 bp, human
gccgccccgcagcgtccgac

SEQ ID NO: 258368 - DNA, 20 bp, human
ggggaggacgccatgttgga

SEQ ID NO: 258369 - DNA, 20 bp, human
gggggcgcacccacgccctg

SEQ ID NO: 258370 - DNA, 20 bp, human
gggacagcgcgggtcacgtg

SEQ ID NO: 258371 - DNA, 20 bp, human
gtcgtgaggccccagggcgt

SEQ ID NO: 258372 - DNA, 20 bp, human
gcctcgccgcgtggagctcg

SEQ ID NO: 258373 - DNA, 20 bp, human
ggaggacaaccactggttgg

SEQ ID NO: 258374 - DNA, 20 bp, human
gcgcgcagagcgaaccgctc

SEQ ID NO: 258375 - DNA, 20 bp, human
gccgccccgcggccttggtg

SEQ ID NO: 258376 - DNA, 20 bp, human
ggaaccgggcgctgagacct

SEQ ID NO: 258377 - DNA, 20 bp, human
gtggccttcgcgccataagg

SEQ ID NO: 258378 - DNA, 20 bp, human
gggggcggggacaagcctga

SEQ ID NO: 258379 - DNA, 20 bp, human
gcctaccgcgcgttggtgtc

SEQ ID NO: 258380 - DNA, 20 bp, human
gaagcgccgactaactacac

SEQ ID NO: 258381 - DNA, 20 bp, human
gtaaaacacgaagatcggcg

SEQ ID NO: 258382 - DNA, 20 bp, human
gcagccaaggtctcagcgcc

SEQ ID NO: 258383 - DNA, 20 bp, human
gccttcgcgccataaggggg

SEQ ID NO: 258384 - DNA, 20 bp, human
ggcttgtccccgccccctta

SEQ ID NO: 258385 - DNA, 20 bp, human
gaaatcccgacaccaacgcg

SEQ ID NO: 258386 - DNA, 20 bp, human
gtggccttcgcgccataagg

SEQ ID NO: 258387 - DNA, 20 bp, human
ggaaccgggcgctgagacct

SEQ ID NO: 258388 - DNA, 20 bp, human
gcctaccgcgcgttggtgtc

SEQ ID NO: 258389 - DNA, 20 bp, human
gggggcggggacaagcctga

SEQ ID NO: 258390 - DNA, 20 bp, human
gtaaaacacgaagatcggcg

SEQ ID NO: 258391 - DNA, 20 bp, human
ggcgctgagaccttggctgc

SEQ ID NO: 258392 - DNA, 20 bp, human
ggcttgtccccgccccctta

SEQ ID NO: 258393 - DNA, 20 bp, human
gccttcgcgccataaggggg

SEQ ID NO: 258394 - DNA, 20 bp, human
gaaatcccgacaccaacgcg

SEQ ID NO: 258395 - DNA, 20 bp, human
gttatggcgcgaaggccact

SEQ ID NO: 258396 - DNA, 20 bp, human
gggcgcctcggaggctaatg

SEQ ID NO: 258397 - DNA, 20 bp, human
ggtgacggtgggatacatgg

SEQ ID NO: 258398 - DNA, 20 bp, human
ggggagtcgcgggtgacggt

SEQ ID NO: 258399 - DNA, 20 bp, human
gaagcattgtgggacacaga

SEQ ID NO: 258400 - DNA, 20 bp, human
gcgaggcgccgagacgcgag

SEQ ID NO: 258401 - DNA, 20 bp, human
ggcgtcctcattagcctccg

SEQ ID NO: 258402 - DNA, 20 bp, human
gatccggggacgcccaaaga

SEQ ID NO: 258403 - DNA, 20 bp, human
gtagaacaggcggggagtcg

SEQ ID NO: 258404 - DNA, 20 bp, human
ggcctggcgaaacgcagtaa

SEQ ID NO: 258405 - DNA, 20 bp, human
gctcacgagccgtaaagcga

SEQ ID NO: 258406 - DNA, 20 bp, human
ggcgccctaacgcaaagggt

SEQ ID NO: 258407 - DNA, 20 bp, human
gaaaggggcggggtttaccc

SEQ ID NO: 258408 - DNA, 20 bp, human
gcactcgcgccctaacgcaa

SEQ ID NO: 258409 - DNA, 20 bp, human
ggacaacgacgcatgcgcgc

SEQ ID NO: 258410 - DNA, 20 bp, human
gttgtcccaccctttgcgtt

SEQ ID NO: 258411 - DNA, 20 bp, human
gctgtactgcgcatgtgctg

SEQ ID NO: 258412 - DNA, 20 bp, human
gaacagatccctctatttgt

SEQ ID NO: 258413 - DNA, 20 bp, human
gctggcctaaagaaaggggc

SEQ ID NO: 258414 - DNA, 20 bp, human
ggatctgtctgttcgtttgt

SEQ ID NO: 258415 - DNA, 20 bp, human
ggtaaaactggcctaaagaa

SEQ ID NO: 258416 - DNA, 20 bp, human
gggttactggtgatacttct

SEQ ID NO: 258417 - DNA, 20 bp, human
gccctgggctaagtagttcc

SEQ ID NO: 258418 - DNA, 20 bp, human
gcaaaaagctctagctcacg

SEQ ID NO: 258419 - DNA, 20 bp, human
gtgaatatcaggagcttgat

SEQ ID NO: 258420 - DNA, 20 bp, human
gtttggcccgaggagcactc

SEQ ID NO: 258421 - DNA, 20 bp, human
gggtttcctgagtgctcctc

SEQ ID NO: 258422 - DNA, 20 bp, human
ggaaccagaaagcagcgcgg

SEQ ID NO: 258423 - DNA, 20 bp, human
gacccggaactacttagccc

SEQ ID NO: 258424 - DNA, 20 bp, human
gcagaagaaattaccaacgg

SEQ ID NO: 258425 - DNA, 20 bp, human
ggcgctctgcttttggcccg

SEQ ID NO: 258426 - DNA, 20 bp, human
gggggcagaggctgatttca

SEQ ID NO: 258427 - DNA, 20 bp, human
ggcacccacagcgacacctg

SEQ ID NO: 258428 - DNA, 20 bp, human
gaccagagtagggccagcgg

SEQ ID NO: 258429 - DNA, 20 bp, human
gggtaccagagtagggccag

SEQ ID NO: 258430 - DNA, 20 bp, human
gggtgtcgctgtgggtgccg

SEQ ID NO: 258431 - DNA, 20 bp, human
gcgctgctggtaccagagta

SEQ ID NO: 258432 - DNA, 20 bp, human
ggcggctgggcccctctagg

SEQ ID NO: 258433 - DNA, 20 bp, human
gcccctctaggcggcgacgg

SEQ ID NO: 258434 - DNA, 20 bp, human
ggggcccctctaggcggcga

SEQ ID NO: 258435 - DNA, 20 bp, human
gcgcggctgtgtatgctact

SEQ ID NO: 258436 - DNA, 20 bp, human
gttcgaggggcggagacgga

SEQ ID NO: 258437 - DNA, 20 bp, human
ggggaggcggggcccaattt

SEQ ID NO: 258438 - DNA, 20 bp, human
gtcgcaggccggcgttcgag

SEQ ID NO: 258439 - DNA, 20 bp, human
gggcgttcgaggggcggaga

SEQ ID NO: 258440 - DNA, 20 bp, human
gggaaggagaagccaaaatt

SEQ ID NO: 258441 - DNA, 20 bp, human
gctcgcgtgacgtcactcgc

SEQ ID NO: 258442 - DNA, 20 bp, human
ggaggtcgaaaatgtacagt

SEQ ID NO: 258443 - DNA, 20 bp, human
gaaacgtgagttaccggaag

SEQ ID NO: 258444 - DNA, 20 bp, human
gatgcacaaaggataccgcc

SEQ ID NO: 258445 - DNA, 20 bp, human
gagatcattccatcggaaag

SEQ ID NO: 258446 - DNA, 20 bp, human
gggtcgggaaatccatggaa

SEQ ID NO: 258447 - DNA, 20 bp, human
gaagctagggagatgaatcc

SEQ ID NO: 258448 - DNA, 20 bp, human
gagcaggggtcggggttaga

SEQ ID NO: 258449 - DNA, 20 bp, human
gggggcggagacccataatc

SEQ ID NO: 258450 - DNA, 20 bp, human
ggcctctggggttgtagcag

SEQ ID NO: 258451 - DNA, 20 bp, human
gtctacttccgggaacgaag

SEQ ID NO: 258452 - DNA, 20 bp, human
ggcggctagctggggctaga

SEQ ID NO: 258453 - DNA, 20 bp, human
gcgggaaatccatggaaggg

SEQ ID NO: 258454 - DNA, 20 bp, human
gggagcaggaaatgaattcg

SEQ ID NO: 258455 - DNA, 20 bp, human
gacttccgggaacgaagggg

SEQ ID NO: 258456 - DNA, 20 bp, human
gacgcgcgcgggtaagaagt

SEQ ID NO: 258457 - DNA, 20 bp, human
gcgcgcgggtaagaagtggg

SEQ ID NO: 258458 - DNA, 20 bp, human
ggggcggggaacgcggtcgg

SEQ ID NO: 258459 - DNA, 20 bp, human
gaagaagtgggcggggaacg

SEQ ID NO: 258460 - DNA, 20 bp, human
gaacgcggtcggtggcgctg

SEQ ID NO: 258461 - DNA, 20 bp, human
ggaggccacgccccctcagg

SEQ ID NO: 258462 - DNA, 20 bp, human
ggaccggcgcggagcaggat

SEQ ID NO: 258463 - DNA, 20 bp, human
gggtctgcgttgtagggagc

SEQ ID NO: 258464 - DNA, 20 bp, human
gcctaccccgcttcgaccgg

SEQ ID NO: 258465 - DNA, 20 bp, human
gtagcgaggagttagcacgg

SEQ ID NO: 258466 - DNA, 20 bp, human
gcgtgcgcgcgcgaactcac

SEQ ID NO: 258467 - DNA, 20 bp, human
gcaggcgcctctcgtggcga

SEQ ID NO: 258468 - DNA, 20 bp, human
gttactggatcccagtgcgc

SEQ ID NO: 258469 - DNA, 20 bp, human
gcagcagccgccacgctttc

SEQ ID NO: 258470 - DNA, 20 bp, human
ggctgtctgtccagcttgag

SEQ ID NO: 258471 - DNA, 20 bp, human
gcgtcctcaaggacgggaac

SEQ ID NO: 258472 - DNA, 20 bp, human
gcgggaagcacccggagctc

SEQ ID NO: 258473 - DNA, 20 bp, human
gcccgccccctcgccacgag

SEQ ID NO: 258474 - DNA, 20 bp, human
ggcgctaccggcactggaac

SEQ ID NO: 258475 - DNA, 20 bp, human
ggaagaagtcacgtggcagc

SEQ ID NO: 258476 - DNA, 20 bp, human
ggaagaggagccgcgttccg

SEQ ID NO: 258477 - DNA, 20 bp, human
gtgagacagccatatccaga

SEQ ID NO: 258478 - DNA, 20 bp, human
gttcccggcaggcccgagtg

SEQ ID NO: 258479 - DNA, 20 bp, human
gatggccagaggcctcggaa

SEQ ID NO: 258480 - DNA, 20 bp, human
gcggaagttcagccccactc

SEQ ID NO: 258481 - DNA, 20 bp, human
ggaaaccggaagcctttccg

SEQ ID NO: 258482 - DNA, 20 bp, human
gcgcgcctgcgtcctgaggc

SEQ ID NO: 258483 - DNA, 20 bp, human
ggggctgaacttccggcctc

SEQ ID NO: 258484 - DNA, 20 bp, human
ggaagcctttccgaggcctc

SEQ ID NO: 258485 - DNA, 20 bp, human
gacttccggcctcaggacgc

SEQ ID NO: 258486 - DNA, 20 bp, human
gcgagagcgcgcgataggat

SEQ ID NO: 258487 - DNA, 20 bp, human
gctagtgggtgggacttact

SEQ ID NO: 258488 - DNA, 20 bp, human
ggcgctcgggctggcctagt

SEQ ID NO: 258489 - DNA, 20 bp, human
gacacgggcctgaaaactgg

SEQ ID NO: 258490 - DNA, 20 bp, human
gctcgccgcggaatgcagca

SEQ ID NO: 258491 - DNA, 20 bp, human
ggctacacgggcctgaaaac

SEQ ID NO: 258492 - DNA, 20 bp, human
gcccaacaggtcgccgctca

SEQ ID NO: 258493 - DNA, 20 bp, human
ggcttccgggtcaccctgag

SEQ ID NO: 258494 - DNA, 20 bp, human
gtcgggctggcctagtgggt

SEQ ID NO: 258495 - DNA, 20 bp, human
gcacgccctgctgcattccg

SEQ ID NO: 258496 - DNA, 20 bp, human
gagagtgcagggccccaaga

SEQ ID NO: 258497 - DNA, 20 bp, human
ggcccgccccgcagcctcat

SEQ ID NO: 258498 - DNA, 20 bp, human
gggcgggccttcaccttgat

SEQ ID NO: 258499 - DNA, 20 bp, human
gtccgccccggccatcgcat

SEQ ID NO: 258500 - DNA, 20 bp, human
gccgtaccggcgagaaaggc

SEQ ID NO: 258501 - DNA, 20 bp, human
gcgagtgcctatcaaggtga

SEQ ID NO: 258502 - DNA, 20 bp, human
gaggcactcgagttatccaa

SEQ ID NO: 258503 - DNA, 20 bp, human
gcctgcgggccggagcgact

SEQ ID NO: 258504 - DNA, 20 bp, human
gccgcagcctcattggctgg

SEQ ID NO: 258505 - DNA, 20 bp, human
gcgacagtgccttggtcatg

SEQ ID NO: 258506 - DNA, 20 bp, human
gaatcctagggcccggggtt

SEQ ID NO: 258507 - DNA, 20 bp, human
gagggacgcggaaaccccgt

SEQ ID NO: 258508 - DNA, 20 bp, human
gaaaccccgtaggagcaggg

SEQ ID NO: 258509 - DNA, 20 bp, human
gccggcccgcctctgcgtca

SEQ ID NO: 258510 - DNA, 20 bp, human
ggcccgacgaacagcatctc

SEQ ID NO: 258511 - DNA, 20 bp, human
gcgcctctgcgtcagggacg

SEQ ID NO: 258512 - DNA, 20 bp, human
ggatcctggggtcgttacct

SEQ ID NO: 258513 - DNA, 20 bp, human
gggccggaacccgtttcttg

SEQ ID NO: 258514 - DNA, 20 bp, human
gtatccgaggtaacgacccc

SEQ ID NO: 258515 - DNA, 20 bp, human
ggccacgagcctataaaaaa

SEQ ID NO: 258516 - DNA, 20 bp, human
gaaaagggaaagtaacctct

SEQ ID NO: 258517 - DNA, 20 bp, human
gttgggcataatgttccaaa

SEQ ID NO: 258518 - DNA, 20 bp, human
ggtgtatcctacttttttta

SEQ ID NO: 258519 - DNA, 20 bp, human
gtaaaggagtctctccttcg

SEQ ID NO: 258520 - DNA, 20 bp, human
gtgctgatcacttgattatt

SEQ ID NO: 258521 - DNA, 20 bp, human
gatgatggcaatcatctttc

SEQ ID NO: 258522 - DNA, 20 bp, human
ggtaagcatagatgccacga

SEQ ID NO: 258523 - DNA, 20 bp, human
gggatcttgaagctttggaa

SEQ ID NO: 258524 - DNA, 20 bp, human
gaaaagaaactggcattttt

SEQ ID NO: 258525 - DNA, 20 bp, human
gatcataccctaaaaaaagt

SEQ ID NO: 258526 - DNA, 20 bp, human
ggcacccagttccttacgaa

SEQ ID NO: 258527 - DNA, 20 bp, human
gtcccgcgggatctcgttga

SEQ ID NO: 258528 - DNA, 20 bp, human
gcactcttcgtcacgtgaaa

SEQ ID NO: 258529 - DNA, 20 bp, human
gtccttacgaaagggatgga

SEQ ID NO: 258530 - DNA, 20 bp, human
gatcccgcgggaactgcata

SEQ ID NO: 258531 - DNA, 20 bp, human
gggaactgggcgtttgccgc

SEQ ID NO: 258532 - DNA, 20 bp, human
ggcgccatatgcagttcccg

SEQ ID NO: 258533 - DNA, 20 bp, human
gagagtgccccgtcccccag

SEQ ID NO: 258534 - DNA, 20 bp, human
ggcgacgcggccacgcctct

SEQ ID NO: 258535 - DNA, 20 bp, human
ggccccgtcccccagaggcg

SEQ ID NO: 258536 - DNA, 20 bp, human
gaggtggcacgccgtccgac

SEQ ID NO: 258537 - DNA, 20 bp, human
ggccctacgtaaagcgtgag

SEQ ID NO: 258538 - DNA, 20 bp, human
ggtcgcgcatgtcttcccgt

SEQ ID NO: 258539 - DNA, 20 bp, human
gaacccctcacgctttacgt

SEQ ID NO: 258540 - DNA, 20 bp, human
gagtctgtgcgtcaggaggc

SEQ ID NO: 258541 - DNA, 20 bp, human
gggaagacatgcgcgacatg

SEQ ID NO: 258542 - DNA, 20 bp, human
gaggagacgcgaagctggga

SEQ ID NO: 258543 - DNA, 20 bp, human
gtctgcacggagccggtgat

SEQ ID NO: 258544 - DNA, 20 bp, human
gaggaagtctgtgcgtcagg

SEQ ID NO: 258545 - DNA, 20 bp, human
ggacatgtggccaaaggggc

SEQ ID NO: 258546 - DNA, 20 bp, human
gcggctgcgtgagtaacgag

SEQ ID NO: 258547 - DNA, 20 bp, human
gaaccgcgcaccctacccat

SEQ ID NO: 258548 - DNA, 20 bp, human
gcggcacctgcgcaagactg

SEQ ID NO: 258549 - DNA, 20 bp, human
gtgactaagccctggactga

SEQ ID NO: 258550 - DNA, 20 bp, human
ggtcacgtggccgatgggta

SEQ ID NO: 258551 - DNA, 20 bp, human
gggccgatgggtagggtgcg

SEQ ID NO: 258552 - DNA, 20 bp, human
ggactggtcacgtggccgat

SEQ ID NO: 258553 - DNA, 20 bp, human
gtgagtaacgagaggcttct

SEQ ID NO: 258554 - DNA, 20 bp, human
ggggcgacaaagggcacagt

SEQ ID NO: 258555 - DNA, 20 bp, human
gtcttgcgcaggtgccgcca

SEQ ID NO: 258556 - DNA, 20 bp, human
gcccgccccgggaggctcat

SEQ ID NO: 258557 - DNA, 20 bp, human
gccggagcgcgcgagctcgc

SEQ ID NO: 258558 - DNA, 20 bp, human
gtccccgccccctgtcagtc

SEQ ID NO: 258559 - DNA, 20 bp, human
gaggggccggaggggggata

SEQ ID NO: 258560 - DNA, 20 bp, human
ggcagggcgcgaggaacgag

SEQ ID NO: 258561 - DNA, 20 bp, human
gcccctgtcagtcaggccga

SEQ ID NO: 258562 - DNA, 20 bp, human
ggggccgggatcaggcgctc

SEQ ID NO: 258563 - DNA, 20 bp, human
ggccaggccggggtggacca

SEQ ID NO: 258564 - DNA, 20 bp, human
gtggctacgcacccgagacc

SEQ ID NO: 258565 - DNA, 20 bp, human
gcgggtcgcgggtcctgagc

SEQ ID NO: 258566 - DNA, 20 bp, human
gcgcaggcccggtttggaag

SEQ ID NO: 258567 - DNA, 20 bp, human
gtgacccgcccgctctccta

SEQ ID NO: 258568 - DNA, 20 bp, human
gcgcagagggctggactcag

SEQ ID NO: 258569 - DNA, 20 bp, human
ggcggggcgcagcggaacgt

SEQ ID NO: 258570 - DNA, 20 bp, human
gcctgaggcagtggcgacag

SEQ ID NO: 258571 - DNA, 20 bp, human
ggaacgtcggcgcgcaggcc

SEQ ID NO: 258572 - DNA, 20 bp, human
gctcagggcggctgcgcaga

SEQ ID NO: 258573 - DNA, 20 bp, human
gtcggcgcgcaggcccggtt

SEQ ID NO: 258574 - DNA, 20 bp, human
gtacccgggcccaaggctga

SEQ ID NO: 258575 - DNA, 20 bp, human
gctggactcagcggcggagc

SEQ ID NO: 258576 - DNA, 20 bp, human
ggggccctctagcccgtccc

SEQ ID NO: 258577 - DNA, 20 bp, human
gccgccgcccgccgccttca

SEQ ID NO: 258578 - DNA, 20 bp, human
gcggccccccatccctccgt

SEQ ID NO: 258579 - DNA, 20 bp, human
gacagacccacggagggatg

SEQ ID NO: 258580 - DNA, 20 bp, human
gtgggtctgtctttgttcgg

SEQ ID NO: 258581 - DNA, 20 bp, human
gacgggctagagggcccacg

SEQ ID NO: 258582 - DNA, 20 bp, human
gtggagggatggatgggaca

SEQ ID NO: 258583 - DNA, 20 bp, human
gaacaaagacagacccacgg

SEQ ID NO: 258584 - DNA, 20 bp, human
ggggaccggggaacggtctg

SEQ ID NO: 258585 - DNA, 20 bp, human
ggcggcgggcggctagcccg

SEQ ID NO: 258586 - DNA, 20 bp, human
gagcagacgggagtgggtcg

SEQ ID NO: 258587 - DNA, 20 bp, human
gcccgtgagcagacgggagt

SEQ ID NO: 258588 - DNA, 20 bp, human
ggacggaggggcagtcgctg

SEQ ID NO: 258589 - DNA, 20 bp, human
ggcgactgcccctccgtccg

SEQ ID NO: 258590 - DNA, 20 bp, human
gggaagcagcgtcctggagc

SEQ ID NO: 258591 - DNA, 20 bp, human
gcaggacgctgcttccacgt

SEQ ID NO: 258592 - DNA, 20 bp, human
gggcggcgggggatcccacg

SEQ ID NO: 258593 - DNA, 20 bp, human
ggcgcggactacaaatccca

SEQ ID NO: 258594 - DNA, 20 bp, human
gctacaaatcccaggggcgt

SEQ ID NO: 258595 - DNA, 20 bp, human
gggagggaccccggacggag

SEQ ID NO: 258596 - DNA, 20 bp, human
ggggcggggcgaggcagtga

SEQ ID NO: 258597 - DNA, 20 bp, human
gtggctgaagttgttgaagg

SEQ ID NO: 258598 - DNA, 20 bp, human
gacttagctcgcgctccctc

SEQ ID NO: 258599 - DNA, 20 bp, human
gtggctcttctcccgctcgc

SEQ ID NO: 258600 - DNA, 20 bp, human
gtggcttaaccccagcgagc

SEQ ID NO: 258601 - DNA, 20 bp, human
gagcctggtgaaggcggaca

SEQ ID NO: 258602 - DNA, 20 bp, human
gggggaagctggtcggccgg

SEQ ID NO: 258603 - DNA, 20 bp, human
gcggaggtgacgtcgccgcg

SEQ ID NO: 258604 - DNA, 20 bp, human
ggaagttgttgaagggggcg

SEQ ID NO: 258605 - DNA, 20 bp, human
gaactggtacagcggttgag

SEQ ID NO: 258606 - DNA, 20 bp, human
gcggtcccgccctatctgct

SEQ ID NO: 258607 - DNA, 20 bp, human
gcagatagggcgggaccgtc

SEQ ID NO: 258608 - DNA, 20 bp, human
gcggccgtcactcaacccga

SEQ ID NO: 258609 - DNA, 20 bp, human
ggccagcagctgcacgtggt

SEQ ID NO: 258610 - DNA, 20 bp, human
gacggccggtggcccgccct

SEQ ID NO: 258611 - DNA, 20 bp, human
ggctgggggcaggtgaagta

SEQ ID NO: 258612 - DNA, 20 bp, human
ggaaatgcgtccaaagtccc

SEQ ID NO: 258613 - DNA, 20 bp, human
gacaacgtcacgcccagggc

SEQ ID NO: 258614 - DNA, 20 bp, human
gagcccggttcagagaaagc

SEQ ID NO: 258615 - DNA, 20 bp, human
gggcttcctagcagataggg

SEQ ID NO: 258616 - DNA, 20 bp, human
gcgcgcgcccggatgtgagg

SEQ ID NO: 258617 - DNA, 20 bp, human
gcggggccagggtgcgtgga

SEQ ID NO: 258618 - DNA, 20 bp, human
ggcgtggagggagttattaa

SEQ ID NO: 258619 - DNA, 20 bp, human
gggccgggctgcagttacgg

SEQ ID NO: 258620 - DNA, 20 bp, human
gcccccaccccgaccggctt

SEQ ID NO: 258621 - DNA, 20 bp, human
gagcccaagccggtcggggt

SEQ ID NO: 258622 - DNA, 20 bp, human
gggtgggggcgcgagagcga

SEQ ID NO: 258623 - DNA, 20 bp, human
gggcgcgagagcgaaggctg

SEQ ID NO: 258624 - DNA, 20 bp, human
gagagacagcccaagccggt

SEQ ID NO: 258625 - DNA, 20 bp, human
ggggagggggccgaagagga

SEQ ID NO: 258626 - DNA, 20 bp, human
gagttcgggaggggacacgg

SEQ ID NO: 258627 - DNA, 20 bp, human
ggcaaatcccatgtgctcgg

SEQ ID NO: 258628 - DNA, 20 bp, human
gggctgtggctgtcacgtga

SEQ ID NO: 258629 - DNA, 20 bp, human
gtgcgcctgcggagaagcgg

SEQ ID NO: 258630 - DNA, 20 bp, human
gggagtttcaaagttcggga

SEQ ID NO: 258631 - DNA, 20 bp, human
gctgtcacgtgacggggcgg

SEQ ID NO: 258632 - DNA, 20 bp, human
gcccccacgtgaccggcgca

SEQ ID NO: 258633 - DNA, 20 bp, human
gccgccgagcgggatctgtg

SEQ ID NO: 258634 - DNA, 20 bp, human
gtccccgcacagatcccgct

SEQ ID NO: 258635 - DNA, 20 bp, human
gacacagaggggaatcggtc

SEQ ID NO: 258636 - DNA, 20 bp, human
gactcagtgaacaaagggac

SEQ ID NO: 258637 - DNA, 20 bp, human
gggctttgcgcactgcggcg

SEQ ID NO: 258638 - DNA, 20 bp, human
gcatattcgcgaagtctctg

SEQ ID NO: 258639 - DNA, 20 bp, human
gccgagcgctgtcgagatga

SEQ ID NO: 258640 - DNA, 20 bp, human
gtcggcgccccttacgccac

SEQ ID NO: 258641 - DNA, 20 bp, human
gggcaaccgggccgctgatt

SEQ ID NO: 258642 - DNA, 20 bp, human
gcattcggggagactctggt

SEQ ID NO: 258643 - DNA, 20 bp, human
ggggcggcgaaggagccatt

SEQ ID NO: 258644 - DNA, 20 bp, human
gtcctcctcgctgccctgcg

SEQ ID NO: 258645 - DNA, 20 bp, human
gtctgccaccaatccgcgca

SEQ ID NO: 258646 - DNA, 20 bp, human
gaacacaagagcattttaaa

SEQ ID NO: 258647 - DNA, 20 bp, human
gccacggggaggaggcgaaa

SEQ ID NO: 258648 - DNA, 20 bp, human
gggaaattccccggtgttca

SEQ ID NO: 258649 - DNA, 20 bp, human
ggaggcgaaagggtggacag

SEQ ID NO: 258650 - DNA, 20 bp, human
gccacgagctctccacgggg

SEQ ID NO: 258651 - DNA, 20 bp, human
gacaccggggaatttccagg

SEQ ID NO: 258652 - DNA, 20 bp, human
gaaggcagtaaaaattccta

SEQ ID NO: 258653 - DNA, 20 bp, human
ggaagaccagggccacaaca

SEQ ID NO: 258654 - DNA, 20 bp, human
gacttgcaggcggaagacca

SEQ ID NO: 258655 - DNA, 20 bp, human
gtcgtggaaagacgcgcgag

SEQ ID NO: 258656 - DNA, 20 bp, human
gcctcggcaaagatcggcga

SEQ ID NO: 258657 - DNA, 20 bp, human
gcctgagccctcccgaacgg

SEQ ID NO: 258658 - DNA, 20 bp, human
ggctaggggtcgggattctt

SEQ ID NO: 258659 - DNA, 20 bp, human
ggggcggagggaaagaccaa

SEQ ID NO: 258660 - DNA, 20 bp, human
gaggggctaactcgcttcct

SEQ ID NO: 258661 - DNA, 20 bp, human
gagacgctcgggtgcgtcct

SEQ ID NO: 258662 - DNA, 20 bp, human
gtccggagactgctaggggt

SEQ ID NO: 258663 - DNA, 20 bp, human
gtcggcgagggaggcttcgc

SEQ ID NO: 258664 - DNA, 20 bp, human
gcgagggtgggaagcctctt

SEQ ID NO: 258665 - DNA, 20 bp, human
gaaagaccaaaggcgaggtc

SEQ ID NO: 258666 - DNA, 20 bp, human
gaggaacaaggagatttttg

SEQ ID NO: 258667 - DNA, 20 bp, human
gtcctcacaggtaacacaag

SEQ ID NO: 258668 - DNA, 20 bp, human
gaaaggaaaacacatgctac

SEQ ID NO: 258669 - DNA, 20 bp, human
gtaaatattgatttcctcac

SEQ ID NO: 258670 - DNA, 20 bp, human
gttagtgtaagttgtgaggt

SEQ ID NO: 258671 - DNA, 20 bp, human
gtggacgtatacactaaaaa

SEQ ID NO: 258672 - DNA, 20 bp, human
ggaactatctgatttttaat

SEQ ID NO: 258673 - DNA, 20 bp, human
gaaggagatgactacagaag

SEQ ID NO: 258674 - DNA, 20 bp, human
gtcaaaaccaaaaatcataa

SEQ ID NO: 258675 - DNA, 20 bp, human
gggaacagaaaagaaataaa

SEQ ID NO: 258676 - DNA, 20 bp, human
gtggccctggggtgcgcccg

SEQ ID NO: 258677 - DNA, 20 bp, human
gtgcgcgtgcctgcgtccaa

SEQ ID NO: 258678 - DNA, 20 bp, human
ggacgcctgcccggcctacg

SEQ ID NO: 258679 - DNA, 20 bp, human
gcagccacgggcgcacccca

SEQ ID NO: 258680 - DNA, 20 bp, human
gtcccagctggacgcctgcc

SEQ ID NO: 258681 - DNA, 20 bp, human
ggtgggctgcagagcgcacg

SEQ ID NO: 258682 - DNA, 20 bp, human
gggtgcggcggcgtcccagc

SEQ ID NO: 258683 - DNA, 20 bp, human
gtgcagcccacgtggtgcgg

SEQ ID NO: 258684 - DNA, 20 bp, human
gcgtcccaggcgaactggag

SEQ ID NO: 258685 - DNA, 20 bp, human
gacgctggccgcgcagcgcc

SEQ ID NO: 258686 - DNA, 20 bp, human
gagaggaaggaagcgagacc

SEQ ID NO: 258687 - DNA, 20 bp, human
gtaccccggccccgccacca

SEQ ID NO: 258688 - DNA, 20 bp, human
gaagacctctgggaaaggcg

SEQ ID NO: 258689 - DNA, 20 bp, human
ggctgcgccgcgaagacctc

SEQ ID NO: 258690 - DNA, 20 bp, human
gcgggtctcgcgagacccaa

SEQ ID NO: 258691 - DNA, 20 bp, human
gccgcgaagacctctgggaa

SEQ ID NO: 258692 - DNA, 20 bp, human
gcctgtcccagacccggcga

SEQ ID NO: 258693 - DNA, 20 bp, human
gagacccggagtggccctgg

SEQ ID NO: 258694 - DNA, 20 bp, human
gaggccgcgagttgagcctc

SEQ ID NO: 258695 - DNA, 20 bp, human
gcccgccaccagggccactc

SEQ ID NO: 258696 - DNA, 20 bp, human
gttacagttaactagatctc

SEQ ID NO: 258697 - DNA, 20 bp, human
gcatggcaaccaataaacca

SEQ ID NO: 258698 - DNA, 20 bp, human
gaacgcatttaaagagtgga

SEQ ID NO: 258699 - DNA, 20 bp, human
ggtgaggaaccgtggtttat

SEQ ID NO: 258700 - DNA, 20 bp, human
gggggaacgcatttaaagag

SEQ ID NO: 258701 - DNA, 20 bp, human
gcaagttaagtgaggaaccg

SEQ ID NO: 258702 - DNA, 20 bp, human
ggttcctcacttaacttgta

SEQ ID NO: 258703 - DNA, 20 bp, human
gtggtagttttgtaaactca

SEQ ID NO: 258704 - DNA, 20 bp, human
gttgtattagtagtagactc

SEQ ID NO: 258705 - DNA, 20 bp, human
gttaccttacaagttaagtg

SEQ ID NO: 258706 - DNA, 20 bp, human
gcagagagcggcgcgaggtg

SEQ ID NO: 258707 - DNA, 20 bp, human
ggctgcttggttggtcagtg

SEQ ID NO: 258708 - DNA, 20 bp, human
gaggacgagcggtctatcaa

SEQ ID NO: 258709 - DNA, 20 bp, human
ggagcggtctatcaagggga

SEQ ID NO: 258710 - DNA, 20 bp, human
ggcagggctccttattgcgc

SEQ ID NO: 258711 - DNA, 20 bp, human
gcgtcattggacgggtcggt

SEQ ID NO: 258712 - DNA, 20 bp, human
gaacgctcagggtttgtgag

SEQ ID NO: 258713 - DNA, 20 bp, human
gcgcttgcgcggctgtcata

SEQ ID NO: 258714 - DNA, 20 bp, human
gggtcacgtatgcgcgtcat

SEQ ID NO: 258715 - DNA, 20 bp, human
ggactgcccggtaggacgag

SEQ ID NO: 258716 - DNA, 20 bp, human
gtcacaggcaccgccctctc

SEQ ID NO: 258717 - DNA, 20 bp, human
gggggcctatcccggaaata

SEQ ID NO: 258718 - DNA, 20 bp, human
gataggccccggagcgtcac

SEQ ID NO: 258719 - DNA, 20 bp, human
ggggcggagcctcgggaatc

SEQ ID NO: 258720 - DNA, 20 bp, human
gcgccctctcgggctaccat

SEQ ID NO: 258721 - DNA, 20 bp, human
gcgctcttcacgtgactggg

SEQ ID NO: 258722 - DNA, 20 bp, human
gcggaaatagggctgagtgg

SEQ ID NO: 258723 - DNA, 20 bp, human
gcactaatccgcagcacgtg

SEQ ID NO: 258724 - DNA, 20 bp, human
gcggtgcctgtgacgctccg

SEQ ID NO: 258725 - DNA, 20 bp, human
gtcgggaatctggtagccaa

SEQ ID NO: 258726 - DNA, 20 bp, human
gtcctggaaggatctctctg

SEQ ID NO: 258727 - DNA, 20 bp, human
gaaacctgattctccatcag

SEQ ID NO: 258728 - DNA, 20 bp, human
gacaactaaacccataagga

SEQ ID NO: 258729 - DNA, 20 bp, human
ggagaatcaggtttccctgt

SEQ ID NO: 258730 - DNA, 20 bp, human
gaggctgattgtctgggttc

SEQ ID NO: 258731 - DNA, 20 bp, human
gttctggcatcagcctctga

SEQ ID NO: 258732 - DNA, 20 bp, human
gtcgtctgactcctcccaca

SEQ ID NO: 258733 - DNA, 20 bp, human
gaatcaggtttccctgtggg

SEQ ID NO: 258734 - DNA, 20 bp, human
gtctctgaggctgattgtct

SEQ ID NO: 258735 - DNA, 20 bp, human
gtcctctgctccgtccttat

SEQ ID NO: 258736 - DNA, 20 bp, human
ggcttcgggtagagcgtctc

SEQ ID NO: 258737 - DNA, 20 bp, human
ggtggaaaacccgcgggtgt

SEQ ID NO: 258738 - DNA, 20 bp, human
ggggctgctgcctggtcggc

SEQ ID NO: 258739 - DNA, 20 bp, human
ggccctgcgtcctcacgccg

SEQ ID NO: 258740 - DNA, 20 bp, human
gtgcgttccccgttgggaga

SEQ ID NO: 258741 - DNA, 20 bp, human
gcgagcggcggcagcacgag

SEQ ID NO: 258742 - DNA, 20 bp, human
gtcatcgagagctgcgcttc

SEQ ID NO: 258743 - DNA, 20 bp, human
ggctcgtggcggacgcttga

SEQ ID NO: 258744 - DNA, 20 bp, human
gcagacccgcgcactggaac

SEQ ID NO: 258745 - DNA, 20 bp, human
ggcccagccgcctcggcgtg

SEQ ID NO: 258746 - DNA, 20 bp, human
gcggcctccggcggactcta

SEQ ID NO: 258747 - DNA, 20 bp, human
ggggcccccaccagaacctc

SEQ ID NO: 258748 - DNA, 20 bp, human
gccggaggccggaggtagag

SEQ ID NO: 258749 - DNA, 20 bp, human
gaagtctccctggacggaag

SEQ ID NO: 258750 - DNA, 20 bp, human
ggaccggagctgaccctccc

SEQ ID NO: 258751 - DNA, 20 bp, human
gcggactctatggtcgcgag

SEQ ID NO: 258752 - DNA, 20 bp, human
gcgaccatagagtccgccgg

SEQ ID NO: 258753 - DNA, 20 bp, human
gggaaacggaaaccttttta

SEQ ID NO: 258754 - DNA, 20 bp, human
gcgcgagcaggctaggcgtg

SEQ ID NO: 258755 - DNA, 20 bp, human
gaacctgggagggtcagctc

SEQ ID NO: 258756 - DNA, 20 bp, human
gggctccccccgggccgcga

SEQ ID NO: 258757 - DNA, 20 bp, human
ggcgcttccgggctcccccc

SEQ ID NO: 258758 - DNA, 20 bp, human
gacacagcgacctgggaaag

SEQ ID NO: 258759 - DNA, 20 bp, human
gcggccgctctaggatgcga

SEQ ID NO: 258760 - DNA, 20 bp, human
gtggctctgggcgcgcttcc

SEQ ID NO: 258761 - DNA, 20 bp, human
gaaggtgcatggtcaggcaa

SEQ ID NO: 258762 - DNA, 20 bp, human
gccgctctaggatgcgaggg

SEQ ID NO: 258763 - DNA, 20 bp, human
gcccagagccaggtcccgcg

SEQ ID NO: 258764 - DNA, 20 bp, human
gaactcaatcactgccctcg

SEQ ID NO: 258765 - DNA, 20 bp, human
gcactgccctcgcggcccgg

SEQ ID NO: 258766 - DNA, 20 bp, human
ggacagtggccatagagtag

SEQ ID NO: 258767 - DNA, 20 bp, human
gcggaacagaactaggggcg

SEQ ID NO: 258768 - DNA, 20 bp, human
ggcaaaccggaacagaacta

SEQ ID NO: 258769 - DNA, 20 bp, human
gaatactagagcgtctcaag

SEQ ID NO: 258770 - DNA, 20 bp, human
ggggacttgtcaattgacag

SEQ ID NO: 258771 - DNA, 20 bp, human
gaaacgcgggcgtaggtgac

SEQ ID NO: 258772 - DNA, 20 bp, human
gcggtaaagctcctttctat

SEQ ID NO: 258773 - DNA, 20 bp, human
ggaaaggagctttaccgctc

SEQ ID NO: 258774 - DNA, 20 bp, human
ggccggacgcaccatgtcgc

SEQ ID NO: 258775 - DNA, 20 bp, human
gtctgagggactgacgtgcc

SEQ ID NO: 258776 - DNA, 20 bp, human
ggcacagggcgttgatgaaa

SEQ ID NO: 258777 - DNA, 20 bp, human
gcggccgtggggcaatgcaa

SEQ ID NO: 258778 - DNA, 20 bp, human
gcaagacgctggattggctc

SEQ ID NO: 258779 - DNA, 20 bp, human
ggagaagggggacaagacgc

SEQ ID NO: 258780 - DNA, 20 bp, human
ggggccctctatggagaggt

SEQ ID NO: 258781 - DNA, 20 bp, human
gacgctggattggctcgggt

SEQ ID NO: 258782 - DNA, 20 bp, human
ggaaaagacacgcgagtcgg

SEQ ID NO: 258783 - DNA, 20 bp, human
gcagggcgttgatgaaaagg

SEQ ID NO: 258784 - DNA, 20 bp, human
ggggggacaagacgctggat

SEQ ID NO: 258785 - DNA, 20 bp, human
gcatcaacgccctgtgccag

SEQ ID NO: 258786 - DNA, 20 bp, human
gcggccgcggagcacttcgc

SEQ ID NO: 258787 - DNA, 20 bp, human
gccgcctgcgaagtgctccg

SEQ ID NO: 258788 - DNA, 20 bp, human
gagcgccgcgacagctacgc

SEQ ID NO: 258789 - DNA, 20 bp, human
gccccctccgcggccatcgc

SEQ ID NO: 258790 - DNA, 20 bp, human
ggggcagccagcgatggccg

SEQ ID NO: 258791 - DNA, 20 bp, human
ggccgcggagggggcgaact

SEQ ID NO: 258792 - DNA, 20 bp, human
gaatgagcagcgcgccgtgg

SEQ ID NO: 258793 - DNA, 20 bp, human
ggagggggcgaactgggttc

SEQ ID NO: 258794 - DNA, 20 bp, human
gactgggttccggccctcgg

SEQ ID NO: 258795 - DNA, 20 bp, human
ggcggcaggacagacaggtg

SEQ ID NO: 258796 - DNA, 20 bp, human
gcccgcctgggcggcctcaa

SEQ ID NO: 258797 - DNA, 20 bp, human
ggtctcacgcggccccgcct

SEQ ID NO: 258798 - DNA, 20 bp, human
gcggggccgcgtgagacgat

SEQ ID NO: 258799 - DNA, 20 bp, human
gtggaccaatcaggatcctg

SEQ ID NO: 258800 - DNA, 20 bp, human
gcgcgtgagacgattggcta

SEQ ID NO: 258801 - DNA, 20 bp, human
gaatgtggagagagcaacgt

SEQ ID NO: 258802 - DNA, 20 bp, human
gtggagagagcaacgtggga

SEQ ID NO: 258803 - DNA, 20 bp, human
gcggcctcaatggaagcgtg

SEQ ID NO: 258804 - DNA, 20 bp, human
gggtccacacgcttccattg

SEQ ID NO: 258805 - DNA, 20 bp, human
ggcttccattgaggccgccc

SEQ ID NO: 258806 - DNA, 20 bp, human
gaagcccggcatctccctgc

SEQ ID NO: 258807 - DNA, 20 bp, human
gccggcacggacccgaaggg

SEQ ID NO: 258808 - DNA, 20 bp, human
gctgccggcacggacccgaa

SEQ ID NO: 258809 - DNA, 20 bp, human
gagcgttgagcgcccagagg

SEQ ID NO: 258810 - DNA, 20 bp, human
gcggacttccgagtctcacc

SEQ ID NO: 258811 - DNA, 20 bp, human
gtgagactcggaagtccgga

SEQ ID NO: 258812 - DNA, 20 bp, human
gactcggaagtccggaggga

SEQ ID NO: 258813 - DNA, 20 bp, human
ggagtccagagaaaccttgt

SEQ ID NO: 258814 - DNA, 20 bp, human
gacccgaagggcggtcgggc

SEQ ID NO: 258815 - DNA, 20 bp, human
gccgaggcccggggcgctaa

SEQ ID NO: 258816 - DNA, 20 bp, human
gtaggaagcaagggcctcga

SEQ ID NO: 258817 - DNA, 20 bp, human
gtaccctggcaccccttctt

SEQ ID NO: 258818 - DNA, 20 bp, human
gctaggagctggacggagga

SEQ ID NO: 258819 - DNA, 20 bp, human
ggaagtgagcgcgcactggt

SEQ ID NO: 258820 - DNA, 20 bp, human
gagcccaagaaggggtgcca

SEQ ID NO: 258821 - DNA, 20 bp, human
gaagcaagggcctcgaggga

SEQ ID NO: 258822 - DNA, 20 bp, human
gcaagggcctcgagggaagg

SEQ ID NO: 258823 - DNA, 20 bp, human
gaccgagctccgcctcctcg

SEQ ID NO: 258824 - DNA, 20 bp, human
gaagcgcatcctaggtgctc

SEQ ID NO: 258825 - DNA, 20 bp, human
gtcccccaaaagcgcatcct

SEQ ID NO: 258826 - DNA, 20 bp, human
ggaaccgtgaggaggggtgt

SEQ ID NO: 258827 - DNA, 20 bp, human
ggccccctggtggaatgcgg

SEQ ID NO: 258828 - DNA, 20 bp, human
ggctcccccgcattccacca

SEQ ID NO: 258829 - DNA, 20 bp, human
gcccaaaaaagcgaaccgtg

SEQ ID NO: 258830 - DNA, 20 bp, human
gtcgtggagaatttttactg

SEQ ID NO: 258831 - DNA, 20 bp, human
gaaaaagcgaaccgtgagga

SEQ ID NO: 258832 - DNA, 20 bp, human
gatgcgggggagcaggcagt

SEQ ID NO: 258833 - DNA, 20 bp, human
gagtgccccctggtggaatg

SEQ ID NO: 258834 - DNA, 20 bp, human
ggcctccccagcacctaggt

SEQ ID NO: 258835 - DNA, 20 bp, human
gccccccaagccatcccatc

SEQ ID NO: 258836 - DNA, 20 bp, human
ggattggctggggaaacgaa

SEQ ID NO: 258837 - DNA, 20 bp, human
gtggctggggaaacgaaggg

SEQ ID NO: 258838 - DNA, 20 bp, human
ggagatgggcagttgtgttt

SEQ ID NO: 258839 - DNA, 20 bp, human
gtccccagccaatcagatcc

SEQ ID NO: 258840 - DNA, 20 bp, human
gtacgtgcctgggttttgtg

SEQ ID NO: 258841 - DNA, 20 bp, human
gatgggcagttgtgtttcgg

SEQ ID NO: 258842 - DNA, 20 bp, human
gtgacagatggtcccataaa

SEQ ID NO: 258843 - DNA, 20 bp, human
gagggaggcgttgcaacatc

SEQ ID NO: 258844 - DNA, 20 bp, human
gaccctcccactgttagttt

SEQ ID NO: 258845 - DNA, 20 bp, human
gcccataaatggatgtaaaa

SEQ ID NO: 258846 - DNA, 20 bp, human
gtaggaaagtggggatgaag

SEQ ID NO: 258847 - DNA, 20 bp, human
gaaaaacggtataggaaagt

SEQ ID NO: 258848 - DNA, 20 bp, human
gctgcaggtaaaaacggtat

SEQ ID NO: 258849 - DNA, 20 bp, human
ggcaaatctgcaggtaaaaa

SEQ ID NO: 258850 - DNA, 20 bp, human
gattgggtccacagcaacat

SEQ ID NO: 258851 - DNA, 20 bp, human
gagggagatagcaaactctg

SEQ ID NO: 258852 - DNA, 20 bp, human
gatgaaaccaagtgtttcta

SEQ ID NO: 258853 - DNA, 20 bp, human
gcttagtaatggtctaatca

SEQ ID NO: 258854 - DNA, 20 bp, human
gtggactggtgagtgtaatc

SEQ ID NO: 258855 - DNA, 20 bp, human
gtgcctcccttagaaacact

SEQ ID NO: 258856 - DNA, 20 bp, human
gggagcactctgagctggcg

SEQ ID NO: 258857 - DNA, 20 bp, human
gccggctatttataccccgc

SEQ ID NO: 258858 - DNA, 20 bp, human
gcaggcgctgcggtgactgg

SEQ ID NO: 258859 - DNA, 20 bp, human
gcccccccgccgcgtgggga

SEQ ID NO: 258860 - DNA, 20 bp, human
gcactctgagctggcgggga

SEQ ID NO: 258861 - DNA, 20 bp, human
ggaggcggactccagtgtcc

SEQ ID NO: 258862 - DNA, 20 bp, human
gccgcgtttgacaggcgctg

SEQ ID NO: 258863 - DNA, 20 bp, human
ggcaaaagaagcaggttcgg

SEQ ID NO: 258864 - DNA, 20 bp, human
ggccgcctccaccaggacac

SEQ ID NO: 258865 - DNA, 20 bp, human
gtagccggcccgcgtttgac

SEQ ID NO: 258866 - DNA, 20 bp, human
gggccaggagcccagtctaa

SEQ ID NO: 258867 - DNA, 20 bp, human
gaccctctggggttgggcac

SEQ ID NO: 258868 - DNA, 20 bp, human
gccccgtgcccaaccccaga

SEQ ID NO: 258869 - DNA, 20 bp, human
ggcactgcctgctaagatcc

SEQ ID NO: 258870 - DNA, 20 bp, human
gagtgctgggaaatcaggcc

SEQ ID NO: 258871 - DNA, 20 bp, human
gcaggggccaggccagagat

SEQ ID NO: 258872 - DNA, 20 bp, human
gtgctaagatccgggccaag

SEQ ID NO: 258873 - DNA, 20 bp, human
gtgtcatcccgcaccctctg

SEQ ID NO: 258874 - DNA, 20 bp, human
gggtgtctcattggatggag

SEQ ID NO: 258875 - DNA, 20 bp, human
gtccaatgagacaccagctc

SEQ ID NO: 258876 - DNA, 20 bp, human
ggccaagacacggggcggca

SEQ ID NO: 258877 - DNA, 20 bp, human
gaccgaaacgagcgagcgaa

SEQ ID NO: 258878 - DNA, 20 bp, human
ggccgccaatggcaagttgg

SEQ ID NO: 258879 - DNA, 20 bp, human
gagggccgggccaagacacg

SEQ ID NO: 258880 - DNA, 20 bp, human
ggcgccggggcaggctggtc

SEQ ID NO: 258881 - DNA, 20 bp, human
gccggcgccgaggtgagtca

SEQ ID NO: 258882 - DNA, 20 bp, human
ggagggacgaggcatctcgg

SEQ ID NO: 258883 - DNA, 20 bp, human
gcgcccgcagtccctcccgt

SEQ ID NO: 258884 - DNA, 20 bp, human
gtctccctccaacttgccat

SEQ ID NO: 258885 - DNA, 20 bp, human
gcccccgccccgttttatca

SEQ ID NO: 258886 - DNA, 20 bp, human
ggtgagctgcgcacaaaagc

SEQ ID NO: 258887 - DNA, 20 bp, human
gacacggctccttggagggg

SEQ ID NO: 258888 - DNA, 20 bp, human
gtgtgacacggctccttgga

SEQ ID NO: 258889 - DNA, 20 bp, human
ggagtggggggttgcagggc

SEQ ID NO: 258890 - DNA, 20 bp, human
gacagtgtgacacggctcct

SEQ ID NO: 258891 - DNA, 20 bp, human
gtgtgcggggatcgtgcgtt

SEQ ID NO: 258892 - DNA, 20 bp, human
gcgatccccgcacagctccc

SEQ ID NO: 258893 - DNA, 20 bp, human
ggcagaaaattcttgtccct

SEQ ID NO: 258894 - DNA, 20 bp, human
ggcagcgcagaccggcacca

SEQ ID NO: 258895 - DNA, 20 bp, human
gcaactagctgcaaaacctg

SEQ ID NO: 258896 - DNA, 20 bp, human
gaggaagtctgacaccagtc

SEQ ID NO: 258897 - DNA, 20 bp, human
gttaattctggaagaattaa

SEQ ID NO: 258898 - DNA, 20 bp, human
gatataccatccattttcaa

SEQ ID NO: 258899 - DNA, 20 bp, human
gaaaggactgacaatatcaa

SEQ ID NO: 258900 - DNA, 20 bp, human
gaaaataatgccattgaaaa

SEQ ID NO: 258901 - DNA, 20 bp, human
gtgacatacaaatatccaaa

SEQ ID NO: 258902 - DNA, 20 bp, human
gtcaagtttcagttttttcc

SEQ ID NO: 258903 - DNA, 20 bp, human
gagtaatgctaaaatttaaa

SEQ ID NO: 258904 - DNA, 20 bp, human
gtaatgccattgaaaatgga

SEQ ID NO: 258905 - DNA, 20 bp, human
gcaccttttcataagtttat

SEQ ID NO: 258906 - DNA, 20 bp, human
ggctggaagaccccacctgc

SEQ ID NO: 258907 - DNA, 20 bp, human
gtgtgccagccgggatagag

SEQ ID NO: 258908 - DNA, 20 bp, human
gtgtgcaggtgcagctgcct

SEQ ID NO: 258909 - DNA, 20 bp, human
ggacacgtgtgactgacagc

SEQ ID NO: 258910 - DNA, 20 bp, human
ggtaggacaaatggtcgcca

SEQ ID NO: 258911 - DNA, 20 bp, human
gaaggtggggctcacttctg

SEQ ID NO: 258912 - DNA, 20 bp, human
gccaggtctggcaactccct

SEQ ID NO: 258913 - DNA, 20 bp, human
gctgcagccgtctcagctgc

SEQ ID NO: 258914 - DNA, 20 bp, human
ggctcctctcccctctatcc

SEQ ID NO: 258915 - DNA, 20 bp, human
gaacagccccagaggctctg

SEQ ID NO: 258916 - DNA, 20 bp, human
gggcgggagcgggcttgctg

SEQ ID NO: 258917 - DNA, 20 bp, human
gctgcggaaaggcctgcgga

SEQ ID NO: 258918 - DNA, 20 bp, human
ggagcgtgcggccggctcgg

SEQ ID NO: 258919 - DNA, 20 bp, human
ggagcgggcttgctgcggaa

SEQ ID NO: 258920 - DNA, 20 bp, human
gaggccggggctcgggtccg

SEQ ID NO: 258921 - DNA, 20 bp, human
gcggcgcgcgtcagggaccg

SEQ ID NO: 258922 - DNA, 20 bp, human
gaaggcctgcggagggcacc

SEQ ID NO: 258923 - DNA, 20 bp, human
gctcgcagacacacgcccgc

SEQ ID NO: 258924 - DNA, 20 bp, human
ggcgcccgggaggggccaaa

SEQ ID NO: 258925 - DNA, 20 bp, human
gtgtccgtggagcgtgcggc

SEQ ID NO: 258926 - DNA, 20 bp, human
gggactgtgagcaactgaaa

SEQ ID NO: 258927 - DNA, 20 bp, human
gcgcctcctcgggactccag

SEQ ID NO: 258928 - DNA, 20 bp, human
gggcccctggagtcccgagg

SEQ ID NO: 258929 - DNA, 20 bp, human
ggtgccgtgattggcgtaag

SEQ ID NO: 258930 - DNA, 20 bp, human
gaaggccgaacgcgcctcct

SEQ ID NO: 258931 - DNA, 20 bp, human
gggaaatgatggaacgctca

SEQ ID NO: 258932 - DNA, 20 bp, human
gtcggcgtggagcaccgtga

SEQ ID NO: 258933 - DNA, 20 bp, human
gagtcccgaggaggcgcgtt

SEQ ID NO: 258934 - DNA, 20 bp, human
gcgcaaggcctcgaggggtt

SEQ ID NO: 258935 - DNA, 20 bp, human
gcgtcagtccttgagccaat

SEQ ID NO: 258936 - DNA, 20 bp, human
gcggagtcgccgcgggtcgg

SEQ ID NO: 258937 - DNA, 20 bp, human
gcgggtcggaggctcctccc

SEQ ID NO: 258938 - DNA, 20 bp, human
gttcctgcgcggccaccccg

SEQ ID NO: 258939 - DNA, 20 bp, human
gcagcccctccccacgggga

SEQ ID NO: 258940 - DNA, 20 bp, human
gagcgcgcggggcaccacga

SEQ ID NO: 258941 - DNA, 20 bp, human
ggacccccctccccgtgggg

SEQ ID NO: 258942 - DNA, 20 bp, human
gcccctccccacggggaggg

SEQ ID NO: 258943 - DNA, 20 bp, human
gcccgcgcgctcgaccccca

SEQ ID NO: 258944 - DNA, 20 bp, human
ggacccgcggcgactccgcg

SEQ ID NO: 258945 - DNA, 20 bp, human
gcggcggcttctgcgggttg

SEQ ID NO: 258946 - DNA, 20 bp, human
gggaggggctgcgaccctaa

SEQ ID NO: 258947 - DNA, 20 bp, human
gagagcggcgagacgactcc

SEQ ID NO: 258948 - DNA, 20 bp, human
gccccggccacaccaaaccc

SEQ ID NO: 258949 - DNA, 20 bp, human
gctgccagcaaacccgggtt

SEQ ID NO: 258950 - DNA, 20 bp, human
gaggacccaagctgccgcct

SEQ ID NO: 258951 - DNA, 20 bp, human
gagcaaacccgggtttggtg

SEQ ID NO: 258952 - DNA, 20 bp, human
ggcggctcacgacacccctt

SEQ ID NO: 258953 - DNA, 20 bp, human
ggggacccaggagcagtcgg

SEQ ID NO: 258954 - DNA, 20 bp, human
gggtcctggcgggttccgga

SEQ ID NO: 258955 - DNA, 20 bp, human
ggcggcgagacgactccagg

SEQ ID NO: 258956 - DNA, 20 bp, human
ggcgctgcctgccggtgtgg

SEQ ID NO: 258957 - DNA, 20 bp, human
gaacttggggcgttgactgt

SEQ ID NO: 258958 - DNA, 20 bp, human
ggcagcgcactacattattc

SEQ ID NO: 258959 - DNA, 20 bp, human
gcgcctggccacgccccatg

SEQ ID NO: 258960 - DNA, 20 bp, human
gttgaggcggagttcgttca

SEQ ID NO: 258961 - DNA, 20 bp, human
gccaacagtcgccgccacac

SEQ ID NO: 258962 - DNA, 20 bp, human
gggccttgtggggccctcat

SEQ ID NO: 258963 - DNA, 20 bp, human
gccgcctcttcaggccctag

SEQ ID NO: 258964 - DNA, 20 bp, human
ggtggcggcgactgttggtt

SEQ ID NO: 258965 - DNA, 20 bp, human
gagtgcgctgcctgccggtg

SEQ ID NO: 258966 - DNA, 20 bp, human
ggggacgtccgagaggtaag

SEQ ID NO: 258967 - DNA, 20 bp, human
gaggtaagaggctgacgtct

SEQ ID NO: 258968 - DNA, 20 bp, human
ggggcccgcccccgtgagag

SEQ ID NO: 258969 - DNA, 20 bp, human
gcgatgagggcggttctgaa

SEQ ID NO: 258970 - DNA, 20 bp, human
gagtggagggcggccgatga

SEQ ID NO: 258971 - DNA, 20 bp, human
gacgtcagcctcttacctct

SEQ ID NO: 258972 - DNA, 20 bp, human
gacgtcagacatgattaagt

SEQ ID NO: 258973 - DNA, 20 bp, human
gcagcctggccaatctcggc

SEQ ID NO: 258974 - DNA, 20 bp, human
ggccctacgcgggtggtcct

SEQ ID NO: 258975 - DNA, 20 bp, human
gtggggactcccctgctaat

SEQ ID NO: 258976 - DNA, 20 bp, human
ggacccgagagaccagagga

SEQ ID NO: 258977 - DNA, 20 bp, human
gcacgcggctgggaaagctt

SEQ ID NO: 258978 - DNA, 20 bp, human
gtgaacctgcaaccccttga

SEQ ID NO: 258979 - DNA, 20 bp, human
gtatccctgcccaccaactg

SEQ ID NO: 258980 - DNA, 20 bp, human
gtggagcgcccccagttggt

SEQ ID NO: 258981 - DNA, 20 bp, human
gcccagttagccccgagctt

SEQ ID NO: 258982 - DNA, 20 bp, human
ggagcgaagcgccgcccacg

SEQ ID NO: 258983 - DNA, 20 bp, human
gaggtccgggcggttggccg

SEQ ID NO: 258984 - DNA, 20 bp, human
gaaagggcctggttggtagg

SEQ ID NO: 258985 - DNA, 20 bp, human
ggaaaccctcaaggggttgc

SEQ ID NO: 258986 - DNA, 20 bp, human
gtgtcctggcgcaggtgccg

SEQ ID NO: 258987 - DNA, 20 bp, human
gaactccgcagcgtccgctc

SEQ ID NO: 258988 - DNA, 20 bp, human
gacctgcgccaggacactcg

SEQ ID NO: 258989 - DNA, 20 bp, human
gagagttcgcggctgatctc

SEQ ID NO: 258990 - DNA, 20 bp, human
gtcctcccgagcggacgctg

SEQ ID NO: 258991 - DNA, 20 bp, human
gcgcgaactctcctcccgag

SEQ ID NO: 258992 - DNA, 20 bp, human
gcgcccccggcacctgcgcc

SEQ ID NO: 258993 - DNA, 20 bp, human
gcccactgcactttgcctag

SEQ ID NO: 258994 - DNA, 20 bp, human
gccccctaggcaaagtgcag

SEQ ID NO: 258995 - DNA, 20 bp, human
gggggacttcaaaaagtcgt

SEQ ID NO: 258996 - DNA, 20 bp, human
gtaagaggcctccactaggg

SEQ ID NO: 258997 - DNA, 20 bp, human
ggggcacagctgccggtaga

SEQ ID NO: 258998 - DNA, 20 bp, human
gcggtagaggggaaaaacgc

SEQ ID NO: 258999 - DNA, 20 bp, human
gggctacagggtctgaagga

SEQ ID NO: 259000 - DNA, 20 bp, human
gctgtcactcaagaaggggc

SEQ ID NO: 259001 - DNA, 20 bp, human
gcagaccctgtagcccgcag

SEQ ID NO: 259002 - DNA, 20 bp, human
gaagccgggcccggcctgtg

SEQ ID NO: 259003 - DNA, 20 bp, human
ggccgtccccgcccccctag

SEQ ID NO: 259004 - DNA, 20 bp, human
gggtcccaagaaggcggggc

SEQ ID NO: 259005 - DNA, 20 bp, human
gcattcccctgcgggctaca

SEQ ID NO: 259006 - DNA, 20 bp, human
gactggcagtgtgattgggt

SEQ ID NO: 259007 - DNA, 20 bp, human
gcctaaggctagctctgatg

SEQ ID NO: 259008 - DNA, 20 bp, human
gctggactggcagtgtgatt

SEQ ID NO: 259009 - DNA, 20 bp, human
gggtcaccttgctggaacta

SEQ ID NO: 259010 - DNA, 20 bp, human
gcagaagtgggcacgtgaga

SEQ ID NO: 259011 - DNA, 20 bp, human
gaggtctctggggaggagtc

SEQ ID NO: 259012 - DNA, 20 bp, human
gagctctgatgtggttcttt

SEQ ID NO: 259013 - DNA, 20 bp, human
gggaggtggggccaatcatc

SEQ ID NO: 259014 - DNA, 20 bp, human
gaagaaggaacagaggtctc

SEQ ID NO: 259015 - DNA, 20 bp, human
gaaaaagccgaaatgaagag

SEQ ID NO: 259016 - DNA, 20 bp, human
gaggaggcgaccgagagcag

SEQ ID NO: 259017 - DNA, 20 bp, human
ggggcgcgggcgcggtgctg

SEQ ID NO: 259018 - DNA, 20 bp, human
gggcgtgcagaggcttccct

SEQ ID NO: 259019 - DNA, 20 bp, human
gcgcccgcttcgtgctccca

SEQ ID NO: 259020 - DNA, 20 bp, human
gttccctgggagcacgaagc

SEQ ID NO: 259021 - DNA, 20 bp, human
gagagcgcggcacccagtgc

SEQ ID NO: 259022 - DNA, 20 bp, human
gagccgccccgggtgcatcc

SEQ ID NO: 259023 - DNA, 20 bp, human
ggaccgagagcagcggggga

SEQ ID NO: 259024 - DNA, 20 bp, human
gagccgggatgcacccgggg

SEQ ID NO: 259025 - DNA, 20 bp, human
ggcacccagtgccggaatct

SEQ ID NO: 259026 - DNA, 20 bp, human
gctgagtggcccaggcgcga

SEQ ID NO: 259027 - DNA, 20 bp, human
gcgcgagggctcagatacta

SEQ ID NO: 259028 - DNA, 20 bp, human
gaggacctgaggttcaagga

SEQ ID NO: 259029 - DNA, 20 bp, human
ggttgccagggaaaccgtct

SEQ ID NO: 259030 - DNA, 20 bp, human
gaacctcaggtccttagcgc

SEQ ID NO: 259031 - DNA, 20 bp, human
ggacgcccagacggtttccc

SEQ ID NO: 259032 - DNA, 20 bp, human
gttagcaataggtggagcgc

SEQ ID NO: 259033 - DNA, 20 bp, human
gtattgctaacgctggagag

SEQ ID NO: 259034 - DNA, 20 bp, human
gctcctggccgccgttgcca

SEQ ID NO: 259035 - DNA, 20 bp, human
gacggtttccctggcaacgg

SEQ ID NO: 259036 - DNA, 20 bp, human
gggcggagccacagtcctag

SEQ ID NO: 259037 - DNA, 20 bp, human
gcagcgaagagccaactctc

SEQ ID NO: 259038 - DNA, 20 bp, human
ggaagtacggagagccggga

SEQ ID NO: 259039 - DNA, 20 bp, human
gctggagagcgaactagccc

SEQ ID NO: 259040 - DNA, 20 bp, human
gggcgtcgggtcgggtaaat

SEQ ID NO: 259041 - DNA, 20 bp, human
gagttcgctctccagtcagg

SEQ ID NO: 259042 - DNA, 20 bp, human
ggctagttcgctctccagtc

SEQ ID NO: 259043 - DNA, 20 bp, human
ggagagcgaactagcccggg

SEQ ID NO: 259044 - DNA, 20 bp, human
gtcaatcatcacctgagagt

SEQ ID NO: 259045 - DNA, 20 bp, human
gtggctcttcgctggctggc

SEQ ID NO: 259046 - DNA, 20 bp, human
gggcgtccttaaacctcagg

SEQ ID NO: 259047 - DNA, 20 bp, human
gacggcgaccgactcgtgag

SEQ ID NO: 259048 - DNA, 20 bp, human
gcgactcgtgagtggaggtg

SEQ ID NO: 259049 - DNA, 20 bp, human
ggcgaccgactcgtgagtgg

SEQ ID NO: 259050 - DNA, 20 bp, human
ggaaggcgtccttaaacctc

SEQ ID NO: 259051 - DNA, 20 bp, human
gcccaggctggcgcccccga

SEQ ID NO: 259052 - DNA, 20 bp, human
ggaccaaataaggccgggga

SEQ ID NO: 259053 - DNA, 20 bp, human
gcatcagcacaactgtctcg

SEQ ID NO: 259054 - DNA, 20 bp, human
gcccgccagcaaagccatcg

SEQ ID NO: 259055 - DNA, 20 bp, human
gcaccaaggtcaggaggaga

SEQ ID NO: 259056 - DNA, 20 bp, human
ggccgagggcgcgcagagtg

SEQ ID NO: 259057 - DNA, 20 bp, human
gaaacgacgcggctggagcg

SEQ ID NO: 259058 - DNA, 20 bp, human
gagtggggagacggcgcctg

SEQ ID NO: 259059 - DNA, 20 bp, human
gcccgctaccccgcagccga

SEQ ID NO: 259060 - DNA, 20 bp, human
gcttcggcgcggaaacgacg

SEQ ID NO: 259061 - DNA, 20 bp, human
gctaggcggccggcagcgca

SEQ ID NO: 259062 - DNA, 20 bp, human
gggggccccggatcgcactt

SEQ ID NO: 259063 - DNA, 20 bp, human
ggacccagcggctcgcgcgg

SEQ ID NO: 259064 - DNA, 20 bp, human
gctctgcgcgccctcggctg

SEQ ID NO: 259065 - DNA, 20 bp, human
gcccggatcgcacttcggcg

SEQ ID NO: 259066 - DNA, 20 bp, human
ggggaggggacaattacgaa

SEQ ID NO: 259067 - DNA, 20 bp, human
ggggacaattacgaaaggcc

SEQ ID NO: 259068 - DNA, 20 bp, human
ggggaaagcgggaaagagat

SEQ ID NO: 259069 - DNA, 20 bp, human
gcccggctcacaagcctccc

SEQ ID NO: 259070 - DNA, 20 bp, human
gttcccgccagaaagagcga

SEQ ID NO: 259071 - DNA, 20 bp, human
gagcgaaagaacagtcgcag

SEQ ID NO: 259072 - DNA, 20 bp, human
ggggcccagtgtgaggatac

SEQ ID NO: 259073 - DNA, 20 bp, human
gagcctaattgttgcctcgt

SEQ ID NO: 259074 - DNA, 20 bp, human
gcgtaattgtcccctccccg

SEQ ID NO: 259075 - DNA, 20 bp, human
gggcccggggcccagccgga

SEQ ID NO: 259076 - DNA, 20 bp, human
gtgagtacgcgtgcgctcag

SEQ ID NO: 259077 - DNA, 20 bp, human
gggtacaggcaaatacgcac

SEQ ID NO: 259078 - DNA, 20 bp, human
gtggcatcgcgcgtaggtac

SEQ ID NO: 259079 - DNA, 20 bp, human
gaagtactggcatcgcgcgt

SEQ ID NO: 259080 - DNA, 20 bp, human
gagtgcgcctgcgcaagagc

SEQ ID NO: 259081 - DNA, 20 bp, human
gctcagaggagcggcgaagg

SEQ ID NO: 259082 - DNA, 20 bp, human
gtggctgaatcagggtgaag

SEQ ID NO: 259083 - DNA, 20 bp, human
gtcaaatagcagcgctccga

SEQ ID NO: 259084 - DNA, 20 bp, human
gggacctgaaagtaggagag

SEQ ID NO: 259085 - DNA, 20 bp, human
ggtggccgggacctgaaagt

SEQ ID NO: 259086 - DNA, 20 bp, human
gcgtgccgccgggtcccagc

SEQ ID NO: 259087 - DNA, 20 bp, human
gggcccgggcggcgagggaa

SEQ ID NO: 259088 - DNA, 20 bp, human
gggccccggggacttctctc

SEQ ID NO: 259089 - DNA, 20 bp, human
gtccccgggtgactgctccc

SEQ ID NO: 259090 - DNA, 20 bp, human
gggggcgcccgctgattggg

SEQ ID NO: 259091 - DNA, 20 bp, human
ggggccagagagaagtcccc

SEQ ID NO: 259092 - DNA, 20 bp, human
gaaagtcggcccagcagatg

SEQ ID NO: 259093 - DNA, 20 bp, human
gctgccggccgcccaatcag

SEQ ID NO: 259094 - DNA, 20 bp, human
gcaacggcggagcgctcgga

SEQ ID NO: 259095 - DNA, 20 bp, human
gaagagacagcgtgctcctg

SEQ ID NO: 259096 - DNA, 20 bp, human
gcggctgccgatctgggcag

SEQ ID NO: 259097 - DNA, 20 bp, human
ggcgcgaaaccggcgccggc

SEQ ID NO: 259098 - DNA, 20 bp, human
gcggccggcgaggcccctgt

SEQ ID NO: 259099 - DNA, 20 bp, human
gagagggggcggggacgaaa

SEQ ID NO: 259100 - DNA, 20 bp, human
gcccgcgcgccctcctggcg

SEQ ID NO: 259101 - DNA, 20 bp, human
gagggcgaggtcggtcgccc

SEQ ID NO: 259102 - DNA, 20 bp, human
gcggggacgaaacggccccg

SEQ ID NO: 259103 - DNA, 20 bp, human
gggggacgccgcggacgcga

SEQ ID NO: 259104 - DNA, 20 bp, human
ggacctcgccctcgcgtccg

SEQ ID NO: 259105 - DNA, 20 bp, human
ggggagaagcagtatcgtgc

SEQ ID NO: 259106 - DNA, 20 bp, human
gtacgacgggacttggggcg

SEQ ID NO: 259107 - DNA, 20 bp, human
gggaacccgcaaggccgcac

SEQ ID NO: 259108 - DNA, 20 bp, human
gtctgattggtcatactcaa

SEQ ID NO: 259109 - DNA, 20 bp, human
gtggcctacgacgggacttg

SEQ ID NO: 259110 - DNA, 20 bp, human
gaatgcggactgcgtcccag

SEQ ID NO: 259111 - DNA, 20 bp, human
gcgcaaggccgcacaggatg

SEQ ID NO: 259112 - DNA, 20 bp, human
ggcggagcagaggcgtatct

SEQ ID NO: 259113 - DNA, 20 bp, human
gacgcagtccgcattctgat

SEQ ID NO: 259114 - DNA, 20 bp, human
ggcggcggggcgcaggaaag

SEQ ID NO: 259115 - DNA, 20 bp, human
gggcgggcgatggcctacga

SEQ ID NO: 259116 - DNA, 20 bp, human
gcaggcgcgcgccgtcgagc

SEQ ID NO: 259117 - DNA, 20 bp, human
ggtgtcccgctcccgctcga

SEQ ID NO: 259118 - DNA, 20 bp, human
ggagcgggagcgggacacct

SEQ ID NO: 259119 - DNA, 20 bp, human
gggaagaatgggtgttctgt

SEQ ID NO: 259120 - DNA, 20 bp, human
gtcccgggcatcggcccctg

SEQ ID NO: 259121 - DNA, 20 bp, human
gacgccaactgggctcgcgc

SEQ ID NO: 259122 - DNA, 20 bp, human
ggctaatgaggcgacttgtg

SEQ ID NO: 259123 - DNA, 20 bp, human
gggggccgatgcccgggaca

SEQ ID NO: 259124 - DNA, 20 bp, human
ggcgcgccgtcgagcgggag

SEQ ID NO: 259125 - DNA, 20 bp, human
gcaagggtgcgacgccaact

SEQ ID NO: 259126 - DNA, 20 bp, human
gcggcccgggagccaatcgc

SEQ ID NO: 259127 - DNA, 20 bp, human
gccagccaatcgggacccga

SEQ ID NO: 259128 - DNA, 20 bp, human
gcctaggctctccaccgcat

SEQ ID NO: 259129 - DNA, 20 bp, human
gtaaattccagaatccgatg

SEQ ID NO: 259130 - DNA, 20 bp, human
gtgtcccgcgattggctccc

SEQ ID NO: 259131 - DNA, 20 bp, human
ggaggggccaaccccggcct

SEQ ID NO: 259132 - DNA, 20 bp, human
ggcggtggagagcctaggcc

SEQ ID NO: 259133 - DNA, 20 bp, human
gctatctacaatcagaacgt

SEQ ID NO: 259134 - DNA, 20 bp, human
gtcatccttcgggtcccgat

SEQ ID NO: 259135 - DNA, 20 bp, human
gggacccgcgcgatgggaag

SEQ ID NO: 259136 - DNA, 20 bp, human
gcaaggcggcccacgaggtt

SEQ ID NO: 259137 - DNA, 20 bp, human
gtccctgtagacgagtaaaa

SEQ ID NO: 259138 - DNA, 20 bp, human
gcccctaagcccaacctcgt

SEQ ID NO: 259139 - DNA, 20 bp, human
gagaaattaacccttggcga

SEQ ID NO: 259140 - DNA, 20 bp, human
gtcgcacactccctcgccaa

SEQ ID NO: 259141 - DNA, 20 bp, human
ggggtgatggacaaacgtgc

SEQ ID NO: 259142 - DNA, 20 bp, human
gcgtccgcatccaccgtagg

SEQ ID NO: 259143 - DNA, 20 bp, human
gtaaacaaaactgtcccccc

SEQ ID NO: 259144 - DNA, 20 bp, human
gagcgcgacctctctccgcc

SEQ ID NO: 259145 - DNA, 20 bp, human
gcaaaactgtcccccccggg

SEQ ID NO: 259146 - DNA, 20 bp, human
gcccgctaacccagagcggc

SEQ ID NO: 259147 - DNA, 20 bp, human
ggccgcgcgccctgactctc

SEQ ID NO: 259148 - DNA, 20 bp, human
ggccgccaggtgcccgccga

SEQ ID NO: 259149 - DNA, 20 bp, human
gggccccagtcccgagagtc

SEQ ID NO: 259150 - DNA, 20 bp, human
gccgccgactgggttggaaa

SEQ ID NO: 259151 - DNA, 20 bp, human
gtcctccctccggccctcgg

SEQ ID NO: 259152 - DNA, 20 bp, human
gcgccctgactctcgggact

SEQ ID NO: 259153 - DNA, 20 bp, human
ggctccccctcgcgccgccc

SEQ ID NO: 259154 - DNA, 20 bp, human
gtcccggccgccgactgggt

SEQ ID NO: 259155 - DNA, 20 bp, human
gcggcgctgcgcgcgtcacg

SEQ ID NO: 259156 - DNA, 20 bp, human
gccagccgagggccagacgg

SEQ ID NO: 259157 - DNA, 20 bp, human
ggggcgctggctagcgagta

SEQ ID NO: 259158 - DNA, 20 bp, human
gagccccgggtccttcggga

SEQ ID NO: 259159 - DNA, 20 bp, human
gggtgggaacggagagtctc

SEQ ID NO: 259160 - DNA, 20 bp, human
gagcagagctagcaaagcgg

SEQ ID NO: 259161 - DNA, 20 bp, human
gctggctgcgaaacgtggac

SEQ ID NO: 259162 - DNA, 20 bp, human
gaagcggcggccttgcacag

SEQ ID NO: 259163 - DNA, 20 bp, human
ggggaccctcccgaaggacc

SEQ ID NO: 259164 - DNA, 20 bp, human
gtggctcgggaccctcccga

SEQ ID NO: 259165 - DNA, 20 bp, human
ggctgggagccgggtcgtaa

SEQ ID NO: 259166 - DNA, 20 bp, human
gcgaatgggcgagaccacgg

SEQ ID NO: 259167 - DNA, 20 bp, human
ggtctctcatgggggggagt

SEQ ID NO: 259168 - DNA, 20 bp, human
gccaggaagcctaagtgaaa

SEQ ID NO: 259169 - DNA, 20 bp, human
gcgcagcctaggggcctcac

SEQ ID NO: 259170 - DNA, 20 bp, human
ggggtgggtgggaacgcgaa

SEQ ID NO: 259171 - DNA, 20 bp, human
gtggatggtctctcatgggg

SEQ ID NO: 259172 - DNA, 20 bp, human
ggaagtggatggtctctcat

SEQ ID NO: 259173 - DNA, 20 bp, human
gcccagggtcgtcacatccg

SEQ ID NO: 259174 - DNA, 20 bp, human
ggacctgggcagtacagcta

SEQ ID NO: 259175 - DNA, 20 bp, human
gccccgtgttgcaactaaca

SEQ ID NO: 259176 - DNA, 20 bp, human
gaaaggacggtcgacttcgg

SEQ ID NO: 259177 - DNA, 20 bp, human
gcccgagccaaccaatcgga

SEQ ID NO: 259178 - DNA, 20 bp, human
gcgcggctctcgtaaccaat

SEQ ID NO: 259179 - DNA, 20 bp, human
ggaaaagtgcgccctacgaa

SEQ ID NO: 259180 - DNA, 20 bp, human
ggttacgagagccgcggttg

SEQ ID NO: 259181 - DNA, 20 bp, human
gactgacgtctcagtcctat

SEQ ID NO: 259182 - DNA, 20 bp, human
gcagtcccgagccaaccaat

SEQ ID NO: 259183 - DNA, 20 bp, human
gggaggcgggagtttggcac

SEQ ID NO: 259184 - DNA, 20 bp, human
gagtgcgccctacgaaagga

SEQ ID NO: 259185 - DNA, 20 bp, human
gacgaaaggacggtcgactt

SEQ ID NO: 259186 - DNA, 20 bp, human
ggccccgcctcaaactgcgt

SEQ ID NO: 259187 - DNA, 20 bp, human
gcagttggggcagttgtcag

SEQ ID NO: 259188 - DNA, 20 bp, human
gccgcgagggccctaagcgc

SEQ ID NO: 259189 - DNA, 20 bp, human
ggggcagttgtcagtgggag

SEQ ID NO: 259190 - DNA, 20 bp, human
gccaccggaagtagtgtcaa

SEQ ID NO: 259191 - DNA, 20 bp, human
gacccacaagccccccgcga

SEQ ID NO: 259192 - DNA, 20 bp, human
gggggcgggaagagcagttg

SEQ ID NO: 259193 - DNA, 20 bp, human
gtccgtacgactgtgcgcca

SEQ ID NO: 259194 - DNA, 20 bp, human
gtccgcgtgagcgcccccct

SEQ ID NO: 259195 - DNA, 20 bp, human
gcctcctgcgcggtctatgg

SEQ ID NO: 259196 - DNA, 20 bp, human
ggcgcccgagccctcccagt

SEQ ID NO: 259197 - DNA, 20 bp, human
ggcacccgcctcattggctg

SEQ ID NO: 259198 - DNA, 20 bp, human
gtagacgtccgtcgagtccc

SEQ ID NO: 259199 - DNA, 20 bp, human
gcggtcgcgtggagccttgg

SEQ ID NO: 259200 - DNA, 20 bp, human
gccgtcgagtcccaggtggt

SEQ ID NO: 259201 - DNA, 20 bp, human
gccaggtggtaggaaacgat

SEQ ID NO: 259202 - DNA, 20 bp, human
gacctgctccgccctgtcgg

SEQ ID NO: 259203 - DNA, 20 bp, human
gaatgaggcgggtgcctcga

SEQ ID NO: 259204 - DNA, 20 bp, human
gacagggcggagcaggtaag

SEQ ID NO: 259205 - DNA, 20 bp, human
ggacccggggattggactgg

SEQ ID NO: 259206 - DNA, 20 bp, human
gcacagaaggggccttgcgg

SEQ ID NO: 259207 - DNA, 20 bp, human
ggggcctcgtggatatgcat

SEQ ID NO: 259208 - DNA, 20 bp, human
gcagtcaagtgtacacagaa

SEQ ID NO: 259209 - DNA, 20 bp, human
ggtctggatgagatcagctg

SEQ ID NO: 259210 - DNA, 20 bp, human
gaggggccttgcgggggctg

SEQ ID NO: 259211 - DNA, 20 bp, human
gaatatcaatgaacagagga

SEQ ID NO: 259212 - DNA, 20 bp, human
gttactgtcagaaggcagtc

SEQ ID NO: 259213 - DNA, 20 bp, human
gacacttgactgaattttat

SEQ ID NO: 259214 - DNA, 20 bp, human
gtcccagaaattcagctatg

SEQ ID NO: 259215 - DNA, 20 bp, human
gatcccttagcaggttaatg

SEQ ID NO: 259216 - DNA, 20 bp, human
gtggggctgtaacattgctc

SEQ ID NO: 259217 - DNA, 20 bp, human
ggcgtcacggaggacggatc

SEQ ID NO: 259218 - DNA, 20 bp, human
gtaacattgctcagggtcag

SEQ ID NO: 259219 - DNA, 20 bp, human
gctcagggtcagtggtcact

SEQ ID NO: 259220 - DNA, 20 bp, human
ggacgtggccagcggattca

SEQ ID NO: 259221 - DNA, 20 bp, human
ggataaactgattcctcagt

SEQ ID NO: 259222 - DNA, 20 bp, human
gcctctggaggggctctccg

SEQ ID NO: 259223 - DNA, 20 bp, human
gactctgggagctgcgcctg

SEQ ID NO: 259224 - DNA, 20 bp, human
gcaatgttacagccccactg

SEQ ID NO: 259225 - DNA, 20 bp, human
gatggagcccaggaggcgtg

SEQ ID NO: 259226 - DNA, 20 bp, human
ggatgtctagccaatctcgt

SEQ ID NO: 259227 - DNA, 20 bp, human
gcgcggtaagagcgtctcgg

SEQ ID NO: 259228 - DNA, 20 bp, human
gggcgttcccggatgtgcgg

SEQ ID NO: 259229 - DNA, 20 bp, human
gagcaccgccaccgcacatc

SEQ ID NO: 259230 - DNA, 20 bp, human
gcgacctctccccacgagat

SEQ ID NO: 259231 - DNA, 20 bp, human
ggttcccggatgtgcggtgg

SEQ ID NO: 259232 - DNA, 20 bp, human
gaattagtgaaacctgcctc

SEQ ID NO: 259233 - DNA, 20 bp, human
gcgaaactctgcctacagac

SEQ ID NO: 259234 - DNA, 20 bp, human
gtctctcttctagtctctga

SEQ ID NO: 259235 - DNA, 20 bp, human
gggactctaaaaccttcatc

SEQ ID NO: 259236 - DNA, 20 bp, human
gcaccccgttaggaccccgg

SEQ ID NO: 259237 - DNA, 20 bp, human
gactctgggacggccctcgg

SEQ ID NO: 259238 - DNA, 20 bp, human
gtgggtcaggcacacgcgag

SEQ ID NO: 259239 - DNA, 20 bp, human
ggcgctgaatccacgtgcgg

SEQ ID NO: 259240 - DNA, 20 bp, human
gacgggacgctcgggattca

SEQ ID NO: 259241 - DNA, 20 bp, human
gagcgcgcgaggccctcggt

SEQ ID NO: 259242 - DNA, 20 bp, human
gaccctggggggagctccgt

SEQ ID NO: 259243 - DNA, 20 bp, human
gcgcgccgccggggtcctaa

SEQ ID NO: 259244 - DNA, 20 bp, human
gcagctctgtggtcccgcgg

SEQ ID NO: 259245 - DNA, 20 bp, human
gcgacaagaaaggtgggcga

SEQ ID NO: 259246 - DNA, 20 bp, human
ggggcctgacgtcagcagga

SEQ ID NO: 259247 - DNA, 20 bp, human
gggccccggcacctgcgcac

SEQ ID NO: 259248 - DNA, 20 bp, human
gcctggggcctgacgtcagc

SEQ ID NO: 259249 - DNA, 20 bp, human
gtggcacccgtccgcacctg

SEQ ID NO: 259250 - DNA, 20 bp, human
ggtcaggccccaggtgcgga

SEQ ID NO: 259251 - DNA, 20 bp, human
gtgccagtgcgcaggtgccg

SEQ ID NO: 259252 - DNA, 20 bp, human
gtccacccagggccggctta

SEQ ID NO: 259253 - DNA, 20 bp, human
gttatgacgtcacacaagag

SEQ ID NO: 259254 - DNA, 20 bp, human
ggcgcacgggcgtcaggatg

SEQ ID NO: 259255 - DNA, 20 bp, human
gctcctggagatcaggccaa

SEQ ID NO: 259256 - DNA, 20 bp, human
gcggaggggctttcggggaa

SEQ ID NO: 259257 - DNA, 20 bp, human
gacggtggacggagctaggt

SEQ ID NO: 259258 - DNA, 20 bp, human
ggagcgagctggacggtgga

SEQ ID NO: 259259 - DNA, 20 bp, human
ggaagggggcggagcgagct

SEQ ID NO: 259260 - DNA, 20 bp, human
ggtagccccgccagcagcca

SEQ ID NO: 259261 - DNA, 20 bp, human
ggcacgtgcacgcggctctg

SEQ ID NO: 259262 - DNA, 20 bp, human
gggcggagcgagctggacgg

SEQ ID NO: 259263 - DNA, 20 bp, human
gctctgcggaggggctttcg

SEQ ID NO: 259264 - DNA, 20 bp, human
ggtggacggagctaggtggg

SEQ ID NO: 259265 - DNA, 20 bp, human
ggggctacggtgctggctcg

SEQ ID NO: 259266 - DNA, 20 bp, human
gcgggaaagtggaaaactat

SEQ ID NO: 259267 - DNA, 20 bp, human
gaaactatcggcggtggccc

SEQ ID NO: 259268 - DNA, 20 bp, human
ggaaagtggaaaactatcgg

SEQ ID NO: 259269 - DNA, 20 bp, human
gacgtcgtggcgcacctcag

SEQ ID NO: 259270 - DNA, 20 bp, human
gagtggaaaactatcggcgg

SEQ ID NO: 259271 - DNA, 20 bp, human
gtcaacgttcgcgccggaag

SEQ ID NO: 259272 - DNA, 20 bp, human
ggaacgttgacgtcacgtcg

SEQ ID NO: 259273 - DNA, 20 bp, human
gatcggcggtggcccaggct

SEQ ID NO: 259274 - DNA, 20 bp, human
ggtgacgtcaacgttcgcgc

SEQ ID NO: 259275 - DNA, 20 bp, human
gttaagagattaggtcgcag

SEQ ID NO: 259276 - DNA, 20 bp, human
gggcccgcggaagacagacc

SEQ ID NO: 259277 - DNA, 20 bp, human
gcgggtctccatggatacgg

SEQ ID NO: 259278 - DNA, 20 bp, human
gggccccacccccgtatcca

SEQ ID NO: 259279 - DNA, 20 bp, human
gacagaccgggcgaacgggg

SEQ ID NO: 259280 - DNA, 20 bp, human
gaagacagaccgggcgaacg

SEQ ID NO: 259281 - DNA, 20 bp, human
gacaggcagtccggcggcgt

SEQ ID NO: 259282 - DNA, 20 bp, human
gtcgcccggtctgtcttccg

SEQ ID NO: 259283 - DNA, 20 bp, human
ggcgctctgtgtctttgtcc

SEQ ID NO: 259284 - DNA, 20 bp, human
gcgtcgggtctccatggata

SEQ ID NO: 259285 - DNA, 20 bp, human
gtgcccgccccgcagggaag

SEQ ID NO: 259286 - DNA, 20 bp, human
gagcgcgcggaagtggcttt

SEQ ID NO: 259287 - DNA, 20 bp, human
gctctgaggtgcactttatg

SEQ ID NO: 259288 - DNA, 20 bp, human
gaaagtgcacctcagaggtc

SEQ ID NO: 259289 - DNA, 20 bp, human
gctggaaattggtggtgctg

SEQ ID NO: 259290 - DNA, 20 bp, human
ggctgtgggttgaggagtcc

SEQ ID NO: 259291 - DNA, 20 bp, human
gctgactcagcgttaagaat

SEQ ID NO: 259292 - DNA, 20 bp, human
gtaacaaggacattcaaaag

SEQ ID NO: 259293 - DNA, 20 bp, human
ggggttgaggagtccgggtt

SEQ ID NO: 259294 - DNA, 20 bp, human
gggtcagggaacacataaca

SEQ ID NO: 259295 - DNA, 20 bp, human
ggtgcactttatggggctga

SEQ ID NO: 259296 - DNA, 20 bp, human
gcgaaagcggagtggcgctc

SEQ ID NO: 259297 - DNA, 20 bp, human
gtggcgctccggccagtgat

SEQ ID NO: 259298 - DNA, 20 bp, human
gcgccctcgctgcttaacaa

SEQ ID NO: 259299 - DNA, 20 bp, human
gtgcgcgtgcgcagaaaagc

SEQ ID NO: 259300 - DNA, 20 bp, human
gagagggcggagcgtgtccg

SEQ ID NO: 259301 - DNA, 20 bp, human
ggggacttccgaaagcggag

SEQ ID NO: 259302 - DNA, 20 bp, human
gccggccagtgattggctgg

SEQ ID NO: 259303 - DNA, 20 bp, human
ggcgctgggcgaccagagca

SEQ ID NO: 259304 - DNA, 20 bp, human
gaccgcgggtactctgctgc

SEQ ID NO: 259305 - DNA, 20 bp, human
ggcgcagggacttccgaaag

SEQ ID NO: 259306 - DNA, 20 bp, human
gccagagtgccgggagttaa

SEQ ID NO: 259307 - DNA, 20 bp, human
gaactcccggcactctggat

SEQ ID NO: 259308 - DNA, 20 bp, human
ggactagcgaggcggaagta

SEQ ID NO: 259309 - DNA, 20 bp, human
ggctgtgggatccaaccaga

SEQ ID NO: 259310 - DNA, 20 bp, human
gggcactctggattggaaga

SEQ ID NO: 259311 - DNA, 20 bp, human
gcatgggcagtccccttcat

SEQ ID NO: 259312 - DNA, 20 bp, human
ggagactgggagggcttccg

SEQ ID NO: 259313 - DNA, 20 bp, human
ggtgtcaagtgcctatgaag

SEQ ID NO: 259314 - DNA, 20 bp, human
gggccgatcgactagcgagg

SEQ ID NO: 259315 - DNA, 20 bp, human
gcgtttctgtcataagctgt

SEQ ID NO: 259316 - DNA, 20 bp, human
gacacccggtgtcccgcgac

SEQ ID NO: 259317 - DNA, 20 bp, human
ggcggagcaccacgggatcg

SEQ ID NO: 259318 - DNA, 20 bp, human
gggacaccgggtgtagaggg

SEQ ID NO: 259319 - DNA, 20 bp, human
ggccgcgccgcggagcacca

SEQ ID NO: 259320 - DNA, 20 bp, human
ggcgggacaccgggtgtaga

SEQ ID NO: 259321 - DNA, 20 bp, human
gcctccgtgcggccgggtgc

SEQ ID NO: 259322 - DNA, 20 bp, human
gcgggtgtagagggcggtcg

SEQ ID NO: 259323 - DNA, 20 bp, human
gagagagcaaggccgcgccg

SEQ ID NO: 259324 - DNA, 20 bp, human
gtgcggacgtgcagacttga

SEQ ID NO: 259325 - DNA, 20 bp, human
gggtcaccgtggagcggaaa

SEQ ID NO: 259326 - DNA, 20 bp, human
gcaaaggcggggcaacgttg

SEQ ID NO: 259327 - DNA, 20 bp, human
ggcggggcaacgttggggcg

SEQ ID NO: 259328 - DNA, 20 bp, human
gttcccgcgcccctagctgg

SEQ ID NO: 259329 - DNA, 20 bp, human
gtccgctggagacaaaggcg

SEQ ID NO: 259330 - DNA, 20 bp, human
gttggggcgcggccgctgat

SEQ ID NO: 259331 - DNA, 20 bp, human
gcacgtggtgctccttgata

SEQ ID NO: 259332 - DNA, 20 bp, human
gttctgtgcttcacaatggt

SEQ ID NO: 259333 - DNA, 20 bp, human
gaaattgcccgcactcttat

SEQ ID NO: 259334 - DNA, 20 bp, human
gccaggcaggcgcagagtcg

SEQ ID NO: 259335 - DNA, 20 bp, human
gaccaaccgagagcggaagt

SEQ ID NO: 259336 - DNA, 20 bp, human
gctctctgctgaactcccaa

SEQ ID NO: 259337 - DNA, 20 bp, human
gaaacacaagtggctgccaa

SEQ ID NO: 259338 - DNA, 20 bp, human
gtcaacagaaaggtcgggac

SEQ ID NO: 259339 - DNA, 20 bp, human
gtattgtttcagtcccttac

SEQ ID NO: 259340 - DNA, 20 bp, human
ggggggctctgataaagaac

SEQ ID NO: 259341 - DNA, 20 bp, human
ggaaatacacacactccctt

SEQ ID NO: 259342 - DNA, 20 bp, human
gctactcagttgggataaag

SEQ ID NO: 259343 - DNA, 20 bp, human
gggctctgataaagaacggg

SEQ ID NO: 259344 - DNA, 20 bp, human
gtctaatctggctttcaagt

SEQ ID NO: 259345 - DNA, 20 bp, human
gcttcttgagaatggatcat

SEQ ID NO: 259346 - DNA, 20 bp, human
gcggggcgggacctaaccgc

SEQ ID NO: 259347 - DNA, 20 bp, human
gcaacgcgaggattggctag

SEQ ID NO: 259348 - DNA, 20 bp, human
ggggcacggccggtctgtgc

SEQ ID NO: 259349 - DNA, 20 bp, human
ggagtcagggcggtgggaac

SEQ ID NO: 259350 - DNA, 20 bp, human
ggggagcagccggcacagac

SEQ ID NO: 259351 - DNA, 20 bp, human
gcccgctcccatcgcgagac

SEQ ID NO: 259352 - DNA, 20 bp, human
gccagctctcagggcacggc

SEQ ID NO: 259353 - DNA, 20 bp, human
ggattggctagcggcggaga

SEQ ID NO: 259354 - DNA, 20 bp, human
gcctgctcccacagcgatac

SEQ ID NO: 259355 - DNA, 20 bp, human
gccccgtgcttgtgacatat

SEQ ID NO: 259356 - DNA, 20 bp, human
ggacccggacagccggtaat

SEQ ID NO: 259357 - DNA, 20 bp, human
gggacgcagtagtcagagcg

SEQ ID NO: 259358 - DNA, 20 bp, human
ggatgcgaggggaagtgtgt

SEQ ID NO: 259359 - DNA, 20 bp, human
gtggtcacgtgacacatcct

SEQ ID NO: 259360 - DNA, 20 bp, human
gagtcagagcggggtgaggc

SEQ ID NO: 259361 - DNA, 20 bp, human
ggaacccgtccgtgctgctg

SEQ ID NO: 259362 - DNA, 20 bp, human
gtgggtggagccgtgagtga

SEQ ID NO: 259363 - DNA, 20 bp, human
ggtactccaggtttgaggga

SEQ ID NO: 259364 - DNA, 20 bp, human
gatcgaaagcatggcgtcgg

SEQ ID NO: 259365 - DNA, 20 bp, human
gcgacaccgtccctcaaacc

SEQ ID NO: 259366 - DNA, 20 bp, human
ggcggaagaaggtgcgtccg

SEQ ID NO: 259367 - DNA, 20 bp, human
gcggtccggccggaagtcac

SEQ ID NO: 259368 - DNA, 20 bp, human
gcctgcgggagcaactgaac

SEQ ID NO: 259369 - DNA, 20 bp, human
ggactcccagctctacgcgg

SEQ ID NO: 259370 - DNA, 20 bp, human
gtcgcggcgcacgtcggccc

SEQ ID NO: 259371 - DNA, 20 bp, human
gacttccggccggaccgctg

SEQ ID NO: 259372 - DNA, 20 bp, human
gcggaagaggccggtgtccc

SEQ ID NO: 259373 - DNA, 20 bp, human
gcggctgccggtccgggcct

SEQ ID NO: 259374 - DNA, 20 bp, human
gccagctccgcgatcagccg

SEQ ID NO: 259375 - DNA, 20 bp, human
gcccgccatggcgcggaaga

SEQ ID NO: 259376 - DNA, 20 bp, human
gcgaagttcgggtccgtagt

SEQ ID NO: 259377 - DNA, 20 bp, human
gcggaagtcccgcccctttc

SEQ ID NO: 259378 - DNA, 20 bp, human
gagggcagccttccagaaag

SEQ ID NO: 259379 - DNA, 20 bp, human
gagtcccgcccctttctgga

SEQ ID NO: 259380 - DNA, 20 bp, human
gctaagggggagggtttcaa

SEQ ID NO: 259381 - DNA, 20 bp, human
gcgggtccgtagtgggctaa

SEQ ID NO: 259382 - DNA, 20 bp, human
ggtaaggctggcgaaagaaa

SEQ ID NO: 259383 - DNA, 20 bp, human
gacgagggttcgggcccgta

SEQ ID NO: 259384 - DNA, 20 bp, human
gggacccgaacttcgcgcac

SEQ ID NO: 259385 - DNA, 20 bp, human
ggcccgaaccctcgtgtgaa

SEQ ID NO: 259386 - DNA, 20 bp, human
gccgccgctgccaacccgga

SEQ ID NO: 259387 - DNA, 20 bp, human
gaacccggaaggagcccgga

SEQ ID NO: 259388 - DNA, 20 bp, human
ggcccctccgggctccttcc

SEQ ID NO: 259389 - DNA, 20 bp, human
gcggccgcggagctggaaac

SEQ ID NO: 259390 - DNA, 20 bp, human
gctggcgggcctcctggcgg

SEQ ID NO: 259391 - DNA, 20 bp, human
gtctccctaggaggagatct

SEQ ID NO: 259392 - DNA, 20 bp, human
gcgccgcggggcccttttgg

SEQ ID NO: 259393 - DNA, 20 bp, human
gcacctggcgggcctcctgg

SEQ ID NO: 259394 - DNA, 20 bp, human
ggtgaggtgcccaatacacg

SEQ ID NO: 259395 - DNA, 20 bp, human
gggctcaggtggacacctgg

SEQ ID NO: 259396 - DNA, 20 bp, human
gaggctggcctcaagcccgg

SEQ ID NO: 259397 - DNA, 20 bp, human
gggaaggactgactggacaa

SEQ ID NO: 259398 - DNA, 20 bp, human
gccagggccgcagctcccct

SEQ ID NO: 259399 - DNA, 20 bp, human
gtggcgcacgatggttggag

SEQ ID NO: 259400 - DNA, 20 bp, human
gtgaggccagcctctcagat

SEQ ID NO: 259401 - DNA, 20 bp, human
gagatgtggcgcacgatggt

SEQ ID NO: 259402 - DNA, 20 bp, human
gtccttcccagcttcggccc

SEQ ID NO: 259403 - DNA, 20 bp, human
gcggaccgccagccagacag

SEQ ID NO: 259404 - DNA, 20 bp, human
gtgcccctgtggctgttcgg

SEQ ID NO: 259405 - DNA, 20 bp, human
gatggagccagggccgaagc

SEQ ID NO: 259406 - DNA, 20 bp, human
gccccctgccgagaagcgaa

SEQ ID NO: 259407 - DNA, 20 bp, human
gggagacggggagacttggt

SEQ ID NO: 259408 - DNA, 20 bp, human
ggggctgcagaaggagaagt

SEQ ID NO: 259409 - DNA, 20 bp, human
ggggacctgtgcgtcattga

SEQ ID NO: 259410 - DNA, 20 bp, human
gagcgagcctgtcggaaggt

SEQ ID NO: 259411 - DNA, 20 bp, human
ggagaagcgcagggcgcacg

SEQ ID NO: 259412 - DNA, 20 bp, human
gagcgaagggactggagacg

SEQ ID NO: 259413 - DNA, 20 bp, human
gaaagagggcggcacccggg

SEQ ID NO: 259414 - DNA, 20 bp, human
gtgccgagaagcgaagggac

SEQ ID NO: 259415 - DNA, 20 bp, human
gcgcttctcggcagggggct

SEQ ID NO: 259416 - DNA, 20 bp, human
gagcaaacggggatgatctg

SEQ ID NO: 259417 - DNA, 20 bp, human
gcacctggggctgctccctt

SEQ ID NO: 259418 - DNA, 20 bp, human
ggcgaacaggaggttccaaa

SEQ ID NO: 259419 - DNA, 20 bp, human
gggaacctcctgttcgcagg

SEQ ID NO: 259420 - DNA, 20 bp, human
gggcagaggttgcggggtaa

SEQ ID NO: 259421 - DNA, 20 bp, human
ggtgcccgcaggcgacagag

SEQ ID NO: 259422 - DNA, 20 bp, human
gcgaggagccgcctgcgaac

SEQ ID NO: 259423 - DNA, 20 bp, human
gtcctggaaagtccacgccc

SEQ ID NO: 259424 - DNA, 20 bp, human
gaacccgggaactgctctcc

SEQ ID NO: 259425 - DNA, 20 bp, human
gagtggctggtgtgctcggg

SEQ ID NO: 259426 - DNA, 20 bp, human
ggaggccgccccctcgcggg

SEQ ID NO: 259427 - DNA, 20 bp, human
ggggaaagaggccgcaggcg

SEQ ID NO: 259428 - DNA, 20 bp, human
gcctgcggcctctttccccg

SEQ ID NO: 259429 - DNA, 20 bp, human
gggcgcggggacaaagacca

SEQ ID NO: 259430 - DNA, 20 bp, human
gtccgcgcacgggggctcag

SEQ ID NO: 259431 - DNA, 20 bp, human
ggcgcccgctccgcccgcga

SEQ ID NO: 259432 - DNA, 20 bp, human
gcgctccgcccgcgaggggg

SEQ ID NO: 259433 - DNA, 20 bp, human
gagcgggcgctgggctcgcg

SEQ ID NO: 259434 - DNA, 20 bp, human
gggcgggcccggggttgcca

SEQ ID NO: 259435 - DNA, 20 bp, human
gccgagcctccccgcgcctg

SEQ ID NO: 259436 - DNA, 20 bp, human
gccaccgggtcacacatccc

SEQ ID NO: 259437 - DNA, 20 bp, human
gtgggaccctccggctccag

SEQ ID NO: 259438 - DNA, 20 bp, human
ggctgtggactcccgatccc

SEQ ID NO: 259439 - DNA, 20 bp, human
gcccgaaagaacctgggatc

SEQ ID NO: 259440 - DNA, 20 bp, human
ggatcgggagtccacagccc

SEQ ID NO: 259441 - DNA, 20 bp, human
ggtgacccggtgggaccctc

SEQ ID NO: 259442 - DNA, 20 bp, human
gctaggaattagcagaactg

SEQ ID NO: 259443 - DNA, 20 bp, human
gagccacccctggagccgga

SEQ ID NO: 259444 - DNA, 20 bp, human
gtgccgcttccggccctggg

SEQ ID NO: 259445 - DNA, 20 bp, human
gcagcccgggatgtgtgacc

SEQ ID NO: 259446 - DNA, 20 bp, human
gggaccagacggtacctagg

SEQ ID NO: 259447 - DNA, 20 bp, human
ggctctcattggttctgaac

SEQ ID NO: 259448 - DNA, 20 bp, human
gggttctgaacgggcgagga

SEQ ID NO: 259449 - DNA, 20 bp, human
ggccccccaacacaatccta

SEQ ID NO: 259450 - DNA, 20 bp, human
gggaacgaagggcgttgcta

SEQ ID NO: 259451 - DNA, 20 bp, human
ggatccccctaggtaccgtc

SEQ ID NO: 259452 - DNA, 20 bp, human
gtgtcccgacccccctttct

SEQ ID NO: 259453 - DNA, 20 bp, human
ggcgccggccgcctgatgcc

SEQ ID NO: 259454 - DNA, 20 bp, human
gctgcgcgacaggctctcat

SEQ ID NO: 259455 - DNA, 20 bp, human
gctggggatgctggaacgaa

SEQ ID NO: 259456 - DNA, 20 bp, human
gccgtcccctgggaatccgg

SEQ ID NO: 259457 - DNA, 20 bp, human
gacagggaggggttaccaag

SEQ ID NO: 259458 - DNA, 20 bp, human
gcccgcccccggattcccag

SEQ ID NO: 259459 - DNA, 20 bp, human
gattcccaggggacggggaa

SEQ ID NO: 259460 - DNA, 20 bp, human
gtgaccccctggcctactcc

SEQ ID NO: 259461 - DNA, 20 bp, human
ggcctcgccgctcagtacgg

SEQ ID NO: 259462 - DNA, 20 bp, human
gcaggggcggggtcacaaaa

SEQ ID NO: 259463 - DNA, 20 bp, human
gacaggggggcgggttatta

SEQ ID NO: 259464 - DNA, 20 bp, human
ggagcggcgaggcccggaca

SEQ ID NO: 259465 - DNA, 20 bp, human
gaatccgggggcggggatcc

SEQ ID NO: 259466 - DNA, 20 bp, human
gtgctgaaggctggggacca

SEQ ID NO: 259467 - DNA, 20 bp, human
ggaggcaaggtgagagggcg

SEQ ID NO: 259468 - DNA, 20 bp, human
ggcgaggcggacaaacgccg

SEQ ID NO: 259469 - DNA, 20 bp, human
gctccgtggcgtcacgtggg

SEQ ID NO: 259470 - DNA, 20 bp, human
ggtcacgtgggaggcggagt

SEQ ID NO: 259471 - DNA, 20 bp, human
gtggcaagaccccgcctccg

SEQ ID NO: 259472 - DNA, 20 bp, human
gggcggagtcggaagtgtga

SEQ ID NO: 259473 - DNA, 20 bp, human
gcggtaggcctgctgaaggc

SEQ ID NO: 259474 - DNA, 20 bp, human
gcgtggcgtcacgtgggagg

SEQ ID NO: 259475 - DNA, 20 bp, human
gcgcctccgtggcgtcacgt

SEQ ID NO: 259476 - DNA, 20 bp, human
gggcttaagcagctcaacga

SEQ ID NO: 259477 - DNA, 20 bp, human
gcgactccgcaactagaccg

SEQ ID NO: 259478 - DNA, 20 bp, human
gtaagcagctcaacgaggga

SEQ ID NO: 259479 - DNA, 20 bp, human
gcgagcgccgcaggtgaccg

SEQ ID NO: 259480 - DNA, 20 bp, human
gagaagaggctggagttcgc

SEQ ID NO: 259481 - DNA, 20 bp, human
gcggggccacggtctagttg

SEQ ID NO: 259482 - DNA, 20 bp, human
ggggagcccggggtcgccga

SEQ ID NO: 259483 - DNA, 20 bp, human
gcggtccctgcacccagcgt

SEQ ID NO: 259484 - DNA, 20 bp, human
gtctctgcaagtgcgcgggc

SEQ ID NO: 259485 - DNA, 20 bp, human
ggggcggagtgagcgcggga

SEQ ID NO: 259486 - DNA, 20 bp, human
gggaaacagcgacgccccgg

SEQ ID NO: 259487 - DNA, 20 bp, human
gacttcccaggatgcgtcgg

SEQ ID NO: 259488 - DNA, 20 bp, human
ggcgcgctgtccgccctaac

SEQ ID NO: 259489 - DNA, 20 bp, human
ggcgacgccccggaggactg

SEQ ID NO: 259490 - DNA, 20 bp, human
gtacacttcccaggatgcgt

SEQ ID NO: 259491 - DNA, 20 bp, human
ggctccgctgacgccggtac

SEQ ID NO: 259492 - DNA, 20 bp, human
gagacctgtaccggcgtcag

SEQ ID NO: 259493 - DNA, 20 bp, human
gcttggaaacagcgacgccc

SEQ ID NO: 259494 - DNA, 20 bp, human
gtctgggcgcgcggaatcct

SEQ ID NO: 259495 - DNA, 20 bp, human
gcgagatctcgcctagtaac

SEQ ID NO: 259496 - DNA, 20 bp, human
ggctggcagtcagtcaagag

SEQ ID NO: 259497 - DNA, 20 bp, human
gtcagagagagcctacaaca

SEQ ID NO: 259498 - DNA, 20 bp, human
ggcagtcagtcaagagtggc

SEQ ID NO: 259499 - DNA, 20 bp, human
gtactggggtgtgtaatggg

SEQ ID NO: 259500 - DNA, 20 bp, human
ggtgtactggggtgtgtaat

SEQ ID NO: 259501 - DNA, 20 bp, human
gacaaggtttcagcctggga

SEQ ID NO: 259502 - DNA, 20 bp, human
gacagggttctttgaattga

SEQ ID NO: 259503 - DNA, 20 bp, human
ggggaggccctgaaggcgaa

SEQ ID NO: 259504 - DNA, 20 bp, human
ggcagctgatgcttttaatg

SEQ ID NO: 259505 - DNA, 20 bp, human
gacagaccacagtggaaaaa

SEQ ID NO: 259506 - DNA, 20 bp, human
ggggccgccggcgaaaggag

SEQ ID NO: 259507 - DNA, 20 bp, human
ggccctggagggaaaggccg

SEQ ID NO: 259508 - DNA, 20 bp, human
gcgggaggcgggatcgggga

SEQ ID NO: 259509 - DNA, 20 bp, human
ggggccgtgacgccaggagc

SEQ ID NO: 259510 - DNA, 20 bp, human
gggcgggaacggtggtgcgg

SEQ ID NO: 259511 - DNA, 20 bp, human
ggggaggggccgccggcgaa

SEQ ID NO: 259512 - DNA, 20 bp, human
gggagccgggagagccgagt

SEQ ID NO: 259513 - DNA, 20 bp, human
gaggggccccgccgcctaga

SEQ ID NO: 259514 - DNA, 20 bp, human
gcgaaaggagggggccctgg

SEQ ID NO: 259515 - DNA, 20 bp, human
gccgggagagccgagtggga

SEQ ID NO: 259516 - DNA, 20 bp, human
gaaggaggcccagacagtga

SEQ ID NO: 259517 - DNA, 20 bp, human
gggtgggggcccaaagaaag

SEQ ID NO: 259518 - DNA, 20 bp, human
gaggtcggctgccagtggga

SEQ ID NO: 259519 - DNA, 20 bp, human
ggtgggagggcccgattctc

SEQ ID NO: 259520 - DNA, 20 bp, human
gggcacggaggcccgagcga

SEQ ID NO: 259521 - DNA, 20 bp, human
gaaagggttctggattggag

SEQ ID NO: 259522 - DNA, 20 bp, human
ggcctcgggagggtgaaagg

SEQ ID NO: 259523 - DNA, 20 bp, human
gcccagacagtgagggcagg

SEQ ID NO: 259524 - DNA, 20 bp, human
gcctcagctgggtgcggtga

SEQ ID NO: 259525 - DNA, 20 bp, human
gtccagacagacatcatctg

SEQ ID NO: 259526 - DNA, 20 bp, human
gaccagaaggtgtgcgaaga

SEQ ID NO: 259527 - DNA, 20 bp, human
gagagagaatgatatacatt

SEQ ID NO: 259528 - DNA, 20 bp, human
gggggaaattaggattttct

SEQ ID NO: 259529 - DNA, 20 bp, human
gtggtacatgatggttgtga

SEQ ID NO: 259530 - DNA, 20 bp, human
gaaaaagggctatgatgacc

SEQ ID NO: 259531 - DNA, 20 bp, human
gcccctcttcgcacaccttc

SEQ ID NO: 259532 - DNA, 20 bp, human
gaaagaaggtgttgagagat

SEQ ID NO: 259533 - DNA, 20 bp, human
gaagcggaagctcctttatt

SEQ ID NO: 259534 - DNA, 20 bp, human
ggatgggagatagatgttga

SEQ ID NO: 259535 - DNA, 20 bp, human
gtattgggtgcaatgaaaga

SEQ ID NO: 259536 - DNA, 20 bp, human
ggggtgagccctaccaaagt

SEQ ID NO: 259537 - DNA, 20 bp, human
gtctggcctctgtgtgttcc

SEQ ID NO: 259538 - DNA, 20 bp, human
ggcagagggatttttaaagc

SEQ ID NO: 259539 - DNA, 20 bp, human
gctgggctcccactttggta

SEQ ID NO: 259540 - DNA, 20 bp, human
gcccagagctatttctgaca

SEQ ID NO: 259541 - DNA, 20 bp, human
gggggaagatactgccagct

SEQ ID NO: 259542 - DNA, 20 bp, human
gtccaggctggctgctgtgc

SEQ ID NO: 259543 - DNA, 20 bp, human
gtcctcatctggaaaacagc

SEQ ID NO: 259544 - DNA, 20 bp, human
gacaataaaaacacagaacc

SEQ ID NO: 259545 - DNA, 20 bp, human
ggcccctgcgtgcctgccca

SEQ ID NO: 259546 - DNA, 20 bp, human
gagctgagactcagatccac

SEQ ID NO: 259547 - DNA, 20 bp, human
gtgattaacgaagtgcccag

SEQ ID NO: 259548 - DNA, 20 bp, human
gggagcacttaatttgtacc

SEQ ID NO: 259549 - DNA, 20 bp, human
gacttaatttgtaccaggtc

SEQ ID NO: 259550 - DNA, 20 bp, human
gatgattagcttgtctcttg

SEQ ID NO: 259551 - DNA, 20 bp, human
gaagcacttaggaccagacc

SEQ ID NO: 259552 - DNA, 20 bp, human
ggagactcagatccacaggc

SEQ ID NO: 259553 - DNA, 20 bp, human
gataaataatagcattttct

SEQ ID NO: 259554 - DNA, 20 bp, human
gcatcattgcagatgtttta

SEQ ID NO: 259555 - DNA, 20 bp, human
gataatagcattttcttggc

SEQ ID NO: 259556 - DNA, 20 bp, human
gtgagtctgatggcgaaaga

SEQ ID NO: 259557 - DNA, 20 bp, human
gtcagggcatttcctcgtta

SEQ ID NO: 259558 - DNA, 20 bp, human
gaacaatagctaggcagaaa

SEQ ID NO: 259559 - DNA, 20 bp, human
gaaggtgatcaacaatagct

SEQ ID NO: 259560 - DNA, 20 bp, human
gaccaactcaatcatcccaa

SEQ ID NO: 259561 - DNA, 20 bp, human
ggagttggtaaaccctaacg

SEQ ID NO: 259562 - DNA, 20 bp, human
gtacatacttcaattctcat

SEQ ID NO: 259563 - DNA, 20 bp, human
gagtaagtatcatctactgg

SEQ ID NO: 259564 - DNA, 20 bp, human
ggaattgaagtatgtatctt

SEQ ID NO: 259565 - DNA, 20 bp, human
gggattaggaagtgcctttg

SEQ ID NO: 259566 - DNA, 20 bp, human
gaggagaagccagtggcgag

SEQ ID NO: 259567 - DNA, 20 bp, human
gagaagccagtggcgagggg

SEQ ID NO: 259568 - DNA, 20 bp, human
ggccaccagactcagctaaa

SEQ ID NO: 259569 - DNA, 20 bp, human
gccgccgtctcaacccacgc

SEQ ID NO: 259570 - DNA, 20 bp, human
gccttcttcggctcccgcgt

SEQ ID NO: 259571 - DNA, 20 bp, human
ggccgaagaaggcgtccgaa

SEQ ID NO: 259572 - DNA, 20 bp, human
gtgagctacacaccggggag

SEQ ID NO: 259573 - DNA, 20 bp, human
gcgggacgaatgggagagtt

SEQ ID NO: 259574 - DNA, 20 bp, human
gccccgcgaaggctccagtc

SEQ ID NO: 259575 - DNA, 20 bp, human
gggagggagcccgcagtcgg

SEQ ID NO: 259576 - DNA, 20 bp, human
gcgccccggccgccacaaag

SEQ ID NO: 259577 - DNA, 20 bp, human
gcagcggcccgcctgagcgc

SEQ ID NO: 259578 - DNA, 20 bp, human
gagcgccgggagccgtggtt

SEQ ID NO: 259579 - DNA, 20 bp, human
gcgtgcgccgcgcaactctg

SEQ ID NO: 259580 - DNA, 20 bp, human
ggggactccaggccgggtct

SEQ ID NO: 259581 - DNA, 20 bp, human
gcctccccacctcgcccaag

SEQ ID NO: 259582 - DNA, 20 bp, human
gctctccaaaccacggctcc

SEQ ID NO: 259583 - DNA, 20 bp, human
ggcgggccgctgccaagacc

SEQ ID NO: 259584 - DNA, 20 bp, human
gacgccgttccggccccctt

SEQ ID NO: 259585 - DNA, 20 bp, human
ggtggtttggagagcgctca

SEQ ID NO: 259586 - DNA, 20 bp, human
gtgagcgcctgggaacccgg

SEQ ID NO: 259587 - DNA, 20 bp, human
gtcgccctgaggtggaaggg

SEQ ID NO: 259588 - DNA, 20 bp, human
gggcccggatccaggcctcc

SEQ ID NO: 259589 - DNA, 20 bp, human
ggcagggcgccctaagtcca

SEQ ID NO: 259590 - DNA, 20 bp, human
gtcctccgaagcctggtaaa

SEQ ID NO: 259591 - DNA, 20 bp, human
ggccgagagtggaacggagt

SEQ ID NO: 259592 - DNA, 20 bp, human
ggggaccggggtgccccgga

SEQ ID NO: 259593 - DNA, 20 bp, human
gagaagcccggccgcccggt

SEQ ID NO: 259594 - DNA, 20 bp, human
gccgcccggtgggcggcaga

SEQ ID NO: 259595 - DNA, 20 bp, human
gccactctcggcccggatcc

SEQ ID NO: 259596 - DNA, 20 bp, human
gagtcagggccgcacgtgtg

SEQ ID NO: 259597 - DNA, 20 bp, human
gtcaaccgctggcggagagg

SEQ ID NO: 259598 - DNA, 20 bp, human
ggggactcgcgctgacactc

SEQ ID NO: 259599 - DNA, 20 bp, human
gcattggctccgcacacgtg

SEQ ID NO: 259600 - DNA, 20 bp, human
gtgaaggcaaaaagtgtgcc

SEQ ID NO: 259601 - DNA, 20 bp, human
gagggcggacccgacgcaca

SEQ ID NO: 259602 - DNA, 20 bp, human
gaaccggaagcacgtgagtc

SEQ ID NO: 259603 - DNA, 20 bp, human
gcgggggcgtcaaccgctgg

SEQ ID NO: 259604 - DNA, 20 bp, human
gactcgggcctcggcccaat

SEQ ID NO: 259605 - DNA, 20 bp, human
gggcgccccctctccgccag

SEQ ID NO: 259606 - DNA, 20 bp, human
ggggacgcgggccgcctccc

SEQ ID NO: 259607 - DNA, 20 bp, human
gcgcggcgaagtcgaggact

SEQ ID NO: 259608 - DNA, 20 bp, human
gggggtctagacagtcgcag

SEQ ID NO: 259609 - DNA, 20 bp, human
gaccccgccgagtcttccga

SEQ ID NO: 259610 - DNA, 20 bp, human
gacgccctcggaagactcgg

SEQ ID NO: 259611 - DNA, 20 bp, human
gcggccgccgcgcacgccct

SEQ ID NO: 259612 - DNA, 20 bp, human
gcggctgcgcggcgaagtcg

SEQ ID NO: 259613 - DNA, 20 bp, human
gctagacagtcgcagtggtc

SEQ ID NO: 259614 - DNA, 20 bp, human
gatcgtctgggcgagcgggg

SEQ ID NO: 259615 - DNA, 20 bp, human
gagcccgaggcggccggacg

SEQ ID NO: 259616 - DNA, 20 bp, human
gaatcccagaggggtgcagg

SEQ ID NO: 259617 - DNA, 20 bp, human
gggcccgcccgaatcccaga

SEQ ID NO: 259618 - DNA, 20 bp, human
gtcgccgcgaggaacccggg

SEQ ID NO: 259619 - DNA, 20 bp, human
gccctcccgcccaacacctc

SEQ ID NO: 259620 - DNA, 20 bp, human
gtcgctctccgcagtccggc

SEQ ID NO: 259621 - DNA, 20 bp, human
gccgggcccccgccggactg

SEQ ID NO: 259622 - DNA, 20 bp, human
gccgaatcccagaggggtgc

SEQ ID NO: 259623 - DNA, 20 bp, human
ggcgcggcggaggaacacgc

SEQ ID NO: 259624 - DNA, 20 bp, human
ggacggggatgagggaatcg

SEQ ID NO: 259625 - DNA, 20 bp, human
gacccctctgggattcgggc

SEQ ID NO: 259626 - DNA, 20 bp, human
gctacttaaaatactctgta

SEQ ID NO: 259627 - DNA, 20 bp, human
gtgaatactggtaaatacaa

SEQ ID NO: 259628 - DNA, 20 bp, human
gatgatctaacagtgaatac

SEQ ID NO: 259629 - DNA, 20 bp, human
gattttaagtaggataatct

SEQ ID NO: 259630 - DNA, 20 bp, human
ggatcataattcttagcagc

SEQ ID NO: 259631 - DNA, 20 bp, human
gatgttctaatatggatact

SEQ ID NO: 259632 - DNA, 20 bp, human
gattattagatgttctaata

SEQ ID NO: 259633 - DNA, 20 bp, human
ggaatgtggcttcatgttta

SEQ ID NO: 259634 - DNA, 20 bp, human
gaattcaaggattgtcagtt

SEQ ID NO: 259635 - DNA, 20 bp, human
gtaattctcctaatcaaact

SEQ ID NO: 259636 - DNA, 20 bp, human
ggagctagagaagagcgtgt

SEQ ID NO: 259637 - DNA, 20 bp, human
gctagagaagagcgtgtcgg

SEQ ID NO: 259638 - DNA, 20 bp, human
gcggcctgtggtgtaggagg

SEQ ID NO: 259639 - DNA, 20 bp, human
gcgtgtcgggggagttaatc

SEQ ID NO: 259640 - DNA, 20 bp, human
ggggaggaagcgcattagcg

SEQ ID NO: 259641 - DNA, 20 bp, human
gcccgccgcgccacttatag

SEQ ID NO: 259642 - DNA, 20 bp, human
ggcgcggcctgtggtgtagg

SEQ ID NO: 259643 - DNA, 20 bp, human
gttagcgcggcctgtggtgt

SEQ ID NO: 259644 - DNA, 20 bp, human
gggcggggcgcagactgctc

SEQ ID NO: 259645 - DNA, 20 bp, human
gtatgcaaagagaccgacac

SEQ ID NO: 259646 - DNA, 20 bp, human
ggacccgcgtctccagtccc

SEQ ID NO: 259647 - DNA, 20 bp, human
gggacgcgcgctaccaagag

SEQ ID NO: 259648 - DNA, 20 bp, human
gtggggcgggcctagtcccg

SEQ ID NO: 259649 - DNA, 20 bp, human
ggatgctgacaacgtaccct

SEQ ID NO: 259650 - DNA, 20 bp, human
gtacgcagccgagcagggta

SEQ ID NO: 259651 - DNA, 20 bp, human
gcgcccgggactggagacgc

SEQ ID NO: 259652 - DNA, 20 bp, human
gggcgggggcgggtccgcgt

SEQ ID NO: 259653 - DNA, 20 bp, human
gtccgcagagcgccgcgcct

SEQ ID NO: 259654 - DNA, 20 bp, human
gtctgcagccatcttcaggg

SEQ ID NO: 259655 - DNA, 20 bp, human
gggaagtcgcaacctaggcg

SEQ ID NO: 259656 - DNA, 20 bp, human
gcaggccccctgctggtcgt

SEQ ID NO: 259657 - DNA, 20 bp, human
gaagcaggagctccctgcgc

SEQ ID NO: 259658 - DNA, 20 bp, human
gccaccccacgaccagcagg

SEQ ID NO: 259659 - DNA, 20 bp, human
gacagtgcttgacccttccg

SEQ ID NO: 259660 - DNA, 20 bp, human
gtctcctctgcgcctgcgca

SEQ ID NO: 259661 - DNA, 20 bp, human
gtccgcggagcgtattaagc

SEQ ID NO: 259662 - DNA, 20 bp, human
gcgcctcgcaggccccctgc

SEQ ID NO: 259663 - DNA, 20 bp, human
gctcgcgattggccaccatc

SEQ ID NO: 259664 - DNA, 20 bp, human
gcactctccgagcggtgtag

SEQ ID NO: 259665 - DNA, 20 bp, human
gggtggccaatcgcgagctg

SEQ ID NO: 259666 - DNA, 20 bp, human
gtgagggaaggtgactaaga

SEQ ID NO: 259667 - DNA, 20 bp, human
gggaaggtgactaagaaggt

SEQ ID NO: 259668 - DNA, 20 bp, human
gaccctagatggataggagg

SEQ ID NO: 259669 - DNA, 20 bp, human
gctgtttgaagcctgaggga

SEQ ID NO: 259670 - DNA, 20 bp, human
ggggaccctagatggatagg

SEQ ID NO: 259671 - DNA, 20 bp, human
gccaaattagggacacccat

SEQ ID NO: 259672 - DNA, 20 bp, human
gcccacctcctatccatcta

SEQ ID NO: 259673 - DNA, 20 bp, human
gtagccatgcgctcgacatg

SEQ ID NO: 259674 - DNA, 20 bp, human
gctccaaactggacccatct

SEQ ID NO: 259675 - DNA, 20 bp, human
gaagtgcccaagcaagggtt

SEQ ID NO: 259676 - DNA, 20 bp, human
gggcttctgaagacccgggt

SEQ ID NO: 259677 - DNA, 20 bp, human
ggaaagcgcaagcgtctcca

SEQ ID NO: 259678 - DNA, 20 bp, human
gagctcggagggtccgcgaa

SEQ ID NO: 259679 - DNA, 20 bp, human
gagggccatggcttcgtccc

SEQ ID NO: 259680 - DNA, 20 bp, human
gcggaagtgacgtgcggaag

SEQ ID NO: 259681 - DNA, 20 bp, human
ggcggcgccgcgcgcgatat

SEQ ID NO: 259682 - DNA, 20 bp, human
gtgcgtgtgcgttcacgcag

SEQ ID NO: 259683 - DNA, 20 bp, human
ggagacgcttgcgctttccc

SEQ ID NO: 259684 - DNA, 20 bp, human
gaaggggcggacggcctccc

SEQ ID NO: 259685 - DNA, 20 bp, human
gagcgtctccatggcaacga

SEQ ID NO: 259686 - DNA, 20 bp, human
gcaccagccttggagagggt

SEQ ID NO: 259687 - DNA, 20 bp, human
gtggcccagccccttctcta

SEQ ID NO: 259688 - DNA, 20 bp, human
gcgggtagaggaagtgccac

SEQ ID NO: 259689 - DNA, 20 bp, human
gcaccgaggggaactttcag

SEQ ID NO: 259690 - DNA, 20 bp, human
gcctctccaaggctggtggg

SEQ ID NO: 259691 - DNA, 20 bp, human
gccgcctgccaaccgggtag

SEQ ID NO: 259692 - DNA, 20 bp, human
ggccaggccgcctgccaacc

SEQ ID NO: 259693 - DNA, 20 bp, human
gtcccctcggtgggctgtta

SEQ ID NO: 259694 - DNA, 20 bp, human
gaccctaacagcccaccgag

SEQ ID NO: 259695 - DNA, 20 bp, human
gggcacttcctctacccggt

SEQ ID NO: 259696 - DNA, 20 bp, human
gggtgctagaaggctctaga

SEQ ID NO: 259697 - DNA, 20 bp, human
gcacagccccgccccgtcct

SEQ ID NO: 259698 - DNA, 20 bp, human
gaagaacgacgacgaaccct

SEQ ID NO: 259699 - DNA, 20 bp, human
ggggactttgttgaggcgac

SEQ ID NO: 259700 - DNA, 20 bp, human
gcgcggcggggactttgttg

SEQ ID NO: 259701 - DNA, 20 bp, human
gtggactcatagccaatgat

SEQ ID NO: 259702 - DNA, 20 bp, human
gtgggcgagttccgagccca

SEQ ID NO: 259703 - DNA, 20 bp, human
gttgttgaggcgacaggccg

SEQ ID NO: 259704 - DNA, 20 bp, human
gagcgctgcgcacttcccat

SEQ ID NO: 259705 - DNA, 20 bp, human
gcgctgacgccgcgctggga

SEQ ID NO: 259706 - DNA, 20 bp, human
gcccgcgccggcacgagagg

SEQ ID NO: 259707 - DNA, 20 bp, human
gaggccgccggcctcccagg

SEQ ID NO: 259708 - DNA, 20 bp, human
ggccgctgccgccactcaat

SEQ ID NO: 259709 - DNA, 20 bp, human
ggcgggagctgcgcggtgtt

SEQ ID NO: 259710 - DNA, 20 bp, human
gggctcggctgcgttcggtt

SEQ ID NO: 259711 - DNA, 20 bp, human
ggagctgcgcggtgttcggc

SEQ ID NO: 259712 - DNA, 20 bp, human
ggaggaggtgcggccccaag

SEQ ID NO: 259713 - DNA, 20 bp, human
gtcgcctcctgggaggccgg

SEQ ID NO: 259714 - DNA, 20 bp, human
gcacctcagcgcaccaccaa

SEQ ID NO: 259715 - DNA, 20 bp, human
gtggggccgcacctcctccg

SEQ ID NO: 259716 - DNA, 20 bp, human
ggagaccggccagcaagcga

SEQ ID NO: 259717 - DNA, 20 bp, human
gcgaccgcggagcccaccct

SEQ ID NO: 259718 - DNA, 20 bp, human
ggggcaggggctcactcgag

SEQ ID NO: 259719 - DNA, 20 bp, human
gtgggccctgaccccgggga

SEQ ID NO: 259720 - DNA, 20 bp, human
gcaaccgtggcttccgtccc

SEQ ID NO: 259721 - DNA, 20 bp, human
gaccccggggacggaagcca

SEQ ID NO: 259722 - DNA, 20 bp, human
gcccggcgcaaagcgtcctg

SEQ ID NO: 259723 - DNA, 20 bp, human
gaagtcccgtcgggtggcag

SEQ ID NO: 259724 - DNA, 20 bp, human
gtcagtgggccctgaccccg

SEQ ID NO: 259725 - DNA, 20 bp, human
gccgcgctgaccccggagac

SEQ ID NO: 259726 - DNA, 20 bp, human
gcgcgaggccgctcggggaa

SEQ ID NO: 259727 - DNA, 20 bp, human
gtccgcccacaccgcgattg

SEQ ID NO: 259728 - DNA, 20 bp, human
gccgccagggagacgaggga

SEQ ID NO: 259729 - DNA, 20 bp, human
gcaggccccaatcgcggtgt

SEQ ID NO: 259730 - DNA, 20 bp, human
ggccctgcgcgaggccgctc

SEQ ID NO: 259731 - DNA, 20 bp, human
gcgctgcagaaagagggaag

SEQ ID NO: 259732 - DNA, 20 bp, human
gagaggggagacctagtttg

SEQ ID NO: 259733 - DNA, 20 bp, human
gaaaacaccctatttctctc

SEQ ID NO: 259734 - DNA, 20 bp, human
gcaaaggcacgtaaaaacag

SEQ ID NO: 259735 - DNA, 20 bp, human
gcgagcactccgatctcctc

SEQ ID NO: 259736 - DNA, 20 bp, human
gggctgcagtagcgtggaaa

SEQ ID NO: 259737 - DNA, 20 bp, human
gtcacctcccggaaaggggt

SEQ ID NO: 259738 - DNA, 20 bp, human
ggctccgcctcgccattcgt

SEQ ID NO: 259739 - DNA, 20 bp, human
gtgcagtagcgtggaaaggg

SEQ ID NO: 259740 - DNA, 20 bp, human
gctcccgacgaatggcgagg

SEQ ID NO: 259741 - DNA, 20 bp, human
gctgcccgcctcaagtccgc

SEQ ID NO: 259742 - DNA, 20 bp, human
ggtgacgtcccgcggacttg

SEQ ID NO: 259743 - DNA, 20 bp, human
gctccccagcggccctgtag

SEQ ID NO: 259744 - DNA, 20 bp, human
gtgcgacggctgcagtagcg

SEQ ID NO: 259745 - DNA, 20 bp, human
gacgtcccgcggacttgagg

SEQ ID NO: 259746 - DNA, 20 bp, human
ggaccgacgagggtggagtg

SEQ ID NO: 259747 - DNA, 20 bp, human
ggcgggtgggggaccgacga

SEQ ID NO: 259748 - DNA, 20 bp, human
ggaggcgcacgtacgagcgc

SEQ ID NO: 259749 - DNA, 20 bp, human
gggtgggggaccgacgaggg

SEQ ID NO: 259750 - DNA, 20 bp, human
ggcagctcctgactcatcgg

SEQ ID NO: 259751 - DNA, 20 bp, human
gtgcgctggggccaggtcgt

SEQ ID NO: 259752 - DNA, 20 bp, human
gccggcagctcctgactcat

SEQ ID NO: 259753 - DNA, 20 bp, human
gcacgtacgagcgcgggtgg

SEQ ID NO: 259754 - DNA, 20 bp, human
gagtcaggagctgccggcgg

SEQ ID NO: 259755 - DNA, 20 bp, human
gaggctgtcttgggcttcac

SEQ ID NO: 259756 - DNA, 20 bp, human
ggggctggctggggaccgag

SEQ ID NO: 259757 - DNA, 20 bp, human
ggctgccagcccagtgtgaa

SEQ ID NO: 259758 - DNA, 20 bp, human
gtagaacagggactgttatt

SEQ ID NO: 259759 - DNA, 20 bp, human
ggcacctgcccccttaccaa

SEQ ID NO: 259760 - DNA, 20 bp, human
ggggaatgtaatcctggggt

SEQ ID NO: 259761 - DNA, 20 bp, human
gggggatagtagttgacctt

SEQ ID NO: 259762 - DNA, 20 bp, human
ggccagcccagtgtgaaggg

SEQ ID NO: 259763 - DNA, 20 bp, human
gagggaggggctacagatga

SEQ ID NO: 259764 - DNA, 20 bp, human
gctcccttgctcctcccaaa

SEQ ID NO: 259765 - DNA, 20 bp, human
gaaagggtggaattagaaca

SEQ ID NO: 259766 - DNA, 20 bp, human
ggcggtccggggcactgctc

SEQ ID NO: 259767 - DNA, 20 bp, human
ggaccctgagggagggactt

SEQ ID NO: 259768 - DNA, 20 bp, human
gtgggggcgggcgcggtcta

SEQ ID NO: 259769 - DNA, 20 bp, human
gcctccctcagggtccaaac

SEQ ID NO: 259770 - DNA, 20 bp, human
gcgcagcgagaggccctgac

SEQ ID NO: 259771 - DNA, 20 bp, human
gaatggcggctgcacgtgag

SEQ ID NO: 259772 - DNA, 20 bp, human
gcacccaagtccctccctca

SEQ ID NO: 259773 - DNA, 20 bp, human
gggtcctatgccccaggcgg

SEQ ID NO: 259774 - DNA, 20 bp, human
gccggggcactgctccggtt

SEQ ID NO: 259775 - DNA, 20 bp, human
gctggaagcggcgcgaatgg

SEQ ID NO: 259776 - DNA, 20 bp, human
gctagtctcgggagtctagg

SEQ ID NO: 259777 - DNA, 20 bp, human
gccgggagggccctagtctc

SEQ ID NO: 259778 - DNA, 20 bp, human
gggaagccacgcgagatctg

SEQ ID NO: 259779 - DNA, 20 bp, human
gccgacccccagatctcgcg

SEQ ID NO: 259780 - DNA, 20 bp, human
gcccctctggaaaatcgcca

SEQ ID NO: 259781 - DNA, 20 bp, human
ggccctagtctcgggagtct

SEQ ID NO: 259782 - DNA, 20 bp, human
gctccctgcggcattaggtc

SEQ ID NO: 259783 - DNA, 20 bp, human
gtcgcgcgctcgggtcccag

SEQ ID NO: 259784 - DNA, 20 bp, human
gctaggaggagcccaacccc

SEQ ID NO: 259785 - DNA, 20 bp, human
gcccagtggcccagcgtctt

SEQ ID NO: 259786 - DNA, 20 bp, human
gcacgcgaggcccattttga

SEQ ID NO: 259787 - DNA, 20 bp, human
gccgccgtcaggcctcgaac

SEQ ID NO: 259788 - DNA, 20 bp, human
gttcctgcccacgtggtctc

SEQ ID NO: 259789 - DNA, 20 bp, human
ggaactggatccgtcaaaat

SEQ ID NO: 259790 - DNA, 20 bp, human
ggccccgcgcggcctctggc

SEQ ID NO: 259791 - DNA, 20 bp, human
gggaacaaagaagcgaacgc

SEQ ID NO: 259792 - DNA, 20 bp, human
gcaggagcccgagaccacgt

SEQ ID NO: 259793 - DNA, 20 bp, human
gcgctcgctcaacctgtctg

SEQ ID NO: 259794 - DNA, 20 bp, human
gcggcccttgacgggttcgg

SEQ ID NO: 259795 - DNA, 20 bp, human
ggggcggcccttgacgggtt

SEQ ID NO: 259796 - DNA, 20 bp, human
gaccctgagcgaaccctctc

SEQ ID NO: 259797 - DNA, 20 bp, human
gcccatggggccaagttcac

SEQ ID NO: 259798 - DNA, 20 bp, human
gctgagaagggaacggcgga

SEQ ID NO: 259799 - DNA, 20 bp, human
gcggccgcaccccgtgaact

SEQ ID NO: 259800 - DNA, 20 bp, human
gggcaccgtcagggcataga

SEQ ID NO: 259801 - DNA, 20 bp, human
gctcggggtcagctccgtct

SEQ ID NO: 259802 - DNA, 20 bp, human
gggaccctgctctgctcgga

SEQ ID NO: 259803 - DNA, 20 bp, human
gagggttcgctcagggtcgc

SEQ ID NO: 259804 - DNA, 20 bp, human
gcagggtcgccggggaacct

SEQ ID NO: 259805 - DNA, 20 bp, human
gaccccgagagggttcgctc

SEQ ID NO: 259806 - DNA, 20 bp, human
ggaggccgagagatgctcgt

SEQ ID NO: 259807 - DNA, 20 bp, human
gtgcgcgcgcgcccacgggg

SEQ ID NO: 259808 - DNA, 20 bp, human
ggccgcctctgctgcatcgg

SEQ ID NO: 259809 - DNA, 20 bp, human
gaaatccgtaaacgcgggga

SEQ ID NO: 259810 - DNA, 20 bp, human
gaagtcagcgaggcgcgcta

SEQ ID NO: 259811 - DNA, 20 bp, human
ggccaccgatgcagcagagg

SEQ ID NO: 259812 - DNA, 20 bp, human
ggctctgccgggctgggatc

SEQ ID NO: 259813 - DNA, 20 bp, human
gggagaagctgcccacgggg

SEQ ID NO: 259814 - DNA, 20 bp, human
gcggggtgggggagtcgcga

SEQ ID NO: 259815 - DNA, 20 bp, human
gggcgccgcctctgctgcat

SEQ ID NO: 259816 - DNA, 20 bp, human
gcgctggggacaatcggaag

SEQ ID NO: 259817 - DNA, 20 bp, human
ggggtaactcgtgttgacat

SEQ ID NO: 259818 - DNA, 20 bp, human
gaagtgaggaccgagaatta

SEQ ID NO: 259819 - DNA, 20 bp, human
ggtcaacacgagttaccccc

SEQ ID NO: 259820 - DNA, 20 bp, human
gtgtccccagcgttcagacg

SEQ ID NO: 259821 - DNA, 20 bp, human
gtgcttgtggggacagacga

SEQ ID NO: 259822 - DNA, 20 bp, human
ggaccgagaattatgggaga

SEQ ID NO: 259823 - DNA, 20 bp, human
gtctgaacgctggggacaat

SEQ ID NO: 259824 - DNA, 20 bp, human
gtggggacaatcggaagggg

SEQ ID NO: 259825 - DNA, 20 bp, human
gccactgcggcgtctcctat

SEQ ID NO: 259826 - DNA, 20 bp, human
ggctgacggagctttggcga

SEQ ID NO: 259827 - DNA, 20 bp, human
gtttcagggagcaagcgttt

SEQ ID NO: 259828 - DNA, 20 bp, human
gtcccactcggctcctctta

SEQ ID NO: 259829 - DNA, 20 bp, human
ggtgctgggtgaatgagaga

SEQ ID NO: 259830 - DNA, 20 bp, human
gcaggatatgacttcttcaa

SEQ ID NO: 259831 - DNA, 20 bp, human
gaatcagttcagctggtgct

SEQ ID NO: 259832 - DNA, 20 bp, human
ggaactgatttaggtttacc

SEQ ID NO: 259833 - DNA, 20 bp, human
gtatttactgagtacctagg

SEQ ID NO: 259834 - DNA, 20 bp, human
gagatttggaaagcatagcc

SEQ ID NO: 259835 - DNA, 20 bp, human
gaagaagccctttagttagg

SEQ ID NO: 259836 - DNA, 20 bp, human
gactgcgagagccgggtgta

SEQ ID NO: 259837 - DNA, 20 bp, human
gcacccggctctcgcagtca

SEQ ID NO: 259838 - DNA, 20 bp, human
ggcaaagcgactcaacgccc

SEQ ID NO: 259839 - DNA, 20 bp, human
ggcggcgcggggcctattaa

SEQ ID NO: 259840 - DNA, 20 bp, human
ggcagcgtgtggtctgcaga

SEQ ID NO: 259841 - DNA, 20 bp, human
gcccctcgcggtcagatcct

SEQ ID NO: 259842 - DNA, 20 bp, human
gagagtgcccgaaatcagac

SEQ ID NO: 259843 - DNA, 20 bp, human
gcgagagccgggtgtagggc

SEQ ID NO: 259844 - DNA, 20 bp, human
ggccaaggatctgaccgcga

SEQ ID NO: 259845 - DNA, 20 bp, human
gcctgcaagtgtcgggaggg

SEQ ID NO: 259846 - DNA, 20 bp, human
gaggggagggacctgtaagg

SEQ ID NO: 259847 - DNA, 20 bp, human
gtgaaagtgtctgtgggtta

SEQ ID NO: 259848 - DNA, 20 bp, human
gatgatagcttaagcctctt

SEQ ID NO: 259849 - DNA, 20 bp, human
gtaccacatgaaagtgtctg

SEQ ID NO: 259850 - DNA, 20 bp, human
gctgtaagggggcggggata

SEQ ID NO: 259851 - DNA, 20 bp, human
gacccacagacactttcatg

SEQ ID NO: 259852 - DNA, 20 bp, human
gggagggacctgtaaggggg

SEQ ID NO: 259853 - DNA, 20 bp, human
gactttcatgtggtatcctc

SEQ ID NO: 259854 - DNA, 20 bp, human
gagctgagaatgtgatacta

SEQ ID NO: 259855 - DNA, 20 bp, human
gagaatgtgatactagggac

SEQ ID NO: 259856 - DNA, 20 bp, human
ggattgggcaatctggagag

SEQ ID NO: 259857 - DNA, 20 bp, human
ggtgacaaggctttttgttc

SEQ ID NO: 259858 - DNA, 20 bp, human
ggtctgaaatttctgtgaca

SEQ ID NO: 259859 - DNA, 20 bp, human
ggtatttagtaaaagttata

SEQ ID NO: 259860 - DNA, 20 bp, human
gtttaaagaaaacagaagat

SEQ ID NO: 259861 - DNA, 20 bp, human
gatcacagctcttcagtgat

SEQ ID NO: 259862 - DNA, 20 bp, human
gcttcagtgattgggcaatc

SEQ ID NO: 259863 - DNA, 20 bp, human
gtaaaagttataaggaaaaa

SEQ ID NO: 259864 - DNA, 20 bp, human
gtcctaaacagttaaaagtc

SEQ ID NO: 259865 - DNA, 20 bp, human
gtatgaagtttatagaaaag

SEQ ID NO: 259866 - DNA, 20 bp, human
gccaacagcaggaacctgta

SEQ ID NO: 259867 - DNA, 20 bp, human
gcctgtacggaagacgggaa

SEQ ID NO: 259868 - DNA, 20 bp, human
gaggttccgtctgtggagaa

SEQ ID NO: 259869 - DNA, 20 bp, human
gaagcgacgccgaggagcta

SEQ ID NO: 259870 - DNA, 20 bp, human
ggggctcaaggttccgtttg

SEQ ID NO: 259871 - DNA, 20 bp, human
gggcgccgctggtttctgcg

SEQ ID NO: 259872 - DNA, 20 bp, human
gggacgagagcgcccccaaa

SEQ ID NO: 259873 - DNA, 20 bp, human
gaacgctccaggtaaagcgc

SEQ ID NO: 259874 - DNA, 20 bp, human
gcaccagaaggttccgtctg

SEQ ID NO: 259875 - DNA, 20 bp, human
ggctccaggtaaagcgctgg

SEQ ID NO: 259876 - DNA, 20 bp, human
gcgtctaaggcgccagctca

SEQ ID NO: 259877 - DNA, 20 bp, human
gggttagacaggtgcttgga

SEQ ID NO: 259878 - DNA, 20 bp, human
gagagtctgaaacacgtcct

SEQ ID NO: 259879 - DNA, 20 bp, human
gtaaggcgccagctcagggc

SEQ ID NO: 259880 - DNA, 20 bp, human
ggatacgaaaagtgcgtggt

SEQ ID NO: 259881 - DNA, 20 bp, human
ggtatcggacctaagagtag

SEQ ID NO: 259882 - DNA, 20 bp, human
ggctgccaggcgagcgtcta

SEQ ID NO: 259883 - DNA, 20 bp, human
ggtgcttggaggggttgtat

SEQ ID NO: 259884 - DNA, 20 bp, human
gggcgcagatagggacgttg

SEQ ID NO: 259885 - DNA, 20 bp, human
gctgaaacacgtccttggat

SEQ ID NO: 259886 - DNA, 20 bp, human
gggcagggacccatctggta

SEQ ID NO: 259887 - DNA, 20 bp, human
ggacccatctggtagggcga

SEQ ID NO: 259888 - DNA, 20 bp, human
gaggccgtgcagctactcct

SEQ ID NO: 259889 - DNA, 20 bp, human
gacggcctgtcaatcagcgg

SEQ ID NO: 259890 - DNA, 20 bp, human
gggcgctgcctgggtttgga

SEQ ID NO: 259891 - DNA, 20 bp, human
gcctgcccccgctgattgac

SEQ ID NO: 259892 - DNA, 20 bp, human
ggctcccaggagtagctgca

SEQ ID NO: 259893 - DNA, 20 bp, human
ggtagggcgaaggcgtggga

SEQ ID NO: 259894 - DNA, 20 bp, human
ggaaaaggcacgttgccgga

SEQ ID NO: 259895 - DNA, 20 bp, human
gcccgcctcctggcttctat

SEQ ID NO: 259896 - DNA, 20 bp, human
gcatagatgtgtggaaaagg

SEQ ID NO: 259897 - DNA, 20 bp, human
gtaaccaaagggaggaacca

SEQ ID NO: 259898 - DNA, 20 bp, human
ggagcatagatgtgtggaaa

SEQ ID NO: 259899 - DNA, 20 bp, human
gtctctggactttctagtaa

SEQ ID NO: 259900 - DNA, 20 bp, human
gcaacccagaattaacacca

SEQ ID NO: 259901 - DNA, 20 bp, human
gccgactccttcagataaac

SEQ ID NO: 259902 - DNA, 20 bp, human
gctcccctggtgttaattct

SEQ ID NO: 259903 - DNA, 20 bp, human
gagggaggaaccaaggaaaa

SEQ ID NO: 259904 - DNA, 20 bp, human
gttgcagttgagctaaccaa

SEQ ID NO: 259905 - DNA, 20 bp, human
gatctgaaggagtcggtctc

SEQ ID NO: 259906 - DNA, 20 bp, human
ggtcccagcctcacgtgcgt

SEQ ID NO: 259907 - DNA, 20 bp, human
gcactcccgaggttcgaccc

SEQ ID NO: 259908 - DNA, 20 bp, human
gcatccccgggtcgaacctc

SEQ ID NO: 259909 - DNA, 20 bp, human
gaccccacgcacgtgaggct

SEQ ID NO: 259910 - DNA, 20 bp, human
ggtgcacagccacattccaa

SEQ ID NO: 259911 - DNA, 20 bp, human
gcaaggccatgctgtgaccc

SEQ ID NO: 259912 - DNA, 20 bp, human
gtggtcctggccctgaccat

SEQ ID NO: 259913 - DNA, 20 bp, human
gggaggagcctggagcacca

SEQ ID NO: 259914 - DNA, 20 bp, human
gggtgggcttcccatggtca

SEQ ID NO: 259915 - DNA, 20 bp, human
gccacattccaaaggcgcac

SEQ ID NO: 259916 - DNA, 20 bp, human
gagcctgtgggggatatcgg

SEQ ID NO: 259917 - DNA, 20 bp, human
gacgcggtgggctggagtga

SEQ ID NO: 259918 - DNA, 20 bp, human
gtcccccacaggcttccaat

SEQ ID NO: 259919 - DNA, 20 bp, human
gaaaaagtggccaacccctg

SEQ ID NO: 259920 - DNA, 20 bp, human
gtgggctctatagaggcgac

SEQ ID NO: 259921 - DNA, 20 bp, human
ggtcgcaacgtcacgggcaa

SEQ ID NO: 259922 - DNA, 20 bp, human
gaggggcggtcgcaacgtca

SEQ ID NO: 259923 - DNA, 20 bp, human
gctgctaagtctctcggacg

SEQ ID NO: 259924 - DNA, 20 bp, human
gaccaattggaagcctgtgg

SEQ ID NO: 259925 - DNA, 20 bp, human
gagtgggagtgaggtagata

SEQ ID NO: 259926 - DNA, 20 bp, human
ggtaagtgtcttcgtttcac

SEQ ID NO: 259927 - DNA, 20 bp, human
gtgagctggagggtaccaag

SEQ ID NO: 259928 - DNA, 20 bp, human
ggcctggtgcagttcctgtc

SEQ ID NO: 259929 - DNA, 20 bp, human
gttagggcagtgtcacagcc

SEQ ID NO: 259930 - DNA, 20 bp, human
gtgcaccaggccagaaagtg

SEQ ID NO: 259931 - DNA, 20 bp, human
ggtcagggcgtcaagcaaga

SEQ ID NO: 259932 - DNA, 20 bp, human
gttctttgaaaggaggatta

SEQ ID NO: 259933 - DNA, 20 bp, human
gtggttgcagatacctgagc

SEQ ID NO: 259934 - DNA, 20 bp, human
gcacttaccttcattcccct

SEQ ID NO: 259935 - DNA, 20 bp, human
gtgcagatacctgagctgga

SEQ ID NO: 259936 - DNA, 20 bp, human
gagggcccgccctaccgtga

SEQ ID NO: 259937 - DNA, 20 bp, human
gggacaagagccaattgcgg

SEQ ID NO: 259938 - DNA, 20 bp, human
gtccgccggccaatccctca

SEQ ID NO: 259939 - DNA, 20 bp, human
gtaagatggcggcctccagg

SEQ ID NO: 259940 - DNA, 20 bp, human
gtgtctgtgctctgggactt

SEQ ID NO: 259941 - DNA, 20 bp, human
ggaagaggacggacctaaga

SEQ ID NO: 259942 - DNA, 20 bp, human
ggacccgcgcagtgattgga

SEQ ID NO: 259943 - DNA, 20 bp, human
gcggccaatccctcacggta

SEQ ID NO: 259944 - DNA, 20 bp, human
gggccctccaatcactgcgc

SEQ ID NO: 259945 - DNA, 20 bp, human
gtgggacttcggattggcct

SEQ ID NO: 259946 - DNA, 20 bp, human
ggagacgctgcgttattggt

SEQ ID NO: 259947 - DNA, 20 bp, human
gcacagaggagctgctcaat

SEQ ID NO: 259948 - DNA, 20 bp, human
gagaaaggattgctggtcat

SEQ ID NO: 259949 - DNA, 20 bp, human
gagaaaggacagattgactg

SEQ ID NO: 259950 - DNA, 20 bp, human
ggcaggagacgctgcgttat

SEQ ID NO: 259951 - DNA, 20 bp, human
gcaagcgatgagtttcctgc

SEQ ID NO: 259952 - DNA, 20 bp, human
gaccagaggctttatgggga

SEQ ID NO: 259953 - DNA, 20 bp, human
gcgctgcgttattggttgga

SEQ ID NO: 259954 - DNA, 20 bp, human
gtagccggccccgtttcgga

SEQ ID NO: 259955 - DNA, 20 bp, human
ggctgagatgactttttcaa

SEQ ID NO: 259956 - DNA, 20 bp, human
gcatcaccggccacgcccac

SEQ ID NO: 259957 - DNA, 20 bp, human
gcaggtgagagacgcgggcg

SEQ ID NO: 259958 - DNA, 20 bp, human
gggccggacggcggaagctt

SEQ ID NO: 259959 - DNA, 20 bp, human
ggacggcggaagcttgggag

SEQ ID NO: 259960 - DNA, 20 bp, human
gcccgcgcaggtgagagacg

SEQ ID NO: 259961 - DNA, 20 bp, human
gcaccggccacgcccacggg

SEQ ID NO: 259962 - DNA, 20 bp, human
ggggcgtggccggtgatggg

SEQ ID NO: 259963 - DNA, 20 bp, human
ggcgaaacctgtccgcccgt

SEQ ID NO: 259964 - DNA, 20 bp, human
gcccgggcgccccgcggcta

SEQ ID NO: 259965 - DNA, 20 bp, human
ggccacgcccacgggcggac

SEQ ID NO: 259966 - DNA, 20 bp, human
gagccctcgatggaagggga

SEQ ID NO: 259967 - DNA, 20 bp, human
gtcccttccccttccatcga

SEQ ID NO: 259968 - DNA, 20 bp, human
gaggcggcgccgggtatagc

SEQ ID NO: 259969 - DNA, 20 bp, human
ggccccccccgtccgtgtca

SEQ ID NO: 259970 - DNA, 20 bp, human
gacacccagccctcgatgga

SEQ ID NO: 259971 - DNA, 20 bp, human
gtggccttgacacggacggg

SEQ ID NO: 259972 - DNA, 20 bp, human
ggccgggtatagcggggcgg

SEQ ID NO: 259973 - DNA, 20 bp, human
ggacagaaggctctctgggc

SEQ ID NO: 259974 - DNA, 20 bp, human
ggaggtgtcagctcagacgc

SEQ ID NO: 259975 - DNA, 20 bp, human
gcgacctggagggggacaga

SEQ ID NO: 259976 - DNA, 20 bp, human
ggcacgggaaatgtggacgt

SEQ ID NO: 259977 - DNA, 20 bp, human
ggagcctgatgcgggatgat

SEQ ID NO: 259978 - DNA, 20 bp, human
gcgagcgctgggctgttccg

SEQ ID NO: 259979 - DNA, 20 bp, human
gcgaggggcgcgttgagcgc

SEQ ID NO: 259980 - DNA, 20 bp, human
ggcgtggccgcgcgggtcca

SEQ ID NO: 259981 - DNA, 20 bp, human
gacgccaatcatcccgcatc

SEQ ID NO: 259982 - DNA, 20 bp, human
gacggaggcacccagtactg

SEQ ID NO: 259983 - DNA, 20 bp, human
gctgtggcgtggtgctcgtc

SEQ ID NO: 259984 - DNA, 20 bp, human
gagcaccacgccacagtact

SEQ ID NO: 259985 - DNA, 20 bp, human
gcggtgtcctaagtacgctg

SEQ ID NO: 259986 - DNA, 20 bp, human
gtacgacagcggagcccctg

SEQ ID NO: 259987 - DNA, 20 bp, human
gggcgcctgggctacgtcac

SEQ ID NO: 259988 - DNA, 20 bp, human
gggctgggcaactacgacag

SEQ ID NO: 259989 - DNA, 20 bp, human
ggaagccaagatgccgtcga

SEQ ID NO: 259990 - DNA, 20 bp, human
gccagggagaggggactctc

SEQ ID NO: 259991 - DNA, 20 bp, human
gccggggagagggtccgagt

SEQ ID NO: 259992 - DNA, 20 bp, human
gcggcatcttggcttcccca

SEQ ID NO: 259993 - DNA, 20 bp, human
gcgcgcccgtgacgtagccc

SEQ ID NO: 259994 - DNA, 20 bp, human
gaaggcaaagacacgaagta

SEQ ID NO: 259995 - DNA, 20 bp, human
ggccccacccgcgccgctga

SEQ ID NO: 259996 - DNA, 20 bp, human
ggacccagttgcgcaggcgc

SEQ ID NO: 259997 - DNA, 20 bp, human
ggggccctcgccagattcaa

SEQ ID NO: 259998 - DNA, 20 bp, human
gtcgggggacccagttgcgc

SEQ ID NO: 259999 - DNA, 20 bp, human
gcgcccgcgcctgcgcaact

SEQ ID NO: 260000 - DNA, 20 bp, human
ggcaggcgcgggcggagtat

SEQ ID NO: 260001 - DNA, 20 bp, human
gccaggccctagggaatcgt

SEQ ID NO: 260002 - DNA, 20 bp, human
gcccctaccagggacgacga

SEQ ID NO: 260003 - DNA, 20 bp, human
gacgaccccacgattcccta

SEQ ID NO: 260004 - DNA, 20 bp, human
gcagccgcgcatgcgcaggc

SEQ ID NO: 260005 - DNA, 20 bp, human
ggtgaggctgccccctacca

SEQ ID NO: 260006 - DNA, 20 bp, human
gcagaggccgagcgctctag

SEQ ID NO: 260007 - DNA, 20 bp, human
ggggcccgcggagagctcac

SEQ ID NO: 260008 - DNA, 20 bp, human
ggagccgcgcccaatcggaa

SEQ ID NO: 260009 - DNA, 20 bp, human
ggtcccggggcgggcatcag

SEQ ID NO: 260010 - DNA, 20 bp, human
ggggcgcggctcaaagtccc

SEQ ID NO: 260011 - DNA, 20 bp, human
ggctccctgcggtttccttg

SEQ ID NO: 260012 - DNA, 20 bp, human
gtctccacgagccgaaccgg

SEQ ID NO: 260013 - DNA, 20 bp, human
ggaccgagctggttcgcccc

SEQ ID NO: 260014 - DNA, 20 bp, human
ggcagcacgtccgtccgcca

SEQ ID NO: 260015 - DNA, 20 bp, human
gaaccgggggcgaaccagct

SEQ ID NO: 260016 - DNA, 20 bp, human
gggggacccgagggtggagt

SEQ ID NO: 260017 - DNA, 20 bp, human
gggcaccgagacagacccgc

SEQ ID NO: 260018 - DNA, 20 bp, human
ggctgcgaggggcagaactc

SEQ ID NO: 260019 - DNA, 20 bp, human
gaggctgaggccagcgccca

SEQ ID NO: 260020 - DNA, 20 bp, human
ggacccacggcgagcgggaa

SEQ ID NO: 260021 - DNA, 20 bp, human
gcgctgtgcacctggctcca

SEQ ID NO: 260022 - DNA, 20 bp, human
ggaggagcctggagctgcga

SEQ ID NO: 260023 - DNA, 20 bp, human
gacccgcgggtgggagatgc

SEQ ID NO: 260024 - DNA, 20 bp, human
gccctcgggtcccccgccca

SEQ ID NO: 260025 - DNA, 20 bp, human
ggtgcacagcgcatcgcccg

SEQ ID NO: 260026 - DNA, 20 bp, human
gcgcgcgcgcgttaagtacc

SEQ ID NO: 260027 - DNA, 20 bp, human
gtcgcacagagactgggaag

SEQ ID NO: 260028 - DNA, 20 bp, human
gtcgcaccgcagtgttttct

SEQ ID NO: 260029 - DNA, 20 bp, human
gctgggctatgtagttctcc

SEQ ID NO: 260030 - DNA, 20 bp, human
ggggccgcctcctggttgct

SEQ ID NO: 260031 - DNA, 20 bp, human
gagaggccctagcaaccagg

SEQ ID NO: 260032 - DNA, 20 bp, human
gtaacgcgcgcgcgacggca

SEQ ID NO: 260033 - DNA, 20 bp, human
gtctgaactctgttacccag

SEQ ID NO: 260034 - DNA, 20 bp, human
gctgcggccctggaaagcga

SEQ ID NO: 260035 - DNA, 20 bp, human
gcacgcctcgcacagagact

SEQ ID NO: 260036 - DNA, 20 bp, human
gactacacccaggagggcca

SEQ ID NO: 260037 - DNA, 20 bp, human
gcggcgagcgcagcagggag

SEQ ID NO: 260038 - DNA, 20 bp, human
gcggggcccgacgctcggag

SEQ ID NO: 260039 - DNA, 20 bp, human
gctgaagccgctccgagcgt

SEQ ID NO: 260040 - DNA, 20 bp, human
ggactcgcgcgaacgttcgc

SEQ ID NO: 260041 - DNA, 20 bp, human
ggaccgggactacacccagg

SEQ ID NO: 260042 - DNA, 20 bp, human
gagtcccggtcctgcctctg

SEQ ID NO: 260043 - DNA, 20 bp, human
gcgcgggagaacgccaggaa

SEQ ID NO: 260044 - DNA, 20 bp, human
gcaggaccgggactacaccc

SEQ ID NO: 260045 - DNA, 20 bp, human
ggccagccggcgccgtgggc

SEQ ID NO: 260046 - DNA, 20 bp, human
gctgaggagcaagaggtacg

SEQ ID NO: 260047 - DNA, 20 bp, human
gagcccggagaccctcctat

SEQ ID NO: 260048 - DNA, 20 bp, human
gcagaaaggcgcgggctagt

SEQ ID NO: 260049 - DNA, 20 bp, human
gagccaataggagggtctcc

SEQ ID NO: 260050 - DNA, 20 bp, human
gggcccgcgagtcggcaggt

SEQ ID NO: 260051 - DNA, 20 bp, human
gaaaaagggcagaaaggcgc

SEQ ID NO: 260052 - DNA, 20 bp, human
gtacccacctgccgactcgc

SEQ ID NO: 260053 - DNA, 20 bp, human
gaaaggcgcgggctagtggg

SEQ ID NO: 260054 - DNA, 20 bp, human
gccaagggtggacaccgcta

SEQ ID NO: 260055 - DNA, 20 bp, human
gggagggtctccgggctgtg

SEQ ID NO: 260056 - DNA, 20 bp, human
gtccgccctaggccccaacg

SEQ ID NO: 260057 - DNA, 20 bp, human
gtcccttacgcagagaccaa

SEQ ID NO: 260058 - DNA, 20 bp, human
gctagggcggatcccgtgat

SEQ ID NO: 260059 - DNA, 20 bp, human
gcccgagccgctcacacaat

SEQ ID NO: 260060 - DNA, 20 bp, human
ggcggggcctgtcccaatca

SEQ ID NO: 260061 - DNA, 20 bp, human
gctaaccgcgttggggccta

SEQ ID NO: 260062 - DNA, 20 bp, human
gccaagggggggtggaaaag

SEQ ID NO: 260063 - DNA, 20 bp, human
gctcccccggcgtcaccctg

SEQ ID NO: 260064 - DNA, 20 bp, human
ggagtggccgggcctccgga

SEQ ID NO: 260065 - DNA, 20 bp, human
ggcggccggaaatgagccaa

SEQ ID NO: 260066 - DNA, 20 bp, human
gcgagggcgccggaggtcga

SEQ ID NO: 260067 - DNA, 20 bp, human
gagggcgccgcgagactctg

SEQ ID NO: 260068 - DNA, 20 bp, human
gcgagggcgccggaggacta

SEQ ID NO: 260069 - DNA, 20 bp, human
gtcgcggcgccctagtcctc

SEQ ID NO: 260070 - DNA, 20 bp, human
gcgccctcgcgcggtcagag

SEQ ID NO: 260071 - DNA, 20 bp, human
gtgggcgggggccgaaccca

SEQ ID NO: 260072 - DNA, 20 bp, human
gcccaccccgcagagtctcg

SEQ ID NO: 260073 - DNA, 20 bp, human
gctgctacggcgagccggaa

SEQ ID NO: 260074 - DNA, 20 bp, human
ggcggggccgagactgagga

SEQ ID NO: 260075 - DNA, 20 bp, human
gcgccgctctgaccgcgcga

SEQ ID NO: 260076 - DNA, 20 bp, human
gtgcggccgcgcgtccccat

SEQ ID NO: 260077 - DNA, 20 bp, human
gcactgcgtcccggccaatg

SEQ ID NO: 260078 - DNA, 20 bp, human
ggggagtcggaaggagtcgg

SEQ ID NO: 260079 - DNA, 20 bp, human
gcgggcggctcactgcgtcc

SEQ ID NO: 260080 - DNA, 20 bp, human
gcgcgagtgtaaagctcccg

SEQ ID NO: 260081 - DNA, 20 bp, human
ggacactgccgaggattgta

SEQ ID NO: 260082 - DNA, 20 bp, human
gtgtgtgggcgggcacgcgc

SEQ ID NO: 260083 - DNA, 20 bp, human
gccggcgcgggtgtgtgggc

SEQ ID NO: 260084 - DNA, 20 bp, human
gcccggccaatggggacgcg

SEQ ID NO: 260085 - DNA, 20 bp, human
ggggcaccggacccgtgtgg

SEQ ID NO: 260086 - DNA, 20 bp, human
gcaactgccgatcagcgggg

SEQ ID NO: 260087 - DNA, 20 bp, human
ggagtgcgagagtcgcagtt

SEQ ID NO: 260088 - DNA, 20 bp, human
gtcagtgtccccgccggacg

SEQ ID NO: 260089 - DNA, 20 bp, human
ggagagtcgcagttgggaag

SEQ ID NO: 260090 - DNA, 20 bp, human
ggcctccacctgcactgaca

SEQ ID NO: 260091 - DNA, 20 bp, human
ggttggtcagaggggatcta

SEQ ID NO: 260092 - DNA, 20 bp, human
ggcaggcaactgccgatcag

SEQ ID NO: 260093 - DNA, 20 bp, human
gaatcagagggcctagcggg

SEQ ID NO: 260094 - DNA, 20 bp, human
gacagggcaactccatcgtg

SEQ ID NO: 260095 - DNA, 20 bp, human
gcaggtgtagcctcgtccgg

SEQ ID NO: 260096 - DNA, 20 bp, human
gccgcggcccgtccgcccat

SEQ ID NO: 260097 - DNA, 20 bp, human
gcgcacgcgcaagtcgaacc

SEQ ID NO: 260098 - DNA, 20 bp, human
gcccctaggccggtaaggag

SEQ ID NO: 260099 - DNA, 20 bp, human
gaacaaggggagctagaagt

SEQ ID NO: 260100 - DNA, 20 bp, human
gaggccggtaaggagaggag

SEQ ID NO: 260101 - DNA, 20 bp, human
ggatcccgcagcacccacgt

SEQ ID NO: 260102 - DNA, 20 bp, human
gctaggggaggggggaaaca

SEQ ID NO: 260103 - DNA, 20 bp, human
gcttaccggcctaggggagg

SEQ ID NO: 260104 - DNA, 20 bp, human
gcgaacccggtctggagccg

SEQ ID NO: 260105 - DNA, 20 bp, human
ggaacaccccggctccagac

SEQ ID NO: 260106 - DNA, 20 bp, human
ggctgggaggcaggcgcaag

SEQ ID NO: 260107 - DNA, 20 bp, human
gcagctgcacagtcccgcag

SEQ ID NO: 260108 - DNA, 20 bp, human
gggtctgggaactgcccgtg

SEQ ID NO: 260109 - DNA, 20 bp, human
gtgggatgggaggcccactg

SEQ ID NO: 260110 - DNA, 20 bp, human
ggggaactgcccgtgtggca

SEQ ID NO: 260111 - DNA, 20 bp, human
gctcccggtccgtgccacac

SEQ ID NO: 260112 - DNA, 20 bp, human
ggatgcatgcctgactcaga

SEQ ID NO: 260113 - DNA, 20 bp, human
ggaggggatccggctccggt

SEQ ID NO: 260114 - DNA, 20 bp, human
ggcgagagcaaggaggcccg

SEQ ID NO: 260115 - DNA, 20 bp, human
gtggtgaggggatccggctc

SEQ ID NO: 260116 - DNA, 20 bp, human
gaaagacgtcctccaccccc

SEQ ID NO: 260117 - DNA, 20 bp, human
gggccgcggagacccggggg

SEQ ID NO: 260118 - DNA, 20 bp, human
gcgcggccgcggagacccgg

SEQ ID NO: 260119 - DNA, 20 bp, human
gcgcgcttgccgaatcccgc

SEQ ID NO: 260120 - DNA, 20 bp, human
gaccccgccggacgagcccc

SEQ ID NO: 260121 - DNA, 20 bp, human
gctccacccccgggtctccg

SEQ ID NO: 260122 - DNA, 20 bp, human
ggattcggcaagcgcggccg

SEQ ID NO: 260123 - DNA, 20 bp, human
gggcgggggacctttcccgc

SEQ ID NO: 260124 - DNA, 20 bp, human
gaggtcccccgcccgcgcag

SEQ ID NO: 260125 - DNA, 20 bp, human
gccggcgcggaaacccccgc

SEQ ID NO: 260126 - DNA, 20 bp, human
gcctgccctcccagccgcgg

SEQ ID NO: 260127 - DNA, 20 bp, human
gtaactgtcctgaagtactg

SEQ ID NO: 260128 - DNA, 20 bp, human
gctcacaggggatgtctggg

SEQ ID NO: 260129 - DNA, 20 bp, human
gtgaccctgcgccaggacgg

SEQ ID NO: 260130 - DNA, 20 bp, human
gccctcccccgcggctggga

SEQ ID NO: 260131 - DNA, 20 bp, human
gtacttcaggacagttacat

SEQ ID NO: 260132 - DNA, 20 bp, human
gccctgcgccaggacggagg

SEQ ID NO: 260133 - DNA, 20 bp, human
gggggccaccgcagtacttc

SEQ ID NO: 260134 - DNA, 20 bp, human
gtgtctccaggcgtcgtccg

SEQ ID NO: 260135 - DNA, 20 bp, human
gctgtcctgaagtactgcgg

SEQ ID NO: 260136 - DNA, 20 bp, human
gggcccctcccgcagtcctg

SEQ ID NO: 260137 - DNA, 20 bp, human
gggggactccgcaggccgat

SEQ ID NO: 260138 - DNA, 20 bp, human
ggaccagaaaaaggagtgat

SEQ ID NO: 260139 - DNA, 20 bp, human
gcccgcgcccccgccttcgg

SEQ ID NO: 260140 - DNA, 20 bp, human
gcggcctgcggagtcccccg

SEQ ID NO: 260141 - DNA, 20 bp, human
gcccatggtcggggcgtcgt

SEQ ID NO: 260142 - DNA, 20 bp, human
gtccgccggcgcttccccgg

SEQ ID NO: 260143 - DNA, 20 bp, human
ggtccccaggactgcgggag

SEQ ID NO: 260144 - DNA, 20 bp, human
gactcggcggatctgacccg

SEQ ID NO: 260145 - DNA, 20 bp, human
gacgccccgaccatgggcgc

SEQ ID NO: 260146 - DNA, 20 bp, human
gtgctcacgtgtgtacacgt

SEQ ID NO: 260147 - DNA, 20 bp, human
ggggctgcgggcgcaggaaa

SEQ ID NO: 260148 - DNA, 20 bp, human
gcctcggcgcgggcttgccc

SEQ ID NO: 260149 - DNA, 20 bp, human
gcccgcaggcggctagagcg

SEQ ID NO: 260150 - DNA, 20 bp, human
gcgagtggccgcaggcggga

SEQ ID NO: 260151 - DNA, 20 bp, human
gttacccggcgcagccccga

SEQ ID NO: 260152 - DNA, 20 bp, human
gagggcactgacggcgtcgc

SEQ ID NO: 260153 - DNA, 20 bp, human
gctctcgcgggctacggccc

SEQ ID NO: 260154 - DNA, 20 bp, human
ggggcgtgctgcagtcccgg

SEQ ID NO: 260155 - DNA, 20 bp, human
ggcgccgggtaattgcaagc

SEQ ID NO: 260156 - DNA, 20 bp, human
ggcggcgactggagagaaac

SEQ ID NO: 260157 - DNA, 20 bp, human
gtaaaccagccgcggacgcc

SEQ ID NO: 260158 - DNA, 20 bp, human
gcgtccgcggctggtttaaa

SEQ ID NO: 260159 - DNA, 20 bp, human
gccgcgccggccaatttccg

SEQ ID NO: 260160 - DNA, 20 bp, human
gcgccggccaatttccgggg

SEQ ID NO: 260161 - DNA, 20 bp, human
ggggaggtcggggtcctccg

SEQ ID NO: 260162 - DNA, 20 bp, human
gggagcgctccgctcttaaa

SEQ ID NO: 260163 - DNA, 20 bp, human
gcgcccctttaaaccagccg

SEQ ID NO: 260164 - DNA, 20 bp, human
gatgacaccgccccggaaat

SEQ ID NO: 260165 - DNA, 20 bp, human
gttcgtgataggactaactg

SEQ ID NO: 260166 - DNA, 20 bp, human
gagagggtcccagaccaggt

SEQ ID NO: 260167 - DNA, 20 bp, human
ggcagcccctgtcacgttta

SEQ ID NO: 260168 - DNA, 20 bp, human
gtcaggccctaaacgtgaca

SEQ ID NO: 260169 - DNA, 20 bp, human
ggactctcagagatgttatc

SEQ ID NO: 260170 - DNA, 20 bp, human
ggccaggcgtattcctgcct

SEQ ID NO: 260171 - DNA, 20 bp, human
gggaatacgcctggcagccc

SEQ ID NO: 260172 - DNA, 20 bp, human
gaggcttcaaggtttgttct

SEQ ID NO: 260173 - DNA, 20 bp, human
ggcaagttgcaagatgttca

SEQ ID NO: 260174 - DNA, 20 bp, human
gaacatgtcagggtgctcac

SEQ ID NO: 260175 - DNA, 20 bp, human
gcctctctgctggtatctcc

SEQ ID NO: 260176 - DNA, 20 bp, human
gtccgcccccggacccgcga

SEQ ID NO: 260177 - DNA, 20 bp, human
gcgcgatgcagtgtggggaa

SEQ ID NO: 260178 - DNA, 20 bp, human
gggggcggacagggcggact

SEQ ID NO: 260179 - DNA, 20 bp, human
gccgggcccccgcccttcgc

SEQ ID NO: 260180 - DNA, 20 bp, human
gccgctgcgcgatgcagtgt

SEQ ID NO: 260181 - DNA, 20 bp, human
ggcgcgggaagcgaggccgg

SEQ ID NO: 260182 - DNA, 20 bp, human
gcccccgcccttcgcgggtc

SEQ ID NO: 260183 - DNA, 20 bp, human
gcgggacgcgcgcttcgtgc

SEQ ID NO: 260184 - DNA, 20 bp, human
gcgcagcggcgcgggcacgc

SEQ ID NO: 260185 - DNA, 20 bp, human
ggcgcgcttcgtgccggcgc

SEQ ID NO: 260186 - DNA, 20 bp, human
gcgagagcgcgcccccgtcg

SEQ ID NO: 260187 - DNA, 20 bp, human
ggcagcgccgcggagagagt

SEQ ID NO: 260188 - DNA, 20 bp, human
gaggcgcgttcccgcgacgg

SEQ ID NO: 260189 - DNA, 20 bp, human
ggcgcagggagcggatcggg

SEQ ID NO: 260190 - DNA, 20 bp, human
gcgccgcggagagagtgggt

SEQ ID NO: 260191 - DNA, 20 bp, human
gatggcggacattaccacag

SEQ ID NO: 260192 - DNA, 20 bp, human
gatggcgcagggagcggatc

SEQ ID NO: 260193 - DNA, 20 bp, human
ggcggacattaccacagcgg

SEQ ID NO: 260194 - DNA, 20 bp, human
ggcgaggcgcgttcccgcga

SEQ ID NO: 260195 - DNA, 20 bp, human
gcgggggcgcgctctcgcgc

SEQ ID NO: 260196 - DNA, 20 bp, human
gcggccctctccacaggtgt

SEQ ID NO: 260197 - DNA, 20 bp, human
ggcgcgcgggcccacacctg

SEQ ID NO: 260198 - DNA, 20 bp, human
gagacgaagcacctggggcg

SEQ ID NO: 260199 - DNA, 20 bp, human
gcccaggtgcttcgtctcca

SEQ ID NO: 260200 - DNA, 20 bp, human
gggtgagcagtcccgggaag

SEQ ID NO: 260201 - DNA, 20 bp, human
gcagccccggcgctgcagtt

SEQ ID NO: 260202 - DNA, 20 bp, human
gaatcttcaaacctcctcgg

SEQ ID NO: 260203 - DNA, 20 bp, human
gccgcctctcggccccttcc

SEQ ID NO: 260204 - DNA, 20 bp, human
gttgaagaatggggcctggg

SEQ ID NO: 260205 - DNA, 20 bp, human
gcgcgccccaactgcagcgc

SEQ ID NO: 260206 - DNA, 20 bp, human
gagtcctaggcccaatgcaa

SEQ ID NO: 260207 - DNA, 20 bp, human
ggtgccactagcatcctggg

SEQ ID NO: 260208 - DNA, 20 bp, human
gtgtcgaggggcaatgtagg

SEQ ID NO: 260209 - DNA, 20 bp, human
ggaggcatcgtgttttaaga

SEQ ID NO: 260210 - DNA, 20 bp, human
gtagactcttcactgggaat

SEQ ID NO: 260211 - DNA, 20 bp, human
gttaaaacacgatgcctccc

SEQ ID NO: 260212 - DNA, 20 bp, human
ggcatcgtgttttaagaggg

SEQ ID NO: 260213 - DNA, 20 bp, human
gagtctcctagactcttcac

SEQ ID NO: 260214 - DNA, 20 bp, human
gtgttgaacactgaagttag

SEQ ID NO: 260215 - DNA, 20 bp, human
gttcaacaggtaatcacaca

SEQ ID NO: 260216 - DNA, 20 bp, human
gcctctacgggccgcaacgt

SEQ ID NO: 260217 - DNA, 20 bp, human
gtgcgcgccgggtggagcca

SEQ ID NO: 260218 - DNA, 20 bp, human
gtggacaagggcagcgaccc

SEQ ID NO: 260219 - DNA, 20 bp, human
gcggagaagaggcggtgagt

SEQ ID NO: 260220 - DNA, 20 bp, human
gcggtgagtcggcgcctcta

SEQ ID NO: 260221 - DNA, 20 bp, human
ggccactcccggagaagagg

SEQ ID NO: 260222 - DNA, 20 bp, human
gggggcctgggctccgggaa

SEQ ID NO: 260223 - DNA, 20 bp, human
gtccgccactcccggagaag

SEQ ID NO: 260224 - DNA, 20 bp, human
gccgggtggagccagggcta

SEQ ID NO: 260225 - DNA, 20 bp, human
gacgcatttgcactggagga

SEQ ID NO: 260226 - DNA, 20 bp, human
gggcgctcacgcacttggtt

SEQ ID NO: 260227 - DNA, 20 bp, human
gcaagtgcgtgagcgcccag

SEQ ID NO: 260228 - DNA, 20 bp, human
ggcagcagcagaaagcctct

SEQ ID NO: 260229 - DNA, 20 bp, human
ggattatgcccacaggtaac

SEQ ID NO: 260230 - DNA, 20 bp, human
gcatacatgattatgcccac

SEQ ID NO: 260231 - DNA, 20 bp, human
gcaaaatgtaatttcaggaa

SEQ ID NO: 260232 - DNA, 20 bp, human
gtcacattgctagataatac

SEQ ID NO: 260233 - DNA, 20 bp, human
gctggtttcctgttacctgt

SEQ ID NO: 260234 - DNA, 20 bp, human
gtataaccaactatagtttc

SEQ ID NO: 260235 - DNA, 20 bp, human
gtttcaggaaaggctcccat

SEQ ID NO: 260236 - DNA, 20 bp, human
gggcgcccgcagtctcattc

SEQ ID NO: 260237 - DNA, 20 bp, human
gcgggcgccgcctagtaggt

SEQ ID NO: 260238 - DNA, 20 bp, human
gtaaggaggtgaaccaggtg

SEQ ID NO: 260239 - DNA, 20 bp, human
gactgcgggcgccgcctagt

SEQ ID NO: 260240 - DNA, 20 bp, human
gtcaagattgggttgagttt

SEQ ID NO: 260241 - DNA, 20 bp, human
gaatcaaattcaagaaccgg

SEQ ID NO: 260242 - DNA, 20 bp, human
gtaaaagctggatcaagatt

SEQ ID NO: 260243 - DNA, 20 bp, human
gtcaagtcagaggtagaatt

SEQ ID NO: 260244 - DNA, 20 bp, human
gatagggccggggaaggcaa

SEQ ID NO: 260245 - DNA, 20 bp, human
gaggaagcaagcccagtcat

SEQ ID NO: 260246 - DNA, 20 bp, human
ggaaccagggcgttcatcaa

SEQ ID NO: 260247 - DNA, 20 bp, human
gacaggagagacagtggcat

SEQ ID NO: 260248 - DNA, 20 bp, human
ggcgcgagggtcagtcgggg

SEQ ID NO: 260249 - DNA, 20 bp, human
gggggcgcgagggtcagtcg

SEQ ID NO: 260250 - DNA, 20 bp, human
gagaggggcgggatgcacga

SEQ ID NO: 260251 - DNA, 20 bp, human
ggggcgggatgcacgagggg

SEQ ID NO: 260252 - DNA, 20 bp, human
gaagggacttggtggatgag

SEQ ID NO: 260253 - DNA, 20 bp, human
gagtggcatggggtcagtca

SEQ ID NO: 260254 - DNA, 20 bp, human
gggacgaccggtgaaggaac

SEQ ID NO: 260255 - DNA, 20 bp, human
gcgttcatcaagggacttgg

SEQ ID NO: 260256 - DNA, 20 bp, human
ggcggaacacccaactggtg

SEQ ID NO: 260257 - DNA, 20 bp, human
gcaggggcggaacacccaac

SEQ ID NO: 260258 - DNA, 20 bp, human
gaatccccgccagcagaggg

SEQ ID NO: 260259 - DNA, 20 bp, human
gctgcgagaggggaatgagc

SEQ ID NO: 260260 - DNA, 20 bp, human
gttaaggaggggcgaccctc

SEQ ID NO: 260261 - DNA, 20 bp, human
gaatcactaggcaccgccgc

SEQ ID NO: 260262 - DNA, 20 bp, human
gaaccaatccccgccagcag

SEQ ID NO: 260263 - DNA, 20 bp, human
gtggcagggcttctgcgaga

SEQ ID NO: 260264 - DNA, 20 bp, human
gattggttggcatcccgcgg

SEQ ID NO: 260265 - DNA, 20 bp, human
gagacacaggaacagaccta

SEQ ID NO: 260266 - DNA, 20 bp, human
ggggagcccgcgagtccaga

SEQ ID NO: 260267 - DNA, 20 bp, human
gggctggcacccggaggaga

SEQ ID NO: 260268 - DNA, 20 bp, human
gagagggaggggaagtccgg

SEQ ID NO: 260269 - DNA, 20 bp, human
gcccctacggattagccccc

SEQ ID NO: 260270 - DNA, 20 bp, human
gccctgggggctaatccgta

SEQ ID NO: 260271 - DNA, 20 bp, human
ggtgaagggcagaatgggta

SEQ ID NO: 260272 - DNA, 20 bp, human
gggctaatccgtaggggcgc

SEQ ID NO: 260273 - DNA, 20 bp, human
gcaaagcgccagcgccccta

SEQ ID NO: 260274 - DNA, 20 bp, human
gtaccaggctcagagatccc

SEQ ID NO: 260275 - DNA, 20 bp, human
gggcatgaatgaacaggagt

SEQ ID NO: 260276 - DNA, 20 bp, human
gtctccttcccgagcagctc

SEQ ID NO: 260277 - DNA, 20 bp, human
ggctcgggaaggagaccggg

SEQ ID NO: 260278 - DNA, 20 bp, human
ggaaggagaccgggtgggag

SEQ ID NO: 260279 - DNA, 20 bp, human
gacccagggaagtccccgag

SEQ ID NO: 260280 - DNA, 20 bp, human
gagaagatgtgatgaggccg

SEQ ID NO: 260281 - DNA, 20 bp, human
gagcccagagctgctcggga

SEQ ID NO: 260282 - DNA, 20 bp, human
ggagcgggatggcacgcagc

SEQ ID NO: 260283 - DNA, 20 bp, human
gggggcgtcgcccatgggac

SEQ ID NO: 260284 - DNA, 20 bp, human
ggaagacggcactaggaccc

SEQ ID NO: 260285 - DNA, 20 bp, human
gaaacacagaagatgtgatg

SEQ ID NO: 260286 - DNA, 20 bp, human
ggccaatggcggcgcagaca

SEQ ID NO: 260287 - DNA, 20 bp, human
ggcgccccgtggagcccgga

SEQ ID NO: 260288 - DNA, 20 bp, human
ggggccctgctcggtgaagg

SEQ ID NO: 260289 - DNA, 20 bp, human
gaatggcggcgcagacaggg

SEQ ID NO: 260290 - DNA, 20 bp, human
gccagggttccgccccctcc

SEQ ID NO: 260291 - DNA, 20 bp, human
gcggtctcccggggctctag

SEQ ID NO: 260292 - DNA, 20 bp, human
gggcgggccctgctcggtga

SEQ ID NO: 260293 - DNA, 20 bp, human
gactggcgggctcacgtcac

SEQ ID NO: 260294 - DNA, 20 bp, human
ggccccgccttcaccgagca

SEQ ID NO: 260295 - DNA, 20 bp, human
gcggggcgcgcggtctcccg

SEQ ID NO: 260296 - DNA, 20 bp, human
gacggagggaagtaatctgg

SEQ ID NO: 260297 - DNA, 20 bp, human
gcccacggagggaagtaatc

SEQ ID NO: 260298 - DNA, 20 bp, human
gcgaagtcacacacccacgg

SEQ ID NO: 260299 - DNA, 20 bp, human
gggctgcgagcagcagaggg

SEQ ID NO: 260300 - DNA, 20 bp, human
ggcgaggctgcgagcagcag

SEQ ID NO: 260301 - DNA, 20 bp, human
gtcccgggataattagggca

SEQ ID NO: 260302 - DNA, 20 bp, human
gcgacgaagtcacacaccca

SEQ ID NO: 260303 - DNA, 20 bp, human
gacttacagtagattctcac

SEQ ID NO: 260304 - DNA, 20 bp, human
gcttcctcccgggataatta

SEQ ID NO: 260305 - DNA, 20 bp, human
ggggttcccgggaggcggaa

SEQ ID NO: 260306 - DNA, 20 bp, human
gcggacgaggtggctcaacg

SEQ ID NO: 260307 - DNA, 20 bp, human
ggacctctcccgactcaagt

SEQ ID NO: 260308 - DNA, 20 bp, human
gcgcgcgcaagagcgagctc

SEQ ID NO: 260309 - DNA, 20 bp, human
gtgagtcgggagaggtcctc

SEQ ID NO: 260310 - DNA, 20 bp, human
gtgcagctgtgaagaggcgt

SEQ ID NO: 260311 - DNA, 20 bp, human
gcttgcggagccaaaagcag

SEQ ID NO: 260312 - DNA, 20 bp, human
gcgcctcaccgcgaggacgg

SEQ ID NO: 260313 - DNA, 20 bp, human
gagctcgggctgtggtttgg

SEQ ID NO: 260314 - DNA, 20 bp, human
ggcggagccaaaagcagggg

SEQ ID NO: 260315 - DNA, 20 bp, human
gtgcccacttgagtcgggag

SEQ ID NO: 260316 - DNA, 20 bp, human
gcgcgagctcagaacctgga

SEQ ID NO: 260317 - DNA, 20 bp, human
gtgccaggaggcgattccca

SEQ ID NO: 260318 - DNA, 20 bp, human
gctgagagcctccgccactc

SEQ ID NO: 260319 - DNA, 20 bp, human
gggagccaatcggtgccgag

SEQ ID NO: 260320 - DNA, 20 bp, human
gagaacgaggatggtagccg

SEQ ID NO: 260321 - DNA, 20 bp, human
gggccctgggaatcgcctcc

SEQ ID NO: 260322 - DNA, 20 bp, human
gcccggcgaaatggccgccc

SEQ ID NO: 260323 - DNA, 20 bp, human
ggccggggcggccatttcgc

SEQ ID NO: 260324 - DNA, 20 bp, human
gccagcaacctgactccgct

SEQ ID NO: 260325 - DNA, 20 bp, human
ggactccgctcggcaccgat

SEQ ID NO: 260326 - DNA, 20 bp, human
gccccggcgggcaccttcgg

SEQ ID NO: 260327 - DNA, 20 bp, human
gtgggcgtgcgcacgtgcgg

SEQ ID NO: 260328 - DNA, 20 bp, human
gcgcccccgaaggtgcccgc

SEQ ID NO: 260329 - DNA, 20 bp, human
ggggacgtcccggcgacacc

SEQ ID NO: 260330 - DNA, 20 bp, human
ggtgcccgccgggggagtgt

SEQ ID NO: 260331 - DNA, 20 bp, human
gggccgggtggccgcggtgc

SEQ ID NO: 260332 - DNA, 20 bp, human
gcgagcatgcggtggatgtg

SEQ ID NO: 260333 - DNA, 20 bp, human
gcccccgcctcggtgctgat

SEQ ID NO: 260334 - DNA, 20 bp, human
ggcgctgcgcacttggactc

SEQ ID NO: 260335 - DNA, 20 bp, human
gcacccagggattccctctg

SEQ ID NO: 260336 - DNA, 20 bp, human
gcttgcaaggctgtgcggga

SEQ ID NO: 260337 - DNA, 20 bp, human
gggctcggaaggcgctagga

SEQ ID NO: 260338 - DNA, 20 bp, human
gccttcgctgggcaccctat

SEQ ID NO: 260339 - DNA, 20 bp, human
ggtgcccagcgaaggagctg

SEQ ID NO: 260340 - DNA, 20 bp, human
ggaaggcgctaggaggggtc

SEQ ID NO: 260341 - DNA, 20 bp, human
gtctccgagagcaccacgag

SEQ ID NO: 260342 - DNA, 20 bp, human
gctgtgcgggagggctcgga

SEQ ID NO: 260343 - DNA, 20 bp, human
gcaaacctgcaaaattcccc

SEQ ID NO: 260344 - DNA, 20 bp, human
gctccccctcgtggtgctct

SEQ ID NO: 260345 - DNA, 20 bp, human
ggggcaccctatggggggac

SEQ ID NO: 260346 - DNA, 20 bp, human
gctgcccccgggtgacccta

SEQ ID NO: 260347 - DNA, 20 bp, human
gcgcccgtagggtcacccgg

SEQ ID NO: 260348 - DNA, 20 bp, human
gtccccacaccgcgcccgta

SEQ ID NO: 260349 - DNA, 20 bp, human
gcgggcgcggtgtggggacc

SEQ ID NO: 260350 - DNA, 20 bp, human
ggaccctacgggcgcggtgt

SEQ ID NO: 260351 - DNA, 20 bp, human
ggggagagaccactgctgcg

SEQ ID NO: 260352 - DNA, 20 bp, human
ggtggtctctcccggcgctg

SEQ ID NO: 260353 - DNA, 20 bp, human
gagagaccactgctgcgcgg

SEQ ID NO: 260354 - DNA, 20 bp, human
ggtgtggggacccgggctcg

SEQ ID NO: 260355 - DNA, 20 bp, human
gtcagtggcccgggcacgcg

SEQ ID NO: 260356 - DNA, 20 bp, human
ggggtctcaggggccggagt

SEQ ID NO: 260357 - DNA, 20 bp, human
gcccaccctcggggtctcag

SEQ ID NO: 260358 - DNA, 20 bp, human
gaccgccaggcccgctggtt

SEQ ID NO: 260359 - DNA, 20 bp, human
gggcctggcggtctgtgagt

SEQ ID NO: 260360 - DNA, 20 bp, human
ggccggagtgggcggggcta

SEQ ID NO: 260361 - DNA, 20 bp, human
gagtgggtggccagccgcta

SEQ ID NO: 260362 - DNA, 20 bp, human
gtctcaggggccggagtggg

SEQ ID NO: 260363 - DNA, 20 bp, human
gtgcctgcccgtcaacgctg

SEQ ID NO: 260364 - DNA, 20 bp, human
gggcggggttctccctctga

SEQ ID NO: 260365 - DNA, 20 bp, human
gcgctctgggcgagaggggt

SEQ ID NO: 260366 - DNA, 20 bp, human
gcgcgcccggggctcactcg

SEQ ID NO: 260367 - DNA, 20 bp, human
gaccgagcatgtcggggctg

SEQ ID NO: 260368 - DNA, 20 bp, human
ggaggggcaccgagtggagc

SEQ ID NO: 260369 - DNA, 20 bp, human
gggcagctctcccaacgcgg

SEQ ID NO: 260370 - DNA, 20 bp, human
gaccgcccagatgtgcgccg

SEQ ID NO: 260371 - DNA, 20 bp, human
ggcaacacggagggccgccc

SEQ ID NO: 260372 - DNA, 20 bp, human
ggggttcgggcctgtcccgg

SEQ ID NO: 260373 - DNA, 20 bp, human
ggggctccgcgagtgagccc

SEQ ID NO: 260374 - DNA, 20 bp, human
ggagccccgggcgcgctgat

SEQ ID NO: 260375 - DNA, 20 bp, human
gcaccgccacggcgcacatc

SEQ ID NO: 260376 - DNA, 20 bp, human
gcctcccggccaagacccgc

SEQ ID NO: 260377 - DNA, 20 bp, human
gccggcgcgcgggggagacg

SEQ ID NO: 260378 - DNA, 20 bp, human
gttcccactcccttcttccg

SEQ ID NO: 260379 - DNA, 20 bp, human
gagtgggaaggcggccaaag

SEQ ID NO: 260380 - DNA, 20 bp, human
ggcggccaaaggggctgaag

SEQ ID NO: 260381 - DNA, 20 bp, human
gcccgccccttcagcccctt

SEQ ID NO: 260382 - DNA, 20 bp, human
gggctcggctccccggaaga

SEQ ID NO: 260383 - DNA, 20 bp, human
gccttcccggcgcacaggcg

SEQ ID NO: 260384 - DNA, 20 bp, human
gctcaccgcctaggccggga

SEQ ID NO: 260385 - DNA, 20 bp, human
gtcctcccgcgggtcttggc

SEQ ID NO: 260386 - DNA, 20 bp, human
gctccgagcggggcgttccc

SEQ ID NO: 260387 - DNA, 20 bp, human
gtaaggctccacctctgcca

SEQ ID NO: 260388 - DNA, 20 bp, human
gcctctgccagggataaaac

SEQ ID NO: 260389 - DNA, 20 bp, human
gataaaacgggctacttaaa

SEQ ID NO: 260390 - DNA, 20 bp, human
gccgctcggaggccgggctt

SEQ ID NO: 260391 - DNA, 20 bp, human
gaagtagcccgttttatccc

SEQ ID NO: 260392 - DNA, 20 bp, human
gcagaggtggagccttaggc

SEQ ID NO: 260393 - DNA, 20 bp, human
gaagtctctaggcctgccta

SEQ ID NO: 260394 - DNA, 20 bp, human
gaacgccccgctcggaggcc

SEQ ID NO: 260395 - DNA, 20 bp, human
gaaacgggctacttaaaggg

SEQ ID NO: 260396 - DNA, 20 bp, human
gagagggcggagtcccgtta

SEQ ID NO: 260397 - DNA, 20 bp, human
gccgccctctgcccgggtta

SEQ ID NO: 260398 - DNA, 20 bp, human
ggggcggagtcccgttaagg

SEQ ID NO: 260399 - DNA, 20 bp, human
gcctctgcccgggttaaggc

SEQ ID NO: 260400 - DNA, 20 bp, human
ggtcccgttaagggggtgtg

SEQ ID NO: 260401 - DNA, 20 bp, human
gctctggccgggaaagaggc

SEQ ID NO: 260402 - DNA, 20 bp, human
gtactgcaggggcgtgggga

SEQ ID NO: 260403 - DNA, 20 bp, human
gccagagtccagccttaacc

SEQ ID NO: 260404 - DNA, 20 bp, human
gtggactctggccgggaaag

SEQ ID NO: 260405 - DNA, 20 bp, human
gtaacctgggagatgcgcga

SEQ ID NO: 260406 - DNA, 20 bp, human
ggcccaggaagactcagcag

SEQ ID NO: 260407 - DNA, 20 bp, human
gccggccctaagccccgcac

SEQ ID NO: 260408 - DNA, 20 bp, human
gaggtcctgtgcggggctta

SEQ ID NO: 260409 - DNA, 20 bp, human
ggggacaggaaacaagggta

SEQ ID NO: 260410 - DNA, 20 bp, human
ggggcctagcaggtcctgtg

SEQ ID NO: 260411 - DNA, 20 bp, human
gccctccttaaggtttgtct

SEQ ID NO: 260412 - DNA, 20 bp, human
gcgggtgggtgagggtctaa

SEQ ID NO: 260413 - DNA, 20 bp, human
gggaagactcagcagcgggt

SEQ ID NO: 260414 - DNA, 20 bp, human
gtgggcgacacctggagtga

SEQ ID NO: 260415 - DNA, 20 bp, human
gtaaatgggcggggcctagc

SEQ ID NO: 260416 - DNA, 20 bp, human
gtgagtggcgctaccttctt

SEQ ID NO: 260417 - DNA, 20 bp, human
gccatcctgggcaccaaaga

SEQ ID NO: 260418 - DNA, 20 bp, human
gcaaaatcgcaaaactgtgg

SEQ ID NO: 260419 - DNA, 20 bp, human
gagtggccatgtcggtgctg

SEQ ID NO: 260420 - DNA, 20 bp, human
gacacctgagagttcgtcga

SEQ ID NO: 260421 - DNA, 20 bp, human
gaacgccggccgccccgggc

SEQ ID NO: 260422 - DNA, 20 bp, human
gagagcttggctgtcttccg

SEQ ID NO: 260423 - DNA, 20 bp, human
ggctgaaccaggcaaggcat

SEQ ID NO: 260424 - DNA, 20 bp, human
ggcgttccgtgtcaccgcgg

SEQ ID NO: 260425 - DNA, 20 bp, human
gagactttcccaaaccatcc

SEQ ID NO: 260426 - DNA, 20 bp, human
ggaacagcacgtgttctccc

SEQ ID NO: 260427 - DNA, 20 bp, human
ggcgtgatgcatcccaaaga

SEQ ID NO: 260428 - DNA, 20 bp, human
gggcacaaagaggcagctag

SEQ ID NO: 260429 - DNA, 20 bp, human
gggccgcagcgattgggcgg

SEQ ID NO: 260430 - DNA, 20 bp, human
ggacacgcgaccggaagaaa

SEQ ID NO: 260431 - DNA, 20 bp, human
ggtgttctccccggtgcccg

SEQ ID NO: 260432 - DNA, 20 bp, human
gggcgctggggacacgcgac

SEQ ID NO: 260433 - DNA, 20 bp, human
gtgtccccagcgcccacagg

SEQ ID NO: 260434 - DNA, 20 bp, human
gaaccgcccgcggggttgcg

SEQ ID NO: 260435 - DNA, 20 bp, human
gccgagcccagacttcgtcc

SEQ ID NO: 260436 - DNA, 20 bp, human
ggcagtagccgcttcaggga

SEQ ID NO: 260437 - DNA, 20 bp, human
gctactgcccgctacctaga

SEQ ID NO: 260438 - DNA, 20 bp, human
gcgcaagcgcatatccttct

SEQ ID NO: 260439 - DNA, 20 bp, human
gctcctaaaaacgaaccaat

SEQ ID NO: 260440 - DNA, 20 bp, human
gcacgaggcactgaggtgat

SEQ ID NO: 260441 - DNA, 20 bp, human
gggagcagagatgccggaac

SEQ ID NO: 260442 - DNA, 20 bp, human
gatagctgccgctgaagggt

SEQ ID NO: 260443 - DNA, 20 bp, human
gtcttcgtccctccctgaag

SEQ ID NO: 260444 - DNA, 20 bp, human
gaacgaaccaataggaagag

SEQ ID NO: 260445 - DNA, 20 bp, human
gaaggaagaacgtgagcacg

SEQ ID NO: 260446 - DNA, 20 bp, human
ggcgggcggaagtgacgtag

SEQ ID NO: 260447 - DNA, 20 bp, human
ggatcccccgctgcagcggg

SEQ ID NO: 260448 - DNA, 20 bp, human
gacgtagaggcgcctagcaa

SEQ ID NO: 260449 - DNA, 20 bp, human
gtcacttccgcccgctgcag

SEQ ID NO: 260450 - DNA, 20 bp, human
gggcggggtgcggcacggga

SEQ ID NO: 260451 - DNA, 20 bp, human
ggggatccgcgcggtgctca

SEQ ID NO: 260452 - DNA, 20 bp, human
gcgcgctgggccccgttgct

SEQ ID NO: 260453 - DNA, 20 bp, human
gcttccgcccgctgcagcgg

SEQ ID NO: 260454 - DNA, 20 bp, human
gttccaggttggcttggctg

SEQ ID NO: 260455 - DNA, 20 bp, human
gaagcaacagaaggaggcga

SEQ ID NO: 260456 - DNA, 20 bp, human
ggggcgggacctcggggcct

SEQ ID NO: 260457 - DNA, 20 bp, human
gacctcggggcctcgggggc

SEQ ID NO: 260458 - DNA, 20 bp, human
ggagggcgcgcgcacgcgtc

SEQ ID NO: 260459 - DNA, 20 bp, human
gcgcaggggccactagggag

SEQ ID NO: 260460 - DNA, 20 bp, human
ggggcgtggtctgcgggcgt

SEQ ID NO: 260461 - DNA, 20 bp, human
gaagccgcgcaggggccact

SEQ ID NO: 260462 - DNA, 20 bp, human
gactgtggggcgctgcggaa

SEQ ID NO: 260463 - DNA, 20 bp, human
gccaacatggcggccgggag

SEQ ID NO: 260464 - DNA, 20 bp, human
ggtggggcgctgcggaaggg

SEQ ID NO: 260465 - DNA, 20 bp, human
gcacacaccagccaacatgg

SEQ ID NO: 260466 - DNA, 20 bp, human
ggcgacgtaagccccctgtg

SEQ ID NO: 260467 - DNA, 20 bp, human
ggtaagccccctgtgagggt

SEQ ID NO: 260468 - DNA, 20 bp, human
gggcttacgtcgcagtggaa

SEQ ID NO: 260469 - DNA, 20 bp, human
gcagggggcttacgtcgcag

SEQ ID NO: 260470 - DNA, 20 bp, human
ggtggtccagcagcaggtac

SEQ ID NO: 260471 - DNA, 20 bp, human
ggtaaaactggggagctgag

SEQ ID NO: 260472 - DNA, 20 bp, human
gcagtctcccaccctcacag

SEQ ID NO: 260473 - DNA, 20 bp, human
gggaagaatcggaaacactg

SEQ ID NO: 260474 - DNA, 20 bp, human
gtcttgggttcgtcctaagg

SEQ ID NO: 260475 - DNA, 20 bp, human
gttatcttgggttcgtccta

SEQ ID NO: 260476 - DNA, 20 bp, human
gcaagtggtgcattgagagg

SEQ ID NO: 260477 - DNA, 20 bp, human
gagggcagggacattccctg

SEQ ID NO: 260478 - DNA, 20 bp, human
ggggatcaggtcgccagcac

SEQ ID NO: 260479 - DNA, 20 bp, human
gccagatgtgcacttcctgg

SEQ ID NO: 260480 - DNA, 20 bp, human
gcctgcctcttcaacaggaa

SEQ ID NO: 260481 - DNA, 20 bp, human
ggctccagatgtgcacttcc

SEQ ID NO: 260482 - DNA, 20 bp, human
gaggcaagtggtgcattgag

SEQ ID NO: 260483 - DNA, 20 bp, human
gcttcccctgcctcttcaac

SEQ ID NO: 260484 - DNA, 20 bp, human
gactcaaagcagaggggatc

SEQ ID NO: 260485 - DNA, 20 bp, human
gggtctgcctcagcagtaac

SEQ ID NO: 260486 - DNA, 20 bp, human
gggaactagcagaaccagtc

SEQ ID NO: 260487 - DNA, 20 bp, human
ggggcagccaggtccaggta

SEQ ID NO: 260488 - DNA, 20 bp, human
gccacccccagccacgggtt

SEQ ID NO: 260489 - DNA, 20 bp, human
gcctccccaacccgtggctg

SEQ ID NO: 260490 - DNA, 20 bp, human
gggtaggggcgtgtgctggg

SEQ ID NO: 260491 - DNA, 20 bp, human
gggggtggcagagtcaagat

SEQ ID NO: 260492 - DNA, 20 bp, human
gagcacacgcccctaccggc

SEQ ID NO: 260493 - DNA, 20 bp, human
gccagagccctacctggacc

SEQ ID NO: 260494 - DNA, 20 bp, human
ggggaggggactctcggtgt

SEQ ID NO: 260495 - DNA, 20 bp, human
ggcctctgggaggggactct

SEQ ID NO: 260496 - DNA, 20 bp, human
gtgtcctgggattgtgggaa

SEQ ID NO: 260497 - DNA, 20 bp, human
gccccccaggggaggtgtcc

SEQ ID NO: 260498 - DNA, 20 bp, human
gtactagacggtgaggagtg

SEQ ID NO: 260499 - DNA, 20 bp, human
ggaacatgtcctgggattgt

SEQ ID NO: 260500 - DNA, 20 bp, human
ggcccctccctaaagcttct

SEQ ID NO: 260501 - DNA, 20 bp, human
gcaagaccgggatgcccccc

SEQ ID NO: 260502 - DNA, 20 bp, human
gaagcccagaagctttaggg

SEQ ID NO: 260503 - DNA, 20 bp, human
gtgtttctagaacatgtcct

SEQ ID NO: 260504 - DNA, 20 bp, human
gtgcagagtactagacggtg

SEQ ID NO: 260505 - DNA, 20 bp, human
ggcaaatagggcaagaaatt

SEQ ID NO: 260506 - DNA, 20 bp, human
gaggagcccaagaaagctca

SEQ ID NO: 260507 - DNA, 20 bp, human
gagagagtctctggtacgaa

SEQ ID NO: 260508 - DNA, 20 bp, human
gtggtcccattgcaattcta

SEQ ID NO: 260509 - DNA, 20 bp, human
gcaatcagagagagagtctc

SEQ ID NO: 260510 - DNA, 20 bp, human
gcgggcgctaaaggggtcta

SEQ ID NO: 260511 - DNA, 20 bp, human
gaatgggaccaataagagta

SEQ ID NO: 260512 - DNA, 20 bp, human
ggaccaataagagtaggggg

SEQ ID NO: 260513 - DNA, 20 bp, human
gacaaaaatagatgacgtgg

SEQ ID NO: 260514 - DNA, 20 bp, human
gctaaaggggtctagggtta

SEQ ID NO: 260515 - DNA, 20 bp, human
gagcactcgtagagggaccc

SEQ ID NO: 260516 - DNA, 20 bp, human
ggggcccttcccgagcccag

SEQ ID NO: 260517 - DNA, 20 bp, human
gcaggcacttatctctaccc

SEQ ID NO: 260518 - DNA, 20 bp, human
gccgagcccagaggccgctt

SEQ ID NO: 260519 - DNA, 20 bp, human
gctaagtggcagatccccga

SEQ ID NO: 260520 - DNA, 20 bp, human
ggccgcaacagctcccgttc

SEQ ID NO: 260521 - DNA, 20 bp, human
ggtagagataagtgcctggc

SEQ ID NO: 260522 - DNA, 20 bp, human
ggccagaacgggagctgttg

SEQ ID NO: 260523 - DNA, 20 bp, human
ggcggcctctgggctcggga

SEQ ID NO: 260524 - DNA, 20 bp, human
ggcggggccagcactcagcc

SEQ ID NO: 260525 - DNA, 20 bp, human
ggaagtctgaagctcaggta

SEQ ID NO: 260526 - DNA, 20 bp, human
gcacccacagctcacagctt

SEQ ID NO: 260527 - DNA, 20 bp, human
gctcccaagctgtgagctgt

SEQ ID NO: 260528 - DNA, 20 bp, human
gctagtcaaccacagggagt

SEQ ID NO: 260529 - DNA, 20 bp, human
gtacacccctaggctgcact

SEQ ID NO: 260530 - DNA, 20 bp, human
gagtaagtgtgcacgtacga

SEQ ID NO: 260531 - DNA, 20 bp, human
gacgctttgcccactccctg

SEQ ID NO: 260532 - DNA, 20 bp, human
gggaagggtctcttattgaa

SEQ ID NO: 260533 - DNA, 20 bp, human
gggtcacaaatgggactaac

SEQ ID NO: 260534 - DNA, 20 bp, human
gggggctctagtcaaccaca

SEQ ID NO: 260535 - DNA, 20 bp, human
gagcgtgtctcccactttcc

SEQ ID NO: 260536 - DNA, 20 bp, human
gcacccacagctcacagctt

SEQ ID NO: 260537 - DNA, 20 bp, human
gctcccaagctgtgagctgt

SEQ ID NO: 260538 - DNA, 20 bp, human
gctagtcaaccacagggagt

SEQ ID NO: 260539 - DNA, 20 bp, human
gtacacccctaggctgcact

SEQ ID NO: 260540 - DNA, 20 bp, human
gagtaagtgtgcacgtacga

SEQ ID NO: 260541 - DNA, 20 bp, human
gacgctttgcccactccctg

SEQ ID NO: 260542 - DNA, 20 bp, human
gggaagggtctcttattgaa

SEQ ID NO: 260543 - DNA, 20 bp, human
gggtcacaaatgggactaac

SEQ ID NO: 260544 - DNA, 20 bp, human
gggggctctagtcaaccaca

SEQ ID NO: 260545 - DNA, 20 bp, human
gagcgtgtctcccactttcc

SEQ ID NO: 260546 - DNA, 20 bp, human
gcccgccctgcgttccttcg

SEQ ID NO: 260547 - DNA, 20 bp, human
gtgggcgccgccctagacgg

SEQ ID NO: 260548 - DNA, 20 bp, human
ggccccgcccccgtctaggg

SEQ ID NO: 260549 - DNA, 20 bp, human
gcaggccccgcccccgtcta

SEQ ID NO: 260550 - DNA, 20 bp, human
ggactccctgctggggacga

SEQ ID NO: 260551 - DNA, 20 bp, human
gtagggcggcgcccaggtcg

SEQ ID NO: 260552 - DNA, 20 bp, human
gtcggggccccgacgcgggg

SEQ ID NO: 260553 - DNA, 20 bp, human
gcagcagggagtcaccgcga

SEQ ID NO: 260554 - DNA, 20 bp, human
gccgcgtcggggccccgacc

SEQ ID NO: 260555 - DNA, 20 bp, human
gggcctggcgcttgcacccc

SEQ ID NO: 260556 - DNA, 20 bp, human
gctgcgggcggggacgaaga

SEQ ID NO: 260557 - DNA, 20 bp, human
gttggccgccagggttagaa

SEQ ID NO: 260558 - DNA, 20 bp, human
gacgcaggccgttctaaccc

SEQ ID NO: 260559 - DNA, 20 bp, human
gaaccctggcggccaagagg

SEQ ID NO: 260560 - DNA, 20 bp, human
gtggcctttcgtgctgcggt

SEQ ID NO: 260561 - DNA, 20 bp, human
gggtgggaaagacgctgaag

SEQ ID NO: 260562 - DNA, 20 bp, human
ggcagcacgaaaggccacgc

SEQ ID NO: 260563 - DNA, 20 bp, human
gggaaagacgctgaagtgga

SEQ ID NO: 260564 - DNA, 20 bp, human
gtagcaggctctggaacctg

SEQ ID NO: 260565 - DNA, 20 bp, human
gcagcaggtcgtaaaacagc

SEQ ID NO: 260566 - DNA, 20 bp, human
ggccgcccaaaccctggcgc

SEQ ID NO: 260567 - DNA, 20 bp, human
gggggcaggctctggtccgg

SEQ ID NO: 260568 - DNA, 20 bp, human
ggggaagttgtggaagttag

SEQ ID NO: 260569 - DNA, 20 bp, human
gggccgagactccggcgcca

SEQ ID NO: 260570 - DNA, 20 bp, human
gagactccggcgccagggtt

SEQ ID NO: 260571 - DNA, 20 bp, human
ggcgccggagtctcggccac

SEQ ID NO: 260572 - DNA, 20 bp, human
gggaccagagcctgcccccg

SEQ ID NO: 260573 - DNA, 20 bp, human
gcgcggcgccgcccaaaccc

SEQ ID NO: 260574 - DNA, 20 bp, human
gttttccaaggcggccccgg

SEQ ID NO: 260575 - DNA, 20 bp, human
gcgcggacataaaattaaag

SEQ ID NO: 260576 - DNA, 20 bp, human
gcaacgttggaaggaggagt

SEQ ID NO: 260577 - DNA, 20 bp, human
gcacgcatgtgcagtcaggc

SEQ ID NO: 260578 - DNA, 20 bp, human
gatgtgcagtcaggccggga

SEQ ID NO: 260579 - DNA, 20 bp, human
gagagggcggggccgtagac

SEQ ID NO: 260580 - DNA, 20 bp, human
gggccgcctgtcccgggaga

SEQ ID NO: 260581 - DNA, 20 bp, human
ggtgcgcaggccgcctgtcc

SEQ ID NO: 260582 - DNA, 20 bp, human
ggcgcactgggacgacggga

SEQ ID NO: 260583 - DNA, 20 bp, human
gtccccaggcgcactggcag

SEQ ID NO: 260584 - DNA, 20 bp, human
ggagtccgaacaacgttgga

SEQ ID NO: 260585 - DNA, 20 bp, human
gcggtcgcccaccccgcgga

SEQ ID NO: 260586 - DNA, 20 bp, human
gtgggcgggagagggaccgg

SEQ ID NO: 260587 - DNA, 20 bp, human
gcagccgagccgcagagttc

SEQ ID NO: 260588 - DNA, 20 bp, human
gccggggcgtccatcctcgc

SEQ ID NO: 260589 - DNA, 20 bp, human
ggccggcaagacccggatag

SEQ ID NO: 260590 - DNA, 20 bp, human
ggcgctgcgccaagttatca

SEQ ID NO: 260591 - DNA, 20 bp, human
gcgcggcgcgcggttggcac

SEQ ID NO: 260592 - DNA, 20 bp, human
gcgcgcgaggaacgagcgag

SEQ ID NO: 260593 - DNA, 20 bp, human
ggccacttcgcctcaagcgc

SEQ ID NO: 260594 - DNA, 20 bp, human
gcgccccgtctcctttcctc

SEQ ID NO: 260595 - DNA, 20 bp, human
gggaaggggcaaagagcgtg

SEQ ID NO: 260596 - DNA, 20 bp, human
gctggcagacagatctagga

SEQ ID NO: 260597 - DNA, 20 bp, human
gcctggctggagtgaccccg

SEQ ID NO: 260598 - DNA, 20 bp, human
gggggctggcagacagatct

SEQ ID NO: 260599 - DNA, 20 bp, human
gaggggctggggggactgca

SEQ ID NO: 260600 - DNA, 20 bp, human
gtgaatgctcaggtatgcgg

SEQ ID NO: 260601 - DNA, 20 bp, human
gtgatgtcacacttgttcac

SEQ ID NO: 260602 - DNA, 20 bp, human
gctcaggtatgcggaggcgg

SEQ ID NO: 260603 - DNA, 20 bp, human
gtcacctggcacagcctggc

SEQ ID NO: 260604 - DNA, 20 bp, human
ggctggagtgaccccggggc

SEQ ID NO: 260605 - DNA, 20 bp, human
gctgtgccaggtgaatgctc

SEQ ID NO: 260606 - DNA, 20 bp, human
gcgcctcggggtgagcagat

SEQ ID NO: 260607 - DNA, 20 bp, human
gcctggaagaagtgcacgtc

SEQ ID NO: 260608 - DNA, 20 bp, human
gtcggggtgagcagatgggc

SEQ ID NO: 260609 - DNA, 20 bp, human
ggagccggggcggaaatggg

SEQ ID NO: 260610 - DNA, 20 bp, human
gtgggtgggaggagtgtctg

SEQ ID NO: 260611 - DNA, 20 bp, human
gctggagccggggcggaaat

SEQ ID NO: 260612 - DNA, 20 bp, human
ggggatggcggggtaaactg

SEQ ID NO: 260613 - DNA, 20 bp, human
gcttccagggcctgcgcctc

SEQ ID NO: 260614 - DNA, 20 bp, human
ggagctggagtcgtacccac

SEQ ID NO: 260615 - DNA, 20 bp, human
ggccccacccatttccgccc

SEQ ID NO: 260616 - DNA, 20 bp, human
ggcgccaggtctcccgcggg

SEQ ID NO: 260617 - DNA, 20 bp, human
ggcggagctgggtccgaggc

SEQ ID NO: 260618 - DNA, 20 bp, human
gttgcggagtcacccgagag

SEQ ID NO: 260619 - DNA, 20 bp, human
ggaacctgagcgacaggttg

SEQ ID NO: 260620 - DNA, 20 bp, human
ggagtcacccgagagcgggc

SEQ ID NO: 260621 - DNA, 20 bp, human
gactccgcaacctgtcgctc

SEQ ID NO: 260622 - DNA, 20 bp, human
ggtgttggggaggacgcaga

SEQ ID NO: 260623 - DNA, 20 bp, human
gcctgcggtgggcccggtaa

SEQ ID NO: 260624 - DNA, 20 bp, human
gccccagcgccccagctcta

SEQ ID NO: 260625 - DNA, 20 bp, human
ggaggaggaacctgagcgac

SEQ ID NO: 260626 - DNA, 20 bp, human
ggctagcagtgggggaaaca

SEQ ID NO: 260627 - DNA, 20 bp, human
gcagacactgccgcaggtcc

SEQ ID NO: 260628 - DNA, 20 bp, human
gcagcatcaggcacggggct

SEQ ID NO: 260629 - DNA, 20 bp, human
gtcccccactgctagccttg

SEQ ID NO: 260630 - DNA, 20 bp, human
gtaggcacctaaaaggcaga

SEQ ID NO: 260631 - DNA, 20 bp, human
gcaccccaaggctagcagtg

SEQ ID NO: 260632 - DNA, 20 bp, human
gcaacatcaacctggacctg

SEQ ID NO: 260633 - DNA, 20 bp, human
gtggggaacaggtcagcatc

SEQ ID NO: 260634 - DNA, 20 bp, human
gggtccaggttgatgttgag

SEQ ID NO: 260635 - DNA, 20 bp, human
gcggcagtgtctgtgctgac

SEQ ID NO: 260636 - DNA, 20 bp, human
gaggtcggacggggcctcag

SEQ ID NO: 260637 - DNA, 20 bp, human
gaatacgtggggaagttctc

SEQ ID NO: 260638 - DNA, 20 bp, human
gcctcagtggagaatacgtg

SEQ ID NO: 260639 - DNA, 20 bp, human
gcagctcaagtcaacatcct

SEQ ID NO: 260640 - DNA, 20 bp, human
gtggtcggctacaggtgaga

SEQ ID NO: 260641 - DNA, 20 bp, human
gccccgtccgaccttatcgc

SEQ ID NO: 260642 - DNA, 20 bp, human
ggggctgttaacccgcgata

SEQ ID NO: 260643 - DNA, 20 bp, human
gacccgcgataaggtcggac

SEQ ID NO: 260644 - DNA, 20 bp, human
ggggatcagccacggacacc

SEQ ID NO: 260645 - DNA, 20 bp, human
gtgttaacccgcgataaggt

SEQ ID NO: 260646 - DNA, 20 bp, human
gtggacaacagcagtgtcgg

SEQ ID NO: 260647 - DNA, 20 bp, human
ggatgggcggggagaagcgt

SEQ ID NO: 260648 - DNA, 20 bp, human
gtctccccgcccatcgaggg

SEQ ID NO: 260649 - DNA, 20 bp, human
ggacactgctgttgtccaat

SEQ ID NO: 260650 - DNA, 20 bp, human
gctagcaaccccccctcgat

SEQ ID NO: 260651 - DNA, 20 bp, human
ggcttctccccgcccatcga

SEQ ID NO: 260652 - DNA, 20 bp, human
gcactgagaggcggccgaag

SEQ ID NO: 260653 - DNA, 20 bp, human
gttgcctgatccacgccgat

SEQ ID NO: 260654 - DNA, 20 bp, human
gggggacgggccgctcgagc

SEQ ID NO: 260655 - DNA, 20 bp, human
ggcggctacgcgtgcgcggt

SEQ ID NO: 260656 - DNA, 20 bp, human
gcagtgggcttggtagtaga

SEQ ID NO: 260657 - DNA, 20 bp, human
ggggcttggtagtagagggt

SEQ ID NO: 260658 - DNA, 20 bp, human
gctgggagaagtgcatcagt

SEQ ID NO: 260659 - DNA, 20 bp, human
gcctagaaacccagcctctt

SEQ ID NO: 260660 - DNA, 20 bp, human
gatgtccccaggctggtagg

SEQ ID NO: 260661 - DNA, 20 bp, human
gtggcccaactctcattcta

SEQ ID NO: 260662 - DNA, 20 bp, human
gggacacaggtgtcgctcaa

SEQ ID NO: 260663 - DNA, 20 bp, human
gccctcccccaccctagaat

SEQ ID NO: 260664 - DNA, 20 bp, human
gatagcccattctagggtgg

SEQ ID NO: 260665 - DNA, 20 bp, human
ggaactccacccaagaggct

SEQ ID NO: 260666 - DNA, 20 bp, human
gtggatcctactgcttagtt

SEQ ID NO: 260667 - DNA, 20 bp, human
ggtcacccaaactaagcagt

SEQ ID NO: 260668 - DNA, 20 bp, human
gattcacagccattggtcag

SEQ ID NO: 260669 - DNA, 20 bp, human
gggtgagtttgttacagatg

SEQ ID NO: 260670 - DNA, 20 bp, human
gggtatttgcccctgaccaa

SEQ ID NO: 260671 - DNA, 20 bp, human
gaattctggtctgtgggagg

SEQ ID NO: 260672 - DNA, 20 bp, human
ggctgtgaattctggtctgt

SEQ ID NO: 260673 - DNA, 20 bp, human
gtatacagtgatactataga

SEQ ID NO: 260674 - DNA, 20 bp, human
ggaccagaattcacagccat

SEQ ID NO: 260675 - DNA, 20 bp, human
gtacttacccaatattaaac

SEQ ID NO: 260676 - DNA, 20 bp, human
ggggcatcagaatgttggtg

SEQ ID NO: 260677 - DNA, 20 bp, human
gcagatgggcatcagaatgt

SEQ ID NO: 260678 - DNA, 20 bp, human
gtgtagagcactcgattctg

SEQ ID NO: 260679 - DNA, 20 bp, human
gactgagtcacaaagctgtt

SEQ ID NO: 260680 - DNA, 20 bp, human
gtatgacatcactgtcagat

SEQ ID NO: 260681 - DNA, 20 bp, human
ggtgccacttgtaacccgca

SEQ ID NO: 260682 - DNA, 20 bp, human
ggaatcgagtgctctacaaa

SEQ ID NO: 260683 - DNA, 20 bp, human
gaatgttaattactcggctc

SEQ ID NO: 260684 - DNA, 20 bp, human
gcagtgttgcatgcctactc

SEQ ID NO: 260685 - DNA, 20 bp, human
gtttatctcaggtactataa

SEQ ID NO: 260686 - DNA, 20 bp, human
ggagacacatgggatgtggg

SEQ ID NO: 260687 - DNA, 20 bp, human
gttgctctggagactggtgg

SEQ ID NO: 260688 - DNA, 20 bp, human
gcagcgagtaggagagaggt

SEQ ID NO: 260689 - DNA, 20 bp, human
ggaattgctctggagactgg

SEQ ID NO: 260690 - DNA, 20 bp, human
ggcgggaggaggaattgctc

SEQ ID NO: 260691 - DNA, 20 bp, human
gagccgagacacatgggatg

SEQ ID NO: 260692 - DNA, 20 bp, human
ggaaatcgtcctcccatcga

SEQ ID NO: 260693 - DNA, 20 bp, human
gaaacccttacggggacagg

SEQ ID NO: 260694 - DNA, 20 bp, human
ggtgtctcggctttcaattt

SEQ ID NO: 260695 - DNA, 20 bp, human
gaaaaaaatacgttgtgtat

SEQ ID NO: 260696 - DNA, 20 bp, human
ggacacccagcgagtccaat

SEQ ID NO: 260697 - DNA, 20 bp, human
ggagggaagccgcaactccc

SEQ ID NO: 260698 - DNA, 20 bp, human
gaagctgcgaggttgcgatg

SEQ ID NO: 260699 - DNA, 20 bp, human
gtcatctcgccactgccagt

SEQ ID NO: 260700 - DNA, 20 bp, human
gaagccgcaactcccaggaa

SEQ ID NO: 260701 - DNA, 20 bp, human
gcgggagtggggccgagcga

SEQ ID NO: 260702 - DNA, 20 bp, human
ggggaagcccctggctaagg

SEQ ID NO: 260703 - DNA, 20 bp, human
gcaaagtgccgcaccttctg

SEQ ID NO: 260704 - DNA, 20 bp, human
gaagggccggtgctcaagtt

SEQ ID NO: 260705 - DNA, 20 bp, human
gcgcaacctcgcagcttccc

SEQ ID NO: 260706 - DNA, 20 bp, human
gtaccctggggacaagggaa

SEQ ID NO: 260707 - DNA, 20 bp, human
gggaaagaaaggatcgccag

SEQ ID NO: 260708 - DNA, 20 bp, human
gaagctgcccgggaggtgtt

SEQ ID NO: 260709 - DNA, 20 bp, human
gtggagtagaagccaaacca

SEQ ID NO: 260710 - DNA, 20 bp, human
ggcaggtgtgaatggagctt

SEQ ID NO: 260711 - DNA, 20 bp, human
gagtgccaagttgttgtctt

SEQ ID NO: 260712 - DNA, 20 bp, human
ggagtacagtaagtactagc

SEQ ID NO: 260713 - DNA, 20 bp, human
gatcacagaagctgcccggg

SEQ ID NO: 260714 - DNA, 20 bp, human
gcgtgcccaaggagacaggg

SEQ ID NO: 260715 - DNA, 20 bp, human
gagctggttcattatcacgc

SEQ ID NO: 260716 - DNA, 20 bp, human
gggcatggggattcttttct

SEQ ID NO: 260717 - DNA, 20 bp, human
gccctccctctgtcatgggg

SEQ ID NO: 260718 - DNA, 20 bp, human
ggtgctgggctagggttcaa

SEQ ID NO: 260719 - DNA, 20 bp, human
gagttcctccccatgacaga

SEQ ID NO: 260720 - DNA, 20 bp, human
gcctgccctccctctgtcat

SEQ ID NO: 260721 - DNA, 20 bp, human
gctagctggctgaacttgat

SEQ ID NO: 260722 - DNA, 20 bp, human
gtgtggcaaggacatggagt

SEQ ID NO: 260723 - DNA, 20 bp, human
gtgggtccctactgtctggc

SEQ ID NO: 260724 - DNA, 20 bp, human
gatgttgggtccctactgtc

SEQ ID NO: 260725 - DNA, 20 bp, human
gggcaggattttgccggttt

SEQ ID NO: 260726 - DNA, 20 bp, human
gcgctaggagggacgcaccc

SEQ ID NO: 260727 - DNA, 20 bp, human
gcccaggcctgcgcgaagag

SEQ ID NO: 260728 - DNA, 20 bp, human
gagtccgggataaattccct

SEQ ID NO: 260729 - DNA, 20 bp, human
gccgaggaaaagtgtgagaa

SEQ ID NO: 260730 - DNA, 20 bp, human
gcaggcgtcccggcgctagg

SEQ ID NO: 260731 - DNA, 20 bp, human
gtgttggaatgcagttggag

SEQ ID NO: 260732 - DNA, 20 bp, human
gtcaccagcctctgcattta

SEQ ID NO: 260733 - DNA, 20 bp, human
gtatcccggactccggggga

SEQ ID NO: 260734 - DNA, 20 bp, human
gaaaacaaataggcttggga

SEQ ID NO: 260735 - DNA, 20 bp, human
gacccccggggcatatcttc

SEQ ID NO: 260736 - DNA, 20 bp, human
gtccgcgcgcaccggagagg

SEQ ID NO: 260737 - DNA, 20 bp, human
gagctccgcgcgcaccggag

SEQ ID NO: 260738 - DNA, 20 bp, human
gtcggcggagatcctcgttg

SEQ ID NO: 260739 - DNA, 20 bp, human
gccgacggacggcccgggga

SEQ ID NO: 260740 - DNA, 20 bp, human
gagtcgggcaggctcaatag

SEQ ID NO: 260741 - DNA, 20 bp, human
ggcgcgcggagctggttttc

SEQ ID NO: 260742 - DNA, 20 bp, human
gaaaccagctccgcgcgcac

SEQ ID NO: 260743 - DNA, 20 bp, human
ggccggttgcccggaacccg

SEQ ID NO: 260744 - DNA, 20 bp, human
ggcgcgcccggcacaccgga

SEQ ID NO: 260745 - DNA, 20 bp, human
gaggatccagctccgtccag

SEQ ID NO: 260746 - DNA, 20 bp, human
gcccgcgcgaggctggagta

SEQ ID NO: 260747 - DNA, 20 bp, human
ggctcggggcaggcggtccg

SEQ ID NO: 260748 - DNA, 20 bp, human
gtggcggagcagatcgagga

SEQ ID NO: 260749 - DNA, 20 bp, human
ggaggctggagtagggattg

SEQ ID NO: 260750 - DNA, 20 bp, human
ggcggggcgtggcacgctcg

SEQ ID NO: 260751 - DNA, 20 bp, human
gcaggagataggccaagggg

SEQ ID NO: 260752 - DNA, 20 bp, human
gaacttggcggagcagatcg

SEQ ID NO: 260753 - DNA, 20 bp, human
gagtccggggagggatggca

SEQ ID NO: 260754 - DNA, 20 bp, human
gccgcggtcccgcaacttgg

SEQ ID NO: 260755 - DNA, 20 bp, human
gagggaagggtaatgaatga

SEQ ID NO: 260756 - DNA, 20 bp, human
ggggaagggcgtggctagtt

SEQ ID NO: 260757 - DNA, 20 bp, human
gccttcccccccccttccaa

SEQ ID NO: 260758 - DNA, 20 bp, human
gctgtcccaggcctctgcca

SEQ ID NO: 260759 - DNA, 20 bp, human
gtccggaggcccaggatttt

SEQ ID NO: 260760 - DNA, 20 bp, human
gagccaataagatttccctt

SEQ ID NO: 260761 - DNA, 20 bp, human
gttccaaagggaaatcttat

SEQ ID NO: 260762 - DNA, 20 bp, human
gagcatgggcggggtttgcg

SEQ ID NO: 260763 - DNA, 20 bp, human
gagccactccccaaaatcct

SEQ ID NO: 260764 - DNA, 20 bp, human
gagccggcctggttgcgtgg

SEQ ID NO: 260765 - DNA, 20 bp, human
ggatgagcaccgtggggcaa

SEQ ID NO: 260766 - DNA, 20 bp, human
ggccgcgtcacgctcccggg

SEQ ID NO: 260767 - DNA, 20 bp, human
gagcaccgaaacagagtgat

SEQ ID NO: 260768 - DNA, 20 bp, human
gtgccccggaaggcgcccgg

SEQ ID NO: 260769 - DNA, 20 bp, human
ggggcgcagcgcgcctcccc

SEQ ID NO: 260770 - DNA, 20 bp, human
ggggcctccgggcgccttcc

SEQ ID NO: 260771 - DNA, 20 bp, human
gcacgctcccgggaggctga

SEQ ID NO: 260772 - DNA, 20 bp, human
gggccgccgcgtcacgctcc

SEQ ID NO: 260773 - DNA, 20 bp, human
ggcctcccgggagcgtgacg

SEQ ID NO: 260774 - DNA, 20 bp, human
gtcccctcccgtggccgcag

SEQ ID NO: 260775 - DNA, 20 bp, human
gacccctgcggccacgggag

SEQ ID NO: 260776 - DNA, 20 bp, human
gagcgcgcgtctcgggactg

SEQ ID NO: 260777 - DNA, 20 bp, human
gaatgctgggaatgtgagtc

SEQ ID NO: 260778 - DNA, 20 bp, human
gcattcccgaggagccgcta

SEQ ID NO: 260779 - DNA, 20 bp, human
gcacgctcgcccgctcgcag

SEQ ID NO: 260780 - DNA, 20 bp, human
gtcccccctagcggctcctc

SEQ ID NO: 260781 - DNA, 20 bp, human
gagcgggcgagcgtgccggc

SEQ ID NO: 260782 - DNA, 20 bp, human
gagaagcggggcggggaaca

SEQ ID NO: 260783 - DNA, 20 bp, human
gcgtcggggatggaagattg

SEQ ID NO: 260784 - DNA, 20 bp, human
gccagccccgtcccccctag

SEQ ID NO: 260785 - DNA, 20 bp, human
ggggcccgggcgcctccgct

SEQ ID NO: 260786 - DNA, 20 bp, human
gggaccgcggaggtcgtggg

SEQ ID NO: 260787 - DNA, 20 bp, human
gggaggaccgcggaggtcgt

SEQ ID NO: 260788 - DNA, 20 bp, human
gtcagccccggagtccggaa

SEQ ID NO: 260789 - DNA, 20 bp, human
gacacagaagcgctcagtaa

SEQ ID NO: 260790 - DNA, 20 bp, human
gggagactgcgggtggagat

SEQ ID NO: 260791 - DNA, 20 bp, human
ggggccggacgaacggaagg

SEQ ID NO: 260792 - DNA, 20 bp, human
ggaagcccttccggactccg

SEQ ID NO: 260793 - DNA, 20 bp, human
gtctcagactcggcaatgat

SEQ ID NO: 260794 - DNA, 20 bp, human
ggcctcccgcacctgtggtc

SEQ ID NO: 260795 - DNA, 20 bp, human
gggagagtagagcatagagc

SEQ ID NO: 260796 - DNA, 20 bp, human
gcgtgcgcacggaaaagcga

SEQ ID NO: 260797 - DNA, 20 bp, human
ggggtcgtggacatcctcga

SEQ ID NO: 260798 - DNA, 20 bp, human
gggtgcgggaggcgtcactg

SEQ ID NO: 260799 - DNA, 20 bp, human
gcgtcactgaggatcgtcga

SEQ ID NO: 260800 - DNA, 20 bp, human
ggcgcacggaaaagcgaggg

SEQ ID NO: 260801 - DNA, 20 bp, human
gcctgcccgtcaatccgcta

SEQ ID NO: 260802 - DNA, 20 bp, human
gagcgagggcggctgactct

SEQ ID NO: 260803 - DNA, 20 bp, human
gggcggctgactctcgggtg

SEQ ID NO: 260804 - DNA, 20 bp, human
ggggatactgcgcgtgcgca

SEQ ID NO: 260805 - DNA, 20 bp, human
gtgacgggcaggttagccaa

SEQ ID NO: 260806 - DNA, 20 bp, human
gtttaattcgcgcactacac

SEQ ID NO: 260807 - DNA, 20 bp, human
gctaacagatcggcggtcgc

SEQ ID NO: 260808 - DNA, 20 bp, human
ggcacgagctaacagatcgg

SEQ ID NO: 260809 - DNA, 20 bp, human
ggtcgcacgagctaacagat

SEQ ID NO: 260810 - DNA, 20 bp, human
gccgccgcggcatccgctct

SEQ ID NO: 260811 - DNA, 20 bp, human
gctcgtgcgacccagcggcg

SEQ ID NO: 260812 - DNA, 20 bp, human
gcctctaggcgccgtgatgt

SEQ ID NO: 260813 - DNA, 20 bp, human
gctaggcgccgtgatgtggg

SEQ ID NO: 260814 - DNA, 20 bp, human
gtgacctgagtccatgggta

SEQ ID NO: 260815 - DNA, 20 bp, human
gccgcggcatccgctctggg

SEQ ID NO: 260816 - DNA, 20 bp, human
ggggccgaacgcagccgaag

SEQ ID NO: 260817 - DNA, 20 bp, human
gagcgcgcctgtcgtggcct

SEQ ID NO: 260818 - DNA, 20 bp, human
ggaagagagccgagtccgag

SEQ ID NO: 260819 - DNA, 20 bp, human
gctgagactgagatgatcgt

SEQ ID NO: 260820 - DNA, 20 bp, human
ggctccactcggctcttctt

SEQ ID NO: 260821 - DNA, 20 bp, human
gcgtggcctcggctcctctt

SEQ ID NO: 260822 - DNA, 20 bp, human
gagagccgagtccgagagga

SEQ ID NO: 260823 - DNA, 20 bp, human
gagccagccgaacgtagccg

SEQ ID NO: 260824 - DNA, 20 bp, human
gagctctcctcggctacgtt

SEQ ID NO: 260825 - DNA, 20 bp, human
ggctgccgtcctctcggact

SEQ ID NO: 260826 - DNA, 20 bp, human
ggtggtccgtgaactcccag

SEQ ID NO: 260827 - DNA, 20 bp, human
gagccctgaaaatatcttgg

SEQ ID NO: 260828 - DNA, 20 bp, human
gtataggaaaatatgtggat

SEQ ID NO: 260829 - DNA, 20 bp, human
gacaacatttggatatctac

SEQ ID NO: 260830 - DNA, 20 bp, human
gcagtgccatgaaagtgtac

SEQ ID NO: 260831 - DNA, 20 bp, human
gcttgcttttacgccatcac

SEQ ID NO: 260832 - DNA, 20 bp, human
ggcaccagcatgtacaatta

SEQ ID NO: 260833 - DNA, 20 bp, human
ggcgttgacatttccagtga

SEQ ID NO: 260834 - DNA, 20 bp, human
gaaaatatcttgggggcccc

SEQ ID NO: 260835 - DNA, 20 bp, human
gaccagtggttttctgggtg

SEQ ID NO: 260836 - DNA, 20 bp, human
ggagcgggcccatttttcat

SEQ ID NO: 260837 - DNA, 20 bp, human
ggcaagggccacgcaggcga

SEQ ID NO: 260838 - DNA, 20 bp, human
gcaccccggtcttccattag

SEQ ID NO: 260839 - DNA, 20 bp, human
gatggaagaccggggtgcaa

SEQ ID NO: 260840 - DNA, 20 bp, human
gcggacccaccagcgaaggc

SEQ ID NO: 260841 - DNA, 20 bp, human
gcccgccaacggccattctc

SEQ ID NO: 260842 - DNA, 20 bp, human
gcggggtgcaagggccacgc

SEQ ID NO: 260843 - DNA, 20 bp, human
gcgacacctcccgccttcgc

SEQ ID NO: 260844 - DNA, 20 bp, human
gacctcccgccttcgctggt

SEQ ID NO: 260845 - DNA, 20 bp, human
gcaaacgtctgcgccgctaa

SEQ ID NO: 260846 - DNA, 20 bp, human
gtgctcgcacgcaagtagaa

SEQ ID NO: 260847 - DNA, 20 bp, human
gccacccagctgaccggcag

SEQ ID NO: 260848 - DNA, 20 bp, human
gcgggcaagaccacgtggtt

SEQ ID NO: 260849 - DNA, 20 bp, human
gaagcacgggcaagaccacg

SEQ ID NO: 260850 - DNA, 20 bp, human
gtcagctgggtggcttgcga

SEQ ID NO: 260851 - DNA, 20 bp, human
ggagccaggcgcatgcgcca

SEQ ID NO: 260852 - DNA, 20 bp, human
gcccgtccctccaaaccacg

SEQ ID NO: 260853 - DNA, 20 bp, human
gagaaagctgtctccgctgc

SEQ ID NO: 260854 - DNA, 20 bp, human
gcaggtgcgcgcgtggcgga

SEQ ID NO: 260855 - DNA, 20 bp, human
ggtctccgctgccggtcagc

SEQ ID NO: 260856 - DNA, 20 bp, human
gtgctcgcacgcaagtagaa

SEQ ID NO: 260857 - DNA, 20 bp, human
gccacccagctgaccggcag

SEQ ID NO: 260858 - DNA, 20 bp, human
gcgggcaagaccacgtggtt

SEQ ID NO: 260859 - DNA, 20 bp, human
gaagcacgggcaagaccacg

SEQ ID NO: 260860 - DNA, 20 bp, human
gtcagctgggtggcttgcga

SEQ ID NO: 260861 - DNA, 20 bp, human
ggagccaggcgcatgcgcca

SEQ ID NO: 260862 - DNA, 20 bp, human
gcccgtccctccaaaccacg

SEQ ID NO: 260863 - DNA, 20 bp, human
gagaaagctgtctccgctgc

SEQ ID NO: 260864 - DNA, 20 bp, human
gcaggtgcgcgcgtggcgga

SEQ ID NO: 260865 - DNA, 20 bp, human
ggtctccgctgccggtcagc

SEQ ID NO: 260866 - DNA, 20 bp, human
gagcacactccgtgtctcga

SEQ ID NO: 260867 - DNA, 20 bp, human
ggatctctgccttcgagaca

SEQ ID NO: 260868 - DNA, 20 bp, human
gcgcaggcgcccaccgtcat

SEQ ID NO: 260869 - DNA, 20 bp, human
gtgagccccgcccatgacgg

SEQ ID NO: 260870 - DNA, 20 bp, human
gtcccggcgcgcgtaggcgc

SEQ ID NO: 260871 - DNA, 20 bp, human
ggcgtcgcagcgcgtggtcg

SEQ ID NO: 260872 - DNA, 20 bp, human
gcggggcagggtatggttgg

SEQ ID NO: 260873 - DNA, 20 bp, human
gcggccgcgaggccgtcggt

SEQ ID NO: 260874 - DNA, 20 bp, human
ggctctgtgcgccgtggaga

SEQ ID NO: 260875 - DNA, 20 bp, human
ggcctgagccccgcccatga

SEQ ID NO: 260876 - DNA, 20 bp, human
ggcgacccccaaatcttcct

SEQ ID NO: 260877 - DNA, 20 bp, human
ggggagttgcgagtgtcgcg

SEQ ID NO: 260878 - DNA, 20 bp, human
gtaaagggccgctgaggcgg

SEQ ID NO: 260879 - DNA, 20 bp, human
ggggacccaagcagaacggg

SEQ ID NO: 260880 - DNA, 20 bp, human
ggggctcccgaattgtcatt

SEQ ID NO: 260881 - DNA, 20 bp, human
gaccgggttggaatttgcgg

SEQ ID NO: 260882 - DNA, 20 bp, human
gtccctctgaggccagtagc

SEQ ID NO: 260883 - DNA, 20 bp, human
ggggggcatggagaatgcgg

SEQ ID NO: 260884 - DNA, 20 bp, human
gcggagcggcggcagagcca

SEQ ID NO: 260885 - DNA, 20 bp, human
gcctcagagggaagagacat

SEQ ID NO: 260886 - DNA, 20 bp, human
ggtgagcgccgttactagaa

SEQ ID NO: 260887 - DNA, 20 bp, human
gctgacttctccgcctcggt

SEQ ID NO: 260888 - DNA, 20 bp, human
gggcagcgctggaaactggg

SEQ ID NO: 260889 - DNA, 20 bp, human
gcgaggcggagaagtcaggt

SEQ ID NO: 260890 - DNA, 20 bp, human
gtagaagggctccaggatgg

SEQ ID NO: 260891 - DNA, 20 bp, human
gcccagagccgggccgggta

SEQ ID NO: 260892 - DNA, 20 bp, human
gccgacccagcccaccgagg

SEQ ID NO: 260893 - DNA, 20 bp, human
gagagtgaaggggtcgacag

SEQ ID NO: 260894 - DNA, 20 bp, human
gggtcagtcggtgatatatc

SEQ ID NO: 260895 - DNA, 20 bp, human
ggctccgatgccagagtgaa

SEQ ID NO: 260896 - DNA, 20 bp, human
gcacctgagagtagtggttg

SEQ ID NO: 260897 - DNA, 20 bp, human
gagggaggatgacttcctga

SEQ ID NO: 260898 - DNA, 20 bp, human
gctggagcacctgagagtag

SEQ ID NO: 260899 - DNA, 20 bp, human
gtggaagcaggggtctcaga

SEQ ID NO: 260900 - DNA, 20 bp, human
gagcccctcccgggccctaa

SEQ ID NO: 260901 - DNA, 20 bp, human
gcccacctcccggagggaga

SEQ ID NO: 260902 - DNA, 20 bp, human
ggagcggcaggaggaccgtc

SEQ ID NO: 260903 - DNA, 20 bp, human
gactctcaggtgctccaggg

SEQ ID NO: 260904 - DNA, 20 bp, human
gaattggcccgagggaggag

SEQ ID NO: 260905 - DNA, 20 bp, human
ggtgcccagagtttcataat

SEQ ID NO: 260906 - DNA, 20 bp, human
gcactcacacacacgctcgt

SEQ ID NO: 260907 - DNA, 20 bp, human
ggggtcatgaccctagtcag

SEQ ID NO: 260908 - DNA, 20 bp, human
gcgtcggcgcgcagccactg

SEQ ID NO: 260909 - DNA, 20 bp, human
ggcgcgcagccactgaggac

SEQ ID NO: 260910 - DNA, 20 bp, human
gagagccggccggtcctcag

SEQ ID NO: 260911 - DNA, 20 bp, human
ggcccctttaagcccagagc

SEQ ID NO: 260912 - DNA, 20 bp, human
gggccggctctgggcttaaa

SEQ ID NO: 260913 - DNA, 20 bp, human
ggcagccactgaggaccggc

SEQ ID NO: 260914 - DNA, 20 bp, human
gtgtctccatggcgacgcgg

SEQ ID NO: 260915 - DNA, 20 bp, human
ggacgcggcggtgacgtcgc

SEQ ID NO: 260916 - DNA, 20 bp, human
gaaaaggcatcaattgggat

SEQ ID NO: 260917 - DNA, 20 bp, human
gctgtccagcccaaagaaac

SEQ ID NO: 260918 - DNA, 20 bp, human
gcccaaagaaacaggatatt

SEQ ID NO: 260919 - DNA, 20 bp, human
gactccgcatggcttcacac

SEQ ID NO: 260920 - DNA, 20 bp, human
gagtgcagtgtgtcacacgg

SEQ ID NO: 260921 - DNA, 20 bp, human
ggtgtcacacggcggcacac

SEQ ID NO: 260922 - DNA, 20 bp, human
gcgaagaattgggctgcgaa

SEQ ID NO: 260923 - DNA, 20 bp, human
gggcaggaagaggtttctat

SEQ ID NO: 260924 - DNA, 20 bp, human
gctgccacagcaggtgtgac

SEQ ID NO: 260925 - DNA, 20 bp, human
gtggggtgccctcaacgcct

SEQ ID NO: 260926 - DNA, 20 bp, human
gcagcacgcgactactggag

SEQ ID NO: 260927 - DNA, 20 bp, human
ggagagagtccggccccagc

SEQ ID NO: 260928 - DNA, 20 bp, human
ggaacccagcacgcgactac

SEQ ID NO: 260929 - DNA, 20 bp, human
gtgcccgggacctcggtcgt

SEQ ID NO: 260930 - DNA, 20 bp, human
gggcaccgcgcctctccctc

SEQ ID NO: 260931 - DNA, 20 bp, human
gaaagcgaccccgagttagg

SEQ ID NO: 260932 - DNA, 20 bp, human
gctaaaagcgaccccgagtt

SEQ ID NO: 260933 - DNA, 20 bp, human
gtgcgcgctcctcctaactc

SEQ ID NO: 260934 - DNA, 20 bp, human
gcgcgactactggaggggcg

SEQ ID NO: 260935 - DNA, 20 bp, human
gcagttctcatcagcatcga

SEQ ID NO: 260936 - DNA, 20 bp, human
gacgctccgcgcagcccatt

SEQ ID NO: 260937 - DNA, 20 bp, human
gggcccctttaaccgggtgg

SEQ ID NO: 260938 - DNA, 20 bp, human
ggggaaggggcggagagtcg

SEQ ID NO: 260939 - DNA, 20 bp, human
gagagtcgaggctgtcggaa

SEQ ID NO: 260940 - DNA, 20 bp, human
gccttccgccacccggttaa

SEQ ID NO: 260941 - DNA, 20 bp, human
gcccgcgggcccctttaacc

SEQ ID NO: 260942 - DNA, 20 bp, human
gtgcgcggagcgtcacttcc

SEQ ID NO: 260943 - DNA, 20 bp, human
gggcgagtggcgagtgtcag

SEQ ID NO: 260944 - DNA, 20 bp, human
gtgagggcctaatactgtgg

SEQ ID NO: 260945 - DNA, 20 bp, human
gccgggcgggcggcgcccaa

SEQ ID NO: 260946 - DNA, 20 bp, human
gacgtgcttagggaatgaag

SEQ ID NO: 260947 - DNA, 20 bp, human
gagtccggttctgtttctat

SEQ ID NO: 260948 - DNA, 20 bp, human
gtaaaagaggcgtgcctaca

SEQ ID NO: 260949 - DNA, 20 bp, human
ggcgtgcctacagggaaatg

SEQ ID NO: 260950 - DNA, 20 bp, human
gtaagcacgtcgtaagcaaa

SEQ ID NO: 260951 - DNA, 20 bp, human
gagaaacagaaccggactgg

SEQ ID NO: 260952 - DNA, 20 bp, human
gcttagggaatgaagaggcg

SEQ ID NO: 260953 - DNA, 20 bp, human
gtgcaacctcatttccctgt

SEQ ID NO: 260954 - DNA, 20 bp, human
gagtaatgaaatacggtgtg

SEQ ID NO: 260955 - DNA, 20 bp, human
ggcacaggtgatatgcatta

SEQ ID NO: 260956 - DNA, 20 bp, human
gcccccttgcgcgggcaatt

SEQ ID NO: 260957 - DNA, 20 bp, human
gggggcgtggcagcatcgtt

SEQ ID NO: 260958 - DNA, 20 bp, human
gcccgggcctccgctgtccg

SEQ ID NO: 260959 - DNA, 20 bp, human
gaaaggtggggccaagcgtg

SEQ ID NO: 260960 - DNA, 20 bp, human
gccggaagagggagtctgta

SEQ ID NO: 260961 - DNA, 20 bp, human
ggggtctggaagctactgcc

SEQ ID NO: 260962 - DNA, 20 bp, human
gttgcgcgggcaattgggtc

SEQ ID NO: 260963 - DNA, 20 bp, human
gctgccacgcccccttgcgc

SEQ ID NO: 260964 - DNA, 20 bp, human
gtgtaagagaacgcggctaa

SEQ ID NO: 260965 - DNA, 20 bp, human
ggcgtggcagcatcgttggg

SEQ ID NO: 260966 - DNA, 20 bp, human
gtacaaccgacctccggccc

SEQ ID NO: 260967 - DNA, 20 bp, human
ggcggcaacgtaagtatcct

SEQ ID NO: 260968 - DNA, 20 bp, human
ggataaaggcaaaaaggtaa

SEQ ID NO: 260969 - DNA, 20 bp, human
gccgggttacaaccgacctc

SEQ ID NO: 260970 - DNA, 20 bp, human
gatacggctcaagtgatcac

SEQ ID NO: 260971 - DNA, 20 bp, human
gagggggtggttagacaatc

SEQ ID NO: 260972 - DNA, 20 bp, human
ggcaacgcaaaagagccttt

SEQ ID NO: 260973 - DNA, 20 bp, human
gtgtgcctctatgatccaaa

SEQ ID NO: 260974 - DNA, 20 bp, human
gttgccgccatttttgagta

SEQ ID NO: 260975 - DNA, 20 bp, human
gtagccctactcaaaaatgg

SEQ ID NO: 260976 - DNA, 20 bp, human
gaggcgcgccggtgagaaga

SEQ ID NO: 260977 - DNA, 20 bp, human
gggagggaggacgaacaaga

SEQ ID NO: 260978 - DNA, 20 bp, human
ggggcgtggccggccgtagg

SEQ ID NO: 260979 - DNA, 20 bp, human
gggtgctaccctccagtgac

SEQ ID NO: 260980 - DNA, 20 bp, human
gccggtgagaagacggggcg

SEQ ID NO: 260981 - DNA, 20 bp, human
gaaggatctagtccagtcac

SEQ ID NO: 260982 - DNA, 20 bp, human
ggaacaagagggaggcgcgc

SEQ ID NO: 260983 - DNA, 20 bp, human
ggccagcgccgcagtccaca

SEQ ID NO: 260984 - DNA, 20 bp, human
gctgacgggaacacacgtgc

SEQ ID NO: 260985 - DNA, 20 bp, human
gcgccgcagtccacaggggg

SEQ ID NO: 260986 - DNA, 20 bp, human
gggcgtctgcctggcaaaga

SEQ ID NO: 260987 - DNA, 20 bp, human
gagcccgcgaggctgagggg

SEQ ID NO: 260988 - DNA, 20 bp, human
gcgtggggagtggttttagg

SEQ ID NO: 260989 - DNA, 20 bp, human
ggctgaggggcggttgttgt

SEQ ID NO: 260990 - DNA, 20 bp, human
ggaaggaaggtgctgccgag

SEQ ID NO: 260991 - DNA, 20 bp, human
ggcagaagagaagacgggcg

SEQ ID NO: 260992 - DNA, 20 bp, human
gaggcggcacgcgggggaat

SEQ ID NO: 260993 - DNA, 20 bp, human
ggagaatccggtaaccgatg

SEQ ID NO: 260994 - DNA, 20 bp, human
gtcggttaccggattctcaa

SEQ ID NO: 260995 - DNA, 20 bp, human
gttgttggcagctgtggcta

SEQ ID NO: 260996 - DNA, 20 bp, human
ggcgggagagcgagcgtttg

SEQ ID NO: 260997 - DNA, 20 bp, human
gcccgccgacatgcgcgcta

SEQ ID NO: 260998 - DNA, 20 bp, human
gactgcagcccattggtcaa

SEQ ID NO: 260999 - DNA, 20 bp, human
gtggtcaaaggggtcggcag

SEQ ID NO: 261000 - DNA, 20 bp, human
ggcgctaaggtatgtcaaga

SEQ ID NO: 261001 - DNA, 20 bp, human
ggccgacccctttgaccaat

SEQ ID NO: 261002 - DNA, 20 bp, human
gagagtgcgcggaggtgagt

SEQ ID NO: 261003 - DNA, 20 bp, human
gacaagtcccataaggccgg

SEQ ID NO: 261004 - DNA, 20 bp, human
gaccttagcgcgcatgtcgg

SEQ ID NO: 261005 - DNA, 20 bp, human
gtcccggccgccggccttat

SEQ ID NO: 261006 - DNA, 20 bp, human
ggggctcccagaggcgggtc

SEQ ID NO: 261007 - DNA, 20 bp, human
gtggagcatgcgcggaggga

SEQ ID NO: 261008 - DNA, 20 bp, human
gcgtggcggggtcccgtatt

SEQ ID NO: 261009 - DNA, 20 bp, human
gctacatcacggccgtagat

SEQ ID NO: 261010 - DNA, 20 bp, human
gagtctgtaggcgtgtcgcg

SEQ ID NO: 261011 - DNA, 20 bp, human
gtggctgatatcgagtctgt

SEQ ID NO: 261012 - DNA, 20 bp, human
ggctgtggagcatgcgcgga

SEQ ID NO: 261013 - DNA, 20 bp, human
ggacccaggagggcggaacc

SEQ ID NO: 261014 - DNA, 20 bp, human
ggcggcggtgcgggctcttg

SEQ ID NO: 261015 - DNA, 20 bp, human
gggaatgcccaatccgaata

SEQ ID NO: 261016 - DNA, 20 bp, human
ggaggactgctttagatcta

SEQ ID NO: 261017 - DNA, 20 bp, human
gataaacagctcctggagag

SEQ ID NO: 261018 - DNA, 20 bp, human
ggaggtcataatgaggaatt

SEQ ID NO: 261019 - DNA, 20 bp, human
ggtaaggtaattgcagtttg

SEQ ID NO: 261020 - DNA, 20 bp, human
gaccaagggaggtcataatg

SEQ ID NO: 261021 - DNA, 20 bp, human
gggtaattgcagtttgtggt

SEQ ID NO: 261022 - DNA, 20 bp, human
ggtgcattgagtcagtctac

SEQ ID NO: 261023 - DNA, 20 bp, human
gggacattttgtgatgtcac

SEQ ID NO: 261024 - DNA, 20 bp, human
ggcactgatgtcaccaaggg

SEQ ID NO: 261025 - DNA, 20 bp, human
gtcctcattatgacctccct

SEQ ID NO: 261026 - DNA, 20 bp, human
gtcgcggtggggatcgaaag

SEQ ID NO: 261027 - DNA, 20 bp, human
gcggtggggatcgaaagcgg

SEQ ID NO: 261028 - DNA, 20 bp, human
gacgtcccggcccccgtagg

SEQ ID NO: 261029 - DNA, 20 bp, human
gggacgcagctctggagacg

SEQ ID NO: 261030 - DNA, 20 bp, human
gcctgcgcgtctctcgtttt

SEQ ID NO: 261031 - DNA, 20 bp, human
ggacggctgcagcatcgcgg

SEQ ID NO: 261032 - DNA, 20 bp, human
gcggagccgtccgcctacgg

SEQ ID NO: 261033 - DNA, 20 bp, human
gcccggcccccgtaggcgga

SEQ ID NO: 261034 - DNA, 20 bp, human
gagacgcgcaggcgacgtcc

SEQ ID NO: 261035 - DNA, 20 bp, human
gcgcgtctctcgttttcgga

SEQ ID NO: 261036 - DNA, 20 bp, human
ggccgcgcaggctcctttgg

SEQ ID NO: 261037 - DNA, 20 bp, human
ggcccgcggctagtgagacg

SEQ ID NO: 261038 - DNA, 20 bp, human
gcactgctggttaactgctt

SEQ ID NO: 261039 - DNA, 20 bp, human
gcggggccggctgttggcgg

SEQ ID NO: 261040 - DNA, 20 bp, human
gagtgagacggggagcgcat

SEQ ID NO: 261041 - DNA, 20 bp, human
gcccgcgcagccgcagtgct

SEQ ID NO: 261042 - DNA, 20 bp, human
gcgggagtcggctgcacgtg

SEQ ID NO: 261043 - DNA, 20 bp, human
gtatgcggagccccactgtg

SEQ ID NO: 261044 - DNA, 20 bp, human
ggacgcacacggcgtagccc

SEQ ID NO: 261045 - DNA, 20 bp, human
ggcctccaaaggagcctgcg

SEQ ID NO: 261046 - DNA, 20 bp, human
gaccgcaccgaccaagtcgc

SEQ ID NO: 261047 - DNA, 20 bp, human
gggatcgcccgcgacttggt

SEQ ID NO: 261048 - DNA, 20 bp, human
gatacccaagaccgaggtcc

SEQ ID NO: 261049 - DNA, 20 bp, human
ggcccgcgacttggtcggtg

SEQ ID NO: 261050 - DNA, 20 bp, human
ggatggcgtcatcgaagcga

SEQ ID NO: 261051 - DNA, 20 bp, human
gagtcgcgggcgatccctgg

SEQ ID NO: 261052 - DNA, 20 bp, human
ggatccctggcggccagcta

SEQ ID NO: 261053 - DNA, 20 bp, human
ggggatgagggcggtgttgg

SEQ ID NO: 261054 - DNA, 20 bp, human
gtcggtgcggtcctggacct

SEQ ID NO: 261055 - DNA, 20 bp, human
ggtcttgggtatccgtcctg

SEQ ID NO: 261056 - DNA, 20 bp, human
gggccgcagtgggaaaaccc

SEQ ID NO: 261057 - DNA, 20 bp, human
gaaaaccctgggcgccctct

SEQ ID NO: 261058 - DNA, 20 bp, human
ggagttaggccggccgcagt

SEQ ID NO: 261059 - DNA, 20 bp, human
gtctcagcgtcccattagga

SEQ ID NO: 261060 - DNA, 20 bp, human
gagcgcggaaccgtcctaat

SEQ ID NO: 261061 - DNA, 20 bp, human
gtgggtctcagcgtcccatt

SEQ ID NO: 261062 - DNA, 20 bp, human
ggggcgggcccggctggcta

SEQ ID NO: 261063 - DNA, 20 bp, human
gcagccgctcctggggccag

SEQ ID NO: 261064 - DNA, 20 bp, human
gtgctgcggcggagttaggc

SEQ ID NO: 261065 - DNA, 20 bp, human
gcccaaggccacaacctcgc

SEQ ID NO: 261066 - DNA, 20 bp, human
gaggaggctcccaaaaatga

SEQ ID NO: 261067 - DNA, 20 bp, human
gtggcagcattggaggaaaa

SEQ ID NO: 261068 - DNA, 20 bp, human
gggcaaacgtgcctcctacc

SEQ ID NO: 261069 - DNA, 20 bp, human
gtatcaggggcatacagaca

SEQ ID NO: 261070 - DNA, 20 bp, human
gtgagtatgactgaccgggt

SEQ ID NO: 261071 - DNA, 20 bp, human
gtatcagaaggcacatgtca

SEQ ID NO: 261072 - DNA, 20 bp, human
gccactgagtatgactgacc

SEQ ID NO: 261073 - DNA, 20 bp, human
gcatcagagggaattactat

SEQ ID NO: 261074 - DNA, 20 bp, human
gaaagaaggtggttaattgg

SEQ ID NO: 261075 - DNA, 20 bp, human
gcagacagggtgtggcttgc

SEQ ID NO: 261076 - DNA, 20 bp, human
ggccctagccagtcccgcga

SEQ ID NO: 261077 - DNA, 20 bp, human
gaccgccggcggtgaagggg

SEQ ID NO: 261078 - DNA, 20 bp, human
ggggagacttccgccctcgc

SEQ ID NO: 261079 - DNA, 20 bp, human
ggccctcgcgggactggcta

SEQ ID NO: 261080 - DNA, 20 bp, human
gacttccgccctcgcgggac

SEQ ID NO: 261081 - DNA, 20 bp, human
gcggtaggaagtgcccgcca

SEQ ID NO: 261082 - DNA, 20 bp, human
gctaccgtacgaggcgcagg

SEQ ID NO: 261083 - DNA, 20 bp, human
gttgaccgccggcggtgaag

SEQ ID NO: 261084 - DNA, 20 bp, human
ggcctccccttcaccgccgg

SEQ ID NO: 261085 - DNA, 20 bp, human
gggctagggcgtttgaccgc

SEQ ID NO: 261086 - DNA, 20 bp, human
gagttccctggcagagttaa

SEQ ID NO: 261087 - DNA, 20 bp, human
gagcttgtcagtccccctct

SEQ ID NO: 261088 - DNA, 20 bp, human
gcaacaaagaaggtggtgat

SEQ ID NO: 261089 - DNA, 20 bp, human
gacaatgggccattatgaaa

SEQ ID NO: 261090 - DNA, 20 bp, human
gcaaaaatctctgttcccag

SEQ ID NO: 261091 - DNA, 20 bp, human
gctctctggattaaagctgt

SEQ ID NO: 261092 - DNA, 20 bp, human
ggattcttgctcatggctcc

SEQ ID NO: 261093 - DNA, 20 bp, human
gaattgtggctcctgttaca

SEQ ID NO: 261094 - DNA, 20 bp, human
gaaagaaggtggtgattggc

SEQ ID NO: 261095 - DNA, 20 bp, human
ggatgcctttaactctgcca

SEQ ID NO: 261096 - DNA, 20 bp, human
gcgccaagacccagcttctt

SEQ ID NO: 261097 - DNA, 20 bp, human
ggcagggccgacccagcagc

SEQ ID NO: 261098 - DNA, 20 bp, human
ggggccaatcagaagaagtt

SEQ ID NO: 261099 - DNA, 20 bp, human
gtgccaaagaagctgggtct

SEQ ID NO: 261100 - DNA, 20 bp, human
gggaaaagccctgcgggaga

SEQ ID NO: 261101 - DNA, 20 bp, human
gggtcttggcgcggcgggac

SEQ ID NO: 261102 - DNA, 20 bp, human
ggcgcctcctagtgagcgga

SEQ ID NO: 261103 - DNA, 20 bp, human
gagcttctttggcagttctc

SEQ ID NO: 261104 - DNA, 20 bp, human
gagggctggaaaagccctgc

SEQ ID NO: 261105 - DNA, 20 bp, human
gcggcggccggggctgtcgc

SEQ ID NO: 261106 - DNA, 20 bp, human
gcccgggcggggatgtggga

SEQ ID NO: 261107 - DNA, 20 bp, human
gacggggcggggccaatcta

SEQ ID NO: 261108 - DNA, 20 bp, human
gcaatctaggggcgtgttcg

SEQ ID NO: 261109 - DNA, 20 bp, human
gttcgctcatgaggcgtcgg

SEQ ID NO: 261110 - DNA, 20 bp, human
gcccgcccggggcacgccct

SEQ ID NO: 261111 - DNA, 20 bp, human
gggcgtgttcggggcggaga

SEQ ID NO: 261112 - DNA, 20 bp, human
gcagatgccagcaccgcctt

SEQ ID NO: 261113 - DNA, 20 bp, human
ggcggcacccagcgcttata

SEQ ID NO: 261114 - DNA, 20 bp, human
gcgggccgagggcgtgcccc

SEQ ID NO: 261115 - DNA, 20 bp, human
gtctaggggcgtgttcgggg

SEQ ID NO: 261116 - DNA, 20 bp, human
gtgactgggacgcgaggatg

SEQ ID NO: 261117 - DNA, 20 bp, human
ggggacgcgaggatgcggct

SEQ ID NO: 261118 - DNA, 20 bp, human
gtcaccccaccaaacacggt

SEQ ID NO: 261119 - DNA, 20 bp, human
ggaaagcgccccaccgtgtt

SEQ ID NO: 261120 - DNA, 20 bp, human
gagaagggcggggatcggcg

SEQ ID NO: 261121 - DNA, 20 bp, human
gtccccgcccgacccggaga

SEQ ID NO: 261122 - DNA, 20 bp, human
ggcgccccaccgtgtttggt

SEQ ID NO: 261123 - DNA, 20 bp, human
gtgggcctgcaaccccagcc

SEQ ID NO: 261124 - DNA, 20 bp, human
gagatcaggcggatctgtat

SEQ ID NO: 261125 - DNA, 20 bp, human
gggacagagcgctcccttgg

SEQ ID NO: 261126 - DNA, 20 bp, human
ggactcccgcgcagggtctg

SEQ ID NO: 261127 - DNA, 20 bp, human
gagcgagagcgaaagccgga

SEQ ID NO: 261128 - DNA, 20 bp, human
gcaaccccgcaggaaaacac

SEQ ID NO: 261129 - DNA, 20 bp, human
gggtctggggttgtgcgcgt

SEQ ID NO: 261130 - DNA, 20 bp, human
ggagatacggaaggattggc

SEQ ID NO: 261131 - DNA, 20 bp, human
gtctcgcattgagatacgga

SEQ ID NO: 261132 - DNA, 20 bp, human
gtcacgcggcgggaaggaac

SEQ ID NO: 261133 - DNA, 20 bp, human
gcattgagatacggaaggat

SEQ ID NO: 261134 - DNA, 20 bp, human
ggggggcgtcagggagccgg

SEQ ID NO: 261135 - DNA, 20 bp, human
gggcgcgggcgcagcggacc

SEQ ID NO: 261136 - DNA, 20 bp, human
gcgggcgagttaggaacgga

SEQ ID NO: 261137 - DNA, 20 bp, human
ggctgaggacctctctgcgt

SEQ ID NO: 261138 - DNA, 20 bp, human
gcgggcctccaaaacaccgg

SEQ ID NO: 261139 - DNA, 20 bp, human
gcccaagcgcggggccttgt

SEQ ID NO: 261140 - DNA, 20 bp, human
ggccgctgaacgagaggact

SEQ ID NO: 261141 - DNA, 20 bp, human
gccgcctgggggatgaagtg

SEQ ID NO: 261142 - DNA, 20 bp, human
gcgagcgactccagggtcag

SEQ ID NO: 261143 - DNA, 20 bp, human
gcccgagtcctctcgttcag

SEQ ID NO: 261144 - DNA, 20 bp, human
gtcgggaactacaactgcga

SEQ ID NO: 261145 - DNA, 20 bp, human
gccaaggggacggttcccag

SEQ ID NO: 261146 - DNA, 20 bp, human
gaaagaatgcactaaattgg

SEQ ID NO: 261147 - DNA, 20 bp, human
gcccggaaaagagtacaggg

SEQ ID NO: 261148 - DNA, 20 bp, human
gactgcccggaaaagagtac

SEQ ID NO: 261149 - DNA, 20 bp, human
gtgcactaaattggaggcag

SEQ ID NO: 261150 - DNA, 20 bp, human
gaacaaactggagagactgc

SEQ ID NO: 261151 - DNA, 20 bp, human
gtaaaagaagtacaacaaac

SEQ ID NO: 261152 - DNA, 20 bp, human
gcagaaacacccagagtaac

SEQ ID NO: 261153 - DNA, 20 bp, human
gaagaaaagccagttactct

SEQ ID NO: 261154 - DNA, 20 bp, human
gcctgttctgggaagtatga

SEQ ID NO: 261155 - DNA, 20 bp, human
gctctggaacattcatgttt

SEQ ID NO: 261156 - DNA, 20 bp, human
gactcggcgaagctcgcgta

SEQ ID NO: 261157 - DNA, 20 bp, human
gcactcgccgagtcttccgg

SEQ ID NO: 261158 - DNA, 20 bp, human
gacgttgcgggcgggaaaat

SEQ ID NO: 261159 - DNA, 20 bp, human
gctcacgtggacaccccagg

SEQ ID NO: 261160 - DNA, 20 bp, human
gtggccccgcccttttaccc

SEQ ID NO: 261161 - DNA, 20 bp, human
gaaagggcggggccacgttg

SEQ ID NO: 261162 - DNA, 20 bp, human
gggaggctcccatctgtcta

SEQ ID NO: 261163 - DNA, 20 bp, human
gcgcgtagggcctgggtaaa

SEQ ID NO: 261164 - DNA, 20 bp, human
gcggaactgggcggacccgc

SEQ ID NO: 261165 - DNA, 20 bp, human
ggggcctgggtaaaagggcg

SEQ ID NO: 261166 - DNA, 20 bp, human
gcgcagaggactcagtggac

SEQ ID NO: 261167 - DNA, 20 bp, human
gccggggccgagagcccaat

SEQ ID NO: 261168 - DNA, 20 bp, human
ggccgagagcccaatgggaa

SEQ ID NO: 261169 - DNA, 20 bp, human
gtctgcgcgcggggtcctgt

SEQ ID NO: 261170 - DNA, 20 bp, human
ggtcctgtgggatagaaggg

SEQ ID NO: 261171 - DNA, 20 bp, human
gccgcgcgcagaggactcag

SEQ ID NO: 261172 - DNA, 20 bp, human
gacggacgacgtgcggggtg

SEQ ID NO: 261173 - DNA, 20 bp, human
gcggggtcctgtgggataga

SEQ ID NO: 261174 - DNA, 20 bp, human
gtcccgaagtgcaccgaggt

SEQ ID NO: 261175 - DNA, 20 bp, human
gctccgcccttctatcccac

SEQ ID NO: 261176 - DNA, 20 bp, human
gagggcgcgcgccgcttaaa

SEQ ID NO: 261177 - DNA, 20 bp, human
gcctctccgggagacaaagc

SEQ ID NO: 261178 - DNA, 20 bp, human
gtctcccggagaggcgtctc

SEQ ID NO: 261179 - DNA, 20 bp, human
gcggcgcaacgcctcggcca

SEQ ID NO: 261180 - DNA, 20 bp, human
gaagcggcgcgcgccctgat

SEQ ID NO: 261181 - DNA, 20 bp, human
ggcagcgccgcgatacgcca

SEQ ID NO: 261182 - DNA, 20 bp, human
ggggcagtgaaggatagtgt

SEQ ID NO: 261183 - DNA, 20 bp, human
gctcctcccgcagccaatca

SEQ ID NO: 261184 - DNA, 20 bp, human
ggcttaaaggggcgatgccg

SEQ ID NO: 261185 - DNA, 20 bp, human
gcacggctcaggcagaggag

SEQ ID NO: 261186 - DNA, 20 bp, human
gggcaaatgccgtctgggga

SEQ ID NO: 261187 - DNA, 20 bp, human
gacaaggcaaatgccgtctg

SEQ ID NO: 261188 - DNA, 20 bp, human
ggctctgcctgaaaaggctt

SEQ ID NO: 261189 - DNA, 20 bp, human
ggtgaaccctaagccttttc

SEQ ID NO: 261190 - DNA, 20 bp, human
gctacaggatagctggaata

SEQ ID NO: 261191 - DNA, 20 bp, human
gttcagacggttgccttaca

SEQ ID NO: 261192 - DNA, 20 bp, human
gaggaagcacaggaggtttg

SEQ ID NO: 261193 - DNA, 20 bp, human
ggctcacattttatttcaga

SEQ ID NO: 261194 - DNA, 20 bp, human
gtgctagaaaggtaaaatac

SEQ ID NO: 261195 - DNA, 20 bp, human
ggaactgcgatgtgctagaa

SEQ ID NO: 261196 - DNA, 20 bp, human
gtgggctgtctgctgtgcag

SEQ ID NO: 261197 - DNA, 20 bp, human
gaggagagggcccccagctc

SEQ ID NO: 261198 - DNA, 20 bp, human
gtgataagatctccgaagct

SEQ ID NO: 261199 - DNA, 20 bp, human
gaagctggttctgttagagt

SEQ ID NO: 261200 - DNA, 20 bp, human
gaaaagcaagcagttctatc

SEQ ID NO: 261201 - DNA, 20 bp, human
gggaggccattaggttaagc

SEQ ID NO: 261202 - DNA, 20 bp, human
gcagaaccagcttaacctaa

SEQ ID NO: 261203 - DNA, 20 bp, human
gcgcctgacattcctgagct

SEQ ID NO: 261204 - DNA, 20 bp, human
gagcaagcagttctatcagg

SEQ ID NO: 261205 - DNA, 20 bp, human
ggttctatcaggaggccatt

SEQ ID NO: 261206 - DNA, 20 bp, human
gctaggcaggcagtggacac

SEQ ID NO: 261207 - DNA, 20 bp, human
gcagggaagactctgggcga

SEQ ID NO: 261208 - DNA, 20 bp, human
gccccaggggagaaaccgag

SEQ ID NO: 261209 - DNA, 20 bp, human
gtcggcgcagggaagactct

SEQ ID NO: 261210 - DNA, 20 bp, human
gcctcgtcccgaagtttcct

SEQ ID NO: 261211 - DNA, 20 bp, human
gctcctgcccagggtacctg

SEQ ID NO: 261212 - DNA, 20 bp, human
ggctggacgggcccagccat

SEQ ID NO: 261213 - DNA, 20 bp, human
gtgagagcctaggcgccaag

SEQ ID NO: 261214 - DNA, 20 bp, human
gtccactgcctgcctaggtc

SEQ ID NO: 261215 - DNA, 20 bp, human
gggcaggcagtggacacagg

SEQ ID NO: 261216 - DNA, 20 bp, human
gacccaggctagttgagacc

SEQ ID NO: 261217 - DNA, 20 bp, human
gcccaggtctcaactagcct

SEQ ID NO: 261218 - DNA, 20 bp, human
gtaacattaggtctgcatgt

SEQ ID NO: 261219 - DNA, 20 bp, human
gtgtgaccctggctagtata

SEQ ID NO: 261220 - DNA, 20 bp, human
gctggagagatgggtcaccc

SEQ ID NO: 261221 - DNA, 20 bp, human
gtagtataagggttgattac

SEQ ID NO: 261222 - DNA, 20 bp, human
ggattctgttgttggttctt

SEQ ID NO: 261223 - DNA, 20 bp, human
gataagggttgattactgga

SEQ ID NO: 261224 - DNA, 20 bp, human
gttccataaaggagagaccc

SEQ ID NO: 261225 - DNA, 20 bp, human
ggaaactttgatagctgtcg

SEQ ID NO: 261226 - DNA, 20 bp, human
gaaaaaaaagccacacccct

SEQ ID NO: 261227 - DNA, 20 bp, human
gatgttctgggaagtcattt

SEQ ID NO: 261228 - DNA, 20 bp, human
gtctgggaagtcatttgggc

SEQ ID NO: 261229 - DNA, 20 bp, human
gagaacatgcttactaataa

SEQ ID NO: 261230 - DNA, 20 bp, human
gggttctcattaaaagggtc

SEQ ID NO: 261231 - DNA, 20 bp, human
gatgtcaggttctcattaaa

SEQ ID NO: 261232 - DNA, 20 bp, human
gaaatctccacccaggggtg

SEQ ID NO: 261233 - DNA, 20 bp, human
ggagatatgtgatgtgtgca

SEQ ID NO: 261234 - DNA, 20 bp, human
gtactaataatggctgtgca

SEQ ID NO: 261235 - DNA, 20 bp, human
gcttcatgaataatcatgtc

SEQ ID NO: 261236 - DNA, 20 bp, human
gcagtggctagccgtcccga

SEQ ID NO: 261237 - DNA, 20 bp, human
gggagaaaactgtcctcgtg

SEQ ID NO: 261238 - DNA, 20 bp, human
gtttgcctgcaactatccaa

SEQ ID NO: 261239 - DNA, 20 bp, human
gtaaaacaacccctagtata

SEQ ID NO: 261240 - DNA, 20 bp, human
gaggggattaccctatacta

SEQ ID NO: 261241 - DNA, 20 bp, human
gtcagcaggagaaacagaat

SEQ ID NO: 261242 - DNA, 20 bp, human
gactgccggggtcatcagaa

SEQ ID NO: 261243 - DNA, 20 bp, human
gcagaatggggaacctcacg

SEQ ID NO: 261244 - DNA, 20 bp, human
ggacggctagccactgaaga

SEQ ID NO: 261245 - DNA, 20 bp, human
ggtatagggtaatcccctcc

SEQ ID NO: 261246 - DNA, 20 bp, human
gaacatagacagaagtccct

SEQ ID NO: 261247 - DNA, 20 bp, human
gccacaacgtcgggaataag

SEQ ID NO: 261248 - DNA, 20 bp, human
gagaaaggaagcccgcccca

SEQ ID NO: 261249 - DNA, 20 bp, human
ggggatgagggcaaaacgcc

SEQ ID NO: 261250 - DNA, 20 bp, human
ggggcttcctttctgggatg

SEQ ID NO: 261251 - DNA, 20 bp, human
gcagatgttacaatcgaaat

SEQ ID NO: 261252 - DNA, 20 bp, human
gataggatataccacaacgt

SEQ ID NO: 261253 - DNA, 20 bp, human
gttcactctccagagagtat

SEQ ID NO: 261254 - DNA, 20 bp, human
gcagcaggagggacaacaat

SEQ ID NO: 261255 - DNA, 20 bp, human
gccgtgtttaaaggtggacg

SEQ ID NO: 261256 - DNA, 20 bp, human
gcggggcggggcattcgagg

SEQ ID NO: 261257 - DNA, 20 bp, human
gaggtcgccgtcctcccggg

SEQ ID NO: 261258 - DNA, 20 bp, human
gtcctccaggtctggacgca

SEQ ID NO: 261259 - DNA, 20 bp, human
gccagccaggtacgagtaga

SEQ ID NO: 261260 - DNA, 20 bp, human
ggcccccagcgcgcggacgg

SEQ ID NO: 261261 - DNA, 20 bp, human
gcgtacctggctggctcgtg

SEQ ID NO: 261262 - DNA, 20 bp, human
gccgccggggtgggatagga

SEQ ID NO: 261263 - DNA, 20 bp, human
ggaagggaaggttacggctc

SEQ ID NO: 261264 - DNA, 20 bp, human
gtccaggtctggacgcaggg

SEQ ID NO: 261265 - DNA, 20 bp, human
gcccgccccgctgtcgccgt

SEQ ID NO: 261266 - DNA, 20 bp, human
gacccagcaaaggtcagtga

SEQ ID NO: 261267 - DNA, 20 bp, human
ggcagtaaatggaatcccgc

SEQ ID NO: 261268 - DNA, 20 bp, human
gtgtgtgaagtgtgggccca

SEQ ID NO: 261269 - DNA, 20 bp, human
gcaaaactatgtgcagtaaa

SEQ ID NO: 261270 - DNA, 20 bp, human
ggcagctgagagggcatatg

SEQ ID NO: 261271 - DNA, 20 bp, human
gaaatggaatcccgcaggcc

SEQ ID NO: 261272 - DNA, 20 bp, human
gttaacagagtgtagtccct

SEQ ID NO: 261273 - DNA, 20 bp, human
gcagtggaggcacagacaac

SEQ ID NO: 261274 - DNA, 20 bp, human
gtgccaagtactagattcta

SEQ ID NO: 261275 - DNA, 20 bp, human
gctctgcgggcagagctgtc

SEQ ID NO: 261276 - DNA, 20 bp, human
ggagccggttagggctgaag

SEQ ID NO: 261277 - DNA, 20 bp, human
gtgcgcaagcgcacccaaga

SEQ ID NO: 261278 - DNA, 20 bp, human
gacggctgggcgtcgaggaa

SEQ ID NO: 261279 - DNA, 20 bp, human
ggcgcacccaagacggtcac

SEQ ID NO: 261280 - DNA, 20 bp, human
ggaggcgtcgccgtcgtcgc

SEQ ID NO: 261281 - DNA, 20 bp, human
gcgtgcccagaagacgaaga

SEQ ID NO: 261282 - DNA, 20 bp, human
ggacgcctcgctcgtcagat

SEQ ID NO: 261283 - DNA, 20 bp, human
gtgacacgcagtgagcgtgg

SEQ ID NO: 261284 - DNA, 20 bp, human
gaactcccatctgacgagcg

SEQ ID NO: 261285 - DNA, 20 bp, human
gagttacctgtgaccgtctt

SEQ ID NO: 261286 - DNA, 20 bp, human
ggagtccggcgttgctgcag

SEQ ID NO: 261287 - DNA, 20 bp, human
gtgctgcaggggattgtggg

SEQ ID NO: 261288 - DNA, 20 bp, human
ggtgaggtgaaaaatctctg

SEQ ID NO: 261289 - DNA, 20 bp, human
ggtggccaatcggaacgcag

SEQ ID NO: 261290 - DNA, 20 bp, human
gcaggggattgtgggtggcg

SEQ ID NO: 261291 - DNA, 20 bp, human
gctaaacaaggccccgggaa

SEQ ID NO: 261292 - DNA, 20 bp, human
gtgcacctaaacaaggcccc

SEQ ID NO: 261293 - DNA, 20 bp, human
gacgccggactccgttcccg

SEQ ID NO: 261294 - DNA, 20 bp, human
gcaggggctggctcggtgat

SEQ ID NO: 261295 - DNA, 20 bp, human
gaatcgcgcgccaggctagg

SEQ ID NO: 261296 - DNA, 20 bp, human
gggcgaaggcaggagttgga

SEQ ID NO: 261297 - DNA, 20 bp, human
gggagggggcgcccacgcgg

SEQ ID NO: 261298 - DNA, 20 bp, human
gttcccggcagcctccgcgt

SEQ ID NO: 261299 - DNA, 20 bp, human
ggggcggggcatcatatggg

SEQ ID NO: 261300 - DNA, 20 bp, human
gcgcgggcgaaggcaggagt

SEQ ID NO: 261301 - DNA, 20 bp, human
ggcaatgtgcaaaggcggcg

SEQ ID NO: 261302 - DNA, 20 bp, human
gagagtgagtgggaccggag

SEQ ID NO: 261303 - DNA, 20 bp, human
gaacctaacgccctcctcgt

SEQ ID NO: 261304 - DNA, 20 bp, human
gagagcagaaacgcgggcga

SEQ ID NO: 261305 - DNA, 20 bp, human
gaggtgacgtggatagtctt

SEQ ID NO: 261306 - DNA, 20 bp, human
gacggcggagcgtcacgcgg

SEQ ID NO: 261307 - DNA, 20 bp, human
ggttccctcgagaagatctt

SEQ ID NO: 261308 - DNA, 20 bp, human
gggagatgctgcggccggca

SEQ ID NO: 261309 - DNA, 20 bp, human
gccgcggggagagacaccag

SEQ ID NO: 261310 - DNA, 20 bp, human
gagggaacgtgcaagtagtt

SEQ ID NO: 261311 - DNA, 20 bp, human
ggggtcccagcggagaatct

SEQ ID NO: 261312 - DNA, 20 bp, human
gactccaaagatcttctcga

SEQ ID NO: 261313 - DNA, 20 bp, human
gagggctctggcgcttatgt

SEQ ID NO: 261314 - DNA, 20 bp, human
gcagctgcgaccccaattgc

SEQ ID NO: 261315 - DNA, 20 bp, human
ggccgtagggaagtcacctc

SEQ ID NO: 261316 - DNA, 20 bp, human
ggagtgaccagcggtttaga

SEQ ID NO: 261317 - DNA, 20 bp, human
gaatcccagggctttatgga

SEQ ID NO: 261318 - DNA, 20 bp, human
gtgcaacccgtctaaaccgc

SEQ ID NO: 261319 - DNA, 20 bp, human
gcatgtgacccagaatacgt

SEQ ID NO: 261320 - DNA, 20 bp, human
gcatctctccaacgtattct

SEQ ID NO: 261321 - DNA, 20 bp, human
gagtatgtgttactaattga

SEQ ID NO: 261322 - DNA, 20 bp, human
ggttcccctccataaagccc

SEQ ID NO: 261323 - DNA, 20 bp, human
gtgacttttcgatccttttc

SEQ ID NO: 261324 - DNA, 20 bp, human
gttctctaaatgatctgtca

SEQ ID NO: 261325 - DNA, 20 bp, human
gatttagagaaataaactta

SEQ ID NO: 261326 - DNA, 20 bp, human
gggctcaaggacgtctgtga

SEQ ID NO: 261327 - DNA, 20 bp, human
gtcactcacatccgtctcaa

SEQ ID NO: 261328 - DNA, 20 bp, human
gtaacacgctgctgccatcc

SEQ ID NO: 261329 - DNA, 20 bp, human
gcaaggacgtctgtgaagga

SEQ ID NO: 261330 - DNA, 20 bp, human
gcgtccttgagcccttgaga

SEQ ID NO: 261331 - DNA, 20 bp, human
gcaattcccgtcctgaagga

SEQ ID NO: 261332 - DNA, 20 bp, human
gggttgaggaaattgatgac

SEQ ID NO: 261333 - DNA, 20 bp, human
gacacctcaagtgatatgcc

SEQ ID NO: 261334 - DNA, 20 bp, human
gaggttgcacaccctccttc

SEQ ID NO: 261335 - DNA, 20 bp, human
ggcttgggcttttcaattcc

SEQ ID NO: 261336 - DNA, 20 bp, human
gcagagcagcaagaccctcc

SEQ ID NO: 261337 - DNA, 20 bp, human
gctgcgcgttagggcctctt

SEQ ID NO: 261338 - DNA, 20 bp, human
gagaccctccggggcgccgc

SEQ ID NO: 261339 - DNA, 20 bp, human
gagcgggcgcggcgcaacgc

SEQ ID NO: 261340 - DNA, 20 bp, human
ggagctctgactggaaaaaa

SEQ ID NO: 261341 - DNA, 20 bp, human
gggaaacccgcacccccaag

SEQ ID NO: 261342 - DNA, 20 bp, human
gccctcctttcaaatatccg

SEQ ID NO: 261343 - DNA, 20 bp, human
gcttgctgctctgcgcgtta

SEQ ID NO: 261344 - DNA, 20 bp, human
ggcagccgcggatatttgaa

SEQ ID NO: 261345 - DNA, 20 bp, human
ggatatttgaaaggagggtc

SEQ ID NO: 261346 - DNA, 20 bp, human
gggggacactcgtgcgactg

SEQ ID NO: 261347 - DNA, 20 bp, human
gtgtccccgcgtcgcggcgg

SEQ ID NO: 261348 - DNA, 20 bp, human
gcactcgtgcgactggggca

SEQ ID NO: 261349 - DNA, 20 bp, human
ggggtctcaactgttacgtg

SEQ ID NO: 261350 - DNA, 20 bp, human
gccccagagggcagcaaaac

SEQ ID NO: 261351 - DNA, 20 bp, human
gcgactggggcaaggtgccc

SEQ ID NO: 261352 - DNA, 20 bp, human
gacctctggaattgcgtcgc

SEQ ID NO: 261353 - DNA, 20 bp, human
gctccccgctggaacctctg

SEQ ID NO: 261354 - DNA, 20 bp, human
ggcccagtgcccgctaactg

SEQ ID NO: 261355 - DNA, 20 bp, human
gtcgaattggagagccgtcc

SEQ ID NO: 261356 - DNA, 20 bp, human
gtgaacccccccagccgtcg

SEQ ID NO: 261357 - DNA, 20 bp, human
ggtcacatctggccggggac

SEQ ID NO: 261358 - DNA, 20 bp, human
gtccagatgcaggaggggaa

SEQ ID NO: 261359 - DNA, 20 bp, human
ggcggctctgcacccgtccc

SEQ ID NO: 261360 - DNA, 20 bp, human
gccaggtgtggcaaagtagt

SEQ ID NO: 261361 - DNA, 20 bp, human
gccgtcgcggatgccacagg

SEQ ID NO: 261362 - DNA, 20 bp, human
gcccataggctggctgtgcg

SEQ ID NO: 261363 - DNA, 20 bp, human
gaggaagtatcaggtaacgc

SEQ ID NO: 261364 - DNA, 20 bp, human
gagtcagccctctcccctct

SEQ ID NO: 261365 - DNA, 20 bp, human
gtatcaggtaacgcaggtgt

SEQ ID NO: 261366 - DNA, 20 bp, human
gcccacaccaggctaggtca

SEQ ID NO: 261367 - DNA, 20 bp, human
ggggtatggccagcagagaa

SEQ ID NO: 261368 - DNA, 20 bp, human
gtgccctgtggcagcttatc

SEQ ID NO: 261369 - DNA, 20 bp, human
gaccaggctaggtcagggct

SEQ ID NO: 261370 - DNA, 20 bp, human
gagctgggaggatggagtac

SEQ ID NO: 261371 - DNA, 20 bp, human
ggctcctgtgagaagctcag

SEQ ID NO: 261372 - DNA, 20 bp, human
gtacccgataagctgccaca

SEQ ID NO: 261373 - DNA, 20 bp, human
ggctaggtcagggctgggta

SEQ ID NO: 261374 - DNA, 20 bp, human
gcctggcaccctcacactgt

SEQ ID NO: 261375 - DNA, 20 bp, human
gaagctgccacagggcagat

SEQ ID NO: 261376 - DNA, 20 bp, human
gcagacgtgttcttcactcg

SEQ ID NO: 261377 - DNA, 20 bp, human
gctgaagtgtgtgttttcat

SEQ ID NO: 261378 - DNA, 20 bp, human
ggcccctaacgcagctctgc

SEQ ID NO: 261379 - DNA, 20 bp, human
gggcctgcagagctgcgtta

SEQ ID NO: 261380 - DNA, 20 bp, human
ggctctgcaggccccaaagc

SEQ ID NO: 261381 - DNA, 20 bp, human
ggtgtgttttcatcggggca

SEQ ID NO: 261382 - DNA, 20 bp, human
gtcggggcagggagcattgc

SEQ ID NO: 261383 - DNA, 20 bp, human
ggcagcaagggaaccagctt

SEQ ID NO: 261384 - DNA, 20 bp, human
ggggagcattgcaggcagca

SEQ ID NO: 261385 - DNA, 20 bp, human
ggtgtctgtgcgtgtctgcc

SEQ ID NO: 261386 - DNA, 20 bp, human
gagaaagttagattcgggcc

SEQ ID NO: 261387 - DNA, 20 bp, human
gtgctaagaaagttagattc

SEQ ID NO: 261388 - DNA, 20 bp, human
gaaagagaaaatcggctgga

SEQ ID NO: 261389 - DNA, 20 bp, human
gaccaccatttgactaggat

SEQ ID NO: 261390 - DNA, 20 bp, human
gtccaatcctagtcaaatgg

SEQ ID NO: 261391 - DNA, 20 bp, human
gacagctaaactaaaagcag

SEQ ID NO: 261392 - DNA, 20 bp, human
gtgagaagctagacctctgc

SEQ ID NO: 261393 - DNA, 20 bp, human
ggaataaagagaaaatcggc

SEQ ID NO: 261394 - DNA, 20 bp, human
ggtaacaagaagtgcagagc

SEQ ID NO: 261395 - DNA, 20 bp, human
gtaaagcttgaagtctagac

SEQ ID NO: 261396 - DNA, 20 bp, human
gcacgaggatctgctaaagg

SEQ ID NO: 261397 - DNA, 20 bp, human
gtgtcgtcgctgctggatag

SEQ ID NO: 261398 - DNA, 20 bp, human
gttggcttaaacatcactcc

SEQ ID NO: 261399 - DNA, 20 bp, human
gatctgctaaaggtggccca

SEQ ID NO: 261400 - DNA, 20 bp, human
gaggtgctggaggacggcca

SEQ ID NO: 261401 - DNA, 20 bp, human
gaggctgagtttcacggcca

SEQ ID NO: 261402 - DNA, 20 bp, human
gagggcaaggcaacagtccc

SEQ ID NO: 261403 - DNA, 20 bp, human
gaacgcgaaagacggatcca

SEQ ID NO: 261404 - DNA, 20 bp, human
gctccaggcacaactcgatt

SEQ ID NO: 261405 - DNA, 20 bp, human
gacaagtaaagtaaagttca

SEQ ID NO: 261406 - DNA, 20 bp, human
gtgtgcgccactatccttgt

SEQ ID NO: 261407 - DNA, 20 bp, human
gtggaccaggagtcggttcg

SEQ ID NO: 261408 - DNA, 20 bp, human
gggtccacccacaaggatag

SEQ ID NO: 261409 - DNA, 20 bp, human
ggactcctggtccacccaca

SEQ ID NO: 261410 - DNA, 20 bp, human
gctccctggctcggtcacgt

SEQ ID NO: 261411 - DNA, 20 bp, human
gagcccacgtgaccgagcca

SEQ ID NO: 261412 - DNA, 20 bp, human
gaaggatagtggcgcacaga

SEQ ID NO: 261413 - DNA, 20 bp, human
gcgagggtgctcccacttag

SEQ ID NO: 261414 - DNA, 20 bp, human
ggccgcgcgtgacctctaag

SEQ ID NO: 261415 - DNA, 20 bp, human
gaccgagccagggagcccga

SEQ ID NO: 261416 - DNA, 20 bp, human
gccccccgggaggcacgcaa

SEQ ID NO: 261417 - DNA, 20 bp, human
gcaaggctgccccccccggg

SEQ ID NO: 261418 - DNA, 20 bp, human
ggagcaaggctgcccccccc

SEQ ID NO: 261419 - DNA, 20 bp, human
gtggagcaccgaccaggtgt

SEQ ID NO: 261420 - DNA, 20 bp, human
gcacgacgtggcagcggtgg

SEQ ID NO: 261421 - DNA, 20 bp, human
gaggggcgggagacaatggc

SEQ ID NO: 261422 - DNA, 20 bp, human
gaggaggccgcttcgggagg

SEQ ID NO: 261423 - DNA, 20 bp, human
ggaggagggggagacgtgag

SEQ ID NO: 261424 - DNA, 20 bp, human
gtggatgaatggagaggcga

SEQ ID NO: 261425 - DNA, 20 bp, human
gacgaggccagacggggaaa

SEQ ID NO: 261426 - DNA, 20 bp, human
ggcggctccgggaaccttgg

SEQ ID NO: 261427 - DNA, 20 bp, human
gcaggtaactcgcctggaga

SEQ ID NO: 261428 - DNA, 20 bp, human
gccgccccgcggggcgccac

SEQ ID NO: 261429 - DNA, 20 bp, human
ggccgccccggtcacgtggc

SEQ ID NO: 261430 - DNA, 20 bp, human
gtgggcgcacgcttaggatc

SEQ ID NO: 261431 - DNA, 20 bp, human
ggccggccacgtgaccgggg

SEQ ID NO: 261432 - DNA, 20 bp, human
gatccggattcctacttcca

SEQ ID NO: 261433 - DNA, 20 bp, human
gagccctggaagtaggaatc

SEQ ID NO: 261434 - DNA, 20 bp, human
gggtcaacacggcaggtctg

SEQ ID NO: 261435 - DNA, 20 bp, human
gctccgggaaccttggggga

SEQ ID NO: 261436 - DNA, 20 bp, human
gcctgcgcgcccggacgagt

SEQ ID NO: 261437 - DNA, 20 bp, human
gcgtacgcggcccctgggag

SEQ ID NO: 261438 - DNA, 20 bp, human
ggcgcccggacgagtcgggg

SEQ ID NO: 261439 - DNA, 20 bp, human
gtgcgccgcagtggctcggc

SEQ ID NO: 261440 - DNA, 20 bp, human
gcatgtgcgccgcagtggct

SEQ ID NO: 261441 - DNA, 20 bp, human
ggcggggccggagacgcgga

SEQ ID NO: 261442 - DNA, 20 bp, human
gctaatcagaccagcggggc

SEQ ID NO: 261443 - DNA, 20 bp, human
ggcagcccgccgagccactg

SEQ ID NO: 261444 - DNA, 20 bp, human
gagccggcagcgccagtggg

SEQ ID NO: 261445 - DNA, 20 bp, human
gggctccgccccgactcgtc

SEQ ID NO: 261446 - DNA, 20 bp, human
ggaggggcaacccccgactc

SEQ ID NO: 261447 - DNA, 20 bp, human
gggccctcaaacatggagag

SEQ ID NO: 261448 - DNA, 20 bp, human
gcccatggttccagagtcgg

SEQ ID NO: 261449 - DNA, 20 bp, human
gacccccgactctggaacca

SEQ ID NO: 261450 - DNA, 20 bp, human
ggtcatcagcctatgctggg

SEQ ID NO: 261451 - DNA, 20 bp, human
gtctggaaccatgggctcta

SEQ ID NO: 261452 - DNA, 20 bp, human
gctgctcgatgcaggctctt

SEQ ID NO: 261453 - DNA, 20 bp, human
gtggtggctctgctcgatgc

SEQ ID NO: 261454 - DNA, 20 bp, human
gaattctgagtcagtcggtt

SEQ ID NO: 261455 - DNA, 20 bp, human
gtgaccttgactttggttta

SEQ ID NO: 261456 - DNA, 20 bp, human
gaggctgccaggttctcctc

SEQ ID NO: 261457 - DNA, 20 bp, human
gtaaccacccgaggagaacc

SEQ ID NO: 261458 - DNA, 20 bp, human
gttctcctcgggtggttacg

SEQ ID NO: 261459 - DNA, 20 bp, human
ggtcgcgggagcccagttaa

SEQ ID NO: 261460 - DNA, 20 bp, human
gacaggcatcatgacgtcct

SEQ ID NO: 261461 - DNA, 20 bp, human
ggtgctggccggccctccgg

SEQ ID NO: 261462 - DNA, 20 bp, human
gcccctcagcccgaatgctg

SEQ ID NO: 261463 - DNA, 20 bp, human
ggccggccctccggtggcaa

SEQ ID NO: 261464 - DNA, 20 bp, human
gtcaccgagccgggctgcga

SEQ ID NO: 261465 - DNA, 20 bp, human
gggagcagcaggatttaaag

SEQ ID NO: 261466 - DNA, 20 bp, human
ggaagcctaacacttgagca

SEQ ID NO: 261467 - DNA, 20 bp, human
gggacttgtgatgctcacat

SEQ ID NO: 261468 - DNA, 20 bp, human
gagcacatgtcaatctcaat

SEQ ID NO: 261469 - DNA, 20 bp, human
gtgatgctcacataggttca

SEQ ID NO: 261470 - DNA, 20 bp, human
ggttcatggtatcgtgttac

SEQ ID NO: 261471 - DNA, 20 bp, human
gtactgggtgtctgatgcaa

SEQ ID NO: 261472 - DNA, 20 bp, human
gaccaccaatttgaccaaat

SEQ ID NO: 261473 - DNA, 20 bp, human
gtggtcttgagaataaacaa

SEQ ID NO: 261474 - DNA, 20 bp, human
gcactcttatgtccctagca

SEQ ID NO: 261475 - DNA, 20 bp, human
gtccaatttggtcaaattgg

SEQ ID NO: 261476 - DNA, 20 bp, human
gaaatctgataaagctgaga

SEQ ID NO: 261477 - DNA, 20 bp, human
gtttcctacacatacactca

SEQ ID NO: 261478 - DNA, 20 bp, human
gcatttgctataaataagag

SEQ ID NO: 261479 - DNA, 20 bp, human
gatagcaaatgctctggtta

SEQ ID NO: 261480 - DNA, 20 bp, human
gatgaggactgtaccttcgt

SEQ ID NO: 261481 - DNA, 20 bp, human
ggacacaaagccttcacgtt

SEQ ID NO: 261482 - DNA, 20 bp, human
gtgtattaacactccaacga

SEQ ID NO: 261483 - DNA, 20 bp, human
gcacaagagagcgagtagag

SEQ ID NO: 261484 - DNA, 20 bp, human
ggaggctcaagctttctaag

SEQ ID NO: 261485 - DNA, 20 bp, human
gttatttatagcaaatgctc

SEQ ID NO: 261486 - DNA, 20 bp, human
gactctggaggagggatgcg

SEQ ID NO: 261487 - DNA, 20 bp, human
gagggccgaatgtggaggtc

SEQ ID NO: 261488 - DNA, 20 bp, human
gcacctaaggggactggagg

SEQ ID NO: 261489 - DNA, 20 bp, human
gaaaggggccgcaaagcctg

SEQ ID NO: 261490 - DNA, 20 bp, human
gggatgcgggggcacctaag

SEQ ID NO: 261491 - DNA, 20 bp, human
gtctcgcgggccattggctt

SEQ ID NO: 261492 - DNA, 20 bp, human
gcccaaggggctagagccag

SEQ ID NO: 261493 - DNA, 20 bp, human
gcgcacgaacagcgtctctg

SEQ ID NO: 261494 - DNA, 20 bp, human
gccgaatgtggaggtcgggt

SEQ ID NO: 261495 - DNA, 20 bp, human
gctctaggaggttttcccaa

SEQ ID NO: 261496 - DNA, 20 bp, human
gaactagtgaatgtaaaaac

SEQ ID NO: 261497 - DNA, 20 bp, human
gcagctctgctgtgggtttc

SEQ ID NO: 261498 - DNA, 20 bp, human
gtcattgcactggcagttag

SEQ ID NO: 261499 - DNA, 20 bp, human
gttacaacaagtcattgcac

SEQ ID NO: 261500 - DNA, 20 bp, human
gctgattgatagctggattg

SEQ ID NO: 261501 - DNA, 20 bp, human
gttggttggaaataggtaag

SEQ ID NO: 261502 - DNA, 20 bp, human
ggattagtctgattgatagc

SEQ ID NO: 261503 - DNA, 20 bp, human
gaaggctctaagtcaaatct

SEQ ID NO: 261504 - DNA, 20 bp, human
gagcttctgttcagttttaa

SEQ ID NO: 261505 - DNA, 20 bp, human
gagggggcatgggcttttat

SEQ ID NO: 261506 - DNA, 20 bp, human
ggacacgaatgcgtcccccg

SEQ ID NO: 261507 - DNA, 20 bp, human
ggtactgtgaatgctaatag

SEQ ID NO: 261508 - DNA, 20 bp, human
gaaagcgtatgcacacgcgt

SEQ ID NO: 261509 - DNA, 20 bp, human
gggtaaagacggttgggcgg

SEQ ID NO: 261510 - DNA, 20 bp, human
gctgcggggtaaagacggtt

SEQ ID NO: 261511 - DNA, 20 bp, human
gagggcgcgcaagtgccaga

SEQ ID NO: 261512 - DNA, 20 bp, human
gacttgcgcgccctatatag

SEQ ID NO: 261513 - DNA, 20 bp, human
gtagttgtgagtgcgacccc

SEQ ID NO: 261514 - DNA, 20 bp, human
ggcggtacggtgccttccgc

SEQ ID NO: 261515 - DNA, 20 bp, human
ggtagtgaacatgctttgcg

SEQ ID NO: 261516 - DNA, 20 bp, human
gtgggcccgaaggccaagat

SEQ ID NO: 261517 - DNA, 20 bp, human
gaacggaccgggtttcggat

SEQ ID NO: 261518 - DNA, 20 bp, human
gtggccttcgggcccaatca

SEQ ID NO: 261519 - DNA, 20 bp, human
gtccgttccccgcggaagag

SEQ ID NO: 261520 - DNA, 20 bp, human
gaaacccggtccgttccccg

SEQ ID NO: 261521 - DNA, 20 bp, human
gagaccaaggtggagttaaa

SEQ ID NO: 261522 - DNA, 20 bp, human
gcttccgcggggaacggacc

SEQ ID NO: 261523 - DNA, 20 bp, human
gaccaagagctcccccacgt

SEQ ID NO: 261524 - DNA, 20 bp, human
ggtccgcgctgcacagacca

SEQ ID NO: 261525 - DNA, 20 bp, human
ggccctacctatccgaaacc

SEQ ID NO: 261526 - DNA, 20 bp, human
ggtaccgcccctttccagga

SEQ ID NO: 261527 - DNA, 20 bp, human
ggacccggaaccatactcta

SEQ ID NO: 261528 - DNA, 20 bp, human
ggtgacacgcaaagcgtgct

SEQ ID NO: 261529 - DNA, 20 bp, human
gaaaggggcggtaccagcat

SEQ ID NO: 261530 - DNA, 20 bp, human
gaggcacgacatggtctaag

SEQ ID NO: 261531 - DNA, 20 bp, human
gtagaccatgtcgtgccttt

SEQ ID NO: 261532 - DNA, 20 bp, human
gcacgctttgcgtgtcacta

SEQ ID NO: 261533 - DNA, 20 bp, human
gcatgtcgtgcctttgggtt

SEQ ID NO: 261534 - DNA, 20 bp, human
ggtctaagcggtagtcgcca

SEQ ID NO: 261535 - DNA, 20 bp, human
ggcgtgctgggaacgccctg

SEQ ID NO: 261536 - DNA, 20 bp, human
ggggtcggagactactggag

SEQ ID NO: 261537 - DNA, 20 bp, human
gcgggagccggggacgggaa

SEQ ID NO: 261538 - DNA, 20 bp, human
gggcgggccgtgggccgggt

SEQ ID NO: 261539 - DNA, 20 bp, human
gcctggggctggcacgtcac

SEQ ID NO: 261540 - DNA, 20 bp, human
gtcatcacgcggggcgggag

SEQ ID NO: 261541 - DNA, 20 bp, human
gacggtggcgtcatcacgcg

SEQ ID NO: 261542 - DNA, 20 bp, human
gtcacgcgagcgttgtgtct

SEQ ID NO: 261543 - DNA, 20 bp, human
ggacgggaaaggagagtgct

SEQ ID NO: 261544 - DNA, 20 bp, human
gacgccaccgtcccgggcgg

SEQ ID NO: 261545 - DNA, 20 bp, human
ggatactgacgtcatcgcgc

SEQ ID NO: 261546 - DNA, 20 bp, human
gactggcgagtgcacacctc

SEQ ID NO: 261547 - DNA, 20 bp, human
gtggcgcaggcgtcagccgg

SEQ ID NO: 261548 - DNA, 20 bp, human
ggacgcctgcgccacgtgct

SEQ ID NO: 261549 - DNA, 20 bp, human
gggtcggaggccgagctcac

SEQ ID NO: 261550 - DNA, 20 bp, human
ggcacttggtccacccggac

SEQ ID NO: 261551 - DNA, 20 bp, human
ggtgcactcgccagtccggg

SEQ ID NO: 261552 - DNA, 20 bp, human
ggggcagcacttggtccacc

SEQ ID NO: 261553 - DNA, 20 bp, human
gagtctccgccctagagggg

SEQ ID NO: 261554 - DNA, 20 bp, human
ggctctaggggccagttgga

SEQ ID NO: 261555 - DNA, 20 bp, human
ggaccaagtgctgccctagg

SEQ ID NO: 261556 - DNA, 20 bp, human
ggagaggggcggaactgtta

SEQ ID NO: 261557 - DNA, 20 bp, human
gcaggctcctgtcccggctg

SEQ ID NO: 261558 - DNA, 20 bp, human
gcgaacaacccccaccagtc

SEQ ID NO: 261559 - DNA, 20 bp, human
gctgctctggaggagtgtct

SEQ ID NO: 261560 - DNA, 20 bp, human
gcaaaatcctccagactggt

SEQ ID NO: 261561 - DNA, 20 bp, human
gagagtgggagcttgtgagt

SEQ ID NO: 261562 - DNA, 20 bp, human
gggaactgttaaggtgccga

SEQ ID NO: 261563 - DNA, 20 bp, human
ggtccgcgtaaactgagagt

SEQ ID NO: 261564 - DNA, 20 bp, human
ggattggctgggtccgggag

SEQ ID NO: 261565 - DNA, 20 bp, human
gggctcaaaatcctccagac

SEQ ID NO: 261566 - DNA, 20 bp, human
ggtccgccgcgacttctcat

SEQ ID NO: 261567 - DNA, 20 bp, human
ggccttgtgaggtaaggctg

SEQ ID NO: 261568 - DNA, 20 bp, human
gcccagctgcagccaatcgg

SEQ ID NO: 261569 - DNA, 20 bp, human
ggggtccgcgccgccttgtg

SEQ ID NO: 261570 - DNA, 20 bp, human
ggggctcattgtaggctgcg

SEQ ID NO: 261571 - DNA, 20 bp, human
gggacccagctgcagccaat

SEQ ID NO: 261572 - DNA, 20 bp, human
gcaatcggcgggctcattgt

SEQ ID NO: 261573 - DNA, 20 bp, human
gtggaaggcggcaggcggaa

SEQ ID NO: 261574 - DNA, 20 bp, human
gccccattcgagcctgacgg

SEQ ID NO: 261575 - DNA, 20 bp, human
gagccaatgagaagtcgcgg

SEQ ID NO: 261576 - DNA, 20 bp, human
gcggctgcgcagccaataga

SEQ ID NO: 261577 - DNA, 20 bp, human
gggaagttaggggctagact

SEQ ID NO: 261578 - DNA, 20 bp, human
gaatagacggcgggaagtta

SEQ ID NO: 261579 - DNA, 20 bp, human
gctgcgcagccaatagacgg

SEQ ID NO: 261580 - DNA, 20 bp, human
gggctgcgcagccgcccaat

SEQ ID NO: 261581 - DNA, 20 bp, human
gcaaaggtgaggctattccc

SEQ ID NO: 261582 - DNA, 20 bp, human
ggcggcccgggcttactcga

SEQ ID NO: 261583 - DNA, 20 bp, human
gtttccgcctgcccattggg

SEQ ID NO: 261584 - DNA, 20 bp, human
ggaacgagataagacgccct

SEQ ID NO: 261585 - DNA, 20 bp, human
ggggaccttcgagtaagccc

SEQ ID NO: 261586 - DNA, 20 bp, human
gcccgagatccgcttcccat

SEQ ID NO: 261587 - DNA, 20 bp, human
ggaccaatcgagaggccgga

SEQ ID NO: 261588 - DNA, 20 bp, human
ggggctctgcagcggttgac

SEQ ID NO: 261589 - DNA, 20 bp, human
gcgacagaggaccaatcgag

SEQ ID NO: 261590 - DNA, 20 bp, human
ggcaagcaatgcaaaccaat

SEQ ID NO: 261591 - DNA, 20 bp, human
ggagcccgcctccccgacag

SEQ ID NO: 261592 - DNA, 20 bp, human
gatcgagaggccggaaggaa

SEQ ID NO: 261593 - DNA, 20 bp, human
gagaggaccaatcgagaggc

SEQ ID NO: 261594 - DNA, 20 bp, human
gtggtcctctgtcggggagg

SEQ ID NO: 261595 - DNA, 20 bp, human
gacaggggaggatacggata

SEQ ID NO: 261596 - DNA, 20 bp, human
gtgggaacttgcacggggag

SEQ ID NO: 261597 - DNA, 20 bp, human
gtacgtgcctgaaaagggga

SEQ ID NO: 261598 - DNA, 20 bp, human
gtgttctttgcgtgactgac

SEQ ID NO: 261599 - DNA, 20 bp, human
gcagtcacgcaaagaacaaa

SEQ ID NO: 261600 - DNA, 20 bp, human
gcgtacatggtggtctctgt

SEQ ID NO: 261601 - DNA, 20 bp, human
gctcttgtttctgtaaccgt

SEQ ID NO: 261602 - DNA, 20 bp, human
gcccttttcaggcacgtaca

SEQ ID NO: 261603 - DNA, 20 bp, human
gctctgtgggaacttgcacg

SEQ ID NO: 261604 - DNA, 20 bp, human
gtagttgtgggtacgtcttt

SEQ ID NO: 261605 - DNA, 20 bp, human
gaaggggagggaacttttcc

SEQ ID NO: 261606 - DNA, 20 bp, human
gtggctgtttcaccgctccc

SEQ ID NO: 261607 - DNA, 20 bp, human
gggactccaagtcccagccg

SEQ ID NO: 261608 - DNA, 20 bp, human
ggaaggcggggcgacgcaca

SEQ ID NO: 261609 - DNA, 20 bp, human
gccaaaccagggaaagataa

SEQ ID NO: 261610 - DNA, 20 bp, human
ggcgacgcacacggcttcct

SEQ ID NO: 261611 - DNA, 20 bp, human
gacgacgcacgcgcagtgaa

SEQ ID NO: 261612 - DNA, 20 bp, human
gtgcgcgtgcgtcgtgctgt

SEQ ID NO: 261613 - DNA, 20 bp, human
gagccacagcgcggccagag

SEQ ID NO: 261614 - DNA, 20 bp, human
gagcctccaatcgatctcga

SEQ ID NO: 261615 - DNA, 20 bp, human
gggcgccatggatgacgcaa

SEQ ID NO: 261616 - DNA, 20 bp, human
gggaccgccgagcgggactg

SEQ ID NO: 261617 - DNA, 20 bp, human
gaaggggccacggacgcctg

SEQ ID NO: 261618 - DNA, 20 bp, human
gtcgccccagtcccgctcgg

SEQ ID NO: 261619 - DNA, 20 bp, human
ggggagacactcaaagtgcg

SEQ ID NO: 261620 - DNA, 20 bp, human
ggggcggagcacgccttaaa

SEQ ID NO: 261621 - DNA, 20 bp, human
gccctcgccccagtcccgct

SEQ ID NO: 261622 - DNA, 20 bp, human
ggggagagaagtagaaaccc

SEQ ID NO: 261623 - DNA, 20 bp, human
gacggcactgaccccgggaa

SEQ ID NO: 261624 - DNA, 20 bp, human
gcgaggctatgagtgtactg

SEQ ID NO: 261625 - DNA, 20 bp, human
gctcatgtaggaacagagat

SEQ ID NO: 261626 - DNA, 20 bp, human
gtccagactagcagttccca

SEQ ID NO: 261627 - DNA, 20 bp, human
ggggacctctgtaccgcgct

SEQ ID NO: 261628 - DNA, 20 bp, human
gcgggtcctgcgctgcgtca

SEQ ID NO: 261629 - DNA, 20 bp, human
gacagaggtcccattgtgac

SEQ ID NO: 261630 - DNA, 20 bp, human
ggaactgctagtctggaaag

SEQ ID NO: 261631 - DNA, 20 bp, human
gatgggtgtgtgctaatcgc

SEQ ID NO: 261632 - DNA, 20 bp, human
ggaaagcggggctgcttctc

SEQ ID NO: 261633 - DNA, 20 bp, human
gtccctgggaactgctagtc

SEQ ID NO: 261634 - DNA, 20 bp, human
gcaggccaacaagcccagcg

SEQ ID NO: 261635 - DNA, 20 bp, human
ggaggcgagaaaccccgcct

SEQ ID NO: 261636 - DNA, 20 bp, human
ggctacctggagcgcggggt

SEQ ID NO: 261637 - DNA, 20 bp, human
ggccccacccccggcgtcac

SEQ ID NO: 261638 - DNA, 20 bp, human
gtgggggcgacgcccccctg

SEQ ID NO: 261639 - DNA, 20 bp, human
gccgccgctacctggagcgc

SEQ ID NO: 261640 - DNA, 20 bp, human
gtgggggccggtgacgccgg

SEQ ID NO: 261641 - DNA, 20 bp, human
ggagcccaagctgacgtcgt

SEQ ID NO: 261642 - DNA, 20 bp, human
ggctggcttcccggcctccg

SEQ ID NO: 261643 - DNA, 20 bp, human
gtggagtctcgcggcctcgg

SEQ ID NO: 261644 - DNA, 20 bp, human
ggctcccacgacgtcagctt

SEQ ID NO: 261645 - DNA, 20 bp, human
gggagagagctggagtctcg

SEQ ID NO: 261646 - DNA, 20 bp, human
ggggccgcgggcaggtcgcc

SEQ ID NO: 261647 - DNA, 20 bp, human
gtgggaaggagggaattcgc

SEQ ID NO: 261648 - DNA, 20 bp, human
gaggaggaaaagcaaagacg

SEQ ID NO: 261649 - DNA, 20 bp, human
gtcagaggaatgataggggc

SEQ ID NO: 261650 - DNA, 20 bp, human
gggaatgataggggcgggta

SEQ ID NO: 261651 - DNA, 20 bp, human
gagaacgccaggagggataa

SEQ ID NO: 261652 - DNA, 20 bp, human
gctcttgcccggggcgtcgg

SEQ ID NO: 261653 - DNA, 20 bp, human
ggaattcagaggaatgatag

SEQ ID NO: 261654 - DNA, 20 bp, human
gagtcccaggctcgcgtagg

SEQ ID NO: 261655 - DNA, 20 bp, human
gggaggaggggcttggcaaa

SEQ ID NO: 261656 - DNA, 20 bp, human
gagaaacgccctaaagagga

SEQ ID NO: 261657 - DNA, 20 bp, human
gcggcccaaagcgaaaggaa

SEQ ID NO: 261658 - DNA, 20 bp, human
ggggccgggcgatgtccgct

SEQ ID NO: 261659 - DNA, 20 bp, human
gcgcgagaaacgccctaaag

SEQ ID NO: 261660 - DNA, 20 bp, human
gaccgcggaggagcagtgcg

SEQ ID NO: 261661 - DNA, 20 bp, human
ggcccgcggcccaaagcgaa

SEQ ID NO: 261662 - DNA, 20 bp, human
gtccacgcactgctcctccg

SEQ ID NO: 261663 - DNA, 20 bp, human
gtgtccgcttgggggagcga

SEQ ID NO: 261664 - DNA, 20 bp, human
gcgcgggcggagattggccg

SEQ ID NO: 261665 - DNA, 20 bp, human
gcactgctcctccgcggtcg

SEQ ID NO: 261666 - DNA, 20 bp, human
gcgcgatcagcaccacgact

SEQ ID NO: 261667 - DNA, 20 bp, human
ggaggagagggaacgcacga

SEQ ID NO: 261668 - DNA, 20 bp, human
ggagggacggccgagtggag

SEQ ID NO: 261669 - DNA, 20 bp, human
ggaagggaggtaggcaggat

SEQ ID NO: 261670 - DNA, 20 bp, human
ggcggcgcgctcttcaggag

SEQ ID NO: 261671 - DNA, 20 bp, human
gcaggatggggagaagcggg

SEQ ID NO: 261672 - DNA, 20 bp, human
gactcggctgggtccctcgc

SEQ ID NO: 261673 - DNA, 20 bp, human
gagtctctggaggaagtaac

SEQ ID NO: 261674 - DNA, 20 bp, human
gcccacgcggcgcgctcttc

SEQ ID NO: 261675 - DNA, 20 bp, human
gacgcacgaggggagagaag

SEQ ID NO: 261676 - DNA, 20 bp, human
gaccggccgagcacccccta

SEQ ID NO: 261677 - DNA, 20 bp, human
gcgagggagacccgcgggaa

SEQ ID NO: 261678 - DNA, 20 bp, human
ggagcaccccctagggcaga

SEQ ID NO: 261679 - DNA, 20 bp, human
gaggggcgagggagacccgc

SEQ ID NO: 261680 - DNA, 20 bp, human
gcctcgcccctctgccctag

SEQ ID NO: 261681 - DNA, 20 bp, human
gaggcagcgatccatcagtt

SEQ ID NO: 261682 - DNA, 20 bp, human
gaggaaatcgagtctctccg

SEQ ID NO: 261683 - DNA, 20 bp, human
gaggcgctgggtcctcagcc

SEQ ID NO: 261684 - DNA, 20 bp, human
gcagctgaataaggcggtac

SEQ ID NO: 261685 - DNA, 20 bp, human
gcctctgacagagctcaatt

SEQ ID NO: 261686 - DNA, 20 bp, human
gccccagtaggtatcgccgt

SEQ ID NO: 261687 - DNA, 20 bp, human
ggcccgacggcgatacctac

SEQ ID NO: 261688 - DNA, 20 bp, human
gaggtggcctctcccgccac

SEQ ID NO: 261689 - DNA, 20 bp, human
ggcgccgctccaagagtccc

SEQ ID NO: 261690 - DNA, 20 bp, human
ggccgggagcaacaccagct

SEQ ID NO: 261691 - DNA, 20 bp, human
gatggggcccgggccgagag

SEQ ID NO: 261692 - DNA, 20 bp, human
gggccagaactgcgtccccg

SEQ ID NO: 261693 - DNA, 20 bp, human
gcccacagaacagtcccagc

SEQ ID NO: 261694 - DNA, 20 bp, human
gaccagctgggactgttctg

SEQ ID NO: 261695 - DNA, 20 bp, human
gcagaactgcgtccccgtgg

SEQ ID NO: 261696 - DNA, 20 bp, human
ggaagtcggcgtctgctgaa

SEQ ID NO: 261697 - DNA, 20 bp, human
gtgctgggtgcggcgaggtg

SEQ ID NO: 261698 - DNA, 20 bp, human
ggaggagtgcgggcggaagt

SEQ ID NO: 261699 - DNA, 20 bp, human
gaggtgaggctgggaaccgg

SEQ ID NO: 261700 - DNA, 20 bp, human
gaggctgggaaccggcggga

SEQ ID NO: 261701 - DNA, 20 bp, human
gcccgtgcgtcacgctgcgg

SEQ ID NO: 261702 - DNA, 20 bp, human
ggatgcgcgggatgcgggcc

SEQ ID NO: 261703 - DNA, 20 bp, human
gtgacgcacgggccgtgccg

SEQ ID NO: 261704 - DNA, 20 bp, human
gcgtgccggggcggatgcgc

SEQ ID NO: 261705 - DNA, 20 bp, human
ggcccagcagcggaccgggc

SEQ ID NO: 261706 - DNA, 20 bp, human
gcccagcaggggcaggatat

SEQ ID NO: 261707 - DNA, 20 bp, human
gcagcggggaggtccccaga

SEQ ID NO: 261708 - DNA, 20 bp, human
gtaaatcttgagtgggaagg

SEQ ID NO: 261709 - DNA, 20 bp, human
ggctcattctaaatcttgag

SEQ ID NO: 261710 - DNA, 20 bp, human
gtgtctaaatcccccagcag

SEQ ID NO: 261711 - DNA, 20 bp, human
gacagggcccagccccctct

SEQ ID NO: 261712 - DNA, 20 bp, human
gcagggctgactcggactca

SEQ ID NO: 261713 - DNA, 20 bp, human
gtctcttcttagggcttaac

SEQ ID NO: 261714 - DNA, 20 bp, human
ggctgggccctgtctgggta

SEQ ID NO: 261715 - DNA, 20 bp, human
gtcttagggcttaacaggat

SEQ ID NO: 261716 - DNA, 20 bp, human
ggagcaggtgggacctcctt

SEQ ID NO: 261717 - DNA, 20 bp, human
ggccctggaatctgcggagg

SEQ ID NO: 261718 - DNA, 20 bp, human
gggggccaatcagaatgtag

SEQ ID NO: 261719 - DNA, 20 bp, human
gcggccggggccccaagcgg

SEQ ID NO: 261720 - DNA, 20 bp, human
ggccaggccggacgactctc

SEQ ID NO: 261721 - DNA, 20 bp, human
gctgggcacgcccgccaatc

SEQ ID NO: 261722 - DNA, 20 bp, human
gccaacccctacattctgat

SEQ ID NO: 261723 - DNA, 20 bp, human
ggggcggagtttcccagccg

SEQ ID NO: 261724 - DNA, 20 bp, human
ggagtcgtccggcctggccg

SEQ ID NO: 261725 - DNA, 20 bp, human
ggggctaggccggagtaagg

SEQ ID NO: 261726 - DNA, 20 bp, human
gggggccggagttgatgggg

SEQ ID NO: 261727 - DNA, 20 bp, human
ggtaaaacagacccctgagg

SEQ ID NO: 261728 - DNA, 20 bp, human
gcctctggccaatgggaaca

SEQ ID NO: 261729 - DNA, 20 bp, human
gtggccagaggccgttcccg

SEQ ID NO: 261730 - DNA, 20 bp, human
gaatgggggccggagttgat

SEQ ID NO: 261731 - DNA, 20 bp, human
gttggatttgcccgcagaca

SEQ ID NO: 261732 - DNA, 20 bp, human
gcggagcggttcaccgtctt

SEQ ID NO: 261733 - DNA, 20 bp, human
gggaacggcctctggccaat

SEQ ID NO: 261734 - DNA, 20 bp, human
gtgggaacaaggctgggcta

SEQ ID NO: 261735 - DNA, 20 bp, human
ggtggagagagatgcaccgc

SEQ ID NO: 261736 - DNA, 20 bp, human
gccacgcggccccgctaccc

SEQ ID NO: 261737 - DNA, 20 bp, human
gggaaataaaagctgcgcgg

SEQ ID NO: 261738 - DNA, 20 bp, human
gcggaggaaacccgggtagc

SEQ ID NO: 261739 - DNA, 20 bp, human
gcaccaggaaataaaagctc

SEQ ID NO: 261740 - DNA, 20 bp, human
gcggggaaataaaagctgcg

SEQ ID NO: 261741 - DNA, 20 bp, human
gaaaagctcgggttacagcc

SEQ ID NO: 261742 - DNA, 20 bp, human
gggaggtctcgcggcgtgga

SEQ ID NO: 261743 - DNA, 20 bp, human
gacgccgcgagacctcccgc

SEQ ID NO: 261744 - DNA, 20 bp, human
ggtctcgcggcgtggagggc

SEQ ID NO: 261745 - DNA, 20 bp, human
ggggttacagcccggcatcg

SEQ ID NO: 261746 - DNA, 20 bp, human
gaaaacgaaagagcgggatg

SEQ ID NO: 261747 - DNA, 20 bp, human
gccaaggccaggtcgccaga

SEQ ID NO: 261748 - DNA, 20 bp, human
gccggtgctgcgctcccacg

SEQ ID NO: 261749 - DNA, 20 bp, human
gagccggcggacagtccctc

SEQ ID NO: 261750 - DNA, 20 bp, human
ggcccgctcgctagcctggg

SEQ ID NO: 261751 - DNA, 20 bp, human
ggggactgtccgccggctgg

SEQ ID NO: 261752 - DNA, 20 bp, human
gtgcaggacccacgcctccc

SEQ ID NO: 261753 - DNA, 20 bp, human
gtgcaggatctgaggatcta

SEQ ID NO: 261754 - DNA, 20 bp, human
gtagcccgcagcggcgcaag

SEQ ID NO: 261755 - DNA, 20 bp, human
ggctgcccgctcgctagcct

SEQ ID NO: 261756 - DNA, 20 bp, human
ggggccgctggcttgcagaa

SEQ ID NO: 261757 - DNA, 20 bp, human
gagaggatggatgctggcag

SEQ ID NO: 261758 - DNA, 20 bp, human
ggcaagacgcgaaacctgaa

SEQ ID NO: 261759 - DNA, 20 bp, human
ggggcgcccacatgggccgc

SEQ ID NO: 261760 - DNA, 20 bp, human
gtcaaagcaggcgacgggac

SEQ ID NO: 261761 - DNA, 20 bp, human
ggcaagccagcggcccatgt

SEQ ID NO: 261762 - DNA, 20 bp, human
gtgaactaacttggcgcgga

SEQ ID NO: 261763 - DNA, 20 bp, human
ggcccccttctgcaagccag

SEQ ID NO: 261764 - DNA, 20 bp, human
ggacagtcggcagcgcgggg

SEQ ID NO: 261765 - DNA, 20 bp, human
ggaccggggaggttccccat

SEQ ID NO: 261766 - DNA, 20 bp, human
gcctccccggcggtttcctg

SEQ ID NO: 261767 - DNA, 20 bp, human
gcgggccgtccgtcccccac

SEQ ID NO: 261768 - DNA, 20 bp, human
gcccccacaggaaaccgccg

SEQ ID NO: 261769 - DNA, 20 bp, human
gcgggccaagggctaaacct

SEQ ID NO: 261770 - DNA, 20 bp, human
ggtttcctgtgggggacgga

SEQ ID NO: 261771 - DNA, 20 bp, human
ggataatggtatcacgtcgc

SEQ ID NO: 261772 - DNA, 20 bp, human
ggttgctgttagtggcctgg

SEQ ID NO: 261773 - DNA, 20 bp, human
gctgcctgcgtgcgggccaa

SEQ ID NO: 261774 - DNA, 20 bp, human
gccagtccagcatgggtctg

SEQ ID NO: 261775 - DNA, 20 bp, human
gcaagggctaaaccttggac

SEQ ID NO: 261776 - DNA, 20 bp, human
gtgggcagcgcgccagggat

SEQ ID NO: 261777 - DNA, 20 bp, human
gggctgcccaggccgatccc

SEQ ID NO: 261778 - DNA, 20 bp, human
ggcccggggcgcgctactgg

SEQ ID NO: 261779 - DNA, 20 bp, human
gaggaagcgaggggggccgt

SEQ ID NO: 261780 - DNA, 20 bp, human
ggggtgcccggctgtttccc

SEQ ID NO: 261781 - DNA, 20 bp, human
ggcaacggagatttcctctc

SEQ ID NO: 261782 - DNA, 20 bp, human
ggcagccgcggggcgcgcga

SEQ ID NO: 261783 - DNA, 20 bp, human
ggccgtgccggaggaagcga

SEQ ID NO: 261784 - DNA, 20 bp, human
gtggctgggcgtccgaacgt

SEQ ID NO: 261785 - DNA, 20 bp, human
ggcgcgccagggatcggcct

SEQ ID NO: 261786 - DNA, 20 bp, human
ggggaggcgcgtctgtctct

SEQ ID NO: 261787 - DNA, 20 bp, human
gggctcggcgaagcagggaa

SEQ ID NO: 261788 - DNA, 20 bp, human
gggcggagcacccaccgcag

SEQ ID NO: 261789 - DNA, 20 bp, human
gtggaaaccgggcccccctc

SEQ ID NO: 261790 - DNA, 20 bp, human
gcacccctttaactttactg

SEQ ID NO: 261791 - DNA, 20 bp, human
gagccccggacccttccgga

SEQ ID NO: 261792 - DNA, 20 bp, human
gaccgggcccccctccggaa

SEQ ID NO: 261793 - DNA, 20 bp, human
gttcgcgtgagcaagttcag

SEQ ID NO: 261794 - DNA, 20 bp, human
ggggcggtgtgttcccggga

SEQ ID NO: 261795 - DNA, 20 bp, human
gtctgggcatgctcagtgca

SEQ ID NO: 261796 - DNA, 20 bp, human
ggggccaggaggtgccggac

SEQ ID NO: 261797 - DNA, 20 bp, human
gggtgccggacgggcgtggg

SEQ ID NO: 261798 - DNA, 20 bp, human
ggagtcctggagcacccaga

SEQ ID NO: 261799 - DNA, 20 bp, human
ggtcacccaggacctaggca

SEQ ID NO: 261800 - DNA, 20 bp, human
gtgggagggggagagcgagt

SEQ ID NO: 261801 - DNA, 20 bp, human
gcggtagcggaggggccctt

SEQ ID NO: 261802 - DNA, 20 bp, human
gggagtgacccgctctgatt

SEQ ID NO: 261803 - DNA, 20 bp, human
gagacccaggtaggcggtag

SEQ ID NO: 261804 - DNA, 20 bp, human
gcctccgctaccgcctacct

SEQ ID NO: 261805 - DNA, 20 bp, human
ggcctggccgccgggcgcct

SEQ ID NO: 261806 - DNA, 20 bp, human
gtggccactggcatgacagg

SEQ ID NO: 261807 - DNA, 20 bp, human
gaaaaccctccctgctctgg

SEQ ID NO: 261808 - DNA, 20 bp, human
gaagcctcctgtcatgccag

SEQ ID NO: 261809 - DNA, 20 bp, human
gaaaggaaatgtgtcatctg

SEQ ID NO: 261810 - DNA, 20 bp, human
gcaactaaagcacatgtcac

SEQ ID NO: 261811 - DNA, 20 bp, human
gcaatccccgcctccagagc

SEQ ID NO: 261812 - DNA, 20 bp, human
ggacagtatgctcattctat

SEQ ID NO: 261813 - DNA, 20 bp, human
gagtggccaactagagaagt

SEQ ID NO: 261814 - DNA, 20 bp, human
gaagctccaacttctctagt

SEQ ID NO: 261815 - DNA, 20 bp, human
gccccgcctccagagcaggg

SEQ ID NO: 261816 - DNA, 20 bp, human
gtaaaagcactcaaatcata

SEQ ID NO: 261817 - DNA, 20 bp, human
gagaagaaaagctgccagtt

SEQ ID NO: 261818 - DNA, 20 bp, human
gctgtaagtgataacccaac

SEQ ID NO: 261819 - DNA, 20 bp, human
gttgtggtttattgcacttc

SEQ ID NO: 261820 - DNA, 20 bp, human
gaagtgcagagtcttgccta

SEQ ID NO: 261821 - DNA, 20 bp, human
gaactatttcagtttgctag

SEQ ID NO: 261822 - DNA, 20 bp, human
ggaggaagtttatcaatagc

SEQ ID NO: 261823 - DNA, 20 bp, human
gtaaatgcctcaccaactgc

SEQ ID NO: 261824 - DNA, 20 bp, human
gtggttacctgcagttggtg

SEQ ID NO: 261825 - DNA, 20 bp, human
gatagtttctgtagaaaaag

SEQ ID NO: 261826 - DNA, 20 bp, human
ggggcgggccggccgagaaa

SEQ ID NO: 261827 - DNA, 20 bp, human
gttccagtggccggggaagt

SEQ ID NO: 261828 - DNA, 20 bp, human
ggacttgcaggactgaaggc

SEQ ID NO: 261829 - DNA, 20 bp, human
gccgaagcgaccccgagctt

SEQ ID NO: 261830 - DNA, 20 bp, human
gtgccagggccctgaaagtc

SEQ ID NO: 261831 - DNA, 20 bp, human
gggaccccggaggaaccagc

SEQ ID NO: 261832 - DNA, 20 bp, human
gccaacccattctgcggtag

SEQ ID NO: 261833 - DNA, 20 bp, human
gtgccctaaggccacctctg

SEQ ID NO: 261834 - DNA, 20 bp, human
ggggattggacggagtgcag

SEQ ID NO: 261835 - DNA, 20 bp, human
ggcagcctctaccgcagaat

SEQ ID NO: 261836 - DNA, 20 bp, human
ggaaatgagggaagcggtga

SEQ ID NO: 261837 - DNA, 20 bp, human
ggagagagcgaattgaaatg

SEQ ID NO: 261838 - DNA, 20 bp, human
ggggcagcggctcctgtcag

SEQ ID NO: 261839 - DNA, 20 bp, human
gccgcctcacggaatggcca

SEQ ID NO: 261840 - DNA, 20 bp, human
gtgggccctggcaactgctg

SEQ ID NO: 261841 - DNA, 20 bp, human
gggggtgtgtccgtgaggaa

SEQ ID NO: 261842 - DNA, 20 bp, human
gtcacggaatggccacggaa

SEQ ID NO: 261843 - DNA, 20 bp, human
gcagaaggttgccgcctctg

SEQ ID NO: 261844 - DNA, 20 bp, human
gccaccagccaggagtgacg

SEQ ID NO: 261845 - DNA, 20 bp, human
gagaccaatagcaaggaaag

SEQ ID NO: 261846 - DNA, 20 bp, human
gtatagagctagttagtggg

SEQ ID NO: 261847 - DNA, 20 bp, human
gctgcagagccccaccagcg

SEQ ID NO: 261848 - DNA, 20 bp, human
gaagctgaaccagagacaaa

SEQ ID NO: 261849 - DNA, 20 bp, human
gtgaagcctgctggaggtag

SEQ ID NO: 261850 - DNA, 20 bp, human
gccttgcaggaagcacttag

SEQ ID NO: 261851 - DNA, 20 bp, human
gggcttgaggttgccagctg

SEQ ID NO: 261852 - DNA, 20 bp, human
ggaagctcagacatcttaag

SEQ ID NO: 261853 - DNA, 20 bp, human
gggaagcacttagaggcttg

SEQ ID NO: 261854 - DNA, 20 bp, human
gaccagcgtgggcggctgag

SEQ ID NO: 261855 - DNA, 20 bp, human
gcccacccttgcacccttgc

SEQ ID NO: 261856 - DNA, 20 bp, human
gggcggctccgagtcctcga

SEQ ID NO: 261857 - DNA, 20 bp, human
gcacgcgcgcgcagtcccct

SEQ ID NO: 261858 - DNA, 20 bp, human
gggccgccgccccgagtctc

SEQ ID NO: 261859 - DNA, 20 bp, human
gcgcgcgcagtcccctcgga

SEQ ID NO: 261860 - DNA, 20 bp, human
gcgcctctccctcgaggact

SEQ ID NO: 261861 - DNA, 20 bp, human
gccgcccgcgcactcgccag

SEQ ID NO: 261862 - DNA, 20 bp, human
gtgcgcgtccgcctgagact

SEQ ID NO: 261863 - DNA, 20 bp, human
gcagtcccctcggagggcgg

SEQ ID NO: 261864 - DNA, 20 bp, human
ggcggggcggacgagagtgg

SEQ ID NO: 261865 - DNA, 20 bp, human
gctgaggggcggggctttga

SEQ ID NO: 261866 - DNA, 20 bp, human
ggacgcgcatgcacccacaa

SEQ ID NO: 261867 - DNA, 20 bp, human
gtcctcctgcacaaccagtc

SEQ ID NO: 261868 - DNA, 20 bp, human
gcatgcctaggggagcgcag

SEQ ID NO: 261869 - DNA, 20 bp, human
gaatcctgagctccggggct

SEQ ID NO: 261870 - DNA, 20 bp, human
gggcatgagtgtggccgttg

SEQ ID NO: 261871 - DNA, 20 bp, human
gcagtggagaacagagagtc

SEQ ID NO: 261872 - DNA, 20 bp, human
gcccagactggttgtgcagg

SEQ ID NO: 261873 - DNA, 20 bp, human
gggtcctctgagctggctgg

SEQ ID NO: 261874 - DNA, 20 bp, human
gttattaatcctgagctccg

SEQ ID NO: 261875 - DNA, 20 bp, human
ggagttgggccaggacagac

SEQ ID NO: 261876 - DNA, 20 bp, human
ggagctgggccaggacagat

SEQ ID NO: 261877 - DNA, 20 bp, human
gtgctcttgcataaccagtc

SEQ ID NO: 261878 - DNA, 20 bp, human
gggcatgagtgtggtttttg

SEQ ID NO: 261879 - DNA, 20 bp, human
ggtctggagtgaacgtcccc

SEQ ID NO: 261880 - DNA, 20 bp, human
gaatcgccaccgcgctcccc

SEQ ID NO: 261881 - DNA, 20 bp, human
ggtttttgtgggtgcatgcg

SEQ ID NO: 261882 - DNA, 20 bp, human
ggggcacagccttgagggtg

SEQ ID NO: 261883 - DNA, 20 bp, human
gtctccagacccatctgtcc

SEQ ID NO: 261884 - DNA, 20 bp, human
gggccccagctctggagctc

SEQ ID NO: 261885 - DNA, 20 bp, human
gaatcctgagctccagagct

SEQ ID NO: 261886 - DNA, 20 bp, human
gcgcgcggcgagttccgcag

SEQ ID NO: 261887 - DNA, 20 bp, human
gaaacccgcagctaatggct

SEQ ID NO: 261888 - DNA, 20 bp, human
gtgtgggcctcgctcgattg

SEQ ID NO: 261889 - DNA, 20 bp, human
ggcagtgatgcgccaggtgt

SEQ ID NO: 261890 - DNA, 20 bp, human
gctgagagagggagacaccc

SEQ ID NO: 261891 - DNA, 20 bp, human
gctgccacagcgaagatgaa

SEQ ID NO: 261892 - DNA, 20 bp, human
ggtgccgcaccgcctctggg

SEQ ID NO: 261893 - DNA, 20 bp, human
gggctcggcagtgatgcgcc

SEQ ID NO: 261894 - DNA, 20 bp, human
ggggcctcgctcgattgggg

SEQ ID NO: 261895 - DNA, 20 bp, human
gctgccgagccattagctgc

SEQ ID NO: 261896 - DNA, 20 bp, human
gtagcgcccgctcgtcatta

SEQ ID NO: 261897 - DNA, 20 bp, human
gcagacaaatagatccaggt

SEQ ID NO: 261898 - DNA, 20 bp, human
gacccccgggcgagcagaac

SEQ ID NO: 261899 - DNA, 20 bp, human
gcgggatcggaaggatgtat

SEQ ID NO: 261900 - DNA, 20 bp, human
gaatacaccctcctgtcagt

SEQ ID NO: 261901 - DNA, 20 bp, human
gcgggcgagcagaactggct

SEQ ID NO: 261902 - DNA, 20 bp, human
gcccccgaggccaaaccccc

SEQ ID NO: 261903 - DNA, 20 bp, human
gatgaatgacatctcgggat

SEQ ID NO: 261904 - DNA, 20 bp, human
gagggaggcggaaaaattgt

SEQ ID NO: 261905 - DNA, 20 bp, human
gactggctcggagcgggcaa

SEQ ID NO: 261906 - DNA, 20 bp, human
gaggctctcagcacgagact

SEQ ID NO: 261907 - DNA, 20 bp, human
gttggcccgagtgtcacgtc

SEQ ID NO: 261908 - DNA, 20 bp, human
gtctcagcgtgaaaccggag

SEQ ID NO: 261909 - DNA, 20 bp, human
gccatcgggccaggccacgg

SEQ ID NO: 261910 - DNA, 20 bp, human
gagcgcccgacgtgacactc

SEQ ID NO: 261911 - DNA, 20 bp, human
ggagacggagatcggcggga

SEQ ID NO: 261912 - DNA, 20 bp, human
gtgtgcgcggaatggattca

SEQ ID NO: 261913 - DNA, 20 bp, human
gtggcccgatggtcgcgccc

SEQ ID NO: 261914 - DNA, 20 bp, human
gaaaggccggtcggggaccc

SEQ ID NO: 261915 - DNA, 20 bp, human
gcatctaaggggccagagcg

SEQ ID NO: 261916 - DNA, 20 bp, human
gtccccgaagggtacaccct

SEQ ID NO: 261917 - DNA, 20 bp, human
gagcgcgtgcagtccccgaa

SEQ ID NO: 261918 - DNA, 20 bp, human
ggcggagagaaacttcgcgt

SEQ ID NO: 261919 - DNA, 20 bp, human
ggacccgggagggaacccag

SEQ ID NO: 261920 - DNA, 20 bp, human
ggagctgggctgattcattc

SEQ ID NO: 261921 - DNA, 20 bp, human
gcgcgtgggggggaacccta

SEQ ID NO: 261922 - DNA, 20 bp, human
ggagagaaacttcgcgtggg

SEQ ID NO: 261923 - DNA, 20 bp, human
gttaaaggggcgatgccact

SEQ ID NO: 261924 - DNA, 20 bp, human
gagactacgctgcctgtcgc

SEQ ID NO: 261925 - DNA, 20 bp, human
gactaggaatcctactcgat

SEQ ID NO: 261926 - DNA, 20 bp, human
gcacccacccggattcacta

SEQ ID NO: 261927 - DNA, 20 bp, human
gcctgtcgcaggaacggaag

SEQ ID NO: 261928 - DNA, 20 bp, human
gcccagctggcgtgtgggaa

SEQ ID NO: 261929 - DNA, 20 bp, human
gcgtcctccaggcctgtcgc

SEQ ID NO: 261930 - DNA, 20 bp, human
gtaaagacctggaacctgtg

SEQ ID NO: 261931 - DNA, 20 bp, human
gggccctagtgaatccgggt

SEQ ID NO: 261932 - DNA, 20 bp, human
gaatccgggtgggtgcgcgc

SEQ ID NO: 261933 - DNA, 20 bp, human
gtggaggacgtaatcccagc

SEQ ID NO: 261934 - DNA, 20 bp, human
ggtacggaagctactggggc

SEQ ID NO: 261935 - DNA, 20 bp, human
gtccaggcctgtcgcaggaa

SEQ ID NO: 261936 - DNA, 20 bp, human
gacgcccactccagaccctc

SEQ ID NO: 261937 - DNA, 20 bp, human
gcgcccgcccctccccggta

SEQ ID NO: 261938 - DNA, 20 bp, human
gtgggcgaggcctgagggtc

SEQ ID NO: 261939 - DNA, 20 bp, human
ggccacgcccccgccagaaa

SEQ ID NO: 261940 - DNA, 20 bp, human
ggggcgcacaaagctcccgg

SEQ ID NO: 261941 - DNA, 20 bp, human
ggggcgtggccttaccgggg

SEQ ID NO: 261942 - DNA, 20 bp, human
ggcgggggccgaatgggagg

SEQ ID NO: 261943 - DNA, 20 bp, human
gtgggcgtagccgtttctgg

SEQ ID NO: 261944 - DNA, 20 bp, human
gcccggcggaagtccggccg

SEQ ID NO: 261945 - DNA, 20 bp, human
gaaagctcccggcggaagtc

SEQ ID NO: 261946 - DNA, 20 bp, human
gcgtctcgctgggtagacag

SEQ ID NO: 261947 - DNA, 20 bp, human
ggggcgttgtagttccctcc

SEQ ID NO: 261948 - DNA, 20 bp, human
gagcagcggctgcagtcgta

SEQ ID NO: 261949 - DNA, 20 bp, human
gctgcggcttccaactcata

SEQ ID NO: 261950 - DNA, 20 bp, human
ggctgcagccccagttctgg

SEQ ID NO: 261951 - DNA, 20 bp, human
gcgagtggcactggcgctga

SEQ ID NO: 261952 - DNA, 20 bp, human
gtgccggcccgaactccgtg

SEQ ID NO: 261953 - DNA, 20 bp, human
gcactggcgctgatggccga

SEQ ID NO: 261954 - DNA, 20 bp, human
gcaacgcccagcagccccgg

SEQ ID NO: 261955 - DNA, 20 bp, human
gccagcgagacggagagctc

SEQ ID NO: 261956 - DNA, 20 bp, human
gcggagacgcggcacttcac

SEQ ID NO: 261957 - DNA, 20 bp, human
gaggtctcccagttaccacc

SEQ ID NO: 261958 - DNA, 20 bp, human
gagacgcggcacttcaccgg

SEQ ID NO: 261959 - DNA, 20 bp, human
gggtgtgcttatgcgagagc

SEQ ID NO: 261960 - DNA, 20 bp, human
gcgcctacctcgcgaggctg

SEQ ID NO: 261961 - DNA, 20 bp, human
gcctcctccgctcacagaga

SEQ ID NO: 261962 - DNA, 20 bp, human
ggaggtaggcggcgccgcga

SEQ ID NO: 261963 - DNA, 20 bp, human
gagacaacggcgcaaacaga

SEQ ID NO: 261964 - DNA, 20 bp, human
gtgggagacctcgccagtga

SEQ ID NO: 261965 - DNA, 20 bp, human
gaatccgtctctgtgagcgg

SEQ ID NO: 261966 - DNA, 20 bp, human
ggggcggggcgccaaccgac

SEQ ID NO: 261967 - DNA, 20 bp, human
gggaggggcgtgtcagggaa

SEQ ID NO: 261968 - DNA, 20 bp, human
gagcagcgatgggagaaaaa

SEQ ID NO: 261969 - DNA, 20 bp, human
gtccgcctggccacgcccgt

SEQ ID NO: 261970 - DNA, 20 bp, human
ggagaaggaagaagcagcga

SEQ ID NO: 261971 - DNA, 20 bp, human
gagggagcggccaatagacg

SEQ ID NO: 261972 - DNA, 20 bp, human
gggaacaaggcctcattgga

SEQ ID NO: 261973 - DNA, 20 bp, human
ggcggccaatagacgcggag

SEQ ID NO: 261974 - DNA, 20 bp, human
gccaatagacgcggaggggc

SEQ ID NO: 261975 - DNA, 20 bp, human
gcacgtgacaaactccgcgc

SEQ ID NO: 261976 - DNA, 20 bp, human
ggtggacgctggaatgcctt

SEQ ID NO: 261977 - DNA, 20 bp, human
gcgggtgctggaggtcagca

SEQ ID NO: 261978 - DNA, 20 bp, human
gcggtggcgggaagcggtga

SEQ ID NO: 261979 - DNA, 20 bp, human
gagaccggcgcgggtgctgg

SEQ ID NO: 261980 - DNA, 20 bp, human
gagccttcaggggagggtag

SEQ ID NO: 261981 - DNA, 20 bp, human
gtctccctgagatgacccga

SEQ ID NO: 261982 - DNA, 20 bp, human
gtgacctccagcacccgcgc

SEQ ID NO: 261983 - DNA, 20 bp, human
ggcgccgagtcctcgatggg

SEQ ID NO: 261984 - DNA, 20 bp, human
gcgagcgccgagtcctcgat

SEQ ID NO: 261985 - DNA, 20 bp, human
gctcgcggcgggcggaagtg

SEQ ID NO: 261986 - DNA, 20 bp, human
gaagaagccccccacctcgg

SEQ ID NO: 261987 - DNA, 20 bp, human
ggagagggcctgagttgggg

SEQ ID NO: 261988 - DNA, 20 bp, human
ggtcgccaggggcagcgaga

SEQ ID NO: 261989 - DNA, 20 bp, human
gcgcacgcggtggtcgccag

SEQ ID NO: 261990 - DNA, 20 bp, human
gtcctgctggggagcggcca

SEQ ID NO: 261991 - DNA, 20 bp, human
gtggggagcggccatggggc

SEQ ID NO: 261992 - DNA, 20 bp, human
gcagcgagagggcctgagtt

SEQ ID NO: 261993 - DNA, 20 bp, human
ggcgccggaagcacgggtcc

SEQ ID NO: 261994 - DNA, 20 bp, human
gtccccgagctgaagtcgct

SEQ ID NO: 261995 - DNA, 20 bp, human
gagctcggggacctgcccca

SEQ ID NO: 261996 - DNA, 20 bp, human
gaggaggatgtgtacctctg

SEQ ID NO: 261997 - DNA, 20 bp, human
ggcactaagaggttctgggt

SEQ ID NO: 261998 - DNA, 20 bp, human
gtgggtaggctggtcaagac

SEQ ID NO: 261999 - DNA, 20 bp, human
gacacttccctgaggggcgg

SEQ ID NO: 262000 - DNA, 20 bp, human
ggctgggcgacacttccctg

SEQ ID NO: 262001 - DNA, 20 bp, human
ggtggcaggctcttgtgaag

SEQ ID NO: 262002 - DNA, 20 bp, human
gtgggcagagtgtgcagata

SEQ ID NO: 262003 - DNA, 20 bp, human
ggggagggaggagcctcggt

SEQ ID NO: 262004 - DNA, 20 bp, human
gtgcccaccaccccaggttg

SEQ ID NO: 262005 - DNA, 20 bp, human
gaggatgtgtacctctgcgg

SEQ ID NO: 262006 - DNA, 20 bp, human
ggccgggacaccatccatca

SEQ ID NO: 262007 - DNA, 20 bp, human
ggacccctaaatatcatgcc

SEQ ID NO: 262008 - DNA, 20 bp, human
gcagcagggcctcagagcat

SEQ ID NO: 262009 - DNA, 20 bp, human
ggtctggtgaaatggatcat

SEQ ID NO: 262010 - DNA, 20 bp, human
gcacagaaacagtgggtagg

SEQ ID NO: 262011 - DNA, 20 bp, human
gtgtcccggcatgatattta

SEQ ID NO: 262012 - DNA, 20 bp, human
gagcccaagtctggggtgtt

SEQ ID NO: 262013 - DNA, 20 bp, human
gtgcaaagggaacttctgtc

SEQ ID NO: 262014 - DNA, 20 bp, human
gcttgaagatctgacatgca

SEQ ID NO: 262015 - DNA, 20 bp, human
gacagtgggtaggagggtgt

SEQ ID NO: 262016 - DNA, 20 bp, human
ggggtttaggaagcccagag

SEQ ID NO: 262017 - DNA, 20 bp, human
gttggactcacagtccagaa

SEQ ID NO: 262018 - DNA, 20 bp, human
gccaccctccctcttcactt

SEQ ID NO: 262019 - DNA, 20 bp, human
gcctgctccgtgttgaacca

SEQ ID NO: 262020 - DNA, 20 bp, human
gtgtgagtccaaggatgcca

SEQ ID NO: 262021 - DNA, 20 bp, human
gtttgggtcatcactacctg

SEQ ID NO: 262022 - DNA, 20 bp, human
gaccagggctgtgcggtgct

SEQ ID NO: 262023 - DNA, 20 bp, human
ggggagggggagtggctcaa

SEQ ID NO: 262024 - DNA, 20 bp, human
gacccaaagctggcaaggct

SEQ ID NO: 262025 - DNA, 20 bp, human
gtgatgacccaaagctggca

SEQ ID NO: 262026 - DNA, 20 bp, human
ggcgcccaggaagtcaggac

SEQ ID NO: 262027 - DNA, 20 bp, human
gcgtccggcgccaggagcgg

SEQ ID NO: 262028 - DNA, 20 bp, human
gggcgggagcggctctgatg

SEQ ID NO: 262029 - DNA, 20 bp, human
gccagtcgggcccacacgtc

SEQ ID NO: 262030 - DNA, 20 bp, human
ggctcctggcgccggacgtg

SEQ ID NO: 262031 - DNA, 20 bp, human
gctgtcagaggcttcccggg

SEQ ID NO: 262032 - DNA, 20 bp, human
ggcagccgctgcccctcttc

SEQ ID NO: 262033 - DNA, 20 bp, human
gcccgcccggcctgacctcc

SEQ ID NO: 262034 - DNA, 20 bp, human
gtgtacagatgcccaggttc

SEQ ID NO: 262035 - DNA, 20 bp, human
gcttccagtcctgacttcct

SEQ ID NO: 262036 - DNA, 20 bp, human
gaattccagaggcgcggaag

SEQ ID NO: 262037 - DNA, 20 bp, human
gtgggtgaagagaattccag

SEQ ID NO: 262038 - DNA, 20 bp, human
gttcctgcgcgcccaggaga

SEQ ID NO: 262039 - DNA, 20 bp, human
gcgcaggagtctccaccaat

SEQ ID NO: 262040 - DNA, 20 bp, human
gagtgaggaggcgggactaa

SEQ ID NO: 262041 - DNA, 20 bp, human
gtgttctctctaagcactct

SEQ ID NO: 262042 - DNA, 20 bp, human
gagagagaacacgcgcgtcg

SEQ ID NO: 262043 - DNA, 20 bp, human
gaattctcttcacccattgg

SEQ ID NO: 262044 - DNA, 20 bp, human
ggaagagaattccagaggcg

SEQ ID NO: 262045 - DNA, 20 bp, human
ggcctcctcacttcagtgat

SEQ ID NO: 262046 - DNA, 20 bp, human
gcgccagggaggttgtcggg

SEQ ID NO: 262047 - DNA, 20 bp, human
gggccggcgaataaaacgag

SEQ ID NO: 262048 - DNA, 20 bp, human
gcgcgcgccagggaggttgt

SEQ ID NO: 262049 - DNA, 20 bp, human
gcggcgaaagaaccgaaaaa

SEQ ID NO: 262050 - DNA, 20 bp, human
gcggcgcaggatgagcctca

SEQ ID NO: 262051 - DNA, 20 bp, human
gcgtatgaggcggtgacaat

SEQ ID NO: 262052 - DNA, 20 bp, human
gggtctgcgctgttcctcgg

SEQ ID NO: 262053 - DNA, 20 bp, human
gcccctcccgacaacctccc

SEQ ID NO: 262054 - DNA, 20 bp, human
gctcgacgctaccgtgtatg

SEQ ID NO: 262055 - DNA, 20 bp, human
ggatcaaagttcctcataca

SEQ ID NO: 262056 - DNA, 20 bp, human
ggggtcgcgcgccttctgcc

SEQ ID NO: 262057 - DNA, 20 bp, human
gcgggggcgcgcggaacgcc

SEQ ID NO: 262058 - DNA, 20 bp, human
gagggactagtcgcgagaga

SEQ ID NO: 262059 - DNA, 20 bp, human
ggtacccccgcgtgtggcac

SEQ ID NO: 262060 - DNA, 20 bp, human
gtgtgagctggggctacggg

SEQ ID NO: 262061 - DNA, 20 bp, human
gcggcgccgcgggaacgacg

SEQ ID NO: 262062 - DNA, 20 bp, human
gctcgcgactagtccctcct

SEQ ID NO: 262063 - DNA, 20 bp, human
gcaagtggcgcgagcgcgaa

SEQ ID NO: 262064 - DNA, 20 bp, human
ggtcgtggggagtcagagaa

SEQ ID NO: 262065 - DNA, 20 bp, human
gactagtcgcgagagagggc

SEQ ID NO: 262066 - DNA, 20 bp, human
gcggacgcggtgacgcaagg

SEQ ID NO: 262067 - DNA, 20 bp, human
gtcggcctgcgggtagccag

SEQ ID NO: 262068 - DNA, 20 bp, human
gcgtgtcgagcctgagggag

SEQ ID NO: 262069 - DNA, 20 bp, human
gcgacggacgcggtgacgca

SEQ ID NO: 262070 - DNA, 20 bp, human
gtggcactttgtggcaaagg

SEQ ID NO: 262071 - DNA, 20 bp, human
ggttctgcgtaatgtccgct

SEQ ID NO: 262072 - DNA, 20 bp, human
gagggggcgtgtcgagcctg

SEQ ID NO: 262073 - DNA, 20 bp, human
gtgatgatcaagtcaggcag

SEQ ID NO: 262074 - DNA, 20 bp, human
gcgcagaacgccgacggacg

SEQ ID NO: 262075 - DNA, 20 bp, human
gtagttctctgggaaatgct

SEQ ID NO: 262076 - DNA, 20 bp, human
gcctgcgcggagcccaagaa

SEQ ID NO: 262077 - DNA, 20 bp, human
gtggccgtcggtccgttctt

SEQ ID NO: 262078 - DNA, 20 bp, human
ggagccatgttgggaatcgc

SEQ ID NO: 262079 - DNA, 20 bp, human
gctgcaagggacctcgacgc

SEQ ID NO: 262080 - DNA, 20 bp, human
ggagcccaagaacggaccga

SEQ ID NO: 262081 - DNA, 20 bp, human
gaggctgaagtgcgcctgcg

SEQ ID NO: 262082 - DNA, 20 bp, human
gccgacggccattttgagcg

SEQ ID NO: 262083 - DNA, 20 bp, human
gagcggaagtgggtgtgacg

SEQ ID NO: 262084 - DNA, 20 bp, human
ggcgggaccaagagcggaag

SEQ ID NO: 262085 - DNA, 20 bp, human
gttcccagccacgctcaaaa

SEQ ID NO: 262086 - DNA, 20 bp, human
gtgaaccgagcgtgacgttg

SEQ ID NO: 262087 - DNA, 20 bp, human
gctattgcggaagtgagggg

SEQ ID NO: 262088 - DNA, 20 bp, human
gtgcgcaagatgagctattg

SEQ ID NO: 262089 - DNA, 20 bp, human
gtgagctattgcggaagtga

SEQ ID NO: 262090 - DNA, 20 bp, human
ggagaggccgagagaaattt

SEQ ID NO: 262091 - DNA, 20 bp, human
gacactgcgcctgcgcaagt

SEQ ID NO: 262092 - DNA, 20 bp, human
gcaaacctcaacgtcacgct

SEQ ID NO: 262093 - DNA, 20 bp, human
ggcgctcggcccacttgcgc

SEQ ID NO: 262094 - DNA, 20 bp, human
gcctagtgggcgcagaacct

SEQ ID NO: 262095 - DNA, 20 bp, human
gaccccaagccgcctagccg

SEQ ID NO: 262096 - DNA, 20 bp, human
gcgccccgtccagtggacca

SEQ ID NO: 262097 - DNA, 20 bp, human
gcatccctggtccactggac

SEQ ID NO: 262098 - DNA, 20 bp, human
gacgccccctggtgacaaac

SEQ ID NO: 262099 - DNA, 20 bp, human
gcggtgaggcgtggggtgac

SEQ ID NO: 262100 - DNA, 20 bp, human
gttggcgggcggtgaggcgt

SEQ ID NO: 262101 - DNA, 20 bp, human
gtcaccgcccgccaagctga

SEQ ID NO: 262102 - DNA, 20 bp, human
gcactggacggggcgatgga

SEQ ID NO: 262103 - DNA, 20 bp, human
gcgcatccccgcttcatccc

SEQ ID NO: 262104 - DNA, 20 bp, human
gaaaacgacgggaaccccgg

SEQ ID NO: 262105 - DNA, 20 bp, human
gggggaatatgatgtctaga

SEQ ID NO: 262106 - DNA, 20 bp, human
gtgcgcgtgtggttgaggat

SEQ ID NO: 262107 - DNA, 20 bp, human
gtaccccgggacaaatccgg

SEQ ID NO: 262108 - DNA, 20 bp, human
ggcgcctgcgcgtgtggttg

SEQ ID NO: 262109 - DNA, 20 bp, human
gccggggcgccgagtcggag

SEQ ID NO: 262110 - DNA, 20 bp, human
gcgcccccggatttgtcccg

SEQ ID NO: 262111 - DNA, 20 bp, human
gtgcgggcggcgggccatgg

SEQ ID NO: 262112 - DNA, 20 bp, human
gttactgcggaactgtgcct

SEQ ID NO: 262113 - DNA, 20 bp, human
gacgctggcgcctgcgcgtg

SEQ ID NO: 262114 - DNA, 20 bp, human
ggaggctacggggctcggtt

SEQ ID NO: 262115 - DNA, 20 bp, human
ggaacttcagaggtccacgc

SEQ ID NO: 262116 - DNA, 20 bp, human
gaggccgcaccctagatcac

SEQ ID NO: 262117 - DNA, 20 bp, human
gggtgccccaccctaaacgc

SEQ ID NO: 262118 - DNA, 20 bp, human
ggaagcctgcgtttagggtg

SEQ ID NO: 262119 - DNA, 20 bp, human
gaaccctgtgatctagggtg

SEQ ID NO: 262120 - DNA, 20 bp, human
ggggcgtctgattatagtgt

SEQ ID NO: 262121 - DNA, 20 bp, human
gccaacaaccctgtgatcta

SEQ ID NO: 262122 - DNA, 20 bp, human
gggcgccccaccccaatcgc

SEQ ID NO: 262123 - DNA, 20 bp, human
gcgcacgcgtcccgtctcct

SEQ ID NO: 262124 - DNA, 20 bp, human
ggggagcctgcgattggggt

SEQ ID NO: 262125 - DNA, 20 bp, human
gaaagtgccaccctaatcgc

SEQ ID NO: 262126 - DNA, 20 bp, human
gacaataaggcgaacccgaa

SEQ ID NO: 262127 - DNA, 20 bp, human
gcgaacgcggcctggagttg

SEQ ID NO: 262128 - DNA, 20 bp, human
gactccaggccgcgttcgga

SEQ ID NO: 262129 - DNA, 20 bp, human
gtgcgcaggcgcagctcagt

SEQ ID NO: 262130 - DNA, 20 bp, human
gtccttgccaatagtagaca

SEQ ID NO: 262131 - DNA, 20 bp, human
gtagaggccatgtttacaat

SEQ ID NO: 262132 - DNA, 20 bp, human
gcggcctggagttgtggagt

SEQ ID NO: 262133 - DNA, 20 bp, human
gctaggccgtgagttctcat

SEQ ID NO: 262134 - DNA, 20 bp, human
gggcccagtctctcgctaag

SEQ ID NO: 262135 - DNA, 20 bp, human
gaatagtagacatggcagct

SEQ ID NO: 262136 - DNA, 20 bp, human
gtccaaggtggcagtgattg

SEQ ID NO: 262137 - DNA, 20 bp, human
gcgcggccaggctgtcagat

SEQ ID NO: 262138 - DNA, 20 bp, human
gggaaacggaaagtcctcaa

SEQ ID NO: 262139 - DNA, 20 bp, human
gggccaggctgtcagatagg

SEQ ID NO: 262140 - DNA, 20 bp, human
gaggctgtcagataggtggc

SEQ ID NO: 262141 - DNA, 20 bp, human
gggaccgctactgccggaaa

SEQ ID NO: 262142 - DNA, 20 bp, human
ggggtcgcgtgttttgtgac

SEQ ID NO: 262143 - DNA, 20 bp, human
gacagggacccgtgagctga

SEQ ID NO: 262144 - DNA, 20 bp, human
gcgacccgagacactggaag

SEQ ID NO: 262145 - DNA, 20 bp, human
gtccggcagtagcggtccgt

SEQ ID NO: 262146 - DNA, 20 bp, human
gggaaaccgtagatccgggg

SEQ ID NO: 262147 - DNA, 20 bp, human
gaactccagttcaccaggac

SEQ ID NO: 262148 - DNA, 20 bp, human
gggaaaccgcagatccacgg

SEQ ID NO: 262149 - DNA, 20 bp, human
ggaactgcggcggcgctatc

SEQ ID NO: 262150 - DNA, 20 bp, human
gcctgacctccgtggatctg

SEQ ID NO: 262151 - DNA, 20 bp, human
ggccggaaaccgtagatccg

SEQ ID NO: 262152 - DNA, 20 bp, human
gcaggcaccactggtcacga

SEQ ID NO: 262153 - DNA, 20 bp, human
gtgtctccggggaactgcgg

SEQ ID NO: 262154 - DNA, 20 bp, human
gcccgacctccccggatcta

SEQ ID NO: 262155 - DNA, 20 bp, human
gtccccggaaccggaagtga

SEQ ID NO: 262156 - DNA, 20 bp, human
gcagtcccacctcctaactc

SEQ ID NO: 262157 - DNA, 20 bp, human
ggtaaagcggatcaatgcca

SEQ ID NO: 262158 - DNA, 20 bp, human
ggcaacgccattggacattt

SEQ ID NO: 262159 - DNA, 20 bp, human
gaagccacgtgcggacgccc

SEQ ID NO: 262160 - DNA, 20 bp, human
ggttgccagagttaggaggt

SEQ ID NO: 262161 - DNA, 20 bp, human
gccgggggcccagagtaaag

SEQ ID NO: 262162 - DNA, 20 bp, human
gctaactctggcaacgccat

SEQ ID NO: 262163 - DNA, 20 bp, human
gctgggcggagccagattgt

SEQ ID NO: 262164 - DNA, 20 bp, human
gtaaccagtgcgcacgcgcc

SEQ ID NO: 262165 - DNA, 20 bp, human
gcaacctgaccagggcctca

SEQ ID NO: 262166 - DNA, 20 bp, human
ggcgcccctggaggcccgga

SEQ ID NO: 262167 - DNA, 20 bp, human
gaccctgcacaactgggacc

SEQ ID NO: 262168 - DNA, 20 bp, human
gggcactacagcgcccctgg

SEQ ID NO: 262169 - DNA, 20 bp, human
gggcccggtcccagttgtgc

SEQ ID NO: 262170 - DNA, 20 bp, human
gcccagttgtgcagggtagc

SEQ ID NO: 262171 - DNA, 20 bp, human
ggggctgtcgagagagcggc

SEQ ID NO: 262172 - DNA, 20 bp, human
gtccggctaccctgcacaac

SEQ ID NO: 262173 - DNA, 20 bp, human
gggaggcactacagcgcccc

SEQ ID NO: 262174 - DNA, 20 bp, human
ggggctgcctcaaacgtctg

SEQ ID NO: 262175 - DNA, 20 bp, human
ggttctccctccgggcctcc

SEQ ID NO: 262176 - DNA, 20 bp, human
gactgccgggagagctcgat

SEQ ID NO: 262177 - DNA, 20 bp, human
ggaagcccatcgagctctcc

SEQ ID NO: 262178 - DNA, 20 bp, human
gctgcgcgccgcccggtgtc

SEQ ID NO: 262179 - DNA, 20 bp, human
gcgagctctcccggcagtgg

SEQ ID NO: 262180 - DNA, 20 bp, human
ggaagcccgaggccgggtcc

SEQ ID NO: 262181 - DNA, 20 bp, human
ggggccgggggactcccagt

SEQ ID NO: 262182 - DNA, 20 bp, human
gtcctcggaacgaggcgccg

SEQ ID NO: 262183 - DNA, 20 bp, human
gccagtcccagaccccggtg

SEQ ID NO: 262184 - DNA, 20 bp, human
ggagccatcgccgaagcccg

SEQ ID NO: 262185 - DNA, 20 bp, human
gcgggagccccaccggggtc

SEQ ID NO: 262186 - DNA, 20 bp, human
gtagaaaggcgtctgggcag

SEQ ID NO: 262187 - DNA, 20 bp, human
gcacgccacgggaaatgcca

SEQ ID NO: 262188 - DNA, 20 bp, human
gaaggtggggacgcgacgaa

SEQ ID NO: 262189 - DNA, 20 bp, human
ggcaggggaaagtcgatgcg

SEQ ID NO: 262190 - DNA, 20 bp, human
gcacgggaaatgccaaggtg

SEQ ID NO: 262191 - DNA, 20 bp, human
gcgtgtcgaaagtgcggcgg

SEQ ID NO: 262192 - DNA, 20 bp, human
ggaaacctagaaaggcgtct

SEQ ID NO: 262193 - DNA, 20 bp, human
gggaaagtcgatgcgagggc

SEQ ID NO: 262194 - DNA, 20 bp, human
gccggggccgctcacgccac

SEQ ID NO: 262195 - DNA, 20 bp, human
gctgcaggtcccggagctga

SEQ ID NO: 262196 - DNA, 20 bp, human
ggagctgcgagaagccattg

SEQ ID NO: 262197 - DNA, 20 bp, human
gcagactcaaagcgtgattg

SEQ ID NO: 262198 - DNA, 20 bp, human
gctcaaagcgtgattgggga

SEQ ID NO: 262199 - DNA, 20 bp, human
gcggcctcccaaagccgcaa

SEQ ID NO: 262200 - DNA, 20 bp, human
gggaacttcacgttcagaaa

SEQ ID NO: 262201 - DNA, 20 bp, human
gaggcgcggcggcggaaaaa

SEQ ID NO: 262202 - DNA, 20 bp, human
ggcggcgcgcaaggaaagat

SEQ ID NO: 262203 - DNA, 20 bp, human
gcgtgagaggactgagcaaa

SEQ ID NO: 262204 - DNA, 20 bp, human
gatggcttctcgcagctcgc

SEQ ID NO: 262205 - DNA, 20 bp, human
gaagccattgcggctttggg

SEQ ID NO: 262206 - DNA, 20 bp, human
ggggcccgcccccttggaac

SEQ ID NO: 262207 - DNA, 20 bp, human
ggggaacgcccacacctgaa

SEQ ID NO: 262208 - DNA, 20 bp, human
ggggcggggagggtgaccgg

SEQ ID NO: 262209 - DNA, 20 bp, human
gatgcaaagtgaacggctaa

SEQ ID NO: 262210 - DNA, 20 bp, human
ggaccggaggggacgaggga

SEQ ID NO: 262211 - DNA, 20 bp, human
gggaaccaatcccgttccaa

SEQ ID NO: 262212 - DNA, 20 bp, human
gcgcccccttggaacgggat

SEQ ID NO: 262213 - DNA, 20 bp, human
gaaccgagatgcaaagtgaa

SEQ ID NO: 262214 - DNA, 20 bp, human
gttaagaggcagaattatgt

SEQ ID NO: 262215 - DNA, 20 bp, human
gtcccctccctcgtcccctc

SEQ ID NO: 262216 - DNA, 20 bp, human
gtggccgagcgtcacgtccg

SEQ ID NO: 262217 - DNA, 20 bp, human
gaggtcagcgctgtcgtgtc

SEQ ID NO: 262218 - DNA, 20 bp, human
gcgggctgcgtggatggatg

SEQ ID NO: 262219 - DNA, 20 bp, human
ggcggccgggggttatgaat

SEQ ID NO: 262220 - DNA, 20 bp, human
ggcgcggcgttgggggcgta

SEQ ID NO: 262221 - DNA, 20 bp, human
gaacccccggccgcgggccg

SEQ ID NO: 262222 - DNA, 20 bp, human
ggctcggccaatggcagcgc

SEQ ID NO: 262223 - DNA, 20 bp, human
ggggttatgaatgggcgcag

SEQ ID NO: 262224 - DNA, 20 bp, human
gcccccccggacgtgacgct

SEQ ID NO: 262225 - DNA, 20 bp, human
ggggccgcggggctcgcacc

SEQ ID NO: 262226 - DNA, 20 bp, human
gaacgcgtggtgtctcgttt

SEQ ID NO: 262227 - DNA, 20 bp, human
gagcctgagcgcgcctgcct

SEQ ID NO: 262228 - DNA, 20 bp, human
ggcctgggaaaacactgcag

SEQ ID NO: 262229 - DNA, 20 bp, human
gaccgctgcagtgttttccc

SEQ ID NO: 262230 - DNA, 20 bp, human
gaaaacactgcagcggtgct

SEQ ID NO: 262231 - DNA, 20 bp, human
gcggactcctcctgtccagc

SEQ ID NO: 262232 - DNA, 20 bp, human
gggtgtctcgtttgggttta

SEQ ID NO: 262233 - DNA, 20 bp, human
gggtgagcgtataacattcc

SEQ ID NO: 262234 - DNA, 20 bp, human
gtgcgcatgcgggagctgcc

SEQ ID NO: 262235 - DNA, 20 bp, human
gagagagcttgttggaatga

SEQ ID NO: 262236 - DNA, 20 bp, human
ggatgggaggagataccata

SEQ ID NO: 262237 - DNA, 20 bp, human
gccaggagcgaatcagggct

SEQ ID NO: 262238 - DNA, 20 bp, human
gtcccagccaggagcgaatc

SEQ ID NO: 262239 - DNA, 20 bp, human
gtaaggaaagagatcaggat

SEQ ID NO: 262240 - DNA, 20 bp, human
gggccagttgccgactggag

SEQ ID NO: 262241 - DNA, 20 bp, human
gaggagccaggctgctgcta

SEQ ID NO: 262242 - DNA, 20 bp, human
ggagcgaatcagggctggga

SEQ ID NO: 262243 - DNA, 20 bp, human
ggctgctaaggaaagagatc

SEQ ID NO: 262244 - DNA, 20 bp, human
gtgtgagttgcagtacttgc

SEQ ID NO: 262245 - DNA, 20 bp, human
gcagaggctgtgataactca

SEQ ID NO: 262246 - DNA, 20 bp, human
gcgagggcgtgtggagcgcg

SEQ ID NO: 262247 - DNA, 20 bp, human
gcaccgcgggtgcccaggaa

SEQ ID NO: 262248 - DNA, 20 bp, human
ggcacccgcggtggatggga

SEQ ID NO: 262249 - DNA, 20 bp, human
gagccccacaggcctttcct

SEQ ID NO: 262250 - DNA, 20 bp, human
gcagaagctggcccctcggt

SEQ ID NO: 262251 - DNA, 20 bp, human
gcagggaagttgtttggctg

SEQ ID NO: 262252 - DNA, 20 bp, human
gaagtgagcgcctggagcaa

SEQ ID NO: 262253 - DNA, 20 bp, human
gaagtggagcgtcaccgaaa

SEQ ID NO: 262254 - DNA, 20 bp, human
gggaaaggattggctttcgg

SEQ ID NO: 262255 - DNA, 20 bp, human
ggcggggaggagagccccac

SEQ ID NO: 262256 - DNA, 20 bp, human
ggccgggcgccggggattgt

SEQ ID NO: 262257 - DNA, 20 bp, human
gcggccccgcgcccctgacc

SEQ ID NO: 262258 - DNA, 20 bp, human
gccgcggtgacacccgggtc

SEQ ID NO: 262259 - DNA, 20 bp, human
gcctcggcggtcttcggacg

SEQ ID NO: 262260 - DNA, 20 bp, human
ggtggctcgggagtcagacc

SEQ ID NO: 262261 - DNA, 20 bp, human
gaagacccgaccgcagatgg

SEQ ID NO: 262262 - DNA, 20 bp, human
ggggagcggcggatcaggcg

SEQ ID NO: 262263 - DNA, 20 bp, human
ggcggggaggatgctcccgg

SEQ ID NO: 262264 - DNA, 20 bp, human
gctcccggcggcgtgggaac

SEQ ID NO: 262265 - DNA, 20 bp, human
ggggaggcctcggcggtctt

SEQ ID NO: 262266 - DNA, 20 bp, human
gcccccctgacaaggggagg

SEQ ID NO: 262267 - DNA, 20 bp, human
gtgtcaggagtcaaaggggt

SEQ ID NO: 262268 - DNA, 20 bp, human
ggctgctttgcatgttgatt

SEQ ID NO: 262269 - DNA, 20 bp, human
gttgcatgttgattggggga

SEQ ID NO: 262270 - DNA, 20 bp, human
ggcctatgacagctgcaaat

SEQ ID NO: 262271 - DNA, 20 bp, human
gttccccccctgacaagggg

SEQ ID NO: 262272 - DNA, 20 bp, human
ggcagcttggaaaaggtgct

SEQ ID NO: 262273 - DNA, 20 bp, human
gataaggataagaaactgtc

SEQ ID NO: 262274 - DNA, 20 bp, human
gaggagtcaaaggggtgggc

SEQ ID NO: 262275 - DNA, 20 bp, human
gcctcctcctccccttgtca

SEQ ID NO: 262276 - DNA, 20 bp, human
gctccatgggcagacctaca

SEQ ID NO: 262277 - DNA, 20 bp, human
gcgctgctgtttggtgggga

SEQ ID NO: 262278 - DNA, 20 bp, human
gactccccaaagatcttaat

SEQ ID NO: 262279 - DNA, 20 bp, human
ggaaagccccgaggctccat

SEQ ID NO: 262280 - DNA, 20 bp, human
gaggctgcgcaaacaaatcg

SEQ ID NO: 262281 - DNA, 20 bp, human
gtactactgaaacaggtctg

SEQ ID NO: 262282 - DNA, 20 bp, human
gagtggattccctaagtttc

SEQ ID NO: 262283 - DNA, 20 bp, human
gtggtaactactgttgcaag

SEQ ID NO: 262284 - DNA, 20 bp, human
gggtctgcccatggagcctc

SEQ ID NO: 262285 - DNA, 20 bp, human
gtgttgcatttaaaccaata

SEQ ID NO: 262286 - DNA, 20 bp, human
gaggaggtgcggggtgtcgg

SEQ ID NO: 262287 - DNA, 20 bp, human
gacccctgtgaaaggaacga

SEQ ID NO: 262288 - DNA, 20 bp, human
gagagcgcgctcactctcgc

SEQ ID NO: 262289 - DNA, 20 bp, human
gggtccccgcgccgctgcgt

SEQ ID NO: 262290 - DNA, 20 bp, human
ggggtcatgcctgggttgca

SEQ ID NO: 262291 - DNA, 20 bp, human
gccgctgcgtgggcgcgtgg

SEQ ID NO: 262292 - DNA, 20 bp, human
gaggatgtgctgccccgggg

SEQ ID NO: 262293 - DNA, 20 bp, human
ggcgcgacgctgggctacgc

SEQ ID NO: 262294 - DNA, 20 bp, human
gctacgcgggcgcacacacc

SEQ ID NO: 262295 - DNA, 20 bp, human
gcccggcccagggaggagaa

SEQ ID NO: 262296 - DNA, 20 bp, human
gaccgggcggggaagctttt

SEQ ID NO: 262297 - DNA, 20 bp, human
gtgtctccgaggcactaaga

SEQ ID NO: 262298 - DNA, 20 bp, human
gcagaagctgcttgtctccg

SEQ ID NO: 262299 - DNA, 20 bp, human
ggaacgaggtgtggattgtg

SEQ ID NO: 262300 - DNA, 20 bp, human
gtaggctccgcccactccgc

SEQ ID NO: 262301 - DNA, 20 bp, human
gactaagaggggcgtggcca

SEQ ID NO: 262302 - DNA, 20 bp, human
ggcccggcgagccacgccca

SEQ ID NO: 262303 - DNA, 20 bp, human
gcacgcccctcttagtgcct

SEQ ID NO: 262304 - DNA, 20 bp, human
ggagcgctaggcagtcctga

SEQ ID NO: 262305 - DNA, 20 bp, human
gctcgccgggccggcggagt

SEQ ID NO: 262306 - DNA, 20 bp, human
ggcgccacccgggacatcca

SEQ ID NO: 262307 - DNA, 20 bp, human
gaggccgccagggacgcggg

SEQ ID NO: 262308 - DNA, 20 bp, human
gtccctggcggcctcccccg

SEQ ID NO: 262309 - DNA, 20 bp, human
ggggaggccgccagggacgc

SEQ ID NO: 262310 - DNA, 20 bp, human
gacgtcgccaccggctactg

SEQ ID NO: 262311 - DNA, 20 bp, human
ggggccctggatgtcccggg

SEQ ID NO: 262312 - DNA, 20 bp, human
gtcggggccctggatgtccc

SEQ ID NO: 262313 - DNA, 20 bp, human
gggtcaaataaaaacggagt

SEQ ID NO: 262314 - DNA, 20 bp, human
gagcaggtggggatcgacag

SEQ ID NO: 262315 - DNA, 20 bp, human
gaggctgcagccgctcgagt

SEQ ID NO: 262316 - DNA, 20 bp, human
gtgcaggctgacataaggcc

SEQ ID NO: 262317 - DNA, 20 bp, human
gagtcattaaagccatgtgc

SEQ ID NO: 262318 - DNA, 20 bp, human
gaaacaaagtgatacacgct

SEQ ID NO: 262319 - DNA, 20 bp, human
gctccagattagctaaataa

SEQ ID NO: 262320 - DNA, 20 bp, human
gccatgtgcaggctgacata

SEQ ID NO: 262321 - DNA, 20 bp, human
gagatggtgttgtatagcaa

SEQ ID NO: 262322 - DNA, 20 bp, human
gaaagaagctttattggatt

SEQ ID NO: 262323 - DNA, 20 bp, human
gtagggaaacctgatgctga

SEQ ID NO: 262324 - DNA, 20 bp, human
gtagagaagtattttgctta

SEQ ID NO: 262325 - DNA, 20 bp, human
ggattagctaaataaaggcc

SEQ ID NO: 262326 - DNA, 20 bp, human
gctgggaggctgcacccgcc

SEQ ID NO: 262327 - DNA, 20 bp, human
gaaagcggcgctggcagggg

SEQ ID NO: 262328 - DNA, 20 bp, human
gcctgagtgcggggttttgg

SEQ ID NO: 262329 - DNA, 20 bp, human
gggtgtctggagaactggta

SEQ ID NO: 262330 - DNA, 20 bp, human
gcaaacgctgaagtgagatg

SEQ ID NO: 262331 - DNA, 20 bp, human
gacggcttccaaagcggcgc

SEQ ID NO: 262332 - DNA, 20 bp, human
gtcccagacggcttccaaag

SEQ ID NO: 262333 - DNA, 20 bp, human
ggggtgaagcatcggtatga

SEQ ID NO: 262334 - DNA, 20 bp, human
gcacgcgccgacaggaggcg

SEQ ID NO: 262335 - DNA, 20 bp, human
gcgcactcaggagtcctggc

SEQ ID NO: 262336 - DNA, 20 bp, human
gcccacgcagagtgcgctca

SEQ ID NO: 262337 - DNA, 20 bp, human
gcgggcgcccgtccaatcac

SEQ ID NO: 262338 - DNA, 20 bp, human
ggacgggaggcggggaggat

SEQ ID NO: 262339 - DNA, 20 bp, human
ggcggcggggttcgctgtaa

SEQ ID NO: 262340 - DNA, 20 bp, human
ggccctgagcgcactctgcg

SEQ ID NO: 262341 - DNA, 20 bp, human
gtgcgctcagggctcgtggg

SEQ ID NO: 262342 - DNA, 20 bp, human
ggagtgcgctcagggctcgt

SEQ ID NO: 262343 - DNA, 20 bp, human
gaatcggggcggcgcttgat

SEQ ID NO: 262344 - DNA, 20 bp, human
gtcgctgtaagggacgccac

SEQ ID NO: 262345 - DNA, 20 bp, human
gagcgcactctgcgtggggc

SEQ ID NO: 262346 - DNA, 20 bp, human
gtcccctcgcagatgcaagt

SEQ ID NO: 262347 - DNA, 20 bp, human
gctcgcagatgcaagtgggg

SEQ ID NO: 262348 - DNA, 20 bp, human
gatggcggcagccgggcctc

SEQ ID NO: 262349 - DNA, 20 bp, human
gtgcgccccccgcaagatgg

SEQ ID NO: 262350 - DNA, 20 bp, human
gggggcgcacctcacaggtc

SEQ ID NO: 262351 - DNA, 20 bp, human
gcgggaaggggcgtggtccc

SEQ ID NO: 262352 - DNA, 20 bp, human
ggccaggtgcagccgcccca

SEQ ID NO: 262353 - DNA, 20 bp, human
gtgcggggggcgcacctcac

SEQ ID NO: 262354 - DNA, 20 bp, human
ggctgccgccatcttgcggg

SEQ ID NO: 262355 - DNA, 20 bp, human
gaggtgcgccccccgcaaga

SEQ ID NO: 262356 - DNA, 20 bp, human
gaggaggcgcccgagagcgg

SEQ ID NO: 262357 - DNA, 20 bp, human
gcgcccaaggggcagccggc

SEQ ID NO: 262358 - DNA, 20 bp, human
gggtgcgcaccccctctcct

SEQ ID NO: 262359 - DNA, 20 bp, human
gaggggacccccagcatgaa

SEQ ID NO: 262360 - DNA, 20 bp, human
gtggaggtgccccccagttg

SEQ ID NO: 262361 - DNA, 20 bp, human
gcgcgcgcccaaggggcagc

SEQ ID NO: 262362 - DNA, 20 bp, human
ggcagggggaacactcagtg

SEQ ID NO: 262363 - DNA, 20 bp, human
gagcgggggcgcgcgcccaa

SEQ ID NO: 262364 - DNA, 20 bp, human
gactcagtggggaggatcgg

SEQ ID NO: 262365 - DNA, 20 bp, human
gcatggggagggggcacggg

SEQ ID NO: 262366 - DNA, 20 bp, human
gatgaggatgaggttctgcg

SEQ ID NO: 262367 - DNA, 20 bp, human
gcagagctgggcggccagag

SEQ ID NO: 262368 - DNA, 20 bp, human
ggccttggggcagaagtcct

SEQ ID NO: 262369 - DNA, 20 bp, human
gagctgggatggctgttgtc

SEQ ID NO: 262370 - DNA, 20 bp, human
gttggcttaggcctcctgat

SEQ ID NO: 262371 - DNA, 20 bp, human
ggctgggaacacatccactc

SEQ ID NO: 262372 - DNA, 20 bp, human
gcaaagtccacgccccagct

SEQ ID NO: 262373 - DNA, 20 bp, human
gggccgctggcagtgagcgt

SEQ ID NO: 262374 - DNA, 20 bp, human
gtcaccagggccgcgggtgt

SEQ ID NO: 262375 - DNA, 20 bp, human
gtgtctggctgcttatcact

SEQ ID NO: 262376 - DNA, 20 bp, human
gagaggcagcgtcacctgaa

SEQ ID NO: 262377 - DNA, 20 bp, human
ggggcaagagccaggctctt

SEQ ID NO: 262378 - DNA, 20 bp, human
gcaaacaagtgacatacaca

SEQ ID NO: 262379 - DNA, 20 bp, human
gggaggaatcctatctgctt

SEQ ID NO: 262380 - DNA, 20 bp, human
gctgggggagagcggacgga

SEQ ID NO: 262381 - DNA, 20 bp, human
ggaggagactttggctgctg

SEQ ID NO: 262382 - DNA, 20 bp, human
ggcccagtcagtttcccttc

SEQ ID NO: 262383 - DNA, 20 bp, human
ggtgtggttaaatgcagctt

SEQ ID NO: 262384 - DNA, 20 bp, human
ggcagataggattcctccta

SEQ ID NO: 262385 - DNA, 20 bp, human
gctttggctagcaggcacac

SEQ ID NO: 262386 - DNA, 20 bp, human
ggggctgagaagtacctcta

SEQ ID NO: 262387 - DNA, 20 bp, human
ggaaaggcgccagtgcgccg

SEQ ID NO: 262388 - DNA, 20 bp, human
gccgccgccactccccgcct

SEQ ID NO: 262389 - DNA, 20 bp, human
gaatctgaggcagctcctgt

SEQ ID NO: 262390 - DNA, 20 bp, human
gcactggcgcctttccccac

SEQ ID NO: 262391 - DNA, 20 bp, human
gactccccgcctcggcgcac

SEQ ID NO: 262392 - DNA, 20 bp, human
gagtctcctgggccaatctg

SEQ ID NO: 262393 - DNA, 20 bp, human
gcctgacgcgacagtctcct

SEQ ID NO: 262394 - DNA, 20 bp, human
ggactcgttctgaagagcag

SEQ ID NO: 262395 - DNA, 20 bp, human
gcgggaacaccaaccaatca

SEQ ID NO: 262396 - DNA, 20 bp, human
gccagcccgtggcccacaaa

SEQ ID NO: 262397 - DNA, 20 bp, human
gagaatgttaagggcttctg

SEQ ID NO: 262398 - DNA, 20 bp, human
gaagggctgtgccaagttca

SEQ ID NO: 262399 - DNA, 20 bp, human
gtgggccaaaaacgacacac

SEQ ID NO: 262400 - DNA, 20 bp, human
ggcgccgcgaacaggtgctg

SEQ ID NO: 262401 - DNA, 20 bp, human
gatgttaagggcttctgcgg

SEQ ID NO: 262402 - DNA, 20 bp, human
gacccggagtcctggttcct

SEQ ID NO: 262403 - DNA, 20 bp, human
gagaccggatccggaagcaa

SEQ ID NO: 262404 - DNA, 20 bp, human
gccgcgaacaggtgctgcgg

SEQ ID NO: 262405 - DNA, 20 bp, human
gtggggccttcccccttgtg

SEQ ID NO: 262406 - DNA, 20 bp, human
gaaagttgggagtttgtggg

SEQ ID NO: 262407 - DNA, 20 bp, human
gtgccccaccaggctcagga

SEQ ID NO: 262408 - DNA, 20 bp, human
gcggaaagttgggagtttgt

SEQ ID NO: 262409 - DNA, 20 bp, human
ggtggggcacaggctgtttg

SEQ ID NO: 262410 - DNA, 20 bp, human
gcccttgagggccggaaagt

SEQ ID NO: 262411 - DNA, 20 bp, human
gccaagtggagcaacttcct

SEQ ID NO: 262412 - DNA, 20 bp, human
ggggtcctgtggagatcagg

SEQ ID NO: 262413 - DNA, 20 bp, human
gaggtcttggaaatagagat

SEQ ID NO: 262414 - DNA, 20 bp, human
gtgggggtgaaatgaagagc

SEQ ID NO: 262415 - DNA, 20 bp, human
gtccaggagtccagatcaat

SEQ ID NO: 262416 - DNA, 20 bp, human
gagaaggccagcccccaggt

SEQ ID NO: 262417 - DNA, 20 bp, human
gtgggacgggcttgccagga

SEQ ID NO: 262418 - DNA, 20 bp, human
gtgtcagccgtgggcctcgg

SEQ ID NO: 262419 - DNA, 20 bp, human
gcaagctgctatgatggccg

SEQ ID NO: 262420 - DNA, 20 bp, human
gaagcgcggaactggggact

SEQ ID NO: 262421 - DNA, 20 bp, human
gttgctcggcagtcacgttc

SEQ ID NO: 262422 - DNA, 20 bp, human
gcgcctgtgccactgcccgg

SEQ ID NO: 262423 - DNA, 20 bp, human
gcgagagcgtggtcctggcc

SEQ ID NO: 262424 - DNA, 20 bp, human
ggcacccgagagcgtggtcc

SEQ ID NO: 262425 - DNA, 20 bp, human
gggcctcggaggccacctac

SEQ ID NO: 262426 - DNA, 20 bp, human
gcaactggttgcggtgggga

SEQ ID NO: 262427 - DNA, 20 bp, human
gggtggggagggcagatcta

SEQ ID NO: 262428 - DNA, 20 bp, human
gtgaccaaaggggacgggtg

SEQ ID NO: 262429 - DNA, 20 bp, human
ggcgcacctgccgggataac

SEQ ID NO: 262430 - DNA, 20 bp, human
gtgggaaattgggagtcaga

SEQ ID NO: 262431 - DNA, 20 bp, human
gaaaccctgtgggacagggg

SEQ ID NO: 262432 - DNA, 20 bp, human
gccagcaactggttgcggtg

SEQ ID NO: 262433 - DNA, 20 bp, human
gcagatctagggatggggat

SEQ ID NO: 262434 - DNA, 20 bp, human
gccacagctggagccagtag

SEQ ID NO: 262435 - DNA, 20 bp, human
gagccagtaggggagctcag

SEQ ID NO: 262436 - DNA, 20 bp, human
gaagagcatgataactgatt

SEQ ID NO: 262437 - DNA, 20 bp, human
gctcttactggactctgaca

SEQ ID NO: 262438 - DNA, 20 bp, human
gtacaaaaggacttagacag

SEQ ID NO: 262439 - DNA, 20 bp, human
gaatttacaattgggaactt

SEQ ID NO: 262440 - DNA, 20 bp, human
gtcagttatcatgctcttac

SEQ ID NO: 262441 - DNA, 20 bp, human
gtactctatgaatttacaat

SEQ ID NO: 262442 - DNA, 20 bp, human
gatagagtaaagttcacttg

SEQ ID NO: 262443 - DNA, 20 bp, human
ggtacacaatacttctcttg

SEQ ID NO: 262444 - DNA, 20 bp, human
gagagtttttactttgtggc

SEQ ID NO: 262445 - DNA, 20 bp, human
gttagagagtttttactttg

SEQ ID NO: 262446 - DNA, 20 bp, human
gcagggccgtggggacgggt

SEQ ID NO: 262447 - DNA, 20 bp, human
ggaggacctgtcctcccaga

SEQ ID NO: 262448 - DNA, 20 bp, human
ggagcagggatggatggtct

SEQ ID NO: 262449 - DNA, 20 bp, human
gagggtgaggtcagagggtc

SEQ ID NO: 262450 - DNA, 20 bp, human
gcagggatggatggtctagg

SEQ ID NO: 262451 - DNA, 20 bp, human
gctaggaggagtcacaaaaa

SEQ ID NO: 262452 - DNA, 20 bp, human
gctccaccatctgggaggac

SEQ ID NO: 262453 - DNA, 20 bp, human
gaatctcagagggggagggt

SEQ ID NO: 262454 - DNA, 20 bp, human
ggaatcctaacatatagcgg

SEQ ID NO: 262455 - DNA, 20 bp, human
gatgaagaaatcagcggaga

SEQ ID NO: 262456 - DNA, 20 bp, human
gagcgaggaagggcgccctc

SEQ ID NO: 262457 - DNA, 20 bp, human
gcggccagggccccccagta

SEQ ID NO: 262458 - DNA, 20 bp, human
gagccagaggggcttgcgag

SEQ ID NO: 262459 - DNA, 20 bp, human
gcagaggggcttgcgagcgg

SEQ ID NO: 262460 - DNA, 20 bp, human
gtggcggggtccttggaatg

SEQ ID NO: 262461 - DNA, 20 bp, human
gggctgagggaccgcgggga

SEQ ID NO: 262462 - DNA, 20 bp, human
ggcagtgagagtctctgcgc

SEQ ID NO: 262463 - DNA, 20 bp, human
gactctcactgcacgccgga

SEQ ID NO: 262464 - DNA, 20 bp, human
gaggacgggaggccacgcca

SEQ ID NO: 262465 - DNA, 20 bp, human
ggcggggcgcacagagccag

SEQ ID NO: 262466 - DNA, 20 bp, human
gagactgcgggagccgcctg

SEQ ID NO: 262467 - DNA, 20 bp, human
gggcggctcccgcagtctaa

SEQ ID NO: 262468 - DNA, 20 bp, human
gcgccaggtcccttagactg

SEQ ID NO: 262469 - DNA, 20 bp, human
ggcaggagcgctgggaccac

SEQ ID NO: 262470 - DNA, 20 bp, human
gggcgcagctgcgcagggaa

SEQ ID NO: 262471 - DNA, 20 bp, human
gctaggcagggattaacccg

SEQ ID NO: 262472 - DNA, 20 bp, human
gggaggccacgccccgggac

SEQ ID NO: 262473 - DNA, 20 bp, human
gggcgcgcgttccggtcccg

SEQ ID NO: 262474 - DNA, 20 bp, human
ggggcggggttgagcgcatg

SEQ ID NO: 262475 - DNA, 20 bp, human
ggctcaaccccgcccgcagg

SEQ ID NO: 262476 - DNA, 20 bp, human
ggataacgtaacacgttcag

SEQ ID NO: 262477 - DNA, 20 bp, human
ggaacgtgttacgttatccc

SEQ ID NO: 262478 - DNA, 20 bp, human
gattcagaatagattgttgg

SEQ ID NO: 262479 - DNA, 20 bp, human
gttaaaagcaaatctactag

SEQ ID NO: 262480 - DNA, 20 bp, human
ggcttcagtaagcatgactc

SEQ ID NO: 262481 - DNA, 20 bp, human
gttacgttatccctggagaa

SEQ ID NO: 262482 - DNA, 20 bp, human
gacggataagaaatgaaatg

SEQ ID NO: 262483 - DNA, 20 bp, human
gaacaaacgccatcctcacc

SEQ ID NO: 262484 - DNA, 20 bp, human
gtgcttactgaagcatcgag

SEQ ID NO: 262485 - DNA, 20 bp, human
gcgtaacacgttcagaggct

SEQ ID NO: 262486 - DNA, 20 bp, human
gaccagagataggaagtcgg

SEQ ID NO: 262487 - DNA, 20 bp, human
gagggctgtcgtgagaacag

SEQ ID NO: 262488 - DNA, 20 bp, human
ggccaggccagcaagatgca

SEQ ID NO: 262489 - DNA, 20 bp, human
gaggccagcaagatgcaggg

SEQ ID NO: 262490 - DNA, 20 bp, human
gaaggcccagagcccgtgat

SEQ ID NO: 262491 - DNA, 20 bp, human
gtgcccccgcagacccacca

SEQ ID NO: 262492 - DNA, 20 bp, human
gcagcaagatgcaggggggg

SEQ ID NO: 262493 - DNA, 20 bp, human
gcgtgatgggcgtggggatt

SEQ ID NO: 262494 - DNA, 20 bp, human
gcgtgggaggactggagtgt

SEQ ID NO: 262495 - DNA, 20 bp, human
ggaagcatctgcggttcaag

SEQ ID NO: 262496 - DNA, 20 bp, human
gaaactccgggaccctgcaa

SEQ ID NO: 262497 - DNA, 20 bp, human
ggacccgcctgcgtcctcca

SEQ ID NO: 262498 - DNA, 20 bp, human
gcaggggtgtggactcgccg

SEQ ID NO: 262499 - DNA, 20 bp, human
gaccgagcgcggagctgccc

SEQ ID NO: 262500 - DNA, 20 bp, human
ggggtcccggagtttcctac

SEQ ID NO: 262501 - DNA, 20 bp, human
ggagctgccctggaggacgc

SEQ ID NO: 262502 - DNA, 20 bp, human
gcctcccggtaggaaactcc

SEQ ID NO: 262503 - DNA, 20 bp, human
ggtggcgcggttgaatcact

SEQ ID NO: 262504 - DNA, 20 bp, human
ggggtgagtcatcccttgca

SEQ ID NO: 262505 - DNA, 20 bp, human
gggcaagtgacccgggccgg

SEQ ID NO: 262506 - DNA, 20 bp, human
ggaggaacctgggtctccga

SEQ ID NO: 262507 - DNA, 20 bp, human
gtggatcaggtcatctctaa

SEQ ID NO: 262508 - DNA, 20 bp, human
ggggttcaatatgcctaaat

SEQ ID NO: 262509 - DNA, 20 bp, human
gccacagtgacttaataaag

SEQ ID NO: 262510 - DNA, 20 bp, human
gtgcactaccctgtgactct

SEQ ID NO: 262511 - DNA, 20 bp, human
gtcttctaaaggggctcaat

SEQ ID NO: 262512 - DNA, 20 bp, human
gcagggtagtgcagagtcac

SEQ ID NO: 262513 - DNA, 20 bp, human
gactctgggcagggccccct

SEQ ID NO: 262514 - DNA, 20 bp, human
gatgacctgatccagccggt

SEQ ID NO: 262515 - DNA, 20 bp, human
gtaggctttgcttagaacct

SEQ ID NO: 262516 - DNA, 20 bp, human
gccagtgaccagaggtatta

SEQ ID NO: 262517 - DNA, 20 bp, human
ggcaggcgggacaatgccca

SEQ ID NO: 262518 - DNA, 20 bp, human
gcggagggagtgagagccag

SEQ ID NO: 262519 - DNA, 20 bp, human
gactccctccgctttttctg

SEQ ID NO: 262520 - DNA, 20 bp, human
gggcctcaggtcagtggtaa

SEQ ID NO: 262521 - DNA, 20 bp, human
gggagggatacagctttgtc

SEQ ID NO: 262522 - DNA, 20 bp, human
gaaagccccagaaaaagcgg

SEQ ID NO: 262523 - DNA, 20 bp, human
gtttactgcaggtgaagaag

SEQ ID NO: 262524 - DNA, 20 bp, human
ggggagccatctgcttaagg

SEQ ID NO: 262525 - DNA, 20 bp, human
gccgtttgcaagaactgcag

SEQ ID NO: 262526 - DNA, 20 bp, human
gtccaagggtgacagaggga

SEQ ID NO: 262527 - DNA, 20 bp, human
gtgccagcgtgcaggtgtta

SEQ ID NO: 262528 - DNA, 20 bp, human
gcccccccacttgagctcag

SEQ ID NO: 262529 - DNA, 20 bp, human
gtctcagctggggtgttcag

SEQ ID NO: 262530 - DNA, 20 bp, human
gagccactgagctcaagtgg

SEQ ID NO: 262531 - DNA, 20 bp, human
ggagctcaagtgggggggac

SEQ ID NO: 262532 - DNA, 20 bp, human
gaggccgttgcctgcaaggg

SEQ ID NO: 262533 - DNA, 20 bp, human
ggtggaccgctggagaatgg

SEQ ID NO: 262534 - DNA, 20 bp, human
gtgactcgcatgattgctat

SEQ ID NO: 262535 - DNA, 20 bp, human
gccccagctgtgctgcagag

SEQ ID NO: 262536 - DNA, 20 bp, human
gtcaggaagagggttggagt

SEQ ID NO: 262537 - DNA, 20 bp, human
gcctctcctcctttccttaa

SEQ ID NO: 262538 - DNA, 20 bp, human
gactgctctcagaagtgaat

SEQ ID NO: 262539 - DNA, 20 bp, human
gaatcagaacctttaaggaa

SEQ ID NO: 262540 - DNA, 20 bp, human
ggttggagtaggctaggaat

SEQ ID NO: 262541 - DNA, 20 bp, human
gagagagactaacaggttgc

SEQ ID NO: 262542 - DNA, 20 bp, human
gtgccactcaggaagagggt

SEQ ID NO: 262543 - DNA, 20 bp, human
gaagagggttggagtaggct

SEQ ID NO: 262544 - DNA, 20 bp, human
ggcagcagcaagagaagttc

SEQ ID NO: 262545 - DNA, 20 bp, human
ggctttaatcagaaccttta

SEQ ID NO: 262546 - DNA, 20 bp, human
gctgggctccggaaggggaa

SEQ ID NO: 262547 - DNA, 20 bp, human
gagtccaagcggcgcgggga

SEQ ID NO: 262548 - DNA, 20 bp, human
gcgcccgcccttaccttgac

SEQ ID NO: 262549 - DNA, 20 bp, human
ggccgcgtccagtcaaggta

SEQ ID NO: 262550 - DNA, 20 bp, human
ggagctcggtcgcgactggc

SEQ ID NO: 262551 - DNA, 20 bp, human
gcagtcgcgaccgagctccc

SEQ ID NO: 262552 - DNA, 20 bp, human
gtggagacgacaccccaggg

SEQ ID NO: 262553 - DNA, 20 bp, human
ggccttcctgggctccggaa

SEQ ID NO: 262554 - DNA, 20 bp, human
ggctccccggggagtccaag

SEQ ID NO: 262555 - DNA, 20 bp, human
gggcgctcggggatcgcccc

SEQ ID NO: 262556 - DNA, 20 bp, human
gcacagaggagcagtctctc

SEQ ID NO: 262557 - DNA, 20 bp, human
gtctccgggtgacagtgcag

SEQ ID NO: 262558 - DNA, 20 bp, human
ggggaaggggacacccccgc

SEQ ID NO: 262559 - DNA, 20 bp, human
ggcgacaggacggacttcta

SEQ ID NO: 262560 - DNA, 20 bp, human
gagtggccctgggtgggaag

SEQ ID NO: 262561 - DNA, 20 bp, human
gcaggggagtggccctgggt

SEQ ID NO: 262562 - DNA, 20 bp, human
gtgctcctctgtgccatccc

SEQ ID NO: 262563 - DNA, 20 bp, human
gagtgcaggggagtggccct

SEQ ID NO: 262564 - DNA, 20 bp, human
gactcccctgcactgtcacc

SEQ ID NO: 262565 - DNA, 20 bp, human
gcagcatgatggtgttcgtt

SEQ ID NO: 262566 - DNA, 20 bp, human
ggcgacaggacggacttcta

SEQ ID NO: 262567 - DNA, 20 bp, human
gcactgcagtcatggtcttg

SEQ ID NO: 262568 - DNA, 20 bp, human
gtgtcgcaacactgcagtca

SEQ ID NO: 262569 - DNA, 20 bp, human
gctgcagtgttgcgacagga

SEQ ID NO: 262570 - DNA, 20 bp, human
gccgagcctgccccttgccc

SEQ ID NO: 262571 - DNA, 20 bp, human
ggatgcggatccaagaccct

SEQ ID NO: 262572 - DNA, 20 bp, human
gggcctggccgggctgtgag

SEQ ID NO: 262573 - DNA, 20 bp, human
gagcggcgtatgcaaatcga

SEQ ID NO: 262574 - DNA, 20 bp, human
gctggtgaggtgcaaagagc

SEQ ID NO: 262575 - DNA, 20 bp, human
ggaggtgcaaagagcgggat

SEQ ID NO: 262576 - DNA, 20 bp, human
ggcgacaggacggacttcta

SEQ ID NO: 262577 - DNA, 20 bp, human
gcactgcagtcatggtcttg

SEQ ID NO: 262578 - DNA, 20 bp, human
gtgtcgcaacactgcagtca

SEQ ID NO: 262579 - DNA, 20 bp, human
gctgcagtgttgcgacagga

SEQ ID NO: 262580 - DNA, 20 bp, human
gccgagcctgccccttgccc

SEQ ID NO: 262581 - DNA, 20 bp, human
gggtgttcgttggggcgggt

SEQ ID NO: 262582 - DNA, 20 bp, human
gctggtgaggtgcaaagagc

SEQ ID NO: 262583 - DNA, 20 bp, human
ggaggtgcaaagagcgggat

SEQ ID NO: 262584 - DNA, 20 bp, human
gcaaagagcgggatcggagg

SEQ ID NO: 262585 - DNA, 20 bp, human
ggtgcaaagagcgggatcgg

SEQ ID NO: 262586 - DNA, 20 bp, human
gtgggacaagtgaagagaat

SEQ ID NO: 262587 - DNA, 20 bp, human
gtcgtgggcttctgccactg

SEQ ID NO: 262588 - DNA, 20 bp, human
gcagaagcccacgaaatcag

SEQ ID NO: 262589 - DNA, 20 bp, human
gatctccctcaatgggtctt

SEQ ID NO: 262590 - DNA, 20 bp, human
gagaatggagataggcatag

SEQ ID NO: 262591 - DNA, 20 bp, human
gacatcttcagaatggagat

SEQ ID NO: 262592 - DNA, 20 bp, human
gtctctgacaaagatacggt

SEQ ID NO: 262593 - DNA, 20 bp, human
gtagtccaaagacccattga

SEQ ID NO: 262594 - DNA, 20 bp, human
gacttgtcccaagaggccat

SEQ ID NO: 262595 - DNA, 20 bp, human
gatagtggctacatttactg

SEQ ID NO: 262596 - DNA, 20 bp, human
ggcgcggcactccctgtccg

SEQ ID NO: 262597 - DNA, 20 bp, human
gcgccaggtggccgcggaca

SEQ ID NO: 262598 - DNA, 20 bp, human
gagggagtgccgcgcccgcc

SEQ ID NO: 262599 - DNA, 20 bp, human
ggcccctcgcggctctgccg

SEQ ID NO: 262600 - DNA, 20 bp, human
gtctgggcggacatcctcgg

SEQ ID NO: 262601 - DNA, 20 bp, human
ggccccggcagagccgcgag

SEQ ID NO: 262602 - DNA, 20 bp, human
ggaggagggtgggcggacac

SEQ ID NO: 262603 - DNA, 20 bp, human
ggggctcccggccggccaat

SEQ ID NO: 262604 - DNA, 20 bp, human
gataccgcgctcccattggc

SEQ ID NO: 262605 - DNA, 20 bp, human
gggggctcccgggatgttag

SEQ ID NO: 262606 - DNA, 20 bp, human
ggcggggagcgggatgtcgc

SEQ ID NO: 262607 - DNA, 20 bp, human
ggaagcgcgccagagcctag

SEQ ID NO: 262608 - DNA, 20 bp, human
ggcaggcgggcgtgggatcc

SEQ ID NO: 262609 - DNA, 20 bp, human
gaagggcgactgtttctcgt

SEQ ID NO: 262610 - DNA, 20 bp, human
ggggagcgggatgtcgctgg

SEQ ID NO: 262611 - DNA, 20 bp, human
gcccacccgcctgctcggct

SEQ ID NO: 262612 - DNA, 20 bp, human
gtgctcggcttggcggggag

SEQ ID NO: 262613 - DNA, 20 bp, human
gtctgatagcctctaggctc

SEQ ID NO: 262614 - DNA, 20 bp, human
ggcctagaggctatcagagg

SEQ ID NO: 262615 - DNA, 20 bp, human
gatcccacgcccgcctgcgc

SEQ ID NO: 262616 - DNA, 20 bp, human
gggctcctagccagagatgg

SEQ ID NO: 262617 - DNA, 20 bp, human
gaagtctccgcccccatctc

SEQ ID NO: 262618 - DNA, 20 bp, human
ggagggttacgtgcaccctg

SEQ ID NO: 262619 - DNA, 20 bp, human
gcaagctcctgtggaattgt

SEQ ID NO: 262620 - DNA, 20 bp, human
gaggaacaactgaatgcggg

SEQ ID NO: 262621 - DNA, 20 bp, human
ggacaggtagcattgcacac

SEQ ID NO: 262622 - DNA, 20 bp, human
gcacgtaaccctcaagcact

SEQ ID NO: 262623 - DNA, 20 bp, human
ggaatgcgggcggtaaatga

SEQ ID NO: 262624 - DNA, 20 bp, human
ggcacggtcctagtgcttga

SEQ ID NO: 262625 - DNA, 20 bp, human
gctaggaccgtgcggaatcc

SEQ ID NO: 262626 - DNA, 20 bp, human
gggtgcggagagtcacttaa

SEQ ID NO: 262627 - DNA, 20 bp, human
gacctctggccgctattcga

SEQ ID NO: 262628 - DNA, 20 bp, human
gtaaaggctgcagggccata

SEQ ID NO: 262629 - DNA, 20 bp, human
gggggtgagaagagatcata

SEQ ID NO: 262630 - DNA, 20 bp, human
gagtcaagcaggaagcctta

SEQ ID NO: 262631 - DNA, 20 bp, human
gcatatacacacatttcgtg

SEQ ID NO: 262632 - DNA, 20 bp, human
gctcccttcccttcgaatag

SEQ ID NO: 262633 - DNA, 20 bp, human
gtggccgctattcgaaggga

SEQ ID NO: 262634 - DNA, 20 bp, human
ggagtcacttaaaggctgca

SEQ ID NO: 262635 - DNA, 20 bp, human
gtaatgaatatcagtcaagc

SEQ ID NO: 262636 - DNA, 20 bp, human
gccgtggaacttttgtgccc

SEQ ID NO: 262637 - DNA, 20 bp, human
gatactcaaggaacattgca

SEQ ID NO: 262638 - DNA, 20 bp, human
gggcataaacacagctgtcc

SEQ ID NO: 262639 - DNA, 20 bp, human
gacactgctttgtgcctggc

SEQ ID NO: 262640 - DNA, 20 bp, human
gctgctttagatgatactca

SEQ ID NO: 262641 - DNA, 20 bp, human
gcaaagcagtgtgtaagagc

SEQ ID NO: 262642 - DNA, 20 bp, human
gaccagacagacttcataga

SEQ ID NO: 262643 - DNA, 20 bp, human
gtttagttttgatgctaaat

SEQ ID NO: 262644 - DNA, 20 bp, human
gtaaaaagttaagtttagta

SEQ ID NO: 262645 - DNA, 20 bp, human
gtccttccctaggacctgcc

SEQ ID NO: 262646 - DNA, 20 bp, human
gccacatcacagtatgaagt

SEQ ID NO: 262647 - DNA, 20 bp, human
gaatatcctggcactttgta

SEQ ID NO: 262648 - DNA, 20 bp, human
gaaagtgcagactatgttgg

SEQ ID NO: 262649 - DNA, 20 bp, human
gttcaaagtgcagactatgt

SEQ ID NO: 262650 - DNA, 20 bp, human
gttaattgcttgacatagtt

SEQ ID NO: 262651 - DNA, 20 bp, human
gatgcaccctacaaagtgcc

SEQ ID NO: 262652 - DNA, 20 bp, human
gtataataaattctcgccca

SEQ ID NO: 262653 - DNA, 20 bp, human
ggcatatatcaaataacatc

SEQ ID NO: 262654 - DNA, 20 bp, human
gggagtttggataaatatcc

SEQ ID NO: 262655 - DNA, 20 bp, human
gcattgtgtttagcattgcc

SEQ ID NO: 262656 - DNA, 20 bp, human
gaacaccagcccgagagcta

SEQ ID NO: 262657 - DNA, 20 bp, human
gggtccccacccacctcggt

SEQ ID NO: 262658 - DNA, 20 bp, human
gtcccccaacccaccgaggt

SEQ ID NO: 262659 - DNA, 20 bp, human
ggcccccgagtccctacccc

SEQ ID NO: 262660 - DNA, 20 bp, human
gggcatgcgccctagctctc

SEQ ID NO: 262661 - DNA, 20 bp, human
ggcgctgacgcaggctagca

SEQ ID NO: 262662 - DNA, 20 bp, human
ggctcacaggggaactgaca

SEQ ID NO: 262663 - DNA, 20 bp, human
gcccacgccggggaaagctc

SEQ ID NO: 262664 - DNA, 20 bp, human
gcaggcactggcgctgacgc

SEQ ID NO: 262665 - DNA, 20 bp, human
ggacgggaagatatccacca

SEQ ID NO: 262666 - DNA, 20 bp, human
ggctcagaacatgtgatctt

SEQ ID NO: 262667 - DNA, 20 bp, human
gatgcagaggccggtaatga

SEQ ID NO: 262668 - DNA, 20 bp, human
gagcattaagctgtcaaaac

SEQ ID NO: 262669 - DNA, 20 bp, human
gagtccagtgactatttgcc

SEQ ID NO: 262670 - DNA, 20 bp, human
gcaatcatttccttcattac

SEQ ID NO: 262671 - DNA, 20 bp, human
ggatcttaggaatgaccaat

SEQ ID NO: 262672 - DNA, 20 bp, human
ggccaggtaattcctgagac

SEQ ID NO: 262673 - DNA, 20 bp, human
gattggatctcattcccaat

SEQ ID NO: 262674 - DNA, 20 bp, human
gtatgtataggaataatagg

SEQ ID NO: 262675 - DNA, 20 bp, human
gttcgggacactcctgtctc

SEQ ID NO: 262676 - DNA, 20 bp, human
ggcgccccctgggccttctc

SEQ ID NO: 262677 - DNA, 20 bp, human
gccccacgcctcatggacgc

SEQ ID NO: 262678 - DNA, 20 bp, human
gcgccggcgtccatgaggcg

SEQ ID NO: 262679 - DNA, 20 bp, human
gcatgaggcgtggggcgcgc

SEQ ID NO: 262680 - DNA, 20 bp, human
gccctgggccttctcggggt

SEQ ID NO: 262681 - DNA, 20 bp, human
gctcttgccagggtacgcga

SEQ ID NO: 262682 - DNA, 20 bp, human
gcgggcgcctcctgcaagca

SEQ ID NO: 262683 - DNA, 20 bp, human
ggcaggcgccggcgtccatg

SEQ ID NO: 262684 - DNA, 20 bp, human
gactgcaggaagtgattgat

SEQ ID NO: 262685 - DNA, 20 bp, human
ggcacctcccgaccccgaga

SEQ ID NO: 262686 - DNA, 20 bp, human
gggcctatcctgagtcaagt

SEQ ID NO: 262687 - DNA, 20 bp, human
gtgcccacttgactcaggat

SEQ ID NO: 262688 - DNA, 20 bp, human
gtgagtcaagtgggcatctc

SEQ ID NO: 262689 - DNA, 20 bp, human
gctgctgccaaaggctggac

SEQ ID NO: 262690 - DNA, 20 bp, human
ggtccaatcagctctgtgca

SEQ ID NO: 262691 - DNA, 20 bp, human
gttatcaaaaggatatcgac

SEQ ID NO: 262692 - DNA, 20 bp, human
gtgcagtgctacccttgata

SEQ ID NO: 262693 - DNA, 20 bp, human
gcatttctgtgatgtgattg

SEQ ID NO: 262694 - DNA, 20 bp, human
gcatgcaccctcattgccat

SEQ ID NO: 262695 - DNA, 20 bp, human
gatcgggcgatgggacaaac

SEQ ID NO: 262696 - DNA, 20 bp, human
ggcctgagccaatcacaaag

SEQ ID NO: 262697 - DNA, 20 bp, human
ggccactgggttagcggagt

SEQ ID NO: 262698 - DNA, 20 bp, human
ggggctgtagtgtgaggatt

SEQ ID NO: 262699 - DNA, 20 bp, human
ggggaaggagcgctcgagtg

SEQ ID NO: 262700 - DNA, 20 bp, human
ggcataagggctgtagtgtg

SEQ ID NO: 262701 - DNA, 20 bp, human
gacctactccgctaacccag

SEQ ID NO: 262702 - DNA, 20 bp, human
ggctcaggccactgggttag

SEQ ID NO: 262703 - DNA, 20 bp, human
gagctcggcagggattcaat

SEQ ID NO: 262704 - DNA, 20 bp, human
gtaggccaaactgaaaaaga

SEQ ID NO: 262705 - DNA, 20 bp, human
gagagaagggctttcaggtt

SEQ ID NO: 262706 - DNA, 20 bp, human
gaatactgagtcaaccctgg

SEQ ID NO: 262707 - DNA, 20 bp, human
gttgtcaggatattcctcca

SEQ ID NO: 262708 - DNA, 20 bp, human
gtcacgtgactcttctgaaa

SEQ ID NO: 262709 - DNA, 20 bp, human
gccttccttacagggttgat

SEQ ID NO: 262710 - DNA, 20 bp, human
gtccacaagtaatatttgtc

SEQ ID NO: 262711 - DNA, 20 bp, human
gaatatttgtcaggtgactt

SEQ ID NO: 262712 - DNA, 20 bp, human
gctcttctgaaatggccaat

SEQ ID NO: 262713 - DNA, 20 bp, human
gacctgacaaatattacttg

SEQ ID NO: 262714 - DNA, 20 bp, human
gtcttgctgctgttgcccat

SEQ ID NO: 262715 - DNA, 20 bp, human
gtgacaaattgataaacacc

SEQ ID NO: 262716 - DNA, 20 bp, human
gcagaagccgcgcccgtccg

SEQ ID NO: 262717 - DNA, 20 bp, human
ggcggcgccgcggacgggcg

SEQ ID NO: 262718 - DNA, 20 bp, human
gaacggctgcggcttcgcta

SEQ ID NO: 262719 - DNA, 20 bp, human
gcggcgtatcgtctcttttc

SEQ ID NO: 262720 - DNA, 20 bp, human
ggccctcaccgcagagagct

SEQ ID NO: 262721 - DNA, 20 bp, human
ggagacgatacgccgggcgc

SEQ ID NO: 262722 - DNA, 20 bp, human
ggcccagctctctgcggtga

SEQ ID NO: 262723 - DNA, 20 bp, human
ggccagggcggaaacggctg

SEQ ID NO: 262724 - DNA, 20 bp, human
ggccgcagccgtttccgccc

SEQ ID NO: 262725 - DNA, 20 bp, human
ggtgagggcacgtgacgttc

SEQ ID NO: 262726 - DNA, 20 bp, human
gccgtcccccggtgggtctt

SEQ ID NO: 262727 - DNA, 20 bp, human
gcccctcgcgggctccctaa

SEQ ID NO: 262728 - DNA, 20 bp, human
gcaggcgggcatcgcggcgt

SEQ ID NO: 262729 - DNA, 20 bp, human
gggcgccgcggtaggaacag

SEQ ID NO: 262730 - DNA, 20 bp, human
gtcttgggcaactcacagct

SEQ ID NO: 262731 - DNA, 20 bp, human
ggacgtcaggaagtcgaatc

SEQ ID NO: 262732 - DNA, 20 bp, human
ggcgatgcccgcctgacgtc

SEQ ID NO: 262733 - DNA, 20 bp, human
gtccctaaaggcgtcgccgc

SEQ ID NO: 262734 - DNA, 20 bp, human
gtcgcagcgcgcgttcccat

SEQ ID NO: 262735 - DNA, 20 bp, human
gtggccgagcctcgtggcgc

SEQ ID NO: 262736 - DNA, 20 bp, human
gcggaggaaggggaccgctt

SEQ ID NO: 262737 - DNA, 20 bp, human
ggcaggcggggcgacgcgac

SEQ ID NO: 262738 - DNA, 20 bp, human
ggcaaaagtccatagcggga

SEQ ID NO: 262739 - DNA, 20 bp, human
gaagccagggatcctccgcc

SEQ ID NO: 262740 - DNA, 20 bp, human
ggctcccggggagtttttac

SEQ ID NO: 262741 - DNA, 20 bp, human
gaggatgtggaacccgaggc

SEQ ID NO: 262742 - DNA, 20 bp, human
gctcccgagcgcaggcgaga

SEQ ID NO: 262743 - DNA, 20 bp, human
ggcgggcagaggaggtgtcg

SEQ ID NO: 262744 - DNA, 20 bp, human
ggatcctccgccaggaaggc

SEQ ID NO: 262745 - DNA, 20 bp, human
gcggggaacgcgggaggatg

SEQ ID NO: 262746 - DNA, 20 bp, human
gcgagctgggtaggctagga

SEQ ID NO: 262747 - DNA, 20 bp, human
gacagaaccccgagctgggt

SEQ ID NO: 262748 - DNA, 20 bp, human
gctcgaggatggggctgaaa

SEQ ID NO: 262749 - DNA, 20 bp, human
ggggctgaaacgggaagctt

SEQ ID NO: 262750 - DNA, 20 bp, human
gcctgctggcgagtggagac

SEQ ID NO: 262751 - DNA, 20 bp, human
gtcgccagcaggagcggaga

SEQ ID NO: 262752 - DNA, 20 bp, human
gctctcctagccatcgagac

SEQ ID NO: 262753 - DNA, 20 bp, human
gcagccccatcctcgagaat

SEQ ID NO: 262754 - DNA, 20 bp, human
gaccccgagctgggtaggct

SEQ ID NO: 262755 - DNA, 20 bp, human
ggcaaggatgcaggccgcct

SEQ ID NO: 262756 - DNA, 20 bp, human
gagggagggcggcgtcgagg

SEQ ID NO: 262757 - DNA, 20 bp, human
gtccgctccaatccaggcgc

SEQ ID NO: 262758 - DNA, 20 bp, human
ggcggggcctcggtctccat

SEQ ID NO: 262759 - DNA, 20 bp, human
gcggccgctgtcctcccggg

SEQ ID NO: 262760 - DNA, 20 bp, human
gccggcagcccgggaaaagg

SEQ ID NO: 262761 - DNA, 20 bp, human
gcaatccaggcgcggggcct

SEQ ID NO: 262762 - DNA, 20 bp, human
gcgtccgcgcggttataagg

SEQ ID NO: 262763 - DNA, 20 bp, human
gtctccattggccgccaggg

SEQ ID NO: 262764 - DNA, 20 bp, human
gcctggattggagcggacgc

SEQ ID NO: 262765 - DNA, 20 bp, human
ggccagggagggcggcgtcg

SEQ ID NO: 262766 - DNA, 20 bp, human
gtacgaatagtcagggtcga

SEQ ID NO: 262767 - DNA, 20 bp, human
gcaaaacgaggacgtctcta

SEQ ID NO: 262768 - DNA, 20 bp, human
ggtcaaggtgcgagacaccc

SEQ ID NO: 262769 - DNA, 20 bp, human
ggcctccgtccctactacct

SEQ ID NO: 262770 - DNA, 20 bp, human
ggtagggacggaggcgtcag

SEQ ID NO: 262771 - DNA, 20 bp, human
ggtgtctcgcaccttgaccc

SEQ ID NO: 262772 - DNA, 20 bp, human
gagctgagagtggctaggcg

SEQ ID NO: 262773 - DNA, 20 bp, human
gaggcggggaggcgaccctg

SEQ ID NO: 262774 - DNA, 20 bp, human
gaatgctcggacagatctca

SEQ ID NO: 262775 - DNA, 20 bp, human
gcggctcaggcgcgcgaccc

SEQ ID NO: 262776 - DNA, 20 bp, human
gcctccccctagctgaggcg

SEQ ID NO: 262777 - DNA, 20 bp, human
gagcgcgcgactacccggcc

SEQ ID NO: 262778 - DNA, 20 bp, human
gtgacaggagggtggtcacg

SEQ ID NO: 262779 - DNA, 20 bp, human
ggtcacgtggagccgcaaag

SEQ ID NO: 262780 - DNA, 20 bp, human
gagactgcaacctgcagctg

SEQ ID NO: 262781 - DNA, 20 bp, human
gccggccaggatctctgcgc

SEQ ID NO: 262782 - DNA, 20 bp, human
gagcgggcgggcgaacgccg

SEQ ID NO: 262783 - DNA, 20 bp, human
ggctggccaaccaggggcgg

SEQ ID NO: 262784 - DNA, 20 bp, human
ggccaggatctctgcgctgg

SEQ ID NO: 262785 - DNA, 20 bp, human
gccgtggcgctggccaacca

SEQ ID NO: 262786 - DNA, 20 bp, human
ggccagagggcgccacgctc

SEQ ID NO: 262787 - DNA, 20 bp, human
gcggctctgcaagactgcac

SEQ ID NO: 262788 - DNA, 20 bp, human
ggcgtggcgccctctggcgg

SEQ ID NO: 262789 - DNA, 20 bp, human
gcaagtcgctcttaccattt

SEQ ID NO: 262790 - DNA, 20 bp, human
gcaactgcgtctgcgcgcgc

SEQ ID NO: 262791 - DNA, 20 bp, human
gacctctggccgccgccaga

SEQ ID NO: 262792 - DNA, 20 bp, human
gcgccggcggccgttcagac

SEQ ID NO: 262793 - DNA, 20 bp, human
ggaaaggatctgctaagatt

SEQ ID NO: 262794 - DNA, 20 bp, human
gtggctgaggtcagttccgg

SEQ ID NO: 262795 - DNA, 20 bp, human
gggcctatcccgaacacttc

SEQ ID NO: 262796 - DNA, 20 bp, human
ggggccgggcctgaccacag

SEQ ID NO: 262797 - DNA, 20 bp, human
gggaagggcgggcgagactg

SEQ ID NO: 262798 - DNA, 20 bp, human
gggcttgcaaggcggggcga

SEQ ID NO: 262799 - DNA, 20 bp, human
gctgtccgcgagtccacgtg

SEQ ID NO: 262800 - DNA, 20 bp, human
gagggctcggggttcggggg

SEQ ID NO: 262801 - DNA, 20 bp, human
gagtccacgtgggggagatc

SEQ ID NO: 262802 - DNA, 20 bp, human
gaggggcagggctcggggtt

SEQ ID NO: 262803 - DNA, 20 bp, human
gtcacccggacaggccgtgg

SEQ ID NO: 262804 - DNA, 20 bp, human
ggctcgcggggtcggggcaa

SEQ ID NO: 262805 - DNA, 20 bp, human
gtcggggagtgaggcaagac

SEQ ID NO: 262806 - DNA, 20 bp, human
gtcccggcccgtggcagtcg

SEQ ID NO: 262807 - DNA, 20 bp, human
gcggcccgggtcatggtggt

SEQ ID NO: 262808 - DNA, 20 bp, human
gctggactgccgagctgccc

SEQ ID NO: 262809 - DNA, 20 bp, human
ggatctgccgggtacccggg

SEQ ID NO: 262810 - DNA, 20 bp, human
gcgcgagcgcgttgattggt

SEQ ID NO: 262811 - DNA, 20 bp, human
ggccacgccgcccgggtacc

SEQ ID NO: 262812 - DNA, 20 bp, human
gctctcccggcgcagctctc

SEQ ID NO: 262813 - DNA, 20 bp, human
gtgagcgcgagcgcgttgat

SEQ ID NO: 262814 - DNA, 20 bp, human
ggtgcgaggtggacgctgat

SEQ ID NO: 262815 - DNA, 20 bp, human
gtacccggcagatcgcgagg

SEQ ID NO: 262816 - DNA, 20 bp, human
gagagcgtctccagagaacg

SEQ ID NO: 262817 - DNA, 20 bp, human
gggaggggcgggcccatcgt

SEQ ID NO: 262818 - DNA, 20 bp, human
ggagccgcccgccccacgat

SEQ ID NO: 262819 - DNA, 20 bp, human
gaggcgccagccgcgttctc

SEQ ID NO: 262820 - DNA, 20 bp, human
ggcggctccggcgggtcttc

SEQ ID NO: 262821 - DNA, 20 bp, human
gggcgggcccatcgtggggc

SEQ ID NO: 262822 - DNA, 20 bp, human
gccggcgggtcttcaggcta

SEQ ID NO: 262823 - DNA, 20 bp, human
gtggagacgctctctctcgg

SEQ ID NO: 262824 - DNA, 20 bp, human
gggatcacccgagagaaaag

SEQ ID NO: 262825 - DNA, 20 bp, human
gcctgtgacgtcacaggcaa

SEQ ID NO: 262826 - DNA, 20 bp, human
gtgggcccgccctccgggat

SEQ ID NO: 262827 - DNA, 20 bp, human
gcgcactgggcccgccctcc

SEQ ID NO: 262828 - DNA, 20 bp, human
gtgcagagggcaggcgtgcg

SEQ ID NO: 262829 - DNA, 20 bp, human
gggctcagggcataggcagg

SEQ ID NO: 262830 - DNA, 20 bp, human
gtgggcgcaggtggggaagt

SEQ ID NO: 262831 - DNA, 20 bp, human
ggtgctccatcccctgcaga

SEQ ID NO: 262832 - DNA, 20 bp, human
ggcctgccctctgcagggga

SEQ ID NO: 262833 - DNA, 20 bp, human
gtccatcccctgcagagggc

SEQ ID NO: 262834 - DNA, 20 bp, human
gggcaccaatcccggagggc

SEQ ID NO: 262835 - DNA, 20 bp, human
ggacatatgtcgttaaggag

SEQ ID NO: 262836 - DNA, 20 bp, human
gctagacggtggggacatac

SEQ ID NO: 262837 - DNA, 20 bp, human
gagggtgcggccttcggcta

SEQ ID NO: 262838 - DNA, 20 bp, human
gcgggacatggtgatgtcct

SEQ ID NO: 262839 - DNA, 20 bp, human
gcctacccacacttgctggc

SEQ ID NO: 262840 - DNA, 20 bp, human
gaggaccagggttgggtccg

SEQ ID NO: 262841 - DNA, 20 bp, human
gtcgccccaggggacctgag

SEQ ID NO: 262842 - DNA, 20 bp, human
gaaggcagaggaccagggtt

SEQ ID NO: 262843 - DNA, 20 bp, human
ggcgcctctcaggtcccctg

SEQ ID NO: 262844 - DNA, 20 bp, human
gcctgcgctggtcgccccag

SEQ ID NO: 262845 - DNA, 20 bp, human
gcggccttcggctaaggcag

SEQ ID NO: 262846 - DNA, 20 bp, human
gcccgcggacccatccactg

SEQ ID NO: 262847 - DNA, 20 bp, human
gcgagcccggggtaaggcgg

SEQ ID NO: 262848 - DNA, 20 bp, human
ggattcgcgagcccggggta

SEQ ID NO: 262849 - DNA, 20 bp, human
gcgactctctctcatcccgg

SEQ ID NO: 262850 - DNA, 20 bp, human
gccgcccttagccctccccc

SEQ ID NO: 262851 - DNA, 20 bp, human
gaggccctgatgcccggctc

SEQ ID NO: 262852 - DNA, 20 bp, human
gtgcgccgccgccttacccc

SEQ ID NO: 262853 - DNA, 20 bp, human
gcggagcaaccccagtggat

SEQ ID NO: 262854 - DNA, 20 bp, human
gcatcccgggggagggctaa

SEQ ID NO: 262855 - DNA, 20 bp, human
gcgctgcggagcaaccccag

SEQ ID NO: 262856 - DNA, 20 bp, human
gacaaaccacagcggaagtc

SEQ ID NO: 262857 - DNA, 20 bp, human
gctggtcactgctaatagtc

SEQ ID NO: 262858 - DNA, 20 bp, human
ggctgagaaaacatgttgtg

SEQ ID NO: 262859 - DNA, 20 bp, human
ggtcactgctaatagtctgg

SEQ ID NO: 262860 - DNA, 20 bp, human
gagtatacataaagcacggg

SEQ ID NO: 262861 - DNA, 20 bp, human
gcagctcctgacttccgctg

SEQ ID NO: 262862 - DNA, 20 bp, human
ggctgtatgggcagacgctt

SEQ ID NO: 262863 - DNA, 20 bp, human
gtgttgtgtggagtaagaaa

SEQ ID NO: 262864 - DNA, 20 bp, human
gagaaaaagcaccaagacaa

SEQ ID NO: 262865 - DNA, 20 bp, human
ggcagggaaaattggtgata

SEQ ID NO: 262866 - DNA, 20 bp, human
gggaccccacaaggcaccct

SEQ ID NO: 262867 - DNA, 20 bp, human
gtccaagagcaccacgaaat

SEQ ID NO: 262868 - DNA, 20 bp, human
gccagtgtggtgcttgttcc

SEQ ID NO: 262869 - DNA, 20 bp, human
ggcaccgagggtgccttgtg

SEQ ID NO: 262870 - DNA, 20 bp, human
gcaccacactggcgcaccga

SEQ ID NO: 262871 - DNA, 20 bp, human
gtatgtcttgggatgacttg

SEQ ID NO: 262872 - DNA, 20 bp, human
gggggacacacgcgcctcgt

SEQ ID NO: 262873 - DNA, 20 bp, human
gcagcagctggagtcccacg

SEQ ID NO: 262874 - DNA, 20 bp, human
gatgattactcgtatgtctt

SEQ ID NO: 262875 - DNA, 20 bp, human
gaggaggcgcctagaaaagg

SEQ ID NO: 262876 - DNA, 20 bp, human
gaatgcagttagagctctta

SEQ ID NO: 262877 - DNA, 20 bp, human
gtctaagcattgcccacaga

SEQ ID NO: 262878 - DNA, 20 bp, human
gagagacgctggactcttca

SEQ ID NO: 262879 - DNA, 20 bp, human
gggctcccggctgtgcgctg

SEQ ID NO: 262880 - DNA, 20 bp, human
gggggacacagatcccagtt

SEQ ID NO: 262881 - DNA, 20 bp, human
gacagggagcagagaggtct

SEQ ID NO: 262882 - DNA, 20 bp, human
gcagacccacagccttctgt

SEQ ID NO: 262883 - DNA, 20 bp, human
gccagctgatgggcccaact

SEQ ID NO: 262884 - DNA, 20 bp, human
gtccctgtccagcgtttctc

SEQ ID NO: 262885 - DNA, 20 bp, human
gaccagagaaacgctggaca

SEQ ID NO: 262886 - DNA, 20 bp, human
ggggccgcgcaatagcggga

SEQ ID NO: 262887 - DNA, 20 bp, human
gcggccgggcccgcctccta

SEQ ID NO: 262888 - DNA, 20 bp, human
gcggctcggggctctcggat

SEQ ID NO: 262889 - DNA, 20 bp, human
gtagccgggccgcgcaatag

SEQ ID NO: 262890 - DNA, 20 bp, human
gggcgcgcagcgcgattggt

SEQ ID NO: 262891 - DNA, 20 bp, human
gaaggcagtgggaggtcgca

SEQ ID NO: 262892 - DNA, 20 bp, human
ggtggggtgggactcgcggg

SEQ ID NO: 262893 - DNA, 20 bp, human
ggattggtgggcggtggcgt

SEQ ID NO: 262894 - DNA, 20 bp, human
gagaggcggctcggggctct

SEQ ID NO: 262895 - DNA, 20 bp, human
ggggcccgcctcctagggcg

SEQ ID NO: 262896 - DNA, 20 bp, human
gagcacgtcacgcctttctg

SEQ ID NO: 262897 - DNA, 20 bp, human
ggcggagaggaagcggtaga

SEQ ID NO: 262898 - DNA, 20 bp, human
ggacgtgctaactgccgtcg

SEQ ID NO: 262899 - DNA, 20 bp, human
gggggcgcccccagcggccg

SEQ ID NO: 262900 - DNA, 20 bp, human
gcgtcgcgggttagagtccg

SEQ ID NO: 262901 - DNA, 20 bp, human
ggacccccgaggcgctgagg

SEQ ID NO: 262902 - DNA, 20 bp, human
ggggcggggactttgtgggc

SEQ ID NO: 262903 - DNA, 20 bp, human
gggactttgtgggcgggcgc

SEQ ID NO: 262904 - DNA, 20 bp, human
gaaggaaagaaaccactgga

SEQ ID NO: 262905 - DNA, 20 bp, human
gcgcacggcggggcggaagc

SEQ ID NO: 262906 - DNA, 20 bp, human
gtgggcaagtagctgtctaa

SEQ ID NO: 262907 - DNA, 20 bp, human
gcccagagctcgatgaggtg

SEQ ID NO: 262908 - DNA, 20 bp, human
gtccggcgggctaaagttga

SEQ ID NO: 262909 - DNA, 20 bp, human
gcaacgcccagagctcgatg

SEQ ID NO: 262910 - DNA, 20 bp, human
gtgctcccggagtcttcgtg

SEQ ID NO: 262911 - DNA, 20 bp, human
gataactaaggctctccgtg

SEQ ID NO: 262912 - DNA, 20 bp, human
ggcaagtagctgtctaaagg

SEQ ID NO: 262913 - DNA, 20 bp, human
gtcaagtctcgcgataacta

SEQ ID NO: 262914 - DNA, 20 bp, human
ggcaggctgaaagtgcatgg

SEQ ID NO: 262915 - DNA, 20 bp, human
ggggtagagacggaagttct

SEQ ID NO: 262916 - DNA, 20 bp, human
gcgagcccgcctcttcccgt

SEQ ID NO: 262917 - DNA, 20 bp, human
gcgtgggcggggttaccagt

SEQ ID NO: 262918 - DNA, 20 bp, human
gtaaccccgcccacgggaag

SEQ ID NO: 262919 - DNA, 20 bp, human
gcgagagggcggtaccacgg

SEQ ID NO: 262920 - DNA, 20 bp, human
ggcggggttaccagtcggtg

SEQ ID NO: 262921 - DNA, 20 bp, human
gcggcggcagcgacatgggg

SEQ ID NO: 262922 - DNA, 20 bp, human
gccactgcgcagccgcgaga

SEQ ID NO: 262923 - DNA, 20 bp, human
gaccacggcggcagcgacat

SEQ ID NO: 262924 - DNA, 20 bp, human
gccgcctcttcccgtgggcg

SEQ ID NO: 262925 - DNA, 20 bp, human
gaggagcgactaggagcttc

SEQ ID NO: 262926 - DNA, 20 bp, human
ggagcctgcggcggacccag

SEQ ID NO: 262927 - DNA, 20 bp, human
gaggaggatcagcggtgtga

SEQ ID NO: 262928 - DNA, 20 bp, human
gacgtgagaagcgtgttcag

SEQ ID NO: 262929 - DNA, 20 bp, human
gggctcccttccctgcagtt

SEQ ID NO: 262930 - DNA, 20 bp, human
ggcgtcagctcccaactgca

SEQ ID NO: 262931 - DNA, 20 bp, human
gcctcagcggatcgtccctc

SEQ ID NO: 262932 - DNA, 20 bp, human
gagcagagcctgaccctcag

SEQ ID NO: 262933 - DNA, 20 bp, human
gcggaaaaacgcagcccgga

SEQ ID NO: 262934 - DNA, 20 bp, human
gagctcccaactgcagggaa

SEQ ID NO: 262935 - DNA, 20 bp, human
ggtcggctcctgtttcctct

SEQ ID NO: 262936 - DNA, 20 bp, human
ggggcgggaagctactcctg

SEQ ID NO: 262937 - DNA, 20 bp, human
ggtcgcgggccccagaactg

SEQ ID NO: 262938 - DNA, 20 bp, human
ggggtccaggcgcgttcctg

SEQ ID NO: 262939 - DNA, 20 bp, human
gggaggcgtagggcggggat

SEQ ID NO: 262940 - DNA, 20 bp, human
ggggcctccgcgcgctgtcg

SEQ ID NO: 262941 - DNA, 20 bp, human
ggcggagggccggctgatga

SEQ ID NO: 262942 - DNA, 20 bp, human
gccccgctgccgagcctcgg

SEQ ID NO: 262943 - DNA, 20 bp, human
gggagggcgggggaggcgta

SEQ ID NO: 262944 - DNA, 20 bp, human
gggggaggagcgggccctag

SEQ ID NO: 262945 - DNA, 20 bp, human
ggggcagccaatcagaggcc

SEQ ID NO: 262946 - DNA, 20 bp, human
ggagcggcggggagcgtcct

SEQ ID NO: 262947 - DNA, 20 bp, human
gtgtgcgggctgagtcgccg

SEQ ID NO: 262948 - DNA, 20 bp, human
gcctcctcgcgcagggtcag

SEQ ID NO: 262949 - DNA, 20 bp, human
gagccagcggcgtccgggga

SEQ ID NO: 262950 - DNA, 20 bp, human
gccctcggaaaccgccccgg

SEQ ID NO: 262951 - DNA, 20 bp, human
gagcgcgcggttccccctcc

SEQ ID NO: 262952 - DNA, 20 bp, human
ggaagcaagccagcggcgtc

SEQ ID NO: 262953 - DNA, 20 bp, human
gtgtgagagcgggaaacgac

SEQ ID NO: 262954 - DNA, 20 bp, human
ggaccctgcgcgaggaggtg

SEQ ID NO: 262955 - DNA, 20 bp, human
gtgagtcgccggggcctgga

SEQ ID NO: 262956 - DNA, 20 bp, human
gtccaagccacacgcttgag

SEQ ID NO: 262957 - DNA, 20 bp, human
gagaggggatgcaccgtgtc

SEQ ID NO: 262958 - DNA, 20 bp, human
ggaagtggccgtgcaccaag

SEQ ID NO: 262959 - DNA, 20 bp, human
gcaaaggctgtctcacttgt

SEQ ID NO: 262960 - DNA, 20 bp, human
gagcaaggcggctcacgtaa

SEQ ID NO: 262961 - DNA, 20 bp, human
gatgttccgcatcgtggaag

SEQ ID NO: 262962 - DNA, 20 bp, human
gtttgtgcctctcaagcgtg

SEQ ID NO: 262963 - DNA, 20 bp, human
gcacggccacttccacgatg

SEQ ID NO: 262964 - DNA, 20 bp, human
gccctcccatggggaagtgc

SEQ ID NO: 262965 - DNA, 20 bp, human
gggaaaagggtggggtgtaa

SEQ ID NO: 262966 - DNA, 20 bp, human
gcgcgcgagccgtggaagga

SEQ ID NO: 262967 - DNA, 20 bp, human
gaaaggccgggcatccgcgc

SEQ ID NO: 262968 - DNA, 20 bp, human
gcgggactcggtgggagcga

SEQ ID NO: 262969 - DNA, 20 bp, human
gtccacggctcgcgcgcgtc

SEQ ID NO: 262970 - DNA, 20 bp, human
ggcgagccgtggaaggaagg

SEQ ID NO: 262971 - DNA, 20 bp, human
gccgggcatccgcgccggga

SEQ ID NO: 262972 - DNA, 20 bp, human
gtcggcctccgggactcggt

SEQ ID NO: 262973 - DNA, 20 bp, human
gccagggcggggcgcgttgg

SEQ ID NO: 262974 - DNA, 20 bp, human
gctgccagggcggggcgcgt

SEQ ID NO: 262975 - DNA, 20 bp, human
gcgcggcggccccggatgac

SEQ ID NO: 262976 - DNA, 20 bp, human
ggcaacctggtacccaccca

SEQ ID NO: 262977 - DNA, 20 bp, human
gcagaaagagagttctttgt

SEQ ID NO: 262978 - DNA, 20 bp, human
gaatcagaatggccctcctg

SEQ ID NO: 262979 - DNA, 20 bp, human
gggtctggaaggtcagtaac

SEQ ID NO: 262980 - DNA, 20 bp, human
gagactctccagccctgggt

SEQ ID NO: 262981 - DNA, 20 bp, human
gtctagcaacttctgaaagc

SEQ ID NO: 262982 - DNA, 20 bp, human
gtctctttgaacttgaactg

SEQ ID NO: 262983 - DNA, 20 bp, human
gtgctgccagcacgttctct

SEQ ID NO: 262984 - DNA, 20 bp, human
gagaatggccctcctgaggc

SEQ ID NO: 262985 - DNA, 20 bp, human
gttgtgtgagtgttgcaacc

SEQ ID NO: 262986 - DNA, 20 bp, human
gaactggggagtcgcgagcc

SEQ ID NO: 262987 - DNA, 20 bp, human
gtcggggcctgccaatcggg

SEQ ID NO: 262988 - DNA, 20 bp, human
gttcgagggcgggctcacgg

SEQ ID NO: 262989 - DNA, 20 bp, human
ggggagtcgcgagccaggag

SEQ ID NO: 262990 - DNA, 20 bp, human
gcaggctgggaagggttaaa

SEQ ID NO: 262991 - DNA, 20 bp, human
gggcctgccaatcgggaggt

SEQ ID NO: 262992 - DNA, 20 bp, human
gagagcgcggatccgacgga

SEQ ID NO: 262993 - DNA, 20 bp, human
gtaagagtgatttcgagggc

SEQ ID NO: 262994 - DNA, 20 bp, human
gcctttaagagtgatttcga

SEQ ID NO: 262995 - DNA, 20 bp, human
gttcccacctcccgattggc

SEQ ID NO: 262996 - DNA, 20 bp, human
ggcccgcggaccgtccgagg

SEQ ID NO: 262997 - DNA, 20 bp, human
ggccgcctcgaggtctgcca

SEQ ID NO: 262998 - DNA, 20 bp, human
gccgaccccggtggcccggt

SEQ ID NO: 262999 - DNA, 20 bp, human
gctgccagggcgggaaactg

SEQ ID NO: 263000 - DNA, 20 bp, human
gtgtgtaggagcccacccta

SEQ ID NO: 263001 - DNA, 20 bp, human
ggcccccctcggacggtccg

SEQ ID NO: 263002 - DNA, 20 bp, human
ggaggcccgcggaccgtccg

SEQ ID NO: 263003 - DNA, 20 bp, human
ggcctcgaggtctgccaggg

SEQ ID NO: 263004 - DNA, 20 bp, human
ggtaggagcccaccctaggg

SEQ ID NO: 263005 - DNA, 20 bp, human
gcccgcaccgaccagtgctg

SEQ ID NO: 263006 - DNA, 20 bp, human
gaggaagtcccagctggccg

SEQ ID NO: 263007 - DNA, 20 bp, human
gcggaagcgaggaaccaatc

SEQ ID NO: 263008 - DNA, 20 bp, human
gtcgccccggacttcctgat

SEQ ID NO: 263009 - DNA, 20 bp, human
ggggtggccctcactgtcga

SEQ ID NO: 263010 - DNA, 20 bp, human
ggggaaagaaccaggcgccg

SEQ ID NO: 263011 - DNA, 20 bp, human
gccctggggcgccgtggaag

SEQ ID NO: 263012 - DNA, 20 bp, human
gtggcggcgcgccgttcgaa

SEQ ID NO: 263013 - DNA, 20 bp, human
ggccagctgggacttcctct

SEQ ID NO: 263014 - DNA, 20 bp, human
gagtccggggcgaaccattc

SEQ ID NO: 263015 - DNA, 20 bp, human
gtcgggcgggggaagctaag

SEQ ID NO: 263016 - DNA, 20 bp, human
gtggagtggaggtgcgagaa

SEQ ID NO: 263017 - DNA, 20 bp, human
gagaagggtggggacccgga

SEQ ID NO: 263018 - DNA, 20 bp, human
ggcggggcggggtgtacgag

SEQ ID NO: 263019 - DNA, 20 bp, human
ggtgggatgggcatcagtag

SEQ ID NO: 263020 - DNA, 20 bp, human
ggcgccgaccgagtggaatg

SEQ ID NO: 263021 - DNA, 20 bp, human
gaacttggagccagttgctg

SEQ ID NO: 263022 - DNA, 20 bp, human
ggtacgaggggcgtgtacac

SEQ ID NO: 263023 - DNA, 20 bp, human
gagtggaggtgcgagaaggg

SEQ ID NO: 263024 - DNA, 20 bp, human
gcttgcgtgcggacataggt

SEQ ID NO: 263025 - DNA, 20 bp, human
gggtgcttgcgtgcggacat

SEQ ID NO: 263026 - DNA, 20 bp, human
gacccggagagcggccaggg

SEQ ID NO: 263027 - DNA, 20 bp, human
gggcacccggagagcggcca

SEQ ID NO: 263028 - DNA, 20 bp, human
ggaccccggacgcgaggtga

SEQ ID NO: 263029 - DNA, 20 bp, human
gggcgctggcacccggagag

SEQ ID NO: 263030 - DNA, 20 bp, human
ggggcggtgccagtcggtgt

SEQ ID NO: 263031 - DNA, 20 bp, human
gggacgggcggggacgagcg

SEQ ID NO: 263032 - DNA, 20 bp, human
gcgcctccctggccgctctc

SEQ ID NO: 263033 - DNA, 20 bp, human
gcccggacgcgaggtgaggg

SEQ ID NO: 263034 - DNA, 20 bp, human
gcagcgccgccggaaggtga

SEQ ID NO: 263035 - DNA, 20 bp, human
gcagtgacctcggggatctg

SEQ ID NO: 263036 - DNA, 20 bp, human
ggaaggcgagggttaatttg

SEQ ID NO: 263037 - DNA, 20 bp, human
gatctgcctcaggaaggcga

SEQ ID NO: 263038 - DNA, 20 bp, human
gcacagccaatcacctaacc

SEQ ID NO: 263039 - DNA, 20 bp, human
gtcacaggtctccacagcgc

SEQ ID NO: 263040 - DNA, 20 bp, human
ggtgatcaggaaagagttaa

SEQ ID NO: 263041 - DNA, 20 bp, human
ggtggaagcactgtgagctt

SEQ ID NO: 263042 - DNA, 20 bp, human
gagggggctgatcccacata

SEQ ID NO: 263043 - DNA, 20 bp, human
gtgatcacagtcctgcgctg

SEQ ID NO: 263044 - DNA, 20 bp, human
gcccagcccggttaggtgat

SEQ ID NO: 263045 - DNA, 20 bp, human
gtggtcaaacagtcccagcc

SEQ ID NO: 263046 - DNA, 20 bp, human
gctcttccggcctaaacctc

SEQ ID NO: 263047 - DNA, 20 bp, human
ggggcgggaaacggagcagg

SEQ ID NO: 263048 - DNA, 20 bp, human
ggctccagctgggcgggaaa

SEQ ID NO: 263049 - DNA, 20 bp, human
gtgcacgctgtagctacctg

SEQ ID NO: 263050 - DNA, 20 bp, human
gctgtagctacctgaggttt

SEQ ID NO: 263051 - DNA, 20 bp, human
gtcccgcccagctggagctc

SEQ ID NO: 263052 - DNA, 20 bp, human
gaggttgtctgcgaaccaat

SEQ ID NO: 263053 - DNA, 20 bp, human
gcgtagtgttgctagtgata

SEQ ID NO: 263054 - DNA, 20 bp, human
ggaaggttgaagggacttca

SEQ ID NO: 263055 - DNA, 20 bp, human
gaaatcagccgtgcctcttc

SEQ ID NO: 263056 - DNA, 20 bp, human
ggaggtggaagttggggcgc

SEQ ID NO: 263057 - DNA, 20 bp, human
gcccgcctgtaaatcatggt

SEQ ID NO: 263058 - DNA, 20 bp, human
gtcgcggaggcaccaggctg

SEQ ID NO: 263059 - DNA, 20 bp, human
ggctggcggcagagccactg

SEQ ID NO: 263060 - DNA, 20 bp, human
gctccccaaccatgatttac

SEQ ID NO: 263061 - DNA, 20 bp, human
gtgtccccgcctgtaaatca

SEQ ID NO: 263062 - DNA, 20 bp, human
gggttggggaggagtcgcgg

SEQ ID NO: 263063 - DNA, 20 bp, human
gtcgcgcgcgcaggaagcgg

SEQ ID NO: 263064 - DNA, 20 bp, human
gaggaggcgctgaggctagt

SEQ ID NO: 263065 - DNA, 20 bp, human
ggtctcgcgcgcgcaggaag

SEQ ID NO: 263066 - DNA, 20 bp, human
gactcatctctcatccactg

SEQ ID NO: 263067 - DNA, 20 bp, human
gagtgattgaagggaaggac

SEQ ID NO: 263068 - DNA, 20 bp, human
ggaactggccgtggactgag

SEQ ID NO: 263069 - DNA, 20 bp, human
gcagacagtgattgaaggga

SEQ ID NO: 263070 - DNA, 20 bp, human
gagcgcgcagcgcgcgcagg

SEQ ID NO: 263071 - DNA, 20 bp, human
ggacaggggacgcccatgag

SEQ ID NO: 263072 - DNA, 20 bp, human
ggggtctgaaggccgggccg

SEQ ID NO: 263073 - DNA, 20 bp, human
gggttggcgcgcagtaccct

SEQ ID NO: 263074 - DNA, 20 bp, human
gggactgagtggtgccgggg

SEQ ID NO: 263075 - DNA, 20 bp, human
ggaggagctgcgcggtagct

SEQ ID NO: 263076 - DNA, 20 bp, human
gggcccggccctcgcagcgt

SEQ ID NO: 263077 - DNA, 20 bp, human
gtccgcgctggcacaggggt

SEQ ID NO: 263078 - DNA, 20 bp, human
gggcgagtctcctggaaact

SEQ ID NO: 263079 - DNA, 20 bp, human
gccgcgctgggcgagtctcc

SEQ ID NO: 263080 - DNA, 20 bp, human
gggccacccccacgctgcga

SEQ ID NO: 263081 - DNA, 20 bp, human
gccccgcggcgctcctcgtg

SEQ ID NO: 263082 - DNA, 20 bp, human
gccggccctgcagacgtggc

SEQ ID NO: 263083 - DNA, 20 bp, human
gtgggacaagccaagtttcc

SEQ ID NO: 263084 - DNA, 20 bp, human
gcactcccttgccctgtcgg

SEQ ID NO: 263085 - DNA, 20 bp, human
gactcccaccgacagggcaa

SEQ ID NO: 263086 - DNA, 20 bp, human
ggccggaaggagctagacgg

SEQ ID NO: 263087 - DNA, 20 bp, human
ggaggccggaaggagctaga

SEQ ID NO: 263088 - DNA, 20 bp, human
gtcgctgcgaggggactact

SEQ ID NO: 263089 - DNA, 20 bp, human
ggggactactaggagcgccg

SEQ ID NO: 263090 - DNA, 20 bp, human
ggtaggtgacggcttggttg

SEQ ID NO: 263091 - DNA, 20 bp, human
ggaaggagctagacggcggt

SEQ ID NO: 263092 - DNA, 20 bp, human
gtagctccttccggcctcag

SEQ ID NO: 263093 - DNA, 20 bp, human
gcgctgaaggagcacttccg

SEQ ID NO: 263094 - DNA, 20 bp, human
gagctagacggcggtcgggt

SEQ ID NO: 263095 - DNA, 20 bp, human
gaacgccgagtcggctgccg

SEQ ID NO: 263096 - DNA, 20 bp, human
ggcctctgaggtctagggga

SEQ ID NO: 263097 - DNA, 20 bp, human
ggcagggcctctgaggtcta

SEQ ID NO: 263098 - DNA, 20 bp, human
ggacgggggcgggacttggc

SEQ ID NO: 263099 - DNA, 20 bp, human
ggaggccctgcccgcagatg

SEQ ID NO: 263100 - DNA, 20 bp, human
gggcgccagcccaggaatat

SEQ ID NO: 263101 - DNA, 20 bp, human
gacaggacttggaaagtctt

SEQ ID NO: 263102 - DNA, 20 bp, human
gtaggcctgcatccgggatt

SEQ ID NO: 263103 - DNA, 20 bp, human
ggattggtcgacgcggacgg

SEQ ID NO: 263104 - DNA, 20 bp, human
gcagatgtggcgccaaatcc

SEQ ID NO: 263105 - DNA, 20 bp, human
gtggtcgacgcggacggggg

SEQ ID NO: 263106 - DNA, 20 bp, human
gacgcctggagaccccatcc

SEQ ID NO: 263107 - DNA, 20 bp, human
gttggcattgctgtggctta

SEQ ID NO: 263108 - DNA, 20 bp, human
gtttgtgtcgccggccctgg

SEQ ID NO: 263109 - DNA, 20 bp, human
ggccgtccacactgccagga

SEQ ID NO: 263110 - DNA, 20 bp, human
gggagaggaggggtttccac

SEQ ID NO: 263111 - DNA, 20 bp, human
gtaccgtgatatattgccaa

SEQ ID NO: 263112 - DNA, 20 bp, human
ggctgtggcttagggacgcc

SEQ ID NO: 263113 - DNA, 20 bp, human
ggtcgccggccctggtggct

SEQ ID NO: 263114 - DNA, 20 bp, human
gtctgactctacattagtaa

SEQ ID NO: 263115 - DNA, 20 bp, human
gcagcgcttctttgtgtcgc

SEQ ID NO: 263116 - DNA, 20 bp, human
gcgccccaaatatggtttat

SEQ ID NO: 263117 - DNA, 20 bp, human
gatcaagtgcgacagcaaac

SEQ ID NO: 263118 - DNA, 20 bp, human
gtctccaataaaccatattt

SEQ ID NO: 263119 - DNA, 20 bp, human
gatggtttattggagactta

SEQ ID NO: 263120 - DNA, 20 bp, human
ggtaggcggggctctctcgt

SEQ ID NO: 263121 - DNA, 20 bp, human
gaggcgggttgtaccgtagg

SEQ ID NO: 263122 - DNA, 20 bp, human
gggcacaggctggggtgagg

SEQ ID NO: 263123 - DNA, 20 bp, human
gcggaggcgggactgtcctg

SEQ ID NO: 263124 - DNA, 20 bp, human
gggcggcggggctgtcttgg

SEQ ID NO: 263125 - DNA, 20 bp, human
gaggtggagtcctgcggtcc

SEQ ID NO: 263126 - DNA, 20 bp, human
ggggatgttggaaaaccgaa

SEQ ID NO: 263127 - DNA, 20 bp, human
gaaccagccctcttctgtac

SEQ ID NO: 263128 - DNA, 20 bp, human
gaccaatcatcctcaggaaa

SEQ ID NO: 263129 - DNA, 20 bp, human
gggcctgtacagaagagggc

SEQ ID NO: 263130 - DNA, 20 bp, human
gtggctggggtggaaggtct

SEQ ID NO: 263131 - DNA, 20 bp, human
gtcatcgaccaatcatcctc

SEQ ID NO: 263132 - DNA, 20 bp, human
gaatgagaagacgcagaata

SEQ ID NO: 263133 - DNA, 20 bp, human
gtagagctgtcattggactg

SEQ ID NO: 263134 - DNA, 20 bp, human
gtgattggcctgtacagaag

SEQ ID NO: 263135 - DNA, 20 bp, human
ggctgcttatctgctgtacg

SEQ ID NO: 263136 - DNA, 20 bp, human
ggagacccagccggaagtga

SEQ ID NO: 263137 - DNA, 20 bp, human
gggcactagggatcgtccgc

SEQ ID NO: 263138 - DNA, 20 bp, human
gcggcccgacggttccgatt

SEQ ID NO: 263139 - DNA, 20 bp, human
ggtagctgaacaaggttcgg

SEQ ID NO: 263140 - DNA, 20 bp, human
gcgtctggagcgttctgcgc

SEQ ID NO: 263141 - DNA, 20 bp, human
gaggtgacgcgagacccagc

SEQ ID NO: 263142 - DNA, 20 bp, human
ggctccagacgctgagaggc

SEQ ID NO: 263143 - DNA, 20 bp, human
ggcagcaggaacggtggctc

SEQ ID NO: 263144 - DNA, 20 bp, human
ggccgccggcaatgccgcga

SEQ ID NO: 263145 - DNA, 20 bp, human
gagggatcgtccgcaggatt

SEQ ID NO: 263146 - DNA, 20 bp, human
gacggtctccgcgcacaccc

SEQ ID NO: 263147 - DNA, 20 bp, human
ggacccgccccccgcgggga

SEQ ID NO: 263148 - DNA, 20 bp, human
gcaggctctcaaggcctcgg

SEQ ID NO: 263149 - DNA, 20 bp, human
gtacgagcagctcgggtccc

SEQ ID NO: 263150 - DNA, 20 bp, human
ggccgctccactgctcccat

SEQ ID NO: 263151 - DNA, 20 bp, human
gcgagctgctcgtagccaat

SEQ ID NO: 263152 - DNA, 20 bp, human
gcaccaatgggcgatcgtgg

SEQ ID NO: 263153 - DNA, 20 bp, human
ggcggctgacgctgcaccaa

SEQ ID NO: 263154 - DNA, 20 bp, human
ggggcaggccccccaagacg

SEQ ID NO: 263155 - DNA, 20 bp, human
ggcggcggcaacaacaacgg

SEQ ID NO: 263156 - DNA, 20 bp, human
gggaccgtggtcaccgaggt

SEQ ID NO: 263157 - DNA, 20 bp, human
gtgggcggtgccagaggatc

SEQ ID NO: 263158 - DNA, 20 bp, human
ggccccgccgccagatcctc

SEQ ID NO: 263159 - DNA, 20 bp, human
gcggctcgccgggccaggta

SEQ ID NO: 263160 - DNA, 20 bp, human
gccgctgccggctaacgcgg

SEQ ID NO: 263161 - DNA, 20 bp, human
gcctctggcaccgcccacct

SEQ ID NO: 263162 - DNA, 20 bp, human
gaccgcggggccgttggttt

SEQ ID NO: 263163 - DNA, 20 bp, human
gggcgcggtcggatgtgcgg

SEQ ID NO: 263164 - DNA, 20 bp, human
gacggtcccgcccaccgggg

SEQ ID NO: 263165 - DNA, 20 bp, human
gcccggggaagggcgaagcc

SEQ ID NO: 263166 - DNA, 20 bp, human
gtgggcgccgccatcttaca

SEQ ID NO: 263167 - DNA, 20 bp, human
gcgtcgggcccctggatccg

SEQ ID NO: 263168 - DNA, 20 bp, human
ggagaagggcgactacaatg

SEQ ID NO: 263169 - DNA, 20 bp, human
ggcgcccaggtggagcgcgt

SEQ ID NO: 263170 - DNA, 20 bp, human
gcccgcccttccttgtaaga

SEQ ID NO: 263171 - DNA, 20 bp, human
gagggcgactacaatgaggc

SEQ ID NO: 263172 - DNA, 20 bp, human
gggcccgacgcgctccacct

SEQ ID NO: 263173 - DNA, 20 bp, human
ggcccctggatccggggaaa

SEQ ID NO: 263174 - DNA, 20 bp, human
gggggcgagccaagaccacg

SEQ ID NO: 263175 - DNA, 20 bp, human
gactacaatgaggcgggagt

SEQ ID NO: 263176 - DNA, 20 bp, human
ggaggcggaggcccggagtt

SEQ ID NO: 263177 - DNA, 20 bp, human
gaggcccgccggctagcagg

SEQ ID NO: 263178 - DNA, 20 bp, human
gggccgggacgggatccggg

SEQ ID NO: 263179 - DNA, 20 bp, human
gcctccgcccggtggttctc

SEQ ID NO: 263180 - DNA, 20 bp, human
gggacgccgcccaggcccgc

SEQ ID NO: 263181 - DNA, 20 bp, human
gctgacgtagcggacccgcc

SEQ ID NO: 263182 - DNA, 20 bp, human
gtcccgtcccggcccaactc

SEQ ID NO: 263183 - DNA, 20 bp, human
gagcctcccggatcccgtcc

SEQ ID NO: 263184 - DNA, 20 bp, human
gcccaggcccgccggctagc

SEQ ID NO: 263185 - DNA, 20 bp, human
gggaggcccggagttgggcc

SEQ ID NO: 263186 - DNA, 20 bp, human
ggaggcggaggcccggagtt

SEQ ID NO: 263187 - DNA, 20 bp, human
gggcctcggcctcgcagcgg

SEQ ID NO: 263188 - DNA, 20 bp, human
gctgacgtagcggacccgcc

SEQ ID NO: 263189 - DNA, 20 bp, human
gccagggccatgtctgggga

SEQ ID NO: 263190 - DNA, 20 bp, human
gaggcccgccggctagcagg

SEQ ID NO: 263191 - DNA, 20 bp, human
gcggcagcacatggcggccg

SEQ ID NO: 263192 - DNA, 20 bp, human
gcatgtgctgccgcctccca

SEQ ID NO: 263193 - DNA, 20 bp, human
ggcgggggcggcggcctcta

SEQ ID NO: 263194 - DNA, 20 bp, human
gggacgccgcccaggcccgc

SEQ ID NO: 263195 - DNA, 20 bp, human
gcggcctctaggggggactg

SEQ ID NO: 263196 - DNA, 20 bp, human
gcaggcgcggacagcggacg

SEQ ID NO: 263197 - DNA, 20 bp, human
gtgaggagcgcccgcgtcgt

SEQ ID NO: 263198 - DNA, 20 bp, human
ggggccgcgccgtcccgata

SEQ ID NO: 263199 - DNA, 20 bp, human
gccggcggcgtgggacgccg

SEQ ID NO: 263200 - DNA, 20 bp, human
gggcgcgcaggcgcggacag

SEQ ID NO: 263201 - DNA, 20 bp, human
ggacctcgggtcgcgcagtc

SEQ ID NO: 263202 - DNA, 20 bp, human
ggaccccgcctctgcgaacc

SEQ ID NO: 263203 - DNA, 20 bp, human
gcagtcaggtagctgcccgc

SEQ ID NO: 263204 - DNA, 20 bp, human
ggacttggccgggttcgcag

SEQ ID NO: 263205 - DNA, 20 bp, human
gttgctgtggcaacaggccg

SEQ ID NO: 263206 - DNA, 20 bp, human
gaaaaggattcccgagggga

SEQ ID NO: 263207 - DNA, 20 bp, human
gaggggaggagaccacaaat

SEQ ID NO: 263208 - DNA, 20 bp, human
gaagcgagggaatgagggcg

SEQ ID NO: 263209 - DNA, 20 bp, human
ggagaccacaaattggattt

SEQ ID NO: 263210 - DNA, 20 bp, human
gggcagaccggacccgggag

SEQ ID NO: 263211 - DNA, 20 bp, human
gcgggaaaaggattcccgag

SEQ ID NO: 263212 - DNA, 20 bp, human
ggggaggggcagaccggacc

SEQ ID NO: 263213 - DNA, 20 bp, human
gggaggataaaagcgaggat

SEQ ID NO: 263214 - DNA, 20 bp, human
gtgagcacaagggctgagaa

SEQ ID NO: 263215 - DNA, 20 bp, human
gcgcgtgcgcactccgcggg

SEQ ID NO: 263216 - DNA, 20 bp, human
gcgcggcagtggtaggggag

SEQ ID NO: 263217 - DNA, 20 bp, human
ggggaggggcgaggagtggt

SEQ ID NO: 263218 - DNA, 20 bp, human
gagaggcccatggtgatgtg

SEQ ID NO: 263219 - DNA, 20 bp, human
gtaagcaggcgccgcgagta

SEQ ID NO: 263220 - DNA, 20 bp, human
ggatgtggggctgtatgacg

SEQ ID NO: 263221 - DNA, 20 bp, human
gctcaatagctatttgccga

SEQ ID NO: 263222 - DNA, 20 bp, human
gaccatgggcctctctttca

SEQ ID NO: 263223 - DNA, 20 bp, human
gcgtaatatgtgcgcggcag

SEQ ID NO: 263224 - DNA, 20 bp, human
ggctagtccgtatattcctt

SEQ ID NO: 263225 - DNA, 20 bp, human
gtacagccccacatcaccat

SEQ ID NO: 263226 - DNA, 20 bp, human
gggcccggcgccttcctcga

SEQ ID NO: 263227 - DNA, 20 bp, human
gaaggggaggagcgtttcca

SEQ ID NO: 263228 - DNA, 20 bp, human
ggtccagcggccactccaat

SEQ ID NO: 263229 - DNA, 20 bp, human
gcgcgtgcgcaggacccgat

SEQ ID NO: 263230 - DNA, 20 bp, human
gaggccaatgccatcgagga

SEQ ID NO: 263231 - DNA, 20 bp, human
gaaatccgcctccaaagggg

SEQ ID NO: 263232 - DNA, 20 bp, human
gtcgaaatccgcctccaaag

SEQ ID NO: 263233 - DNA, 20 bp, human
gaggtcggagcgtacaaatt

SEQ ID NO: 263234 - DNA, 20 bp, human
gaaacgctcctcccctttgg

SEQ ID NO: 263235 - DNA, 20 bp, human
gccccaggccaatgccatcg

SEQ ID NO: 263236 - DNA, 20 bp, human
gccggctgatagcttatcgc

SEQ ID NO: 263237 - DNA, 20 bp, human
ggcaggacatggggataaag

SEQ ID NO: 263238 - DNA, 20 bp, human
gcccctggcaaagctgacta

SEQ ID NO: 263239 - DNA, 20 bp, human
gcattggggaaagaggaagg

SEQ ID NO: 263240 - DNA, 20 bp, human
gtatcgcaggctctgagggg

SEQ ID NO: 263241 - DNA, 20 bp, human
gcatcacaacaggcgtcgtc

SEQ ID NO: 263242 - DNA, 20 bp, human
gtcattgcctgcatcacaac

SEQ ID NO: 263243 - DNA, 20 bp, human
gggacccaactgattgtcaa

SEQ ID NO: 263244 - DNA, 20 bp, human
gttaactgcgcgtgcgcccc

SEQ ID NO: 263245 - DNA, 20 bp, human
gccacggtaagtgggcattg

SEQ ID NO: 263246 - DNA, 20 bp, human
ggggtcccgccggacggcga

SEQ ID NO: 263247 - DNA, 20 bp, human
gtgtgcatgcggtgtgatgt

SEQ ID NO: 263248 - DNA, 20 bp, human
gagcgcgtgtgcgagcgcgt

SEQ ID NO: 263249 - DNA, 20 bp, human
ggcgtgtgcgagcgcgtggg

SEQ ID NO: 263250 - DNA, 20 bp, human
ggggggcgtgtgagcgtgag

SEQ ID NO: 263251 - DNA, 20 bp, human
ggccgggcgcggtcgggaga

SEQ ID NO: 263252 - DNA, 20 bp, human
gaccgcatgcacagacgcac

SEQ ID NO: 263253 - DNA, 20 bp, human
gtgggtgcggtgtgcactcc

SEQ ID NO: 263254 - DNA, 20 bp, human
ggtgcccagccgggcgcggt

SEQ ID NO: 263255 - DNA, 20 bp, human
gacacgcgggtcccgccgga

SEQ ID NO: 263256 - DNA, 20 bp, human
gaggaaatgaccggccgaaa

SEQ ID NO: 263257 - DNA, 20 bp, human
gtcctgagaaacacccaaat

SEQ ID NO: 263258 - DNA, 20 bp, human
gccgttgtaagttgataaaa

SEQ ID NO: 263259 - DNA, 20 bp, human
ggtattcagattggtggagc

SEQ ID NO: 263260 - DNA, 20 bp, human
ggctactgtaaaccgtaagt

SEQ ID NO: 263261 - DNA, 20 bp, human
gtgagaaacacccaaatggg

SEQ ID NO: 263262 - DNA, 20 bp, human
gggttctcatttcctactta

SEQ ID NO: 263263 - DNA, 20 bp, human
gccctggggaacgcctgaaa

SEQ ID NO: 263264 - DNA, 20 bp, human
gaaaaaactggcaaagggtc

SEQ ID NO: 263265 - DNA, 20 bp, human
gtctataagagccgcccatt

SEQ ID NO: 263266 - DNA, 20 bp, human
gtgggcgtggtctgagcaat

SEQ ID NO: 263267 - DNA, 20 bp, human
gagcagaagaagattctcat

SEQ ID NO: 263268 - DNA, 20 bp, human
ggccatgaggcgccttgagt

SEQ ID NO: 263269 - DNA, 20 bp, human
gcgccccggaggacggcgat

SEQ ID NO: 263270 - DNA, 20 bp, human
ggggaagttgattgactgta

SEQ ID NO: 263271 - DNA, 20 bp, human
gaggcgatgacaatcagcga

SEQ ID NO: 263272 - DNA, 20 bp, human
ggcccactcaaggcgcctca

SEQ ID NO: 263273 - DNA, 20 bp, human
gggacggcgataggctgaac

SEQ ID NO: 263274 - DNA, 20 bp, human
gtctctgacaggcacgacca

SEQ ID NO: 263275 - DNA, 20 bp, human
gaggctgaactggcgtgggg

SEQ ID NO: 263276 - DNA, 20 bp, human
gcaacaaccaaccctctcat

SEQ ID NO: 263277 - DNA, 20 bp, human
ggccctgtgtgcggtgtcta

SEQ ID NO: 263278 - DNA, 20 bp, human
gatactgcagccaataaggg

SEQ ID NO: 263279 - DNA, 20 bp, human
gagacagcagggtgacaggt

SEQ ID NO: 263280 - DNA, 20 bp, human
gggcatactgcagccaataa

SEQ ID NO: 263281 - DNA, 20 bp, human
gcagggtgacaggtaggcgg

SEQ ID NO: 263282 - DNA, 20 bp, human
gcaacaacagcctcccttat

SEQ ID NO: 263283 - DNA, 20 bp, human
gtgttgtccttgcttgggga

SEQ ID NO: 263284 - DNA, 20 bp, human
gtaggaagccggagacagca

SEQ ID NO: 263285 - DNA, 20 bp, human
ggtgttctcacccaatgaga

SEQ ID NO: 263286 - DNA, 20 bp, human
gaggccggcttgtatcggag

SEQ ID NO: 263287 - DNA, 20 bp, human
gcgggtggtccctagtacgc

SEQ ID NO: 263288 - DNA, 20 bp, human
gcgtgtcgtggggtatacac

SEQ ID NO: 263289 - DNA, 20 bp, human
gagtacgcaggcgtgtcgtg

SEQ ID NO: 263290 - DNA, 20 bp, human
gctaaagccctcaaggaggc

SEQ ID NO: 263291 - DNA, 20 bp, human
ggaccacccggctttgtggg

SEQ ID NO: 263292 - DNA, 20 bp, human
gcggggctccaaccctctca

SEQ ID NO: 263293 - DNA, 20 bp, human
gagggaccacccggctttgt

SEQ ID NO: 263294 - DNA, 20 bp, human
gggactccgcccacaaagcc

SEQ ID NO: 263295 - DNA, 20 bp, human
ggtgggcggagtccatgaga

SEQ ID NO: 263296 - DNA, 20 bp, human
gaatgccaggagttctgggg

SEQ ID NO: 263297 - DNA, 20 bp, human
gagtgcgctggtgcgtcaca

SEQ ID NO: 263298 - DNA, 20 bp, human
ggggtctcatactgtggagg

SEQ ID NO: 263299 - DNA, 20 bp, human
ggtgtagcctcagaggagta

SEQ ID NO: 263300 - DNA, 20 bp, human
gggcgcggaagggcaatgcc

SEQ ID NO: 263301 - DNA, 20 bp, human
gtggggtgggtctcatactg

SEQ ID NO: 263302 - DNA, 20 bp, human
gcggaagcgcatgtcgaggg

SEQ ID NO: 263303 - DNA, 20 bp, human
gagtgaccacaagtctttgt

SEQ ID NO: 263304 - DNA, 20 bp, human
gagacccaccccagaactcc

SEQ ID NO: 263305 - DNA, 20 bp, human
gcgccggaagcgcatgtcga

SEQ ID NO: 263306 - DNA, 20 bp, human
ggggtcgcaccgtaggggtg

SEQ ID NO: 263307 - DNA, 20 bp, human
gccggggcacccagcggagc

SEQ ID NO: 263308 - DNA, 20 bp, human
gagcgggaagtgcatgtcgc

SEQ ID NO: 263309 - DNA, 20 bp, human
ggaggcagggtcgcaccgta

SEQ ID NO: 263310 - DNA, 20 bp, human
gggggcaaagtctttctagg

SEQ ID NO: 263311 - DNA, 20 bp, human
gtggggagtgaggatttttt

SEQ ID NO: 263312 - DNA, 20 bp, human
ggaggtcattagtgcgccag

SEQ ID NO: 263313 - DNA, 20 bp, human
gggggtcccggggcacccag

SEQ ID NO: 263314 - DNA, 20 bp, human
gtagtgcgccagggggtccc

SEQ ID NO: 263315 - DNA, 20 bp, human
gttaactggtcaaggaggca

SEQ ID NO: 263316 - DNA, 20 bp, human
gctagctggtgagctccgac

SEQ ID NO: 263317 - DNA, 20 bp, human
ggatccgtgggccggcccgg

SEQ ID NO: 263318 - DNA, 20 bp, human
gaggagctggccgacctcct

SEQ ID NO: 263319 - DNA, 20 bp, human
ggagctcaccagctaggcga

SEQ ID NO: 263320 - DNA, 20 bp, human
gtcaccagctaggcgagggc

SEQ ID NO: 263321 - DNA, 20 bp, human
gcggcccacggatcatcaga

SEQ ID NO: 263322 - DNA, 20 bp, human
ggacgggctggcaaccgagg

SEQ ID NO: 263323 - DNA, 20 bp, human
gtcccagctcacatccttcg

SEQ ID NO: 263324 - DNA, 20 bp, human
gctggtgagctccgacgggc

SEQ ID NO: 263325 - DNA, 20 bp, human
gatcttgagctccacctcga

SEQ ID NO: 263326 - DNA, 20 bp, human
gcaggggggtgcaggaccga

SEQ ID NO: 263327 - DNA, 20 bp, human
gggggcggggcatacggggc

SEQ ID NO: 263328 - DNA, 20 bp, human
gcgccggggtgcagggccga

SEQ ID NO: 263329 - DNA, 20 bp, human
ggcacaggggcggtggacgc

SEQ ID NO: 263330 - DNA, 20 bp, human
ggtgggacgcggcgggcgca

SEQ ID NO: 263331 - DNA, 20 bp, human
gtggtctggtggggcggagc

SEQ ID NO: 263332 - DNA, 20 bp, human
ggtggacgccgggaccgccc

SEQ ID NO: 263333 - DNA, 20 bp, human
ggccgggaccgccctggaga

SEQ ID NO: 263334 - DNA, 20 bp, human
gcggagggggcggggcatac

SEQ ID NO: 263335 - DNA, 20 bp, human
gtgcgggggcgtggtctggt

SEQ ID NO: 263336 - DNA, 20 bp, human
gccgggcgcagcctcaccgc

SEQ ID NO: 263337 - DNA, 20 bp, human
gcaggatgacagtgccgatt

SEQ ID NO: 263338 - DNA, 20 bp, human
gagggttgcgagggcccaat

SEQ ID NO: 263339 - DNA, 20 bp, human
ggcgcccgggctcccgggtg

SEQ ID NO: 263340 - DNA, 20 bp, human
gtgagtcaccagctggtgag

SEQ ID NO: 263341 - DNA, 20 bp, human
gaagtctagcatggaagagg

SEQ ID NO: 263342 - DNA, 20 bp, human
gcggtgagtgcccaggagat

SEQ ID NO: 263343 - DNA, 20 bp, human
gctctcagcccccatctcct

SEQ ID NO: 263344 - DNA, 20 bp, human
gacaaagtctagcatggaag

SEQ ID NO: 263345 - DNA, 20 bp, human
gaaatcagcaagacctaaag

SEQ ID NO: 263346 - DNA, 20 bp, human
gcagccccggggttaggttg

SEQ ID NO: 263347 - DNA, 20 bp, human
gaccccacaacctaaccccg

SEQ ID NO: 263348 - DNA, 20 bp, human
gtgccccagcactgacctca

SEQ ID NO: 263349 - DNA, 20 bp, human
gcagcctctacagaaaccac

SEQ ID NO: 263350 - DNA, 20 bp, human
gcggggacagccccggggtt

SEQ ID NO: 263351 - DNA, 20 bp, human
ggaggacgcaggtgcagcgt

SEQ ID NO: 263352 - DNA, 20 bp, human
gccagctcctaggagtcccc

SEQ ID NO: 263353 - DNA, 20 bp, human
gccgtgttgcccagagccag

SEQ ID NO: 263354 - DNA, 20 bp, human
gggcagggcagacatctggc

SEQ ID NO: 263355 - DNA, 20 bp, human
gcagcagtcgttgtgtatgg

SEQ ID NO: 263356 - DNA, 20 bp, human
gcgacgtcacagccacgcag

SEQ ID NO: 263357 - DNA, 20 bp, human
ggcgccccgcctactttggg

SEQ ID NO: 263358 - DNA, 20 bp, human
gcgtcacagccacgcagagg

SEQ ID NO: 263359 - DNA, 20 bp, human
gggtggcagtcggctctggg

SEQ ID NO: 263360 - DNA, 20 bp, human
gtcaggtggcagtcggctct

SEQ ID NO: 263361 - DNA, 20 bp, human
gcagcccagtcacactacac

SEQ ID NO: 263362 - DNA, 20 bp, human
gtcaccacccaaagtaggcg

SEQ ID NO: 263363 - DNA, 20 bp, human
gcctgccttcaggtggcagt

SEQ ID NO: 263364 - DNA, 20 bp, human
ggcccccgcgcttacgtcac

SEQ ID NO: 263365 - DNA, 20 bp, human
gcgaccccgtgtagtgtgac

SEQ ID NO: 263366 - DNA, 20 bp, human
gggcggccccagatccccga

SEQ ID NO: 263367 - DNA, 20 bp, human
gagaacctcggggtaggccc

SEQ ID NO: 263368 - DNA, 20 bp, human
gccccggcacggccggagca

SEQ ID NO: 263369 - DNA, 20 bp, human
ggaacccagggcctaccccg

SEQ ID NO: 263370 - DNA, 20 bp, human
ggatgccctgagagaaagtg

SEQ ID NO: 263371 - DNA, 20 bp, human
gtcctggagaaccccggctt

SEQ ID NO: 263372 - DNA, 20 bp, human
gcgtgccaagccccgctccc

SEQ ID NO: 263373 - DNA, 20 bp, human
ggatccccgagggagcgccc

SEQ ID NO: 263374 - DNA, 20 bp, human
ggagccgaggcacgaaccca

SEQ ID NO: 263375 - DNA, 20 bp, human
gagcggggcttggcacgggc

SEQ ID NO: 263376 - DNA, 20 bp, human
gggtggggtagagagagtgc

SEQ ID NO: 263377 - DNA, 20 bp, human
gcgggtagatagtgcgctgg

SEQ ID NO: 263378 - DNA, 20 bp, human
ggcccgccgctgccagggga

SEQ ID NO: 263379 - DNA, 20 bp, human
ggcctctcagggcttgtcta

SEQ ID NO: 263380 - DNA, 20 bp, human
gcgaaggcttgggagcgagg

SEQ ID NO: 263381 - DNA, 20 bp, human
gcaacgacgactgggcacga

SEQ ID NO: 263382 - DNA, 20 bp, human
gcgactgggcacgaaggctt

SEQ ID NO: 263383 - DNA, 20 bp, human
gcagcccgggcaaccccagg

SEQ ID NO: 263384 - DNA, 20 bp, human
ggaggtgggggagccccgaa

SEQ ID NO: 263385 - DNA, 20 bp, human
gggaggctcgggcacacctg

SEQ ID NO: 263386 - DNA, 20 bp, human
gacggccagggacggagacg

SEQ ID NO: 263387 - DNA, 20 bp, human
ggagcctgcgaggtctgggg

SEQ ID NO: 263388 - DNA, 20 bp, human
ggcgccccgacggccaggga

SEQ ID NO: 263389 - DNA, 20 bp, human
ggaggggaggatttactggg

SEQ ID NO: 263390 - DNA, 20 bp, human
gaggcgaggggaggatttac

SEQ ID NO: 263391 - DNA, 20 bp, human
ggggctggagcgggaccccg

SEQ ID NO: 263392 - DNA, 20 bp, human
ggccagggacggagacgggg

SEQ ID NO: 263393 - DNA, 20 bp, human
gctggagcctgcgaggtctg

SEQ ID NO: 263394 - DNA, 20 bp, human
ggggaggatttactgggcgg

SEQ ID NO: 263395 - DNA, 20 bp, human
gtctccgtccctggccgtcg

SEQ ID NO: 263396 - DNA, 20 bp, human
ggtgcgcgctgcatggggat

SEQ ID NO: 263397 - DNA, 20 bp, human
gctcccgtgcgcgctgcatg

SEQ ID NO: 263398 - DNA, 20 bp, human
gaaagaaaatggggtcgcga

SEQ ID NO: 263399 - DNA, 20 bp, human
gcgctggacagcgcgaagga

SEQ ID NO: 263400 - DNA, 20 bp, human
gggtccctgcagaggacgtg

SEQ ID NO: 263401 - DNA, 20 bp, human
gtgggaaaggggcgctgaga

SEQ ID NO: 263402 - DNA, 20 bp, human
gcacgccagccatggacgga

SEQ ID NO: 263403 - DNA, 20 bp, human
gcgcgcggtctcgggcgagg

SEQ ID NO: 263404 - DNA, 20 bp, human
gtggctccccgcaaagaaaa

SEQ ID NO: 263405 - DNA, 20 bp, human
gcctcgagccgtctgggagg

SEQ ID NO: 263406 - DNA, 20 bp, human
ggacccgtgacaaactaaac

SEQ ID NO: 263407 - DNA, 20 bp, human
ggagagtcggttattggcag

SEQ ID NO: 263408 - DNA, 20 bp, human
ggagcggcgtctgggaaggt

SEQ ID NO: 263409 - DNA, 20 bp, human
ggagggagggactagacagc

SEQ ID NO: 263410 - DNA, 20 bp, human
ggtcggttattggcagagga

SEQ ID NO: 263411 - DNA, 20 bp, human
gttcccgtttagtttgtcac

SEQ ID NO: 263412 - DNA, 20 bp, human
ggaattcagggtgggcggat

SEQ ID NO: 263413 - DNA, 20 bp, human
gtggtccaaatggcgtcatt

SEQ ID NO: 263414 - DNA, 20 bp, human
gcaaatgaggagcgaactaa

SEQ ID NO: 263415 - DNA, 20 bp, human
gtggctgaggtgcgacccct

SEQ ID NO: 263416 - DNA, 20 bp, human
gacagcgccccctatctctg

SEQ ID NO: 263417 - DNA, 20 bp, human
gagctgccttggtggggctc

SEQ ID NO: 263418 - DNA, 20 bp, human
ggaagcgagctgccttggtg

SEQ ID NO: 263419 - DNA, 20 bp, human
gtgggtgcctaatgaacgac

SEQ ID NO: 263420 - DNA, 20 bp, human
gcgcagcgtcgcctgctctt

SEQ ID NO: 263421 - DNA, 20 bp, human
gcggcaccacgcggactcga

SEQ ID NO: 263422 - DNA, 20 bp, human
gccgcgtggtgccgctctct

SEQ ID NO: 263423 - DNA, 20 bp, human
gcgacgctgcgcttctgcac

SEQ ID NO: 263424 - DNA, 20 bp, human
gcagagatcgctgcagttgg

SEQ ID NO: 263425 - DNA, 20 bp, human
gaggagtccggtcgttcatt

SEQ ID NO: 263426 - DNA, 20 bp, human
gcggcccgccctatccgggg

SEQ ID NO: 263427 - DNA, 20 bp, human
ggggaggaccagtgcgttga

SEQ ID NO: 263428 - DNA, 20 bp, human
ggacgagcgtcacgtgactg

SEQ ID NO: 263429 - DNA, 20 bp, human
ggcgcggcccgccctatccg

SEQ ID NO: 263430 - DNA, 20 bp, human
ggtgtcagcggcagccgccg

SEQ ID NO: 263431 - DNA, 20 bp, human
gacccccccccccccggata

SEQ ID NO: 263432 - DNA, 20 bp, human
gtaccccgggttccgagtcc

SEQ ID NO: 263433 - DNA, 20 bp, human
ggctgacactgcgcctacac

SEQ ID NO: 263434 - DNA, 20 bp, human
gtagccgccctgcctactgt

SEQ ID NO: 263435 - DNA, 20 bp, human
gttaggccgcgtcacgtgac

SEQ ID NO: 263436 - DNA, 20 bp, human
gtgactaggcacccacctaa

SEQ ID NO: 263437 - DNA, 20 bp, human
gcctccttcaagtcacagga

SEQ ID NO: 263438 - DNA, 20 bp, human
gcacccacctaagggtggag

SEQ ID NO: 263439 - DNA, 20 bp, human
gggccactccacccttaggt

SEQ ID NO: 263440 - DNA, 20 bp, human
gaaaaagggcaggcgggcct

SEQ ID NO: 263441 - DNA, 20 bp, human
gaaagccgggggaagaaaaa

SEQ ID NO: 263442 - DNA, 20 bp, human
gaaacaggctgtacctgtga

SEQ ID NO: 263443 - DNA, 20 bp, human
gactccctcctgtgacttga

SEQ ID NO: 263444 - DNA, 20 bp, human
ggaggagatttgatagccca

SEQ ID NO: 263445 - DNA, 20 bp, human
gaggctgtacctgtgagggt

SEQ ID NO: 263446 - DNA, 20 bp, human
gcggctccgcgcctcagtga

SEQ ID NO: 263447 - DNA, 20 bp, human
gtggagcggaggaagttcgt

SEQ ID NO: 263448 - DNA, 20 bp, human
gcctcagtgagggcggggta

SEQ ID NO: 263449 - DNA, 20 bp, human
ggcgcaatctgcatgaacga

SEQ ID NO: 263450 - DNA, 20 bp, human
gcagatgcgcgattcggcgg

SEQ ID NO: 263451 - DNA, 20 bp, human
gggctcggcgcctccggatc

SEQ ID NO: 263452 - DNA, 20 bp, human
gcaagcaggcgcccacccag

SEQ ID NO: 263453 - DNA, 20 bp, human
ggccagaactcgattctcat

SEQ ID NO: 263454 - DNA, 20 bp, human
gcgcggctccggatgcggct

SEQ ID NO: 263455 - DNA, 20 bp, human
gagcggaggaagttcgtggg

SEQ ID NO: 263456 - DNA, 20 bp, human
gcggggcctagcctcagaga

SEQ ID NO: 263457 - DNA, 20 bp, human
ggcggggcacggagcttgaa

SEQ ID NO: 263458 - DNA, 20 bp, human
gctcgcgggaacttgggaac

SEQ ID NO: 263459 - DNA, 20 bp, human
ggggctcgcttgtgggttta

SEQ ID NO: 263460 - DNA, 20 bp, human
ggggaccgggctctctaccc

SEQ ID NO: 263461 - DNA, 20 bp, human
gaggcgcgcgtcaagaaaag

SEQ ID NO: 263462 - DNA, 20 bp, human
gcacggagcttgaaggggcg

SEQ ID NO: 263463 - DNA, 20 bp, human
gtgggccagtagccgagccg

SEQ ID NO: 263464 - DNA, 20 bp, human
gcagtcccgggtagagagcc

SEQ ID NO: 263465 - DNA, 20 bp, human
gaagttcccgcgagaacggg

SEQ ID NO: 263466 - DNA, 20 bp, human
ggcggggcgcggcggagaac

SEQ ID NO: 263467 - DNA, 20 bp, human
gggtccctgcagatatccgg

SEQ ID NO: 263468 - DNA, 20 bp, human
gccgcccccggatatctgca

SEQ ID NO: 263469 - DNA, 20 bp, human
ggcgcggcggagaactggct

SEQ ID NO: 263470 - DNA, 20 bp, human
ggggaggggactgttgaact

SEQ ID NO: 263471 - DNA, 20 bp, human
ggggccgcagcctgcgccct

SEQ ID NO: 263472 - DNA, 20 bp, human
gcgcgccggtcagtctggga

SEQ ID NO: 263473 - DNA, 20 bp, human
ggtgcccagggcgcaggctg

SEQ ID NO: 263474 - DNA, 20 bp, human
gccgccccgggctcccatca

SEQ ID NO: 263475 - DNA, 20 bp, human
gtggggtcttggctcgagag

SEQ ID NO: 263476 - DNA, 20 bp, human
gtgaccggttcccaagcggg

SEQ ID NO: 263477 - DNA, 20 bp, human
ggggcaggtgtcccagtgac

SEQ ID NO: 263478 - DNA, 20 bp, human
gcaagcgggaggagggcggt

SEQ ID NO: 263479 - DNA, 20 bp, human
gcggttcccaagcgggagga

SEQ ID NO: 263480 - DNA, 20 bp, human
gcccccccctggcggccgaa

SEQ ID NO: 263481 - DNA, 20 bp, human
gggcccacgcccccccctgg

SEQ ID NO: 263482 - DNA, 20 bp, human
gcgcggacaccagcatgcag

SEQ ID NO: 263483 - DNA, 20 bp, human
gcgcttgggaaccggtcact

SEQ ID NO: 263484 - DNA, 20 bp, human
gtggaagggcaggcggcgaa

SEQ ID NO: 263485 - DNA, 20 bp, human
gaagggcaggcggcgaaggg

SEQ ID NO: 263486 - DNA, 20 bp, human
gagcctgtgtgtaggatcta

SEQ ID NO: 263487 - DNA, 20 bp, human
gctccctagatcctacacac

SEQ ID NO: 263488 - DNA, 20 bp, human
ggtgtaggatctagggagtc

SEQ ID NO: 263489 - DNA, 20 bp, human
gagagggagtcacgtgacac

SEQ ID NO: 263490 - DNA, 20 bp, human
ggtcaaagaagcctgtgtgt

SEQ ID NO: 263491 - DNA, 20 bp, human
gcctcagtgctggcaagtag

SEQ ID NO: 263492 - DNA, 20 bp, human
gatgaaagccaccaggtgac

SEQ ID NO: 263493 - DNA, 20 bp, human
gtctgatggggtagcatgga

SEQ ID NO: 263494 - DNA, 20 bp, human
gcttagagctgtgtggaatc

SEQ ID NO: 263495 - DNA, 20 bp, human
ggactcaggtttaaaactgc

SEQ ID NO: 263496 - DNA, 20 bp, human
gccaggcgccatcccggggc

SEQ ID NO: 263497 - DNA, 20 bp, human
gccgctgcccggaatgctgt

SEQ ID NO: 263498 - DNA, 20 bp, human
ggttcctctcccaccaattg

SEQ ID NO: 263499 - DNA, 20 bp, human
ggctgctcgcaccctaattc

SEQ ID NO: 263500 - DNA, 20 bp, human
ggcagccaggcgccatcccg

SEQ ID NO: 263501 - DNA, 20 bp, human
gattcaggaccccaattggt

SEQ ID NO: 263502 - DNA, 20 bp, human
gcggacgtgacgtgcgtggg

SEQ ID NO: 263503 - DNA, 20 bp, human
gccatcccggggcgggttgt

SEQ ID NO: 263504 - DNA, 20 bp, human
gcccacccccacagcattcc

SEQ ID NO: 263505 - DNA, 20 bp, human
gtggggtcctcggtatgggg

SEQ ID NO: 263506 - DNA, 20 bp, human
gtctgtccccgcagcctcgc

SEQ ID NO: 263507 - DNA, 20 bp, human
ggggaccccgggatccagcg

SEQ ID NO: 263508 - DNA, 20 bp, human
gtgctcctcgctggatcccg

SEQ ID NO: 263509 - DNA, 20 bp, human
gctgcggggacagagctggg

SEQ ID NO: 263510 - DNA, 20 bp, human
gagcaggggcccagcggcac

SEQ ID NO: 263511 - DNA, 20 bp, human
gaataaaggcagccttgtta

SEQ ID NO: 263512 - DNA, 20 bp, human
gttgtgccagccaccccccg

SEQ ID NO: 263513 - DNA, 20 bp, human
gggacaccgtgcaaggggtg

SEQ ID NO: 263514 - DNA, 20 bp, human
gttctcattgccagcctcgg

SEQ ID NO: 263515 - DNA, 20 bp, human
gtctgcgagcctccatccct

SEQ ID NO: 263516 - DNA, 20 bp, human
gtgagccggtagggcaggac

SEQ ID NO: 263517 - DNA, 20 bp, human
ggggctgtgcatactggtgc

SEQ ID NO: 263518 - DNA, 20 bp, human
gggaaggcgcgctttcccgg

SEQ ID NO: 263519 - DNA, 20 bp, human
gccggccccgcgccgacctc

SEQ ID NO: 263520 - DNA, 20 bp, human
gcgcagccgggattagctgg

SEQ ID NO: 263521 - DNA, 20 bp, human
gcctaccggctcacacaagc

SEQ ID NO: 263522 - DNA, 20 bp, human
ggcgggcggggcggaggatc

SEQ ID NO: 263523 - DNA, 20 bp, human
gctttcccggaggtcggcgc

SEQ ID NO: 263524 - DNA, 20 bp, human
gggtggggagtggacgaatg

SEQ ID NO: 263525 - DNA, 20 bp, human
ggggcaggacgggcgtggaa

SEQ ID NO: 263526 - DNA, 20 bp, human
gtcaggttccggtcaggcgt

SEQ ID NO: 263527 - DNA, 20 bp, human
gggccgccgaagcctggatc

SEQ ID NO: 263528 - DNA, 20 bp, human
gaaggtttcggggactgagt

SEQ ID NO: 263529 - DNA, 20 bp, human
ggcagtcggagaggcggcta

SEQ ID NO: 263530 - DNA, 20 bp, human
gtgccacagcagagacgcga

SEQ ID NO: 263531 - DNA, 20 bp, human
gcggaagtgacgaaggcccc

SEQ ID NO: 263532 - DNA, 20 bp, human
gtcagctctcgcagtcggag

SEQ ID NO: 263533 - DNA, 20 bp, human
gagcctgatccaggcttcgg

SEQ ID NO: 263534 - DNA, 20 bp, human
gcggagaggcggctaaggaa

SEQ ID NO: 263535 - DNA, 20 bp, human
gtccgcccccgcggcaaagc

SEQ ID NO: 263536 - DNA, 20 bp, human
gagcccggggtccggatccg

SEQ ID NO: 263537 - DNA, 20 bp, human
gtccccgggaggacccagta

SEQ ID NO: 263538 - DNA, 20 bp, human
gtcggactcagcgggtctca

SEQ ID NO: 263539 - DNA, 20 bp, human
gtcgccccggcggttctccc

SEQ ID NO: 263540 - DNA, 20 bp, human
gagcccagggagaaccgccg

SEQ ID NO: 263541 - DNA, 20 bp, human
ggcccagcgcggacttccga

SEQ ID NO: 263542 - DNA, 20 bp, human
ggcaacgcctgcctcggatc

SEQ ID NO: 263543 - DNA, 20 bp, human
ggaccctcggaagtccgcgc

SEQ ID NO: 263544 - DNA, 20 bp, human
gaaaccggccactcccccca

SEQ ID NO: 263545 - DNA, 20 bp, human
ggacccgctgagtccgaggc

SEQ ID NO: 263546 - DNA, 20 bp, human
ggggacccgcctgacgtcgg

SEQ ID NO: 263547 - DNA, 20 bp, human
gacgtcaggcgggtccccaa

SEQ ID NO: 263548 - DNA, 20 bp, human
ggggagacgcggtggagatg

SEQ ID NO: 263549 - DNA, 20 bp, human
gacgcggtggagatgcgggt

SEQ ID NO: 263550 - DNA, 20 bp, human
gggcgggggcggagttgagg

SEQ ID NO: 263551 - DNA, 20 bp, human
gggcgagagcgaggtgaggc

SEQ ID NO: 263552 - DNA, 20 bp, human
ggactgacgaagatccgcat

SEQ ID NO: 263553 - DNA, 20 bp, human
gtggacccacggccgacctg

SEQ ID NO: 263554 - DNA, 20 bp, human
gcgggagcgcggcccctccg

SEQ ID NO: 263555 - DNA, 20 bp, human
ggcggggggaggagaacagg

SEQ ID NO: 263556 - DNA, 20 bp, human
ggactccagaaaagcaacag

SEQ ID NO: 263557 - DNA, 20 bp, human
gtggaccgagccccgacccc

SEQ ID NO: 263558 - DNA, 20 bp, human
gaccctcccaggatcttaac

SEQ ID NO: 263559 - DNA, 20 bp, human
gtctcctgactcccaagcag

SEQ ID NO: 263560 - DNA, 20 bp, human
gtggggaagaggattggggc

SEQ ID NO: 263561 - DNA, 20 bp, human
gcaagcaggggcagacagcc

SEQ ID NO: 263562 - DNA, 20 bp, human
gcagaaaagcaacaggggct

SEQ ID NO: 263563 - DNA, 20 bp, human
gtctccagaggggatattac

SEQ ID NO: 263564 - DNA, 20 bp, human
gctgcccctgcttgggagtc

SEQ ID NO: 263565 - DNA, 20 bp, human
ggcagcgagtccatggggaa

SEQ ID NO: 263566 - DNA, 20 bp, human
ggcgttagggcatactgcgg

SEQ ID NO: 263567 - DNA, 20 bp, human
gccagcgaagcggaaccaaa

SEQ ID NO: 263568 - DNA, 20 bp, human
gttagggcatactgcggcgg

SEQ ID NO: 263569 - DNA, 20 bp, human
ggcgcaaaggctggcgttcg

SEQ ID NO: 263570 - DNA, 20 bp, human
gagcttccgaaacctttcgg

SEQ ID NO: 263571 - DNA, 20 bp, human
gtgcgtgccgcggctccgtt

SEQ ID NO: 263572 - DNA, 20 bp, human
gcctttgcgcctgcgtgccg

SEQ ID NO: 263573 - DNA, 20 bp, human
gggcgaagcgctcctccgaa

SEQ ID NO: 263574 - DNA, 20 bp, human
gcaccacctgcacggcgaag

SEQ ID NO: 263575 - DNA, 20 bp, human
gaaaccacaggcctcggcgg

SEQ ID NO: 263576 - DNA, 20 bp, human
ggccgaagccaggctcatcc

SEQ ID NO: 263577 - DNA, 20 bp, human
gccagcaccagatctctctt

SEQ ID NO: 263578 - DNA, 20 bp, human
gccaccccgccttaagggga

SEQ ID NO: 263579 - DNA, 20 bp, human
ggggccctccccttaaggcg

SEQ ID NO: 263580 - DNA, 20 bp, human
ggctgccccaggaccacgga

SEQ ID NO: 263581 - DNA, 20 bp, human
gcggcccaccccgccttaag

SEQ ID NO: 263582 - DNA, 20 bp, human
gcaccccgcggccaccggag

SEQ ID NO: 263583 - DNA, 20 bp, human
gaaggagcgagtgactctcc

SEQ ID NO: 263584 - DNA, 20 bp, human
gaccacggacggaaaatcgc

SEQ ID NO: 263585 - DNA, 20 bp, human
ggggctgcctggctggtgtc

SEQ ID NO: 263586 - DNA, 20 bp, human
gttagtataatggaattgaa

SEQ ID NO: 263587 - DNA, 20 bp, human
gaatggaattgaagggtaac

SEQ ID NO: 263588 - DNA, 20 bp, human
gcaagggtattttagtataa

SEQ ID NO: 263589 - DNA, 20 bp, human
gcatgtatctctatttccca

SEQ ID NO: 263590 - DNA, 20 bp, human
gaaaacatcctcacacattg

SEQ ID NO: 263591 - DNA, 20 bp, human
gaatcagcaacttaaacttc

SEQ ID NO: 263592 - DNA, 20 bp, human
gaatcaaaaactgtaaaagg

SEQ ID NO: 263593 - DNA, 20 bp, human
gacttataagatccattcta

SEQ ID NO: 263594 - DNA, 20 bp, human
gaagatgcacttttcaggcc

SEQ ID NO: 263595 - DNA, 20 bp, human
gactttttaaatagataatt

SEQ ID NO: 263596 - DNA, 20 bp, human
ggtaaactattaaaatagtt

SEQ ID NO: 263597 - DNA, 20 bp, human
gtattaaaatatgaaataat

SEQ ID NO: 263598 - DNA, 20 bp, human
gcagagcagaccctcaggtg

SEQ ID NO: 263599 - DNA, 20 bp, human
gtttgttcaatggcaactct

SEQ ID NO: 263600 - DNA, 20 bp, human
ggcatcgctcccccacctga

SEQ ID NO: 263601 - DNA, 20 bp, human
ggggacgcgggcctggtctg

SEQ ID NO: 263602 - DNA, 20 bp, human
ggtggcccctgcgctcttgg

SEQ ID NO: 263603 - DNA, 20 bp, human
gagcgcaggggccaccgggg

SEQ ID NO: 263604 - DNA, 20 bp, human
ggccaccggggaggcaattt

SEQ ID NO: 263605 - DNA, 20 bp, human
gacctcctccaagagcgcag

SEQ ID NO: 263606 - DNA, 20 bp, human
ggccgaagccaggctcatcc

SEQ ID NO: 263607 - DNA, 20 bp, human
gcaccccgcggccaccggag

SEQ ID NO: 263608 - DNA, 20 bp, human
gccagcaccagatctctctt

SEQ ID NO: 263609 - DNA, 20 bp, human
ggggccctccccttaaggcg

SEQ ID NO: 263610 - DNA, 20 bp, human
gaaggagcgagtgactctcc

SEQ ID NO: 263611 - DNA, 20 bp, human
ggggctgcctggctggtgtc

SEQ ID NO: 263612 - DNA, 20 bp, human
ggggacgcgggcctggtctg

SEQ ID NO: 263613 - DNA, 20 bp, human
gctggcacgagcagcggtgg

SEQ ID NO: 263614 - DNA, 20 bp, human
gaccagccaggcagccccca

SEQ ID NO: 263615 - DNA, 20 bp, human
gccaccccgccttaagggga

SEQ ID NO: 263616 - DNA, 20 bp, human
ggcccaggacaggggttccc

SEQ ID NO: 263617 - DNA, 20 bp, human
gatccatggtgccccctctt

SEQ ID NO: 263618 - DNA, 20 bp, human
gggcctgccagtgaggtgct

SEQ ID NO: 263619 - DNA, 20 bp, human
gggccctggcgacatcacag

SEQ ID NO: 263620 - DNA, 20 bp, human
ggccaggaggggcacgcctc

SEQ ID NO: 263621 - DNA, 20 bp, human
gagcttcccgacctcacaag

SEQ ID NO: 263622 - DNA, 20 bp, human
gaagagccgcttgtgaggtc

SEQ ID NO: 263623 - DNA, 20 bp, human
gagcctctgtgatgtcgcca

SEQ ID NO: 263624 - DNA, 20 bp, human
gcaaatgccacccaaggtga

SEQ ID NO: 263625 - DNA, 20 bp, human
gtctcaagagcgcaggtctg

SEQ ID NO: 263626 - DNA, 20 bp, human
gcgacccgagagaaggagcg

SEQ ID NO: 263627 - DNA, 20 bp, human
gcgaaagtccgagagctctg

SEQ ID NO: 263628 - DNA, 20 bp, human
gtcagagacgtgcgggtgaa

SEQ ID NO: 263629 - DNA, 20 bp, human
ggtgggtgcgacccgagaga

SEQ ID NO: 263630 - DNA, 20 bp, human
gccctggcgcgcgggcgtgt

SEQ ID NO: 263631 - DNA, 20 bp, human
gacgcccgcgcgccaggggg

SEQ ID NO: 263632 - DNA, 20 bp, human
ggagtgccgcttcccgtctg

SEQ ID NO: 263633 - DNA, 20 bp, human
gtttcggaagctctcggtgt

SEQ ID NO: 263634 - DNA, 20 bp, human
gtgaaaggtcgagcgacagc

SEQ ID NO: 263635 - DNA, 20 bp, human
gttcctccggcaccgcccaa

SEQ ID NO: 263636 - DNA, 20 bp, human
gaggcccagcccaggcgatt

SEQ ID NO: 263637 - DNA, 20 bp, human
gcatcctggcgcagtggcgc

SEQ ID NO: 263638 - DNA, 20 bp, human
ggctccgggccgaatcgcct

SEQ ID NO: 263639 - DNA, 20 bp, human
gtcagcagtcggagccccgg

SEQ ID NO: 263640 - DNA, 20 bp, human
ggggaggcggcgtcagcagt

SEQ ID NO: 263641 - DNA, 20 bp, human
gcggcccggagctccgcggg

SEQ ID NO: 263642 - DNA, 20 bp, human
gcgccaggatggagcgagct

SEQ ID NO: 263643 - DNA, 20 bp, human
gcgcggactgaagatgactg

SEQ ID NO: 263644 - DNA, 20 bp, human
ggctcgaattggctagagga

SEQ ID NO: 263645 - DNA, 20 bp, human
gcgtggacagggggacagaa

SEQ ID NO: 263646 - DNA, 20 bp, human
gctgcccggcgtcccggctg

SEQ ID NO: 263647 - DNA, 20 bp, human
gacgccgggcagcgcctagc

SEQ ID NO: 263648 - DNA, 20 bp, human
gtaggcgctgcccggcgtcc

SEQ ID NO: 263649 - DNA, 20 bp, human
ggggcagcgcctagcgggcc

SEQ ID NO: 263650 - DNA, 20 bp, human
gccagagcgccccgcgactc

SEQ ID NO: 263651 - DNA, 20 bp, human
gtgaggggcccgacactatg

SEQ ID NO: 263652 - DNA, 20 bp, human
gccgtccaggctctacctcg

SEQ ID NO: 263653 - DNA, 20 bp, human
ggctgagagcgacggagcgc

SEQ ID NO: 263654 - DNA, 20 bp, human
gccgctcaggccggagtcgc

SEQ ID NO: 263655 - DNA, 20 bp, human
gcctgagcggggcatcgcgc

SEQ ID NO: 263656 - DNA, 20 bp, human
gatgtgaagggcggggtcga

SEQ ID NO: 263657 - DNA, 20 bp, human
gcccgctggggaccgcaaag

SEQ ID NO: 263658 - DNA, 20 bp, human
gggaaccagagatgcgaaga

SEQ ID NO: 263659 - DNA, 20 bp, human
gccccggaaaagcttagtcg

SEQ ID NO: 263660 - DNA, 20 bp, human
gcggggtcgagggccgtccc

SEQ ID NO: 263661 - DNA, 20 bp, human
gggccgtcccgggaggtgat

SEQ ID NO: 263662 - DNA, 20 bp, human
gattggctccaagatgtgaa

SEQ ID NO: 263663 - DNA, 20 bp, human
gtgactatgtagaaacgaag

SEQ ID NO: 263664 - DNA, 20 bp, human
ggaccccgcccttcacatct

SEQ ID NO: 263665 - DNA, 20 bp, human
gctccaagatgtgaagggcg

SEQ ID NO: 263666 - DNA, 20 bp, human
ggaccgccggagccggaaga

SEQ ID NO: 263667 - DNA, 20 bp, human
gaggatgtgctcacgtcaca

SEQ ID NO: 263668 - DNA, 20 bp, human
gcagtccacccgagcggcgt

SEQ ID NO: 263669 - DNA, 20 bp, human
gccggagccggaagacggag

SEQ ID NO: 263670 - DNA, 20 bp, human
gccgctcgggtggactgcga

SEQ ID NO: 263671 - DNA, 20 bp, human
gccgcggcgcacctccggaa

SEQ ID NO: 263672 - DNA, 20 bp, human
gggtggactgcgaggggaga

SEQ ID NO: 263673 - DNA, 20 bp, human
gggaagacggagcggttggg

SEQ ID NO: 263674 - DNA, 20 bp, human
gctcgcgacccacgccgctc

SEQ ID NO: 263675 - DNA, 20 bp, human
ggtccgcggcagccaatcaa

SEQ ID NO: 263676 - DNA, 20 bp, human
gtgcggctactggacacaaa

SEQ ID NO: 263677 - DNA, 20 bp, human
gctactggacacaaatggcc

SEQ ID NO: 263678 - DNA, 20 bp, human
gagggtctcatgtttagaga

SEQ ID NO: 263679 - DNA, 20 bp, human
gctgcagcttgtgcggctac

SEQ ID NO: 263680 - DNA, 20 bp, human
gccaacgggtcagtgagtag

SEQ ID NO: 263681 - DNA, 20 bp, human
gaaaggactactgtattctt

SEQ ID NO: 263682 - DNA, 20 bp, human
gcttatcagggcactagcag

SEQ ID NO: 263683 - DNA, 20 bp, human
gaaaagcgaatggccttggt

SEQ ID NO: 263684 - DNA, 20 bp, human
gggtgcgttggatttgtgcg

SEQ ID NO: 263685 - DNA, 20 bp, human
gcggagagggctaccgccca

SEQ ID NO: 263686 - DNA, 20 bp, human
ggaccgccggagccggaaga

SEQ ID NO: 263687 - DNA, 20 bp, human
gaggatgtgctcacgtcaca

SEQ ID NO: 263688 - DNA, 20 bp, human
gcagtccacccgagcggcgt

SEQ ID NO: 263689 - DNA, 20 bp, human
gccggagccggaagacggag

SEQ ID NO: 263690 - DNA, 20 bp, human
gccgctcgggtggactgcga

SEQ ID NO: 263691 - DNA, 20 bp, human
gccgcggcgcacctccggaa

SEQ ID NO: 263692 - DNA, 20 bp, human
gggtggactgcgaggggaga

SEQ ID NO: 263693 - DNA, 20 bp, human
gggaagacggagcggttggg

SEQ ID NO: 263694 - DNA, 20 bp, human
gctcgcgacccacgccgctc

SEQ ID NO: 263695 - DNA, 20 bp, human
ggtccgcggcagccaatcaa

SEQ ID NO: 263696 - DNA, 20 bp, human
gtagacttcctcacaagaga

SEQ ID NO: 263697 - DNA, 20 bp, human
gctgaccagcatttatgtta

SEQ ID NO: 263698 - DNA, 20 bp, human
gtgtcaaagaaatgtattgt

SEQ ID NO: 263699 - DNA, 20 bp, human
gtcacaagagatggctttgt

SEQ ID NO: 263700 - DNA, 20 bp, human
gatagcatcacataacaaat

SEQ ID NO: 263701 - DNA, 20 bp, human
gtctcccttaacataaatgc

SEQ ID NO: 263702 - DNA, 20 bp, human
gtaaaagttgctggactctt

SEQ ID NO: 263703 - DNA, 20 bp, human
gaacactttgacttctttca

SEQ ID NO: 263704 - DNA, 20 bp, human
gggctgcctcgggacttcat

SEQ ID NO: 263705 - DNA, 20 bp, human
ggatgctatactagtcaggc

SEQ ID NO: 263706 - DNA, 20 bp, human
gtccaaggagccaggaatgg

SEQ ID NO: 263707 - DNA, 20 bp, human
gactcaaggtcacacatcta

SEQ ID NO: 263708 - DNA, 20 bp, human
gtatggcaggcatgagacgg

SEQ ID NO: 263709 - DNA, 20 bp, human
gtcacacatctagggagtgg

SEQ ID NO: 263710 - DNA, 20 bp, human
gaggccagtgcagtccaacc

SEQ ID NO: 263711 - DNA, 20 bp, human
gtcaggaacagcttctccca

SEQ ID NO: 263712 - DNA, 20 bp, human
gaggaataaaatattgtcca

SEQ ID NO: 263713 - DNA, 20 bp, human
gcaccatagcccaggtggtc

SEQ ID NO: 263714 - DNA, 20 bp, human
gcagttgcagatgaggtaac

SEQ ID NO: 263715 - DNA, 20 bp, human
gaaaatcaccatagcccagg

SEQ ID NO: 263716 - DNA, 20 bp, human
ggaaccatggcgccaccaga

SEQ ID NO: 263717 - DNA, 20 bp, human
gcttgctcacagtttctcgg

SEQ ID NO: 263718 - DNA, 20 bp, human
ggggaagggtatggatatac

SEQ ID NO: 263719 - DNA, 20 bp, human
gtatttcaggacagccagga

SEQ ID NO: 263720 - DNA, 20 bp, human
gccatcaccatttatgggaa

SEQ ID NO: 263721 - DNA, 20 bp, human
ggcgggaagttggttggggc

SEQ ID NO: 263722 - DNA, 20 bp, human
ggatatactggcctttattt

SEQ ID NO: 263723 - DNA, 20 bp, human
ggcgccctctggtggcgcca

SEQ ID NO: 263724 - DNA, 20 bp, human
gaccatttatgggaagggta

SEQ ID NO: 263725 - DNA, 20 bp, human
gcaattgaagttgtagtctc

SEQ ID NO: 263726 - DNA, 20 bp, human
ggtcttatcatcatcccaga

SEQ ID NO: 263727 - DNA, 20 bp, human
gacttcgcctccctggatgc

SEQ ID NO: 263728 - DNA, 20 bp, human
gaccaaggatctcgaaccat

SEQ ID NO: 263729 - DNA, 20 bp, human
ggtgagaaacacacagaata

SEQ ID NO: 263730 - DNA, 20 bp, human
gtagacttcacattgtccca

SEQ ID NO: 263731 - DNA, 20 bp, human
gaaggctcgagaagcaactg

SEQ ID NO: 263732 - DNA, 20 bp, human
gctgaggatgctcgaatcac

SEQ ID NO: 263733 - DNA, 20 bp, human
gtcttgctgtgttttacgaa

SEQ ID NO: 263734 - DNA, 20 bp, human
ggagctccctccaaccttct

SEQ ID NO: 263735 - DNA, 20 bp, human
gtgaagtctagacctagtgg

SEQ ID NO: 263736 - DNA, 20 bp, human
gggcccctgggtttttgcgg

SEQ ID NO: 263737 - DNA, 20 bp, human
ggggagtctcggggcattcg

SEQ ID NO: 263738 - DNA, 20 bp, human
ggggacaaggagccgaatat

SEQ ID NO: 263739 - DNA, 20 bp, human
gagccggcgccgggagtctc

SEQ ID NO: 263740 - DNA, 20 bp, human
gcccccggttaaaatctcgt

SEQ ID NO: 263741 - DNA, 20 bp, human
gccacacggcggggtcagtg

SEQ ID NO: 263742 - DNA, 20 bp, human
ggtggcggggcgggaattcg

SEQ ID NO: 263743 - DNA, 20 bp, human
gccagccggcgaccacacgg

SEQ ID NO: 263744 - DNA, 20 bp, human
gccaacctccgcaaaaaccc

SEQ ID NO: 263745 - DNA, 20 bp, human
ggtctcggggcattcggggc

SEQ ID NO: 263746 - DNA, 20 bp, human
gcaggctgctgatgaagtga

SEQ ID NO: 263747 - DNA, 20 bp, human
ggacagggcaggtggattct

SEQ ID NO: 263748 - DNA, 20 bp, human
gggagagtcggcgccgagat

SEQ ID NO: 263749 - DNA, 20 bp, human
gctgcccggccattgactca

SEQ ID NO: 263750 - DNA, 20 bp, human
gcatcgagtggggacagcta

SEQ ID NO: 263751 - DNA, 20 bp, human
gtgggcaaacagactgggtc

SEQ ID NO: 263752 - DNA, 20 bp, human
gacaccatgtggacaagggg

SEQ ID NO: 263753 - DNA, 20 bp, human
ggattctgggcaaacagact

SEQ ID NO: 263754 - DNA, 20 bp, human
ggccgagatgggcggataaa

SEQ ID NO: 263755 - DNA, 20 bp, human
gcggccattgactcaaggag

SEQ ID NO: 263756 - DNA, 20 bp, human
gtggcggcggcgtgtcccag

SEQ ID NO: 263757 - DNA, 20 bp, human
gtgtcccagcggcagaggcg

SEQ ID NO: 263758 - DNA, 20 bp, human
ggcggcactgcctaagtccc

SEQ ID NO: 263759 - DNA, 20 bp, human
gcggcgtgtcccagcggcag

SEQ ID NO: 263760 - DNA, 20 bp, human
gtggggcccaacctgcctgg

SEQ ID NO: 263761 - DNA, 20 bp, human
gaagtccccggcgcacctgg

SEQ ID NO: 263762 - DNA, 20 bp, human
ggccccccccgcgctcacta

SEQ ID NO: 263763 - DNA, 20 bp, human
ggaaaccggcgcgggccgtg

SEQ ID NO: 263764 - DNA, 20 bp, human
gtgaacgattgtgctgtgta

SEQ ID NO: 263765 - DNA, 20 bp, human
gcctaagtccccggcgcacc

SEQ ID NO: 263766 - DNA, 20 bp, human
gacacgccggagtccttctg

SEQ ID NO: 263767 - DNA, 20 bp, human
ggtcgccgacggctatccga

SEQ ID NO: 263768 - DNA, 20 bp, human
ggaaacaagcgtccttgctc

SEQ ID NO: 263769 - DNA, 20 bp, human
gccgcccctcagaaggactc

SEQ ID NO: 263770 - DNA, 20 bp, human
ggggcggggtttacgtacga

SEQ ID NO: 263771 - DNA, 20 bp, human
gtggcaacggctaaacgcaa

SEQ ID NO: 263772 - DNA, 20 bp, human
gaaggactccggcgtgtcat

SEQ ID NO: 263773 - DNA, 20 bp, human
gagaggcggtgctcctccct

SEQ ID NO: 263774 - DNA, 20 bp, human
gtcctccctcggatagccgt

SEQ ID NO: 263775 - DNA, 20 bp, human
gtccttgctcgggtttggtc

SEQ ID NO: 263776 - DNA, 20 bp, human
gccaggcgccctgagaaagc

SEQ ID NO: 263777 - DNA, 20 bp, human
gccctgagaaagccgggaga

SEQ ID NO: 263778 - DNA, 20 bp, human
gtgaggcctcggcctcgcgc

SEQ ID NO: 263779 - DNA, 20 bp, human
gggggggcgcgctgaggcct

SEQ ID NO: 263780 - DNA, 20 bp, human
gccaggcctgccctgcggcg

SEQ ID NO: 263781 - DNA, 20 bp, human
ggggggaaggaacccgagcc

SEQ ID NO: 263782 - DNA, 20 bp, human
ggcggggccgctaggcgccg

SEQ ID NO: 263783 - DNA, 20 bp, human
ggcctagcggccccgccgca

SEQ ID NO: 263784 - DNA, 20 bp, human
gccgcccccgcggcgcctag

SEQ ID NO: 263785 - DNA, 20 bp, human
ggtaacaggctgactttgta

SEQ ID NO: 263786 - DNA, 20 bp, human
ggcgtggcgctggctaaccc

SEQ ID NO: 263787 - DNA, 20 bp, human
gaactctcagggcccaccgc

SEQ ID NO: 263788 - DNA, 20 bp, human
gtcgggctgggaaccgccag

SEQ ID NO: 263789 - DNA, 20 bp, human
gtgggccctgagagttggct

SEQ ID NO: 263790 - DNA, 20 bp, human
ggctgggaaccgccagcggt

SEQ ID NO: 263791 - DNA, 20 bp, human
gcggccccggcgcgacgagg

SEQ ID NO: 263792 - DNA, 20 bp, human
ggggggcgcccagtcgggct

SEQ ID NO: 263793 - DNA, 20 bp, human
ggcgctggctaaccccggct

SEQ ID NO: 263794 - DNA, 20 bp, human
gttagccagcgccacgcagc

SEQ ID NO: 263795 - DNA, 20 bp, human
gcgcccccctcgtcgcgccg

SEQ ID NO: 263796 - DNA, 20 bp, human
gttcaggcggttagacgcaa

SEQ ID NO: 263797 - DNA, 20 bp, human
ggcggcccctggcaacccgg

SEQ ID NO: 263798 - DNA, 20 bp, human
gttacggcgcccatagcaac

SEQ ID NO: 263799 - DNA, 20 bp, human
gacccgggggcgcctagcta

SEQ ID NO: 263800 - DNA, 20 bp, human
gctagggagccggttgctat

SEQ ID NO: 263801 - DNA, 20 bp, human
ggacgctacaggagccgcca

SEQ ID NO: 263802 - DNA, 20 bp, human
ggctatgggcgccgtaactg

SEQ ID NO: 263803 - DNA, 20 bp, human
gcccccgcgggagacatgtt

SEQ ID NO: 263804 - DNA, 20 bp, human
gttgcgtgacttttggtccc

SEQ ID NO: 263805 - DNA, 20 bp, human
gcgcctgcgctggcccggga

SEQ ID NO: 263806 - DNA, 20 bp, human
gtgcacgcacagccccgcat

SEQ ID NO: 263807 - DNA, 20 bp, human
gtctgaggacgccgcggaag

SEQ ID NO: 263808 - DNA, 20 bp, human
gcccacctacgtagtgcgtc

SEQ ID NO: 263809 - DNA, 20 bp, human
gcgcggaagcgggacgggat

SEQ ID NO: 263810 - DNA, 20 bp, human
gctcgggcgggatggatcgg

SEQ ID NO: 263811 - DNA, 20 bp, human
gacggcgcaggtctgcacca

SEQ ID NO: 263812 - DNA, 20 bp, human
gtccgcggcgtcctcagaac

SEQ ID NO: 263813 - DNA, 20 bp, human
gtgctccggacgcactacgt

SEQ ID NO: 263814 - DNA, 20 bp, human
gctgacaagccgggccgcca

SEQ ID NO: 263815 - DNA, 20 bp, human
gcgaaccttgcctcctcggg

SEQ ID NO: 263816 - DNA, 20 bp, human
gctccacaggaccatctccg

SEQ ID NO: 263817 - DNA, 20 bp, human
ggccacgcgctggagacccg

SEQ ID NO: 263818 - DNA, 20 bp, human
gggcactaggctggcgccgc

SEQ ID NO: 263819 - DNA, 20 bp, human
gccacggcgccacactccac

SEQ ID NO: 263820 - DNA, 20 bp, human
gcgtgcgcgacgcggtgtac

SEQ ID NO: 263821 - DNA, 20 bp, human
gctagcggatatgtacccat

SEQ ID NO: 263822 - DNA, 20 bp, human
ggctcaggatgcggcgccag

SEQ ID NO: 263823 - DNA, 20 bp, human
gggcgccagcctagtgcccc

SEQ ID NO: 263824 - DNA, 20 bp, human
gacacgccccgcactggcgc

SEQ ID NO: 263825 - DNA, 20 bp, human
ggagatggtcctgtggagtg

SEQ ID NO: 263826 - DNA, 20 bp, human
gtcagggcgtcaagccccga

SEQ ID NO: 263827 - DNA, 20 bp, human
gatcccgggtcgctggccgg

SEQ ID NO: 263828 - DNA, 20 bp, human
ggaacaaacgatggaatcaa

SEQ ID NO: 263829 - DNA, 20 bp, human
ggagctacacgcactgcctc

SEQ ID NO: 263830 - DNA, 20 bp, human
gcgcccccggccagcgaccc

SEQ ID NO: 263831 - DNA, 20 bp, human
ggggcttgacgccctgatcc

SEQ ID NO: 263832 - DNA, 20 bp, human
gtctcctggggaacaaacga

SEQ ID NO: 263833 - DNA, 20 bp, human
gcacgcactgcctcaggcgg

SEQ ID NO: 263834 - DNA, 20 bp, human
ggaatcaaaggctaaaagcc

SEQ ID NO: 263835 - DNA, 20 bp, human
gaaggattgttgtctcttcc

SEQ ID NO: 263836 - DNA, 20 bp, human
ggggtccaggacggaaaatt

SEQ ID NO: 263837 - DNA, 20 bp, human
gaggcccgggtacccctcag

SEQ ID NO: 263838 - DNA, 20 bp, human
ggggcgggatcagatcagtc

SEQ ID NO: 263839 - DNA, 20 bp, human
gctacagatcgggtccagga

SEQ ID NO: 263840 - DNA, 20 bp, human
gcacagtgcgggccggaaat

SEQ ID NO: 263841 - DNA, 20 bp, human
ggcctcgagagcctcccgaa

SEQ ID NO: 263842 - DNA, 20 bp, human
ggaacacagaggagcccttc

SEQ ID NO: 263843 - DNA, 20 bp, human
ggccacctggaggggcgatg

SEQ ID NO: 263844 - DNA, 20 bp, human
gacgcagtcaaacagcgcaa

SEQ ID NO: 263845 - DNA, 20 bp, human
gtgcctaagaaatgtaaacg

SEQ ID NO: 263846 - DNA, 20 bp, human
gtcctgctgcaccccgtccc

SEQ ID NO: 263847 - DNA, 20 bp, human
gctctcacaggcacatcctg

SEQ ID NO: 263848 - DNA, 20 bp, human
ggtagcatgctgtcaatgaa

SEQ ID NO: 263849 - DNA, 20 bp, human
gcttccacatccgtagaagg

SEQ ID NO: 263850 - DNA, 20 bp, human
gaagcgtgatgctctaaagc

SEQ ID NO: 263851 - DNA, 20 bp, human
gatagcacgagtgacttttg

SEQ ID NO: 263852 - DNA, 20 bp, human
gcgtgatgctctaaagctgg

SEQ ID NO: 263853 - DNA, 20 bp, human
gggtcctgctctgcctcagc

SEQ ID NO: 263854 - DNA, 20 bp, human
gaggtggatgctaatagcac

SEQ ID NO: 263855 - DNA, 20 bp, human
gcatccaccttctacggatg

SEQ ID NO: 263856 - DNA, 20 bp, human
gtggcagaagggagtctgcg

SEQ ID NO: 263857 - DNA, 20 bp, human
gcgggctctggataacatct

SEQ ID NO: 263858 - DNA, 20 bp, human
gttatccagagcccggctgg

SEQ ID NO: 263859 - DNA, 20 bp, human
ggcccaccacgggttctgag

SEQ ID NO: 263860 - DNA, 20 bp, human
gtcagctgcggggggaagag

SEQ ID NO: 263861 - DNA, 20 bp, human
gagcccctcagaacccgtgg

SEQ ID NO: 263862 - DNA, 20 bp, human
ggaagggagtctgcggggcc

SEQ ID NO: 263863 - DNA, 20 bp, human
gagaccaaccgcggcagcac

SEQ ID NO: 263864 - DNA, 20 bp, human
gtgccctgtgctgccgcggt

SEQ ID NO: 263865 - DNA, 20 bp, human
ggcccgcggagcatgaaatt

SEQ ID NO: 263866 - DNA, 20 bp, human
gcaggggaggagttgcggtg

SEQ ID NO: 263867 - DNA, 20 bp, human
gccagacaggtgccaggcag

SEQ ID NO: 263868 - DNA, 20 bp, human
ggtgaggcaggtggtccggg

SEQ ID NO: 263869 - DNA, 20 bp, human
gttagcctcaccctgagact

SEQ ID NO: 263870 - DNA, 20 bp, human
gacaccctgcgccacatgaa

SEQ ID NO: 263871 - DNA, 20 bp, human
gggccaccagccccagtctc

SEQ ID NO: 263872 - DNA, 20 bp, human
ggagccttggctcgagtcag

SEQ ID NO: 263873 - DNA, 20 bp, human
gaccgggcaaccattgtgag

SEQ ID NO: 263874 - DNA, 20 bp, human
gggccccctcctctgacagg

SEQ ID NO: 263875 - DNA, 20 bp, human
gaagcccctgactcgagcca

SEQ ID NO: 263876 - DNA, 20 bp, human
gaagccctgaggtgggacgt

SEQ ID NO: 263877 - DNA, 20 bp, human
gaggaaggaggcggggctaa

SEQ ID NO: 263878 - DNA, 20 bp, human
gcggcagaactgtagagcag

SEQ ID NO: 263879 - DNA, 20 bp, human
gaaggaggcggggctaaggg

SEQ ID NO: 263880 - DNA, 20 bp, human
gtgtctgtccaggacaaagg

SEQ ID NO: 263881 - DNA, 20 bp, human
gcccacctcagggcttcctt

SEQ ID NO: 263882 - DNA, 20 bp, human
gacaaaggtggtcctgctcg

SEQ ID NO: 263883 - DNA, 20 bp, human
gaccgaaggaagccctgagg

SEQ ID NO: 263884 - DNA, 20 bp, human
gctagcaggtctgtctgtcc

SEQ ID NO: 263885 - DNA, 20 bp, human
gagtcttcatcaaaggagat

SEQ ID NO: 263886 - DNA, 20 bp, human
gaggccgggatcgcggtgaa

SEQ ID NO: 263887 - DNA, 20 bp, human
ggacccggggcgagaacgcg

SEQ ID NO: 263888 - DNA, 20 bp, human
gcccgggccggtgaaccgac

SEQ ID NO: 263889 - DNA, 20 bp, human
gcgacagggcgctaggaccc

SEQ ID NO: 263890 - DNA, 20 bp, human
gagttcctctccactcgcgg

SEQ ID NO: 263891 - DNA, 20 bp, human
gcgccctgacgcaacgcagg

SEQ ID NO: 263892 - DNA, 20 bp, human
ggatcgcggtgaaaggctcg

SEQ ID NO: 263893 - DNA, 20 bp, human
ggggcaagtgtaggcatctc

SEQ ID NO: 263894 - DNA, 20 bp, human
gcgcggtgaaaggctcgcgg

SEQ ID NO: 263895 - DNA, 20 bp, human
gaactcctgccgtttggggg

SEQ ID NO: 263896 - DNA, 20 bp, human
gacgccataggcttacgggg

SEQ ID NO: 263897 - DNA, 20 bp, human
gaaggcgacatgaaggagag

SEQ ID NO: 263898 - DNA, 20 bp, human
ggtgtccaggggactcccat

SEQ ID NO: 263899 - DNA, 20 bp, human
gagagagaaaggttcagagt

SEQ ID NO: 263900 - DNA, 20 bp, human
gcctagacaaatggctctgt

SEQ ID NO: 263901 - DNA, 20 bp, human
gcccatgggctcctcactcc

SEQ ID NO: 263902 - DNA, 20 bp, human
gatgacgccataggcttacg

SEQ ID NO: 263903 - DNA, 20 bp, human
gcagtccagtggttgcagga

SEQ ID NO: 263904 - DNA, 20 bp, human
gtctcctccccgtaagccta

SEQ ID NO: 263905 - DNA, 20 bp, human
gaacagcgaaggcgacatga

SEQ ID NO: 263906 - DNA, 20 bp, human
ggggaggagggccaagactc

SEQ ID NO: 263907 - DNA, 20 bp, human
ggtgtcacgagtaaggacaa

SEQ ID NO: 263908 - DNA, 20 bp, human
gctcccaagactcatgttaa

SEQ ID NO: 263909 - DNA, 20 bp, human
gggagctgagatcaggaagg

SEQ ID NO: 263910 - DNA, 20 bp, human
gaacatgagtcttgggagga

SEQ ID NO: 263911 - DNA, 20 bp, human
gccagaaaggaagttgctcc

SEQ ID NO: 263912 - DNA, 20 bp, human
gagggctggtgtcacgagta

SEQ ID NO: 263913 - DNA, 20 bp, human
gcggaggaaccctgctcctc

SEQ ID NO: 263914 - DNA, 20 bp, human
gcacgagtaaggacaagggg

SEQ ID NO: 263915 - DNA, 20 bp, human
gacgtgatgcccatctgggt

SEQ ID NO: 263916 - DNA, 20 bp, human
ggggaccgctcagaagggca

SEQ ID NO: 263917 - DNA, 20 bp, human
gccgcgcgcgggctaaagca

SEQ ID NO: 263918 - DNA, 20 bp, human
ggcgccgggaccacaactcc

SEQ ID NO: 263919 - DNA, 20 bp, human
ggggctaaagcagggcatgc

SEQ ID NO: 263920 - DNA, 20 bp, human
ggccgcgagcccggtgcaga

SEQ ID NO: 263921 - DNA, 20 bp, human
ggggaggggacgctcggctg

SEQ ID NO: 263922 - DNA, 20 bp, human
gggtgtctatgcaaagagga

SEQ ID NO: 263923 - DNA, 20 bp, human
ggaggagcccgacgggtggg

SEQ ID NO: 263924 - DNA, 20 bp, human
gcccggcgctctgaggctgt

SEQ ID NO: 263925 - DNA, 20 bp, human
ggcgacctgactttcctcac

SEQ ID NO: 263926 - DNA, 20 bp, human
gcgctcgcgctcgtccatcc

SEQ ID NO: 263927 - DNA, 20 bp, human
gcgccctcgagacgcccgga

SEQ ID NO: 263928 - DNA, 20 bp, human
ggtccatccgggcgtctcga

SEQ ID NO: 263929 - DNA, 20 bp, human
ggcccggcgcgcccccgtcg

SEQ ID NO: 263930 - DNA, 20 bp, human
ggcgagcgcgagcgcggagt

SEQ ID NO: 263931 - DNA, 20 bp, human
gaggctgcgggcgcccgctc

SEQ ID NO: 263932 - DNA, 20 bp, human
gccggtcccagttggcgaaa

SEQ ID NO: 263933 - DNA, 20 bp, human
gcccccgtcgcggcgcgctc

SEQ ID NO: 263934 - DNA, 20 bp, human
gccactacggggtcggagcg

SEQ ID NO: 263935 - DNA, 20 bp, human
gtgtgctcgactcccgggtg

SEQ ID NO: 263936 - DNA, 20 bp, human
ggggccggcgcctgaaagcc

SEQ ID NO: 263937 - DNA, 20 bp, human
gcggggctggagaactccac

SEQ ID NO: 263938 - DNA, 20 bp, human
gggaggcagggcggcgtccc

SEQ ID NO: 263939 - DNA, 20 bp, human
gtggccaagcccgcacctgc

SEQ ID NO: 263940 - DNA, 20 bp, human
gcgctagtgcgtcacgtcgt

SEQ ID NO: 263941 - DNA, 20 bp, human
ggccatcccggcctcgggac

SEQ ID NO: 263942 - DNA, 20 bp, human
gctgcgaaggtcggcattaa

SEQ ID NO: 263943 - DNA, 20 bp, human
gcccactctgggtaaatttc

SEQ ID NO: 263944 - DNA, 20 bp, human
gccagcccgggggcgtcacg

SEQ ID NO: 263945 - DNA, 20 bp, human
gcctaagtggcagtaggttt

SEQ ID NO: 263946 - DNA, 20 bp, human
gctagtgatagcattctcca

SEQ ID NO: 263947 - DNA, 20 bp, human
gagagggtccctgatagcat

SEQ ID NO: 263948 - DNA, 20 bp, human
gtatcggaagtgactgtgat

SEQ ID NO: 263949 - DNA, 20 bp, human
ggctgtgggctcaattgtgt

SEQ ID NO: 263950 - DNA, 20 bp, human
gtcttgtggcttgaagcatg

SEQ ID NO: 263951 - DNA, 20 bp, human
gtggaaatgtgcgatgtgtt

SEQ ID NO: 263952 - DNA, 20 bp, human
gagttcctttgccactttct

SEQ ID NO: 263953 - DNA, 20 bp, human
gaagctgtttgataagccct

SEQ ID NO: 263954 - DNA, 20 bp, human
gaataattaactcataccca

SEQ ID NO: 263955 - DNA, 20 bp, human
ggcagcagccgatgctatca

SEQ ID NO: 263956 - DNA, 20 bp, human
gtcagaggaggggtatggca

SEQ ID NO: 263957 - DNA, 20 bp, human
gggagagttgaattcattag

SEQ ID NO: 263958 - DNA, 20 bp, human
gcacagactgtgttggacct

SEQ ID NO: 263959 - DNA, 20 bp, human
gatgtcagagaatctgcgat

SEQ ID NO: 263960 - DNA, 20 bp, human
gatgacatcacggcgttcta

SEQ ID NO: 263961 - DNA, 20 bp, human
gtgttcattgctcagaggag

SEQ ID NO: 263962 - DNA, 20 bp, human
gttctgccacatttgaaata

SEQ ID NO: 263963 - DNA, 20 bp, human
gctctcccgtatttcaaatg

SEQ ID NO: 263964 - DNA, 20 bp, human
gattgctcagaggaggggta

SEQ ID NO: 263965 - DNA, 20 bp, human
gacaacaggcaccagacacg

SEQ ID NO: 263966 - DNA, 20 bp, human
gcagaaaaggagttcccatg

SEQ ID NO: 263967 - DNA, 20 bp, human
ggaggctgaggctggatacc

SEQ ID NO: 263968 - DNA, 20 bp, human
gaaagagtggaggaagtgac

SEQ ID NO: 263969 - DNA, 20 bp, human
gcatctgtgtggcttacaaa

SEQ ID NO: 263970 - DNA, 20 bp, human
gataatacacaagacagaaa

SEQ ID NO: 263971 - DNA, 20 bp, human
gtggggaaatgagaacatgt

SEQ ID NO: 263972 - DNA, 20 bp, human
ggttctgtgacccatggcga

SEQ ID NO: 263973 - DNA, 20 bp, human
gcagcctctgccctcgccat

SEQ ID NO: 263974 - DNA, 20 bp, human
gtaggatcttagcgaccatg

SEQ ID NO: 263975 - DNA, 20 bp, human
ggcttacaaagggatacctg

SEQ ID NO: 263976 - DNA, 20 bp, human
gacccccggcgacactgccc

SEQ ID NO: 263977 - DNA, 20 bp, human
ggcgcccccctccatgtcgc

SEQ ID NO: 263978 - DNA, 20 bp, human
gaggtggcaccacgggcccg

SEQ ID NO: 263979 - DNA, 20 bp, human
gcgcgccggggcagtgtcgc

SEQ ID NO: 263980 - DNA, 20 bp, human
gcggggccgggccaatcggg

SEQ ID NO: 263981 - DNA, 20 bp, human
ggccggggcagtgtcgccgg

SEQ ID NO: 263982 - DNA, 20 bp, human
gagccgccaggtggcaccac

SEQ ID NO: 263983 - DNA, 20 bp, human
gccgccctgaaaggcaggtc

SEQ ID NO: 263984 - DNA, 20 bp, human
gccgccgccgcggctcttcg

SEQ ID NO: 263985 - DNA, 20 bp, human
ggcggctcttcggggaaacc

SEQ ID NO: 263986 - DNA, 20 bp, human
ggcaaaggagtgtcgggatt

SEQ ID NO: 263987 - DNA, 20 bp, human
ggaaggtgggcagtaccggg

SEQ ID NO: 263988 - DNA, 20 bp, human
gtgcgctgcaaaggagtgtc

SEQ ID NO: 263989 - DNA, 20 bp, human
gtgcggggtgggctgaaggt

SEQ ID NO: 263990 - DNA, 20 bp, human
gaggcggcgcgccacaccgc

SEQ ID NO: 263991 - DNA, 20 bp, human
gaacccaagaacccgggtga

SEQ ID NO: 263992 - DNA, 20 bp, human
gtcccatcacccgggttctt

SEQ ID NO: 263993 - DNA, 20 bp, human
gttgcctacaacactctcaa

SEQ ID NO: 263994 - DNA, 20 bp, human
ggcagtgctggggtgatagc

SEQ ID NO: 263995 - DNA, 20 bp, human
gcgcttgcggcggctccggt

SEQ ID NO: 263996 - DNA, 20 bp, human
ggggctgcagcccgggtgga

SEQ ID NO: 263997 - DNA, 20 bp, human
ggccctaggggaaacagaaa

SEQ ID NO: 263998 - DNA, 20 bp, human
gtcccctagggccctccacc

SEQ ID NO: 263999 - DNA, 20 bp, human
gcccgggtggagggccctag

SEQ ID NO: 264000 - DNA, 20 bp, human
gcgcatgtgacgcgcgggga

SEQ ID NO: 264001 - DNA, 20 bp, human
gcccgcgcgtcacatgcgcg

SEQ ID NO: 264002 - DNA, 20 bp, human
gtcctcgcgcatgtgacgcg

SEQ ID NO: 264003 - DNA, 20 bp, human
gtgggaagtggacgctgtga

SEQ ID NO: 264004 - DNA, 20 bp, human
gtggaaagaaattcccacta

SEQ ID NO: 264005 - DNA, 20 bp, human
gctccgagaggacgcgatgc

SEQ ID NO: 264006 - DNA, 20 bp, human
gggccctgggtaggttcctg

SEQ ID NO: 264007 - DNA, 20 bp, human
gtggtcgcccttccttgtga

SEQ ID NO: 264008 - DNA, 20 bp, human
gaggttcctgtggtattagg

SEQ ID NO: 264009 - DNA, 20 bp, human
gtaccacaggaacctaccca

SEQ ID NO: 264010 - DNA, 20 bp, human
gtgggtagccgtagaggacg

SEQ ID NO: 264011 - DNA, 20 bp, human
ggcggcgacaacccggaaac

SEQ ID NO: 264012 - DNA, 20 bp, human
gtgcaactcgaacttggtcg

SEQ ID NO: 264013 - DNA, 20 bp, human
gcaactccagaaaaaccggg

SEQ ID NO: 264014 - DNA, 20 bp, human
gggcagcggcggcgacaacc

SEQ ID NO: 264015 - DNA, 20 bp, human
gacgcacttgacggcagcgg

SEQ ID NO: 264016 - DNA, 20 bp, human
gagccccagtgggcggtgaa

SEQ ID NO: 264017 - DNA, 20 bp, human
gccactggggctcatcgctc

SEQ ID NO: 264018 - DNA, 20 bp, human
gtccggctccaagcctgcga

SEQ ID NO: 264019 - DNA, 20 bp, human
gcggcgagctgcagcctcgg

SEQ ID NO: 264020 - DNA, 20 bp, human
gctccccgaggcagagtcat

SEQ ID NO: 264021 - DNA, 20 bp, human
ggctccaagcctgcgagggt

SEQ ID NO: 264022 - DNA, 20 bp, human
gagcctgcgcggtcggtccg

SEQ ID NO: 264023 - DNA, 20 bp, human
gggaggaggggctgacacgg

SEQ ID NO: 264024 - DNA, 20 bp, human
ggagcccccggctggttctg

SEQ ID NO: 264025 - DNA, 20 bp, human
gaacccgcgggagggcagcc

SEQ ID NO: 264026 - DNA, 20 bp, human
gcaaccggcggagaccgcta

SEQ ID NO: 264027 - DNA, 20 bp, human
ggattccagaagatactgtc

SEQ ID NO: 264028 - DNA, 20 bp, human
gttatccaggaagccgggga

SEQ ID NO: 264029 - DNA, 20 bp, human
gctcgcggtgggctaagggg

SEQ ID NO: 264030 - DNA, 20 bp, human
gaggcgcagagccacggcct

SEQ ID NO: 264031 - DNA, 20 bp, human
gacctgctcgcggtgggcta

SEQ ID NO: 264032 - DNA, 20 bp, human
gcactccggctccgagaaga

SEQ ID NO: 264033 - DNA, 20 bp, human
gcacgccagacagtatcttc

SEQ ID NO: 264034 - DNA, 20 bp, human
gccggctccgagaagatggt

SEQ ID NO: 264035 - DNA, 20 bp, human
ggacgccggcgcctaatcct

SEQ ID NO: 264036 - DNA, 20 bp, human
gatgcacttggtgacgtcag

SEQ ID NO: 264037 - DNA, 20 bp, human
gcgcacttgtgtaaaaagcg

SEQ ID NO: 264038 - DNA, 20 bp, human
gttcggttgctaacttgtag

SEQ ID NO: 264039 - DNA, 20 bp, human
gggttgctaacttgtagggg

SEQ ID NO: 264040 - DNA, 20 bp, human
gaaggcgtccttagcagcag

SEQ ID NO: 264041 - DNA, 20 bp, human
gagcgaggacgtgaccgttt

SEQ ID NO: 264042 - DNA, 20 bp, human
gggaagttcgtacatctcag

SEQ ID NO: 264043 - DNA, 20 bp, human
gtgttagtgaggagcggtca

SEQ ID NO: 264044 - DNA, 20 bp, human
gaaagcttgtaatgaagcta

SEQ ID NO: 264045 - DNA, 20 bp, human
ggtacgaacttccggttctc

SEQ ID NO: 264046 - DNA, 20 bp, human
gtggcctgccccgcccacgt

SEQ ID NO: 264047 - DNA, 20 bp, human
ggttgcaaggagtcattcga

SEQ ID NO: 264048 - DNA, 20 bp, human
gcccgaggaattggggtcgc

SEQ ID NO: 264049 - DNA, 20 bp, human
gactccttgcaacgtgttgg

SEQ ID NO: 264050 - DNA, 20 bp, human
gaattggggtcgcgggcgag

SEQ ID NO: 264051 - DNA, 20 bp, human
gtctcaagtcccgaggaatt

SEQ ID NO: 264052 - DNA, 20 bp, human
gcacggggtctcaagtcccg

SEQ ID NO: 264053 - DNA, 20 bp, human
gcggctgcgcggtgcttggc

SEQ ID NO: 264054 - DNA, 20 bp, human
gccaccaccaacacgttgca

SEQ ID NO: 264055 - DNA, 20 bp, human
gcaactgccacgatgacact

SEQ ID NO: 264056 - DNA, 20 bp, human
gccggcagcagaagcgaagg

SEQ ID NO: 264057 - DNA, 20 bp, human
gccggaaggccgctgcatgt

SEQ ID NO: 264058 - DNA, 20 bp, human
gcatgtcggtaccactgcag

SEQ ID NO: 264059 - DNA, 20 bp, human
gtgcagcggccttccgggag

SEQ ID NO: 264060 - DNA, 20 bp, human
gcagtggtaccgacatgcag

SEQ ID NO: 264061 - DNA, 20 bp, human
ggcggccttccgggagaggc

SEQ ID NO: 264062 - DNA, 20 bp, human
gaggagccgagcgcgcggct

SEQ ID NO: 264063 - DNA, 20 bp, human
ggcagcccgtgcgccggcgc

SEQ ID NO: 264064 - DNA, 20 bp, human
gttctgctgccggcctctcc

SEQ ID NO: 264065 - DNA, 20 bp, human
gccgcctcgctgccaccaca

SEQ ID NO: 264066 - DNA, 20 bp, human
gaggccgtgtgccctccgcg

SEQ ID NO: 264067 - DNA, 20 bp, human
gtgagcgctcacagtcttga

SEQ ID NO: 264068 - DNA, 20 bp, human
ggtcgggagcgacacccctg

SEQ ID NO: 264069 - DNA, 20 bp, human
gcctgcggaggatacggtgc

SEQ ID NO: 264070 - DNA, 20 bp, human
ggggagcgacacccctgcgg

SEQ ID NO: 264071 - DNA, 20 bp, human
ggggaagtggagtctgcggc

SEQ ID NO: 264072 - DNA, 20 bp, human
gcccgacacgcctcagacag

SEQ ID NO: 264073 - DNA, 20 bp, human
gcccttggcatcatgggaag

SEQ ID NO: 264074 - DNA, 20 bp, human
ggacacccctgcggaggata

SEQ ID NO: 264075 - DNA, 20 bp, human
gcccgaccccttggcatcat

SEQ ID NO: 264076 - DNA, 20 bp, human
gaagcctggcgtctcgacct

SEQ ID NO: 264077 - DNA, 20 bp, human
gggcggggatccacgagctc

SEQ ID NO: 264078 - DNA, 20 bp, human
gtggccaactgcagtctggg

SEQ ID NO: 264079 - DNA, 20 bp, human
gtcacaggcggtgccaggcg

SEQ ID NO: 264080 - DNA, 20 bp, human
ggtctgggaggcgcaactac

SEQ ID NO: 264081 - DNA, 20 bp, human
gcccagacgccgctggtgac

SEQ ID NO: 264082 - DNA, 20 bp, human
gtctggggcagtcaccccgc

SEQ ID NO: 264083 - DNA, 20 bp, human
gccttgcggggcgtcgcttc

SEQ ID NO: 264084 - DNA, 20 bp, human
gagctggccaactgcagtct

SEQ ID NO: 264085 - DNA, 20 bp, human
gggtacgtgtacctgaagcc

SEQ ID NO: 264086 - DNA, 20 bp, human
gtggaacatgtttgagttgt

SEQ ID NO: 264087 - DNA, 20 bp, human
gcccaatgttcaggcaagtt

SEQ ID NO: 264088 - DNA, 20 bp, human
gtgcagaaagcttaaacatc

SEQ ID NO: 264089 - DNA, 20 bp, human
gcctgaacattgggatgacc

SEQ ID NO: 264090 - DNA, 20 bp, human
gagaaagcaagaaagcctct

SEQ ID NO: 264091 - DNA, 20 bp, human
gaacagagacttgtgattta

SEQ ID NO: 264092 - DNA, 20 bp, human
gctcactctctttagggcac

SEQ ID NO: 264093 - DNA, 20 bp, human
ggacttgtgatttagggatt

SEQ ID NO: 264094 - DNA, 20 bp, human
ggtatattttgaagctgccc

SEQ ID NO: 264095 - DNA, 20 bp, human
gaataattttgagagccact

SEQ ID NO: 264096 - DNA, 20 bp, human
gaggtcaaacccctggtgag

SEQ ID NO: 264097 - DNA, 20 bp, human
gtgagttccagctacgtgta

SEQ ID NO: 264098 - DNA, 20 bp, human
gcaatgctgtgtttcagtga

SEQ ID NO: 264099 - DNA, 20 bp, human
ggaggagttatataacagat

SEQ ID NO: 264100 - DNA, 20 bp, human
gttcaaccacctcagaaaaa

SEQ ID NO: 264101 - DNA, 20 bp, human
gggttctctcctctcaccag

SEQ ID NO: 264102 - DNA, 20 bp, human
gggttgaaaggtcaaacccc

SEQ ID NO: 264103 - DNA, 20 bp, human
gtgatgttgggtcattacgc

SEQ ID NO: 264104 - DNA, 20 bp, human
gtttagttaaggttaatggg

SEQ ID NO: 264105 - DNA, 20 bp, human
gacacactagttctacatct

SEQ ID NO: 264106 - DNA, 20 bp, human
gcgccctcagtgcatgtgac

SEQ ID NO: 264107 - DNA, 20 bp, human
gtcagtgcatgtgacggggt

SEQ ID NO: 264108 - DNA, 20 bp, human
ggaacctggggaccagtaag

SEQ ID NO: 264109 - DNA, 20 bp, human
ggaagtgactccggcgtgag

SEQ ID NO: 264110 - DNA, 20 bp, human
gaggctgtcggagcagaggt

SEQ ID NO: 264111 - DNA, 20 bp, human
gtaggaagccgcagcctctc

SEQ ID NO: 264112 - DNA, 20 bp, human
gaggggaaacctggcctagc

SEQ ID NO: 264113 - DNA, 20 bp, human
ggcgacggcggcatgagccg

SEQ ID NO: 264114 - DNA, 20 bp, human
gggggcaagggtatgagggg

SEQ ID NO: 264115 - DNA, 20 bp, human
gccgccccttactggtcccc

SEQ ID NO: 264116 - DNA, 20 bp, human
gaagagggcgcgcacgtgga

SEQ ID NO: 264117 - DNA, 20 bp, human
gcacgtgcgcgggaattggc

SEQ ID NO: 264118 - DNA, 20 bp, human
gcatccacgtgcgcgggaat

SEQ ID NO: 264119 - DNA, 20 bp, human
gcgtgacccaggactgcctg

SEQ ID NO: 264120 - DNA, 20 bp, human
gacgtggatgcgcacgtgga

SEQ ID NO: 264121 - DNA, 20 bp, human
ggtgcgcgggaattggctgg

SEQ ID NO: 264122 - DNA, 20 bp, human
gctacaagtgcgcgtgaccc

SEQ ID NO: 264123 - DNA, 20 bp, human
gcaggaagagggcgcgcacg

SEQ ID NO: 264124 - DNA, 20 bp, human
gcgtgcgcatccacgtgcgc

SEQ ID NO: 264125 - DNA, 20 bp, human
gtaccaagacagtgagacag

SEQ ID NO: 264126 - DNA, 20 bp, human
ggagcacaggcactaccaag

SEQ ID NO: 264127 - DNA, 20 bp, human
gcccccgcgcagggagctat

SEQ ID NO: 264128 - DNA, 20 bp, human
gcagccaggaagtgcatagc

SEQ ID NO: 264129 - DNA, 20 bp, human
ggtggtgtccatgaccctag

SEQ ID NO: 264130 - DNA, 20 bp, human
ggagcccatagctccctgcg

SEQ ID NO: 264131 - DNA, 20 bp, human
ggtccatgaccctagaggac

SEQ ID NO: 264132 - DNA, 20 bp, human
gagtggccgacctgtcctct

SEQ ID NO: 264133 - DNA, 20 bp, human
gatgaccctagaggacaggt

SEQ ID NO: 264134 - DNA, 20 bp, human
gacagaggcaatgagaccaa

SEQ ID NO: 264135 - DNA, 20 bp, human
gtggctgcagtcaccaggca

SEQ ID NO: 264136 - DNA, 20 bp, human
gcagctacagcggagaaggg

SEQ ID NO: 264137 - DNA, 20 bp, human
gggccaaagtctcctggaag

SEQ ID NO: 264138 - DNA, 20 bp, human
ggtggcagctgtggggtcta

SEQ ID NO: 264139 - DNA, 20 bp, human
gctagtctcaacacctgacg

SEQ ID NO: 264140 - DNA, 20 bp, human
ggggttatgtagtccacgtc

SEQ ID NO: 264141 - DNA, 20 bp, human
gagactaggccaaagtctcc

SEQ ID NO: 264142 - DNA, 20 bp, human
gcacttgccgtgatgaatgc

SEQ ID NO: 264143 - DNA, 20 bp, human
ggccccacccgtaagagtta

SEQ ID NO: 264144 - DNA, 20 bp, human
gaacgcagctacagcggaga

SEQ ID NO: 264145 - DNA, 20 bp, human
gaccatggaagcaatcggtt

SEQ ID NO: 264146 - DNA, 20 bp, human
gagagcagccaactcttcgc

SEQ ID NO: 264147 - DNA, 20 bp, human
gacggggcatgtgatctcct

SEQ ID NO: 264148 - DNA, 20 bp, human
gagagagcccggcgaagagt

SEQ ID NO: 264149 - DNA, 20 bp, human
gggctctctaacaagttccg

SEQ ID NO: 264150 - DNA, 20 bp, human
gccgaagtggagaggtgaca

SEQ ID NO: 264151 - DNA, 20 bp, human
gagcctgcctggcagacacc

SEQ ID NO: 264152 - DNA, 20 bp, human
gcaaaatcattgtggtgcct

SEQ ID NO: 264153 - DNA, 20 bp, human
gtgaccgagccgaagtggag

SEQ ID NO: 264154 - DNA, 20 bp, human
gcatgtgatctccttggcag

SEQ ID NO: 264155 - DNA, 20 bp, human
gtggtatcgtatgtgtggac

SEQ ID NO: 264156 - DNA, 20 bp, human
gctgggcaggaacaggctga

SEQ ID NO: 264157 - DNA, 20 bp, human
ggtagcttggccctcccaaa

SEQ ID NO: 264158 - DNA, 20 bp, human
ggctgagggcctgacaagca

SEQ ID NO: 264159 - DNA, 20 bp, human
gtgggccagactgggtgtcg

SEQ ID NO: 264160 - DNA, 20 bp, human
gggcctcggtcacctcccag

SEQ ID NO: 264161 - DNA, 20 bp, human
gagcctgttcctgcccagct

SEQ ID NO: 264162 - DNA, 20 bp, human
gccagccccgacacccagtc

SEQ ID NO: 264163 - DNA, 20 bp, human
ggtagcaaatagctgtagct

SEQ ID NO: 264164 - DNA, 20 bp, human
gcagtcgcaggatattttga

SEQ ID NO: 264165 - DNA, 20 bp, human
gagacagatcagctgggcta

SEQ ID NO: 264166 - DNA, 20 bp, human
gaactgaggtcaaggggagg

SEQ ID NO: 264167 - DNA, 20 bp, human
gggagctgtcttttttgtga

SEQ ID NO: 264168 - DNA, 20 bp, human
gggctgggcctagtggagac

SEQ ID NO: 264169 - DNA, 20 bp, human
gctgaagggtagaaatttac

SEQ ID NO: 264170 - DNA, 20 bp, human
gcccaaatgcaatcatttcc

SEQ ID NO: 264171 - DNA, 20 bp, human
gccgtcacaaattgtcacca

SEQ ID NO: 264172 - DNA, 20 bp, human
gttgtgacggcaaagaatgt

SEQ ID NO: 264173 - DNA, 20 bp, human
gtgcggacagacaatcggac

SEQ ID NO: 264174 - DNA, 20 bp, human
gggcaaagaatgtgggaacg

SEQ ID NO: 264175 - DNA, 20 bp, human
gaaccagggaactgaggtca

SEQ ID NO: 264176 - DNA, 20 bp, human
ggctgtgtgccaagtgtccc

SEQ ID NO: 264177 - DNA, 20 bp, human
gcaggtcagaatcacaggat

SEQ ID NO: 264178 - DNA, 20 bp, human
gctagtgatgtcttccctga

SEQ ID NO: 264179 - DNA, 20 bp, human
gggatccaggtcagaatcac

SEQ ID NO: 264180 - DNA, 20 bp, human
ggccctgtggagagattcca

SEQ ID NO: 264181 - DNA, 20 bp, human
gacctggatccagggacact

SEQ ID NO: 264182 - DNA, 20 bp, human
gagcctgccattttaatcaa

SEQ ID NO: 264183 - DNA, 20 bp, human
ggtgatgtcttccctgaggg

SEQ ID NO: 264184 - DNA, 20 bp, human
gcccttggaatctctccaca

SEQ ID NO: 264185 - DNA, 20 bp, human
ggaattctggcctgggaggt

SEQ ID NO: 264186 - DNA, 20 bp, human
ggggaggggcttacttagcc

SEQ ID NO: 264187 - DNA, 20 bp, human
gtaagcaaggggcggaggga

SEQ ID NO: 264188 - DNA, 20 bp, human
gagaaacaccacggggcaaa

SEQ ID NO: 264189 - DNA, 20 bp, human
gtcccggtggtagaggggag

SEQ ID NO: 264190 - DNA, 20 bp, human
gcgcgcggcgaccgtcccgg

SEQ ID NO: 264191 - DNA, 20 bp, human
gcctctaaccgcaaggggtg

SEQ ID NO: 264192 - DNA, 20 bp, human
gttgactcctctaaccgcaa

SEQ ID NO: 264193 - DNA, 20 bp, human
ggaccgtcccggtggtagag

SEQ ID NO: 264194 - DNA, 20 bp, human
gacggggcaaagggaaacga

SEQ ID NO: 264195 - DNA, 20 bp, human
gaagggaaacgaaggagtta

SEQ ID NO: 264196 - DNA, 20 bp, human
gtagtgctgcccggtcgggg

SEQ ID NO: 264197 - DNA, 20 bp, human
gggcgatgcaggcagggtaa

SEQ ID NO: 264198 - DNA, 20 bp, human
gggcccggctggttactaga

SEQ ID NO: 264199 - DNA, 20 bp, human
gggaccttctagtaaccagc

SEQ ID NO: 264200 - DNA, 20 bp, human
gcgcgaaataagatcccgac

SEQ ID NO: 264201 - DNA, 20 bp, human
gccgccccgcgcccgccggt

SEQ ID NO: 264202 - DNA, 20 bp, human
gtgagtacagtgccagaata

SEQ ID NO: 264203 - DNA, 20 bp, human
gacagtgccagaatagggcg

SEQ ID NO: 264204 - DNA, 20 bp, human
gctacccgagcgctgttgcc

SEQ ID NO: 264205 - DNA, 20 bp, human
ggggtagtgctgcccggtcg

SEQ ID NO: 264206 - DNA, 20 bp, human
gcccgcgcgcgccctggtaa

SEQ ID NO: 264207 - DNA, 20 bp, human
gccagtgcgggcgcctcgcg

SEQ ID NO: 264208 - DNA, 20 bp, human
gtgcacggggatcgccgcca

SEQ ID NO: 264209 - DNA, 20 bp, human
gcgcctcgcgaggtcgatcc

SEQ ID NO: 264210 - DNA, 20 bp, human
gatcccggatcgacctcgcg

SEQ ID NO: 264211 - DNA, 20 bp, human
gctgctggatccccgccaca

SEQ ID NO: 264212 - DNA, 20 bp, human
gcacccgttctgctaaccga

SEQ ID NO: 264213 - DNA, 20 bp, human
gggctgcggcggggataggc

SEQ ID NO: 264214 - DNA, 20 bp, human
gagcactggcggcacgatcc

SEQ ID NO: 264215 - DNA, 20 bp, human
gcgcagccccgcggccagtg

SEQ ID NO: 264216 - DNA, 20 bp, human
gtgcccgaggtggggatccc

SEQ ID NO: 264217 - DNA, 20 bp, human
ggaagaagagcctccggaga

SEQ ID NO: 264218 - DNA, 20 bp, human
gctgatagcggagatggcgg

SEQ ID NO: 264219 - DNA, 20 bp, human
gagcctgggatccccacctc

SEQ ID NO: 264220 - DNA, 20 bp, human
ggccctggacttggtggcga

SEQ ID NO: 264221 - DNA, 20 bp, human
ggagccatcgggactcaagg

SEQ ID NO: 264222 - DNA, 20 bp, human
gtggcgacggaccctgcccg

SEQ ID NO: 264223 - DNA, 20 bp, human
ggatccggggcgcacggtgt

SEQ ID NO: 264224 - DNA, 20 bp, human
gaggagctgccggccttggg

SEQ ID NO: 264225 - DNA, 20 bp, human
ggctatcagctcggagactc

SEQ ID NO: 264226 - DNA, 20 bp, human
gcttgcccctggggattgcg

SEQ ID NO: 264227 - DNA, 20 bp, human
gagcacggaaggggcaacgc

SEQ ID NO: 264228 - DNA, 20 bp, human
gaagcacgcgacttcttggt

SEQ ID NO: 264229 - DNA, 20 bp, human
gcaacgcgggtaaagctgcg

SEQ ID NO: 264230 - DNA, 20 bp, human
gcatcagccgcgcaatcccc

SEQ ID NO: 264231 - DNA, 20 bp, human
gagcttcactaacttagtga

SEQ ID NO: 264232 - DNA, 20 bp, human
gtggatgttgacatccacag

SEQ ID NO: 264233 - DNA, 20 bp, human
gcaagattggtgctttttga

SEQ ID NO: 264234 - DNA, 20 bp, human
gagaaagtaaagagcaagat

SEQ ID NO: 264235 - DNA, 20 bp, human
ggctctttactttcttacca

SEQ ID NO: 264236 - DNA, 20 bp, human
gcaacaggacgggaatatca

SEQ ID NO: 264237 - DNA, 20 bp, human
gatatgctgccatggtagaa

SEQ ID NO: 264238 - DNA, 20 bp, human
gggtctattgtgacatcaac

SEQ ID NO: 264239 - DNA, 20 bp, human
gcttactatgtgcagagaac

SEQ ID NO: 264240 - DNA, 20 bp, human
ggtcattctatatgctgcca

SEQ ID NO: 264241 - DNA, 20 bp, human
gtattgtgacatcaacagga

SEQ ID NO: 264242 - DNA, 20 bp, human
gtcaatgataatgtcacaat

SEQ ID NO: 264243 - DNA, 20 bp, human
ggcttaaaatctagatgtgt

SEQ ID NO: 264244 - DNA, 20 bp, human
gttttaagcttatttaagca

SEQ ID NO: 264245 - DNA, 20 bp, human
ggtagaagggtgagggggga

SEQ ID NO: 264246 - DNA, 20 bp, human
ggacaaaaagctagatagtg

SEQ ID NO: 264247 - DNA, 20 bp, human
gcagtttgattagaagaatt

SEQ ID NO: 264248 - DNA, 20 bp, human
gcaaactgatgatgtcactg

SEQ ID NO: 264249 - DNA, 20 bp, human
gtgatgtcactggggaaaag

SEQ ID NO: 264250 - DNA, 20 bp, human
gagtcaagtaaatatatgtt

SEQ ID NO: 264251 - DNA, 20 bp, human
gaaaaagcaacaagtaggcc

SEQ ID NO: 264252 - DNA, 20 bp, human
gagacattaatgttttgttt

SEQ ID NO: 264253 - DNA, 20 bp, human
gaatttaaaatattttattc

SEQ ID NO: 264254 - DNA, 20 bp, human
gtttttaaaaagcaacaagt

SEQ ID NO: 264255 - DNA, 20 bp, human
gtggggaaaagaggatcagt

SEQ ID NO: 264256 - DNA, 20 bp, human
gttggagcagcccacgtctt

SEQ ID NO: 264257 - DNA, 20 bp, human
gtcgggaccaccctgaaaat

SEQ ID NO: 264258 - DNA, 20 bp, human
gcctccccccattttcaggg

SEQ ID NO: 264259 - DNA, 20 bp, human
ggacgagtagcccaagacgt

SEQ ID NO: 264260 - DNA, 20 bp, human
gcagaccacgcccgcagctg

SEQ ID NO: 264261 - DNA, 20 bp, human
gcctgcgcccgccgccagga

SEQ ID NO: 264262 - DNA, 20 bp, human
gactccgccttgccagtccg

SEQ ID NO: 264263 - DNA, 20 bp, human
gaaggcgacagcggcgtctg

SEQ ID NO: 264264 - DNA, 20 bp, human
gggggcggaagcacgatctc

SEQ ID NO: 264265 - DNA, 20 bp, human
gcctcagctctcaccctctt

SEQ ID NO: 264266 - DNA, 20 bp, human
gggtgacctcacaatgttcg

SEQ ID NO: 264267 - DNA, 20 bp, human
ggtcacaaaacaaaagggga

SEQ ID NO: 264268 - DNA, 20 bp, human
gcaattcatcccactgccca

SEQ ID NO: 264269 - DNA, 20 bp, human
gtgaggtcacccatgaactc

SEQ ID NO: 264270 - DNA, 20 bp, human
gagcttgtcacaaaacaaaa

SEQ ID NO: 264271 - DNA, 20 bp, human
ggacctcacaatgttcgggg

SEQ ID NO: 264272 - DNA, 20 bp, human
gtgccccgcttcctttccca

SEQ ID NO: 264273 - DNA, 20 bp, human
gccaagccctccattttgct

SEQ ID NO: 264274 - DNA, 20 bp, human
gtgccaccccgaacattgtg

SEQ ID NO: 264275 - DNA, 20 bp, human
gagaaattaaatatggtcag

SEQ ID NO: 264276 - DNA, 20 bp, human
gtgaaattggaggcggaaac

SEQ ID NO: 264277 - DNA, 20 bp, human
gcggaaacaggcacggaaag

SEQ ID NO: 264278 - DNA, 20 bp, human
gtccgggccctcagccttaa

SEQ ID NO: 264279 - DNA, 20 bp, human
gggtcccagacagttcagaa

SEQ ID NO: 264280 - DNA, 20 bp, human
gccctccccggaagtgaaat

SEQ ID NO: 264281 - DNA, 20 bp, human
gggcaccagcacttccggta

SEQ ID NO: 264282 - DNA, 20 bp, human
gaaacaggcacggaaagcgg

SEQ ID NO: 264283 - DNA, 20 bp, human
gccggaagtgaaattggagg

SEQ ID NO: 264284 - DNA, 20 bp, human
gtgtctgggaccctttggtg

SEQ ID NO: 264285 - DNA, 20 bp, human
gggccctcagccttaagggg

SEQ ID NO: 264286 - DNA, 20 bp, human
gggggccctaggcgacacca

SEQ ID NO: 264287 - DNA, 20 bp, human
gggcgccctggtgtcgccta

SEQ ID NO: 264288 - DNA, 20 bp, human
ggtcccgcaaactcgcgtct

SEQ ID NO: 264289 - DNA, 20 bp, human
gcaaactcgcgtctcggagt

SEQ ID NO: 264290 - DNA, 20 bp, human
gcagagtgaggccccgagtc

SEQ ID NO: 264291 - DNA, 20 bp, human
gagcaccacggccccctctg

SEQ ID NO: 264292 - DNA, 20 bp, human
ggagccgtggacggggccct

SEQ ID NO: 264293 - DNA, 20 bp, human
gcggagcggtaatttgtcct

SEQ ID NO: 264294 - DNA, 20 bp, human
ggtccacggctccggactcg

SEQ ID NO: 264295 - DNA, 20 bp, human
gtagtcctccagaaacaagg

SEQ ID NO: 264296 - DNA, 20 bp, human
gtcaacgtgctgcagagtat

SEQ ID NO: 264297 - DNA, 20 bp, human
gggcaggggttacaagtcat

SEQ ID NO: 264298 - DNA, 20 bp, human
ggggttacaagtcatgggta

SEQ ID NO: 264299 - DNA, 20 bp, human
gatggccacctcaaggaggt

SEQ ID NO: 264300 - DNA, 20 bp, human
gcaaaggaaggagagacacg

SEQ ID NO: 264301 - DNA, 20 bp, human
gcaccatgaggaatatgtct

SEQ ID NO: 264302 - DNA, 20 bp, human
gtgtaaacctgaatgtagaa

SEQ ID NO: 264303 - DNA, 20 bp, human
gaggaaaacctcaaagaccc

SEQ ID NO: 264304 - DNA, 20 bp, human
ggtagatgcctggcaaagga

SEQ ID NO: 264305 - DNA, 20 bp, human
ggtctagacatcttctgctc

SEQ ID NO: 264306 - DNA, 20 bp, human
gcgctgctctctgactttga

SEQ ID NO: 264307 - DNA, 20 bp, human
gtctagccttcccaagaagt

SEQ ID NO: 264308 - DNA, 20 bp, human
gggagccagtctttacacag

SEQ ID NO: 264309 - DNA, 20 bp, human
gaagtcaagggcaggaactt

SEQ ID NO: 264310 - DNA, 20 bp, human
gggcaggagtaggaaaccat

SEQ ID NO: 264311 - DNA, 20 bp, human
gtaggtgatgttcattccaa

SEQ ID NO: 264312 - DNA, 20 bp, human
gaagactggctcccacttct

SEQ ID NO: 264313 - DNA, 20 bp, human
gcatcacctagccacagaga

SEQ ID NO: 264314 - DNA, 20 bp, human
gaatgcagtataaaagtcaa

SEQ ID NO: 264315 - DNA, 20 bp, human
gaagctataatgcagaaggc

SEQ ID NO: 264316 - DNA, 20 bp, human
ggggggcggcagcgcatcaa

SEQ ID NO: 264317 - DNA, 20 bp, human
ggcgcgaggcgtgagcgcgg

SEQ ID NO: 264318 - DNA, 20 bp, human
gctcacgcctcgcgccctgg

SEQ ID NO: 264319 - DNA, 20 bp, human
gagggcgcgaggcgtgagcg

SEQ ID NO: 264320 - DNA, 20 bp, human
ggcgcggaggggcccgatag

SEQ ID NO: 264321 - DNA, 20 bp, human
ggcgctgaggacggggagac

SEQ ID NO: 264322 - DNA, 20 bp, human
ggcaacggcatcagcctccg

SEQ ID NO: 264323 - DNA, 20 bp, human
ggccgccgctgctgccgtac

SEQ ID NO: 264324 - DNA, 20 bp, human
gaggggcccgatagcggcag

SEQ ID NO: 264325 - DNA, 20 bp, human
ggagccccgccgccgtgcgc

SEQ ID NO: 264326 - DNA, 20 bp, human
ggccccgggtactttcttta

SEQ ID NO: 264327 - DNA, 20 bp, human
gttgacttatgagctatatc

SEQ ID NO: 264328 - DNA, 20 bp, human
gcatccgtaaagaaagtacc

SEQ ID NO: 264329 - DNA, 20 bp, human
gcggaacccccaaacttccg

SEQ ID NO: 264330 - DNA, 20 bp, human
ggggggttccgtgttctatc

SEQ ID NO: 264331 - DNA, 20 bp, human
gttacacttgccatgcactc

SEQ ID NO: 264332 - DNA, 20 bp, human
ggaaagtacccggggcagcc

SEQ ID NO: 264333 - DNA, 20 bp, human
gactgcaaagaacactgctc

SEQ ID NO: 264334 - DNA, 20 bp, human
gtatttcctcggaagtttgg

SEQ ID NO: 264335 - DNA, 20 bp, human
gacgcattagaattcttccg

SEQ ID NO: 264336 - DNA, 20 bp, human
gaggaggggcatggcggcga

SEQ ID NO: 264337 - DNA, 20 bp, human
ggcaggtcggggactagaga

SEQ ID NO: 264338 - DNA, 20 bp, human
gtcccgaactacaactcccg

SEQ ID NO: 264339 - DNA, 20 bp, human
gctagccagggtccagagcg

SEQ ID NO: 264340 - DNA, 20 bp, human
gcagggtccagagcgaggca

SEQ ID NO: 264341 - DNA, 20 bp, human
gtcggggagcggagcgtggt

SEQ ID NO: 264342 - DNA, 20 bp, human
gcgggactgagaccctgtcg

SEQ ID NO: 264343 - DNA, 20 bp, human
gctccggctgccgcaggtcg

SEQ ID NO: 264344 - DNA, 20 bp, human
gcacccctctccattaatga

SEQ ID NO: 264345 - DNA, 20 bp, human
gctcccggggtgcaccgcgc

SEQ ID NO: 264346 - DNA, 20 bp, human
gcacgcctcaggatgaggac

SEQ ID NO: 264347 - DNA, 20 bp, human
gtggcccaatcaagtctctc

SEQ ID NO: 264348 - DNA, 20 bp, human
gccgccctccaggcgcagac

SEQ ID NO: 264349 - DNA, 20 bp, human
ggggttacgtcgccggaagt

SEQ ID NO: 264350 - DNA, 20 bp, human
ggggcgggactctattgtgg

SEQ ID NO: 264351 - DNA, 20 bp, human
gctggccagtcctcatcctg

SEQ ID NO: 264352 - DNA, 20 bp, human
gcgggagcccgatggaaatc

SEQ ID NO: 264353 - DNA, 20 bp, human
gcgggaccggcccgccctcc

SEQ ID NO: 264354 - DNA, 20 bp, human
ggaggaaggggcgtttccta

SEQ ID NO: 264355 - DNA, 20 bp, human
ggagccggagagacttgatt

SEQ ID NO: 264356 - DNA, 20 bp, human
gtcccaccactgccggcctc

SEQ ID NO: 264357 - DNA, 20 bp, human
gggctgggagccaccaagcg

SEQ ID NO: 264358 - DNA, 20 bp, human
ggtggtgggaggctcgctct

SEQ ID NO: 264359 - DNA, 20 bp, human
gaccactgccggcctctggc

SEQ ID NO: 264360 - DNA, 20 bp, human
gcgaggcctgcagtgagcgc

SEQ ID NO: 264361 - DNA, 20 bp, human
gcaggcctcgcacgagcatg

SEQ ID NO: 264362 - DNA, 20 bp, human
gacgagcatgcggtgtctga

SEQ ID NO: 264363 - DNA, 20 bp, human
gttcttcactcctcgcttgg

SEQ ID NO: 264364 - DNA, 20 bp, human
gttcttcttcactcctcgct

SEQ ID NO: 264365 - DNA, 20 bp, human
ggacaccgcatgctcgtgcg

SEQ ID NO: 264366 - DNA, 20 bp, human
ggtcccgcgtagggggggaa

SEQ ID NO: 264367 - DNA, 20 bp, human
gtctcccagcgaactccggg

SEQ ID NO: 264368 - DNA, 20 bp, human
ggctgggagaaaaacttggt

SEQ ID NO: 264369 - DNA, 20 bp, human
gttcccgtcccgcgtagggg

SEQ ID NO: 264370 - DNA, 20 bp, human
ggtcaccacccggagttcgc

SEQ ID NO: 264371 - DNA, 20 bp, human
gcatccttcccgtcccgcgt

SEQ ID NO: 264372 - DNA, 20 bp, human
gcgcccttccccccctacgc

SEQ ID NO: 264373 - DNA, 20 bp, human
ggcctcgggggctagtgcgg

SEQ ID NO: 264374 - DNA, 20 bp, human
gtggaggaacgcgtgtaatg

SEQ ID NO: 264375 - DNA, 20 bp, human
ggcggcctcgggggctagtg

SEQ ID NO: 264376 - DNA, 20 bp, human
gtgggtgccgagggccggtg

SEQ ID NO: 264377 - DNA, 20 bp, human
gagggacagaaagaagtctg

SEQ ID NO: 264378 - DNA, 20 bp, human
gggttagccggatagaatgt

SEQ ID NO: 264379 - DNA, 20 bp, human
ggacagaaagaagtctgcgg

SEQ ID NO: 264380 - DNA, 20 bp, human
gagtctgcggtggcccccac

SEQ ID NO: 264381 - DNA, 20 bp, human
ggatagaatgtgggtgccga

SEQ ID NO: 264382 - DNA, 20 bp, human
gcagggcaagcagttgcccg

SEQ ID NO: 264383 - DNA, 20 bp, human
gggggccgcggccaaagagc

SEQ ID NO: 264384 - DNA, 20 bp, human
gggagaccaacgcacaacag

SEQ ID NO: 264385 - DNA, 20 bp, human
gcgctcgcgagagccgaccg

SEQ ID NO: 264386 - DNA, 20 bp, human
gcagggaaacacaatcccca

SEQ ID NO: 264387 - DNA, 20 bp, human
gtgaaggtcgcctgtgtcag

SEQ ID NO: 264388 - DNA, 20 bp, human
gcacacacgcagattagatg

SEQ ID NO: 264389 - DNA, 20 bp, human
gcagttccccgccaggagag

SEQ ID NO: 264390 - DNA, 20 bp, human
gccccgccaggagagaggct

SEQ ID NO: 264391 - DNA, 20 bp, human
gcccacaaggggttgatctg

SEQ ID NO: 264392 - DNA, 20 bp, human
gctcctggcggggaactgtt

SEQ ID NO: 264393 - DNA, 20 bp, human
gtgtttggaccagtcgtcag

SEQ ID NO: 264394 - DNA, 20 bp, human
gtgcaacttccccctgacac

SEQ ID NO: 264395 - DNA, 20 bp, human
gagacagcaggaaaactttc

SEQ ID NO: 264396 - DNA, 20 bp, human
gaggcagcaacggccttccc

SEQ ID NO: 264397 - DNA, 20 bp, human
gtgctggcggcgaggaccca

SEQ ID NO: 264398 - DNA, 20 bp, human
gcacgcccccggcccttaaa

SEQ ID NO: 264399 - DNA, 20 bp, human
ggaaggccgttgctgcctgg

SEQ ID NO: 264400 - DNA, 20 bp, human
gcggtgccccgacactgaca

SEQ ID NO: 264401 - DNA, 20 bp, human
ggaccccggacacgcggcgg

SEQ ID NO: 264402 - DNA, 20 bp, human
gcgcctccgccgcgtgtccg

SEQ ID NO: 264403 - DNA, 20 bp, human
gcgggctgaccccggacacg

SEQ ID NO: 264404 - DNA, 20 bp, human
gccttggcctcgggcctccg

SEQ ID NO: 264405 - DNA, 20 bp, human
ggctgaccccggacacgcgg

SEQ ID NO: 264406 - DNA, 20 bp, human
gcggccagagcccagtaatc

SEQ ID NO: 264407 - DNA, 20 bp, human
gcggaagctccggacctccc

SEQ ID NO: 264408 - DNA, 20 bp, human
gcggacctccctggcccgaa

SEQ ID NO: 264409 - DNA, 20 bp, human
ggggcctgggtctacacacg

SEQ ID NO: 264410 - DNA, 20 bp, human
gggcgctcaccgttcgggcc

SEQ ID NO: 264411 - DNA, 20 bp, human
gctcaccgttcgggccaggg

SEQ ID NO: 264412 - DNA, 20 bp, human
gggaccacgtgtgtagaccc

SEQ ID NO: 264413 - DNA, 20 bp, human
gtctacacacgtggtccctg

SEQ ID NO: 264414 - DNA, 20 bp, human
gggcggccgggattcccgtg

SEQ ID NO: 264415 - DNA, 20 bp, human
ggggctcgtggcggaagctc

SEQ ID NO: 264416 - DNA, 20 bp, human
gaaacccggaggacgcgctg

SEQ ID NO: 264417 - DNA, 20 bp, human
gctgcagcccagaaacccgg

SEQ ID NO: 264418 - DNA, 20 bp, human
gcgcccggctggcaccgagg

SEQ ID NO: 264419 - DNA, 20 bp, human
gcgcctgcagcccagaaacc

SEQ ID NO: 264420 - DNA, 20 bp, human
gaggtggaaggagctgccgc

SEQ ID NO: 264421 - DNA, 20 bp, human
gtgccagccgggcgcacagg

SEQ ID NO: 264422 - DNA, 20 bp, human
ggccgggcggccagaggcga

SEQ ID NO: 264423 - DNA, 20 bp, human
gcgggccgcgtgcgtggggt

SEQ ID NO: 264424 - DNA, 20 bp, human
gccgccacagcgcgtcctcc

SEQ ID NO: 264425 - DNA, 20 bp, human
gcgcctgccgcctgtgcgcc

SEQ ID NO: 264426 - DNA, 20 bp, human
gggctgaattctttaaggaa

SEQ ID NO: 264427 - DNA, 20 bp, human
gccacaggctgaattcttta

SEQ ID NO: 264428 - DNA, 20 bp, human
gtgcctgccacccagtgtag

SEQ ID NO: 264429 - DNA, 20 bp, human
gctacaccccacaaatgcta

SEQ ID NO: 264430 - DNA, 20 bp, human
gctgggactctcagggacaa

SEQ ID NO: 264431 - DNA, 20 bp, human
ggtgttctgtctagtttgaa

SEQ ID NO: 264432 - DNA, 20 bp, human
gactagaaaacatgcaaatc

SEQ ID NO: 264433 - DNA, 20 bp, human
gaacttgtagcctctacact

SEQ ID NO: 264434 - DNA, 20 bp, human
gagaaaccttagcatttgtg

SEQ ID NO: 264435 - DNA, 20 bp, human
ggaaaagaaaagacctctag

SEQ ID NO: 264436 - DNA, 20 bp, human
gtccccagcaggctcaaatg

SEQ ID NO: 264437 - DNA, 20 bp, human
gtgagcctgctggggaccgg

SEQ ID NO: 264438 - DNA, 20 bp, human
gcaaatgcggacaggagctt

SEQ ID NO: 264439 - DNA, 20 bp, human
gagcctaggggtgcaggaca

SEQ ID NO: 264440 - DNA, 20 bp, human
gttgaccagtgccagatctg

SEQ ID NO: 264441 - DNA, 20 bp, human
gagtgggtctgttggagccc

SEQ ID NO: 264442 - DNA, 20 bp, human
gagcaggctcaaatgcggac

SEQ ID NO: 264443 - DNA, 20 bp, human
ggggagcttctggatcgtca

SEQ ID NO: 264444 - DNA, 20 bp, human
gtttcaaggagtgggtctgt

SEQ ID NO: 264445 - DNA, 20 bp, human
ggcccatgtcctgcacccct

SEQ ID NO: 264446 - DNA, 20 bp, human
gccgacccacgccgacatct

SEQ ID NO: 264447 - DNA, 20 bp, human
gtttggcacacccgagatgt

SEQ ID NO: 264448 - DNA, 20 bp, human
gcgtgcctggcgctctccaa

SEQ ID NO: 264449 - DNA, 20 bp, human
ggccaggcacgaccctgctg

SEQ ID NO: 264450 - DNA, 20 bp, human
gtaactacaaggcttccctc

SEQ ID NO: 264451 - DNA, 20 bp, human
ggctgtggcttctaactaca

SEQ ID NO: 264452 - DNA, 20 bp, human
ggccacagcagggtcgtgcc

SEQ ID NO: 264453 - DNA, 20 bp, human
gaattcccttggagagcgcc

SEQ ID NO: 264454 - DNA, 20 bp, human
gcacacccgagatgtcggcg

SEQ ID NO: 264455 - DNA, 20 bp, human
gtgtgaggcggctgcttctc

SEQ ID NO: 264456 - DNA, 20 bp, human
gaagaccagaagactgcggc

SEQ ID NO: 264457 - DNA, 20 bp, human
gcccgtcaggcgggcagtca

SEQ ID NO: 264458 - DNA, 20 bp, human
gccttggtgcatcacccgtc

SEQ ID NO: 264459 - DNA, 20 bp, human
gtcccctgaaagcgcgggag

SEQ ID NO: 264460 - DNA, 20 bp, human
ggcacaccgggatactccgc

SEQ ID NO: 264461 - DNA, 20 bp, human
ggccctgactgcccgcctga

SEQ ID NO: 264462 - DNA, 20 bp, human
gacggtgagggacgcctcta

SEQ ID NO: 264463 - DNA, 20 bp, human
gccccacccgcggagtatcc

SEQ ID NO: 264464 - DNA, 20 bp, human
gttctggtcttctggagtag

SEQ ID NO: 264465 - DNA, 20 bp, human
ggagatctacggggatctga

SEQ ID NO: 264466 - DNA, 20 bp, human
gtgtcctagcacaaaggcag

SEQ ID NO: 264467 - DNA, 20 bp, human
gatgtgggatggacactcga

SEQ ID NO: 264468 - DNA, 20 bp, human
ggacactagagggctcccag

SEQ ID NO: 264469 - DNA, 20 bp, human
gaaccccaagttatgtggga

SEQ ID NO: 264470 - DNA, 20 bp, human
gtgtccatcccacataactt

SEQ ID NO: 264471 - DNA, 20 bp, human
gttgcgaacaggacactaga

SEQ ID NO: 264472 - DNA, 20 bp, human
gagaatgtttgctatcttgg

SEQ ID NO: 264473 - DNA, 20 bp, human
ggctctaaccccaagttatg

SEQ ID NO: 264474 - DNA, 20 bp, human
gtctgagtctgtttgcgaac

SEQ ID NO: 264475 - DNA, 20 bp, human
gggcaggggctgatgacctt

SEQ ID NO: 264476 - DNA, 20 bp, human
gccccctgctggaccggagg

SEQ ID NO: 264477 - DNA, 20 bp, human
ggcgcccgcaaggaggggaa

SEQ ID NO: 264478 - DNA, 20 bp, human
gagtacgagtgagaaagcgg

SEQ ID NO: 264479 - DNA, 20 bp, human
gtgcccggcgcccgcaagga

SEQ ID NO: 264480 - DNA, 20 bp, human
gagtctgcccggcgcccgca

SEQ ID NO: 264481 - DNA, 20 bp, human
ggtgccccctgctggaccgg

SEQ ID NO: 264482 - DNA, 20 bp, human
gtcctcctccggtccagcag

SEQ ID NO: 264483 - DNA, 20 bp, human
gagggcggggcgggccgctt

SEQ ID NO: 264484 - DNA, 20 bp, human
ggggccgcttggggccgcgg

SEQ ID NO: 264485 - DNA, 20 bp, human
gtcgagtacgagtgagaaag

SEQ ID NO: 264486 - DNA, 20 bp, human
ggagttgttgaagagttagt

SEQ ID NO: 264487 - DNA, 20 bp, human
gtcactgtagctgtaataga

SEQ ID NO: 264488 - DNA, 20 bp, human
gtactcttttgttaaatcag

SEQ ID NO: 264489 - DNA, 20 bp, human
gtagacttctaacagtaaat

SEQ ID NO: 264490 - DNA, 20 bp, human
gttaaatcagtggtatcagt

SEQ ID NO: 264491 - DNA, 20 bp, human
gacttctaatgtaataaatc

SEQ ID NO: 264492 - DNA, 20 bp, human
gatgtgatactttagagcgg

SEQ ID NO: 264493 - DNA, 20 bp, human
ggacatgtgatactttagag

SEQ ID NO: 264494 - DNA, 20 bp, human
gataaacctgacaatatttg

SEQ ID NO: 264495 - DNA, 20 bp, human
gaaaatactgatagtattag

SEQ ID NO: 264496 - DNA, 20 bp, human
ggcacgccccagagcattat

SEQ ID NO: 264497 - DNA, 20 bp, human
gtgctcctcgggacaagagg

SEQ ID NO: 264498 - DNA, 20 bp, human
ggacgggcggggaccgatgg

SEQ ID NO: 264499 - DNA, 20 bp, human
gggacaagaggaggccccgg

SEQ ID NO: 264500 - DNA, 20 bp, human
ggggtgctcctcgggacaag

SEQ ID NO: 264501 - DNA, 20 bp, human
ggggagcgggggtgctcctc

SEQ ID NO: 264502 - DNA, 20 bp, human
gctggacgggcggggaccga

SEQ ID NO: 264503 - DNA, 20 bp, human
gccccgctcccggtgtcttt

SEQ ID NO: 264504 - DNA, 20 bp, human
gtcgaccggccgactgggag

SEQ ID NO: 264505 - DNA, 20 bp, human
gccaaggcaagatgctggac

SEQ ID NO: 264506 - DNA, 20 bp, human
gaatccggttgaccctctag

SEQ ID NO: 264507 - DNA, 20 bp, human
gctagtaaagcgttctaatc

SEQ ID NO: 264508 - DNA, 20 bp, human
gggactatgtctccctctag

SEQ ID NO: 264509 - DNA, 20 bp, human
gtcaaatgaagggtcttctg

SEQ ID NO: 264510 - DNA, 20 bp, human
gagcaagggctttgcttaat

SEQ ID NO: 264511 - DNA, 20 bp, human
gtaaaagatgaggaggcaac

SEQ ID NO: 264512 - DNA, 20 bp, human
gtaagcaaagcccttgctaa

SEQ ID NO: 264513 - DNA, 20 bp, human
gttctcaaggatttagacgg

SEQ ID NO: 264514 - DNA, 20 bp, human
gtgcatatgagctcaaatga

SEQ ID NO: 264515 - DNA, 20 bp, human
ggtcgtgatattcatgacgc

SEQ ID NO: 264516 - DNA, 20 bp, human
gggcacgtgggagatacctg

SEQ ID NO: 264517 - DNA, 20 bp, human
ggaacctgacagattcctgc

SEQ ID NO: 264518 - DNA, 20 bp, human
gaggtgccatagtgggtagg

SEQ ID NO: 264519 - DNA, 20 bp, human
gtcctgctggaagaggcacg

SEQ ID NO: 264520 - DNA, 20 bp, human
ggtggaagcaaagaggatca

SEQ ID NO: 264521 - DNA, 20 bp, human
ggtgaagcagggtgatggta

SEQ ID NO: 264522 - DNA, 20 bp, human
gcaggaagcaggtgccatag

SEQ ID NO: 264523 - DNA, 20 bp, human
gcccacgtgcctcttccagc

SEQ ID NO: 264524 - DNA, 20 bp, human
gaagaggtgccagttcccag

SEQ ID NO: 264525 - DNA, 20 bp, human
gcctccctttagagaggtga

SEQ ID NO: 264526 - DNA, 20 bp, human
gccgcctgagcaggggtgcg

SEQ ID NO: 264527 - DNA, 20 bp, human
gtctcccgagcgcctcgctg

SEQ ID NO: 264528 - DNA, 20 bp, human
gggggcgcgccgcctgagca

SEQ ID NO: 264529 - DNA, 20 bp, human
gctagcgcgctgaccaggag

SEQ ID NO: 264530 - DNA, 20 bp, human
gccgccccgcacccctgctc

SEQ ID NO: 264531 - DNA, 20 bp, human
gaatgtgctactgcacgggg

SEQ ID NO: 264532 - DNA, 20 bp, human
gctccacgcaggacccaaag

SEQ ID NO: 264533 - DNA, 20 bp, human
ggggagaaggccggcccacg

SEQ ID NO: 264534 - DNA, 20 bp, human
gcctggccccgcggtccacg

SEQ ID NO: 264535 - DNA, 20 bp, human
gccggcccacgtggaccgcg

SEQ ID NO: 264536 - DNA, 20 bp, human
gacgccgagcagcgggcggt

SEQ ID NO: 264537 - DNA, 20 bp, human
gcggcggcggggctgattca

SEQ ID NO: 264538 - DNA, 20 bp, human
ggggctgattcatggggccg

SEQ ID NO: 264539 - DNA, 20 bp, human
gggaaggcgacgccgagcag

SEQ ID NO: 264540 - DNA, 20 bp, human
gcgggccgcggattgcgcaa

SEQ ID NO: 264541 - DNA, 20 bp, human
gctggcgggccggtccccac

SEQ ID NO: 264542 - DNA, 20 bp, human
gagaaagtctcgggccgcgg

SEQ ID NO: 264543 - DNA, 20 bp, human
gggccccctcctccgcctgt

SEQ ID NO: 264544 - DNA, 20 bp, human
gggtggccgagtggtcggag

SEQ ID NO: 264545 - DNA, 20 bp, human
gggcagcccaggggcgcggt

SEQ ID NO: 264546 - DNA, 20 bp, human
gtgcacagggcggggaaaaa

SEQ ID NO: 264547 - DNA, 20 bp, human
gcgctccgaggaggtgcaca

SEQ ID NO: 264548 - DNA, 20 bp, human
gtctgagcagggcggtataa

SEQ ID NO: 264549 - DNA, 20 bp, human
gtgtgtagggctctaatctc

SEQ ID NO: 264550 - DNA, 20 bp, human
ggaggagctgaatgaaacga

SEQ ID NO: 264551 - DNA, 20 bp, human
gcctcggagcggacaagctg

SEQ ID NO: 264552 - DNA, 20 bp, human
gggagcgcagctccggaagg

SEQ ID NO: 264553 - DNA, 20 bp, human
gccgaagcggagcgcagctc

SEQ ID NO: 264554 - DNA, 20 bp, human
ggagctgaatgaaacgaggg

SEQ ID NO: 264555 - DNA, 20 bp, human
gggctctaatctcgggtttg

SEQ ID NO: 264556 - DNA, 20 bp, human
gccccggatgaggaactcgg

SEQ ID NO: 264557 - DNA, 20 bp, human
gagtgcagggtcccgaatga

SEQ ID NO: 264558 - DNA, 20 bp, human
gggaccctgcactccgtcgc

SEQ ID NO: 264559 - DNA, 20 bp, human
ggaccctcatgcctgggcgg

SEQ ID NO: 264560 - DNA, 20 bp, human
ggggctgtctacagcggccc

SEQ ID NO: 264561 - DNA, 20 bp, human
gcatccgggaccctcatccg

SEQ ID NO: 264562 - DNA, 20 bp, human
gcgggaccctcatgcctggg

SEQ ID NO: 264563 - DNA, 20 bp, human
gcctcccctcggtgagtacc

SEQ ID NO: 264564 - DNA, 20 bp, human
gtgtgtaggtgacaggacag

SEQ ID NO: 264565 - DNA, 20 bp, human
gaggagggggggccctcatt

SEQ ID NO: 264566 - DNA, 20 bp, human
gagactgccgacagagcgta

SEQ ID NO: 264567 - DNA, 20 bp, human
gccgacagagcgtagggaag

SEQ ID NO: 264568 - DNA, 20 bp, human
gcgcatgcgtgagaccgggg

SEQ ID NO: 264569 - DNA, 20 bp, human
gagaccggggcggtgtccgg

SEQ ID NO: 264570 - DNA, 20 bp, human
gggcccgcccaccagctcag

SEQ ID NO: 264571 - DNA, 20 bp, human
gagcgcggacagggctagtc

SEQ ID NO: 264572 - DNA, 20 bp, human
gttctccgcggtgtctccta

SEQ ID NO: 264573 - DNA, 20 bp, human
gagcctgcaccgcccgctcc

SEQ ID NO: 264574 - DNA, 20 bp, human
ggggccgatccagttctttt

SEQ ID NO: 264575 - DNA, 20 bp, human
gagggcggtaacgactccct

SEQ ID NO: 264576 - DNA, 20 bp, human
gacaacacagggccccagtg

SEQ ID NO: 264577 - DNA, 20 bp, human
gccccagtggggacctgagg

SEQ ID NO: 264578 - DNA, 20 bp, human
gtgaggaggcagctttggag

SEQ ID NO: 264579 - DNA, 20 bp, human
ggcctcctcaggtccccact

SEQ ID NO: 264580 - DNA, 20 bp, human
gggacctgaggaggcagctt

SEQ ID NO: 264581 - DNA, 20 bp, human
gcagctttggagaggcctct

SEQ ID NO: 264582 - DNA, 20 bp, human
ggccgcgcgcggggagttat

SEQ ID NO: 264583 - DNA, 20 bp, human
gaggctgtcgggtcagagaa

SEQ ID NO: 264584 - DNA, 20 bp, human
gctgtgatgtcccgagccat

SEQ ID NO: 264585 - DNA, 20 bp, human
gaaggggcgggaccggcgtg

SEQ ID NO: 264586 - DNA, 20 bp, human
gacaacacagggccccagtg

SEQ ID NO: 264587 - DNA, 20 bp, human
gccccagtggggacctgagg

SEQ ID NO: 264588 - DNA, 20 bp, human
gtgaggaggcagctttggag

SEQ ID NO: 264589 - DNA, 20 bp, human
ggcctcctcaggtccccact

SEQ ID NO: 264590 - DNA, 20 bp, human
gggacctgaggaggcagctt

SEQ ID NO: 264591 - DNA, 20 bp, human
gcagctttggagaggcctct

SEQ ID NO: 264592 - DNA, 20 bp, human
ggccgcgcgcggggagttat

SEQ ID NO: 264593 - DNA, 20 bp, human
gaggctgtcgggtcagagaa

SEQ ID NO: 264594 - DNA, 20 bp, human
ggggcgggaccggcgtgcgg

SEQ ID NO: 264595 - DNA, 20 bp, human
gaaggggcgggaccggcgtg

SEQ ID NO: 264596 - DNA, 20 bp, human
gagaaggcgcgatgttgacg

SEQ ID NO: 264597 - DNA, 20 bp, human
gccttcgggcggactaaaaa

SEQ ID NO: 264598 - DNA, 20 bp, human
gcccaggaggccggttgcta

SEQ ID NO: 264599 - DNA, 20 bp, human
gcagaacggccccagcccat

SEQ ID NO: 264600 - DNA, 20 bp, human
gttagtccgcccgaaggagg

SEQ ID NO: 264601 - DNA, 20 bp, human
gtgttgacggggtcctaaga

SEQ ID NO: 264602 - DNA, 20 bp, human
gctcctgcgtctcaaccaat

SEQ ID NO: 264603 - DNA, 20 bp, human
gcaacatcgcgccttctcat

SEQ ID NO: 264604 - DNA, 20 bp, human
ggacgcaggagccaatgaga

SEQ ID NO: 264605 - DNA, 20 bp, human
gtggggccgttctggcccta

SEQ ID NO: 264606 - DNA, 20 bp, human
gctcataagaaggggtagat

SEQ ID NO: 264607 - DNA, 20 bp, human
gaggagagagccgaggcatc

SEQ ID NO: 264608 - DNA, 20 bp, human
gaggggtcacctcataagaa

SEQ ID NO: 264609 - DNA, 20 bp, human
ggaaggggtagataggccgg

SEQ ID NO: 264610 - DNA, 20 bp, human
gcatggctgatgtggtaggg

SEQ ID NO: 264611 - DNA, 20 bp, human
gcaaggtggttgtacgtatc

SEQ ID NO: 264612 - DNA, 20 bp, human
ggttgtgaaggagagagccg

SEQ ID NO: 264613 - DNA, 20 bp, human
gtgtacgtatctggtctgtg

SEQ ID NO: 264614 - DNA, 20 bp, human
gaaattcatgtgtgtttctc

SEQ ID NO: 264615 - DNA, 20 bp, human
gaggtgcaggaaggggacca

SEQ ID NO: 264616 - DNA, 20 bp, human
gagggcgcctccatccttgg

SEQ ID NO: 264617 - DNA, 20 bp, human
gcggactgggcgtgctcttc

SEQ ID NO: 264618 - DNA, 20 bp, human
ggagtgacgtcaccaggcgg

SEQ ID NO: 264619 - DNA, 20 bp, human
gcctccgcgcagcccggact

SEQ ID NO: 264620 - DNA, 20 bp, human
gcgggagtgacgtcaccagg

SEQ ID NO: 264621 - DNA, 20 bp, human
gcccaaagcactgtaattgg

SEQ ID NO: 264622 - DNA, 20 bp, human
ggaagcgctggggtcccgga

SEQ ID NO: 264623 - DNA, 20 bp, human
gtgtaggcctggcaccgtag

SEQ ID NO: 264624 - DNA, 20 bp, human
ggcgcgggagtgacgtcacc

SEQ ID NO: 264625 - DNA, 20 bp, human
ggacgcacccattgagtcgc

SEQ ID NO: 264626 - DNA, 20 bp, human
gcagggtcgcgggtgtaggg

SEQ ID NO: 264627 - DNA, 20 bp, human
ggcgcagggtcgcgggtgta

SEQ ID NO: 264628 - DNA, 20 bp, human
gtacccggaagcggctcggg

SEQ ID NO: 264629 - DNA, 20 bp, human
gcaggtgcgtcggtgaaagg

SEQ ID NO: 264630 - DNA, 20 bp, human
gagaaacagaccggaggacg

SEQ ID NO: 264631 - DNA, 20 bp, human
gtcccaggtgcgtcggtgaa

SEQ ID NO: 264632 - DNA, 20 bp, human
gcgccggaagtacccggaag

SEQ ID NO: 264633 - DNA, 20 bp, human
gacccccgcggcagtcgaga

SEQ ID NO: 264634 - DNA, 20 bp, human
gccgcgccacccgcgtcctc

SEQ ID NO: 264635 - DNA, 20 bp, human
gacagaccggaggacgcggg

SEQ ID NO: 264636 - DNA, 20 bp, human
ggcgcccgagcccgccaaaa

SEQ ID NO: 264637 - DNA, 20 bp, human
gaacgtgcgcgcgtcggggc

SEQ ID NO: 264638 - DNA, 20 bp, human
gccgacgcgcgcacgttgag

SEQ ID NO: 264639 - DNA, 20 bp, human
gacgcgcgcacgttgagtgg

SEQ ID NO: 264640 - DNA, 20 bp, human
ggcggcgtcgaggtcctcgc

SEQ ID NO: 264641 - DNA, 20 bp, human
gcgcgggccactccaccaat

SEQ ID NO: 264642 - DNA, 20 bp, human
gtgggcccctggcgatcttc

SEQ ID NO: 264643 - DNA, 20 bp, human
gcgcgcacgttgagtggcgg

SEQ ID NO: 264644 - DNA, 20 bp, human
gaggcagaagaactgcccga

SEQ ID NO: 264645 - DNA, 20 bp, human
gtgcggtcgccccttttggc

SEQ ID NO: 264646 - DNA, 20 bp, human
gcgcccgaaggcgaccacgt

SEQ ID NO: 264647 - DNA, 20 bp, human
gtccgcctcctgtcaagggt

SEQ ID NO: 264648 - DNA, 20 bp, human
gaccacgcgctcgttgggat

SEQ ID NO: 264649 - DNA, 20 bp, human
ggttgccgacccttgacagg

SEQ ID NO: 264650 - DNA, 20 bp, human
ggaggcgtctccctcagaga

SEQ ID NO: 264651 - DNA, 20 bp, human
gggaggcggaagatgccctt

SEQ ID NO: 264652 - DNA, 20 bp, human
ggattggttcccatctctga

SEQ ID NO: 264653 - DNA, 20 bp, human
ggccgcgtggacgctgacct

SEQ ID NO: 264654 - DNA, 20 bp, human
gaccgaggtcagcgtccacg

SEQ ID NO: 264655 - DNA, 20 bp, human
gccacagctcgctcctgatt

SEQ ID NO: 264656 - DNA, 20 bp, human
gtgaggcagaagtgcatgac

SEQ ID NO: 264657 - DNA, 20 bp, human
ggtgaaggctttaggagtta

SEQ ID NO: 264658 - DNA, 20 bp, human
gtgactggtgtcacatgcag

SEQ ID NO: 264659 - DNA, 20 bp, human
gtgacagatttcagtaataa

SEQ ID NO: 264660 - DNA, 20 bp, human
gcagttgtcaccatcaacat

SEQ ID NO: 264661 - DNA, 20 bp, human
gtaataagggccaatgttga

SEQ ID NO: 264662 - DNA, 20 bp, human
gtgtctcatgtgactagcat

SEQ ID NO: 264663 - DNA, 20 bp, human
ggagtaacacagagtatata

SEQ ID NO: 264664 - DNA, 20 bp, human
gagcatcggtcagtcagaca

SEQ ID NO: 264665 - DNA, 20 bp, human
gtgtcacatgcagagggtga

SEQ ID NO: 264666 - DNA, 20 bp, human
ggtcacaggggttgcccggg

SEQ ID NO: 264667 - DNA, 20 bp, human
gcctctcccagcaaagctcc

SEQ ID NO: 264668 - DNA, 20 bp, human
gacagaggttacaggtcaca

SEQ ID NO: 264669 - DNA, 20 bp, human
gagacattgtgatgagcaga

SEQ ID NO: 264670 - DNA, 20 bp, human
gtaggtggctccaaatttgt

SEQ ID NO: 264671 - DNA, 20 bp, human
gacaggtcacaggggttgcc

SEQ ID NO: 264672 - DNA, 20 bp, human
gccaaccctggagctttgct

SEQ ID NO: 264673 - DNA, 20 bp, human
gttagtttgagccacatagg

SEQ ID NO: 264674 - DNA, 20 bp, human
gaaatttggagccacctatg

SEQ ID NO: 264675 - DNA, 20 bp, human
gtgtttagtttgagccacat

SEQ ID NO: 264676 - DNA, 20 bp, human
gcaggggggcggaggtggaa

SEQ ID NO: 264677 - DNA, 20 bp, human
gcgggctagtcccctgtgga

SEQ ID NO: 264678 - DNA, 20 bp, human
gcagcagcagagtcagtagg

SEQ ID NO: 264679 - DNA, 20 bp, human
gccccccccacacactcatt

SEQ ID NO: 264680 - DNA, 20 bp, human
gggaaaaaaagggttttagg

SEQ ID NO: 264681 - DNA, 20 bp, human
ggcagcgccggcttcggatc

SEQ ID NO: 264682 - DNA, 20 bp, human
gctgcccccggcgtccccct

SEQ ID NO: 264683 - DNA, 20 bp, human
gccggcttcggatcgggagt

SEQ ID NO: 264684 - DNA, 20 bp, human
ggccaaatgagtgtgtgggg

SEQ ID NO: 264685 - DNA, 20 bp, human
gaagtgggaggcccgagcga

SEQ ID NO: 264686 - DNA, 20 bp, human
ggacgggcccggtatggaag

SEQ ID NO: 264687 - DNA, 20 bp, human
gtaagcggacgggcccggta

SEQ ID NO: 264688 - DNA, 20 bp, human
gcccagtaggcggcccctac

SEQ ID NO: 264689 - DNA, 20 bp, human
ggtccggagcgggtccggta

SEQ ID NO: 264690 - DNA, 20 bp, human
gcccggtatggaagaggtta

SEQ ID NO: 264691 - DNA, 20 bp, human
gccccggcccggccattccc

SEQ ID NO: 264692 - DNA, 20 bp, human
gccgagggagttaagcggac

SEQ ID NO: 264693 - DNA, 20 bp, human
gaaaaagagaagacggggtg

SEQ ID NO: 264694 - DNA, 20 bp, human
ggtatggaagaggttaaggg

SEQ ID NO: 264695 - DNA, 20 bp, human
gtaaggggggcagtccggag

SEQ ID NO: 264696 - DNA, 20 bp, human
ggccgccgccccacgagtca

SEQ ID NO: 264697 - DNA, 20 bp, human
gtagcgggcccggagctcag

SEQ ID NO: 264698 - DNA, 20 bp, human
ggccccgcgctcctctgggg

SEQ ID NO: 264699 - DNA, 20 bp, human
gcggagctcagaggcgtcgc

SEQ ID NO: 264700 - DNA, 20 bp, human
gcctgcccgcggtttgcaga

SEQ ID NO: 264701 - DNA, 20 bp, human
gcgggcccagccgtgactcg

SEQ ID NO: 264702 - DNA, 20 bp, human
gggcggctccgccaatctgt

SEQ ID NO: 264703 - DNA, 20 bp, human
gccagccgtgactcgtgggg

SEQ ID NO: 264704 - DNA, 20 bp, human
gcgcgtcagcgcccacagat

SEQ ID NO: 264705 - DNA, 20 bp, human
gccagcagctgcggccgagt

SEQ ID NO: 264706 - DNA, 20 bp, human
gcacgtgactctcgcacctc

SEQ ID NO: 264707 - DNA, 20 bp, human
gaagcagacacgcgtggcgc

SEQ ID NO: 264708 - DNA, 20 bp, human
ggagtcacgtggagacggtc

SEQ ID NO: 264709 - DNA, 20 bp, human
gtgcgagagtcacgtggaga

SEQ ID NO: 264710 - DNA, 20 bp, human
ggggactcgtagttccggcg

SEQ ID NO: 264711 - DNA, 20 bp, human
gcgaagtgagcccatgtcag

SEQ ID NO: 264712 - DNA, 20 bp, human
gtgacgtaagcagacacgcg

SEQ ID NO: 264713 - DNA, 20 bp, human
gacgtcgggactcgtagttc

SEQ ID NO: 264714 - DNA, 20 bp, human
gccaaacgcgattctgtttg

SEQ ID NO: 264715 - DNA, 20 bp, human
ggccgcgctaatgacggagg

SEQ ID NO: 264716 - DNA, 20 bp, human
ggagccaaggggatgtgcac

SEQ ID NO: 264717 - DNA, 20 bp, human
ggagctagcgggtgagccaa

SEQ ID NO: 264718 - DNA, 20 bp, human
gaggcctgtgcacatcccct

SEQ ID NO: 264719 - DNA, 20 bp, human
gagctccgctcctcgggagc

SEQ ID NO: 264720 - DNA, 20 bp, human
gcccgctagctccgctcctc

SEQ ID NO: 264721 - DNA, 20 bp, human
gcaggtcttttcagggtctt

SEQ ID NO: 264722 - DNA, 20 bp, human
gcgcgcggcggcgaagccgg

SEQ ID NO: 264723 - DNA, 20 bp, human
gcggcggcgaagccggcggg

SEQ ID NO: 264724 - DNA, 20 bp, human
gacccacccccaaaggggcg

SEQ ID NO: 264725 - DNA, 20 bp, human
ggccggagtccagggctggt

SEQ ID NO: 264726 - DNA, 20 bp, human
ggagcgggagcccgagaaga

SEQ ID NO: 264727 - DNA, 20 bp, human
gcgcgcccgggtagccaaga

SEQ ID NO: 264728 - DNA, 20 bp, human
gcgggagcccgagaagaggg

SEQ ID NO: 264729 - DNA, 20 bp, human
gaagcgtcggggagcccggt

SEQ ID NO: 264730 - DNA, 20 bp, human
gagggaggcgcgcgacgccg

SEQ ID NO: 264731 - DNA, 20 bp, human
gcggtggggaccgagagcga

SEQ ID NO: 264732 - DNA, 20 bp, human
ggggcgagatggggaaagtt

SEQ ID NO: 264733 - DNA, 20 bp, human
gctacccgggcgcgctcccc

SEQ ID NO: 264734 - DNA, 20 bp, human
gaggaggcgcgactgccgag

SEQ ID NO: 264735 - DNA, 20 bp, human
gtcagcgcccaaatcgtcgg

SEQ ID NO: 264736 - DNA, 20 bp, human
gctgccccgtccgggtccga

SEQ ID NO: 264737 - DNA, 20 bp, human
gtcttggcgctagaacccga

SEQ ID NO: 264738 - DNA, 20 bp, human
gcgagggcctggagccgcca

SEQ ID NO: 264739 - DNA, 20 bp, human
gggcctgatcacactggagg

SEQ ID NO: 264740 - DNA, 20 bp, human
ggggccgcggtgattggagg

SEQ ID NO: 264741 - DNA, 20 bp, human
gcagccttcggacccggacg

SEQ ID NO: 264742 - DNA, 20 bp, human
ggcagggccgcggtgattgg

SEQ ID NO: 264743 - DNA, 20 bp, human
gggcctcctccagtgtgatc

SEQ ID NO: 264744 - DNA, 20 bp, human
ggaggcggggcgactagggg

SEQ ID NO: 264745 - DNA, 20 bp, human
ggcgccggagcgaggccagt

SEQ ID NO: 264746 - DNA, 20 bp, human
gggaagggcggggtcataac

SEQ ID NO: 264747 - DNA, 20 bp, human
gctccgccgcggttctgggt

SEQ ID NO: 264748 - DNA, 20 bp, human
gcggctgccagatgtcgggg

SEQ ID NO: 264749 - DNA, 20 bp, human
gttcccacccagaaccgcgg

SEQ ID NO: 264750 - DNA, 20 bp, human
gtccccgtaccggccccgtc

SEQ ID NO: 264751 - DNA, 20 bp, human
ggggtccactcaacagtctg

SEQ ID NO: 264752 - DNA, 20 bp, human
gcccttcccacccagaaccg

SEQ ID NO: 264753 - DNA, 20 bp, human
gcggggtcataactggaagc

SEQ ID NO: 264754 - DNA, 20 bp, human
ggccccgcggccaaaggggg

SEQ ID NO: 264755 - DNA, 20 bp, human
gactggaagccggacggggc

SEQ ID NO: 264756 - DNA, 20 bp, human
gtcccggccgccctgcccat

SEQ ID NO: 264757 - DNA, 20 bp, human
ggggtcctgtgcaaacactg

SEQ ID NO: 264758 - DNA, 20 bp, human
gacagccaatgagaattcag

SEQ ID NO: 264759 - DNA, 20 bp, human
gagccccagtggctgcgccc

SEQ ID NO: 264760 - DNA, 20 bp, human
ggtgtcctcgccagccccag

SEQ ID NO: 264761 - DNA, 20 bp, human
gcgcgcgcggctagccgctg

SEQ ID NO: 264762 - DNA, 20 bp, human
gcctgtgcaaacactgcggt

SEQ ID NO: 264763 - DNA, 20 bp, human
ggggtcacgtgcttcgttgg

SEQ ID NO: 264764 - DNA, 20 bp, human
ggggtagcggtctcagtaac

SEQ ID NO: 264765 - DNA, 20 bp, human
gtcccggccagcgcggcgga

SEQ ID NO: 264766 - DNA, 20 bp, human
gggcggctccgcccagaaga

SEQ ID NO: 264767 - DNA, 20 bp, human
gacaaagaacggcgagaggg

SEQ ID NO: 264768 - DNA, 20 bp, human
gccgcctctcggccctcttc

SEQ ID NO: 264769 - DNA, 20 bp, human
gctctcggccctcttctggg

SEQ ID NO: 264770 - DNA, 20 bp, human
gaaggggaggcggggatctt

SEQ ID NO: 264771 - DNA, 20 bp, human
gccctcttggggctttcctc

SEQ ID NO: 264772 - DNA, 20 bp, human
ggaaaacggaagcacgagac

SEQ ID NO: 264773 - DNA, 20 bp, human
gagatctcgcggtgcttaag

SEQ ID NO: 264774 - DNA, 20 bp, human
ggtggcgccgggggcacggc

SEQ ID NO: 264775 - DNA, 20 bp, human
gactggtgagtcgctgcctg

SEQ ID NO: 264776 - DNA, 20 bp, human
ggcccggaggtcggcgagtc

SEQ ID NO: 264777 - DNA, 20 bp, human
ggcctcggttcgcggacttg

SEQ ID NO: 264778 - DNA, 20 bp, human
gaccgagcgctgtgcgtaaa

SEQ ID NO: 264779 - DNA, 20 bp, human
gcccgagcgccaccggagct

SEQ ID NO: 264780 - DNA, 20 bp, human
ggtgcgtaaaaggaccgctg

SEQ ID NO: 264781 - DNA, 20 bp, human
ggcgtcggggcctcggttcg

SEQ ID NO: 264782 - DNA, 20 bp, human
gaggcgctggacacccctaa

SEQ ID NO: 264783 - DNA, 20 bp, human
gcaccggagctaggagaccg

SEQ ID NO: 264784 - DNA, 20 bp, human
gggccccgacgcgttcttca

SEQ ID NO: 264785 - DNA, 20 bp, human
gagcacctgtcctgcagccg

SEQ ID NO: 264786 - DNA, 20 bp, human
gtgggcaggcggcaagggga

SEQ ID NO: 264787 - DNA, 20 bp, human
gtcacccaggaagggagtgt

SEQ ID NO: 264788 - DNA, 20 bp, human
ggggcctgggcaggcggcaa

SEQ ID NO: 264789 - DNA, 20 bp, human
gtcaactttttgaagggcta

SEQ ID NO: 264790 - DNA, 20 bp, human
gtctccagaaaacatctaaa

SEQ ID NO: 264791 - DNA, 20 bp, human
gttttctggagactgactgt

SEQ ID NO: 264792 - DNA, 20 bp, human
ggaggcgggactaggtccct

SEQ ID NO: 264793 - DNA, 20 bp, human
gcaggccacccagaaaccct

SEQ ID NO: 264794 - DNA, 20 bp, human
gttgagggaagccaccgatg

SEQ ID NO: 264795 - DNA, 20 bp, human
gctaggctcagtcactccat

SEQ ID NO: 264796 - DNA, 20 bp, human
gaaggcccggattgaggagg

SEQ ID NO: 264797 - DNA, 20 bp, human
ggggaaacaaggcgggacta

SEQ ID NO: 264798 - DNA, 20 bp, human
gcaacggagaggcggggcta

SEQ ID NO: 264799 - DNA, 20 bp, human
gagggctcggggtgcggtcg

SEQ ID NO: 264800 - DNA, 20 bp, human
ggcgcgctgcggccatcttg

SEQ ID NO: 264801 - DNA, 20 bp, human
ggcctcggcggcagcaagaa

SEQ ID NO: 264802 - DNA, 20 bp, human
gaatccgagggggcggagca

SEQ ID NO: 264803 - DNA, 20 bp, human
ggcagcaagaaaggcgggac

SEQ ID NO: 264804 - DNA, 20 bp, human
ggggcggagacgagcccgaa

SEQ ID NO: 264805 - DNA, 20 bp, human
gagcggggaacagggagtcg

SEQ ID NO: 264806 - DNA, 20 bp, human
ggctgcctcaggtgaccgtg

SEQ ID NO: 264807 - DNA, 20 bp, human
gaggtcggccgagggagcgg

SEQ ID NO: 264808 - DNA, 20 bp, human
ggaggaggcgggattgggac

SEQ ID NO: 264809 - DNA, 20 bp, human
gaggaagtgacgaccggggt

SEQ ID NO: 264810 - DNA, 20 bp, human
gagagcgagttagtcagcag

SEQ ID NO: 264811 - DNA, 20 bp, human
gggggaggaagtgacgaccg

SEQ ID NO: 264812 - DNA, 20 bp, human
gggccagcgggagcggagta

SEQ ID NO: 264813 - DNA, 20 bp, human
ggggtccccacggtcacctg

SEQ ID NO: 264814 - DNA, 20 bp, human
gagtcagcagaggtcggccg

SEQ ID NO: 264815 - DNA, 20 bp, human
ggcttcgggctggtcgtctc

SEQ ID NO: 264816 - DNA, 20 bp, human
ggaggtgcgaggtcagaagg

SEQ ID NO: 264817 - DNA, 20 bp, human
gggcggggcccgggctacag

SEQ ID NO: 264818 - DNA, 20 bp, human
gtccacagaaggtggaaggt

SEQ ID NO: 264819 - DNA, 20 bp, human
ggggacaagtccacagaagg

SEQ ID NO: 264820 - DNA, 20 bp, human
gaaggggcgaggtttgcagg

SEQ ID NO: 264821 - DNA, 20 bp, human
gcaggcggaggctacagcta

SEQ ID NO: 264822 - DNA, 20 bp, human
gggcggggctcagactgaag

SEQ ID NO: 264823 - DNA, 20 bp, human
gagagccagcggatcctggt

SEQ ID NO: 264824 - DNA, 20 bp, human
ggagctcgagaaattaaacg

SEQ ID NO: 264825 - DNA, 20 bp, human
gaggaggaggggctctgaga

SEQ ID NO: 264826 - DNA, 20 bp, human
gagaggggcagtggagtcgg

SEQ ID NO: 264827 - DNA, 20 bp, human
gggagggcgtagcctgaggg

SEQ ID NO: 264828 - DNA, 20 bp, human
gtacccccttatggaccaat

SEQ ID NO: 264829 - DNA, 20 bp, human
gggaaagcgaccatgctcat

SEQ ID NO: 264830 - DNA, 20 bp, human
gggcgtgtgcctcttggagg

SEQ ID NO: 264831 - DNA, 20 bp, human
gcccggggagggaccgtcgc

SEQ ID NO: 264832 - DNA, 20 bp, human
gccgccgcggcgcgggtggt

SEQ ID NO: 264833 - DNA, 20 bp, human
gcccatcagctggtaggaaa

SEQ ID NO: 264834 - DNA, 20 bp, human
gagaagggcggagcgacctt

SEQ ID NO: 264835 - DNA, 20 bp, human
gaaatggcctgtgagtcaga

SEQ ID NO: 264836 - DNA, 20 bp, human
gcgcgacgcccactgagctc

SEQ ID NO: 264837 - DNA, 20 bp, human
gcgcgaaggctaagggagtg

SEQ ID NO: 264838 - DNA, 20 bp, human
gcgaccccggagttacggtg

SEQ ID NO: 264839 - DNA, 20 bp, human
gacactgcccgaacagcttc

SEQ ID NO: 264840 - DNA, 20 bp, human
ggtcctgagaaaaaagggga

SEQ ID NO: 264841 - DNA, 20 bp, human
gctcccccaccgtaactccg

SEQ ID NO: 264842 - DNA, 20 bp, human
gtggaggcgtagaaagaatg

SEQ ID NO: 264843 - DNA, 20 bp, human
gtgttcgggcagtgtccgaa

SEQ ID NO: 264844 - DNA, 20 bp, human
gtgccccgtagtaggaggtg

SEQ ID NO: 264845 - DNA, 20 bp, human
ggggcgtcgcgcgaaggcta

SEQ ID NO: 264846 - DNA, 20 bp, human
gtcgggggtaacatgcatag

SEQ ID NO: 264847 - DNA, 20 bp, human
ggtgttacatgcagatatcg

SEQ ID NO: 264848 - DNA, 20 bp, human
gtcattgctcaggatgatga

SEQ ID NO: 264849 - DNA, 20 bp, human
gttcctgaatatagaggtat

SEQ ID NO: 264850 - DNA, 20 bp, human
gcatgcctttcttcacttct

SEQ ID NO: 264851 - DNA, 20 bp, human
ggggaacttagcttaaacta

SEQ ID NO: 264852 - DNA, 20 bp, human
gtgcccatacctctatattc

SEQ ID NO: 264853 - DNA, 20 bp, human
gaaggtcaacaaatccatca

SEQ ID NO: 264854 - DNA, 20 bp, human
gcagagattctaaatattaa

SEQ ID NO: 264855 - DNA, 20 bp, human
gggctctagtcttacgccac

SEQ ID NO: 264856 - DNA, 20 bp, human
gggacgcacggggccgccag

SEQ ID NO: 264857 - DNA, 20 bp, human
gcgggcccgcgggacgcacg

SEQ ID NO: 264858 - DNA, 20 bp, human
gcgcacggggccgccagggg

SEQ ID NO: 264859 - DNA, 20 bp, human
ggcggccccgtgcgtcccgc

SEQ ID NO: 264860 - DNA, 20 bp, human
gcaggccaggatggccgagt

SEQ ID NO: 264861 - DNA, 20 bp, human
ggcccaggcgcggagcctct

SEQ ID NO: 264862 - DNA, 20 bp, human
ggagcctctcgggggtcacc

SEQ ID NO: 264863 - DNA, 20 bp, human
gaggctcaggctttcccgcg

SEQ ID NO: 264864 - DNA, 20 bp, human
gggcccaggaaggccgaaga

SEQ ID NO: 264865 - DNA, 20 bp, human
gaggcccactggccatgtcg

SEQ ID NO: 264866 - DNA, 20 bp, human
gcggaccgggaaagtgggag

SEQ ID NO: 264867 - DNA, 20 bp, human
gcaggcggcgtcacgagggg

SEQ ID NO: 264868 - DNA, 20 bp, human
gctgcaggcggcgtcacgag

SEQ ID NO: 264869 - DNA, 20 bp, human
gtacaaggctgcaacttgac

SEQ ID NO: 264870 - DNA, 20 bp, human
ggtccgcggcgttacttaca

SEQ ID NO: 264871 - DNA, 20 bp, human
ggctaccctgcgctcccggg

SEQ ID NO: 264872 - DNA, 20 bp, human
gggcggggcggaggctcgct

SEQ ID NO: 264873 - DNA, 20 bp, human
gttacaagaaggctgcgttc

SEQ ID NO: 264874 - DNA, 20 bp, human
ggacaaggactcgaggagca

SEQ ID NO: 264875 - DNA, 20 bp, human
ggccgtcggaagatgaggca

SEQ ID NO: 264876 - DNA, 20 bp, human
gggcgctgcggcggtccctg

SEQ ID NO: 264877 - DNA, 20 bp, human
gggcgtccgcgtagtgtcgg

SEQ ID NO: 264878 - DNA, 20 bp, human
gcccgccttccgccgttcgc

SEQ ID NO: 264879 - DNA, 20 bp, human
gccgcagcgcctccggcgaa

SEQ ID NO: 264880 - DNA, 20 bp, human
gcagcgcctccggcgaacgg

SEQ ID NO: 264881 - DNA, 20 bp, human
gtccggcgaacggcggaagg

SEQ ID NO: 264882 - DNA, 20 bp, human
ggcagagttgcgacgctcgg

SEQ ID NO: 264883 - DNA, 20 bp, human
gcgacgctcggcggcatagg

SEQ ID NO: 264884 - DNA, 20 bp, human
gcgctcggcggcataggggg

SEQ ID NO: 264885 - DNA, 20 bp, human
ggcacctggcgcggattgga

SEQ ID NO: 264886 - DNA, 20 bp, human
gaggctgggcgagtccgtag

SEQ ID NO: 264887 - DNA, 20 bp, human
gagaacacaaggctctcaag

SEQ ID NO: 264888 - DNA, 20 bp, human
ggagaaacgctgcagtgctt

SEQ ID NO: 264889 - DNA, 20 bp, human
ggcactgcagcgtttctccc

SEQ ID NO: 264890 - DNA, 20 bp, human
gacggactcgcccagcctcc

SEQ ID NO: 264891 - DNA, 20 bp, human
ggccgctccgacttccgcta

SEQ ID NO: 264892 - DNA, 20 bp, human
gcctacctgtgccagactga

SEQ ID NO: 264893 - DNA, 20 bp, human
gagtctggcacaggtagggt

SEQ ID NO: 264894 - DNA, 20 bp, human
ggtctctgggcttcgacttc

SEQ ID NO: 264895 - DNA, 20 bp, human
gcgaagcccagagacggtgc

SEQ ID NO: 264896 - DNA, 20 bp, human
gggaactcccgcatgtgggt

SEQ ID NO: 264897 - DNA, 20 bp, human
gcccagccggcccggaaagg

SEQ ID NO: 264898 - DNA, 20 bp, human
ggcccagctgtgattcctga

SEQ ID NO: 264899 - DNA, 20 bp, human
gagccaaggcgcaggcgctt

SEQ ID NO: 264900 - DNA, 20 bp, human
ggcgcccagccggcccggaa

SEQ ID NO: 264901 - DNA, 20 bp, human
ggcacggggacccacaacga

SEQ ID NO: 264902 - DNA, 20 bp, human
gagccggcccggaaaggagg

SEQ ID NO: 264903 - DNA, 20 bp, human
gcattcggaactcccgcatg

SEQ ID NO: 264904 - DNA, 20 bp, human
gggaggcgaggcaagacctg

SEQ ID NO: 264905 - DNA, 20 bp, human
gggtaaccgcgtcagggagt

SEQ ID NO: 264906 - DNA, 20 bp, human
ggtccccccgaaaagaaggg

SEQ ID NO: 264907 - DNA, 20 bp, human
ggaaccggagagctccgaaa

SEQ ID NO: 264908 - DNA, 20 bp, human
gggcgcaggtagtccccttt

SEQ ID NO: 264909 - DNA, 20 bp, human
gcccgtggcgaaagagtgac

SEQ ID NO: 264910 - DNA, 20 bp, human
gccggtccccccgaaaagaa

SEQ ID NO: 264911 - DNA, 20 bp, human
ggttccgcccttcttttcgg

SEQ ID NO: 264912 - DNA, 20 bp, human
gggctcttttaacaagatgg

SEQ ID NO: 264913 - DNA, 20 bp, human
gtgaccggccgagggagagg

SEQ ID NO: 264914 - DNA, 20 bp, human
gaaagaagggcggaacattt

SEQ ID NO: 264915 - DNA, 20 bp, human
gagtcctcagactaccgaac

SEQ ID NO: 264916 - DNA, 20 bp, human
gcgggtggcgctgcccccca

SEQ ID NO: 264917 - DNA, 20 bp, human
ggaactggcggccggtgctg

SEQ ID NO: 264918 - DNA, 20 bp, human
gtcggcgggtctggaaagag

SEQ ID NO: 264919 - DNA, 20 bp, human
ggcgggatcggccacagcac

SEQ ID NO: 264920 - DNA, 20 bp, human
gcagaggcgggttggccggg

SEQ ID NO: 264921 - DNA, 20 bp, human
gctgcagaggcgggttggcc

SEQ ID NO: 264922 - DNA, 20 bp, human
ggccgctgcctcgggccttg

SEQ ID NO: 264923 - DNA, 20 bp, human
gtggactgggactggagttt

SEQ ID NO: 264924 - DNA, 20 bp, human
ggacgccaggaacgctgcag

SEQ ID NO: 264925 - DNA, 20 bp, human
ggcggaggaagctggaggat

SEQ ID NO: 264926 - DNA, 20 bp, human
gaacgctgcagaggcgggtt

SEQ ID NO: 264927 - DNA, 20 bp, human
ggcagaggcgggttgggcgg

SEQ ID NO: 264928 - DNA, 20 bp, human
gcggggggcgctgccgccca

SEQ ID NO: 264929 - DNA, 20 bp, human
ggcttgtccttgaacttgag

SEQ ID NO: 264930 - DNA, 20 bp, human
ggatccgacctgcgatgctg

SEQ ID NO: 264931 - DNA, 20 bp, human
gtcccctcagcatcgcaggt

SEQ ID NO: 264932 - DNA, 20 bp, human
ggaactggcggccggtgctt

SEQ ID NO: 264933 - DNA, 20 bp, human
gttcctcccctcagcatcgc

SEQ ID NO: 264934 - DNA, 20 bp, human
ggctgcagaggcgggttggg

SEQ ID NO: 264935 - DNA, 20 bp, human
ggcgggatcggccaaagcac

SEQ ID NO: 264936 - DNA, 20 bp, human
gaggcgatggacggtagcga

SEQ ID NO: 264937 - DNA, 20 bp, human
ggtggcaagggcgtgtccag

SEQ ID NO: 264938 - DNA, 20 bp, human
ggacaaagggaggcgatgga

SEQ ID NO: 264939 - DNA, 20 bp, human
gaggtaagacgcgcatgcgc

SEQ ID NO: 264940 - DNA, 20 bp, human
gagacgcgcatgcgcgggag

SEQ ID NO: 264941 - DNA, 20 bp, human
gtggctggctttgtgacgtc

SEQ ID NO: 264942 - DNA, 20 bp, human
ggcaagggcgtgtccagggg

SEQ ID NO: 264943 - DNA, 20 bp, human
gtgcgcggccaggctggtac

SEQ ID NO: 264944 - DNA, 20 bp, human
gtacaggcggctgctcgcgg

SEQ ID NO: 264945 - DNA, 20 bp, human
gctcaccagtagggggcgga

SEQ ID NO: 264946 - DNA, 20 bp, human
gggcgccaggcaccagaacc

SEQ ID NO: 264947 - DNA, 20 bp, human
gagggggcgcggtaccggga

SEQ ID NO: 264948 - DNA, 20 bp, human
gtggcgccggcagccagtag

SEQ ID NO: 264949 - DNA, 20 bp, human
gcttgcggagatccgggttc

SEQ ID NO: 264950 - DNA, 20 bp, human
gataacaggcgcatagaaaa

SEQ ID NO: 264951 - DNA, 20 bp, human
ggctgcgcttgcggagatcc

SEQ ID NO: 264952 - DNA, 20 bp, human
gtggcgcgaggctgcgcttg

SEQ ID NO: 264953 - DNA, 20 bp, human
gcggcaaactgcactccatg

SEQ ID NO: 264954 - DNA, 20 bp, human
ggactcgccggtccagggaa

SEQ ID NO: 264955 - DNA, 20 bp, human
ggcgggagggggcgcggtac

SEQ ID NO: 264956 - DNA, 20 bp, human
gaagcccagcaggactaagt

SEQ ID NO: 264957 - DNA, 20 bp, human
gcgcccccgccctactctat

SEQ ID NO: 264958 - DNA, 20 bp, human
gacaccggaggccacccccc

SEQ ID NO: 264959 - DNA, 20 bp, human
gccaaggcggggattgggat

SEQ ID NO: 264960 - DNA, 20 bp, human
gggcggcctcgacttgacgt

SEQ ID NO: 264961 - DNA, 20 bp, human
ggacctcgggctctgtgctt

SEQ ID NO: 264962 - DNA, 20 bp, human
gcgcggggcctggttatcgc

SEQ ID NO: 264963 - DNA, 20 bp, human
ggcagggtctcgggtagctg

SEQ ID NO: 264964 - DNA, 20 bp, human
gttcaggcctgggcgactcc

SEQ ID NO: 264965 - DNA, 20 bp, human
gcccgggcccgcgaggacac

SEQ ID NO: 264966 - DNA, 20 bp, human
ggcggcaccgcgtcctgcga

SEQ ID NO: 264967 - DNA, 20 bp, human
gccgcctcgtccctgcttgg

SEQ ID NO: 264968 - DNA, 20 bp, human
gcaacctcctcccccaagca

SEQ ID NO: 264969 - DNA, 20 bp, human
gcctcccccaagcagggacg

SEQ ID NO: 264970 - DNA, 20 bp, human
gcaccgcgtcctgcgagggg

SEQ ID NO: 264971 - DNA, 20 bp, human
ggggtggaggggccccgact

SEQ ID NO: 264972 - DNA, 20 bp, human
gggctgagaggcggttacca

SEQ ID NO: 264973 - DNA, 20 bp, human
ggggcccctccacccggcgc

SEQ ID NO: 264974 - DNA, 20 bp, human
ggggagttgcagtcctcgcg

SEQ ID NO: 264975 - DNA, 20 bp, human
gccgccacgcgcgcttttcg

SEQ ID NO: 264976 - DNA, 20 bp, human
gaggaagacgcccccggcag

SEQ ID NO: 264977 - DNA, 20 bp, human
gcccaggggtccagaccatc

SEQ ID NO: 264978 - DNA, 20 bp, human
gggaagagccagtaagtctg

SEQ ID NO: 264979 - DNA, 20 bp, human
gactccagaggcgtaccctg

SEQ ID NO: 264980 - DNA, 20 bp, human
gcaggcgcgtgcggcccgaa

SEQ ID NO: 264981 - DNA, 20 bp, human
gtggacccctgggtctctag

SEQ ID NO: 264982 - DNA, 20 bp, human
gatgtccactagagacccag

SEQ ID NO: 264983 - DNA, 20 bp, human
gctctagtggacatgggagc

SEQ ID NO: 264984 - DNA, 20 bp, human
gctgcctcagggtacgcctc

SEQ ID NO: 264985 - DNA, 20 bp, human
ggcactgaggaagacgcccc

SEQ ID NO: 264986 - DNA, 20 bp, human
gggtagcgggcctatcccgg

SEQ ID NO: 264987 - DNA, 20 bp, human
gccaactggggaggcccaca

SEQ ID NO: 264988 - DNA, 20 bp, human
ggccaaacagccaactgggg

SEQ ID NO: 264989 - DNA, 20 bp, human
gggaggtcagccaccgggat

SEQ ID NO: 264990 - DNA, 20 bp, human
ggggggcagcgctaacaaag

SEQ ID NO: 264991 - DNA, 20 bp, human
gtaggggccgggagagatgg

SEQ ID NO: 264992 - DNA, 20 bp, human
gactcgccaaacagccaact

SEQ ID NO: 264993 - DNA, 20 bp, human
gaacaaagaggagccgagtc

SEQ ID NO: 264994 - DNA, 20 bp, human
ggggccgggtccgcgggtag

SEQ ID NO: 264995 - DNA, 20 bp, human
ggggataggcccgctacccg

SEQ ID NO: 264996 - DNA, 20 bp, human
gaaaggggtaaccggcgcgg

SEQ ID NO: 264997 - DNA, 20 bp, human
gaccaatgtgtcagtggaga

SEQ ID NO: 264998 - DNA, 20 bp, human
gggtgggtcaaggtaactct

SEQ ID NO: 264999 - DNA, 20 bp, human
gaggaaaggggtaaccggcg

SEQ ID NO: 265000 - DNA, 20 bp, human
ggcccagaccaatgtgtcag

SEQ ID NO: 265001 - DNA, 20 bp, human
gcggttacccctttcctcgg

SEQ ID NO: 265002 - DNA, 20 bp, human
gcatgcgcgtggcgggcagg

SEQ ID NO: 265003 - DNA, 20 bp, human
gcgcccggcctctaccaccg

SEQ ID NO: 265004 - DNA, 20 bp, human
gaaactccgtgaatcacctc

SEQ ID NO: 265005 - DNA, 20 bp, human
gtccactgacacattggtct

SEQ ID NO: 265006 - DNA, 20 bp, human
gcaacaggctgggacgacag

SEQ ID NO: 265007 - DNA, 20 bp, human
gggcgcggggacctccacca

SEQ ID NO: 265008 - DNA, 20 bp, human
gtcccgcggccgcacctctg

SEQ ID NO: 265009 - DNA, 20 bp, human
ggcggcttaagcaacaggct

SEQ ID NO: 265010 - DNA, 20 bp, human
gcgagcccgagccacgcgcc

SEQ ID NO: 265011 - DNA, 20 bp, human
gctttccgggagacaccaga

SEQ ID NO: 265012 - DNA, 20 bp, human
gcaggctgggacgacagcgg

SEQ ID NO: 265013 - DNA, 20 bp, human
ggagctgttcgaggactcgc

SEQ ID NO: 265014 - DNA, 20 bp, human
ggtgtcgcacttctcccgag

SEQ ID NO: 265015 - DNA, 20 bp, human
ggacaccgccgctgattgag

SEQ ID NO: 265016 - DNA, 20 bp, human
gcccccgagacagacgtgga

SEQ ID NO: 265017 - DNA, 20 bp, human
gcgaagtcccgggaaaagga

SEQ ID NO: 265018 - DNA, 20 bp, human
ggcggtgacaccgacttccc

SEQ ID NO: 265019 - DNA, 20 bp, human
gggcgcccccgagacagacg

SEQ ID NO: 265020 - DNA, 20 bp, human
gcatgcgccacgccagatcc

SEQ ID NO: 265021 - DNA, 20 bp, human
gagacgtggagggagggcga

SEQ ID NO: 265022 - DNA, 20 bp, human
gctccctccacgtctgtctc

SEQ ID NO: 265023 - DNA, 20 bp, human
gacggtgacgccgaagtccc

SEQ ID NO: 265024 - DNA, 20 bp, human
gcctcgataaaagtccagaa

SEQ ID NO: 265025 - DNA, 20 bp, human
gtaaaagtccagaagggcgg

SEQ ID NO: 265026 - DNA, 20 bp, human
gaacggacgcggttgcgggt

SEQ ID NO: 265027 - DNA, 20 bp, human
gacccgaccgtcaacggacg

SEQ ID NO: 265028 - DNA, 20 bp, human
gaggcccaaaggggattggg

SEQ ID NO: 265029 - DNA, 20 bp, human
gccaaggacccgaccgtcaa

SEQ ID NO: 265030 - DNA, 20 bp, human
gccgcaaccgcgtccgttga

SEQ ID NO: 265031 - DNA, 20 bp, human
gtgggtggcggcggcaggat

SEQ ID NO: 265032 - DNA, 20 bp, human
gaaccgcgtccgttgacggt

SEQ ID NO: 265033 - DNA, 20 bp, human
ggggcggcggctctaggtgg

SEQ ID NO: 265034 - DNA, 20 bp, human
ggacggcttcaggcccaaag

SEQ ID NO: 265035 - DNA, 20 bp, human
gcggtcgggtccttggtcgc

SEQ ID NO: 265036 - DNA, 20 bp, human
ggcctcgcggcgggttgccc

SEQ ID NO: 265037 - DNA, 20 bp, human
gctcggcggtgacttaatcc

SEQ ID NO: 265038 - DNA, 20 bp, human
gagaccccggacacccgagg

SEQ ID NO: 265039 - DNA, 20 bp, human
gcgcccccctcgggtgtccg

SEQ ID NO: 265040 - DNA, 20 bp, human
gtcagcgcgggccagaatcg

SEQ ID NO: 265041 - DNA, 20 bp, human
gccgccgcgtctgtgtggac

SEQ ID NO: 265042 - DNA, 20 bp, human
gaccccgtctccaggcgcca

SEQ ID NO: 265043 - DNA, 20 bp, human
gcgtggacgccgcctcgcgg

SEQ ID NO: 265044 - DNA, 20 bp, human
gggccagaatcggggactgg

SEQ ID NO: 265045 - DNA, 20 bp, human
gccgagcccgcccccgtgcc

SEQ ID NO: 265046 - DNA, 20 bp, human
gacccagtcggtggtcgtac

SEQ ID NO: 265047 - DNA, 20 bp, human
ggcggcagtagcgtgactta

SEQ ID NO: 265048 - DNA, 20 bp, human
gaccaccatgacccagtcgg

SEQ ID NO: 265049 - DNA, 20 bp, human
gaccctgtacgaccaccgac

SEQ ID NO: 265050 - DNA, 20 bp, human
gaccaccgactgggtcatgg

SEQ ID NO: 265051 - DNA, 20 bp, human
gcacttgcgcggccttctga

SEQ ID NO: 265052 - DNA, 20 bp, human
gagcagagcgccgttgctgg

SEQ ID NO: 265053 - DNA, 20 bp, human
gccgcgggctagcaagctcc

SEQ ID NO: 265054 - DNA, 20 bp, human
gagggtaagctacgccgggc

SEQ ID NO: 265055 - DNA, 20 bp, human
gggtcatggtggtgcgccgc

SEQ ID NO: 265056 - DNA, 20 bp, human
ggtggcatgaatgtcagaat

SEQ ID NO: 265057 - DNA, 20 bp, human
ggctgtgtgacatcagctct

SEQ ID NO: 265058 - DNA, 20 bp, human
gctaagtctttcaccttttc

SEQ ID NO: 265059 - DNA, 20 bp, human
gcaggatatctgttctagtc

SEQ ID NO: 265060 - DNA, 20 bp, human
ggtgcttgaatcctagtaaa

SEQ ID NO: 265061 - DNA, 20 bp, human
gacaaaaatgaaagttgaac

SEQ ID NO: 265062 - DNA, 20 bp, human
gtaatatggagccgtttact

SEQ ID NO: 265063 - DNA, 20 bp, human
gacacaatcttccttgaacc

SEQ ID NO: 265064 - DNA, 20 bp, human
gtctggtttgtatgatttta

SEQ ID NO: 265065 - DNA, 20 bp, human
gttaattttactacactggc

SEQ ID NO: 265066 - DNA, 20 bp, human
gaacgcctctcgagtccagt

SEQ ID NO: 265067 - DNA, 20 bp, human
ggggcaggcagagcgactcc

SEQ ID NO: 265068 - DNA, 20 bp, human
gtaagccaactggactcgag

SEQ ID NO: 265069 - DNA, 20 bp, human
gcgggcgcagacacgagccc

SEQ ID NO: 265070 - DNA, 20 bp, human
gaggcggcgcagtggacacg

SEQ ID NO: 265071 - DNA, 20 bp, human
gctggccgacacttaagcac

SEQ ID NO: 265072 - DNA, 20 bp, human
gctcaggaagcgctaaagag

SEQ ID NO: 265073 - DNA, 20 bp, human
gaggcgttcaaactttgctc

SEQ ID NO: 265074 - DNA, 20 bp, human
gcgcatgcgcataagccaac

SEQ ID NO: 265075 - DNA, 20 bp, human
ggcctgcgcatggtctccaa

SEQ ID NO: 265076 - DNA, 20 bp, human
ggggaagttttggtctcggg

SEQ ID NO: 265077 - DNA, 20 bp, human
ggcttgggaagttttggtct

SEQ ID NO: 265078 - DNA, 20 bp, human
ggccccaccctgtcccatag

SEQ ID NO: 265079 - DNA, 20 bp, human
gttgtggcctctatgggaca

SEQ ID NO: 265080 - DNA, 20 bp, human
ggagcagtttgtggcctcta

SEQ ID NO: 265081 - DNA, 20 bp, human
gggacagggtggggcgttca

SEQ ID NO: 265082 - DNA, 20 bp, human
ggcctctatgggacagggtg

SEQ ID NO: 265083 - DNA, 20 bp, human
gctgcagagccagggtctcc

SEQ ID NO: 265084 - DNA, 20 bp, human
gtctcggggggctggcactc

SEQ ID NO: 265085 - DNA, 20 bp, human
gaaactgctctgcagagcca

SEQ ID NO: 265086 - DNA, 20 bp, human
gttgagagacatggttttac

SEQ ID NO: 265087 - DNA, 20 bp, human
gttggaaattaacctgaggc

SEQ ID NO: 265088 - DNA, 20 bp, human
gggctttggaaattaacctg

SEQ ID NO: 265089 - DNA, 20 bp, human
ggacatggttttactggatg

SEQ ID NO: 265090 - DNA, 20 bp, human
gcagggccaaggggcttcag

SEQ ID NO: 265091 - DNA, 20 bp, human
ggacgtataggtccattgtg

SEQ ID NO: 265092 - DNA, 20 bp, human
gcgtccctggacatccaagg

SEQ ID NO: 265093 - DNA, 20 bp, human
gtggatgtccagggacgtat

SEQ ID NO: 265094 - DNA, 20 bp, human
ggacatccaaggtggggctc

SEQ ID NO: 265095 - DNA, 20 bp, human
gctcatgccccctgagtcca

SEQ ID NO: 265096 - DNA, 20 bp, human
gagggaaccaagaggtggaa

SEQ ID NO: 265097 - DNA, 20 bp, human
gggggccattgccagtgtgg

SEQ ID NO: 265098 - DNA, 20 bp, human
gttgagagacatggttttac

SEQ ID NO: 265099 - DNA, 20 bp, human
ggcagagaattccctcttgt

SEQ ID NO: 265100 - DNA, 20 bp, human
ggagaattccctcttgttgg

SEQ ID NO: 265101 - DNA, 20 bp, human
gttggaaattaacctgaggc

SEQ ID NO: 265102 - DNA, 20 bp, human
gcagggggccattgccagtg

SEQ ID NO: 265103 - DNA, 20 bp, human
gggctttggaaattaacctg

SEQ ID NO: 265104 - DNA, 20 bp, human
gtgggggcaacaaagtcccg

SEQ ID NO: 265105 - DNA, 20 bp, human
ggacatggttttactggatg

SEQ ID NO: 265106 - DNA, 20 bp, human
gtggaatgttgtgttgtgtt

SEQ ID NO: 265107 - DNA, 20 bp, human
gtcaataggctcttacaatt

SEQ ID NO: 265108 - DNA, 20 bp, human
gtagttgttgagggattaca

SEQ ID NO: 265109 - DNA, 20 bp, human
ggagttagcctttgaaaaac

SEQ ID NO: 265110 - DNA, 20 bp, human
gtatacggtgttttaccctt

SEQ ID NO: 265111 - DNA, 20 bp, human
ggttgagaatgaggcatata

SEQ ID NO: 265112 - DNA, 20 bp, human
gacaacattccagagaaggc

SEQ ID NO: 265113 - DNA, 20 bp, human
gttaagacatcttacaattt

SEQ ID NO: 265114 - DNA, 20 bp, human
gaatctatctgccatatttc

SEQ ID NO: 265115 - DNA, 20 bp, human
gattcaattcctgtttacca

SEQ ID NO: 265116 - DNA, 20 bp, human
ggcctcctactggtggaaat

SEQ ID NO: 265117 - DNA, 20 bp, human
gggaaacaatgtcattcctt

SEQ ID NO: 265118 - DNA, 20 bp, human
gcccaatttccaccagtagg

SEQ ID NO: 265119 - DNA, 20 bp, human
gcagcccaatttccaccagt

SEQ ID NO: 265120 - DNA, 20 bp, human
ggaagaaagagctccaccct

SEQ ID NO: 265121 - DNA, 20 bp, human
ggctgctctgccaataacaa

SEQ ID NO: 265122 - DNA, 20 bp, human
gagataatgcctcctactgg

SEQ ID NO: 265123 - DNA, 20 bp, human
ggactgaattgagccagata

SEQ ID NO: 265124 - DNA, 20 bp, human
gagaataaattcaaagtgca

SEQ ID NO: 265125 - DNA, 20 bp, human
gcttccaaatctcaagtcat

SEQ ID NO: 265126 - DNA, 20 bp, human
gcccccggggcgtcgcgcac

SEQ ID NO: 265127 - DNA, 20 bp, human
gggcctgtgcgcgacgcccc

SEQ ID NO: 265128 - DNA, 20 bp, human
gccgcctggaacctgcccta

SEQ ID NO: 265129 - DNA, 20 bp, human
ggacaagcaggacaacgaag

SEQ ID NO: 265130 - DNA, 20 bp, human
gaccacagcgccttgggcta

SEQ ID NO: 265131 - DNA, 20 bp, human
gccagagaagtcaaggtcct

SEQ ID NO: 265132 - DNA, 20 bp, human
gcgaagaggcagaaggatct

SEQ ID NO: 265133 - DNA, 20 bp, human
gctcatggagaagtttcggg

SEQ ID NO: 265134 - DNA, 20 bp, human
gtccccgcccgccgtcagca

SEQ ID NO: 265135 - DNA, 20 bp, human
gcgcgacgccccgggggacg

SEQ ID NO: 265136 - DNA, 20 bp, human
gcgtggcttgggtcaggcac

SEQ ID NO: 265137 - DNA, 20 bp, human
gaggggaaacgtggagaaga

SEQ ID NO: 265138 - DNA, 20 bp, human
gtccctgcctgagacacgaa

SEQ ID NO: 265139 - DNA, 20 bp, human
ggcaatccacccaccatgag

SEQ ID NO: 265140 - DNA, 20 bp, human
gagcgctaggcgaccatgac

SEQ ID NO: 265141 - DNA, 20 bp, human
gtggccttgtcttccaggaa

SEQ ID NO: 265142 - DNA, 20 bp, human
gcaagggagtcagtccaccc

SEQ ID NO: 265143 - DNA, 20 bp, human
gccacgtttcccctcatggt

SEQ ID NO: 265144 - DNA, 20 bp, human
gaatgagacaggaagtgcag

SEQ ID NO: 265145 - DNA, 20 bp, human
ggtcgcctagcgctcattct

SEQ ID NO: 265146 - DNA, 20 bp, human
ggcagcagataggaatcgaa

SEQ ID NO: 265147 - DNA, 20 bp, human
gcacacttccgggtagtggg

SEQ ID NO: 265148 - DNA, 20 bp, human
gcggaagtgggcgccaaatt

SEQ ID NO: 265149 - DNA, 20 bp, human
gtggacccgggccacacttc

SEQ ID NO: 265150 - DNA, 20 bp, human
gctacccggaagtgtggccc

SEQ ID NO: 265151 - DNA, 20 bp, human
gcgaagggcactcattcgct

SEQ ID NO: 265152 - DNA, 20 bp, human
gagaagcgaggcggccattc

SEQ ID NO: 265153 - DNA, 20 bp, human
gaaacgctcaaaaaggggtt

SEQ ID NO: 265154 - DNA, 20 bp, human
gggcgccaaattcggaagtg

SEQ ID NO: 265155 - DNA, 20 bp, human
gtgcgcaaaacgctcaaaaa

SEQ ID NO: 265156 - DNA, 20 bp, human
gctcgcgcgccagtggggaa

SEQ ID NO: 265157 - DNA, 20 bp, human
gcctccccgggcctcgctgg

SEQ ID NO: 265158 - DNA, 20 bp, human
gaggacggacttcggggaca

SEQ ID NO: 265159 - DNA, 20 bp, human
ggggcgctcgccacctaacg

SEQ ID NO: 265160 - DNA, 20 bp, human
gggaggggaacggacgggag

SEQ ID NO: 265161 - DNA, 20 bp, human
gggcgagcgcccgaggggag

SEQ ID NO: 265162 - DNA, 20 bp, human
ggcacgctcgcgcgccagtg

SEQ ID NO: 265163 - DNA, 20 bp, human
ggggaggaagggtcccgcgc

SEQ ID NO: 265164 - DNA, 20 bp, human
gcgcgcccccgacgccccgc

SEQ ID NO: 265165 - DNA, 20 bp, human
gagagtggaggggaacggac

SEQ ID NO: 265166 - DNA, 20 bp, human
gtgaacgcaccgcggaggtg

SEQ ID NO: 265167 - DNA, 20 bp, human
gccgacgagggatccagggg

SEQ ID NO: 265168 - DNA, 20 bp, human
gggggccgacgagggatcca

SEQ ID NO: 265169 - DNA, 20 bp, human
gcagcctgaacgcaccgcgg

SEQ ID NO: 265170 - DNA, 20 bp, human
gaacccaccggccgccgagt

SEQ ID NO: 265171 - DNA, 20 bp, human
ggcggaggtggggccgacga

SEQ ID NO: 265172 - DNA, 20 bp, human
gcaggggcgggacaggttcg

SEQ ID NO: 265173 - DNA, 20 bp, human
ggagtgggaggggcccacgt

SEQ ID NO: 265174 - DNA, 20 bp, human
gccacccgagaaagggccga

SEQ ID NO: 265175 - DNA, 20 bp, human
ggctggccgccgcatgggag

SEQ ID NO: 265176 - DNA, 20 bp, human
gggtcagcccggcggggaac

SEQ ID NO: 265177 - DNA, 20 bp, human
gtccccgccgggctgacccc

SEQ ID NO: 265178 - DNA, 20 bp, human
ggggtggacccgttccccgc

SEQ ID NO: 265179 - DNA, 20 bp, human
gctctgaggtcgctggcgga

SEQ ID NO: 265180 - DNA, 20 bp, human
ggcccggggtcagcccggcg

SEQ ID NO: 265181 - DNA, 20 bp, human
gtgaggtcgctggcggaggg

SEQ ID NO: 265182 - DNA, 20 bp, human
gcaaatggcaggtgcggacc

SEQ ID NO: 265183 - DNA, 20 bp, human
gctcttgggagacattaact

SEQ ID NO: 265184 - DNA, 20 bp, human
gccagcaaggttggctctga

SEQ ID NO: 265185 - DNA, 20 bp, human
gtggacggcgaacttggact

SEQ ID NO: 265186 - DNA, 20 bp, human
ggtaaacggtggggagacgg

SEQ ID NO: 265187 - DNA, 20 bp, human
ggccgggtggcactacggga

SEQ ID NO: 265188 - DNA, 20 bp, human
gggaagggccggagagcgga

SEQ ID NO: 265189 - DNA, 20 bp, human
gtggcggtggaggaccaagc

SEQ ID NO: 265190 - DNA, 20 bp, human
gcgtgtaaacggtggggaga

SEQ ID NO: 265191 - DNA, 20 bp, human
gggcctcctcccacgcttcc

SEQ ID NO: 265192 - DNA, 20 bp, human
gccgtagtgccacccggcgc

SEQ ID NO: 265193 - DNA, 20 bp, human
gggcgggggcccattggtcg

SEQ ID NO: 265194 - DNA, 20 bp, human
gcttcccggccgcgaccaat

SEQ ID NO: 265195 - DNA, 20 bp, human
gaccaatgggcccccgccgc

SEQ ID NO: 265196 - DNA, 20 bp, human
gctggctaggtaagcatcca

SEQ ID NO: 265197 - DNA, 20 bp, human
gacagacaatgggaggaacg

SEQ ID NO: 265198 - DNA, 20 bp, human
gacactcggagcaggtacac

SEQ ID NO: 265199 - DNA, 20 bp, human
gagaagggagctatggggaa

SEQ ID NO: 265200 - DNA, 20 bp, human
gcaagtggcagtggaaaggg

SEQ ID NO: 265201 - DNA, 20 bp, human
ggggacaatctccaacagga

SEQ ID NO: 265202 - DNA, 20 bp, human
gagtgaggacagacaatggg

SEQ ID NO: 265203 - DNA, 20 bp, human
gcatggctaagtccgcttag

SEQ ID NO: 265204 - DNA, 20 bp, human
gttacaaagttgcccggcaa

SEQ ID NO: 265205 - DNA, 20 bp, human
ggttgcccggcaaaggaacg

SEQ ID NO: 265206 - DNA, 20 bp, human
gctggctgaggagtggctta

SEQ ID NO: 265207 - DNA, 20 bp, human
gctaaagtcttgcctggctg

SEQ ID NO: 265208 - DNA, 20 bp, human
ggagtggcttagggcctggc

SEQ ID NO: 265209 - DNA, 20 bp, human
gtgaggagtggcttagggcc

SEQ ID NO: 265210 - DNA, 20 bp, human
ggaccttggcaagggaggtt

SEQ ID NO: 265211 - DNA, 20 bp, human
gttaaacaatctcacaagga

SEQ ID NO: 265212 - DNA, 20 bp, human
gaaggtcaggatagctctac

SEQ ID NO: 265213 - DNA, 20 bp, human
gtgagattgtttaacagggc

SEQ ID NO: 265214 - DNA, 20 bp, human
gcaggcaagaaactcaggac

SEQ ID NO: 265215 - DNA, 20 bp, human
gctggggaggttgttagcac

SEQ ID NO: 265216 - DNA, 20 bp, human
gcgtgacagccattggtcga

SEQ ID NO: 265217 - DNA, 20 bp, human
gtccccgctccctcgaccaa

SEQ ID NO: 265218 - DNA, 20 bp, human
gccgctcgcagcaccggaga

SEQ ID NO: 265219 - DNA, 20 bp, human
gcggagagggcgcactgcaa

SEQ ID NO: 265220 - DNA, 20 bp, human
ggggaccgcgtgacagccat

SEQ ID NO: 265221 - DNA, 20 bp, human
gccgtccgggaggaagatct

SEQ ID NO: 265222 - DNA, 20 bp, human
gagtggcaattcagcctggg

SEQ ID NO: 265223 - DNA, 20 bp, human
ggagctggacaccgcctcgg

SEQ ID NO: 265224 - DNA, 20 bp, human
gccgactccgggcggattcc

SEQ ID NO: 265225 - DNA, 20 bp, human
gggctccgagaacaggggac

SEQ ID NO: 265226 - DNA, 20 bp, human
gcagcgcgagcctgcgtggg

SEQ ID NO: 265227 - DNA, 20 bp, human
ggggcagcgcgagcctgcgt

SEQ ID NO: 265228 - DNA, 20 bp, human
gcggtcccgcccggtgatgt

SEQ ID NO: 265229 - DNA, 20 bp, human
gcgagagcgcggctgcggtg

SEQ ID NO: 265230 - DNA, 20 bp, human
gcccgggctgcctacatcac

SEQ ID NO: 265231 - DNA, 20 bp, human
gaggggcagcaggaatcgtg

SEQ ID NO: 265232 - DNA, 20 bp, human
gcagaccgagagcgcggctg

SEQ ID NO: 265233 - DNA, 20 bp, human
gccgggaccctgcacaggcg

SEQ ID NO: 265234 - DNA, 20 bp, human
gtgcacaggcgcggtggaac

SEQ ID NO: 265235 - DNA, 20 bp, human
gtcccctgaaatatacagga

SEQ ID NO: 265236 - DNA, 20 bp, human
gagggaggcgggtcctacag

SEQ ID NO: 265237 - DNA, 20 bp, human
ggggaggcggggcttatgat

SEQ ID NO: 265238 - DNA, 20 bp, human
ggactggggctggaataggt

SEQ ID NO: 265239 - DNA, 20 bp, human
gaggccccgcctcccgctgt

SEQ ID NO: 265240 - DNA, 20 bp, human
gaggctgcggagactcaagg

SEQ ID NO: 265241 - DNA, 20 bp, human
ggggttgatggtcctgtgat

SEQ ID NO: 265242 - DNA, 20 bp, human
ggggaggcggggcctgtgat

SEQ ID NO: 265243 - DNA, 20 bp, human
gggccgacggggggggttga

SEQ ID NO: 265244 - DNA, 20 bp, human
gggtcctacagcgggaggcg

SEQ ID NO: 265245 - DNA, 20 bp, human
ggaccatcaaccccccccgt

SEQ ID NO: 265246 - DNA, 20 bp, human
gccggtgagcgtgaggtcct

SEQ ID NO: 265247 - DNA, 20 bp, human
gtcgtcccgcactaactgct

SEQ ID NO: 265248 - DNA, 20 bp, human
gacgactgccggtgagcgtg

SEQ ID NO: 265249 - DNA, 20 bp, human
gcagctgcgtgccctgcggg

SEQ ID NO: 265250 - DNA, 20 bp, human
gcgccctatgcagatgagga

SEQ ID NO: 265251 - DNA, 20 bp, human
gactagcccagcagttagtg

SEQ ID NO: 265252 - DNA, 20 bp, human
gaggtcctgggctgtatgtg

SEQ ID NO: 265253 - DNA, 20 bp, human
ggcggcgccctatgcagatg

SEQ ID NO: 265254 - DNA, 20 bp, human
gctgcgtgccctgcgggcgg

SEQ ID NO: 265255 - DNA, 20 bp, human
gcaccctcctcatctgcata

SEQ ID NO: 265256 - DNA, 20 bp, human
ggccccgcctctgaacgctc

SEQ ID NO: 265257 - DNA, 20 bp, human
gggcccgggcctggacttaa

SEQ ID NO: 265258 - DNA, 20 bp, human
gggcgtgccctctagccaat

SEQ ID NO: 265259 - DNA, 20 bp, human
gcggctctcgctgttggcag

SEQ ID NO: 265260 - DNA, 20 bp, human
gtctctagggagattccgat

SEQ ID NO: 265261 - DNA, 20 bp, human
gctctgaacgctccggacac

SEQ ID NO: 265262 - DNA, 20 bp, human
ggcgacgtgcccattggtcc

SEQ ID NO: 265263 - DNA, 20 bp, human
ggaattcagcctgagaagga

SEQ ID NO: 265264 - DNA, 20 bp, human
gaacttctgttcactgtgat

SEQ ID NO: 265265 - DNA, 20 bp, human
gggagattccgattggctag

SEQ ID NO: 265266 - DNA, 20 bp, human
gtgcgcaagcgcaatagagg

SEQ ID NO: 265267 - DNA, 20 bp, human
gcacccgaagagccaatcag

SEQ ID NO: 265268 - DNA, 20 bp, human
gcgcccggccctgacggcag

SEQ ID NO: 265269 - DNA, 20 bp, human
ggcgagggctgccctctgat

SEQ ID NO: 265270 - DNA, 20 bp, human
gcgggcggaagggtcccgag

SEQ ID NO: 265271 - DNA, 20 bp, human
gtggcggagccagtcccctc

SEQ ID NO: 265272 - DNA, 20 bp, human
gtggtcccgccgtataagaa

SEQ ID NO: 265273 - DNA, 20 bp, human
gtgccctctgattggctctt

SEQ ID NO: 265274 - DNA, 20 bp, human
gcgccccgcccctgccgtca

SEQ ID NO: 265275 - DNA, 20 bp, human
gttacccgcctcactcctgg

SEQ ID NO: 265276 - DNA, 20 bp, human
ggcctcccgcgaaaagtcgt

SEQ ID NO: 265277 - DNA, 20 bp, human
gaggactagcgcaggactct

SEQ ID NO: 265278 - DNA, 20 bp, human
gtggtcccacgacttttcgc

SEQ ID NO: 265279 - DNA, 20 bp, human
ggcagcacgagtgggatgtg

SEQ ID NO: 265280 - DNA, 20 bp, human
gcgtgggaccacgtcgaata

SEQ ID NO: 265281 - DNA, 20 bp, human
gatactccccatattcgacg

SEQ ID NO: 265282 - DNA, 20 bp, human
gtcgcgggaggcgagtgccc

SEQ ID NO: 265283 - DNA, 20 bp, human
gagcgctggcaccgattggt

SEQ ID NO: 265284 - DNA, 20 bp, human
gtaagagcagcttttcaaac

SEQ ID NO: 265285 - DNA, 20 bp, human
gtgagagcgctggcaccgat

SEQ ID NO: 265286 - DNA, 20 bp, human
gtgtagtggaatctcattcc

SEQ ID NO: 265287 - DNA, 20 bp, human
gaaaaccttgacctttggat

SEQ ID NO: 265288 - DNA, 20 bp, human
gaaattaaaaccttgacctt

SEQ ID NO: 265289 - DNA, 20 bp, human
gttggcctatccaaaggtca

SEQ ID NO: 265290 - DNA, 20 bp, human
gtgatgtatctatgaaaact

SEQ ID NO: 265291 - DNA, 20 bp, human
gacactgttaagacaatgaa

SEQ ID NO: 265292 - DNA, 20 bp, human
gcaatgaaagggaaaagcca

SEQ ID NO: 265293 - DNA, 20 bp, human
gaaagaacaaactgataaat

SEQ ID NO: 265294 - DNA, 20 bp, human
gctgtgttctagatgtaaat

SEQ ID NO: 265295 - DNA, 20 bp, human
gctagatgtaaataggttat

SEQ ID NO: 265296 - DNA, 20 bp, human
gccacagaaacttcaaccaa

SEQ ID NO: 265297 - DNA, 20 bp, human
gcaatgaaagagcaaagcca

SEQ ID NO: 265298 - DNA, 20 bp, human
gcaggttccttcctggaggt

SEQ ID NO: 265299 - DNA, 20 bp, human
gaacacaatttaaaaatggg

SEQ ID NO: 265300 - DNA, 20 bp, human
gttacatctagaacacagca

SEQ ID NO: 265301 - DNA, 20 bp, human
gtgtagtagaatctcattct

SEQ ID NO: 265302 - DNA, 20 bp, human
gtcagcgctgccccacctcc

SEQ ID NO: 265303 - DNA, 20 bp, human
gctgtgttctagatgtaaat

SEQ ID NO: 265304 - DNA, 20 bp, human
gaaatttttcacttcatcct

SEQ ID NO: 265305 - DNA, 20 bp, human
ggcgcagcccggattctaac

SEQ ID NO: 265306 - DNA, 20 bp, human
gaaatttttctcttcatcgt

SEQ ID NO: 265307 - DNA, 20 bp, human
gtgtagtagaatctcattct

SEQ ID NO: 265308 - DNA, 20 bp, human
gacactgttaagacaatgaa

SEQ ID NO: 265309 - DNA, 20 bp, human
gaaagagcaaattaataaat

SEQ ID NO: 265310 - DNA, 20 bp, human
gcaacacaatttaaaaatgg

SEQ ID NO: 265311 - DNA, 20 bp, human
gcaaatcatatagatgataa

SEQ ID NO: 265312 - DNA, 20 bp, human
ggcgcagcccagattctaac

SEQ ID NO: 265313 - DNA, 20 bp, human
gagaatctgggctgcgcagg

SEQ ID NO: 265314 - DNA, 20 bp, human
gtgccatccttatctctcct

SEQ ID NO: 265315 - DNA, 20 bp, human
gagcccaggttccttcctgg

SEQ ID NO: 265316 - DNA, 20 bp, human
ggtccccaggcgtcggagaa

SEQ ID NO: 265317 - DNA, 20 bp, human
ggggacgtggacctggccga

SEQ ID NO: 265318 - DNA, 20 bp, human
gacgcctggggacgtggacc

SEQ ID NO: 265319 - DNA, 20 bp, human
gcaggcgtcggagaaggggt

SEQ ID NO: 265320 - DNA, 20 bp, human
gaaggggttggaccgcgcag

SEQ ID NO: 265321 - DNA, 20 bp, human
gcgtggacctggccgaggga

SEQ ID NO: 265322 - DNA, 20 bp, human
ggggcaaataccggcagcgg

SEQ ID NO: 265323 - DNA, 20 bp, human
gagtctatggcgcgtttcgg

SEQ ID NO: 265324 - DNA, 20 bp, human
ggtaaaacgtgattacacca

SEQ ID NO: 265325 - DNA, 20 bp, human
ggggagagggtaccggtcct

SEQ ID NO: 265326 - DNA, 20 bp, human
gtgccagtggggttactgga

SEQ ID NO: 265327 - DNA, 20 bp, human
gcgcacgcatctgtatgaac

SEQ ID NO: 265328 - DNA, 20 bp, human
ggaaccttgcaccccgttaa

SEQ ID NO: 265329 - DNA, 20 bp, human
ggcctttagcagttgaatgt

SEQ ID NO: 265330 - DNA, 20 bp, human
gtctgtaatcataagagagg

SEQ ID NO: 265331 - DNA, 20 bp, human
gaatacacacttaaaacatc

SEQ ID NO: 265332 - DNA, 20 bp, human
gaaagtcatcagatcagcag

SEQ ID NO: 265333 - DNA, 20 bp, human
gatctgtaggagctcgtcca

SEQ ID NO: 265334 - DNA, 20 bp, human
gaatatatataacaccgcac

SEQ ID NO: 265335 - DNA, 20 bp, human
ggttgaatgtcggagtccaa

SEQ ID NO: 265336 - DNA, 20 bp, human
gacgcggccggtgacagcgc

SEQ ID NO: 265337 - DNA, 20 bp, human
gcagagccgggcaaagagat

SEQ ID NO: 265338 - DNA, 20 bp, human
ggatggggttgtccaggcta

SEQ ID NO: 265339 - DNA, 20 bp, human
gggctccgaggccgtctcgc

SEQ ID NO: 265340 - DNA, 20 bp, human
gaggcaaggccaagtggcca

SEQ ID NO: 265341 - DNA, 20 bp, human
ggcagcctgcgagacggcct

SEQ ID NO: 265342 - DNA, 20 bp, human
gtccccacccgcgctgtcac

SEQ ID NO: 265343 - DNA, 20 bp, human
gggtggggatcccccggggc

SEQ ID NO: 265344 - DNA, 20 bp, human
gggcaggggcgaccgtgctg

SEQ ID NO: 265345 - DNA, 20 bp, human
ggccgtctcgcaggctgcgg

SEQ ID NO: 265346 - DNA, 20 bp, human
gcccgccgaccacctgtctc

SEQ ID NO: 265347 - DNA, 20 bp, human
ggatgaggggcggagaagat

SEQ ID NO: 265348 - DNA, 20 bp, human
gcgccccgccccttcgggag

SEQ ID NO: 265349 - DNA, 20 bp, human
gtacagggtaacgacgggga

SEQ ID NO: 265350 - DNA, 20 bp, human
ggggcggagaagataggcta

SEQ ID NO: 265351 - DNA, 20 bp, human
gagggcgccgcggacctgtc

SEQ ID NO: 265352 - DNA, 20 bp, human
gcatccccgcccctcccgaa

SEQ ID NO: 265353 - DNA, 20 bp, human
ggcaccccggcctccttaaa

SEQ ID NO: 265354 - DNA, 20 bp, human
gcaagtgacccggatgtaca

SEQ ID NO: 265355 - DNA, 20 bp, human
gcccgcccctcccgaagggg

SEQ ID NO: 265356 - DNA, 20 bp, human
gacgccggggccccgcgatg

SEQ ID NO: 265357 - DNA, 20 bp, human
gaggcgggcgcggggttctg

SEQ ID NO: 265358 - DNA, 20 bp, human
gccggggccccgcgatgcgg

SEQ ID NO: 265359 - DNA, 20 bp, human
gccccggctcgggaggacac

SEQ ID NO: 265360 - DNA, 20 bp, human
gccgccggcgctcgcacaaa

SEQ ID NO: 265361 - DNA, 20 bp, human
ggcggggcgcgctgcgattg

SEQ ID NO: 265362 - DNA, 20 bp, human
ggcgcggcgcgcgctgacgc

SEQ ID NO: 265363 - DNA, 20 bp, human
gcggcggctcggcttctcga

SEQ ID NO: 265364 - DNA, 20 bp, human
gccggcgctcgcacaaaagg

SEQ ID NO: 265365 - DNA, 20 bp, human
gtcgcagcggggtcagtgag

SEQ ID NO: 265366 - DNA, 20 bp, human
gcaggaccaggggcggtctc

SEQ ID NO: 265367 - DNA, 20 bp, human
gggagtccacgcaggaccag

SEQ ID NO: 265368 - DNA, 20 bp, human
gaacgtcgaggcagcgcgag

SEQ ID NO: 265369 - DNA, 20 bp, human
ggaccaggggcggtctccgg

SEQ ID NO: 265370 - DNA, 20 bp, human
gtcgacgttaacccgagcca

SEQ ID NO: 265371 - DNA, 20 bp, human
ggcagccaggggaccagcgt

SEQ ID NO: 265372 - DNA, 20 bp, human
gctggggcgggagtccacgc

SEQ ID NO: 265373 - DNA, 20 bp, human
ggtcaccaggaggaattaga

SEQ ID NO: 265374 - DNA, 20 bp, human
gccaggggccagcctcggat

SEQ ID NO: 265375 - DNA, 20 bp, human
ggcgggcggtggtcacgctc

SEQ ID NO: 265376 - DNA, 20 bp, human
gagcgcggggaggatcctgg

SEQ ID NO: 265377 - DNA, 20 bp, human
gagctccgggctcctggtag

SEQ ID NO: 265378 - DNA, 20 bp, human
ggggccctgaggagagtgcc

SEQ ID NO: 265379 - DNA, 20 bp, human
gggtaggggcggtgctcctg

SEQ ID NO: 265380 - DNA, 20 bp, human
ggggcggtgctcctgtgggg

SEQ ID NO: 265381 - DNA, 20 bp, human
gctgcggaaacaggaagtgg

SEQ ID NO: 265382 - DNA, 20 bp, human
ggtagggcggctgcggaaac

SEQ ID NO: 265383 - DNA, 20 bp, human
gtccgggctcctggtagggg

SEQ ID NO: 265384 - DNA, 20 bp, human
gctgcccacagcgtgaaaac

SEQ ID NO: 265385 - DNA, 20 bp, human
ggccccggccagccacggct

SEQ ID NO: 265386 - DNA, 20 bp, human
ggcggcgacctgaggcggcg

SEQ ID NO: 265387 - DNA, 20 bp, human
ggggcggggcgtcgatccgg

SEQ ID NO: 265388 - DNA, 20 bp, human
gggcgcgctgcggactcggt

SEQ ID NO: 265389 - DNA, 20 bp, human
gaaggcaagacctgtggcgg

SEQ ID NO: 265390 - DNA, 20 bp, human
ggccgcgccgcgccgacgga

SEQ ID NO: 265391 - DNA, 20 bp, human
gacagggcgcgctgcggact

SEQ ID NO: 265392 - DNA, 20 bp, human
gccgcagcgcgccctgtgcg

SEQ ID NO: 265393 - DNA, 20 bp, human
ggcgctgcggactcggtggg

SEQ ID NO: 265394 - DNA, 20 bp, human
ggggcgcgggcggccaatga

SEQ ID NO: 265395 - DNA, 20 bp, human
gggggccagaccctcgcaca

SEQ ID NO: 265396 - DNA, 20 bp, human
gcggcccagcgttttcatcc

SEQ ID NO: 265397 - DNA, 20 bp, human
gacagcgggcgggtggggtc

SEQ ID NO: 265398 - DNA, 20 bp, human
ggcggggagagaagcccgta

SEQ ID NO: 265399 - DNA, 20 bp, human
gggcctcgcaggcgcgagcg

SEQ ID NO: 265400 - DNA, 20 bp, human
ggggaagtggccccgggcct

SEQ ID NO: 265401 - DNA, 20 bp, human
gtgaaaacgctgggccgcat

SEQ ID NO: 265402 - DNA, 20 bp, human
ggggccacttcccgcgtccc

SEQ ID NO: 265403 - DNA, 20 bp, human
gcgagccgggatgaaaacgc

SEQ ID NO: 265404 - DNA, 20 bp, human
gtggacgcctgaagcctatg

SEQ ID NO: 265405 - DNA, 20 bp, human
ggcggggagtgagggactcg

SEQ ID NO: 265406 - DNA, 20 bp, human
gctagcatcacagatggttt

SEQ ID NO: 265407 - DNA, 20 bp, human
ggcaggccctaatccgcgct

SEQ ID NO: 265408 - DNA, 20 bp, human
gcccccaagccacccatgga

SEQ ID NO: 265409 - DNA, 20 bp, human
ggagctgcgccctccatggg

SEQ ID NO: 265410 - DNA, 20 bp, human
ggggaggccatgtcggaaga

SEQ ID NO: 265411 - DNA, 20 bp, human
gagcctggcgctttgattta

SEQ ID NO: 265412 - DNA, 20 bp, human
ggcggcccgaaccgagtggg

SEQ ID NO: 265413 - DNA, 20 bp, human
gtgacgcggcccgaaccgag

SEQ ID NO: 265414 - DNA, 20 bp, human
ggggaagtgtggtccaagcg

SEQ ID NO: 265415 - DNA, 20 bp, human
gttctgcgatattttggagg

SEQ ID NO: 265416 - DNA, 20 bp, human
gaggcccggcggctgcgata

SEQ ID NO: 265417 - DNA, 20 bp, human
gggacgccggggaaccctcc

SEQ ID NO: 265418 - DNA, 20 bp, human
gcggctgcgatagggcgggg

SEQ ID NO: 265419 - DNA, 20 bp, human
ggccccgcggccgctcggga

SEQ ID NO: 265420 - DNA, 20 bp, human
gcccggcggctgcgataggg

SEQ ID NO: 265421 - DNA, 20 bp, human
gggcctcgccccaccccgga

SEQ ID NO: 265422 - DNA, 20 bp, human
gcccggagggggttcctacc

SEQ ID NO: 265423 - DNA, 20 bp, human
gcgcggtccctgggcccgga

SEQ ID NO: 265424 - DNA, 20 bp, human
gaagccctggtgcttctcgg

SEQ ID NO: 265425 - DNA, 20 bp, human
gcgggagggagcggcggact

SEQ ID NO: 265426 - DNA, 20 bp, human
gcagctctgagccacagccg

SEQ ID NO: 265427 - DNA, 20 bp, human
gcggctgcgacagagatggg

SEQ ID NO: 265428 - DNA, 20 bp, human
gccgcggctgcgacagagat

SEQ ID NO: 265429 - DNA, 20 bp, human
ggccacccaaagctcggacc

SEQ ID NO: 265430 - DNA, 20 bp, human
ggaggggaggcttacgtgag

SEQ ID NO: 265431 - DNA, 20 bp, human
gaggggccagctcttctctt

SEQ ID NO: 265432 - DNA, 20 bp, human
gaggccccctcacccgatgg

SEQ ID NO: 265433 - DNA, 20 bp, human
gagggatggcttggtgaggg

SEQ ID NO: 265434 - DNA, 20 bp, human
gtgccccgggtccgagcttt

SEQ ID NO: 265435 - DNA, 20 bp, human
gccctgggagagggagtaag

SEQ ID NO: 265436 - DNA, 20 bp, human
gcaagcgcgcgctcaccctt

SEQ ID NO: 265437 - DNA, 20 bp, human
gcgcgctcacccttgggcga

SEQ ID NO: 265438 - DNA, 20 bp, human
gcctcagggccctcgcccaa

SEQ ID NO: 265439 - DNA, 20 bp, human
ggagctgctccgagacccgc

SEQ ID NO: 265440 - DNA, 20 bp, human
gggtctcggagcagctccgc

SEQ ID NO: 265441 - DNA, 20 bp, human
ggcgcagaggccgacaccac

SEQ ID NO: 265442 - DNA, 20 bp, human
ggctcgaggcgcctaggggc

SEQ ID NO: 265443 - DNA, 20 bp, human
gcctgcgtctcccaggggcg

SEQ ID NO: 265444 - DNA, 20 bp, human
ggcggggctcgaggcgccta

SEQ ID NO: 265445 - DNA, 20 bp, human
gcccgccaagccctgggcta

SEQ ID NO: 265446 - DNA, 20 bp, human
gcggagcttctccccttaaa

SEQ ID NO: 265447 - DNA, 20 bp, human
ggtgcccctaacaacttcgg

SEQ ID NO: 265448 - DNA, 20 bp, human
gctccgcggcgcgggaaacg

SEQ ID NO: 265449 - DNA, 20 bp, human
ggggcggggactgcttacta

SEQ ID NO: 265450 - DNA, 20 bp, human
ggtagcaactgcagaactgc

SEQ ID NO: 265451 - DNA, 20 bp, human
gcggcggccagagggaaacg

SEQ ID NO: 265452 - DNA, 20 bp, human
gacgggcgcgcgcacgttgc

SEQ ID NO: 265453 - DNA, 20 bp, human
ggcctctattgtccttttaa

SEQ ID NO: 265454 - DNA, 20 bp, human
ggcacgttgcgggctgggag

SEQ ID NO: 265455 - DNA, 20 bp, human
gcggggactgcttactacgg

SEQ ID NO: 265456 - DNA, 20 bp, human
gttgctaagtagggaggaga

SEQ ID NO: 265457 - DNA, 20 bp, human
ggaagcagcttgttggatct

SEQ ID NO: 265458 - DNA, 20 bp, human
gctggacagaagcagcttgt

SEQ ID NO: 265459 - DNA, 20 bp, human
ggtgcccttgctaagtaggg

SEQ ID NO: 265460 - DNA, 20 bp, human
gccctctgcctgcctctaga

SEQ ID NO: 265461 - DNA, 20 bp, human
ggtgcctctctggtgagaat

SEQ ID NO: 265462 - DNA, 20 bp, human
ggcaagtgcccttgctaagt

SEQ ID NO: 265463 - DNA, 20 bp, human
gctccagagggaaaagagct

SEQ ID NO: 265464 - DNA, 20 bp, human
gctctctggagggctccaga

SEQ ID NO: 265465 - DNA, 20 bp, human
gtggtagaagccccaggctc

SEQ ID NO: 265466 - DNA, 20 bp, human
gcggacgcacggaaagggct

SEQ ID NO: 265467 - DNA, 20 bp, human
gtcggtcggacgcacggaaa

SEQ ID NO: 265468 - DNA, 20 bp, human
gtcagcgcgcagtcaggcgg

SEQ ID NO: 265469 - DNA, 20 bp, human
gactgcgcgctgagaggcga

SEQ ID NO: 265470 - DNA, 20 bp, human
gtcggaaggccgggcgtgga

SEQ ID NO: 265471 - DNA, 20 bp, human
ggtggagggcgtggctagga

SEQ ID NO: 265472 - DNA, 20 bp, human
gtcagagcgcacggacagag

SEQ ID NO: 265473 - DNA, 20 bp, human
gtgagaggatgttttcctac

SEQ ID NO: 265474 - DNA, 20 bp, human
gcctcggtcaggcacgtcac

SEQ ID NO: 265475 - DNA, 20 bp, human
gcgggcagctcccttgtgtg

SEQ ID NO: 265476 - DNA, 20 bp, human
gaccgccccggggatccgat

SEQ ID NO: 265477 - DNA, 20 bp, human
gagggagccaatcggatccc

SEQ ID NO: 265478 - DNA, 20 bp, human
gcgattggctccctctctcg

SEQ ID NO: 265479 - DNA, 20 bp, human
gcgggggccggagcgatgaa

SEQ ID NO: 265480 - DNA, 20 bp, human
ggcaaatgctgcgcttggat

SEQ ID NO: 265481 - DNA, 20 bp, human
gccggagcgatgaatgggca

SEQ ID NO: 265482 - DNA, 20 bp, human
ggaaccctgtgcgcgctcca

SEQ ID NO: 265483 - DNA, 20 bp, human
gcagctgtgaggacggggcc

SEQ ID NO: 265484 - DNA, 20 bp, human
ggccaatcggatccccgggg

SEQ ID NO: 265485 - DNA, 20 bp, human
gtacaaagcccggagccacg

SEQ ID NO: 265486 - DNA, 20 bp, human
ggccccgttatccgagaggg

SEQ ID NO: 265487 - DNA, 20 bp, human
ggagccgtgggcgcctctag

SEQ ID NO: 265488 - DNA, 20 bp, human
ggccctccctgcaagctggt

SEQ ID NO: 265489 - DNA, 20 bp, human
gagagggcggagcgagccgt

SEQ ID NO: 265490 - DNA, 20 bp, human
gcctgccccgttatccgaga

SEQ ID NO: 265491 - DNA, 20 bp, human
ggctccgccctctcggataa

SEQ ID NO: 265492 - DNA, 20 bp, human
ggcacccctagaggcgccca

SEQ ID NO: 265493 - DNA, 20 bp, human
gcagaccctgggggatgtga

SEQ ID NO: 265494 - DNA, 20 bp, human
ggggaggggacaagcaggcg

SEQ ID NO: 265495 - DNA, 20 bp, human
gaagccgcctggcaccttct

SEQ ID NO: 265496 - DNA, 20 bp, human
gtgactcagcccgcctggat

SEQ ID NO: 265497 - DNA, 20 bp, human
gagcatggggatgaatatga

SEQ ID NO: 265498 - DNA, 20 bp, human
ggtgactggggttcccctcg

SEQ ID NO: 265499 - DNA, 20 bp, human
gcagacccctcgccccccgt

SEQ ID NO: 265500 - DNA, 20 bp, human
gccctcggggaggggaccga

SEQ ID NO: 265501 - DNA, 20 bp, human
gggtcccgccccatccaggc

SEQ ID NO: 265502 - DNA, 20 bp, human
ggggaccgacggggggcgag

SEQ ID NO: 265503 - DNA, 20 bp, human
gcggggaggggaccgacggg

SEQ ID NO: 265504 - DNA, 20 bp, human
gtcagcccgcctggatgggg

SEQ ID NO: 265505 - DNA, 20 bp, human
gggggcgggaccggtgactg

SEQ ID NO: 265506 - DNA, 20 bp, human
gggggtaattctcaccactg

SEQ ID NO: 265507 - DNA, 20 bp, human
gtgaagagtgaatcccaggt

SEQ ID NO: 265508 - DNA, 20 bp, human
gagagggcttgggcaaccca

SEQ ID NO: 265509 - DNA, 20 bp, human
gggtgagaattaccccacct

SEQ ID NO: 265510 - DNA, 20 bp, human
gctgggattcactcttcaca

SEQ ID NO: 265511 - DNA, 20 bp, human
ggttgcccaagccctctgga

SEQ ID NO: 265512 - DNA, 20 bp, human
ggagaaagaattttttgaag

SEQ ID NO: 265513 - DNA, 20 bp, human
gcagtttcattcatatgaat

SEQ ID NO: 265514 - DNA, 20 bp, human
gagagggctgcagatccggt

SEQ ID NO: 265515 - DNA, 20 bp, human
ggcacccaccttcctcttta

SEQ ID NO: 265516 - DNA, 20 bp, human
gacttcagcccaactccagg

SEQ ID NO: 265517 - DNA, 20 bp, human
ggctccccggcgcgattcca

SEQ ID NO: 265518 - DNA, 20 bp, human
gggcgtcacttgtgctggga

SEQ ID NO: 265519 - DNA, 20 bp, human
gcggcggcgtcacttgtgct

SEQ ID NO: 265520 - DNA, 20 bp, human
ggccgcgccagctcttgcaa

SEQ ID NO: 265521 - DNA, 20 bp, human
gccggcgatcagctggaagc

SEQ ID NO: 265522 - DNA, 20 bp, human
gagcgcagcctcctggagtt

SEQ ID NO: 265523 - DNA, 20 bp, human
ggggcagaggaaaggagccg

SEQ ID NO: 265524 - DNA, 20 bp, human
ggacccgtggaatcgcgccg

SEQ ID NO: 265525 - DNA, 20 bp, human
gcgccggggagcgagcccgg

SEQ ID NO: 265526 - DNA, 20 bp, human
gccgcctgctgctctggacg

SEQ ID NO: 265527 - DNA, 20 bp, human
gcggctggggggccccagga

SEQ ID NO: 265528 - DNA, 20 bp, human
ggccaagagcagtttaggag

SEQ ID NO: 265529 - DNA, 20 bp, human
ggtgggacgtgaaggggtgg

SEQ ID NO: 265530 - DNA, 20 bp, human
gagcagcaggcggcatccgg

SEQ ID NO: 265531 - DNA, 20 bp, human
ggggtggccaagagcagttt

SEQ ID NO: 265532 - DNA, 20 bp, human
ggccagcatggaattccccc

SEQ ID NO: 265533 - DNA, 20 bp, human
ggtcactcccagctctgccg

SEQ ID NO: 265534 - DNA, 20 bp, human
gtgcctcagagaggggcgga

SEQ ID NO: 265535 - DNA, 20 bp, human
gagtggggggtgggacgtga

SEQ ID NO: 265536 - DNA, 20 bp, human
gctcggcccggctgcagtga

SEQ ID NO: 265537 - DNA, 20 bp, human
gctgcagtgaaggcggcgag

SEQ ID NO: 265538 - DNA, 20 bp, human
ggcagcctctctgacagccg

SEQ ID NO: 265539 - DNA, 20 bp, human
ggaggtgcgactccccttta

SEQ ID NO: 265540 - DNA, 20 bp, human
gctgccgactccgccataaa

SEQ ID NO: 265541 - DNA, 20 bp, human
gggcggccggcgggcgaaca

SEQ ID NO: 265542 - DNA, 20 bp, human
ggggagcgtcggtgctgccg

SEQ ID NO: 265543 - DNA, 20 bp, human
gactgcgcctggagcttaaa

SEQ ID NO: 265544 - DNA, 20 bp, human
gttaaaggggaggcgcgcgg

SEQ ID NO: 265545 - DNA, 20 bp, human
gaggcgcagtcgatttgtgt

SEQ ID NO: 265546 - DNA, 20 bp, human
ggaccccgcccctcatgcaa

SEQ ID NO: 265547 - DNA, 20 bp, human
gccgccttcgacccccggct

SEQ ID NO: 265548 - DNA, 20 bp, human
gccctcctcagccgagccgg

SEQ ID NO: 265549 - DNA, 20 bp, human
gacccccggctcggctgagg

SEQ ID NO: 265550 - DNA, 20 bp, human
gccgcagcaccgttgcatga

SEQ ID NO: 265551 - DNA, 20 bp, human
gtcgacccccggctcggctg

SEQ ID NO: 265552 - DNA, 20 bp, human
gacgcaggctgcggggttca

SEQ ID NO: 265553 - DNA, 20 bp, human
ggcggcccgccttcgacccc

SEQ ID NO: 265554 - DNA, 20 bp, human
ggggcccgcgttaaaggcga

SEQ ID NO: 265555 - DNA, 20 bp, human
gcaccgttgcatgaggggcg

SEQ ID NO: 265556 - DNA, 20 bp, human
gcgccccgagcacccactgg

SEQ ID NO: 265557 - DNA, 20 bp, human
gcggcgagtggacccccagt

SEQ ID NO: 265558 - DNA, 20 bp, human
gggagcatgcagagagtcgg

SEQ ID NO: 265559 - DNA, 20 bp, human
gctctcagagaagttggtgg

SEQ ID NO: 265560 - DNA, 20 bp, human
gctgcagccccctggggcga

SEQ ID NO: 265561 - DNA, 20 bp, human
ggacccccagtgggtgctcg

SEQ ID NO: 265562 - DNA, 20 bp, human
gaggacagtcagtaggttct

SEQ ID NO: 265563 - DNA, 20 bp, human
gctagtggagaggtaaacgg

SEQ ID NO: 265564 - DNA, 20 bp, human
gaggggccgcgcgagggttg

SEQ ID NO: 265565 - DNA, 20 bp, human
gagtagagagggtggagcag

SEQ ID NO: 265566 - DNA, 20 bp, human
gctgggggatgagaacaaag

SEQ ID NO: 265567 - DNA, 20 bp, human
gcggtggggctgtcctctat

SEQ ID NO: 265568 - DNA, 20 bp, human
ggcaactaggcagagtctac

SEQ ID NO: 265569 - DNA, 20 bp, human
gtacaggaacgcaagatgat

SEQ ID NO: 265570 - DNA, 20 bp, human
gtgacagcaacaggtcacaa

SEQ ID NO: 265571 - DNA, 20 bp, human
gtgctgaatcttttgaattt

SEQ ID NO: 265572 - DNA, 20 bp, human
gtggcacccacttgagtacc

SEQ ID NO: 265573 - DNA, 20 bp, human
ggcaacgcttctcatcttac

SEQ ID NO: 265574 - DNA, 20 bp, human
gctgtcctctatgggggcaa

SEQ ID NO: 265575 - DNA, 20 bp, human
ggggcaatggagtattagtg

SEQ ID NO: 265576 - DNA, 20 bp, human
gagaggggatagctacatgg

SEQ ID NO: 265577 - DNA, 20 bp, human
gacatggaggctaggacaaa

SEQ ID NO: 265578 - DNA, 20 bp, human
gaccagaggggatagctaca

SEQ ID NO: 265579 - DNA, 20 bp, human
gagatgcgcacaggtcacaa

SEQ ID NO: 265580 - DNA, 20 bp, human
ggtcagcctctcccctgtgg

SEQ ID NO: 265581 - DNA, 20 bp, human
gcaaatcaatgcctccacag

SEQ ID NO: 265582 - DNA, 20 bp, human
gactgtaacaacagcaaaac

SEQ ID NO: 265583 - DNA, 20 bp, human
gaggggtgtgagatgcgcac

SEQ ID NO: 265584 - DNA, 20 bp, human
gttcctgggggtaaaatcct

SEQ ID NO: 265585 - DNA, 20 bp, human
gtctgcttttataaatatct

SEQ ID NO: 265586 - DNA, 20 bp, human
ggggcaggtcacaatgggta

SEQ ID NO: 265587 - DNA, 20 bp, human
ggctctgaggcagggactac

SEQ ID NO: 265588 - DNA, 20 bp, human
gtgatggggcaggtcacaat

SEQ ID NO: 265589 - DNA, 20 bp, human
gtgagctgtggagggcggtg

SEQ ID NO: 265590 - DNA, 20 bp, human
gaggtccctagatggtaggt

SEQ ID NO: 265591 - DNA, 20 bp, human
gctagatggtaggttggtgg

SEQ ID NO: 265592 - DNA, 20 bp, human
gtagggaccttaatgcattc

SEQ ID NO: 265593 - DNA, 20 bp, human
gatgcattaaggtccctaga

SEQ ID NO: 265594 - DNA, 20 bp, human
gctggcaaattgctttcaaa

SEQ ID NO: 265595 - DNA, 20 bp, human
gaggtcacaatgggtagggg

SEQ ID NO: 265596 - DNA, 20 bp, human
gagccctgaccggaccgctc

SEQ ID NO: 265597 - DNA, 20 bp, human
gggtccggtcagggctccat

SEQ ID NO: 265598 - DNA, 20 bp, human
gctcctgagcggtccggtca

SEQ ID NO: 265599 - DNA, 20 bp, human
gagtaagagaagaacggcac

SEQ ID NO: 265600 - DNA, 20 bp, human
gtgaccacacttcctctcag

SEQ ID NO: 265601 - DNA, 20 bp, human
ggtgcaggtctgcccctgag

SEQ ID NO: 265602 - DNA, 20 bp, human
ggagaagaacggcactgggg

SEQ ID NO: 265603 - DNA, 20 bp, human
gtgcccactcctgagcggtc

SEQ ID NO: 265604 - DNA, 20 bp, human
gattcccatggagccctgac

SEQ ID NO: 265605 - DNA, 20 bp, human
gggtggtgtgaagttttcag

SEQ ID NO: 265606 - DNA, 20 bp, human
ggggcctgacgtcagcagga

SEQ ID NO: 265607 - DNA, 20 bp, human
gggccccggcacctgcgcac

SEQ ID NO: 265608 - DNA, 20 bp, human
gtggcacccgtccgcacctg

SEQ ID NO: 265609 - DNA, 20 bp, human
gcctggggcctgacgtcagc

SEQ ID NO: 265610 - DNA, 20 bp, human
ggtcaggccccaggtgcgga

SEQ ID NO: 265611 - DNA, 20 bp, human
gtgccagtgcgcaggtgccg

SEQ ID NO: 265612 - DNA, 20 bp, human
ggcgcacgggcgtcaggatg

SEQ ID NO: 265613 - DNA, 20 bp, human
gaggggcctcgccagtgcac

SEQ ID NO: 265614 - DNA, 20 bp, human
gcggacgggtgccagtgcgc

SEQ ID NO: 265615 - DNA, 20 bp, human
gctcctggagatcaggccaa

SEQ ID NO: 265616 - DNA, 20 bp, human
gaaactccaggctgtatccc

SEQ ID NO: 265617 - DNA, 20 bp, human
gtcagaccctgcctccacgg

SEQ ID NO: 265618 - DNA, 20 bp, human
gggaactctccggggactgt

SEQ ID NO: 265619 - DNA, 20 bp, human
gctcttccaggaactctccg

SEQ ID NO: 265620 - DNA, 20 bp, human
gtgacctcatcggacacaca

SEQ ID NO: 265621 - DNA, 20 bp, human
gggcccctgtgtgtccgatg

SEQ ID NO: 265622 - DNA, 20 bp, human
ggtgcctcctccgtggaggc

SEQ ID NO: 265623 - DNA, 20 bp, human
gcacaaagcccctccaccag

SEQ ID NO: 265624 - DNA, 20 bp, human
ggaccctgcctccacggagg

SEQ ID NO: 265625 - DNA, 20 bp, human
ggctgtttgtgatgtgatct

SEQ ID NO: 265626 - DNA, 20 bp, human
gagctgagacacagtgtgaa

SEQ ID NO: 265627 - DNA, 20 bp, human
ggctctcaaccacatgtccc

SEQ ID NO: 265628 - DNA, 20 bp, human
gtctcagctgacagccctga

SEQ ID NO: 265629 - DNA, 20 bp, human
ggcccagaaagaagccatca

SEQ ID NO: 265630 - DNA, 20 bp, human
ggacccgtgcctgtggcatc

SEQ ID NO: 265631 - DNA, 20 bp, human
gggcctgtaggtggacagag

SEQ ID NO: 265632 - DNA, 20 bp, human
gagccctgatggcttctttc

SEQ ID NO: 265633 - DNA, 20 bp, human
gacagaggggagaggataca

SEQ ID NO: 265634 - DNA, 20 bp, human
gggtctgccctcccgggtct

SEQ ID NO: 265635 - DNA, 20 bp, human
gtgccacaggcacgggtcca

SEQ ID NO: 265636 - DNA, 20 bp, human
ggggccacacccagatacaa

SEQ ID NO: 265637 - DNA, 20 bp, human
gtggtcggaattcaaacaca

SEQ ID NO: 265638 - DNA, 20 bp, human
gtcccagcttcccttgtatc

SEQ ID NO: 265639 - DNA, 20 bp, human
gtaaggatgagggatattga

SEQ ID NO: 265640 - DNA, 20 bp, human
gtaattctccagttgtaggt

SEQ ID NO: 265641 - DNA, 20 bp, human
gtacttaatgcgtatggcaa

SEQ ID NO: 265642 - DNA, 20 bp, human
gtgacatagcttcttcccac

SEQ ID NO: 265643 - DNA, 20 bp, human
gtgtttgaattccgaccaat

SEQ ID NO: 265644 - DNA, 20 bp, human
gtggacaattagcaacccgt

SEQ ID NO: 265645 - DNA, 20 bp, human
gtaaggctatgacctgaaaa

SEQ ID NO: 265646 - DNA, 20 bp, human
gatgtcctggggttccgaaa

SEQ ID NO: 265647 - DNA, 20 bp, human
gaaagggctggggaatgtcc

SEQ ID NO: 265648 - DNA, 20 bp, human
gccgggaggactatgtcctg

SEQ ID NO: 265649 - DNA, 20 bp, human
ggaatgtccaggcacggata

SEQ ID NO: 265650 - DNA, 20 bp, human
gataggttgcattcagagta

SEQ ID NO: 265651 - DNA, 20 bp, human
gctggggttccgaaaagggc

SEQ ID NO: 265652 - DNA, 20 bp, human
ggagctgactggtggtccca

SEQ ID NO: 265653 - DNA, 20 bp, human
gagatccaccagggtgtcgg

SEQ ID NO: 265654 - DNA, 20 bp, human
gtgctttctcagcaagttcc

SEQ ID NO: 265655 - DNA, 20 bp, human
gagatccttccactgctaag

SEQ ID NO: 265656 - DNA, 20 bp, human
gactgctggtttgtagttgg

SEQ ID NO: 265657 - DNA, 20 bp, human
gtggacagcccgtaagtaaa

SEQ ID NO: 265658 - DNA, 20 bp, human
ggaaggacagaggatgtgcc

SEQ ID NO: 265659 - DNA, 20 bp, human
gtctcccatgagatggggta

SEQ ID NO: 265660 - DNA, 20 bp, human
gaatggcaggaatgacatca

SEQ ID NO: 265661 - DNA, 20 bp, human
gagggcctgtcagctcacaa

SEQ ID NO: 265662 - DNA, 20 bp, human
gacttacgggctgtccacca

SEQ ID NO: 265663 - DNA, 20 bp, human
gggcaggtgaacaagtccca

SEQ ID NO: 265664 - DNA, 20 bp, human
ggaataggctgcattactgc

SEQ ID NO: 265665 - DNA, 20 bp, human
gaaggctctcgggaacatac

SEQ ID NO: 265666 - DNA, 20 bp, human
ggccactttcactagggcga

SEQ ID NO: 265667 - DNA, 20 bp, human
gtttcactagggcgaaggca

SEQ ID NO: 265668 - DNA, 20 bp, human
gagccggccaatgagatcgg

SEQ ID NO: 265669 - DNA, 20 bp, human
gcgaagccggccaatgagat

SEQ ID NO: 265670 - DNA, 20 bp, human
ggctccgcctccgatctcat

SEQ ID NO: 265671 - DNA, 20 bp, human
gaacggtgctgagatcaatt

SEQ ID NO: 265672 - DNA, 20 bp, human
gaaggcacggccaattgggc

SEQ ID NO: 265673 - DNA, 20 bp, human
gcggccaatgagatcggagg

SEQ ID NO: 265674 - DNA, 20 bp, human
gtgccttgccactttcacta

SEQ ID NO: 265675 - DNA, 20 bp, human
ggatctcagcaccgttactg

SEQ ID NO: 265676 - DNA, 20 bp, human
gtttaaccaataaagagtag

SEQ ID NO: 265677 - DNA, 20 bp, human
gtttcactagggctaaggca

SEQ ID NO: 265678 - DNA, 20 bp, human
gaataaagagtagaggccgg

SEQ ID NO: 265679 - DNA, 20 bp, human
gaccaataaagagtagaggc

SEQ ID NO: 265680 - DNA, 20 bp, human
ggcccatcagttctacttcg

SEQ ID NO: 265681 - DNA, 20 bp, human
gcccgcttcttattggaaga

SEQ ID NO: 265682 - DNA, 20 bp, human
gagccggccaatgagatcgg

SEQ ID NO: 265683 - DNA, 20 bp, human
gcgaagccggccaatgagat

SEQ ID NO: 265684 - DNA, 20 bp, human
gatcaattcggctttctggt

SEQ ID NO: 265685 - DNA, 20 bp, human
ggctccgcctccgatctcat

SEQ ID NO: 265686 - DNA, 20 bp, human
gtttcactagggctaaagca

SEQ ID NO: 265687 - DNA, 20 bp, human
gaacacaaactcttgagctg

SEQ ID NO: 265688 - DNA, 20 bp, human
gcccgcttcttattggaaga

SEQ ID NO: 265689 - DNA, 20 bp, human
gagccctagtgaaagtggca

SEQ ID NO: 265690 - DNA, 20 bp, human
gagccggccaatgagatcgg

SEQ ID NO: 265691 - DNA, 20 bp, human
ggctccgcctccgatctcat

SEQ ID NO: 265692 - DNA, 20 bp, human
gcgaagccggccaatgagat

SEQ ID NO: 265693 - DNA, 20 bp, human
gatcaattcggctttctggt

SEQ ID NO: 265694 - DNA, 20 bp, human
gtgccttgccactttcacta

SEQ ID NO: 265695 - DNA, 20 bp, human
gaacggtgctgagatcaatt

SEQ ID NO: 265696 - DNA, 20 bp, human
gtccggggtcaggagtgcga

SEQ ID NO: 265697 - DNA, 20 bp, human
ggtagttcgtaacctgtcgg

SEQ ID NO: 265698 - DNA, 20 bp, human
gaggctccttcctcgtcaag

SEQ ID NO: 265699 - DNA, 20 bp, human
gcctgtcgggggatctagaa

SEQ ID NO: 265700 - DNA, 20 bp, human
gggggtcaggagtgcgaagg

SEQ ID NO: 265701 - DNA, 20 bp, human
gcctctaccctaaacaaaaa

SEQ ID NO: 265702 - DNA, 20 bp, human
gtaccctaaacaaaaatggc

SEQ ID NO: 265703 - DNA, 20 bp, human
gattgtagttcgtaacctgt

SEQ ID NO: 265704 - DNA, 20 bp, human
gtgcatccacttgacgagga

SEQ ID NO: 265705 - DNA, 20 bp, human
ggtccctcacgcagaaagcc

SEQ ID NO: 265706 - DNA, 20 bp, human
ggggcggggccattcttaaa

SEQ ID NO: 265707 - DNA, 20 bp, human
gcagcctctggccaattagg

SEQ ID NO: 265708 - DNA, 20 bp, human
gagcatcgctgagtctctca

SEQ ID NO: 265709 - DNA, 20 bp, human
gtgcggttgaagcgcgaaag

SEQ ID NO: 265710 - DNA, 20 bp, human
ggagaggcggaatataagct

SEQ ID NO: 265711 - DNA, 20 bp, human
gttcgcgcttcaaccgcact

SEQ ID NO: 265712 - DNA, 20 bp, human
gcttcaaccgcactaggagg

SEQ ID NO: 265713 - DNA, 20 bp, human
ggcgcttcaaccgcactagg

SEQ ID NO: 265714 - DNA, 20 bp, human
gtcttcccctcctcctagtg

SEQ ID NO: 265715 - DNA, 20 bp, human
gatgctcattggccagaaga

SEQ ID NO: 265716 - DNA, 20 bp, human
gtgccctctgggagcacgag

SEQ ID NO: 265717 - DNA, 20 bp, human
gcgcccactctgattcggtc

SEQ ID NO: 265718 - DNA, 20 bp, human
ggtaaagcgcagtcacgcgg

SEQ ID NO: 265719 - DNA, 20 bp, human
gtagacgcccgctcactggt

SEQ ID NO: 265720 - DNA, 20 bp, human
gactgcgctttacataatcg

SEQ ID NO: 265721 - DNA, 20 bp, human
gcgggacctcggaagagctt

SEQ ID NO: 265722 - DNA, 20 bp, human
ggacgtcgatcaagtgggaa

SEQ ID NO: 265723 - DNA, 20 bp, human
gtacgccactgtgacgctcc

SEQ ID NO: 265724 - DNA, 20 bp, human
gccgtggagaggcggagcga

SEQ ID NO: 265725 - DNA, 20 bp, human
gcgtcacagtggcgtactcc

SEQ ID NO: 265726 - DNA, 20 bp, human
gaggaagcgcccacaaaggg

SEQ ID NO: 265727 - DNA, 20 bp, human
gcacaaagggaggatgtcgc

SEQ ID NO: 265728 - DNA, 20 bp, human
ggggcggggcaggttcaaag

SEQ ID NO: 265729 - DNA, 20 bp, human
gacgcaggaagcgcccacaa

SEQ ID NO: 265730 - DNA, 20 bp, human
ggagagctccgggatgtcat

SEQ ID NO: 265731 - DNA, 20 bp, human
gtcgccggccaatgacatcc

SEQ ID NO: 265732 - DNA, 20 bp, human
gtaacagccagtcccaggtt

SEQ ID NO: 265733 - DNA, 20 bp, human
gagcgtaggcggccctgagg

SEQ ID NO: 265734 - DNA, 20 bp, human
gcggctctgcggggattcta

SEQ ID NO: 265735 - DNA, 20 bp, human
gaggctatcgcgtcattcga

SEQ ID NO: 265736 - DNA, 20 bp, human
gcccgcgcccgccccgtcag

SEQ ID NO: 265737 - DNA, 20 bp, human
gcgtgcggccgccactgacg

SEQ ID NO: 265738 - DNA, 20 bp, human
gcagctctgggcggtctccc

SEQ ID NO: 265739 - DNA, 20 bp, human
ggagccggagggaccggggt

SEQ ID NO: 265740 - DNA, 20 bp, human
gccgtccgggacggtatcag

SEQ ID NO: 265741 - DNA, 20 bp, human
gctctgggcggtctccccgg

SEQ ID NO: 265742 - DNA, 20 bp, human
ggtatcagcggagatgtcac

SEQ ID NO: 265743 - DNA, 20 bp, human
gcgccccccgcagcaaagtt

SEQ ID NO: 265744 - DNA, 20 bp, human
gtcagcggagatgtcacggg

SEQ ID NO: 265745 - DNA, 20 bp, human
gcccgacgcgtggggacccg

SEQ ID NO: 265746 - DNA, 20 bp, human
ggggcccaagcgccaccggg

SEQ ID NO: 265747 - DNA, 20 bp, human
ggaacccggtagcccagtag

SEQ ID NO: 265748 - DNA, 20 bp, human
ggggtggggccccgcacgtg

SEQ ID NO: 265749 - DNA, 20 bp, human
gggggcggggccctggtagg

SEQ ID NO: 265750 - DNA, 20 bp, human
gcccagggcaccacctacca

SEQ ID NO: 265751 - DNA, 20 bp, human
ggggctaccgggttccccac

SEQ ID NO: 265752 - DNA, 20 bp, human
ggggcgggcccaagcgccac

SEQ ID NO: 265753 - DNA, 20 bp, human
ggggccgaggagtgtcggtg

SEQ ID NO: 265754 - DNA, 20 bp, human
gggggggggggtaatgtgta

SEQ ID NO: 265755 - DNA, 20 bp, human
gcgaatagggacaaaactca

SEQ ID NO: 265756 - DNA, 20 bp, human
gcgcccggaagcggctccgg

SEQ ID NO: 265757 - DNA, 20 bp, human
gttgggtgtgggaacgagga

SEQ ID NO: 265758 - DNA, 20 bp, human
gcgccgccggagccgcttcc

SEQ ID NO: 265759 - DNA, 20 bp, human
gaggctgggcgcgggtgcgc

SEQ ID NO: 265760 - DNA, 20 bp, human
gtgccacggcaaccgcgtcc

SEQ ID NO: 265761 - DNA, 20 bp, human
gtgcctggacgcggttgccg

SEQ ID NO: 265762 - DNA, 20 bp, human
gcgcggcccggccgggttcg

SEQ ID NO: 265763 - DNA, 20 bp, human
gcgggagccgcgaacccggc

SEQ ID NO: 265764 - DNA, 20 bp, human
gcaggtgaacgaaccctccg

SEQ ID NO: 265765 - DNA, 20 bp, human
gcgggcgcgttgcctggacg

SEQ ID NO: 265766 - DNA, 20 bp, human
gaattgggataagtgaggag

SEQ ID NO: 265767 - DNA, 20 bp, human
ggtaaccagaatgctgaatc

SEQ ID NO: 265768 - DNA, 20 bp, human
ggggagaattgggataagtg

SEQ ID NO: 265769 - DNA, 20 bp, human
gggggggatgggggagaatt

SEQ ID NO: 265770 - DNA, 20 bp, human
gcagaatgctgaatcaggtc

SEQ ID NO: 265771 - DNA, 20 bp, human
gtatagcttggcttaaaggg

SEQ ID NO: 265772 - DNA, 20 bp, human
gtaactatagatgttatggg

SEQ ID NO: 265773 - DNA, 20 bp, human
gtagctaactatagatgtta

SEQ ID NO: 265774 - DNA, 20 bp, human
gtatagatgttatgggggga

SEQ ID NO: 265775 - DNA, 20 bp, human
gagtttctgtacatatagct

SEQ ID NO: 265776 - DNA, 20 bp, human
gtcaccttcgcctccccctg

SEQ ID NO: 265777 - DNA, 20 bp, human
gttcgcctccccctgcggct

SEQ ID NO: 265778 - DNA, 20 bp, human
gtcctctcctcccagccgca

SEQ ID NO: 265779 - DNA, 20 bp, human
ggagagttgcgaaacccagc

SEQ ID NO: 265780 - DNA, 20 bp, human
gtcctcccagccgcaggggg

SEQ ID NO: 265781 - DNA, 20 bp, human
gcatgggaatcgaggcaccc

SEQ ID NO: 265782 - DNA, 20 bp, human
gaccagcccagctggaggat

SEQ ID NO: 265783 - DNA, 20 bp, human
gtgaaacagcatgggaatcg

SEQ ID NO: 265784 - DNA, 20 bp, human
gaatcccgcagctgcagatg

SEQ ID NO: 265785 - DNA, 20 bp, human
gcctcctcacacagagaggg

SEQ ID NO: 265786 - DNA, 20 bp, human
gacaaggtgcagcgctggag

SEQ ID NO: 265787 - DNA, 20 bp, human
gcagcgctgcaccttgtctc

SEQ ID NO: 265788 - DNA, 20 bp, human
gaattgccccgtagccccga

SEQ ID NO: 265789 - DNA, 20 bp, human
gctgcccagcgtcaggtccg

SEQ ID NO: 265790 - DNA, 20 bp, human
gtaggcttggagaggacgtg

SEQ ID NO: 265791 - DNA, 20 bp, human
gctggggcgaggagcgatcc

SEQ ID NO: 265792 - DNA, 20 bp, human
gtcagtgcctaagagtcttt

SEQ ID NO: 265793 - DNA, 20 bp, human
ggggcgaggagcgatcccgg

SEQ ID NO: 265794 - DNA, 20 bp, human
gggttacaacaagtcccaag

SEQ ID NO: 265795 - DNA, 20 bp, human
gcctccgcggacctgacgct

SEQ ID NO: 265796 - DNA, 20 bp, human
gatggggcggcgttgctggg

SEQ ID NO: 265797 - DNA, 20 bp, human
gaggcaggagtgtgcaccga

SEQ ID NO: 265798 - DNA, 20 bp, human
gccaacacaggcagacaggt

SEQ ID NO: 265799 - DNA, 20 bp, human
gcctggcactgccgcttccc

SEQ ID NO: 265800 - DNA, 20 bp, human
ggggatggggcggcgttgct

SEQ ID NO: 265801 - DNA, 20 bp, human
gggagtgtgcaccgagggcc

SEQ ID NO: 265802 - DNA, 20 bp, human
gtagggtggcaacagtttgg

SEQ ID NO: 265803 - DNA, 20 bp, human
gtccagaggccaggggcaat

SEQ ID NO: 265804 - DNA, 20 bp, human
gagaggggcccaggcgactc

SEQ ID NO: 265805 - DNA, 20 bp, human
gtgagcgactcaagacaccc

SEQ ID NO: 265806 - DNA, 20 bp, human
gccgccccctgatgcgttat

SEQ ID NO: 265807 - DNA, 20 bp, human
ggcagccaataacgcatcag

SEQ ID NO: 265808 - DNA, 20 bp, human
gcccgcctcggctctcccat

SEQ ID NO: 265809 - DNA, 20 bp, human
gtcagggggcggagccgtag

SEQ ID NO: 265810 - DNA, 20 bp, human
gtggccgcacctccccgcct

SEQ ID NO: 265811 - DNA, 20 bp, human
ggcgaggcgggccgcagagc

SEQ ID NO: 265812 - DNA, 20 bp, human
gctagacaacgaggagaggc

SEQ ID NO: 265813 - DNA, 20 bp, human
ggcagccaatgggagagccg

SEQ ID NO: 265814 - DNA, 20 bp, human
gccccgcctcgctccgctat

SEQ ID NO: 265815 - DNA, 20 bp, human
ggcctcgctccgctattgga

SEQ ID NO: 265816 - DNA, 20 bp, human
gtgtgtgactggtgggttgg

SEQ ID NO: 265817 - DNA, 20 bp, human
gtgggcactgtgtgactggt

SEQ ID NO: 265818 - DNA, 20 bp, human
gtgggtgattagagacaggc

SEQ ID NO: 265819 - DNA, 20 bp, human
gctgatgggtcacacagttg

SEQ ID NO: 265820 - DNA, 20 bp, human
gggtcagcctgaccaaattc

SEQ ID NO: 265821 - DNA, 20 bp, human
gtgactgggcactgtgtgac

SEQ ID NO: 265822 - DNA, 20 bp, human
ggagcaggagaaactcgtgg

SEQ ID NO: 265823 - DNA, 20 bp, human
gacggctggcaggaaggtca

SEQ ID NO: 265824 - DNA, 20 bp, human
gcacccagtggcaccatgcc

SEQ ID NO: 265825 - DNA, 20 bp, human
gacagctgaagggtctgact

SEQ ID NO: 265826 - DNA, 20 bp, human
ggtcccggcgagcccggcgg

SEQ ID NO: 265827 - DNA, 20 bp, human
ggctcgccgggacctccggg

SEQ ID NO: 265828 - DNA, 20 bp, human
gcccgcacgtgggtctgcga

SEQ ID NO: 265829 - DNA, 20 bp, human
gctgcaggacgggattgtga

SEQ ID NO: 265830 - DNA, 20 bp, human
gcggcctggcggacgcggtc

SEQ ID NO: 265831 - DNA, 20 bp, human
gcggattggccgctccccga

SEQ ID NO: 265832 - DNA, 20 bp, human
gccggggctagagtccctga

SEQ ID NO: 265833 - DNA, 20 bp, human
gccgcgcgggcgtggccgtc

SEQ ID NO: 265834 - DNA, 20 bp, human
gccgggctcgccgggacctc

SEQ ID NO: 265835 - DNA, 20 bp, human
ggggcccgaccgcgtccgcc

SEQ ID NO: 265836 - DNA, 20 bp, human
gcagacagacagacctgggg

SEQ ID NO: 265837 - DNA, 20 bp, human
gtcgggcaccaggggaccgt

SEQ ID NO: 265838 - DNA, 20 bp, human
gggggcgcgccggtgactca

SEQ ID NO: 265839 - DNA, 20 bp, human
gcggggcggccctgagtcac

SEQ ID NO: 265840 - DNA, 20 bp, human
gggggcggacgcactgccca

SEQ ID NO: 265841 - DNA, 20 bp, human
gaggtctgtctgtctgtcga

SEQ ID NO: 265842 - DNA, 20 bp, human
gcggggccgggaactcaggt

SEQ ID NO: 265843 - DNA, 20 bp, human
gccgggcggcacgtgaccgc

SEQ ID NO: 265844 - DNA, 20 bp, human
gccgcgagacccgggatccg

SEQ ID NO: 265845 - DNA, 20 bp, human
gcgcactgcccacggtcccc

SEQ ID NO: 265846 - DNA, 20 bp, human
gggcgcggggcgcaggaatg

SEQ ID NO: 265847 - DNA, 20 bp, human
gcctgcccgggcagcacctg

SEQ ID NO: 265848 - DNA, 20 bp, human
ggagccttgggtcaacagtt

SEQ ID NO: 265849 - DNA, 20 bp, human
ggagcccaactgttgaccca

SEQ ID NO: 265850 - DNA, 20 bp, human
ggaccctcgccccggaagtc

SEQ ID NO: 265851 - DNA, 20 bp, human
gggtcggggtctttgaagtg

SEQ ID NO: 265852 - DNA, 20 bp, human
gcgggcctcacggtctccgg

SEQ ID NO: 265853 - DNA, 20 bp, human
ggcagggcacgggcgggtcg

SEQ ID NO: 265854 - DNA, 20 bp, human
gcggggtgactcggaagttc

SEQ ID NO: 265855 - DNA, 20 bp, human
ggccgcgcgcccggagaccc

SEQ ID NO: 265856 - DNA, 20 bp, human
ggtcgggtgtgcggggtacg

SEQ ID NO: 265857 - DNA, 20 bp, human
ggaggtgtgcgcacccgcgg

SEQ ID NO: 265858 - DNA, 20 bp, human
ggccctgggaccggctgctc

SEQ ID NO: 265859 - DNA, 20 bp, human
ggagctgtgtcaatcttcgc

SEQ ID NO: 265860 - DNA, 20 bp, human
gaggacgcgctcattggttg

SEQ ID NO: 265861 - DNA, 20 bp, human
gcgccccaggacgcgctcat

SEQ ID NO: 265862 - DNA, 20 bp, human
gacgcgctcattggttgggg

SEQ ID NO: 265863 - DNA, 20 bp, human
gaaagcgccgcgccccccgc

SEQ ID NO: 265864 - DNA, 20 bp, human
gcgcccgcgttccgtgttcc

SEQ ID NO: 265865 - DNA, 20 bp, human
gtgtcaatcttcgccggcgg

SEQ ID NO: 265866 - DNA, 20 bp, human
gtaaacccgctccggcgcgg

SEQ ID NO: 265867 - DNA, 20 bp, human
ggtcccgaggcccgagtggg

SEQ ID NO: 265868 - DNA, 20 bp, human
gggagtcccgaggcccgagt

SEQ ID NO: 265869 - DNA, 20 bp, human
gcggcgggtggattatttac

SEQ ID NO: 265870 - DNA, 20 bp, human
gtgaaaaagacccgagctcg

SEQ ID NO: 265871 - DNA, 20 bp, human
gccttccgagacaagttaga

SEQ ID NO: 265872 - DNA, 20 bp, human
gcgggtggattatttacagg

SEQ ID NO: 265873 - DNA, 20 bp, human
gagggacgggattgtagatc

SEQ ID NO: 265874 - DNA, 20 bp, human
gggcggggctcccggccgct

SEQ ID NO: 265875 - DNA, 20 bp, human
gccgtggcatttaaagagac

SEQ ID NO: 265876 - DNA, 20 bp, human
gtcagctatgagaataagag

SEQ ID NO: 265877 - DNA, 20 bp, human
ggctatgagaataagagagg

SEQ ID NO: 265878 - DNA, 20 bp, human
gtacttgcagaaggtagatg

SEQ ID NO: 265879 - DNA, 20 bp, human
gcgctcatttggttctggtg

SEQ ID NO: 265880 - DNA, 20 bp, human
gtcttgcgctcatttggttc

SEQ ID NO: 265881 - DNA, 20 bp, human
gagtgcctctcatctgaaag

SEQ ID NO: 265882 - DNA, 20 bp, human
gctctcgggactcttccaaa

SEQ ID NO: 265883 - DNA, 20 bp, human
gtacacagttcagatttcag

SEQ ID NO: 265884 - DNA, 20 bp, human
gtgttaagtatacttgcaga

SEQ ID NO: 265885 - DNA, 20 bp, human
gattacctctttcagatgag

SEQ ID NO: 265886 - DNA, 20 bp, human
ggggtcaggaggaacgtcgt

SEQ ID NO: 265887 - DNA, 20 bp, human
gtggggcaggtcctgggtag

SEQ ID NO: 265888 - DNA, 20 bp, human
gggccaggatgattgttatg

SEQ ID NO: 265889 - DNA, 20 bp, human
gaggatgattgttatgaggg

SEQ ID NO: 265890 - DNA, 20 bp, human
gtgacccccgggggaccccc

SEQ ID NO: 265891 - DNA, 20 bp, human
gacgttcctcctgacccccg

SEQ ID NO: 265892 - DNA, 20 bp, human
gcagaccgtggcctcgctgc

SEQ ID NO: 265893 - DNA, 20 bp, human
ggggtcccccgggggtcagg

SEQ ID NO: 265894 - DNA, 20 bp, human
ggcggggccggttagggcga

SEQ ID NO: 265895 - DNA, 20 bp, human
gcgggaggcggggccggtta

SEQ ID NO: 265896 - DNA, 20 bp, human
gggcccagggcagtgcaccg

SEQ ID NO: 265897 - DNA, 20 bp, human
gggcctggaggtagagtcgt

SEQ ID NO: 265898 - DNA, 20 bp, human
ggatgagagttatgaggccg

SEQ ID NO: 265899 - DNA, 20 bp, human
ggctaggatgagcattatga

SEQ ID NO: 265900 - DNA, 20 bp, human
gggcaggataagattcccgg

SEQ ID NO: 265901 - DNA, 20 bp, human
gctgccccggtgcactgccc

SEQ ID NO: 265902 - DNA, 20 bp, human
gcgggagagttcaggttggt

SEQ ID NO: 265903 - DNA, 20 bp, human
ggatgagcattatgagggcg

SEQ ID NO: 265904 - DNA, 20 bp, human
gcagaccaggagaagcgctc

SEQ ID NO: 265905 - DNA, 20 bp, human
ggtccaggagacaggtcttg

SEQ ID NO: 265906 - DNA, 20 bp, human
gagggaggaggagacccggg

SEQ ID NO: 265907 - DNA, 20 bp, human
gggacccggggcccgcgcag

SEQ ID NO: 265908 - DNA, 20 bp, human
gacccgggtggaggcgagcc

SEQ ID NO: 265909 - DNA, 20 bp, human
gagccgggctcgcctccacc

SEQ ID NO: 265910 - DNA, 20 bp, human
ggccccgccccctctcctcg

SEQ ID NO: 265911 - DNA, 20 bp, human
gcggagttggagatgaatta

SEQ ID NO: 265912 - DNA, 20 bp, human
ggcacagaagggttcgtgac

SEQ ID NO: 265913 - DNA, 20 bp, human
ggctggacgcggacgccacc

SEQ ID NO: 265914 - DNA, 20 bp, human
gatgaattagggcgctggag

SEQ ID NO: 265915 - DNA, 20 bp, human
ggcaggggcctcgaggagag

SEQ ID NO: 265916 - DNA, 20 bp, human
ggtcgcgcaaagctgagaaa

SEQ ID NO: 265917 - DNA, 20 bp, human
gttaaaaaggcaacggttgt

SEQ ID NO: 265918 - DNA, 20 bp, human
ggaggcccggcccatccaga

SEQ ID NO: 265919 - DNA, 20 bp, human
gggccgggcctctcttaaaa

SEQ ID NO: 265920 - DNA, 20 bp, human
ggcctctcttaaaaaggcaa

SEQ ID NO: 265921 - DNA, 20 bp, human
gagatggaaaaatgcggcgg

SEQ ID NO: 265922 - DNA, 20 bp, human
gccaccccctctggatgggc

SEQ ID NO: 265923 - DNA, 20 bp, human
gggacatccactcactcaag

SEQ ID NO: 265924 - DNA, 20 bp, human
ggggaatggacaccagatgg

SEQ ID NO: 265925 - DNA, 20 bp, human
gacaaagcgaggcctgcggg

SEQ ID NO: 265926 - DNA, 20 bp, human
gactactagggcccgaaccc

SEQ ID NO: 265927 - DNA, 20 bp, human
gttcgggccctagtagtcgg

SEQ ID NO: 265928 - DNA, 20 bp, human
gccgccaggcggagctggga

SEQ ID NO: 265929 - DNA, 20 bp, human
ggaccagccaccgactacta

SEQ ID NO: 265930 - DNA, 20 bp, human
gggccctagtagtcggtggc

SEQ ID NO: 265931 - DNA, 20 bp, human
gaggagcaacgcccgccgcc

SEQ ID NO: 265932 - DNA, 20 bp, human
ggcgtctgcagtcccgggtt

SEQ ID NO: 265933 - DNA, 20 bp, human
gggcgggcgttgctcctgag

SEQ ID NO: 265934 - DNA, 20 bp, human
gcccacgggaatatacagag

SEQ ID NO: 265935 - DNA, 20 bp, human
gacttaaagctgtaaaaggg

SEQ ID NO: 265936 - DNA, 20 bp, human
ggcgacgacgaggtaccggg

SEQ ID NO: 265937 - DNA, 20 bp, human
gccgccccgcagcctgtaga

SEQ ID NO: 265938 - DNA, 20 bp, human
gcggggcgacgacgaggtac

SEQ ID NO: 265939 - DNA, 20 bp, human
gccgcagcctgtagagggcg

SEQ ID NO: 265940 - DNA, 20 bp, human
gcgggcggggaacgctcacc

SEQ ID NO: 265941 - DNA, 20 bp, human
ggcggggcggggcgacgacg

SEQ ID NO: 265942 - DNA, 20 bp, human
gggaggggcggggcacggac

SEQ ID NO: 265943 - DNA, 20 bp, human
gtgaacggcgatagtcgctt

SEQ ID NO: 265944 - DNA, 20 bp, human
ggggccgccggaaatggctc

SEQ ID NO: 265945 - DNA, 20 bp, human
gacggggagacgaagcgcgc

SEQ ID NO: 265946 - DNA, 20 bp, human
gcccccgcggtcaatgcccg

SEQ ID NO: 265947 - DNA, 20 bp, human
gcggctgttagagaggatgg

SEQ ID NO: 265948 - DNA, 20 bp, human
gagtagcctagcagcgctgg

SEQ ID NO: 265949 - DNA, 20 bp, human
gctgcctcgggcattgaccg

SEQ ID NO: 265950 - DNA, 20 bp, human
gcgcgcgtccctgccggcga

SEQ ID NO: 265951 - DNA, 20 bp, human
gacgcgcgggacaaccgcgc

SEQ ID NO: 265952 - DNA, 20 bp, human
ggtaagcgcggctgttagag

SEQ ID NO: 265953 - DNA, 20 bp, human
gggaaagcgccaagcaggca

SEQ ID NO: 265954 - DNA, 20 bp, human
ggagaagcaccgcggggcta

SEQ ID NO: 265955 - DNA, 20 bp, human
gggctcggaaagcgccaagc

SEQ ID NO: 265956 - DNA, 20 bp, human
gagaagagggcaccccacag

SEQ ID NO: 265957 - DNA, 20 bp, human
gggcctccccagcctcgcgt

SEQ ID NO: 265958 - DNA, 20 bp, human
ggggctccccaggaggtagc

SEQ ID NO: 265959 - DNA, 20 bp, human
gtgcgtgcggccacatgtgt

SEQ ID NO: 265960 - DNA, 20 bp, human
gcagctcctgagccaacgcg

SEQ ID NO: 265961 - DNA, 20 bp, human
gttgaagatggaggctcttg

SEQ ID NO: 265962 - DNA, 20 bp, human
gcgggcgaccggctcctcct

SEQ ID NO: 265963 - DNA, 20 bp, human
gtgggcaggacccacacatg

SEQ ID NO: 265964 - DNA, 20 bp, human
ggtagcagggagagatttag

SEQ ID NO: 265965 - DNA, 20 bp, human
ggccgcccacggcaggccct

SEQ ID NO: 265966 - DNA, 20 bp, human
ggctcgaaggacctagggaa

SEQ ID NO: 265967 - DNA, 20 bp, human
ggggacaaaaacaatcttcg

SEQ ID NO: 265968 - DNA, 20 bp, human
ggccagacggagtagctcga

SEQ ID NO: 265969 - DNA, 20 bp, human
gatactgagtgagtcagtcg

SEQ ID NO: 265970 - DNA, 20 bp, human
gggagtagctcgaaggacct

SEQ ID NO: 265971 - DNA, 20 bp, human
gcaggaagtaagaaagacgt

SEQ ID NO: 265972 - DNA, 20 bp, human
ggagacaagcctaaaggttc

SEQ ID NO: 265973 - DNA, 20 bp, human
ggtgctttgctcgatttcgg

SEQ ID NO: 265974 - DNA, 20 bp, human
ggggacttgtagtgtccgcc

SEQ ID NO: 265975 - DNA, 20 bp, human
gtcgtcagcacattgcatgc

SEQ ID NO: 265976 - DNA, 20 bp, human
gcacttccggagaacgggaa

SEQ ID NO: 265977 - DNA, 20 bp, human
gctcggacccgggaacatga

SEQ ID NO: 265978 - DNA, 20 bp, human
gtggcgacggagtcgcgcga

SEQ ID NO: 265979 - DNA, 20 bp, human
ggagggacacgccgcgttgt

SEQ ID NO: 265980 - DNA, 20 bp, human
ggcctgaggtgcgagagaag

SEQ ID NO: 265981 - DNA, 20 bp, human
ggggtcgtgcgagccagtag

SEQ ID NO: 265982 - DNA, 20 bp, human
ggagcagaaggcgctgagaa

SEQ ID NO: 265983 - DNA, 20 bp, human
gacgccgcgttgtgggttct

SEQ ID NO: 265984 - DNA, 20 bp, human
ggaagcggtgaccgcggccc

SEQ ID NO: 265985 - DNA, 20 bp, human
gccagcgaccatcatgttcc

SEQ ID NO: 265986 - DNA, 20 bp, human
ggaagctagccgcccagaga

SEQ ID NO: 265987 - DNA, 20 bp, human
gcggtcctcctacccttctc

SEQ ID NO: 265988 - DNA, 20 bp, human
gccgcccagagaagggtagg

SEQ ID NO: 265989 - DNA, 20 bp, human
gctcccgcactgcgcatgtc

SEQ ID NO: 265990 - DNA, 20 bp, human
ggggccctgtaattctttag

SEQ ID NO: 265991 - DNA, 20 bp, human
gtggaagagtctcgggacgc

SEQ ID NO: 265992 - DNA, 20 bp, human
gtacgcgttgccggcgaaga

SEQ ID NO: 265993 - DNA, 20 bp, human
ggggcgtggggaccacgcga

SEQ ID NO: 265994 - DNA, 20 bp, human
gcaggggtggggcggtcagt

SEQ ID NO: 265995 - DNA, 20 bp, human
gcgcgcatgcgcgacttccc

SEQ ID NO: 265996 - DNA, 20 bp, human
gcagctgaagaagggcgcaa

SEQ ID NO: 265997 - DNA, 20 bp, human
gaaaaggtctggaatcggat

SEQ ID NO: 265998 - DNA, 20 bp, human
gttaccggccagacccggac

SEQ ID NO: 265999 - DNA, 20 bp, human
gcagacccggaccggaacct

SEQ ID NO: 266000 - DNA, 20 bp, human
gcgcgccaaggttccggtcc

SEQ ID NO: 266001 - DNA, 20 bp, human
ggcaaaggttcccagccccg

SEQ ID NO: 266002 - DNA, 20 bp, human
gtgaagtgtttattgcctcg

SEQ ID NO: 266003 - DNA, 20 bp, human
ggttccggtccgggtctggc

SEQ ID NO: 266004 - DNA, 20 bp, human
gtgtgctctcaggcagttac

SEQ ID NO: 266005 - DNA, 20 bp, human
gttagagcgccgaacagctc

SEQ ID NO: 266006 - DNA, 20 bp, human
gtgggtgctcccattggcgc

SEQ ID NO: 266007 - DNA, 20 bp, human
ggcccctcggctaacctgtc

SEQ ID NO: 266008 - DNA, 20 bp, human
gagctccccgcagcgtccgg

SEQ ID NO: 266009 - DNA, 20 bp, human
gagcacccaagcccctgcgc

SEQ ID NO: 266010 - DNA, 20 bp, human
gaaccccgacaggttagccg

SEQ ID NO: 266011 - DNA, 20 bp, human
gtcttcccgcgcaggggctt

SEQ ID NO: 266012 - DNA, 20 bp, human
gcgtgcgcgcggcgcttttg

SEQ ID NO: 266013 - DNA, 20 bp, human
gtccggcggcactgaccaat

SEQ ID NO: 266014 - DNA, 20 bp, human
ggcggcgggtgtcactgttg

SEQ ID NO: 266015 - DNA, 20 bp, human
ggaggacgccgaacccgccc

SEQ ID NO: 266016 - DNA, 20 bp, human
gtgcgggtgaaggaccttgg

SEQ ID NO: 266017 - DNA, 20 bp, human
gagggaaggcgtgtcagcag

SEQ ID NO: 266018 - DNA, 20 bp, human
ggaggcgctgaaaacttctg

SEQ ID NO: 266019 - DNA, 20 bp, human
gggaccacccatatttgctg

SEQ ID NO: 266020 - DNA, 20 bp, human
gcgcatgcgcatgcgggtga

SEQ ID NO: 266021 - DNA, 20 bp, human
gctaagtgcgcatgcgcatg

SEQ ID NO: 266022 - DNA, 20 bp, human
gggtggtcccttacggaaag

SEQ ID NO: 266023 - DNA, 20 bp, human
gggtgggtggtggttctttg

SEQ ID NO: 266024 - DNA, 20 bp, human
ggatggaagccaagtggacg

SEQ ID NO: 266025 - DNA, 20 bp, human
gccccagtccacagcaaata

SEQ ID NO: 266026 - DNA, 20 bp, human
gtgacagcccgtggttgctg

SEQ ID NO: 266027 - DNA, 20 bp, human
gggcctagaacctcgccctg

SEQ ID NO: 266028 - DNA, 20 bp, human
gtgaaagattgtggggacag

SEQ ID NO: 266029 - DNA, 20 bp, human
ggcgtgtgacgggctgtgtg

SEQ ID NO: 266030 - DNA, 20 bp, human
gcaaccacgggctgtcactt

SEQ ID NO: 266031 - DNA, 20 bp, human
ggggctgtcacttaggggaa

SEQ ID NO: 266032 - DNA, 20 bp, human
gacacaaggacttgggatgg

SEQ ID NO: 266033 - DNA, 20 bp, human
gtcagtgcacatgcgtgtga

SEQ ID NO: 266034 - DNA, 20 bp, human
gagaatggccatcaccctgt

SEQ ID NO: 266035 - DNA, 20 bp, human
gggtggctggaacaagcccc

SEQ ID NO: 266036 - DNA, 20 bp, human
ggggtcgctaggtgactcag

SEQ ID NO: 266037 - DNA, 20 bp, human
ggggatcacaggttcaagaa

SEQ ID NO: 266038 - DNA, 20 bp, human
gcacctctaggggaatgtca

SEQ ID NO: 266039 - DNA, 20 bp, human
gcccgtccagcccgtccccg

SEQ ID NO: 266040 - DNA, 20 bp, human
gcccgccctgggtctcatgt

SEQ ID NO: 266041 - DNA, 20 bp, human
gcgcagaggccgtggagttc

SEQ ID NO: 266042 - DNA, 20 bp, human
gggtcccctgtgcgtccagg

SEQ ID NO: 266043 - DNA, 20 bp, human
ggagttctgtcccaaaaggg

SEQ ID NO: 266044 - DNA, 20 bp, human
gctgggtctcatgtgggagc

SEQ ID NO: 266045 - DNA, 20 bp, human
gcgtggagttcaggtgtgag

SEQ ID NO: 266046 - DNA, 20 bp, human
gcagccatggacagtccgtg

SEQ ID NO: 266047 - DNA, 20 bp, human
gccccctcacggactgtcca

SEQ ID NO: 266048 - DNA, 20 bp, human
ggtgaaggaagcaaggactc

SEQ ID NO: 266049 - DNA, 20 bp, human
gtggaatatcgtggggacag

SEQ ID NO: 266050 - DNA, 20 bp, human
gtgcgcatgcaggtggcggg

SEQ ID NO: 266051 - DNA, 20 bp, human
gctgctgtggactcattggg

SEQ ID NO: 266052 - DNA, 20 bp, human
gcagctcctcatcctggtga

SEQ ID NO: 266053 - DNA, 20 bp, human
gtggctgctgtggactcatt

SEQ ID NO: 266054 - DNA, 20 bp, human
gacgagagcagcagccgccc

SEQ ID NO: 266055 - DNA, 20 bp, human
gggaagcaaggactcgggag

SEQ ID NO: 266056 - DNA, 20 bp, human
gttaaaggctcccataccgt

SEQ ID NO: 266057 - DNA, 20 bp, human
gggaagcgagacgcggggat

SEQ ID NO: 266058 - DNA, 20 bp, human
gggcgcctgcctctgcgggt

SEQ ID NO: 266059 - DNA, 20 bp, human
gtcgcagagaaggcgtgcgg

SEQ ID NO: 266060 - DNA, 20 bp, human
gccttgggcacctacggtat

SEQ ID NO: 266061 - DNA, 20 bp, human
gagcctgccttgggcaccta

SEQ ID NO: 266062 - DNA, 20 bp, human
gggggcgtgcaggggcgcac

SEQ ID NO: 266063 - DNA, 20 bp, human
gggtatgggagcctttaacg

SEQ ID NO: 266064 - DNA, 20 bp, human
gcgagacgcggggatcggct

SEQ ID NO: 266065 - DNA, 20 bp, human
ggcccgggtttccgctccca

SEQ ID NO: 266066 - DNA, 20 bp, human
ggccaggcgcgcacacccgt

SEQ ID NO: 266067 - DNA, 20 bp, human
ggcctcccccaggaccaaca

SEQ ID NO: 266068 - DNA, 20 bp, human
gaggaaccacgcttgagggg

SEQ ID NO: 266069 - DNA, 20 bp, human
gccgccgcggtgtagtccgc

SEQ ID NO: 266070 - DNA, 20 bp, human
gacgcaaggcctcgacctga

SEQ ID NO: 266071 - DNA, 20 bp, human
gtcgtggccatgttggtcct

SEQ ID NO: 266072 - DNA, 20 bp, human
gtggccaaccaagccgaggc

SEQ ID NO: 266073 - DNA, 20 bp, human
gcccgcgcgagacgcccccg

SEQ ID NO: 266074 - DNA, 20 bp, human
gcggccgccgggaggaacag

SEQ ID NO: 266075 - DNA, 20 bp, human
ggcccccgcggactacaccg

SEQ ID NO: 266076 - DNA, 20 bp, human
gagagcccgcgagctctcta

SEQ ID NO: 266077 - DNA, 20 bp, human
gctagggcggagctccgcgg

SEQ ID NO: 266078 - DNA, 20 bp, human
ggggcgggaccgcagtgcgg

SEQ ID NO: 266079 - DNA, 20 bp, human
gggaagcgccggcgatctcg

SEQ ID NO: 266080 - DNA, 20 bp, human
gtccgccctagagagctcgc

SEQ ID NO: 266081 - DNA, 20 bp, human
gaggccagacgagaatcgaa

SEQ ID NO: 266082 - DNA, 20 bp, human
ggcagtgcgggggatgtcgc

SEQ ID NO: 266083 - DNA, 20 bp, human
gatcgccggcgcttcccccg

SEQ ID NO: 266084 - DNA, 20 bp, human
ggcgtcgaacgcagaggagg

SEQ ID NO: 266085 - DNA, 20 bp, human
gcaatccaatgcggacgcct

SEQ ID NO: 266086 - DNA, 20 bp, human
gaggacgaggccagctgtag

SEQ ID NO: 266087 - DNA, 20 bp, human
gaggggcgaggtccaattag

SEQ ID NO: 266088 - DNA, 20 bp, human
gggttctaggcgagcggagt

SEQ ID NO: 266089 - DNA, 20 bp, human
gtccctccgggaataaaagg

SEQ ID NO: 266090 - DNA, 20 bp, human
gcctggcgccccggcgaatg

SEQ ID NO: 266091 - DNA, 20 bp, human
ggctctggcggaagtgggcc

SEQ ID NO: 266092 - DNA, 20 bp, human
gtgcaaccctgctcccgccg

SEQ ID NO: 266093 - DNA, 20 bp, human
gcgcgctcccgcggcgtcgc

SEQ ID NO: 266094 - DNA, 20 bp, human
gcaaaggggcgagcttttca

SEQ ID NO: 266095 - DNA, 20 bp, human
gaggggtaacagccgcgccc

SEQ ID NO: 266096 - DNA, 20 bp, human
gcgggcataggggcgagaga

SEQ ID NO: 266097 - DNA, 20 bp, human
gtctgtgctagccgggcata

SEQ ID NO: 266098 - DNA, 20 bp, human
gccagctgaaggcaataagc

SEQ ID NO: 266099 - DNA, 20 bp, human
ggagagaagcaactgcgccc

SEQ ID NO: 266100 - DNA, 20 bp, human
ggtgacgccaacttccgcgc

SEQ ID NO: 266101 - DNA, 20 bp, human
gctggctcccagccggtgat

SEQ ID NO: 266102 - DNA, 20 bp, human
gcgggaaagtcgaaaactac

SEQ ID NO: 266103 - DNA, 20 bp, human
gccaacttccgcgccggaag

SEQ ID NO: 266104 - DNA, 20 bp, human
gagagaagctcgcccatcac

SEQ ID NO: 266105 - DNA, 20 bp, human
gaagagtgataacgatgggt

SEQ ID NO: 266106 - DNA, 20 bp, human
ggtgtggcacggtagggagg

SEQ ID NO: 266107 - DNA, 20 bp, human
gacacaggtgtggcacggta

SEQ ID NO: 266108 - DNA, 20 bp, human
ggccctgacgcctcccagta

SEQ ID NO: 266109 - DNA, 20 bp, human
gtggacaaggcattccaatg

SEQ ID NO: 266110 - DNA, 20 bp, human
ggaccatggccattgaagta

SEQ ID NO: 266111 - DNA, 20 bp, human
ggccctactgggaggcgtca

SEQ ID NO: 266112 - DNA, 20 bp, human
ggggctcgaggcgccctact

SEQ ID NO: 266113 - DNA, 20 bp, human
gcttcaatggccatggtcag

SEQ ID NO: 266114 - DNA, 20 bp, human
gcaaggcattccaatgaggt

SEQ ID NO: 266115 - DNA, 20 bp, human
gggaggacaatggaggggac

SEQ ID NO: 266116 - DNA, 20 bp, human
gtggccccgcccacctactc

SEQ ID NO: 266117 - DNA, 20 bp, human
gggggcgggggttgatggag

SEQ ID NO: 266118 - DNA, 20 bp, human
gaagtccagccggagtaggt

SEQ ID NO: 266119 - DNA, 20 bp, human
gaggcctggggcgtgcccat

SEQ ID NO: 266120 - DNA, 20 bp, human
gggggcgtggacaaaacaag

SEQ ID NO: 266121 - DNA, 20 bp, human
gtccagccggagtaggtggg

SEQ ID NO: 266122 - DNA, 20 bp, human
ggcacaagtccagccggagt

SEQ ID NO: 266123 - DNA, 20 bp, human
ggcgcgagggccggtcgcaa

SEQ ID NO: 266124 - DNA, 20 bp, human
gcggccctgccccttgcgac

SEQ ID NO: 266125 - DNA, 20 bp, human
ggggccggtcgcaaggggca

SEQ ID NO: 266126 - DNA, 20 bp, human
ggggtcccaggtgctgacgt

SEQ ID NO: 266127 - DNA, 20 bp, human
gggaacacggataaagacgc

SEQ ID NO: 266128 - DNA, 20 bp, human
gtgcccagagtcaaggaaca

SEQ ID NO: 266129 - DNA, 20 bp, human
gctgcagaagggattccatg

SEQ ID NO: 266130 - DNA, 20 bp, human
gctacctgcgccacatccat

SEQ ID NO: 266131 - DNA, 20 bp, human
gcagagagtcgccgtctcca

SEQ ID NO: 266132 - DNA, 20 bp, human
gcgactctctgcgtactgat

SEQ ID NO: 266133 - DNA, 20 bp, human
gcgcacggtggcggggtccc

SEQ ID NO: 266134 - DNA, 20 bp, human
gcaaggtgaaagcggaagta

SEQ ID NO: 266135 - DNA, 20 bp, human
ggctccagagccgtgcgaat

SEQ ID NO: 266136 - DNA, 20 bp, human
ggtctccagttaccgctttc

SEQ ID NO: 266137 - DNA, 20 bp, human
ggggagtcgtagtaccgcac

SEQ ID NO: 266138 - DNA, 20 bp, human
ggagctgttccgccccggtg

SEQ ID NO: 266139 - DNA, 20 bp, human
gcgactgcgaggtgcatgct

SEQ ID NO: 266140 - DNA, 20 bp, human
gaagcggtaactggagacga

SEQ ID NO: 266141 - DNA, 20 bp, human
ggggttcccgcttccaccga

SEQ ID NO: 266142 - DNA, 20 bp, human
gtcgtagtaccgcaccgggg

SEQ ID NO: 266143 - DNA, 20 bp, human
gagggccgagccacggactg

SEQ ID NO: 266144 - DNA, 20 bp, human
ggaaacaccatccgccgggg

SEQ ID NO: 266145 - DNA, 20 bp, human
gccaccgagggccgactgcg

SEQ ID NO: 266146 - DNA, 20 bp, human
gcgtcccagctcacagtcgg

SEQ ID NO: 266147 - DNA, 20 bp, human
gtcccaccgcgcgtgctcat

SEQ ID NO: 266148 - DNA, 20 bp, human
gcccccctccgactgtgagc

SEQ ID NO: 266149 - DNA, 20 bp, human
gactactccctcaacaggac

SEQ ID NO: 266150 - DNA, 20 bp, human
gcaccgcgcgtgctcatcgg

SEQ ID NO: 266151 - DNA, 20 bp, human
gccctagcgcgagttcggac

SEQ ID NO: 266152 - DNA, 20 bp, human
ggagggaagctgaacctgtc

SEQ ID NO: 266153 - DNA, 20 bp, human
gcccagcgcggtgtcccgac

SEQ ID NO: 266154 - DNA, 20 bp, human
gcccgcaggtacccggacgg

SEQ ID NO: 266155 - DNA, 20 bp, human
ggtgtaccatgaagactgaa

SEQ ID NO: 266156 - DNA, 20 bp, human
gtctgcgggaggcgacatca

SEQ ID NO: 266157 - DNA, 20 bp, human
gagggctccccaaccggtag

SEQ ID NO: 266158 - DNA, 20 bp, human
gtccccaaccggtagtggga

SEQ ID NO: 266159 - DNA, 20 bp, human
gttccctcccactaccggtt

SEQ ID NO: 266160 - DNA, 20 bp, human
gaggccaagtggcgctctgc

SEQ ID NO: 266161 - DNA, 20 bp, human
gccaagtggcgctctgcggg

SEQ ID NO: 266162 - DNA, 20 bp, human
gtccgcccgcggaatcctcc

SEQ ID NO: 266163 - DNA, 20 bp, human
gggaaatgaaggtgaagcgc

SEQ ID NO: 266164 - DNA, 20 bp, human
gagggctcctgggacaattg

SEQ ID NO: 266165 - DNA, 20 bp, human
gattccgcgggcggaaatga

SEQ ID NO: 266166 - DNA, 20 bp, human
gccgctactgagtttccgtt

SEQ ID NO: 266167 - DNA, 20 bp, human
gaataatgcgcatgagtctc

SEQ ID NO: 266168 - DNA, 20 bp, human
gtgcgcatgagtctccggca

SEQ ID NO: 266169 - DNA, 20 bp, human
ggaaaccttcacagccctgc

SEQ ID NO: 266170 - DNA, 20 bp, human
gagtttccgttgggaatgat

SEQ ID NO: 266171 - DNA, 20 bp, human
gcaaaacaccggaaccgcac

SEQ ID NO: 266172 - DNA, 20 bp, human
gcgcccagccatctaatcat

SEQ ID NO: 266173 - DNA, 20 bp, human
gtccgttgggaatgattggc

SEQ ID NO: 266174 - DNA, 20 bp, human
gcagtagcggcattttcaac

SEQ ID NO: 266175 - DNA, 20 bp, human
gatggtccccggtgcggttc

SEQ ID NO: 266176 - DNA, 20 bp, human
gtcgccggggacactgagcg

SEQ ID NO: 266177 - DNA, 20 bp, human
gagggcgcgaccgcctgacc

SEQ ID NO: 266178 - DNA, 20 bp, human
gggacactgagcgagggtag

SEQ ID NO: 266179 - DNA, 20 bp, human
ggggagggaccaaaagccgc

SEQ ID NO: 266180 - DNA, 20 bp, human
gcaaaagccgcaggaagtga

SEQ ID NO: 266181 - DNA, 20 bp, human
gtgaggacccgcgcgtcgcc

SEQ ID NO: 266182 - DNA, 20 bp, human
gagtgtccccggcgacgcgc

SEQ ID NO: 266183 - DNA, 20 bp, human
ggcggccaggtcaccggctg

SEQ ID NO: 266184 - DNA, 20 bp, human
ggggctccgtcctcccgctg

SEQ ID NO: 266185 - DNA, 20 bp, human
ggaactaaagggacggcgag

SEQ ID NO: 266186 - DNA, 20 bp, human
gatgaactgtgagtgactca

SEQ ID NO: 266187 - DNA, 20 bp, human
gtgtcaacgtaagcagatgt

SEQ ID NO: 266188 - DNA, 20 bp, human
gcacggtattcaaaagtccg

SEQ ID NO: 266189 - DNA, 20 bp, human
gttcttctagaattcactga

SEQ ID NO: 266190 - DNA, 20 bp, human
gtgcttacgttgacatacag

SEQ ID NO: 266191 - DNA, 20 bp, human
ggatcactttagcaagtcat

SEQ ID NO: 266192 - DNA, 20 bp, human
ggtagttggaagctgaagcc

SEQ ID NO: 266193 - DNA, 20 bp, human
gacagaaatcttttgaaact

SEQ ID NO: 266194 - DNA, 20 bp, human
gaagtgcatatggtgctata

SEQ ID NO: 266195 - DNA, 20 bp, human
gttttcttttttaccagttc

SEQ ID NO: 266196 - DNA, 20 bp, human
gccggagggaaaccgggttg

SEQ ID NO: 266197 - DNA, 20 bp, human
ggacgcccgcggaacgcgaa

SEQ ID NO: 266198 - DNA, 20 bp, human
ggaacgcgaacggccaatgg

SEQ ID NO: 266199 - DNA, 20 bp, human
gacgtcgcgaggtgcggtcg

SEQ ID NO: 266200 - DNA, 20 bp, human
gaagcagggaggaggatgac

SEQ ID NO: 266201 - DNA, 20 bp, human
gcgcgagagccaatcaaaag

SEQ ID NO: 266202 - DNA, 20 bp, human
gaaaagcggatgtcgaaaag

SEQ ID NO: 266203 - DNA, 20 bp, human
gctcccgcccggagggaaac

SEQ ID NO: 266204 - DNA, 20 bp, human
ggccctgggcgcgacccgac

SEQ ID NO: 266205 - DNA, 20 bp, human
gatgactggtcctgcggata

SEQ ID NO: 266206 - DNA, 20 bp, human
gaaggccctacaggtcgcgg

SEQ ID NO: 266207 - DNA, 20 bp, human
ggggccagcgaaggccctac

SEQ ID NO: 266208 - DNA, 20 bp, human
ggcgaaggccctacaggtcg

SEQ ID NO: 266209 - DNA, 20 bp, human
ggcgggggcgacagcatcgt

SEQ ID NO: 266210 - DNA, 20 bp, human
ggggcgacagcatcgtgggc

SEQ ID NO: 266211 - DNA, 20 bp, human
gcggagccggggaaggtcgg

SEQ ID NO: 266212 - DNA, 20 bp, human
ggtcgcccccgcgacctgta

SEQ ID NO: 266213 - DNA, 20 bp, human
gcggctcggagactgggtgt

SEQ ID NO: 266214 - DNA, 20 bp, human
gctagaaaggcgcccctctc

SEQ ID NO: 266215 - DNA, 20 bp, human
ggcactgggcgcgaaaccgg

SEQ ID NO: 266216 - DNA, 20 bp, human
ggagaggcgcagatccccgg

SEQ ID NO: 266217 - DNA, 20 bp, human
gctggccggaagcccaagag

SEQ ID NO: 266218 - DNA, 20 bp, human
gcgcccgggcaggtgcgccc

SEQ ID NO: 266219 - DNA, 20 bp, human
gtctgggccggcccctcggc

SEQ ID NO: 266220 - DNA, 20 bp, human
gggggatctgcgcctctctt

SEQ ID NO: 266221 - DNA, 20 bp, human
ggcgcgggcccggacgctgg

SEQ ID NO: 266222 - DNA, 20 bp, human
gcgaggggccggcccagacc

SEQ ID NO: 266223 - DNA, 20 bp, human
gagatccccggcggcgcgct

SEQ ID NO: 266224 - DNA, 20 bp, human
gacagccccctccagcgtcc

SEQ ID NO: 266225 - DNA, 20 bp, human
gccgcgcagcccgagcagcg

SEQ ID NO: 266226 - DNA, 20 bp, human
gggctcgttgggcggggcgt

SEQ ID NO: 266227 - DNA, 20 bp, human
gttggtgaacggacggagaa

SEQ ID NO: 266228 - DNA, 20 bp, human
gcgcaagatcgagttctgat

SEQ ID NO: 266229 - DNA, 20 bp, human
gacgcggacgcgcagtcgat

SEQ ID NO: 266230 - DNA, 20 bp, human
ggcggagccttcccgtcccg

SEQ ID NO: 266231 - DNA, 20 bp, human
gctgggcggggctagatctt

SEQ ID NO: 266232 - DNA, 20 bp, human
gttcaggccgcgggacggga

SEQ ID NO: 266233 - DNA, 20 bp, human
gccggcgggcagttgggagc

SEQ ID NO: 266234 - DNA, 20 bp, human
ggttctgattggtgaacgga

SEQ ID NO: 266235 - DNA, 20 bp, human
gggcggggctagatcttggg

SEQ ID NO: 266236 - DNA, 20 bp, human
gggcgtgggaggggcatcgg

SEQ ID NO: 266237 - DNA, 20 bp, human
gagagtttgcgggatttcaa

SEQ ID NO: 266238 - DNA, 20 bp, human
ggggcatcggcggtcagggg

SEQ ID NO: 266239 - DNA, 20 bp, human
gcggcctcctggatgtagga

SEQ ID NO: 266240 - DNA, 20 bp, human
gaccgcagccggcgtgggag

SEQ ID NO: 266241 - DNA, 20 bp, human
gtctccgccaagaccccaga

SEQ ID NO: 266242 - DNA, 20 bp, human
ggggatgcgacgtctgggtg

SEQ ID NO: 266243 - DNA, 20 bp, human
ggcgtcccgcgccgcttcgg

SEQ ID NO: 266244 - DNA, 20 bp, human
gaaaccccaccctgccgacc

SEQ ID NO: 266245 - DNA, 20 bp, human
ggatcctggtcggcagggtg

SEQ ID NO: 266246 - DNA, 20 bp, human
gtccaccctggctccatcaa

SEQ ID NO: 266247 - DNA, 20 bp, human
ggagtcccatgcaccttttg

SEQ ID NO: 266248 - DNA, 20 bp, human
gggagccgcaaaaggtgcat

SEQ ID NO: 266249 - DNA, 20 bp, human
gacacagcccgctcgaagtg

SEQ ID NO: 266250 - DNA, 20 bp, human
ggagccaccggaaccggaac

SEQ ID NO: 266251 - DNA, 20 bp, human
gtggctccatcaatggcgtc

SEQ ID NO: 266252 - DNA, 20 bp, human
ggtggcgacggagccgcaaa

SEQ ID NO: 266253 - DNA, 20 bp, human
gtgtgtcgtcatcttgagtg

SEQ ID NO: 266254 - DNA, 20 bp, human
gaagatggcggtacacactc

SEQ ID NO: 266255 - DNA, 20 bp, human
gccagagacggggaagtcca

SEQ ID NO: 266256 - DNA, 20 bp, human
gccggggacgcccaccaggt

SEQ ID NO: 266257 - DNA, 20 bp, human
ggagtggggcgcgtcaggga

SEQ ID NO: 266258 - DNA, 20 bp, human
gctcgccccgcccacctggt

SEQ ID NO: 266259 - DNA, 20 bp, human
gaggtgggcggggcgagagt

SEQ ID NO: 266260 - DNA, 20 bp, human
gagggggtggggcctccacg

SEQ ID NO: 266261 - DNA, 20 bp, human
gaatcctggcggcgggagag

SEQ ID NO: 266262 - DNA, 20 bp, human
gggtcctacgcgcttcgcta

SEQ ID NO: 266263 - DNA, 20 bp, human
gacggccggggacgcccacc

SEQ ID NO: 266264 - DNA, 20 bp, human
gggaagcatccgggacttca

SEQ ID NO: 266265 - DNA, 20 bp, human
ggacgcccaccaggtgggcg

SEQ ID NO: 266266 - DNA, 20 bp, human
gaaaagccccggtggtcagg

SEQ ID NO: 266267 - DNA, 20 bp, human
ggggaacgcccgggttgggg

SEQ ID NO: 266268 - DNA, 20 bp, human
gagctcacgaaaagccccgg

SEQ ID NO: 266269 - DNA, 20 bp, human
gcctgcgcgcgggtagggag

SEQ ID NO: 266270 - DNA, 20 bp, human
gctggggaacgcccgggttg

SEQ ID NO: 266271 - DNA, 20 bp, human
gacgaaaagccccggtggtc

SEQ ID NO: 266272 - DNA, 20 bp, human
ggtgttcaaagacgcttctg

SEQ ID NO: 266273 - DNA, 20 bp, human
gagccactgcaggaacgccc

SEQ ID NO: 266274 - DNA, 20 bp, human
gacgagctcacgaaaagccc

SEQ ID NO: 266275 - DNA, 20 bp, human
ggcctcgctggggaacgccc

SEQ ID NO: 266276 - DNA, 20 bp, human
gaggctatgctcaccttcct

SEQ ID NO: 266277 - DNA, 20 bp, human
ggggagcagttcacactaac

SEQ ID NO: 266278 - DNA, 20 bp, human
gagcacagcgacagcaactg

SEQ ID NO: 266279 - DNA, 20 bp, human
gttgtgggcggaaacttcca

SEQ ID NO: 266280 - DNA, 20 bp, human
ggtgaactgctcccagctac

SEQ ID NO: 266281 - DNA, 20 bp, human
gcatagcctactaacctgtt

SEQ ID NO: 266282 - DNA, 20 bp, human
ggctacccaaacaggttagt

SEQ ID NO: 266283 - DNA, 20 bp, human
ggctacaggagaatggtcag

SEQ ID NO: 266284 - DNA, 20 bp, human
ggtaaatggtagttgtgtgt

SEQ ID NO: 266285 - DNA, 20 bp, human
gtttctgataacagccttca

SEQ ID NO: 266286 - DNA, 20 bp, human
gcgcacgagcatcaccccac

SEQ ID NO: 266287 - DNA, 20 bp, human
ggcgcagccccgacgctcat

SEQ ID NO: 266288 - DNA, 20 bp, human
gggaacgcgcctgggggggt

SEQ ID NO: 266289 - DNA, 20 bp, human
gcccgcgcagggtcccggct

SEQ ID NO: 266290 - DNA, 20 bp, human
ggggtcggggatggctcggg

SEQ ID NO: 266291 - DNA, 20 bp, human
gcgcccaggccaatgagcgt

SEQ ID NO: 266292 - DNA, 20 bp, human
gccgggcggccacgccacat

SEQ ID NO: 266293 - DNA, 20 bp, human
gagcatcaccccaccggcgg

SEQ ID NO: 266294 - DNA, 20 bp, human
gacgagcatcaccccaccgg

SEQ ID NO: 266295 - DNA, 20 bp, human
ggagcgtcggggctgcgccc

SEQ ID NO: 266296 - DNA, 20 bp, human
gaagccagagcagaacgctg

SEQ ID NO: 266297 - DNA, 20 bp, human
gagtgcgcgcccggcgccga

SEQ ID NO: 266298 - DNA, 20 bp, human
gtctccccagcgttctgctc

SEQ ID NO: 266299 - DNA, 20 bp, human
gaggcggagggccagacccc

SEQ ID NO: 266300 - DNA, 20 bp, human
gtcggtgggaggctggtgaa

SEQ ID NO: 266301 - DNA, 20 bp, human
gtcagcccaaggagctgtca

SEQ ID NO: 266302 - DNA, 20 bp, human
gagggcacggactgcgcctg

SEQ ID NO: 266303 - DNA, 20 bp, human
gctcgccccttgggagagaa

SEQ ID NO: 266304 - DNA, 20 bp, human
gcaatccctgacagctcctt

SEQ ID NO: 266305 - DNA, 20 bp, human
gcggagacgtggctcccggc

SEQ ID NO: 266306 - DNA, 20 bp, human
gcatatcccagggtgggtcg

SEQ ID NO: 266307 - DNA, 20 bp, human
ggcactacatatcccagggt

SEQ ID NO: 266308 - DNA, 20 bp, human
gcgcggcgaggtgggtgaaa

SEQ ID NO: 266309 - DNA, 20 bp, human
ggggtgggtcgcggcgaggt

SEQ ID NO: 266310 - DNA, 20 bp, human
ggcaggcgcagcgtgcactg

SEQ ID NO: 266311 - DNA, 20 bp, human
ggacgtcgctcacgcatttt

SEQ ID NO: 266312 - DNA, 20 bp, human
gcattgtagttcctcattga

SEQ ID NO: 266313 - DNA, 20 bp, human
gtgtagttcctcattgaggg

SEQ ID NO: 266314 - DNA, 20 bp, human
gccaggaaaaaatgcccggc

SEQ ID NO: 266315 - DNA, 20 bp, human
gggtgattctctactatcta

SEQ ID NO: 266316 - DNA, 20 bp, human
gcatacaggagtggggctcg

SEQ ID NO: 266317 - DNA, 20 bp, human
ggcagccaagggcaaggcgc

SEQ ID NO: 266318 - DNA, 20 bp, human
gctggcgcccagcagaggtt

SEQ ID NO: 266319 - DNA, 20 bp, human
gcatggagcggtccgtatag

SEQ ID NO: 266320 - DNA, 20 bp, human
gatggtcgagagagactcag

SEQ ID NO: 266321 - DNA, 20 bp, human
ggcaggcgcactacaaagtc

SEQ ID NO: 266322 - DNA, 20 bp, human
ggataccacagagcttataa

SEQ ID NO: 266323 - DNA, 20 bp, human
gcttctcggggaagctgtca

SEQ ID NO: 266324 - DNA, 20 bp, human
gatcgcccttataagctctg

SEQ ID NO: 266325 - DNA, 20 bp, human
ggtcaaaaagcatatgttcg

SEQ ID NO: 266326 - DNA, 20 bp, human
gcgcgctggcgcaaggttgg

SEQ ID NO: 266327 - DNA, 20 bp, human
gggtcctgggtaccgagcat

SEQ ID NO: 266328 - DNA, 20 bp, human
gctgacgcagcgcccatgct

SEQ ID NO: 266329 - DNA, 20 bp, human
gtctcccaggagattagtgc

SEQ ID NO: 266330 - DNA, 20 bp, human
gcagggcggcgcaatgtgat

SEQ ID NO: 266331 - DNA, 20 bp, human
ggcgacccccggaggccgaa

SEQ ID NO: 266332 - DNA, 20 bp, human
gcggggcgggagcacgactc

SEQ ID NO: 266333 - DNA, 20 bp, human
gggagctttctattggtcct

SEQ ID NO: 266334 - DNA, 20 bp, human
gtgcccggctggcgcggcgt

SEQ ID NO: 266335 - DNA, 20 bp, human
ggggcgagcggccggaatcc

SEQ ID NO: 266336 - DNA, 20 bp, human
gcagagggaaaacaccttcc

SEQ ID NO: 266337 - DNA, 20 bp, human
ggggaaaacaccttcctgga

SEQ ID NO: 266338 - DNA, 20 bp, human
gacgttgttgaggaggcagg

SEQ ID NO: 266339 - DNA, 20 bp, human
ggctgcgcgagtgacggatg

SEQ ID NO: 266340 - DNA, 20 bp, human
ggcgcagcaggcggaagtag

SEQ ID NO: 266341 - DNA, 20 bp, human
gcagagcgatccatccagga

SEQ ID NO: 266342 - DNA, 20 bp, human
gaggacgttgttgaggaggc

SEQ ID NO: 266343 - DNA, 20 bp, human
gctccagtggaaaatgtcct

SEQ ID NO: 266344 - DNA, 20 bp, human
gaagcagcttagtcccggcg

SEQ ID NO: 266345 - DNA, 20 bp, human
gcctcaacaacgtcctccag

SEQ ID NO: 266346 - DNA, 20 bp, human
ggggcgcggacgggattctc

SEQ ID NO: 266347 - DNA, 20 bp, human
gagacgcagccgaaggagga

SEQ ID NO: 266348 - DNA, 20 bp, human
gccggccagagagaccgcag

SEQ ID NO: 266349 - DNA, 20 bp, human
ggctgctgccactgtcgggg

SEQ ID NO: 266350 - DNA, 20 bp, human
gccaccgcctccaaggggga

SEQ ID NO: 266351 - DNA, 20 bp, human
gtcggggtggcgcgcccagc

SEQ ID NO: 266352 - DNA, 20 bp, human
ggggcgcgccaccccgacag

SEQ ID NO: 266353 - DNA, 20 bp, human
ggcccgggagacgcagccga

SEQ ID NO: 266354 - DNA, 20 bp, human
gttcacccgcgccacagctg

SEQ ID NO: 266355 - DNA, 20 bp, human
gcggacgggattctccggct

SEQ ID NO: 266356 - DNA, 20 bp, human
gagccggcagccggggaaag

SEQ ID NO: 266357 - DNA, 20 bp, human
ggtcccagagccggcagccg

SEQ ID NO: 266358 - DNA, 20 bp, human
gaactcgagcccactttccc

SEQ ID NO: 266359 - DNA, 20 bp, human
gctgccggctctgggaccgc

SEQ ID NO: 266360 - DNA, 20 bp, human
gcgcccagcggggtctagcg

SEQ ID NO: 266361 - DNA, 20 bp, human
gggcgccggcgctcatttct

SEQ ID NO: 266362 - DNA, 20 bp, human
ggggtctagcgcggctccga

SEQ ID NO: 266363 - DNA, 20 bp, human
gctggtgttcgcagggactg

SEQ ID NO: 266364 - DNA, 20 bp, human
ggggctctttgggtccgggc

SEQ ID NO: 266365 - DNA, 20 bp, human
ggagacgagaaggcgcccag

SEQ ID NO: 266366 - DNA, 20 bp, human
gacggtggggaatcaagtca

SEQ ID NO: 266367 - DNA, 20 bp, human
gtctgtctcacggagaggga

SEQ ID NO: 266368 - DNA, 20 bp, human
gtcggtgaaaccaagaaggg

SEQ ID NO: 266369 - DNA, 20 bp, human
gtggcccagaactcacggtg

SEQ ID NO: 266370 - DNA, 20 bp, human
gataaactgaggccctggac

SEQ ID NO: 266371 - DNA, 20 bp, human
gctgctgagaaagttggagt

SEQ ID NO: 266372 - DNA, 20 bp, human
ggaggaagccaactggtttg

SEQ ID NO: 266373 - DNA, 20 bp, human
gttctgggccacaaaccagt

SEQ ID NO: 266374 - DNA, 20 bp, human
gccctcggtgaaaccaagaa

SEQ ID NO: 266375 - DNA, 20 bp, human
gagctctctgtctcacggag

SEQ ID NO: 266376 - DNA, 20 bp, human
gtaaccatcctagaagaagg

SEQ ID NO: 266377 - DNA, 20 bp, human
gaattaaccatcctagaaga

SEQ ID NO: 266378 - DNA, 20 bp, human
gatcatacttccatcctgga

SEQ ID NO: 266379 - DNA, 20 bp, human
gtcaaaggtaaatgcactta

SEQ ID NO: 266380 - DNA, 20 bp, human
gtaattatgggacactgtgt

SEQ ID NO: 266381 - DNA, 20 bp, human
gttgccactactaggtaata

SEQ ID NO: 266382 - DNA, 20 bp, human
gtactgacagcgttgttcat

SEQ ID NO: 266383 - DNA, 20 bp, human
gtcacatcatacttccatcc

SEQ ID NO: 266384 - DNA, 20 bp, human
gttttggccactgtctccca

SEQ ID NO: 266385 - DNA, 20 bp, human
ggttccttattacctagtag

SEQ ID NO: 266386 - DNA, 20 bp, human
gcagtagccaaaacactcga

SEQ ID NO: 266387 - DNA, 20 bp, human
ggggcaggcctgggtccacg

SEQ ID NO: 266388 - DNA, 20 bp, human
gcacccgggtggatgagagt

SEQ ID NO: 266389 - DNA, 20 bp, human
gggtgctaagtccatggtcc

SEQ ID NO: 266390 - DNA, 20 bp, human
gatggacttagcaccagaca

SEQ ID NO: 266391 - DNA, 20 bp, human
ggagtgcaagagagatgctg

SEQ ID NO: 266392 - DNA, 20 bp, human
ggctactgtcattgcttccg

SEQ ID NO: 266393 - DNA, 20 bp, human
gtcagctccttcgagtgttt

SEQ ID NO: 266394 - DNA, 20 bp, human
gatactgatagagtgtgcaa

SEQ ID NO: 266395 - DNA, 20 bp, human
gctaggtagccagttgaacg

SEQ ID NO: 266396 - DNA, 20 bp, human
ggagccagagcagttctcac

SEQ ID NO: 266397 - DNA, 20 bp, human
gaagaaacagggattggcac

SEQ ID NO: 266398 - DNA, 20 bp, human
gtaggcaggagccataacaa

SEQ ID NO: 266399 - DNA, 20 bp, human
gggagtgagactccctctct

SEQ ID NO: 266400 - DNA, 20 bp, human
gaagatatagtcagatctgg

SEQ ID NO: 266401 - DNA, 20 bp, human
gccaaggcctcagcctagag

SEQ ID NO: 266402 - DNA, 20 bp, human
ggttgcttacagagtagcag

SEQ ID NO: 266403 - DNA, 20 bp, human
gaggcccctgggggttctag

SEQ ID NO: 266404 - DNA, 20 bp, human
gaggctacctcccgtgtctg

SEQ ID NO: 266405 - DNA, 20 bp, human
ggtctggggactctggatgg

SEQ ID NO: 266406 - DNA, 20 bp, human
gagctcgcgcaggacggggc

SEQ ID NO: 266407 - DNA, 20 bp, human
gcaggcagctcgcgcaggac

SEQ ID NO: 266408 - DNA, 20 bp, human
gcacagaaggctggcgtagc

SEQ ID NO: 266409 - DNA, 20 bp, human
gcgcaccggcgaacctgcct

SEQ ID NO: 266410 - DNA, 20 bp, human
gtcgccggtgcgagcgtaaa

SEQ ID NO: 266411 - DNA, 20 bp, human
gcggtgcgagcgtaaagggg

SEQ ID NO: 266412 - DNA, 20 bp, human
gagggcatcgcgtgggtgtg

SEQ ID NO: 266413 - DNA, 20 bp, human
gcctgcccaggcaggttcgc

SEQ ID NO: 266414 - DNA, 20 bp, human
gctgcgcgagctgcctgccc

SEQ ID NO: 266415 - DNA, 20 bp, human
gggagctgagggcatcgcgt

SEQ ID NO: 266416 - DNA, 20 bp, human
gcaggctccgcgcctccggg

SEQ ID NO: 266417 - DNA, 20 bp, human
gcgcgaggaagctgcagtcg

SEQ ID NO: 266418 - DNA, 20 bp, human
gtactctggggcccgcggga

SEQ ID NO: 266419 - DNA, 20 bp, human
gagccctgcagatccggccc

SEQ ID NO: 266420 - DNA, 20 bp, human
ggcgcaggactcacctgggg

SEQ ID NO: 266421 - DNA, 20 bp, human
gggagggccggccggggtag

SEQ ID NO: 266422 - DNA, 20 bp, human
gcgcctcagccctgcagatc

SEQ ID NO: 266423 - DNA, 20 bp, human
gcggccggaccgcggagatg

SEQ ID NO: 266424 - DNA, 20 bp, human
ggaaatgcggccccaccgcg

SEQ ID NO: 266425 - DNA, 20 bp, human
ggtaggggaggaccgggatc

SEQ ID NO: 266426 - DNA, 20 bp, human
gaaaaaagtttgggtctgtg

SEQ ID NO: 266427 - DNA, 20 bp, human
gcatgtccttaaagcggaaa

SEQ ID NO: 266428 - DNA, 20 bp, human
ggtcgctgtcccataggagg

SEQ ID NO: 266429 - DNA, 20 bp, human
ggcacgtgatgaaaaaagtt

SEQ ID NO: 266430 - DNA, 20 bp, human
gggacccatgacatgaagtg

SEQ ID NO: 266431 - DNA, 20 bp, human
gctgcgtactggctcggacc

SEQ ID NO: 266432 - DNA, 20 bp, human
gtcattacagagctgcgtac

SEQ ID NO: 266433 - DNA, 20 bp, human
gtgcaggaaaggcatgcctg

SEQ ID NO: 266434 - DNA, 20 bp, human
ggtgcatttggccaaactct

SEQ ID NO: 266435 - DNA, 20 bp, human
gaaaacacccttctttccag

SEQ ID NO: 266436 - DNA, 20 bp, human
ggagctctcaggctgtacat

SEQ ID NO: 266437 - DNA, 20 bp, human
gtgggagcctcttccttatc

SEQ ID NO: 266438 - DNA, 20 bp, human
gaagaggctcccacagaagc

SEQ ID NO: 266439 - DNA, 20 bp, human
gaattgcctgctagtttctc

SEQ ID NO: 266440 - DNA, 20 bp, human
gttccttatcaggagctctc

SEQ ID NO: 266441 - DNA, 20 bp, human
gggaggggaccctgggtatt

SEQ ID NO: 266442 - DNA, 20 bp, human
gtgactccagagaaactagc

SEQ ID NO: 266443 - DNA, 20 bp, human
gataaagagtccctgggggt

SEQ ID NO: 266444 - DNA, 20 bp, human
gggaattaactggggagccc

SEQ ID NO: 266445 - DNA, 20 bp, human
gggtatctccatttgccaag

SEQ ID NO: 266446 - DNA, 20 bp, human
gtcacccgccctcacagagg

SEQ ID NO: 266447 - DNA, 20 bp, human
gaagagggcgccaggctcaa

SEQ ID NO: 266448 - DNA, 20 bp, human
gtcctcctgcccacttctga

SEQ ID NO: 266449 - DNA, 20 bp, human
ggactcacccgccctcacag

SEQ ID NO: 266450 - DNA, 20 bp, human
gcaggctcaaaggccctctt

SEQ ID NO: 266451 - DNA, 20 bp, human
gtcttcccggagaggcgttg

SEQ ID NO: 266452 - DNA, 20 bp, human
gtcctgggagtcgcagtcgg

SEQ ID NO: 266453 - DNA, 20 bp, human
gagctgccccaacgcctctc

SEQ ID NO: 266454 - DNA, 20 bp, human
gtggcgccctcttcccggag

SEQ ID NO: 266455 - DNA, 20 bp, human
gaccgccgactgcgactccc

SEQ ID NO: 266456 - DNA, 20 bp, human
ggcgaccgctgcacaggcaa

SEQ ID NO: 266457 - DNA, 20 bp, human
gtcgacaggctcgagaatcc

SEQ ID NO: 266458 - DNA, 20 bp, human
gcagcgggttgcgtgtcgac

SEQ ID NO: 266459 - DNA, 20 bp, human
gggcgcacgcgcagtgagcc

SEQ ID NO: 266460 - DNA, 20 bp, human
ggaaaccggaagcgagttta

SEQ ID NO: 266461 - DNA, 20 bp, human
gggtgctcgcattggggaag

SEQ ID NO: 266462 - DNA, 20 bp, human
ggggccagagggatttagct

SEQ ID NO: 266463 - DNA, 20 bp, human
gggcccctgtacacccaaaa

SEQ ID NO: 266464 - DNA, 20 bp, human
gtattggggtgctcgcattg

SEQ ID NO: 266465 - DNA, 20 bp, human
ggcgagcaccccaataatca

SEQ ID NO: 266466 - DNA, 20 bp, human
ggggaggggcgatgatcagt

SEQ ID NO: 266467 - DNA, 20 bp, human
ggaggggtgactgtagctga

SEQ ID NO: 266468 - DNA, 20 bp, human
ggaggcctcagggacattgt

SEQ ID NO: 266469 - DNA, 20 bp, human
gggacccagcgccatctgcg

SEQ ID NO: 266470 - DNA, 20 bp, human
gcaggagctgccattgatag

SEQ ID NO: 266471 - DNA, 20 bp, human
gttggctgagaggatcaaat

SEQ ID NO: 266472 - DNA, 20 bp, human
ggggacggcagggaccactc

SEQ ID NO: 266473 - DNA, 20 bp, human
ggggaggggaggcgtcgtcc

SEQ ID NO: 266474 - DNA, 20 bp, human
gccagctggagcaattagga

SEQ ID NO: 266475 - DNA, 20 bp, human
ggggccgggatggactgcct

SEQ ID NO: 266476 - DNA, 20 bp, human
gaccctccctccccggaccc

SEQ ID NO: 266477 - DNA, 20 bp, human
gcgcccacggctgggggcga

SEQ ID NO: 266478 - DNA, 20 bp, human
ggggcgcgcgcccacggctg

SEQ ID NO: 266479 - DNA, 20 bp, human
ggatcccagacttccccgga

SEQ ID NO: 266480 - DNA, 20 bp, human
gtgcgaggggcgcgcgccca

SEQ ID NO: 266481 - DNA, 20 bp, human
gtccccccaccccctctcga

SEQ ID NO: 266482 - DNA, 20 bp, human
gtgccccctccggggaagtc

SEQ ID NO: 266483 - DNA, 20 bp, human
gcccggaccccggctgcgag

SEQ ID NO: 266484 - DNA, 20 bp, human
gccaccccctctcgagggga

SEQ ID NO: 266485 - DNA, 20 bp, human
gccgagccctcccctcgaga

SEQ ID NO: 266486 - DNA, 20 bp, human
gtctcggccgcccgccggag

SEQ ID NO: 266487 - DNA, 20 bp, human
gagtctgggctctgagcgag

SEQ ID NO: 266488 - DNA, 20 bp, human
gggcccggccccctctccgg

SEQ ID NO: 266489 - DNA, 20 bp, human
gggagccgggtcagcgagtc

SEQ ID NO: 266490 - DNA, 20 bp, human
gtcgctgacccggctcctag

SEQ ID NO: 266491 - DNA, 20 bp, human
gacctggcactgctgcccac

SEQ ID NO: 266492 - DNA, 20 bp, human
gccgcagcgagcgcgccggg

SEQ ID NO: 266493 - DNA, 20 bp, human
gcccctggctgtgtgcgcgc

SEQ ID NO: 266494 - DNA, 20 bp, human
gcccagggtaggaagcaagg

SEQ ID NO: 266495 - DNA, 20 bp, human
gcttccaggggtgatcactg

SEQ ID NO: 266496 - DNA, 20 bp, human
ggccgagcgcggccggggaa

SEQ ID NO: 266497 - DNA, 20 bp, human
gagggcccagtgctcggcgc

SEQ ID NO: 266498 - DNA, 20 bp, human
gcgcccgggcagaaggcgag

SEQ ID NO: 266499 - DNA, 20 bp, human
gcctcccagcgccgagcact

SEQ ID NO: 266500 - DNA, 20 bp, human
gtcttcccgaagaaggggtg

SEQ ID NO: 266501 - DNA, 20 bp, human
gtgaccttcccacccagggg

SEQ ID NO: 266502 - DNA, 20 bp, human
gaatcttggggcgtctgcca

SEQ ID NO: 266503 - DNA, 20 bp, human
gcgcccgcgctgcgtggcaa

SEQ ID NO: 266504 - DNA, 20 bp, human
gtcgcagccgagcgcggccg

SEQ ID NO: 266505 - DNA, 20 bp, human
ggccccgcccctgggtggga

SEQ ID NO: 266506 - DNA, 20 bp, human
ggagtgaacccgcccagggt

SEQ ID NO: 266507 - DNA, 20 bp, human
gcgggaggagggtgtcgcgt

SEQ ID NO: 266508 - DNA, 20 bp, human
gccagtgccccgcatatgtg

SEQ ID NO: 266509 - DNA, 20 bp, human
ggacgagcgcgggcatcctc

SEQ ID NO: 266510 - DNA, 20 bp, human
gttcccaaccaagtagactg

SEQ ID NO: 266511 - DNA, 20 bp, human
ggcccctgggctaaggacga

SEQ ID NO: 266512 - DNA, 20 bp, human
gtcgggagtgaacccgccca

SEQ ID NO: 266513 - DNA, 20 bp, human
gggttgggaaataggacggt

SEQ ID NO: 266514 - DNA, 20 bp, human
gactggaagcccaccctggg

SEQ ID NO: 266515 - DNA, 20 bp, human
gccagtcacccgcacatatg

SEQ ID NO: 266516 - DNA, 20 bp, human
gggagccgcggcagagactg

SEQ ID NO: 266517 - DNA, 20 bp, human
gccgaggcggaggctggcaa

SEQ ID NO: 266518 - DNA, 20 bp, human
ggagaggccccgcaccgagg

SEQ ID NO: 266519 - DNA, 20 bp, human
gagactgtgggtgccacaag

SEQ ID NO: 266520 - DNA, 20 bp, human
ggtggtgatgagggcgacga

SEQ ID NO: 266521 - DNA, 20 bp, human
ggcgcggacgatacttgaag

SEQ ID NO: 266522 - DNA, 20 bp, human
ggacgatacttgaagaggtg

SEQ ID NO: 266523 - DNA, 20 bp, human
gtgcggggcctctcgctcgc

SEQ ID NO: 266524 - DNA, 20 bp, human
gatgagggcgacgaaggagg

SEQ ID NO: 266525 - DNA, 20 bp, human
ggtgatgagggcgacgaagg

SEQ ID NO: 266526 - DNA, 20 bp, human
gacagagtaagggagagatc

SEQ ID NO: 266527 - DNA, 20 bp, human
gtgaggaacgaggggaacca

SEQ ID NO: 266528 - DNA, 20 bp, human
ggatcgggactgaggaacga

SEQ ID NO: 266529 - DNA, 20 bp, human
ggtgggcggggacagagtaa

SEQ ID NO: 266530 - DNA, 20 bp, human
ggggctcaacccggactgag

SEQ ID NO: 266531 - DNA, 20 bp, human
gtgagaggccggcgcagagt

SEQ ID NO: 266532 - DNA, 20 bp, human
ggggcggcggctgtcagtgg

SEQ ID NO: 266533 - DNA, 20 bp, human
gccagcccggccttcctctc

SEQ ID NO: 266534 - DNA, 20 bp, human
gaggccggcgcagagtgggc

SEQ ID NO: 266535 - DNA, 20 bp, human
gaagggagagatcgggactg

SEQ ID NO: 266536 - DNA, 20 bp, human
gtccgagtgaaaaactccga

SEQ ID NO: 266537 - DNA, 20 bp, human
ggagagaggctgcggctcgg

SEQ ID NO: 266538 - DNA, 20 bp, human
ggacggggggctccgatccg

SEQ ID NO: 266539 - DNA, 20 bp, human
gcgggctgggggcgcctagt

SEQ ID NO: 266540 - DNA, 20 bp, human
gactggagggatgtgagggc

SEQ ID NO: 266541 - DNA, 20 bp, human
ggccactcgggggggagttg

SEQ ID NO: 266542 - DNA, 20 bp, human
gaaaaactccgatggactgg

SEQ ID NO: 266543 - DNA, 20 bp, human
gggagcctggattcttaact

SEQ ID NO: 266544 - DNA, 20 bp, human
ggggggctccgatccggggc

SEQ ID NO: 266545 - DNA, 20 bp, human
gcacctcttagctcccgggg

SEQ ID NO: 266546 - DNA, 20 bp, human
gtaccccgcggaccagaccg

SEQ ID NO: 266547 - DNA, 20 bp, human
gcgggggttgggagaccgca

SEQ ID NO: 266548 - DNA, 20 bp, human
gaggccatgtggactggctg

SEQ ID NO: 266549 - DNA, 20 bp, human
gcgacagcccaggaagacta

SEQ ID NO: 266550 - DNA, 20 bp, human
gggcgcaagagtgttcccgg

SEQ ID NO: 266551 - DNA, 20 bp, human
gctcagatgggtgagaaacg

SEQ ID NO: 266552 - DNA, 20 bp, human
gggatcttcagacaaggtcg

SEQ ID NO: 266553 - DNA, 20 bp, human
ggcactgtggagcgggactc

SEQ ID NO: 266554 - DNA, 20 bp, human
ggccgccccctagtcttcct

SEQ ID NO: 266555 - DNA, 20 bp, human
gcgggggcaggcagccacac

SEQ ID NO: 266556 - DNA, 20 bp, human
ggcttcttggtatcttgaaa

SEQ ID NO: 266557 - DNA, 20 bp, human
ggccagagggagttccttga

SEQ ID NO: 266558 - DNA, 20 bp, human
gggccctgccaggatctcta

SEQ ID NO: 266559 - DNA, 20 bp, human
gaatctgccacctccgccct

SEQ ID NO: 266560 - DNA, 20 bp, human
gcagggcctggctctcccga

SEQ ID NO: 266561 - DNA, 20 bp, human
gcagcagtctgtaaatagga

SEQ ID NO: 266562 - DNA, 20 bp, human
gccaccatttaggcacaggt

SEQ ID NO: 266563 - DNA, 20 bp, human
ggacgggctgcccagaaaca

SEQ ID NO: 266564 - DNA, 20 bp, human
gtgcctaaatggtggcttct

SEQ ID NO: 266565 - DNA, 20 bp, human
gcctggctaaaggaattctg

SEQ ID NO: 266566 - DNA, 20 bp, human
ggggccgcgacggcgaaaac

SEQ ID NO: 266567 - DNA, 20 bp, human
gctaggccgccggacactgt

SEQ ID NO: 266568 - DNA, 20 bp, human
gcccggggcgacaagcccga

SEQ ID NO: 266569 - DNA, 20 bp, human
gacgacccgacagtgtccgg

SEQ ID NO: 266570 - DNA, 20 bp, human
gagcccgagggccccccctg

SEQ ID NO: 266571 - DNA, 20 bp, human
gccgggagctggacaacttg

SEQ ID NO: 266572 - DNA, 20 bp, human
gactgtcgggtcgtcttaaa

SEQ ID NO: 266573 - DNA, 20 bp, human
ggggtggccactgaactcgg

SEQ ID NO: 266574 - DNA, 20 bp, human
gaagacgacccgacagtgtc

SEQ ID NO: 266575 - DNA, 20 bp, human
gcgcgacggcgaaaacgggg

SEQ ID NO: 266576 - DNA, 20 bp, human
ggggcggggcctgcgtgaat

SEQ ID NO: 266577 - DNA, 20 bp, human
gggggcctgcgtgaatgggg

SEQ ID NO: 266578 - DNA, 20 bp, human
gctgccccgccccgctcata

SEQ ID NO: 266579 - DNA, 20 bp, human
ggctagggggcgaggtcgaa

SEQ ID NO: 266580 - DNA, 20 bp, human
ggcccggctgcgctcgccag

SEQ ID NO: 266581 - DNA, 20 bp, human
ggggggcggagccttatgag

SEQ ID NO: 266582 - DNA, 20 bp, human
gctgcgtgagcgggtcgggg

SEQ ID NO: 266583 - DNA, 20 bp, human
gggccggagccttgtgagcg

SEQ ID NO: 266584 - DNA, 20 bp, human
ggagccttatgagcggggcg

SEQ ID NO: 266585 - DNA, 20 bp, human
gcggcggccctcacttcctc

SEQ ID NO: 266586 - DNA, 20 bp, human
gggagtgaggcgaagctcgg

SEQ ID NO: 266587 - DNA, 20 bp, human
ggctggggtggggcgaggat

SEQ ID NO: 266588 - DNA, 20 bp, human
ggtgaggcgaagctcggagg

SEQ ID NO: 266589 - DNA, 20 bp, human
gtggggaggggcgagacccg

SEQ ID NO: 266590 - DNA, 20 bp, human
gggaaggcgtcgctggagtt

SEQ ID NO: 266591 - DNA, 20 bp, human
gagcctggaaagcgtggctg

SEQ ID NO: 266592 - DNA, 20 bp, human
gcaagcccggaaggcgtcgc

SEQ ID NO: 266593 - DNA, 20 bp, human
gaggggcgagacccggggac

SEQ ID NO: 266594 - DNA, 20 bp, human
ggggcggggcgagaccttgg

SEQ ID NO: 266595 - DNA, 20 bp, human
gtggacttggttccgttctc

SEQ ID NO: 266596 - DNA, 20 bp, human
gggccccggcgtctccgcgt

SEQ ID NO: 266597 - DNA, 20 bp, human
gagaagccgccgggacgcgc

SEQ ID NO: 266598 - DNA, 20 bp, human
gagacgggaagctcggctct

SEQ ID NO: 266599 - DNA, 20 bp, human
gcggggcgctgcacaccggg

SEQ ID NO: 266600 - DNA, 20 bp, human
gtggttgcttcacgccccgg

SEQ ID NO: 266601 - DNA, 20 bp, human
gacgccccgggggaagagac

SEQ ID NO: 266602 - DNA, 20 bp, human
ggcgccccacgcggagacgc

SEQ ID NO: 266603 - DNA, 20 bp, human
ggccccgcgctccgctgcca

SEQ ID NO: 266604 - DNA, 20 bp, human
ggcgctgcacaccgggaggg

SEQ ID NO: 266605 - DNA, 20 bp, human
ggaagctcggctctgggttg

SEQ ID NO: 266606 - DNA, 20 bp, human
ggggaccaggaggccaatcc

SEQ ID NO: 266607 - DNA, 20 bp, human
gcccaagtggccgcggacgg

SEQ ID NO: 266608 - DNA, 20 bp, human
gttgccctggaaaccgagtt

SEQ ID NO: 266609 - DNA, 20 bp, human
gcagaccccgggcgagcagg

SEQ ID NO: 266610 - DNA, 20 bp, human
ggcggctcggcgcagacccc

SEQ ID NO: 266611 - DNA, 20 bp, human
ggaggggacgcgctgcaggg

SEQ ID NO: 266612 - DNA, 20 bp, human
gggtccccccgcctgggcgg

SEQ ID NO: 266613 - DNA, 20 bp, human
gcaggcccgtaccattgcgc

SEQ ID NO: 266614 - DNA, 20 bp, human
gcgcgcccgcgcaatggtac

SEQ ID NO: 266615 - DNA, 20 bp, human
ggcctgcgctgccggaactg

SEQ ID NO: 266616 - DNA, 20 bp, human
ggggcggagccaggactctt

SEQ ID NO: 266617 - DNA, 20 bp, human
ggcaaggccaaacgcggagg

SEQ ID NO: 266618 - DNA, 20 bp, human
gcctctgagcgaagtggtgg

SEQ ID NO: 266619 - DNA, 20 bp, human
gtgaagctggagaatgcggt

SEQ ID NO: 266620 - DNA, 20 bp, human
gagacggcactcgattaaat

SEQ ID NO: 266621 - DNA, 20 bp, human
gcgggtggaccccgaaacgg

SEQ ID NO: 266622 - DNA, 20 bp, human
gggcccaaactgttacgaag

SEQ ID NO: 266623 - DNA, 20 bp, human
gtagccgcctctgagcgaag

SEQ ID NO: 266624 - DNA, 20 bp, human
gttactgtctgccacgtagc

SEQ ID NO: 266625 - DNA, 20 bp, human
ggtggcagacagtaagagcc

SEQ ID NO: 266626 - DNA, 20 bp, human
gcgggctcgcgaacccggat

SEQ ID NO: 266627 - DNA, 20 bp, human
gagggcgcggcgtttggtgc

SEQ ID NO: 266628 - DNA, 20 bp, human
gccgcccgggctcgcgaacc

SEQ ID NO: 266629 - DNA, 20 bp, human
gccggcgtggcgagccaatc

SEQ ID NO: 266630 - DNA, 20 bp, human
gccacggaggagcgcgggga

SEQ ID NO: 266631 - DNA, 20 bp, human
gccgcgccctcgcgcgctcc

SEQ ID NO: 266632 - DNA, 20 bp, human
gcattctcggcgcccccgcc

SEQ ID NO: 266633 - DNA, 20 bp, human
ggaggcagaagggagggcga

SEQ ID NO: 266634 - DNA, 20 bp, human
ggtgccgccccggtccccat

SEQ ID NO: 266635 - DNA, 20 bp, human
gcgggagggtccagagacgg

SEQ ID NO: 266636 - DNA, 20 bp, human
gtaaacggatgtcacacagc

SEQ ID NO: 266637 - DNA, 20 bp, human
gggaagaagccggccggcta

SEQ ID NO: 266638 - DNA, 20 bp, human
gcggcactacgggaagaagc

SEQ ID NO: 266639 - DNA, 20 bp, human
gccgccggaagggccagtgt

SEQ ID NO: 266640 - DNA, 20 bp, human
gcccgcggaagaagcagtcc

SEQ ID NO: 266641 - DNA, 20 bp, human
gtcctcggggccttctatat

SEQ ID NO: 266642 - DNA, 20 bp, human
gaagccggccggctagggca

SEQ ID NO: 266643 - DNA, 20 bp, human
gcgcgcggcccgttccggca

SEQ ID NO: 266644 - DNA, 20 bp, human
gccggtgtgacggccgtccc

SEQ ID NO: 266645 - DNA, 20 bp, human
gggctagggcacggagctct

SEQ ID NO: 266646 - DNA, 20 bp, human
ggggagctgctggagtacga

SEQ ID NO: 266647 - DNA, 20 bp, human
ggcggccgccatgttgaatg

SEQ ID NO: 266648 - DNA, 20 bp, human
gtccgcaggcgggccctagg

SEQ ID NO: 266649 - DNA, 20 bp, human
ggccgcctagggcccgcctg

SEQ ID NO: 266650 - DNA, 20 bp, human
ggacgaacggaagtgcgtgt

SEQ ID NO: 266651 - DNA, 20 bp, human
gtcaacatggcggccgccta

SEQ ID NO: 266652 - DNA, 20 bp, human
gaacggaagtgcgtgtaggc

SEQ ID NO: 266653 - DNA, 20 bp, human
ggggcccgcctgcggacgaa

SEQ ID NO: 266654 - DNA, 20 bp, human
gggcggagccacattcaaca

SEQ ID NO: 266655 - DNA, 20 bp, human
gttgaatgtggctccgcccg

SEQ ID NO: 266656 - DNA, 20 bp, human
gaacgcacgcagggctcgac

SEQ ID NO: 266657 - DNA, 20 bp, human
ggacagcgggaactacaaac

SEQ ID NO: 266658 - DNA, 20 bp, human
ggccctgcgtgcgttcgtcc

SEQ ID NO: 266659 - DNA, 20 bp, human
gggaactacaaacaggacgg

SEQ ID NO: 266660 - DNA, 20 bp, human
gagaaggagggagtaaagag

SEQ ID NO: 266661 - DNA, 20 bp, human
gtgttcccccgtagcatcag

SEQ ID NO: 266662 - DNA, 20 bp, human
gcctgggaaggaggtcgggt

SEQ ID NO: 266663 - DNA, 20 bp, human
gttccaggacgaacgcacgc

SEQ ID NO: 266664 - DNA, 20 bp, human
ggaagggggcggggttcctc

SEQ ID NO: 266665 - DNA, 20 bp, human
ggatgctacgggggaacaat

SEQ ID NO: 266666 - DNA, 20 bp, human
ggcgaagaggcccagttcca

SEQ ID NO: 266667 - DNA, 20 bp, human
gcgcccccggccctggaact

SEQ ID NO: 266668 - DNA, 20 bp, human
gaggcccagttccagggccg

SEQ ID NO: 266669 - DNA, 20 bp, human
gcccgccccgtccccaaggt

SEQ ID NO: 266670 - DNA, 20 bp, human
gaccagatacgaagtgggag

SEQ ID NO: 266671 - DNA, 20 bp, human
gccaaagggcaccgcccctg

SEQ ID NO: 266672 - DNA, 20 bp, human
ggatggaccagatacgaagt

SEQ ID NO: 266673 - DNA, 20 bp, human
gggaggcggccattggtggt

SEQ ID NO: 266674 - DNA, 20 bp, human
gtccgagcccaccttgggga

SEQ ID NO: 266675 - DNA, 20 bp, human
gggcgagcacgtgacccgca

SEQ ID NO: 266676 - DNA, 20 bp, human
ggcctcggagcgcccgggag

SEQ ID NO: 266677 - DNA, 20 bp, human
ggctcccgggagcgccgtca

SEQ ID NO: 266678 - DNA, 20 bp, human
gcgtgctcgcggaccagcga

SEQ ID NO: 266679 - DNA, 20 bp, human
ggtcagggccggccccgtgt

SEQ ID NO: 266680 - DNA, 20 bp, human
ggagcagcggcgttgctggc

SEQ ID NO: 266681 - DNA, 20 bp, human
gggccggccccgtgtggggg

SEQ ID NO: 266682 - DNA, 20 bp, human
gcggccctgacggcgctccc

SEQ ID NO: 266683 - DNA, 20 bp, human
gagcccatcgggagaaggcg

SEQ ID NO: 266684 - DNA, 20 bp, human
gtgcctgtgcgtgtggaaaa

SEQ ID NO: 266685 - DNA, 20 bp, human
ggggagcagccggtgcgcgg

SEQ ID NO: 266686 - DNA, 20 bp, human
ggaaccgccgcccctgcggg

SEQ ID NO: 266687 - DNA, 20 bp, human
gtccgggagcgccccttagg

SEQ ID NO: 266688 - DNA, 20 bp, human
gcccttaggtggcatgtggg

SEQ ID NO: 266689 - DNA, 20 bp, human
gcaggtgggcgccatcgccg

SEQ ID NO: 266690 - DNA, 20 bp, human
gtcccagaaaccacaagcgt

SEQ ID NO: 266691 - DNA, 20 bp, human
gataaaggggcgcccttcat

SEQ ID NO: 266692 - DNA, 20 bp, human
ggggacttactcccgatgaa

SEQ ID NO: 266693 - DNA, 20 bp, human
ggccacctaaggggcgctcc

SEQ ID NO: 266694 - DNA, 20 bp, human
gcctcgcgcccgctcctcaa

SEQ ID NO: 266695 - DNA, 20 bp, human
gcctgtgtggagtcacaggc

SEQ ID NO: 266696 - DNA, 20 bp, human
gggtgctgaagctctgcgga

SEQ ID NO: 266697 - DNA, 20 bp, human
ggaagctctgcggaggggtg

SEQ ID NO: 266698 - DNA, 20 bp, human
gacacatgtgcggcagtctg

SEQ ID NO: 266699 - DNA, 20 bp, human
gaactggtgctgaagctctg

SEQ ID NO: 266700 - DNA, 20 bp, human
gggcttatgttcagagggat

SEQ ID NO: 266701 - DNA, 20 bp, human
gcggcccagagtcggggagg

SEQ ID NO: 266702 - DNA, 20 bp, human
gtgtgcggcagtctgtggtt

SEQ ID NO: 266703 - DNA, 20 bp, human
gctgggccggtggacatata

SEQ ID NO: 266704 - DNA, 20 bp, human
gaggcaggtcagccgtcccc

SEQ ID NO: 266705 - DNA, 20 bp, human
ggactgccgcacatgtgtct

SEQ ID NO: 266706 - DNA, 20 bp, human
ggcagcgcgcgctcccgctt

SEQ ID NO: 266707 - DNA, 20 bp, human
gcaagcgggagtcacatctc

SEQ ID NO: 266708 - DNA, 20 bp, human
ggcggagcccggcgggagta

SEQ ID NO: 266709 - DNA, 20 bp, human
gcgtcccacagcaaggagac

SEQ ID NO: 266710 - DNA, 20 bp, human
gcgccccagtctccttgctg

SEQ ID NO: 266711 - DNA, 20 bp, human
gagtagggccgcgcccaagc

SEQ ID NO: 266712 - DNA, 20 bp, human
gggctgaagctagctatatg

SEQ ID NO: 266713 - DNA, 20 bp, human
gctggcgcgtccccgcccaa

SEQ ID NO: 266714 - DNA, 20 bp, human
gggcgcggccctactcccgc

SEQ ID NO: 266715 - DNA, 20 bp, human
ggcccccttcccgccccctt

SEQ ID NO: 266716 - DNA, 20 bp, human
ggacccagagcacctcccat

SEQ ID NO: 266717 - DNA, 20 bp, human
gacccggaaggaagacgcgg

SEQ ID NO: 266718 - DNA, 20 bp, human
gtctcccatgggaggtgctc

SEQ ID NO: 266719 - DNA, 20 bp, human
gagcccgctcccaggccagg

SEQ ID NO: 266720 - DNA, 20 bp, human
gggaggtgctctgggtccta

SEQ ID NO: 266721 - DNA, 20 bp, human
gagcagaaagctcctccccc

SEQ ID NO: 266722 - DNA, 20 bp, human
gccagtggtgcccgtgtaaa

SEQ ID NO: 266723 - DNA, 20 bp, human
gctgggagcgggctgtccgt

SEQ ID NO: 266724 - DNA, 20 bp, human
gcggggccagaagcaaagcc

SEQ ID NO: 266725 - DNA, 20 bp, human
gaagccgggcgtttctccca

SEQ ID NO: 266726 - DNA, 20 bp, human
gtgcgcgcgcccggtcacgt

SEQ ID NO: 266727 - DNA, 20 bp, human
gcgcagggatcgcatggcgg

SEQ ID NO: 266728 - DNA, 20 bp, human
gcgcgcccggtcggcttggc

SEQ ID NO: 266729 - DNA, 20 bp, human
gtccctgcggcccacgtgac

SEQ ID NO: 266730 - DNA, 20 bp, human
ggggcgcgcgcagaggctcg

SEQ ID NO: 266731 - DNA, 20 bp, human
gggccgcagggatcgcatgg

SEQ ID NO: 266732 - DNA, 20 bp, human
gcccggtcacgtgggccgca

SEQ ID NO: 266733 - DNA, 20 bp, human
gacaaaaaacgaaaagagtg

SEQ ID NO: 266734 - DNA, 20 bp, human
gcccgccggccaagccgacc

SEQ ID NO: 266735 - DNA, 20 bp, human
gaggcgaagggcagctccgg

SEQ ID NO: 266736 - DNA, 20 bp, human
gagactgccgacagagcgta

SEQ ID NO: 266737 - DNA, 20 bp, human
gccgacagagcgtagggaag

SEQ ID NO: 266738 - DNA, 20 bp, human
gcgcatgcgtgagaccgggg

SEQ ID NO: 266739 - DNA, 20 bp, human
gagaccggggcggtgtccgg

SEQ ID NO: 266740 - DNA, 20 bp, human
ggggccgatccagttctttt

SEQ ID NO: 266741 - DNA, 20 bp, human
gagcctgcaccgcccgctcc

SEQ ID NO: 266742 - DNA, 20 bp, human
gtaggccggaagtggtgttg

SEQ ID NO: 266743 - DNA, 20 bp, human
ggtgttgcggagggaagtgt

SEQ ID NO: 266744 - DNA, 20 bp, human
gcggtctcacgcatgcgcag

SEQ ID NO: 266745 - DNA, 20 bp, human
gttctccgcggtgtctccta

SEQ ID NO: 266746 - DNA, 20 bp, human
gggcgggcccggaaccgcca

SEQ ID NO: 266747 - DNA, 20 bp, human
ggaaccgccacgggtgagtc

SEQ ID NO: 266748 - DNA, 20 bp, human
gcagggacgccacctcagtc

SEQ ID NO: 266749 - DNA, 20 bp, human
gcgacccgactcacccgtgg

SEQ ID NO: 266750 - DNA, 20 bp, human
ggggaggcgcagggaccgga

SEQ ID NO: 266751 - DNA, 20 bp, human
gcctccgagcagagccgtcc

SEQ ID NO: 266752 - DNA, 20 bp, human
gccacctgacggtaccgaga

SEQ ID NO: 266753 - DNA, 20 bp, human
gcgcccgccgaccagcttcc

SEQ ID NO: 266754 - DNA, 20 bp, human
ggggaagccggcactggagc

SEQ ID NO: 266755 - DNA, 20 bp, human
gccccggcatggcccacgac

SEQ ID NO: 266756 - DNA, 20 bp, human
gtggagccgcagccccgaaa

SEQ ID NO: 266757 - DNA, 20 bp, human
ggcgctacgcgcgaaccctt

SEQ ID NO: 266758 - DNA, 20 bp, human
ggagcgaagcaacgtcctgt

SEQ ID NO: 266759 - DNA, 20 bp, human
gagatgcgcggccttttaaa

SEQ ID NO: 266760 - DNA, 20 bp, human
ggcccagcgtcaatcacagc

SEQ ID NO: 266761 - DNA, 20 bp, human
gaggccggcccggagatgcg

SEQ ID NO: 266762 - DNA, 20 bp, human
gtaaaaggccgcgcatctcc

SEQ ID NO: 266763 - DNA, 20 bp, human
gggacgttgcttcgctccga

SEQ ID NO: 266764 - DNA, 20 bp, human
gtacttgcagacaaactcaa

SEQ ID NO: 266765 - DNA, 20 bp, human
gtccagctgtgattgacgct

SEQ ID NO: 266766 - DNA, 20 bp, human
ggcgggtcgcaaggagtcac

SEQ ID NO: 266767 - DNA, 20 bp, human
gcggaagcggcggagtagag

SEQ ID NO: 266768 - DNA, 20 bp, human
gtaacctggccgcctcggcg

SEQ ID NO: 266769 - DNA, 20 bp, human
gctggcgggcgtgggaaccc

SEQ ID NO: 266770 - DNA, 20 bp, human
ggcggcgcagatgtcaccgg

SEQ ID NO: 266771 - DNA, 20 bp, human
ggacggggcggctcgggcta

SEQ ID NO: 266772 - DNA, 20 bp, human
gaagaagagctgccagtcgg

SEQ ID NO: 266773 - DNA, 20 bp, human
gggcgcggcgcagatgtcac

SEQ ID NO: 266774 - DNA, 20 bp, human
gcgacccccacagacctgat

SEQ ID NO: 266775 - DNA, 20 bp, human
ggggactgttaggtgttcag

SEQ ID NO: 266776 - DNA, 20 bp, human
gggggcttcgggtactgcaa

SEQ ID NO: 266777 - DNA, 20 bp, human
ggcaaaggcgagcttgcgga

SEQ ID NO: 266778 - DNA, 20 bp, human
ggtatctgcaggaggggcac

SEQ ID NO: 266779 - DNA, 20 bp, human
ggcttgcggaaggacgattc

SEQ ID NO: 266780 - DNA, 20 bp, human
gagggggcgcgtggggcttc

SEQ ID NO: 266781 - DNA, 20 bp, human
gaaagctgtatctgcaggag

SEQ ID NO: 266782 - DNA, 20 bp, human
gcagctgcctggggatcgtg

SEQ ID NO: 266783 - DNA, 20 bp, human
gcgggggcggacagctgcct

SEQ ID NO: 266784 - DNA, 20 bp, human
gactgcagggaggcatgcta

SEQ ID NO: 266785 - DNA, 20 bp, human
ggtgacgcgcaaggcggcga

SEQ ID NO: 266786 - DNA, 20 bp, human
gtgggtgggcggggaaagga

SEQ ID NO: 266787 - DNA, 20 bp, human
gaggaggaaaggttccttta

SEQ ID NO: 266788 - DNA, 20 bp, human
ggaggctccggcggtgtcaa

SEQ ID NO: 266789 - DNA, 20 bp, human
gcggcggggagggaccgact

SEQ ID NO: 266790 - DNA, 20 bp, human
gagtgtgaagggaggagata

SEQ ID NO: 266791 - DNA, 20 bp, human
ggactcgcgagcggcgtctc

SEQ ID NO: 266792 - DNA, 20 bp, human
gcgtccaggcggccaatcta

SEQ ID NO: 266793 - DNA, 20 bp, human
gggaccgactgggcgagtgg

SEQ ID NO: 266794 - DNA, 20 bp, human
gggaccccgagtccggagaa

SEQ ID NO: 266795 - DNA, 20 bp, human
gagaggaaacagggcgttga

SEQ ID NO: 266796 - DNA, 20 bp, human
ggcggcagaatgttaggggt

SEQ ID NO: 266797 - DNA, 20 bp, human
gctaggcggcagaatgttag

SEQ ID NO: 266798 - DNA, 20 bp, human
gcgcgcgtgagcaaaagtaa

SEQ ID NO: 266799 - DNA, 20 bp, human
gcgcatgcgcataaggggtg

SEQ ID NO: 266800 - DNA, 20 bp, human
gagacacccgctcacagagc

SEQ ID NO: 266801 - DNA, 20 bp, human
gacgcctccgcgcccagcgt

SEQ ID NO: 266802 - DNA, 20 bp, human
gtagaagcccgctctgtgag

SEQ ID NO: 266803 - DNA, 20 bp, human
gtccctggagcggcggaaag

SEQ ID NO: 266804 - DNA, 20 bp, human
ggtgccgtctgcgcaagggt

SEQ ID NO: 266805 - DNA, 20 bp, human
gcagcaagtggggatgaacg

SEQ ID NO: 266806 - DNA, 20 bp, human
gttggccgcgagatccagga

SEQ ID NO: 266807 - DNA, 20 bp, human
gtgggcgtgctccgtaggta

SEQ ID NO: 266808 - DNA, 20 bp, human
gctggcatccggggtctctt

SEQ ID NO: 266809 - DNA, 20 bp, human
gaatcccgtcgctggcatcc

SEQ ID NO: 266810 - DNA, 20 bp, human
gtgaccaggacaatgtgact

SEQ ID NO: 266811 - DNA, 20 bp, human
gctcttaggcaacaatgtgt

SEQ ID NO: 266812 - DNA, 20 bp, human
ggagggctggctacaaaatt

SEQ ID NO: 266813 - DNA, 20 bp, human
ggtgtggcggccaagagcgt

SEQ ID NO: 266814 - DNA, 20 bp, human
gctggatctcgcggccaatc

SEQ ID NO: 266815 - DNA, 20 bp, human
ggtgactgggcgtgctccgt

SEQ ID NO: 266816 - DNA, 20 bp, human
gtccgggcgctatccgtgca

SEQ ID NO: 266817 - DNA, 20 bp, human
gcgggacacagacgacgatt

SEQ ID NO: 266818 - DNA, 20 bp, human
gggacctaaaggtgaggtcg

SEQ ID NO: 266819 - DNA, 20 bp, human
gcacggatagcgcccggaag

SEQ ID NO: 266820 - DNA, 20 bp, human
ggcgacgaaggactctatcg

SEQ ID NO: 266821 - DNA, 20 bp, human
gtgtccgcgacctcaccttt

SEQ ID NO: 266822 - DNA, 20 bp, human
gacgagccaatcagatcctg

SEQ ID NO: 266823 - DNA, 20 bp, human
ggcgctatccgtgcagggat

SEQ ID NO: 266824 - DNA, 20 bp, human
gctcacaggacctaaaggtg

SEQ ID NO: 266825 - DNA, 20 bp, human
ggacgacgattgggcgacga

SEQ ID NO: 266826 - DNA, 20 bp, human
ggcgggcgggggagcttgga

SEQ ID NO: 266827 - DNA, 20 bp, human
ggggtgggccccggatccta

SEQ ID NO: 266828 - DNA, 20 bp, human
gccccccgcgggggcgtctt

SEQ ID NO: 266829 - DNA, 20 bp, human
gaggaccagtccccccgcgg

SEQ ID NO: 266830 - DNA, 20 bp, human
ggggaggcccagttgccgcg

SEQ ID NO: 266831 - DNA, 20 bp, human
gcccgcgcccctaggatccg

SEQ ID NO: 266832 - DNA, 20 bp, human
gtggagggctgcgtgcagcg

SEQ ID NO: 266833 - DNA, 20 bp, human
gggatccggggcccacccct

SEQ ID NO: 266834 - DNA, 20 bp, human
gtagctgtgagcccgaccca

SEQ ID NO: 266835 - DNA, 20 bp, human
ggtcctctcccggggcgtgg

SEQ ID NO: 266836 - DNA, 20 bp, human
gacggcccccgcgaccaatc

SEQ ID NO: 266837 - DNA, 20 bp, human
ggggcgtggcccggtagctg

SEQ ID NO: 266838 - DNA, 20 bp, human
gagtccccgcggagcagcgg

SEQ ID NO: 266839 - DNA, 20 bp, human
gcccgagcggaagcgcggat

SEQ ID NO: 266840 - DNA, 20 bp, human
gcggagcagcggcggtcgag

SEQ ID NO: 266841 - DNA, 20 bp, human
gcgaaatgcgcaatcggtgg

SEQ ID NO: 266842 - DNA, 20 bp, human
gagctcgcggaggaagtcgg

SEQ ID NO: 266843 - DNA, 20 bp, human
gaccaatcgggacgcgagac

SEQ ID NO: 266844 - DNA, 20 bp, human
ggggcggagcccaggaacgc

SEQ ID NO: 266845 - DNA, 20 bp, human
gcgcgcttccgctcgggccg

SEQ ID NO: 266846 - DNA, 20 bp, human
gtgctgggaggaggcggcta

SEQ ID NO: 266847 - DNA, 20 bp, human
ggttcctcagcggaccgagg

SEQ ID NO: 266848 - DNA, 20 bp, human
gggggctgcgggttcctcag

SEQ ID NO: 266849 - DNA, 20 bp, human
gtctcgcagctcgctcctgg

SEQ ID NO: 266850 - DNA, 20 bp, human
gagtcccagcagtctgctcg

SEQ ID NO: 266851 - DNA, 20 bp, human
gcccgcgcagcgctgggcca

SEQ ID NO: 266852 - DNA, 20 bp, human
ggctgcgagatgccccaaat

SEQ ID NO: 266853 - DNA, 20 bp, human
gcagcctcctcggtccgctg

SEQ ID NO: 266854 - DNA, 20 bp, human
gtccgcgtctgtgtcggtcc

SEQ ID NO: 266855 - DNA, 20 bp, human
ggggcctcgagcagactgct

SEQ ID NO: 266856 - DNA, 20 bp, human
ggggtggcagcgccgcaaaa

SEQ ID NO: 266857 - DNA, 20 bp, human
gacctcccctgcatcggctg

SEQ ID NO: 266858 - DNA, 20 bp, human
gcccccagccgatgcagggg

SEQ ID NO: 266859 - DNA, 20 bp, human
gggccacacctcccctgcat

SEQ ID NO: 266860 - DNA, 20 bp, human
gtggcagcgccgcaaaaggg

SEQ ID NO: 266861 - DNA, 20 bp, human
gtggccccgcctactggtct

SEQ ID NO: 266862 - DNA, 20 bp, human
gcaaaagggaggacataatt

SEQ ID NO: 266863 - DNA, 20 bp, human
ggggaggtgtggcccgcgga

SEQ ID NO: 266864 - DNA, 20 bp, human
ggcagcccccagccgatgca

SEQ ID NO: 266865 - DNA, 20 bp, human
gcgcaagccgcctctagtcc

SEQ ID NO: 266866 - DNA, 20 bp, human
gcctagaaagttgccaggag

SEQ ID NO: 266867 - DNA, 20 bp, human
gcggagtacacctcggagta

SEQ ID NO: 266868 - DNA, 20 bp, human
ggtctggagcccgtactccg

SEQ ID NO: 266869 - DNA, 20 bp, human
ggagtacgggctccagacga

SEQ ID NO: 266870 - DNA, 20 bp, human
gaaggtgggcgtggcaacgc

SEQ ID NO: 266871 - DNA, 20 bp, human
gtccggctggacggggaagg

SEQ ID NO: 266872 - DNA, 20 bp, human
gtccagacgagggaacgcac

SEQ ID NO: 266873 - DNA, 20 bp, human
gttccccgtccagccggaag

SEQ ID NO: 266874 - DNA, 20 bp, human
gtacggaacggagtacacct

SEQ ID NO: 266875 - DNA, 20 bp, human
gaacccgattacgccagcat

SEQ ID NO: 266876 - DNA, 20 bp, human
gccggagtctgacgagagaa

SEQ ID NO: 266877 - DNA, 20 bp, human
gaatcagaacccgtcagtgg

SEQ ID NO: 266878 - DNA, 20 bp, human
gggaccggacggaccaatcg

SEQ ID NO: 266879 - DNA, 20 bp, human
ggctcccgctgcctgactga

SEQ ID NO: 266880 - DNA, 20 bp, human
gcagaacccgtcagtggggg

SEQ ID NO: 266881 - DNA, 20 bp, human
gccccttgaggcaactacgg

SEQ ID NO: 266882 - DNA, 20 bp, human
ggccaatcagaacccgtcag

SEQ ID NO: 266883 - DNA, 20 bp, human
gggtcccgtcagtcaggcag

SEQ ID NO: 266884 - DNA, 20 bp, human
gacggccggtcccgtcagtc

SEQ ID NO: 266885 - DNA, 20 bp, human
gccccgagacgcgtcagaag

SEQ ID NO: 266886 - DNA, 20 bp, human
gtggacgcgcgcggacggag

SEQ ID NO: 266887 - DNA, 20 bp, human
gaggcagcaacattgccacg

SEQ ID NO: 266888 - DNA, 20 bp, human
gggtggggctcgggtgcgca

SEQ ID NO: 266889 - DNA, 20 bp, human
ggggcttccctgaggcgcgc

SEQ ID NO: 266890 - DNA, 20 bp, human
ggtgccgggcgtggaggcgt

SEQ ID NO: 266891 - DNA, 20 bp, human
ggggctcgggtgcgcaggga

SEQ ID NO: 266892 - DNA, 20 bp, human
gttgccacgcggatccgcgc

SEQ ID NO: 266893 - DNA, 20 bp, human
gggcgcacgctgcgggcgac

SEQ ID NO: 266894 - DNA, 20 bp, human
gccggcactctggacgcgcg

SEQ ID NO: 266895 - DNA, 20 bp, human
gtggccggcgcggatccgcg

SEQ ID NO: 266896 - DNA, 20 bp, human
gccgtcgcgggaagcaggtt

SEQ ID NO: 266897 - DNA, 20 bp, human
gaggacttggggtgcggtgt

SEQ ID NO: 266898 - DNA, 20 bp, human
ggggctggcgagtaagaaag

SEQ ID NO: 266899 - DNA, 20 bp, human
ggggctgattgcatgcaatt

SEQ ID NO: 266900 - DNA, 20 bp, human
gggagcttgcggcacagcta

SEQ ID NO: 266901 - DNA, 20 bp, human
gatatcggggctatcaagga

SEQ ID NO: 266902 - DNA, 20 bp, human
gggtgcggctggcagaatca

SEQ ID NO: 266903 - DNA, 20 bp, human
gcaggccccggggtaggact

SEQ ID NO: 266904 - DNA, 20 bp, human
gttggggtgcggtgtcggtg

SEQ ID NO: 266905 - DNA, 20 bp, human
gcgggatatcggggctatca

SEQ ID NO: 266906 - DNA, 20 bp, human
ggaggagcctgtgggataac

SEQ ID NO: 266907 - DNA, 20 bp, human
gccgccggggaaggggtacc

SEQ ID NO: 266908 - DNA, 20 bp, human
gcaggcggagagagactcac

SEQ ID NO: 266909 - DNA, 20 bp, human
gtctccgcctgttatcccac

SEQ ID NO: 266910 - DNA, 20 bp, human
gggaggaggaagtgacgcac

SEQ ID NO: 266911 - DNA, 20 bp, human
ggagcctgtgggataacagg

SEQ ID NO: 266912 - DNA, 20 bp, human
gactgtgcagttttcttaaa

SEQ ID NO: 266913 - DNA, 20 bp, human
gtccctgacttccacttgaa

SEQ ID NO: 266914 - DNA, 20 bp, human
gtgcctttcaagtggaagtc

SEQ ID NO: 266915 - DNA, 20 bp, human
gttaaagggcttcctgacaa

SEQ ID NO: 266916 - DNA, 20 bp, human
gctagcgggcggggtctcca

SEQ ID NO: 266917 - DNA, 20 bp, human
gcgcccccagccgctctcac

SEQ ID NO: 266918 - DNA, 20 bp, human
gacgcggagcgcgaagaaag

SEQ ID NO: 266919 - DNA, 20 bp, human
gtcagcccaccctgagggcg

SEQ ID NO: 266920 - DNA, 20 bp, human
ggagaccccgcccgctagcc

SEQ ID NO: 266921 - DNA, 20 bp, human
ggctgggcaagtttacgaac

SEQ ID NO: 266922 - DNA, 20 bp, human
gtgaactcgcactgcgccgc

SEQ ID NO: 266923 - DNA, 20 bp, human
gctggctcccggctagcggg

SEQ ID NO: 266924 - DNA, 20 bp, human
ggggaaaacgaggggttctc

SEQ ID NO: 266925 - DNA, 20 bp, human
ggagctggagagatttgacg

SEQ ID NO: 266926 - DNA, 20 bp, human
gagtctggaggaatcttctc

SEQ ID NO: 266927 - DNA, 20 bp, human
gcaacgagggcaatgagcac

SEQ ID NO: 266928 - DNA, 20 bp, human
gtcagagtgagctgaaacct

SEQ ID NO: 266929 - DNA, 20 bp, human
gatgaagtacaccatgaacg

SEQ ID NO: 266930 - DNA, 20 bp, human
gatggcacattccacgttca

SEQ ID NO: 266931 - DNA, 20 bp, human
gtagttacttacaaattgaa

SEQ ID NO: 266932 - DNA, 20 bp, human
gcgtggaatgtgccatagta

SEQ ID NO: 266933 - DNA, 20 bp, human
gataaactgagtagcactgc

SEQ ID NO: 266934 - DNA, 20 bp, human
gaaagagtccttgtagactg

SEQ ID NO: 266935 - DNA, 20 bp, human
gtgctggaccacagccacta

SEQ ID NO: 266936 - DNA, 20 bp, human
gcagcgtcgtggctagagta

SEQ ID NO: 266937 - DNA, 20 bp, human
gacgacgctgcggggtcaga

SEQ ID NO: 266938 - DNA, 20 bp, human
ggacgcgcacgcagtcccgg

SEQ ID NO: 266939 - DNA, 20 bp, human
gtcgtggctagagtagggtc

SEQ ID NO: 266940 - DNA, 20 bp, human
gctggagagagctcccactg

SEQ ID NO: 266941 - DNA, 20 bp, human
gcgaacaagtcatgctactt

SEQ ID NO: 266942 - DNA, 20 bp, human
gccccagagtcaagggatcg

SEQ ID NO: 266943 - DNA, 20 bp, human
ggggaggtaaaacccgacag

SEQ ID NO: 266944 - DNA, 20 bp, human
gctgtggcgagtcctgtcgt

SEQ ID NO: 266945 - DNA, 20 bp, human
ggccgcgggaatccaacgac

SEQ ID NO: 266946 - DNA, 20 bp, human
gtgagggcgccgcccgtgac

SEQ ID NO: 266947 - DNA, 20 bp, human
gacgggcggcgccctcacgc

SEQ ID NO: 266948 - DNA, 20 bp, human
gccggggcggagctctacgt

SEQ ID NO: 266949 - DNA, 20 bp, human
gcggcgccctcacgctggag

SEQ ID NO: 266950 - DNA, 20 bp, human
gcgccctcacgctggagggg

SEQ ID NO: 266951 - DNA, 20 bp, human
gaggggagggcagcagtgcg

SEQ ID NO: 266952 - DNA, 20 bp, human
gggcggggctaggctctcca

SEQ ID NO: 266953 - DNA, 20 bp, human
gcggagctctacgtaggggc

SEQ ID NO: 266954 - DNA, 20 bp, human
gctctgaggtcgccgccccg

SEQ ID NO: 266955 - DNA, 20 bp, human
gttctcatgcccgtcacggg

SEQ ID NO: 266956 - DNA, 20 bp, human
gcagcagcggcacgcagcgt

SEQ ID NO: 266957 - DNA, 20 bp, human
ggccgccgccatgacgggcg

SEQ ID NO: 266958 - DNA, 20 bp, human
ggccacgcccgtcatggcgg

SEQ ID NO: 266959 - DNA, 20 bp, human
ggcgacgcgtcaccgagggg

SEQ ID NO: 266960 - DNA, 20 bp, human
gggtgtgtgcgcgtgcgcga

SEQ ID NO: 266961 - DNA, 20 bp, human
gtccgccacgcccgtcatgg

SEQ ID NO: 266962 - DNA, 20 bp, human
gggttccgccacgcccgtca

SEQ ID NO: 266963 - DNA, 20 bp, human
gcccgtcatggcggcggccc

SEQ ID NO: 266964 - DNA, 20 bp, human
ggactcgcgacgcgtcaccg

SEQ ID NO: 266965 - DNA, 20 bp, human
gcgtcgcgagtcacctgacc

SEQ ID NO: 266966 - DNA, 20 bp, human
gcgcggttgtgcaaccggga

SEQ ID NO: 266967 - DNA, 20 bp, human
ggccacgtggctttgtttat

SEQ ID NO: 266968 - DNA, 20 bp, human
ggggccgggctaagagcggg

SEQ ID NO: 266969 - DNA, 20 bp, human
gagggcgcgcggaggtgcca

SEQ ID NO: 266970 - DNA, 20 bp, human
ggggcctcgctctgggacaa

SEQ ID NO: 266971 - DNA, 20 bp, human
gggaggggagcgtgagccgc

SEQ ID NO: 266972 - DNA, 20 bp, human
ggggctcggcttgttttccg

SEQ ID NO: 266973 - DNA, 20 bp, human
gccggcgcggttgtgcaacc

SEQ ID NO: 266974 - DNA, 20 bp, human
gcggaggtgccaggggcggc

SEQ ID NO: 266975 - DNA, 20 bp, human
gtaagagcgggcggctcttc

SEQ ID NO: 266976 - DNA, 20 bp, human
gcggcgcgacttccggaaga

SEQ ID NO: 266977 - DNA, 20 bp, human
gaagtcgcgccggtgcgcgc

SEQ ID NO: 266978 - DNA, 20 bp, human
ggccggactcctcccaccag

SEQ ID NO: 266979 - DNA, 20 bp, human
ggccgctggtgggaggagtc

SEQ ID NO: 266980 - DNA, 20 bp, human
gtagaacacaagttgtggag

SEQ ID NO: 266981 - DNA, 20 bp, human
gctgccgaccggcgcaggga

SEQ ID NO: 266982 - DNA, 20 bp, human
gcccagtcacatctgtaagt

SEQ ID NO: 266983 - DNA, 20 bp, human
gagcctcaaggcgtactgta

SEQ ID NO: 266984 - DNA, 20 bp, human
gtgtctctgccgaccggcgc

SEQ ID NO: 266985 - DNA, 20 bp, human
gggccaccgtaaggcgtaag

SEQ ID NO: 266986 - DNA, 20 bp, human
gagagtggccgagcccggga

SEQ ID NO: 266987 - DNA, 20 bp, human
gagggggcgccgtgaaactc

SEQ ID NO: 266988 - DNA, 20 bp, human
gcacgcgccggcccaatcga

SEQ ID NO: 266989 - DNA, 20 bp, human
gctcccaggccagccaagaa

SEQ ID NO: 266990 - DNA, 20 bp, human
ggacctggatgacgcgtctg

SEQ ID NO: 266991 - DNA, 20 bp, human
gccaatcgacggttggccgg

SEQ ID NO: 266992 - DNA, 20 bp, human
gcgccggcccaatcgacggt

SEQ ID NO: 266993 - DNA, 20 bp, human
gaagaagggtagtgacgcca

SEQ ID NO: 266994 - DNA, 20 bp, human
gcgcgtctgcggcccccaag

SEQ ID NO: 266995 - DNA, 20 bp, human
gcgcccccagtgtccggcag

SEQ ID NO: 266996 - DNA, 20 bp, human
gcccttcgagggaccaggaa

SEQ ID NO: 266997 - DNA, 20 bp, human
gaggtcccgggtgacccgag

SEQ ID NO: 266998 - DNA, 20 bp, human
gctccgcccgatcccttcga

SEQ ID NO: 266999 - DNA, 20 bp, human
ggggatcgggcggagatcgg

SEQ ID NO: 267000 - DNA, 20 bp, human
ggggactgtggagatctact

SEQ ID NO: 267001 - DNA, 20 bp, human
gccctcttccaagggtctta

SEQ ID NO: 267002 - DNA, 20 bp, human
gctgctaccacggaggggag

SEQ ID NO: 267003 - DNA, 20 bp, human
gagttcctgctaccacggag

SEQ ID NO: 267004 - DNA, 20 bp, human
gcaggaactaattccccctc

SEQ ID NO: 267005 - DNA, 20 bp, human
ggaaggggcggggcttggtt

SEQ ID NO: 267006 - DNA, 20 bp, human
gtcggaaggcttgtcagggg

SEQ ID NO: 267007 - DNA, 20 bp, human
gttcagcgtggcatttcgga

SEQ ID NO: 267008 - DNA, 20 bp, human
gcacacacacaatatggaca

SEQ ID NO: 267009 - DNA, 20 bp, human
gttccggagtgttgtcatcc

SEQ ID NO: 267010 - DNA, 20 bp, human
gttgtcaggggtggagaagc

SEQ ID NO: 267011 - DNA, 20 bp, human
gcgaaatgccacgctgaaca

SEQ ID NO: 267012 - DNA, 20 bp, human
ggccccggatgacaacactc

SEQ ID NO: 267013 - DNA, 20 bp, human
ggtgaagaagcatcgaagcg

SEQ ID NO: 267014 - DNA, 20 bp, human
gggaagtgcctcagcggtag

SEQ ID NO: 267015 - DNA, 20 bp, human
ggccgccgctcgcatatttc

SEQ ID NO: 267016 - DNA, 20 bp, human
gggggcgtgccatcctcacc

SEQ ID NO: 267017 - DNA, 20 bp, human
ggcctcccaacgcctggcca

SEQ ID NO: 267018 - DNA, 20 bp, human
gcctgcagttgcctggtcag

SEQ ID NO: 267019 - DNA, 20 bp, human
gaaaaacccggggctgggtc

SEQ ID NO: 267020 - DNA, 20 bp, human
gcggcttcggaaaaaacccg

SEQ ID NO: 267021 - DNA, 20 bp, human
gccgaacttggggctcaaaa

SEQ ID NO: 267022 - DNA, 20 bp, human
gcctcccgcctcccaacgcc

SEQ ID NO: 267023 - DNA, 20 bp, human
gcggcagcgcgtcacaaagg

SEQ ID NO: 267024 - DNA, 20 bp, human
gtcggaaaaaacccggggct

SEQ ID NO: 267025 - DNA, 20 bp, human
gccatgtgcagagggcgaga

SEQ ID NO: 267026 - DNA, 20 bp, human
gggaggaagcccactgtgcg

SEQ ID NO: 267027 - DNA, 20 bp, human
gcgggccagaggttgtacag

SEQ ID NO: 267028 - DNA, 20 bp, human
ggctcacagccacgcacagt

SEQ ID NO: 267029 - DNA, 20 bp, human
gggcaagggcgggtactggg

SEQ ID NO: 267030 - DNA, 20 bp, human
gaggggcaagggcgggtact

SEQ ID NO: 267031 - DNA, 20 bp, human
gttgacaggagcttcgtact

SEQ ID NO: 267032 - DNA, 20 bp, human
gctcccgcgagtccgcctcc

SEQ ID NO: 267033 - DNA, 20 bp, human
gcgggaggcggaacgcccga

SEQ ID NO: 267034 - DNA, 20 bp, human
gggctggcgcggagctgcgc

SEQ ID NO: 267035 - DNA, 20 bp, human
ggccctggaggcggactcgc

SEQ ID NO: 267036 - DNA, 20 bp, human
gctggagtggcatttagcag

SEQ ID NO: 267037 - DNA, 20 bp, human
gcacaaggggcaatgtgacc

SEQ ID NO: 267038 - DNA, 20 bp, human
gtgttgataaatacagggga

SEQ ID NO: 267039 - DNA, 20 bp, human
gccagtgatgggtttaggtg

SEQ ID NO: 267040 - DNA, 20 bp, human
ggagcagcagccagtcctga

SEQ ID NO: 267041 - DNA, 20 bp, human
ggcaacttgtgcaaatgaca

SEQ ID NO: 267042 - DNA, 20 bp, human
gctgagtgttgataaataca

SEQ ID NO: 267043 - DNA, 20 bp, human
ggcaggcccagctgtgctga

SEQ ID NO: 267044 - DNA, 20 bp, human
gcactcagtctctactggag

SEQ ID NO: 267045 - DNA, 20 bp, human
gataggttttctttcccttg

SEQ ID NO: 267046 - DNA, 20 bp, human
ggcgccgccctaggggtgta

SEQ ID NO: 267047 - DNA, 20 bp, human
gcatccctacacccctaggg

SEQ ID NO: 267048 - DNA, 20 bp, human
gcggcagatgcgcccagcag

SEQ ID NO: 267049 - DNA, 20 bp, human
gcgcgggccgaggaaagcaa

SEQ ID NO: 267050 - DNA, 20 bp, human
gagcggaaaacgtggggtcc

SEQ ID NO: 267051 - DNA, 20 bp, human
gaggcagcaccgaggtgggg

SEQ ID NO: 267052 - DNA, 20 bp, human
ggggaggcagcaccgaggtg

SEQ ID NO: 267053 - DNA, 20 bp, human
gaccttgagcggaaaacgtg

SEQ ID NO: 267054 - DNA, 20 bp, human
ggtcttcggcgccgccctag

SEQ ID NO: 267055 - DNA, 20 bp, human
gggtccctaagcggcctcat

SEQ ID NO: 267056 - DNA, 20 bp, human
ggtcacaggccgaggttctg

SEQ ID NO: 267057 - DNA, 20 bp, human
gggcggcgcagtgttgagaa

SEQ ID NO: 267058 - DNA, 20 bp, human
gctagagacgcggcgaaggc

SEQ ID NO: 267059 - DNA, 20 bp, human
gcaggccgaggttctgtgga

SEQ ID NO: 267060 - DNA, 20 bp, human
ggacgcggcgaaggcgggtg

SEQ ID NO: 267061 - DNA, 20 bp, human
gtggagggtggaatgcgctc

SEQ ID NO: 267062 - DNA, 20 bp, human
gcagcgcggcgggatggcga

SEQ ID NO: 267063 - DNA, 20 bp, human
gtgagaaaggccgtggtcac

SEQ ID NO: 267064 - DNA, 20 bp, human
ggaacctcggcctgtgacca

SEQ ID NO: 267065 - DNA, 20 bp, human
gcgcactcacgtcagcgcgg

SEQ ID NO: 267066 - DNA, 20 bp, human
ggtcccgaggcgggtcagaa

SEQ ID NO: 267067 - DNA, 20 bp, human
gccctgcacccgtcccgagg

SEQ ID NO: 267068 - DNA, 20 bp, human
gtctaatggcatcccactgt

SEQ ID NO: 267069 - DNA, 20 bp, human
gcccgctcaagcgaggaccc

SEQ ID NO: 267070 - DNA, 20 bp, human
ggggaagcattaccgtattt

SEQ ID NO: 267071 - DNA, 20 bp, human
gcgctcctcccgctcaagcg

SEQ ID NO: 267072 - DNA, 20 bp, human
ggctctgcagcgctcccgcc

SEQ ID NO: 267073 - DNA, 20 bp, human
ggcctgggtcctcgcttgag

SEQ ID NO: 267074 - DNA, 20 bp, human
gtgctaacgtggcctacagt

SEQ ID NO: 267075 - DNA, 20 bp, human
gagcgaggacccaggcctgc

SEQ ID NO: 267076 - DNA, 20 bp, human
gcccgcgcagcgctgggcca

SEQ ID NO: 267077 - DNA, 20 bp, human
gtgctgggaggaggcggcta

SEQ ID NO: 267078 - DNA, 20 bp, human
gcgggtggcccaggcggagt

SEQ ID NO: 267079 - DNA, 20 bp, human
gcgcacccccaccgcgtcgt

SEQ ID NO: 267080 - DNA, 20 bp, human
gcggtcgcgagaggaggagc

SEQ ID NO: 267081 - DNA, 20 bp, human
ggaaaattacctggtgtggg

SEQ ID NO: 267082 - DNA, 20 bp, human
gacgcctggaccgctcgctg

SEQ ID NO: 267083 - DNA, 20 bp, human
ggagaggctgggtcaggccg

SEQ ID NO: 267084 - DNA, 20 bp, human
ggcctgggatgcgtctggga

SEQ ID NO: 267085 - DNA, 20 bp, human
gcgggcgagcgctgcacaga

SEQ ID NO: 267086 - DNA, 20 bp, human
gagcgggaagcgcaggtatg

SEQ ID NO: 267087 - DNA, 20 bp, human
gggcgggtgaggttatcact

SEQ ID NO: 267088 - DNA, 20 bp, human
gcgcacgcccagctcgttcg

SEQ ID NO: 267089 - DNA, 20 bp, human
gggaagcgcaggtatgaggc

SEQ ID NO: 267090 - DNA, 20 bp, human
ggcgcgccccgcctcactga

SEQ ID NO: 267091 - DNA, 20 bp, human
gggtatgaggctggcgccgg

SEQ ID NO: 267092 - DNA, 20 bp, human
gtatcactaggcgccgagga

SEQ ID NO: 267093 - DNA, 20 bp, human
gctcacgcctgacgctcgac

SEQ ID NO: 267094 - DNA, 20 bp, human
ggctcgacgggattgggcgc

SEQ ID NO: 267095 - DNA, 20 bp, human
gggccccggatgtgactgtt

SEQ ID NO: 267096 - DNA, 20 bp, human
gaggaagcaaattaggcggg

SEQ ID NO: 267097 - DNA, 20 bp, human
ggcagcacggtcaagcttgg

SEQ ID NO: 267098 - DNA, 20 bp, human
gaagcaaattaggcgggcgg

SEQ ID NO: 267099 - DNA, 20 bp, human
ggcaatagggtgttggtgag

SEQ ID NO: 267100 - DNA, 20 bp, human
gaactcccgggagacaaagc

SEQ ID NO: 267101 - DNA, 20 bp, human
gtcgggacgagaacccggaa

SEQ ID NO: 267102 - DNA, 20 bp, human
gaaggcagcacggtcaagct

SEQ ID NO: 267103 - DNA, 20 bp, human
gacttggcagcgcaagcgca

SEQ ID NO: 267104 - DNA, 20 bp, human
gcccgctgggaattgaagtc

SEQ ID NO: 267105 - DNA, 20 bp, human
ggggcttcgggacgagaacc

SEQ ID NO: 267106 - DNA, 20 bp, human
ggggaacctccttcccgcta

SEQ ID NO: 267107 - DNA, 20 bp, human
gcataaagcggggaggcggg

SEQ ID NO: 267108 - DNA, 20 bp, human
ggcaagagagccagctccca

SEQ ID NO: 267109 - DNA, 20 bp, human
gcccagaagccctagcggga

SEQ ID NO: 267110 - DNA, 20 bp, human
gagaagccctagcgggaagg

SEQ ID NO: 267111 - DNA, 20 bp, human
ggcgggcactacgagagctg

SEQ ID NO: 267112 - DNA, 20 bp, human
gtattcataaagcggggagg

SEQ ID NO: 267113 - DNA, 20 bp, human
gatgagacggagggcaccat

SEQ ID NO: 267114 - DNA, 20 bp, human
gccttcccgcgggggctctt

SEQ ID NO: 267115 - DNA, 20 bp, human
gtagttattcatgagacgga

SEQ ID NO: 267116 - DNA, 20 bp, human
ggctggggccgggctctgag

SEQ ID NO: 267117 - DNA, 20 bp, human
ggcccggcgtcctccaagat

SEQ ID NO: 267118 - DNA, 20 bp, human
gggcgtcctccaagatggga

SEQ ID NO: 267119 - DNA, 20 bp, human
gttccagggcgtctccgctc

SEQ ID NO: 267120 - DNA, 20 bp, human
gccccggttgcgtcattagt

SEQ ID NO: 267121 - DNA, 20 bp, human
gcaccgagggagggcctcaa

SEQ ID NO: 267122 - DNA, 20 bp, human
gcacctccctcccatcttgg

SEQ ID NO: 267123 - DNA, 20 bp, human
gccctgggaaaaaacaccga

SEQ ID NO: 267124 - DNA, 20 bp, human
gaactcgcgcaggcgccgag

SEQ ID NO: 267125 - DNA, 20 bp, human
ggggcctcaaaggctccccg

SEQ ID NO: 267126 - DNA, 20 bp, human
gctcgtccgcgcccaattgg

SEQ ID NO: 267127 - DNA, 20 bp, human
ggggagccggtaagctggaa

SEQ ID NO: 267128 - DNA, 20 bp, human
gcgcaccaataggagggcag

SEQ ID NO: 267129 - DNA, 20 bp, human
gcccggccgtagcatctttc

SEQ ID NO: 267130 - DNA, 20 bp, human
gcatgcgcgcaccaatagga

SEQ ID NO: 267131 - DNA, 20 bp, human
gggaagccagcgctgaattt

SEQ ID NO: 267132 - DNA, 20 bp, human
gtcgcggctcggccccgcct

SEQ ID NO: 267133 - DNA, 20 bp, human
gcgcagaggcgtgggtcaag

SEQ ID NO: 267134 - DNA, 20 bp, human
ggcctcggcagcctccaatt

SEQ ID NO: 267135 - DNA, 20 bp, human
gccggaggaaaaaatcgcgg

SEQ ID NO: 267136 - DNA, 20 bp, human
gcctctagggaggggaccgc

SEQ ID NO: 267137 - DNA, 20 bp, human
gctgcggaggtcacgcccta

SEQ ID NO: 267138 - DNA, 20 bp, human
gaggtcctgcctctagggag

SEQ ID NO: 267139 - DNA, 20 bp, human
gggaggggaccgcgggtcaa

SEQ ID NO: 267140 - DNA, 20 bp, human
ggtgtcaggtcctgcctcta

SEQ ID NO: 267141 - DNA, 20 bp, human
ggccctgggccgcataagga

SEQ ID NO: 267142 - DNA, 20 bp, human
ggggaaagaaggagcccact

SEQ ID NO: 267143 - DNA, 20 bp, human
gggggaccgcgggtcaaggg

SEQ ID NO: 267144 - DNA, 20 bp, human
ggaactagtgcggaggtccg

SEQ ID NO: 267145 - DNA, 20 bp, human
gcataaggaaggaactagtg

SEQ ID NO: 267146 - DNA, 20 bp, human
gccaccgccgcggaaaatct

SEQ ID NO: 267147 - DNA, 20 bp, human
gtgcccgcctccagctctcg

SEQ ID NO: 267148 - DNA, 20 bp, human
ggaaccgggcctctcggggt

SEQ ID NO: 267149 - DNA, 20 bp, human
gtgagggccacggaagaaag

SEQ ID NO: 267150 - DNA, 20 bp, human
gtgcgcgcggagtcatcgat

SEQ ID NO: 267151 - DNA, 20 bp, human
gccagcgagcggccgcatct

SEQ ID NO: 267152 - DNA, 20 bp, human
gcagatgccgctggaactga

SEQ ID NO: 267153 - DNA, 20 bp, human
gtggcatcccagattttccg

SEQ ID NO: 267154 - DNA, 20 bp, human
ggcactgtgcccgcgctctc

SEQ ID NO: 267155 - DNA, 20 bp, human
gaacaacggtagcgctgata

SEQ ID NO: 267156 - DNA, 20 bp, human
gttcacaggagtcttgaacg

SEQ ID NO: 267157 - DNA, 20 bp, human
gccgctgagagcctcctcaa

SEQ ID NO: 267158 - DNA, 20 bp, human
gcttgaacgcggtgtggaat

SEQ ID NO: 267159 - DNA, 20 bp, human
gaatcggcagcgaggaatcc

SEQ ID NO: 267160 - DNA, 20 bp, human
gtggctgtagcgactggttg

SEQ ID NO: 267161 - DNA, 20 bp, human
gagaagtggactggccattg

SEQ ID NO: 267162 - DNA, 20 bp, human
gaaggtcttgcggtggtgcg

SEQ ID NO: 267163 - DNA, 20 bp, human
gagtggactggccattgagg

SEQ ID NO: 267164 - DNA, 20 bp, human
gtgttgccggaagtgacgtt

SEQ ID NO: 267165 - DNA, 20 bp, human
gtcttgcggtggtgcgtggc

SEQ ID NO: 267166 - DNA, 20 bp, human
ggcagatgggtcaagggttg

SEQ ID NO: 267167 - DNA, 20 bp, human
gggtcaagggttgtggagag

SEQ ID NO: 267168 - DNA, 20 bp, human
gagttagcaaactgggataa

SEQ ID NO: 267169 - DNA, 20 bp, human
gtacattctggctttttccc

SEQ ID NO: 267170 - DNA, 20 bp, human
gttgacccatctgcaagcct

SEQ ID NO: 267171 - DNA, 20 bp, human
gtcccagatgcgtaacagct

SEQ ID NO: 267172 - DNA, 20 bp, human
gagcacggactttagttaaa

SEQ ID NO: 267173 - DNA, 20 bp, human
ggtcagatttgttataccac

SEQ ID NO: 267174 - DNA, 20 bp, human
gttataccactgggaaaaat

SEQ ID NO: 267175 - DNA, 20 bp, human
gattcttagtaatatacttc

SEQ ID NO: 267176 - DNA, 20 bp, human
ggctgcctagtggagggcta

SEQ ID NO: 267177 - DNA, 20 bp, human
gcccggccacccatccccgc

SEQ ID NO: 267178 - DNA, 20 bp, human
gcagcctcaccccccgcgtc

SEQ ID NO: 267179 - DNA, 20 bp, human
gcaagcccaacccgcgtgtt

SEQ ID NO: 267180 - DNA, 20 bp, human
gccgcgggctgcctagtgga

SEQ ID NO: 267181 - DNA, 20 bp, human
gagggcccacccctaaattt

SEQ ID NO: 267182 - DNA, 20 bp, human
ggccctgagaagcatcgaac

SEQ ID NO: 267183 - DNA, 20 bp, human
gtcaggcgcgcgcacacagt

SEQ ID NO: 267184 - DNA, 20 bp, human
gtcagcccaacacgcgggtt

SEQ ID NO: 267185 - DNA, 20 bp, human
gacaacccaaatttaggggt

SEQ ID NO: 267186 - DNA, 20 bp, human
ggagctatatggtctcgagc

SEQ ID NO: 267187 - DNA, 20 bp, human
ggaaatctcactgtagtcaa

SEQ ID NO: 267188 - DNA, 20 bp, human
gaccgagtcttacctgcagt

SEQ ID NO: 267189 - DNA, 20 bp, human
gggcccaggcaaaacatatt

SEQ ID NO: 267190 - DNA, 20 bp, human
gaactaggatggagacactg

SEQ ID NO: 267191 - DNA, 20 bp, human
gtgcccaatatgttttgcct

SEQ ID NO: 267192 - DNA, 20 bp, human
gtcggttcaaacattgactc

SEQ ID NO: 267193 - DNA, 20 bp, human
gtcctactgcaggtaagact

SEQ ID NO: 267194 - DNA, 20 bp, human
gctggtacttaggagctata

SEQ ID NO: 267195 - DNA, 20 bp, human
ggagataattctcctactgc

SEQ ID NO: 267196 - DNA, 20 bp, human
gagcaagctcttaactcttc

SEQ ID NO: 267197 - DNA, 20 bp, human
gcggcagtgtctgatggtag

SEQ ID NO: 267198 - DNA, 20 bp, human
gtcagctcggagttcagctt

SEQ ID NO: 267199 - DNA, 20 bp, human
gctagccggaaggacaaccc

SEQ ID NO: 267200 - DNA, 20 bp, human
ggcaactcctcacttgtcgg

SEQ ID NO: 267201 - DNA, 20 bp, human
ggcggcccgcagagcgttgt

SEQ ID NO: 267202 - DNA, 20 bp, human
gggaccgagcctctgacacc

SEQ ID NO: 267203 - DNA, 20 bp, human
gtgcgcccgggttgtccttc

SEQ ID NO: 267204 - DNA, 20 bp, human
gaaggctgcccagaccggga

SEQ ID NO: 267205 - DNA, 20 bp, human
ggagagtagcactggacggt

SEQ ID NO: 267206 - DNA, 20 bp, human
gtaacccttggtgtgattgg

SEQ ID NO: 267207 - DNA, 20 bp, human
gagggctagagagcgttctg

SEQ ID NO: 267208 - DNA, 20 bp, human
gtgggaaagcgtcacatccc

SEQ ID NO: 267209 - DNA, 20 bp, human
gaatgagttgtcaggttctt

SEQ ID NO: 267210 - DNA, 20 bp, human
gtcctcgcatgatatgaaca

SEQ ID NO: 267211 - DNA, 20 bp, human
gccacctccaatcacaccaa

SEQ ID NO: 267212 - DNA, 20 bp, human
ggaacctgacaactcattct

SEQ ID NO: 267213 - DNA, 20 bp, human
gaaacacccaggctatgaca

SEQ ID NO: 267214 - DNA, 20 bp, human
ggacacacgggagtggttgt

SEQ ID NO: 267215 - DNA, 20 bp, human
gttgggagatctgtaactgt

SEQ ID NO: 267216 - DNA, 20 bp, human
gaggctggaggccgggagta

SEQ ID NO: 267217 - DNA, 20 bp, human
gccgcggctcccggcggaag

SEQ ID NO: 267218 - DNA, 20 bp, human
gggtggggagaagagcgtcc

SEQ ID NO: 267219 - DNA, 20 bp, human
gcgcggccctcacggtgctt

SEQ ID NO: 267220 - DNA, 20 bp, human
gcccagcctaagcaccgtga

SEQ ID NO: 267221 - DNA, 20 bp, human
gccggtccccgcccggaggt

SEQ ID NO: 267222 - DNA, 20 bp, human
gagctggtgcaagatcagat

SEQ ID NO: 267223 - DNA, 20 bp, human
gaagctgaacgcgtgccgcg

SEQ ID NO: 267224 - DNA, 20 bp, human
gcggcacgcgttcagcttcc

SEQ ID NO: 267225 - DNA, 20 bp, human
gccggtccgcagcctcacag

SEQ ID NO: 267226 - DNA, 20 bp, human
gccaactaggggcttcttga

SEQ ID NO: 267227 - DNA, 20 bp, human
ggcaccccgaagtggctcca

SEQ ID NO: 267228 - DNA, 20 bp, human
gaagaggagggcttctagag

SEQ ID NO: 267229 - DNA, 20 bp, human
gcggaccgggtcacatgggg

SEQ ID NO: 267230 - DNA, 20 bp, human
gggaacggcgggcccggcga

SEQ ID NO: 267231 - DNA, 20 bp, human
gcccagcccgcaccccgaag

SEQ ID NO: 267232 - DNA, 20 bp, human
gcggggccccccgggaacgg

SEQ ID NO: 267233 - DNA, 20 bp, human
gggaaaggaggcatcactcg

SEQ ID NO: 267234 - DNA, 20 bp, human
gaggcgacaccatgtcggac

SEQ ID NO: 267235 - DNA, 20 bp, human
gcagccttggagccacttcg

SEQ ID NO: 267236 - DNA, 20 bp, human
gcaaggcgcaggcgcacgag

SEQ ID NO: 267237 - DNA, 20 bp, human
gcctgcgccttgggctccgg

SEQ ID NO: 267238 - DNA, 20 bp, human
gggcgcaggcgcacgagggg

SEQ ID NO: 267239 - DNA, 20 bp, human
ggcgcacgaggggcggatgc

SEQ ID NO: 267240 - DNA, 20 bp, human
gacgagccccgaggcatcga

SEQ ID NO: 267241 - DNA, 20 bp, human
gcgaggaaggcagagcgcgc

SEQ ID NO: 267242 - DNA, 20 bp, human
ggccgcccgctggccacaag

SEQ ID NO: 267243 - DNA, 20 bp, human
ggccagcgggcggcggtcgt

SEQ ID NO: 267244 - DNA, 20 bp, human
gaatgcgcccgagtgcgcgc

SEQ ID NO: 267245 - DNA, 20 bp, human
ggccaggccgccggagccca

SEQ ID NO: 267246 - DNA, 20 bp, human
gcctcagagcggaaagaaga

SEQ ID NO: 267247 - DNA, 20 bp, human
gagttctgacgcggccgtag

SEQ ID NO: 267248 - DNA, 20 bp, human
gcgctctgatgacgctccaa

SEQ ID NO: 267249 - DNA, 20 bp, human
gagagccccgcacagagcga

SEQ ID NO: 267250 - DNA, 20 bp, human
gccagggcggggtggctgga

SEQ ID NO: 267251 - DNA, 20 bp, human
gaccgccgctgccgcctcta

SEQ ID NO: 267252 - DNA, 20 bp, human
ggtgagagcgaaggtctcgg

SEQ ID NO: 267253 - DNA, 20 bp, human
ggatgacgctccaagggaag

SEQ ID NO: 267254 - DNA, 20 bp, human
gggtcaggggtaagatcggg

SEQ ID NO: 267255 - DNA, 20 bp, human
gcttacccctgacccgaggg

SEQ ID NO: 267256 - DNA, 20 bp, human
gtcccccgccccagtcccga

SEQ ID NO: 267257 - DNA, 20 bp, human
ggccccgccgccctcgggac

SEQ ID NO: 267258 - DNA, 20 bp, human
gaagggagaagacccccgga

SEQ ID NO: 267259 - DNA, 20 bp, human
gcggggaccccgatgtgaag

SEQ ID NO: 267260 - DNA, 20 bp, human
gctggggcggcggagagaac

SEQ ID NO: 267261 - DNA, 20 bp, human
gggaccccgatgtgaagcgg

SEQ ID NO: 267262 - DNA, 20 bp, human
ggccgccctcgggactgggg

SEQ ID NO: 267263 - DNA, 20 bp, human
ggagtccagccaaggagccg

SEQ ID NO: 267264 - DNA, 20 bp, human
gtccttggctggactccggg

SEQ ID NO: 267265 - DNA, 20 bp, human
gcccgccccagtcccgaggg

SEQ ID NO: 267266 - DNA, 20 bp, human
gcattctgcaggggaaaata

SEQ ID NO: 267267 - DNA, 20 bp, human
gtcttctgatagtctagcca

SEQ ID NO: 267268 - DNA, 20 bp, human
gtggcttttggaaatgaatc

SEQ ID NO: 267269 - DNA, 20 bp, human
gaggttttcacattctgcag

SEQ ID NO: 267270 - DNA, 20 bp, human
gcttgctacttcttggacct

SEQ ID NO: 267271 - DNA, 20 bp, human
gaaaagtttgggaaataccc

SEQ ID NO: 267272 - DNA, 20 bp, human
gaaagaacattttaatgcct

SEQ ID NO: 267273 - DNA, 20 bp, human
gtctgtgatcagaaaagttt

SEQ ID NO: 267274 - DNA, 20 bp, human
gtcagacacagttttctagc

SEQ ID NO: 267275 - DNA, 20 bp, human
gttcagtgttcagttaattt

SEQ ID NO: 267276 - DNA, 20 bp, human
gcccacccggaaccctagag

SEQ ID NO: 267277 - DNA, 20 bp, human
gtgcccctgtacgcacgtgg

SEQ ID NO: 267278 - DNA, 20 bp, human
gcacgtggtggtccggcttg

SEQ ID NO: 267279 - DNA, 20 bp, human
gtggtccggcttgtggcttg

SEQ ID NO: 267280 - DNA, 20 bp, human
gctgtacgcacgtggtggtc

SEQ ID NO: 267281 - DNA, 20 bp, human
gcgctgcccctgtacgcacg

SEQ ID NO: 267282 - DNA, 20 bp, human
gagcagagctgacgggctga

SEQ ID NO: 267283 - DNA, 20 bp, human
gggcgccacaagccacaagc

SEQ ID NO: 267284 - DNA, 20 bp, human
gccgcggcggacacttccct

SEQ ID NO: 267285 - DNA, 20 bp, human
gccacgagacagtcccgccc

SEQ ID NO: 267286 - DNA, 20 bp, human
gaagcgacgaagtcagacac

SEQ ID NO: 267287 - DNA, 20 bp, human
ggggtctcttgcaactgcgt

SEQ ID NO: 267288 - DNA, 20 bp, human
ggaacatcgccccgcttaca

SEQ ID NO: 267289 - DNA, 20 bp, human
gtgacttcgtcgcttccggt

SEQ ID NO: 267290 - DNA, 20 bp, human
gtgcaagagaccctgtaagc

SEQ ID NO: 267291 - DNA, 20 bp, human
ggttggctggctctcggtat

SEQ ID NO: 267292 - DNA, 20 bp, human
gttgcaactgcgtcggcctt

SEQ ID NO: 267293 - DNA, 20 bp, human
gtaaaaacgaaactcaagcc

SEQ ID NO: 267294 - DNA, 20 bp, human
ggccttaggctggaaaatgc

SEQ ID NO: 267295 - DNA, 20 bp, human
gaactgcgtcggccttaggc

SEQ ID NO: 267296 - DNA, 20 bp, human
gaggggccaggtcagctgga

SEQ ID NO: 267297 - DNA, 20 bp, human
gacaagtgatgcaacaactt

SEQ ID NO: 267298 - DNA, 20 bp, human
gtgaatgggctggtaagctg

SEQ ID NO: 267299 - DNA, 20 bp, human
gaatgggcacaaggggatgg

SEQ ID NO: 267300 - DNA, 20 bp, human
gtctcatagagaagaacttt

SEQ ID NO: 267301 - DNA, 20 bp, human
gagttcttctctatgagagt

SEQ ID NO: 267302 - DNA, 20 bp, human
ggtccgggagatgcctgaat

SEQ ID NO: 267303 - DNA, 20 bp, human
gtcagagttgcatgatctgg

SEQ ID NO: 267304 - DNA, 20 bp, human
gcttctctatgagagttgga

SEQ ID NO: 267305 - DNA, 20 bp, human
gaattcccctgccatttggc

SEQ ID NO: 267306 - DNA, 20 bp, human
gaggacagagcccctcgtca

SEQ ID NO: 267307 - DNA, 20 bp, human
ggtggaaattccctgacgag

SEQ ID NO: 267308 - DNA, 20 bp, human
gtgccgaataacttagttcc

SEQ ID NO: 267309 - DNA, 20 bp, human
gaacctggaactaagttatt

SEQ ID NO: 267310 - DNA, 20 bp, human
gatgctacatccaaatagac

SEQ ID NO: 267311 - DNA, 20 bp, human
gagaaatataggtcttaggc

SEQ ID NO: 267312 - DNA, 20 bp, human
ggggacagaatataaggtgg

SEQ ID NO: 267313 - DNA, 20 bp, human
gcctgctaatgtgcattgaa

SEQ ID NO: 267314 - DNA, 20 bp, human
gtgttgtgaggcaatagatg

SEQ ID NO: 267315 - DNA, 20 bp, human
gtgtcccaagcccgtctatt

SEQ ID NO: 267316 - DNA, 20 bp, human
gctggaatctggtgagagag

SEQ ID NO: 267317 - DNA, 20 bp, human
ggatagggagtggagtaagt

SEQ ID NO: 267318 - DNA, 20 bp, human
gaaaaccaggcacagctgat

SEQ ID NO: 267319 - DNA, 20 bp, human
gcagattccaggtgtatatg

SEQ ID NO: 267320 - DNA, 20 bp, human
gattcaggatggtgcccaac

SEQ ID NO: 267321 - DNA, 20 bp, human
gttaacccatcagctgtgcc

SEQ ID NO: 267322 - DNA, 20 bp, human
gttagaaaagtgggatgcaa

SEQ ID NO: 267323 - DNA, 20 bp, human
gcagattgacagattaagaa

SEQ ID NO: 267324 - DNA, 20 bp, human
gggaaaactgaatcttagtg

SEQ ID NO: 267325 - DNA, 20 bp, human
gagtttacaacttagaaaag

SEQ ID NO: 267326 - DNA, 20 bp, human
gtaagggagttgggagatct

SEQ ID NO: 267327 - DNA, 20 bp, human
gttaggagttggtcattgaa

SEQ ID NO: 267328 - DNA, 20 bp, human
gtcccggaagggccaactaa

SEQ ID NO: 267329 - DNA, 20 bp, human
gagggccaactaagggagtt

SEQ ID NO: 267330 - DNA, 20 bp, human
gagaccgggcggctcccgga

SEQ ID NO: 267331 - DNA, 20 bp, human
gaaccaggtggagtggaaaa

SEQ ID NO: 267332 - DNA, 20 bp, human
gccttcctgcacaagagacc

SEQ ID NO: 267333 - DNA, 20 bp, human
ggaaagtctcctcattctgt

SEQ ID NO: 267334 - DNA, 20 bp, human
gtcctgcacaagagaccggg

SEQ ID NO: 267335 - DNA, 20 bp, human
gatctcccaactcccttagt

SEQ ID NO: 267336 - DNA, 20 bp, human
gtaagcagcaagttcccaca

SEQ ID NO: 267337 - DNA, 20 bp, human
gctcccaggtcaaatgtccc

SEQ ID NO: 267338 - DNA, 20 bp, human
gcctctgtgatcggccatag

SEQ ID NO: 267339 - DNA, 20 bp, human
gattcagtgtgcagtaacag

SEQ ID NO: 267340 - DNA, 20 bp, human
ggttcccacagggctgaagg

SEQ ID NO: 267341 - DNA, 20 bp, human
gcaagttcccacagggctga

SEQ ID NO: 267342 - DNA, 20 bp, human
ggggtggcaagcccatattt

SEQ ID NO: 267343 - DNA, 20 bp, human
gcggacttcacccgggtgtg

SEQ ID NO: 267344 - DNA, 20 bp, human
gtctgctggtaagtgccggg

SEQ ID NO: 267345 - DNA, 20 bp, human
gaataacacggacttcaccc

SEQ ID NO: 267346 - DNA, 20 bp, human
ggggctccccagtccctctc

SEQ ID NO: 267347 - DNA, 20 bp, human
ggggagccccgcttctcttc

SEQ ID NO: 267348 - DNA, 20 bp, human
ggggtgaaaggcagtagcta

SEQ ID NO: 267349 - DNA, 20 bp, human
gtggtgtgagtaaggaggtg

SEQ ID NO: 267350 - DNA, 20 bp, human
gtgtgccaggaaagtcagtc

SEQ ID NO: 267351 - DNA, 20 bp, human
ggaggccggactgactttcc

SEQ ID NO: 267352 - DNA, 20 bp, human
ggtgttgaatcagaaaaagg

SEQ ID NO: 267353 - DNA, 20 bp, human
gggaaggagtggcaaattga

SEQ ID NO: 267354 - DNA, 20 bp, human
ggactctctggttctaacgt

SEQ ID NO: 267355 - DNA, 20 bp, human
ggggacttggtggcactcag

SEQ ID NO: 267356 - DNA, 20 bp, human
gcgggtggagaccaactctg

SEQ ID NO: 267357 - DNA, 20 bp, human
gcggaagcggaaactccttg

SEQ ID NO: 267358 - DNA, 20 bp, human
ggcagcactcagcagaagac

SEQ ID NO: 267359 - DNA, 20 bp, human
ggcgctgcaacccccggctc

SEQ ID NO: 267360 - DNA, 20 bp, human
gctccacccggcctgggaac

SEQ ID NO: 267361 - DNA, 20 bp, human
ggcaaaggatagcccggaag

SEQ ID NO: 267362 - DNA, 20 bp, human
gatcccccgagccggttccc

SEQ ID NO: 267363 - DNA, 20 bp, human
gcccggcctgggaaccggct

SEQ ID NO: 267364 - DNA, 20 bp, human
gggtctgttggtgggagagt

SEQ ID NO: 267365 - DNA, 20 bp, human
gggcctgggaaccggctcgg

SEQ ID NO: 267366 - DNA, 20 bp, human
ggggccacctgggaccatga

SEQ ID NO: 267367 - DNA, 20 bp, human
gagggcagaagccagggacg

SEQ ID NO: 267368 - DNA, 20 bp, human
ggtccagcgggtctggaggt

SEQ ID NO: 267369 - DNA, 20 bp, human
gagtcgggcagattgggcca

SEQ ID NO: 267370 - DNA, 20 bp, human
ggaaagaagtcgggcagatt

SEQ ID NO: 267371 - DNA, 20 bp, human
ggccagggggtatggatcca

SEQ ID NO: 267372 - DNA, 20 bp, human
gcagattgggccagggggta

SEQ ID NO: 267373 - DNA, 20 bp, human
gtggctgtcttgtgggtcta

SEQ ID NO: 267374 - DNA, 20 bp, human
ggggcccactctcatgacaa

SEQ ID NO: 267375 - DNA, 20 bp, human
gtgaggaggcctacagtcag

SEQ ID NO: 267376 - DNA, 20 bp, human
gagagccaggcaaatactga

SEQ ID NO: 267377 - DNA, 20 bp, human
ggaagccttcagtatttgcc

SEQ ID NO: 267378 - DNA, 20 bp, human
gatttgcctggctctttctg

SEQ ID NO: 267379 - DNA, 20 bp, human
gtcaagtggagtaaagggga

SEQ ID NO: 267380 - DNA, 20 bp, human
ggggctctgagcaactggtg

SEQ ID NO: 267381 - DNA, 20 bp, human
gggaacacgctgacccatgg

SEQ ID NO: 267382 - DNA, 20 bp, human
ggcaactggtgaggcttttg

SEQ ID NO: 267383 - DNA, 20 bp, human
gtctgggtgttgggaatctg

SEQ ID NO: 267384 - DNA, 20 bp, human
gtgggtcagcgtgttccaag

SEQ ID NO: 267385 - DNA, 20 bp, human
gaagatcaagtggagtaaag

SEQ ID NO: 267386 - DNA, 20 bp, human
gcaaattcatgatgtctttc

SEQ ID NO: 267387 - DNA, 20 bp, human
ggaatttggagtgtttattt

SEQ ID NO: 267388 - DNA, 20 bp, human
gtttattttggctaaatcca

SEQ ID NO: 267389 - DNA, 20 bp, human
gattaaacaattaattacct

SEQ ID NO: 267390 - DNA, 20 bp, human
ggagatgtatttcccagaaa

SEQ ID NO: 267391 - DNA, 20 bp, human
ggggctaacaggtatgagca

SEQ ID NO: 267392 - DNA, 20 bp, human
ggattcaaactgggagagat

SEQ ID NO: 267393 - DNA, 20 bp, human
gtaaccctaagaaacagaaa

SEQ ID NO: 267394 - DNA, 20 bp, human
gaaaaggaacatgatgaaaa

SEQ ID NO: 267395 - DNA, 20 bp, human
gaaaatcagagattcaaact

SEQ ID NO: 267396 - DNA, 20 bp, human
gcctccccggggttttcaca

SEQ ID NO: 267397 - DNA, 20 bp, human
ggaacagtaacccctccccg

SEQ ID NO: 267398 - DNA, 20 bp, human
gtgtccttgtgaaaaccccg

SEQ ID NO: 267399 - DNA, 20 bp, human
gttttcacaaggacacaagc

SEQ ID NO: 267400 - DNA, 20 bp, human
gaaaaagaatactctaagga

SEQ ID NO: 267401 - DNA, 20 bp, human
gctgtttctgctaaccaatc

SEQ ID NO: 267402 - DNA, 20 bp, human
ggggttactgttctgctggc

SEQ ID NO: 267403 - DNA, 20 bp, human
gacaagcttagaaaagagga

SEQ ID NO: 267404 - DNA, 20 bp, human
gagcagactcaactcctaac

SEQ ID NO: 267405 - DNA, 20 bp, human
gaagataattcctggtcggc

SEQ ID NO: 267406 - DNA, 20 bp, human
gtgagggcaggggaataatg

SEQ ID NO: 267407 - DNA, 20 bp, human
gaaaaagaatgaatgagggc

SEQ ID NO: 267408 - DNA, 20 bp, human
gggaataatgaggatgagtg

SEQ ID NO: 267409 - DNA, 20 bp, human
gtaagaaaaagaatgaatga

SEQ ID NO: 267410 - DNA, 20 bp, human
gggcctcagaggaagaagaa

SEQ ID NO: 267411 - DNA, 20 bp, human
ggaaagactgagaggaaaga

SEQ ID NO: 267412 - DNA, 20 bp, human
gaagctctgaatcttctagg

SEQ ID NO: 267413 - DNA, 20 bp, human
gggatagagactgaaacagg

SEQ ID NO: 267414 - DNA, 20 bp, human
gtcctgcatcaccctttctc

SEQ ID NO: 267415 - DNA, 20 bp, human
ggggaagctctgaatcttct

SEQ ID NO: 267416 - DNA, 20 bp, human
gtgagggcaggggaataatg

SEQ ID NO: 267417 - DNA, 20 bp, human
gaaaaagaatgaatgagggc

SEQ ID NO: 267418 - DNA, 20 bp, human
gggaataatgaggatgagtg

SEQ ID NO: 267419 - DNA, 20 bp, human
gtaagaaaaagaatgaatga

SEQ ID NO: 267420 - DNA, 20 bp, human
gggcctcagaggaagaagaa

SEQ ID NO: 267421 - DNA, 20 bp, human
ggaaagactgagaggaaaga

SEQ ID NO: 267422 - DNA, 20 bp, human
gggatagagactgaaacagg

SEQ ID NO: 267423 - DNA, 20 bp, human
gtcctgcatcaccctttctc

SEQ ID NO: 267424 - DNA, 20 bp, human
gaagctctgaatcttctagg

SEQ ID NO: 267425 - DNA, 20 bp, human
gcatccagattccagggcct

SEQ ID NO: 267426 - DNA, 20 bp, human
gccagccacagccttcccca

SEQ ID NO: 267427 - DNA, 20 bp, human
gtgagatactggggaagatg

SEQ ID NO: 267428 - DNA, 20 bp, human
gtgtggctgggtgaccccaa

SEQ ID NO: 267429 - DNA, 20 bp, human
gccagtgtggcccgtgggga

SEQ ID NO: 267430 - DNA, 20 bp, human
ggcctcatgtacccaccctt

SEQ ID NO: 267431 - DNA, 20 bp, human
ggccaagggctaagtaaata

SEQ ID NO: 267432 - DNA, 20 bp, human
gcctgcccacgctgatgctg

SEQ ID NO: 267433 - DNA, 20 bp, human
gtggagggaagcagtcactt

SEQ ID NO: 267434 - DNA, 20 bp, human
gcacagtcctgtaaggccaa

SEQ ID NO: 267435 - DNA, 20 bp, human
gttggggatctgagatactg

SEQ ID NO: 267436 - DNA, 20 bp, human
gacctttgagggagtaaagg

SEQ ID NO: 267437 - DNA, 20 bp, human
gtcagtctgaagtctggcaa

SEQ ID NO: 267438 - DNA, 20 bp, human
gcccaccatagaacaggacc

SEQ ID NO: 267439 - DNA, 20 bp, human
ggccccctttactccctcaa

SEQ ID NO: 267440 - DNA, 20 bp, human
gccttcctggtcctgttcta

SEQ ID NO: 267441 - DNA, 20 bp, human
gttgccccatctcctggatt

SEQ ID NO: 267442 - DNA, 20 bp, human
ggtgtgccctcagccatccc

SEQ ID NO: 267443 - DNA, 20 bp, human
gtcaagaaaaggaaattggt

SEQ ID NO: 267444 - DNA, 20 bp, human
gagtggtctgaagatttgaa

SEQ ID NO: 267445 - DNA, 20 bp, human
ggacttctcagtctgaagtc

SEQ ID NO: 267446 - DNA, 20 bp, human
gaatgggacagcaagaccct

SEQ ID NO: 267447 - DNA, 20 bp, human
gagacctttgggagagtaaa

SEQ ID NO: 267448 - DNA, 20 bp, human
ggccccctttactctcccaa

SEQ ID NO: 267449 - DNA, 20 bp, human
ggatgcttgcccccatctcc

SEQ ID NO: 267450 - DNA, 20 bp, human
gccttcctattcctgttcta

SEQ ID NO: 267451 - DNA, 20 bp, human
gtcaatctgaagtctcgcaa

SEQ ID NO: 267452 - DNA, 20 bp, human
gagatgggggcaagcatcct

SEQ ID NO: 267453 - DNA, 20 bp, human
gcccaccatagaacaggaat

SEQ ID NO: 267454 - DNA, 20 bp, human
gagcatcctgggaaagctga

SEQ ID NO: 267455 - DNA, 20 bp, human
ggtgtgccctcagctttccc

SEQ ID NO: 267456 - DNA, 20 bp, human
gaaggccacggggatacaga

SEQ ID NO: 267457 - DNA, 20 bp, human
gcacggggatacagaggggt

SEQ ID NO: 267458 - DNA, 20 bp, human
ggggcctgaggggggcggaa

SEQ ID NO: 267459 - DNA, 20 bp, human
gccgaccagggcccgactga

SEQ ID NO: 267460 - DNA, 20 bp, human
gggctcctggctcccgtgac

SEQ ID NO: 267461 - DNA, 20 bp, human
gagcgctagggaaggccacg

SEQ ID NO: 267462 - DNA, 20 bp, human
gaaggggcgtggcggagctc

SEQ ID NO: 267463 - DNA, 20 bp, human
gcttgaaggaggaactaagg

SEQ ID NO: 267464 - DNA, 20 bp, human
ggaactggggtctccagtca

SEQ ID NO: 267465 - DNA, 20 bp, human
gggggtgtgccctgcaactg

SEQ ID NO: 267466 - DNA, 20 bp, human
gtaaaaaggagcctagtctt

SEQ ID NO: 267467 - DNA, 20 bp, human
gcctcctggcgccgtcgcgg

SEQ ID NO: 267468 - DNA, 20 bp, human
gagactgcgggtggcgtaag

SEQ ID NO: 267469 - DNA, 20 bp, human
gatcccgcgcggccccccat

SEQ ID NO: 267470 - DNA, 20 bp, human
gtaagggggggaacataaaa

SEQ ID NO: 267471 - DNA, 20 bp, human
ggcccaatggggggccgcgc

SEQ ID NO: 267472 - DNA, 20 bp, human
gctgcgggtggcgtaagggg

SEQ ID NO: 267473 - DNA, 20 bp, human
ggccccccattgggccattt

SEQ ID NO: 267474 - DNA, 20 bp, human
ggcggagctgggcgcctaaa

SEQ ID NO: 267475 - DNA, 20 bp, human
gcgcctaaatggcccaatgg

SEQ ID NO: 267476 - DNA, 20 bp, human
gcatgcgcacaccgtggccg

SEQ ID NO: 267477 - DNA, 20 bp, human
gaacacccgagaatggggac

SEQ ID NO: 267478 - DNA, 20 bp, human
gcacttagacgccacggcca

SEQ ID NO: 267479 - DNA, 20 bp, human
gctgggttgagtgttctctt

SEQ ID NO: 267480 - DNA, 20 bp, human
ggcgccctgtccccattctc

SEQ ID NO: 267481 - DNA, 20 bp, human
gacagtgcgagcagtctccc

SEQ ID NO: 267482 - DNA, 20 bp, human
gtctctctgcatcccgggcg

SEQ ID NO: 267483 - DNA, 20 bp, human
gcagccagcggcagtggagt

SEQ ID NO: 267484 - DNA, 20 bp, human
gctaccaacacccgagaatg

SEQ ID NO: 267485 - DNA, 20 bp, human
gaaggtgcgggccggtctct

SEQ ID NO: 267486 - DNA, 20 bp, human
gacgtcgccggacaagtcgt

SEQ ID NO: 267487 - DNA, 20 bp, human
ggggcggtgggaagaacccc

SEQ ID NO: 267488 - DNA, 20 bp, human
gagggcgcggaagcgagagg

SEQ ID NO: 267489 - DNA, 20 bp, human
gccgcgccctgcgacgtcgc

SEQ ID NO: 267490 - DNA, 20 bp, human
gtcgccggacaagtcgtggg

SEQ ID NO: 267491 - DNA, 20 bp, human
gaacaggtttagtttctcgg

SEQ ID NO: 267492 - DNA, 20 bp, human
gtggggcggggctccatagt

SEQ ID NO: 267493 - DNA, 20 bp, human
gcggggctccatagtgggcg

SEQ ID NO: 267494 - DNA, 20 bp, human
ggggcggacgcagcgtccgc

SEQ ID NO: 267495 - DNA, 20 bp, human
gcggcagggtccgggtggcg

SEQ ID NO: 267496 - DNA, 20 bp, human
gggcgccgctctccccgcta

SEQ ID NO: 267497 - DNA, 20 bp, human
gtgtccagagcggggttcga

SEQ ID NO: 267498 - DNA, 20 bp, human
gaaccccgctctggacagag

SEQ ID NO: 267499 - DNA, 20 bp, human
gagggccgggccgcctgagt

SEQ ID NO: 267500 - DNA, 20 bp, human
ggcgaggccggaaattcccg

SEQ ID NO: 267501 - DNA, 20 bp, human
ggggaagctaacggattggt

SEQ ID NO: 267502 - DNA, 20 bp, human
ggttccctcagcatccggag

SEQ ID NO: 267503 - DNA, 20 bp, human
gaagctaacggattggtcgg

SEQ ID NO: 267504 - DNA, 20 bp, human
ggggagctaggccacggcac

SEQ ID NO: 267505 - DNA, 20 bp, human
gccgtggcctagctccctcc

SEQ ID NO: 267506 - DNA, 20 bp, human
ggaagagagcccaatggggt

SEQ ID NO: 267507 - DNA, 20 bp, human
ggcaagatgcccaccccatt

SEQ ID NO: 267508 - DNA, 20 bp, human
gctgggggaagagagcccaa

SEQ ID NO: 267509 - DNA, 20 bp, human
gggagcagggtgtctttgct

SEQ ID NO: 267510 - DNA, 20 bp, human
gggggacacccacttcctat

SEQ ID NO: 267511 - DNA, 20 bp, human
gaggtatgaggtcatctcaa

SEQ ID NO: 267512 - DNA, 20 bp, human
gcttgctggagcctagtgga

SEQ ID NO: 267513 - DNA, 20 bp, human
gtaagcagcccataggaagt

SEQ ID NO: 267514 - DNA, 20 bp, human
gctcaggagctctctggact

SEQ ID NO: 267515 - DNA, 20 bp, human
ggctcctgagactcctctgc

SEQ ID NO: 267516 - DNA, 20 bp, human
gagaggaagcggctgtcact

SEQ ID NO: 267517 - DNA, 20 bp, human
gaggtgcgagatcatctcca

SEQ ID NO: 267518 - DNA, 20 bp, human
gaggtccaggcaggctgcca

SEQ ID NO: 267519 - DNA, 20 bp, human
ggtcgccatgggatccccaa

SEQ ID NO: 267520 - DNA, 20 bp, human
gccgccccttggggatccca

SEQ ID NO: 267521 - DNA, 20 bp, human
ggcaggctgccagggtgaaa

SEQ ID NO: 267522 - DNA, 20 bp, human
gtcaccatgagctgagaacg

SEQ ID NO: 267523 - DNA, 20 bp, human
gaggagaccgtccccctgca

SEQ ID NO: 267524 - DNA, 20 bp, human
gcagggatgacagtcgccat

SEQ ID NO: 267525 - DNA, 20 bp, human
ggactctaggtattcggata

SEQ ID NO: 267526 - DNA, 20 bp, human
gctgccctatccaaccagga

SEQ ID NO: 267527 - DNA, 20 bp, human
gagggacaccccacccagac

SEQ ID NO: 267528 - DNA, 20 bp, human
gtgctggctccagtctgggt

SEQ ID NO: 267529 - DNA, 20 bp, human
gactccatcctggttggata

SEQ ID NO: 267530 - DNA, 20 bp, human
ggtccctgggggacaatggg

SEQ ID NO: 267531 - DNA, 20 bp, human
ggcctggcccccttataatc

SEQ ID NO: 267532 - DNA, 20 bp, human
gggtgtccctgggggacaat

SEQ ID NO: 267533 - DNA, 20 bp, human
gaaatactcccaccccctgc

SEQ ID NO: 267534 - DNA, 20 bp, human
gttcctcccattgtccccca

SEQ ID NO: 267535 - DNA, 20 bp, human
gaagatgttggactccatcc

SEQ ID NO: 267536 - DNA, 20 bp, human
gaatggagactggtcactag

SEQ ID NO: 267537 - DNA, 20 bp, human
gcaggagacatccctatcaa

SEQ ID NO: 267538 - DNA, 20 bp, human
gggtttgaggaagttgatat

SEQ ID NO: 267539 - DNA, 20 bp, human
gagtacacatcaatatttga

SEQ ID NO: 267540 - DNA, 20 bp, human
gacccttcagcagaagtaga

SEQ ID NO: 267541 - DNA, 20 bp, human
gcaaacatgtcattaaatca

SEQ ID NO: 267542 - DNA, 20 bp, human
ggcagctcatcagaggtttg

SEQ ID NO: 267543 - DNA, 20 bp, human
ggatgagtctcatcaggtta

SEQ ID NO: 267544 - DNA, 20 bp, human
gttctcagacttcatagaaa

SEQ ID NO: 267545 - DNA, 20 bp, human
gtcagacactacacataacc

SEQ ID NO: 267546 - DNA, 20 bp, human
gatacctagcatttacatat

SEQ ID NO: 267547 - DNA, 20 bp, human
ggaaattgaggcactagtaa

SEQ ID NO: 267548 - DNA, 20 bp, human
gatgctaggtatcataatga

SEQ ID NO: 267549 - DNA, 20 bp, human
gccttccaggacaaagataa

SEQ ID NO: 267550 - DNA, 20 bp, human
ggtgtggaactcttatgaaa

SEQ ID NO: 267551 - DNA, 20 bp, human
gcacactcatgacccctaaa

SEQ ID NO: 267552 - DNA, 20 bp, human
gttccttattcatgtgaaag

SEQ ID NO: 267553 - DNA, 20 bp, human
gatcatgtgaagacacatag

SEQ ID NO: 267554 - DNA, 20 bp, human
gaaggtcatgtaataaaagg

SEQ ID NO: 267555 - DNA, 20 bp, human
gtcaatgcaatagtaataaa

SEQ ID NO: 267556 - DNA, 20 bp, human
gtaggcaagcttaatgagcg

SEQ ID NO: 267557 - DNA, 20 bp, human
ggagctgcatgcagaaccaa

SEQ ID NO: 267558 - DNA, 20 bp, human
ggggagcaataacgaaaaaa

SEQ ID NO: 267559 - DNA, 20 bp, human
gtgcatgcagctcctaatgt

SEQ ID NO: 267560 - DNA, 20 bp, human
gtgtgaagacaaggtagtga

SEQ ID NO: 267561 - DNA, 20 bp, human
gaatacaaatgtacagatca

SEQ ID NO: 267562 - DNA, 20 bp, human
gggggcccttaaatgttagt

SEQ ID NO: 267563 - DNA, 20 bp, human
ggcagatctgggtgagatta

SEQ ID NO: 267564 - DNA, 20 bp, human
gcattaagcttgcctacatt

SEQ ID NO: 267565 - DNA, 20 bp, human
gtttcacataagttgttatg

SEQ ID NO: 267566 - DNA, 20 bp, human
gctctagtagcagagagaat

SEQ ID NO: 267567 - DNA, 20 bp, human
gttgagaagtgattcacccc

SEQ ID NO: 267568 - DNA, 20 bp, human
gctctctgctactagagatg

SEQ ID NO: 267569 - DNA, 20 bp, human
gaagtactgctgtgacatcc

SEQ ID NO: 267570 - DNA, 20 bp, human
gagagatgaggtgagattgc

SEQ ID NO: 267571 - DNA, 20 bp, human
gtagaggtatcagcggtcag

SEQ ID NO: 267572 - DNA, 20 bp, human
gctactggaacacctccagc

SEQ ID NO: 267573 - DNA, 20 bp, human
ggggacatccttagattatg

SEQ ID NO: 267574 - DNA, 20 bp, human
gaaaagttgtggtttccccc

SEQ ID NO: 267575 - DNA, 20 bp, human
ggttccagtagaggtatcag

SEQ ID NO: 267576 - DNA, 20 bp, human
gagcaaaaatgtagggtcaa

SEQ ID NO: 267577 - DNA, 20 bp, human
gtcccaatagcaaaaatgta

SEQ ID NO: 267578 - DNA, 20 bp, human
gtcttcagatacttccttca

SEQ ID NO: 267579 - DNA, 20 bp, human
ggtgattagcagctgaagac

SEQ ID NO: 267580 - DNA, 20 bp, human
gaacaaaaaaccatgatatg

SEQ ID NO: 267581 - DNA, 20 bp, human
ggaccctacatttttgctat

SEQ ID NO: 267582 - DNA, 20 bp, human
gttaaacagtccccatatca

SEQ ID NO: 267583 - DNA, 20 bp, human
gtattgggaaattaccctga

SEQ ID NO: 267584 - DNA, 20 bp, human
ggcattagtgaattgaaaaa

SEQ ID NO: 267585 - DNA, 20 bp, human
gcaaggtggtcttcccttct

SEQ ID NO: 267586 - DNA, 20 bp, human
ggtcagggcggcagtagtca

SEQ ID NO: 267587 - DNA, 20 bp, human
ggctgcatgttgttcccttg

SEQ ID NO: 267588 - DNA, 20 bp, human
gccctgttgctgttccctga

SEQ ID NO: 267589 - DNA, 20 bp, human
gctgccctggcaacttctac

SEQ ID NO: 267590 - DNA, 20 bp, human
gaacccggtagaagttgcca

SEQ ID NO: 267591 - DNA, 20 bp, human
gctctcatgccgctagaacc

SEQ ID NO: 267592 - DNA, 20 bp, human
gctgaccttgaactgagaat

SEQ ID NO: 267593 - DNA, 20 bp, human
gtcaggggctaaaaggaggt

SEQ ID NO: 267594 - DNA, 20 bp, human
ggggtcaccttcatccccaa

SEQ ID NO: 267595 - DNA, 20 bp, human
gttggaatcttccaggactc

SEQ ID NO: 267596 - DNA, 20 bp, human
gaggtcactcggtggtcaag

SEQ ID NO: 267597 - DNA, 20 bp, human
gcatcctagttccctggcat

SEQ ID NO: 267598 - DNA, 20 bp, human
gaagctgggaggtcactcgg

SEQ ID NO: 267599 - DNA, 20 bp, human
gacactaagtatgaaggagt

SEQ ID NO: 267600 - DNA, 20 bp, human
gctgcaatgcgatggagaag

SEQ ID NO: 267601 - DNA, 20 bp, human
gagtctctggacctttctaa

SEQ ID NO: 267602 - DNA, 20 bp, human
gagggaactaggatggaaca

SEQ ID NO: 267603 - DNA, 20 bp, human
gtgaagctgcagaaaatgtc

SEQ ID NO: 267604 - DNA, 20 bp, human
gcttcaacaagcctatgcca

SEQ ID NO: 267605 - DNA, 20 bp, human
gtgatagccaaaataggaag

SEQ ID NO: 267606 - DNA, 20 bp, human
ggcaactggggacagaaggt

SEQ ID NO: 267607 - DNA, 20 bp, human
gaaaacagaccccagatgca

SEQ ID NO: 267608 - DNA, 20 bp, human
gagcatcatctgcaccctta

SEQ ID NO: 267609 - DNA, 20 bp, human
gaaggtgggatgttgtttga

SEQ ID NO: 267610 - DNA, 20 bp, human
gtggccttcatgtacactct

SEQ ID NO: 267611 - DNA, 20 bp, human
gaatttactcacagagctca

SEQ ID NO: 267612 - DNA, 20 bp, human
gagtgtacatgaaggccagc

SEQ ID NO: 267613 - DNA, 20 bp, human
gggctttcatcattcagatt

SEQ ID NO: 267614 - DNA, 20 bp, human
ggatgatgctgaaagcgtgt

SEQ ID NO: 267615 - DNA, 20 bp, human
gcaacaaccacccttttcac

SEQ ID NO: 267616 - DNA, 20 bp, human
gaaaagaaagcggtgggaga

SEQ ID NO: 267617 - DNA, 20 bp, human
ggggagggagaggagttaag

SEQ ID NO: 267618 - DNA, 20 bp, human
gtgagagtgggagatctcca

SEQ ID NO: 267619 - DNA, 20 bp, human
ggaaagcggtgggagatggc

SEQ ID NO: 267620 - DNA, 20 bp, human
ggtggagtcaagcgtgtctg

SEQ ID NO: 267621 - DNA, 20 bp, human
gtccacagaaagtccagccc

SEQ ID NO: 267622 - DNA, 20 bp, human
gtgtggtgtctgtcgcagat

SEQ ID NO: 267623 - DNA, 20 bp, human
gacaggccttccctggtggt

SEQ ID NO: 267624 - DNA, 20 bp, human
ggtccgctcaagaaagcagt

SEQ ID NO: 267625 - DNA, 20 bp, human
gctcccactgctttcttgag

SEQ ID NO: 267626 - DNA, 20 bp, human
gactggggaactagatgata

SEQ ID NO: 267627 - DNA, 20 bp, human
gaggatgagctcattgggat

SEQ ID NO: 267628 - DNA, 20 bp, human
gtagatgatagggatgtgaa

SEQ ID NO: 267629 - DNA, 20 bp, human
gtgtggcaggatgtgagctc

SEQ ID NO: 267630 - DNA, 20 bp, human
gccacaatgagtagacgaaa

SEQ ID NO: 267631 - DNA, 20 bp, human
gacctagagaggtcagtgtt

SEQ ID NO: 267632 - DNA, 20 bp, human
gtctgtcatcaggagtgagc

SEQ ID NO: 267633 - DNA, 20 bp, human
gaccgaacactgacctctct

SEQ ID NO: 267634 - DNA, 20 bp, human
gccccgaggtcagatctgag

SEQ ID NO: 267635 - DNA, 20 bp, human
gattggcatgagacctagag

SEQ ID NO: 267636 - DNA, 20 bp, human
ggcttaaaggcctctcccct

SEQ ID NO: 267637 - DNA, 20 bp, human
gataactgatcctaggggag

SEQ ID NO: 267638 - DNA, 20 bp, human
gtttctaggaaactaaacat

SEQ ID NO: 267639 - DNA, 20 bp, human
gatctcaatatgttgaaatt

SEQ ID NO: 267640 - DNA, 20 bp, human
gaaattgtgagagtagacaa

SEQ ID NO: 267641 - DNA, 20 bp, human
gactcaaaggtataatggaa

SEQ ID NO: 267642 - DNA, 20 bp, human
gcagcatcttgtttacctta

SEQ ID NO: 267643 - DNA, 20 bp, human
gataccagtaaaatgcttag

SEQ ID NO: 267644 - DNA, 20 bp, human
gaaagcatatttgatagtgc

SEQ ID NO: 267645 - DNA, 20 bp, human
gtttaaattgtgggaagtaa

SEQ ID NO: 267646 - DNA, 20 bp, human
ggggctagctgcggcctcgt

SEQ ID NO: 267647 - DNA, 20 bp, human
gccgccagcggggctagctg

SEQ ID NO: 267648 - DNA, 20 bp, human
gcactctagaagctcattgg

SEQ ID NO: 267649 - DNA, 20 bp, human
gggccagggccgctcacact

SEQ ID NO: 267650 - DNA, 20 bp, human
gtgggagcgcgaacgctgtg

SEQ ID NO: 267651 - DNA, 20 bp, human
gaggccgcagctagccccgc

SEQ ID NO: 267652 - DNA, 20 bp, human
gtgggctgacgggcgctgat

SEQ ID NO: 267653 - DNA, 20 bp, human
gggccgaggccggttgaagt

SEQ ID NO: 267654 - DNA, 20 bp, human
gcctcgtggggtgggctgac

SEQ ID NO: 267655 - DNA, 20 bp, human
gagcgggattggtgccctga

SEQ ID NO: 267656 - DNA, 20 bp, human
gaacccagcgcacttccgag

SEQ ID NO: 267657 - DNA, 20 bp, human
gcagtgggttctggtgagaa

SEQ ID NO: 267658 - DNA, 20 bp, human
gctggtgagaagggcaacag

SEQ ID NO: 267659 - DNA, 20 bp, human
ggagccgctcggaagtgcgc

SEQ ID NO: 267660 - DNA, 20 bp, human
ggggagactctgtcactggg

SEQ ID NO: 267661 - DNA, 20 bp, human
gaggaggcgccggtgcggag

SEQ ID NO: 267662 - DNA, 20 bp, human
gagaacccactggccgctaa

SEQ ID NO: 267663 - DNA, 20 bp, human
ggggcgggcccgttgtgggt

SEQ ID NO: 267664 - DNA, 20 bp, human
ggggggatgtggaacctaat

SEQ ID NO: 267665 - DNA, 20 bp, human
ggtgcgctgggttcccttag

SEQ ID NO: 267666 - DNA, 20 bp, human
gtcagtgccggaagcgagcc

SEQ ID NO: 267667 - DNA, 20 bp, human
gtgacggacgaccaatggaa

SEQ ID NO: 267668 - DNA, 20 bp, human
ggcgcactgtggcactgtga

SEQ ID NO: 267669 - DNA, 20 bp, human
gaacgtccccgctgtggctt

SEQ ID NO: 267670 - DNA, 20 bp, human
gtcccagcctggctcgcttc

SEQ ID NO: 267671 - DNA, 20 bp, human
ggaagatgagccgcgctgat

SEQ ID NO: 267672 - DNA, 20 bp, human
gaacgcgatcctgcgtgtcc

SEQ ID NO: 267673 - DNA, 20 bp, human
gggctgaagtctagaggtcg

SEQ ID NO: 267674 - DNA, 20 bp, human
gcggctggaggcgtcagtgc

SEQ ID NO: 267675 - DNA, 20 bp, human
ggtgcgccatgctcacacga

SEQ ID NO: 267676 - DNA, 20 bp, human
ggaacctggagggttggtaa

SEQ ID NO: 267677 - DNA, 20 bp, human
ggggcctttaccaaccctcc

SEQ ID NO: 267678 - DNA, 20 bp, human
gacaacggaacctggagggt

SEQ ID NO: 267679 - DNA, 20 bp, human
gcacgccgcccggtcccatg

SEQ ID NO: 267680 - DNA, 20 bp, human
gtggccccgccccatgggac

SEQ ID NO: 267681 - DNA, 20 bp, human
gagagactccaaagaggcgg

SEQ ID NO: 267682 - DNA, 20 bp, human
gaagctggatgcttttttag

SEQ ID NO: 267683 - DNA, 20 bp, human
ggcttacaacggaacctgga

SEQ ID NO: 267684 - DNA, 20 bp, human
gctgcggcgcagacgcccga

SEQ ID NO: 267685 - DNA, 20 bp, human
gcgggcggcgtgggcgtgag

SEQ ID NO: 267686 - DNA, 20 bp, human
gagggaaagcccataatcaa

SEQ ID NO: 267687 - DNA, 20 bp, human
ggcagcctgcagtagaaccc

SEQ ID NO: 267688 - DNA, 20 bp, human
gacaaacagtgggcttgagt

SEQ ID NO: 267689 - DNA, 20 bp, human
gggttcttgggacaaacagt

SEQ ID NO: 267690 - DNA, 20 bp, human
gggtccacatccactccaag

SEQ ID NO: 267691 - DNA, 20 bp, human
gcggggaggcgtgagtgcca

SEQ ID NO: 267692 - DNA, 20 bp, human
gagcatgcgccgcgccaggg

SEQ ID NO: 267693 - DNA, 20 bp, human
ggggcctgcggtgaccaggt

SEQ ID NO: 267694 - DNA, 20 bp, human
gagtcacgtgatgcatgtca

SEQ ID NO: 267695 - DNA, 20 bp, human
gaggtctgggatggccccgc

SEQ ID NO: 267696 - DNA, 20 bp, human
gagccggtgtaccgactccc

SEQ ID NO: 267697 - DNA, 20 bp, human
gcaccggggagtcggtacac

SEQ ID NO: 267698 - DNA, 20 bp, human
gggcggagagagatccgtga

SEQ ID NO: 267699 - DNA, 20 bp, human
gtgcgtcatcaactagtgac

SEQ ID NO: 267700 - DNA, 20 bp, human
gaactagtgacgggagaaga

SEQ ID NO: 267701 - DNA, 20 bp, human
ggggtgaaagaaacggggcg

SEQ ID NO: 267702 - DNA, 20 bp, human
gactgcttgtgacctcatgc

SEQ ID NO: 267703 - DNA, 20 bp, human
gccggctcgtctagacaacc

SEQ ID NO: 267704 - DNA, 20 bp, human
gttatcatccaccggggagt

SEQ ID NO: 267705 - DNA, 20 bp, human
gggtgaaagggcgaggtgac

SEQ ID NO: 267706 - DNA, 20 bp, human
ggggcggggcttcgacggtg

SEQ ID NO: 267707 - DNA, 20 bp, human
ggtggggcgtagttaagggc

SEQ ID NO: 267708 - DNA, 20 bp, human
gccgcccctcggagcatccg

SEQ ID NO: 267709 - DNA, 20 bp, human
ggacggtggggcgtagttaa

SEQ ID NO: 267710 - DNA, 20 bp, human
gtataccccggatgctccga

SEQ ID NO: 267711 - DNA, 20 bp, human
gaatcccggaagcctagggt

SEQ ID NO: 267712 - DNA, 20 bp, human
gagggcgggtctctcttttg

SEQ ID NO: 267713 - DNA, 20 bp, human
gggctaggacgaagtcacgt

SEQ ID NO: 267714 - DNA, 20 bp, human
gcccctgcgctccgggaaag

SEQ ID NO: 267715 - DNA, 20 bp, human
gcgacgagagcctcccgaga

SEQ ID NO: 267716 - DNA, 20 bp, human
ggagcggcgcccagctgggg

SEQ ID NO: 267717 - DNA, 20 bp, human
gagggagcggcgcccagctg

SEQ ID NO: 267718 - DNA, 20 bp, human
gtgcgtgaaaatgggcccgg

SEQ ID NO: 267719 - DNA, 20 bp, human
gccgctccctgcgtgaaaat

SEQ ID NO: 267720 - DNA, 20 bp, human
gccgggagggcgcgaggtca

SEQ ID NO: 267721 - DNA, 20 bp, human
gcggcccggcagcgaatgag

SEQ ID NO: 267722 - DNA, 20 bp, human
ggcagcctcggcccgagtcc

SEQ ID NO: 267723 - DNA, 20 bp, human
ggatcctgacttcgctagtt

SEQ ID NO: 267724 - DNA, 20 bp, human
ggcgcccgctcattcgctgc

SEQ ID NO: 267725 - DNA, 20 bp, human
gcgctccccaccaccatcgc

SEQ ID NO: 267726 - DNA, 20 bp, human
gcgcgcgctcacagctctca

SEQ ID NO: 267727 - DNA, 20 bp, human
gtgtgagcgcgcggcatggt

SEQ ID NO: 267728 - DNA, 20 bp, human
gcagtcgcagcgcatggcat

SEQ ID NO: 267729 - DNA, 20 bp, human
gcaagactacacttccccaa

SEQ ID NO: 267730 - DNA, 20 bp, human
ggaacagaaaaggaatcttg

SEQ ID NO: 267731 - DNA, 20 bp, human
gtgtgggaaccggcgaaatt

SEQ ID NO: 267732 - DNA, 20 bp, human
gcgcgcggcatggtgggaat

SEQ ID NO: 267733 - DNA, 20 bp, human
gaatggctgccgcgacccga

SEQ ID NO: 267734 - DNA, 20 bp, human
gaggaggccgaaaagctgga

SEQ ID NO: 267735 - DNA, 20 bp, human
gggctgtcctgtggcctttg

SEQ ID NO: 267736 - DNA, 20 bp, human
gtgtgcccgccggtcggctt

SEQ ID NO: 267737 - DNA, 20 bp, human
ggccccggagatcctcgcgt

SEQ ID NO: 267738 - DNA, 20 bp, human
gagcgggagggacgctaagt

SEQ ID NO: 267739 - DNA, 20 bp, human
gaagagcggcgccggaactt

SEQ ID NO: 267740 - DNA, 20 bp, human
gcccgcgtgtgcccgccggt

SEQ ID NO: 267741 - DNA, 20 bp, human
gtagttggcccatcccgttt

SEQ ID NO: 267742 - DNA, 20 bp, human
gagcggcgccggaacttggg

SEQ ID NO: 267743 - DNA, 20 bp, human
gcggaacgctcccgcaagag

SEQ ID NO: 267744 - DNA, 20 bp, human
gacgcgggcccggtagagaa

SEQ ID NO: 267745 - DNA, 20 bp, human
ggcccctacgcgaggatctc

SEQ ID NO: 267746 - DNA, 20 bp, human
ggggcggggcctgaactact

SEQ ID NO: 267747 - DNA, 20 bp, human
gctgcgacggatggtgtaat

SEQ ID NO: 267748 - DNA, 20 bp, human
gccggggtggggcgacgggg

SEQ ID NO: 267749 - DNA, 20 bp, human
gcccgcgcctaggctgttgc

SEQ ID NO: 267750 - DNA, 20 bp, human
gccgcggccagcaacagcct

SEQ ID NO: 267751 - DNA, 20 bp, human
ggccagcaacagcctaggcg

SEQ ID NO: 267752 - DNA, 20 bp, human
gcccccagcgcgttgcacgc

SEQ ID NO: 267753 - DNA, 20 bp, human
gcggggcctgaactactggg

SEQ ID NO: 267754 - DNA, 20 bp, human
gcggccggggtggggcgacg

SEQ ID NO: 267755 - DNA, 20 bp, human
ggctgcctcccgcccttagt

SEQ ID NO: 267756 - DNA, 20 bp, human
gggcctgcggggacctggtg

SEQ ID NO: 267757 - DNA, 20 bp, human
gatggcaaccagtccctcca

SEQ ID NO: 267758 - DNA, 20 bp, human
ggtggagtggggacaagcgg

SEQ ID NO: 267759 - DNA, 20 bp, human
gcaggctgcgtcccctcaga

SEQ ID NO: 267760 - DNA, 20 bp, human
gggtggagaagggtacgcca

SEQ ID NO: 267761 - DNA, 20 bp, human
gtcgggtgtagagggagcag

SEQ ID NO: 267762 - DNA, 20 bp, human
ggaagtgcctccggcgcaag

SEQ ID NO: 267763 - DNA, 20 bp, human
gccggcgcaagtggcattga

SEQ ID NO: 267764 - DNA, 20 bp, human
gcgccaccggaagaacacgt

SEQ ID NO: 267765 - DNA, 20 bp, human
gtgttcttccggtggcggag

SEQ ID NO: 267766 - DNA, 20 bp, human
gcgctcttgcccattggctg

SEQ ID NO: 267767 - DNA, 20 bp, human
gccctcgaggcctcagccaa

SEQ ID NO: 267768 - DNA, 20 bp, human
gcagcccaggacacccgcta

SEQ ID NO: 267769 - DNA, 20 bp, human
gcggtctccgggcaccctcg

SEQ ID NO: 267770 - DNA, 20 bp, human
gaatgggcaagagcggaagg

SEQ ID NO: 267771 - DNA, 20 bp, human
ggaggcggggagcggccgat

SEQ ID NO: 267772 - DNA, 20 bp, human
gggcccaagtcctgcccctt

SEQ ID NO: 267773 - DNA, 20 bp, human
gcagacctcgggactccacc

SEQ ID NO: 267774 - DNA, 20 bp, human
gccccgaaggggcaggactt

SEQ ID NO: 267775 - DNA, 20 bp, human
gccgctgcactccggtctcc

SEQ ID NO: 267776 - DNA, 20 bp, human
gggtatgcgtcattattcga

SEQ ID NO: 267777 - DNA, 20 bp, human
gaagtctactacaggaacat

SEQ ID NO: 267778 - DNA, 20 bp, human
ggccttaaaaagtctactac

SEQ ID NO: 267779 - DNA, 20 bp, human
gtgtaactcagtttttgaga

SEQ ID NO: 267780 - DNA, 20 bp, human
gtgtgtagggctgttctcta

SEQ ID NO: 267781 - DNA, 20 bp, human
ggcggtgttatcttttgcat

SEQ ID NO: 267782 - DNA, 20 bp, human
gtcctgtagtagacttttta

SEQ ID NO: 267783 - DNA, 20 bp, human
gtcatcctccattttcaata

SEQ ID NO: 267784 - DNA, 20 bp, human
ggaaccacatagcgtcaatc

SEQ ID NO: 267785 - DNA, 20 bp, human
ggaactacaagattattact

SEQ ID NO: 267786 - DNA, 20 bp, human
ggcacccaacaagctctcca

SEQ ID NO: 267787 - DNA, 20 bp, human
ggctccctggagagcttgtt

SEQ ID NO: 267788 - DNA, 20 bp, human
gtcctcatccacccaggatg

SEQ ID NO: 267789 - DNA, 20 bp, human
gggacctcacgattccaatt

SEQ ID NO: 267790 - DNA, 20 bp, human
gtccacctggaattgcacgt

SEQ ID NO: 267791 - DNA, 20 bp, human
gaattcgggtgggatttttg

SEQ ID NO: 267792 - DNA, 20 bp, human
gcacccgaattggaatcgtg

SEQ ID NO: 267793 - DNA, 20 bp, human
gaggccgggcaatgtttcta

SEQ ID NO: 267794 - DNA, 20 bp, human
gtggtgggcttcatgaagct

SEQ ID NO: 267795 - DNA, 20 bp, human
gagagctaccactggatccc

SEQ ID NO: 267796 - DNA, 20 bp, human
ggagatcaaggggtaaaaat

SEQ ID NO: 267797 - DNA, 20 bp, human
gggtgctagtcaggactcat

SEQ ID NO: 267798 - DNA, 20 bp, human
gtcatgggtccagagatcaa

SEQ ID NO: 267799 - DNA, 20 bp, human
ggtcctgactagcacctgac

SEQ ID NO: 267800 - DNA, 20 bp, human
gtagtggaagcattcttttt

SEQ ID NO: 267801 - DNA, 20 bp, human
gggccacagccagccacttt

SEQ ID NO: 267802 - DNA, 20 bp, human
gctaagatctctaggctaac

SEQ ID NO: 267803 - DNA, 20 bp, human
gtcactgttgtatctgctag

SEQ ID NO: 267804 - DNA, 20 bp, human
gcaaagttttggtgttgtct

SEQ ID NO: 267805 - DNA, 20 bp, human
gaggataataaaggaacaag

SEQ ID NO: 267806 - DNA, 20 bp, human
gactctggggaatgcactct

SEQ ID NO: 267807 - DNA, 20 bp, human
gggttccaacagcgactctg

SEQ ID NO: 267808 - DNA, 20 bp, human
gtgagtaggaggtaaaggta

SEQ ID NO: 267809 - DNA, 20 bp, human
gagcttaagtaagcatggca

SEQ ID NO: 267810 - DNA, 20 bp, human
gcattccccagagtcgctgt

SEQ ID NO: 267811 - DNA, 20 bp, human
gctgcctgcctggcatcaag

SEQ ID NO: 267812 - DNA, 20 bp, human
gttatatgagtaggaggtaa

SEQ ID NO: 267813 - DNA, 20 bp, human
gctgacttctaaagtctgtt

SEQ ID NO: 267814 - DNA, 20 bp, human
gtgactctttggcttatcaa

SEQ ID NO: 267815 - DNA, 20 bp, human
gtcagggtttgtaacgtggc

SEQ ID NO: 267816 - DNA, 20 bp, human
ggggctgctcggcggagaga

SEQ ID NO: 267817 - DNA, 20 bp, human
gaccccggggtgtgagtgat

SEQ ID NO: 267818 - DNA, 20 bp, human
gagaaggcggcgagaacccg

SEQ ID NO: 267819 - DNA, 20 bp, human
ggatactgagcgtgcgcccc

SEQ ID NO: 267820 - DNA, 20 bp, human
ggcagtctgcagatttttaa

SEQ ID NO: 267821 - DNA, 20 bp, human
gtctccgccgagcagccctt

SEQ ID NO: 267822 - DNA, 20 bp, human
gctgctaggtctcgctcccg

SEQ ID NO: 267823 - DNA, 20 bp, human
ggagactccaggagacccaa

SEQ ID NO: 267824 - DNA, 20 bp, human
gtctcgctcccgcggagagg

SEQ ID NO: 267825 - DNA, 20 bp, human
gagactgcgcctcctctccg

SEQ ID NO: 267826 - DNA, 20 bp, human
gaggccggccggacccgctc

SEQ ID NO: 267827 - DNA, 20 bp, human
gccgctcagggcagctctgc

SEQ ID NO: 267828 - DNA, 20 bp, human
ggagctgccctgagcgggtc

SEQ ID NO: 267829 - DNA, 20 bp, human
gccctcccggcgccgcgctc

SEQ ID NO: 267830 - DNA, 20 bp, human
ggctctgcgggcggcgaagg

SEQ ID NO: 267831 - DNA, 20 bp, human
gagcgcgggcggcctttccc

SEQ ID NO: 267832 - DNA, 20 bp, human
gtgccctgagcgggtccggc

SEQ ID NO: 267833 - DNA, 20 bp, human
ggaaatgaaggacccggctc

SEQ ID NO: 267834 - DNA, 20 bp, human
gaaaagggcagcgctccgcg

SEQ ID NO: 267835 - DNA, 20 bp, human
gggcggcaatctcggccccg

SEQ ID NO: 267836 - DNA, 20 bp, human
gggcccctggaaccctctgt

SEQ ID NO: 267837 - DNA, 20 bp, human
gctctctggggacaaaggtg

SEQ ID NO: 267838 - DNA, 20 bp, human
gcccccggctgtgtgtgttc

SEQ ID NO: 267839 - DNA, 20 bp, human
gcttccctccaaatgaggaa

SEQ ID NO: 267840 - DNA, 20 bp, human
gcgtgataaggcacaagcaa

SEQ ID NO: 267841 - DNA, 20 bp, human
gagccctgaacacacacagc

SEQ ID NO: 267842 - DNA, 20 bp, human
ggggctaggtccacttttgt

SEQ ID NO: 267843 - DNA, 20 bp, human
gtcatgtgacaggctgagga

SEQ ID NO: 267844 - DNA, 20 bp, human
ggcgccagcccgccctgggg

SEQ ID NO: 267845 - DNA, 20 bp, human
ggaggaagggggcgttttta

SEQ ID NO: 267846 - DNA, 20 bp, human
gcggccgccacgggtgtctc

SEQ ID NO: 267847 - DNA, 20 bp, human
gtcaccgtgacaccattatc

SEQ ID NO: 267848 - DNA, 20 bp, human
gctgaactcggcaccatggg

SEQ ID NO: 267849 - DNA, 20 bp, human
ggggatgaagacagcctccg

SEQ ID NO: 267850 - DNA, 20 bp, human
gttgctgaactcggcaccat

SEQ ID NO: 267851 - DNA, 20 bp, human
ggccgagtcggtcaccctgc

SEQ ID NO: 267852 - DNA, 20 bp, human
gggtgccgagttcagcaagc

SEQ ID NO: 267853 - DNA, 20 bp, human
gtcactggggagtcgcacat

SEQ ID NO: 267854 - DNA, 20 bp, human
gggtgtctctgggcacttcc

SEQ ID NO: 267855 - DNA, 20 bp, human
ggaggacccagaggccgagt

SEQ ID NO: 267856 - DNA, 20 bp, human
ggccaccgcagaagagaaag

SEQ ID NO: 267857 - DNA, 20 bp, human
ggcgcgggcggctcttggct

SEQ ID NO: 267858 - DNA, 20 bp, human
ggggaaggggcgcaaggtgg

SEQ ID NO: 267859 - DNA, 20 bp, human
ggggctggcaggcgtcgggg

SEQ ID NO: 267860 - DNA, 20 bp, human
gcccggggcgggcctgtgga

SEQ ID NO: 267861 - DNA, 20 bp, human
gctgggccgcagcctctagc

SEQ ID NO: 267862 - DNA, 20 bp, human
gcgccccgggaacaccggga

SEQ ID NO: 267863 - DNA, 20 bp, human
gtggccgtgcggccggctag

SEQ ID NO: 267864 - DNA, 20 bp, human
gcacggccacggaaacggaa

SEQ ID NO: 267865 - DNA, 20 bp, human
gggccgcacggccacggaaa

SEQ ID NO: 267866 - DNA, 20 bp, human
gggtctaaggttagaatcat

SEQ ID NO: 267867 - DNA, 20 bp, human
gctatccaaagtactgactt

SEQ ID NO: 267868 - DNA, 20 bp, human
gagcaaaggtgttaggggag

SEQ ID NO: 267869 - DNA, 20 bp, human
ggaggttgctcaagggtcta

SEQ ID NO: 267870 - DNA, 20 bp, human
ggtatgtacaggtggatatg

SEQ ID NO: 267871 - DNA, 20 bp, human
gctcctgaataggaatatgg

SEQ ID NO: 267872 - DNA, 20 bp, human
gcccctcctgaataggaata

SEQ ID NO: 267873 - DNA, 20 bp, human
gtacctccctgatctaacaa

SEQ ID NO: 267874 - DNA, 20 bp, human
gtccacagcaaaggtgttag

SEQ ID NO: 267875 - DNA, 20 bp, human
gtgagcggttttgttacaac

SEQ ID NO: 267876 - DNA, 20 bp, human
gtggagacgggaacccgggt

SEQ ID NO: 267877 - DNA, 20 bp, human
ggaacccgggtggggataga

SEQ ID NO: 267878 - DNA, 20 bp, human
gactctctgcaaacagtgat

SEQ ID NO: 267879 - DNA, 20 bp, human
gcgggagccgactggaagaa

SEQ ID NO: 267880 - DNA, 20 bp, human
ggtggccgagccgtaccaga

SEQ ID NO: 267881 - DNA, 20 bp, human
ggactggaagaagggctcta

SEQ ID NO: 267882 - DNA, 20 bp, human
ggggcactggggagacctaa

SEQ ID NO: 267883 - DNA, 20 bp, human
gagtgagcggcgagtggagc

SEQ ID NO: 267884 - DNA, 20 bp, human
ggcgaccgcgggtgacaagg

SEQ ID NO: 267885 - DNA, 20 bp, human
gcagcctggagacgggaacc

SEQ ID NO: 267886 - DNA, 20 bp, human
gtgggtgggtgcccgagcgc

SEQ ID NO: 267887 - DNA, 20 bp, human
gaggctatgaatgttaacga

SEQ ID NO: 267888 - DNA, 20 bp, human
gcccgcgcgtgccagttggg

SEQ ID NO: 267889 - DNA, 20 bp, human
ggctcgggcacccacccaac

SEQ ID NO: 267890 - DNA, 20 bp, human
gcgggcacgagcgcggggaa

SEQ ID NO: 267891 - DNA, 20 bp, human
ggctccccgcgcagctccgg

SEQ ID NO: 267892 - DNA, 20 bp, human
ggctcgtgcccgggctccgg

SEQ ID NO: 267893 - DNA, 20 bp, human
gggcaagcccacgtgctcgg

SEQ ID NO: 267894 - DNA, 20 bp, human
gagctcccgcgcgtgccagt

SEQ ID NO: 267895 - DNA, 20 bp, human
gacgtctcccagctccaact

SEQ ID NO: 267896 - DNA, 20 bp, human
gcccaaccctgggtctccgg

SEQ ID NO: 267897 - DNA, 20 bp, human
ggccaccggagacccagggt

SEQ ID NO: 267898 - DNA, 20 bp, human
gtaccgtgctgacagatccc

SEQ ID NO: 267899 - DNA, 20 bp, human
gtaggccaagttgctaataa

SEQ ID NO: 267900 - DNA, 20 bp, human
gctcaggccaccggagaccc

SEQ ID NO: 267901 - DNA, 20 bp, human
gctaataagggaagctaaca

SEQ ID NO: 267902 - DNA, 20 bp, human
ggcggggcgcgcgactgctc

SEQ ID NO: 267903 - DNA, 20 bp, human
gcccaggctgtcccaaccct

SEQ ID NO: 267904 - DNA, 20 bp, human
gccggtggcctgagtcttcc

SEQ ID NO: 267905 - DNA, 20 bp, human
ggatctgtcagcacggtagc

SEQ ID NO: 267906 - DNA, 20 bp, human
gcggcagagtgtgtgcgcag

SEQ ID NO: 267907 - DNA, 20 bp, human
ggagggtagtgaagtgtgcg

SEQ ID NO: 267908 - DNA, 20 bp, human
gaggaagcaaaaggggggtg

SEQ ID NO: 267909 - DNA, 20 bp, human
ggaaacggagtctaattcag

SEQ ID NO: 267910 - DNA, 20 bp, human
gtccccgcccagaaaaggcg

SEQ ID NO: 267911 - DNA, 20 bp, human
ggaggggagggcgcgccaag

SEQ ID NO: 267912 - DNA, 20 bp, human
ggcaaaaggggggtggggat

SEQ ID NO: 267913 - DNA, 20 bp, human
gggaggaagaaataggtctg

SEQ ID NO: 267914 - DNA, 20 bp, human
gaaagcgcccccgccttttc

SEQ ID NO: 267915 - DNA, 20 bp, human
gggaagaaataggtctgcgg

SEQ ID NO: 267916 - DNA, 20 bp, human
ggggacccaaacccaaacct

SEQ ID NO: 267917 - DNA, 20 bp, human
gagaaagctcccactgacta

SEQ ID NO: 267918 - DNA, 20 bp, human
gcaggcgcgggggaacacag

SEQ ID NO: 267919 - DNA, 20 bp, human
gtggcgcccgcgctcctctc

SEQ ID NO: 267920 - DNA, 20 bp, human
gggagggctaagggatactt

SEQ ID NO: 267921 - DNA, 20 bp, human
gatacccaggggccctttgg

SEQ ID NO: 267922 - DNA, 20 bp, human
gggaacacaggggccgctac

SEQ ID NO: 267923 - DNA, 20 bp, human
gctcggctgcggagggctaa

SEQ ID NO: 267924 - DNA, 20 bp, human
gtgcgagcggtttgcgaata

SEQ ID NO: 267925 - DNA, 20 bp, human
gcgggcgccgcgtttggagg

SEQ ID NO: 267926 - DNA, 20 bp, human
ggaagctcctgcagcgtcac

SEQ ID NO: 267927 - DNA, 20 bp, human
gggctcctgggatcactcgc

SEQ ID NO: 267928 - DNA, 20 bp, human
gtgggatcagggaggaaacg

SEQ ID NO: 267929 - DNA, 20 bp, human
ggagcttccctggttttaag

SEQ ID NO: 267930 - DNA, 20 bp, human
gaattcacctggtgggatca

SEQ ID NO: 267931 - DNA, 20 bp, human
ggccccaagatctgaggaca

SEQ ID NO: 267932 - DNA, 20 bp, human
gagatcttggggccccggag

SEQ ID NO: 267933 - DNA, 20 bp, human
ggagataggatgtggcgcac

SEQ ID NO: 267934 - DNA, 20 bp, human
gtggagaattacaattcacc

SEQ ID NO: 267935 - DNA, 20 bp, human
gtgactgctgcctttctctg

SEQ ID NO: 267936 - DNA, 20 bp, human
gcaagagtgaggattctcta

SEQ ID NO: 267937 - DNA, 20 bp, human
gcacgtgaccagagaaagga

SEQ ID NO: 267938 - DNA, 20 bp, human
gcctctcaaacccaaaggaa

SEQ ID NO: 267939 - DNA, 20 bp, human
gcagccacgtgaccagagaa

SEQ ID NO: 267940 - DNA, 20 bp, human
gagactgaccttcctttctc

SEQ ID NO: 267941 - DNA, 20 bp, human
ggatgctgggcctttccttt

SEQ ID NO: 267942 - DNA, 20 bp, human
gaatttggaagtcaagagtg

SEQ ID NO: 267943 - DNA, 20 bp, human
gggacagaaaaatctgaatt

SEQ ID NO: 267944 - DNA, 20 bp, human
gaaagaaaataatctgactt

SEQ ID NO: 267945 - DNA, 20 bp, human
ggggagagaataaagatgct

SEQ ID NO: 267946 - DNA, 20 bp, human
gacagagagcgagctccgtg

SEQ ID NO: 267947 - DNA, 20 bp, human
ggatgagctctgttctgcag

SEQ ID NO: 267948 - DNA, 20 bp, human
gacagcagctgccttttcat

SEQ ID NO: 267949 - DNA, 20 bp, human
gtgtggtcgtgagcaggcag

SEQ ID NO: 267950 - DNA, 20 bp, human
gggagcaagtcacttcccta

SEQ ID NO: 267951 - DNA, 20 bp, human
gctgcccttacaaggcaaat

SEQ ID NO: 267952 - DNA, 20 bp, human
gttgacggaagcctggcgtg

SEQ ID NO: 267953 - DNA, 20 bp, human
gctggtgcaggattatctct

SEQ ID NO: 267954 - DNA, 20 bp, human
gctggcgtgtggtcgtgagc

SEQ ID NO: 267955 - DNA, 20 bp, human
gatgcgttgatctatgagat

SEQ ID NO: 267956 - DNA, 20 bp, human
gaggaagtgcccggcaacac

SEQ ID NO: 267957 - DNA, 20 bp, human
gtggccgcgaacaccgcagc

SEQ ID NO: 267958 - DNA, 20 bp, human
gcggccagctgcggtgttcg

SEQ ID NO: 267959 - DNA, 20 bp, human
gacaccgcagctggccgggg

SEQ ID NO: 267960 - DNA, 20 bp, human
gtgttcgcggccagtgttgc

SEQ ID NO: 267961 - DNA, 20 bp, human
gctggcgctcctcagaaggg

SEQ ID NO: 267962 - DNA, 20 bp, human
ggggcacgaggcttccgcct

SEQ ID NO: 267963 - DNA, 20 bp, human
gaggttgggcaggccctgcg

SEQ ID NO: 267964 - DNA, 20 bp, human
ggtgccaaggcggggaaaga

SEQ ID NO: 267965 - DNA, 20 bp, human
gaattcctcgagcccccgca

SEQ ID NO: 267966 - DNA, 20 bp, human
gaacaaaggacgtagaggga

SEQ ID NO: 267967 - DNA, 20 bp, human
ggaggaacaaaggacgtaga

SEQ ID NO: 267968 - DNA, 20 bp, human
gtctgggataccaacagcat

SEQ ID NO: 267969 - DNA, 20 bp, human
ggggataccaacagcatagg

SEQ ID NO: 267970 - DNA, 20 bp, human
gtgaaaagaggagcatagga

SEQ ID NO: 267971 - DNA, 20 bp, human
gaagaggtttggttaatcat

SEQ ID NO: 267972 - DNA, 20 bp, human
gaacagcataggaggaacaa

SEQ ID NO: 267973 - DNA, 20 bp, human
gtacctttgcaacagcttat

SEQ ID NO: 267974 - DNA, 20 bp, human
gcccaggaacaaaacatctt

SEQ ID NO: 267975 - DNA, 20 bp, human
gttccgataagctgttgcaa

SEQ ID NO: 267976 - DNA, 20 bp, human
gctaggaatgacttcagaaa

SEQ ID NO: 267977 - DNA, 20 bp, human
ggacaaaatgatgggaagtt

SEQ ID NO: 267978 - DNA, 20 bp, human
gtagtggttgccttgtgagt

SEQ ID NO: 267979 - DNA, 20 bp, human
gtttaattggacaaaatgat

SEQ ID NO: 267980 - DNA, 20 bp, human
gacaagtaaataagctttgc

SEQ ID NO: 267981 - DNA, 20 bp, human
gtatatctgagtcctctgct

SEQ ID NO: 267982 - DNA, 20 bp, human
gtacaactattattctttgt

SEQ ID NO: 267983 - DNA, 20 bp, human
gtaatttttggttcacttgt

SEQ ID NO: 267984 - DNA, 20 bp, human
gtaatgagtcacgattttag

SEQ ID NO: 267985 - DNA, 20 bp, human
gcagaaaacataagcattta

SEQ ID NO: 267986 - DNA, 20 bp, human
ggtagcagcgagaagtgagg

SEQ ID NO: 267987 - DNA, 20 bp, human
gctgaagctggggaggacgg

SEQ ID NO: 267988 - DNA, 20 bp, human
gtcagcctgggtctcggcgg

SEQ ID NO: 267989 - DNA, 20 bp, human
ggggcggggccccggtaact

SEQ ID NO: 267990 - DNA, 20 bp, human
gcactgggacccagttaccg

SEQ ID NO: 267991 - DNA, 20 bp, human
gtgaccacgccccctcgctc

SEQ ID NO: 267992 - DNA, 20 bp, human
ggaggcggccccgagcgagg

SEQ ID NO: 267993 - DNA, 20 bp, human
gtccccacaggcaagtctcc

SEQ ID NO: 267994 - DNA, 20 bp, human
gagagtgaacggcaagcaga

SEQ ID NO: 267995 - DNA, 20 bp, human
gcaggcgcaaatcccgggcg

SEQ ID NO: 267996 - DNA, 20 bp, human
gggctccagaagctacctct

SEQ ID NO: 267997 - DNA, 20 bp, human
gggccctgttgccacctctt

SEQ ID NO: 267998 - DNA, 20 bp, human
gagcttctggagcccagtct

SEQ ID NO: 267999 - DNA, 20 bp, human
gggccccacctctccctcag

SEQ ID NO: 268000 - DNA, 20 bp, human
gcacctaagaggtggcaaca

SEQ ID NO: 268001 - DNA, 20 bp, human
gtgaaaggtcagcccccctg

SEQ ID NO: 268002 - DNA, 20 bp, human
gggagaggtggggcccgagc

SEQ ID NO: 268003 - DNA, 20 bp, human
ggtcagcccccctgagggag

SEQ ID NO: 268004 - DNA, 20 bp, human
gccagcactcccgcagtggg

SEQ ID NO: 268005 - DNA, 20 bp, human
gccagaagccacctaagagg

SEQ ID NO: 268006 - DNA, 20 bp, human
gctagaaggtgcaacttgca

SEQ ID NO: 268007 - DNA, 20 bp, human
ggagcctagcacctgatcag

SEQ ID NO: 268008 - DNA, 20 bp, human
ggcaacttgcagggtggcgg

SEQ ID NO: 268009 - DNA, 20 bp, human
gtgcagggtggcgggggcaa

SEQ ID NO: 268010 - DNA, 20 bp, human
ggaaggtgcaacttgcaggg

SEQ ID NO: 268011 - DNA, 20 bp, human
ggcaggaggatggtggttgt

SEQ ID NO: 268012 - DNA, 20 bp, human
gcatttccgcatcattacgc

SEQ ID NO: 268013 - DNA, 20 bp, human
gtctgggcttgtctggtcta

SEQ ID NO: 268014 - DNA, 20 bp, human
gttaacagggctgctcacag

SEQ ID NO: 268015 - DNA, 20 bp, human
gtctccactgatcaggtgct

SEQ ID NO: 268016 - DNA, 20 bp, human
ggagagctctagaataccgg

SEQ ID NO: 268017 - DNA, 20 bp, human
gagaataccgggggtggact

SEQ ID NO: 268018 - DNA, 20 bp, human
gagctctagaataccggggg

SEQ ID NO: 268019 - DNA, 20 bp, human
gtgagagagctctagaatac

SEQ ID NO: 268020 - DNA, 20 bp, human
gatacttcctagtccacccc

SEQ ID NO: 268021 - DNA, 20 bp, human
gtggcagtgatgcaggctca

SEQ ID NO: 268022 - DNA, 20 bp, human
gtgtttcataagtcttcttc

SEQ ID NO: 268023 - DNA, 20 bp, human
gcttcttctggcagtgatgc

SEQ ID NO: 268024 - DNA, 20 bp, human
gtaataaagttacatgtatt

SEQ ID NO: 268025 - DNA, 20 bp, human
gacattttgaaacaccttcg

SEQ ID NO: 268026 - DNA, 20 bp, human
gctgtggcgtcccctgcaac

SEQ ID NO: 268027 - DNA, 20 bp, human
gtaagctccatgagggcagc

SEQ ID NO: 268028 - DNA, 20 bp, human
gaccctccctgctgccctca

SEQ ID NO: 268029 - DNA, 20 bp, human
gggatggacggaaccatctg

SEQ ID NO: 268030 - DNA, 20 bp, human
gtctcctacacaccagttgc

SEQ ID NO: 268031 - DNA, 20 bp, human
ggaggaagggaatttgggcg

SEQ ID NO: 268032 - DNA, 20 bp, human
gtggttgattttcgttagtt

SEQ ID NO: 268033 - DNA, 20 bp, human
gtcagtggactggtagtctt

SEQ ID NO: 268034 - DNA, 20 bp, human
gtcccctgcaactggtgtgt

SEQ ID NO: 268035 - DNA, 20 bp, human
gtggctgaggaagggaattt

SEQ ID NO: 268036 - DNA, 20 bp, human
ggaagctcgagccctccgat

SEQ ID NO: 268037 - DNA, 20 bp, human
gctagcctcctccaatcgga

SEQ ID NO: 268038 - DNA, 20 bp, human
ggggcgccccctgctagtcg

SEQ ID NO: 268039 - DNA, 20 bp, human
gcgagaagggcacgcgccag

SEQ ID NO: 268040 - DNA, 20 bp, human
gtacggccgcgactagcagg

SEQ ID NO: 268041 - DNA, 20 bp, human
gagccctagcctcctccaat

SEQ ID NO: 268042 - DNA, 20 bp, human
ggatttttggagcccgagaa

SEQ ID NO: 268043 - DNA, 20 bp, human
gaataagcgggctcgaaaag

SEQ ID NO: 268044 - DNA, 20 bp, human
gctcgaaaagggggcgtgag

SEQ ID NO: 268045 - DNA, 20 bp, human
gcgagccctccgattggagg

SEQ ID NO: 268046 - DNA, 20 bp, human
gagctggctacccgtcccta

SEQ ID NO: 268047 - DNA, 20 bp, human
gggaccggagatagacctag

SEQ ID NO: 268048 - DNA, 20 bp, human
gggagtgggcggttgtctaa

SEQ ID NO: 268049 - DNA, 20 bp, human
ggggccgtggcatgcacatc

SEQ ID NO: 268050 - DNA, 20 bp, human
gtctgtgggaaatcgaggtg

SEQ ID NO: 268051 - DNA, 20 bp, human
gtggggagagggacgggccg

SEQ ID NO: 268052 - DNA, 20 bp, human
ggtgggaaatcgaggtgggg

SEQ ID NO: 268053 - DNA, 20 bp, human
gctgctggctgtccagagta

SEQ ID NO: 268054 - DNA, 20 bp, human
gtgggcggttgtctaaaggc

SEQ ID NO: 268055 - DNA, 20 bp, human
gcccacagagccctagggac

SEQ ID NO: 268056 - DNA, 20 bp, human
gccccagaagggattggttc

SEQ ID NO: 268057 - DNA, 20 bp, human
ggctgggaacgccagggaga

SEQ ID NO: 268058 - DNA, 20 bp, human
ggtgggacatctgaaaccct

SEQ ID NO: 268059 - DNA, 20 bp, human
gggagggggtcaaccggcgg

SEQ ID NO: 268060 - DNA, 20 bp, human
gtggaaagcaagtgagaaag

SEQ ID NO: 268061 - DNA, 20 bp, human
gccgcggcgaggaagggacc

SEQ ID NO: 268062 - DNA, 20 bp, human
ggggggagggggtcaaccgg

SEQ ID NO: 268063 - DNA, 20 bp, human
gtggcccgcgctgcaagcat

SEQ ID NO: 268064 - DNA, 20 bp, human
ggcaacagccgcggcgagga

SEQ ID NO: 268065 - DNA, 20 bp, human
gtagacagagctagaggcgc

SEQ ID NO: 268066 - DNA, 20 bp, human
ggaaccccggggttccttgg

SEQ ID NO: 268067 - DNA, 20 bp, human
ggagacgctgggaaatagga

SEQ ID NO: 268068 - DNA, 20 bp, human
gccgggcaggaggaaccccg

SEQ ID NO: 268069 - DNA, 20 bp, human
gggcggagacgctgggaaat

SEQ ID NO: 268070 - DNA, 20 bp, human
gaacgcacccctgggtagga

SEQ ID NO: 268071 - DNA, 20 bp, human
gaatggcggacgctgggaga

SEQ ID NO: 268072 - DNA, 20 bp, human
gggaaataggagggtgaagc

SEQ ID NO: 268073 - DNA, 20 bp, human
gctacctccaaggaaccccg

SEQ ID NO: 268074 - DNA, 20 bp, human
ggagacgtgcggccttgcct

SEQ ID NO: 268075 - DNA, 20 bp, human
gtccttggaggtagagagtg

SEQ ID NO: 268076 - DNA, 20 bp, human
gtcggcagagagcaagcgat

SEQ ID NO: 268077 - DNA, 20 bp, human
gagagagcaagcgatggggg

SEQ ID NO: 268078 - DNA, 20 bp, human
gactccctgactgtcgtaca

SEQ ID NO: 268079 - DNA, 20 bp, human
gtagctgcaaggacacccga

SEQ ID NO: 268080 - DNA, 20 bp, human
gggggtcgtaccacctacaa

SEQ ID NO: 268081 - DNA, 20 bp, human
gcctgactgtcgtacatgga

SEQ ID NO: 268082 - DNA, 20 bp, human
gccaccctctgagtaggacc

SEQ ID NO: 268083 - DNA, 20 bp, human
ggagttgtgagagttagaat

SEQ ID NO: 268084 - DNA, 20 bp, human
gccgctcccagctcccctaa

SEQ ID NO: 268085 - DNA, 20 bp, human
gagcctacgggacccgattt

SEQ ID NO: 268086 - DNA, 20 bp, human
ggagggagggagatcctcga

SEQ ID NO: 268087 - DNA, 20 bp, human
gggcggggagctccagttaa

SEQ ID NO: 268088 - DNA, 20 bp, human
gccccgccatggtccacccg

SEQ ID NO: 268089 - DNA, 20 bp, human
ggccccgggtggaccatggc

SEQ ID NO: 268090 - DNA, 20 bp, human
gaaggaaggggcgccctggc

SEQ ID NO: 268091 - DNA, 20 bp, human
gtgtgggcgccgagctggag

SEQ ID NO: 268092 - DNA, 20 bp, human
gagaaagagcgcccactctt

SEQ ID NO: 268093 - DNA, 20 bp, human
gtctgcggggtcccaagagt

SEQ ID NO: 268094 - DNA, 20 bp, human
gaatacccgcgcgtccgctc

SEQ ID NO: 268095 - DNA, 20 bp, human
gcaaagagagcgggaggcga

SEQ ID NO: 268096 - DNA, 20 bp, human
gaacgggcggccggggactt

SEQ ID NO: 268097 - DNA, 20 bp, human
gcgggaggaaacagtgatgg

SEQ ID NO: 268098 - DNA, 20 bp, human
ggaactgagatgaggtagtt

SEQ ID NO: 268099 - DNA, 20 bp, human
gagaaggatttggacgactg

SEQ ID NO: 268100 - DNA, 20 bp, human
gtcctcccgaagctcctttc

SEQ ID NO: 268101 - DNA, 20 bp, human
gagcccctacaggtgttagc

SEQ ID NO: 268102 - DNA, 20 bp, human
gtcccgaaaggagcttcggg

SEQ ID NO: 268103 - DNA, 20 bp, human
gttccggctaacacctgtag

SEQ ID NO: 268104 - DNA, 20 bp, human
gaggtgttagccggaacggg

SEQ ID NO: 268105 - DNA, 20 bp, human
ggcagtgcggaagcccctac

SEQ ID NO: 268106 - DNA, 20 bp, human
gagggcgatgggtcccggtc

SEQ ID NO: 268107 - DNA, 20 bp, human
gcggcggcggccacgacgtc

SEQ ID NO: 268108 - DNA, 20 bp, human
ggtggccccgggaacgggtc

SEQ ID NO: 268109 - DNA, 20 bp, human
gcggagagggcgatgggtcc

SEQ ID NO: 268110 - DNA, 20 bp, human
ggccccgcggagagggcgat

SEQ ID NO: 268111 - DNA, 20 bp, human
ggccatggtggccccgggaa

SEQ ID NO: 268112 - DNA, 20 bp, human
gccgggaacgggtccgggga

SEQ ID NO: 268113 - DNA, 20 bp, human
gtcgccctcggggcagagga

SEQ ID NO: 268114 - DNA, 20 bp, human
gccggcttcccgggatcgtc

SEQ ID NO: 268115 - DNA, 20 bp, human
gggcgcagccggacgatccc

SEQ ID NO: 268116 - DNA, 20 bp, human
gcactcttaggcatattatg

SEQ ID NO: 268117 - DNA, 20 bp, human
ggtgtcccccgttttacata

SEQ ID NO: 268118 - DNA, 20 bp, human
gctgcgtgctctaaggaaga

SEQ ID NO: 268119 - DNA, 20 bp, human
gcgtgctctaaggaagaggg

SEQ ID NO: 268120 - DNA, 20 bp, human
ggcttctactcaacactctt

SEQ ID NO: 268121 - DNA, 20 bp, human
gcagggctggcctccagttg

SEQ ID NO: 268122 - DNA, 20 bp, human
gtgttgagtagaagcagaga

SEQ ID NO: 268123 - DNA, 20 bp, human
gctgatgaaaccatcttttg

SEQ ID NO: 268124 - DNA, 20 bp, human
gtcatcaggcattttatcaa

SEQ ID NO: 268125 - DNA, 20 bp, human
gtgtggctttaaggacatgg

SEQ ID NO: 268126 - DNA, 20 bp, human
gactgggcgcaacaggttgg

SEQ ID NO: 268127 - DNA, 20 bp, human
gaatactgggcgcaacaggt

SEQ ID NO: 268128 - DNA, 20 bp, human
ggtgggttggcaggtacaga

SEQ ID NO: 268129 - DNA, 20 bp, human
gagcagctgattgcccggga

SEQ ID NO: 268130 - DNA, 20 bp, human
gaatgcctcagggtgttggg

SEQ ID NO: 268131 - DNA, 20 bp, human
gaaggagccgcctccctcca

SEQ ID NO: 268132 - DNA, 20 bp, human
ggatctaggaagaatcccaa

SEQ ID NO: 268133 - DNA, 20 bp, human
ggctgattgcccgggaagga

SEQ ID NO: 268134 - DNA, 20 bp, human
gttctccaagtgtctgtctc

SEQ ID NO: 268135 - DNA, 20 bp, human
gacagaggcccaaggaaaag

SEQ ID NO: 268136 - DNA, 20 bp, human
gtgcgcccagcccacatcaa

SEQ ID NO: 268137 - DNA, 20 bp, human
ggcagggccgcctttgatgt

SEQ ID NO: 268138 - DNA, 20 bp, human
ggggaccggcagctccaaag

SEQ ID NO: 268139 - DNA, 20 bp, human
gggcccgagccggcacaatg

SEQ ID NO: 268140 - DNA, 20 bp, human
gctcgggcgcagagctccga

SEQ ID NO: 268141 - DNA, 20 bp, human
gccgagccgccaggagaagg

SEQ ID NO: 268142 - DNA, 20 bp, human
gccggcacaatgaggatgcg

SEQ ID NO: 268143 - DNA, 20 bp, human
gagactctcggagacgggac

SEQ ID NO: 268144 - DNA, 20 bp, human
ggcccagcccacatcaaagg

SEQ ID NO: 268145 - DNA, 20 bp, human
ggggcggctccactgaatgg

SEQ ID NO: 268146 - DNA, 20 bp, human
gggcctgggcggggtcaccc

SEQ ID NO: 268147 - DNA, 20 bp, human
gccggaggcggggtgtgagt

SEQ ID NO: 268148 - DNA, 20 bp, human
gtctcccagccaagaacctc

SEQ ID NO: 268149 - DNA, 20 bp, human
gtgaccccgcccaggccgtt

SEQ ID NO: 268150 - DNA, 20 bp, human
ggatccgaacggcctgggcg

SEQ ID NO: 268151 - DNA, 20 bp, human
gctcctcccgcagatccgaa

SEQ ID NO: 268152 - DNA, 20 bp, human
gggccccgaggttcttggct

SEQ ID NO: 268153 - DNA, 20 bp, human
gccgcagatccgaacggcct

SEQ ID NO: 268154 - DNA, 20 bp, human
gcggcttcttgtcccagccg

SEQ ID NO: 268155 - DNA, 20 bp, human
gagaaatgctcgggtgtctt

SEQ ID NO: 268156 - DNA, 20 bp, human
gggagcccggcctcagtcgg

SEQ ID NO: 268157 - DNA, 20 bp, human
gcaagcgcgcgacatcagtc

SEQ ID NO: 268158 - DNA, 20 bp, human
gaacccgagcgagtaggggg

SEQ ID NO: 268159 - DNA, 20 bp, human
gtgtggagaaagcctaaacg

SEQ ID NO: 268160 - DNA, 20 bp, human
gtctcccccgcccccgactg

SEQ ID NO: 268161 - DNA, 20 bp, human
ggaaaacccgagcgagtagg

SEQ ID NO: 268162 - DNA, 20 bp, human
ggcagggctttggcattccc

SEQ ID NO: 268163 - DNA, 20 bp, human
gtactcgctcgggttttctg

SEQ ID NO: 268164 - DNA, 20 bp, human
gaacgctagcggggaaaaaa

SEQ ID NO: 268165 - DNA, 20 bp, human
gcagagaaggggagcagatt

SEQ ID NO: 268166 - DNA, 20 bp, human
gccagccagcaacttcgagg

SEQ ID NO: 268167 - DNA, 20 bp, human
gtgcaggaatggtttttgtg

SEQ ID NO: 268168 - DNA, 20 bp, human
gcaaggacaaccccaaagag

SEQ ID NO: 268169 - DNA, 20 bp, human
gcatggatggagaagtgcca

SEQ ID NO: 268170 - DNA, 20 bp, human
gtgcacctcctcgaagttgc

SEQ ID NO: 268171 - DNA, 20 bp, human
ggcaaagctcacatcaaaga

SEQ ID NO: 268172 - DNA, 20 bp, human
ggcagtcgaggcccctcttt

SEQ ID NO: 268173 - DNA, 20 bp, human
gtcaacacgtttttgctctt

SEQ ID NO: 268174 - DNA, 20 bp, human
gcagcatcaccgctgtccca

SEQ ID NO: 268175 - DNA, 20 bp, human
gaatggtttttgtgagggca

SEQ ID NO: 268176 - DNA, 20 bp, human
ggtggctgaaagtccctgac

SEQ ID NO: 268177 - DNA, 20 bp, human
gaatggagggccagactcct

SEQ ID NO: 268178 - DNA, 20 bp, human
gagggtctgagcatctgagc

SEQ ID NO: 268179 - DNA, 20 bp, human
gtaacctggggtcctttcaa

SEQ ID NO: 268180 - DNA, 20 bp, human
gcaggctgcccttgccacga

SEQ ID NO: 268181 - DNA, 20 bp, human
gtggcccacggccaggtgag

SEQ ID NO: 268182 - DNA, 20 bp, human
gaaacaccaggattgcatca

SEQ ID NO: 268183 - DNA, 20 bp, human
ggggcctgggatggcttctc

SEQ ID NO: 268184 - DNA, 20 bp, human
gagggcgtgatctgacactg

SEQ ID NO: 268185 - DNA, 20 bp, human
gaagcctctcacctggccgt

SEQ ID NO: 268186 - DNA, 20 bp, human
gggccaatgggacgtctcgg

SEQ ID NO: 268187 - DNA, 20 bp, human
gcggggactcggctgactca

SEQ ID NO: 268188 - DNA, 20 bp, human
gggcggggccgggttcgctg

SEQ ID NO: 268189 - DNA, 20 bp, human
gacaaacaacaaacgcgcgg

SEQ ID NO: 268190 - DNA, 20 bp, human
gcctagcccgcccggggact

SEQ ID NO: 268191 - DNA, 20 bp, human
gaacgcgcggaggccgagcg

SEQ ID NO: 268192 - DNA, 20 bp, human
ggacgagcgcgcagcgaacc

SEQ ID NO: 268193 - DNA, 20 bp, human
gccgccccgaggcaccccat

SEQ ID NO: 268194 - DNA, 20 bp, human
gcgtcgctcccgggcgtccg

SEQ ID NO: 268195 - DNA, 20 bp, human
ggcgggggccaggtgcacag

SEQ ID NO: 268196 - DNA, 20 bp, human
ggaccccggaggcgcacgga

SEQ ID NO: 268197 - DNA, 20 bp, human
ggagaaggaaaaggccagta

SEQ ID NO: 268198 - DNA, 20 bp, human
gaggcgcacggaaggcacgt

SEQ ID NO: 268199 - DNA, 20 bp, human
ggaaaaggccagtaaggcct

SEQ ID NO: 268200 - DNA, 20 bp, human
ggggccaggagagtcccgac

SEQ ID NO: 268201 - DNA, 20 bp, human
gtcagagcagggcacgatgt

SEQ ID NO: 268202 - DNA, 20 bp, human
ggaaacctgacactcctgtc

SEQ ID NO: 268203 - DNA, 20 bp, human
gagcgttggcttgaaattga

SEQ ID NO: 268204 - DNA, 20 bp, human
gccaaaaaatgaatgacgtg

SEQ ID NO: 268205 - DNA, 20 bp, human
ggacctgtcccacttccatc

SEQ ID NO: 268206 - DNA, 20 bp, human
gggacctttcagagccagga

SEQ ID NO: 268207 - DNA, 20 bp, human
gcggagccgcggctcgacgg

SEQ ID NO: 268208 - DNA, 20 bp, human
gacgcccccgaaagccctcc

SEQ ID NO: 268209 - DNA, 20 bp, human
gggagcgggagggggtgaca

SEQ ID NO: 268210 - DNA, 20 bp, human
ggcgcaccgccgtcgagccg

SEQ ID NO: 268211 - DNA, 20 bp, human
ggagccaggagggctttcgg

SEQ ID NO: 268212 - DNA, 20 bp, human
ggggattgatggggagcggg

SEQ ID NO: 268213 - DNA, 20 bp, human
gaaaggcggcgcataatgaa

SEQ ID NO: 268214 - DNA, 20 bp, human
gttcggaggcataattggtc

SEQ ID NO: 268215 - DNA, 20 bp, human
ggagcggagccgcggctcga

SEQ ID NO: 268216 - DNA, 20 bp, human
gcggggcgctgtggcgttcg

SEQ ID NO: 268217 - DNA, 20 bp, human
gggagcgggcgagtaggagg

SEQ ID NO: 268218 - DNA, 20 bp, human
ggcgcccaggagaacgcgaa

SEQ ID NO: 268219 - DNA, 20 bp, human
ggggccgttcgcgttctcct

SEQ ID NO: 268220 - DNA, 20 bp, human
gcctgtggggccaagaccta

SEQ ID NO: 268221 - DNA, 20 bp, human
ggcgggacgaacaggtccgt

SEQ ID NO: 268222 - DNA, 20 bp, human
gccaatcagggccgggggaa

SEQ ID NO: 268223 - DNA, 20 bp, human
gtccctccaggtggcactcg

SEQ ID NO: 268224 - DNA, 20 bp, human
ggccgcctgccaatcagggc

SEQ ID NO: 268225 - DNA, 20 bp, human
gggctgaaaagcagaagtgt

SEQ ID NO: 268226 - DNA, 20 bp, human
gtgggcgcacccagcgtccg

SEQ ID NO: 268227 - DNA, 20 bp, human
ggggtgaggggaagcttcgc

SEQ ID NO: 268228 - DNA, 20 bp, human
gtcactggccggtgcgggga

SEQ ID NO: 268229 - DNA, 20 bp, human
ggggagcctcgcggtcccgg

SEQ ID NO: 268230 - DNA, 20 bp, human
gaacctgcgccccggacgct

SEQ ID NO: 268231 - DNA, 20 bp, human
ggaagcttcgcaggcgtgca

SEQ ID NO: 268232 - DNA, 20 bp, human
ggcgacgcgagagaactgct

SEQ ID NO: 268233 - DNA, 20 bp, human
gggagatccgagcgagtgag

SEQ ID NO: 268234 - DNA, 20 bp, human
ggctgggtgcgcccatacca

SEQ ID NO: 268235 - DNA, 20 bp, human
gcctagtcggggaatccggg

SEQ ID NO: 268236 - DNA, 20 bp, human
gaacccctggggagtgtgga

SEQ ID NO: 268237 - DNA, 20 bp, human
ggtggctcccagaacccctg

SEQ ID NO: 268238 - DNA, 20 bp, human
gcgcccagctcacttatcca

SEQ ID NO: 268239 - DNA, 20 bp, human
gagtgagcagggagcatctc

SEQ ID NO: 268240 - DNA, 20 bp, human
ggccacccaggacccatatt

SEQ ID NO: 268241 - DNA, 20 bp, human
gagggcacagacattctcag

SEQ ID NO: 268242 - DNA, 20 bp, human
gctcatagttggaatgacag

SEQ ID NO: 268243 - DNA, 20 bp, human
gaggcaggaatgaagtgagc

SEQ ID NO: 268244 - DNA, 20 bp, human
gcgatgatgggtggagggga

SEQ ID NO: 268245 - DNA, 20 bp, human
gttgacgtcagggcgatgat

SEQ ID NO: 268246 - DNA, 20 bp, human
gcaacagcgagaataaaagg

SEQ ID NO: 268247 - DNA, 20 bp, human
ggtattcaatggtcatgaga

SEQ ID NO: 268248 - DNA, 20 bp, human
gaggcttgtatagtattcaa

SEQ ID NO: 268249 - DNA, 20 bp, human
gtggttctgaagcagttaga

SEQ ID NO: 268250 - DNA, 20 bp, human
gctttgtagaaacagatctc

SEQ ID NO: 268251 - DNA, 20 bp, human
gtatgcttaaatctacaagt

SEQ ID NO: 268252 - DNA, 20 bp, human
gatacaacagcgagaataaa

SEQ ID NO: 268253 - DNA, 20 bp, human
gaactgctatattgcaaaga

SEQ ID NO: 268254 - DNA, 20 bp, human
gatagcagttgtattatact

SEQ ID NO: 268255 - DNA, 20 bp, human
gtgcatgtatcataaagcta

SEQ ID NO: 268256 - DNA, 20 bp, human
ggaggggcggccgacgggtt

SEQ ID NO: 268257 - DNA, 20 bp, human
gcggcgggacacacagtagg

SEQ ID NO: 268258 - DNA, 20 bp, human
ggcccggcgggacacacagt

SEQ ID NO: 268259 - DNA, 20 bp, human
gcccgccccgggctgcatcc

SEQ ID NO: 268260 - DNA, 20 bp, human
gccgacgggttcgggattga

SEQ ID NO: 268261 - DNA, 20 bp, human
gaggccccagttcccagccg

SEQ ID NO: 268262 - DNA, 20 bp, human
ggcagcccccggctgggaac

SEQ ID NO: 268263 - DNA, 20 bp, human
gaggggacaggccggggata

SEQ ID NO: 268264 - DNA, 20 bp, human
gacaggccggggataggggg

SEQ ID NO: 268265 - DNA, 20 bp, human
ggggcgcgaggggggagcgc

SEQ ID NO: 268266 - DNA, 20 bp, human
gccactctgcgcgccggcgg

SEQ ID NO: 268267 - DNA, 20 bp, human
gccagagcgcaggacttcct

SEQ ID NO: 268268 - DNA, 20 bp, human
gacttcctgggaggcagtcg

SEQ ID NO: 268269 - DNA, 20 bp, human
gtactgcccgcgccgctctg

SEQ ID NO: 268270 - DNA, 20 bp, human
gaaagatgcactgcgagagg

SEQ ID NO: 268271 - DNA, 20 bp, human
gggctcctcgactgcctccc

SEQ ID NO: 268272 - DNA, 20 bp, human
gtccccgcggtcctagcgcc

SEQ ID NO: 268273 - DNA, 20 bp, human
ggtgcggcgcgccagagcgc

SEQ ID NO: 268274 - DNA, 20 bp, human
gccggcgcgcagagtggcgc

SEQ ID NO: 268275 - DNA, 20 bp, human
gtggcgcaggcagcggcatt

SEQ ID NO: 268276 - DNA, 20 bp, human
gggaaccggctccctcggag

SEQ ID NO: 268277 - DNA, 20 bp, human
gtccaccctgtggccaggat

SEQ ID NO: 268278 - DNA, 20 bp, human
gaccccagcagtgatgtcta

SEQ ID NO: 268279 - DNA, 20 bp, human
ggtcctctccccatcaagga

SEQ ID NO: 268280 - DNA, 20 bp, human
gcgagggagccggttcctgc

SEQ ID NO: 268281 - DNA, 20 bp, human
gaggtaaccccccttttcac

SEQ ID NO: 268282 - DNA, 20 bp, human
ggaagcgtttgatggcatgc

SEQ ID NO: 268283 - DNA, 20 bp, human
gggatgtaatccagtgaaaa

SEQ ID NO: 268284 - DNA, 20 bp, human
gtcacagtgaccctccttga

SEQ ID NO: 268285 - DNA, 20 bp, human
gcacgcccctccgagggagc

SEQ ID NO: 268286 - DNA, 20 bp, human
ggctggggcagatctctctg

SEQ ID NO: 268287 - DNA, 20 bp, human
ggccgcccaccacaagcaaa

SEQ ID NO: 268288 - DNA, 20 bp, human
ggacacgtaacacttggcaa

SEQ ID NO: 268289 - DNA, 20 bp, human
gaaagcgccacacacagctt

SEQ ID NO: 268290 - DNA, 20 bp, human
gtggcgctttgtgcgtgaca

SEQ ID NO: 268291 - DNA, 20 bp, human
ggccaagtgttacgtgtcta

SEQ ID NO: 268292 - DNA, 20 bp, human
gcattccctttgcttgtggt

SEQ ID NO: 268293 - DNA, 20 bp, human
ggctttgtgcgtgacagggc

SEQ ID NO: 268294 - DNA, 20 bp, human
gaaaccattccctttgcttg

SEQ ID NO: 268295 - DNA, 20 bp, human
ggttacgtgtctaaggtctg

SEQ ID NO: 268296 - DNA, 20 bp, human
gtgtgagagaaatcggggag

SEQ ID NO: 268297 - DNA, 20 bp, human
gtgtctctccagatggatga

SEQ ID NO: 268298 - DNA, 20 bp, human
gtccagatggatgatggaag

SEQ ID NO: 268299 - DNA, 20 bp, human
gctcccagtgtgagagaaat

SEQ ID NO: 268300 - DNA, 20 bp, human
gaccgcttccatcatccatc

SEQ ID NO: 268301 - DNA, 20 bp, human
ggagagagagagaagcgcgg

SEQ ID NO: 268302 - DNA, 20 bp, human
gagtgcccagcagttcaccc

SEQ ID NO: 268303 - DNA, 20 bp, human
gcacccaggagtggacattt

SEQ ID NO: 268304 - DNA, 20 bp, human
ggatttgtatttcatactac

SEQ ID NO: 268305 - DNA, 20 bp, human
ggcctgattattttaaacat

SEQ ID NO: 268306 - DNA, 20 bp, human
gccttgtagttccccagccg

SEQ ID NO: 268307 - DNA, 20 bp, human
ggtcgcaagagctccgcggc

SEQ ID NO: 268308 - DNA, 20 bp, human
gcaggccctagacatagcag

SEQ ID NO: 268309 - DNA, 20 bp, human
gccaaaggagaccaggctgt

SEQ ID NO: 268310 - DNA, 20 bp, human
ggccccaaaggacggggagc

SEQ ID NO: 268311 - DNA, 20 bp, human
ggccgcggccccaaaggacg

SEQ ID NO: 268312 - DNA, 20 bp, human
gaggttgtacctggtagcgt

SEQ ID NO: 268313 - DNA, 20 bp, human
gcggcccgctccccgtcctt

SEQ ID NO: 268314 - DNA, 20 bp, human
gtccccagccgcggccccaa

SEQ ID NO: 268315 - DNA, 20 bp, human
gtccccgtcctttggggccg

SEQ ID NO: 268316 - DNA, 20 bp, human
gtggccctgccccctggcgt

SEQ ID NO: 268317 - DNA, 20 bp, human
ggagacctcggggttgacgc

SEQ ID NO: 268318 - DNA, 20 bp, human
gcctccagccggcaacccgt

SEQ ID NO: 268319 - DNA, 20 bp, human
gggcgcgggtgggcacgcaa

SEQ ID NO: 268320 - DNA, 20 bp, human
gccccgcctcccgacgccag

SEQ ID NO: 268321 - DNA, 20 bp, human
gcgggtgggcacgcaagggg

SEQ ID NO: 268322 - DNA, 20 bp, human
ggtgtccagcgtcaaccccg

SEQ ID NO: 268323 - DNA, 20 bp, human
ggaggcgcgagctttgaagc

SEQ ID NO: 268324 - DNA, 20 bp, human
gagtggtccggcgctcccca

SEQ ID NO: 268325 - DNA, 20 bp, human
gggcggggcatagagacctc

SEQ ID NO: 268326 - DNA, 20 bp, human
gtgggtgggtcgtacgctta

SEQ ID NO: 268327 - DNA, 20 bp, human
gaatagggagggacatagaa

SEQ ID NO: 268328 - DNA, 20 bp, human
ggccgagcgaaagcctggga

SEQ ID NO: 268329 - DNA, 20 bp, human
gcacccaggccggtttcccc

SEQ ID NO: 268330 - DNA, 20 bp, human
gagaggccgagcgaaagcct

SEQ ID NO: 268331 - DNA, 20 bp, human
ggggacgcctggccctacga

SEQ ID NO: 268332 - DNA, 20 bp, human
gagcgggtggaaaatctcga

SEQ ID NO: 268333 - DNA, 20 bp, human
gttgccccagaaggcagggc

SEQ ID NO: 268334 - DNA, 20 bp, human
gttccaggggaaaccggcct

SEQ ID NO: 268335 - DNA, 20 bp, human
gtcgccgaacaggaagaggg

SEQ ID NO: 268336 - DNA, 20 bp, human
gacaccggcccgggaggcga

SEQ ID NO: 268337 - DNA, 20 bp, human
gcggcgctgattggcagaga

SEQ ID NO: 268338 - DNA, 20 bp, human
gggtgtctccggctgctcgg

SEQ ID NO: 268339 - DNA, 20 bp, human
gggcgccgccgtccaggaaa

SEQ ID NO: 268340 - DNA, 20 bp, human
ggaaacggctcgggtttcag

SEQ ID NO: 268341 - DNA, 20 bp, human
gcgggagccgcgcgggactc

SEQ ID NO: 268342 - DNA, 20 bp, human
gcatccctacggccgcatcg

SEQ ID NO: 268343 - DNA, 20 bp, human
gtgacccgccgcgaggaggc

SEQ ID NO: 268344 - DNA, 20 bp, human
ggccgtccaggaaacggctc

SEQ ID NO: 268345 - DNA, 20 bp, human
gtccggctgctcggaggcgt

SEQ ID NO: 268346 - DNA, 20 bp, human
gggcgcagggcacgccccct

SEQ ID NO: 268347 - DNA, 20 bp, human
gtaggcccctagtcgcaccg

SEQ ID NO: 268348 - DNA, 20 bp, human
gcggagcggggcatccgagg

SEQ ID NO: 268349 - DNA, 20 bp, human
ggggcgcccggcggtctcga

SEQ ID NO: 268350 - DNA, 20 bp, human
gcgcaccgcggggcggccca

SEQ ID NO: 268351 - DNA, 20 bp, human
gccctagtcgcaccgcgggg

SEQ ID NO: 268352 - DNA, 20 bp, human
ggccaccgcgcactgagcct

SEQ ID NO: 268353 - DNA, 20 bp, human
gggcgcggaccgtcccccac

SEQ ID NO: 268354 - DNA, 20 bp, human
gcccacgccctcgagaccgc

SEQ ID NO: 268355 - DNA, 20 bp, human
gctcgagggcgtgggagccg

SEQ ID NO: 268356 - DNA, 20 bp, human
gctgggtggggcgaaagagg

SEQ ID NO: 268357 - DNA, 20 bp, human
gaagaggcggagcctgaatg

SEQ ID NO: 268358 - DNA, 20 bp, human
ggagtgggctgactgggtcg

SEQ ID NO: 268359 - DNA, 20 bp, human
ggaatggggtgtgtataggg

SEQ ID NO: 268360 - DNA, 20 bp, human
gtcccgggagtgggctgact

SEQ ID NO: 268361 - DNA, 20 bp, human
gcgagctggtctaggcgggg

SEQ ID NO: 268362 - DNA, 20 bp, human
gtccaggtgggcggggatct

SEQ ID NO: 268363 - DNA, 20 bp, human
gctcgagccggagagaggtg

SEQ ID NO: 268364 - DNA, 20 bp, human
gggggtgtgtgtataggctg

SEQ ID NO: 268365 - DNA, 20 bp, human
gcggcactgcgcagaagaca

SEQ ID NO: 268366 - DNA, 20 bp, human
ggcccgaggcggacaggggc

SEQ ID NO: 268367 - DNA, 20 bp, human
ggccggcacgcgctgccctc

SEQ ID NO: 268368 - DNA, 20 bp, human
gggggacgtccgcaccgcga

SEQ ID NO: 268369 - DNA, 20 bp, human
gctcccggccttaaccctcg

SEQ ID NO: 268370 - DNA, 20 bp, human
gccgcccccggcacaacttc

SEQ ID NO: 268371 - DNA, 20 bp, human
ggcggtgcggacgtccccgc

SEQ ID NO: 268372 - DNA, 20 bp, human
gcgcggattggggaaaagtt

SEQ ID NO: 268373 - DNA, 20 bp, human
gggcgcggcgaggctcgggt

SEQ ID NO: 268374 - DNA, 20 bp, human
gcgggcggcttccccgggtc

SEQ ID NO: 268375 - DNA, 20 bp, human
gggtgtgcgcgcgcggattg

SEQ ID NO: 268376 - DNA, 20 bp, human
ggcccccaacctatactgtc

SEQ ID NO: 268377 - DNA, 20 bp, human
ggaacctgacagtataggtt

SEQ ID NO: 268378 - DNA, 20 bp, human
gaaagacctgcccacccttc

SEQ ID NO: 268379 - DNA, 20 bp, human
gcggggcctccttaccagaa

SEQ ID NO: 268380 - DNA, 20 bp, human
ggcctccttaccagaagggt

SEQ ID NO: 268381 - DNA, 20 bp, human
gtcccaggagcttacataaa

SEQ ID NO: 268382 - DNA, 20 bp, human
gtctgggaacctgacagtat

SEQ ID NO: 268383 - DNA, 20 bp, human
ggccctcctcctcacagcaa

SEQ ID NO: 268384 - DNA, 20 bp, human
gaggatgaggaaaaaggaac

SEQ ID NO: 268385 - DNA, 20 bp, human
gttgagctgggccaaaaagg

SEQ ID NO: 268386 - DNA, 20 bp, human
gcccacgtgggactgagagg

SEQ ID NO: 268387 - DNA, 20 bp, human
gccccgggaccgccctgctc

SEQ ID NO: 268388 - DNA, 20 bp, human
gagcgcgcacgcccagaaag

SEQ ID NO: 268389 - DNA, 20 bp, human
ggaggaggaggcaacgactg

SEQ ID NO: 268390 - DNA, 20 bp, human
gaccccacggcgcctgagca

SEQ ID NO: 268391 - DNA, 20 bp, human
ggtagccgcgccgaacccca

SEQ ID NO: 268392 - DNA, 20 bp, human
gccacggcgcctgagcaggg

SEQ ID NO: 268393 - DNA, 20 bp, human
gaagcccccagcgcccacgt

SEQ ID NO: 268394 - DNA, 20 bp, human
ggcgcccacgtgggactgag

SEQ ID NO: 268395 - DNA, 20 bp, human
gtacaggggccgcgccggcg

SEQ ID NO: 268396 - DNA, 20 bp, human
gtcctgggaagcagagtgtc

SEQ ID NO: 268397 - DNA, 20 bp, human
gcaggatcctgtaactgcat

SEQ ID NO: 268398 - DNA, 20 bp, human
ggaaactttgctttgtatta

SEQ ID NO: 268399 - DNA, 20 bp, human
gagaaaaatatcagagtatt

SEQ ID NO: 268400 - DNA, 20 bp, human
gctgactcacttctgacttt

SEQ ID NO: 268401 - DNA, 20 bp, human
gggaagcatcgattatactc

SEQ ID NO: 268402 - DNA, 20 bp, human
gatagggacaatgttgattc

SEQ ID NO: 268403 - DNA, 20 bp, human
gaataattgccaaggtgaaa

SEQ ID NO: 268404 - DNA, 20 bp, human
gccattatttgattagaaat

SEQ ID NO: 268405 - DNA, 20 bp, human
gtacaaagcaaagtttcagc

SEQ ID NO: 268406 - DNA, 20 bp, human
gggcaaactgcgtttgatga

SEQ ID NO: 268407 - DNA, 20 bp, human
gacaagttttagaaacgcac

SEQ ID NO: 268408 - DNA, 20 bp, human
gtttagaaacgcacaggaag

SEQ ID NO: 268409 - DNA, 20 bp, human
gagcggcagctgcctgagtc

SEQ ID NO: 268410 - DNA, 20 bp, human
gccttcttagaatggggcat

SEQ ID NO: 268411 - DNA, 20 bp, human
gttatgaaagtgaatcttgt

SEQ ID NO: 268412 - DNA, 20 bp, human
gttcttcatgttggactttc

SEQ ID NO: 268413 - DNA, 20 bp, human
gtaattatacgtaacttcac

SEQ ID NO: 268414 - DNA, 20 bp, human
ggagagtaagttacagtttt

SEQ ID NO: 268415 - DNA, 20 bp, human
gtgtgttcccaggaaagggt

SEQ ID NO: 268416 - DNA, 20 bp, human
ggggagctggcttggggcta

SEQ ID NO: 268417 - DNA, 20 bp, human
gcgggtgggcctaggatctg

SEQ ID NO: 268418 - DNA, 20 bp, human
gtgggggcgcctcctcgctg

SEQ ID NO: 268419 - DNA, 20 bp, human
ggctggggactcaggtctgg

SEQ ID NO: 268420 - DNA, 20 bp, human
gaaaagagcaggtgcttcgg

SEQ ID NO: 268421 - DNA, 20 bp, human
gggaggcgcccccagatcct

SEQ ID NO: 268422 - DNA, 20 bp, human
gcgggctggggactcaggtc

SEQ ID NO: 268423 - DNA, 20 bp, human
ggacctcccgtaaaccaggg

SEQ ID NO: 268424 - DNA, 20 bp, human
gagccgacctcccgtaaacc

SEQ ID NO: 268425 - DNA, 20 bp, human
gtctgaccgccgcccctgct

SEQ ID NO: 268426 - DNA, 20 bp, human
ggtaaggccttcggattcat

SEQ ID NO: 268427 - DNA, 20 bp, human
gtcggtgtgaggctgttgat

SEQ ID NO: 268428 - DNA, 20 bp, human
gtaactttctagtagtagtg

SEQ ID NO: 268429 - DNA, 20 bp, human
gcagcctcacaccgacaggt

SEQ ID NO: 268430 - DNA, 20 bp, human
gagaaggcgggagtattagt

SEQ ID NO: 268431 - DNA, 20 bp, human
gtgccccacctgtcggtgtg

SEQ ID NO: 268432 - DNA, 20 bp, human
ggaatgaccagtaaagaatg

SEQ ID NO: 268433 - DNA, 20 bp, human
ggtgtggggtgtaaggcctt

SEQ ID NO: 268434 - DNA, 20 bp, human
gcggaacggtttctgacaac

SEQ ID NO: 268435 - DNA, 20 bp, human
gagtagtagtgtggggtgta

SEQ ID NO: 268436 - DNA, 20 bp, human
ggggtccagcctaatagatg

SEQ ID NO: 268437 - DNA, 20 bp, human
gttcacagataggaaagcgg

SEQ ID NO: 268438 - DNA, 20 bp, human
gtgaaatggggcaggctcgt

SEQ ID NO: 268439 - DNA, 20 bp, human
gtcagcaggcggtaacccag

SEQ ID NO: 268440 - DNA, 20 bp, human
gggggcctggagcattcagc

SEQ ID NO: 268441 - DNA, 20 bp, human
gacagtgaggggtaatggaa

SEQ ID NO: 268442 - DNA, 20 bp, human
gcgtgcagggaacgcccact

SEQ ID NO: 268443 - DNA, 20 bp, human
ggcaacgcgcgtacacaggc

SEQ ID NO: 268444 - DNA, 20 bp, human
ggggagaggtaggagattga

SEQ ID NO: 268445 - DNA, 20 bp, human
gaccgcctgctgaatgctcc

SEQ ID NO: 268446 - DNA, 20 bp, human
gcgggaagcagtgtgccccg

SEQ ID NO: 268447 - DNA, 20 bp, human
gggtgagcgcgtggcggtga

SEQ ID NO: 268448 - DNA, 20 bp, human
gggcgcgcgtagggtggaag

SEQ ID NO: 268449 - DNA, 20 bp, human
ggctcctggccggccgggaa

SEQ ID NO: 268450 - DNA, 20 bp, human
gcgcccgtgtgcacaagaga

SEQ ID NO: 268451 - DNA, 20 bp, human
ggcgcgtagggtggaagggg

SEQ ID NO: 268452 - DNA, 20 bp, human
ggggccaccgagagaagtag

SEQ ID NO: 268453 - DNA, 20 bp, human
gggtgacggtggcgcgcgta

SEQ ID NO: 268454 - DNA, 20 bp, human
ggcctcaggtaacaaagctg

SEQ ID NO: 268455 - DNA, 20 bp, human
gtgccccgaggcgtctcccc

SEQ ID NO: 268456 - DNA, 20 bp, human
gtgtctggggacaggagcgg

SEQ ID NO: 268457 - DNA, 20 bp, human
ggtaggggcgggacccaaga

SEQ ID NO: 268458 - DNA, 20 bp, human
gtggccgcttgtctggggac

SEQ ID NO: 268459 - DNA, 20 bp, human
gcccagaagaccccacggta

SEQ ID NO: 268460 - DNA, 20 bp, human
gtgacagtaaccctgattca

SEQ ID NO: 268461 - DNA, 20 bp, human
gcaagatggccgcttgtctg

SEQ ID NO: 268462 - DNA, 20 bp, human
ggggtcccgcccctaccgtg

SEQ ID NO: 268463 - DNA, 20 bp, human
gcagagcatgcgcctacgcc

SEQ ID NO: 268464 - DNA, 20 bp, human
gagtaaccctgattcagggg

SEQ ID NO: 268465 - DNA, 20 bp, human
ggtttcccgcccctgaatca

SEQ ID NO: 268466 - DNA, 20 bp, human
gaggttgtgatctctgggga

SEQ ID NO: 268467 - DNA, 20 bp, human
ggggtcctattcttctccct

SEQ ID NO: 268468 - DNA, 20 bp, human
ggctacatataaatacctgc

SEQ ID NO: 268469 - DNA, 20 bp, human
gggattaaggttgtgatctc

SEQ ID NO: 268470 - DNA, 20 bp, human
gacagggatgactttctatg

SEQ ID NO: 268471 - DNA, 20 bp, human
gaaccattttaggtgatcca

SEQ ID NO: 268472 - DNA, 20 bp, human
gacagtaatctgctgatctc

SEQ ID NO: 268473 - DNA, 20 bp, human
gggccaaatgcaagctcttg

SEQ ID NO: 268474 - DNA, 20 bp, human
ggatcagcagattactgtac

SEQ ID NO: 268475 - DNA, 20 bp, human
gtcccttggatcacctaaaa

SEQ ID NO: 268476 - DNA, 20 bp, human
gacacggcggggtttctcga

SEQ ID NO: 268477 - DNA, 20 bp, human
gacccggagggcacgaagaa

SEQ ID NO: 268478 - DNA, 20 bp, human
gggcacgaagaaaggagccc

SEQ ID NO: 268479 - DNA, 20 bp, human
ggctcgctggcaccgggcgt

SEQ ID NO: 268480 - DNA, 20 bp, human
gcctcccccggcacgtcctg

SEQ ID NO: 268481 - DNA, 20 bp, human
gaggagccctggcaaacaaa

SEQ ID NO: 268482 - DNA, 20 bp, human
ggcaaacaaagggtacgggc

SEQ ID NO: 268483 - DNA, 20 bp, human
gcaggcagagatcccggcgt

SEQ ID NO: 268484 - DNA, 20 bp, human
gggagcgtcgcctccggcgt

SEQ ID NO: 268485 - DNA, 20 bp, human
ggcccgagagcccacgccgg

SEQ ID NO: 268486 - DNA, 20 bp, human
gtcccggccgcttgaaggtt

SEQ ID NO: 268487 - DNA, 20 bp, human
gagggggccgggccgactgg

SEQ ID NO: 268488 - DNA, 20 bp, human
gagaacagaggctgcgggga

SEQ ID NO: 268489 - DNA, 20 bp, human
gtggcggccgaaagggaggt

SEQ ID NO: 268490 - DNA, 20 bp, human
gcctcccgcccggcctaacc

SEQ ID NO: 268491 - DNA, 20 bp, human
gcggggtcccggccgcttga

SEQ ID NO: 268492 - DNA, 20 bp, human
ggggctgagtgtcacccctg

SEQ ID NO: 268493 - DNA, 20 bp, human
gcccgcccccacctcccttt

SEQ ID NO: 268494 - DNA, 20 bp, human
gggcccgcgctcacttcctc

SEQ ID NO: 268495 - DNA, 20 bp, human
gtgggagagccaggttaggc

SEQ ID NO: 268496 - DNA, 20 bp, human
ggattagcattcgaagtatc

SEQ ID NO: 268497 - DNA, 20 bp, human
gctctgcaggacatccttaa

SEQ ID NO: 268498 - DNA, 20 bp, human
gcgtgtacatgactcctact

SEQ ID NO: 268499 - DNA, 20 bp, human
gctcccttcttgggaaattg

SEQ ID NO: 268500 - DNA, 20 bp, human
ggatagaggccacaatccag

SEQ ID NO: 268501 - DNA, 20 bp, human
gtacacggtataagacttgg

SEQ ID NO: 268502 - DNA, 20 bp, human
ggtccaaaagaaaagctcag

SEQ ID NO: 268503 - DNA, 20 bp, human
gaccttaagagatggccccc

SEQ ID NO: 268504 - DNA, 20 bp, human
gattttgcaggtaagagcat

SEQ ID NO: 268505 - DNA, 20 bp, human
gatgtacacggtataagact

SEQ ID NO: 268506 - DNA, 20 bp, human
ggggaatcccgttagttcac

SEQ ID NO: 268507 - DNA, 20 bp, human
ggggccctgtgagtggctag

SEQ ID NO: 268508 - DNA, 20 bp, human
gccgccgctagccactcaca

SEQ ID NO: 268509 - DNA, 20 bp, human
gaactaacgggattcccatt

SEQ ID NO: 268510 - DNA, 20 bp, human
gtccggcagtggttacctcc

SEQ ID NO: 268511 - DNA, 20 bp, human
gtcccattgggccctgtgag

SEQ ID NO: 268512 - DNA, 20 bp, human
ggccactcacagggcccaat

SEQ ID NO: 268513 - DNA, 20 bp, human
ggggaggctttctttggtct

SEQ ID NO: 268514 - DNA, 20 bp, human
gcgcactcggggactaatct

SEQ ID NO: 268515 - DNA, 20 bp, human
gcagccgcgtccggtccggc

SEQ ID NO: 268516 - DNA, 20 bp, human
gcggccgggggtagaggacc

SEQ ID NO: 268517 - DNA, 20 bp, human
gccgggctgccccgaacgac

SEQ ID NO: 268518 - DNA, 20 bp, human
ggggtagaggacccggagga

SEQ ID NO: 268519 - DNA, 20 bp, human
gcgttcggggcagcccggcc

SEQ ID NO: 268520 - DNA, 20 bp, human
ggccctgcgccaaaggccgg

SEQ ID NO: 268521 - DNA, 20 bp, human
ggcagcccggccgggggtag

SEQ ID NO: 268522 - DNA, 20 bp, human
gggagcctggaggaccgagt

SEQ ID NO: 268523 - DNA, 20 bp, human
gtcggcagcaagaggggtgg

SEQ ID NO: 268524 - DNA, 20 bp, human
gcgcagccgggaaagtgcaa

SEQ ID NO: 268525 - DNA, 20 bp, human
gctccccaactcggtcctcc

SEQ ID NO: 268526 - DNA, 20 bp, human
gacctggacccagacctcgg

SEQ ID NO: 268527 - DNA, 20 bp, human
gagggctcgccccaagaccc

SEQ ID NO: 268528 - DNA, 20 bp, human
ggcgccgggggcagtttcgg

SEQ ID NO: 268529 - DNA, 20 bp, human
gcctcccggctcaggacgca

SEQ ID NO: 268530 - DNA, 20 bp, human
gggccggttcggcgtctccg

SEQ ID NO: 268531 - DNA, 20 bp, human
gggcaagtgcgcccagctgt

SEQ ID NO: 268532 - DNA, 20 bp, human
ggctgcgccgggggcagttt

SEQ ID NO: 268533 - DNA, 20 bp, human
gcagacctcgggggcccgca

SEQ ID NO: 268534 - DNA, 20 bp, human
gaagacccaggctgcgccgg

SEQ ID NO: 268535 - DNA, 20 bp, human
gcggccaggctcacgcgtcg

SEQ ID NO: 268536 - DNA, 20 bp, human
gggaagccagggaacaagtt

SEQ ID NO: 268537 - DNA, 20 bp, human
ggtacagggtcgctttttaa

SEQ ID NO: 268538 - DNA, 20 bp, human
gcgctttttaaaggttggaa

SEQ ID NO: 268539 - DNA, 20 bp, human
gagggtcgctttttaaaggt

SEQ ID NO: 268540 - DNA, 20 bp, human
gctccactattaaaggtaca

SEQ ID NO: 268541 - DNA, 20 bp, human
ggtgaaatggcatttttcca

SEQ ID NO: 268542 - DNA, 20 bp, human
gggggaaggaatgattaccc

SEQ ID NO: 268543 - DNA, 20 bp, human
ggttattgacatattgggag

SEQ ID NO: 268544 - DNA, 20 bp, human
gtctgctctcaaattacagc

SEQ ID NO: 268545 - DNA, 20 bp, human
gtaacaaaccagggtttttg

SEQ ID NO: 268546 - DNA, 20 bp, human
gggagcggcgagggaagaga

SEQ ID NO: 268547 - DNA, 20 bp, human
gggacacagccagtcgggga

SEQ ID NO: 268548 - DNA, 20 bp, human
gccgtctgcaggagcacgaa

SEQ ID NO: 268549 - DNA, 20 bp, human
gtccgggacacagccagtcg

SEQ ID NO: 268550 - DNA, 20 bp, human
gcgggactccccctcccggc

SEQ ID NO: 268551 - DNA, 20 bp, human
gaagcggtgctcctccgcgc

SEQ ID NO: 268552 - DNA, 20 bp, human
gcgtgctcctgcagacggcc

SEQ ID NO: 268553 - DNA, 20 bp, human
ggcttcctcccgccgggagg

SEQ ID NO: 268554 - DNA, 20 bp, human
gtcctgcagacggccgggga

SEQ ID NO: 268555 - DNA, 20 bp, human
ggatgccgcgagcggaatct

SEQ ID NO: 268556 - DNA, 20 bp, human
gaacccggaaatgcgaggga

SEQ ID NO: 268557 - DNA, 20 bp, human
gcgggaacccggaaatgcga

SEQ ID NO: 268558 - DNA, 20 bp, human
gccacggcgcgtctttcccg

SEQ ID NO: 268559 - DNA, 20 bp, human
gaacgcaagcaacaaccaat

SEQ ID NO: 268560 - DNA, 20 bp, human
gcgtccgcgtcggcttcccc

SEQ ID NO: 268561 - DNA, 20 bp, human
gcgccgtgggccactcccat

SEQ ID NO: 268562 - DNA, 20 bp, human
gcaggtgctggaaacccgat

SEQ ID NO: 268563 - DNA, 20 bp, human
gcgcccctcccgctgcttat

SEQ ID NO: 268564 - DNA, 20 bp, human
gaatgcgagggaaggacaag

SEQ ID NO: 268565 - DNA, 20 bp, human
gagggctgcgggcggttcaa

SEQ ID NO: 268566 - DNA, 20 bp, human
gctgccgagagaggaagcga

SEQ ID NO: 268567 - DNA, 20 bp, human
gaggtcgggtagaggctccc

SEQ ID NO: 268568 - DNA, 20 bp, human
gccgcccctcacgtcgggag

SEQ ID NO: 268569 - DNA, 20 bp, human
gtcggcagcacgcaggtccc

SEQ ID NO: 268570 - DNA, 20 bp, human
gtgggcggagaaaaagtcga

SEQ ID NO: 268571 - DNA, 20 bp, human
gtcatagagaggtcgggtag

SEQ ID NO: 268572 - DNA, 20 bp, human
gagccccgctcccgacgtga

SEQ ID NO: 268573 - DNA, 20 bp, human
ggaggcggggcgcagggatc

SEQ ID NO: 268574 - DNA, 20 bp, human
gtcctctctcggcagcacgc

SEQ ID NO: 268575 - DNA, 20 bp, human
ggacgtatcatagagaggtc

SEQ ID NO: 268576 - DNA, 20 bp, human
gaggtcaaagctatgtgctg

SEQ ID NO: 268577 - DNA, 20 bp, human
gaaactgccctgctattggt

SEQ ID NO: 268578 - DNA, 20 bp, human
gctattggtagggacgcaac

SEQ ID NO: 268579 - DNA, 20 bp, human
gtgctggggtttcatgttac

SEQ ID NO: 268580 - DNA, 20 bp, human
gtgcgtccctaccaatagca

SEQ ID NO: 268581 - DNA, 20 bp, human
gcttaaaactgccctgctat

SEQ ID NO: 268582 - DNA, 20 bp, human
gcatccatacatgcaaaaaa

SEQ ID NO: 268583 - DNA, 20 bp, human
ggcagatgcatgagcatctg

SEQ ID NO: 268584 - DNA, 20 bp, human
gtctgagattgagccattga

SEQ ID NO: 268585 - DNA, 20 bp, human
gccacactaacgtgataaca

SEQ ID NO: 268586 - DNA, 20 bp, human
gctcccgagtcacacctgtg

SEQ ID NO: 268587 - DNA, 20 bp, human
gggttccaggtgtgcagccg

SEQ ID NO: 268588 - DNA, 20 bp, human
gagccgcacaggtgtgactc

SEQ ID NO: 268589 - DNA, 20 bp, human
gaggtgtgactcgggagcgc

SEQ ID NO: 268590 - DNA, 20 bp, human
gaccacctgcaaccattccc

SEQ ID NO: 268591 - DNA, 20 bp, human
gccacgctcccggcggttcc

SEQ ID NO: 268592 - DNA, 20 bp, human
gggactggaaccgtggcatg

SEQ ID NO: 268593 - DNA, 20 bp, human
gaccactaccacgctcccgg

SEQ ID NO: 268594 - DNA, 20 bp, human
gtgattaaatgggaatttgg

SEQ ID NO: 268595 - DNA, 20 bp, human
gcggctgcgtattccaatcc

SEQ ID NO: 268596 - DNA, 20 bp, human
ggagacggaggctgccgtga

SEQ ID NO: 268597 - DNA, 20 bp, human
gagacgcgccagagattcat

SEQ ID NO: 268598 - DNA, 20 bp, human
ggagagagacgggcagcggg

SEQ ID NO: 268599 - DNA, 20 bp, human
gtgagcgcatcggcgaggct

SEQ ID NO: 268600 - DNA, 20 bp, human
gcggagcccgcggagctgga

SEQ ID NO: 268601 - DNA, 20 bp, human
gcggcccagcctggggaaag

SEQ ID NO: 268602 - DNA, 20 bp, human
ggaaaggggagcagcgccgt

SEQ ID NO: 268603 - DNA, 20 bp, human
gccgctcgggtcatgttaca

SEQ ID NO: 268604 - DNA, 20 bp, human
gccgccagagagtgcgtgca

SEQ ID NO: 268605 - DNA, 20 bp, human
gtacacggccggggccgcgg

SEQ ID NO: 268606 - DNA, 20 bp, human
gaggccctagctccgaccag

SEQ ID NO: 268607 - DNA, 20 bp, human
ggtcggagctagggcctagg

SEQ ID NO: 268608 - DNA, 20 bp, human
ggggcgtgggcgcggcacct

SEQ ID NO: 268609 - DNA, 20 bp, human
ggaagtgagccacgctctat

SEQ ID NO: 268610 - DNA, 20 bp, human
gcacgtacggcgcgagtccg

SEQ ID NO: 268611 - DNA, 20 bp, human
gcacccgctcacgtgctgta

SEQ ID NO: 268612 - DNA, 20 bp, human
gcgttcggcgcgcggggcgt

SEQ ID NO: 268613 - DNA, 20 bp, human
gcgctcgctgtcccggtgag

SEQ ID NO: 268614 - DNA, 20 bp, human
gcacccgggagagcaaacaa

SEQ ID NO: 268615 - DNA, 20 bp, human
gacaccactggtcggagcta

SEQ ID NO: 268616 - DNA, 20 bp, human
gggagtgaggccaaggggta

SEQ ID NO: 268617 - DNA, 20 bp, human
gtcccaggaaccaaatcggg

SEQ ID NO: 268618 - DNA, 20 bp, human
ggcctcccaggaaccaaatc

SEQ ID NO: 268619 - DNA, 20 bp, human
ggaaccaaatcgggcggtgg

SEQ ID NO: 268620 - DNA, 20 bp, human
gaaaactggggagcccccca

SEQ ID NO: 268621 - DNA, 20 bp, human
gcgggcggtggcggcggttc

SEQ ID NO: 268622 - DNA, 20 bp, human
gaccgcccgatttggttcct

SEQ ID NO: 268623 - DNA, 20 bp, human
ggggcccccgcacgcattgc

SEQ ID NO: 268624 - DNA, 20 bp, human
gccaaggggtagggtggctc

SEQ ID NO: 268625 - DNA, 20 bp, human
ggcgacgcctccttcctcaa

SEQ ID NO: 268626 - DNA, 20 bp, human
gtaaaagattgcgggaaaac

SEQ ID NO: 268627 - DNA, 20 bp, human
gtcaccctgtaaaagattgc

SEQ ID NO: 268628 - DNA, 20 bp, human
gaaaccggcaggccctttta

SEQ ID NO: 268629 - DNA, 20 bp, human
gcagctgagaagtttggagc

SEQ ID NO: 268630 - DNA, 20 bp, human
gaaacttctcagctgttgac

SEQ ID NO: 268631 - DNA, 20 bp, human
gcttaggaactgagtaaagc

SEQ ID NO: 268632 - DNA, 20 bp, human
gatgagcagaagtccttaaa

SEQ ID NO: 268633 - DNA, 20 bp, human
gagattgcgggaaaaccggc

SEQ ID NO: 268634 - DNA, 20 bp, human
gactcagttcctaagcagct

SEQ ID NO: 268635 - DNA, 20 bp, human
gaaaagtgtatcacaactgt

SEQ ID NO: 268636 - DNA, 20 bp, human
gggctgcagggtacaaaatg

SEQ ID NO: 268637 - DNA, 20 bp, human
gacagcagtgctagcacctt

SEQ ID NO: 268638 - DNA, 20 bp, human
ggacaagtagaggcaggcac

SEQ ID NO: 268639 - DNA, 20 bp, human
gagtgtcacaggagacacga

SEQ ID NO: 268640 - DNA, 20 bp, human
gacacgagggcaaagtgctg

SEQ ID NO: 268641 - DNA, 20 bp, human
gtgggacccaggttgtgctt

SEQ ID NO: 268642 - DNA, 20 bp, human
ggggttatgggtgtcaaaga

SEQ ID NO: 268643 - DNA, 20 bp, human
gacagcaaagaatgggaccc

SEQ ID NO: 268644 - DNA, 20 bp, human
gggaaactctagagcaacat

SEQ ID NO: 268645 - DNA, 20 bp, human
gaacttcccaagcacaacct

SEQ ID NO: 268646 - DNA, 20 bp, human
ggcaaaccgggatcctagag

SEQ ID NO: 268647 - DNA, 20 bp, human
gctcccgtggcgtcctgagt

SEQ ID NO: 268648 - DNA, 20 bp, human
ggcggcgcggcgcgtatagg

SEQ ID NO: 268649 - DNA, 20 bp, human
gtatacgcgccgcgccgctt

SEQ ID NO: 268650 - DNA, 20 bp, human
gccacgcaaaatagcaaacc

SEQ ID NO: 268651 - DNA, 20 bp, human
gtcagcgcgcaggcgcaacc

SEQ ID NO: 268652 - DNA, 20 bp, human
gggtggcttcgcttccgcgg

SEQ ID NO: 268653 - DNA, 20 bp, human
gggggaaccctggccgactc

SEQ ID NO: 268654 - DNA, 20 bp, human
gtggcgtcctgagtcggcca

SEQ ID NO: 268655 - DNA, 20 bp, human
ggcttccgcggcggccacct

SEQ ID NO: 268656 - DNA, 20 bp, human
gtctccctgcgcgcagtctg

SEQ ID NO: 268657 - DNA, 20 bp, human
gcagcccgcagactgcgcgc

SEQ ID NO: 268658 - DNA, 20 bp, human
gacctgggaagaccaacctg

SEQ ID NO: 268659 - DNA, 20 bp, human
gccggtgccttcctctgtgg

SEQ ID NO: 268660 - DNA, 20 bp, human
gccggcgctgctgaactgag

SEQ ID NO: 268661 - DNA, 20 bp, human
ggggcgctagtgcgcaggct

SEQ ID NO: 268662 - DNA, 20 bp, human
gtccccaggttggtcttccc

SEQ ID NO: 268663 - DNA, 20 bp, human
gaggtcgtgccagcatccgc

SEQ ID NO: 268664 - DNA, 20 bp, human
ggaaactggaggccatgtct

SEQ ID NO: 268665 - DNA, 20 bp, human
gggggctaaccgccaagaca

SEQ ID NO: 268666 - DNA, 20 bp, human
ggcgcaggagccaccctagg

SEQ ID NO: 268667 - DNA, 20 bp, human
gtctgcgcaggagccaccct

SEQ ID NO: 268668 - DNA, 20 bp, human
gtctaggaggaggactcggt

SEQ ID NO: 268669 - DNA, 20 bp, human
gccgagcgaagcccggtgcg

SEQ ID NO: 268670 - DNA, 20 bp, human
gggagccaccctaggcgggg

SEQ ID NO: 268671 - DNA, 20 bp, human
gaagcccggtgcggggcacg

SEQ ID NO: 268672 - DNA, 20 bp, human
ggccaccctaggcggggagg

SEQ ID NO: 268673 - DNA, 20 bp, human
gggactcggagcaacgctca

SEQ ID NO: 268674 - DNA, 20 bp, human
ggcagagctgagtcgttcat

SEQ ID NO: 268675 - DNA, 20 bp, human
gcttctggggccgctctagg

SEQ ID NO: 268676 - DNA, 20 bp, human
ggccccccctggacaaggat

SEQ ID NO: 268677 - DNA, 20 bp, human
gcagctgaggaggggctgat

SEQ ID NO: 268678 - DNA, 20 bp, human
gtggagcaaatggtaaagta

SEQ ID NO: 268679 - DNA, 20 bp, human
ggggagggaacatggagcgg

SEQ ID NO: 268680 - DNA, 20 bp, human
gggccaggaccctgctgacg

SEQ ID NO: 268681 - DNA, 20 bp, human
gactgcctatccttgtccag

SEQ ID NO: 268682 - DNA, 20 bp, human
ggacacaggactaacaggaa

SEQ ID NO: 268683 - DNA, 20 bp, human
gacgtggcagacctccaccc

SEQ ID NO: 268684 - DNA, 20 bp, human
gctggccctgtcacaggaac

SEQ ID NO: 268685 - DNA, 20 bp, human
gagccctgttggcagctggc

SEQ ID NO: 268686 - DNA, 20 bp, human
gcagaggagacgagcgagtt

SEQ ID NO: 268687 - DNA, 20 bp, human
ggcagtgcgcatgcgctcga

SEQ ID NO: 268688 - DNA, 20 bp, human
gcgggcgaagggcgatacgg

SEQ ID NO: 268689 - DNA, 20 bp, human
gtgcgcatgcgctcgaaggg

SEQ ID NO: 268690 - DNA, 20 bp, human
ggaggcgcaggtccgggcga

SEQ ID NO: 268691 - DNA, 20 bp, human
gggcagcagcggccacgagg

SEQ ID NO: 268692 - DNA, 20 bp, human
gcaagcacgcctcaagctgt

SEQ ID NO: 268693 - DNA, 20 bp, human
gttgaggcgtgcttgggctc

SEQ ID NO: 268694 - DNA, 20 bp, human
gccgcgagtcccacagcttg

SEQ ID NO: 268695 - DNA, 20 bp, human
gtggccgagagggcacggag

SEQ ID NO: 268696 - DNA, 20 bp, human
ggcccgcgccatcttgggtg

SEQ ID NO: 268697 - DNA, 20 bp, human
ggagctgaggcggaagtcga

SEQ ID NO: 268698 - DNA, 20 bp, human
gggcaaggagctgagagcga

SEQ ID NO: 268699 - DNA, 20 bp, human
ggaaagggggagtacggcgg

SEQ ID NO: 268700 - DNA, 20 bp, human
ggccaggcccgcgccatctt

SEQ ID NO: 268701 - DNA, 20 bp, human
gacggcgccatacagactaa

SEQ ID NO: 268702 - DNA, 20 bp, human
gccaagagggcgggagaaag

SEQ ID NO: 268703 - DNA, 20 bp, human
gggagaaagggggagtacgg

SEQ ID NO: 268704 - DNA, 20 bp, human
gttgggtgagggcagcggga

SEQ ID NO: 268705 - DNA, 20 bp, human
gaagcccatggagtgctaag

SEQ ID NO: 268706 - DNA, 20 bp, human
ggccgcctctccctctcgga

SEQ ID NO: 268707 - DNA, 20 bp, human
gcccgcgccggggcgtagga

SEQ ID NO: 268708 - DNA, 20 bp, human
gaagtcccggaccgagtgtg

SEQ ID NO: 268709 - DNA, 20 bp, human
gcactcggtccgggacttgg

SEQ ID NO: 268710 - DNA, 20 bp, human
ggcggccccacactcggtcc

SEQ ID NO: 268711 - DNA, 20 bp, human
gacgcgccctgggccctcgc

SEQ ID NO: 268712 - DNA, 20 bp, human
gacccgcgctgcctaggcaa

SEQ ID NO: 268713 - DNA, 20 bp, human
ggatgtgcgagctcggaaaa

SEQ ID NO: 268714 - DNA, 20 bp, human
gctgcctaggcaaagggacc

SEQ ID NO: 268715 - DNA, 20 bp, human
gtgcgcccgcgccggggcgt

SEQ ID NO: 268716 - DNA, 20 bp, human
ggaccccagctgtactccaa

SEQ ID NO: 268717 - DNA, 20 bp, human
ggctggtccacgtggaatgg

SEQ ID NO: 268718 - DNA, 20 bp, human
ggccccaggtctcgcagcca

SEQ ID NO: 268719 - DNA, 20 bp, human
ggaaagatgagaactctgag

SEQ ID NO: 268720 - DNA, 20 bp, human
gctggctggtccacgtggaa

SEQ ID NO: 268721 - DNA, 20 bp, human
gcgggggagggggttgcaat

SEQ ID NO: 268722 - DNA, 20 bp, human
gagggggttgcaataggagg

SEQ ID NO: 268723 - DNA, 20 bp, human
gccaagggaaggcatctcca

SEQ ID NO: 268724 - DNA, 20 bp, human
gctgagtgtgttagagtctg

SEQ ID NO: 268725 - DNA, 20 bp, human
ggggagggggttgcaatagg

SEQ ID NO: 268726 - DNA, 20 bp, human
ggtaccctccaagatccgga

SEQ ID NO: 268727 - DNA, 20 bp, human
gtataggacagaacgtctaa

SEQ ID NO: 268728 - DNA, 20 bp, human
ggcgccctccggatcttgga

SEQ ID NO: 268729 - DNA, 20 bp, human
gacgttctgtcctataacgt

SEQ ID NO: 268730 - DNA, 20 bp, human
gggatcttggagggtacaga

SEQ ID NO: 268731 - DNA, 20 bp, human
gttggcccgacccacgttat

SEQ ID NO: 268732 - DNA, 20 bp, human
gcgtcagaacctgcgccctc

SEQ ID NO: 268733 - DNA, 20 bp, human
gtggctatcctggcagtgtc

SEQ ID NO: 268734 - DNA, 20 bp, human
gtcggcctcctccctttcgg

SEQ ID NO: 268735 - DNA, 20 bp, human
gaggccagactggacgggac

SEQ ID NO: 268736 - DNA, 20 bp, human
gagcaccaatagccaatggg

SEQ ID NO: 268737 - DNA, 20 bp, human
gggaggctgctattcccagg

SEQ ID NO: 268738 - DNA, 20 bp, human
ggggaatagcagcctcccat

SEQ ID NO: 268739 - DNA, 20 bp, human
gggcagctgcccggctctac

SEQ ID NO: 268740 - DNA, 20 bp, human
gtccatcgttgcagcgtcat

SEQ ID NO: 268741 - DNA, 20 bp, human
ggcagcctcccattggctat

SEQ ID NO: 268742 - DNA, 20 bp, human
gagccaaccggaaactcctc

SEQ ID NO: 268743 - DNA, 20 bp, human
gctgactggctcttataacg

SEQ ID NO: 268744 - DNA, 20 bp, human
gccgggctctaggaccacaa

SEQ ID NO: 268745 - DNA, 20 bp, human
gggacagcaccaatagccaa

SEQ ID NO: 268746 - DNA, 20 bp, human
gtggggcaaaggcaaatgag

SEQ ID NO: 268747 - DNA, 20 bp, human
gcgaactccagcacggtctc

SEQ ID NO: 268748 - DNA, 20 bp, human
ggcaaatgagaggctcgcgc

SEQ ID NO: 268749 - DNA, 20 bp, human
gacgagcgccgagtgacgtc

SEQ ID NO: 268750 - DNA, 20 bp, human
gtaccgaccaatccctgcaa

SEQ ID NO: 268751 - DNA, 20 bp, human
gactgggctctggagaaggt

SEQ ID NO: 268752 - DNA, 20 bp, human
gtctggaccgaaagtagact

SEQ ID NO: 268753 - DNA, 20 bp, human
gggagaggcctgacgtcact

SEQ ID NO: 268754 - DNA, 20 bp, human
gccgaaagtagactgggctc

SEQ ID NO: 268755 - DNA, 20 bp, human
gacgtcgtaaaatgccgcgg

SEQ ID NO: 268756 - DNA, 20 bp, human
gaaacccaggcctccggaag

SEQ ID NO: 268757 - DNA, 20 bp, human
gcaaacacagctgtatccgg

SEQ ID NO: 268758 - DNA, 20 bp, human
ggggcagggagatgcttaac

SEQ ID NO: 268759 - DNA, 20 bp, human
gtcccggaaacccaggcctc

SEQ ID NO: 268760 - DNA, 20 bp, human
gcgggcttccggaggtctcg

SEQ ID NO: 268761 - DNA, 20 bp, human
gcggaggtctcggggcttct

SEQ ID NO: 268762 - DNA, 20 bp, human
ggaggcctccgggcttccgg

SEQ ID NO: 268763 - DNA, 20 bp, human
gggcgacgcgccgaggtact

SEQ ID NO: 268764 - DNA, 20 bp, human
gcctgcgtgcgcgccccaca

SEQ ID NO: 268765 - DNA, 20 bp, human
gcggcaaacacagctgtatc

SEQ ID NO: 268766 - DNA, 20 bp, human
gggacggatgcgcgaatgaa

SEQ ID NO: 268767 - DNA, 20 bp, human
gggaaaggtggggtcggccg

SEQ ID NO: 268768 - DNA, 20 bp, human
ggggcggggtcccttccccc

SEQ ID NO: 268769 - DNA, 20 bp, human
gcggagccgcgcggaaaggt

SEQ ID NO: 268770 - DNA, 20 bp, human
gccaccccccacaagtctgt

SEQ ID NO: 268771 - DNA, 20 bp, human
gcagtcctacagacttgtgg

SEQ ID NO: 268772 - DNA, 20 bp, human
gctaatctgtagtaagctct

SEQ ID NO: 268773 - DNA, 20 bp, human
gaggctcgctaacagccggg

SEQ ID NO: 268774 - DNA, 20 bp, human
ggggttaatgtcgtcaggcg

SEQ ID NO: 268775 - DNA, 20 bp, human
ggccaggctcgctaacagcc

SEQ ID NO: 268776 - DNA, 20 bp, human
gcccccggagtcaaccccgg

SEQ ID NO: 268777 - DNA, 20 bp, human
gcagggcagcggcgtcgcgg

SEQ ID NO: 268778 - DNA, 20 bp, human
gggcggagcggtagtctgta

SEQ ID NO: 268779 - DNA, 20 bp, human
gcggaagtgacgcagggcag

SEQ ID NO: 268780 - DNA, 20 bp, human
ggggaaagacccgtgccagc

SEQ ID NO: 268781 - DNA, 20 bp, human
gcaccaccggggttgactcc

SEQ ID NO: 268782 - DNA, 20 bp, human
ggccacacgcccgctggcac

SEQ ID NO: 268783 - DNA, 20 bp, human
gggtgctgccgcctctgcgc

SEQ ID NO: 268784 - DNA, 20 bp, human
ggggcgtgggttcccggagg

SEQ ID NO: 268785 - DNA, 20 bp, human
gagcggtagtctgtaaggtt

SEQ ID NO: 268786 - DNA, 20 bp, human
gagggcttctttgttgagtc

SEQ ID NO: 268787 - DNA, 20 bp, human
ggggcgatgccgaactgcgg

SEQ ID NO: 268788 - DNA, 20 bp, human
gtcgactgcagagacgaccg

SEQ ID NO: 268789 - DNA, 20 bp, human
gggcctctgctctagcagtc

SEQ ID NO: 268790 - DNA, 20 bp, human
gcgtcaaggctgtgctatga

SEQ ID NO: 268791 - DNA, 20 bp, human
gggccactcacggaggtcga

SEQ ID NO: 268792 - DNA, 20 bp, human
ggctctagcagtcgggattg

SEQ ID NO: 268793 - DNA, 20 bp, human
gtggccccgccccgccctag

SEQ ID NO: 268794 - DNA, 20 bp, human
ggcggggcgatgccgaactg

SEQ ID NO: 268795 - DNA, 20 bp, human
gctgtctttgagtgacgtca

SEQ ID NO: 268796 - DNA, 20 bp, human
ggcgggagcgcagacagagg

SEQ ID NO: 268797 - DNA, 20 bp, human
gtggtcccgccccgccgcga

SEQ ID NO: 268798 - DNA, 20 bp, human
gggggagatcccgagtccga

SEQ ID NO: 268799 - DNA, 20 bp, human
ggcgcgagagctggggtagg

SEQ ID NO: 268800 - DNA, 20 bp, human
gggcgggactgagccggttc

SEQ ID NO: 268801 - DNA, 20 bp, human
gcgcagcactgagcccgaac

SEQ ID NO: 268802 - DNA, 20 bp, human
gcagaactttctagagacgg

SEQ ID NO: 268803 - DNA, 20 bp, human
gtgcacgcggcgcgagagct

SEQ ID NO: 268804 - DNA, 20 bp, human
gggagcgggagcgcagacag

SEQ ID NO: 268805 - DNA, 20 bp, human
ggagcggctcggggagcgat

SEQ ID NO: 268806 - DNA, 20 bp, human
ggggcaagggccagacacgt

SEQ ID NO: 268807 - DNA, 20 bp, human
gcagacacgtgggctggcgt

SEQ ID NO: 268808 - DNA, 20 bp, human
gcgcggccaccaatccggac

SEQ ID NO: 268809 - DNA, 20 bp, human
gcagcccgcgcgccttttgg

SEQ ID NO: 268810 - DNA, 20 bp, human
gggtggaggagcaaatgatg

SEQ ID NO: 268811 - DNA, 20 bp, human
gggctgtcgatccgcctgtc

SEQ ID NO: 268812 - DNA, 20 bp, human
gagccccggggccctatgga

SEQ ID NO: 268813 - DNA, 20 bp, human
ggcaggacccgccttccata

SEQ ID NO: 268814 - DNA, 20 bp, human
gtctctatggcccccacaaa

SEQ ID NO: 268815 - DNA, 20 bp, human
gtcgatccgcctgtccggat

SEQ ID NO: 268816 - DNA, 20 bp, human
ggatgaggcacggacgtggg

SEQ ID NO: 268817 - DNA, 20 bp, human
gtgcgggtcatgatgaggca

SEQ ID NO: 268818 - DNA, 20 bp, human
gcatgatgaggcacggacgt

SEQ ID NO: 268819 - DNA, 20 bp, human
gggaccacgcagggcacgtt

SEQ ID NO: 268820 - DNA, 20 bp, human
ggagcatgatggggcacgcg

SEQ ID NO: 268821 - DNA, 20 bp, human
gggcacgttgggtacgtgca

SEQ ID NO: 268822 - DNA, 20 bp, human
gcacgcgcggtagcgcgagg

SEQ ID NO: 268823 - DNA, 20 bp, human
ggggcacgcgcggtagcgcg

SEQ ID NO: 268824 - DNA, 20 bp, human
gcatcatgacccgcacgcta

SEQ ID NO: 268825 - DNA, 20 bp, human
ggtacccaacgtgccctgcg

SEQ ID NO: 268826 - DNA, 20 bp, human
ggcgccccgtggatgtcccg

SEQ ID NO: 268827 - DNA, 20 bp, human
gaggggttggggccatgaga

SEQ ID NO: 268828 - DNA, 20 bp, human
gctgaggacagccagcccga

SEQ ID NO: 268829 - DNA, 20 bp, human
gcccgctgcgggaggcggag

SEQ ID NO: 268830 - DNA, 20 bp, human
gcgcggttaacgctgtttct

SEQ ID NO: 268831 - DNA, 20 bp, human
gaacgagcagatagatactg

SEQ ID NO: 268832 - DNA, 20 bp, human
gctgggatgtcgtagagtca

SEQ ID NO: 268833 - DNA, 20 bp, human
gcggggcggggccatagatg

SEQ ID NO: 268834 - DNA, 20 bp, human
gacgctgtttctaggccctc

SEQ ID NO: 268835 - DNA, 20 bp, human
gcggccgcgggacatccacg

SEQ ID NO: 268836 - DNA, 20 bp, human
gccgcggggccaagcaggaa

SEQ ID NO: 268837 - DNA, 20 bp, human
gcccgcggggcgttcttaaa

SEQ ID NO: 268838 - DNA, 20 bp, human
gcgaagcctcccggctgctg

SEQ ID NO: 268839 - DNA, 20 bp, human
gctgcatgagccaacgggtg

SEQ ID NO: 268840 - DNA, 20 bp, human
ggaggtgccaacgcccggga

SEQ ID NO: 268841 - DNA, 20 bp, human
ggcgcctcgggaaccaggtt

SEQ ID NO: 268842 - DNA, 20 bp, human
gcggccaatgggcacggcag

SEQ ID NO: 268843 - DNA, 20 bp, human
gtaaagggaccgaagcctcc

SEQ ID NO: 268844 - DNA, 20 bp, human
gcggccgaacctggttcccg

SEQ ID NO: 268845 - DNA, 20 bp, human
gacgccccgcggggccaagc

SEQ ID NO: 268846 - DNA, 20 bp, human
ggtgcgtgccgcagcgggga

SEQ ID NO: 268847 - DNA, 20 bp, human
gtccagtggggaccaagtct

SEQ ID NO: 268848 - DNA, 20 bp, human
ggggaatgtgcgtgccgcag

SEQ ID NO: 268849 - DNA, 20 bp, human
ggatcacagtgtctcgctcg

SEQ ID NO: 268850 - DNA, 20 bp, human
gctggccgcgcgccgagggc

SEQ ID NO: 268851 - DNA, 20 bp, human
gccctctctaggcccagact

SEQ ID NO: 268852 - DNA, 20 bp, human
gcagcctggccgcgcgccga

SEQ ID NO: 268853 - DNA, 20 bp, human
gccctgccccgcccggcatt

SEQ ID NO: 268854 - DNA, 20 bp, human
gaccaaacccggtgtctcca

SEQ ID NO: 268855 - DNA, 20 bp, human
gtccctggagacaccgggtt

SEQ ID NO: 268856 - DNA, 20 bp, human
gtggcctagttcagttgcta

SEQ ID NO: 268857 - DNA, 20 bp, human
gtggagcttcatggttgcgg

SEQ ID NO: 268858 - DNA, 20 bp, human
ggcctggagcttcatggttg

SEQ ID NO: 268859 - DNA, 20 bp, human
gtggcagccaatcgggagaa

SEQ ID NO: 268860 - DNA, 20 bp, human
gcggctgccctctccgcgtg

SEQ ID NO: 268861 - DNA, 20 bp, human
gcagccaatcgggagaaggg

SEQ ID NO: 268862 - DNA, 20 bp, human
ggctaaggcctggagcttca

SEQ ID NO: 268863 - DNA, 20 bp, human
gaggccttagcaactgaact

SEQ ID NO: 268864 - DNA, 20 bp, human
gtcgggagaagggaggaatc

SEQ ID NO: 268865 - DNA, 20 bp, human
ggcggagagggcagccggag

SEQ ID NO: 268866 - DNA, 20 bp, human
ggaccgggacggcccgaggt

SEQ ID NO: 268867 - DNA, 20 bp, human
ggccgcggggctcctgagag

SEQ ID NO: 268868 - DNA, 20 bp, human
ggggctgtgtaaggacccga

SEQ ID NO: 268869 - DNA, 20 bp, human
gggctcgagtcgcctctctc

SEQ ID NO: 268870 - DNA, 20 bp, human
gaggggaggctaagagaact

SEQ ID NO: 268871 - DNA, 20 bp, human
gggaaagagcgggtccagat

SEQ ID NO: 268872 - DNA, 20 bp, human
gcctgagggcactccggggt

SEQ ID NO: 268873 - DNA, 20 bp, human
gaggcgactcgagccctgga

SEQ ID NO: 268874 - DNA, 20 bp, human
gtggacccgctctttcccag

SEQ ID NO: 268875 - DNA, 20 bp, human
gggagggaccacaaccagct

SEQ ID NO: 268876 - DNA, 20 bp, human
gaggatgcgacaagagtcac

SEQ ID NO: 268877 - DNA, 20 bp, human
gtaaaagcgaggaatcgcca

SEQ ID NO: 268878 - DNA, 20 bp, human
ggggctcagtgaacttctgg

SEQ ID NO: 268879 - DNA, 20 bp, human
ggaggctggggctggaccgt

SEQ ID NO: 268880 - DNA, 20 bp, human
gcagtgaacttctggcggtg

SEQ ID NO: 268881 - DNA, 20 bp, human
ggccgccgtcaagtgctgag

SEQ ID NO: 268882 - DNA, 20 bp, human
gacagcggaagatgaactgg

SEQ ID NO: 268883 - DNA, 20 bp, human
gaagagtcacaggaaagccg

SEQ ID NO: 268884 - DNA, 20 bp, human
ggtagagctaggggatagag

SEQ ID NO: 268885 - DNA, 20 bp, human
gggctggcttggttcctgct

SEQ ID NO: 268886 - DNA, 20 bp, human
gcggccctgctcccatccac

SEQ ID NO: 268887 - DNA, 20 bp, human
gcgggcgagaagtgaccacg

SEQ ID NO: 268888 - DNA, 20 bp, human
gagcagggccggattgttat

SEQ ID NO: 268889 - DNA, 20 bp, human
gaggtcccgcccccgaccgt

SEQ ID NO: 268890 - DNA, 20 bp, human
gttagccagtggatgggagc

SEQ ID NO: 268891 - DNA, 20 bp, human
ggcgggacctcgggagttta

SEQ ID NO: 268892 - DNA, 20 bp, human
gggaaaggagccgtagttaa

SEQ ID NO: 268893 - DNA, 20 bp, human
ggacctcgggagtttagggc

SEQ ID NO: 268894 - DNA, 20 bp, human
gtcaggctttagccagtgga

SEQ ID NO: 268895 - DNA, 20 bp, human
gggaccttagcccacggtcg

SEQ ID NO: 268896 - DNA, 20 bp, human
gaaggcgcggcgcccgtggg

SEQ ID NO: 268897 - DNA, 20 bp, human
ggtggaaaagggtaattgtc

SEQ ID NO: 268898 - DNA, 20 bp, human
gggttcagaccgcaccagct

SEQ ID NO: 268899 - DNA, 20 bp, human
gtccgagtcctacaactccg

SEQ ID NO: 268900 - DNA, 20 bp, human
gggcaccggaataggggcgg

SEQ ID NO: 268901 - DNA, 20 bp, human
gccttctccgcgtcacgtga

SEQ ID NO: 268902 - DNA, 20 bp, human
gagacggccgtcacgtgacg

SEQ ID NO: 268903 - DNA, 20 bp, human
gcagaggggggcaccggaat

SEQ ID NO: 268904 - DNA, 20 bp, human
gcaccacccaacactgcggt

SEQ ID NO: 268905 - DNA, 20 bp, human
ggtaccaccacccaacactg

SEQ ID NO: 268906 - DNA, 20 bp, human
ggggaggagccaccctctgt

SEQ ID NO: 268907 - DNA, 20 bp, human
gagggtggctcctccctgca

SEQ ID NO: 268908 - DNA, 20 bp, human
gtcttctagagacaaggatc

SEQ ID NO: 268909 - DNA, 20 bp, human
ggaagctgggaagtaaacac

SEQ ID NO: 268910 - DNA, 20 bp, human
gcaggttgctggagaaatag

SEQ ID NO: 268911 - DNA, 20 bp, human
gcatggggcctgctataaaa

SEQ ID NO: 268912 - DNA, 20 bp, human
ggatgagtacgtgaggaagc

SEQ ID NO: 268913 - DNA, 20 bp, human
gttatagcaggccccatgca

SEQ ID NO: 268914 - DNA, 20 bp, human
gatatgggtggatctaggtt

SEQ ID NO: 268915 - DNA, 20 bp, human
ggaatcagaccatcccacag

SEQ ID NO: 268916 - DNA, 20 bp, human
ggaggaaggtaaatatgtag

SEQ ID NO: 268917 - DNA, 20 bp, human
gagagtgtaagatacttgga

SEQ ID NO: 268918 - DNA, 20 bp, human
gtgtcctcgtactggaaggt

SEQ ID NO: 268919 - DNA, 20 bp, human
gtgcaaccatgtcctcgtac

SEQ ID NO: 268920 - DNA, 20 bp, human
gtagcagagtgtaagatact

SEQ ID NO: 268921 - DNA, 20 bp, human
ggtagataacaatgtgaagg

SEQ ID NO: 268922 - DNA, 20 bp, human
gtctacagatgattgcagaa

SEQ ID NO: 268923 - DNA, 20 bp, human
gagccccaccttccagtacg

SEQ ID NO: 268924 - DNA, 20 bp, human
gaccatgtcctcgtactgga

SEQ ID NO: 268925 - DNA, 20 bp, human
ggcaagataccttttttttc

SEQ ID NO: 268926 - DNA, 20 bp, human
gggggggggagggaagacga

SEQ ID NO: 268927 - DNA, 20 bp, human
gaaagcaggaccagcagggg

SEQ ID NO: 268928 - DNA, 20 bp, human
gtggaccccgtcattgttcc

SEQ ID NO: 268929 - DNA, 20 bp, human
gcgaaaagcaggaccagcag

SEQ ID NO: 268930 - DNA, 20 bp, human
ggcagcgcatgaatgtgtct

SEQ ID NO: 268931 - DNA, 20 bp, human
gacacaggatacttgctcct

SEQ ID NO: 268932 - DNA, 20 bp, human
gggggtagggggggtatgga

SEQ ID NO: 268933 - DNA, 20 bp, human
ggtaacccagcgcctactgc

SEQ ID NO: 268934 - DNA, 20 bp, human
gacgcggcagactcccagag

SEQ ID NO: 268935 - DNA, 20 bp, human
gatggagggagagttggcta

SEQ ID NO: 268936 - DNA, 20 bp, human
ggtgacggtgcctcgaccag

SEQ ID NO: 268937 - DNA, 20 bp, human
ggaggtttagaatctctctg

SEQ ID NO: 268938 - DNA, 20 bp, human
gagattctaaacctcggccc

SEQ ID NO: 268939 - DNA, 20 bp, human
ggcattccgcggggaagtgt

SEQ ID NO: 268940 - DNA, 20 bp, human
gcccagggcaggggccgtaa

SEQ ID NO: 268941 - DNA, 20 bp, human
gcggaggcaccaaggagtgc

SEQ ID NO: 268942 - DNA, 20 bp, human
gcgcgcccgccgcattccgc

SEQ ID NO: 268943 - DNA, 20 bp, human
gcctccaactccagcacagg

SEQ ID NO: 268944 - DNA, 20 bp, human
ggggcgcgggcgggttaaag

SEQ ID NO: 268945 - DNA, 20 bp, human
gcctcgaccagcggccgtta

SEQ ID NO: 268946 - DNA, 20 bp, human
ggaagcgcgccgagggggat

SEQ ID NO: 268947 - DNA, 20 bp, human
ggaggaacccagatagtcaa

SEQ ID NO: 268948 - DNA, 20 bp, human
gaacccagatagtcaacggt

SEQ ID NO: 268949 - DNA, 20 bp, human
gtcccaaccgttgactatct

SEQ ID NO: 268950 - DNA, 20 bp, human
gtcggggcaggtgtatgtgt

SEQ ID NO: 268951 - DNA, 20 bp, human
gctctcccgcccgcggccga

SEQ ID NO: 268952 - DNA, 20 bp, human
gatagtcaacggttgggact

SEQ ID NO: 268953 - DNA, 20 bp, human
gccggcggaagcgcgccgag

SEQ ID NO: 268954 - DNA, 20 bp, human
gaagcgcgctttggagagaa

SEQ ID NO: 268955 - DNA, 20 bp, human
gcgggggcgcgcgctcgatc

SEQ ID NO: 268956 - DNA, 20 bp, human
ggaaatcagacgttatcaga

SEQ ID NO: 268957 - DNA, 20 bp, human
gggcataatagttagccgtt

SEQ ID NO: 268958 - DNA, 20 bp, human
gaaacttcgctttcagcgtc

SEQ ID NO: 268959 - DNA, 20 bp, human
gaatagttagccgtttggca

SEQ ID NO: 268960 - DNA, 20 bp, human
gagcacgttttccttgtatg

SEQ ID NO: 268961 - DNA, 20 bp, human
gaaagaaaaaaattctcgac

SEQ ID NO: 268962 - DNA, 20 bp, human
ggtcttcaaaaaggccaacc

SEQ ID NO: 268963 - DNA, 20 bp, human
ggtgctagctggatttcttt

SEQ ID NO: 268964 - DNA, 20 bp, human
gagctagcacgccgcataca

SEQ ID NO: 268965 - DNA, 20 bp, human
ggtgtgctatccatgccaaa

SEQ ID NO: 268966 - DNA, 20 bp, human
gcgcctccctgccaaggtag

SEQ ID NO: 268967 - DNA, 20 bp, human
gcgggcgcagctggcgcggt

SEQ ID NO: 268968 - DNA, 20 bp, human
gcgcccgggcgcagctggcg

SEQ ID NO: 268969 - DNA, 20 bp, human
gcggcgcacaccagagtacg

SEQ ID NO: 268970 - DNA, 20 bp, human
gcccgcggggcggacgcgtc

SEQ ID NO: 268971 - DNA, 20 bp, human
gctcgcgccggggcccccgc

SEQ ID NO: 268972 - DNA, 20 bp, human
gcagagtacggggcacgtcg

SEQ ID NO: 268973 - DNA, 20 bp, human
gcgcggcccctaccttggca

SEQ ID NO: 268974 - DNA, 20 bp, human
gaggtgaagccgagcgcccg

SEQ ID NO: 268975 - DNA, 20 bp, human
gtgtgctgatgagacaatag

SEQ ID NO: 268976 - DNA, 20 bp, human
gtccctggctcctgtcactg

SEQ ID NO: 268977 - DNA, 20 bp, human
gcagtgtgagagcagattgg

SEQ ID NO: 268978 - DNA, 20 bp, human
gaccctatgccccccaagtt

SEQ ID NO: 268979 - DNA, 20 bp, human
ggcaggggaaagctaaactg

SEQ ID NO: 268980 - DNA, 20 bp, human
gcactgcactcctcagtgac

SEQ ID NO: 268981 - DNA, 20 bp, human
gtgccaaacttggggggcat

SEQ ID NO: 268982 - DNA, 20 bp, human
ggtgcagtgtgagagcagat

SEQ ID NO: 268983 - DNA, 20 bp, human
gggtcactgaattgaaaaag

SEQ ID NO: 268984 - DNA, 20 bp, human
gactctggacagcaggagag

SEQ ID NO: 268985 - DNA, 20 bp, human
gagttagtgcacaccactgg

SEQ ID NO: 268986 - DNA, 20 bp, human
gagctccagcgctaccccta

SEQ ID NO: 268987 - DNA, 20 bp, human
gggagctgggcttggatcag

SEQ ID NO: 268988 - DNA, 20 bp, human
gggcggctcgcattactcta

SEQ ID NO: 268989 - DNA, 20 bp, human
gagagtctgggaatagggag

SEQ ID NO: 268990 - DNA, 20 bp, human
ggggtagcgctggagctcct

SEQ ID NO: 268991 - DNA, 20 bp, human
gcgctacccctagggaaact

SEQ ID NO: 268992 - DNA, 20 bp, human
ggaccagcaggaacctggct

SEQ ID NO: 268993 - DNA, 20 bp, human
gtctctgagagtctgggaat

SEQ ID NO: 268994 - DNA, 20 bp, human
gtccatccccagtttcccta

SEQ ID NO: 268995 - DNA, 20 bp, human
ggtaatgcgagccgcctgcc

SEQ ID NO: 268996 - DNA, 20 bp, human
gctgatcagacgcgaaaccc

SEQ ID NO: 268997 - DNA, 20 bp, human
gcgtctgatcagccgaaccc

SEQ ID NO: 268998 - DNA, 20 bp, human
gccctcctcccgcatttaaa

SEQ ID NO: 268999 - DNA, 20 bp, human
gcccactaggcccccgggtt

SEQ ID NO: 269000 - DNA, 20 bp, human
gagagcgagccctttaaatg

SEQ ID NO: 269001 - DNA, 20 bp, human
gggcattccaacgggcgggg

SEQ ID NO: 269002 - DNA, 20 bp, human
ggggggcattccaacgggcg

SEQ ID NO: 269003 - DNA, 20 bp, human
gggtgctgcagcctcggcga

SEQ ID NO: 269004 - DNA, 20 bp, human
gctagtgggggcattccaac

SEQ ID NO: 269005 - DNA, 20 bp, human
gttgaggcgcgagaagccgg

SEQ ID NO: 269006 - DNA, 20 bp, human
gcccaggaactcccgcggga

SEQ ID NO: 269007 - DNA, 20 bp, human
ggaatcacccggtcagcccc

SEQ ID NO: 269008 - DNA, 20 bp, human
gtagggctgcctgaatcacc

SEQ ID NO: 269009 - DNA, 20 bp, human
gaggcccgacccattctgtc

SEQ ID NO: 269010 - DNA, 20 bp, human
gcagtggggcgcagtgcctg

SEQ ID NO: 269011 - DNA, 20 bp, human
gaccaccccagcaggatgta

SEQ ID NO: 269012 - DNA, 20 bp, human
ggggtggtgggcttcgagcg

SEQ ID NO: 269013 - DNA, 20 bp, human
gctgcgccccactgcgtcct

SEQ ID NO: 269014 - DNA, 20 bp, human
gcccgcgggtccccccaccc

SEQ ID NO: 269015 - DNA, 20 bp, human
ggctgggagccggacagaat

SEQ ID NO: 269016 - DNA, 20 bp, human
ggcctcccaggaatgccgcc

SEQ ID NO: 269017 - DNA, 20 bp, human
gggtgtggatggagaactgt

SEQ ID NO: 269018 - DNA, 20 bp, human
gagcccgtgcggggtgtgga

SEQ ID NO: 269019 - DNA, 20 bp, human
ggttgagggcgcccaccccc

SEQ ID NO: 269020 - DNA, 20 bp, human
gtacctcttcagcccgtgcg

SEQ ID NO: 269021 - DNA, 20 bp, human
gggtgggggccgcgccgcac

SEQ ID NO: 269022 - DNA, 20 bp, human
gaaactgaggccagtgatta

SEQ ID NO: 269023 - DNA, 20 bp, human
gacgggctgaagaggtaaat

SEQ ID NO: 269024 - DNA, 20 bp, human
gcgctctgacgtggacccgg

SEQ ID NO: 269025 - DNA, 20 bp, human
gaccttgcccgggccaatga

SEQ ID NO: 269026 - DNA, 20 bp, human
gtcaagaagggcggtgactg

SEQ ID NO: 269027 - DNA, 20 bp, human
ggggattcccggctcaagaa

SEQ ID NO: 269028 - DNA, 20 bp, human
ggggctgcctggttagcccg

SEQ ID NO: 269029 - DNA, 20 bp, human
gattcccggctcaagaaggg

SEQ ID NO: 269030 - DNA, 20 bp, human
gacgccagggtgccaggcgg

SEQ ID NO: 269031 - DNA, 20 bp, human
gacgctccgcccccgggtga

SEQ ID NO: 269032 - DNA, 20 bp, human
ggcggcgtgggcgggattcc

SEQ ID NO: 269033 - DNA, 20 bp, human
gctgccgcagcaacggggtg

SEQ ID NO: 269034 - DNA, 20 bp, human
ggcagcaacggggtgcggca

SEQ ID NO: 269035 - DNA, 20 bp, human
gccgaggcggggcgaagtgg

SEQ ID NO: 269036 - DNA, 20 bp, human
gggagtgagcgcagcttcgg

SEQ ID NO: 269037 - DNA, 20 bp, human
ggcaggagtgagcgcagctt

SEQ ID NO: 269038 - DNA, 20 bp, human
gaggtgccccatgggagtaa

SEQ ID NO: 269039 - DNA, 20 bp, human
ggggccgactgccgtaagat

SEQ ID NO: 269040 - DNA, 20 bp, human
gcccgccggaagtgtggcgg

SEQ ID NO: 269041 - DNA, 20 bp, human
gggagtaaggggacgccttc

SEQ ID NO: 269042 - DNA, 20 bp, human
ggcctgggatctgaacccaa

SEQ ID NO: 269043 - DNA, 20 bp, human
gggggccggcgcgttgaggc

SEQ ID NO: 269044 - DNA, 20 bp, human
gcactcctgcctcaacgcgc

SEQ ID NO: 269045 - DNA, 20 bp, human
ggccctggcctcagaccctt

SEQ ID NO: 269046 - DNA, 20 bp, human
gactcaggctgtgtctccgg

SEQ ID NO: 269047 - DNA, 20 bp, human
gaacatctgaactcctcagc

SEQ ID NO: 269048 - DNA, 20 bp, human
gagttcagatgttcatggtg

SEQ ID NO: 269049 - DNA, 20 bp, human
ggaactcctcagcggggtaa

SEQ ID NO: 269050 - DNA, 20 bp, human
gagagagtgttcttgcatga

SEQ ID NO: 269051 - DNA, 20 bp, human
gcaaggaaacctctacaaac

SEQ ID NO: 269052 - DNA, 20 bp, human
gtacggtccctcatgtctct

SEQ ID NO: 269053 - DNA, 20 bp, human
gtgaggagttcagatgttca

SEQ ID NO: 269054 - DNA, 20 bp, human
ggagcagccaagcaggactg

SEQ ID NO: 269055 - DNA, 20 bp, human
gagacatgagggaccgtact

SEQ ID NO: 269056 - DNA, 20 bp, human
gaaaagcagcatactgtctc

SEQ ID NO: 269057 - DNA, 20 bp, human
ggtggcaagacgcccgtggc

SEQ ID NO: 269058 - DNA, 20 bp, human
gtgaacaaagctctcgcccc

SEQ ID NO: 269059 - DNA, 20 bp, human
gggcaaaaaatagactccga

SEQ ID NO: 269060 - DNA, 20 bp, human
ggcggagagcagagaagtaa

SEQ ID NO: 269061 - DNA, 20 bp, human
gactaggaaaccgcaggcag

SEQ ID NO: 269062 - DNA, 20 bp, human
gtgacactccctagagaagc

SEQ ID NO: 269063 - DNA, 20 bp, human
gagagaagctgggatcgact

SEQ ID NO: 269064 - DNA, 20 bp, human
gtagacagcaacacacccac

SEQ ID NO: 269065 - DNA, 20 bp, human
gttccagcgcccaagattca

SEQ ID NO: 269066 - DNA, 20 bp, human
gcctcgcagtggctgaagaa

SEQ ID NO: 269067 - DNA, 20 bp, human
gagctttgcaaacgctagag

SEQ ID NO: 269068 - DNA, 20 bp, human
gccaaagctaggatgccatt

SEQ ID NO: 269069 - DNA, 20 bp, human
gtcttgttcagtgaggtaac

SEQ ID NO: 269070 - DNA, 20 bp, human
ggggctgcctacaaaccaaa

SEQ ID NO: 269071 - DNA, 20 bp, human
gaagggggtgatgtcataga

SEQ ID NO: 269072 - DNA, 20 bp, human
gggtgatgtcatagatgggc

SEQ ID NO: 269073 - DNA, 20 bp, human
gacctcactgaacaagatct

SEQ ID NO: 269074 - DNA, 20 bp, human
gtgggctgtgtgcagtaaac

SEQ ID NO: 269075 - DNA, 20 bp, human
gaaaatgttgagattccaaa

SEQ ID NO: 269076 - DNA, 20 bp, human
gtccctgcggctacggagag

SEQ ID NO: 269077 - DNA, 20 bp, human
ggacgagggcgggtggcccg

SEQ ID NO: 269078 - DNA, 20 bp, human
ggctcgcttccctgcggcta

SEQ ID NO: 269079 - DNA, 20 bp, human
ggggcgggggccgacgaggg

SEQ ID NO: 269080 - DNA, 20 bp, human
ggggcaagggcaagagggcg

SEQ ID NO: 269081 - DNA, 20 bp, human
gagaggggcgggggccgacg

SEQ ID NO: 269082 - DNA, 20 bp, human
ggccgcagggaagcgagcct

SEQ ID NO: 269083 - DNA, 20 bp, human
gagctgagtaagccgggtgg

SEQ ID NO: 269084 - DNA, 20 bp, human
gaggcgcggccagcttccct

SEQ ID NO: 269085 - DNA, 20 bp, human
gggccgcccgaaactgggga

SEQ ID NO: 269086 - DNA, 20 bp, human
gcacaggctgcggaccgcgg

SEQ ID NO: 269087 - DNA, 20 bp, human
ggtccgcagcctgtgctcgg

SEQ ID NO: 269088 - DNA, 20 bp, human
gcggaccgcggcgggcacgt

SEQ ID NO: 269089 - DNA, 20 bp, human
gccccggggctccccgactg

SEQ ID NO: 269090 - DNA, 20 bp, human
gaggcgggagcggagaggtt

SEQ ID NO: 269091 - DNA, 20 bp, human
gacagagttcggggactcac

SEQ ID NO: 269092 - DNA, 20 bp, human
gcgactgcggcggggaagat

SEQ ID NO: 269093 - DNA, 20 bp, human
gaaccctctccccagaggca

SEQ ID NO: 269094 - DNA, 20 bp, human
ggcactaggagggtggtttg

SEQ ID NO: 269095 - DNA, 20 bp, human
ggatccaaacgacagagttc

SEQ ID NO: 269096 - DNA, 20 bp, human
gtaacctggggagggttctg

SEQ ID NO: 269097 - DNA, 20 bp, human
gcaccaggcttgccccagtt

SEQ ID NO: 269098 - DNA, 20 bp, human
gcgggtccctaacctgggga

SEQ ID NO: 269099 - DNA, 20 bp, human
gcggccgcctctcaccacca

SEQ ID NO: 269100 - DNA, 20 bp, human
gacgtcgaggttcttagaag

SEQ ID NO: 269101 - DNA, 20 bp, human
gtggactctaggtccccaag

SEQ ID NO: 269102 - DNA, 20 bp, human
ggggcagacgcaggaagcct

SEQ ID NO: 269103 - DNA, 20 bp, human
gccttggcggggcaaagttg

SEQ ID NO: 269104 - DNA, 20 bp, human
gctcccgcgtcccattgatg

SEQ ID NO: 269105 - DNA, 20 bp, human
gggtccccactcctggggca

SEQ ID NO: 269106 - DNA, 20 bp, human
ggggacgcgggtaacgcaga

SEQ ID NO: 269107 - DNA, 20 bp, human
gcgcccggagccgcccagga

SEQ ID NO: 269108 - DNA, 20 bp, human
gagggtccgggccccctcct

SEQ ID NO: 269109 - DNA, 20 bp, human
gcaccaggctccatcacctc

SEQ ID NO: 269110 - DNA, 20 bp, human
gacggtctcgcgatgcgctc

SEQ ID NO: 269111 - DNA, 20 bp, human
gttacccgcgtccccgcgcc

SEQ ID NO: 269112 - DNA, 20 bp, human
gcgctccgcaccacagggtc

SEQ ID NO: 269113 - DNA, 20 bp, human
gcagcccgccgcggggcgtc

SEQ ID NO: 269114 - DNA, 20 bp, human
gcggggagcggcctgaatcc

SEQ ID NO: 269115 - DNA, 20 bp, human
gagtgcgcgctccgcaccac

SEQ ID NO: 269116 - DNA, 20 bp, human
gaccgggcgagaacttcggg

SEQ ID NO: 269117 - DNA, 20 bp, human
ggagccagtcggggagctac

SEQ ID NO: 269118 - DNA, 20 bp, human
gagctaccgggcgagaactt

SEQ ID NO: 269119 - DNA, 20 bp, human
gtccggcgcgagagccagtc

SEQ ID NO: 269120 - DNA, 20 bp, human
ggcctcccgaagttctcgcc

SEQ ID NO: 269121 - DNA, 20 bp, human
gtggctctcgcgccggacaa

SEQ ID NO: 269122 - DNA, 20 bp, human
ggacgcgcgactctaggggc

SEQ ID NO: 269123 - DNA, 20 bp, human
gcccgggccatgcatccttc

SEQ ID NO: 269124 - DNA, 20 bp, human
ggcaggacgcgcgactctag

SEQ ID NO: 269125 - DNA, 20 bp, human
ggccatgcatccttccgggc

SEQ ID NO: 269126 - DNA, 20 bp, human
gcggaggaccgggctcgaga

SEQ ID NO: 269127 - DNA, 20 bp, human
ggcccgggagaggactctgc

SEQ ID NO: 269128 - DNA, 20 bp, human
gcgagaaggcaagagacact

SEQ ID NO: 269129 - DNA, 20 bp, human
gcgggtggcaaatgaatatg

SEQ ID NO: 269130 - DNA, 20 bp, human
gcggtcacgtgtgcccgact

SEQ ID NO: 269131 - DNA, 20 bp, human
gaagaagccaggcaggacgg

SEQ ID NO: 269132 - DNA, 20 bp, human
gggcaagagacactgggtcg

SEQ ID NO: 269133 - DNA, 20 bp, human
gcatggcgcccggggcgtgg

SEQ ID NO: 269134 - DNA, 20 bp, human
ggcaaagggtgggggttaac

SEQ ID NO: 269135 - DNA, 20 bp, human
ggcccgcagagtcctctccc

SEQ ID NO: 269136 - DNA, 20 bp, human
ggggccatcccgagattgga

SEQ ID NO: 269137 - DNA, 20 bp, human
gggggcggggacgtaactca

SEQ ID NO: 269138 - DNA, 20 bp, human
ggggacgtaactcacggaaa

SEQ ID NO: 269139 - DNA, 20 bp, human
ggacgccgccgtccaatctc

SEQ ID NO: 269140 - DNA, 20 bp, human
gaccgcgcggcccgttcctt

SEQ ID NO: 269141 - DNA, 20 bp, human
ggctccgggtcttccctgcg

SEQ ID NO: 269142 - DNA, 20 bp, human
gcggagcagcggtttaccta

SEQ ID NO: 269143 - DNA, 20 bp, human
ggcgccgcgcagggaagacc

SEQ ID NO: 269144 - DNA, 20 bp, human
gccatcccgagattggacgg

SEQ ID NO: 269145 - DNA, 20 bp, human
ggcctggcctgtcagcgcat

SEQ ID NO: 269146 - DNA, 20 bp, human
ggggacctgcggcctggatc

SEQ ID NO: 269147 - DNA, 20 bp, human
gcctccgcgtcttgcccgtg

SEQ ID NO: 269148 - DNA, 20 bp, human
gcggggccaaaattcagtaa

SEQ ID NO: 269149 - DNA, 20 bp, human
gctggcgtccggccaatcgg

SEQ ID NO: 269150 - DNA, 20 bp, human
gccaggccgcaggtcccccg

SEQ ID NO: 269151 - DNA, 20 bp, human
ggggctaaactaatagacga

SEQ ID NO: 269152 - DNA, 20 bp, human
ggggctggaccaatgggcag

SEQ ID NO: 269153 - DNA, 20 bp, human
ggcggcgtagagctggcgtc

SEQ ID NO: 269154 - DNA, 20 bp, human
gagccggagtcaaatccgtg

SEQ ID NO: 269155 - DNA, 20 bp, human
ggacggcgacactcaatccc

SEQ ID NO: 269156 - DNA, 20 bp, human
ggagctcctcgtgaagtcct

SEQ ID NO: 269157 - DNA, 20 bp, human
ggcaacaggacccgggagtc

SEQ ID NO: 269158 - DNA, 20 bp, human
gggcaactgtgaaaaatctg

SEQ ID NO: 269159 - DNA, 20 bp, human
gcccaggccggcggttctcc

SEQ ID NO: 269160 - DNA, 20 bp, human
gcggctgacagcctgactcc

SEQ ID NO: 269161 - DNA, 20 bp, human
gtggcattcaacttcctcat

SEQ ID NO: 269162 - DNA, 20 bp, human
gccttactacacacggacca

SEQ ID NO: 269163 - DNA, 20 bp, human
gcctcgtgaagtcctgggtt

SEQ ID NO: 269164 - DNA, 20 bp, human
ggtcctgggttgggattaca

SEQ ID NO: 269165 - DNA, 20 bp, human
ggtagtaaggtgcgcagcct

SEQ ID NO: 269166 - DNA, 20 bp, human
ggcggctcctcgctgaacct

SEQ ID NO: 269167 - DNA, 20 bp, human
ggctgcgcagaacgcagctc

SEQ ID NO: 269168 - DNA, 20 bp, human
gttccagctgacgatctctt

SEQ ID NO: 269169 - DNA, 20 bp, human
ggttcagcgaggagccgcgc

SEQ ID NO: 269170 - DNA, 20 bp, human
gttcgcgcccaggttcagcg

SEQ ID NO: 269171 - DNA, 20 bp, human
gacaatgcattcgattcgca

SEQ ID NO: 269172 - DNA, 20 bp, human
gagacagggggttgtgtatg

SEQ ID NO: 269173 - DNA, 20 bp, human
gctgacgatctcttcggtcg

SEQ ID NO: 269174 - DNA, 20 bp, human
gagagcgcggcgcccaccaa

SEQ ID NO: 269175 - DNA, 20 bp, human
gcggctgcggctgcggctag

SEQ ID NO: 269176 - DNA, 20 bp, human
ggggacccccgcaaccatgg

SEQ ID NO: 269177 - DNA, 20 bp, human
gcggcggcggcggcgaactg

SEQ ID NO: 269178 - DNA, 20 bp, human
gcctcggtggcctcccgctc

SEQ ID NO: 269179 - DNA, 20 bp, human
gtgaaggggatcacggcctg

SEQ ID NO: 269180 - DNA, 20 bp, human
ggcgccggccgccccctctg

SEQ ID NO: 269181 - DNA, 20 bp, human
gcccaggggggcgggctgga

SEQ ID NO: 269182 - DNA, 20 bp, human
gtccccgcccgccatggttg

SEQ ID NO: 269183 - DNA, 20 bp, human
gaccatggcgggcggggagt

SEQ ID NO: 269184 - DNA, 20 bp, human
gtcccgctcgcctcgggcga

SEQ ID NO: 269185 - DNA, 20 bp, human
gcgaggcgagcgggaggatg

SEQ ID NO: 269186 - DNA, 20 bp, human
gcgagaggtggcattgtgta

SEQ ID NO: 269187 - DNA, 20 bp, human
gtttctgcgcgcggacactt

SEQ ID NO: 269188 - DNA, 20 bp, human
ggctgcaaatggtcccaacc

SEQ ID NO: 269189 - DNA, 20 bp, human
gcggcctggcgctctagagc

SEQ ID NO: 269190 - DNA, 20 bp, human
gctagagcgccaggccgggt

SEQ ID NO: 269191 - DNA, 20 bp, human
gtggcgctctagagcaggcg

SEQ ID NO: 269192 - DNA, 20 bp, human
gtacgcgtcccggcagtccg

SEQ ID NO: 269193 - DNA, 20 bp, human
gcactcgccccgcggactgc

SEQ ID NO: 269194 - DNA, 20 bp, human
gtaggcgggtctgaccatga

SEQ ID NO: 269195 - DNA, 20 bp, human
gaccctcctcaccccaacag

SEQ ID NO: 269196 - DNA, 20 bp, human
ggcgtcgcgcgggctgcagt

SEQ ID NO: 269197 - DNA, 20 bp, human
ggggaagcccgagtctcggc

SEQ ID NO: 269198 - DNA, 20 bp, human
ggaggaagcgaggttggcgg

SEQ ID NO: 269199 - DNA, 20 bp, human
gccacacccggccgagactc

SEQ ID NO: 269200 - DNA, 20 bp, human
gcgtcaatcgggcgcaggtg

SEQ ID NO: 269201 - DNA, 20 bp, human
gaatggggcgcgcgtcgcgc

SEQ ID NO: 269202 - DNA, 20 bp, human
gctgcagtcggcgctcgcgg

SEQ ID NO: 269203 - DNA, 20 bp, human
gaaccgcggtgattcgatgc

SEQ ID NO: 269204 - DNA, 20 bp, human
gcccggcacgaggccgtcaa

SEQ ID NO: 269205 - DNA, 20 bp, human
gtcccgcccagaggcctcac

SEQ ID NO: 269206 - DNA, 20 bp, human
gcttgggaatcacaagtcct

SEQ ID NO: 269207 - DNA, 20 bp, human
gacagactataaactaagtt

SEQ ID NO: 269208 - DNA, 20 bp, human
gtaaaataggcatgatcgag

SEQ ID NO: 269209 - DNA, 20 bp, human
gaatgcaacagcgaaatgct

SEQ ID NO: 269210 - DNA, 20 bp, human
gaccacagattcacttttaa

SEQ ID NO: 269211 - DNA, 20 bp, human
ggaacgcaatactcgaaccc

SEQ ID NO: 269212 - DNA, 20 bp, human
ggctgattgcccaagcactt

SEQ ID NO: 269213 - DNA, 20 bp, human
gatgggaggagtctgatctt

SEQ ID NO: 269214 - DNA, 20 bp, human
gataaacaacggctaacctt

SEQ ID NO: 269215 - DNA, 20 bp, human
ggcccttaaaagtgaatctg

SEQ ID NO: 269216 - DNA, 20 bp, human
gagtcctagaattaggcaag

SEQ ID NO: 269217 - DNA, 20 bp, human
gtcagctggaagaatgctgg

SEQ ID NO: 269218 - DNA, 20 bp, human
gtgtgtatgtatctacaaat

SEQ ID NO: 269219 - DNA, 20 bp, human
gcatatagggataaataaca

SEQ ID NO: 269220 - DNA, 20 bp, human
gggactcctaactaagtctt

SEQ ID NO: 269221 - DNA, 20 bp, human
gggtggctgtgagaaatggg

SEQ ID NO: 269222 - DNA, 20 bp, human
gcgtttttaagagttggagg

SEQ ID NO: 269223 - DNA, 20 bp, human
gaagtctttggagtttcagc

SEQ ID NO: 269224 - DNA, 20 bp, human
gtctggcagattaccatgcc

SEQ ID NO: 269225 - DNA, 20 bp, human
gtgcagttaagcactatttc

SEQ ID NO: 269226 - DNA, 20 bp, human
gccaaccctctgtgatggat

SEQ ID NO: 269227 - DNA, 20 bp, human
gactgtaggccagtctccca

SEQ ID NO: 269228 - DNA, 20 bp, human
gacacgccaaccctctgtga

SEQ ID NO: 269229 - DNA, 20 bp, human
gcagtcccatccatcacaga

SEQ ID NO: 269230 - DNA, 20 bp, human
ggtagaaactgggtggccat

SEQ ID NO: 269231 - DNA, 20 bp, human
gctgggtggccatgggagac

SEQ ID NO: 269232 - DNA, 20 bp, human
gaggaaaagtagaaactggg

SEQ ID NO: 269233 - DNA, 20 bp, human
ggagaaactacttgactccc

SEQ ID NO: 269234 - DNA, 20 bp, human
ggcgtgtgctcacccattca

SEQ ID NO: 269235 - DNA, 20 bp, human
ggaccccaaaattccaagac

SEQ ID NO: 269236 - DNA, 20 bp, human
ggtaatccaagcaagagtca

SEQ ID NO: 269237 - DNA, 20 bp, human
gagaactatgacgttgagga

SEQ ID NO: 269238 - DNA, 20 bp, human
gccgccctcccttaagatca

SEQ ID NO: 269239 - DNA, 20 bp, human
gtggcaaagccctaaagcta

SEQ ID NO: 269240 - DNA, 20 bp, human
gtatgacgttgaggagggtg

SEQ ID NO: 269241 - DNA, 20 bp, human
gtgtgcttcccatagcttta

SEQ ID NO: 269242 - DNA, 20 bp, human
gatcttaagggagggcggaa

SEQ ID NO: 269243 - DNA, 20 bp, human
ggatacttccgtgatcttaa

SEQ ID NO: 269244 - DNA, 20 bp, human
gcgccctctacagactataa

SEQ ID NO: 269245 - DNA, 20 bp, human
gttgccattatagtctgtag

SEQ ID NO: 269246 - DNA, 20 bp, human
ggggagtggtccctgaaagg

SEQ ID NO: 269247 - DNA, 20 bp, human
gcactcccccgcccactcag

SEQ ID NO: 269248 - DNA, 20 bp, human
gagaatgggtgccgctgagt

SEQ ID NO: 269249 - DNA, 20 bp, human
gcagcgagagccaacgggga

SEQ ID NO: 269250 - DNA, 20 bp, human
gctcgatgggaataaaacgt

SEQ ID NO: 269251 - DNA, 20 bp, human
ggcagaagcgagcacagacg

SEQ ID NO: 269252 - DNA, 20 bp, human
gccatcgagggagggagaat

SEQ ID NO: 269253 - DNA, 20 bp, human
gcgggggagtggtccctgaa

SEQ ID NO: 269254 - DNA, 20 bp, human
ggcgagcacagacggggcta

SEQ ID NO: 269255 - DNA, 20 bp, human
gttttattcccatcgaggga

SEQ ID NO: 269256 - DNA, 20 bp, human
gcagggctgccaatgtttca

SEQ ID NO: 269257 - DNA, 20 bp, human
ggcggaccgaaggatttgcg

SEQ ID NO: 269258 - DNA, 20 bp, human
ggctctctggagggacatgt

SEQ ID NO: 269259 - DNA, 20 bp, human
gatagcgtcaggcggaccga

SEQ ID NO: 269260 - DNA, 20 bp, human
gttggggcgggaccctggtc

SEQ ID NO: 269261 - DNA, 20 bp, human
gtcatcaggctagtggataa

SEQ ID NO: 269262 - DNA, 20 bp, human
gggctgaggaacccggatcc

SEQ ID NO: 269263 - DNA, 20 bp, human
ggaaaaggggctgaggaacc

SEQ ID NO: 269264 - DNA, 20 bp, human
gcgggaccctggtctggcac

SEQ ID NO: 269265 - DNA, 20 bp, human
gactgtacaaataacttcta

SEQ ID NO: 269266 - DNA, 20 bp, human
gcatgcgcgctgctgggaac

SEQ ID NO: 269267 - DNA, 20 bp, human
gcacttgaagagagagggcg

SEQ ID NO: 269268 - DNA, 20 bp, human
gcgtgcgcgggcttggtgga

SEQ ID NO: 269269 - DNA, 20 bp, human
gcgctgctgggaaccggccg

SEQ ID NO: 269270 - DNA, 20 bp, human
gcaggccacttgaagagaga

SEQ ID NO: 269271 - DNA, 20 bp, human
ggggaaccggccggggtgcc

SEQ ID NO: 269272 - DNA, 20 bp, human
gaaggctgaagggcggtgac

SEQ ID NO: 269273 - DNA, 20 bp, human
ggaggtgcactcagtggcgt

SEQ ID NO: 269274 - DNA, 20 bp, human
gttcgacccggcaccccggc

SEQ ID NO: 269275 - DNA, 20 bp, human
gtacacccgcagcgggccgg

SEQ ID NO: 269276 - DNA, 20 bp, human
gcgtgactcagaagccaata

SEQ ID NO: 269277 - DNA, 20 bp, human
gcacgtggttataagggtct

SEQ ID NO: 269278 - DNA, 20 bp, human
gagttggcacatgccacgcg

SEQ ID NO: 269279 - DNA, 20 bp, human
ggcagaagacgtcatcgtga

SEQ ID NO: 269280 - DNA, 20 bp, human
gactggccacgtggttataa

SEQ ID NO: 269281 - DNA, 20 bp, human
gtagggcagtggccctcgcg

SEQ ID NO: 269282 - DNA, 20 bp, human
gtaaccacgtggccagtggt

SEQ ID NO: 269283 - DNA, 20 bp, human
gcttgtggaacaagtgaacg

SEQ ID NO: 269284 - DNA, 20 bp, human
ggtgggggtgcaccaaccac

SEQ ID NO: 269285 - DNA, 20 bp, human
gaacaagtgaacggggcttc

SEQ ID NO: 269286 - DNA, 20 bp, human
ggctccgggtgacgtcacgg

SEQ ID NO: 269287 - DNA, 20 bp, human
gcgccgattggcccgggctc

SEQ ID NO: 269288 - DNA, 20 bp, human
gtgacgtcacgggggactgt

SEQ ID NO: 269289 - DNA, 20 bp, human
gcgggctccgggtgacgtca

SEQ ID NO: 269290 - DNA, 20 bp, human
ggggccaatcggcgcgcggt

SEQ ID NO: 269291 - DNA, 20 bp, human
gctgatggcccgccaggact

SEQ ID NO: 269292 - DNA, 20 bp, human
gtggacttgtgtgaagcgaa

SEQ ID NO: 269293 - DNA, 20 bp, human
gcgcgccccgggcctccaga

SEQ ID NO: 269294 - DNA, 20 bp, human
gacccggagcccgggccaat

SEQ ID NO: 269295 - DNA, 20 bp, human
gccccgggcctccagagggg

SEQ ID NO: 269296 - DNA, 20 bp, human
gagtccgcgcagctcttcgc

SEQ ID NO: 269297 - DNA, 20 bp, human
gcggcccccgtgatgacgtg

SEQ ID NO: 269298 - DNA, 20 bp, human
gtcctgcgcccgggattcgg

SEQ ID NO: 269299 - DNA, 20 bp, human
gcgcgctccccgcgttcgtc

SEQ ID NO: 269300 - DNA, 20 bp, human
ggcttcctgcgcccgggatt

SEQ ID NO: 269301 - DNA, 20 bp, human
gagcgcgcggcgcgtgaccc

SEQ ID NO: 269302 - DNA, 20 bp, human
gggagagagaggctgacgtg

SEQ ID NO: 269303 - DNA, 20 bp, human
ggaagagctgcgcggactcc

SEQ ID NO: 269304 - DNA, 20 bp, human
gccggcctggtctgcagtgt

SEQ ID NO: 269305 - DNA, 20 bp, human
gcgctgcggggcagggatac

SEQ ID NO: 269306 - DNA, 20 bp, human
gagatgagcgctgggattga

SEQ ID NO: 269307 - DNA, 20 bp, human
gagtccgcgcgaggattggg

SEQ ID NO: 269308 - DNA, 20 bp, human
gtaggattgggtggcgggaa

SEQ ID NO: 269309 - DNA, 20 bp, human
gtaggcgcgggggattgggt

SEQ ID NO: 269310 - DNA, 20 bp, human
gagagacaagcgctaggatt

SEQ ID NO: 269311 - DNA, 20 bp, human
ggggattgaggggcgggaag

SEQ ID NO: 269312 - DNA, 20 bp, human
gtgggggtgagatgacgtca

SEQ ID NO: 269313 - DNA, 20 bp, human
ggacaagcgctaggattggg

SEQ ID NO: 269314 - DNA, 20 bp, human
ggcggagactcgagagacgg

SEQ ID NO: 269315 - DNA, 20 bp, human
gctcccggcacccagacctt

SEQ ID NO: 269316 - DNA, 20 bp, human
gccgggtccgcgtcgccctg

SEQ ID NO: 269317 - DNA, 20 bp, human
ggggtccggaaggacgcgga

SEQ ID NO: 269318 - DNA, 20 bp, human
ggcggagcatcggtgatccc

SEQ ID NO: 269319 - DNA, 20 bp, human
ggacgcggagggaggtgtga

SEQ ID NO: 269320 - DNA, 20 bp, human
gcgtgcgcgagctgtcagac

SEQ ID NO: 269321 - DNA, 20 bp, human
gggaagcccgagagtcccgc

SEQ ID NO: 269322 - DNA, 20 bp, human
ggagcgatctcagaccgcgg

SEQ ID NO: 269323 - DNA, 20 bp, human
gtcagaccgcggcggagcat

SEQ ID NO: 269324 - DNA, 20 bp, human
gcgtcgccctggggtccgga

SEQ ID NO: 269325 - DNA, 20 bp, human
gcaagcgcgacggcctcgag

SEQ ID NO: 269326 - DNA, 20 bp, human
gctgggatcggggaggacct

SEQ ID NO: 269327 - DNA, 20 bp, human
gcgccggcggggtccccaag

SEQ ID NO: 269328 - DNA, 20 bp, human
gctagcctggccaccgccgg

SEQ ID NO: 269329 - DNA, 20 bp, human
ggccgaggggaggcggaacg

SEQ ID NO: 269330 - DNA, 20 bp, human
gcaagctccggggtacctgc

SEQ ID NO: 269331 - DNA, 20 bp, human
ggagactcgaccagcgagag

SEQ ID NO: 269332 - DNA, 20 bp, human
ggaccccgccggcggtggcc

SEQ ID NO: 269333 - DNA, 20 bp, human
gcctcgctggcccctctcgc

SEQ ID NO: 269334 - DNA, 20 bp, human
ggggtccccaagcgggcacc

SEQ ID NO: 269335 - DNA, 20 bp, human
ggggaggacctgggctagcc

SEQ ID NO: 269336 - DNA, 20 bp, human
ggaggagccagaagagccga

SEQ ID NO: 269337 - DNA, 20 bp, human
ggaccggtggccaatggaaa

SEQ ID NO: 269338 - DNA, 20 bp, human
gagaagagccgaagggtccg

SEQ ID NO: 269339 - DNA, 20 bp, human
gcgggctggaggcggtgtca

SEQ ID NO: 269340 - DNA, 20 bp, human
gtcaggccctaccgcactat

SEQ ID NO: 269341 - DNA, 20 bp, human
gggtggaacccgacggaagt

SEQ ID NO: 269342 - DNA, 20 bp, human
gcgctggttgaaagcggatc

SEQ ID NO: 269343 - DNA, 20 bp, human
ggtgctccgctggttgaaag

SEQ ID NO: 269344 - DNA, 20 bp, human
gaccaactgcgctaggcgat

SEQ ID NO: 269345 - DNA, 20 bp, human
ggtaatcccgccctttctcc

SEQ ID NO: 269346 - DNA, 20 bp, human
ggggcggggcgcgggacgaa

SEQ ID NO: 269347 - DNA, 20 bp, human
gcgggcgacaggggcgacgg

SEQ ID NO: 269348 - DNA, 20 bp, human
gacccgggcgacaggggcga

SEQ ID NO: 269349 - DNA, 20 bp, human
ggcgccccggactgacttag

SEQ ID NO: 269350 - DNA, 20 bp, human
gggggcgacccgggcgacag

SEQ ID NO: 269351 - DNA, 20 bp, human
gcggcccgagtccccacttg

SEQ ID NO: 269352 - DNA, 20 bp, human
gaaaatgagagggttagacg

SEQ ID NO: 269353 - DNA, 20 bp, human
ggcgccccaagtggggactc

SEQ ID NO: 269354 - DNA, 20 bp, human
ggaaccgctaagtcagtccg

SEQ ID NO: 269355 - DNA, 20 bp, human
gccccagccagaaaatgaga

SEQ ID NO: 269356 - DNA, 20 bp, human
gccgacagggtgcgtctcag

SEQ ID NO: 269357 - DNA, 20 bp, human
ggggaggaggagcccgaagt

SEQ ID NO: 269358 - DNA, 20 bp, human
gactaggaagcctctgaaat

SEQ ID NO: 269359 - DNA, 20 bp, human
gcggaagcccgagagggtgt

SEQ ID NO: 269360 - DNA, 20 bp, human
gcaggctcggagctacactc

SEQ ID NO: 269361 - DNA, 20 bp, human
gcggggccaccggcgcgtgg

SEQ ID NO: 269362 - DNA, 20 bp, human
gtcccggccgcgggctccgt

SEQ ID NO: 269363 - DNA, 20 bp, human
gcgcgccggggctctctcac

SEQ ID NO: 269364 - DNA, 20 bp, human
gagaaagccggaagcccgag

SEQ ID NO: 269365 - DNA, 20 bp, human
gcagaggcttcctagtcctt

SEQ ID NO: 269366 - DNA, 20 bp, human
gggtgctgggcgatcctctc

SEQ ID NO: 269367 - DNA, 20 bp, human
gagggccggggcactctcca

SEQ ID NO: 269368 - DNA, 20 bp, human
ggcgagccgcgtagctccgg

SEQ ID NO: 269369 - DNA, 20 bp, human
ggaaaagcgttcaagttcgg

SEQ ID NO: 269370 - DNA, 20 bp, human
gcccggggagaggaactgcc

SEQ ID NO: 269371 - DNA, 20 bp, human
gcccgcggcgccttcggctt

SEQ ID NO: 269372 - DNA, 20 bp, human
gctagatgccgcctcctctt

SEQ ID NO: 269373 - DNA, 20 bp, human
ggcggcgagccgcgtagctc

SEQ ID NO: 269374 - DNA, 20 bp, human
ggccgggcggccaaagccga

SEQ ID NO: 269375 - DNA, 20 bp, human
ggcggcatctagcccgaggg

SEQ ID NO: 269376 - DNA, 20 bp, human
gtggcggccggtatattcgg

SEQ ID NO: 269377 - DNA, 20 bp, human
gccccctcccggaatctccg

SEQ ID NO: 269378 - DNA, 20 bp, human
gaacaactcctgaatggcga

SEQ ID NO: 269379 - DNA, 20 bp, human
gggcctggcccccccgtccc

SEQ ID NO: 269380 - DNA, 20 bp, human
gggaactaacaactcctgaa

SEQ ID NO: 269381 - DNA, 20 bp, human
gcgcagaagctgttgtcccc

SEQ ID NO: 269382 - DNA, 20 bp, human
gcgggccccaaatccccatg

SEQ ID NO: 269383 - DNA, 20 bp, human
gagggcgggagtgcgaagtg

SEQ ID NO: 269384 - DNA, 20 bp, human
gagtctgcgattgtggcggc

SEQ ID NO: 269385 - DNA, 20 bp, human
gctgccggctgggaaggcgt

SEQ ID NO: 269386 - DNA, 20 bp, human
ggaagcggacgagtcggcgg

SEQ ID NO: 269387 - DNA, 20 bp, human
ggggtgagacgcgggtgcta

SEQ ID NO: 269388 - DNA, 20 bp, human
gggcgggaggggaatgacgg

SEQ ID NO: 269389 - DNA, 20 bp, human
ggggaggagccccgagagga

SEQ ID NO: 269390 - DNA, 20 bp, human
ggcgccattgggagggtcgt

SEQ ID NO: 269391 - DNA, 20 bp, human
gcctcccacgaccctcccaa

SEQ ID NO: 269392 - DNA, 20 bp, human
gaccctcccaatggcgcctc

SEQ ID NO: 269393 - DNA, 20 bp, human
gggcgtggggggtgagacgc

SEQ ID NO: 269394 - DNA, 20 bp, human
gtccacctccagtgcccgag

SEQ ID NO: 269395 - DNA, 20 bp, human
gccagctgaagcggacgagt

SEQ ID NO: 269396 - DNA, 20 bp, human
ggggctcccgctcggtgaga

SEQ ID NO: 269397 - DNA, 20 bp, human
gggagagagagtgaccgcgg

SEQ ID NO: 269398 - DNA, 20 bp, human
ggggcgcggagaaccccgct

SEQ ID NO: 269399 - DNA, 20 bp, human
gaaggggcttcgcggaccca

SEQ ID NO: 269400 - DNA, 20 bp, human
gccccggcagaggacctaat

SEQ ID NO: 269401 - DNA, 20 bp, human
gtggggcagacgggagcaga

SEQ ID NO: 269402 - DNA, 20 bp, human
ggaggggatccctaggccca

SEQ ID NO: 269403 - DNA, 20 bp, human
ggggaggcgcgcttaggggt

SEQ ID NO: 269404 - DNA, 20 bp, human
ggtcctctgccggggaggaa

SEQ ID NO: 269405 - DNA, 20 bp, human
gagagatcacagtaaggctg

SEQ ID NO: 269406 - DNA, 20 bp, human
gtggagctgacctgtaacca

SEQ ID NO: 269407 - DNA, 20 bp, human
gtccaagtgcccctggttac

SEQ ID NO: 269408 - DNA, 20 bp, human
ggatgctgggaagagaccct

SEQ ID NO: 269409 - DNA, 20 bp, human
ggggcacttggagaccggca

SEQ ID NO: 269410 - DNA, 20 bp, human
gcgttggtcgctgggatgta

SEQ ID NO: 269411 - DNA, 20 bp, human
gaccaacggtgttatactcc

SEQ ID NO: 269412 - DNA, 20 bp, human
gtactgagaaagatagtgag

SEQ ID NO: 269413 - DNA, 20 bp, human
gcccaggagtataacaccgt

SEQ ID NO: 269414 - DNA, 20 bp, human
ggtataacaccgttggtcgc

SEQ ID NO: 269415 - DNA, 20 bp, human
gggggaggagctacttccta

SEQ ID NO: 269416 - DNA, 20 bp, human
gttgcagagcctggaggata

SEQ ID NO: 269417 - DNA, 20 bp, human
gagaactaaaagggccacgt

SEQ ID NO: 269418 - DNA, 20 bp, human
gggataaggtacccaatagt

SEQ ID NO: 269419 - DNA, 20 bp, human
gaactcttacgtagtttgta

SEQ ID NO: 269420 - DNA, 20 bp, human
gtaggatgatgcctgggaac

SEQ ID NO: 269421 - DNA, 20 bp, human
gagagacttgaatgttggca

SEQ ID NO: 269422 - DNA, 20 bp, human
gacaaaaagggtaaataata

SEQ ID NO: 269423 - DNA, 20 bp, human
gttcaagtctctttcgatag

SEQ ID NO: 269424 - DNA, 20 bp, human
ggaatgttggcaggggcccg

SEQ ID NO: 269425 - DNA, 20 bp, human
gctctaaaatgtaggtcctc

SEQ ID NO: 269426 - DNA, 20 bp, human
gagagctggaaggggcccaa

SEQ ID NO: 269427 - DNA, 20 bp, human
gcatgagaggggtaaaacca

SEQ ID NO: 269428 - DNA, 20 bp, human
gatgtggctggccagaccaa

SEQ ID NO: 269429 - DNA, 20 bp, human
gtgaagcagcatcatgagag

SEQ ID NO: 269430 - DNA, 20 bp, human
ggatggtgagagatgggcgt

SEQ ID NO: 269431 - DNA, 20 bp, human
ggctcatgcagtctgttcct

SEQ ID NO: 269432 - DNA, 20 bp, human
ggggcagtgcggaaggacac

SEQ ID NO: 269433 - DNA, 20 bp, human
gcagtagcctcaaatcaagg

SEQ ID NO: 269434 - DNA, 20 bp, human
gctgggaaggagaataagga

SEQ ID NO: 269435 - DNA, 20 bp, human
gacagactgcatgagccctt

SEQ ID NO: 269436 - DNA, 20 bp, human
gggccaaagaggatctagat

SEQ ID NO: 269437 - DNA, 20 bp, human
gactggggaccagttttcag

SEQ ID NO: 269438 - DNA, 20 bp, human
gagaggagctctcattcctt

SEQ ID NO: 269439 - DNA, 20 bp, human
gagaagaattagtactgcac

SEQ ID NO: 269440 - DNA, 20 bp, human
ggaatgagagctcctctcac

SEQ ID NO: 269441 - DNA, 20 bp, human
gaagaggtggggtaggcagt

SEQ ID NO: 269442 - DNA, 20 bp, human
gtgtacgcacgatgctttca

SEQ ID NO: 269443 - DNA, 20 bp, human
ggtcccatctagatcctctt

SEQ ID NO: 269444 - DNA, 20 bp, human
gggatggggaagtgtagggg

SEQ ID NO: 269445 - DNA, 20 bp, human
gataatgtgagcattagggg

SEQ ID NO: 269446 - DNA, 20 bp, human
gaggcaaggccggcactcat

SEQ ID NO: 269447 - DNA, 20 bp, human
gtggcggcgcgcggagcaag

SEQ ID NO: 269448 - DNA, 20 bp, human
gcctcccataggctcactgg

SEQ ID NO: 269449 - DNA, 20 bp, human
ggcgcgcggagcaaggggca

SEQ ID NO: 269450 - DNA, 20 bp, human
ggacccgccagtgagcctat

SEQ ID NO: 269451 - DNA, 20 bp, human
ggggtcccgtcacgtggcag

SEQ ID NO: 269452 - DNA, 20 bp, human
gctgcctcccataggctcac

SEQ ID NO: 269453 - DNA, 20 bp, human
gggggggccgcatcacgtgg

SEQ ID NO: 269454 - DNA, 20 bp, human
gcgcgcgccgccacgtgatg

SEQ ID NO: 269455 - DNA, 20 bp, human
gaggggcaaggtgggggcgt

SEQ ID NO: 269456 - DNA, 20 bp, human
gggcaggcgcggcacttaaa

SEQ ID NO: 269457 - DNA, 20 bp, human
gcgggctcacgtaaccccgg

SEQ ID NO: 269458 - DNA, 20 bp, human
ggcgggcggcccagtactcc

SEQ ID NO: 269459 - DNA, 20 bp, human
gcccgcgtgcccggagtact

SEQ ID NO: 269460 - DNA, 20 bp, human
gccccgggctcacgtaaccc

SEQ ID NO: 269461 - DNA, 20 bp, human
gggagcccgcagccccacgg

SEQ ID NO: 269462 - DNA, 20 bp, human
gctcacgtaaccccggcggg

SEQ ID NO: 269463 - DNA, 20 bp, human
gggaggtgggaggtgcggcc

SEQ ID NO: 269464 - DNA, 20 bp, human
gcactcgcggagctgcgccc

SEQ ID NO: 269465 - DNA, 20 bp, human
gtcgctgtgcgaaagaaccc

SEQ ID NO: 269466 - DNA, 20 bp, human
gctcgggaacggcgacagat

SEQ ID NO: 269467 - DNA, 20 bp, human
ggacagatgggaagacgcgt

SEQ ID NO: 269468 - DNA, 20 bp, human
gcgggctgccggggtatggg

SEQ ID NO: 269469 - DNA, 20 bp, human
gcgggccagagagtcttggc

SEQ ID NO: 269470 - DNA, 20 bp, human
ggagccgcgcaaactcgcgg

SEQ ID NO: 269471 - DNA, 20 bp, human
gggagagccgcgcaaactcg

SEQ ID NO: 269472 - DNA, 20 bp, human
gtggacggaagctgcaactg

SEQ ID NO: 269473 - DNA, 20 bp, human
gcatcggcaaagctcgggaa

SEQ ID NO: 269474 - DNA, 20 bp, human
ggggaagacgcgtgggagcc

SEQ ID NO: 269475 - DNA, 20 bp, human
gaggaagtggcctcgagagg

SEQ ID NO: 269476 - DNA, 20 bp, human
gcgtgcgtgggcaaagggtg

SEQ ID NO: 269477 - DNA, 20 bp, human
gtctccttggcaccgtgcgt

SEQ ID NO: 269478 - DNA, 20 bp, human
gctcctgggtattccgtctc

SEQ ID NO: 269479 - DNA, 20 bp, human
gtggcaccgtgcgtgggcaa

SEQ ID NO: 269480 - DNA, 20 bp, human
gtgctaaggggcggagactt

SEQ ID NO: 269481 - DNA, 20 bp, human
gttcccgagacggaataccc

SEQ ID NO: 269482 - DNA, 20 bp, human
gaggcagggcacagtctcct

SEQ ID NO: 269483 - DNA, 20 bp, human
ggacaacagttgctaagggg

SEQ ID NO: 269484 - DNA, 20 bp, human
gtgtgcgctaacagatgtga

SEQ ID NO: 269485 - DNA, 20 bp, human
gagcaactgttgtcaaggca

SEQ ID NO: 269486 - DNA, 20 bp, human
gggctctgcagagtaatcct

SEQ ID NO: 269487 - DNA, 20 bp, human
gagccccaattcagaccagt

SEQ ID NO: 269488 - DNA, 20 bp, human
gttccaactggtctgaattg

SEQ ID NO: 269489 - DNA, 20 bp, human
gtttcaggattagctctcat

SEQ ID NO: 269490 - DNA, 20 bp, human
gaaaagatgaatttgcacta

SEQ ID NO: 269491 - DNA, 20 bp, human
gttatttccattgttatctt

SEQ ID NO: 269492 - DNA, 20 bp, human
gcacacttgtcactagcagt

SEQ ID NO: 269493 - DNA, 20 bp, human
ggtgcaaattcatctttttc

SEQ ID NO: 269494 - DNA, 20 bp, human
gaaaaatgcccaacagctct

SEQ ID NO: 269495 - DNA, 20 bp, human
ggtttgcttgttcctccttt

SEQ ID NO: 269496 - DNA, 20 bp, human
gaaaagttcctcataattat

SEQ ID NO: 269497 - DNA, 20 bp, human
gaaatccggccccttttgag

SEQ ID NO: 269498 - DNA, 20 bp, human
gcctccaggagaaggaaatc

SEQ ID NO: 269499 - DNA, 20 bp, human
gctccactcctataattatg

SEQ ID NO: 269500 - DNA, 20 bp, human
ggttgcctctctctctcgct

SEQ ID NO: 269501 - DNA, 20 bp, human
ggggccggatttccttctcc

SEQ ID NO: 269502 - DNA, 20 bp, human
gttaaggcgcctctcaaaag

SEQ ID NO: 269503 - DNA, 20 bp, human
gttcctcataattataggag

SEQ ID NO: 269504 - DNA, 20 bp, human
gcacgcccggctttaaaaaa

SEQ ID NO: 269505 - DNA, 20 bp, human
gggcgcctctcaaaaggggc

SEQ ID NO: 269506 - DNA, 20 bp, human
ggggcctggacggaagcctg

SEQ ID NO: 269507 - DNA, 20 bp, human
ggcaccaaggaatgcggagg

SEQ ID NO: 269508 - DNA, 20 bp, human
ggggccttaagttgtgtgca

SEQ ID NO: 269509 - DNA, 20 bp, human
gtcagtggcaccaaggaatg

SEQ ID NO: 269510 - DNA, 20 bp, human
gcctacctttcattggatct

SEQ ID NO: 269511 - DNA, 20 bp, human
gggaaaactgagggagatgg

SEQ ID NO: 269512 - DNA, 20 bp, human
ggtggcaccaaggaatgcgg

SEQ ID NO: 269513 - DNA, 20 bp, human
gaatgaggctcaagccaggg

SEQ ID NO: 269514 - DNA, 20 bp, human
gccttctccaggtggtcacg

SEQ ID NO: 269515 - DNA, 20 bp, human
gtggacctatggcaaactcc

SEQ ID NO: 269516 - DNA, 20 bp, human
ggataccccaagtggttctt

SEQ ID NO: 269517 - DNA, 20 bp, human
gccttgaagagggtggggtc

SEQ ID NO: 269518 - DNA, 20 bp, human
gtggcctgaccctaaagcct

SEQ ID NO: 269519 - DNA, 20 bp, human
ggctcgatggagattaggtc

SEQ ID NO: 269520 - DNA, 20 bp, human
gcgatggagattaggtctgg

SEQ ID NO: 269521 - DNA, 20 bp, human
gttatcctaagaaccacttg

SEQ ID NO: 269522 - DNA, 20 bp, human
gggaaggagaatagctaagt

SEQ ID NO: 269523 - DNA, 20 bp, human
ggcaagcaggaatgactaaa

SEQ ID NO: 269524 - DNA, 20 bp, human
gccatctcttgcacaacctt

SEQ ID NO: 269525 - DNA, 20 bp, human
ggactcagggagccttgaag

SEQ ID NO: 269526 - DNA, 20 bp, human
gccaacatctctactctaat

SEQ ID NO: 269527 - DNA, 20 bp, human
gggaaggcatatgagtctgc

SEQ ID NO: 269528 - DNA, 20 bp, human
gtagagtagagatgttgggg

SEQ ID NO: 269529 - DNA, 20 bp, human
gactggggtaggggagacaa

SEQ ID NO: 269530 - DNA, 20 bp, human
gagaaaggagccacgatttt

SEQ ID NO: 269531 - DNA, 20 bp, human
gtgggctggatagatcattt

SEQ ID NO: 269532 - DNA, 20 bp, human
ggtagagatgttggggcggc

SEQ ID NO: 269533 - DNA, 20 bp, human
gtatgataatctagaggtag

SEQ ID NO: 269534 - DNA, 20 bp, human
gtcgttcagcccaaaaatcg

SEQ ID NO: 269535 - DNA, 20 bp, human
gttttgagttgggaaggaat

SEQ ID NO: 269536 - DNA, 20 bp, human
gacctcagctgccatggggt

SEQ ID NO: 269537 - DNA, 20 bp, human
gagggcggtggctccctaca

SEQ ID NO: 269538 - DNA, 20 bp, human
gggtcagcggcaaacggagg

SEQ ID NO: 269539 - DNA, 20 bp, human
gctcacccttcaccccttct

SEQ ID NO: 269540 - DNA, 20 bp, human
gatctaaacctcagctgcca

SEQ ID NO: 269541 - DNA, 20 bp, human
gtaatttcccaagacccaga

SEQ ID NO: 269542 - DNA, 20 bp, human
gacaggtcagcggcaaacgg

SEQ ID NO: 269543 - DNA, 20 bp, human
gggtcccggagcagatgctg

SEQ ID NO: 269544 - DNA, 20 bp, human
gtcctaccccatggcagctg

SEQ ID NO: 269545 - DNA, 20 bp, human
gctgcgggaggcaaggaggt

SEQ ID NO: 269546 - DNA, 20 bp, human
gaggcctccagcactgtgtc

SEQ ID NO: 269547 - DNA, 20 bp, human
gaggcctgacacagtgctgg

SEQ ID NO: 269548 - DNA, 20 bp, human
gcagagccaggggcatgccg

SEQ ID NO: 269549 - DNA, 20 bp, human
ggggcaggtagaataatcct

SEQ ID NO: 269550 - DNA, 20 bp, human
gctcaagcacccaacctctt

SEQ ID NO: 269551 - DNA, 20 bp, human
gtcctgggctatgaaggtga

SEQ ID NO: 269552 - DNA, 20 bp, human
ggccgaggcatgagtcagat

SEQ ID NO: 269553 - DNA, 20 bp, human
gtgctcctaggaccttcttt

SEQ ID NO: 269554 - DNA, 20 bp, human
ggccctgtgtcctaagaggt

SEQ ID NO: 269555 - DNA, 20 bp, human
ggggtagtagtggtaatgag

SEQ ID NO: 269556 - DNA, 20 bp, human
gaggcagtggagagccctgt

SEQ ID NO: 269557 - DNA, 20 bp, human
gaactgagaggggcggaagt

SEQ ID NO: 269558 - DNA, 20 bp, human
gaaggcccagttgagtgaga

SEQ ID NO: 269559 - DNA, 20 bp, human
ggcagagctcataaactgag

SEQ ID NO: 269560 - DNA, 20 bp, human
gttgagtgagacggcaggga

SEQ ID NO: 269561 - DNA, 20 bp, human
gcctgccgtctcactcaact

SEQ ID NO: 269562 - DNA, 20 bp, human
gatgagctctgcggttgagt

SEQ ID NO: 269563 - DNA, 20 bp, human
gtccgagagcgctcgctgat

SEQ ID NO: 269564 - DNA, 20 bp, human
ggctcataaactgagagggg

SEQ ID NO: 269565 - DNA, 20 bp, human
ggaccacgccgcagggtgag

SEQ ID NO: 269566 - DNA, 20 bp, human
ggggctgcagccaacaccga

SEQ ID NO: 269567 - DNA, 20 bp, human
gtggacatcctgtgtaaggg

SEQ ID NO: 269568 - DNA, 20 bp, human
gcacggtggcgccagagggg

SEQ ID NO: 269569 - DNA, 20 bp, human
gaaccacggtggcgccagag

SEQ ID NO: 269570 - DNA, 20 bp, human
ggcgaaatgctcacgagatt

SEQ ID NO: 269571 - DNA, 20 bp, human
ggggctacagggaaaggccg

SEQ ID NO: 269572 - DNA, 20 bp, human
gcccacgagacctctgagac

SEQ ID NO: 269573 - DNA, 20 bp, human
gcagggagctgcgagcgctg

SEQ ID NO: 269574 - DNA, 20 bp, human
gggcccgcgcgccacccctc

SEQ ID NO: 269575 - DNA, 20 bp, human
gttcgcagttcctgtctcag

SEQ ID NO: 269576 - DNA, 20 bp, human
gcggaatgcctgggaggaaa

SEQ ID NO: 269577 - DNA, 20 bp, human
gagccactgcaggtccggac

SEQ ID NO: 269578 - DNA, 20 bp, human
gtcgagatggcagtgaccgt

SEQ ID NO: 269579 - DNA, 20 bp, human
gaactcgccccacctgtgtc

SEQ ID NO: 269580 - DNA, 20 bp, human
ggggactccgaaagggtgag

SEQ ID NO: 269581 - DNA, 20 bp, human
gaggtccggactggtcgaga

SEQ ID NO: 269582 - DNA, 20 bp, human
ggccacggaggagacgaggg

SEQ ID NO: 269583 - DNA, 20 bp, human
ggacgtgagcgagcaggttc

SEQ ID NO: 269584 - DNA, 20 bp, human
gagcaggttccggacacagg

SEQ ID NO: 269585 - DNA, 20 bp, human
ggtgggaatgaagttggcac

SEQ ID NO: 269586 - DNA, 20 bp, human
ggacagtgcgggactcgatt

SEQ ID NO: 269587 - DNA, 20 bp, human
gggactcgatttggcggggc

SEQ ID NO: 269588 - DNA, 20 bp, human
ggccggccgagctccttata

SEQ ID NO: 269589 - DNA, 20 bp, human
gtggcggggccggagatttg

SEQ ID NO: 269590 - DNA, 20 bp, human
ggggatcccctcccgccgag

SEQ ID NO: 269591 - DNA, 20 bp, human
ggtcacttgcatgaccctcg

SEQ ID NO: 269592 - DNA, 20 bp, human
gcgtcacaggaactccggga

SEQ ID NO: 269593 - DNA, 20 bp, human
ggagacccccagggccccga

SEQ ID NO: 269594 - DNA, 20 bp, human
ggtcccgggcatataaatac

SEQ ID NO: 269595 - DNA, 20 bp, human
gggcgggtgacgtaagcagg

SEQ ID NO: 269596 - DNA, 20 bp, human
gaacgctcccgggacgtcag

SEQ ID NO: 269597 - DNA, 20 bp, human
gcgtgccccgcgtcagacgg

SEQ ID NO: 269598 - DNA, 20 bp, human
gggccacgttgctaagggag

SEQ ID NO: 269599 - DNA, 20 bp, human
gtcccgggagcgttctattt

SEQ ID NO: 269600 - DNA, 20 bp, human
gtcccgggacgtcaggggcg

SEQ ID NO: 269601 - DNA, 20 bp, human
ggccaaggcgtgcgccccgg

SEQ ID NO: 269602 - DNA, 20 bp, human
gtcaggggcggggcggacga

SEQ ID NO: 269603 - DNA, 20 bp, human
ggccggggccacgttgctaa

SEQ ID NO: 269604 - DNA, 20 bp, human
ggggtcgccctccacccatc

SEQ ID NO: 269605 - DNA, 20 bp, human
gcggcggccaatcgaaacgc

SEQ ID NO: 269606 - DNA, 20 bp, human
ggttagcccaggcctcgaga

SEQ ID NO: 269607 - DNA, 20 bp, human
gtggagtgaggtctttccac

SEQ ID NO: 269608 - DNA, 20 bp, human
gccaaggcggcgcgtctcgg

SEQ ID NO: 269609 - DNA, 20 bp, human
gcaggtgcgtcagtccgcag

SEQ ID NO: 269610 - DNA, 20 bp, human
gccggctcggcgttccccgg

SEQ ID NO: 269611 - DNA, 20 bp, human
gcgggcccatcccggtgaaa

SEQ ID NO: 269612 - DNA, 20 bp, human
ggggaggcgtcgccaagttc

SEQ ID NO: 269613 - DNA, 20 bp, human
gggcccggctcggcgttccc

SEQ ID NO: 269614 - DNA, 20 bp, human
gggcccgtcggtcccgaact

SEQ ID NO: 269615 - DNA, 20 bp, human
gacgcgccgccttggcccgt

SEQ ID NO: 269616 - DNA, 20 bp, human
gaatccacatggtacagggc

SEQ ID NO: 269617 - DNA, 20 bp, human
ggctcggcggggacagaaag

SEQ ID NO: 269618 - DNA, 20 bp, human
gagtgaatccacatggtaca

SEQ ID NO: 269619 - DNA, 20 bp, human
gcatctcgggcagagcgcta

SEQ ID NO: 269620 - DNA, 20 bp, human
gcgaacgagcggcgctcggc

SEQ ID NO: 269621 - DNA, 20 bp, human
gtgcgcggttggcgtcagcg

SEQ ID NO: 269622 - DNA, 20 bp, human
gccccagactccaccttgca

SEQ ID NO: 269623 - DNA, 20 bp, human
gtggccctgtctgaaatcgg

SEQ ID NO: 269624 - DNA, 20 bp, human
gtcccgcccgtgccaccgcc

SEQ ID NO: 269625 - DNA, 20 bp, human
gcattgtagtgactcatctc

SEQ ID NO: 269626 - DNA, 20 bp, human
gccgaggtgcacctgcaagg

SEQ ID NO: 269627 - DNA, 20 bp, human
ggcctccgcgggaagtgagc

SEQ ID NO: 269628 - DNA, 20 bp, human
gctcgcacctacaaagcccg

SEQ ID NO: 269629 - DNA, 20 bp, human
ggtcgcgcgcagcggtgaag

SEQ ID NO: 269630 - DNA, 20 bp, human
gaaggtggcgtgtacctctg

SEQ ID NO: 269631 - DNA, 20 bp, human
ggcagcccgcgctcggaagg

SEQ ID NO: 269632 - DNA, 20 bp, human
gggcggtggcgtcggagact

SEQ ID NO: 269633 - DNA, 20 bp, human
gggcgggcgggctagggctc

SEQ ID NO: 269634 - DNA, 20 bp, human
ggcgcgcagcggtgaagcgg

SEQ ID NO: 269635 - DNA, 20 bp, human
gggtttaggcccggaggcta

SEQ ID NO: 269636 - DNA, 20 bp, human
gggaggcggtagttggaagt

SEQ ID NO: 269637 - DNA, 20 bp, human
gcaggccagcgccccgcggt

SEQ ID NO: 269638 - DNA, 20 bp, human
gcggcagcccgtgagcgcgg

SEQ ID NO: 269639 - DNA, 20 bp, human
gatgggctgccccgggtctg

SEQ ID NO: 269640 - DNA, 20 bp, human
gagtgccgcagtgacgtggg

SEQ ID NO: 269641 - DNA, 20 bp, human
gcggcgggtgctccctaccg

SEQ ID NO: 269642 - DNA, 20 bp, human
gcggcgcgggggctagtggg

SEQ ID NO: 269643 - DNA, 20 bp, human
gacaagtgccgcagtgacgt

SEQ ID NO: 269644 - DNA, 20 bp, human
ggcaggccggaggcggtagt

SEQ ID NO: 269645 - DNA, 20 bp, human
gaggaaaccaccctctgggg

SEQ ID NO: 269646 - DNA, 20 bp, human
gagacagacctcaggcgccg

SEQ ID NO: 269647 - DNA, 20 bp, human
gagccccaggacgcgacagc

SEQ ID NO: 269648 - DNA, 20 bp, human
ggggggtgattcaggagtga

SEQ ID NO: 269649 - DNA, 20 bp, human
ggggcggcgcgctcggactg

SEQ ID NO: 269650 - DNA, 20 bp, human
gggccccgaggtcagaactc

SEQ ID NO: 269651 - DNA, 20 bp, human
ggcgacgctgcagataccaa

SEQ ID NO: 269652 - DNA, 20 bp, human
gccccagctgtcgcgtcctg

SEQ ID NO: 269653 - DNA, 20 bp, human
gcgacagctgggggtgattc

SEQ ID NO: 269654 - DNA, 20 bp, human
gtccccgagggcggcgcgct

SEQ ID NO: 269655 - DNA, 20 bp, human
ggcgcctgaggtctgtctcc

SEQ ID NO: 269656 - DNA, 20 bp, human
gcgtccagctgcctgcccag

SEQ ID NO: 269657 - DNA, 20 bp, human
gagctcaagactgggcgagg

SEQ ID NO: 269658 - DNA, 20 bp, human
gaagcggccgccgcggaaga

SEQ ID NO: 269659 - DNA, 20 bp, human
gccaaggtgtccatgtaaat

SEQ ID NO: 269660 - DNA, 20 bp, human
gcgcctggctccctcttccg

SEQ ID NO: 269661 - DNA, 20 bp, human
gctggctccctcttccgcgg

SEQ ID NO: 269662 - DNA, 20 bp, human
gtgcgccgtgtgaaggtatg

SEQ ID NO: 269663 - DNA, 20 bp, human
gtcacacggcgcacaccggc

SEQ ID NO: 269664 - DNA, 20 bp, human
gggaaaagggtcggcttcag

SEQ ID NO: 269665 - DNA, 20 bp, human
ggaccactcacgttcacaga

SEQ ID NO: 269666 - DNA, 20 bp, human
gacaccaggcaattcggaga

SEQ ID NO: 269667 - DNA, 20 bp, human
gggcgagagggcaaagtggc

SEQ ID NO: 269668 - DNA, 20 bp, human
gcaaagtggcgggactggag

SEQ ID NO: 269669 - DNA, 20 bp, human
gcgccagtcggcaaccgtcg

SEQ ID NO: 269670 - DNA, 20 bp, human
ggactggcgcgcacagtcgc

SEQ ID NO: 269671 - DNA, 20 bp, human
gggccccgacggttgccgac

SEQ ID NO: 269672 - DNA, 20 bp, human
gtcggagacaccaggcaatt

SEQ ID NO: 269673 - DNA, 20 bp, human
gaggccccaggaacggagtg

SEQ ID NO: 269674 - DNA, 20 bp, human
gagagctgagtaggcccgaa

SEQ ID NO: 269675 - DNA, 20 bp, human
ggccgagtgggaattagtgg

SEQ ID NO: 269676 - DNA, 20 bp, human
gccgggcccggactcggact

SEQ ID NO: 269677 - DNA, 20 bp, human
ggaggcggggtcgctgcgag

SEQ ID NO: 269678 - DNA, 20 bp, human
gcggcctccggctcattcgg

SEQ ID NO: 269679 - DNA, 20 bp, human
ggggctgaccacacgcgcgc

SEQ ID NO: 269680 - DNA, 20 bp, human
gaaaaggtgacgcggggccc

SEQ ID NO: 269681 - DNA, 20 bp, human
gcgtaaaaaagtcctcgcct

SEQ ID NO: 269682 - DNA, 20 bp, human
ggccccgcgtcaccttttct

SEQ ID NO: 269683 - DNA, 20 bp, human
gcctgccggcccgctcccgg

SEQ ID NO: 269684 - DNA, 20 bp, human
gagccctgccggcccgctcc

SEQ ID NO: 269685 - DNA, 20 bp, human
ggctcggcctccggctcatt

SEQ ID NO: 269686 - DNA, 20 bp, human
ggaggagcgcaggaatccgt

SEQ ID NO: 269687 - DNA, 20 bp, human
gcaatcggggcgaggagcgc

SEQ ID NO: 269688 - DNA, 20 bp, human
ggagaggagtcggcgccaat

SEQ ID NO: 269689 - DNA, 20 bp, human
gtggctcaaagttccgggag

SEQ ID NO: 269690 - DNA, 20 bp, human
gggggctgccgattcgctgg

SEQ ID NO: 269691 - DNA, 20 bp, human
gggcggggtcttagagccga

SEQ ID NO: 269692 - DNA, 20 bp, human
gccccggcgcgctgaccctc

SEQ ID NO: 269693 - DNA, 20 bp, human
gctctaagaccccgccgccc

SEQ ID NO: 269694 - DNA, 20 bp, human
gagtgaagacggagtcgccg

SEQ ID NO: 269695 - DNA, 20 bp, human
ggccgactcctctcagctgc

SEQ ID NO: 269696 - DNA, 20 bp, human
gtcagagcgctgccgaggga

SEQ ID NO: 269697 - DNA, 20 bp, human
gcgcccaggaacgtgcggga

SEQ ID NO: 269698 - DNA, 20 bp, human
gggtcaaaccagagtgtcgc

SEQ ID NO: 269699 - DNA, 20 bp, human
ggggtgtgcttctgaggtta

SEQ ID NO: 269700 - DNA, 20 bp, human
ggacgtgcacaccatgtgac

SEQ ID NO: 269701 - DNA, 20 bp, human
gacgcggctgtctgcaccga

SEQ ID NO: 269702 - DNA, 20 bp, human
ggcagacagccgcgtaattc

SEQ ID NO: 269703 - DNA, 20 bp, human
gcccccaggggccacctcag

SEQ ID NO: 269704 - DNA, 20 bp, human
gcacccgtcccgcacgttcc

SEQ ID NO: 269705 - DNA, 20 bp, human
gcaggcgcccaggaacgtgc

SEQ ID NO: 269706 - DNA, 20 bp, human
ggccaccccgaggggactag

SEQ ID NO: 269707 - DNA, 20 bp, human
gcggccgagctgggccgcca

SEQ ID NO: 269708 - DNA, 20 bp, human
gctcggccgcgctgcctctg

SEQ ID NO: 269709 - DNA, 20 bp, human
gtccccggccgcgctgtccg

SEQ ID NO: 269710 - DNA, 20 bp, human
gggccacgagcctcccgcgg

SEQ ID NO: 269711 - DNA, 20 bp, human
gggtcccagctcggattccc

SEQ ID NO: 269712 - DNA, 20 bp, human
ggccgacgcagacatagacg

SEQ ID NO: 269713 - DNA, 20 bp, human
gcagacatagacgtggtggg

SEQ ID NO: 269714 - DNA, 20 bp, human
gctgaggcccgcccaggtaa

SEQ ID NO: 269715 - DNA, 20 bp, human
gtcagcccctagtcccctcg

SEQ ID NO: 269716 - DNA, 20 bp, human
gagcatccccggggcacgga

SEQ ID NO: 269717 - DNA, 20 bp, human
gctgtgcgccagcatccccg

SEQ ID NO: 269718 - DNA, 20 bp, human
ggagccggccaaactcaagt

SEQ ID NO: 269719 - DNA, 20 bp, human
gtcagggaattgtcaacaaa

SEQ ID NO: 269720 - DNA, 20 bp, human
gccaaactcaagttggttca

SEQ ID NO: 269721 - DNA, 20 bp, human
ggcagcgccctccgtgcccc

SEQ ID NO: 269722 - DNA, 20 bp, human
gtgtgagcgagtcagggcgt

SEQ ID NO: 269723 - DNA, 20 bp, human
ggcggccctgacgtcacgca

SEQ ID NO: 269724 - DNA, 20 bp, human
gcgagtcagggcgtgggcct

SEQ ID NO: 269725 - DNA, 20 bp, human
gcagtcccgcggacgctccc

SEQ ID NO: 269726 - DNA, 20 bp, human
gtcctcggactgcgggtcca

SEQ ID NO: 269727 - DNA, 20 bp, human
gaactcgcagatgccgctca

SEQ ID NO: 269728 - DNA, 20 bp, human
ggctgcaagggcggtgttgg

SEQ ID NO: 269729 - DNA, 20 bp, human
gaccctggacccgcagtccg

SEQ ID NO: 269730 - DNA, 20 bp, human
gagaagaagctgaccctgag

SEQ ID NO: 269731 - DNA, 20 bp, human
gcctccttgggcaatgtcag

SEQ ID NO: 269732 - DNA, 20 bp, human
ggcttcactaggctgttctt

SEQ ID NO: 269733 - DNA, 20 bp, human
gacggctgcaagggcggtgt

SEQ ID NO: 269734 - DNA, 20 bp, human
gcggaggcggacggctgcaa

SEQ ID NO: 269735 - DNA, 20 bp, human
gccggaccggggggcgacgt

SEQ ID NO: 269736 - DNA, 20 bp, human
gagggcgcttggagatcccc

SEQ ID NO: 269737 - DNA, 20 bp, human
gtccgcaccccgatcgactg

SEQ ID NO: 269738 - DNA, 20 bp, human
gtaggagccccacagcgtca

SEQ ID NO: 269739 - DNA, 20 bp, human
gtccgggcctcagtcgatcg

SEQ ID NO: 269740 - DNA, 20 bp, human
gacgaagcgtggggcggcac

SEQ ID NO: 269741 - DNA, 20 bp, human
ggactcgcaggtgaaaggac

SEQ ID NO: 269742 - DNA, 20 bp, human
ggcccggagagttcaggaac

SEQ ID NO: 269743 - DNA, 20 bp, human
gcgggcgcacctccccaggt

SEQ ID NO: 269744 - DNA, 20 bp, human
gtgcggagggggccgacccg

SEQ ID NO: 269745 - DNA, 20 bp, human
gtaaaggggccacgaagcgt

SEQ ID NO: 269746 - DNA, 20 bp, human
gggaggggcgaaatggagga

SEQ ID NO: 269747 - DNA, 20 bp, human
gaaagggaggggcgaaatgg

SEQ ID NO: 269748 - DNA, 20 bp, human
gcagaaagggaggggcgaaa

SEQ ID NO: 269749 - DNA, 20 bp, human
gggctgatataaccgagatg

SEQ ID NO: 269750 - DNA, 20 bp, human
ggtaccgtgaacagagtaag

SEQ ID NO: 269751 - DNA, 20 bp, human
ggggactgaccaaatacagt

SEQ ID NO: 269752 - DNA, 20 bp, human
gggccccatcccactgtatt

SEQ ID NO: 269753 - DNA, 20 bp, human
gtgaccaaatacagtgggat

SEQ ID NO: 269754 - DNA, 20 bp, human
gctccccatcaggatactga

SEQ ID NO: 269755 - DNA, 20 bp, human
gatataaccgagatggggaa

SEQ ID NO: 269756 - DNA, 20 bp, human
ggctgcacctctgccgtcat

SEQ ID NO: 269757 - DNA, 20 bp, human
gtggccgccgatgacggcag

SEQ ID NO: 269758 - DNA, 20 bp, human
ggcggctcgctcgggagaag

SEQ ID NO: 269759 - DNA, 20 bp, human
gggcgcgccgcggctcgctc

SEQ ID NO: 269760 - DNA, 20 bp, human
gcgcgggcggcggggactca

SEQ ID NO: 269761 - DNA, 20 bp, human
ggagctgctggatccgccgg

SEQ ID NO: 269762 - DNA, 20 bp, human
gaggaggaagaggacgacgg

SEQ ID NO: 269763 - DNA, 20 bp, human
ggagaagtggccgccgatga

SEQ ID NO: 269764 - DNA, 20 bp, human
ggcacctctgccgtcatcgg

SEQ ID NO: 269765 - DNA, 20 bp, human
gacccccgccggtatttttt

SEQ ID NO: 269766 - DNA, 20 bp, human
gcggggagcgagataagaga

SEQ ID NO: 269767 - DNA, 20 bp, human
gcggccgccaggtcgggagg

SEQ ID NO: 269768 - DNA, 20 bp, human
gagcgaggagcgctcctgaa

SEQ ID NO: 269769 - DNA, 20 bp, human
gaggcggccgccaggtcggg

SEQ ID NO: 269770 - DNA, 20 bp, human
ggcgagaggaatgaagagcg

SEQ ID NO: 269771 - DNA, 20 bp, human
ggcgcccgcgagtgggaccg

SEQ ID NO: 269772 - DNA, 20 bp, human
gccgccaggtcgggaggggg

SEQ ID NO: 269773 - DNA, 20 bp, human
ggctcctgaagggagacgtc

SEQ ID NO: 269774 - DNA, 20 bp, human
ggagacgtcgggctcgtccc

SEQ ID NO: 269775 - DNA, 20 bp, human
ggagcccgacgtctcccttc

SEQ ID NO: 269776 - DNA, 20 bp, human
ggggaggcgagcgcccgagg

SEQ ID NO: 269777 - DNA, 20 bp, human
gaggccgcgcggagccgcgt

SEQ ID NO: 269778 - DNA, 20 bp, human
gtccgaggcccgcggagagg

SEQ ID NO: 269779 - DNA, 20 bp, human
gtcgccgtcgaccaatcgga

SEQ ID NO: 269780 - DNA, 20 bp, human
gcggcaccgcgtgctcccgc

SEQ ID NO: 269781 - DNA, 20 bp, human
ggagccgcgtagggatacgc

SEQ ID NO: 269782 - DNA, 20 bp, human
gggcccctccgattggtcga

SEQ ID NO: 269783 - DNA, 20 bp, human
gcctaggaggggaatttcgg

SEQ ID NO: 269784 - DNA, 20 bp, human
ggcggagccggcggggtgga

SEQ ID NO: 269785 - DNA, 20 bp, human
gtccccctctccgcgggcct

SEQ ID NO: 269786 - DNA, 20 bp, human
gggggaggggagcatgccga

SEQ ID NO: 269787 - DNA, 20 bp, human
ggggcagagagcattctagt

SEQ ID NO: 269788 - DNA, 20 bp, human
gccacccaaaggcaactcag

SEQ ID NO: 269789 - DNA, 20 bp, human
ggggtcctgaaacctgacca

SEQ ID NO: 269790 - DNA, 20 bp, human
ggccaggcccggcttcaaag

SEQ ID NO: 269791 - DNA, 20 bp, human
gtggggcagtgtagaaggca

SEQ ID NO: 269792 - DNA, 20 bp, human
gaaggggctgcgatgaccca

SEQ ID NO: 269793 - DNA, 20 bp, human
ggagggcttccacaattagc

SEQ ID NO: 269794 - DNA, 20 bp, human
gtagcaggttttggttaatc

SEQ ID NO: 269795 - DNA, 20 bp, human
gaaacctgaccagggaagac

SEQ ID NO: 269796 - DNA, 20 bp, human
gcaggtggccgcccctgggt

SEQ ID NO: 269797 - DNA, 20 bp, human
gccgtctagcatgtcattag

SEQ ID NO: 269798 - DNA, 20 bp, human
gagcctccagcccacgggga

SEQ ID NO: 269799 - DNA, 20 bp, human
gaagccctaggggtataagt

SEQ ID NO: 269800 - DNA, 20 bp, human
gcgggaaagtcccctccccg

SEQ ID NO: 269801 - DNA, 20 bp, human
gcccgtgggctggaggctga

SEQ ID NO: 269802 - DNA, 20 bp, human
gtgcctgtggatcccagccc

SEQ ID NO: 269803 - DNA, 20 bp, human
gctgcgctgcgtgtcagctc

SEQ ID NO: 269804 - DNA, 20 bp, human
gtggggacctgaggcgccag

SEQ ID NO: 269805 - DNA, 20 bp, human
gaagccgggagagaggatag

SEQ ID NO: 269806 - DNA, 20 bp, human
ggggcggaaaactgacacca

SEQ ID NO: 269807 - DNA, 20 bp, human
ggggacggatcgcacaaagg

SEQ ID NO: 269808 - DNA, 20 bp, human
gggccccgacggtgtttaaa

SEQ ID NO: 269809 - DNA, 20 bp, human
gccaccgcgcccagatcccc

SEQ ID NO: 269810 - DNA, 20 bp, human
gacccgaagcgtaggacttg

SEQ ID NO: 269811 - DNA, 20 bp, human
gcagacgaggctacggactt

SEQ ID NO: 269812 - DNA, 20 bp, human
gcgcgagcgactgtggactc

SEQ ID NO: 269813 - DNA, 20 bp, human
ggggcccaggtcgtcgcagt

SEQ ID NO: 269814 - DNA, 20 bp, human
gaggggccgcgcattggacg

SEQ ID NO: 269815 - DNA, 20 bp, human
gactcggggctagggataga

SEQ ID NO: 269816 - DNA, 20 bp, human
gcccgggcagaggggcggta

SEQ ID NO: 269817 - DNA, 20 bp, human
gcccgggcccgggagcgtct

SEQ ID NO: 269818 - DNA, 20 bp, human
gccggcctcccagacgctcc

SEQ ID NO: 269819 - DNA, 20 bp, human
ggagaaggggacacgccaag

SEQ ID NO: 269820 - DNA, 20 bp, human
ggaagccgatcggttgagac

SEQ ID NO: 269821 - DNA, 20 bp, human
gagaaacgtgggctaggaat

SEQ ID NO: 269822 - DNA, 20 bp, human
gacgtccagtctcaaccgat

SEQ ID NO: 269823 - DNA, 20 bp, human
gtaacttggggtggccgctc

SEQ ID NO: 269824 - DNA, 20 bp, human
gtcctcggggattctgtgat

SEQ ID NO: 269825 - DNA, 20 bp, human
gatgttaagaaacgtgggct

SEQ ID NO: 269826 - DNA, 20 bp, human
ggggcacttgccactctccc

SEQ ID NO: 269827 - DNA, 20 bp, human
gcaagtgcccgcggtctcct

SEQ ID NO: 269828 - DNA, 20 bp, human
gcacgtctccaaggagaccg

SEQ ID NO: 269829 - DNA, 20 bp, human
gtcgaagagagttgccgcca

SEQ ID NO: 269830 - DNA, 20 bp, human
gccgccgctaagtcccggct

SEQ ID NO: 269831 - DNA, 20 bp, human
ggagccgagccgggacttag

SEQ ID NO: 269832 - DNA, 20 bp, human
gagaggcggaagctgtttat

SEQ ID NO: 269833 - DNA, 20 bp, human
gaaagcgtacgggacaggaa

SEQ ID NO: 269834 - DNA, 20 bp, human
gattggccagcacgtctcca

SEQ ID NO: 269835 - DNA, 20 bp, human
gtgctggccaatggcagagg

SEQ ID NO: 269836 - DNA, 20 bp, human
gctcccggcgcgggttaagg

SEQ ID NO: 269837 - DNA, 20 bp, human
gacaactcactgctccccgt

SEQ ID NO: 269838 - DNA, 20 bp, human
ggggcggcgagatccctcgc

SEQ ID NO: 269839 - DNA, 20 bp, human
gagagcggccgtggctctcc

SEQ ID NO: 269840 - DNA, 20 bp, human
ggccgctctcacgccggcga

SEQ ID NO: 269841 - DNA, 20 bp, human
gtccctcgccggcgtgagag

SEQ ID NO: 269842 - DNA, 20 bp, human
gcgcggccgcaggtgggcga

SEQ ID NO: 269843 - DNA, 20 bp, human
ggcgcgggttaaggaggagc

SEQ ID NO: 269844 - DNA, 20 bp, human
gagccgcgagcctcgctacc

SEQ ID NO: 269845 - DNA, 20 bp, human
gcgcctcccggcgcgggtta

SEQ ID NO: 269846 - DNA, 20 bp, human
gcagagcctcgggagtctca

SEQ ID NO: 269847 - DNA, 20 bp, human
ggactcccgaggctctgcat

SEQ ID NO: 269848 - DNA, 20 bp, human
gtgcgccgatgcagagcctc

SEQ ID NO: 269849 - DNA, 20 bp, human
ggaagcgaccgtgaccgcgc

SEQ ID NO: 269850 - DNA, 20 bp, human
gcggtcgcttcgacgcacgc

SEQ ID NO: 269851 - DNA, 20 bp, human
gtcaagtccctgcgcggtca

SEQ ID NO: 269852 - DNA, 20 bp, human
gcacgcaggatccctccgct

SEQ ID NO: 269853 - DNA, 20 bp, human
gcgggtcgggaagtagttcc

SEQ ID NO: 269854 - DNA, 20 bp, human
ggccggccgctagatgacac

SEQ ID NO: 269855 - DNA, 20 bp, human
ggcggcgtcaagtccctgcg

SEQ ID NO: 269856 - DNA, 20 bp, human
ggcgaggcgaggcgcacggt

SEQ ID NO: 269857 - DNA, 20 bp, human
gccgcccagcgtagcccacg

SEQ ID NO: 269858 - DNA, 20 bp, human
gtccccctggatggaggaaa

SEQ ID NO: 269859 - DNA, 20 bp, human
gcgcgccacgtgggctacgc

SEQ ID NO: 269860 - DNA, 20 bp, human
gtacgctgggcgggaccggc

SEQ ID NO: 269861 - DNA, 20 bp, human
ggggccagatcgcgccggcg

SEQ ID NO: 269862 - DNA, 20 bp, human
gagatcgcgccggcgcggag

SEQ ID NO: 269863 - DNA, 20 bp, human
gctgggcgggcgcggaaacc

SEQ ID NO: 269864 - DNA, 20 bp, human
gcacgtggcgcgcgccagcg

SEQ ID NO: 269865 - DNA, 20 bp, human
gagcctgggtcattggagaa

SEQ ID NO: 269866 - DNA, 20 bp, human
gaaaacccggggcggacagt

SEQ ID NO: 269867 - DNA, 20 bp, human
gaagctgccggcacgtccgg

SEQ ID NO: 269868 - DNA, 20 bp, human
ggcagtggggctaccgaagc

SEQ ID NO: 269869 - DNA, 20 bp, human
ggggcgccgcggaaaacccg

SEQ ID NO: 269870 - DNA, 20 bp, human
gcccggagtcgggactgcgt

SEQ ID NO: 269871 - DNA, 20 bp, human
gaggggcgggcccggcgtgc

SEQ ID NO: 269872 - DNA, 20 bp, human
gcgccgcggaaaacccgggg

SEQ ID NO: 269873 - DNA, 20 bp, human
gggggcggcgtacggcagtg

SEQ ID NO: 269874 - DNA, 20 bp, human
gcccgacgcagtcccgactc

SEQ ID NO: 269875 - DNA, 20 bp, human
gaccaagctgccggcacgtc

SEQ ID NO: 269876 - DNA, 20 bp, human
gacagagcacggagcggccg

SEQ ID NO: 269877 - DNA, 20 bp, human
ggcgccgcaagggccctccc

SEQ ID NO: 269878 - DNA, 20 bp, human
gtaagcacacacagtcagtg

SEQ ID NO: 269879 - DNA, 20 bp, human
gccagaggcagaggcacggc

SEQ ID NO: 269880 - DNA, 20 bp, human
ggcacggctggctccccggg

SEQ ID NO: 269881 - DNA, 20 bp, human
gtatcaaaaagacacgtgga

SEQ ID NO: 269882 - DNA, 20 bp, human
gcaggagacccgggcggcct

SEQ ID NO: 269883 - DNA, 20 bp, human
gtgtgtgcttacagcgtcaa

SEQ ID NO: 269884 - DNA, 20 bp, human
gccccgcaacgcaggagacc

SEQ ID NO: 269885 - DNA, 20 bp, human
gggatcgaagaggtgactca

SEQ ID NO: 269886 - DNA, 20 bp, human
ggagtaccggcagatttcaa

SEQ ID NO: 269887 - DNA, 20 bp, human
gccctgaggctcgctgggcg

SEQ ID NO: 269888 - DNA, 20 bp, human
gtgacgcaagcggaactcgg

SEQ ID NO: 269889 - DNA, 20 bp, human
gcccccgcccagcgagcctc

SEQ ID NO: 269890 - DNA, 20 bp, human
gcgtgagcctggctgtcggc

SEQ ID NO: 269891 - DNA, 20 bp, human
gcagcccgcagagcgagtac

SEQ ID NO: 269892 - DNA, 20 bp, human
ggctggccgccccgctatag

SEQ ID NO: 269893 - DNA, 20 bp, human
ggggaggggcgagacggcga

SEQ ID NO: 269894 - DNA, 20 bp, human
gtgggcccctgaggctcgct

SEQ ID NO: 269895 - DNA, 20 bp, human
gggcgggggcaggccggtcc

SEQ ID NO: 269896 - DNA, 20 bp, human
gccggcccgggctggtaagg

SEQ ID NO: 269897 - DNA, 20 bp, human
gcgtccggcccgggctggta

SEQ ID NO: 269898 - DNA, 20 bp, human
ggagcgttaaggtcacgtga

SEQ ID NO: 269899 - DNA, 20 bp, human
gggaccgcaggccggcttgt

SEQ ID NO: 269900 - DNA, 20 bp, human
gggtaaggcggaccgcaggc

SEQ ID NO: 269901 - DNA, 20 bp, human
gagcccggaatgccgagaca

SEQ ID NO: 269902 - DNA, 20 bp, human
ggaagcggcgtgacaggccc

SEQ ID NO: 269903 - DNA, 20 bp, human
gtcccccacaagccggcctg

SEQ ID NO: 269904 - DNA, 20 bp, human
ggggtccccgccgcgtgggt

SEQ ID NO: 269905 - DNA, 20 bp, human
gcggaatgccgagacaaggc

SEQ ID NO: 269906 - DNA, 20 bp, human
gaggttctggggaacagcgc

SEQ ID NO: 269907 - DNA, 20 bp, human
ggagcccactcatgaggttc

SEQ ID NO: 269908 - DNA, 20 bp, human
gagggggcctgggctagctc

SEQ ID NO: 269909 - DNA, 20 bp, human
gcaggcctgtgccccacctg

SEQ ID NO: 269910 - DNA, 20 bp, human
gctgtgccccacctgtgggt

SEQ ID NO: 269911 - DNA, 20 bp, human
ggaggggctgcgccaaaacg

SEQ ID NO: 269912 - DNA, 20 bp, human
gctcatggagcccactcatg

SEQ ID NO: 269913 - DNA, 20 bp, human
gcctcctcctgagctagccc

SEQ ID NO: 269914 - DNA, 20 bp, human
gagccacaggctgtgcgcac

SEQ ID NO: 269915 - DNA, 20 bp, human
gctaatgcttggcccttgaa

SEQ ID NO: 269916 - DNA, 20 bp, human
gcggccgagcccccttcctc

SEQ ID NO: 269917 - DNA, 20 bp, human
gtgaaatgcagggtccggaa

SEQ ID NO: 269918 - DNA, 20 bp, human
gtgtccgaggaaggacctat

SEQ ID NO: 269919 - DNA, 20 bp, human
gaggacctataggagtgcgg

SEQ ID NO: 269920 - DNA, 20 bp, human
gcaaaggcctcgcatgtccg

SEQ ID NO: 269921 - DNA, 20 bp, human
gggaaagcgggaaaatgcaa

SEQ ID NO: 269922 - DNA, 20 bp, human
gtaacgtggggtgtcgagga

SEQ ID NO: 269923 - DNA, 20 bp, human
gaggcagccagccggaaccc

SEQ ID NO: 269924 - DNA, 20 bp, human
gcggaaacccacataacgtg

SEQ ID NO: 269925 - DNA, 20 bp, human
gccacctcctaccgaaggga

SEQ ID NO: 269926 - DNA, 20 bp, human
gtcccagcgccgcgagtctc

SEQ ID NO: 269927 - DNA, 20 bp, human
gcagcccgagggtaagcgta

SEQ ID NO: 269928 - DNA, 20 bp, human
gggcctcgcccggagactcg

SEQ ID NO: 269929 - DNA, 20 bp, human
gcccgcggccgctttcgcaa

SEQ ID NO: 269930 - DNA, 20 bp, human
gtaagcgtaggggcagtacc

SEQ ID NO: 269931 - DNA, 20 bp, human
ggcggggtgtgcggatgaac

SEQ ID NO: 269932 - DNA, 20 bp, human
gagctgcctgccctcggtgc

SEQ ID NO: 269933 - DNA, 20 bp, human
gcgcgcactaggacccagca

SEQ ID NO: 269934 - DNA, 20 bp, human
gtgcagcccgcaccgagggc

SEQ ID NO: 269935 - DNA, 20 bp, human
gtgcccctacgcttaccctc

SEQ ID NO: 269936 - DNA, 20 bp, human
gccggagaaagggaaaacgt

SEQ ID NO: 269937 - DNA, 20 bp, human
ggcgccccagcactcagcca

SEQ ID NO: 269938 - DNA, 20 bp, human
gggcggagggagccggagaa

SEQ ID NO: 269939 - DNA, 20 bp, human
gccccagcactcagccaggg

SEQ ID NO: 269940 - DNA, 20 bp, human
gctccgccctggctgagtgc

SEQ ID NO: 269941 - DNA, 20 bp, human
ggggcactgacccgccgggg

SEQ ID NO: 269942 - DNA, 20 bp, human
ggagtgctggggcgcgcgag

SEQ ID NO: 269943 - DNA, 20 bp, human
gccgcgcggcctcgcctctt

SEQ ID NO: 269944 - DNA, 20 bp, human
ggcaggaggaggggaagcgc

SEQ ID NO: 269945 - DNA, 20 bp, human
ggcggggcactgacccgccg

SEQ ID NO: 269946 - DNA, 20 bp, human
gacgccccggggttctgggg

SEQ ID NO: 269947 - DNA, 20 bp, human
gagcatgcgttgaggagcag

SEQ ID NO: 269948 - DNA, 20 bp, human
gctcctcaacgcatgctctc

SEQ ID NO: 269949 - DNA, 20 bp, human
gccggggcgtgcaaggctcg

SEQ ID NO: 269950 - DNA, 20 bp, human
ggggcggggcggaggagtgc

SEQ ID NO: 269951 - DNA, 20 bp, human
ggcggaggagtgcaggggta

SEQ ID NO: 269952 - DNA, 20 bp, human
gttgcacgccccggggttct

SEQ ID NO: 269953 - DNA, 20 bp, human
gtgcccgagagcatgcgttg

SEQ ID NO: 269954 - DNA, 20 bp, human
gcgggcgcaactttcttaaa

SEQ ID NO: 269955 - DNA, 20 bp, human
gaaaacttgcaatcccgcct

SEQ ID NO: 269956 - DNA, 20 bp, human
gccggttttccacggggagg

SEQ ID NO: 269957 - DNA, 20 bp, human
gagcagcagagccgagtact

SEQ ID NO: 269958 - DNA, 20 bp, human
gtggggcccggttttccacg

SEQ ID NO: 269959 - DNA, 20 bp, human
gcgggcagccagtgggcgcc

SEQ ID NO: 269960 - DNA, 20 bp, human
gcgggctgtcggtcaggggc

SEQ ID NO: 269961 - DNA, 20 bp, human
gcgcgcggccaatgggcatg

SEQ ID NO: 269962 - DNA, 20 bp, human
ggcggcagatcccgtaagtc

SEQ ID NO: 269963 - DNA, 20 bp, human
gcgcgcgggctgtcggtcag

SEQ ID NO: 269964 - DNA, 20 bp, human
ggcagatcccgtaagtcggg

SEQ ID NO: 269965 - DNA, 20 bp, human
gggcccggttttccacgggg

SEQ ID NO: 269966 - DNA, 20 bp, human
gagcccagcggggacagcag

SEQ ID NO: 269967 - DNA, 20 bp, human
ggctgcgggcgtgggtgtcc

SEQ ID NO: 269968 - DNA, 20 bp, human
gctcccgctgctgtccccgc

SEQ ID NO: 269969 - DNA, 20 bp, human
gcccgccgagtcccggccca

SEQ ID NO: 269970 - DNA, 20 bp, human
gccgccgtcagcctaggttg

SEQ ID NO: 269971 - DNA, 20 bp, human
ggcgggagcccgccgagtcc

SEQ ID NO: 269972 - DNA, 20 bp, human
gcagggcgcctggtaccagg

SEQ ID NO: 269973 - DNA, 20 bp, human
gaagatgggcagggttatcg

SEQ ID NO: 269974 - DNA, 20 bp, human
ggcggtgtggaaatactgaa

SEQ ID NO: 269975 - DNA, 20 bp, human
gcgcgccgtgggccgggact

SEQ ID NO: 269976 - DNA, 20 bp, human
gctagcccgggagggacctg

SEQ ID NO: 269977 - DNA, 20 bp, human
gtccctcccgggctaggcgg

SEQ ID NO: 269978 - DNA, 20 bp, human
gggagccgcgagcgaatcga

SEQ ID NO: 269979 - DNA, 20 bp, human
gcgcacgcacacccgagctc

SEQ ID NO: 269980 - DNA, 20 bp, human
ggccgcgggaggcactagag

SEQ ID NO: 269981 - DNA, 20 bp, human
gcggccgctgcccgctttaa

SEQ ID NO: 269982 - DNA, 20 bp, human
gagctggcgcagccgagccg

SEQ ID NO: 269983 - DNA, 20 bp, human
gaggcggccaggctaggaaa

SEQ ID NO: 269984 - DNA, 20 bp, human
gcccgccgcctagcccggga

SEQ ID NO: 269985 - DNA, 20 bp, human
gacagcacagacttgagcgg

SEQ ID NO: 269986 - DNA, 20 bp, human
ggggaatcggtgcgggaata

SEQ ID NO: 269987 - DNA, 20 bp, human
ggccactcttactagggtcc

SEQ ID NO: 269988 - DNA, 20 bp, human
ggtggcacgactgcagaact

SEQ ID NO: 269989 - DNA, 20 bp, human
gagggcagcaatccgggtgg

SEQ ID NO: 269990 - DNA, 20 bp, human
gggcgtggcaggatataacg

SEQ ID NO: 269991 - DNA, 20 bp, human
ggggctcctggccgcgaagc

SEQ ID NO: 269992 - DNA, 20 bp, human
gtagtcctcaagagtgacca

SEQ ID NO: 269993 - DNA, 20 bp, human
gttgataggggaatcggtgc

SEQ ID NO: 269994 - DNA, 20 bp, human
gaaacagagacgtcaggagg

SEQ ID NO: 269995 - DNA, 20 bp, human
gtcctggccgcgaagcagga

SEQ ID NO: 269996 - DNA, 20 bp, human
gtgcaatccggcctcgtccc

SEQ ID NO: 269997 - DNA, 20 bp, human
gagcccaggtgccccgcccg

SEQ ID NO: 269998 - DNA, 20 bp, human
gctacggagcaggggcggag

SEQ ID NO: 269999 - DNA, 20 bp, human
gcggtgacgcgcttctggga

SEQ ID NO: 270000 - DNA, 20 bp, human
gacagcgccgcctacggagc

SEQ ID NO: 270001 - DNA, 20 bp, human
ggggcaggacagtccagccg

SEQ ID NO: 270002 - DNA, 20 bp, human
gaggcggcgctgttgcttgc

SEQ ID NO: 270003 - DNA, 20 bp, human
ggggctggctgaggattccg

SEQ ID NO: 270004 - DNA, 20 bp, human
gcccctgctcggcgcggagg

SEQ ID NO: 270005 - DNA, 20 bp, human
gtcagcgccggctgcacctc

SEQ ID NO: 270006 - DNA, 20 bp, human
gagaggccaacacgtcgcgg

SEQ ID NO: 270007 - DNA, 20 bp, human
gacctgctgggtaaacaacc

SEQ ID NO: 270008 - DNA, 20 bp, human
gacagcggaaaaaacgagaa

SEQ ID NO: 270009 - DNA, 20 bp, human
gagccccgcggaccagagag

SEQ ID NO: 270010 - DNA, 20 bp, human
gccccggcgaacggcaaaga

SEQ ID NO: 270011 - DNA, 20 bp, human
gggggtgcgtgaagcggaga

SEQ ID NO: 270012 - DNA, 20 bp, human
gggaacgccagagcagtccc

SEQ ID NO: 270013 - DNA, 20 bp, human
ggagagaggccaacacgtcg

SEQ ID NO: 270014 - DNA, 20 bp, human
gaccccgctgggcactccag

SEQ ID NO: 270015 - DNA, 20 bp, human
gaagtgaggggcgtccaggc

SEQ ID NO: 270016 - DNA, 20 bp, human
gcacagaagtagagggatat

SEQ ID NO: 270017 - DNA, 20 bp, human
gctagccgtggaggcacatg

SEQ ID NO: 270018 - DNA, 20 bp, human
gtctgcctcaaaacagagtg

SEQ ID NO: 270019 - DNA, 20 bp, human
gcacttgtcacatacaccct

SEQ ID NO: 270020 - DNA, 20 bp, human
gagaaccacttcaaacacat

SEQ ID NO: 270021 - DNA, 20 bp, human
gatccctctacttctgtgcc

SEQ ID NO: 270022 - DNA, 20 bp, human
gaccttagaccaccacataa

SEQ ID NO: 270023 - DNA, 20 bp, human
gacctttatgtggtggtcta

SEQ ID NO: 270024 - DNA, 20 bp, human
ggcttccccactctgttttg

SEQ ID NO: 270025 - DNA, 20 bp, human
gcacttctacctttatgtgg

SEQ ID NO: 270026 - DNA, 20 bp, human
ggggctccgggaagctagtc

SEQ ID NO: 270027 - DNA, 20 bp, human
gccccggcgaacggcaaaga

SEQ ID NO: 270028 - DNA, 20 bp, human
gggggtgcgtgaagcggaga

SEQ ID NO: 270029 - DNA, 20 bp, human
gagaggccaacacgtcgcgg

SEQ ID NO: 270030 - DNA, 20 bp, human
gcacacgcactcccgggcga

SEQ ID NO: 270031 - DNA, 20 bp, human
gaccccgctgggcactccag

SEQ ID NO: 270032 - DNA, 20 bp, human
ggggaggtagagggtcgggc

SEQ ID NO: 270033 - DNA, 20 bp, human
gagggagccgctcccgctcg

SEQ ID NO: 270034 - DNA, 20 bp, human
ggagagaggccaacacgtcg

SEQ ID NO: 270035 - DNA, 20 bp, human
gagccccgcggaccagagag

SEQ ID NO: 270036 - DNA, 20 bp, human
gtaggaatggctgaaaagac

SEQ ID NO: 270037 - DNA, 20 bp, human
gttggcctcctctgacgggg

SEQ ID NO: 270038 - DNA, 20 bp, human
gaggagggcctgtttgaact

SEQ ID NO: 270039 - DNA, 20 bp, human
gacggggaggtaaccatatt

SEQ ID NO: 270040 - DNA, 20 bp, human
gaaggcttgtatctctgcaa

SEQ ID NO: 270041 - DNA, 20 bp, human
gaaccatattaggatgtgta

SEQ ID NO: 270042 - DNA, 20 bp, human
ggttacctccccgtcagagg

SEQ ID NO: 270043 - DNA, 20 bp, human
gtggcttggcctcctctgac

SEQ ID NO: 270044 - DNA, 20 bp, human
ggcagaagcgagagttccgt

SEQ ID NO: 270045 - DNA, 20 bp, human
gtaggagctttctcccggag

SEQ ID NO: 270046 - DNA, 20 bp, human
gaatcactagggtatgtctt

SEQ ID NO: 270047 - DNA, 20 bp, human
gggtaagcttgtcctaataa

SEQ ID NO: 270048 - DNA, 20 bp, human
gtctttggtgtgcaacgtga

SEQ ID NO: 270049 - DNA, 20 bp, human
gcagacatgaaagctaaccg

SEQ ID NO: 270050 - DNA, 20 bp, human
gcgatcacgtcccagactga

SEQ ID NO: 270051 - DNA, 20 bp, human
gccaaaagtgcagtgtataa

SEQ ID NO: 270052 - DNA, 20 bp, human
gacttcttgcttcccttatt

SEQ ID NO: 270053 - DNA, 20 bp, human
gcacaaaatgccatcagtct

SEQ ID NO: 270054 - DNA, 20 bp, human
gaatcagcatttaatcacta

SEQ ID NO: 270055 - DNA, 20 bp, human
ggatggtatctagtgttcaa

SEQ ID NO: 270056 - DNA, 20 bp, human
gactgaagctggtaaatcaa

SEQ ID NO: 270057 - DNA, 20 bp, human
gacagtgtcgttcctgtctt

SEQ ID NO: 270058 - DNA, 20 bp, human
gagtcagttcttgcaatagg

SEQ ID NO: 270059 - DNA, 20 bp, human
gtagcctagcagggtttgtg

SEQ ID NO: 270060 - DNA, 20 bp, human
gtggtagcctcaaactgtta

SEQ ID NO: 270061 - DNA, 20 bp, human
gcaagacaacttgaactcac

SEQ ID NO: 270062 - DNA, 20 bp, human
gatgaacaacttactgaagc

SEQ ID NO: 270063 - DNA, 20 bp, human
gtaggagttacacccaagac

SEQ ID NO: 270064 - DNA, 20 bp, human
gaaagcttgtccactcacga

SEQ ID NO: 270065 - DNA, 20 bp, human
gtcttcctttcatgcttatg

SEQ ID NO: 270066 - DNA, 20 bp, human
gtgcgctgataatcacgggg

SEQ ID NO: 270067 - DNA, 20 bp, human
gctgataatcacggggtggg

SEQ ID NO: 270068 - DNA, 20 bp, human
gtgtgtgcgctgataatcac

SEQ ID NO: 270069 - DNA, 20 bp, human
gttttcagatgactcgtaaa

SEQ ID NO: 270070 - DNA, 20 bp, human
gaaatcacagggccaacccg

SEQ ID NO: 270071 - DNA, 20 bp, human
ggaagaaaaaccacgctgta

SEQ ID NO: 270072 - DNA, 20 bp, human
gaaaaccacgctgtacggtg

SEQ ID NO: 270073 - DNA, 20 bp, human
ggcttccacaccgtacagcg

SEQ ID NO: 270074 - DNA, 20 bp, human
gtgaagctctatgtgtggat

SEQ ID NO: 270075 - DNA, 20 bp, human
ggtctctgcctgcctcgggt

SEQ ID NO: 270076 - DNA, 20 bp, human
ggggagcgcgcggagagcga

SEQ ID NO: 270077 - DNA, 20 bp, human
gcgagagagcaagcggcgga

SEQ ID NO: 270078 - DNA, 20 bp, human
gaggggctgcgactgagcct

SEQ ID NO: 270079 - DNA, 20 bp, human
gactgagcctgggctgcgag

SEQ ID NO: 270080 - DNA, 20 bp, human
ggcgggctccggactccgag

SEQ ID NO: 270081 - DNA, 20 bp, human
gaacgtggggagaagacgtg

SEQ ID NO: 270082 - DNA, 20 bp, human
gagactccaggggatggccg

SEQ ID NO: 270083 - DNA, 20 bp, human
ggcccgccgtccctgcggac

SEQ ID NO: 270084 - DNA, 20 bp, human
gccggagcccgccgtccctg

SEQ ID NO: 270085 - DNA, 20 bp, human
gaggccagggtgaatccctg

SEQ ID NO: 270086 - DNA, 20 bp, human
gaggccacactgcagcgcgg

SEQ ID NO: 270087 - DNA, 20 bp, human
gagcgcggacggcaaggggt

SEQ ID NO: 270088 - DNA, 20 bp, human
gccgcctggtgcgcgcccgt

SEQ ID NO: 270089 - DNA, 20 bp, human
ggctggggcccacacctgaa

SEQ ID NO: 270090 - DNA, 20 bp, human
gtgtccccctaggggaactg

SEQ ID NO: 270091 - DNA, 20 bp, human
gtccccaacgggcgcgcacc

SEQ ID NO: 270092 - DNA, 20 bp, human
ggcctgagcgcggacggcaa

SEQ ID NO: 270093 - DNA, 20 bp, human
gagcgcggcggcaaagtcgc

SEQ ID NO: 270094 - DNA, 20 bp, human
gcgcgcgcgctccccattgg

SEQ ID NO: 270095 - DNA, 20 bp, human
gggggcccacacctgaacgg

SEQ ID NO: 270096 - DNA, 20 bp, human
gaggacctggggatccggaa

SEQ ID NO: 270097 - DNA, 20 bp, human
gaggatgcgtaagatgatct

SEQ ID NO: 270098 - DNA, 20 bp, human
gcaaggggcttgggcaaacg

SEQ ID NO: 270099 - DNA, 20 bp, human
ggactctacccttacatgcc

SEQ ID NO: 270100 - DNA, 20 bp, human
ggcgccttttcaatgaaata

SEQ ID NO: 270101 - DNA, 20 bp, human
gtcaatgaaataaggggcaa

SEQ ID NO: 270102 - DNA, 20 bp, human
ggccgggggtcgaggacctg

SEQ ID NO: 270103 - DNA, 20 bp, human
gtccccaggtcctcgacccc

SEQ ID NO: 270104 - DNA, 20 bp, human
gggtggagatggaattacat

SEQ ID NO: 270105 - DNA, 20 bp, human
gctcgacccccggcatgtaa

SEQ ID NO: 270106 - DNA, 20 bp, human
gaataccatgttatcttgca

SEQ ID NO: 270107 - DNA, 20 bp, human
gatcgagtgcctttggattt

SEQ ID NO: 270108 - DNA, 20 bp, human
gcccttgatgagttcattta

SEQ ID NO: 270109 - DNA, 20 bp, human
gtgcataataggtgatcatc

SEQ ID NO: 270110 - DNA, 20 bp, human
gacagccctgcaagataaca

SEQ ID NO: 270111 - DNA, 20 bp, human
gatttctgagtcttccttaa

SEQ ID NO: 270112 - DNA, 20 bp, human
gttcattcatcgagtgcctt

SEQ ID NO: 270113 - DNA, 20 bp, human
gtccttaaatgaactcatca

SEQ ID NO: 270114 - DNA, 20 bp, human
ggatggtaactatcagaaca

SEQ ID NO: 270115 - DNA, 20 bp, human
gatcagtatgagaataatag

SEQ ID NO: 270116 - DNA, 20 bp, human
ggcgcccccgggcggagatg

SEQ ID NO: 270117 - DNA, 20 bp, human
gaaggccagccaatggcggg

SEQ ID NO: 270118 - DNA, 20 bp, human
ggggccggcgccgggaattc

SEQ ID NO: 270119 - DNA, 20 bp, human
gaattggccagcggccctca

SEQ ID NO: 270120 - DNA, 20 bp, human
gccccgggcggagatgggga

SEQ ID NO: 270121 - DNA, 20 bp, human
gctgccccgcccaatgctct

SEQ ID NO: 270122 - DNA, 20 bp, human
ggtatcgcaaggccagccaa

SEQ ID NO: 270123 - DNA, 20 bp, human
gccccgcccaatgctctagg

SEQ ID NO: 270124 - DNA, 20 bp, human
gggctccaggagaggtcacg

SEQ ID NO: 270125 - DNA, 20 bp, human
ggcgggacacgtcacaccag

SEQ ID NO: 270126 - DNA, 20 bp, human
ggctgcgttcgctgctccgg

SEQ ID NO: 270127 - DNA, 20 bp, human
gggctagcgcgcacccgcga

SEQ ID NO: 270128 - DNA, 20 bp, human
ggctccgggggctggtagag

SEQ ID NO: 270129 - DNA, 20 bp, human
ggcgcccggaccaatggcag

SEQ ID NO: 270130 - DNA, 20 bp, human
ggcggcacgccgggaccagc

SEQ ID NO: 270131 - DNA, 20 bp, human
gaaggtctggagatccggga

SEQ ID NO: 270132 - DNA, 20 bp, human
gggtggaaggtctggagatc

SEQ ID NO: 270133 - DNA, 20 bp, human
gcgtgctgcgttcgctgctc

SEQ ID NO: 270134 - DNA, 20 bp, human
gtagcgcgcacccgcgaggg

SEQ ID NO: 270135 - DNA, 20 bp, human
gccgccccctgccattggtc

SEQ ID NO: 270136 - DNA, 20 bp, human
gtggaaaggcaaaaaggggt

SEQ ID NO: 270137 - DNA, 20 bp, human
gggcaggagaggccagtagt

SEQ ID NO: 270138 - DNA, 20 bp, human
gacccagcacacgtgggctg

SEQ ID NO: 270139 - DNA, 20 bp, human
gcaaaagaggcgggcaggag

SEQ ID NO: 270140 - DNA, 20 bp, human
gctcccacaaggcccaaaag

SEQ ID NO: 270141 - DNA, 20 bp, human
gaccctcagcccacgtgtgc

SEQ ID NO: 270142 - DNA, 20 bp, human
gccttgtgggagtggggcga

SEQ ID NO: 270143 - DNA, 20 bp, human
gaggcccaaaagaggcgggc

SEQ ID NO: 270144 - DNA, 20 bp, human
gctgctcggcttcccactac

SEQ ID NO: 270145 - DNA, 20 bp, human
gcagcctggaaaggcaaaaa

SEQ ID NO: 270146 - DNA, 20 bp, human
ggggctggtcggtggtagtt

SEQ ID NO: 270147 - DNA, 20 bp, human
gggcgccgggactatgtcgc

SEQ ID NO: 270148 - DNA, 20 bp, human
ggggcggtgctgattgatgg

SEQ ID NO: 270149 - DNA, 20 bp, human
ggcggggcggtgctgattgg

SEQ ID NO: 270150 - DNA, 20 bp, human
gttggggcggtgctgattga

SEQ ID NO: 270151 - DNA, 20 bp, human
gagtgcgtgcccgctaaggg

SEQ ID NO: 270152 - DNA, 20 bp, human
gctggtgaggggcaggcctc

SEQ ID NO: 270153 - DNA, 20 bp, human
ggcgcaagggggctggtcgg

SEQ ID NO: 270154 - DNA, 20 bp, human
gggaaggggcggctttttag

SEQ ID NO: 270155 - DNA, 20 bp, human
gatggtgcacgcggaagggg

SEQ ID NO: 270156 - DNA, 20 bp, human
gtacgtgggcgacgcacgga

SEQ ID NO: 270157 - DNA, 20 bp, human
gcgcccggaaaaccatgatg

SEQ ID NO: 270158 - DNA, 20 bp, human
ggccagccaaggcgctccgg

SEQ ID NO: 270159 - DNA, 20 bp, human
ggggcgggtcagaaacaacc

SEQ ID NO: 270160 - DNA, 20 bp, human
ggcccacgtaaccacgcccc

SEQ ID NO: 270161 - DNA, 20 bp, human
gtgctgtgcggcgcggtctc

SEQ ID NO: 270162 - DNA, 20 bp, human
gacagcacgcatgcgccctg

SEQ ID NO: 270163 - DNA, 20 bp, human
gtggttacgtgggcgacgca

SEQ ID NO: 270164 - DNA, 20 bp, human
ggcccccggagcgccttggc

SEQ ID NO: 270165 - DNA, 20 bp, human
gtccgggggcgtggttacgt

SEQ ID NO: 270166 - DNA, 20 bp, human
gcgcccggaaaaccatgatg

SEQ ID NO: 270167 - DNA, 20 bp, human
gtacgtgggcgacgcacgga

SEQ ID NO: 270168 - DNA, 20 bp, human
ggccagccaaggcgctccgg

SEQ ID NO: 270169 - DNA, 20 bp, human
ggggcgggtcagaaacaacc

SEQ ID NO: 270170 - DNA, 20 bp, human
ggcccacgtaaccacgcccc

SEQ ID NO: 270171 - DNA, 20 bp, human
gacagcacgcatgcgccctg

SEQ ID NO: 270172 - DNA, 20 bp, human
gtgctgtgcggcgcggtctc

SEQ ID NO: 270173 - DNA, 20 bp, human
ggcccccggagcgccttggc

SEQ ID NO: 270174 - DNA, 20 bp, human
gtggttacgtgggcgacgca

SEQ ID NO: 270175 - DNA, 20 bp, human
gtccgggggcgtggttacgt

SEQ ID NO: 270176 - DNA, 20 bp, human
gcagctgggtagcaggaaat

SEQ ID NO: 270177 - DNA, 20 bp, human
gtctcagcctcagtctctgt

SEQ ID NO: 270178 - DNA, 20 bp, human
gttaatggcattaggacagt

SEQ ID NO: 270179 - DNA, 20 bp, human
ggagcaggggcccggacact

SEQ ID NO: 270180 - DNA, 20 bp, human
gtgtggtgagaagaatcaga

SEQ ID NO: 270181 - DNA, 20 bp, human
gggtgagaagaatcagaggg

SEQ ID NO: 270182 - DNA, 20 bp, human
gggtacatgagtttctaaac

SEQ ID NO: 270183 - DNA, 20 bp, human
ggccaagaaatccaagtgtc

SEQ ID NO: 270184 - DNA, 20 bp, human
ggtatattggtgtattcttg

SEQ ID NO: 270185 - DNA, 20 bp, human
gattaaagcagacagtatat

SEQ ID NO: 270186 - DNA, 20 bp, human
gcggagactactgaatgatg

SEQ ID NO: 270187 - DNA, 20 bp, human
gtccgctgacaacataccca

SEQ ID NO: 270188 - DNA, 20 bp, human
gctagccttctgtgagagac

SEQ ID NO: 270189 - DNA, 20 bp, human
gaatgatgggggagggacaa

SEQ ID NO: 270190 - DNA, 20 bp, human
gaatcccctaacagaaactc

SEQ ID NO: 270191 - DNA, 20 bp, human
gaatcctgagtttctgttag

SEQ ID NO: 270192 - DNA, 20 bp, human
gttcatgcttccaaatgtca

SEQ ID NO: 270193 - DNA, 20 bp, human
gggccacctgggacttggat

SEQ ID NO: 270194 - DNA, 20 bp, human
gtcgacttatgcagtacttc

SEQ ID NO: 270195 - DNA, 20 bp, human
ggctataaatcgggggtggg

SEQ ID NO: 270196 - DNA, 20 bp, human
gcaaggaagttggttttaca

SEQ ID NO: 270197 - DNA, 20 bp, human
gaagttggttttacagggat

SEQ ID NO: 270198 - DNA, 20 bp, human
gtggttttacagggatagga

SEQ ID NO: 270199 - DNA, 20 bp, human
gttgaaggacacggggacaa

SEQ ID NO: 270200 - DNA, 20 bp, human
gttgtcgaacctagtacaat

SEQ ID NO: 270201 - DNA, 20 bp, human
ggagacttagttgaaggaca

SEQ ID NO: 270202 - DNA, 20 bp, human
gtggactgacctattgtact

SEQ ID NO: 270203 - DNA, 20 bp, human
gttcgacaaagcaaaccaaa

SEQ ID NO: 270204 - DNA, 20 bp, human
gaacatccagatgaccaatc

SEQ ID NO: 270205 - DNA, 20 bp, human
gaaaaacctgattggtcatc

SEQ ID NO: 270206 - DNA, 20 bp, human
gggcccggaaagggacgaag

SEQ ID NO: 270207 - DNA, 20 bp, human
gacaaggtcggcgcactcgg

SEQ ID NO: 270208 - DNA, 20 bp, human
gtctggctgtagcacaaggt

SEQ ID NO: 270209 - DNA, 20 bp, human
gctacagccagaacagctcc

SEQ ID NO: 270210 - DNA, 20 bp, human
gctccgggaaacaagggcag

SEQ ID NO: 270211 - DNA, 20 bp, human
gtctccctacgggtcccgac

SEQ ID NO: 270212 - DNA, 20 bp, human
gacaagggcagcgggagaaa

SEQ ID NO: 270213 - DNA, 20 bp, human
ggcaacccgcctctccctac

SEQ ID NO: 270214 - DNA, 20 bp, human
gcaccacttccggtccgaca

SEQ ID NO: 270215 - DNA, 20 bp, human
ggtgcccagtcgggacccgt

SEQ ID NO: 270216 - DNA, 20 bp, human
ggcgctgaacaccccggagg

SEQ ID NO: 270217 - DNA, 20 bp, human
gtccgcgctgaacaccccgg

SEQ ID NO: 270218 - DNA, 20 bp, human
ggtagaggtgcaatgattac

SEQ ID NO: 270219 - DNA, 20 bp, human
gaccccggaggaggtctgca

SEQ ID NO: 270220 - DNA, 20 bp, human
gaccctgcagacctcctccg

SEQ ID NO: 270221 - DNA, 20 bp, human
ggaggaggtctgcagggtag

SEQ ID NO: 270222 - DNA, 20 bp, human
gtcagcgcggaggtgggtgt

SEQ ID NO: 270223 - DNA, 20 bp, human
gaggaaaaagctagcgaggc

SEQ ID NO: 270224 - DNA, 20 bp, human
gggcaagggagactagagga

SEQ ID NO: 270225 - DNA, 20 bp, human
gaggaggcaagggagactag

SEQ ID NO: 270226 - DNA, 20 bp, human
gcctaccaccgcgccgggga

SEQ ID NO: 270227 - DNA, 20 bp, human
gagggggtgctgtgccgctg

SEQ ID NO: 270228 - DNA, 20 bp, human
ggtgctgtgccgctggggga

SEQ ID NO: 270229 - DNA, 20 bp, human
gactaagtctggaccggggc

SEQ ID NO: 270230 - DNA, 20 bp, human
gctcagggtgctgtctgcaa

SEQ ID NO: 270231 - DNA, 20 bp, human
gtgggggacggcgcttctgt

SEQ ID NO: 270232 - DNA, 20 bp, human
ggcaccagcgtgaaccctgt

SEQ ID NO: 270233 - DNA, 20 bp, human
gacggcgcttctgtgggatt

SEQ ID NO: 270234 - DNA, 20 bp, human
gaaaccaacagggttcacgc

SEQ ID NO: 270235 - DNA, 20 bp, human
gacggagagaaggggtgtgt

SEQ ID NO: 270236 - DNA, 20 bp, human
gttaggcgcggccgacacgt

SEQ ID NO: 270237 - DNA, 20 bp, human
gagtcgggcgggcttaggcg

SEQ ID NO: 270238 - DNA, 20 bp, human
ggacgcgcgagcaggcacgg

SEQ ID NO: 270239 - DNA, 20 bp, human
gaaacgtggcgcctcggagg

SEQ ID NO: 270240 - DNA, 20 bp, human
gcaggcacgggggcaaaggg

SEQ ID NO: 270241 - DNA, 20 bp, human
gcctaccaccgcaccggggc

SEQ ID NO: 270242 - DNA, 20 bp, human
gcacaggcgcgggacggctt

SEQ ID NO: 270243 - DNA, 20 bp, human
gctggagggacaacgaacac

SEQ ID NO: 270244 - DNA, 20 bp, human
gcgcccctcccccacgacca

SEQ ID NO: 270245 - DNA, 20 bp, human
gtccgcgtccgcccctgctc

SEQ ID NO: 270246 - DNA, 20 bp, human
gtcaggactccctgtgagaa

SEQ ID NO: 270247 - DNA, 20 bp, human
ggctctgtgtaaacagtaga

SEQ ID NO: 270248 - DNA, 20 bp, human
ggctgtccgccagggaggtc

SEQ ID NO: 270249 - DNA, 20 bp, human
gacacagagcccgacctccc

SEQ ID NO: 270250 - DNA, 20 bp, human
gtagcggtggctgtccgcca

SEQ ID NO: 270251 - DNA, 20 bp, human
gctagccccgtgccttctgc

SEQ ID NO: 270252 - DNA, 20 bp, human
gaggaaaaagaaccccggga

SEQ ID NO: 270253 - DNA, 20 bp, human
gccaaccagcagaaggcacg

SEQ ID NO: 270254 - DNA, 20 bp, human
gttcctgagcgccaagcctc

SEQ ID NO: 270255 - DNA, 20 bp, human
gtggtttaaagggctttgag

SEQ ID NO: 270256 - DNA, 20 bp, human
ggcggggaaactgcggggag

SEQ ID NO: 270257 - DNA, 20 bp, human
gccaaggcggggaaactgcg

SEQ ID NO: 270258 - DNA, 20 bp, human
ggtggccaatcgttggtcgg

SEQ ID NO: 270259 - DNA, 20 bp, human
gtctgccaatcagctcttag

SEQ ID NO: 270260 - DNA, 20 bp, human
ggaggcgcaacaggttgtcc

SEQ ID NO: 270261 - DNA, 20 bp, human
gaatcagctcttagaggcca

SEQ ID NO: 270262 - DNA, 20 bp, human
gcctgcttgcgctactctct

SEQ ID NO: 270263 - DNA, 20 bp, human
gctcccaggtggccaatcgt

SEQ ID NO: 270264 - DNA, 20 bp, human
gccagcacagcagtgtgttc

SEQ ID NO: 270265 - DNA, 20 bp, human
gcctgggaggactggagtaa

SEQ ID NO: 270266 - DNA, 20 bp, human
gcctgtcagcggtaaggaag

SEQ ID NO: 270267 - DNA, 20 bp, human
gtacactcctgtcagcggta

SEQ ID NO: 270268 - DNA, 20 bp, human
ggagcagaagaaaaacgtca

SEQ ID NO: 270269 - DNA, 20 bp, human
ggaagatacactcctgtcag

SEQ ID NO: 270270 - DNA, 20 bp, human
gccctggatgaatggacaac

SEQ ID NO: 270271 - DNA, 20 bp, human
ggaaaaacgtcagggttgtt

SEQ ID NO: 270272 - DNA, 20 bp, human
ggagagacggtgactgtact

SEQ ID NO: 270273 - DNA, 20 bp, human
gagggattgtccctcagggt

SEQ ID NO: 270274 - DNA, 20 bp, human
gtagacagtagccagagggg

SEQ ID NO: 270275 - DNA, 20 bp, human
gacaccaatccctggatgaa

SEQ ID NO: 270276 - DNA, 20 bp, human
gtgcggccgccgtagctccc

SEQ ID NO: 270277 - DNA, 20 bp, human
ggcgggttctacagagacgt

SEQ ID NO: 270278 - DNA, 20 bp, human
gcgaggcgcggtgctgacgg

SEQ ID NO: 270279 - DNA, 20 bp, human
gttctgccggggagctacgg

SEQ ID NO: 270280 - DNA, 20 bp, human
ggctgcgcgcggatgccttt

SEQ ID NO: 270281 - DNA, 20 bp, human
gaggattcgcgcctcccgga

SEQ ID NO: 270282 - DNA, 20 bp, human
gagggagaaaagcccgcccg

SEQ ID NO: 270283 - DNA, 20 bp, human
ggcggccgcagagggccaaa

SEQ ID NO: 270284 - DNA, 20 bp, human
gtctggacgagtatgtgagt

SEQ ID NO: 270285 - DNA, 20 bp, human
gagcccgctgctctagcagg

SEQ ID NO: 270286 - DNA, 20 bp, human
gaattatggttgattgtatt

SEQ ID NO: 270287 - DNA, 20 bp, human
ggcccttcctaccttaaaaa

SEQ ID NO: 270288 - DNA, 20 bp, human
gtaggaagggccatttcatt

SEQ ID NO: 270289 - DNA, 20 bp, human
gtcttccccatttttaaggt

SEQ ID NO: 270290 - DNA, 20 bp, human
gcccatttttaaggtaggaa

SEQ ID NO: 270291 - DNA, 20 bp, human
gaaataaataccaaatgaaa

SEQ ID NO: 270292 - DNA, 20 bp, human
gagcacagggaccggaaaat

SEQ ID NO: 270293 - DNA, 20 bp, human
ggttttctggacaccatgac

SEQ ID NO: 270294 - DNA, 20 bp, human
gaaatgcttccccgattttc

SEQ ID NO: 270295 - DNA, 20 bp, human
gattatcttccccattttta

SEQ ID NO: 270296 - DNA, 20 bp, human
ggcccttcctaccttaaaaa

SEQ ID NO: 270297 - DNA, 20 bp, human
gtaggaagggccatttcatt

SEQ ID NO: 270298 - DNA, 20 bp, human
gtcttccccatttttaaggt

SEQ ID NO: 270299 - DNA, 20 bp, human
gcccatttttaaggtaggaa

SEQ ID NO: 270300 - DNA, 20 bp, human
gaaataaataccaaatgaaa

SEQ ID NO: 270301 - DNA, 20 bp, human
gagcacagggaccggaaaat

SEQ ID NO: 270302 - DNA, 20 bp, human
ggttttctggacaccatgac

SEQ ID NO: 270303 - DNA, 20 bp, human
gaaatgcttccccgattttc

SEQ ID NO: 270304 - DNA, 20 bp, human
gattatcttccccattttta

SEQ ID NO: 270305 - DNA, 20 bp, human
ggaaccgggagcacagggac

SEQ ID NO: 270306 - DNA, 20 bp, human
gcacagggaccggaagatca

SEQ ID NO: 270307 - DNA, 20 bp, human
gatcataaatacctccaggt

SEQ ID NO: 270308 - DNA, 20 bp, human
gcaggatcataaatacctcc

SEQ ID NO: 270309 - DNA, 20 bp, human
gaaatgattccctgatcttc

SEQ ID NO: 270310 - DNA, 20 bp, human
ggcccttcctaccttaaaaa

SEQ ID NO: 270311 - DNA, 20 bp, human
gtaggaagggccatttcatt

SEQ ID NO: 270312 - DNA, 20 bp, human
gtcttccccatttttaaggt

SEQ ID NO: 270313 - DNA, 20 bp, human
gcccatttttaaggtaggaa

SEQ ID NO: 270314 - DNA, 20 bp, human
gaaataaataccaaatgaaa

SEQ ID NO: 270315 - DNA, 20 bp, human
gattatcttccccattttta

SEQ ID NO: 270316 - DNA, 20 bp, human
gaaaggatctggtctatctt

SEQ ID NO: 270317 - DNA, 20 bp, human
gtgggctagcctgtttctcc

SEQ ID NO: 270318 - DNA, 20 bp, human
gcgaccagtccggatctgga

SEQ ID NO: 270319 - DNA, 20 bp, human
gaacagtttggtaaaggatc

SEQ ID NO: 270320 - DNA, 20 bp, human
gggagagagccgtccagatc

SEQ ID NO: 270321 - DNA, 20 bp, human
gttgtcagacacagagcaat

SEQ ID NO: 270322 - DNA, 20 bp, human
gtccggactggtcgaaagac

SEQ ID NO: 270323 - DNA, 20 bp, human
gttcccagcactgaaattca

SEQ ID NO: 270324 - DNA, 20 bp, human
gtgctttaacagtttggtaa

SEQ ID NO: 270325 - DNA, 20 bp, human
ggagccgtccagatccggac

SEQ ID NO: 270326 - DNA, 20 bp, human
gccccagcctggttctcacg

SEQ ID NO: 270327 - DNA, 20 bp, human
gtctcacggggcccacaccg

SEQ ID NO: 270328 - DNA, 20 bp, human
gacggggcccacaccgaggc

SEQ ID NO: 270329 - DNA, 20 bp, human
gcagcagggcaggacgagga

SEQ ID NO: 270330 - DNA, 20 bp, human
gctgcaaatagctgggtgtg

SEQ ID NO: 270331 - DNA, 20 bp, human
gtgacaacccctatctcctc

SEQ ID NO: 270332 - DNA, 20 bp, human
gagggctatgcaaaccccat

SEQ ID NO: 270333 - DNA, 20 bp, human
gcagcagccagcctcggtgt

SEQ ID NO: 270334 - DNA, 20 bp, human
gaggcaccctgaggagatag

SEQ ID NO: 270335 - DNA, 20 bp, human
ggtcagagctgcaaatagct

SEQ ID NO: 270336 - DNA, 20 bp, human
gtgctccgggcacgcccttt

SEQ ID NO: 270337 - DNA, 20 bp, human
gctttctgcgttgtcagcca

SEQ ID NO: 270338 - DNA, 20 bp, human
ggcagctgacgctgcatatg

SEQ ID NO: 270339 - DNA, 20 bp, human
gcattccatagctgagagag

SEQ ID NO: 270340 - DNA, 20 bp, human
gcaaaactggcacatgctcc

SEQ ID NO: 270341 - DNA, 20 bp, human
gggcacccctctctcagcta

SEQ ID NO: 270342 - DNA, 20 bp, human
gttcaaaactgagtgtggct

SEQ ID NO: 270343 - DNA, 20 bp, human
gagcatcttaacacacatgc

SEQ ID NO: 270344 - DNA, 20 bp, human
gttgtaatattcctacacgt

SEQ ID NO: 270345 - DNA, 20 bp, human
gctttcccaaagggcgtgcc

SEQ ID NO: 270346 - DNA, 20 bp, human
gactgagcaggccaccacca

SEQ ID NO: 270347 - DNA, 20 bp, human
gagcgacagcggccagggga

SEQ ID NO: 270348 - DNA, 20 bp, human
gcgcgccgagcagctgaagg

SEQ ID NO: 270349 - DNA, 20 bp, human
gcacgagcgcgcgcgacaga

SEQ ID NO: 270350 - DNA, 20 bp, human
gcgagcccgccgggggtctc

SEQ ID NO: 270351 - DNA, 20 bp, human
gtgcccgggctcgctcgccg

SEQ ID NO: 270352 - DNA, 20 bp, human
ggcccagcttgacgcagcgg

SEQ ID NO: 270353 - DNA, 20 bp, human
ggtcctcggcgagcgagccc

SEQ ID NO: 270354 - DNA, 20 bp, human
gccccctggcggtgtgggtc

SEQ ID NO: 270355 - DNA, 20 bp, human
gggggattccgcctcgggaa

SEQ ID NO: 270356 - DNA, 20 bp, human
gcctatgcctccctgaacta

SEQ ID NO: 270357 - DNA, 20 bp, human
gatgcctccctgaactaggg

SEQ ID NO: 270358 - DNA, 20 bp, human
gtagggctaacatacttaag

SEQ ID NO: 270359 - DNA, 20 bp, human
ggagcctccctagttcaggg

SEQ ID NO: 270360 - DNA, 20 bp, human
gacaagggacactgcttaac

SEQ ID NO: 270361 - DNA, 20 bp, human
ggacactgcttaacaggaaa

SEQ ID NO: 270362 - DNA, 20 bp, human
gcccggaagatgtcaatgaa

SEQ ID NO: 270363 - DNA, 20 bp, human
gagccctgtggagagatggg

SEQ ID NO: 270364 - DNA, 20 bp, human
ggaaggagcctccctagttc

SEQ ID NO: 270365 - DNA, 20 bp, human
gtctgtatgcggcgtacatg

SEQ ID NO: 270366 - DNA, 20 bp, human
gtataatgccaggagttgga

SEQ ID NO: 270367 - DNA, 20 bp, human
gatacagtgccgactcccag

SEQ ID NO: 270368 - DNA, 20 bp, human
gagccagacaaagggttaga

SEQ ID NO: 270369 - DNA, 20 bp, human
ggaccctctaaccctttgtc

SEQ ID NO: 270370 - DNA, 20 bp, human
ggcctggcagagtgcagcgt

SEQ ID NO: 270371 - DNA, 20 bp, human
ggagtctagcagccagacaa

SEQ ID NO: 270372 - DNA, 20 bp, human
gctgccaggcatattcctct

SEQ ID NO: 270373 - DNA, 20 bp, human
gctctgggcaaaacttcctc

SEQ ID NO: 270374 - DNA, 20 bp, human
ggtcggcactgtataatgcc

SEQ ID NO: 270375 - DNA, 20 bp, human
gcaaaacttcctctgggagt

SEQ ID NO: 270376 - DNA, 20 bp, human
gtcgcaaagcggcacagaca

SEQ ID NO: 270377 - DNA, 20 bp, human
gagggagcaaaaggctcaag

SEQ ID NO: 270378 - DNA, 20 bp, human
gcccgaggaggaagtcactt

SEQ ID NO: 270379 - DNA, 20 bp, human
gaaaggctcaaggggaagat

SEQ ID NO: 270380 - DNA, 20 bp, human
gcctccccaccctgtgtgaa

SEQ ID NO: 270381 - DNA, 20 bp, human
gacactgaccagattgcgag

SEQ ID NO: 270382 - DNA, 20 bp, human
gttaactgctaccttcgccc

SEQ ID NO: 270383 - DNA, 20 bp, human
gccccaccctgtgtgaaagg

SEQ ID NO: 270384 - DNA, 20 bp, human
gagggtgggaactgtgctta

SEQ ID NO: 270385 - DNA, 20 bp, human
ggctccctaagtctggattt

SEQ ID NO: 270386 - DNA, 20 bp, human
gcccaggagtagggtccaaa

SEQ ID NO: 270387 - DNA, 20 bp, human
gcgtgccccgggagcatcga

SEQ ID NO: 270388 - DNA, 20 bp, human
gttcgcgcgcgcgcaagacg

SEQ ID NO: 270389 - DNA, 20 bp, human
gaagcggagcaactctttgc

SEQ ID NO: 270390 - DNA, 20 bp, human
gcgccctggggaagcgccag

SEQ ID NO: 270391 - DNA, 20 bp, human
gctggccctcgatgctcccg

SEQ ID NO: 270392 - DNA, 20 bp, human
gaccactcgtccggtgtggg

SEQ ID NO: 270393 - DNA, 20 bp, human
gatgagtaaggtgttccccg

SEQ ID NO: 270394 - DNA, 20 bp, human
gaccccccacaccggacgag

SEQ ID NO: 270395 - DNA, 20 bp, human
ggagaccactcgtccggtgt

SEQ ID NO: 270396 - DNA, 20 bp, human
gccaatcgagatagagtact

SEQ ID NO: 270397 - DNA, 20 bp, human
gggacgctagagggctgctc

SEQ ID NO: 270398 - DNA, 20 bp, human
ggggctgctccggcttgact

SEQ ID NO: 270399 - DNA, 20 bp, human
gggagaggaacccctcgttt

SEQ ID NO: 270400 - DNA, 20 bp, human
ggagctgggcacgggcactg

SEQ ID NO: 270401 - DNA, 20 bp, human
gccctcgtttgggacgctag

SEQ ID NO: 270402 - DNA, 20 bp, human
ggagtactgggatgatgggc

SEQ ID NO: 270403 - DNA, 20 bp, human
gcagtcggacctagtcaagc

SEQ ID NO: 270404 - DNA, 20 bp, human
ggatagagtactgggatgat

SEQ ID NO: 270405 - DNA, 20 bp, human
gccaggtgtgagcacccaac

SEQ ID NO: 270406 - DNA, 20 bp, human
gccgccgcggccagttgggg

SEQ ID NO: 270407 - DNA, 20 bp, human
gctgccgccgcggccagttg

SEQ ID NO: 270408 - DNA, 20 bp, human
gcggacgcggagcgcccctc

SEQ ID NO: 270409 - DNA, 20 bp, human
ggaggggtgcggccacttgg

SEQ ID NO: 270410 - DNA, 20 bp, human
gcggccagttggggcgggtc

SEQ ID NO: 270411 - DNA, 20 bp, human
gcaaccaagcgtcccgcgga

SEQ ID NO: 270412 - DNA, 20 bp, human
gccggtaggaagagtcagag

SEQ ID NO: 270413 - DNA, 20 bp, human
gggacgcttggttgggtcca

SEQ ID NO: 270414 - DNA, 20 bp, human
gggagtacgccacccctcta

SEQ ID NO: 270415 - DNA, 20 bp, human
ggacccaaccaagcgtcccg

SEQ ID NO: 270416 - DNA, 20 bp, human
gtggcagcacaaatgccctt

SEQ ID NO: 270417 - DNA, 20 bp, human
ggcaggggatcaatagcatc

SEQ ID NO: 270418 - DNA, 20 bp, human
gtgaagtaatgcacacccaa

SEQ ID NO: 270419 - DNA, 20 bp, human
gagtgtgccccgctgacagt

SEQ ID NO: 270420 - DNA, 20 bp, human
gcaggcattcccactgtcag

SEQ ID NO: 270421 - DNA, 20 bp, human
gcgagtgcaccacatccagc

SEQ ID NO: 270422 - DNA, 20 bp, human
gcaagcatttgtggtccctg

SEQ ID NO: 270423 - DNA, 20 bp, human
gacagtgggaatgcctggct

SEQ ID NO: 270424 - DNA, 20 bp, human
gcatttgtgctgccaagtgc

SEQ ID NO: 270425 - DNA, 20 bp, human
gctgagtttaagaaggctag

SEQ ID NO: 270426 - DNA, 20 bp, human
ggggcgtgatgagacacgcg

SEQ ID NO: 270427 - DNA, 20 bp, human
gggctcccccgggtcgaagg

SEQ ID NO: 270428 - DNA, 20 bp, human
gtcgacccgggggagccaat

SEQ ID NO: 270429 - DNA, 20 bp, human
gggccccgcccccttcgacc

SEQ ID NO: 270430 - DNA, 20 bp, human
gtctcatcacgcccgtgggg

SEQ ID NO: 270431 - DNA, 20 bp, human
gacgtgacgcggccacccca

SEQ ID NO: 270432 - DNA, 20 bp, human
gacacgcgaggctggcgtcc

SEQ ID NO: 270433 - DNA, 20 bp, human
ggtgtctcatcacgcccgtg

SEQ ID NO: 270434 - DNA, 20 bp, human
gctggcgtccgggcatgcgc

SEQ ID NO: 270435 - DNA, 20 bp, human
gggctcccattggctccccc

SEQ ID NO: 270436 - DNA, 20 bp, human
gcgcccgcgccgtctggcgg

SEQ ID NO: 270437 - DNA, 20 bp, human
gccgcgcccgcgccgtctgg

SEQ ID NO: 270438 - DNA, 20 bp, human
gcggacgctgcgtgccccgg

SEQ ID NO: 270439 - DNA, 20 bp, human
ggtacccaggggggagactg

SEQ ID NO: 270440 - DNA, 20 bp, human
gcgggaccgcccactgcggc

SEQ ID NO: 270441 - DNA, 20 bp, human
gcgtccgctgagtacccagg

SEQ ID NO: 270442 - DNA, 20 bp, human
gctcccccctgggtactcag

SEQ ID NO: 270443 - DNA, 20 bp, human
gtccgctggctccgaggtcc

SEQ ID NO: 270444 - DNA, 20 bp, human
ggcggaggcagggcccgggt

SEQ ID NO: 270445 - DNA, 20 bp, human
gtcgcggcgccggcagctgg

SEQ ID NO: 270446 - DNA, 20 bp, human
gtgtccatgagccggcatga

SEQ ID NO: 270447 - DNA, 20 bp, human
gcaaaccacccacacttcat

SEQ ID NO: 270448 - DNA, 20 bp, human
gagcctgccacaggtagagc

SEQ ID NO: 270449 - DNA, 20 bp, human
gggatcccatgaagtgtggg

SEQ ID NO: 270450 - DNA, 20 bp, human
gttaggatcccatgaagtgt

SEQ ID NO: 270451 - DNA, 20 bp, human
gtcatggacaaagaatactc

SEQ ID NO: 270452 - DNA, 20 bp, human
ggatggggaaatgacgccac

SEQ ID NO: 270453 - DNA, 20 bp, human
gaggggtgacctacctccct

SEQ ID NO: 270454 - DNA, 20 bp, human
gaggggggataatgtgctta

SEQ ID NO: 270455 - DNA, 20 bp, human
gcagccctcatgccggctca

SEQ ID NO: 270456 - DNA, 20 bp, human
gaggtgccactgaaggcaat

SEQ ID NO: 270457 - DNA, 20 bp, human
ggacctgcaaccaacaggac

SEQ ID NO: 270458 - DNA, 20 bp, human
gagagactgcgcaggaccca

SEQ ID NO: 270459 - DNA, 20 bp, human
ggagccaggaagagctcaag

SEQ ID NO: 270460 - DNA, 20 bp, human
gaatccacttgagctcttcc

SEQ ID NO: 270461 - DNA, 20 bp, human
gaagagctctgcaaggaact

SEQ ID NO: 270462 - DNA, 20 bp, human
gcagtctctggcctgttagc

SEQ ID NO: 270463 - DNA, 20 bp, human
gaacaggccagagactgcgc

SEQ ID NO: 270464 - DNA, 20 bp, human
ggcaatcccattgccttcag

SEQ ID NO: 270465 - DNA, 20 bp, human
gtgacactaagcctctgctc

SEQ ID NO: 270466 - DNA, 20 bp, human
gttattgatagcattattcg

SEQ ID NO: 270467 - DNA, 20 bp, human
gttgcggggctgtctcttag

SEQ ID NO: 270468 - DNA, 20 bp, human
gagcggacagagtacgttgc

SEQ ID NO: 270469 - DNA, 20 bp, human
gaggaatcagggcatctaga

SEQ ID NO: 270470 - DNA, 20 bp, human
gttagcccacggaggaatca

SEQ ID NO: 270471 - DNA, 20 bp, human
gttgtctcgtagttgggtca

SEQ ID NO: 270472 - DNA, 20 bp, human
gccaacaacacggagtgaac

SEQ ID NO: 270473 - DNA, 20 bp, human
gacccaactacgagacaacc

SEQ ID NO: 270474 - DNA, 20 bp, human
ggggctgtctcttagaggca

SEQ ID NO: 270475 - DNA, 20 bp, human
gagccaggttgtctcgtagt

SEQ ID NO: 270476 - DNA, 20 bp, human
gggcagctgcagtgctgcga

SEQ ID NO: 270477 - DNA, 20 bp, human
gtgggcgagaggcgctgctc

SEQ ID NO: 270478 - DNA, 20 bp, human
ggggctagagcgcacggggc

SEQ ID NO: 270479 - DNA, 20 bp, human
ggtggggcacgagggtccga

SEQ ID NO: 270480 - DNA, 20 bp, human
gcggttgcacggctctcctt

SEQ ID NO: 270481 - DNA, 20 bp, human
gctctccttcggcttgggga

SEQ ID NO: 270482 - DNA, 20 bp, human
gggcacacgcagtgggtgac

SEQ ID NO: 270483 - DNA, 20 bp, human
gcccgtgcgctctagccccg

SEQ ID NO: 270484 - DNA, 20 bp, human
gcgggcgtccagagaaagcg

SEQ ID NO: 270485 - DNA, 20 bp, human
ggatctggtctaacagtcta

SEQ ID NO: 270486 - DNA, 20 bp, human
gtggcgaagtaggtactagt

SEQ ID NO: 270487 - DNA, 20 bp, human
gaagttctgcagcttagttt

SEQ ID NO: 270488 - DNA, 20 bp, human
gcaagaccagtgctagtttt

SEQ ID NO: 270489 - DNA, 20 bp, human
gtttgggaaaggttcccttt

SEQ ID NO: 270490 - DNA, 20 bp, human
gggagtcctaaaactagcac

SEQ ID NO: 270491 - DNA, 20 bp, human
gctgcagcttagtttgggaa

SEQ ID NO: 270492 - DNA, 20 bp, human
gttttggctcaaggcttaac

SEQ ID NO: 270493 - DNA, 20 bp, human
gtcacactgcagaaaggttt

SEQ ID NO: 270494 - DNA, 20 bp, human
ggtatcacatttcagcagct

SEQ ID NO: 270495 - DNA, 20 bp, human
gataatttttgtggcgaagt

SEQ ID NO: 270496 - DNA, 20 bp, human
gaggaaggagagatcggtgc

SEQ ID NO: 270497 - DNA, 20 bp, human
gaggagagatcggtgcgggg

SEQ ID NO: 270498 - DNA, 20 bp, human
gggaaagaaggacggtagaa

SEQ ID NO: 270499 - DNA, 20 bp, human
ggagtagcaaggggccagaa

SEQ ID NO: 270500 - DNA, 20 bp, human
gcctgcgtggagggaagtcg

SEQ ID NO: 270501 - DNA, 20 bp, human
gccaaatctgcctgcgtgga

SEQ ID NO: 270502 - DNA, 20 bp, human
gcaggcagatttggcccttc

SEQ ID NO: 270503 - DNA, 20 bp, human
gccacactccggagtagcaa

SEQ ID NO: 270504 - DNA, 20 bp, human
gagcgaggatgcgcagaccg

SEQ ID NO: 270505 - DNA, 20 bp, human
gaggatgcgcagaccgaggc

SEQ ID NO: 270506 - DNA, 20 bp, human
ggagcccagaggctgatctg

SEQ ID NO: 270507 - DNA, 20 bp, human
gcgcccacagatcagcctct

SEQ ID NO: 270508 - DNA, 20 bp, human
gggggcggaaagggttagtt

SEQ ID NO: 270509 - DNA, 20 bp, human
ggggcggggcctctctcgcc

SEQ ID NO: 270510 - DNA, 20 bp, human
gagtagccggggaatcgagg

SEQ ID NO: 270511 - DNA, 20 bp, human
ggaggaggcgcggggcggaa

SEQ ID NO: 270512 - DNA, 20 bp, human
gaagggtgcagcagtagccg

SEQ ID NO: 270513 - DNA, 20 bp, human
gtacactgaagggagtcggg

SEQ ID NO: 270514 - DNA, 20 bp, human
gccggggaatcgaggaggcg

SEQ ID NO: 270515 - DNA, 20 bp, human
ggagggaagggttttggcac

SEQ ID NO: 270516 - DNA, 20 bp, human
gtcctccaaagggaccttct

SEQ ID NO: 270517 - DNA, 20 bp, human
gagcaagcccggaggggaca

SEQ ID NO: 270518 - DNA, 20 bp, human
ggggctgaggacaccaaagt

SEQ ID NO: 270519 - DNA, 20 bp, human
gagcatgcgcagacgccaga

SEQ ID NO: 270520 - DNA, 20 bp, human
ggaccggcacgcagcctaga

SEQ ID NO: 270521 - DNA, 20 bp, human
gggagcggaaaggggacgga

SEQ ID NO: 270522 - DNA, 20 bp, human
gccagcccgcagcgtctcgt

SEQ ID NO: 270523 - DNA, 20 bp, human
ggaaggggagagggtctgaa

SEQ ID NO: 270524 - DNA, 20 bp, human
gcgggctggcggacccgagc

SEQ ID NO: 270525 - DNA, 20 bp, human
gcagagggcgctcctggcca

SEQ ID NO: 270526 - DNA, 20 bp, human
gagtgctcatctaaaggaca

SEQ ID NO: 270527 - DNA, 20 bp, human
gaagcaagtcctggacccgg

SEQ ID NO: 270528 - DNA, 20 bp, human
ggccgggagtgctcatctaa

SEQ ID NO: 270529 - DNA, 20 bp, human
gccgccgcggggctaaggga

SEQ ID NO: 270530 - DNA, 20 bp, human
gcaagtcctggacccggagg

SEQ ID NO: 270531 - DNA, 20 bp, human
ggctcatctaaaggacacgg

SEQ ID NO: 270532 - DNA, 20 bp, human
gagctctgcggatccacctc

SEQ ID NO: 270533 - DNA, 20 bp, human
gccagccaggtacgcaaccg

SEQ ID NO: 270534 - DNA, 20 bp, human
ggcggccgggagcaggtacc

SEQ ID NO: 270535 - DNA, 20 bp, human
gaggctgcctgcaccgcgtc

SEQ ID NO: 270536 - DNA, 20 bp, human
gagggcagagaatgattaga

SEQ ID NO: 270537 - DNA, 20 bp, human
gaagaccaacccgggaaaag

SEQ ID NO: 270538 - DNA, 20 bp, human
gggctccaaagcaacgttag

SEQ ID NO: 270539 - DNA, 20 bp, human
gccaacccgggaaaaggggc

SEQ ID NO: 270540 - DNA, 20 bp, human
gaaagcaacgttagaggcga

SEQ ID NO: 270541 - DNA, 20 bp, human
gtaggagcaactttgagcgg

SEQ ID NO: 270542 - DNA, 20 bp, human
ggggtgagccttgactgcca

SEQ ID NO: 270543 - DNA, 20 bp, human
gtcctcgccctccactggcc

SEQ ID NO: 270544 - DNA, 20 bp, human
gtcttcctgtacacttgatt

SEQ ID NO: 270545 - DNA, 20 bp, human
gattagagggaagaccaacc

SEQ ID NO: 270546 - DNA, 20 bp, human
gcccggggaagagaaggcct

SEQ ID NO: 270547 - DNA, 20 bp, human
gaaggcctgggagtcgcagg

SEQ ID NO: 270548 - DNA, 20 bp, human
gcgagcgcgccctcacacta

SEQ ID NO: 270549 - DNA, 20 bp, human
gagcccaccccaattcccta

SEQ ID NO: 270550 - DNA, 20 bp, human
ggggtgggctcttcagtgag

SEQ ID NO: 270551 - DNA, 20 bp, human
ggggcgcccactccattctc

SEQ ID NO: 270552 - DNA, 20 bp, human
gctcgactcggcgctgtctt

SEQ ID NO: 270553 - DNA, 20 bp, human
gttccgtagggaattggggt

SEQ ID NO: 270554 - DNA, 20 bp, human
gtccccctagttccccactt

SEQ ID NO: 270555 - DNA, 20 bp, human
gctgggagtcgcaggcggtg

SEQ ID NO: 270556 - DNA, 20 bp, human
gaggcccacgcctacagggg

SEQ ID NO: 270557 - DNA, 20 bp, human
gaaccctcccctgtaggcgt

SEQ ID NO: 270558 - DNA, 20 bp, human
ggtaggcgtgggcctaaatg

SEQ ID NO: 270559 - DNA, 20 bp, human
gtcagtgagaagctttatgt

SEQ ID NO: 270560 - DNA, 20 bp, human
ggagaagctttatgtaggtc

SEQ ID NO: 270561 - DNA, 20 bp, human
gaacctgcgtcagcttaagc

SEQ ID NO: 270562 - DNA, 20 bp, human
gttactgtggagtctgggtc

SEQ ID NO: 270563 - DNA, 20 bp, human
gctccagcttaagctgacgc

SEQ ID NO: 270564 - DNA, 20 bp, human
gaactaggctagcctcattt

SEQ ID NO: 270565 - DNA, 20 bp, human
gaaagggaacagctcgagac

SEQ ID NO: 270566 - DNA, 20 bp, human
gaccactgatggaatcctga

SEQ ID NO: 270567 - DNA, 20 bp, human
gcacttgcagccattaccta

SEQ ID NO: 270568 - DNA, 20 bp, human
gacaacccataacatgagtg

SEQ ID NO: 270569 - DNA, 20 bp, human
gagtatacatccataggtaa

SEQ ID NO: 270570 - DNA, 20 bp, human
gacatcctcactcatgttat

SEQ ID NO: 270571 - DNA, 20 bp, human
gaatttcagcaattagaaag

SEQ ID NO: 270572 - DNA, 20 bp, human
gttgtctacaaaagaacatc

SEQ ID NO: 270573 - DNA, 20 bp, human
ggtcctaggaataccactga

SEQ ID NO: 270574 - DNA, 20 bp, human
gttccatcagtggtattcct

SEQ ID NO: 270575 - DNA, 20 bp, human
gtgatgtcatagacccttga

SEQ ID NO: 270576 - DNA, 20 bp, human
gcggggagccggggttgtga

SEQ ID NO: 270577 - DNA, 20 bp, human
gtgcggcgaggacaccggtg

SEQ ID NO: 270578 - DNA, 20 bp, human
gggtcggggtgtccgaggtg

SEQ ID NO: 270579 - DNA, 20 bp, human
gaggtgggggacatccgggg

SEQ ID NO: 270580 - DNA, 20 bp, human
gggtggggtgagagcaccgg

SEQ ID NO: 270581 - DNA, 20 bp, human
gaccggtggggtgagagcac

SEQ ID NO: 270582 - DNA, 20 bp, human
ggacatccgggggggttagg

SEQ ID NO: 270583 - DNA, 20 bp, human
gagcgccgggtccctcggcc

SEQ ID NO: 270584 - DNA, 20 bp, human
gcaaggacgagcgaggtttg

SEQ ID NO: 270585 - DNA, 20 bp, human
ggaggggtgatgtcctcagg

SEQ ID NO: 270586 - DNA, 20 bp, human
gacagtgcggggccagtccg

SEQ ID NO: 270587 - DNA, 20 bp, human
ggggtcacacagcagtcccc

SEQ ID NO: 270588 - DNA, 20 bp, human
ggaccggcgcatcacactga

SEQ ID NO: 270589 - DNA, 20 bp, human
gtctgtgctgggcatccccc

SEQ ID NO: 270590 - DNA, 20 bp, human
gcccagggtaggacagtgcg

SEQ ID NO: 270591 - DNA, 20 bp, human
ggccccgcactgtcctaccc

SEQ ID NO: 270592 - DNA, 20 bp, human
ggctgggcatccccccggac

SEQ ID NO: 270593 - DNA, 20 bp, human
gtagcccaggcaaggtggtg

SEQ ID NO: 270594 - DNA, 20 bp, human
gtcccctgtcccagaaagag

SEQ ID NO: 270595 - DNA, 20 bp, human
gggacgctgacggccaccgg

SEQ ID NO: 270596 - DNA, 20 bp, human
gcccacacggggttggagga

SEQ ID NO: 270597 - DNA, 20 bp, human
gagggcggatcagagacgtg

SEQ ID NO: 270598 - DNA, 20 bp, human
ggctctgtgcaatccgggag

SEQ ID NO: 270599 - DNA, 20 bp, human
gccagagcccgagggcctga

SEQ ID NO: 270600 - DNA, 20 bp, human
gcacagagcccagagcccga

SEQ ID NO: 270601 - DNA, 20 bp, human
gtggcggccaccgagggtac

SEQ ID NO: 270602 - DNA, 20 bp, human
gagggcctggcggccaccga

SEQ ID NO: 270603 - DNA, 20 bp, human
gtggctgaaatccaagctga

SEQ ID NO: 270604 - DNA, 20 bp, human
gcgagggcctgagggcctac

SEQ ID NO: 270605 - DNA, 20 bp, human
gagagaggccaaaaggtgca

SEQ ID NO: 270606 - DNA, 20 bp, human
gttggtgcccaaaggggaat

SEQ ID NO: 270607 - DNA, 20 bp, human
gcccctttgggcaccaaagt

SEQ ID NO: 270608 - DNA, 20 bp, human
gtgcccaaaggggaatagga

SEQ ID NO: 270609 - DNA, 20 bp, human
ggcgcagcagcattaatcca

SEQ ID NO: 270610 - DNA, 20 bp, human
ggggagcattgtgactgtga

SEQ ID NO: 270611 - DNA, 20 bp, human
gttaccagaatgagaaacgg

SEQ ID NO: 270612 - DNA, 20 bp, human
gataggaaggcaaacaccgg

SEQ ID NO: 270613 - DNA, 20 bp, human
ggcctcttatcacaccacag

SEQ ID NO: 270614 - DNA, 20 bp, human
gaaaacttgcctaaattcac

SEQ ID NO: 270615 - DNA, 20 bp, human
gatccatggcctagaggagg

SEQ ID NO: 270616 - DNA, 20 bp, human
gccagcgcctggggctcact

SEQ ID NO: 270617 - DNA, 20 bp, human
gccctcacatccagcgcctg

SEQ ID NO: 270618 - DNA, 20 bp, human
ggctcactgggcggtgttgg

SEQ ID NO: 270619 - DNA, 20 bp, human
gacaccgcccagtgagcccc

SEQ ID NO: 270620 - DNA, 20 bp, human
gtgcgcaggcgcacccgccg

SEQ ID NO: 270621 - DNA, 20 bp, human
ggccccaggcgctggatgtg

SEQ ID NO: 270622 - DNA, 20 bp, human
ggcgcctggggctcactggg

SEQ ID NO: 270623 - DNA, 20 bp, human
ggtgatggagcgctaaccgg

SEQ ID NO: 270624 - DNA, 20 bp, human
gccccttgtcttctcatcca

SEQ ID NO: 270625 - DNA, 20 bp, human
gctggcacggagacttctgg

SEQ ID NO: 270626 - DNA, 20 bp, human
gcccgggaagtagccgtgga

SEQ ID NO: 270627 - DNA, 20 bp, human
gcagcctgcagaggcactag

SEQ ID NO: 270628 - DNA, 20 bp, human
gctagcggtagacagacggg

SEQ ID NO: 270629 - DNA, 20 bp, human
gggcactagcggtagacaga

SEQ ID NO: 270630 - DNA, 20 bp, human
ggctggaggaaaaaggatgg

SEQ ID NO: 270631 - DNA, 20 bp, human
gccggagagaccgctatcgc

SEQ ID NO: 270632 - DNA, 20 bp, human
gcgcagcggctgactgctcc

SEQ ID NO: 270633 - DNA, 20 bp, human
ggcagtcagccgctgcgcgc

SEQ ID NO: 270634 - DNA, 20 bp, human
gcgcggttgccagggtgaaa

SEQ ID NO: 270635 - DNA, 20 bp, human
gtgaaagggcggcccgcaga

SEQ ID NO: 270636 - DNA, 20 bp, human
gatggctggtcatgtggaga

SEQ ID NO: 270637 - DNA, 20 bp, human
gcacggcatgtgacctctcc

SEQ ID NO: 270638 - DNA, 20 bp, human
gagagggctggggactgtca

SEQ ID NO: 270639 - DNA, 20 bp, human
gtagcctgtggggcatgcag

SEQ ID NO: 270640 - DNA, 20 bp, human
ggtgaggggttttagacttg

SEQ ID NO: 270641 - DNA, 20 bp, human
gtagacttgtggctctacca

SEQ ID NO: 270642 - DNA, 20 bp, human
gacacttgagtagtaagaag

SEQ ID NO: 270643 - DNA, 20 bp, human
gcatgcagaggtcactagga

SEQ ID NO: 270644 - DNA, 20 bp, human
gggactgtcacggcaagacc

SEQ ID NO: 270645 - DNA, 20 bp, human
gttggaccttcactcatggc

SEQ ID NO: 270646 - DNA, 20 bp, human
gtagggggccagaatgtggg

SEQ ID NO: 270647 - DNA, 20 bp, human
gaatcagtgtttagatagac

SEQ ID NO: 270648 - DNA, 20 bp, human
gtaacaccttgtggatttgt

SEQ ID NO: 270649 - DNA, 20 bp, human
gtgattagggggccagaatg

SEQ ID NO: 270650 - DNA, 20 bp, human
gatgtgcaactaacaccttg

SEQ ID NO: 270651 - DNA, 20 bp, human
gttcacttacagcaagcttc

SEQ ID NO: 270652 - DNA, 20 bp, human
gagtcacaattaatttgaga

SEQ ID NO: 270653 - DNA, 20 bp, human
ggtcaaagcaatacttggaa

SEQ ID NO: 270654 - DNA, 20 bp, human
gacagcttttgatatgctct

SEQ ID NO: 270655 - DNA, 20 bp, human
ggcaagcttcaggctagcat

SEQ ID NO: 270656 - DNA, 20 bp, human
gaggggtactaataagtgaa

SEQ ID NO: 270657 - DNA, 20 bp, human
ggtaagaaacccaatcttga

SEQ ID NO: 270658 - DNA, 20 bp, human
gtgctgtgtgccttaggtca

SEQ ID NO: 270659 - DNA, 20 bp, human
ggggtcatgtgacccaccaa

SEQ ID NO: 270660 - DNA, 20 bp, human
gtagtgatgtgtcatattgt

SEQ ID NO: 270661 - DNA, 20 bp, human
gatatgacacatcactaaga

SEQ ID NO: 270662 - DNA, 20 bp, human
gaggtgggttagcaaacctt

SEQ ID NO: 270663 - DNA, 20 bp, human
gggtgggaggtacttctgat

SEQ ID NO: 270664 - DNA, 20 bp, human
gtttcttacaccctgaccta

SEQ ID NO: 270665 - DNA, 20 bp, human
ggagagaaaaccagcccttc

SEQ ID NO: 270666 - DNA, 20 bp, human
gaagacggaaggacacacgc

SEQ ID NO: 270667 - DNA, 20 bp, human
gcgctcccaacccccaccgt

SEQ ID NO: 270668 - DNA, 20 bp, human
gcgtcggcagcgaagacgga

SEQ ID NO: 270669 - DNA, 20 bp, human
gccctgcgagctgggacggc

SEQ ID NO: 270670 - DNA, 20 bp, human
gtcttcgctgccgacggtgg

SEQ ID NO: 270671 - DNA, 20 bp, human
ggccggccgtcccagctcgc

SEQ ID NO: 270672 - DNA, 20 bp, human
gggtctcgcgatagcggaaa

SEQ ID NO: 270673 - DNA, 20 bp, human
gcggaggaggaaactgtgct

SEQ ID NO: 270674 - DNA, 20 bp, human
gccggccccggtcccatttc

SEQ ID NO: 270675 - DNA, 20 bp, human
ggaggaaactgtgctcggag

SEQ ID NO: 270676 - DNA, 20 bp, human
ggtgggttaggctgttttaa

SEQ ID NO: 270677 - DNA, 20 bp, human
gaagaaatgaaaggcaagca

SEQ ID NO: 270678 - DNA, 20 bp, human
ggtaaaacatggtgagctgg

SEQ ID NO: 270679 - DNA, 20 bp, human
gttgtagttcaagaaatgaa

SEQ ID NO: 270680 - DNA, 20 bp, human
ggaaacagtaacttcaaatg

SEQ ID NO: 270681 - DNA, 20 bp, human
gacacaagtatctgatataa

SEQ ID NO: 270682 - DNA, 20 bp, human
ggcactcttactcagatatt

SEQ ID NO: 270683 - DNA, 20 bp, human
gatatcagatacttgtgtag

SEQ ID NO: 270684 - DNA, 20 bp, human
ggttttaaaggtttataaac

SEQ ID NO: 270685 - DNA, 20 bp, human
gaatattgctaaaggtgaat

SEQ ID NO: 270686 - DNA, 20 bp, human
gccgagaggcctgatctgag

SEQ ID NO: 270687 - DNA, 20 bp, human
ggatggggtgtggtctatat

SEQ ID NO: 270688 - DNA, 20 bp, human
gcccgcagagctgggaaaat

SEQ ID NO: 270689 - DNA, 20 bp, human
gcttctggggccgctaccat

SEQ ID NO: 270690 - DNA, 20 bp, human
gcgtagagcgcccgcagagc

SEQ ID NO: 270691 - DNA, 20 bp, human
ggcgcgagccgcccctcagg

SEQ ID NO: 270692 - DNA, 20 bp, human
gagcggccccagaagggcgg

SEQ ID NO: 270693 - DNA, 20 bp, human
gactgtggtcctctcagatc

SEQ ID NO: 270694 - DNA, 20 bp, human
gctgggaaaatcggtccgag

SEQ ID NO: 270695 - DNA, 20 bp, human
gttttcgttaggattggcta

SEQ ID NO: 270696 - DNA, 20 bp, human
gggtgtgcgcggctccttgg

SEQ ID NO: 270697 - DNA, 20 bp, human
gcgcgcgagtgtgagaggga

SEQ ID NO: 270698 - DNA, 20 bp, human
gggagggcggccgcgagcga

SEQ ID NO: 270699 - DNA, 20 bp, human
gcgcgcgcgcgagtgtgaga

SEQ ID NO: 270700 - DNA, 20 bp, human
ggggcggtctcccagtgtgt

SEQ ID NO: 270701 - DNA, 20 bp, human
ggaggtgcccgaaatcaaaa

SEQ ID NO: 270702 - DNA, 20 bp, human
gtgggcagcccggggctctt

SEQ ID NO: 270703 - DNA, 20 bp, human
gagcacggagacaaactccc

SEQ ID NO: 270704 - DNA, 20 bp, human
gcgtaggagcgagagggagg

SEQ ID NO: 270705 - DNA, 20 bp, human
ggggctacgcgtcgggggtg

SEQ ID NO: 270706 - DNA, 20 bp, human
gccgaaggggcgccggacga

SEQ ID NO: 270707 - DNA, 20 bp, human
gtgcctccgctccacgtcca

SEQ ID NO: 270708 - DNA, 20 bp, human
gagggaccgtgcggagagag

SEQ ID NO: 270709 - DNA, 20 bp, human
gccccctggacgtggagcgg

SEQ ID NO: 270710 - DNA, 20 bp, human
gcctgccacaaaggggtagg

SEQ ID NO: 270711 - DNA, 20 bp, human
gcggccccctggacgtggag

SEQ ID NO: 270712 - DNA, 20 bp, human
gccctgctccggggagcccg

SEQ ID NO: 270713 - DNA, 20 bp, human
gccgctgcagcagaaggggg

SEQ ID NO: 270714 - DNA, 20 bp, human
gaggactcccgcgggctccc

SEQ ID NO: 270715 - DNA, 20 bp, human
ggtccctgccacaaaggggt

SEQ ID NO: 270716 - DNA, 20 bp, human
gccgctgcggggggcagttg

SEQ ID NO: 270717 - DNA, 20 bp, human
gggaaccgggacaggggtgt

SEQ ID NO: 270718 - DNA, 20 bp, human
ggagcgcccgggtccccttc

SEQ ID NO: 270719 - DNA, 20 bp, human
gcccaagaggagcacgtctg

SEQ ID NO: 270720 - DNA, 20 bp, human
gggacaggggtgtgggttcg

SEQ ID NO: 270721 - DNA, 20 bp, human
gggcccgcgggacctttata

SEQ ID NO: 270722 - DNA, 20 bp, human
gccagggcggaaccgggaca

SEQ ID NO: 270723 - DNA, 20 bp, human
gcattctctggctccggaag

SEQ ID NO: 270724 - DNA, 20 bp, human
ggggcgggtcgggaacaagg

SEQ ID NO: 270725 - DNA, 20 bp, human
ggcgaggccgtgtcccgcgc

SEQ ID NO: 270726 - DNA, 20 bp, human
gccgctgccgcagtacgtgg

SEQ ID NO: 270727 - DNA, 20 bp, human
gggcctggggcgggaccacc

SEQ ID NO: 270728 - DNA, 20 bp, human
gaccacgcccccacgtactg

SEQ ID NO: 270729 - DNA, 20 bp, human
gacctgagcgtgacgtatcg

SEQ ID NO: 270730 - DNA, 20 bp, human
ggccccggtacatgacgctc

SEQ ID NO: 270731 - DNA, 20 bp, human
ggggccgctgccgcagtacg

SEQ ID NO: 270732 - DNA, 20 bp, human
gaggctgctgccgcagtagg

SEQ ID NO: 270733 - DNA, 20 bp, human
ggccccgatacgtcacgctc

SEQ ID NO: 270734 - DNA, 20 bp, human
gacctgcgcgtcatgtatcg

SEQ ID NO: 270735 - DNA, 20 bp, human
ggcgcagctcgcactcgtcg

SEQ ID NO: 270736 - DNA, 20 bp, human
gacgcggggcgcgatgactc

SEQ ID NO: 270737 - DNA, 20 bp, human
ggggccatctagggcccgga

SEQ ID NO: 270738 - DNA, 20 bp, human
ggccgccgcgcgggtctgac

SEQ ID NO: 270739 - DNA, 20 bp, human
ggcccagagggtgacgtcac

SEQ ID NO: 270740 - DNA, 20 bp, human
gcgggccggtacaccacagc

SEQ ID NO: 270741 - DNA, 20 bp, human
gaatccgcggccattgctcg

SEQ ID NO: 270742 - DNA, 20 bp, human
ggggcggcgcgcacaggtgg

SEQ ID NO: 270743 - DNA, 20 bp, human
gcctccctccgggccctaga

SEQ ID NO: 270744 - DNA, 20 bp, human
gtggggaacctggcccggaa

SEQ ID NO: 270745 - DNA, 20 bp, human
gggtcccggcggcagaaata

SEQ ID NO: 270746 - DNA, 20 bp, human
gctagcagaagcccagtcaa

SEQ ID NO: 270747 - DNA, 20 bp, human
gaggggccgcccccttgact

SEQ ID NO: 270748 - DNA, 20 bp, human
gtcaactcgccgagaggtga

SEQ ID NO: 270749 - DNA, 20 bp, human
gagaagcccagtcaaggggg

SEQ ID NO: 270750 - DNA, 20 bp, human
gcagctctggaaggaagacg

SEQ ID NO: 270751 - DNA, 20 bp, human
gggggcggcccctcacctct

SEQ ID NO: 270752 - DNA, 20 bp, human
gcttctgctagagtcagctg

SEQ ID NO: 270753 - DNA, 20 bp, human
ggaaacggcagtccccgcga

SEQ ID NO: 270754 - DNA, 20 bp, human
gagctgctgccactcaaccc

SEQ ID NO: 270755 - DNA, 20 bp, human
gagagtcagctgcggcaatc

SEQ ID NO: 270756 - DNA, 20 bp, human
gtccctgtgcagccgcggag

SEQ ID NO: 270757 - DNA, 20 bp, human
gaggcagcacagggtcacga

SEQ ID NO: 270758 - DNA, 20 bp, human
gcgggtgctgttgacccaga

SEQ ID NO: 270759 - DNA, 20 bp, human
ggctgttgacccagagggga

SEQ ID NO: 270760 - DNA, 20 bp, human
gtgagtggagccatcccctc

SEQ ID NO: 270761 - DNA, 20 bp, human
ggggtcacccgcagtggcac

SEQ ID NO: 270762 - DNA, 20 bp, human
gaacccacactctggctgag

SEQ ID NO: 270763 - DNA, 20 bp, human
gaggcctccctgtgccactg

SEQ ID NO: 270764 - DNA, 20 bp, human
gcagccagagtgtgggttcc

SEQ ID NO: 270765 - DNA, 20 bp, human
gagggaggcctcgtcacgac

SEQ ID NO: 270766 - DNA, 20 bp, human
gctgtgtctagctactgggg

SEQ ID NO: 270767 - DNA, 20 bp, human
gtgcagagggagtcgcctga

SEQ ID NO: 270768 - DNA, 20 bp, human
gtcgcctgagggtcccgttc

SEQ ID NO: 270769 - DNA, 20 bp, human
gagctactggggtgggaact

SEQ ID NO: 270770 - DNA, 20 bp, human
gggcgcctgtgtttctggga

SEQ ID NO: 270771 - DNA, 20 bp, human
ggcactgtgtctagctactg

SEQ ID NO: 270772 - DNA, 20 bp, human
gagacccccagccctaagtt

SEQ ID NO: 270773 - DNA, 20 bp, human
ggcgactccctctgcaaatc

SEQ ID NO: 270774 - DNA, 20 bp, human
ggcacgtggaatccacacac

SEQ ID NO: 270775 - DNA, 20 bp, human
gcctctccacaggaccagaa

SEQ ID NO: 270776 - DNA, 20 bp, human
ggctccgccagagcgcgcga

SEQ ID NO: 270777 - DNA, 20 bp, human
ggggtcccgcgcccaccgga

SEQ ID NO: 270778 - DNA, 20 bp, human
gagcgcgcgagggcctccag

SEQ ID NO: 270779 - DNA, 20 bp, human
gactgcctctgggacagcgg

SEQ ID NO: 270780 - DNA, 20 bp, human
ggaccccgcccctgctgtgg

SEQ ID NO: 270781 - DNA, 20 bp, human
gggcgcccgggcgttggaac

SEQ ID NO: 270782 - DNA, 20 bp, human
gcgagcccgctccttccggt

SEQ ID NO: 270783 - DNA, 20 bp, human
gcgcgcccaccggaaggagc

SEQ ID NO: 270784 - DNA, 20 bp, human
gggtgcccgttcgggaaaat

SEQ ID NO: 270785 - DNA, 20 bp, human
gtggccctgcgggtcgcttg

SEQ ID NO: 270786 - DNA, 20 bp, human
gaagtggccgggatttccga

SEQ ID NO: 270787 - DNA, 20 bp, human
gagagcgcgctcctccctaa

SEQ ID NO: 270788 - DNA, 20 bp, human
gcacaagcgctgacttccgt

SEQ ID NO: 270789 - DNA, 20 bp, human
gacagagttgcggggcaagg

SEQ ID NO: 270790 - DNA, 20 bp, human
gaggagcgcgctctgtcggt

SEQ ID NO: 270791 - DNA, 20 bp, human
gagggaggagcgcgctctgt

SEQ ID NO: 270792 - DNA, 20 bp, human
gcgctctgtcggtgggggga

SEQ ID NO: 270793 - DNA, 20 bp, human
gagcgcgctctgtcggtggg

SEQ ID NO: 270794 - DNA, 20 bp, human
ggggacagagttgcggggca

SEQ ID NO: 270795 - DNA, 20 bp, human
ggtgcgatgaaaccggaagt

SEQ ID NO: 270796 - DNA, 20 bp, human
gagggctagcggccaatctg

SEQ ID NO: 270797 - DNA, 20 bp, human
gccagcgtgttgtgaaatgg

SEQ ID NO: 270798 - DNA, 20 bp, human
gaggccgtgcctgaccaatc

SEQ ID NO: 270799 - DNA, 20 bp, human
gtgggaggctagagttttat

SEQ ID NO: 270800 - DNA, 20 bp, human
gcgaggggacgtggctaggg

SEQ ID NO: 270801 - DNA, 20 bp, human
ggggaccgccgaactgcgag

SEQ ID NO: 270802 - DNA, 20 bp, human
ggatccttgggaagcttgga

SEQ ID NO: 270803 - DNA, 20 bp, human
ggctagcggccaatctgcgg

SEQ ID NO: 270804 - DNA, 20 bp, human
ggcgccagcgtgttgtgaaa

SEQ ID NO: 270805 - DNA, 20 bp, human
gacgtcccctcgcagttcgg

SEQ ID NO: 270806 - DNA, 20 bp, human
gtggggcgcagtctaggcgg

SEQ ID NO: 270807 - DNA, 20 bp, human
gagcagaaatctcacgtcgt

SEQ ID NO: 270808 - DNA, 20 bp, human
gagaacgtggccctaggcaa

SEQ ID NO: 270809 - DNA, 20 bp, human
ggggctctggggacccgcgt

SEQ ID NO: 270810 - DNA, 20 bp, human
gagaaatctcacgtcgtcgg

SEQ ID NO: 270811 - DNA, 20 bp, human
gcggtgggggcgaatgctca

SEQ ID NO: 270812 - DNA, 20 bp, human
gacgcagtcaccgttgccta

SEQ ID NO: 270813 - DNA, 20 bp, human
gcgcgcctctggaacagaag

SEQ ID NO: 270814 - DNA, 20 bp, human
gctgtcaggagagtaggccc

SEQ ID NO: 270815 - DNA, 20 bp, human
gtgctcacggaatcgtgact

SEQ ID NO: 270816 - DNA, 20 bp, human
gggcacggtgagtacccggg

SEQ ID NO: 270817 - DNA, 20 bp, human
gtagcacaggagaatttccc

SEQ ID NO: 270818 - DNA, 20 bp, human
gggtgagtacccgggaggat

SEQ ID NO: 270819 - DNA, 20 bp, human
ggcaaacaggctagagtcca

SEQ ID NO: 270820 - DNA, 20 bp, human
gagggagaatagctccagac

SEQ ID NO: 270821 - DNA, 20 bp, human
ggcgccacgggatttagcac

SEQ ID NO: 270822 - DNA, 20 bp, human
gtagctagctgcagggccag

SEQ ID NO: 270823 - DNA, 20 bp, human
gactacgctcttccagctgt

SEQ ID NO: 270824 - DNA, 20 bp, human
gcagccgcccgccacgctgt

SEQ ID NO: 270825 - DNA, 20 bp, human
ggaggagcacgggagaaaca

SEQ ID NO: 270826 - DNA, 20 bp, human
ggcaacgggcacggccaaag

SEQ ID NO: 270827 - DNA, 20 bp, human
gcgggggagcaaatcgatct

SEQ ID NO: 270828 - DNA, 20 bp, human
gaacaagcacggtccaagaa

SEQ ID NO: 270829 - DNA, 20 bp, human
gtcccggcatgcaacgggca

SEQ ID NO: 270830 - DNA, 20 bp, human
gcggtccaagaagggagggg

SEQ ID NO: 270831 - DNA, 20 bp, human
gtgcgtggattcagccgctt

SEQ ID NO: 270832 - DNA, 20 bp, human
gcccgggggggcaagcctat

SEQ ID NO: 270833 - DNA, 20 bp, human
gaagcacggtccaagaaggg

SEQ ID NO: 270834 - DNA, 20 bp, human
gagcaaatcgatcttggcct

SEQ ID NO: 270835 - DNA, 20 bp, human
ggctcgcgaactgcgtttcc

SEQ ID NO: 270836 - DNA, 20 bp, human
gcaggcgcggggaacaccaa

SEQ ID NO: 270837 - DNA, 20 bp, human
gccaggagtcgtggtgacca

SEQ ID NO: 270838 - DNA, 20 bp, human
gagcgggcggcaggagacta

SEQ ID NO: 270839 - DNA, 20 bp, human
ggccacgcccccggaagcgg

SEQ ID NO: 270840 - DNA, 20 bp, human
gaccagaagagcagggtcgg

SEQ ID NO: 270841 - DNA, 20 bp, human
ggcgcggggaacaccaatgg

SEQ ID NO: 270842 - DNA, 20 bp, human
gcccccggaagcggcggtgc

SEQ ID NO: 270843 - DNA, 20 bp, human
gaagcgcgcgcggggattcc

SEQ ID NO: 270844 - DNA, 20 bp, human
gtgaggccaggcacttccgg

SEQ ID NO: 270845 - DNA, 20 bp, human
ggagtcgtggtgaccaggga

SEQ ID NO: 270846 - DNA, 20 bp, human
gctaagggaaccatgatggg

SEQ ID NO: 270847 - DNA, 20 bp, human
gagttcaggggctttggaag

SEQ ID NO: 270848 - DNA, 20 bp, human
ggtgcggcgagaccacacta

SEQ ID NO: 270849 - DNA, 20 bp, human
ggggacgcaggggacgcaag

SEQ ID NO: 270850 - DNA, 20 bp, human
gcgcgcaagcgcggaagcgg

SEQ ID NO: 270851 - DNA, 20 bp, human
gcacactaagggaaccatga

SEQ ID NO: 270852 - DNA, 20 bp, human
gtctaggtagtgtgcggaga

SEQ ID NO: 270853 - DNA, 20 bp, human
gggcggctactcgagttcag

SEQ ID NO: 270854 - DNA, 20 bp, human
gagcgcggaagcggaggatt

SEQ ID NO: 270855 - DNA, 20 bp, human
gagaagaattccgggtcaat

SEQ ID NO: 270856 - DNA, 20 bp, human
gaacgcgctggtgtgggtta

SEQ ID NO: 270857 - DNA, 20 bp, human
gagggctgagaaagaacgac

SEQ ID NO: 270858 - DNA, 20 bp, human
ggggaagggcgtgacaacga

SEQ ID NO: 270859 - DNA, 20 bp, human
gtccgcgcgttcttggggtg

SEQ ID NO: 270860 - DNA, 20 bp, human
gcgaccatcgtgccgtaaag

SEQ ID NO: 270861 - DNA, 20 bp, human
gctcctctccgcgcgttctt

SEQ ID NO: 270862 - DNA, 20 bp, human
gccatcgtgccgtaaagggg

SEQ ID NO: 270863 - DNA, 20 bp, human
gccgaggcaacgcgctggtg

SEQ ID NO: 270864 - DNA, 20 bp, human
gcaggaacagagacgtcgcg

SEQ ID NO: 270865 - DNA, 20 bp, human
ggagagcgctgccgcccgga

SEQ ID NO: 270866 - DNA, 20 bp, human
gcccacttccgatcggtcga

SEQ ID NO: 270867 - DNA, 20 bp, human
ggggacggcagcgccggggt

SEQ ID NO: 270868 - DNA, 20 bp, human
ggcgtcttgacaggtccccg

SEQ ID NO: 270869 - DNA, 20 bp, human
gcacgtgaccttcgaccgat

SEQ ID NO: 270870 - DNA, 20 bp, human
ggctggaggagtcgcgtctg

SEQ ID NO: 270871 - DNA, 20 bp, human
gaccttcgaccgatcggaag

SEQ ID NO: 270872 - DNA, 20 bp, human
gaccaaatcccgcccgggaa

SEQ ID NO: 270873 - DNA, 20 bp, human
gcctggaccaaatcccgccc

SEQ ID NO: 270874 - DNA, 20 bp, human
gtggcgatctgagcccaccc

SEQ ID NO: 270875 - DNA, 20 bp, human
gcagatcgccaggcagccgt

SEQ ID NO: 270876 - DNA, 20 bp, human
gagggcgctcctccgacccg

SEQ ID NO: 270877 - DNA, 20 bp, human
ggcccgagtcgcttcctcct

SEQ ID NO: 270878 - DNA, 20 bp, human
gtcaagaagggaaagacgca

SEQ ID NO: 270879 - DNA, 20 bp, human
gaaaaaggggtgggacaacc

SEQ ID NO: 270880 - DNA, 20 bp, human
gcgccctctggtgctcaaga

SEQ ID NO: 270881 - DNA, 20 bp, human
gtaactgcgaggttaaatcg

SEQ ID NO: 270882 - DNA, 20 bp, human
gggcacctgcgcgttaagag

SEQ ID NO: 270883 - DNA, 20 bp, human
gagtcgcttcctcctcgggt

SEQ ID NO: 270884 - DNA, 20 bp, human
ggttgacagcgcttcgctga

SEQ ID NO: 270885 - DNA, 20 bp, human
ggattggcccggaaggaaaa

SEQ ID NO: 270886 - DNA, 20 bp, human
ggggcgttccgaatgacctc

SEQ ID NO: 270887 - DNA, 20 bp, human
gagctgggacggctttgcta

SEQ ID NO: 270888 - DNA, 20 bp, human
gcgcggcgcggcatactcag

SEQ ID NO: 270889 - DNA, 20 bp, human
gcagccctcctgaggtcatt

SEQ ID NO: 270890 - DNA, 20 bp, human
gcgggagtggccactctccc

SEQ ID NO: 270891 - DNA, 20 bp, human
ggagcgatgcagccctcctg

SEQ ID NO: 270892 - DNA, 20 bp, human
gcgttccgaatgacctcagg

SEQ ID NO: 270893 - DNA, 20 bp, human
gtggccactcccgccccaga

SEQ ID NO: 270894 - DNA, 20 bp, human
gcgcggtcacctgaccaagt

SEQ ID NO: 270895 - DNA, 20 bp, human
gcagaggccgagaaggatct

SEQ ID NO: 270896 - DNA, 20 bp, human
gccaccgcataggccagcgt

SEQ ID NO: 270897 - DNA, 20 bp, human
gagcggggctgcaatccaga

SEQ ID NO: 270898 - DNA, 20 bp, human
gctgccccggccacccacgc

SEQ ID NO: 270899 - DNA, 20 bp, human
gccacccacgctggcctatg

SEQ ID NO: 270900 - DNA, 20 bp, human
ggaccctcgcggtgcactcc

SEQ ID NO: 270901 - DNA, 20 bp, human
gccaaggccgagcccccgtc

SEQ ID NO: 270902 - DNA, 20 bp, human
gatcccggagtcccagaaaa

SEQ ID NO: 270903 - DNA, 20 bp, human
gaggccagcgtgggtggccg

SEQ ID NO: 270904 - DNA, 20 bp, human
gctgggagttgtagtttcgt

SEQ ID NO: 270905 - DNA, 20 bp, human
gggggcagcgctttcctgaa

SEQ ID NO: 270906 - DNA, 20 bp, human
gaggtcctgcgctgagagaa

SEQ ID NO: 270907 - DNA, 20 bp, human
gggcgcgaaactccggaatg

SEQ ID NO: 270908 - DNA, 20 bp, human
ggccttccgcaactaggaag

SEQ ID NO: 270909 - DNA, 20 bp, human
gcatagccccgcgagagcgt

SEQ ID NO: 270910 - DNA, 20 bp, human
gagtcccctacgctctcgcg

SEQ ID NO: 270911 - DNA, 20 bp, human
gctgcgcaggcgcgaaactc

SEQ ID NO: 270912 - DNA, 20 bp, human
gcgcctggagtaggagaagg

SEQ ID NO: 270913 - DNA, 20 bp, human
ggaccttctgccttctgcgc

SEQ ID NO: 270914 - DNA, 20 bp, human
gaggactacgcgcctggagt

SEQ ID NO: 270915 - DNA, 20 bp, human
gccctcccccttcctagttg

SEQ ID NO: 270916 - DNA, 20 bp, human
gacggccgcggtgggtggag

SEQ ID NO: 270917 - DNA, 20 bp, human
gggctcgctcgctcagtacc

SEQ ID NO: 270918 - DNA, 20 bp, human
gagaaagcgtcccgggggtg

SEQ ID NO: 270919 - DNA, 20 bp, human
ggtgcgcagaaagcgtcccg

SEQ ID NO: 270920 - DNA, 20 bp, human
ggagcgagccccgacggccg

SEQ ID NO: 270921 - DNA, 20 bp, human
ggactcactgaaaataaaga

SEQ ID NO: 270922 - DNA, 20 bp, human
gtctcggtgcatctgttggg

SEQ ID NO: 270923 - DNA, 20 bp, human
gtcgctcgctcagtacctgg

SEQ ID NO: 270924 - DNA, 20 bp, human
gcatctgttgggcgggaccg

SEQ ID NO: 270925 - DNA, 20 bp, human
ggcgtcaggaactcgcctcc

SEQ ID NO: 270926 - DNA, 20 bp, human
gagggcggggctttattgga

SEQ ID NO: 270927 - DNA, 20 bp, human
ggggccatggtggcgctgaa

SEQ ID NO: 270928 - DNA, 20 bp, human
gagcgcgtagagcagctcgg

SEQ ID NO: 270929 - DNA, 20 bp, human
ggcagcacgaagtggtcaga

SEQ ID NO: 270930 - DNA, 20 bp, human
gctggcgcggatggggcacg

SEQ ID NO: 270931 - DNA, 20 bp, human
gcggggagccccaggaactg

SEQ ID NO: 270932 - DNA, 20 bp, human
gccaccatggcccggcagac

SEQ ID NO: 270933 - DNA, 20 bp, human
ggacctggcgaggagcccgt

SEQ ID NO: 270934 - DNA, 20 bp, human
gcatggcccggcagacgggg

SEQ ID NO: 270935 - DNA, 20 bp, human
gtccctggggtcaccatggt

SEQ ID NO: 270936 - DNA, 20 bp, human
ggatgtggtggtgacatatc

SEQ ID NO: 270937 - DNA, 20 bp, human
ggtgacatatctggtcgcac

SEQ ID NO: 270938 - DNA, 20 bp, human
gaagtcattaagtcagccag

SEQ ID NO: 270939 - DNA, 20 bp, human
gggagctaaaagtgatgtgg

SEQ ID NO: 270940 - DNA, 20 bp, human
gagacccaccccaataaatg

SEQ ID NO: 270941 - DNA, 20 bp, human
gtttcctcatttattggggt

SEQ ID NO: 270942 - DNA, 20 bp, human
gctactagagaggtggtctc

SEQ ID NO: 270943 - DNA, 20 bp, human
gctggaactggatcctaaca

SEQ ID NO: 270944 - DNA, 20 bp, human
gaaggcagaacacaaggagc

SEQ ID NO: 270945 - DNA, 20 bp, human
gtacataattgtggcagcac

SEQ ID NO: 270946 - DNA, 20 bp, human
ggaccctgagaggaacaaga

SEQ ID NO: 270947 - DNA, 20 bp, human
ggaagagtgccgaccctgag

SEQ ID NO: 270948 - DNA, 20 bp, human
gcccaccccaagtttcaatt

SEQ ID NO: 270949 - DNA, 20 bp, human
gctttagtgcgtagcagggg

SEQ ID NO: 270950 - DNA, 20 bp, human
gggggcctgaaatgagatct

SEQ ID NO: 270951 - DNA, 20 bp, human
gccagtcagccccgggccac

SEQ ID NO: 270952 - DNA, 20 bp, human
gtcccctcttgttcctctca

SEQ ID NO: 270953 - DNA, 20 bp, human
gggcagctttagtgcgtagc

SEQ ID NO: 270954 - DNA, 20 bp, human
ggggggcatggggccgagac

SEQ ID NO: 270955 - DNA, 20 bp, human
gcaggccccaattgaaactt

SEQ ID NO: 270956 - DNA, 20 bp, human
gtctacctgccctacgaagg

SEQ ID NO: 270957 - DNA, 20 bp, human
ggggggtggagatagatcgt

SEQ ID NO: 270958 - DNA, 20 bp, human
gagggtccgagcaggcagaa

SEQ ID NO: 270959 - DNA, 20 bp, human
gcgtaccactgtgccttcat

SEQ ID NO: 270960 - DNA, 20 bp, human
gtagtcctgccgaggagaga

SEQ ID NO: 270961 - DNA, 20 bp, human
ggcactccgcccccttcgta

SEQ ID NO: 270962 - DNA, 20 bp, human
gcgcctgcgcggtgcgtagg

SEQ ID NO: 270963 - DNA, 20 bp, human
gaccaaacgcggaagagcag

SEQ ID NO: 270964 - DNA, 20 bp, human
gacagccgggagtagcgggg

SEQ ID NO: 270965 - DNA, 20 bp, human
gcggcggctggggacgaaac

SEQ ID NO: 270966 - DNA, 20 bp, human
gcccctgcatccccgatctg

SEQ ID NO: 270967 - DNA, 20 bp, human
ggggctcggcgccaagtgac

SEQ ID NO: 270968 - DNA, 20 bp, human
gtcacccagggcaggctacc

SEQ ID NO: 270969 - DNA, 20 bp, human
gcgactctaagccctggcac

SEQ ID NO: 270970 - DNA, 20 bp, human
gtggagccccgcccgtcact

SEQ ID NO: 270971 - DNA, 20 bp, human
gcccaccgctccccagatcg

SEQ ID NO: 270972 - DNA, 20 bp, human
ggggctaaggcgatggcccc

SEQ ID NO: 270973 - DNA, 20 bp, human
gccttcgcgcaggtcaatga

SEQ ID NO: 270974 - DNA, 20 bp, human
gggtccacgcaatgatgctg

SEQ ID NO: 270975 - DNA, 20 bp, human
gaagccaggtagcctgccct

SEQ ID NO: 270976 - DNA, 20 bp, human
ggtcccaagagcttgtgaac

SEQ ID NO: 270977 - DNA, 20 bp, human
ggcccggtgttcttagaacc

SEQ ID NO: 270978 - DNA, 20 bp, human
gaagacccgaagagccgatc

SEQ ID NO: 270979 - DNA, 20 bp, human
gttcccgagaactttccata

SEQ ID NO: 270980 - DNA, 20 bp, human
gtgaaaacccggatccaggc

SEQ ID NO: 270981 - DNA, 20 bp, human
ggggccctcttctttaagac

SEQ ID NO: 270982 - DNA, 20 bp, human
gcggccctatggaaagttct

SEQ ID NO: 270983 - DNA, 20 bp, human
gcgaaccaagatcatcagca

SEQ ID NO: 270984 - DNA, 20 bp, human
gccgaagagccgatcaggag

SEQ ID NO: 270985 - DNA, 20 bp, human
gagctcggggcgcgttccgg

SEQ ID NO: 270986 - DNA, 20 bp, human
gagcaggggcatcccaggtg

SEQ ID NO: 270987 - DNA, 20 bp, human
gtcctgcccccaagccagtt

SEQ ID NO: 270988 - DNA, 20 bp, human
gccggcctccctctccgcta

SEQ ID NO: 270989 - DNA, 20 bp, human
gcgctgggcggggtcggtgc

SEQ ID NO: 270990 - DNA, 20 bp, human
gcacgtgcccccgtggcgta

SEQ ID NO: 270991 - DNA, 20 bp, human
gcatgggtccgtagcggaga

SEQ ID NO: 270992 - DNA, 20 bp, human
gcccccaagccagttggggt

SEQ ID NO: 270993 - DNA, 20 bp, human
gagtgggcggaaccgtggga

SEQ ID NO: 270994 - DNA, 20 bp, human
gctcagagtgggatgtgaac

SEQ ID NO: 270995 - DNA, 20 bp, human
ggcggagtgggcggaaccgt

SEQ ID NO: 270996 - DNA, 20 bp, human
ggtgcaggtggaggagctaa

SEQ ID NO: 270997 - DNA, 20 bp, human
gagaccctcggggacccgga

SEQ ID NO: 270998 - DNA, 20 bp, human
gcccccatccgggtccccga

SEQ ID NO: 270999 - DNA, 20 bp, human
gttgtggccggcaatgggga

SEQ ID NO: 271000 - DNA, 20 bp, human
gcaagcctggccataagggt

SEQ ID NO: 271001 - DNA, 20 bp, human
gcaccccaagcctggccata

SEQ ID NO: 271002 - DNA, 20 bp, human
gtccccgagggtcttccttg

SEQ ID NO: 271003 - DNA, 20 bp, human
gagcccagccacacctgctc

SEQ ID NO: 271004 - DNA, 20 bp, human
gtccccaaggaagaccctcg

SEQ ID NO: 271005 - DNA, 20 bp, human
gcaaggtcgcatcccccatc

SEQ ID NO: 271006 - DNA, 20 bp, human
gggagcccgggtcacgtccc

SEQ ID NO: 271007 - DNA, 20 bp, human
gtaagggtgcaggaacttgg

SEQ ID NO: 271008 - DNA, 20 bp, human
gctgcaggggagaacaccct

SEQ ID NO: 271009 - DNA, 20 bp, human
ggtctggaagccagtttccg

SEQ ID NO: 271010 - DNA, 20 bp, human
gcgcctgtgagaccggataa

SEQ ID NO: 271011 - DNA, 20 bp, human
ggcagcacacacctgtcacc

SEQ ID NO: 271012 - DNA, 20 bp, human
gcacccttatccggtctcac

SEQ ID NO: 271013 - DNA, 20 bp, human
ggaggcccgggacgtgaccc

SEQ ID NO: 271014 - DNA, 20 bp, human
ggaaacccatggggcccccg

SEQ ID NO: 271015 - DNA, 20 bp, human
gcctgtcaccaggtgaccta

SEQ ID NO: 271016 - DNA, 20 bp, human
ggcgccgcaggaggctcccg

SEQ ID NO: 271017 - DNA, 20 bp, human
gaggctcccggggcctggtc

SEQ ID NO: 271018 - DNA, 20 bp, human
ggcggaacggaggatagcgt

SEQ ID NO: 271019 - DNA, 20 bp, human
gggcgcgcgcagagggaaac

SEQ ID NO: 271020 - DNA, 20 bp, human
ggccccgcccggcacttggg

SEQ ID NO: 271021 - DNA, 20 bp, human
gccgccttccgtctgttcta

SEQ ID NO: 271022 - DNA, 20 bp, human
gaagccctcgggcgcgggct

SEQ ID NO: 271023 - DNA, 20 bp, human
gatgaggcgcttgtggggcg

SEQ ID NO: 271024 - DNA, 20 bp, human
gcgagacggtcgaattgtgg

SEQ ID NO: 271025 - DNA, 20 bp, human
gtctcccagcccgcgcccga

SEQ ID NO: 271026 - DNA, 20 bp, human
ggggccgtggacaggatcag

SEQ ID NO: 271027 - DNA, 20 bp, human
gacagccgcggggtgaacag

SEQ ID NO: 271028 - DNA, 20 bp, human
ggggactatctactagggga

SEQ ID NO: 271029 - DNA, 20 bp, human
gagggaggggacagtatcga

SEQ ID NO: 271030 - DNA, 20 bp, human
ggaggggccgggctcagact

SEQ ID NO: 271031 - DNA, 20 bp, human
gggcggggactatctactag

SEQ ID NO: 271032 - DNA, 20 bp, human
gctcagggagtcctaggtta

SEQ ID NO: 271033 - DNA, 20 bp, human
ggatcaggggcggggattat

SEQ ID NO: 271034 - DNA, 20 bp, human
ggggcgggactccagttgat

SEQ ID NO: 271035 - DNA, 20 bp, human
ggctgcgcgcgcaacctttc

SEQ ID NO: 271036 - DNA, 20 bp, human
gctccaggacaggatgccct

SEQ ID NO: 271037 - DNA, 20 bp, human
gtcccaaagcgggttccaca

SEQ ID NO: 271038 - DNA, 20 bp, human
gccccgttgcagaaccaaac

SEQ ID NO: 271039 - DNA, 20 bp, human
ggacccagggcatcctgtcc

SEQ ID NO: 271040 - DNA, 20 bp, human
ggttctgcaacggggattag

SEQ ID NO: 271041 - DNA, 20 bp, human
gcaaacagggtgaagggatt

SEQ ID NO: 271042 - DNA, 20 bp, human
gtggaacccgctttgggaac

SEQ ID NO: 271043 - DNA, 20 bp, human
gctgtggcttcaatgcgatg

SEQ ID NO: 271044 - DNA, 20 bp, human
gaacccgctttgggaaccgg

SEQ ID NO: 271045 - DNA, 20 bp, human
gtgagtgagaaggtgggatc

SEQ ID NO: 271046 - DNA, 20 bp, human
ggaggggtacagccacaaga

SEQ ID NO: 271047 - DNA, 20 bp, human
gtcggggacttgctagtcct

SEQ ID NO: 271048 - DNA, 20 bp, human
gtgcccagctggacatctct

SEQ ID NO: 271049 - DNA, 20 bp, human
gactagcaagtccccgagat

SEQ ID NO: 271050 - DNA, 20 bp, human
gtctctggagaccagtgggg

SEQ ID NO: 271051 - DNA, 20 bp, human
gcccctgcccccacaacctt

SEQ ID NO: 271052 - DNA, 20 bp, human
gtgggggcgtcatattgccc

SEQ ID NO: 271053 - DNA, 20 bp, human
gggcccagagatgtccagct

SEQ ID NO: 271054 - DNA, 20 bp, human
gtagtcctggggctgctggg

SEQ ID NO: 271055 - DNA, 20 bp, human
gacaagagggatgccaagcc

SEQ ID NO: 271056 - DNA, 20 bp, human
gcggctgcgcacgccggctc

SEQ ID NO: 271057 - DNA, 20 bp, human
ggcgaccctggcatgtgcca

SEQ ID NO: 271058 - DNA, 20 bp, human
gcgagcggatcctggatccc

SEQ ID NO: 271059 - DNA, 20 bp, human
gctgctgctacgctctccac

SEQ ID NO: 271060 - DNA, 20 bp, human
gatgcagagcagtggaccga

SEQ ID NO: 271061 - DNA, 20 bp, human
gcaccggcgcagcgaggaag

SEQ ID NO: 271062 - DNA, 20 bp, human
gaatacgagtctcaaggtct

SEQ ID NO: 271063 - DNA, 20 bp, human
gccggctcgcacacaggcgt

SEQ ID NO: 271064 - DNA, 20 bp, human
ggagctgcgcgccgcgtgag

SEQ ID NO: 271065 - DNA, 20 bp, human
gtcagcctccggccttcagg

SEQ ID NO: 271066 - DNA, 20 bp, human
gtggtcgcccagagttgagg

SEQ ID NO: 271067 - DNA, 20 bp, human
gaggaggcacgcggtaggga

SEQ ID NO: 271068 - DNA, 20 bp, human
gccccagcctgagccacgag

SEQ ID NO: 271069 - DNA, 20 bp, human
ggtggcggggagagctgtag

SEQ ID NO: 271070 - DNA, 20 bp, human
gcacaggtgccacaggccgg

SEQ ID NO: 271071 - DNA, 20 bp, human
gggggaggaggcacgcggta

SEQ ID NO: 271072 - DNA, 20 bp, human
gcccaaggaaagggcgcgaa

SEQ ID NO: 271073 - DNA, 20 bp, human
gccacgagaggaagagccca

SEQ ID NO: 271074 - DNA, 20 bp, human
gggaggggaaatgtaagatg

SEQ ID NO: 271075 - DNA, 20 bp, human
gcgcccagagttgagggggt

SEQ ID NO: 271076 - DNA, 20 bp, human
gtggactcaaccaccctcga

SEQ ID NO: 271077 - DNA, 20 bp, human
ggggcggaagagaacctaat

SEQ ID NO: 271078 - DNA, 20 bp, human
gtgcctagccaccatcctgt

SEQ ID NO: 271079 - DNA, 20 bp, human
gtggaaacctacagggaatg

SEQ ID NO: 271080 - DNA, 20 bp, human
gcagcctgatatccattcca

SEQ ID NO: 271081 - DNA, 20 bp, human
gaagtccgagcaccctcctt

SEQ ID NO: 271082 - DNA, 20 bp, human
ggtaaagagaaccaagaagc

SEQ ID NO: 271083 - DNA, 20 bp, human
ggtaccgtgacttccggcta

SEQ ID NO: 271084 - DNA, 20 bp, human
gtagcaaccacattccctgt

SEQ ID NO: 271085 - DNA, 20 bp, human
gtggttgctaggcaatgctt

SEQ ID NO: 271086 - DNA, 20 bp, human
gggggcgtggtcaatcggga

SEQ ID NO: 271087 - DNA, 20 bp, human
ggataggggcgtggtcaatc

SEQ ID NO: 271088 - DNA, 20 bp, human
gggggggtgtacaaggatag

SEQ ID NO: 271089 - DNA, 20 bp, human
gaagaagagtggagggcgga

SEQ ID NO: 271090 - DNA, 20 bp, human
gcgggagcggccgatcttgg

SEQ ID NO: 271091 - DNA, 20 bp, human
gcctggaagaatagaggcag

SEQ ID NO: 271092 - DNA, 20 bp, human
gggaggtcggggggtgtaca

SEQ ID NO: 271093 - DNA, 20 bp, human
ggggaaagatgccgctggca

SEQ ID NO: 271094 - DNA, 20 bp, human
gtgaggtcgtcatgggaagg

SEQ ID NO: 271095 - DNA, 20 bp, human
gtggtggggaagggccctcc

SEQ ID NO: 271096 - DNA, 20 bp, human
gcagctagaggttagacctc

SEQ ID NO: 271097 - DNA, 20 bp, human
gcgcaggcactcttctgtgg

SEQ ID NO: 271098 - DNA, 20 bp, human
ggtgctgcggcgacccctgg

SEQ ID NO: 271099 - DNA, 20 bp, human
gagagtggggccaactctgc

SEQ ID NO: 271100 - DNA, 20 bp, human
gtgcggcccgcggctgttcc

SEQ ID NO: 271101 - DNA, 20 bp, human
ggtgcaggtcgcatcgatgt

SEQ ID NO: 271102 - DNA, 20 bp, human
gccgcagcacccagcgctgg

SEQ ID NO: 271103 - DNA, 20 bp, human
ggaagagtgcctgcggccag

SEQ ID NO: 271104 - DNA, 20 bp, human
ggctgcttggccgccggtat

SEQ ID NO: 271105 - DNA, 20 bp, human
gcaggaggccggctactgcg

SEQ ID NO: 271106 - DNA, 20 bp, human
ggcgaactgcgggcactgtg

SEQ ID NO: 271107 - DNA, 20 bp, human
gcggcacgttgagaccccag

SEQ ID NO: 271108 - DNA, 20 bp, human
gcctgcgcaccctgcatcac

SEQ ID NO: 271109 - DNA, 20 bp, human
gcgtgccgccccgactctcc

SEQ ID NO: 271110 - DNA, 20 bp, human
gcaccctgcatcaccggctt

SEQ ID NO: 271111 - DNA, 20 bp, human
gcctaggggcgggtcaacaa

SEQ ID NO: 271112 - DNA, 20 bp, human
gccgccgcggtgcgaactgc

SEQ ID NO: 271113 - DNA, 20 bp, human
gggggcgggtcaacaaaggt

SEQ ID NO: 271114 - DNA, 20 bp, human
gtcaggatgccggagctcag

SEQ ID NO: 271115 - DNA, 20 bp, human
gggatcccacctggagagtc

SEQ ID NO: 271116 - DNA, 20 bp, human
gctagcaagcgaccaggagg

SEQ ID NO: 271117 - DNA, 20 bp, human
ggggccagcggcggcggagt

SEQ ID NO: 271118 - DNA, 20 bp, human
gctagcgccagctagcgcat

SEQ ID NO: 271119 - DNA, 20 bp, human
gccaccgccgcctactgcgc

SEQ ID NO: 271120 - DNA, 20 bp, human
ggcgctagcaagcgaccagg

SEQ ID NO: 271121 - DNA, 20 bp, human
gcaagcgctagcaagcgacc

SEQ ID NO: 271122 - DNA, 20 bp, human
gtgtgcggacgccgcccaat

SEQ ID NO: 271123 - DNA, 20 bp, human
gcgctagctggcgctagctg

SEQ ID NO: 271124 - DNA, 20 bp, human
ggcttggacaagttagggat

SEQ ID NO: 271125 - DNA, 20 bp, human
gtgcgcaccaagaaagacaa

SEQ ID NO: 271126 - DNA, 20 bp, human
gaagcgggccagggcagtct

SEQ ID NO: 271127 - DNA, 20 bp, human
gggagaggctaggaggattg

SEQ ID NO: 271128 - DNA, 20 bp, human
ggaggctaggaggattgtgg

SEQ ID NO: 271129 - DNA, 20 bp, human
gtaggaggattgtggaggac

SEQ ID NO: 271130 - DNA, 20 bp, human
ggagttaaccaagcgggcca

SEQ ID NO: 271131 - DNA, 20 bp, human
ggggcggcgcgtccagctct

SEQ ID NO: 271132 - DNA, 20 bp, human
gtcacggagcactgggatcg

SEQ ID NO: 271133 - DNA, 20 bp, human
gtcacccagcctgactgccc

SEQ ID NO: 271134 - DNA, 20 bp, human
ggctgggtgaccttcggccc

SEQ ID NO: 271135 - DNA, 20 bp, human
ggctccgtgaggtccttaac

SEQ ID NO: 271136 - DNA, 20 bp, human
ggcagggtgaggacgtgcgt

SEQ ID NO: 271137 - DNA, 20 bp, human
ggcagcggcggcatccatgg

SEQ ID NO: 271138 - DNA, 20 bp, human
gggtgaggacgtgcgtgggg

SEQ ID NO: 271139 - DNA, 20 bp, human
ggggctccttctgcagggtg

SEQ ID NO: 271140 - DNA, 20 bp, human
ggaagctacagctggggcgg

SEQ ID NO: 271141 - DNA, 20 bp, human
ggcagtgggccaggctccta

SEQ ID NO: 271142 - DNA, 20 bp, human
ggacagatgaagggcccttc

SEQ ID NO: 271143 - DNA, 20 bp, human
gaatgcccgcacctcgtccc

SEQ ID NO: 271144 - DNA, 20 bp, human
ggcagctggtgttccttatg

SEQ ID NO: 271145 - DNA, 20 bp, human
ggaataggatgacagatgaa

SEQ ID NO: 271146 - DNA, 20 bp, human
gccacctggcacttgaggat

SEQ ID NO: 271147 - DNA, 20 bp, human
ggcaagtgggcacgaggtaa

SEQ ID NO: 271148 - DNA, 20 bp, human
ggggatgcacgtgaaagcca

SEQ ID NO: 271149 - DNA, 20 bp, human
gccctggccctctccctcga

SEQ ID NO: 271150 - DNA, 20 bp, human
ggggatgcctagctacagac

SEQ ID NO: 271151 - DNA, 20 bp, human
gagcccagggtgcccgaaaa

SEQ ID NO: 271152 - DNA, 20 bp, human
gttgcccatcctcaagtgcc

SEQ ID NO: 271153 - DNA, 20 bp, human
gtggagcccctcgagggaga

SEQ ID NO: 271154 - DNA, 20 bp, human
gtacccttttcgggcaccct

SEQ ID NO: 271155 - DNA, 20 bp, human
gctgtgcctcccagtctcag

SEQ ID NO: 271156 - DNA, 20 bp, human
gggcggcaggttgctccctg

SEQ ID NO: 271157 - DNA, 20 bp, human
gtgccgcccatggctgggga

SEQ ID NO: 271158 - DNA, 20 bp, human
ggtgagacggagaattggat

SEQ ID NO: 271159 - DNA, 20 bp, human
gccccctccccagccatggg

SEQ ID NO: 271160 - DNA, 20 bp, human
gaggcaaaacacatcatcta

SEQ ID NO: 271161 - DNA, 20 bp, human
gcaacctgccgcccatggct

SEQ ID NO: 271162 - DNA, 20 bp, human
gcacccccaactgggaccat

SEQ ID NO: 271163 - DNA, 20 bp, human
gtgcacagaccccatccgga

SEQ ID NO: 271164 - DNA, 20 bp, human
gtgaccaaagtcaggagatg

SEQ ID NO: 271165 - DNA, 20 bp, human
gaagctgtctctttaagagc

SEQ ID NO: 271166 - DNA, 20 bp, human
gtgggccgaagaccctcttt

SEQ ID NO: 271167 - DNA, 20 bp, human
gaggctggagggaactggtc

SEQ ID NO: 271168 - DNA, 20 bp, human
gaacagccctgggtgtggca

SEQ ID NO: 271169 - DNA, 20 bp, human
gaaaccctgcagccacgccc

SEQ ID NO: 271170 - DNA, 20 bp, human
ggcccagggctccatgacgc

SEQ ID NO: 271171 - DNA, 20 bp, human
gttccctccagcctgcgtca

SEQ ID NO: 271172 - DNA, 20 bp, human
gagcctgcgtcatggagccc

SEQ ID NO: 271173 - DNA, 20 bp, human
gcctaaaagagggacctgga

SEQ ID NO: 271174 - DNA, 20 bp, human
gccgcgcccagcctttcttt

SEQ ID NO: 271175 - DNA, 20 bp, human
gagatcctaaaagagggacc

SEQ ID NO: 271176 - DNA, 20 bp, human
gagcgggcggggacccagac

SEQ ID NO: 271177 - DNA, 20 bp, human
gaatcgctgagggcgacggg

SEQ ID NO: 271178 - DNA, 20 bp, human
gggggtgagggcatagtggt

SEQ ID NO: 271179 - DNA, 20 bp, human
gcaggagggggaatcgctga

SEQ ID NO: 271180 - DNA, 20 bp, human
gagagagcagggggagaaac

SEQ ID NO: 271181 - DNA, 20 bp, human
gagcagggggagaaacggga

SEQ ID NO: 271182 - DNA, 20 bp, human
gggaagggaaaggacaaatc

SEQ ID NO: 271183 - DNA, 20 bp, human
gtggccaggggagcgcgagc

SEQ ID NO: 271184 - DNA, 20 bp, human
ggggaatcgctgagggcgac

SEQ ID NO: 271185 - DNA, 20 bp, human
gggctcagtcatttcctctt

SEQ ID NO: 271186 - DNA, 20 bp, human
gccgcccctcgagaggagag

SEQ ID NO: 271187 - DNA, 20 bp, human
gtcccctcctcctaggagtc

SEQ ID NO: 271188 - DNA, 20 bp, human
ggccgctacccagaagccag

SEQ ID NO: 271189 - DNA, 20 bp, human
ggcggacggcagcacggagt

SEQ ID NO: 271190 - DNA, 20 bp, human
gtgggaggcgcgtcctgcgg

SEQ ID NO: 271191 - DNA, 20 bp, human
ggacgcgcgcgagcacagag

SEQ ID NO: 271192 - DNA, 20 bp, human
gctacccagaagccagcgga

SEQ ID NO: 271193 - DNA, 20 bp, human
gcaacaggagactgccgccg

SEQ ID NO: 271194 - DNA, 20 bp, human
gcgcttgcacgcctcctcgg

SEQ ID NO: 271195 - DNA, 20 bp, human
gagccagcccgactcctagg

SEQ ID NO: 271196 - DNA, 20 bp, human
gccgcccctcgagaggagag

SEQ ID NO: 271197 - DNA, 20 bp, human
ggacgcgcgcgagcacagag

SEQ ID NO: 271198 - DNA, 20 bp, human
ggccgctacccagaagccag

SEQ ID NO: 271199 - DNA, 20 bp, human
gcaacaggagactgccgccg

SEQ ID NO: 271200 - DNA, 20 bp, human
gcgcttgcacgcctcctcgg

SEQ ID NO: 271201 - DNA, 20 bp, human
ggcggacggcagcacggagt

SEQ ID NO: 271202 - DNA, 20 bp, human
gcaggagactgccgccgagg

SEQ ID NO: 271203 - DNA, 20 bp, human
gctgccgtccgctggcttct

SEQ ID NO: 271204 - DNA, 20 bp, human
gctacccagaagccagcgga

SEQ ID NO: 271205 - DNA, 20 bp, human
gggcggagagatttttccaa

SEQ ID NO: 271206 - DNA, 20 bp, human
gcgccccaccctagaggaag

SEQ ID NO: 271207 - DNA, 20 bp, human
gtgggcgcgcaggtggagcg

SEQ ID NO: 271208 - DNA, 20 bp, human
gcctctcgacagcactttgt

SEQ ID NO: 271209 - DNA, 20 bp, human
gaggacggaccgatgtgggg

SEQ ID NO: 271210 - DNA, 20 bp, human
ggccaagtgccagagttgaa

SEQ ID NO: 271211 - DNA, 20 bp, human
gcgcgaaacgccagcgccac

SEQ ID NO: 271212 - DNA, 20 bp, human
ggcgctggcgtttcgcgctg

SEQ ID NO: 271213 - DNA, 20 bp, human
gggggacgacggtggtgggc

SEQ ID NO: 271214 - DNA, 20 bp, human
gcacctggagcgatggaatc

SEQ ID NO: 271215 - DNA, 20 bp, human
gtgcaggcccccccacgcca

SEQ ID NO: 271216 - DNA, 20 bp, human
gagggttttgtcccggtcag

SEQ ID NO: 271217 - DNA, 20 bp, human
ggggtgtgtggaaagattat

SEQ ID NO: 271218 - DNA, 20 bp, human
gcccactagactcactctgt

SEQ ID NO: 271219 - DNA, 20 bp, human
gagtttgcctggtcagggga

SEQ ID NO: 271220 - DNA, 20 bp, human
gaatgttagcagaagtatcc

SEQ ID NO: 271221 - DNA, 20 bp, human
gaggcaggagaatcttgttt

SEQ ID NO: 271222 - DNA, 20 bp, human
gtcctcttgaataaacatgg

SEQ ID NO: 271223 - DNA, 20 bp, human
gaccgggacaaaaccctgcc

SEQ ID NO: 271224 - DNA, 20 bp, human
ggaagaagctgtaagttctt

SEQ ID NO: 271225 - DNA, 20 bp, human
gcattgcaggtgacactcct

SEQ ID NO: 271226 - DNA, 20 bp, human
ggcaacttattttgccagag

SEQ ID NO: 271227 - DNA, 20 bp, human
gggcctgcagcgttgctgat

SEQ ID NO: 271228 - DNA, 20 bp, human
gtgcgagagtttcttgaaag

SEQ ID NO: 271229 - DNA, 20 bp, human
gtcttgaaagaggaaggcta

SEQ ID NO: 271230 - DNA, 20 bp, human
gcaaaccaggaagctctgta

SEQ ID NO: 271231 - DNA, 20 bp, human
gagagtttcttgaaagagga

SEQ ID NO: 271232 - DNA, 20 bp, human
gtataccttacagagcttcc

SEQ ID NO: 271233 - DNA, 20 bp, human
gaaccaatcagcaacgctgc

SEQ ID NO: 271234 - DNA, 20 bp, human
gaacaaacagaacttcaatg

SEQ ID NO: 271235 - DNA, 20 bp, human
gtgaagttctgtttgttaac

SEQ ID NO: 271236 - DNA, 20 bp, human
ggggtgggacagtcggtccg

SEQ ID NO: 271237 - DNA, 20 bp, human
gctggggccagcatgggtcg

SEQ ID NO: 271238 - DNA, 20 bp, human
ggggtcgcgggtgggacagt

SEQ ID NO: 271239 - DNA, 20 bp, human
gaactcccatcggactcccg

SEQ ID NO: 271240 - DNA, 20 bp, human
gggccagcatgggtcgcggg

SEQ ID NO: 271241 - DNA, 20 bp, human
gttaacgcctgcaaccccgg

SEQ ID NO: 271242 - DNA, 20 bp, human
ggacgcgcacaccaagaggg

SEQ ID NO: 271243 - DNA, 20 bp, human
gagtcgccgggagttgtagt

SEQ ID NO: 271244 - DNA, 20 bp, human
gaactcccggcgactccgca

SEQ ID NO: 271245 - DNA, 20 bp, human
gccggagggccacaaatcaa

SEQ ID NO: 271246 - DNA, 20 bp, human
gccccaggcgccaatggttg

SEQ ID NO: 271247 - DNA, 20 bp, human
ggggcgggacggcagtaggt

SEQ ID NO: 271248 - DNA, 20 bp, human
gcccaaggggctctttgata

SEQ ID NO: 271249 - DNA, 20 bp, human
gtaacgctcaacccactcgg

SEQ ID NO: 271250 - DNA, 20 bp, human
gccagggtgcgtgcggtgca

SEQ ID NO: 271251 - DNA, 20 bp, human
gggcgcgcctcgagagtgac

SEQ ID NO: 271252 - DNA, 20 bp, human
ggcgtgggcgggacggcagt

SEQ ID NO: 271253 - DNA, 20 bp, human
gagtgggttgagcgttactg

SEQ ID NO: 271254 - DNA, 20 bp, human
gctgcccctccagctccgga

SEQ ID NO: 271255 - DNA, 20 bp, human
gctgtggcagcgggcatccc

SEQ ID NO: 271256 - DNA, 20 bp, human
gcggggccaccgacactcgc

SEQ ID NO: 271257 - DNA, 20 bp, human
gcgtgcgcgctccctcggtg

SEQ ID NO: 271258 - DNA, 20 bp, human
gcgctcctagcggccctcgc

SEQ ID NO: 271259 - DNA, 20 bp, human
ggcctcgtccgatcctgcga

SEQ ID NO: 271260 - DNA, 20 bp, human
gtaggagcgagtcacggcgc

SEQ ID NO: 271261 - DNA, 20 bp, human
gcactcgcgggcgaccagag

SEQ ID NO: 271262 - DNA, 20 bp, human
gggtcgcccgcgagtgtcgg

SEQ ID NO: 271263 - DNA, 20 bp, human
gcgtcctcggtctccacccg

SEQ ID NO: 271264 - DNA, 20 bp, human
ggccctcgcaggatcggacg

SEQ ID NO: 271265 - DNA, 20 bp, human
ggtctagcatcccccagttt

SEQ ID NO: 271266 - DNA, 20 bp, human
ggcctcgcgcgccctcggac

SEQ ID NO: 271267 - DNA, 20 bp, human
gcgcctggaaaccggtccga

SEQ ID NO: 271268 - DNA, 20 bp, human
ggaaaccgacgcagaactgg

SEQ ID NO: 271269 - DNA, 20 bp, human
gcggagccgcgattgggcga

SEQ ID NO: 271270 - DNA, 20 bp, human
gctgccgctggctttcgctc

SEQ ID NO: 271271 - DNA, 20 bp, human
gtggtgaaagacagactacg

SEQ ID NO: 271272 - DNA, 20 bp, human
gacaaatggtcaggcggcgg

SEQ ID NO: 271273 - DNA, 20 bp, human
gggaagccggagccgcgatt

SEQ ID NO: 271274 - DNA, 20 bp, human
gctacggggcgcctggaaac

SEQ ID NO: 271275 - DNA, 20 bp, human
gtgagcctccagttctgcgt

SEQ ID NO: 271276 - DNA, 20 bp, human
gtaggcgctgcgccccccgc

SEQ ID NO: 271277 - DNA, 20 bp, human
gcgccaggcgggctgtcccg

SEQ ID NO: 271278 - DNA, 20 bp, human
gctgcagcccagcctgcggg

SEQ ID NO: 271279 - DNA, 20 bp, human
gaagactcgcaaaaaggcaa

SEQ ID NO: 271280 - DNA, 20 bp, human
ggaggcgggcgggactgccg

SEQ ID NO: 271281 - DNA, 20 bp, human
gccagccggcagctgtttcg

SEQ ID NO: 271282 - DNA, 20 bp, human
ggtttcgaggtttgcgtccc

SEQ ID NO: 271283 - DNA, 20 bp, human
ggatgagaagactcgcaaaa

SEQ ID NO: 271284 - DNA, 20 bp, human
gcggcggagaggatagcgag

SEQ ID NO: 271285 - DNA, 20 bp, human
gcggtccccgggatggtccc

SEQ ID NO: 271286 - DNA, 20 bp, human
ggaaaccgactaattgggat

SEQ ID NO: 271287 - DNA, 20 bp, human
gcgactaattgggatcggag

SEQ ID NO: 271288 - DNA, 20 bp, human
gcccttgaaaccgactaatt

SEQ ID NO: 271289 - DNA, 20 bp, human
gtcaagggggcccccgctgg

SEQ ID NO: 271290 - DNA, 20 bp, human
ggcaactccggagaaatccc

SEQ ID NO: 271291 - DNA, 20 bp, human
ggtttcaaggatcccttttt

SEQ ID NO: 271292 - DNA, 20 bp, human
gcctcgggtttaaatctgat

SEQ ID NO: 271293 - DNA, 20 bp, human
gatcggagaggccgaggtga

SEQ ID NO: 271294 - DNA, 20 bp, human
ggctcgacggggcggtttca

SEQ ID NO: 271295 - DNA, 20 bp, human
gcgggaagaggagtgagcca

SEQ ID NO: 271296 - DNA, 20 bp, human
gggcccgcaagcccaggatc

SEQ ID NO: 271297 - DNA, 20 bp, human
gtctcagatgagcgcctcca

SEQ ID NO: 271298 - DNA, 20 bp, human
gggagctccaggcgtcactc

SEQ ID NO: 271299 - DNA, 20 bp, human
gcgcaagcccaggatccggc

SEQ ID NO: 271300 - DNA, 20 bp, human
gtcggccgaaagctccctgc

SEQ ID NO: 271301 - DNA, 20 bp, human
gaggcgtcactcagggcgag

SEQ ID NO: 271302 - DNA, 20 bp, human
gaacgagcacgccggagcaa

SEQ ID NO: 271303 - DNA, 20 bp, human
gcaggcgcactgagtacgct

SEQ ID NO: 271304 - DNA, 20 bp, human
gacggagtgcattgcgagga

SEQ ID NO: 271305 - DNA, 20 bp, human
gcgctcgtgagctcgctctc

SEQ ID NO: 271306 - DNA, 20 bp, human
gcgggcgcggtgggcagcta

SEQ ID NO: 271307 - DNA, 20 bp, human
gcccctgcgcgcctagatcc

SEQ ID NO: 271308 - DNA, 20 bp, human
gggggcctgactcctcctgc

SEQ ID NO: 271309 - DNA, 20 bp, human
gaagcagggacgcagcccag

SEQ ID NO: 271310 - DNA, 20 bp, human
gggacagcgggcctctccaa

SEQ ID NO: 271311 - DNA, 20 bp, human
ggggaggtggccaccggcct

SEQ ID NO: 271312 - DNA, 20 bp, human
ggcggggcgggacggacagc

SEQ ID NO: 271313 - DNA, 20 bp, human
gcacccggatctaggcgcgc

SEQ ID NO: 271314 - DNA, 20 bp, human
gccgcgcccggccattggag

SEQ ID NO: 271315 - DNA, 20 bp, human
ggaaagggggcagatggaac

SEQ ID NO: 271316 - DNA, 20 bp, human
gaaagggtgcgagagcgcgg

SEQ ID NO: 271317 - DNA, 20 bp, human
gcaaccgcgcccgggcctga

SEQ ID NO: 271318 - DNA, 20 bp, human
gaggagcgctgaccaatcgc

SEQ ID NO: 271319 - DNA, 20 bp, human
gaggcccgggcgcggttggt

SEQ ID NO: 271320 - DNA, 20 bp, human
gtagaagcaggtgacccggg

SEQ ID NO: 271321 - DNA, 20 bp, human
gcccgcccgggtgcccagag

SEQ ID NO: 271322 - DNA, 20 bp, human
gttggctgcccgctcctggc

SEQ ID NO: 271323 - DNA, 20 bp, human
gtctcctccaggcccgcgat

SEQ ID NO: 271324 - DNA, 20 bp, human
gctcgccagaggtgggcgaa

SEQ ID NO: 271325 - DNA, 20 bp, human
gtgcggccgtgagtccgctg

SEQ ID NO: 271326 - DNA, 20 bp, human
gaggacccggccccggtgaa

SEQ ID NO: 271327 - DNA, 20 bp, human
gcggccccgcagccggacct

SEQ ID NO: 271328 - DNA, 20 bp, human
ggtaacagacggcaaggtgg

SEQ ID NO: 271329 - DNA, 20 bp, human
gcctggcggcgcagtctcgc

SEQ ID NO: 271330 - DNA, 20 bp, human
ggcaccccgagcccgttcac

SEQ ID NO: 271331 - DNA, 20 bp, human
gactgcgccgccaggtcggg

SEQ ID NO: 271332 - DNA, 20 bp, human
gcggacccggatagcgagat

SEQ ID NO: 271333 - DNA, 20 bp, human
ggcgggccgcggagtgaggc

SEQ ID NO: 271334 - DNA, 20 bp, human
gcctcgggggtcgtaacaga

SEQ ID NO: 271335 - DNA, 20 bp, human
gggcaggtccgggctcgcgg

SEQ ID NO: 271336 - DNA, 20 bp, human
gtggggctgaagaaggagcg

SEQ ID NO: 271337 - DNA, 20 bp, human
gcgccgtgctcccgactccg

SEQ ID NO: 271338 - DNA, 20 bp, human
gccgactccggggccgagat

SEQ ID NO: 271339 - DNA, 20 bp, human
gtggtcgccagaagaagcgt

SEQ ID NO: 271340 - DNA, 20 bp, human
gacttggggccgagcttttg

SEQ ID NO: 271341 - DNA, 20 bp, human
gcggccgtttggctgaaact

SEQ ID NO: 271342 - DNA, 20 bp, human
ggcgactccgaggcgttagt

SEQ ID NO: 271343 - DNA, 20 bp, human
ggagcttttggggctgaaga

SEQ ID NO: 271344 - DNA, 20 bp, human
gcctggggccgcccccggag

SEQ ID NO: 271345 - DNA, 20 bp, human
gcccggagtggtttgtgaat

SEQ ID NO: 271346 - DNA, 20 bp, human
gggccagcagagcggaccta

SEQ ID NO: 271347 - DNA, 20 bp, human
gtacacgcccatctgcctag

SEQ ID NO: 271348 - DNA, 20 bp, human
gtcaccgtgccgctgtgtaa

SEQ ID NO: 271349 - DNA, 20 bp, human
gaggcgcacagcatggagtg

SEQ ID NO: 271350 - DNA, 20 bp, human
gggcgcgcgccacagtccgt

SEQ ID NO: 271351 - DNA, 20 bp, human
gccgcggtgcgcagtcaaga

SEQ ID NO: 271352 - DNA, 20 bp, human
ggggtacagcgggtgatctg

SEQ ID NO: 271353 - DNA, 20 bp, human
gcctctgcgcgccgcctgga

SEQ ID NO: 271354 - DNA, 20 bp, human
gtgccgctgtgtaagggcat

SEQ ID NO: 271355 - DNA, 20 bp, human
gcacccgctgtacccgtctg

SEQ ID NO: 271356 - DNA, 20 bp, human
gccacgcggagcacggggtg

SEQ ID NO: 271357 - DNA, 20 bp, human
ggctaccagcccccggggcg

SEQ ID NO: 271358 - DNA, 20 bp, human
gtcccggccacgcggagcac

SEQ ID NO: 271359 - DNA, 20 bp, human
gctccgggaggacacgccca

SEQ ID NO: 271360 - DNA, 20 bp, human
gcagtgggaggcgtgtccct

SEQ ID NO: 271361 - DNA, 20 bp, human
ggcgcccggacacacgtggg

SEQ ID NO: 271362 - DNA, 20 bp, human
ggtccctgggcgtgtcctcc

SEQ ID NO: 271363 - DNA, 20 bp, human
gggaagaaaccgagtgtaag

SEQ ID NO: 271364 - DNA, 20 bp, human
gtctcccaggcagcaaggga

SEQ ID NO: 271365 - DNA, 20 bp, human
gcagagccggcgcaacctcc

SEQ ID NO: 271366 - DNA, 20 bp, human
gaggccctgcccactccgag

SEQ ID NO: 271367 - DNA, 20 bp, human
gtgcgcgcgttgggcatctc

SEQ ID NO: 271368 - DNA, 20 bp, human
gaggcgcagccactcggagt

SEQ ID NO: 271369 - DNA, 20 bp, human
ggcggccggaagaggacccg

SEQ ID NO: 271370 - DNA, 20 bp, human
gaatggctctggtagatgga

SEQ ID NO: 271371 - DNA, 20 bp, human
gtgggggcgtggtcgggttg

SEQ ID NO: 271372 - DNA, 20 bp, human
ggcaacgtctagcaccccgc

SEQ ID NO: 271373 - DNA, 20 bp, human
gcagggcctggcggtgtgtg

SEQ ID NO: 271374 - DNA, 20 bp, human
gcaaatcaatacaggaagcg

SEQ ID NO: 271375 - DNA, 20 bp, human
ggcagccactcggagtgggc

SEQ ID NO: 271376 - DNA, 20 bp, human
gagagccaggggaactcgga

SEQ ID NO: 271377 - DNA, 20 bp, human
gaaaaggagggggtggaacc

SEQ ID NO: 271378 - DNA, 20 bp, human
ggccccctagctcacacagt

SEQ ID NO: 271379 - DNA, 20 bp, human
gcccacgcgccccgctgcga

SEQ ID NO: 271380 - DNA, 20 bp, human
gaaggccagtgtgcacgcga

SEQ ID NO: 271381 - DNA, 20 bp, human
gatgtccgcggacacctccc

SEQ ID NO: 271382 - DNA, 20 bp, human
gtcccactccaggcgagcgc

SEQ ID NO: 271383 - DNA, 20 bp, human
gcacgcgaaggtcccactcc

SEQ ID NO: 271384 - DNA, 20 bp, human
gggcgcgggtgccatcgcag

SEQ ID NO: 271385 - DNA, 20 bp, human
gccctgcgctcgcctggagt

SEQ ID NO: 271386 - DNA, 20 bp, human
gctgctgctcggtgctaacc

SEQ ID NO: 271387 - DNA, 20 bp, human
gcggtcggccccgccctcga

SEQ ID NO: 271388 - DNA, 20 bp, human
gcagcgcaggagcgccagaa

SEQ ID NO: 271389 - DNA, 20 bp, human
gcgcgggtcccacccctcga

SEQ ID NO: 271390 - DNA, 20 bp, human
ggggtcccacccctcgaggg

SEQ ID NO: 271391 - DNA, 20 bp, human
gtagcaccgagcagcagcgc

SEQ ID NO: 271392 - DNA, 20 bp, human
gcattcgccccattcctcga

SEQ ID NO: 271393 - DNA, 20 bp, human
gcggccccgccctcgagggg

SEQ ID NO: 271394 - DNA, 20 bp, human
ggcaggagcgccagaagggc

SEQ ID NO: 271395 - DNA, 20 bp, human
gcagaagggcgggagcacac

SEQ ID NO: 271396 - DNA, 20 bp, human
gtgaaggcgtggctcttgat

SEQ ID NO: 271397 - DNA, 20 bp, human
gaatcccgaccgcgtcctca

SEQ ID NO: 271398 - DNA, 20 bp, human
ggacctggccgcaacaagtt

SEQ ID NO: 271399 - DNA, 20 bp, human
gggctcttcgaacagtaatt

SEQ ID NO: 271400 - DNA, 20 bp, human
gtgactcggggatgaaggcg

SEQ ID NO: 271401 - DNA, 20 bp, human
ggagatcctcacagtctcat

SEQ ID NO: 271402 - DNA, 20 bp, human
gttagtgccgatctgttact

SEQ ID NO: 271403 - DNA, 20 bp, human
gggccgccgtgccctctggg

SEQ ID NO: 271404 - DNA, 20 bp, human
ggagccctgaggacgcggtc

SEQ ID NO: 271405 - DNA, 20 bp, human
gcgttaacacgtcttcccct

SEQ ID NO: 271406 - DNA, 20 bp, human
gtctggaggagatgcgtgat

SEQ ID NO: 271407 - DNA, 20 bp, human
ggtgctccgcagagggacac

SEQ ID NO: 271408 - DNA, 20 bp, human
gggaaggttgggtccggctc

SEQ ID NO: 271409 - DNA, 20 bp, human
gtactgcgcgtgctccgcag

SEQ ID NO: 271410 - DNA, 20 bp, human
gaaagccggggaaccggaac

SEQ ID NO: 271411 - DNA, 20 bp, human
gtggctgacgctgtgctcgg

SEQ ID NO: 271412 - DNA, 20 bp, human
gtccgcagagggacacggga

SEQ ID NO: 271413 - DNA, 20 bp, human
gaaggctggagcctcgggac

SEQ ID NO: 271414 - DNA, 20 bp, human
ggctcgcgcccggaaagccg

SEQ ID NO: 271415 - DNA, 20 bp, human
gagagggggcggtggcaaag

SEQ ID NO: 271416 - DNA, 20 bp, human
ggacctgaatactggataca

SEQ ID NO: 271417 - DNA, 20 bp, human
ggctgagtacatggccgatc

SEQ ID NO: 271418 - DNA, 20 bp, human
gtcaaaggtgcatcaccagt

SEQ ID NO: 271419 - DNA, 20 bp, human
gggttgatgcaaacatgttc

SEQ ID NO: 271420 - DNA, 20 bp, human
gctggtttcggggaccagga

SEQ ID NO: 271421 - DNA, 20 bp, human
gtcaacccagccctgatctt

SEQ ID NO: 271422 - DNA, 20 bp, human
gattggccctgctgagtaca

SEQ ID NO: 271423 - DNA, 20 bp, human
gtggcctggtttcggggacc

SEQ ID NO: 271424 - DNA, 20 bp, human
gcctgcaactgcacttattt

SEQ ID NO: 271425 - DNA, 20 bp, human
gcagggccaatgattaactt

SEQ ID NO: 271426 - DNA, 20 bp, human
gctgatctgtggcaattcga

SEQ ID NO: 271427 - DNA, 20 bp, human
gtgagctattcagcagagga

SEQ ID NO: 271428 - DNA, 20 bp, human
gctattcagcagaggagggc

SEQ ID NO: 271429 - DNA, 20 bp, human
gatgctgaccatctgtggag

SEQ ID NO: 271430 - DNA, 20 bp, human
ggcaattcgagggggaaatt

SEQ ID NO: 271431 - DNA, 20 bp, human
gatggctcgacatgccacaa

SEQ ID NO: 271432 - DNA, 20 bp, human
gaactgttcgcacaaaaggg

SEQ ID NO: 271433 - DNA, 20 bp, human
gatccaactgttcgcacaaa

SEQ ID NO: 271434 - DNA, 20 bp, human
gtagatgagctattcagcag

SEQ ID NO: 271435 - DNA, 20 bp, human
gctgcattttaatttaagat

SEQ ID NO: 271436 - DNA, 20 bp, human
ggaaaaccggaggagagcgc

SEQ ID NO: 271437 - DNA, 20 bp, human
gcagtagggaggaaaaccgg

SEQ ID NO: 271438 - DNA, 20 bp, human
gtcccctgcgctgcccagta

SEQ ID NO: 271439 - DNA, 20 bp, human
gccctgacccggaaccgcac

SEQ ID NO: 271440 - DNA, 20 bp, human
ggcgcaggaggaaacagtac

SEQ ID NO: 271441 - DNA, 20 bp, human
ggcccacgtgcctgcaacag

SEQ ID NO: 271442 - DNA, 20 bp, human
gtcccccgctcctgcaagac

SEQ ID NO: 271443 - DNA, 20 bp, human
ggccggtcttgcaggagcgg

SEQ ID NO: 271444 - DNA, 20 bp, human
ggctagcggcggcaccagtg

SEQ ID NO: 271445 - DNA, 20 bp, human
ggaggccggtcttgcaggag

SEQ ID NO: 271446 - DNA, 20 bp, human
gaacaggcgagggttcccgg

SEQ ID NO: 271447 - DNA, 20 bp, human
gttgacccgcgaacaggcga

SEQ ID NO: 271448 - DNA, 20 bp, human
gtccagcgcaggtgcccgag

SEQ ID NO: 271449 - DNA, 20 bp, human
gcggcctcgcgcgctcgcgg

SEQ ID NO: 271450 - DNA, 20 bp, human
ggtagggccgcatcccgctc

SEQ ID NO: 271451 - DNA, 20 bp, human
ggccgccgtccgagagacga

SEQ ID NO: 271452 - DNA, 20 bp, human
gaaaccggacagtaggggcg

SEQ ID NO: 271453 - DNA, 20 bp, human
gccgcccgcacgaggggtgg

SEQ ID NO: 271454 - DNA, 20 bp, human
gcctcctctgggctgtccct

SEQ ID NO: 271455 - DNA, 20 bp, human
ggagtccgtcagacgtgaga

SEQ ID NO: 271456 - DNA, 20 bp, human
gtccgcgctacgccccccag

SEQ ID NO: 271457 - DNA, 20 bp, human
gggcgcgtcctcgctctcgg

SEQ ID NO: 271458 - DNA, 20 bp, human
gcggacgcgcacccttgcct

SEQ ID NO: 271459 - DNA, 20 bp, human
gggggcctggggagcgcgtc

SEQ ID NO: 271460 - DNA, 20 bp, human
ggcgcaggcgcccgaggcaa

SEQ ID NO: 271461 - DNA, 20 bp, human
gcccgctgccggttcctctg

SEQ ID NO: 271462 - DNA, 20 bp, human
gaccccagaggaaccggcag

SEQ ID NO: 271463 - DNA, 20 bp, human
ggcgctacgccccccagtgg

SEQ ID NO: 271464 - DNA, 20 bp, human
gtgccggagccgccactggg

SEQ ID NO: 271465 - DNA, 20 bp, human
gtccccgtggggtcggagat

SEQ ID NO: 271466 - DNA, 20 bp, human
gcctcccccgaggagaggga

SEQ ID NO: 271467 - DNA, 20 bp, human
gtggggaggtcttgtcccta

SEQ ID NO: 271468 - DNA, 20 bp, human
gggcgcatcgaaaccgaggg

SEQ ID NO: 271469 - DNA, 20 bp, human
ggggagggtgggtcacttcg

SEQ ID NO: 271470 - DNA, 20 bp, human
gccgggcgcatcgaaaccga

SEQ ID NO: 271471 - DNA, 20 bp, human
gcccaccctcccccgaggag

SEQ ID NO: 271472 - DNA, 20 bp, human
ggcgcaaaggacagaagctc

SEQ ID NO: 271473 - DNA, 20 bp, human
gagaagctccggcaccgagt

SEQ ID NO: 271474 - DNA, 20 bp, human
ggagggaaggaggatcgctc

SEQ ID NO: 271475 - DNA, 20 bp, human
gcatcgaaaccgagggcggg

SEQ ID NO: 271476 - DNA, 20 bp, human
gtacagaaagccaccgccgc

SEQ ID NO: 271477 - DNA, 20 bp, human
gtggctttctgtatcctcgc

SEQ ID NO: 271478 - DNA, 20 bp, human
gcggcccggcggggactagg

SEQ ID NO: 271479 - DNA, 20 bp, human
gcgacggggaagggatacta

SEQ ID NO: 271480 - DNA, 20 bp, human
gcccgcgtccgcgtgcgcgg

SEQ ID NO: 271481 - DNA, 20 bp, human
gtccctggcctccgcgcccg

SEQ ID NO: 271482 - DNA, 20 bp, human
gtggcgctggcgggtgtgag

SEQ ID NO: 271483 - DNA, 20 bp, human
ggctgcagctgctcccccgg

SEQ ID NO: 271484 - DNA, 20 bp, human
gactctccgcccggccgccg

SEQ ID NO: 271485 - DNA, 20 bp, human
gtcctgaggccccaagccgc

SEQ ID NO: 271486 - DNA, 20 bp, human
ggggtggtgcttaagtggat

SEQ ID NO: 271487 - DNA, 20 bp, human
gcgcccgcaacccaagacgg

SEQ ID NO: 271488 - DNA, 20 bp, human
ggagctgcagttgctcgaag

SEQ ID NO: 271489 - DNA, 20 bp, human
gccagcggctgtgcccgggg

SEQ ID NO: 271490 - DNA, 20 bp, human
gacacagctctggctgccta

SEQ ID NO: 271491 - DNA, 20 bp, human
ggcagatgcaggtggtactt

SEQ ID NO: 271492 - DNA, 20 bp, human
ggcagagggtggtgcttaag

SEQ ID NO: 271493 - DNA, 20 bp, human
gacacgagaaaatcatccat

SEQ ID NO: 271494 - DNA, 20 bp, human
gtggcgtggcggattgggga

SEQ ID NO: 271495 - DNA, 20 bp, human
gggcaggcgccctgctgcgt

SEQ ID NO: 271496 - DNA, 20 bp, human
gcgcaggtgctcacaggcga

SEQ ID NO: 271497 - DNA, 20 bp, human
ggcagctcacagtgaaggtg

SEQ ID NO: 271498 - DNA, 20 bp, human
gggtagaaagcgcagttcta

SEQ ID NO: 271499 - DNA, 20 bp, human
gtgggggagacagggcgaga

SEQ ID NO: 271500 - DNA, 20 bp, human
gggtcagaggtgaagctcgt

SEQ ID NO: 271501 - DNA, 20 bp, human
gcctgtgagcacctgcgccc

SEQ ID NO: 271502 - DNA, 20 bp, human
gggacggcttgcgataccct

SEQ ID NO: 271503 - DNA, 20 bp, human
gagtgaaggtgggggagaca

SEQ ID NO: 271504 - DNA, 20 bp, human
gagaggtgaagctcgtgggg

SEQ ID NO: 271505 - DNA, 20 bp, human
gcggggttcaggttccagct

SEQ ID NO: 271506 - DNA, 20 bp, human
gggcagtccccgatagtcgg

SEQ ID NO: 271507 - DNA, 20 bp, human
gaggtagtggcgtatcttag

SEQ ID NO: 271508 - DNA, 20 bp, human
gcaaccccgcccccgactat

SEQ ID NO: 271509 - DNA, 20 bp, human
gtagtggcgtatcttagcgg

SEQ ID NO: 271510 - DNA, 20 bp, human
ggacgcgcgggcggattcag

SEQ ID NO: 271511 - DNA, 20 bp, human
ggggggcagtccccgatagt

SEQ ID NO: 271512 - DNA, 20 bp, human
ggggaagtggcgcaaattcg

SEQ ID NO: 271513 - DNA, 20 bp, human
ggcaggcgacgtagcaaaga

SEQ ID NO: 271514 - DNA, 20 bp, human
ggtccccgatagtcgggggc

SEQ ID NO: 271515 - DNA, 20 bp, human
ggcgacgtagcaaagacggt

SEQ ID NO: 271516 - DNA, 20 bp, human
ggggcagcggaacgcgcaga

SEQ ID NO: 271517 - DNA, 20 bp, human
ggcgcctggcgcatgggggg

SEQ ID NO: 271518 - DNA, 20 bp, human
gtggccaaagggatcccagg

SEQ ID NO: 271519 - DNA, 20 bp, human
gaacagctgggtggcgcgtc

SEQ ID NO: 271520 - DNA, 20 bp, human
gaggcctcctgggatccctt

SEQ ID NO: 271521 - DNA, 20 bp, human
gcattggccaaagggatccc

SEQ ID NO: 271522 - DNA, 20 bp, human
ggccccgccccccatgcgcc

SEQ ID NO: 271523 - DNA, 20 bp, human
ggtgacatcgattgtgaaaa

SEQ ID NO: 271524 - DNA, 20 bp, human
gaaagagggccaggcctcct

SEQ ID NO: 271525 - DNA, 20 bp, human
gtgggagcacaaaaacagct

SEQ ID NO: 271526 - DNA, 20 bp, human
ggggcggggccgcacgtaaa

SEQ ID NO: 271527 - DNA, 20 bp, human
ggggccgcggaggacccctt

SEQ ID NO: 271528 - DNA, 20 bp, human
gcagcccaggagcccccaaa

SEQ ID NO: 271529 - DNA, 20 bp, human
gcccccaaaggggtcctccg

SEQ ID NO: 271530 - DNA, 20 bp, human
gtggcgaagaagttggttat

SEQ ID NO: 271531 - DNA, 20 bp, human
gagtgtagggctcttactga

SEQ ID NO: 271532 - DNA, 20 bp, human
gtgtcagggcgccacgccaa

SEQ ID NO: 271533 - DNA, 20 bp, human
ggggccgcacgtaaaggggc

SEQ ID NO: 271534 - DNA, 20 bp, human
gggccccgcccctttacgtg

SEQ ID NO: 271535 - DNA, 20 bp, human
ggggaactggtgacaggagt

SEQ ID NO: 271536 - DNA, 20 bp, human
ggtgggagcgacagtcggag

SEQ ID NO: 271537 - DNA, 20 bp, human
gtcacttaaggggacccgag

SEQ ID NO: 271538 - DNA, 20 bp, human
ggggagggatctcacttaag

SEQ ID NO: 271539 - DNA, 20 bp, human
gccgaggtgggagcgacagt

SEQ ID NO: 271540 - DNA, 20 bp, human
gagggaagcgagcgccgagg

SEQ ID NO: 271541 - DNA, 20 bp, human
ggggaggagaaatggggacg

SEQ ID NO: 271542 - DNA, 20 bp, human
gcagtgaagcactgaggatg

SEQ ID NO: 271543 - DNA, 20 bp, human
gctgaagcacggaggaacca

SEQ ID NO: 271544 - DNA, 20 bp, human
gggaagggaaggatgcgagt

SEQ ID NO: 271545 - DNA, 20 bp, human
gcggaggaaccagggtagga

SEQ ID NO: 271546 - DNA, 20 bp, human
gggaagagaggggaagaccg

SEQ ID NO: 271547 - DNA, 20 bp, human
gctgtgggcggtccagggcg

SEQ ID NO: 271548 - DNA, 20 bp, human
gctcccggggctcgggttgt

SEQ ID NO: 271549 - DNA, 20 bp, human
ggggaagaaggagggtgcaa

SEQ ID NO: 271550 - DNA, 20 bp, human
gggaccgcccacagcgcggt

SEQ ID NO: 271551 - DNA, 20 bp, human
ggacctgcgggccaaacaac

SEQ ID NO: 271552 - DNA, 20 bp, human
ggggcgccggtcactgccga

SEQ ID NO: 271553 - DNA, 20 bp, human
ggacgagtgcgtgtgcacca

SEQ ID NO: 271554 - DNA, 20 bp, human
gcgcccacagcgcggtgggg

SEQ ID NO: 271555 - DNA, 20 bp, human
ggcccgccccaccgcgctgt

SEQ ID NO: 271556 - DNA, 20 bp, human
gcgcccggggacagcgatct

SEQ ID NO: 271557 - DNA, 20 bp, human
gtcccccggccgagctccag

SEQ ID NO: 271558 - DNA, 20 bp, human
ggggagcaagcgagcaaacg

SEQ ID NO: 271559 - DNA, 20 bp, human
gggagcgagcggagtgcggg

SEQ ID NO: 271560 - DNA, 20 bp, human
ggggacagcgatctgggaac

SEQ ID NO: 271561 - DNA, 20 bp, human
gcggccagacctccgagaag

SEQ ID NO: 271562 - DNA, 20 bp, human
gtcagagcgcgcacgggggc

SEQ ID NO: 271563 - DNA, 20 bp, human
gaatcacgccgggaaggggt

SEQ ID NO: 271564 - DNA, 20 bp, human
gcacggctcgtccccgtccc

SEQ ID NO: 271565 - DNA, 20 bp, human
gagcccctggagctcggccg

SEQ ID NO: 271566 - DNA, 20 bp, human
gggactgagtgcaaggtgac

SEQ ID NO: 271567 - DNA, 20 bp, human
gagggccggaagtagagcgg

SEQ ID NO: 271568 - DNA, 20 bp, human
gagacagtctgcgaccggac

SEQ ID NO: 271569 - DNA, 20 bp, human
gtcagtcggtcgacgctcac

SEQ ID NO: 271570 - DNA, 20 bp, human
gcgtcgaccgactgaaacgg

SEQ ID NO: 271571 - DNA, 20 bp, human
gaaaaagaacgggtcaaatt

SEQ ID NO: 271572 - DNA, 20 bp, human
gcgtacagagcaaggtttca

SEQ ID NO: 271573 - DNA, 20 bp, human
gcggaggggagcttgaacta

SEQ ID NO: 271574 - DNA, 20 bp, human
ggagcgtcgaccgactgaaa

SEQ ID NO: 271575 - DNA, 20 bp, human
gatggcgggtaggcgtgtgg

SEQ ID NO: 271576 - DNA, 20 bp, human
gaagagggccgggtccggga

SEQ ID NO: 271577 - DNA, 20 bp, human
gcgggaacacagctagggag

SEQ ID NO: 271578 - DNA, 20 bp, human
gaacaggcgggaaggttcgg

SEQ ID NO: 271579 - DNA, 20 bp, human
ggagcaggatctgccgacga

SEQ ID NO: 271580 - DNA, 20 bp, human
gtcgggcgatgagctgaaga

SEQ ID NO: 271581 - DNA, 20 bp, human
ggatctgccgacgagggcag

SEQ ID NO: 271582 - DNA, 20 bp, human
gtttccgcctctgccctcgt

SEQ ID NO: 271583 - DNA, 20 bp, human
gtccccgcgggaacacagct

SEQ ID NO: 271584 - DNA, 20 bp, human
gcccccgtgctgcgcgcgga

SEQ ID NO: 271585 - DNA, 20 bp, human
ggcagaggcggaaaatcctc

SEQ ID NO: 271586 - DNA, 20 bp, human
gtaacggggcggaggactgc

SEQ ID NO: 271587 - DNA, 20 bp, human
gtgctgaggcacttctgagg

SEQ ID NO: 271588 - DNA, 20 bp, human
gagaacctggcgaactgctg

SEQ ID NO: 271589 - DNA, 20 bp, human
gccagcaggggacggatcct

SEQ ID NO: 271590 - DNA, 20 bp, human
gcagaaaggcgatgaacctc

SEQ ID NO: 271591 - DNA, 20 bp, human
gtcaccgaggcatgctaggc

SEQ ID NO: 271592 - DNA, 20 bp, human
gcgtctgaatagttccagca

SEQ ID NO: 271593 - DNA, 20 bp, human
gaggggacggatcctaggtc

SEQ ID NO: 271594 - DNA, 20 bp, human
gttctgctgaggcacttctg

SEQ ID NO: 271595 - DNA, 20 bp, human
gtggcgccaacaccagacct

SEQ ID NO: 271596 - DNA, 20 bp, human
gggggagggaagggtagaaa

SEQ ID NO: 271597 - DNA, 20 bp, human
ggattggtctccagatccag

SEQ ID NO: 271598 - DNA, 20 bp, human
ggcagagtcacgaatggtga

SEQ ID NO: 271599 - DNA, 20 bp, human
gtggtaccagcctctggatc

SEQ ID NO: 271600 - DNA, 20 bp, human
ggagcctgcagctagagaga

SEQ ID NO: 271601 - DNA, 20 bp, human
gggcaaaccggatgtgaaat

SEQ ID NO: 271602 - DNA, 20 bp, human
gggacgtattactactgtct

SEQ ID NO: 271603 - DNA, 20 bp, human
gaaggggattagggccagag

SEQ ID NO: 271604 - DNA, 20 bp, human
ggcttgcagcagattgtaga

SEQ ID NO: 271605 - DNA, 20 bp, human
ggggacttagacatatgtgt

SEQ ID NO: 271606 - DNA, 20 bp, human
ggggcgacggtcagttacca

SEQ ID NO: 271607 - DNA, 20 bp, human
gggggccggggggggaaatt

SEQ ID NO: 271608 - DNA, 20 bp, human
gaggaggagtcaggccgggt

SEQ ID NO: 271609 - DNA, 20 bp, human
ggatcgagggatcgaggcag

SEQ ID NO: 271610 - DNA, 20 bp, human
gggagtcaggccgggtagga

SEQ ID NO: 271611 - DNA, 20 bp, human
ggagggctaaggaggttccc

SEQ ID NO: 271612 - DNA, 20 bp, human
gaggccgggtaggagggcta

SEQ ID NO: 271613 - DNA, 20 bp, human
gcacagtagggtgatgttgg

SEQ ID NO: 271614 - DNA, 20 bp, human
ggcgcagacccgggcggcgt

SEQ ID NO: 271615 - DNA, 20 bp, human
gggggaaattggggggacgc

SEQ ID NO: 271616 - DNA, 20 bp, human
gttagcacgcggctgtgctg

SEQ ID NO: 271617 - DNA, 20 bp, human
gcaaaagggtatgagcgaat

SEQ ID NO: 271618 - DNA, 20 bp, human
gtaaagccagcaaaggggga

SEQ ID NO: 271619 - DNA, 20 bp, human
gtgaacctaaagccagcaaa

SEQ ID NO: 271620 - DNA, 20 bp, human
gcttccctctatttctctgt

SEQ ID NO: 271621 - DNA, 20 bp, human
gcacgcccataaggatataa

SEQ ID NO: 271622 - DNA, 20 bp, human
gcatccaacagagaaataga

SEQ ID NO: 271623 - DNA, 20 bp, human
gtgagcgaataggaggataa

SEQ ID NO: 271624 - DNA, 20 bp, human
gtgggcgtgccttctaaccc

SEQ ID NO: 271625 - DNA, 20 bp, human
ggtctcccttatatccttat

SEQ ID NO: 271626 - DNA, 20 bp, human
gtcagcgcgcgggcacgaaa

SEQ ID NO: 271627 - DNA, 20 bp, human
ggggctgcgaagccggagga

SEQ ID NO: 271628 - DNA, 20 bp, human
gcccgcgcgctgaaggttct

SEQ ID NO: 271629 - DNA, 20 bp, human
ggcgcgggcacgaaagggtg

SEQ ID NO: 271630 - DNA, 20 bp, human
gtaactccggggatgaggaa

SEQ ID NO: 271631 - DNA, 20 bp, human
ggggcgtcgggtggtagcgg

SEQ ID NO: 271632 - DNA, 20 bp, human
ggacggggactgctgggcgt

SEQ ID NO: 271633 - DNA, 20 bp, human
gtacccagagtcaaggttgg

SEQ ID NO: 271634 - DNA, 20 bp, human
gaatcccagcggaagggagg

SEQ ID NO: 271635 - DNA, 20 bp, human
gtgttccgactgtaactccg

SEQ ID NO: 271636 - DNA, 20 bp, human
gcccccggctcggcctgcaa

SEQ ID NO: 271637 - DNA, 20 bp, human
gggagggcagtgtcagcagt

SEQ ID NO: 271638 - DNA, 20 bp, human
ggggccctcaacagcatctt

SEQ ID NO: 271639 - DNA, 20 bp, human
ggcgccgaagatgctgttga

SEQ ID NO: 271640 - DNA, 20 bp, human
ggtcagcagtcgggtgatag

SEQ ID NO: 271641 - DNA, 20 bp, human
gcctccgcccagctcggcca

SEQ ID NO: 271642 - DNA, 20 bp, human
gtgcagaggtgctccggtag

SEQ ID NO: 271643 - DNA, 20 bp, human
gaccgcccgcttgtagagca

SEQ ID NO: 271644 - DNA, 20 bp, human
gcagtcgggtgatagaggcc

SEQ ID NO: 271645 - DNA, 20 bp, human
ggagcgccacatgtcgtctc

SEQ ID NO: 271646 - DNA, 20 bp, human
gtaaacagtaagagctgtgt

SEQ ID NO: 271647 - DNA, 20 bp, human
gagggccctgtgaggaaatc

SEQ ID NO: 271648 - DNA, 20 bp, human
gagtctgaagggacagtgca

SEQ ID NO: 271649 - DNA, 20 bp, human
gaacactattgtgaccctct

SEQ ID NO: 271650 - DNA, 20 bp, human
gttttggcatggaattagca

SEQ ID NO: 271651 - DNA, 20 bp, human
gggcattaagggagattaga

SEQ ID NO: 271652 - DNA, 20 bp, human
gtgctgacccttcttgtcaa

SEQ ID NO: 271653 - DNA, 20 bp, human
gctttccagatttcctcaca

SEQ ID NO: 271654 - DNA, 20 bp, human
ggacacacctttgacaagaa

SEQ ID NO: 271655 - DNA, 20 bp, human
gaacacaacagaacaactca

SEQ ID NO: 271656 - DNA, 20 bp, human
gtggggtgctccatgtcctc

SEQ ID NO: 271657 - DNA, 20 bp, human
gggaacgggagagttactaa

SEQ ID NO: 271658 - DNA, 20 bp, human
ggacatggagcaccccaaat

SEQ ID NO: 271659 - DNA, 20 bp, human
gggaggcatcctaggacatc

SEQ ID NO: 271660 - DNA, 20 bp, human
gtctgactacccggaggaca

SEQ ID NO: 271661 - DNA, 20 bp, human
ggctcgtaggatcccctgcg

SEQ ID NO: 271662 - DNA, 20 bp, human
ggcgctcagtgatctggcta

SEQ ID NO: 271663 - DNA, 20 bp, human
gcgcatgcgcaggtccattc

SEQ ID NO: 271664 - DNA, 20 bp, human
gcccaaataggaactttaga

SEQ ID NO: 271665 - DNA, 20 bp, human
ggggaggatgtgatcagcgg

SEQ ID NO: 271666 - DNA, 20 bp, human
gagggagggaaaaaaccaat

SEQ ID NO: 271667 - DNA, 20 bp, human
gaggaaatctgctcggtccc

SEQ ID NO: 271668 - DNA, 20 bp, human
gcctggggcgagactgggat

SEQ ID NO: 271669 - DNA, 20 bp, human
gggggcgttgggagtcgaag

SEQ ID NO: 271670 - DNA, 20 bp, human
gtccggctgagaccagaagt

SEQ ID NO: 271671 - DNA, 20 bp, human
ggcgtaccaaaacatcaaag

SEQ ID NO: 271672 - DNA, 20 bp, human
gaaactccttgccccgtgtc

SEQ ID NO: 271673 - DNA, 20 bp, human
gcaaaaacccacaacccgct

SEQ ID NO: 271674 - DNA, 20 bp, human
gtggcgtgccagcggaagat

SEQ ID NO: 271675 - DNA, 20 bp, human
gagcaggtgtggcgtgccag

SEQ ID NO: 271676 - DNA, 20 bp, human
gccgaggcgagcgtggggga

SEQ ID NO: 271677 - DNA, 20 bp, human
gggctccgcctccgactctc

SEQ ID NO: 271678 - DNA, 20 bp, human
gagcccagaggagccggctc

SEQ ID NO: 271679 - DNA, 20 bp, human
gcggctgcgcggagtcggga

SEQ ID NO: 271680 - DNA, 20 bp, human
gtcgcctcggcccgaggccg

SEQ ID NO: 271681 - DNA, 20 bp, human
gcgtgcggggccaacttcgg

SEQ ID NO: 271682 - DNA, 20 bp, human
gtcggcgccggcataagcgg

SEQ ID NO: 271683 - DNA, 20 bp, human
gcgggccgaggcgagcgtgg

SEQ ID NO: 271684 - DNA, 20 bp, human
gcctcgggccgaggcgagcg

SEQ ID NO: 271685 - DNA, 20 bp, human
ggcacgggactcggacctct

SEQ ID NO: 271686 - DNA, 20 bp, human
gaccctccgggtgtcttcat

SEQ ID NO: 271687 - DNA, 20 bp, human
gagagctgcccgcgagggag

SEQ ID NO: 271688 - DNA, 20 bp, human
ggagagccagaccccggcca

SEQ ID NO: 271689 - DNA, 20 bp, human
ggggccacagtgtccacgcg

SEQ ID NO: 271690 - DNA, 20 bp, human
ggagcgcggcgcgggcgcga

SEQ ID NO: 271691 - DNA, 20 bp, human
ggcagaacctcgtcccgagg

SEQ ID NO: 271692 - DNA, 20 bp, human
gacccggagggtcccgtctg

SEQ ID NO: 271693 - DNA, 20 bp, human
gccagggagagctgcccgcg

SEQ ID NO: 271694 - DNA, 20 bp, human
ggccgcagacgggaccctcc

SEQ ID NO: 271695 - DNA, 20 bp, human
ggatccctggggaccctcga

SEQ ID NO: 271696 - DNA, 20 bp, human
gcggcgctgccagacagcca

SEQ ID NO: 271697 - DNA, 20 bp, human
gtcccccgcccctggctgtc

SEQ ID NO: 271698 - DNA, 20 bp, human
ggcagtggcggcgtggggac

SEQ ID NO: 271699 - DNA, 20 bp, human
ggaaatctccgacgacgtga

SEQ ID NO: 271700 - DNA, 20 bp, human
ggcttcagggacaagatgtg

SEQ ID NO: 271701 - DNA, 20 bp, human
ggacgacgtgacggctgctg

SEQ ID NO: 271702 - DNA, 20 bp, human
gctgtctggcagcgccgcag

SEQ ID NO: 271703 - DNA, 20 bp, human
ggctgccagacagccagggg

SEQ ID NO: 271704 - DNA, 20 bp, human
gagcgccgcagtggcggcgt

SEQ ID NO: 271705 - DNA, 20 bp, human
gaaactcgcgccccaggctg

SEQ ID NO: 271706 - DNA, 20 bp, human
gcggcggagaaacgtttgag

SEQ ID NO: 271707 - DNA, 20 bp, human
gagaatccctccctagggag

SEQ ID NO: 271708 - DNA, 20 bp, human
gcgccgctgcgagggagaag

SEQ ID NO: 271709 - DNA, 20 bp, human
gtagggagggattctgttca

SEQ ID NO: 271710 - DNA, 20 bp, human
gaatcaggccgagaggatgg

SEQ ID NO: 271711 - DNA, 20 bp, human
gaacctggggaaaaccaatt

SEQ ID NO: 271712 - DNA, 20 bp, human
ggcctccttgggctactgat

SEQ ID NO: 271713 - DNA, 20 bp, human
gtgagccaatcagtagccca

SEQ ID NO: 271714 - DNA, 20 bp, human
gcgaaatagagtcagacaag

SEQ ID NO: 271715 - DNA, 20 bp, human
gttgagccagggagccaatc

SEQ ID NO: 271716 - DNA, 20 bp, human
gccccccacctgcctctagt

SEQ ID NO: 271717 - DNA, 20 bp, human
gccagtgaaggacctactag

SEQ ID NO: 271718 - DNA, 20 bp, human
ggacctactagaggcaggtg

SEQ ID NO: 271719 - DNA, 20 bp, human
gtgaaggacctactagaggc

SEQ ID NO: 271720 - DNA, 20 bp, human
gtggcagcggcttccaagtc

SEQ ID NO: 271721 - DNA, 20 bp, human
ggggagaacgcgtaagtgtg

SEQ ID NO: 271722 - DNA, 20 bp, human
ggtacaaggagagactcata

SEQ ID NO: 271723 - DNA, 20 bp, human
ggatgagttcgccaaatata

SEQ ID NO: 271724 - DNA, 20 bp, human
gactcatacggagacaaata

SEQ ID NO: 271725 - DNA, 20 bp, human
gtgccagagtgacgctttga

SEQ ID NO: 271726 - DNA, 20 bp, human
gacaacgcgcagggcgagga

SEQ ID NO: 271727 - DNA, 20 bp, human
gaccccggggacctttcttc

SEQ ID NO: 271728 - DNA, 20 bp, human
gccgcagggagcctgaagaa

SEQ ID NO: 271729 - DNA, 20 bp, human
gagggggcggagctccgagg

SEQ ID NO: 271730 - DNA, 20 bp, human
gcccgccgggaccgcctcgg

SEQ ID NO: 271731 - DNA, 20 bp, human
gtgaatggactcggagtttg

SEQ ID NO: 271732 - DNA, 20 bp, human
gctaagtcggctgaactcct

SEQ ID NO: 271733 - DNA, 20 bp, human
gacggcgggcacgggaggtc

SEQ ID NO: 271734 - DNA, 20 bp, human
gcccacccgcgcactagcgc

SEQ ID NO: 271735 - DNA, 20 bp, human
gcacgaagagtgcgatggaa

SEQ ID NO: 271736 - DNA, 20 bp, human
gcagagcccggcatagtggg

SEQ ID NO: 271737 - DNA, 20 bp, human
ggacccccacccactatgcc

SEQ ID NO: 271738 - DNA, 20 bp, human
gtggaggcagtagctatagc

SEQ ID NO: 271739 - DNA, 20 bp, human
gcaaagccccatccttggtg

SEQ ID NO: 271740 - DNA, 20 bp, human
gtcagtgtccccaccaagga

SEQ ID NO: 271741 - DNA, 20 bp, human
ggctgtgcagaaacagaggt

SEQ ID NO: 271742 - DNA, 20 bp, human
ggtgcagaaacagaggtggg

SEQ ID NO: 271743 - DNA, 20 bp, human
ggtcttttctggcagaggtc

SEQ ID NO: 271744 - DNA, 20 bp, human
gtgacgatctccagaaactc

SEQ ID NO: 271745 - DNA, 20 bp, human
ggatctcagaatcaaacccc

SEQ ID NO: 271746 - DNA, 20 bp, human
gtgtgtctggagatggccgg

SEQ ID NO: 271747 - DNA, 20 bp, human
ggccgctcctggctgcgact

SEQ ID NO: 271748 - DNA, 20 bp, human
ggcggcgcgcaggctacggg

SEQ ID NO: 271749 - DNA, 20 bp, human
gcgggcggcgcgcaggctac

SEQ ID NO: 271750 - DNA, 20 bp, human
ggcgcgcaggctacgggcgg

SEQ ID NO: 271751 - DNA, 20 bp, human
gcctgcgatgccgtcggagt

SEQ ID NO: 271752 - DNA, 20 bp, human
ggagcgcgcgcctttttgtg

SEQ ID NO: 271753 - DNA, 20 bp, human
gctggctccgcccactccga

SEQ ID NO: 271754 - DNA, 20 bp, human
ggcgaggtgcgctccgtctg

SEQ ID NO: 271755 - DNA, 20 bp, human
gggcccgcccggcagctgcg

SEQ ID NO: 271756 - DNA, 20 bp, human
gctgacgtaggaggatttat

SEQ ID NO: 271757 - DNA, 20 bp, human
gcctcctacgtcagatgtca

SEQ ID NO: 271758 - DNA, 20 bp, human
gaggatgcaatctggagagc

SEQ ID NO: 271759 - DNA, 20 bp, human
gcctgcgtgggctgtctata

SEQ ID NO: 271760 - DNA, 20 bp, human
gccaagaggagtaaggccag

SEQ ID NO: 271761 - DNA, 20 bp, human
gaattgttccactgggacac

SEQ ID NO: 271762 - DNA, 20 bp, human
gtgtctatatggctgagatt

SEQ ID NO: 271763 - DNA, 20 bp, human
gggaggatttataggtttag

SEQ ID NO: 271764 - DNA, 20 bp, human
gctcctcttggaaattgctt

SEQ ID NO: 271765 - DNA, 20 bp, human
ggaaagcagttccgcacctc

SEQ ID NO: 271766 - DNA, 20 bp, human
gtgtcatggcccggagtgga

SEQ ID NO: 271767 - DNA, 20 bp, human
gccactcaccccctccactc

SEQ ID NO: 271768 - DNA, 20 bp, human
gaatcactaatcagcaggga

SEQ ID NO: 271769 - DNA, 20 bp, human
ggagctgaccccctggtgga

SEQ ID NO: 271770 - DNA, 20 bp, human
gatccgagctgaccccctgg

SEQ ID NO: 271771 - DNA, 20 bp, human
ggggccatgacacaaacacc

SEQ ID NO: 271772 - DNA, 20 bp, human
gagtctgtcccatccaccag

SEQ ID NO: 271773 - DNA, 20 bp, human
gggccaatcactaatcagca

SEQ ID NO: 271774 - DNA, 20 bp, human
gctgaatcctagaatagctt

SEQ ID NO: 271775 - DNA, 20 bp, human
ggttttatgcagccagaaga

SEQ ID NO: 271776 - DNA, 20 bp, human
gagccataagataatggaaa

SEQ ID NO: 271777 - DNA, 20 bp, human
gcatgctaaggcagtctgta

SEQ ID NO: 271778 - DNA, 20 bp, human
ggcagtctgtatggcatttg

SEQ ID NO: 271779 - DNA, 20 bp, human
ggtctgtatggcatttgggg

SEQ ID NO: 271780 - DNA, 20 bp, human
gttattttgtattcatgcta

SEQ ID NO: 271781 - DNA, 20 bp, human
gtagccacacactctcctaa

SEQ ID NO: 271782 - DNA, 20 bp, human
gcttcaactggaatagcaca

SEQ ID NO: 271783 - DNA, 20 bp, human
ggcacctttaggagagtgtg

SEQ ID NO: 271784 - DNA, 20 bp, human
gacaaaagtggtttaattta

SEQ ID NO: 271785 - DNA, 20 bp, human
ggatattgcattggattaag

SEQ ID NO: 271786 - DNA, 20 bp, human
gaccgcctctggagctttat

SEQ ID NO: 271787 - DNA, 20 bp, human
gcgcgggggcagctagtcgg

SEQ ID NO: 271788 - DNA, 20 bp, human
gacgaggccgttgctcgcgg

SEQ ID NO: 271789 - DNA, 20 bp, human
ggctcgcgggggcagctagt

SEQ ID NO: 271790 - DNA, 20 bp, human
gggggaggcggggaccggat

SEQ ID NO: 271791 - DNA, 20 bp, human
ggaggcggggaccggatcgg

SEQ ID NO: 271792 - DNA, 20 bp, human
gcgggcgcaaaaccgtgagc

SEQ ID NO: 271793 - DNA, 20 bp, human
gtcgcagggtcacagatctg

SEQ ID NO: 271794 - DNA, 20 bp, human
gtcgccctataaagctccag

SEQ ID NO: 271795 - DNA, 20 bp, human
ggcaggtgcctgaccgcctc

SEQ ID NO: 271796 - DNA, 20 bp, human
ggcccagtggggatgaatga

SEQ ID NO: 271797 - DNA, 20 bp, human
gtgtatgcgagctggagaca

SEQ ID NO: 271798 - DNA, 20 bp, human
ggagagccccagagcatttg

SEQ ID NO: 271799 - DNA, 20 bp, human
ggcgagggcgggtgtcacgc

SEQ ID NO: 271800 - DNA, 20 bp, human
gaggaaaaaaacacgagaga

SEQ ID NO: 271801 - DNA, 20 bp, human
gtgcccgtgtggcgggagga

SEQ ID NO: 271802 - DNA, 20 bp, human
gaagctccccggcttccaaa

SEQ ID NO: 271803 - DNA, 20 bp, human
gaaaaaacacgagagaggga

SEQ ID NO: 271804 - DNA, 20 bp, human
gtgcgcgccagcgtcagcga

SEQ ID NO: 271805 - DNA, 20 bp, human
gtagggacgtggcaaccctt

SEQ ID NO: 271806 - DNA, 20 bp, human
gggggaccattgggagtggg

SEQ ID NO: 271807 - DNA, 20 bp, human
gctcctggagtcaggttgag

SEQ ID NO: 271808 - DNA, 20 bp, human
gtgagaggagcggaaaaggg

SEQ ID NO: 271809 - DNA, 20 bp, human
gcacgcgggaggcgagccga

SEQ ID NO: 271810 - DNA, 20 bp, human
ggccaagctgcatgcaaatg

SEQ ID NO: 271811 - DNA, 20 bp, human
gtggcggggaccattgggag

SEQ ID NO: 271812 - DNA, 20 bp, human
gcccaatggtccccgccaac

SEQ ID NO: 271813 - DNA, 20 bp, human
gcgcactcttatccggttgg

SEQ ID NO: 271814 - DNA, 20 bp, human
gtcccgcgcgcactcttatc

SEQ ID NO: 271815 - DNA, 20 bp, human
gggagctggggtcaaattgc

SEQ ID NO: 271816 - DNA, 20 bp, human
gtagctctgcggttggccga

SEQ ID NO: 271817 - DNA, 20 bp, human
gccacgtgggggcgagaacc

SEQ ID NO: 271818 - DNA, 20 bp, human
gtgcgggggcgccccacgtg

SEQ ID NO: 271819 - DNA, 20 bp, human
gggttggccgacggagggga

SEQ ID NO: 271820 - DNA, 20 bp, human
ggcgagtgcagctagctctg

SEQ ID NO: 271821 - DNA, 20 bp, human
gggggcgaatgactccactg

SEQ ID NO: 271822 - DNA, 20 bp, human
gactctccgcggatcgggag

SEQ ID NO: 271823 - DNA, 20 bp, human
ggcggcccggactttcgggg

SEQ ID NO: 271824 - DNA, 20 bp, human
gtctgcggttggccgacgga

SEQ ID NO: 271825 - DNA, 20 bp, human
gcgtgggggcgagaaccggg

SEQ ID NO: 271826 - DNA, 20 bp, human
gaaatgaggcggcgagccag

SEQ ID NO: 271827 - DNA, 20 bp, human
gcacgtggggaggggtgcgg

SEQ ID NO: 271828 - DNA, 20 bp, human
gtaagggcgcgcagcgtagt

SEQ ID NO: 271829 - DNA, 20 bp, human
gcacccaccagcctatataa

SEQ ID NO: 271830 - DNA, 20 bp, human
gacgctgcgcgcccttatat

SEQ ID NO: 271831 - DNA, 20 bp, human
gaggctgcgcgcctattggc

SEQ ID NO: 271832 - DNA, 20 bp, human
gtcgtgccagaaggccacgt

SEQ ID NO: 271833 - DNA, 20 bp, human
gggtaacaccccaacaaaag

SEQ ID NO: 271834 - DNA, 20 bp, human
ggccagcggctcgtgccaga

SEQ ID NO: 271835 - DNA, 20 bp, human
gcgcccttatataggctggt

SEQ ID NO: 271836 - DNA, 20 bp, human
ggcggcgaaggggatagtat

SEQ ID NO: 271837 - DNA, 20 bp, human
gtaagtgtcagtgtgcagaa

SEQ ID NO: 271838 - DNA, 20 bp, human
gccctgctgcctcagttcgg

SEQ ID NO: 271839 - DNA, 20 bp, human
ggctgcctcagttcggggga

SEQ ID NO: 271840 - DNA, 20 bp, human
gttcgggggagggcggcgaa

SEQ ID NO: 271841 - DNA, 20 bp, human
gcgaggcccggtgtgggcca

SEQ ID NO: 271842 - DNA, 20 bp, human
ggggcctcgcgctcaggcac

SEQ ID NO: 271843 - DNA, 20 bp, human
ggcctcagttcgggggaggg

SEQ ID NO: 271844 - DNA, 20 bp, human
gccgccgggctgtccatgcc

SEQ ID NO: 271845 - DNA, 20 bp, human
gcacaccgggcctcgcgctc

SEQ ID NO: 271846 - DNA, 20 bp, human
ggcccagcctgtatcctagg

SEQ ID NO: 271847 - DNA, 20 bp, human
gtatcctaggagggctggta

SEQ ID NO: 271848 - DNA, 20 bp, human
gccctcctaggatacaggct

SEQ ID NO: 271849 - DNA, 20 bp, human
ggggaagtgtgtaggagcgt

SEQ ID NO: 271850 - DNA, 20 bp, human
gttgccacaggcttgaccca

SEQ ID NO: 271851 - DNA, 20 bp, human
gaaggcagataagtggctct

SEQ ID NO: 271852 - DNA, 20 bp, human
gcttgcccagcctgtatcct

SEQ ID NO: 271853 - DNA, 20 bp, human
ggcaccctaccagccctcct

SEQ ID NO: 271854 - DNA, 20 bp, human
gtgtaggagcgtgggtaatt

SEQ ID NO: 271855 - DNA, 20 bp, human
gagggcagagctgaatgaat

SEQ ID NO: 271856 - DNA, 20 bp, human
gcagtggggatgggaatcga

SEQ ID NO: 271857 - DNA, 20 bp, human
ggatgggaatcgagggttgg

SEQ ID NO: 271858 - DNA, 20 bp, human
gggggatgggaatcgagggt

SEQ ID NO: 271859 - DNA, 20 bp, human
gaatcgagggttgggggcgt

SEQ ID NO: 271860 - DNA, 20 bp, human
gggtccttgtccccatggtg

SEQ ID NO: 271861 - DNA, 20 bp, human
gcaaggagcatgtacagctg

SEQ ID NO: 271862 - DNA, 20 bp, human
gagcatgtacagctgcgggt

SEQ ID NO: 271863 - DNA, 20 bp, human
ggtggtttacctgtcttctc

SEQ ID NO: 271864 - DNA, 20 bp, human
gtcttctcaggcagtcaccg

SEQ ID NO: 271865 - DNA, 20 bp, human
gagattccattatcctcagt

SEQ ID NO: 271866 - DNA, 20 bp, human
gagacacgggatctcccata

SEQ ID NO: 271867 - DNA, 20 bp, human
ggactaaaaacagaacccta

SEQ ID NO: 271868 - DNA, 20 bp, human
gaggaagcacttgatgttca

SEQ ID NO: 271869 - DNA, 20 bp, human
gaagcacttgatgttcaggg

SEQ ID NO: 271870 - DNA, 20 bp, human
gtaagtgcttgtgacttgaa

SEQ ID NO: 271871 - DNA, 20 bp, human
ggaagactgacagtggggca

SEQ ID NO: 271872 - DNA, 20 bp, human
gttcaattgcgtgtaagaca

SEQ ID NO: 271873 - DNA, 20 bp, human
gacgctcaaagttaatgcag

SEQ ID NO: 271874 - DNA, 20 bp, human
gacaaagcacactacagttt

SEQ ID NO: 271875 - DNA, 20 bp, human
ggctcatgaagactgacagt

SEQ ID NO: 271876 - DNA, 20 bp, human
gcgggcttgcgatgaacttc

SEQ ID NO: 271877 - DNA, 20 bp, human
gcggccgggagcttgacagc

SEQ ID NO: 271878 - DNA, 20 bp, human
gccggccgggctgactcaag

SEQ ID NO: 271879 - DNA, 20 bp, human
gccaggaagtgaggccgcgg

SEQ ID NO: 271880 - DNA, 20 bp, human
gtgacgcgacgcgtcctcac

SEQ ID NO: 271881 - DNA, 20 bp, human
gagcgcgtgcgcggcgtcgc

SEQ ID NO: 271882 - DNA, 20 bp, human
gaccatgtggggaacggtac

SEQ ID NO: 271883 - DNA, 20 bp, human
ggggcgctgaactacctggg

SEQ ID NO: 271884 - DNA, 20 bp, human
gaagtgaggccgcggcggag

SEQ ID NO: 271885 - DNA, 20 bp, human
gctggggcgctgaactacct

SEQ ID NO: 271886 - DNA, 20 bp, human
gtctcccgcgggatgagggg

SEQ ID NO: 271887 - DNA, 20 bp, human
ggggccatcataggcgggtg

SEQ ID NO: 271888 - DNA, 20 bp, human
gcgccctcggggctcggcga

SEQ ID NO: 271889 - DNA, 20 bp, human
gcaccctcgccgagccccga

SEQ ID NO: 271890 - DNA, 20 bp, human
gtcctctgggccatcatagg

SEQ ID NO: 271891 - DNA, 20 bp, human
gcccgcctatgatggcccag

SEQ ID NO: 271892 - DNA, 20 bp, human
ggcccagaggacccgagctc

SEQ ID NO: 271893 - DNA, 20 bp, human
gacgggagtgacccgagctc

SEQ ID NO: 271894 - DNA, 20 bp, human
gccgcccggagtcgcgtcac

SEQ ID NO: 271895 - DNA, 20 bp, human
gagtctctcccgcgggatga

SEQ ID NO: 271896 - DNA, 20 bp, human
gtgaatgagtgtaccagtaa

SEQ ID NO: 271897 - DNA, 20 bp, human
ggcgggtggaggaactgtcc

SEQ ID NO: 271898 - DNA, 20 bp, human
gaaagagctgcttgcttgtt

SEQ ID NO: 271899 - DNA, 20 bp, human
gaggctctaaggctgagtga

SEQ ID NO: 271900 - DNA, 20 bp, human
gggctctctgcaggcgtctg

SEQ ID NO: 271901 - DNA, 20 bp, human
gaaagattccaggtatcctt

SEQ ID NO: 271902 - DNA, 20 bp, human
gtccaaagagaggtgaggac

SEQ ID NO: 271903 - DNA, 20 bp, human
gtggctccctcccactccag

SEQ ID NO: 271904 - DNA, 20 bp, human
gtgcctccactggacagctc

SEQ ID NO: 271905 - DNA, 20 bp, human
gtctgcggttgctgtgtcct

SEQ ID NO: 271906 - DNA, 20 bp, human
ggaacacaggggcccatcga

SEQ ID NO: 271907 - DNA, 20 bp, human
gctccctccaagccccccgg

SEQ ID NO: 271908 - DNA, 20 bp, human
gtccccgcacctccatcgga

SEQ ID NO: 271909 - DNA, 20 bp, human
ggagtctggggagccctcga

SEQ ID NO: 271910 - DNA, 20 bp, human
gcctctccccgcacctccat

SEQ ID NO: 271911 - DNA, 20 bp, human
gtccccccggggggcttgga

SEQ ID NO: 271912 - DNA, 20 bp, human
gggggaggaagctgggaatt

SEQ ID NO: 271913 - DNA, 20 bp, human
gggacctgacgcagacgaga

SEQ ID NO: 271914 - DNA, 20 bp, human
ggagggagctgtccccacaa

SEQ ID NO: 271915 - DNA, 20 bp, human
gggggatggacactgagggt

SEQ ID NO: 271916 - DNA, 20 bp, human
ggccaggccacgagcaagta

SEQ ID NO: 271917 - DNA, 20 bp, human
gggctgccgtgaacagtctc

SEQ ID NO: 271918 - DNA, 20 bp, human
ggcagccagcgggcaagcca

SEQ ID NO: 271919 - DNA, 20 bp, human
ggccccccatcgcacaccgg

SEQ ID NO: 271920 - DNA, 20 bp, human
ggccacccagagactgttca

SEQ ID NO: 271921 - DNA, 20 bp, human
ggccgtgaacagtctctggg

SEQ ID NO: 271922 - DNA, 20 bp, human
gggttccctggcttgcccgc

SEQ ID NO: 271923 - DNA, 20 bp, human
gcctcactatagctctggtc

SEQ ID NO: 271924 - DNA, 20 bp, human
ggcagagttggacactaatg

SEQ ID NO: 271925 - DNA, 20 bp, human
gccttcctccggtgtgcgat

SEQ ID NO: 271926 - DNA, 20 bp, human
gtgggtgccctgccgaagag

SEQ ID NO: 271927 - DNA, 20 bp, human
gagggcacccagactcctct

SEQ ID NO: 271928 - DNA, 20 bp, human
ggggctggcggcacaaaggg

SEQ ID NO: 271929 - DNA, 20 bp, human
gctggggctggcggcacaaa

SEQ ID NO: 271930 - DNA, 20 bp, human
gccagccaccgcccgactct

SEQ ID NO: 271931 - DNA, 20 bp, human
gggcgctgagaaagttcttg

SEQ ID NO: 271932 - DNA, 20 bp, human
ggctgctgcagctttgatcg

SEQ ID NO: 271933 - DNA, 20 bp, human
ggattcccaagtgtgaaagc

SEQ ID NO: 271934 - DNA, 20 bp, human
gctggcggcacaaagggagg

SEQ ID NO: 271935 - DNA, 20 bp, human
ggtgaaagcgggggcggaag

SEQ ID NO: 271936 - DNA, 20 bp, human
ggggccacctaggagagtct

SEQ ID NO: 271937 - DNA, 20 bp, human
gcactccccttccctgaagg

SEQ ID NO: 271938 - DNA, 20 bp, human
gagcagagacagtagttgtg

SEQ ID NO: 271939 - DNA, 20 bp, human
gcgtctagaagggaaatgag

SEQ ID NO: 271940 - DNA, 20 bp, human
ggcagctgagacctccttca

SEQ ID NO: 271941 - DNA, 20 bp, human
gacaactgtaggtggggagc

SEQ ID NO: 271942 - DNA, 20 bp, human
gctcagggacaactgtaggt

SEQ ID NO: 271943 - DNA, 20 bp, human
gatacccagactctcctagg

SEQ ID NO: 271944 - DNA, 20 bp, human
ggacacaggtgtatgaaccc

SEQ ID NO: 271945 - DNA, 20 bp, human
ggagccttggggatttataa

SEQ ID NO: 271946 - DNA, 20 bp, human
ggcggcggcgtcagcatcag

SEQ ID NO: 271947 - DNA, 20 bp, human
gactccgccagctgcgtcag

SEQ ID NO: 271948 - DNA, 20 bp, human
gctggggaagagccatggta

SEQ ID NO: 271949 - DNA, 20 bp, human
gcaagggcctctgacgcagc

SEQ ID NO: 271950 - DNA, 20 bp, human
gctcctgcccgtatctatcg

SEQ ID NO: 271951 - DNA, 20 bp, human
ggacccacacaatggctgag

SEQ ID NO: 271952 - DNA, 20 bp, human
gaaaggaagagggccatgag

SEQ ID NO: 271953 - DNA, 20 bp, human
gcttatcgctcgcgtgtctg

SEQ ID NO: 271954 - DNA, 20 bp, human
ggccgccgccattttgagtg

SEQ ID NO: 271955 - DNA, 20 bp, human
gtgtgtgggtcacatgactc

SEQ ID NO: 271956 - DNA, 20 bp, human
gcgcccgcggaaggcggaag

SEQ ID NO: 271957 - DNA, 20 bp, human
ggggagggcgggaggacaaa

SEQ ID NO: 271958 - DNA, 20 bp, human
gactgcgcagcgcgcgcccg

SEQ ID NO: 271959 - DNA, 20 bp, human
ggttacggccactacgggga

SEQ ID NO: 271960 - DNA, 20 bp, human
ggggacccggggcaccggca

SEQ ID NO: 271961 - DNA, 20 bp, human
gaagcgcagccctcttccag

SEQ ID NO: 271962 - DNA, 20 bp, human
gtgggccgtcagcacttaaa

SEQ ID NO: 271963 - DNA, 20 bp, human
gcggccactacggggagggc

SEQ ID NO: 271964 - DNA, 20 bp, human
gcgcagcgcgcgcccgcgga

SEQ ID NO: 271965 - DNA, 20 bp, human
gcgcccacttccgccttccg

SEQ ID NO: 271966 - DNA, 20 bp, human
gtcccacgggagttgcgggt

SEQ ID NO: 271967 - DNA, 20 bp, human
gccccacccgcaactcccgt

SEQ ID NO: 271968 - DNA, 20 bp, human
gtggcaggggctaatggtgc

SEQ ID NO: 271969 - DNA, 20 bp, human
gcggaaccggctgaggtctg

SEQ ID NO: 271970 - DNA, 20 bp, human
ggagggaaggacaccatcgg

SEQ ID NO: 271971 - DNA, 20 bp, human
gggtgccagctccattgctc

SEQ ID NO: 271972 - DNA, 20 bp, human
ggggggcgctgtatcccacc

SEQ ID NO: 271973 - DNA, 20 bp, human
ggggacctaggggatccctt

SEQ ID NO: 271974 - DNA, 20 bp, human
ggtgggggcggaaccggctg

SEQ ID NO: 271975 - DNA, 20 bp, human
gcgagcatcccgcgccgacg

SEQ ID NO: 271976 - DNA, 20 bp, human
gggaaacagctcctctaaga

SEQ ID NO: 271977 - DNA, 20 bp, human
ggcagggaatggaactctga

SEQ ID NO: 271978 - DNA, 20 bp, human
gctcctcccacaatcctccg

SEQ ID NO: 271979 - DNA, 20 bp, human
gtcctctaagagggactgga

SEQ ID NO: 271980 - DNA, 20 bp, human
gtgacgcctctgagccgcgg

SEQ ID NO: 271981 - DNA, 20 bp, human
gccggccaagatgtctgaca

SEQ ID NO: 271982 - DNA, 20 bp, human
ggagtgacgcctctgagccg

SEQ ID NO: 271983 - DNA, 20 bp, human
ggccaagatgtctgacatgg

SEQ ID NO: 271984 - DNA, 20 bp, human
gaaggcaccaaccacttcgg

SEQ ID NO: 271985 - DNA, 20 bp, human
ggatgaggaggactacgacc

SEQ ID NO: 271986 - DNA, 20 bp, human
gtacctgactgctgcttgga

SEQ ID NO: 271987 - DNA, 20 bp, human
gtcgcacgtgctctgcgcag

SEQ ID NO: 271988 - DNA, 20 bp, human
ggggaaccctggctgagtcc

SEQ ID NO: 271989 - DNA, 20 bp, human
gagctcccagggagggacta

SEQ ID NO: 271990 - DNA, 20 bp, human
gagccagaggaggggccgat

SEQ ID NO: 271991 - DNA, 20 bp, human
gcgtgcgaagctgactagtg

SEQ ID NO: 271992 - DNA, 20 bp, human
ggaggccctagtccctccct

SEQ ID NO: 271993 - DNA, 20 bp, human
gaaatcctgcagcttcgctg

SEQ ID NO: 271994 - DNA, 20 bp, human
ggtcctgctcttagctccca

SEQ ID NO: 271995 - DNA, 20 bp, human
gttccaatcggcccctcctc

SEQ ID NO: 271996 - DNA, 20 bp, human
gtgcctgagggtaacaagag

SEQ ID NO: 271997 - DNA, 20 bp, human
gcccaacatgcaatgcaacc

SEQ ID NO: 271998 - DNA, 20 bp, human
ggggaatggtagtttttggg

SEQ ID NO: 271999 - DNA, 20 bp, human
gtgcccctcttgttaccctc

SEQ ID NO: 272000 - DNA, 20 bp, human
gttgcattgcatgttgggaa

SEQ ID NO: 272001 - DNA, 20 bp, human
gggtagaaccccgtcaaccc

SEQ ID NO: 272002 - DNA, 20 bp, human
gcaggagaaggggcgtgact

SEQ ID NO: 272003 - DNA, 20 bp, human
gcccaggggctattttttgc

SEQ ID NO: 272004 - DNA, 20 bp, human
gacggtcactccctaaatcc

SEQ ID NO: 272005 - DNA, 20 bp, human
gcccaagtttacaggagaag

SEQ ID NO: 272006 - DNA, 20 bp, human
gagccagctgtgtgcggatg

SEQ ID NO: 272007 - DNA, 20 bp, human
gcagctgtgtgcggatgggg

SEQ ID NO: 272008 - DNA, 20 bp, human
gtgacccgccgctggtcacg

SEQ ID NO: 272009 - DNA, 20 bp, human
gcggggccagagtccgcgga

SEQ ID NO: 272010 - DNA, 20 bp, human
gaggccgcgtgaccagcggc

SEQ ID NO: 272011 - DNA, 20 bp, human
gggggcggggccagagtccg

SEQ ID NO: 272012 - DNA, 20 bp, human
gtgcacaccgccatcttggg

SEQ ID NO: 272013 - DNA, 20 bp, human
gggaactggggtctcagtca

SEQ ID NO: 272014 - DNA, 20 bp, human
gttggaggccgcgtgaccag

SEQ ID NO: 272015 - DNA, 20 bp, human
gtccgggctcgcaccatcct

SEQ ID NO: 272016 - DNA, 20 bp, human
gtaagacccaggtgtttgat

SEQ ID NO: 272017 - DNA, 20 bp, human
gatacagcagttgagtagga

SEQ ID NO: 272018 - DNA, 20 bp, human
gaaaatatataaagagtatc

SEQ ID NO: 272019 - DNA, 20 bp, human
gtcacacccatcaaacacct

SEQ ID NO: 272020 - DNA, 20 bp, human
gacgtgatttctgatgaaac

SEQ ID NO: 272021 - DNA, 20 bp, human
gcaatatacaacaatccaat

SEQ ID NO: 272022 - DNA, 20 bp, human
gtataatacagcagttgagt

SEQ ID NO: 272023 - DNA, 20 bp, human
gtcaagctattaattaccat

SEQ ID NO: 272024 - DNA, 20 bp, human
gatttctgatgaaactggat

SEQ ID NO: 272025 - DNA, 20 bp, human
gtgctcaattccctacaatt

SEQ ID NO: 272026 - DNA, 20 bp, human
gctgcagcgcagagactcgg

SEQ ID NO: 272027 - DNA, 20 bp, human
gcatcctgcagcgcccgggc

SEQ ID NO: 272028 - DNA, 20 bp, human
ggaccatcgcggctcgagag

SEQ ID NO: 272029 - DNA, 20 bp, human
gagactcggcggtcgacgcg

SEQ ID NO: 272030 - DNA, 20 bp, human
ggccgagacgctccgtgaga

SEQ ID NO: 272031 - DNA, 20 bp, human
gcccccctctcgagccgcga

SEQ ID NO: 272032 - DNA, 20 bp, human
ggacgaccccctcgtggcgg

SEQ ID NO: 272033 - DNA, 20 bp, human
gtgcaggctcggccctctca

SEQ ID NO: 272034 - DNA, 20 bp, human
gcggccccgctccaactccg

SEQ ID NO: 272035 - DNA, 20 bp, human
gggagtgggacggaccatcg

SEQ ID NO: 272036 - DNA, 20 bp, human
gcgcctctgcgcgaacgcta

SEQ ID NO: 272037 - DNA, 20 bp, human
gcgcggcggccggtgacgtc

SEQ ID NO: 272038 - DNA, 20 bp, human
gctcgctgccctgacgtcac

SEQ ID NO: 272039 - DNA, 20 bp, human
gctagggaggactcagcgcg

SEQ ID NO: 272040 - DNA, 20 bp, human
gcggctcggggactgggcga

SEQ ID NO: 272041 - DNA, 20 bp, human
ggggaggactcagcgcgcgg

SEQ ID NO: 272042 - DNA, 20 bp, human
gctccctagcgttcgcgcag

SEQ ID NO: 272043 - DNA, 20 bp, human
ggccggcgccgcgtgacagg

SEQ ID NO: 272044 - DNA, 20 bp, human
gggcggggccgcctgtcacg

SEQ ID NO: 272045 - DNA, 20 bp, human
gaggcagcggctcggggact

SEQ ID NO: 272046 - DNA, 20 bp, human
gccgaaatgagccaccccgg

SEQ ID NO: 272047 - DNA, 20 bp, human
gttcggcagggtcttcaagt

SEQ ID NO: 272048 - DNA, 20 bp, human
gccagcccaagcgcagcccc

SEQ ID NO: 272049 - DNA, 20 bp, human
ggcgcggggctggacggaaa

SEQ ID NO: 272050 - DNA, 20 bp, human
ggcagggtcttcaagtgggc

SEQ ID NO: 272051 - DNA, 20 bp, human
ggctgcgcttgggctggcgc

SEQ ID NO: 272052 - DNA, 20 bp, human
gggggtggctcatttcggca

SEQ ID NO: 272053 - DNA, 20 bp, human
ggaggccaggacccggatcc

SEQ ID NO: 272054 - DNA, 20 bp, human
gcagcctctgccatactctt

SEQ ID NO: 272055 - DNA, 20 bp, human
gaatgcaccatagcccaaga

SEQ ID NO: 272056 - DNA, 20 bp, human
gagagccgacggcaagggtg

SEQ ID NO: 272057 - DNA, 20 bp, human
gcctccagctcccctctaag

SEQ ID NO: 272058 - DNA, 20 bp, human
ggcaccagggagcctcttag

SEQ ID NO: 272059 - DNA, 20 bp, human
gtgaccccagggttgctctt

SEQ ID NO: 272060 - DNA, 20 bp, human
gtcccctctaagaggctccc

SEQ ID NO: 272061 - DNA, 20 bp, human
ggcgagaggagctgacccca

SEQ ID NO: 272062 - DNA, 20 bp, human
gtggggccccaaagcggcca

SEQ ID NO: 272063 - DNA, 20 bp, human
gagcctggaggcctctcact

SEQ ID NO: 272064 - DNA, 20 bp, human
ggcgttgtggggccccaaag

SEQ ID NO: 272065 - DNA, 20 bp, human
ggagcctcttagaggggagc

SEQ ID NO: 272066 - DNA, 20 bp, human
gcaccccgggaggagcacga

SEQ ID NO: 272067 - DNA, 20 bp, human
gactcggagcgagcccaggt

SEQ ID NO: 272068 - DNA, 20 bp, human
ggcccaggtgggagtgagcg

SEQ ID NO: 272069 - DNA, 20 bp, human
ggggcgggagcggtgcactc

SEQ ID NO: 272070 - DNA, 20 bp, human
ggaaacgctcggtgctgttg

SEQ ID NO: 272071 - DNA, 20 bp, human
ggcagctcccagaccatcgt

SEQ ID NO: 272072 - DNA, 20 bp, human
ggcacagcgccgcctggcga

SEQ ID NO: 272073 - DNA, 20 bp, human
ggagggcgggcccgacagac

SEQ ID NO: 272074 - DNA, 20 bp, human
gcccgggaggagcacgaggg

SEQ ID NO: 272075 - DNA, 20 bp, human
gagcgagagggaggaatccg

SEQ ID NO: 272076 - DNA, 20 bp, human
ggagtggagctatgtgtgaa

SEQ ID NO: 272077 - DNA, 20 bp, human
gttgcctgatcccccatggg

SEQ ID NO: 272078 - DNA, 20 bp, human
gaatatcccaagagttcaga

SEQ ID NO: 272079 - DNA, 20 bp, human
gcaagcgtgcgcgtcactcc

SEQ ID NO: 272080 - DNA, 20 bp, human
ggctagagccaaatcaaaac

SEQ ID NO: 272081 - DNA, 20 bp, human
gtctttccttctgaactctt

SEQ ID NO: 272082 - DNA, 20 bp, human
gcaaagcctgggaacagtga

SEQ ID NO: 272083 - DNA, 20 bp, human
gcttggctctgggttgtgtc

SEQ ID NO: 272084 - DNA, 20 bp, human
gaccgagttgtgcaaagcct

SEQ ID NO: 272085 - DNA, 20 bp, human
gtgtgtgtggcatagctgca

SEQ ID NO: 272086 - DNA, 20 bp, human
gccaccaggccactgcgcac

SEQ ID NO: 272087 - DNA, 20 bp, human
gccggcgagacagacgcccg

SEQ ID NO: 272088 - DNA, 20 bp, human
gcacctagcggtgggagccg

SEQ ID NO: 272089 - DNA, 20 bp, human
ggccctgcgcacgaatgaat

SEQ ID NO: 272090 - DNA, 20 bp, human
gcgccgccggctgacccacc

SEQ ID NO: 272091 - DNA, 20 bp, human
ggcccccgcgcggccctggt

SEQ ID NO: 272092 - DNA, 20 bp, human
gggaccgaccagggccgcgc

SEQ ID NO: 272093 - DNA, 20 bp, human
gcgttcggtcacctagcggt

SEQ ID NO: 272094 - DNA, 20 bp, human
gcgaatgaatgggcgcccgg

SEQ ID NO: 272095 - DNA, 20 bp, human
gcctctgggcgggcccggtc

SEQ ID NO: 272096 - DNA, 20 bp, human
gggcagcggaccaacgggga

SEQ ID NO: 272097 - DNA, 20 bp, human
gggcccgggcgcgtccctgg

SEQ ID NO: 272098 - DNA, 20 bp, human
gcctccacccgcgcctgcac

SEQ ID NO: 272099 - DNA, 20 bp, human
ggagcggcagcggaccaacg

SEQ ID NO: 272100 - DNA, 20 bp, human
ggaggaagctgccgacctaa

SEQ ID NO: 272101 - DNA, 20 bp, human
gcgcgctccggctcgggaga

SEQ ID NO: 272102 - DNA, 20 bp, human
ggctgccaccaatcgcgctc

SEQ ID NO: 272103 - DNA, 20 bp, human
gggaggcccgggcgcgtccc

SEQ ID NO: 272104 - DNA, 20 bp, human
gactggcagcgcgccctctc

SEQ ID NO: 272105 - DNA, 20 bp, human
gtcccgagccggagcgcgat

SEQ ID NO: 272106 - DNA, 20 bp, human
gccgagcagtagcaccgcgc

SEQ ID NO: 272107 - DNA, 20 bp, human
ggggggagcacgctgagggg

SEQ ID NO: 272108 - DNA, 20 bp, human
ggcaaagggcgaccaatcgg

SEQ ID NO: 272109 - DNA, 20 bp, human
ggcccggcgtgctgcagcca

SEQ ID NO: 272110 - DNA, 20 bp, human
gcaggaagcagcggcctcgg

SEQ ID NO: 272111 - DNA, 20 bp, human
gaggggggtcagggagcaaa

SEQ ID NO: 272112 - DNA, 20 bp, human
gaagggcgaccaatcggcgg

SEQ ID NO: 272113 - DNA, 20 bp, human
gacccccctcgccgcctccg

SEQ ID NO: 272114 - DNA, 20 bp, human
gggagcaaagggcgaccaat

SEQ ID NO: 272115 - DNA, 20 bp, human
gagcagtagcaccgcgcggg

SEQ ID NO: 272116 - DNA, 20 bp, human
gaggaagggaggaaccgtgt

SEQ ID NO: 272117 - DNA, 20 bp, human
ggctcccggcccatctacat

SEQ ID NO: 272118 - DNA, 20 bp, human
gttggcgaaccgaggaggaa

SEQ ID NO: 272119 - DNA, 20 bp, human
gaaggggtgcgctgcctccg

SEQ ID NO: 272120 - DNA, 20 bp, human
gcacctggagcgctcaggta

SEQ ID NO: 272121 - DNA, 20 bp, human
gcccggcccatctacattgg

SEQ ID NO: 272122 - DNA, 20 bp, human
gactgccaccaggtcagtgc

SEQ ID NO: 272123 - DNA, 20 bp, human
gctcccgaagtggtcctcgg

SEQ ID NO: 272124 - DNA, 20 bp, human
gaccctgcgcgcgcgatcca

SEQ ID NO: 272125 - DNA, 20 bp, human
gtgcctccgaggaccacttc

SEQ ID NO: 272126 - DNA, 20 bp, human
gaggaagtggggtagtaacc

SEQ ID NO: 272127 - DNA, 20 bp, human
gtgtgtggccacagctgacc

SEQ ID NO: 272128 - DNA, 20 bp, human
gagccctgtaaagagaggac

SEQ ID NO: 272129 - DNA, 20 bp, human
gcctgtaaagagaggacggg

SEQ ID NO: 272130 - DNA, 20 bp, human
gctctgatcgcatcgatcac

SEQ ID NO: 272131 - DNA, 20 bp, human
ggaggacgggaggtatgcgc

SEQ ID NO: 272132 - DNA, 20 bp, human
gccgccagccctgtaaagag

SEQ ID NO: 272133 - DNA, 20 bp, human
gaataagagcgatgaatgga

SEQ ID NO: 272134 - DNA, 20 bp, human
gcagggctggcggtgtctcg

SEQ ID NO: 272135 - DNA, 20 bp, human
gtggtttgatgtcaggaagt

SEQ ID NO: 272136 - DNA, 20 bp, human
gcggctaagggcctgtatga

SEQ ID NO: 272137 - DNA, 20 bp, human
gtccctaggagaacggctaa

SEQ ID NO: 272138 - DNA, 20 bp, human
ggcctcctatccagcggtct

SEQ ID NO: 272139 - DNA, 20 bp, human
gtgagagcacccggagacga

SEQ ID NO: 272140 - DNA, 20 bp, human
gaccaccaggaggagtgagt

SEQ ID NO: 272141 - DNA, 20 bp, human
ggcccttagccgttctccta

SEQ ID NO: 272142 - DNA, 20 bp, human
gcctgcccggacaggaggaa

SEQ ID NO: 272143 - DNA, 20 bp, human
gccgctggataggaggctct

SEQ ID NO: 272144 - DNA, 20 bp, human
gtggataggaggctcttggc

SEQ ID NO: 272145 - DNA, 20 bp, human
ggaggctcttggccgggccg

SEQ ID NO: 272146 - DNA, 20 bp, human
gagcgtgcagacggagaacg

SEQ ID NO: 272147 - DNA, 20 bp, human
gagggttaatgagcaggagt

SEQ ID NO: 272148 - DNA, 20 bp, human
gtacaacagggttaatgagc

SEQ ID NO: 272149 - DNA, 20 bp, human
gagaaacggcagtctcaatc

SEQ ID NO: 272150 - DNA, 20 bp, human
gttggcacctggctacaaca

SEQ ID NO: 272151 - DNA, 20 bp, human
gagagctgaatgaagttttc

SEQ ID NO: 272152 - DNA, 20 bp, human
gacaagcccaagaaaaggtg

SEQ ID NO: 272153 - DNA, 20 bp, human
gtgctctcacataacacaga

SEQ ID NO: 272154 - DNA, 20 bp, human
gaattcctcaggcagagcat

SEQ ID NO: 272155 - DNA, 20 bp, human
gttttcttgggcttgtagga

SEQ ID NO: 272156 - DNA, 20 bp, human
ggccgtccggtggggaaacc

SEQ ID NO: 272157 - DNA, 20 bp, human
gcggtccgccgggagttccc

SEQ ID NO: 272158 - DNA, 20 bp, human
gaagaccgcacccccggggc

SEQ ID NO: 272159 - DNA, 20 bp, human
gagcaggctgaggacacggc

SEQ ID NO: 272160 - DNA, 20 bp, human
gcggccgggagggtgggacc

SEQ ID NO: 272161 - DNA, 20 bp, human
gctgcgggcccgggaactcc

SEQ ID NO: 272162 - DNA, 20 bp, human
ggggcgcgttagtgcagctg

SEQ ID NO: 272163 - DNA, 20 bp, human
gactcccggcggaccggcag

SEQ ID NO: 272164 - DNA, 20 bp, human
gctgagacgcagagaagccg

SEQ ID NO: 272165 - DNA, 20 bp, human
gctcccggggagagggtcgc

SEQ ID NO: 272166 - DNA, 20 bp, human
gccgaggggagttccggatc

SEQ ID NO: 272167 - DNA, 20 bp, human
ggtgtagccgaggggagttc

SEQ ID NO: 272168 - DNA, 20 bp, human
gcggggaaaggtgtagccga

SEQ ID NO: 272169 - DNA, 20 bp, human
gcggtggccgccagagggga

SEQ ID NO: 272170 - DNA, 20 bp, human
gtcccccacccctaccgcta

SEQ ID NO: 272171 - DNA, 20 bp, human
gagccgtagcggtaggggtg

SEQ ID NO: 272172 - DNA, 20 bp, human
gggcggcagccgtagcggta

SEQ ID NO: 272173 - DNA, 20 bp, human
gcgtggagagcaggggactg

SEQ ID NO: 272174 - DNA, 20 bp, human
ggggactgcggatctggaag

SEQ ID NO: 272175 - DNA, 20 bp, human
ggtagcagggactgtgaagg

SEQ ID NO: 272176 - DNA, 20 bp, human
gtgctaggccagatgttctc

SEQ ID NO: 272177 - DNA, 20 bp, human
gccggactcggggtatccgc

SEQ ID NO: 272178 - DNA, 20 bp, human
ggggtgtcatctatgaagct

SEQ ID NO: 272179 - DNA, 20 bp, human
ggactctgatagggcatgtg

SEQ ID NO: 272180 - DNA, 20 bp, human
gctccctggaaaaaccacct

SEQ ID NO: 272181 - DNA, 20 bp, human
ggcagctataatagtgttct

SEQ ID NO: 272182 - DNA, 20 bp, human
gaacatctggcctagcaggc

SEQ ID NO: 272183 - DNA, 20 bp, human
gccacctgggagactctgat

SEQ ID NO: 272184 - DNA, 20 bp, human
gtgtcatctatgaagctggg

SEQ ID NO: 272185 - DNA, 20 bp, human
gttcttggccggagaacatc

SEQ ID NO: 272186 - DNA, 20 bp, human
ggaccccaggacagcaggtc

SEQ ID NO: 272187 - DNA, 20 bp, human
gcccccggacctgctgtcct

SEQ ID NO: 272188 - DNA, 20 bp, human
gggggcgcgcggggtagcct

SEQ ID NO: 272189 - DNA, 20 bp, human
ggctgtcctggggtccccgg

SEQ ID NO: 272190 - DNA, 20 bp, human
gtcccggggggcggccttga

SEQ ID NO: 272191 - DNA, 20 bp, human
gagacgcccggggcccccaa

SEQ ID NO: 272192 - DNA, 20 bp, human
ggaccccaagcttgacccga

SEQ ID NO: 272193 - DNA, 20 bp, human
gaggccgcgtcactctgcac

SEQ ID NO: 272194 - DNA, 20 bp, human
gtgccctcgggtcaagcttg

SEQ ID NO: 272195 - DNA, 20 bp, human
ggtccccgggggggcgcggt

SEQ ID NO: 272196 - DNA, 20 bp, human
gtaggtgaggctagaatcca

SEQ ID NO: 272197 - DNA, 20 bp, human
gctgaggggtaaggaccctt

SEQ ID NO: 272198 - DNA, 20 bp, human
ggaaagcctcatattaggtg

SEQ ID NO: 272199 - DNA, 20 bp, human
gacccctcagctgagaaaat

SEQ ID NO: 272200 - DNA, 20 bp, human
gaggagttccaaggtcctaa

SEQ ID NO: 272201 - DNA, 20 bp, human
gtggttggagcttacaggca

SEQ ID NO: 272202 - DNA, 20 bp, human
gtctagcctcacctaatatg

SEQ ID NO: 272203 - DNA, 20 bp, human
ggtaaggacccttaggacct

SEQ ID NO: 272204 - DNA, 20 bp, human
gagggcgtcacagccccaca

SEQ ID NO: 272205 - DNA, 20 bp, human
gccctattttctcagctgag

SEQ ID NO: 272206 - DNA, 20 bp, human
ggtaaagagaggacccgcgc

SEQ ID NO: 272207 - DNA, 20 bp, human
ggggtaatctgggaccgaca

SEQ ID NO: 272208 - DNA, 20 bp, human
gagccctggcaggtaaagag

SEQ ID NO: 272209 - DNA, 20 bp, human
gccccggcgcctgccttccg

SEQ ID NO: 272210 - DNA, 20 bp, human
gcgccctttgggtgagatga

SEQ ID NO: 272211 - DNA, 20 bp, human
gattcctggggaaaagtcgc

SEQ ID NO: 272212 - DNA, 20 bp, human
gagacccggacgcgaggcag

SEQ ID NO: 272213 - DNA, 20 bp, human
gcggagggcgagcgtgacgc

SEQ ID NO: 272214 - DNA, 20 bp, human
gcagccggcgacttttcccc

SEQ ID NO: 272215 - DNA, 20 bp, human
ggacaccagcgacgtctccg

SEQ ID NO: 272216 - DNA, 20 bp, human
ggaagggcagggtctaccag

SEQ ID NO: 272217 - DNA, 20 bp, human
ggaacagtcatccactccag

SEQ ID NO: 272218 - DNA, 20 bp, human
gtagctgcaaagtctggaac

SEQ ID NO: 272219 - DNA, 20 bp, human
ggaagataaaggggcacaga

SEQ ID NO: 272220 - DNA, 20 bp, human
gcaggacagctggaagataa

SEQ ID NO: 272221 - DNA, 20 bp, human
gggtctaccaggggaaacca

SEQ ID NO: 272222 - DNA, 20 bp, human
gtggcaggtggagacaacca

SEQ ID NO: 272223 - DNA, 20 bp, human
gggcccagacgcagataaga

SEQ ID NO: 272224 - DNA, 20 bp, human
gggcagaggggacagggcta

SEQ ID NO: 272225 - DNA, 20 bp, human
ggaggagacaatagaaggga

SEQ ID NO: 272226 - DNA, 20 bp, human
gcaaaagagctctcgccctg

SEQ ID NO: 272227 - DNA, 20 bp, human
gaaagccgggagggagtcgg

SEQ ID NO: 272228 - DNA, 20 bp, human
gcctggtggtggatagagtc

SEQ ID NO: 272229 - DNA, 20 bp, human
gagactggacggattctagc

SEQ ID NO: 272230 - DNA, 20 bp, human
gctccctcccggcttttcca

SEQ ID NO: 272231 - DNA, 20 bp, human
gtcggaggcgccagcccact

SEQ ID NO: 272232 - DNA, 20 bp, human
gaaccccaggaaatcgaggc

SEQ ID NO: 272233 - DNA, 20 bp, human
gtctcgccctgtggacgact

SEQ ID NO: 272234 - DNA, 20 bp, human
gcgcgcaccgtgacttctaa

SEQ ID NO: 272235 - DNA, 20 bp, human
gctgagaggcgaaaacagct

SEQ ID NO: 272236 - DNA, 20 bp, human
gaacgtctcgggctgcccag

SEQ ID NO: 272237 - DNA, 20 bp, human
ggggcagcccgagacgttca

SEQ ID NO: 272238 - DNA, 20 bp, human
gggtcccggcgcgcattcca

SEQ ID NO: 272239 - DNA, 20 bp, human
gccgtccagggtgtagatgg

SEQ ID NO: 272240 - DNA, 20 bp, human
gccagaacccccgactgcgg

SEQ ID NO: 272241 - DNA, 20 bp, human
gctccagcccccgcagtcgg

SEQ ID NO: 272242 - DNA, 20 bp, human
gaagggctgcggagtggtcc

SEQ ID NO: 272243 - DNA, 20 bp, human
gggcgcgcattccacggcgc

SEQ ID NO: 272244 - DNA, 20 bp, human
gcgggctcctgcagccgtct

SEQ ID NO: 272245 - DNA, 20 bp, human
gaggacccctgggagatcgg

SEQ ID NO: 272246 - DNA, 20 bp, human
ggggaaggcacaagcgaagt

SEQ ID NO: 272247 - DNA, 20 bp, human
gcaagctcgtggtgttcaag

SEQ ID NO: 272248 - DNA, 20 bp, human
ggctggaagctcgtgggaga

SEQ ID NO: 272249 - DNA, 20 bp, human
ggactccaggggtgttcctt

SEQ ID NO: 272250 - DNA, 20 bp, human
gaggggccaaacccagaaac

SEQ ID NO: 272251 - DNA, 20 bp, human
gttctgggctggaagctcgt

SEQ ID NO: 272252 - DNA, 20 bp, human
gaggatgaagatatggcgat

SEQ ID NO: 272253 - DNA, 20 bp, human
gtgacactcagcgatgactt

SEQ ID NO: 272254 - DNA, 20 bp, human
gggactacctaggtatttga

SEQ ID NO: 272255 - DNA, 20 bp, human
ggcttccagcccagaacacc

SEQ ID NO: 272256 - DNA, 20 bp, human
ggaacagctgtgaaccctgg

SEQ ID NO: 272257 - DNA, 20 bp, human
ggcggctggccaatcatcgg

SEQ ID NO: 272258 - DNA, 20 bp, human
ggaagtaggatcatcaatgt

SEQ ID NO: 272259 - DNA, 20 bp, human
gtcagaacagctgtgaaccc

SEQ ID NO: 272260 - DNA, 20 bp, human
gtgcagcaagcaagtcctgt

SEQ ID NO: 272261 - DNA, 20 bp, human
gtcatcaatgtcggccccca

SEQ ID NO: 272262 - DNA, 20 bp, human
ggctggccaatcatcggggg

SEQ ID NO: 272263 - DNA, 20 bp, human
gccgcgccgcccccgatgat

SEQ ID NO: 272264 - DNA, 20 bp, human
gcagtcagtcagtcacgtgc

SEQ ID NO: 272265 - DNA, 20 bp, human
gctgggctgccctgccacct

SEQ ID NO: 272266 - DNA, 20 bp, human
gcgggagcggcctctagcgg

SEQ ID NO: 272267 - DNA, 20 bp, human
gcaccgaggctccttgggga

SEQ ID NO: 272268 - DNA, 20 bp, human
ggaaaggccccctcctcgct

SEQ ID NO: 272269 - DNA, 20 bp, human
gctccgggagcggcctctag

SEQ ID NO: 272270 - DNA, 20 bp, human
gggtgcccgctccgcagagg

SEQ ID NO: 272271 - DNA, 20 bp, human
gcgcgcgcgcgtcctctcgc

SEQ ID NO: 272272 - DNA, 20 bp, human
gcggccacgcgagaggtggc

SEQ ID NO: 272273 - DNA, 20 bp, human
gtctcacaccccagcgagga

SEQ ID NO: 272274 - DNA, 20 bp, human
gctagcggcggccacgcgag

SEQ ID NO: 272275 - DNA, 20 bp, human
gtgcggtgcccgctccgcag

SEQ ID NO: 272276 - DNA, 20 bp, human
ggtgcagcggaaggtgtcta

SEQ ID NO: 272277 - DNA, 20 bp, human
gcacccagccgcagctggtc

SEQ ID NO: 272278 - DNA, 20 bp, human
gtccagcagcggaggcgaga

SEQ ID NO: 272279 - DNA, 20 bp, human
ggaggaaggaggcttctgat

SEQ ID NO: 272280 - DNA, 20 bp, human
gcccgcgatggagggatgtg

SEQ ID NO: 272281 - DNA, 20 bp, human
ggatggagggatgtgcgggc

SEQ ID NO: 272282 - DNA, 20 bp, human
gaggtcgctcccgcgatgga

SEQ ID NO: 272283 - DNA, 20 bp, human
gaaggcggggagcgacggtg

SEQ ID NO: 272284 - DNA, 20 bp, human
gaggtgtctacggatgagat

SEQ ID NO: 272285 - DNA, 20 bp, human
gagataggtcgctcccgcga

SEQ ID NO: 272286 - DNA, 20 bp, human
gcgccgggcagctgtctcat

SEQ ID NO: 272287 - DNA, 20 bp, human
ggggcgggaactaggatacg

SEQ ID NO: 272288 - DNA, 20 bp, human
gcccgccccctgcgataatt

SEQ ID NO: 272289 - DNA, 20 bp, human
gggcgggaacgtccagagcc

SEQ ID NO: 272290 - DNA, 20 bp, human
ggcgcactccaaattatcgc

SEQ ID NO: 272291 - DNA, 20 bp, human
gggaagggactaacgtgctc

SEQ ID NO: 272292 - DNA, 20 bp, human
gcactccaaattatcgcagg

SEQ ID NO: 272293 - DNA, 20 bp, human
gggactaacgtgctccggaa

SEQ ID NO: 272294 - DNA, 20 bp, human
gcgcgatggggcgggaggtt

SEQ ID NO: 272295 - DNA, 20 bp, human
gccccttccggccttatgat

SEQ ID NO: 272296 - DNA, 20 bp, human
gtaggctagcgggaatgtaa

SEQ ID NO: 272297 - DNA, 20 bp, human
ggccgcgcacttctgtgatt

SEQ ID NO: 272298 - DNA, 20 bp, human
gcaaaaggggtggggttgct

SEQ ID NO: 272299 - DNA, 20 bp, human
gggccacttcagcaacagaa

SEQ ID NO: 272300 - DNA, 20 bp, human
gtggggctacggcggcccaa

SEQ ID NO: 272301 - DNA, 20 bp, human
gaagtctcttcaaaaggggt

SEQ ID NO: 272302 - DNA, 20 bp, human
gtctgaacctagaggagcaa

SEQ ID NO: 272303 - DNA, 20 bp, human
ggcaaggggtggggctacgg

SEQ ID NO: 272304 - DNA, 20 bp, human
gggaagaaggcgggacgaac

SEQ ID NO: 272305 - DNA, 20 bp, human
gacggctgtgaagatggcgg

SEQ ID NO: 272306 - DNA, 20 bp, human
ggggcgactgtctagaatgg

SEQ ID NO: 272307 - DNA, 20 bp, human
ggcagttagcagcaactgta

SEQ ID NO: 272308 - DNA, 20 bp, human
gagggggcgactgtctagaa

SEQ ID NO: 272309 - DNA, 20 bp, human
ggtgcgatgagcaatagctg

SEQ ID NO: 272310 - DNA, 20 bp, human
gggaagtgattagtcactga

SEQ ID NO: 272311 - DNA, 20 bp, human
gactgtctagaatgggggta

SEQ ID NO: 272312 - DNA, 20 bp, human
ggagcaagcgagcagaaaag

SEQ ID NO: 272313 - DNA, 20 bp, human
gtgggtaattgggtccagat

SEQ ID NO: 272314 - DNA, 20 bp, human
gatgaggctggcaggggact

SEQ ID NO: 272315 - DNA, 20 bp, human
ggaaaagtcggtgggtaatt

SEQ ID NO: 272316 - DNA, 20 bp, human
gtgtgggccccgacgtaggg

SEQ ID NO: 272317 - DNA, 20 bp, human
gagcgtgtgggccccgacgt

SEQ ID NO: 272318 - DNA, 20 bp, human
gcgtgcccagttgaaccagg

SEQ ID NO: 272319 - DNA, 20 bp, human
ggcggggagaaagtagggcc

SEQ ID NO: 272320 - DNA, 20 bp, human
gggactgagattggcccgat

SEQ ID NO: 272321 - DNA, 20 bp, human
gggccccgacgtagggggga

SEQ ID NO: 272322 - DNA, 20 bp, human
ggggcacgcaccgagcgtgt

SEQ ID NO: 272323 - DNA, 20 bp, human
gagtcccttcccccctacgt

SEQ ID NO: 272324 - DNA, 20 bp, human
gaaaaaagcggggagaaagt

SEQ ID NO: 272325 - DNA, 20 bp, human
ggtgcgtgcccagttgaacc

SEQ ID NO: 272326 - DNA, 20 bp, human
ggggaggtagaggggtgatg

SEQ ID NO: 272327 - DNA, 20 bp, human
gactcatggtatgagagctg

SEQ ID NO: 272328 - DNA, 20 bp, human
ggatgtggggagtacgctgc

SEQ ID NO: 272329 - DNA, 20 bp, human
gaactgtggcgtgatggccg

SEQ ID NO: 272330 - DNA, 20 bp, human
ggttgcacgcagccccggca

SEQ ID NO: 272331 - DNA, 20 bp, human
gccggggctgcgtgcaaccc

SEQ ID NO: 272332 - DNA, 20 bp, human
gtgcgtgcaaccctggggtt

SEQ ID NO: 272333 - DNA, 20 bp, human
ggactggctcctccctgccg

SEQ ID NO: 272334 - DNA, 20 bp, human
gcagtcttggatgagaaagg

SEQ ID NO: 272335 - DNA, 20 bp, human
gatggactgtggtctgcaaa

SEQ ID NO: 272336 - DNA, 20 bp, human
ggacgtcccatgcctctacg

SEQ ID NO: 272337 - DNA, 20 bp, human
gcccatgcctctacggggat

SEQ ID NO: 272338 - DNA, 20 bp, human
ggcccctcggcgacgtcact

SEQ ID NO: 272339 - DNA, 20 bp, human
ggcagtgcgtggccgtggaa

SEQ ID NO: 272340 - DNA, 20 bp, human
gtcgcatcccatccccgtag

SEQ ID NO: 272341 - DNA, 20 bp, human
gcacgcactgccgtctggaa

SEQ ID NO: 272342 - DNA, 20 bp, human
gtcccatccccgtagaggca

SEQ ID NO: 272343 - DNA, 20 bp, human
ggatgggatgcgatggtgtc

SEQ ID NO: 272344 - DNA, 20 bp, human
ggctatgcatcaccgttcca

SEQ ID NO: 272345 - DNA, 20 bp, human
ggtacccagtgacgtcgccg

SEQ ID NO: 272346 - DNA, 20 bp, human
gtggcgtgaggttttgaata

SEQ ID NO: 272347 - DNA, 20 bp, human
gaaatagcgtgaacgaagga

SEQ ID NO: 272348 - DNA, 20 bp, human
gaattaagataaatggcgtg

SEQ ID NO: 272349 - DNA, 20 bp, human
ggcagcagaattaagataaa

SEQ ID NO: 272350 - DNA, 20 bp, human
ggtagtaacacataggtctt

SEQ ID NO: 272351 - DNA, 20 bp, human
gcccaaataaaaaaccatgt

SEQ ID NO: 272352 - DNA, 20 bp, human
ggagctgctagcatatctca

SEQ ID NO: 272353 - DNA, 20 bp, human
gacccaccaaagtgaaaaag

SEQ ID NO: 272354 - DNA, 20 bp, human
gtattacttgacaaagatga

SEQ ID NO: 272355 - DNA, 20 bp, human
gtaatacttgcaaagtttcc

SEQ ID NO: 272356 - DNA, 20 bp, human
gtcagggggcagctgaccta

SEQ ID NO: 272357 - DNA, 20 bp, human
gtgccccctgaggctgtcgt

SEQ ID NO: 272358 - DNA, 20 bp, human
gtccggaatcgtcttccgga

SEQ ID NO: 272359 - DNA, 20 bp, human
gcgggtccggaatcgtcttc

SEQ ID NO: 272360 - DNA, 20 bp, human
ggggagctgtagttccgccc

SEQ ID NO: 272361 - DNA, 20 bp, human
ggacacccacgacagcctca

SEQ ID NO: 272362 - DNA, 20 bp, human
gcgcgtgcgcagcgccgcgg

SEQ ID NO: 272363 - DNA, 20 bp, human
ggccttccggaagacgattc

SEQ ID NO: 272364 - DNA, 20 bp, human
ggggctgcctaaggcggaag

SEQ ID NO: 272365 - DNA, 20 bp, human
gttccggaaggctgttcacc

SEQ ID NO: 272366 - DNA, 20 bp, human
gggcggggcaggtttctgtt

SEQ ID NO: 272367 - DNA, 20 bp, human
gaccttgcaaggaatgaagt

SEQ ID NO: 272368 - DNA, 20 bp, human
gccgggacgtcgtgctgcaa

SEQ ID NO: 272369 - DNA, 20 bp, human
gtggaagtgacgtataacag

SEQ ID NO: 272370 - DNA, 20 bp, human
gcgacgtcccggaagtgctg

SEQ ID NO: 272371 - DNA, 20 bp, human
gagaaacctgccccgcctct

SEQ ID NO: 272372 - DNA, 20 bp, human
gttggagatagctggcgtta

SEQ ID NO: 272373 - DNA, 20 bp, human
gttagttctggccgttaggg

SEQ ID NO: 272374 - DNA, 20 bp, human
ggccttctctcccagaggcg

SEQ ID NO: 272375 - DNA, 20 bp, human
gttgcaaggtgctttagttc

SEQ ID NO: 272376 - DNA, 20 bp, human
ggggcgcccgagtggtcgga

SEQ ID NO: 272377 - DNA, 20 bp, human
gcgcccgagtggtcggacgg

SEQ ID NO: 272378 - DNA, 20 bp, human
gcaggctcgcgtcagctccc

SEQ ID NO: 272379 - DNA, 20 bp, human
gctcccccgtccgaccactc

SEQ ID NO: 272380 - DNA, 20 bp, human
gtgcagggcgcccgagtggt

SEQ ID NO: 272381 - DNA, 20 bp, human
ggagcgagagctaaagcttg

SEQ ID NO: 272382 - DNA, 20 bp, human
gagcacccggcgagactgca

SEQ ID NO: 272383 - DNA, 20 bp, human
ggtgcccgacaccacgactc

SEQ ID NO: 272384 - DNA, 20 bp, human
gagctcgctcggcaattccc

SEQ ID NO: 272385 - DNA, 20 bp, human
ggagctgacgcgagcctgcc

SEQ ID NO: 272386 - DNA, 20 bp, human
gacggccgtggagtactcgt

SEQ ID NO: 272387 - DNA, 20 bp, human
gaagcgctcgcggcagtagg

SEQ ID NO: 272388 - DNA, 20 bp, human
ggacccgcgcgtcgagcgcc

SEQ ID NO: 272389 - DNA, 20 bp, human
gcaccaggcgctcgacgcgc

SEQ ID NO: 272390 - DNA, 20 bp, human
gtcgaagcgctcgcggcagt

SEQ ID NO: 272391 - DNA, 20 bp, human
gcagcggcgccgggccctcg

SEQ ID NO: 272392 - DNA, 20 bp, human
gcgcgcttcgcgctgccgca

SEQ ID NO: 272393 - DNA, 20 bp, human
gtccgctggcgcctcgcgca

SEQ ID NO: 272394 - DNA, 20 bp, human
gcgcgggctggcgcagtctt

SEQ ID NO: 272395 - DNA, 20 bp, human
ggcaccgggtgcaggtcgta

SEQ ID NO: 272396 - DNA, 20 bp, human
ggacccggggtcccagaagg

SEQ ID NO: 272397 - DNA, 20 bp, human
ggggcagggcggacagggct

SEQ ID NO: 272398 - DNA, 20 bp, human
gcggcggcgagtccgggtcg

SEQ ID NO: 272399 - DNA, 20 bp, human
gggctgggggcggaggtccg

SEQ ID NO: 272400 - DNA, 20 bp, human
gggtgggcgcggcctccggg

SEQ ID NO: 272401 - DNA, 20 bp, human
gtcgccgccggacccacccc

SEQ ID NO: 272402 - DNA, 20 bp, human
gcgggtgatggaggacccca

SEQ ID NO: 272403 - DNA, 20 bp, human
gggtcggggcggacagagca

SEQ ID NO: 272404 - DNA, 20 bp, human
gaagtcccgagcggcatctg

SEQ ID NO: 272405 - DNA, 20 bp, human
gcgcggggaagctggcggga

SEQ ID NO: 272406 - DNA, 20 bp, human
gagggacaaagctgctgaac

SEQ ID NO: 272407 - DNA, 20 bp, human
gtgatttaagcctttttggg

SEQ ID NO: 272408 - DNA, 20 bp, human
gctaaattaaagggggacag

SEQ ID NO: 272409 - DNA, 20 bp, human
ggaaagaaacttcacaatcg

SEQ ID NO: 272410 - DNA, 20 bp, human
gtaaaaatcctaaattaaag

SEQ ID NO: 272411 - DNA, 20 bp, human
gctgcagtaaacttgaggca

SEQ ID NO: 272412 - DNA, 20 bp, human
ggtaaaaagctgaatatact

SEQ ID NO: 272413 - DNA, 20 bp, human
ggcacagttgcacactcaaa

SEQ ID NO: 272414 - DNA, 20 bp, human
gagtgtgcaactgtgcattc

SEQ ID NO: 272415 - DNA, 20 bp, human
gggatctaacatgcaaagaa

SEQ ID NO: 272416 - DNA, 20 bp, human
gccggcgccgcgtcacgcgg

SEQ ID NO: 272417 - DNA, 20 bp, human
gccgaaccggagaaaacctt

SEQ ID NO: 272418 - DNA, 20 bp, human
ggacccggcgccgcgtcacg

SEQ ID NO: 272419 - DNA, 20 bp, human
gccccgccgaaggttttctc

SEQ ID NO: 272420 - DNA, 20 bp, human
gaaccggagaaaaccttcgg

SEQ ID NO: 272421 - DNA, 20 bp, human
ggcgtcaagccaccccagca

SEQ ID NO: 272422 - DNA, 20 bp, human
ggggttttgtgtcgaatctg

SEQ ID NO: 272423 - DNA, 20 bp, human
gcccggccgacctacttgaa

SEQ ID NO: 272424 - DNA, 20 bp, human
gattcgacacaaaacccgga

SEQ ID NO: 272425 - DNA, 20 bp, human
gagctctgagcgagacctgc

SEQ ID NO: 272426 - DNA, 20 bp, human
ggcctggaggactagcgagg

SEQ ID NO: 272427 - DNA, 20 bp, human
gaaattccgggaaattcaac

SEQ ID NO: 272428 - DNA, 20 bp, human
ggggcagggaagccgtcgta

SEQ ID NO: 272429 - DNA, 20 bp, human
ggtcccgcgccggtcccggt

SEQ ID NO: 272430 - DNA, 20 bp, human
gagcagtcaggcagcgccca

SEQ ID NO: 272431 - DNA, 20 bp, human
gagggccgcgcggaccaatg

SEQ ID NO: 272432 - DNA, 20 bp, human
gaaaaggcgaagttcctcga

SEQ ID NO: 272433 - DNA, 20 bp, human
gggaaggcgagagaccgaat

SEQ ID NO: 272434 - DNA, 20 bp, human
gtataaacgtgctaaggctt

SEQ ID NO: 272435 - DNA, 20 bp, human
gaaggcttgggtgtctcggc

SEQ ID NO: 272436 - DNA, 20 bp, human
gagcaaagggcgaaagagag

SEQ ID NO: 272437 - DNA, 20 bp, human
gatctcgaaaagccgggaaa

SEQ ID NO: 272438 - DNA, 20 bp, human
gaaccagcgggcagggctta

SEQ ID NO: 272439 - DNA, 20 bp, human
gctggagtggggttgcggag

SEQ ID NO: 272440 - DNA, 20 bp, human
ggggaaagggggccgagcaa

SEQ ID NO: 272441 - DNA, 20 bp, human
ggagaaaggagaaagcgggc

SEQ ID NO: 272442 - DNA, 20 bp, human
gtccgagcctccttaagagt

SEQ ID NO: 272443 - DNA, 20 bp, human
gggcttgaaaggaacggctt

SEQ ID NO: 272444 - DNA, 20 bp, human
gtggttctgtgcgcgagctg

SEQ ID NO: 272445 - DNA, 20 bp, human
ggctcctcctactcttaagg

SEQ ID NO: 272446 - DNA, 20 bp, human
gtgaatctcaggggatacgt

SEQ ID NO: 272447 - DNA, 20 bp, human
gacaactgatctaaccttgt

SEQ ID NO: 272448 - DNA, 20 bp, human
ggaagagggagcaaaagcga

SEQ ID NO: 272449 - DNA, 20 bp, human
gtatcccctgagattcacag

SEQ ID NO: 272450 - DNA, 20 bp, human
gtctcaggggatacgtgggg

SEQ ID NO: 272451 - DNA, 20 bp, human
gagaagatcacggaggtgag

SEQ ID NO: 272452 - DNA, 20 bp, human
gcactgtaagaagatcacgg

SEQ ID NO: 272453 - DNA, 20 bp, human
ggaaacttcttcggatacct

SEQ ID NO: 272454 - DNA, 20 bp, human
gcttcactgtaagaagatca

SEQ ID NO: 272455 - DNA, 20 bp, human
gcatcctagtattaaaataa

SEQ ID NO: 272456 - DNA, 20 bp, human
ggactcacaatttagagaac

SEQ ID NO: 272457 - DNA, 20 bp, human
gaagtgtggtagagagtctt

SEQ ID NO: 272458 - DNA, 20 bp, human
gttttggccaaacacttagt

SEQ ID NO: 272459 - DNA, 20 bp, human
gtgagcccaaaggtacgcag

SEQ ID NO: 272460 - DNA, 20 bp, human
gacaatgggagttaacaaat

SEQ ID NO: 272461 - DNA, 20 bp, human
ggtactggccctctcacttt

SEQ ID NO: 272462 - DNA, 20 bp, human
gtataatgaactggatccgc

SEQ ID NO: 272463 - DNA, 20 bp, human
gggagacggccaagcaatca

SEQ ID NO: 272464 - DNA, 20 bp, human
gttgttaactcccattgttt

SEQ ID NO: 272465 - DNA, 20 bp, human
ggtgtttggccaaaagtgag

SEQ ID NO: 272466 - DNA, 20 bp, human
gcctccgtctgcaaaatcac

SEQ ID NO: 272467 - DNA, 20 bp, human
gtctctcttaggttagtgtc

SEQ ID NO: 272468 - DNA, 20 bp, human
gggcagcaattccgaggttg

SEQ ID NO: 272469 - DNA, 20 bp, human
ggaagagtggccgaagttac

SEQ ID NO: 272470 - DNA, 20 bp, human
gacctcggaattgctgccaa

SEQ ID NO: 272471 - DNA, 20 bp, human
gaacctaagagagaaaaggt

SEQ ID NO: 272472 - DNA, 20 bp, human
ggcccttggcagcaattccg

SEQ ID NO: 272473 - DNA, 20 bp, human
gttagaagaggctgtactca

SEQ ID NO: 272474 - DNA, 20 bp, human
ggatcagcacactcagcaag

SEQ ID NO: 272475 - DNA, 20 bp, human
gtgaacatctgtccacttca

SEQ ID NO: 272476 - DNA, 20 bp, human
gccggggagcccaccgtctg

SEQ ID NO: 272477 - DNA, 20 bp, human
ggggccccgtccaacctctt

SEQ ID NO: 272478 - DNA, 20 bp, human
gagcccaccgtctggggagg

SEQ ID NO: 272479 - DNA, 20 bp, human
gctcccgccggctcggggaa

SEQ ID NO: 272480 - DNA, 20 bp, human
gtctccccccgcccgcgatc

SEQ ID NO: 272481 - DNA, 20 bp, human
ggcccccctccccagacggt

SEQ ID NO: 272482 - DNA, 20 bp, human
gggacggggccccgggtact

SEQ ID NO: 272483 - DNA, 20 bp, human
ggggccccgggtactaggct

SEQ ID NO: 272484 - DNA, 20 bp, human
gtgaaggcaggaagcgatag

SEQ ID NO: 272485 - DNA, 20 bp, human
ggggcaggatccgaattcca

SEQ ID NO: 272486 - DNA, 20 bp, human
gggccaaatgggaactttgg

SEQ ID NO: 272487 - DNA, 20 bp, human
ggactgccctgcagaaccaa

SEQ ID NO: 272488 - DNA, 20 bp, human
gccgctgtctccaaggagag

SEQ ID NO: 272489 - DNA, 20 bp, human
ggctggccaaatgggaactt

SEQ ID NO: 272490 - DNA, 20 bp, human
gccctgcagaaccaagggag

SEQ ID NO: 272491 - DNA, 20 bp, human
gctggcttctctcacggggc

SEQ ID NO: 272492 - DNA, 20 bp, human
gctgctgggaagggttaaca

SEQ ID NO: 272493 - DNA, 20 bp, human
gctcccccaaagttcccatt

SEQ ID NO: 272494 - DNA, 20 bp, human
gggcaggcacaggtctgagt

SEQ ID NO: 272495 - DNA, 20 bp, human
gttagtgagtacaggagaat

SEQ ID NO: 272496 - DNA, 20 bp, human
gctgacaggcgagcgcccac

SEQ ID NO: 272497 - DNA, 20 bp, human
ggaagctccgagacgcccgg

SEQ ID NO: 272498 - DNA, 20 bp, human
gccgggaagcacgcgacccg

SEQ ID NO: 272499 - DNA, 20 bp, human
ggggcgtctcggagcttcgg

SEQ ID NO: 272500 - DNA, 20 bp, human
gcacgcccccgccttatgat

SEQ ID NO: 272501 - DNA, 20 bp, human
ggggaccaatcataaggcgg

SEQ ID NO: 272502 - DNA, 20 bp, human
gagcggcggcggttggtcag

SEQ ID NO: 272503 - DNA, 20 bp, human
gcgtccagcgctgcgcctcc

SEQ ID NO: 272504 - DNA, 20 bp, human
gtgtcgctgaaaggccagat

SEQ ID NO: 272505 - DNA, 20 bp, human
gccagcggctactgaccctg

SEQ ID NO: 272506 - DNA, 20 bp, human
gcccgcgcccggatcctccc

SEQ ID NO: 272507 - DNA, 20 bp, human
ggatccgggcgcggggaaag

SEQ ID NO: 272508 - DNA, 20 bp, human
gcggggaaagcggagcgtcc

SEQ ID NO: 272509 - DNA, 20 bp, human
ggactcgagtgtttcggaaa

SEQ ID NO: 272510 - DNA, 20 bp, human
gctagcgatggggtaaaagg

SEQ ID NO: 272511 - DNA, 20 bp, human
gcacctcaagcgctcggtct

SEQ ID NO: 272512 - DNA, 20 bp, human
ggcgggttcccgggaggatc

SEQ ID NO: 272513 - DNA, 20 bp, human
gaggtcagatccaatcccac

SEQ ID NO: 272514 - DNA, 20 bp, human
gaaggatgcagtagattcgg

SEQ ID NO: 272515 - DNA, 20 bp, human
gcggtctgggcgtgttcggg

SEQ ID NO: 272516 - DNA, 20 bp, human
gggagcgcgcagccctccgc

SEQ ID NO: 272517 - DNA, 20 bp, human
ggctccggagacaacttccc

SEQ ID NO: 272518 - DNA, 20 bp, human
gggggttagctcactggcga

SEQ ID NO: 272519 - DNA, 20 bp, human
gccgggaagcagagactcgt

SEQ ID NO: 272520 - DNA, 20 bp, human
gccgccgcggagtcctgccg

SEQ ID NO: 272521 - DNA, 20 bp, human
gcccccgcggcaggactccg

SEQ ID NO: 272522 - DNA, 20 bp, human
gcgggcgggggttagctcac

SEQ ID NO: 272523 - DNA, 20 bp, human
ggcagaggggcctgtcactg

SEQ ID NO: 272524 - DNA, 20 bp, human
gtcccgggaacgcggaacgc

SEQ ID NO: 272525 - DNA, 20 bp, human
ggggcggccacgcccgcgga

SEQ ID NO: 272526 - DNA, 20 bp, human
gggagtgcgtccctagagac

SEQ ID NO: 272527 - DNA, 20 bp, human
gcgggcgtccggaaggaacc

SEQ ID NO: 272528 - DNA, 20 bp, human
ggaacccggttgtgaacgtt

SEQ ID NO: 272529 - DNA, 20 bp, human
gttccggacgcccgtctcta

SEQ ID NO: 272530 - DNA, 20 bp, human
gttcccccctcgtggagctt

SEQ ID NO: 272531 - DNA, 20 bp, human
gttcacaaccgggttccttc

SEQ ID NO: 272532 - DNA, 20 bp, human
ggatcctcgcgagactccgc

SEQ ID NO: 272533 - DNA, 20 bp, human
gaacgttgggaaaatgtcgc

SEQ ID NO: 272534 - DNA, 20 bp, human
gcgggcagcggccctgccaa

SEQ ID NO: 272535 - DNA, 20 bp, human
gccctgcagcgaaaggcttc

SEQ ID NO: 272536 - DNA, 20 bp, human
gcggggccgcacctgtcctg

SEQ ID NO: 272537 - DNA, 20 bp, human
gcatcggggcagcaaccggg

SEQ ID NO: 272538 - DNA, 20 bp, human
gccgggcgccccaacagctg

SEQ ID NO: 272539 - DNA, 20 bp, human
ggcggcagggaggagcccgc

SEQ ID NO: 272540 - DNA, 20 bp, human
ggccgcatggagcccccgga

SEQ ID NO: 272541 - DNA, 20 bp, human
gcggtgccggcgccctccgg

SEQ ID NO: 272542 - DNA, 20 bp, human
gtgcggcagcgactcggccc

SEQ ID NO: 272543 - DNA, 20 bp, human
ggcgcatcggggcagcaacc

SEQ ID NO: 272544 - DNA, 20 bp, human
ggccctccgggggctccatg

SEQ ID NO: 272545 - DNA, 20 bp, human
gcgactcccgggagcggcga

SEQ ID NO: 272546 - DNA, 20 bp, human
gaggatgtgggggaaggata

SEQ ID NO: 272547 - DNA, 20 bp, human
ggagtccaggcgagaggaat

SEQ ID NO: 272548 - DNA, 20 bp, human
gtcatccaggatgtggggga

SEQ ID NO: 272549 - DNA, 20 bp, human
gtcagtcatccaggatgtgg

SEQ ID NO: 272550 - DNA, 20 bp, human
gctccagcccctcaccatga

SEQ ID NO: 272551 - DNA, 20 bp, human
ggagttgaccttcatggtga

SEQ ID NO: 272552 - DNA, 20 bp, human
gctaaatgaaagggcggggc

SEQ ID NO: 272553 - DNA, 20 bp, human
ggactcatatggcagggtag

SEQ ID NO: 272554 - DNA, 20 bp, human
ggcctctgacccccaggata

SEQ ID NO: 272555 - DNA, 20 bp, human
gggcaggaaccaagctccct

SEQ ID NO: 272556 - DNA, 20 bp, human
gcaggaagacgcacatacac

SEQ ID NO: 272557 - DNA, 20 bp, human
ggggcgggtcccatgcttgt

SEQ ID NO: 272558 - DNA, 20 bp, human
gtgcttgtggggcacctctt

SEQ ID NO: 272559 - DNA, 20 bp, human
gagtgggtggggcagtccag

SEQ ID NO: 272560 - DNA, 20 bp, human
gcgaggtccaagaatcccca

SEQ ID NO: 272561 - DNA, 20 bp, human
gtggctggtgccccagtggg

SEQ ID NO: 272562 - DNA, 20 bp, human
ggtccaagaatccccagggt

SEQ ID NO: 272563 - DNA, 20 bp, human
gccggccccgcacaaattaa

SEQ ID NO: 272564 - DNA, 20 bp, human
gcttggacctcgctcgacct

SEQ ID NO: 272565 - DNA, 20 bp, human
gctacagtccacgggagcct

SEQ ID NO: 272566 - DNA, 20 bp, human
gtggccggccaagggccgct

SEQ ID NO: 272567 - DNA, 20 bp, human
gcaagggccgctaggcactc

SEQ ID NO: 272568 - DNA, 20 bp, human
gcacagctcctgagggtccc

SEQ ID NO: 272569 - DNA, 20 bp, human
gtgtgcgctccggagagggt

SEQ ID NO: 272570 - DNA, 20 bp, human
gcgcgtgtgcgctccggaga

SEQ ID NO: 272571 - DNA, 20 bp, human
gcggctggacctggtaggcc

SEQ ID NO: 272572 - DNA, 20 bp, human
ggcctggagtgtggatgcac

SEQ ID NO: 272573 - DNA, 20 bp, human
ggcgcgccctgagtgcctag

SEQ ID NO: 272574 - DNA, 20 bp, human
gagcgccgcagggggcagga

SEQ ID NO: 272575 - DNA, 20 bp, human
gttctgagcaagcatccctg

SEQ ID NO: 272576 - DNA, 20 bp, human
ggggaggcccagagcatcga

SEQ ID NO: 272577 - DNA, 20 bp, human
gccggcccgcgggtcagtcc

SEQ ID NO: 272578 - DNA, 20 bp, human
gccaacgcgccccaccacta

SEQ ID NO: 272579 - DNA, 20 bp, human
gggtcagtcccggagtccag

SEQ ID NO: 272580 - DNA, 20 bp, human
gggactccgggactgacccg

SEQ ID NO: 272581 - DNA, 20 bp, human
gcctccctgcgcgctcctgg

SEQ ID NO: 272582 - DNA, 20 bp, human
gcccgagctaggggagggaa

SEQ ID NO: 272583 - DNA, 20 bp, human
gctaggggagggaacggtct

SEQ ID NO: 272584 - DNA, 20 bp, human
gggagggggcccgccggctg

SEQ ID NO: 272585 - DNA, 20 bp, human
gttcccgaaccgctggactc

SEQ ID NO: 272586 - DNA, 20 bp, human
gcgccggcggccgccctctg

SEQ ID NO: 272587 - DNA, 20 bp, human
ggagtaggggacaggatccc

SEQ ID NO: 272588 - DNA, 20 bp, human
gcccctttccggtcagtgga

SEQ ID NO: 272589 - DNA, 20 bp, human
ggcgctggcgagtaggggac

SEQ ID NO: 272590 - DNA, 20 bp, human
gagcctggcgctggcgagta

SEQ ID NO: 272591 - DNA, 20 bp, human
gagaagtcctggagcgggtt

SEQ ID NO: 272592 - DNA, 20 bp, human
gctcccgcccctccactgac

SEQ ID NO: 272593 - DNA, 20 bp, human
gggacaggatccccggcaca

SEQ ID NO: 272594 - DNA, 20 bp, human
ggagccgcggccacatttaa

SEQ ID NO: 272595 - DNA, 20 bp, human
gaggctcctcccccccggcg

SEQ ID NO: 272596 - DNA, 20 bp, human
ggcggggccagtagagaaga

SEQ ID NO: 272597 - DNA, 20 bp, human
ggccccggctacacctccgc

SEQ ID NO: 272598 - DNA, 20 bp, human
gcccagcggaggtgtagccg

SEQ ID NO: 272599 - DNA, 20 bp, human
ggctgcgggatgaggaccac

SEQ ID NO: 272600 - DNA, 20 bp, human
gctacacctccgctgggcgc

SEQ ID NO: 272601 - DNA, 20 bp, human
gctgtgggagtcacgtgcaa

SEQ ID NO: 272602 - DNA, 20 bp, human
gacccagccggaggtcgatt

SEQ ID NO: 272603 - DNA, 20 bp, human
gtgcccaagtgctaccgcca

SEQ ID NO: 272604 - DNA, 20 bp, human
gaggtcgattgggttcgctg

SEQ ID NO: 272605 - DNA, 20 bp, human
ggcccagcaactcggcccta

SEQ ID NO: 272606 - DNA, 20 bp, human
gctgaccctgcggggaagaa

SEQ ID NO: 272607 - DNA, 20 bp, human
gtcgccaagccccgcgagca

SEQ ID NO: 272608 - DNA, 20 bp, human
gcggaccagtgcagctagac

SEQ ID NO: 272609 - DNA, 20 bp, human
gctggcaggccctgctcgcg

SEQ ID NO: 272610 - DNA, 20 bp, human
ggacaaggacgcacgacacg

SEQ ID NO: 272611 - DNA, 20 bp, human
gaaggacgcacgacacgggg

SEQ ID NO: 272612 - DNA, 20 bp, human
gctcgcggggcttggcgaca

SEQ ID NO: 272613 - DNA, 20 bp, human
gggcgggccgagggcttcgt

SEQ ID NO: 272614 - DNA, 20 bp, human
gccgtagagccacgtgaccc

SEQ ID NO: 272615 - DNA, 20 bp, human
ggggtgcggccacgcaacga

SEQ ID NO: 272616 - DNA, 20 bp, human
ggcgacccgcacccatccag

SEQ ID NO: 272617 - DNA, 20 bp, human
gcaagccctgtccccggagt

SEQ ID NO: 272618 - DNA, 20 bp, human
gaggaggaggagggatcgag

SEQ ID NO: 272619 - DNA, 20 bp, human
gggcgagcgctgtttgttta

SEQ ID NO: 272620 - DNA, 20 bp, human
gtcagcgagcagctgggcgc

SEQ ID NO: 272621 - DNA, 20 bp, human
gcgcccccactccggggaca

SEQ ID NO: 272622 - DNA, 20 bp, human
gtggactcgcccccactccg

SEQ ID NO: 272623 - DNA, 20 bp, human
ggggctcggtgagtccaatc

SEQ ID NO: 272624 - DNA, 20 bp, human
gtgggggcgagtccacccgg

SEQ ID NO: 272625 - DNA, 20 bp, human
gccgcgctgcctgcgggcgt

SEQ ID NO: 272626 - DNA, 20 bp, human
ggggacgcggagacttccgg

SEQ ID NO: 272627 - DNA, 20 bp, human
gttgctgtcgcctaggggca

SEQ ID NO: 272628 - DNA, 20 bp, human
gtgaccggaagtgcagcacc

SEQ ID NO: 272629 - DNA, 20 bp, human
gtccgcttgctgtcgcctag

SEQ ID NO: 272630 - DNA, 20 bp, human
gcacttccggtcaggcggtc

SEQ ID NO: 272631 - DNA, 20 bp, human
gtgcagcacccggaattact

SEQ ID NO: 272632 - DNA, 20 bp, human
gagcaagctcccagtaattc

SEQ ID NO: 272633 - DNA, 20 bp, human
gaatttgccgggtaaaatac

SEQ ID NO: 272634 - DNA, 20 bp, human
gactgggaaagggatctggc

SEQ ID NO: 272635 - DNA, 20 bp, human
ggaaagggatctggccgggg

SEQ ID NO: 272636 - DNA, 20 bp, human
ggggccggacggtaccgccc

SEQ ID NO: 272637 - DNA, 20 bp, human
ggggttccaggcgtagaagg

SEQ ID NO: 272638 - DNA, 20 bp, human
ggggcggggcgtggcgaccg

SEQ ID NO: 272639 - DNA, 20 bp, human
gcgagaagggaggagctcgt

SEQ ID NO: 272640 - DNA, 20 bp, human
gagccagccggagcccgcgt

SEQ ID NO: 272641 - DNA, 20 bp, human
gctcccacgcgacacctcgt

SEQ ID NO: 272642 - DNA, 20 bp, human
gaagggaggagctcgtgggc

SEQ ID NO: 272643 - DNA, 20 bp, human
gggagcgcgccggagagggg

SEQ ID NO: 272644 - DNA, 20 bp, human
ggacctggtgcgcatgtccc

SEQ ID NO: 272645 - DNA, 20 bp, human
ggcccaacgaggtgtcgcgt

SEQ ID NO: 272646 - DNA, 20 bp, human
gccacaccttccatggggtg

SEQ ID NO: 272647 - DNA, 20 bp, human
gcgggacttaaacttcgggg

SEQ ID NO: 272648 - DNA, 20 bp, human
gagtcctggctggacctcat

SEQ ID NO: 272649 - DNA, 20 bp, human
ggagccgcgagactgagctg

SEQ ID NO: 272650 - DNA, 20 bp, human
gcctagcaaccggggaagcc

SEQ ID NO: 272651 - DNA, 20 bp, human
gggagagacgcgcctcaacc

SEQ ID NO: 272652 - DNA, 20 bp, human
gaggacccgcaccccatgga

SEQ ID NO: 272653 - DNA, 20 bp, human
ggcgccggggcgctgaccct

SEQ ID NO: 272654 - DNA, 20 bp, human
gaaggcgccacaagccaatg

SEQ ID NO: 272655 - DNA, 20 bp, human
ggaaatctgcctagcaaccg

SEQ ID NO: 272656 - DNA, 20 bp, human
gggcatggccgagaagatga

SEQ ID NO: 272657 - DNA, 20 bp, human
gtggccgagaagatgagggc

SEQ ID NO: 272658 - DNA, 20 bp, human
gtcgtggcgtgtgggtaagg

SEQ ID NO: 272659 - DNA, 20 bp, human
gcacacgccacgacgcccat

SEQ ID NO: 272660 - DNA, 20 bp, human
gccagtagaagactagatgc

SEQ ID NO: 272661 - DNA, 20 bp, human
ggcgtcgtggcgtgtgggta

SEQ ID NO: 272662 - DNA, 20 bp, human
gcactcattcttcaagggtg

SEQ ID NO: 272663 - DNA, 20 bp, human
ggtacagacgggggcagcgg

SEQ ID NO: 272664 - DNA, 20 bp, human
ggacactgcggtacagacgg

SEQ ID NO: 272665 - DNA, 20 bp, human
gccggcttaggtcgcccaat

SEQ ID NO: 272666 - DNA, 20 bp, human
gtcgccgagaaatttctcaa

SEQ ID NO: 272667 - DNA, 20 bp, human
ggattgggactggactggaa

SEQ ID NO: 272668 - DNA, 20 bp, human
ggtcgccatgaacagtgtgg

SEQ ID NO: 272669 - DNA, 20 bp, human
ggccatgaacagtgtggggg

SEQ ID NO: 272670 - DNA, 20 bp, human
gttcatggcgacagtggtgg

SEQ ID NO: 272671 - DNA, 20 bp, human
gacggggattgggactggac

SEQ ID NO: 272672 - DNA, 20 bp, human
gaggtcggtgcacgggtccc

SEQ ID NO: 272673 - DNA, 20 bp, human
gctcaagggggacagctccg

SEQ ID NO: 272674 - DNA, 20 bp, human
ggaaccagcgattgaagcac

SEQ ID NO: 272675 - DNA, 20 bp, human
gcgaccagtgcttcaatcgc

SEQ ID NO: 272676 - DNA, 20 bp, human
gggccccgctggctaaaaaa

SEQ ID NO: 272677 - DNA, 20 bp, human
gacggcttctgttgcacgtc

SEQ ID NO: 272678 - DNA, 20 bp, human
gaaaaaagggcaagcatcgg

SEQ ID NO: 272679 - DNA, 20 bp, human
gaagccgtcagtggccccgc

SEQ ID NO: 272680 - DNA, 20 bp, human
ggggccttcttgcgacgctc

SEQ ID NO: 272681 - DNA, 20 bp, human
ggcgtcgcaagaaggcccgt

SEQ ID NO: 272682 - DNA, 20 bp, human
ggacgctcgggtctgggtcc

SEQ ID NO: 272683 - DNA, 20 bp, human
ggagtctcgcgcaactgggc

SEQ ID NO: 272684 - DNA, 20 bp, human
ggtgcaacagaagccgtcag

SEQ ID NO: 272685 - DNA, 20 bp, human
gtagccagcggggccactga

SEQ ID NO: 272686 - DNA, 20 bp, human
gcatgcgcgcaatctgcttc

SEQ ID NO: 272687 - DNA, 20 bp, human
gagattgcgcgcatgcgcta

SEQ ID NO: 272688 - DNA, 20 bp, human
ggaaacgttagacgacgctc

SEQ ID NO: 272689 - DNA, 20 bp, human
gtcggtgttccgctttttgt

SEQ ID NO: 272690 - DNA, 20 bp, human
gagctgagtgaaggccgaaa

SEQ ID NO: 272691 - DNA, 20 bp, human
gcgcgcgcccagggcgtgga

SEQ ID NO: 272692 - DNA, 20 bp, human
ggcacccagcgctgccgcct

SEQ ID NO: 272693 - DNA, 20 bp, human
ggggcctctgggtagagcgt

SEQ ID NO: 272694 - DNA, 20 bp, human
ggttgctagcagctgagtga

SEQ ID NO: 272695 - DNA, 20 bp, human
gccccggtctctagcgtcta

SEQ ID NO: 272696 - DNA, 20 bp, human
gagcaccgggagagccccgc

SEQ ID NO: 272697 - DNA, 20 bp, human
gagctccggccgcccggcgg

SEQ ID NO: 272698 - DNA, 20 bp, human
gcgggcaccctcaggaccac

SEQ ID NO: 272699 - DNA, 20 bp, human
ggccttccccgtggtcctga

SEQ ID NO: 272700 - DNA, 20 bp, human
gggtagctccggccgcccgg

SEQ ID NO: 272701 - DNA, 20 bp, human
gaaggacagaagccttcggg

SEQ ID NO: 272702 - DNA, 20 bp, human
gagttcgtagcaagggagtg

SEQ ID NO: 272703 - DNA, 20 bp, human
gagtgagggcgcgcggttga

SEQ ID NO: 272704 - DNA, 20 bp, human
ggttgaaggacagaagcctt

SEQ ID NO: 272705 - DNA, 20 bp, human
gtgaatgggagttcgtagca

SEQ ID NO: 272706 - DNA, 20 bp, human
gagttcgtagcaagagagtg

SEQ ID NO: 272707 - DNA, 20 bp, human
gagtgagggcgcgcggatgg

SEQ ID NO: 272708 - DNA, 20 bp, human
ggagagtgagggcgcgcgga

SEQ ID NO: 272709 - DNA, 20 bp, human
ggcaagagagtgagggcgcg

SEQ ID NO: 272710 - DNA, 20 bp, human
gcactcaggctgggttttga

SEQ ID NO: 272711 - DNA, 20 bp, human
gcgggcaccctcaggactaa

SEQ ID NO: 272712 - DNA, 20 bp, human
gaccctcaggactaagggga

SEQ ID NO: 272713 - DNA, 20 bp, human
ggctgctgttgctgccgcgg

SEQ ID NO: 272714 - DNA, 20 bp, human
gacttgtagtccgcctgggg

SEQ ID NO: 272715 - DNA, 20 bp, human
ggcaccgggggagccccccc

SEQ ID NO: 272716 - DNA, 20 bp, human
gggaagagaagcctattggg

SEQ ID NO: 272717 - DNA, 20 bp, human
gcccgagccagtactaaaaa

SEQ ID NO: 272718 - DNA, 20 bp, human
gcgttcggggcggtctcggt

SEQ ID NO: 272719 - DNA, 20 bp, human
gggaggcgtgaccacccaat

SEQ ID NO: 272720 - DNA, 20 bp, human
gggaaagcgggatgaggttc

SEQ ID NO: 272721 - DNA, 20 bp, human
ggggcctggaggagtcagac

SEQ ID NO: 272722 - DNA, 20 bp, human
ggggatgaggttctggcgtt

SEQ ID NO: 272723 - DNA, 20 bp, human
ggagccgttcggggcggtct

SEQ ID NO: 272724 - DNA, 20 bp, human
ggcgggaagagaagcctatt

SEQ ID NO: 272725 - DNA, 20 bp, human
gctggctggaaagcgggatg

SEQ ID NO: 272726 - DNA, 20 bp, human
gaaactctggagggcatgta

SEQ ID NO: 272727 - DNA, 20 bp, human
gtgccctataaaactctgga

SEQ ID NO: 272728 - DNA, 20 bp, human
gtgcatggagaatggggtag

SEQ ID NO: 272729 - DNA, 20 bp, human
gataatctgtaacagatgag

SEQ ID NO: 272730 - DNA, 20 bp, human
gtgccctatagaggtgtgtg

SEQ ID NO: 272731 - DNA, 20 bp, human
ggcacaagagggtgggacac

SEQ ID NO: 272732 - DNA, 20 bp, human
gcagatttgcatggagaatg

SEQ ID NO: 272733 - DNA, 20 bp, human
ggtgcagggcacaagagggt

SEQ ID NO: 272734 - DNA, 20 bp, human
gatgtatgggtgacaacttt

SEQ ID NO: 272735 - DNA, 20 bp, human
gatgccctccagagttttat

SEQ ID NO: 272736 - DNA, 20 bp, human
gttgaacgaacaagtgtcgc

SEQ ID NO: 272737 - DNA, 20 bp, human
gagcacactgttggtggatg

SEQ ID NO: 272738 - DNA, 20 bp, human
ggtcggggcgggacctggat

SEQ ID NO: 272739 - DNA, 20 bp, human
gccaccaacagtgtgctggc

SEQ ID NO: 272740 - DNA, 20 bp, human
gctcaggaagggatagggca

SEQ ID NO: 272741 - DNA, 20 bp, human
gtttcccgccagcacactgt

SEQ ID NO: 272742 - DNA, 20 bp, human
gccagcctcaggaagggata

SEQ ID NO: 272743 - DNA, 20 bp, human
ggctgcttttctcgcggctg

SEQ ID NO: 272744 - DNA, 20 bp, human
ggagaactacgcatgcgtgt

SEQ ID NO: 272745 - DNA, 20 bp, human
ggcatgcgtagttctcgcgc

SEQ ID NO: 272746 - DNA, 20 bp, human
gtacctagccaggtccctga

SEQ ID NO: 272747 - DNA, 20 bp, human
gcggcaggccagaccggaaa

SEQ ID NO: 272748 - DNA, 20 bp, human
ggacctggctaggtacgcgg

SEQ ID NO: 272749 - DNA, 20 bp, human
ggactagcggcggtgatctt

SEQ ID NO: 272750 - DNA, 20 bp, human
ggggacctggcgcccaatcc

SEQ ID NO: 272751 - DNA, 20 bp, human
gtccgctgggcggtagaggc

SEQ ID NO: 272752 - DNA, 20 bp, human
gcggagggtgggggaccgaa

SEQ ID NO: 272753 - DNA, 20 bp, human
gagcgcccggcaggccagac

SEQ ID NO: 272754 - DNA, 20 bp, human
gaactccgcgggggtgccca

SEQ ID NO: 272755 - DNA, 20 bp, human
ggccggaagggactccgcgg

SEQ ID NO: 272756 - DNA, 20 bp, human
ggggaagaaagtataaatga

SEQ ID NO: 272757 - DNA, 20 bp, human
gttaagaatcagggagtgct

SEQ ID NO: 272758 - DNA, 20 bp, human
gactaagggaaaattctagt

SEQ ID NO: 272759 - DNA, 20 bp, human
gtggattcttatcaaggctg

SEQ ID NO: 272760 - DNA, 20 bp, human
gcctctacagagtacggatc

SEQ ID NO: 272761 - DNA, 20 bp, human
ggggtgctaagtccctgatt

SEQ ID NO: 272762 - DNA, 20 bp, human
gaggcaaaacatcaggtaaa

SEQ ID NO: 272763 - DNA, 20 bp, human
gaattgggatgaatgaacta

SEQ ID NO: 272764 - DNA, 20 bp, human
gtgggtgccctgccaaatca

SEQ ID NO: 272765 - DNA, 20 bp, human
gggccttgtacaaagtatct

SEQ ID NO: 272766 - DNA, 20 bp, human
gctcctcccgctgaagtgat

SEQ ID NO: 272767 - DNA, 20 bp, human
gcagaagcgcgggtgcagaa

SEQ ID NO: 272768 - DNA, 20 bp, human
ggacgccccgccgacccccg

SEQ ID NO: 272769 - DNA, 20 bp, human
gcacttcagcgggaggagct

SEQ ID NO: 272770 - DNA, 20 bp, human
gtgcaagccgatcacttcag

SEQ ID NO: 272771 - DNA, 20 bp, human
ggcttgcactgactgcgctt

SEQ ID NO: 272772 - DNA, 20 bp, human
ggcgggtgcagaagggacaa

SEQ ID NO: 272773 - DNA, 20 bp, human
ggccgaggcgccgagcaaga

SEQ ID NO: 272774 - DNA, 20 bp, human
gtcaaggtcacggaggggac

SEQ ID NO: 272775 - DNA, 20 bp, human
gcagtggccgcgttggggcc

SEQ ID NO: 272776 - DNA, 20 bp, human
gtgccagccgcgtgagtggg

SEQ ID NO: 272777 - DNA, 20 bp, human
gccgggacgcacgtccggag

SEQ ID NO: 272778 - DNA, 20 bp, human
gtgagtgggcggagaggcct

SEQ ID NO: 272779 - DNA, 20 bp, human
gggaaaaaaccgttaagggg

SEQ ID NO: 272780 - DNA, 20 bp, human
gagcaggaaaaaaccgttaa

SEQ ID NO: 272781 - DNA, 20 bp, human
gcactcacgcggctggcacc

SEQ ID NO: 272782 - DNA, 20 bp, human
gaaaccgttaaggggaggaa

SEQ ID NO: 272783 - DNA, 20 bp, human
gggaccgccgcggctcgcct

SEQ ID NO: 272784 - DNA, 20 bp, human
ggtccggggccctttatagc

SEQ ID NO: 272785 - DNA, 20 bp, human
gttgaaggggtcgctgtcag

SEQ ID NO: 272786 - DNA, 20 bp, human
ggcagtgcgcggtttggcag

SEQ ID NO: 272787 - DNA, 20 bp, human
gcggctagagaggtggagtt

SEQ ID NO: 272788 - DNA, 20 bp, human
gtaaagaagcgcgattacaa

SEQ ID NO: 272789 - DNA, 20 bp, human
ggaaagaaagggtatgttag

SEQ ID NO: 272790 - DNA, 20 bp, human
gggtggagttaggtagagtt

SEQ ID NO: 272791 - DNA, 20 bp, human
gagagagtactcgtatccgt

SEQ ID NO: 272792 - DNA, 20 bp, human
gaaaggaaattggcttcagg

SEQ ID NO: 272793 - DNA, 20 bp, human
gcacggtgcaaagctatgat

SEQ ID NO: 272794 - DNA, 20 bp, human
gggctgggcggctagagagg

SEQ ID NO: 272795 - DNA, 20 bp, human
gtggggaaaaaggctacaat

SEQ ID NO: 272796 - DNA, 20 bp, human
gagcgcctgagctgacccct

SEQ ID NO: 272797 - DNA, 20 bp, human
ggcctgggagcaggatcccg

SEQ ID NO: 272798 - DNA, 20 bp, human
ggccccggacctgcggttct

SEQ ID NO: 272799 - DNA, 20 bp, human
gcccccgggatcctgctccc

SEQ ID NO: 272800 - DNA, 20 bp, human
gcggggccatggtagggtgc

SEQ ID NO: 272801 - DNA, 20 bp, human
ggggccgagaaccgcaggtc

SEQ ID NO: 272802 - DNA, 20 bp, human
gctcaggcgctcggtccccc

SEQ ID NO: 272803 - DNA, 20 bp, human
ggccgcctagaactctgcct

SEQ ID NO: 272804 - DNA, 20 bp, human
ggttctcggccccccgagct

SEQ ID NO: 272805 - DNA, 20 bp, human
gaaggggctctgggaccgca

SEQ ID NO: 272806 - DNA, 20 bp, human
gtcactgttccgaagttgta

SEQ ID NO: 272807 - DNA, 20 bp, human
gttgagaggtgcagtacata

SEQ ID NO: 272808 - DNA, 20 bp, human
gaacacatggagccccctcc

SEQ ID NO: 272809 - DNA, 20 bp, human
gctgactccactaccataaa

SEQ ID NO: 272810 - DNA, 20 bp, human
ggttctaggctcagtactga

SEQ ID NO: 272811 - DNA, 20 bp, human
ggctgggcattaagtgccag

SEQ ID NO: 272812 - DNA, 20 bp, human
gtctaaatatttcatcaatg

SEQ ID NO: 272813 - DNA, 20 bp, human
gctaccataaatggaattag

SEQ ID NO: 272814 - DNA, 20 bp, human
gagaacatgagtacaacaca

SEQ ID NO: 272815 - DNA, 20 bp, human
gctcatgaacacctaacccc

SEQ ID NO: 272816 - DNA, 20 bp, human
gtgacagctgtgctggtaag

SEQ ID NO: 272817 - DNA, 20 bp, human
gctgtcaacaattcctttta

SEQ ID NO: 272818 - DNA, 20 bp, human
gaagacatagatattccctc

SEQ ID NO: 272819 - DNA, 20 bp, human
ggtgctcaagctaatattca

SEQ ID NO: 272820 - DNA, 20 bp, human
gaattatcagcacctaaccc

SEQ ID NO: 272821 - DNA, 20 bp, human
gatgttaagtgtcaggacct

SEQ ID NO: 272822 - DNA, 20 bp, human
ggttttaaaaaccccttcat

SEQ ID NO: 272823 - DNA, 20 bp, human
gtgaaggtaactctcattta

SEQ ID NO: 272824 - DNA, 20 bp, human
gattttaaatgacccaatga

SEQ ID NO: 272825 - DNA, 20 bp, human
ggaactttccactttatcat

SEQ ID NO: 272826 - DNA, 20 bp, human
gaacaggagacaattcacaa

SEQ ID NO: 272827 - DNA, 20 bp, human
gggctctgaagccattacaa

SEQ ID NO: 272828 - DNA, 20 bp, human
gctggattctgctagtagga

SEQ ID NO: 272829 - DNA, 20 bp, human
gctcatgaacacctagtccc

SEQ ID NO: 272830 - DNA, 20 bp, human
gtttgggatcaggaatccct

SEQ ID NO: 272831 - DNA, 20 bp, human
gagtttcaaagtttttttgt

SEQ ID NO: 272832 - DNA, 20 bp, human
gtaaccataaatgcaatttc

SEQ ID NO: 272833 - DNA, 20 bp, human
gatttctggattctgctagt

SEQ ID NO: 272834 - DNA, 20 bp, human
ggcattaagtgccagggact

SEQ ID NO: 272835 - DNA, 20 bp, human
gagttaagcaacctttgtaa

SEQ ID NO: 272836 - DNA, 20 bp, human
gcctaagctaagggtggaag

SEQ ID NO: 272837 - DNA, 20 bp, human
gaacctgagtttcaggagtc

SEQ ID NO: 272838 - DNA, 20 bp, human
gtgtggggagttgactgttg

SEQ ID NO: 272839 - DNA, 20 bp, human
gcgaaagatacctaagctaa

SEQ ID NO: 272840 - DNA, 20 bp, human
gtgctgctctatattcattt

SEQ ID NO: 272841 - DNA, 20 bp, human
gtgaaaggacatgcactttg

SEQ ID NO: 272842 - DNA, 20 bp, human
gaaaattacccctgagagac

SEQ ID NO: 272843 - DNA, 20 bp, human
gaagatacctaagctaaggg

SEQ ID NO: 272844 - DNA, 20 bp, human
gctctgggcaacaacgttag

SEQ ID NO: 272845 - DNA, 20 bp, human
gtctcaggggtaattttgtc

SEQ ID NO: 272846 - DNA, 20 bp, human
ggtggagcaggggtcagcac

SEQ ID NO: 272847 - DNA, 20 bp, human
gcaggggtcagcacaggttg

SEQ ID NO: 272848 - DNA, 20 bp, human
ggggtcagcacaggttgggg

SEQ ID NO: 272849 - DNA, 20 bp, human
ggagtgccagtgcatggagc

SEQ ID NO: 272850 - DNA, 20 bp, human
gtccatgcactggcactcct

SEQ ID NO: 272851 - DNA, 20 bp, human
gcagcaccctgtcccatcca

SEQ ID NO: 272852 - DNA, 20 bp, human
gatccatggcccaaggaccg

SEQ ID NO: 272853 - DNA, 20 bp, human
gggatcttgcaccgggcggc

SEQ ID NO: 272854 - DNA, 20 bp, human
gactggcactcctcggtcct

SEQ ID NO: 272855 - DNA, 20 bp, human
gctcctcggtccttgggcca

SEQ ID NO: 272856 - DNA, 20 bp, human
gcccatcctcaaactcacat

SEQ ID NO: 272857 - DNA, 20 bp, human
gtgtgactgtgcagtatctg

SEQ ID NO: 272858 - DNA, 20 bp, human
gggcaggattgtgcttgcta

SEQ ID NO: 272859 - DNA, 20 bp, human
gcctgtgaagccttctaaga

SEQ ID NO: 272860 - DNA, 20 bp, human
gtaggaaactaaagccacct

SEQ ID NO: 272861 - DNA, 20 bp, human
ggagtttgaggatgggtgtt

SEQ ID NO: 272862 - DNA, 20 bp, human
gtccgatgtgagtttgagga

SEQ ID NO: 272863 - DNA, 20 bp, human
gaactaaagccacctgggaa

SEQ ID NO: 272864 - DNA, 20 bp, human
gttgtctttcccatcttaga

SEQ ID NO: 272865 - DNA, 20 bp, human
gagtgggaattcttgagttc

SEQ ID NO: 272866 - DNA, 20 bp, human
gtgacagctgtgctagtgag

SEQ ID NO: 272867 - DNA, 20 bp, human
gctggaaagccccatgacat

SEQ ID NO: 272868 - DNA, 20 bp, human
gaatcttccaattttattat

SEQ ID NO: 272869 - DNA, 20 bp, human
gtacaggtctctagaaagtc

SEQ ID NO: 272870 - DNA, 20 bp, human
gcttacctctccaatgtcat

SEQ ID NO: 272871 - DNA, 20 bp, human
ggggccacattgagaagtac

SEQ ID NO: 272872 - DNA, 20 bp, human
gtagcacctaactcaggtct

SEQ ID NO: 272873 - DNA, 20 bp, human
gagacgtggacattccttca

SEQ ID NO: 272874 - DNA, 20 bp, human
gtttttacatgtataaatac

SEQ ID NO: 272875 - DNA, 20 bp, human
gattcctgtacttctcaatg

SEQ ID NO: 272876 - DNA, 20 bp, human
gcggccgggccgctgggaac

SEQ ID NO: 272877 - DNA, 20 bp, human
gtgggaacgggctctgcgga

SEQ ID NO: 272878 - DNA, 20 bp, human
ggctgccgccgccttctcgt

SEQ ID NO: 272879 - DNA, 20 bp, human
gcacgccggggaatgacttg

SEQ ID NO: 272880 - DNA, 20 bp, human
ggagcccgttcccagcggcc

SEQ ID NO: 272881 - DNA, 20 bp, human
gcgggccccaagtcattccc

SEQ ID NO: 272882 - DNA, 20 bp, human
ggggccaggtgggctgagtt

SEQ ID NO: 272883 - DNA, 20 bp, human
gaggtggcccaggctccgat

SEQ ID NO: 272884 - DNA, 20 bp, human
gaagcgtaatttgaggaaga

SEQ ID NO: 272885 - DNA, 20 bp, human
gggaagatggatgagtccgg

SEQ ID NO: 272886 - DNA, 20 bp, human
gccgtgatccctgacgtcaa

SEQ ID NO: 272887 - DNA, 20 bp, human
gggcactagcgaggcgacga

SEQ ID NO: 272888 - DNA, 20 bp, human
gacgaagggcggggccagga

SEQ ID NO: 272889 - DNA, 20 bp, human
gcgcgaagggacaggggttg

SEQ ID NO: 272890 - DNA, 20 bp, human
gtggacagagttcccccagg

SEQ ID NO: 272891 - DNA, 20 bp, human
gctagcgaggcgacgaaggg

SEQ ID NO: 272892 - DNA, 20 bp, human
gccgccaaccggcactagcg

SEQ ID NO: 272893 - DNA, 20 bp, human
gccagcgacccttgacgtca

SEQ ID NO: 272894 - DNA, 20 bp, human
gaggagggcgcgaagggaca

SEQ ID NO: 272895 - DNA, 20 bp, human
gaggcgaagggcaggtggtc

SEQ ID NO: 272896 - DNA, 20 bp, human
ggggctgcgggcgccaccgt

SEQ ID NO: 272897 - DNA, 20 bp, human
gggcccgcgcgctccgacgg

SEQ ID NO: 272898 - DNA, 20 bp, human
gcgctcgaggccagcttggg

SEQ ID NO: 272899 - DNA, 20 bp, human
ggaggccagcttgggtggaa

SEQ ID NO: 272900 - DNA, 20 bp, human
gcgggcggatggcacctcca

SEQ ID NO: 272901 - DNA, 20 bp, human
gccagcttgggtggaaaggg

SEQ ID NO: 272902 - DNA, 20 bp, human
ggcccggctcgcctcacgtg

SEQ ID NO: 272903 - DNA, 20 bp, human
gcggcacgggctaggcatgc

SEQ ID NO: 272904 - DNA, 20 bp, human
gttgtcgaggccacctcgaa

SEQ ID NO: 272905 - DNA, 20 bp, human
ggcccccggcccagccgtgg

SEQ ID NO: 272906 - DNA, 20 bp, human
gaaggtaaatagacaccctg

SEQ ID NO: 272907 - DNA, 20 bp, human
gcaccctggggatactgtag

SEQ ID NO: 272908 - DNA, 20 bp, human
gaagacacacagccctatac

SEQ ID NO: 272909 - DNA, 20 bp, human
gttccactacagtatcccca

SEQ ID NO: 272910 - DNA, 20 bp, human
gcaccttctccccctgtata

SEQ ID NO: 272911 - DNA, 20 bp, human
gagccctatacagggggaga

SEQ ID NO: 272912 - DNA, 20 bp, human
gatactgtagtggaaaatct

SEQ ID NO: 272913 - DNA, 20 bp, human
gcacttacatatgagaaagg

SEQ ID NO: 272914 - DNA, 20 bp, human
gtattaaacacagaagcaag

SEQ ID NO: 272915 - DNA, 20 bp, human
gaattgattaattcatagtc

SEQ ID NO: 272916 - DNA, 20 bp, human
gggactggagggctcccgat

SEQ ID NO: 272917 - DNA, 20 bp, human
gtggggctaggctgcgggaa

SEQ ID NO: 272918 - DNA, 20 bp, human
gagccagtaagagtcgagca

SEQ ID NO: 272919 - DNA, 20 bp, human
ggatggggtgtagccaatca

SEQ ID NO: 272920 - DNA, 20 bp, human
gcgccctgcacggttccgat

SEQ ID NO: 272921 - DNA, 20 bp, human
gagagcgcgcgagaacctga

SEQ ID NO: 272922 - DNA, 20 bp, human
gcacccatctctgccctgat

SEQ ID NO: 272923 - DNA, 20 bp, human
ggtaagagtcgagcagggac

SEQ ID NO: 272924 - DNA, 20 bp, human
gcgaacccgcccccttccgc

SEQ ID NO: 272925 - DNA, 20 bp, human
ggcagcagccaaggcttctt

SEQ ID NO: 272926 - DNA, 20 bp, human
ggggcctggcgggatccgcc

SEQ ID NO: 272927 - DNA, 20 bp, human
gcaagcctctcggtccctgg

SEQ ID NO: 272928 - DNA, 20 bp, human
ggagactgccgaagtccgga

SEQ ID NO: 272929 - DNA, 20 bp, human
gcggggaggcgggcctagga

SEQ ID NO: 272930 - DNA, 20 bp, human
gaggtgagtacgtgggaatg

SEQ ID NO: 272931 - DNA, 20 bp, human
gagtccggatggcagagggg

SEQ ID NO: 272932 - DNA, 20 bp, human
gaggcgggcctaggacgggt

SEQ ID NO: 272933 - DNA, 20 bp, human
gcgggcctaggacgggtggg

SEQ ID NO: 272934 - DNA, 20 bp, human
gggccccgcccacccgtcct

SEQ ID NO: 272935 - DNA, 20 bp, human
ggggctcgcttaaaaaggcg

SEQ ID NO: 272936 - DNA, 20 bp, human
ggccgcgagcggcaaaaaac

SEQ ID NO: 272937 - DNA, 20 bp, human
gtaggcggggccaagtcggc

SEQ ID NO: 272938 - DNA, 20 bp, human
gcggcctgttgagaacgcag

SEQ ID NO: 272939 - DNA, 20 bp, human
gagcgcccaagcttgacctc

SEQ ID NO: 272940 - DNA, 20 bp, human
ggccccactgcgttctcaac

SEQ ID NO: 272941 - DNA, 20 bp, human
gcccccagtgggcccaaggt

SEQ ID NO: 272942 - DNA, 20 bp, human
ggtagcccgaggtcaagctt

SEQ ID NO: 272943 - DNA, 20 bp, human
gaacgcagtggggccgcgag

SEQ ID NO: 272944 - DNA, 20 bp, human
gccagtgggcccaaggtagg

SEQ ID NO: 272945 - DNA, 20 bp, human
ggacacggaagcgccgttgt

SEQ ID NO: 272946 - DNA, 20 bp, human
ggttccccgtacggcgctaa

SEQ ID NO: 272947 - DNA, 20 bp, human
gcccaggtagaacgtctaga

SEQ ID NO: 272948 - DNA, 20 bp, human
gtacctggggctcgacccct

SEQ ID NO: 272949 - DNA, 20 bp, human
gcgggagaaggttccccgta

SEQ ID NO: 272950 - DNA, 20 bp, human
gtccgcccttagcgccgtac

SEQ ID NO: 272951 - DNA, 20 bp, human
ggcagtagagcctacgtcag

SEQ ID NO: 272952 - DNA, 20 bp, human
gtgtagctatggagacgtgg

SEQ ID NO: 272953 - DNA, 20 bp, human
gccccgtacggcgctaaggg

SEQ ID NO: 272954 - DNA, 20 bp, human
gtgctgccgagctgtagcta

SEQ ID NO: 272955 - DNA, 20 bp, human
gtccgtctagacgttctacc

SEQ ID NO: 272956 - DNA, 20 bp, human
gcagactcgagttctctaat

SEQ ID NO: 272957 - DNA, 20 bp, human
gaaattctggcgcgagcact

SEQ ID NO: 272958 - DNA, 20 bp, human
gtaggggcggaagacgagtg

SEQ ID NO: 272959 - DNA, 20 bp, human
gtgggccccccgatttccac

SEQ ID NO: 272960 - DNA, 20 bp, human
gttaagaagcggacggggta

SEQ ID NO: 272961 - DNA, 20 bp, human
ggaagcggacggggtagggg

SEQ ID NO: 272962 - DNA, 20 bp, human
gaaaaggcagagctgcggag

SEQ ID NO: 272963 - DNA, 20 bp, human
gacgagtgcgggaaaccgat

SEQ ID NO: 272964 - DNA, 20 bp, human
gccccgtccgcttcttaaag

SEQ ID NO: 272965 - DNA, 20 bp, human
gcctggttggtcagttgcag

SEQ ID NO: 272966 - DNA, 20 bp, human
gactcggcctaccagatcca

SEQ ID NO: 272967 - DNA, 20 bp, human
gtgtctgcgcctgcgtgctt

SEQ ID NO: 272968 - DNA, 20 bp, human
gccagggagccaaagcacgc

SEQ ID NO: 272969 - DNA, 20 bp, human
gggagcgcgccctagggggc

SEQ ID NO: 272970 - DNA, 20 bp, human
gtaggccgagttctgttctg

SEQ ID NO: 272971 - DNA, 20 bp, human
gtgcggttcagcgggttcta

SEQ ID NO: 272972 - DNA, 20 bp, human
gtgctttggctccctggatc

SEQ ID NO: 272973 - DNA, 20 bp, human
gcgggacgggcgcgcgcact

SEQ ID NO: 272974 - DNA, 20 bp, human
gcttcagtgcccgcccccta

SEQ ID NO: 272975 - DNA, 20 bp, human
ggcggcgggagcgcgcccta

SEQ ID NO: 272976 - DNA, 20 bp, human
gctgcattctatgcttatat

SEQ ID NO: 272977 - DNA, 20 bp, human
gtgaggttcttacaagtctt

SEQ ID NO: 272978 - DNA, 20 bp, human
gcgtgattgaaagtagaagg

SEQ ID NO: 272979 - DNA, 20 bp, human
gacaaaacagggatggccat

SEQ ID NO: 272980 - DNA, 20 bp, human
gcatgggctacgtaatttca

SEQ ID NO: 272981 - DNA, 20 bp, human
gtgtcagcgtaatatctgtg

SEQ ID NO: 272982 - DNA, 20 bp, human
ggagtgcataaaaagtttcc

SEQ ID NO: 272983 - DNA, 20 bp, human
ggacatgcacaaaacaggga

SEQ ID NO: 272984 - DNA, 20 bp, human
ggtgagagaccttagagacc

SEQ ID NO: 272985 - DNA, 20 bp, human
gatgaggacatgcacaaaac

SEQ ID NO: 272986 - DNA, 20 bp, human
gggattctcatgacaagcta

SEQ ID NO: 272987 - DNA, 20 bp, human
ggcaactatactaaaacgaa

SEQ ID NO: 272988 - DNA, 20 bp, human
gtcaagtgagtctactcttg

SEQ ID NO: 272989 - DNA, 20 bp, human
gaagaccatataaaacagta

SEQ ID NO: 272990 - DNA, 20 bp, human
gagatcattctcagcttccc

SEQ ID NO: 272991 - DNA, 20 bp, human
gtatggtggctagcagtgga

SEQ ID NO: 272992 - DNA, 20 bp, human
ggctgcccaaagaaatgatt

SEQ ID NO: 272993 - DNA, 20 bp, human
gcaattatctagttatatgg

SEQ ID NO: 272994 - DNA, 20 bp, human
gcaactagaagttcaaagaa

SEQ ID NO: 272995 - DNA, 20 bp, human
gatcactgagtgggtctgcc

SEQ ID NO: 272996 - DNA, 20 bp, human
ggggcaggaccgaagctcgc

SEQ ID NO: 272997 - DNA, 20 bp, human
gaggaccgaagctcgccggg

SEQ ID NO: 272998 - DNA, 20 bp, human
gacgaggcgctccctgcgca

SEQ ID NO: 272999 - DNA, 20 bp, human
gtctgtggggcgcgggtccg

SEQ ID NO: 273000 - DNA, 20 bp, human
ggggtgggagcggcagccga

SEQ ID NO: 273001 - DNA, 20 bp, human
gcggcggcgacgcagggcga

SEQ ID NO: 273002 - DNA, 20 bp, human
gctccgggaggggacgccct

SEQ ID NO: 273003 - DNA, 20 bp, human
gacaaaggtctgtggggcgc

SEQ ID NO: 273004 - DNA, 20 bp, human
gcccgtgggacaaaggtctg

SEQ ID NO: 273005 - DNA, 20 bp, human
ggtcctgcccaccctgcgca

SEQ ID NO: 273006 - DNA, 20 bp, human
gccctcttggcctgaagagg

SEQ ID NO: 273007 - DNA, 20 bp, human
gcaagagggcgctgcattga

SEQ ID NO: 273008 - DNA, 20 bp, human
ggggtcccgcctgatcctag

SEQ ID NO: 273009 - DNA, 20 bp, human
gccagcaggggtcgcggctc

SEQ ID NO: 273010 - DNA, 20 bp, human
ggctccggagacgcccggag

SEQ ID NO: 273011 - DNA, 20 bp, human
ggggacccctccacttattg

SEQ ID NO: 273012 - DNA, 20 bp, human
ggagccgccgggccataaaa

SEQ ID NO: 273013 - DNA, 20 bp, human
gccgccgggccataaaaagg

SEQ ID NO: 273014 - DNA, 20 bp, human
gggcgccggcccctaggatc

SEQ ID NO: 273015 - DNA, 20 bp, human
gccggcccctaggatcaggc

SEQ ID NO: 273016 - DNA, 20 bp, human
gcggcggcggacttggaccc

SEQ ID NO: 273017 - DNA, 20 bp, human
ggagtgatccagttgcggga

SEQ ID NO: 273018 - DNA, 20 bp, human
gtgacgcgccctgcagtcgg

SEQ ID NO: 273019 - DNA, 20 bp, human
gtccaagtccgccgccggga

SEQ ID NO: 273020 - DNA, 20 bp, human
gaccgccgtggccgccaatc

SEQ ID NO: 273021 - DNA, 20 bp, human
gggaagcctcaggtgggccc

SEQ ID NO: 273022 - DNA, 20 bp, human
gactcggcggaagcctcagg

SEQ ID NO: 273023 - DNA, 20 bp, human
gcacaggcggcgtcaatccc

SEQ ID NO: 273024 - DNA, 20 bp, human
gccgtgacgcgccctgcagt

SEQ ID NO: 273025 - DNA, 20 bp, human
ggccctcccggcggcggact

SEQ ID NO: 273026 - DNA, 20 bp, human
gtagtgacaaggcgattgag

SEQ ID NO: 273027 - DNA, 20 bp, human
gactgccccaggatctgaac

SEQ ID NO: 273028 - DNA, 20 bp, human
ggccacctgttcagatcctg

SEQ ID NO: 273029 - DNA, 20 bp, human
gagctgccatgcataaaact

SEQ ID NO: 273030 - DNA, 20 bp, human
ggcctccatccccatcacca

SEQ ID NO: 273031 - DNA, 20 bp, human
gggcgattgagtggtcacca

SEQ ID NO: 273032 - DNA, 20 bp, human
gcccgtgagtctggaagcag

SEQ ID NO: 273033 - DNA, 20 bp, human
ggccctagataggggggtta

SEQ ID NO: 273034 - DNA, 20 bp, human
gggcagctctaatgacagga

SEQ ID NO: 273035 - DNA, 20 bp, human
gggatgtgagatggtcccag

SEQ ID NO: 273036 - DNA, 20 bp, human
gtaaccccagggaaactcct

SEQ ID NO: 273037 - DNA, 20 bp, human
gtttccctggggttaccaga

SEQ ID NO: 273038 - DNA, 20 bp, human
ggtgaccagaggggtttgtg

SEQ ID NO: 273039 - DNA, 20 bp, human
gagtcagggtgcttgcaaag

SEQ ID NO: 273040 - DNA, 20 bp, human
gccctcttctacagaggacc

SEQ ID NO: 273041 - DNA, 20 bp, human
ggactcgccagcctctgctt

SEQ ID NO: 273042 - DNA, 20 bp, human
ggagtgcaggacaacaccca

SEQ ID NO: 273043 - DNA, 20 bp, human
gagagggcattgtcccggta

SEQ ID NO: 273044 - DNA, 20 bp, human
gcatcactggggctcagata

SEQ ID NO: 273045 - DNA, 20 bp, human
gacttggtgaccctgatctc

SEQ ID NO: 273046 - DNA, 20 bp, human
gggagcagctcgcgagaagg

SEQ ID NO: 273047 - DNA, 20 bp, human
gagcccccgcggttcccacc

SEQ ID NO: 273048 - DNA, 20 bp, human
gggctcaggaggcgtgtgca

SEQ ID NO: 273049 - DNA, 20 bp, human
gagcccggtgggaaccgcgg

SEQ ID NO: 273050 - DNA, 20 bp, human
gaggggagcagctcgcgaga

SEQ ID NO: 273051 - DNA, 20 bp, human
gtgattgggtcgcagttgag

SEQ ID NO: 273052 - DNA, 20 bp, human
gtgaagcccggtgggaaccg

SEQ ID NO: 273053 - DNA, 20 bp, human
gctcgcgagaagggggcgtg

SEQ ID NO: 273054 - DNA, 20 bp, human
ggctagcggacgcaaagact

SEQ ID NO: 273055 - DNA, 20 bp, human
ggcccgtagtctataaaacc

SEQ ID NO: 273056 - DNA, 20 bp, human
gcccgccgcgggatgagtaa

SEQ ID NO: 273057 - DNA, 20 bp, human
ggcggggcgcgaatgggctg

SEQ ID NO: 273058 - DNA, 20 bp, human
ggcaggggcggggcgcgaat

SEQ ID NO: 273059 - DNA, 20 bp, human
gacgccggcccgcaagtgac

SEQ ID NO: 273060 - DNA, 20 bp, human
ggggagacctcaccaggcgg

SEQ ID NO: 273061 - DNA, 20 bp, human
gcacgcccgccgcaggccaa

SEQ ID NO: 273062 - DNA, 20 bp, human
gcgcgcgggtcgagagagcg

SEQ ID NO: 273063 - DNA, 20 bp, human
ggagccgcgacctgaacgcc

SEQ ID NO: 273064 - DNA, 20 bp, human
gaacgccgggagacctcacc

SEQ ID NO: 273065 - DNA, 20 bp, human
gcggcgggcgtggcgacggg

SEQ ID NO: 273066 - DNA, 20 bp, human
gtggcattctgggaagaatc

SEQ ID NO: 273067 - DNA, 20 bp, human
gtcctcataacataaaggga

SEQ ID NO: 273068 - DNA, 20 bp, human
gggctggttaagtgactccc

SEQ ID NO: 273069 - DNA, 20 bp, human
gtgtaccctgacctggaata

SEQ ID NO: 273070 - DNA, 20 bp, human
gattctgggaagaatcaggc

SEQ ID NO: 273071 - DNA, 20 bp, human
gtacctgccgggtaaatagt

SEQ ID NO: 273072 - DNA, 20 bp, human
ggatgctctaggctctggat

SEQ ID NO: 273073 - DNA, 20 bp, human
gggataggtaagagcagcct

SEQ ID NO: 273074 - DNA, 20 bp, human
gcaggcagacgattcacagt

SEQ ID NO: 273075 - DNA, 20 bp, human
gtgttccctattccaggtca

SEQ ID NO: 273076 - DNA, 20 bp, human
gcgaccggcccctggagcgt

SEQ ID NO: 273077 - DNA, 20 bp, human
ggcgtgggcgctagcgaggt

SEQ ID NO: 273078 - DNA, 20 bp, human
gacagtcccaggaacggagg

SEQ ID NO: 273079 - DNA, 20 bp, human
gcagtttccatttgcttcca

SEQ ID NO: 273080 - DNA, 20 bp, human
gaccacagtcccaggaacgg

SEQ ID NO: 273081 - DNA, 20 bp, human
gtggaggttaaactcagccc

SEQ ID NO: 273082 - DNA, 20 bp, human
gtagcgaggtaggcgagaca

SEQ ID NO: 273083 - DNA, 20 bp, human
gttcctgggactgtggtgga

SEQ ID NO: 273084 - DNA, 20 bp, human
gcgaggtaggcgagacaggg

SEQ ID NO: 273085 - DNA, 20 bp, human
gaacctccacctccgttcct

SEQ ID NO: 273086 - DNA, 20 bp, human
gcgggctggaagtgggtcag

SEQ ID NO: 273087 - DNA, 20 bp, human
gtcagccccgggcgcctcgt

SEQ ID NO: 273088 - DNA, 20 bp, human
gcggccgccgtcctgcccgg

SEQ ID NO: 273089 - DNA, 20 bp, human
ggcccgggcagccggatcac

SEQ ID NO: 273090 - DNA, 20 bp, human
gctcaggaaaggcccacgta

SEQ ID NO: 273091 - DNA, 20 bp, human
gggccctgcgggctggaagt

SEQ ID NO: 273092 - DNA, 20 bp, human
gagcccgcggtgtaacgcta

SEQ ID NO: 273093 - DNA, 20 bp, human
gagggcccgctcttcagccc

SEQ ID NO: 273094 - DNA, 20 bp, human
gggaggaggccttgtggctc

SEQ ID NO: 273095 - DNA, 20 bp, human
ggcccatagcgttacaccgc

SEQ ID NO: 273096 - DNA, 20 bp, human
gggttcccgcctacaggcga

SEQ ID NO: 273097 - DNA, 20 bp, human
gggcgaggcggggacgtggt

SEQ ID NO: 273098 - DNA, 20 bp, human
ggggcgccctcgcctgtagg

SEQ ID NO: 273099 - DNA, 20 bp, human
ggggacttgctgcggactcg

SEQ ID NO: 273100 - DNA, 20 bp, human
gcgccctctgggcactgacg

SEQ ID NO: 273101 - DNA, 20 bp, human
ggccccgagctcgcgcaggt

SEQ ID NO: 273102 - DNA, 20 bp, human
gacaggcgagggcgccctct

SEQ ID NO: 273103 - DNA, 20 bp, human
gtcgcccacctgcgcgagct

SEQ ID NO: 273104 - DNA, 20 bp, human
ggaccacgtcagtgcccaga

SEQ ID NO: 273105 - DNA, 20 bp, human
gtggtgggcggggcctagaa

SEQ ID NO: 273106 - DNA, 20 bp, human
gccagccaatggggagagcg

SEQ ID NO: 273107 - DNA, 20 bp, human
gagactctggccgggacaag

SEQ ID NO: 273108 - DNA, 20 bp, human
gatacgacatggcatatgac

SEQ ID NO: 273109 - DNA, 20 bp, human
gcacacctcgctctccccat

SEQ ID NO: 273110 - DNA, 20 bp, human
gggacatagttactagactc

SEQ ID NO: 273111 - DNA, 20 bp, human
ggtggcactcggatgaataa

SEQ ID NO: 273112 - DNA, 20 bp, human
gatagcatacccagccaatg

SEQ ID NO: 273113 - DNA, 20 bp, human
gacaatgattaacaggaagc

SEQ ID NO: 273114 - DNA, 20 bp, human
gaaagcatgtgaatactgcc

SEQ ID NO: 273115 - DNA, 20 bp, human
gctgggtatgctatacgaca

SEQ ID NO: 273116 - DNA, 20 bp, human
gtgccctaagagtctgagac

SEQ ID NO: 273117 - DNA, 20 bp, human
gctcctgtctcagactctta

SEQ ID NO: 273118 - DNA, 20 bp, human
gacactccaagatagacctc

SEQ ID NO: 273119 - DNA, 20 bp, human
ggaggctggaatgtgaaagt

SEQ ID NO: 273120 - DNA, 20 bp, human
gtctaagggggcaaaatgga

SEQ ID NO: 273121 - DNA, 20 bp, human
gctggaatgtgaaagtggga

SEQ ID NO: 273122 - DNA, 20 bp, human
gtccaggactctagaggcag

SEQ ID NO: 273123 - DNA, 20 bp, human
gaaaaacccagttacaccca

SEQ ID NO: 273124 - DNA, 20 bp, human
ggctttcagtcccaccccca

SEQ ID NO: 273125 - DNA, 20 bp, human
gctcttagggcaggccttgg

SEQ ID NO: 273126 - DNA, 20 bp, human
gaactctagccacagacaaa

SEQ ID NO: 273127 - DNA, 20 bp, human
gaggatgtggagctctaagg

SEQ ID NO: 273128 - DNA, 20 bp, human
gcactaaagaagatgaggag

SEQ ID NO: 273129 - DNA, 20 bp, human
gagggctgtctagagcaagg

SEQ ID NO: 273130 - DNA, 20 bp, human
gaataaatgttctaggtagt

SEQ ID NO: 273131 - DNA, 20 bp, human
gagacccagtgtgatcaaac

SEQ ID NO: 273132 - DNA, 20 bp, human
gggcaggtcacaagtagcaa

SEQ ID NO: 273133 - DNA, 20 bp, human
gctcctggatgcacttcaca

SEQ ID NO: 273134 - DNA, 20 bp, human
ggctctaaggaggaacctac

SEQ ID NO: 273135 - DNA, 20 bp, human
gaacaaaaactgctgagtaa

SEQ ID NO: 273136 - DNA, 20 bp, human
gacaaaaggcgaggtactta

SEQ ID NO: 273137 - DNA, 20 bp, human
gtgttcgggtatctatgaac

SEQ ID NO: 273138 - DNA, 20 bp, human
gtgggcgcctaccacatact

SEQ ID NO: 273139 - DNA, 20 bp, human
ggctcaaaagcttgtctcaa

SEQ ID NO: 273140 - DNA, 20 bp, human
gttgtggacaaccaaagaat

SEQ ID NO: 273141 - DNA, 20 bp, human
gggtatgaagttaactgttc

SEQ ID NO: 273142 - DNA, 20 bp, human
gcagccatagggttaaaaac

SEQ ID NO: 273143 - DNA, 20 bp, human
gcaaccaaagaataggctat

SEQ ID NO: 273144 - DNA, 20 bp, human
gtcatgttaaggatgaagtc

SEQ ID NO: 273145 - DNA, 20 bp, human
ggtaggcgcccagtagattt

SEQ ID NO: 273146 - DNA, 20 bp, human
gtggtagcccagcctggatg

SEQ ID NO: 273147 - DNA, 20 bp, human
gactggggagatggggtaaa

SEQ ID NO: 273148 - DNA, 20 bp, human
ggccacacaggacagaaagg

SEQ ID NO: 273149 - DNA, 20 bp, human
gtggctgtaactggggagat

SEQ ID NO: 273150 - DNA, 20 bp, human
gcagaattgacactcaactg

SEQ ID NO: 273151 - DNA, 20 bp, human
ggtcctgtgtggctgtaact

SEQ ID NO: 273152 - DNA, 20 bp, human
gtagtcttggtagcccagcc

SEQ ID NO: 273153 - DNA, 20 bp, human
gttgacactcaactgaggaa

SEQ ID NO: 273154 - DNA, 20 bp, human
gagtcaatgcatcctcatcc

SEQ ID NO: 273155 - DNA, 20 bp, human
gtccctgggtatgcatatct

SEQ ID NO: 273156 - DNA, 20 bp, human
gtcacgatctgtgaaatatg

SEQ ID NO: 273157 - DNA, 20 bp, human
gaggtagtggcagtaacctc

SEQ ID NO: 273158 - DNA, 20 bp, human
gtcacgtcatctagagctgt

SEQ ID NO: 273159 - DNA, 20 bp, human
ggctctagatgacgtgagag

SEQ ID NO: 273160 - DNA, 20 bp, human
gagctcgtgcttctgttcaa

SEQ ID NO: 273161 - DNA, 20 bp, human
ggtgccatggcaacaggtag

SEQ ID NO: 273162 - DNA, 20 bp, human
gcacagatcgtgacatggta

SEQ ID NO: 273163 - DNA, 20 bp, human
gcgtcatctagagctgtggg

SEQ ID NO: 273164 - DNA, 20 bp, human
gtgcttctgttcaatggccg

SEQ ID NO: 273165 - DNA, 20 bp, human
gtagagagcaagagtttgta

SEQ ID NO: 273166 - DNA, 20 bp, human
gcctcccagggtcagtccca

SEQ ID NO: 273167 - DNA, 20 bp, human
gcaggtggatctcaactctg

SEQ ID NO: 273168 - DNA, 20 bp, human
gtgggcgtccaggctgtcca

SEQ ID NO: 273169 - DNA, 20 bp, human
gagggcgtgcagaggctgta

SEQ ID NO: 273170 - DNA, 20 bp, human
gcgcgctcacccgacccgtc

SEQ ID NO: 273171 - DNA, 20 bp, human
gagggcgctgcgccctccca

SEQ ID NO: 273172 - DNA, 20 bp, human
gaggctgcattttctcccga

SEQ ID NO: 273173 - DNA, 20 bp, human
ggtaggtcgtgagactgaat

SEQ ID NO: 273174 - DNA, 20 bp, human
gaaaatgcagcctgacgggt

SEQ ID NO: 273175 - DNA, 20 bp, human
gtctcccgagggcgccgacc

SEQ ID NO: 273176 - DNA, 20 bp, human
gcagacctgggattccccag

SEQ ID NO: 273177 - DNA, 20 bp, human
gcgaacctctggggaatccc

SEQ ID NO: 273178 - DNA, 20 bp, human
ggagaagggtgtctctgcag

SEQ ID NO: 273179 - DNA, 20 bp, human
gccaacagccaggttggttc

SEQ ID NO: 273180 - DNA, 20 bp, human
ggctgggggaggagtgttag

SEQ ID NO: 273181 - DNA, 20 bp, human
gcaggtctgaaattacagat

SEQ ID NO: 273182 - DNA, 20 bp, human
gggttcgaagctctcattga

SEQ ID NO: 273183 - DNA, 20 bp, human
gttatggccaacagccaggt

SEQ ID NO: 273184 - DNA, 20 bp, human
gtgagagcttcgaacctctg

SEQ ID NO: 273185 - DNA, 20 bp, human
ggacgggtagttgctggtta

SEQ ID NO: 273186 - DNA, 20 bp, human
gggcctgcgcatgatagaga

SEQ ID NO: 273187 - DNA, 20 bp, human
gaggaagagctcgaaagggg

SEQ ID NO: 273188 - DNA, 20 bp, human
gggcaggaagagctcgaaag

SEQ ID NO: 273189 - DNA, 20 bp, human
gcatacagtgggaaaaaatc

SEQ ID NO: 273190 - DNA, 20 bp, human
gcacacgcgtgggcatacag

SEQ ID NO: 273191 - DNA, 20 bp, human
ggcccctggcagctcgtggt

SEQ ID NO: 273192 - DNA, 20 bp, human
gtggaagaggacaacatatt

SEQ ID NO: 273193 - DNA, 20 bp, human
gaaagtgaatctatcactcc

SEQ ID NO: 273194 - DNA, 20 bp, human
gtgcgcatgatagagaaggc

SEQ ID NO: 273195 - DNA, 20 bp, human
gtgccaaccacgagctgcca

SEQ ID NO: 273196 - DNA, 20 bp, human
gtgactgggcagagcgtgga

SEQ ID NO: 273197 - DNA, 20 bp, human
gggccagcacgcggagactg

SEQ ID NO: 273198 - DNA, 20 bp, human
gaaagaggggcgtgggcatg

SEQ ID NO: 273199 - DNA, 20 bp, human
ggatacggcgacgcgaaaga

SEQ ID NO: 273200 - DNA, 20 bp, human
gcggaagaggcagcaccgag

SEQ ID NO: 273201 - DNA, 20 bp, human
gggcgggcctgggtatgatt

SEQ ID NO: 273202 - DNA, 20 bp, human
gcctggcgcgacctcggata

SEQ ID NO: 273203 - DNA, 20 bp, human
gccagggcctggcgcgacct

SEQ ID NO: 273204 - DNA, 20 bp, human
gggcggagactcccaggcga

SEQ ID NO: 273205 - DNA, 20 bp, human
ggtggagggcggagactccc

SEQ ID NO: 273206 - DNA, 20 bp, human
gggagcgcggagccaactcg

SEQ ID NO: 273207 - DNA, 20 bp, human
gacaaccaaaactaacgcaa

SEQ ID NO: 273208 - DNA, 20 bp, human
ggagaaagaccacaccccac

SEQ ID NO: 273209 - DNA, 20 bp, human
gtgacacaactcatagaagg

SEQ ID NO: 273210 - DNA, 20 bp, human
gcgcgggagaaaaatcctat

SEQ ID NO: 273211 - DNA, 20 bp, human
gtgaagaagtaagtgatcct

SEQ ID NO: 273212 - DNA, 20 bp, human
gaccacaccccacgggagcg

SEQ ID NO: 273213 - DNA, 20 bp, human
gggctgacacaactcataga

SEQ ID NO: 273214 - DNA, 20 bp, human
gcaaccgcccgggtaagcgg

SEQ ID NO: 273215 - DNA, 20 bp, human
gctaggagttgaagggtcag

SEQ ID NO: 273216 - DNA, 20 bp, human
gaacacgcggggtctgcgac

SEQ ID NO: 273217 - DNA, 20 bp, human
ggcagagtctgcgaacacgc

SEQ ID NO: 273218 - DNA, 20 bp, human
gggaaatgtagtttcgccgg

SEQ ID NO: 273219 - DNA, 20 bp, human
gaacgccttgcggggcagtg

SEQ ID NO: 273220 - DNA, 20 bp, human
gaaaacccggaaacgccttg

SEQ ID NO: 273221 - DNA, 20 bp, human
gtgttcgcagactctgccgc

SEQ ID NO: 273222 - DNA, 20 bp, human
gtgccccgcaaggcgtttcc

SEQ ID NO: 273223 - DNA, 20 bp, human
gacctcccaggtgcactccc

SEQ ID NO: 273224 - DNA, 20 bp, human
gctgggaaatgtagtttcgc

SEQ ID NO: 273225 - DNA, 20 bp, human
gtctgcgactggaaagcccc

SEQ ID NO: 273226 - DNA, 20 bp, human
ggggcacgacccacttcctc

SEQ ID NO: 273227 - DNA, 20 bp, human
ggccgccagccctcagtgtc

SEQ ID NO: 273228 - DNA, 20 bp, human
gagtgtcaggctccctgcaa

SEQ ID NO: 273229 - DNA, 20 bp, human
gcaagggtggaaggagcccg

SEQ ID NO: 273230 - DNA, 20 bp, human
gggctccttccacccttgca

SEQ ID NO: 273231 - DNA, 20 bp, human
gctcaccgggcagttggggg

SEQ ID NO: 273232 - DNA, 20 bp, human
gaggcaggaaagcgttgatg

SEQ ID NO: 273233 - DNA, 20 bp, human
gggagcctgacactgagggc

SEQ ID NO: 273234 - DNA, 20 bp, human
gcggcgaggccatgtgatgc

SEQ ID NO: 273235 - DNA, 20 bp, human
gtgccccttagaagactgag

SEQ ID NO: 273236 - DNA, 20 bp, human
gtcggctgggagcctcgtgg

SEQ ID NO: 273237 - DNA, 20 bp, human
gtgggcgggtccaatcggct

SEQ ID NO: 273238 - DNA, 20 bp, human
gactcacctcagcctccacg

SEQ ID NO: 273239 - DNA, 20 bp, human
gagtcctggaggtgcgtggt

SEQ ID NO: 273240 - DNA, 20 bp, human
gtcttgtgggcgggtccaat

SEQ ID NO: 273241 - DNA, 20 bp, human
gtccggaacggacccggaag

SEQ ID NO: 273242 - DNA, 20 bp, human
ggcggaagaggcttccggaa

SEQ ID NO: 273243 - DNA, 20 bp, human
ggggagcctcgtggaggctg

SEQ ID NO: 273244 - DNA, 20 bp, human
ggaggcttccggaacggacc

SEQ ID NO: 273245 - DNA, 20 bp, human
gagggaacctctggcggaag

SEQ ID NO: 273246 - DNA, 20 bp, human
ggctccatggcaacggggga

SEQ ID NO: 273247 - DNA, 20 bp, human
ggattcgcagcgccagtggg

SEQ ID NO: 273248 - DNA, 20 bp, human
gagccgctccatggcaacgg

SEQ ID NO: 273249 - DNA, 20 bp, human
gtaaagctgtaggactggaa

SEQ ID NO: 273250 - DNA, 20 bp, human
gtcggccgcccagccaatca

SEQ ID NO: 273251 - DNA, 20 bp, human
ggcccagccaatcagggatc

SEQ ID NO: 273252 - DNA, 20 bp, human
ggaccagcgccgcacaatgg

SEQ ID NO: 273253 - DNA, 20 bp, human
gctcctaggcgagaaaagga

SEQ ID NO: 273254 - DNA, 20 bp, human
gcctaggagtctgaacgccc

SEQ ID NO: 273255 - DNA, 20 bp, human
ggcagcagacacatccagag

SEQ ID NO: 273256 - DNA, 20 bp, human
gggtccttgagaaggagcga

SEQ ID NO: 273257 - DNA, 20 bp, human
gcggtgcgcggggtctctcg

SEQ ID NO: 273258 - DNA, 20 bp, human
gcagagaaacccaggcgcgg

SEQ ID NO: 273259 - DNA, 20 bp, human
gcagctgcggcgcgtgacgc

SEQ ID NO: 273260 - DNA, 20 bp, human
gtcacgcgccgcagctgggc

SEQ ID NO: 273261 - DNA, 20 bp, human
gtctcggggtccaggtccaa

SEQ ID NO: 273262 - DNA, 20 bp, human
gcggctccgtcggctaccgc

SEQ ID NO: 273263 - DNA, 20 bp, human
ggctccaagaacggtgaggt

SEQ ID NO: 273264 - DNA, 20 bp, human
gtcccgcattcaggaggcgt

SEQ ID NO: 273265 - DNA, 20 bp, human
ggtcacgggcacggcgcggt

SEQ ID NO: 273266 - DNA, 20 bp, human
gcccctgtgaggaccagaga

SEQ ID NO: 273267 - DNA, 20 bp, human
ggggctgggcggcagttgga

SEQ ID NO: 273268 - DNA, 20 bp, human
gctgggcggcagttggaggg

SEQ ID NO: 273269 - DNA, 20 bp, human
gcggccggctgcgccctcga

SEQ ID NO: 273270 - DNA, 20 bp, human
gtgcgcgccccggacctctg

SEQ ID NO: 273271 - DNA, 20 bp, human
gcgcagccgggtcccctcga

SEQ ID NO: 273272 - DNA, 20 bp, human
gtcggcgccgcagcctgccc

SEQ ID NO: 273273 - DNA, 20 bp, human
gggtctcgggctctcggctg

SEQ ID NO: 273274 - DNA, 20 bp, human
gtgtgtgcgcccagttgcct

SEQ ID NO: 273275 - DNA, 20 bp, human
gccagcccccctcgcagcca

SEQ ID NO: 273276 - DNA, 20 bp, human
gccggcccccgtgtcgtcag

SEQ ID NO: 273277 - DNA, 20 bp, human
gctgtcatccgaggcgagag

SEQ ID NO: 273278 - DNA, 20 bp, human
gccggctccctctctcgcct

SEQ ID NO: 273279 - DNA, 20 bp, human
ggcgggggggcggatataga

SEQ ID NO: 273280 - DNA, 20 bp, human
gcgggggccggggctataaa

SEQ ID NO: 273281 - DNA, 20 bp, human
ggctataaagggcctggccc

SEQ ID NO: 273282 - DNA, 20 bp, human
gtctattcctcggctctctc

SEQ ID NO: 273283 - DNA, 20 bp, human
gcgccggagtcccgcgggga

SEQ ID NO: 273284 - DNA, 20 bp, human
ggaggcagcgctgtcatccg

SEQ ID NO: 273285 - DNA, 20 bp, human
ggaagagacagagatatgag

SEQ ID NO: 273286 - DNA, 20 bp, human
gggcgctcctagtaaagcta

SEQ ID NO: 273287 - DNA, 20 bp, human
gcggagacggacaaagtccg

SEQ ID NO: 273288 - DNA, 20 bp, human
ggggtctgggggtgtattta

SEQ ID NO: 273289 - DNA, 20 bp, human
gtagggggaggatctttagg

SEQ ID NO: 273290 - DNA, 20 bp, human
gagaagagaggaaatcccat

SEQ ID NO: 273291 - DNA, 20 bp, human
gggggaggatctttaggtgg

SEQ ID NO: 273292 - DNA, 20 bp, human
gcaaagtccggggactataa

SEQ ID NO: 273293 - DNA, 20 bp, human
ggagggcgggactgagcagg

SEQ ID NO: 273294 - DNA, 20 bp, human
gtatcctcttcctcgatatg

SEQ ID NO: 273295 - DNA, 20 bp, human
gcagacaagagtttaagagg

SEQ ID NO: 273296 - DNA, 20 bp, human
gccgcctgcagtctcctctc

SEQ ID NO: 273297 - DNA, 20 bp, human
gcgggcctaagatgtgtcct

SEQ ID NO: 273298 - DNA, 20 bp, human
gaggaccagataagcacaag

SEQ ID NO: 273299 - DNA, 20 bp, human
ggtgccccaggacacatctt

SEQ ID NO: 273300 - DNA, 20 bp, human
gatgtgtcctggggcactgt

SEQ ID NO: 273301 - DNA, 20 bp, human
gacctccaggcacccccagt

SEQ ID NO: 273302 - DNA, 20 bp, human
gtgctctgaaggaaccgtcc

SEQ ID NO: 273303 - DNA, 20 bp, human
ggctggctggctccctacag

SEQ ID NO: 273304 - DNA, 20 bp, human
gaacatctgacaaacacaca

SEQ ID NO: 273305 - DNA, 20 bp, human
gacgtcggagcgcggcatcg

SEQ ID NO: 273306 - DNA, 20 bp, human
gccagctcctcaaaggccat

SEQ ID NO: 273307 - DNA, 20 bp, human
gtgaccctccggccgcaggt

SEQ ID NO: 273308 - DNA, 20 bp, human
gggtcacatgaggctcacga

SEQ ID NO: 273309 - DNA, 20 bp, human
ggcggccggagggtcacatg

SEQ ID NO: 273310 - DNA, 20 bp, human
gtgagcctcatgtgaccctc

SEQ ID NO: 273311 - DNA, 20 bp, human
gatgtgcacggtgctgagat

SEQ ID NO: 273312 - DNA, 20 bp, human
gaacaaagattaccaatgca

SEQ ID NO: 273313 - DNA, 20 bp, human
gtaaattctacaacaatgtg

SEQ ID NO: 273314 - DNA, 20 bp, human
gtctcttgctctactcttcc

SEQ ID NO: 273315 - DNA, 20 bp, human
gaagtttatgaatctgtgtg

SEQ ID NO: 273316 - DNA, 20 bp, human
gctgactgagggcttgaagg

SEQ ID NO: 273317 - DNA, 20 bp, human
gctcctgcacaactgactga

SEQ ID NO: 273318 - DNA, 20 bp, human
gcttgaaggaggcttgtata

SEQ ID NO: 273319 - DNA, 20 bp, human
ggaaaggattcaaaactagg

SEQ ID NO: 273320 - DNA, 20 bp, human
gtcgaggccatggctcacgg

SEQ ID NO: 273321 - DNA, 20 bp, human
gcaggagcccccgtgagcca

SEQ ID NO: 273322 - DNA, 20 bp, human
ggtgagccatggcctcgaaa

SEQ ID NO: 273323 - DNA, 20 bp, human
gctccacggggcagactcag

SEQ ID NO: 273324 - DNA, 20 bp, human
ggaggcttgtataaggctga

SEQ ID NO: 273325 - DNA, 20 bp, human
ggcagcgggactctaggctt

SEQ ID NO: 273326 - DNA, 20 bp, human
ggcaagcgctgaccggggga

SEQ ID NO: 273327 - DNA, 20 bp, human
gtcgccgggaggggaggaat

SEQ ID NO: 273328 - DNA, 20 bp, human
gcccccgcgggacgcgcgcg

SEQ ID NO: 273329 - DNA, 20 bp, human
gggccgcaagcgctgaccgg

SEQ ID NO: 273330 - DNA, 20 bp, human
gcgcgcgcggggttgccggg

SEQ ID NO: 273331 - DNA, 20 bp, human
gcaaccccgcgcgcgtcccg

SEQ ID NO: 273332 - DNA, 20 bp, human
gagagccgggtggtgcgggc

SEQ ID NO: 273333 - DNA, 20 bp, human
ggcccgtggccggggagcaa

SEQ ID NO: 273334 - DNA, 20 bp, human
gggaggagagccgggtggtg

SEQ ID NO: 273335 - DNA, 20 bp, human
gggcggggccggggtttgtg

SEQ ID NO: 273336 - DNA, 20 bp, human
gcatccggggcgcccgacgg

SEQ ID NO: 273337 - DNA, 20 bp, human
gcagtaggggcgaaaggcaa

SEQ ID NO: 273338 - DNA, 20 bp, human
gtggcatccggggcgcccga

SEQ ID NO: 273339 - DNA, 20 bp, human
gccgccgccgtcgggcgccc

SEQ ID NO: 273340 - DNA, 20 bp, human
gggtcgtggccgccgccgtc

SEQ ID NO: 273341 - DNA, 20 bp, human
ggagcagctgggctcggccg

SEQ ID NO: 273342 - DNA, 20 bp, human
gggcggcggccacgacccct

SEQ ID NO: 273343 - DNA, 20 bp, human
gagccaaggcctggcatccg

SEQ ID NO: 273344 - DNA, 20 bp, human
gcggccttcgccagtcgcca

SEQ ID NO: 273345 - DNA, 20 bp, human
gggcgccccctgcgggtcca

SEQ ID NO: 273346 - DNA, 20 bp, human
gccggcctagagtggagacc

SEQ ID NO: 273347 - DNA, 20 bp, human
gtgggggcgtagcgctgcgg

SEQ ID NO: 273348 - DNA, 20 bp, human
gtgccgcggggaggcgtgtc

SEQ ID NO: 273349 - DNA, 20 bp, human
gagggcgcgttggtcttggg

SEQ ID NO: 273350 - DNA, 20 bp, human
gagtggcagtcgcttggcga

SEQ ID NO: 273351 - DNA, 20 bp, human
gcgccccctgctgaaagctc

SEQ ID NO: 273352 - DNA, 20 bp, human
gtgctccgggcgttgggcgg

SEQ ID NO: 273353 - DNA, 20 bp, human
ggggaggcgtgtcgggaggc

SEQ ID NO: 273354 - DNA, 20 bp, human
gcggagggcgcgttggtctt

SEQ ID NO: 273355 - DNA, 20 bp, human
gtccactctaggccggggtg

SEQ ID NO: 273356 - DNA, 20 bp, human
gacgaacgagtcaaccggat

SEQ ID NO: 273357 - DNA, 20 bp, human
ggctgggctgggaaaggata

SEQ ID NO: 273358 - DNA, 20 bp, human
gggaaaggataaggagtgca

SEQ ID NO: 273359 - DNA, 20 bp, human
gtaggggcgccccgctgggc

SEQ ID NO: 273360 - DNA, 20 bp, human
gcagaccccactcacgcaca

SEQ ID NO: 273361 - DNA, 20 bp, human
gaccggatcggtgactgtgg

SEQ ID NO: 273362 - DNA, 20 bp, human
gcgtggaccctgggaggcta

SEQ ID NO: 273363 - DNA, 20 bp, human
ggataggcgcgctgctcgaa

SEQ ID NO: 273364 - DNA, 20 bp, human
gtctggttgtgcagtgttcg

SEQ ID NO: 273365 - DNA, 20 bp, human
ggaagcgccgcagtccccgc

SEQ ID NO: 273366 - DNA, 20 bp, human
gcccgcgcacggattcttcc

SEQ ID NO: 273367 - DNA, 20 bp, human
ggctcgccgagagtctagag

SEQ ID NO: 273368 - DNA, 20 bp, human
gccgcgcctctctagactct

SEQ ID NO: 273369 - DNA, 20 bp, human
gccgcgccgagactcccggg

SEQ ID NO: 273370 - DNA, 20 bp, human
gcatccgcggagaccgggag

SEQ ID NO: 273371 - DNA, 20 bp, human
gcgcgctggtgctgtggccc

SEQ ID NO: 273372 - DNA, 20 bp, human
ggcggggcgcgggaagaggc

SEQ ID NO: 273373 - DNA, 20 bp, human
gtcttcctgggccgcagcac

SEQ ID NO: 273374 - DNA, 20 bp, human
gccgctgcggcagcctgggg

SEQ ID NO: 273375 - DNA, 20 bp, human
ggccccgccgcaaccggcag

SEQ ID NO: 273376 - DNA, 20 bp, human
ggcgggagtcagaacggtgg

SEQ ID NO: 273377 - DNA, 20 bp, human
gtggttcgggaggcggcgcg

SEQ ID NO: 273378 - DNA, 20 bp, human
ggcgctcccggcactctaat

SEQ ID NO: 273379 - DNA, 20 bp, human
gtctcgcgagaggaaaaggg

SEQ ID NO: 273380 - DNA, 20 bp, human
ggccgcctcccgaaccaccg

SEQ ID NO: 273381 - DNA, 20 bp, human
gcagaggccgcaaggggaac

SEQ ID NO: 273382 - DNA, 20 bp, human
ggcctctcgcgagaggaaaa

SEQ ID NO: 273383 - DNA, 20 bp, human
gagtgccgggagcgcctgat

SEQ ID NO: 273384 - DNA, 20 bp, human
gaccgtggcagaggccgcaa

SEQ ID NO: 273385 - DNA, 20 bp, human
gacggcgggagtcagaacgg

SEQ ID NO: 273386 - DNA, 20 bp, human
gcactcacaatcagacattg

SEQ ID NO: 273387 - DNA, 20 bp, human
gcatgccttgttatcaactg

SEQ ID NO: 273388 - DNA, 20 bp, human
ggttatcaactgcggaatgc

SEQ ID NO: 273389 - DNA, 20 bp, human
ggccaccgcgcctaaaatgc

SEQ ID NO: 273390 - DNA, 20 bp, human
gcaggatgcaatttaagata

SEQ ID NO: 273391 - DNA, 20 bp, human
ggcatcctgcattttaggcg

SEQ ID NO: 273392 - DNA, 20 bp, human
gaaattgcatcctgcatttt

SEQ ID NO: 273393 - DNA, 20 bp, human
ggtttgaaaaacgtcgcttc

SEQ ID NO: 273394 - DNA, 20 bp, human
gtcctgcattttaggcgcgg

SEQ ID NO: 273395 - DNA, 20 bp, human
gttttttatttaggcctaat

SEQ ID NO: 273396 - DNA, 20 bp, human
ggagtcccgtgaagacatga

SEQ ID NO: 273397 - DNA, 20 bp, human
ggggtcgggaggcgtcggct

SEQ ID NO: 273398 - DNA, 20 bp, human
gccccgcctcgggaactcca

SEQ ID NO: 273399 - DNA, 20 bp, human
ggcaccccggccccccgcct

SEQ ID NO: 273400 - DNA, 20 bp, human
gcccgcgcgccgcactggga

SEQ ID NO: 273401 - DNA, 20 bp, human
gggctggtcttctagagccc

SEQ ID NO: 273402 - DNA, 20 bp, human
gtcttctagagcccgggctg

SEQ ID NO: 273403 - DNA, 20 bp, human
gggcgccctcatgtcttcac

SEQ ID NO: 273404 - DNA, 20 bp, human
gggtgcgagtgggcgacgcg

SEQ ID NO: 273405 - DNA, 20 bp, human
gggaggccctggagttcccg

SEQ ID NO: 273406 - DNA, 20 bp, human
gccccgcctcgggaactcca

SEQ ID NO: 273407 - DNA, 20 bp, human
gggagaaggcgctagccccg

SEQ ID NO: 273408 - DNA, 20 bp, human
ggcaccccggccccccgcct

SEQ ID NO: 273409 - DNA, 20 bp, human
gaatgtgcggcgctctgcgc

SEQ ID NO: 273410 - DNA, 20 bp, human
gggtgcgagtgggcgacgcg

SEQ ID NO: 273411 - DNA, 20 bp, human
ggggtcgggaggcgtcggct

SEQ ID NO: 273412 - DNA, 20 bp, human
gtgcgcgggccagccgaaag

SEQ ID NO: 273413 - DNA, 20 bp, human
gaaaaatcgagaggaatgtg

SEQ ID NO: 273414 - DNA, 20 bp, human
gctgcctgggagcacgagac

SEQ ID NO: 273415 - DNA, 20 bp, human
ggggtggatcaaaaatcgag

SEQ ID NO: 273416 - DNA, 20 bp, human
gagagggagcttaatgttgc

SEQ ID NO: 273417 - DNA, 20 bp, human
ggagttacatgattgggaaa

SEQ ID NO: 273418 - DNA, 20 bp, human
gagggcttgagttacatgat

SEQ ID NO: 273419 - DNA, 20 bp, human
gagattctaacagttgacac

SEQ ID NO: 273420 - DNA, 20 bp, human
gtggagttagttagaacaag

SEQ ID NO: 273421 - DNA, 20 bp, human
gtgatggctacaaatagaca

SEQ ID NO: 273422 - DNA, 20 bp, human
gaacatccatacactggaga

SEQ ID NO: 273423 - DNA, 20 bp, human
ggtcagaaacatccatacac

SEQ ID NO: 273424 - DNA, 20 bp, human
gaacccccacaaaaacagtg

SEQ ID NO: 273425 - DNA, 20 bp, human
gaatctcttttcatgagttc

SEQ ID NO: 273426 - DNA, 20 bp, human
gccaaagggacagagaggta

SEQ ID NO: 273427 - DNA, 20 bp, human
ggacagtcacaggggtgttg

SEQ ID NO: 273428 - DNA, 20 bp, human
gtgtgcttggacagtcacag

SEQ ID NO: 273429 - DNA, 20 bp, human
ggacgcctgtgtgacatact

SEQ ID NO: 273430 - DNA, 20 bp, human
gcaaaggaaaggtttgccta

SEQ ID NO: 273431 - DNA, 20 bp, human
gaattcccagtatgtcacac

SEQ ID NO: 273432 - DNA, 20 bp, human
gcaaggtgtgacttgtccaa

SEQ ID NO: 273433 - DNA, 20 bp, human
gggcaaacctttcctttgta

SEQ ID NO: 273434 - DNA, 20 bp, human
gcacatccacaccttgccct

SEQ ID NO: 273435 - DNA, 20 bp, human
gtatttccaaagggacagag

SEQ ID NO: 273436 - DNA, 20 bp, human
gcgctctccggctcccgtgt

SEQ ID NO: 273437 - DNA, 20 bp, human
ggcggcagtagcaacgacgg

SEQ ID NO: 273438 - DNA, 20 bp, human
gatctctgcaggttcctaca

SEQ ID NO: 273439 - DNA, 20 bp, human
gtaggaacctgcagagatcc

SEQ ID NO: 273440 - DNA, 20 bp, human
gcagcgccccagcaacaaag

SEQ ID NO: 273441 - DNA, 20 bp, human
ggcaccagtggcaccggctg

SEQ ID NO: 273442 - DNA, 20 bp, human
gagggtccgtccacagagct

SEQ ID NO: 273443 - DNA, 20 bp, human
gtgccgcagcggagttcaga

SEQ ID NO: 273444 - DNA, 20 bp, human
gggccctctgaactccgctg

SEQ ID NO: 273445 - DNA, 20 bp, human
ggacaagtgcgctgcaccag

SEQ ID NO: 273446 - DNA, 20 bp, human
gggcctgggcacagcccggg

SEQ ID NO: 273447 - DNA, 20 bp, human
gccccggcagtgactgggag

SEQ ID NO: 273448 - DNA, 20 bp, human
gcgggaagctggtgtgtgtg

SEQ ID NO: 273449 - DNA, 20 bp, human
gcaaagccccggcagtgact

SEQ ID NO: 273450 - DNA, 20 bp, human
gctgtgtgggtcctctccca

SEQ ID NO: 273451 - DNA, 20 bp, human
gcactgccggggctttgtcc

SEQ ID NO: 273452 - DNA, 20 bp, human
gttactcgctggcggtcagg

SEQ ID NO: 273453 - DNA, 20 bp, human
ggactcatagggctgaaccg

SEQ ID NO: 273454 - DNA, 20 bp, human
gcagagcagctgcaggcctt

SEQ ID NO: 273455 - DNA, 20 bp, human
gtcagggaggcgagggctga

SEQ ID NO: 273456 - DNA, 20 bp, human
gcctggggatatgagagcca

SEQ ID NO: 273457 - DNA, 20 bp, human
gctgaagctggggtagtgtc

SEQ ID NO: 273458 - DNA, 20 bp, human
ggaggtgaggcaagtagccc

SEQ ID NO: 273459 - DNA, 20 bp, human
gcccccagcagccccgtcct

SEQ ID NO: 273460 - DNA, 20 bp, human
gccgtcctgggctacatgag

SEQ ID NO: 273461 - DNA, 20 bp, human
gaagctggggtagtgtcagg

SEQ ID NO: 273462 - DNA, 20 bp, human
gtggctccaagccagcccag

SEQ ID NO: 273463 - DNA, 20 bp, human
gtgcagggttcggctgaagc

SEQ ID NO: 273464 - DNA, 20 bp, human
ggcccaggacggggctgctg

SEQ ID NO: 273465 - DNA, 20 bp, human
gcacccccagccagttagac

SEQ ID NO: 273466 - DNA, 20 bp, human
gttaccggacatttaaaagg

SEQ ID NO: 273467 - DNA, 20 bp, human
gcagtctgggcctcaaactt

SEQ ID NO: 273468 - DNA, 20 bp, human
ggccccaccttttaaatgtc

SEQ ID NO: 273469 - DNA, 20 bp, human
gggtatgctctctttgtttt

SEQ ID NO: 273470 - DNA, 20 bp, human
gaccttaccggacatttaaa

SEQ ID NO: 273471 - DNA, 20 bp, human
gtcagccttgctctggcacg

SEQ ID NO: 273472 - DNA, 20 bp, human
gcaaagagagcataccttac

SEQ ID NO: 273473 - DNA, 20 bp, human
gttgaactaagttattaaca

SEQ ID NO: 273474 - DNA, 20 bp, human
gtaaaataaagaggtagcct

SEQ ID NO: 273475 - DNA, 20 bp, human
ggggctctgagccaaggctg

SEQ ID NO: 273476 - DNA, 20 bp, human
gggccgcaggagccaatccg

SEQ ID NO: 273477 - DNA, 20 bp, human
gcccggccggctgcgggcag

SEQ ID NO: 273478 - DNA, 20 bp, human
gcaggagccaatccgagggt

SEQ ID NO: 273479 - DNA, 20 bp, human
gaggacaatggcggggctgg

SEQ ID NO: 273480 - DNA, 20 bp, human
gggggctgggggttcggaac

SEQ ID NO: 273481 - DNA, 20 bp, human
gtccgctcccaccctcggat

SEQ ID NO: 273482 - DNA, 20 bp, human
gggcggggcggacaatggag

SEQ ID NO: 273483 - DNA, 20 bp, human
gtgcgcggccccgcccggac

SEQ ID NO: 273484 - DNA, 20 bp, human
gtgggtggcggggatgacag

SEQ ID NO: 273485 - DNA, 20 bp, human
gcggaaagcggattctacct

SEQ ID NO: 273486 - DNA, 20 bp, human
gtctgcagaggagcgggagc

SEQ ID NO: 273487 - DNA, 20 bp, human
gcagtgacgcggcccaaggg

SEQ ID NO: 273488 - DNA, 20 bp, human
gggaggggcccgacgctccg

SEQ ID NO: 273489 - DNA, 20 bp, human
ggcagctcgcctgccaaacc

SEQ ID NO: 273490 - DNA, 20 bp, human
gcccgcggcaaccgctcctg

SEQ ID NO: 273491 - DNA, 20 bp, human
ggccggctccaagcggtcct

SEQ ID NO: 273492 - DNA, 20 bp, human
ggaggcggggccgtgagtcc

SEQ ID NO: 273493 - DNA, 20 bp, human
ggggctccgccccggagcgt

SEQ ID NO: 273494 - DNA, 20 bp, human
ggttcccagccgggtttggc

SEQ ID NO: 273495 - DNA, 20 bp, human
gcctaggcgagctggaggcg

SEQ ID NO: 273496 - DNA, 20 bp, human
ggaaaagccccgcggcgggt

SEQ ID NO: 273497 - DNA, 20 bp, human
gtcacggaaaagccccgcgg

SEQ ID NO: 273498 - DNA, 20 bp, human
gacgtcacggaaaagccccg

SEQ ID NO: 273499 - DNA, 20 bp, human
gcgcaagtgctttgctggga

SEQ ID NO: 273500 - DNA, 20 bp, human
ggtcgggataaaggatggaa

SEQ ID NO: 273501 - DNA, 20 bp, human
gagtaactgatttagccaag

SEQ ID NO: 273502 - DNA, 20 bp, human
gttgcgagctgtcgggataa

SEQ ID NO: 273503 - DNA, 20 bp, human
gaagggaaacaaagccttgt

SEQ ID NO: 273504 - DNA, 20 bp, human
gcagccaccttgaatagcca

SEQ ID NO: 273505 - DNA, 20 bp, human
gtatccagaagaaggtgaca

SEQ ID NO: 273506 - DNA, 20 bp, human
gtcccccctacccccaataa

SEQ ID NO: 273507 - DNA, 20 bp, human
gtgcccactgcaaccctggc

SEQ ID NO: 273508 - DNA, 20 bp, human
gaaccctggctggactggac

SEQ ID NO: 273509 - DNA, 20 bp, human
gggactggacaggcacttat

SEQ ID NO: 273510 - DNA, 20 bp, human
ggctccaaacctagacaccc

SEQ ID NO: 273511 - DNA, 20 bp, human
gccctacccccaataatggc

SEQ ID NO: 273512 - DNA, 20 bp, human
gtacccccaataatggcagg

SEQ ID NO: 273513 - DNA, 20 bp, human
gatccacctgccattattgg

SEQ ID NO: 273514 - DNA, 20 bp, human
ggtggtatctgtgggtaaga

SEQ ID NO: 273515 - DNA, 20 bp, human
ggtccagccagggttgcagt

SEQ ID NO: 273516 - DNA, 20 bp, human
gggctccggtggtgtaataa

SEQ ID NO: 273517 - DNA, 20 bp, human
ggctgcttgcctcaaggtta

SEQ ID NO: 273518 - DNA, 20 bp, human
gctgcgctgtgacctagaat

SEQ ID NO: 273519 - DNA, 20 bp, human
gtaaggatccctcactacta

SEQ ID NO: 273520 - DNA, 20 bp, human
gctcaaggttaaggctccgg

SEQ ID NO: 273521 - DNA, 20 bp, human
gctaatagacaccttaggcg

SEQ ID NO: 273522 - DNA, 20 bp, human
gcgttcgaaccaattcagct

SEQ ID NO: 273523 - DNA, 20 bp, human
gagatcctttattacaccac

SEQ ID NO: 273524 - DNA, 20 bp, human
ggcgtactaatagacacctt

SEQ ID NO: 273525 - DNA, 20 bp, human
gtatgcatccctagtagtga

SEQ ID NO: 273526 - DNA, 20 bp, human
gccgctgggaccccggaaga

SEQ ID NO: 273527 - DNA, 20 bp, human
gtccggggtcccagcgggtc

SEQ ID NO: 273528 - DNA, 20 bp, human
ggggtctagtgagcgacgtc

SEQ ID NO: 273529 - DNA, 20 bp, human
gctgcccggcccctcttccg

SEQ ID NO: 273530 - DNA, 20 bp, human
ggcgacgtccgggtacctga

SEQ ID NO: 273531 - DNA, 20 bp, human
gtggcgcgagctgggcgggt

SEQ ID NO: 273532 - DNA, 20 bp, human
gggagggctctgccggaagg

SEQ ID NO: 273533 - DNA, 20 bp, human
ggggcacgcccggggttacc

SEQ ID NO: 273534 - DNA, 20 bp, human
gccaccagccctcaggtacc

SEQ ID NO: 273535 - DNA, 20 bp, human
gtaccgggtgagggtgaatg

SEQ ID NO: 273536 - DNA, 20 bp, human
gtccgccccaaccctggcta

SEQ ID NO: 273537 - DNA, 20 bp, human
gggaacgcaacgcgcggtgc

SEQ ID NO: 273538 - DNA, 20 bp, human
ggggaccacgcgtgctgcac

SEQ ID NO: 273539 - DNA, 20 bp, human
gagggccagtgcagcacgcg

SEQ ID NO: 273540 - DNA, 20 bp, human
gttgcgttcccgctaccgcc

SEQ ID NO: 273541 - DNA, 20 bp, human
gaggaggtccgccccaaccc

SEQ ID NO: 273542 - DNA, 20 bp, human
gaccgcgggctaggtactga

SEQ ID NO: 273543 - DNA, 20 bp, human
ggccctcagtacctagcccg

SEQ ID NO: 273544 - DNA, 20 bp, human
gtaacctcggggctgtgctc

SEQ ID NO: 273545 - DNA, 20 bp, human
gcctgaccctagccagggtt

SEQ ID NO: 273546 - DNA, 20 bp, human
gtcgcgggacctagagtgca

SEQ ID NO: 273547 - DNA, 20 bp, human
ggactctcagacctccaagt

SEQ ID NO: 273548 - DNA, 20 bp, human
gtccgtcgtggcaatggaga

SEQ ID NO: 273549 - DNA, 20 bp, human
gggacctagagtgcagggtg

SEQ ID NO: 273550 - DNA, 20 bp, human
gtgaaccgccatgtcctcta

SEQ ID NO: 273551 - DNA, 20 bp, human
gttggaggtctgagagtcgc

SEQ ID NO: 273552 - DNA, 20 bp, human
gtacaaaacagaggtttctg

SEQ ID NO: 273553 - DNA, 20 bp, human
gcgcaaagcatgctggtctc

SEQ ID NO: 273554 - DNA, 20 bp, human
ggaactgtccgtcgtggcaa

SEQ ID NO: 273555 - DNA, 20 bp, human
gaagtaggactacaaaacag

SEQ ID NO: 273556 - DNA, 20 bp, human
gagccagcccgcgaccacgt

SEQ ID NO: 273557 - DNA, 20 bp, human
ggcgggccaggtggcgaccc

SEQ ID NO: 273558 - DNA, 20 bp, human
gcactgccccacgtggtcgc

SEQ ID NO: 273559 - DNA, 20 bp, human
ggtggcgacccgggctgtgc

SEQ ID NO: 273560 - DNA, 20 bp, human
gaactcgcaggcaggaagat

SEQ ID NO: 273561 - DNA, 20 bp, human
gccgccgccactgccccacg

SEQ ID NO: 273562 - DNA, 20 bp, human
ggacctcggtgagtacaagg

SEQ ID NO: 273563 - DNA, 20 bp, human
gcacctggcccgcggctttg

SEQ ID NO: 273564 - DNA, 20 bp, human
gccagacgcccccaactcgc

SEQ ID NO: 273565 - DNA, 20 bp, human
gaagtgccccgcaaagccgc

SEQ ID NO: 273566 - DNA, 20 bp, human
gcgccccggcgctccactcg

SEQ ID NO: 273567 - DNA, 20 bp, human
ggagagggagctgcaccggg

SEQ ID NO: 273568 - DNA, 20 bp, human
gtaccccgagtggagcgccg

SEQ ID NO: 273569 - DNA, 20 bp, human
gaccgcaggcggtgcagtgc

SEQ ID NO: 273570 - DNA, 20 bp, human
gtaaaggctggaaacccggg

SEQ ID NO: 273571 - DNA, 20 bp, human
gtggaagcgcgcttccggtg

SEQ ID NO: 273572 - DNA, 20 bp, human
gagggaggcggctgttgccg

SEQ ID NO: 273573 - DNA, 20 bp, human
gccggaagctgcctgctaat

SEQ ID NO: 273574 - DNA, 20 bp, human
gggtgcagctccctctccgc

SEQ ID NO: 273575 - DNA, 20 bp, human
ggctaatcggctaccccgag

SEQ ID NO: 273576 - DNA, 20 bp, human
gccgcagtgaccggactcgg

SEQ ID NO: 273577 - DNA, 20 bp, human
ggctccgcagtgaccggact

SEQ ID NO: 273578 - DNA, 20 bp, human
gggcgcgggcggagcccgaa

SEQ ID NO: 273579 - DNA, 20 bp, human
gcgaaaccccgcaactgcgc

SEQ ID NO: 273580 - DNA, 20 bp, human
gccggcctctcagactccgg

SEQ ID NO: 273581 - DNA, 20 bp, human
gggccagcggcggtcagccg

SEQ ID NO: 273582 - DNA, 20 bp, human
gcgggcggctccgcagtgac

SEQ ID NO: 273583 - DNA, 20 bp, human
gaaagccgagcgggccccat

SEQ ID NO: 273584 - DNA, 20 bp, human
gcgcgccgccggagtctgag

SEQ ID NO: 273585 - DNA, 20 bp, human
gcactcacctcccccgagtc

SEQ ID NO: 273586 - DNA, 20 bp, human
gaggagtcgcgcgcagtcgg

SEQ ID NO: 273587 - DNA, 20 bp, human
ggctagctgcacgtgacctg

SEQ ID NO: 273588 - DNA, 20 bp, human
ggcccgacgcccttctacgg

SEQ ID NO: 273589 - DNA, 20 bp, human
gggccaccgtagaagggcgt

SEQ ID NO: 273590 - DNA, 20 bp, human
ggccgcccgacgcccttcta

SEQ ID NO: 273591 - DNA, 20 bp, human
gtgacctggggcgggtccgc

SEQ ID NO: 273592 - DNA, 20 bp, human
gctcgcgggccaccgtagaa

SEQ ID NO: 273593 - DNA, 20 bp, human
gagtcgcgcgcagtcggggg

SEQ ID NO: 273594 - DNA, 20 bp, human
gagctgcacgtgacctgggg

SEQ ID NO: 273595 - DNA, 20 bp, human
gggcaacacgtggcccaggg

SEQ ID NO: 273596 - DNA, 20 bp, human
ggggcacagtgacctcagtg

SEQ ID NO: 273597 - DNA, 20 bp, human
ggggccgcagcccagctatg

SEQ ID NO: 273598 - DNA, 20 bp, human
gtctccccatagctgggctg

SEQ ID NO: 273599 - DNA, 20 bp, human
gagtgacctcagtggggtga

SEQ ID NO: 273600 - DNA, 20 bp, human
gaccccctcaggctatgcca

SEQ ID NO: 273601 - DNA, 20 bp, human
gaccccctggcatagcctga

SEQ ID NO: 273602 - DNA, 20 bp, human
gaccctctctctaggaaggt

SEQ ID NO: 273603 - DNA, 20 bp, human
ggcacgccaactcctgcatg

SEQ ID NO: 273604 - DNA, 20 bp, human
ggggagctctccccatagct

SEQ ID NO: 273605 - DNA, 20 bp, human
ggtacctggagccagaccat

SEQ ID NO: 273606 - DNA, 20 bp, human
ggccttgcgtggtggacaga

SEQ ID NO: 273607 - DNA, 20 bp, human
gagcacaaggatgtgatgtg

SEQ ID NO: 273608 - DNA, 20 bp, human
gtgaggcaggacccacctgg

SEQ ID NO: 273609 - DNA, 20 bp, human
gggggtggtgagataacact

SEQ ID NO: 273610 - DNA, 20 bp, human
gagacggggcagaggccacc

SEQ ID NO: 273611 - DNA, 20 bp, human
ggactccttaatgacctgca

SEQ ID NO: 273612 - DNA, 20 bp, human
gtaaccacagctgccttgcg

SEQ ID NO: 273613 - DNA, 20 bp, human
gtagcgtcatgcctggcgag

SEQ ID NO: 273614 - DNA, 20 bp, human
ggcctcgtggtggtggacct

SEQ ID NO: 273615 - DNA, 20 bp, human
gccccaggtccaccaccacg

SEQ ID NO: 273616 - DNA, 20 bp, human
gctggccgggcccgaggaca

SEQ ID NO: 273617 - DNA, 20 bp, human
gtgcttgcgggcccgtgtgg

SEQ ID NO: 273618 - DNA, 20 bp, human
ggccctcaggcgtcgatccg

SEQ ID NO: 273619 - DNA, 20 bp, human
gagcgcgcggccacaggagc

SEQ ID NO: 273620 - DNA, 20 bp, human
ggaggggcgcgtccacccgc

SEQ ID NO: 273621 - DNA, 20 bp, human
gcaggagggtcggaccctgc

SEQ ID NO: 273622 - DNA, 20 bp, human
ggcaacccctgcgtgcgccg

SEQ ID NO: 273623 - DNA, 20 bp, human
gttgcgggcccgtgtggagg

SEQ ID NO: 273624 - DNA, 20 bp, human
ggcgcgcgccgtgctcgcgg

SEQ ID NO: 273625 - DNA, 20 bp, human
ggacgcctgagggcgccagc

SEQ ID NO: 273626 - DNA, 20 bp, human
ggcgcccggccgcccgacgg

SEQ ID NO: 273627 - DNA, 20 bp, human
gagaactgggaggactacta

SEQ ID NO: 273628 - DNA, 20 bp, human
gactaaggggcgcgcgggac

SEQ ID NO: 273629 - DNA, 20 bp, human
gtctccctgtgggtcggcag

SEQ ID NO: 273630 - DNA, 20 bp, human
gacctgctcccaacccccgt

SEQ ID NO: 273631 - DNA, 20 bp, human
gcgcgcgggacgggctggaa

SEQ ID NO: 273632 - DNA, 20 bp, human
gcggccgcccgacgggggtt

SEQ ID NO: 273633 - DNA, 20 bp, human
gtgcgcaagtggccaggcgg

SEQ ID NO: 273634 - DNA, 20 bp, human
ggctcccaacccccgtcggg

SEQ ID NO: 273635 - DNA, 20 bp, human
gggactactaaggggcgcgc

SEQ ID NO: 273636 - DNA, 20 bp, human
gagggcggggacacgcggat

SEQ ID NO: 273637 - DNA, 20 bp, human
ggcgatgagtagctgagttg

SEQ ID NO: 273638 - DNA, 20 bp, human
ggggacacgcggatcggttt

SEQ ID NO: 273639 - DNA, 20 bp, human
gcggggatgcccagtggtcg

SEQ ID NO: 273640 - DNA, 20 bp, human
ggagagctgtagttcccatc

SEQ ID NO: 273641 - DNA, 20 bp, human
gctccggcaatcaaactccc

SEQ ID NO: 273642 - DNA, 20 bp, human
gttggggtaacccacccgat

SEQ ID NO: 273643 - DNA, 20 bp, human
gcctgcctggctgtgcttta

SEQ ID NO: 273644 - DNA, 20 bp, human
ggcgagcttcgctaggaaag

SEQ ID NO: 273645 - DNA, 20 bp, human
gagcttcgctaggaaagggg

SEQ ID NO: 273646 - DNA, 20 bp, human
ggctcccgcgctctcttcat

SEQ ID NO: 273647 - DNA, 20 bp, human
gcagccaatgaagagagcgc

SEQ ID NO: 273648 - DNA, 20 bp, human
gcgtgccgctccaagtgtcg

SEQ ID NO: 273649 - DNA, 20 bp, human
gcagattgaaaatcagggag

SEQ ID NO: 273650 - DNA, 20 bp, human
gtaaccctcgacacttggag

SEQ ID NO: 273651 - DNA, 20 bp, human
ggagaaattcagaatttcgc

SEQ ID NO: 273652 - DNA, 20 bp, human
gttgcttatcaaaactttcc

SEQ ID NO: 273653 - DNA, 20 bp, human
gtaaaactcgattttgcata

SEQ ID NO: 273654 - DNA, 20 bp, human
gatttctaaccctcgacact

SEQ ID NO: 273655 - DNA, 20 bp, human
gtcagggaggggaacagaag

SEQ ID NO: 273656 - DNA, 20 bp, human
gcgcgcgccgtctgccgact

SEQ ID NO: 273657 - DNA, 20 bp, human
ggacggcgcgcgagcagcgt

SEQ ID NO: 273658 - DNA, 20 bp, human
ggctcccagtaagacggcat

SEQ ID NO: 273659 - DNA, 20 bp, human
gtaagacggcataggtatat

SEQ ID NO: 273660 - DNA, 20 bp, human
ggaaagaagagcaactggat

SEQ ID NO: 273661 - DNA, 20 bp, human
gagaagagcaactggattgg

SEQ ID NO: 273662 - DNA, 20 bp, human
gtgcactttctcttccaagt

SEQ ID NO: 273663 - DNA, 20 bp, human
gtaggtatatgggtgaggga

SEQ ID NO: 273664 - DNA, 20 bp, human
gttccggggcaaaggacgcg

SEQ ID NO: 273665 - DNA, 20 bp, human
ggaagcggtcaaagtcacgc

SEQ ID NO: 273666 - DNA, 20 bp, human
gactctggggcgctggggta

SEQ ID NO: 273667 - DNA, 20 bp, human
gaaagagtcaccctttaaaa

SEQ ID NO: 273668 - DNA, 20 bp, human
ggaaaaggatggtagacccg

SEQ ID NO: 273669 - DNA, 20 bp, human
ggatggtagacccgtggggt

SEQ ID NO: 273670 - DNA, 20 bp, human
gagctaaaagcggaaaacag

SEQ ID NO: 273671 - DNA, 20 bp, human
gaagagcaagaaccacgcag

SEQ ID NO: 273672 - DNA, 20 bp, human
gttcactcggccgttttaaa

SEQ ID NO: 273673 - DNA, 20 bp, human
gcacacctccacacttccgg

SEQ ID NO: 273674 - DNA, 20 bp, human
gtagtgggacctgaggactc

SEQ ID NO: 273675 - DNA, 20 bp, human
gcatttggccggtacaccgc

SEQ ID NO: 273676 - DNA, 20 bp, human
gagggcggagttggcgagtt

SEQ ID NO: 273677 - DNA, 20 bp, human
gtgggatcccgcggggacga

SEQ ID NO: 273678 - DNA, 20 bp, human
gaagaaagggaagaagcgga

SEQ ID NO: 273679 - DNA, 20 bp, human
gcgcagcgcgcacccggagc

SEQ ID NO: 273680 - DNA, 20 bp, human
gcgcggcgctgcagcgaggg

SEQ ID NO: 273681 - DNA, 20 bp, human
gcccgggcgcagcgcgcacc

SEQ ID NO: 273682 - DNA, 20 bp, human
ggagggcggtgcaggaacac

SEQ ID NO: 273683 - DNA, 20 bp, human
gctgcagcgccgcgcgccat

SEQ ID NO: 273684 - DNA, 20 bp, human
gcggggtttggagtgaagca

SEQ ID NO: 273685 - DNA, 20 bp, human
ggatcccgcggggacgaggg

SEQ ID NO: 273686 - DNA, 20 bp, human
gcatgcgcagctcccggcta

SEQ ID NO: 273687 - DNA, 20 bp, human
gggtccctgacgccggtcag

SEQ ID NO: 273688 - DNA, 20 bp, human
ggcgcatgctcgctttttgg

SEQ ID NO: 273689 - DNA, 20 bp, human
gaaactgccgcctccgccgc

SEQ ID NO: 273690 - DNA, 20 bp, human
gcgcaggcccatccccgtta

SEQ ID NO: 273691 - DNA, 20 bp, human
gcatgctccataacggggat

SEQ ID NO: 273692 - DNA, 20 bp, human
gactgcgcatgctccataac

SEQ ID NO: 273693 - DNA, 20 bp, human
gaaaacctggtccctgacgc

SEQ ID NO: 273694 - DNA, 20 bp, human
ggggcggagcttaagcagcc

SEQ ID NO: 273695 - DNA, 20 bp, human
gtaacctgagcctcctagcc

SEQ ID NO: 273696 - DNA, 20 bp, human
gagcagtccagcgcctgcgt

SEQ ID NO: 273697 - DNA, 20 bp, human
gcggcgcgtgagcggttcaa

SEQ ID NO: 273698 - DNA, 20 bp, human
ggcgacgtggcagtggctcg

SEQ ID NO: 273699 - DNA, 20 bp, human
ggggagggaccgagccgaga

SEQ ID NO: 273700 - DNA, 20 bp, human
gggcggcggcgacgtggcag

SEQ ID NO: 273701 - DNA, 20 bp, human
gcccgagcccacgcaggcgc

SEQ ID NO: 273702 - DNA, 20 bp, human
gcctgcgtgggctcgggggg

SEQ ID NO: 273703 - DNA, 20 bp, human
gcgtctccaggaactccagg

SEQ ID NO: 273704 - DNA, 20 bp, human
ggggcgtctccaggaactcc

SEQ ID NO: 273705 - DNA, 20 bp, human
gagaaactcagcacctggca

SEQ ID NO: 273706 - DNA, 20 bp, human
gcggctcccaggcgcgggtc

SEQ ID NO: 273707 - DNA, 20 bp, human
gtgagtcggggtctgaactc

SEQ ID NO: 273708 - DNA, 20 bp, human
ggggtcgggcgtgtaaggct

SEQ ID NO: 273709 - DNA, 20 bp, human
gaacccggagccctccgaga

SEQ ID NO: 273710 - DNA, 20 bp, human
gggcgcgggtcgggcgtgta

SEQ ID NO: 273711 - DNA, 20 bp, human
gtcgttgtcacgacaaccgg

SEQ ID NO: 273712 - DNA, 20 bp, human
gggagggctccgggttataa

SEQ ID NO: 273713 - DNA, 20 bp, human
ggcgcctgggagccgcccct

SEQ ID NO: 273714 - DNA, 20 bp, human
gccgtcgttgtcacgacaac

SEQ ID NO: 273715 - DNA, 20 bp, human
ggcctccagcccttataacc

SEQ ID NO: 273716 - DNA, 20 bp, human
gacctctgagtcactcccgg

SEQ ID NO: 273717 - DNA, 20 bp, human
gctccaagggcagatcacca

SEQ ID NO: 273718 - DNA, 20 bp, human
ggtgttagttgggatgtggg

SEQ ID NO: 273719 - DNA, 20 bp, human
ggtgacttaagtcaagaaca

SEQ ID NO: 273720 - DNA, 20 bp, human
gttgacttaagtcactccaa

SEQ ID NO: 273721 - DNA, 20 bp, human
gaacagggaaaaccgggaag

SEQ ID NO: 273722 - DNA, 20 bp, human
ggggatgatctcagggcctc

SEQ ID NO: 273723 - DNA, 20 bp, human
ggtggtgttagttgggatgt

SEQ ID NO: 273724 - DNA, 20 bp, human
gcggtgacgtggctgagtgt

SEQ ID NO: 273725 - DNA, 20 bp, human
gtataccggcggagttggga

SEQ ID NO: 273726 - DNA, 20 bp, human
gtccccaaaggcgggaacgg

SEQ ID NO: 273727 - DNA, 20 bp, human
gaggggagagggttctgtgg

SEQ ID NO: 273728 - DNA, 20 bp, human
gggaaccgatgtcccgactg

SEQ ID NO: 273729 - DNA, 20 bp, human
gagggcggcgactggggcta

SEQ ID NO: 273730 - DNA, 20 bp, human
gcatgcaccccgacctgggt

SEQ ID NO: 273731 - DNA, 20 bp, human
gcagaggccgccaagccagg

SEQ ID NO: 273732 - DNA, 20 bp, human
gtgggtcctcaccccggtgt

SEQ ID NO: 273733 - DNA, 20 bp, human
gtcgggacatcggttccccc

SEQ ID NO: 273734 - DNA, 20 bp, human
gagggggaggccaacttccc

SEQ ID NO: 273735 - DNA, 20 bp, human
gtggggaatttccaacaccg

SEQ ID NO: 273736 - DNA, 20 bp, human
gggcgcgagagcccgggcga

SEQ ID NO: 273737 - DNA, 20 bp, human
gcggcggcgccggggatcgc

SEQ ID NO: 273738 - DNA, 20 bp, human
gagggagccgcgaagggaga

SEQ ID NO: 273739 - DNA, 20 bp, human
gccgcccccttctcccttcg

SEQ ID NO: 273740 - DNA, 20 bp, human
gctacgatgctctgcagcgg

SEQ ID NO: 273741 - DNA, 20 bp, human
gcccctgcgccgctgggtct

SEQ ID NO: 273742 - DNA, 20 bp, human
gggcggcgacaaggcgaagg

SEQ ID NO: 273743 - DNA, 20 bp, human
ggacaaggcgaaggcggtgg

SEQ ID NO: 273744 - DNA, 20 bp, human
gggcgacaaggcgaaggcgg

SEQ ID NO: 273745 - DNA, 20 bp, human
gaaggcagcaggtcagtccc

SEQ ID NO: 273746 - DNA, 20 bp, human
gcgcctccagcgctggtccg

SEQ ID NO: 273747 - DNA, 20 bp, human
ggccgggcttggtgcggaag

SEQ ID NO: 273748 - DNA, 20 bp, human
gggatccagaaagtgagaaa

SEQ ID NO: 273749 - DNA, 20 bp, human
gtccctcggaccagcgctgg

SEQ ID NO: 273750 - DNA, 20 bp, human
gtggacgcgcgcttcggagt

SEQ ID NO: 273751 - DNA, 20 bp, human
gctggtccgagggaccgcgg

SEQ ID NO: 273752 - DNA, 20 bp, human
gagagcggggctccctcgac

SEQ ID NO: 273753 - DNA, 20 bp, human
gccccgggagccgccgggct

SEQ ID NO: 273754 - DNA, 20 bp, human
gcggtccctcggaccagcgc

SEQ ID NO: 273755 - DNA, 20 bp, human
ggggtcgcagacaggtggaa

SEQ ID NO: 273756 - DNA, 20 bp, human
gtggggtggagacttaatga

SEQ ID NO: 273757 - DNA, 20 bp, human
gcaccccaggctgcaccgtc

SEQ ID NO: 273758 - DNA, 20 bp, human
gtgtctgcgctgatacccct

SEQ ID NO: 273759 - DNA, 20 bp, human
gggctcccaggtttacctga

SEQ ID NO: 273760 - DNA, 20 bp, human
gttacctgacggtgcagcct

SEQ ID NO: 273761 - DNA, 20 bp, human
gctgcaccgtcaggtaaacc

SEQ ID NO: 273762 - DNA, 20 bp, human
gtccagaggcactaggaagg

SEQ ID NO: 273763 - DNA, 20 bp, human
ggggggcgcctatcagacta

SEQ ID NO: 273764 - DNA, 20 bp, human
gtggcagggctagtgtgttg

SEQ ID NO: 273765 - DNA, 20 bp, human
ggcccccttcctagtgcctc

SEQ ID NO: 273766 - DNA, 20 bp, human
gggctcatgggctttcttag

SEQ ID NO: 273767 - DNA, 20 bp, human
gggtgctggtcttgaatatt

SEQ ID NO: 273768 - DNA, 20 bp, human
gcacaacttaggaaacactg

SEQ ID NO: 273769 - DNA, 20 bp, human
gtaaaaacgcataatagccc

SEQ ID NO: 273770 - DNA, 20 bp, human
gctcttagtatttggctcat

SEQ ID NO: 273771 - DNA, 20 bp, human
gtagtgttgtattttagtta

SEQ ID NO: 273772 - DNA, 20 bp, human
gttaagcatactggggtttg

SEQ ID NO: 273773 - DNA, 20 bp, human
gaattcgattattctcctga

SEQ ID NO: 273774 - DNA, 20 bp, human
gctttaggaagcaaacacag

SEQ ID NO: 273775 - DNA, 20 bp, human
gacatgaaattgccttaatg

SEQ ID NO: 273776 - DNA, 20 bp, human
gtagacgccgcgtgggggtg

SEQ ID NO: 273777 - DNA, 20 bp, human
gaaaggggcaacgtccgaac

SEQ ID NO: 273778 - DNA, 20 bp, human
gcgcgctcggcaccatagag

SEQ ID NO: 273779 - DNA, 20 bp, human
gtctacgtcgcagctgggac

SEQ ID NO: 273780 - DNA, 20 bp, human
gacgctctaggcgagctcgt

SEQ ID NO: 273781 - DNA, 20 bp, human
ggcgacgtagacgccgcgtg

SEQ ID NO: 273782 - DNA, 20 bp, human
gagctctcgcgggacctcct

SEQ ID NO: 273783 - DNA, 20 bp, human
gcggacgttgcccctttaat

SEQ ID NO: 273784 - DNA, 20 bp, human
gggcgagtaggtgacgctct

SEQ ID NO: 273785 - DNA, 20 bp, human
gcgccctctgccgattaaag

SEQ ID NO: 273786 - DNA, 20 bp, human
gaagaccagcgctgggtgga

SEQ ID NO: 273787 - DNA, 20 bp, human
ggagcggtggacacgtgacg

SEQ ID NO: 273788 - DNA, 20 bp, human
gccggccggtcccgcgtgga

SEQ ID NO: 273789 - DNA, 20 bp, human
gcctgccgcgcagtcagcag

SEQ ID NO: 273790 - DNA, 20 bp, human
gccccccctccacgcgggac

SEQ ID NO: 273791 - DNA, 20 bp, human
gcccaggccccccctccacg

SEQ ID NO: 273792 - DNA, 20 bp, human
gggtcttagaagaccagcgc

SEQ ID NO: 273793 - DNA, 20 bp, human
gtctggactaagaaatgttc

SEQ ID NO: 273794 - DNA, 20 bp, human
gttagaagaccagcgctggg

SEQ ID NO: 273795 - DNA, 20 bp, human
gtctaagaccactcaccgta

SEQ ID NO: 273796 - DNA, 20 bp, human
gccagactgcgacggataca

SEQ ID NO: 273797 - DNA, 20 bp, human
gactgcgacggatacaggga

SEQ ID NO: 273798 - DNA, 20 bp, human
gacggatacagggagggcaa

SEQ ID NO: 273799 - DNA, 20 bp, human
gctggcgcggccctcggtga

SEQ ID NO: 273800 - DNA, 20 bp, human
ggcgccgagggcagtccttg

SEQ ID NO: 273801 - DNA, 20 bp, human
gtcctcgtggccagccaaga

SEQ ID NO: 273802 - DNA, 20 bp, human
ggagtgagtgccgtcaccga

SEQ ID NO: 273803 - DNA, 20 bp, human
gtgagcgagtgacgggaaac

SEQ ID NO: 273804 - DNA, 20 bp, human
ggccaggcccgaccatcctc

SEQ ID NO: 273805 - DNA, 20 bp, human
gaccccacaaggactgccct

SEQ ID NO: 273806 - DNA, 20 bp, human
gctccggcgggcatcggcgt

SEQ ID NO: 273807 - DNA, 20 bp, human
gagcggccacgtgtgtgcga

SEQ ID NO: 273808 - DNA, 20 bp, human
gaggcggccagttgtgcgag

SEQ ID NO: 273809 - DNA, 20 bp, human
gtgagtgcccaggtgtgtta

SEQ ID NO: 273810 - DNA, 20 bp, human
ggtgtgcgagggcgccgcag

SEQ ID NO: 273811 - DNA, 20 bp, human
gagggtggatgtgacttctg

SEQ ID NO: 273812 - DNA, 20 bp, human
gccccggctgccggcaggtg

SEQ ID NO: 273813 - DNA, 20 bp, human
gacgtggccgctcgcacaac

SEQ ID NO: 273814 - DNA, 20 bp, human
ggggccagggcggaaatgca

SEQ ID NO: 273815 - DNA, 20 bp, human
ggctcccaggccgcccccgg

SEQ ID NO: 273816 - DNA, 20 bp, human
gcgtggggatggccaatcaa

SEQ ID NO: 273817 - DNA, 20 bp, human
gcaaagggggcgactcaggt

SEQ ID NO: 273818 - DNA, 20 bp, human
gtctgagtctcggcggaagg

SEQ ID NO: 273819 - DNA, 20 bp, human
gggtcgggtcccatggacac

SEQ ID NO: 273820 - DNA, 20 bp, human
gtccggcgctggctcctcat

SEQ ID NO: 273821 - DNA, 20 bp, human
gggaggggcgggacatcagt

SEQ ID NO: 273822 - DNA, 20 bp, human
gtcaaggcttcctctgattg

SEQ ID NO: 273823 - DNA, 20 bp, human
gggggatggccaatcaaagg

SEQ ID NO: 273824 - DNA, 20 bp, human
gtggggaccggcagccaatc

SEQ ID NO: 273825 - DNA, 20 bp, human
ggcccaggcgactccatcaa

SEQ ID NO: 273826 - DNA, 20 bp, human
gccccctcggaaggcataac

SEQ ID NO: 273827 - DNA, 20 bp, human
gaacaaggagccttggagcg

SEQ ID NO: 273828 - DNA, 20 bp, human
ggggacggagaggactaatg

SEQ ID NO: 273829 - DNA, 20 bp, human
gcagccgctgacgcgtcggg

SEQ ID NO: 273830 - DNA, 20 bp, human
gggcggcagggggcggaaca

SEQ ID NO: 273831 - DNA, 20 bp, human
gggggcggaacaaggagcct

SEQ ID NO: 273832 - DNA, 20 bp, human
gtggagatcaacggcactaa

SEQ ID NO: 273833 - DNA, 20 bp, human
ggagaggactaatggggtcg

SEQ ID NO: 273834 - DNA, 20 bp, human
gtacccacgaccggcggcgc

SEQ ID NO: 273835 - DNA, 20 bp, human
gcgccggattccttgcttgg

SEQ ID NO: 273836 - DNA, 20 bp, human
gggaccggggacagagcaat

SEQ ID NO: 273837 - DNA, 20 bp, human
gcgcgcgctaggcggccgtg

SEQ ID NO: 273838 - DNA, 20 bp, human
gcactcgcgtgagactcggg

SEQ ID NO: 273839 - DNA, 20 bp, human
ggctggcaggggattctaga

SEQ ID NO: 273840 - DNA, 20 bp, human
gcgcccgcagagcttttgaa

SEQ ID NO: 273841 - DNA, 20 bp, human
gaacgcctggggcgggtacc

SEQ ID NO: 273842 - DNA, 20 bp, human
ggcctcccaccgccgcccca

SEQ ID NO: 273843 - DNA, 20 bp, human
gagtcccggcgcgcgctagg

SEQ ID NO: 273844 - DNA, 20 bp, human
gcccccacgggccgcctaag

SEQ ID NO: 273845 - DNA, 20 bp, human
ggcgcactcgcgtgagactc

SEQ ID NO: 273846 - DNA, 20 bp, human
gaggggcgggacattctaaa

SEQ ID NO: 273847 - DNA, 20 bp, human
ggcctcgggagggaatgaga

SEQ ID NO: 273848 - DNA, 20 bp, human
gggagacctaggttcgtaag

SEQ ID NO: 273849 - DNA, 20 bp, human
gcaagtgggcgagacaacta

SEQ ID NO: 273850 - DNA, 20 bp, human
gggggcgaggaacaagacct

SEQ ID NO: 273851 - DNA, 20 bp, human
gctaaggagaacaacccaaa

SEQ ID NO: 273852 - DNA, 20 bp, human
gagggcggaccccgagatgt

SEQ ID NO: 273853 - DNA, 20 bp, human
gttagaaccagaaggcctgg

SEQ ID NO: 273854 - DNA, 20 bp, human
ggacgcatcggtgttcgcgt

SEQ ID NO: 273855 - DNA, 20 bp, human
gaggtaaattgccttagggg

SEQ ID NO: 273856 - DNA, 20 bp, human
gaaggagggcgggggacgag

SEQ ID NO: 273857 - DNA, 20 bp, human
gcgaactaggactggtagga

SEQ ID NO: 273858 - DNA, 20 bp, human
gaatggctgggctccgagaa

SEQ ID NO: 273859 - DNA, 20 bp, human
gcgcccgccggcctccagtc

SEQ ID NO: 273860 - DNA, 20 bp, human
gaaggcttccccacggacga

SEQ ID NO: 273861 - DNA, 20 bp, human
gacgtcctctcgcgagactg

SEQ ID NO: 273862 - DNA, 20 bp, human
gccagccccagtctcgcgag

SEQ ID NO: 273863 - DNA, 20 bp, human
gccactccccgcggcgcgag

SEQ ID NO: 273864 - DNA, 20 bp, human
gagcggctgactgcccgtag

SEQ ID NO: 273865 - DNA, 20 bp, human
gcgccgcggggagtggaaga

SEQ ID NO: 273866 - DNA, 20 bp, human
gcccccgcaccggtccacgc

SEQ ID NO: 273867 - DNA, 20 bp, human
ggcggggcaacaaagcagta

SEQ ID NO: 273868 - DNA, 20 bp, human
ggcgggccttgcagttctcg

SEQ ID NO: 273869 - DNA, 20 bp, human
ggccctgcgcctgcgtggac

SEQ ID NO: 273870 - DNA, 20 bp, human
ggacgcctgcgcagtgtgac

SEQ ID NO: 273871 - DNA, 20 bp, human
gaccaataggaacagtgtat

SEQ ID NO: 273872 - DNA, 20 bp, human
ggggcaacaaagcagtaggg

SEQ ID NO: 273873 - DNA, 20 bp, human
gcactgttcctattggtccc

SEQ ID NO: 273874 - DNA, 20 bp, human
gggggggaacctagagtcgg

SEQ ID NO: 273875 - DNA, 20 bp, human
gaaataaagtccatactctg

SEQ ID NO: 273876 - DNA, 20 bp, human
gaggaaggaaaccctttccc

SEQ ID NO: 273877 - DNA, 20 bp, human
ggtgctatgagccggggaaa

SEQ ID NO: 273878 - DNA, 20 bp, human
gtggcaggtgctatgagccg

SEQ ID NO: 273879 - DNA, 20 bp, human
gcaggctggacctccgtgag

SEQ ID NO: 273880 - DNA, 20 bp, human
gaagttcacgcagccctggg

SEQ ID NO: 273881 - DNA, 20 bp, human
gagactcagttccctccaaa

SEQ ID NO: 273882 - DNA, 20 bp, human
gggcagacagcgccctttgg

SEQ ID NO: 273883 - DNA, 20 bp, human
gctaaagttcacgcagccct

SEQ ID NO: 273884 - DNA, 20 bp, human
ggccccaggctggttccctc

SEQ ID NO: 273885 - DNA, 20 bp, human
ggagccagagggaaccagcc

SEQ ID NO: 273886 - DNA, 20 bp, human
gcccccaggccactagggga

SEQ ID NO: 273887 - DNA, 20 bp, human
gcatccctgaggctgtgatc

SEQ ID NO: 273888 - DNA, 20 bp, human
gtcctccttccctcccctag

SEQ ID NO: 273889 - DNA, 20 bp, human
gccccagcttgcaggactac

SEQ ID NO: 273890 - DNA, 20 bp, human
ggaggctgggtttcagcggg

SEQ ID NO: 273891 - DNA, 20 bp, human
gccttgacccccaatttcag

SEQ ID NO: 273892 - DNA, 20 bp, human
gggggttgtagaggtgaact

SEQ ID NO: 273893 - DNA, 20 bp, human
ggtcccagatcacagcctca

SEQ ID NO: 273894 - DNA, 20 bp, human
gaactgctgcaggtgggatg

SEQ ID NO: 273895 - DNA, 20 bp, human
gaactctgaaagcctcggtg

SEQ ID NO: 273896 - DNA, 20 bp, human
gacacagactagttagagaa

SEQ ID NO: 273897 - DNA, 20 bp, human
gaaaaactggacattaatat

SEQ ID NO: 273898 - DNA, 20 bp, human
ggaaaaaaaaggtctcctgc

SEQ ID NO: 273899 - DNA, 20 bp, human
gcaaagggttaaccatatca

SEQ ID NO: 273900 - DNA, 20 bp, human
gaactagtctgtgttccagc

SEQ ID NO: 273901 - DNA, 20 bp, human
gatggttaaccctttgacac

SEQ ID NO: 273902 - DNA, 20 bp, human
gaaacagaacagccttgata

SEQ ID NO: 273903 - DNA, 20 bp, human
gagtgtttgccagtgtcaaa

SEQ ID NO: 273904 - DNA, 20 bp, human
gtagttgtgataataaaaac

SEQ ID NO: 273905 - DNA, 20 bp, human
gtattatcacaactaagcag

SEQ ID NO: 273906 - DNA, 20 bp, human
ggatgtgcatgcggtaagca

SEQ ID NO: 273907 - DNA, 20 bp, human
gcgtgcaaaaccctgtgcct

SEQ ID NO: 273908 - DNA, 20 bp, human
ggctcactgtatgtcccctg

SEQ ID NO: 273909 - DNA, 20 bp, human
gagcctggaagggagtccac

SEQ ID NO: 273910 - DNA, 20 bp, human
gactcactgcacagcctgga

SEQ ID NO: 273911 - DNA, 20 bp, human
gtgccactcactgcacagcc

SEQ ID NO: 273912 - DNA, 20 bp, human
gcttaccgcatgcacatcct

SEQ ID NO: 273913 - DNA, 20 bp, human
ggcagggcaggtaggggaca

SEQ ID NO: 273914 - DNA, 20 bp, human
ggcggtaagcatggcaaagg

SEQ ID NO: 273915 - DNA, 20 bp, human
gaacacggagtcccccagaa

SEQ ID NO: 273916 - DNA, 20 bp, human
gcaactctctcccctggatc

SEQ ID NO: 273917 - DNA, 20 bp, human
gcagagctgccgggaacccg

SEQ ID NO: 273918 - DNA, 20 bp, human
gtccaggggagagagttgag

SEQ ID NO: 273919 - DNA, 20 bp, human
ggccgctcaactctctcccc

SEQ ID NO: 273920 - DNA, 20 bp, human
ggcagccttgccggatccag

SEQ ID NO: 273921 - DNA, 20 bp, human
gggccaccctggggagttgt

SEQ ID NO: 273922 - DNA, 20 bp, human
gaactccccagggtggccaa

SEQ ID NO: 273923 - DNA, 20 bp, human
gacaccattccccgggttcc

SEQ ID NO: 273924 - DNA, 20 bp, human
gactacaagacgcccatgtg

SEQ ID NO: 273925 - DNA, 20 bp, human
ggagggagggggacacaagg

SEQ ID NO: 273926 - DNA, 20 bp, human
gctctcgcgacagggttccc

SEQ ID NO: 273927 - DNA, 20 bp, human
gcatgggctacatcccccaa

SEQ ID NO: 273928 - DNA, 20 bp, human
gccggggtgactgcctgtaa

SEQ ID NO: 273929 - DNA, 20 bp, human
gcatgtgagcctgccccatt

SEQ ID NO: 273930 - DNA, 20 bp, human
gcccgaggagctctcgcgac

SEQ ID NO: 273931 - DNA, 20 bp, human
gagtccctagagtcccaggt

SEQ ID NO: 273932 - DNA, 20 bp, human
gccacagtccctagagtccc

SEQ ID NO: 273933 - DNA, 20 bp, human
gcgggccttgtgtcctaatg

SEQ ID NO: 273934 - DNA, 20 bp, human
ggtggcagcgaccttgggga

SEQ ID NO: 273935 - DNA, 20 bp, human
gagcgaccttggggaagggt

SEQ ID NO: 273936 - DNA, 20 bp, human
gcagaccgggacacggccga

SEQ ID NO: 273937 - DNA, 20 bp, human
ggaaggcagcgcagggtcga

SEQ ID NO: 273938 - DNA, 20 bp, human
gccagccctcggccgtgtcc

SEQ ID NO: 273939 - DNA, 20 bp, human
gaggcctggagatgaagcat

SEQ ID NO: 273940 - DNA, 20 bp, human
gggcgagtcagaccgggaca

SEQ ID NO: 273941 - DNA, 20 bp, human
gacaggatctggggtcgaga

SEQ ID NO: 273942 - DNA, 20 bp, human
ggcacacaggtgcgtgtaga

SEQ ID NO: 273943 - DNA, 20 bp, human
ggggcccgaaaaggaagcct

SEQ ID NO: 273944 - DNA, 20 bp, human
gggggcaagcgagacttcag

SEQ ID NO: 273945 - DNA, 20 bp, human
gaggaggagtctaaaatcgg

SEQ ID NO: 273946 - DNA, 20 bp, human
ggggtgttttggacaccaaa

SEQ ID NO: 273947 - DNA, 20 bp, human
gaagcaaccgacggttcccc

SEQ ID NO: 273948 - DNA, 20 bp, human
gagagagtccttgtgctcag

SEQ ID NO: 273949 - DNA, 20 bp, human
ggggagccctggggaaccgt

SEQ ID NO: 273950 - DNA, 20 bp, human
gtccccagggctcccaggag

SEQ ID NO: 273951 - DNA, 20 bp, human
gaaactgctggcttcgcctt

SEQ ID NO: 273952 - DNA, 20 bp, human
gtccccgttgctcctgcctg

SEQ ID NO: 273953 - DNA, 20 bp, human
ggatgggctgaaccggctcc

SEQ ID NO: 273954 - DNA, 20 bp, human
gtggggacagccgggtgttt

SEQ ID NO: 273955 - DNA, 20 bp, human
gcctgttcgggcccaggcct

SEQ ID NO: 273956 - DNA, 20 bp, human
gacaagttgggtggtatctc

SEQ ID NO: 273957 - DNA, 20 bp, human
gtggtcggtagggggtctca

SEQ ID NO: 273958 - DNA, 20 bp, human
gaacaggtggggtcaacagt

SEQ ID NO: 273959 - DNA, 20 bp, human
gaagggataggatagagaat

SEQ ID NO: 273960 - DNA, 20 bp, human
ggccaacctgcacgcggcga

SEQ ID NO: 273961 - DNA, 20 bp, human
gggtagggggtctcaaggac

SEQ ID NO: 273962 - DNA, 20 bp, human
gtgggtcagcctgagtcagc

SEQ ID NO: 273963 - DNA, 20 bp, human
gggtcaacagtgggagagaa

SEQ ID NO: 273964 - DNA, 20 bp, human
gatgggatgtggtcggtagg

SEQ ID NO: 273965 - DNA, 20 bp, human
gtccttcgccgcgtgcaggt

SEQ ID NO: 273966 - DNA, 20 bp, human
gtgggtggaggggaaacatg

SEQ ID NO: 273967 - DNA, 20 bp, human
gccccaaggctcaggtaaag

SEQ ID NO: 273968 - DNA, 20 bp, human
gaatagattgcgggggttct

SEQ ID NO: 273969 - DNA, 20 bp, human
gtcctgggctcgcctgagac

SEQ ID NO: 273970 - DNA, 20 bp, human
gatccaggcgggcctgtctc

SEQ ID NO: 273971 - DNA, 20 bp, human
gcaatctattggctgtgctt

SEQ ID NO: 273972 - DNA, 20 bp, human
gcgcctgagacaggcccgcc

SEQ ID NO: 273973 - DNA, 20 bp, human
gattagcactgcatccaggc

SEQ ID NO: 273974 - DNA, 20 bp, human
gcagtattagcactgcatcc

SEQ ID NO: 273975 - DNA, 20 bp, human
gcgcccccgccccaaggctc

SEQ ID NO: 273976 - DNA, 20 bp, human
ggaggggggtgctcttaaag

SEQ ID NO: 273977 - DNA, 20 bp, human
gcgcctacaggacttcatgt

SEQ ID NO: 273978 - DNA, 20 bp, human
gaaaggggcaggtcgcctac

SEQ ID NO: 273979 - DNA, 20 bp, human
gacccgacatgaagtcctgt

SEQ ID NO: 273980 - DNA, 20 bp, human
ggcccctctcccagctcaag

SEQ ID NO: 273981 - DNA, 20 bp, human
gtcatgtcgggtgctagccc

SEQ ID NO: 273982 - DNA, 20 bp, human
gctgccccaactgccagcct

SEQ ID NO: 273983 - DNA, 20 bp, human
gaaggagcgatggctttaaa

SEQ ID NO: 273984 - DNA, 20 bp, human
gatccggccaccaggcctga

SEQ ID NO: 273985 - DNA, 20 bp, human
gggccagaaagaaggagcga

SEQ ID NO: 273986 - DNA, 20 bp, human
gaggaggcggggttccaaat

SEQ ID NO: 273987 - DNA, 20 bp, human
gtggccccgccccaccaatt

SEQ ID NO: 273988 - DNA, 20 bp, human
gaggcggggttccaaattgg

SEQ ID NO: 273989 - DNA, 20 bp, human
ggcggggttccgggttgagg

SEQ ID NO: 273990 - DNA, 20 bp, human
ggaaccccgcctcctcaacc

SEQ ID NO: 273991 - DNA, 20 bp, human
gagtacgagcagccaatcac

SEQ ID NO: 273992 - DNA, 20 bp, human
gaaagcggccacactggggg

SEQ ID NO: 273993 - DNA, 20 bp, human
gccactgcccaaaacaaaga

SEQ ID NO: 273994 - DNA, 20 bp, human
gcaggcctctgtcggaaaag

SEQ ID NO: 273995 - DNA, 20 bp, human
gtcaaagagcacagttcctc

SEQ ID NO: 273996 - DNA, 20 bp, human
ggctgcgcggctcctcctag

SEQ ID NO: 273997 - DNA, 20 bp, human
gaaggcgaagcggacgttca

SEQ ID NO: 273998 - DNA, 20 bp, human
ggcgaagcggacgttcaagg

SEQ ID NO: 273999 - DNA, 20 bp, human
ggagaggccgagtgccgccc

SEQ ID NO: 274000 - DNA, 20 bp, human
gctaacatgctgagtgtcct

SEQ ID NO: 274001 - DNA, 20 bp, human
gaaaaaggttagctatctcc

SEQ ID NO: 274002 - DNA, 20 bp, human
ggccagttcgagaactgctg

SEQ ID NO: 274003 - DNA, 20 bp, human
gccaggcgcggcgtgacccc

SEQ ID NO: 274004 - DNA, 20 bp, human
gctgcacttaacgctcttgt

SEQ ID NO: 274005 - DNA, 20 bp, human
gcgtgacccctggtgaacgg

SEQ ID NO: 274006 - DNA, 20 bp, human
gtcacactgacaaaccctgt

SEQ ID NO: 274007 - DNA, 20 bp, human
gcaggagtctaagtctgcaa

SEQ ID NO: 274008 - DNA, 20 bp, human
gccactgtgccaaagataaa

SEQ ID NO: 274009 - DNA, 20 bp, human
gcaaaccctgttggtgaaag

SEQ ID NO: 274010 - DNA, 20 bp, human
gcagtcctttggttgacttg

SEQ ID NO: 274011 - DNA, 20 bp, human
ggtgattggagaactcggct

SEQ ID NO: 274012 - DNA, 20 bp, human
gtctgacgctgacaacgctt

SEQ ID NO: 274013 - DNA, 20 bp, human
gatactgctataatagtgat

SEQ ID NO: 274014 - DNA, 20 bp, human
gaaatgatgggaacgccagg

SEQ ID NO: 274015 - DNA, 20 bp, human
gaggctggagtgccatagcg

SEQ ID NO: 274016 - DNA, 20 bp, human
gggatgggaagcaacgagct

SEQ ID NO: 274017 - DNA, 20 bp, human
ggctcaggagatgatgtctg

SEQ ID NO: 274018 - DNA, 20 bp, human
ggcttcccatccagtgtccc

SEQ ID NO: 274019 - DNA, 20 bp, human
gggggtggggggagttgctc

SEQ ID NO: 274020 - DNA, 20 bp, human
gcacaactgagcgggggggt

SEQ ID NO: 274021 - DNA, 20 bp, human
ggtctgaggacgtctcacca

SEQ ID NO: 274022 - DNA, 20 bp, human
ggcccaggaatctgcatcgt

SEQ ID NO: 274023 - DNA, 20 bp, human
gctcaggcaggcagcaccgt

SEQ ID NO: 274024 - DNA, 20 bp, human
gagcaccgtcggcccagcca

SEQ ID NO: 274025 - DNA, 20 bp, human
gccagcttccacaactgagc

SEQ ID NO: 274026 - DNA, 20 bp, human
gagtagaaggcgatgagggt

SEQ ID NO: 274027 - DNA, 20 bp, human
gccagagtagaaggcgatga

SEQ ID NO: 274028 - DNA, 20 bp, human
gtctctgggcccttgctatc

SEQ ID NO: 274029 - DNA, 20 bp, human
gaatcctggtgaatattcag

SEQ ID NO: 274030 - DNA, 20 bp, human
ggaaacagagtcccacctca

SEQ ID NO: 274031 - DNA, 20 bp, human
gtgaggggtcactccaatga

SEQ ID NO: 274032 - DNA, 20 bp, human
gagaccgctgaatattcacc

SEQ ID NO: 274033 - DNA, 20 bp, human
ggtgtctgtcctgatagcaa

SEQ ID NO: 274034 - DNA, 20 bp, human
ggaatattcaccaggattgc

SEQ ID NO: 274035 - DNA, 20 bp, human
gtaagatcccatcaatctga

SEQ ID NO: 274036 - DNA, 20 bp, human
gaagcccgagcgacctggag

SEQ ID NO: 274037 - DNA, 20 bp, human
gagtcccctccaggtcgctc

SEQ ID NO: 274038 - DNA, 20 bp, human
gagggcagcgaggtagcttc

SEQ ID NO: 274039 - DNA, 20 bp, human
gggaggaagcccgagcgacc

SEQ ID NO: 274040 - DNA, 20 bp, human
gcatggcgggaggagtcatc

SEQ ID NO: 274041 - DNA, 20 bp, human
gctcgctgccctgtcagtta

SEQ ID NO: 274042 - DNA, 20 bp, human
gatggacggaagaaccatgg

SEQ ID NO: 274043 - DNA, 20 bp, human
gacggaagaaccatggcggg

SEQ ID NO: 274044 - DNA, 20 bp, human
gctctgttccgtaactgaca

SEQ ID NO: 274045 - DNA, 20 bp, human
gctgatggacggaagaacca

SEQ ID NO: 274046 - DNA, 20 bp, human
gaggtgagaggcagaagccg

SEQ ID NO: 274047 - DNA, 20 bp, human
gccgaggaagaaggtgagat

SEQ ID NO: 274048 - DNA, 20 bp, human
gaaggacaggtcacacccgg

SEQ ID NO: 274049 - DNA, 20 bp, human
gcgggtgcagacgcgtaggg

SEQ ID NO: 274050 - DNA, 20 bp, human
ggacgcgtagggaggatgct

SEQ ID NO: 274051 - DNA, 20 bp, human
ggcaccctcccgcgcctaag

SEQ ID NO: 274052 - DNA, 20 bp, human
ggtgttgggagaaactttgg

SEQ ID NO: 274053 - DNA, 20 bp, human
gcgccggccggaggatgtgt

SEQ ID NO: 274054 - DNA, 20 bp, human
gctggtgacaggtatgcgtg

SEQ ID NO: 274055 - DNA, 20 bp, human
ggagcgggtgcagacgcgta

SEQ ID NO: 274056 - DNA, 20 bp, human
gggcgggaggagaaaacacg

SEQ ID NO: 274057 - DNA, 20 bp, human
gtgagccaatcggaaggggc

SEQ ID NO: 274058 - DNA, 20 bp, human
gggcgcttccgcccattggc

SEQ ID NO: 274059 - DNA, 20 bp, human
gccgaggcgcggcgtggagg

SEQ ID NO: 274060 - DNA, 20 bp, human
gcgcctgagccaatcggaag

SEQ ID NO: 274061 - DNA, 20 bp, human
gacaccccgccccttccgat

SEQ ID NO: 274062 - DNA, 20 bp, human
gacgtggcgcggtgcgcgag

SEQ ID NO: 274063 - DNA, 20 bp, human
gggcgtccaagggaggttga

SEQ ID NO: 274064 - DNA, 20 bp, human
ggagcctgctcccgcccccc

SEQ ID NO: 274065 - DNA, 20 bp, human
ggaggagaaaacacgtggcg

SEQ ID NO: 274066 - DNA, 20 bp, human
gggggcgcttcattggtcat

SEQ ID NO: 274067 - DNA, 20 bp, human
gtgcgcaagtacggaagctg

SEQ ID NO: 274068 - DNA, 20 bp, human
gtcgcggcgaccacgcacta

SEQ ID NO: 274069 - DNA, 20 bp, human
ggcgaccacgcactacgggt

SEQ ID NO: 274070 - DNA, 20 bp, human
gggacggcctcccggaagcg

SEQ ID NO: 274071 - DNA, 20 bp, human
gggggagttctgcgcaagta

SEQ ID NO: 274072 - DNA, 20 bp, human
gtcaaaaggcgtcggccctc

SEQ ID NO: 274073 - DNA, 20 bp, human
gcaatgaagcgcccccgcga

SEQ ID NO: 274074 - DNA, 20 bp, human
gggttggcgccagagtcaaa

SEQ ID NO: 274075 - DNA, 20 bp, human
gcgtcggccctctggcaaga

SEQ ID NO: 274076 - DNA, 20 bp, human
gaccttggagggtctatagt

SEQ ID NO: 274077 - DNA, 20 bp, human
gcaccttcagacaccttgga

SEQ ID NO: 274078 - DNA, 20 bp, human
gaccgactatagaccctcca

SEQ ID NO: 274079 - DNA, 20 bp, human
ggaaaggagaggtcagcaca

SEQ ID NO: 274080 - DNA, 20 bp, human
gtaactgattggatacaata

SEQ ID NO: 274081 - DNA, 20 bp, human
gaagcagcctggtaactgat

SEQ ID NO: 274082 - DNA, 20 bp, human
gtacttacttgtatcaggaa

SEQ ID NO: 274083 - DNA, 20 bp, human
gggggctgggtatgcagtga

SEQ ID NO: 274084 - DNA, 20 bp, human
gggtcagacatcaggaagtt

SEQ ID NO: 274085 - DNA, 20 bp, human
gaaggcctgggtcagacatc

SEQ ID NO: 274086 - DNA, 20 bp, human
ggggaccgggaataagaagt

SEQ ID NO: 274087 - DNA, 20 bp, human
gtctgagcaatgaggtcaat

SEQ ID NO: 274088 - DNA, 20 bp, human
gggcggagacgaacccaagt

SEQ ID NO: 274089 - DNA, 20 bp, human
gttaccgttgggtaaggttg

SEQ ID NO: 274090 - DNA, 20 bp, human
gtgaggtcaatgggaggagc

SEQ ID NO: 274091 - DNA, 20 bp, human
gagagtgcagtattagggca

SEQ ID NO: 274092 - DNA, 20 bp, human
gggagaaatacattcatgga

SEQ ID NO: 274093 - DNA, 20 bp, human
gaggaggggcctcaaaggca

SEQ ID NO: 274094 - DNA, 20 bp, human
gttgctcagagtgcagtatt

SEQ ID NO: 274095 - DNA, 20 bp, human
gaagtgggtgagcaatagaa

SEQ ID NO: 274096 - DNA, 20 bp, human
gccacagcggcgtggaccga

SEQ ID NO: 274097 - DNA, 20 bp, human
gggctccccgcagagagcac

SEQ ID NO: 274098 - DNA, 20 bp, human
ggcccctgggctgtaggcca

SEQ ID NO: 274099 - DNA, 20 bp, human
gtgccctggcctacagccca

SEQ ID NO: 274100 - DNA, 20 bp, human
gtctggtgagatcgagagcg

SEQ ID NO: 274101 - DNA, 20 bp, human
gactccctgcacggatcttc

SEQ ID NO: 274102 - DNA, 20 bp, human
gtcttcctgtgctctctgcg

SEQ ID NO: 274103 - DNA, 20 bp, human
ggcagggagtaccctgaagc

SEQ ID NO: 274104 - DNA, 20 bp, human
gcctcgtggtgggtgagtta

SEQ ID NO: 274105 - DNA, 20 bp, human
gtgtgtttgtaacaagtgct

SEQ ID NO: 274106 - DNA, 20 bp, human
gcggaaaggaaggatgtcgt

SEQ ID NO: 274107 - DNA, 20 bp, human
gtcgtgggagactggagagt

SEQ ID NO: 274108 - DNA, 20 bp, human
gcgggtggtggcggaaagga

SEQ ID NO: 274109 - DNA, 20 bp, human
gcaactcaagggcaggtacc

SEQ ID NO: 274110 - DNA, 20 bp, human
gcgagacccggatgaaaggt

SEQ ID NO: 274111 - DNA, 20 bp, human
ggtacccggctgctgccaag

SEQ ID NO: 274112 - DNA, 20 bp, human
gtgcccgagacccggatgaa

SEQ ID NO: 274113 - DNA, 20 bp, human
gctcgggcaggggcgtgtct

SEQ ID NO: 274114 - DNA, 20 bp, human
ggggagcctgcgcactgcca

SEQ ID NO: 274115 - DNA, 20 bp, human
gcgcggtcacgtgacgtgcg

SEQ ID NO: 274116 - DNA, 20 bp, human
gagggatgttgtagtctctg

SEQ ID NO: 274117 - DNA, 20 bp, human
gatcttgccatgctctaaga

SEQ ID NO: 274118 - DNA, 20 bp, human
gaggttatgtgtctccagca

SEQ ID NO: 274119 - DNA, 20 bp, human
ggaaggacttgagggtgaac

SEQ ID NO: 274120 - DNA, 20 bp, human
gtgccaacccacagctcaat

SEQ ID NO: 274121 - DNA, 20 bp, human
gagggtgaactggtatgttg

SEQ ID NO: 274122 - DNA, 20 bp, human
gtccggggcaggagactctc

SEQ ID NO: 274123 - DNA, 20 bp, human
gatggggaaatgtccctata

SEQ ID NO: 274124 - DNA, 20 bp, human
gagactaaagcctcctaata

SEQ ID NO: 274125 - DNA, 20 bp, human
gctactttctgctgtgactg

SEQ ID NO: 274126 - DNA, 20 bp, human
gagggatgttgtagtctctg

SEQ ID NO: 274127 - DNA, 20 bp, human
gatcttgccatgctctaaga

SEQ ID NO: 274128 - DNA, 20 bp, human
gaggttatgtgtctccagca

SEQ ID NO: 274129 - DNA, 20 bp, human
ggaaggacttgagggtgaac

SEQ ID NO: 274130 - DNA, 20 bp, human
gtgccaacccacagctcaat

SEQ ID NO: 274131 - DNA, 20 bp, human
gagggtgaactggtatgttg

SEQ ID NO: 274132 - DNA, 20 bp, human
gtccggggcaggagactctc

SEQ ID NO: 274133 - DNA, 20 bp, human
gatggggaaatgtccctata

SEQ ID NO: 274134 - DNA, 20 bp, human
gagactaaagcctcctaata

SEQ ID NO: 274135 - DNA, 20 bp, human
gctactttctgctgtgactg

SEQ ID NO: 274136 - DNA, 20 bp, human
gtgaatgccaaggaagttgg

SEQ ID NO: 274137 - DNA, 20 bp, human
gtgaaatccaccaacttcct

SEQ ID NO: 274138 - DNA, 20 bp, human
gcctgctgctggtgtcaatg

SEQ ID NO: 274139 - DNA, 20 bp, human
ggctcaggaagattcaagag

SEQ ID NO: 274140 - DNA, 20 bp, human
gattagcagtcaggaagctc

SEQ ID NO: 274141 - DNA, 20 bp, human
gtagttatttgctgtcatgt

SEQ ID NO: 274142 - DNA, 20 bp, human
gttcaaacacaggcacgtgg

SEQ ID NO: 274143 - DNA, 20 bp, human
gaagaaaggcatgaatgcca

SEQ ID NO: 274144 - DNA, 20 bp, human
gcctctgataggcactgccc

SEQ ID NO: 274145 - DNA, 20 bp, human
gaggtttaagcccttctcag

SEQ ID NO: 274146 - DNA, 20 bp, human
ggagctgctggatgatcagg

SEQ ID NO: 274147 - DNA, 20 bp, human
gtccagatttacttgtgcaa

SEQ ID NO: 274148 - DNA, 20 bp, human
ggctggatgatcaggtgggc

SEQ ID NO: 274149 - DNA, 20 bp, human
ggggtcatgctgtgacattc

SEQ ID NO: 274150 - DNA, 20 bp, human
gtcccttgcacaagtaaatc

SEQ ID NO: 274151 - DNA, 20 bp, human
gttcagcttggtatgcctgg

SEQ ID NO: 274152 - DNA, 20 bp, human
gttagagctgctggatgatc

SEQ ID NO: 274153 - DNA, 20 bp, human
ggcagtgagacaaaaaacat

SEQ ID NO: 274154 - DNA, 20 bp, human
gtactgggagaaaggggtat

SEQ ID NO: 274155 - DNA, 20 bp, human
gccattgtcagaattctaaa

SEQ ID NO: 274156 - DNA, 20 bp, human
gtgagcagacgcagttaagg

SEQ ID NO: 274157 - DNA, 20 bp, human
gtgcggggatgctgttcaca

SEQ ID NO: 274158 - DNA, 20 bp, human
gagggtgtcctagtccgcag

SEQ ID NO: 274159 - DNA, 20 bp, human
gttaaggaggagccatgtgc

SEQ ID NO: 274160 - DNA, 20 bp, human
gctagtccgcagaggtgtgg

SEQ ID NO: 274161 - DNA, 20 bp, human
gggatggggcacactgtccc

SEQ ID NO: 274162 - DNA, 20 bp, human
ggactaggacaccctggtgt

SEQ ID NO: 274163 - DNA, 20 bp, human
gcccagggcaggctcatgac

SEQ ID NO: 274164 - DNA, 20 bp, human
ggagaaggtgccccggtgat

SEQ ID NO: 274165 - DNA, 20 bp, human
ggtcctagtccgcagaggtg

SEQ ID NO: 274166 - DNA, 20 bp, human
gagcctcggaagtagaaaaa

SEQ ID NO: 274167 - DNA, 20 bp, human
gctgaggcatagaagttccc

SEQ ID NO: 274168 - DNA, 20 bp, human
gactgtttgccccaatactg

SEQ ID NO: 274169 - DNA, 20 bp, human
gcctcagaaagatttgtgtc

SEQ ID NO: 274170 - DNA, 20 bp, human
gaagggaggataccagtggt

SEQ ID NO: 274171 - DNA, 20 bp, human
gtaaagagagcacttgttat

SEQ ID NO: 274172 - DNA, 20 bp, human
gaacttctatgcctcagtat

SEQ ID NO: 274173 - DNA, 20 bp, human
gctccctttttctacttccg

SEQ ID NO: 274174 - DNA, 20 bp, human
gtattaaaggaaggagaggt

SEQ ID NO: 274175 - DNA, 20 bp, human
gcctctaaggcatgaatcat

SEQ ID NO: 274176 - DNA, 20 bp, human
gggacctgattgtcttccca

SEQ ID NO: 274177 - DNA, 20 bp, human
gtggaaatggtgtttatagc

SEQ ID NO: 274178 - DNA, 20 bp, human
gccaccctgggaagacaatc

SEQ ID NO: 274179 - DNA, 20 bp, human
gtgaagcaatcaccagatta

SEQ ID NO: 274180 - DNA, 20 bp, human
ggtgtttatagcaggcccat

SEQ ID NO: 274181 - DNA, 20 bp, human
gtgggcaaaacgtttcaacc

SEQ ID NO: 274182 - DNA, 20 bp, human
gtgcctagaaaacaaggcac

SEQ ID NO: 274183 - DNA, 20 bp, human
gtctacgcttggaaatggca

SEQ ID NO: 274184 - DNA, 20 bp, human
ggtcctgtgccttgttttct

SEQ ID NO: 274185 - DNA, 20 bp, human
gtgattgcttcagttttgcc

SEQ ID NO: 274186 - DNA, 20 bp, human
ggccacttaagggcacacag

SEQ ID NO: 274187 - DNA, 20 bp, human
gagtcctaaaggccacttaa

SEQ ID NO: 274188 - DNA, 20 bp, human
ggaagcagcgttggtctgtc

SEQ ID NO: 274189 - DNA, 20 bp, human
gccccgggttgtgggtttta

SEQ ID NO: 274190 - DNA, 20 bp, human
gtctgagcaaagccagctcc

SEQ ID NO: 274191 - DNA, 20 bp, human
gttggagttccccgggttgt

SEQ ID NO: 274192 - DNA, 20 bp, human
gaagtagagaccaggtagtt

SEQ ID NO: 274193 - DNA, 20 bp, human
gaggtgagttggggtgtaat

SEQ ID NO: 274194 - DNA, 20 bp, human
gggttcggggaggtgagttg

SEQ ID NO: 274195 - DNA, 20 bp, human
ggcgaggaaggacttgtgag

SEQ ID NO: 274196 - DNA, 20 bp, human
gtcgacgcatgaagctgtgg

SEQ ID NO: 274197 - DNA, 20 bp, human
ggctgtggaggtgacaactg

SEQ ID NO: 274198 - DNA, 20 bp, human
gatcttgttggggtctgtca

SEQ ID NO: 274199 - DNA, 20 bp, human
gaacatgtggtcacagaaca

SEQ ID NO: 274200 - DNA, 20 bp, human
gtggggtctgtcatggctgt

SEQ ID NO: 274201 - DNA, 20 bp, human
gagagtggaaaaagttctgc

SEQ ID NO: 274202 - DNA, 20 bp, human
gcggcccaggctacaacatg

SEQ ID NO: 274203 - DNA, 20 bp, human
gagatcccccagtgacagaa

SEQ ID NO: 274204 - DNA, 20 bp, human
gaggtaagaaaacttacatt

SEQ ID NO: 274205 - DNA, 20 bp, human
gcatggctgtaggaaaacaa

SEQ ID NO: 274206 - DNA, 20 bp, human
gtcggcgtgagacccgagga

SEQ ID NO: 274207 - DNA, 20 bp, human
gggccacataagggaacctc

SEQ ID NO: 274208 - DNA, 20 bp, human
ggttccgcccggtgaggttt

SEQ ID NO: 274209 - DNA, 20 bp, human
gcctcaggctactacacctc

SEQ ID NO: 274210 - DNA, 20 bp, human
ggcctcttccccgccctcct

SEQ ID NO: 274211 - DNA, 20 bp, human
gggcgtgacggagattcctg

SEQ ID NO: 274212 - DNA, 20 bp, human
gagcctgaggttcccttatg

SEQ ID NO: 274213 - DNA, 20 bp, human
gcagttgtaggcgtggacgt

SEQ ID NO: 274214 - DNA, 20 bp, human
gtctcacgccgaaacctcac

SEQ ID NO: 274215 - DNA, 20 bp, human
gcctgcctccgggatgaaag

SEQ ID NO: 274216 - DNA, 20 bp, human
gcctgagggcgggtctaatg

SEQ ID NO: 274217 - DNA, 20 bp, human
gcagcgccgcgcggcgtcga

SEQ ID NO: 274218 - DNA, 20 bp, human
ggaggggcggagtgaaatct

SEQ ID NO: 274219 - DNA, 20 bp, human
gggcggagtgaaatcttgga

SEQ ID NO: 274220 - DNA, 20 bp, human
ggagtcctgtccaatcctga

SEQ ID NO: 274221 - DNA, 20 bp, human
gtccctggcgagccggatct

SEQ ID NO: 274222 - DNA, 20 bp, human
ggcggggacgctccgagatc

SEQ ID NO: 274223 - DNA, 20 bp, human
ggtgcgcaaacgcctttccc

SEQ ID NO: 274224 - DNA, 20 bp, human
gcccgccctcaggattggac

SEQ ID NO: 274225 - DNA, 20 bp, human
gtccgagatccggctcgcca

SEQ ID NO: 274226 - DNA, 20 bp, human
gggttctgccatctccgggg

SEQ ID NO: 274227 - DNA, 20 bp, human
gccaagaggggcggagtggg

SEQ ID NO: 274228 - DNA, 20 bp, human
gaggggttctgccatctccg

SEQ ID NO: 274229 - DNA, 20 bp, human
gagccgcattccaagagggg

SEQ ID NO: 274230 - DNA, 20 bp, human
ggaggtccccgccccggaga

SEQ ID NO: 274231 - DNA, 20 bp, human
gattccaagaggggcggagt

SEQ ID NO: 274232 - DNA, 20 bp, human
gagtgggccgggggactcta

SEQ ID NO: 274233 - DNA, 20 bp, human
gcaaggtgaggtccccgccc

SEQ ID NO: 274234 - DNA, 20 bp, human
gcgcctacggcgcccgaaaa

SEQ ID NO: 274235 - DNA, 20 bp, human
ggaggggtctttccaaggtg

SEQ ID NO: 274236 - DNA, 20 bp, human
gggcgccggggacaggtgaa

SEQ ID NO: 274237 - DNA, 20 bp, human
gaagagcccgcggattggca

SEQ ID NO: 274238 - DNA, 20 bp, human
gtataggcgctgtctgcggg

SEQ ID NO: 274239 - DNA, 20 bp, human
ggcgccagcctataggaagg

SEQ ID NO: 274240 - DNA, 20 bp, human
gacggcctgcgccagcctat

SEQ ID NO: 274241 - DNA, 20 bp, human
gtcgcgaagagcccgcggat

SEQ ID NO: 274242 - DNA, 20 bp, human
gcctgcgccagcctatagga

SEQ ID NO: 274243 - DNA, 20 bp, human
gaaggcggtagacagcctat

SEQ ID NO: 274244 - DNA, 20 bp, human
gggattggcaaggccgaggg

SEQ ID NO: 274245 - DNA, 20 bp, human
gccgcggattggcaaggccg

SEQ ID NO: 274246 - DNA, 20 bp, human
gacaccgtgcagcaagcgga

SEQ ID NO: 274247 - DNA, 20 bp, human
ggctggggagcggtaggtgg

SEQ ID NO: 274248 - DNA, 20 bp, human
ggacacggctggggagcggt

SEQ ID NO: 274249 - DNA, 20 bp, human
gacggctggggagcggtagg

SEQ ID NO: 274250 - DNA, 20 bp, human
ggcccggggacgcatcagac

SEQ ID NO: 274251 - DNA, 20 bp, human
gtcccacaccgtgcagcaag

SEQ ID NO: 274252 - DNA, 20 bp, human
ggatttagagcagcgggaca

SEQ ID NO: 274253 - DNA, 20 bp, human
gcaggagcagtcaattcggg

SEQ ID NO: 274254 - DNA, 20 bp, human
ggtaggaaagggtcggactt

SEQ ID NO: 274255 - DNA, 20 bp, human
gagacaggagcagtcaattc

SEQ ID NO: 274256 - DNA, 20 bp, human
gcgggcggggactgtcttcg

SEQ ID NO: 274257 - DNA, 20 bp, human
gccaccgcggccaaggggag

SEQ ID NO: 274258 - DNA, 20 bp, human
gtcccgccgcctcaagtcct

SEQ ID NO: 274259 - DNA, 20 bp, human
ggcggggactgtcttcgcgg

SEQ ID NO: 274260 - DNA, 20 bp, human
gcagtccccgcccgccgggt

SEQ ID NO: 274261 - DNA, 20 bp, human
gacccaaggacttgaggcgg

SEQ ID NO: 274262 - DNA, 20 bp, human
gtgaccaatcaaggcccggg

SEQ ID NO: 274263 - DNA, 20 bp, human
gaagagcggggcggtctcct

SEQ ID NO: 274264 - DNA, 20 bp, human
gcccgcccacccggcgggcg

SEQ ID NO: 274265 - DNA, 20 bp, human
gttgcactacccaagagcgt

SEQ ID NO: 274266 - DNA, 20 bp, human
gggcaactgtaaaggaagta

SEQ ID NO: 274267 - DNA, 20 bp, human
gggcatagaagaatagtagt

SEQ ID NO: 274268 - DNA, 20 bp, human
gcctgtgcccagaagggagg

SEQ ID NO: 274269 - DNA, 20 bp, human
gggccctgtgcccagaaggg

SEQ ID NO: 274270 - DNA, 20 bp, human
gtagcacagttcaggtggaa

SEQ ID NO: 274271 - DNA, 20 bp, human
gttaatgtggcaggagctgt

SEQ ID NO: 274272 - DNA, 20 bp, human
gtaactgagggcaactgtaa

SEQ ID NO: 274273 - DNA, 20 bp, human
gagaaaaaagggggtactta

SEQ ID NO: 274274 - DNA, 20 bp, human
gcttagggtaccctacccac

SEQ ID NO: 274275 - DNA, 20 bp, human
gcagttgccctcagttagaa

SEQ ID NO: 274276 - DNA, 20 bp, human
ggggccccggccaatcgcga

SEQ ID NO: 274277 - DNA, 20 bp, human
gcgaagcggaagacgcggat

SEQ ID NO: 274278 - DNA, 20 bp, human
gccgacggaaacattccaga

SEQ ID NO: 274279 - DNA, 20 bp, human
gcgaggcggagggatccctc

SEQ ID NO: 274280 - DNA, 20 bp, human
gccacccgaagcggaagacg

SEQ ID NO: 274281 - DNA, 20 bp, human
gcccctgaaccacgtgctgt

SEQ ID NO: 274282 - DNA, 20 bp, human
gggctggctgtaccaccgga

SEQ ID NO: 274283 - DNA, 20 bp, human
gggaggagtcgggaagagcc

SEQ ID NO: 274284 - DNA, 20 bp, human
gccccggccaatcgcgaggg

SEQ ID NO: 274285 - DNA, 20 bp, human
gccgtcgggtccacccgaag

SEQ ID NO: 274286 - DNA, 20 bp, human
gcgggcggctgctccggtcc

SEQ ID NO: 274287 - DNA, 20 bp, human
gcgcccagcctcccccggga

SEQ ID NO: 274288 - DNA, 20 bp, human
gaaacctggtgataggatga

SEQ ID NO: 274289 - DNA, 20 bp, human
gtgctccggtccaggggtgg

SEQ ID NO: 274290 - DNA, 20 bp, human
gtagggataaacctggtgat

SEQ ID NO: 274291 - DNA, 20 bp, human
gacgctctgcagggcagaat

SEQ ID NO: 274292 - DNA, 20 bp, human
gagtccctcatcctatcacc

SEQ ID NO: 274293 - DNA, 20 bp, human
ggcctcccccgggatggatc

SEQ ID NO: 274294 - DNA, 20 bp, human
ggaagcgcggctgccattgg

SEQ ID NO: 274295 - DNA, 20 bp, human
gtctctccagatccatcccg

SEQ ID NO: 274296 - DNA, 20 bp, human
gcggactgcgggtatccccg

SEQ ID NO: 274297 - DNA, 20 bp, human
gagccgagacgcccgggtaa

SEQ ID NO: 274298 - DNA, 20 bp, human
ggacaccgcggggtgcgcag

SEQ ID NO: 274299 - DNA, 20 bp, human
gccgcggggtgcgcaggggt

SEQ ID NO: 274300 - DNA, 20 bp, human
gactgcgggtatccccgggg

SEQ ID NO: 274301 - DNA, 20 bp, human
gctgcaggaagcggcggatc

SEQ ID NO: 274302 - DNA, 20 bp, human
gcgcgacagccgagacgccc

SEQ ID NO: 274303 - DNA, 20 bp, human
gggatacccgcagtccgggg

SEQ ID NO: 274304 - DNA, 20 bp, human
gcaggaagcggcggatccgg

SEQ ID NO: 274305 - DNA, 20 bp, human
gagaacagggaccacaaata

SEQ ID NO: 274306 - DNA, 20 bp, human
ggccaaggcgggacagggaa

SEQ ID NO: 274307 - DNA, 20 bp, human
gcgggacagggaacggaagc

SEQ ID NO: 274308 - DNA, 20 bp, human
gtcatcaaggtcatgaggga

SEQ ID NO: 274309 - DNA, 20 bp, human
ggagcagggggcagtcatca

SEQ ID NO: 274310 - DNA, 20 bp, human
ggcagtcatcaaggtcatga

SEQ ID NO: 274311 - DNA, 20 bp, human
ggaacggaagcggggagctc

SEQ ID NO: 274312 - DNA, 20 bp, human
ggcggggccaaggcgggaca

SEQ ID NO: 274313 - DNA, 20 bp, human
gaggggtcctcaggacgata

SEQ ID NO: 274314 - DNA, 20 bp, human
ggtgtcacacacaatcccat

SEQ ID NO: 274315 - DNA, 20 bp, human
gtgtgaccatgggactgtat

SEQ ID NO: 274316 - DNA, 20 bp, human
gcccgggcttcctttctcta

SEQ ID NO: 274317 - DNA, 20 bp, human
gcggggccgggcatctgccg

SEQ ID NO: 274318 - DNA, 20 bp, human
ggcagatgcccggccccggc

SEQ ID NO: 274319 - DNA, 20 bp, human
gggccgcgccccctagagaa

SEQ ID NO: 274320 - DNA, 20 bp, human
gagaaaggaagcccgggcgc

SEQ ID NO: 274321 - DNA, 20 bp, human
gggggcgggggcgcttaaag

SEQ ID NO: 274322 - DNA, 20 bp, human
gacggcgagggtggggatta

SEQ ID NO: 274323 - DNA, 20 bp, human
gctgggcccacggacggcga

SEQ ID NO: 274324 - DNA, 20 bp, human
gagcgctgcagcggaggcca

SEQ ID NO: 274325 - DNA, 20 bp, human
gggccaggcgagcgctgcag

SEQ ID NO: 274326 - DNA, 20 bp, human
gcgcgcggggaggtgccctt

SEQ ID NO: 274327 - DNA, 20 bp, human
gctcactcaagatggcgaca

SEQ ID NO: 274328 - DNA, 20 bp, human
ggaatttgggtcttcttctc

SEQ ID NO: 274329 - DNA, 20 bp, human
gcccctggtattaatcagtt

SEQ ID NO: 274330 - DNA, 20 bp, human
ggagtgtcaggtcatgtgac

SEQ ID NO: 274331 - DNA, 20 bp, human
gacagcacgcacgcgcgggg

SEQ ID NO: 274332 - DNA, 20 bp, human
ggattgcctcaggaaggttg

SEQ ID NO: 274333 - DNA, 20 bp, human
ggtattaatcagttgggacg

SEQ ID NO: 274334 - DNA, 20 bp, human
gcaggtcatgtgaccggaaa

SEQ ID NO: 274335 - DNA, 20 bp, human
gcaaggctgcaaggcgctga

SEQ ID NO: 274336 - DNA, 20 bp, human
ggaggctggtaaatgtggaa

SEQ ID NO: 274337 - DNA, 20 bp, human
gaggaggggctagaagaaag

SEQ ID NO: 274338 - DNA, 20 bp, human
gggtaaatgtggaagggctg

SEQ ID NO: 274339 - DNA, 20 bp, human
gctgactcaactgggaggag

SEQ ID NO: 274340 - DNA, 20 bp, human
gtcaagccactgactcaact

SEQ ID NO: 274341 - DNA, 20 bp, human
gaagaggcaaagagcagcag

SEQ ID NO: 274342 - DNA, 20 bp, human
gaaagagcagcagtgggatc

SEQ ID NO: 274343 - DNA, 20 bp, human
gggacatgaacgcctctact

SEQ ID NO: 274344 - DNA, 20 bp, human
gagccactgactcaactggg

SEQ ID NO: 274345 - DNA, 20 bp, human
ggaggagcaactccaagtag

SEQ ID NO: 274346 - DNA, 20 bp, human
gataacaggcagctttgtgg

SEQ ID NO: 274347 - DNA, 20 bp, human
ggtaagtagcgtatctcatg

SEQ ID NO: 274348 - DNA, 20 bp, human
gagaataacaggcagctttg

SEQ ID NO: 274349 - DNA, 20 bp, human
ggggtagggaacacttcctg

SEQ ID NO: 274350 - DNA, 20 bp, human
gggaaaaataactacaactt

SEQ ID NO: 274351 - DNA, 20 bp, human
ggtaaactgctgaaattgtg

SEQ ID NO: 274352 - DNA, 20 bp, human
gctacaacttgggatgggta

SEQ ID NO: 274353 - DNA, 20 bp, human
gaggttaatagcacccatgg

SEQ ID NO: 274354 - DNA, 20 bp, human
gaataactacaacttgggat

SEQ ID NO: 274355 - DNA, 20 bp, human
gtatgtcagcaaaattatga

SEQ ID NO: 274356 - DNA, 20 bp, human
gtggctgcgcgtacagggta

SEQ ID NO: 274357 - DNA, 20 bp, human
gtggacgtgcgcgcggggta

SEQ ID NO: 274358 - DNA, 20 bp, human
ggctgcagggatggcgatca

SEQ ID NO: 274359 - DNA, 20 bp, human
gtgctgtggctgcgcgtaca

SEQ ID NO: 274360 - DNA, 20 bp, human
ggcccgcgcaggtgcgggat

SEQ ID NO: 274361 - DNA, 20 bp, human
gatgccccggagtgcgtagg

SEQ ID NO: 274362 - DNA, 20 bp, human
gtcgggcgcagcgcacactg

SEQ ID NO: 274363 - DNA, 20 bp, human
ggggcggtaggtgtgcgtgc

SEQ ID NO: 274364 - DNA, 20 bp, human
ggtcccgcgcgggcatgccc

SEQ ID NO: 274365 - DNA, 20 bp, human
gggcatgccccggagtgcgt

SEQ ID NO: 274366 - DNA, 20 bp, human
gactccctaaacccactccg

SEQ ID NO: 274367 - DNA, 20 bp, human
gaggcccacctccccggagt

SEQ ID NO: 274368 - DNA, 20 bp, human
gaaacccactccggggaggt

SEQ ID NO: 274369 - DNA, 20 bp, human
gacggcgcgggaagctccaa

SEQ ID NO: 274370 - DNA, 20 bp, human
ggcaggaaacgcgacgggga

SEQ ID NO: 274371 - DNA, 20 bp, human
ggggcctgtgtgatttgcgg

SEQ ID NO: 274372 - DNA, 20 bp, human
gtgggagaactctccttccc

SEQ ID NO: 274373 - DNA, 20 bp, human
gttaaatagcgcagaggggc

SEQ ID NO: 274374 - DNA, 20 bp, human
gccctaaacccactccgggg

SEQ ID NO: 274375 - DNA, 20 bp, human
ggtgggggcaggaaacgcga

SEQ ID NO: 274376 - DNA, 20 bp, human
gggggagaatctaaagtaga

SEQ ID NO: 274377 - DNA, 20 bp, human
gctaccagaactaactgcag

SEQ ID NO: 274378 - DNA, 20 bp, human
ggcctctgaagcaactcttg

SEQ ID NO: 274379 - DNA, 20 bp, human
ggaagcggtggggctaagtg

SEQ ID NO: 274380 - DNA, 20 bp, human
gtctccctcctgttcaccag

SEQ ID NO: 274381 - DNA, 20 bp, human
ggaggctcactcctattcac

SEQ ID NO: 274382 - DNA, 20 bp, human
gcagggaattggttttctat

SEQ ID NO: 274383 - DNA, 20 bp, human
ggctctctccatttactggg

SEQ ID NO: 274384 - DNA, 20 bp, human
gcaggcaagaaacagggaat

SEQ ID NO: 274385 - DNA, 20 bp, human
ggaatgaaggaggggctgac

SEQ ID NO: 274386 - DNA, 20 bp, human
gaggggagcacagtgagctg

SEQ ID NO: 274387 - DNA, 20 bp, human
ggtgagctgaggctacgagg

SEQ ID NO: 274388 - DNA, 20 bp, human
ggggagggagggattcagag

SEQ ID NO: 274389 - DNA, 20 bp, human
gacagtgagctgaggctacg

SEQ ID NO: 274390 - DNA, 20 bp, human
gtgaggctacgaggaggtgg

SEQ ID NO: 274391 - DNA, 20 bp, human
ggtgggcaggaagagactta

SEQ ID NO: 274392 - DNA, 20 bp, human
gctgtgaggacaaggacaac

SEQ ID NO: 274393 - DNA, 20 bp, human
gaggtggtgcaccagcggcc

SEQ ID NO: 274394 - DNA, 20 bp, human
gaggcgacgcagcagagggg

SEQ ID NO: 274395 - DNA, 20 bp, human
gtagggaggtggtgcaccag

SEQ ID NO: 274396 - DNA, 20 bp, human
gagaatgggagagctgtgtt

SEQ ID NO: 274397 - DNA, 20 bp, human
gtgagcagatatgactggat

SEQ ID NO: 274398 - DNA, 20 bp, human
gcagtcgtgcagcacagtag

SEQ ID NO: 274399 - DNA, 20 bp, human
gtcgtgcagcacagtagggg

SEQ ID NO: 274400 - DNA, 20 bp, human
gacaatgggagtgagagaat

SEQ ID NO: 274401 - DNA, 20 bp, human
ggggatgtttgggaaacaat

SEQ ID NO: 274402 - DNA, 20 bp, human
gaggggcggggtagagaagt

SEQ ID NO: 274403 - DNA, 20 bp, human
gcccctaggctcatgcgctc

SEQ ID NO: 274404 - DNA, 20 bp, human
gtgggagcttaaaatattgc

SEQ ID NO: 274405 - DNA, 20 bp, human
gtgactggattggccctgat

SEQ ID NO: 274406 - DNA, 20 bp, human
gtacctaatggctgcttttt

SEQ ID NO: 274407 - DNA, 20 bp, human
gttactagataataacttct

SEQ ID NO: 274408 - DNA, 20 bp, human
gggacatgacccatttatta

SEQ ID NO: 274409 - DNA, 20 bp, human
gtgacatctctgaattatgg

SEQ ID NO: 274410 - DNA, 20 bp, human
gctattgaacacttgcatta

SEQ ID NO: 274411 - DNA, 20 bp, human
gcattcactcagcttaattt

SEQ ID NO: 274412 - DNA, 20 bp, human
gctagtaagaaagacttttt

SEQ ID NO: 274413 - DNA, 20 bp, human
ggtcatctgccttaataaat

SEQ ID NO: 274414 - DNA, 20 bp, human
gtgtatgcaacttttgccac

SEQ ID NO: 274415 - DNA, 20 bp, human
gaattgttaataacagaaca

SEQ ID NO: 274416 - DNA, 20 bp, human
ggatcctctgagctccctat

SEQ ID NO: 274417 - DNA, 20 bp, human
ggggacaaggcagtgactcc

SEQ ID NO: 274418 - DNA, 20 bp, human
ggggctggttaatgtttgtc

SEQ ID NO: 274419 - DNA, 20 bp, human
ggggctgggctgacagtacc

SEQ ID NO: 274420 - DNA, 20 bp, human
gagtcactgccttgtcccag

SEQ ID NO: 274421 - DNA, 20 bp, human
ggcagagagggatcctgtac

SEQ ID NO: 274422 - DNA, 20 bp, human
gtcccagagagactaaacat

SEQ ID NO: 274423 - DNA, 20 bp, human
ggggagggacaacgaaccca

SEQ ID NO: 274424 - DNA, 20 bp, human
gaaacccatagggagctcag

SEQ ID NO: 274425 - DNA, 20 bp, human
gtgtttgtctggttcctctt

SEQ ID NO: 274426 - DNA, 20 bp, human
ggaccgggcgggcacagaac

SEQ ID NO: 274427 - DNA, 20 bp, human
ggcacagaacaggtgggtgc

SEQ ID NO: 274428 - DNA, 20 bp, human
gcacaagtgctctgtgtgta

SEQ ID NO: 274429 - DNA, 20 bp, human
gcagaagaatggccacgggg

SEQ ID NO: 274430 - DNA, 20 bp, human
gtatggggcgggtgcggcga

SEQ ID NO: 274431 - DNA, 20 bp, human
ggtgcggcgatggaccgggc

SEQ ID NO: 274432 - DNA, 20 bp, human
gcggtgatgaattgggacgc

SEQ ID NO: 274433 - DNA, 20 bp, human
ggggcgggcacagaacaggt

SEQ ID NO: 274434 - DNA, 20 bp, human
gcaggcaggtggatgtgaag

SEQ ID NO: 274435 - DNA, 20 bp, human
gcaggctgggtgtccggcgc

SEQ ID NO: 274436 - DNA, 20 bp, human
gaggcggcgctcggggtaac

SEQ ID NO: 274437 - DNA, 20 bp, human
gtaggagatcgggacctcga

SEQ ID NO: 274438 - DNA, 20 bp, human
ggggacctcgaaggggactt

SEQ ID NO: 274439 - DNA, 20 bp, human
ggggcacttggggaactcat

SEQ ID NO: 274440 - DNA, 20 bp, human
gactgggaaagttacggagg

SEQ ID NO: 274441 - DNA, 20 bp, human
gaccccccaagtccccttcg

SEQ ID NO: 274442 - DNA, 20 bp, human
gcggcgctcggggtaaccgg

SEQ ID NO: 274443 - DNA, 20 bp, human
gggcggcccgggtgaagcgg

SEQ ID NO: 274444 - DNA, 20 bp, human
gggaactcatgggggctcaa

SEQ ID NO: 274445 - DNA, 20 bp, human
gggtaaccgggggagactca

SEQ ID NO: 274446 - DNA, 20 bp, human
gacgctgcagacgatcctgg

SEQ ID NO: 274447 - DNA, 20 bp, human
gttagctgaaaggcactcag

SEQ ID NO: 274448 - DNA, 20 bp, human
gtactctgggcggtttgctc

SEQ ID NO: 274449 - DNA, 20 bp, human
gggcacgctgcagacgatcc

SEQ ID NO: 274450 - DNA, 20 bp, human
gcactagctaggacagaaca

SEQ ID NO: 274451 - DNA, 20 bp, human
ggggagacttctctgagtct

SEQ ID NO: 274452 - DNA, 20 bp, human
gtaagagttggtgtttgctc

SEQ ID NO: 274453 - DNA, 20 bp, human
gaagctctgcagaggatgca

SEQ ID NO: 274454 - DNA, 20 bp, human
gtacacaacctcaccaaaac

SEQ ID NO: 274455 - DNA, 20 bp, human
gatcctcgttgtggctgcaa

SEQ ID NO: 274456 - DNA, 20 bp, human
gcagctctatatcgactgat

SEQ ID NO: 274457 - DNA, 20 bp, human
gatgaacagacgattcagga

SEQ ID NO: 274458 - DNA, 20 bp, human
ggtagatagcatacttccac

SEQ ID NO: 274459 - DNA, 20 bp, human
gccctctgagtcactccagg

SEQ ID NO: 274460 - DNA, 20 bp, human
gagtccctggatcttagggt

SEQ ID NO: 274461 - DNA, 20 bp, human
ggaatatgaacagacgattc

SEQ ID NO: 274462 - DNA, 20 bp, human
ggcaggtgggtctgcggctg

SEQ ID NO: 274463 - DNA, 20 bp, human
gtgggagtccctggatctta

SEQ ID NO: 274464 - DNA, 20 bp, human
gactatatagtcttaacctg

SEQ ID NO: 274465 - DNA, 20 bp, human
gttcaggaatgagggcgggt

SEQ ID NO: 274466 - DNA, 20 bp, human
gtcccaggcaggcaggtatg

SEQ ID NO: 274467 - DNA, 20 bp, human
gtgggtgagactgctgtgtg

SEQ ID NO: 274468 - DNA, 20 bp, human
ggggacagggtcaatcccac

SEQ ID NO: 274469 - DNA, 20 bp, human
gcaggagggcggacttcccc

SEQ ID NO: 274470 - DNA, 20 bp, human
gccaggctagagaggaggcg

SEQ ID NO: 274471 - DNA, 20 bp, human
gtagagaggaggcgtgggcc

SEQ ID NO: 274472 - DNA, 20 bp, human
gaggcagggtaaggaggcaa

SEQ ID NO: 274473 - DNA, 20 bp, human
gtctcagcagctgacatcta

SEQ ID NO: 274474 - DNA, 20 bp, human
gcaagcgagagtgattgggt

SEQ ID NO: 274475 - DNA, 20 bp, human
gacctgcggctcttctctcc

SEQ ID NO: 274476 - DNA, 20 bp, human
gactgcttctgatgaggctc

SEQ ID NO: 274477 - DNA, 20 bp, human
gtctcccctgagaggatacc

SEQ ID NO: 274478 - DNA, 20 bp, human
ggagaggataccaggattcg

SEQ ID NO: 274479 - DNA, 20 bp, human
gcaggctgggccagcacacc

SEQ ID NO: 274480 - DNA, 20 bp, human
ggcctcatcagaagcagtct

SEQ ID NO: 274481 - DNA, 20 bp, human
gaatcctggtatcctctcag

SEQ ID NO: 274482 - DNA, 20 bp, human
ggcccagccaatggcagtgc

SEQ ID NO: 274483 - DNA, 20 bp, human
gacagatgggaggatgaaca

SEQ ID NO: 274484 - DNA, 20 bp, human
gtctaagcacttcaccccta

SEQ ID NO: 274485 - DNA, 20 bp, human
ggacctgcactgccattggc

SEQ ID NO: 274486 - DNA, 20 bp, human
gggcgcggaccgtccccctg

SEQ ID NO: 274487 - DNA, 20 bp, human
ggaccggggctgtccctccg

SEQ ID NO: 274488 - DNA, 20 bp, human
gcccagcggctagtgcgccc

SEQ ID NO: 274489 - DNA, 20 bp, human
gggagcaaggagtgcaggac

SEQ ID NO: 274490 - DNA, 20 bp, human
gcggggccggatgcgcagag

SEQ ID NO: 274491 - DNA, 20 bp, human
gccccacgggtgcactaggg

SEQ ID NO: 274492 - DNA, 20 bp, human
gctagtgcgccccgggtagg

SEQ ID NO: 274493 - DNA, 20 bp, human
gcgcccccgccacgggaaaa

SEQ ID NO: 274494 - DNA, 20 bp, human
gcaccccgcgggctatgaga

SEQ ID NO: 274495 - DNA, 20 bp, human
gcgcctgctcaggccctcga

SEQ ID NO: 274496 - DNA, 20 bp, human
ggcagcaccctgcaattcta

SEQ ID NO: 274497 - DNA, 20 bp, human
gcagtctccttagaattgca

SEQ ID NO: 274498 - DNA, 20 bp, human
gtagcctgtcacataactgg

SEQ ID NO: 274499 - DNA, 20 bp, human
gctgctcagaactgctcctg

SEQ ID NO: 274500 - DNA, 20 bp, human
gacctcagtgtcccctgggt

SEQ ID NO: 274501 - DNA, 20 bp, human
gtggggagcaggaagggtca

SEQ ID NO: 274502 - DNA, 20 bp, human
ggggcaagaaaatagctgta

SEQ ID NO: 274503 - DNA, 20 bp, human
gctctagcctgtcacataac

SEQ ID NO: 274504 - DNA, 20 bp, human
gcaattctaaggagactgca

SEQ ID NO: 274505 - DNA, 20 bp, human
gttagattctgctagaactg

SEQ ID NO: 274506 - DNA, 20 bp, human
gactcagattgtcagtactc

SEQ ID NO: 274507 - DNA, 20 bp, human
gaatgtcatggactactgtt

SEQ ID NO: 274508 - DNA, 20 bp, human
gcaactggacatctaacatt

SEQ ID NO: 274509 - DNA, 20 bp, human
gagacagtactacatccaag

SEQ ID NO: 274510 - DNA, 20 bp, human
gaaaaggggaaaggctttgc

SEQ ID NO: 274511 - DNA, 20 bp, human
ggactactgttcggtgccga

SEQ ID NO: 274512 - DNA, 20 bp, human
gtagtactgtctctgaaaaa

SEQ ID NO: 274513 - DNA, 20 bp, human
gtgacaatctgagtctcatc

SEQ ID NO: 274514 - DNA, 20 bp, human
gtgttagatgtccagttggt

SEQ ID NO: 274515 - DNA, 20 bp, human
gctggcttcccccaatgtca

SEQ ID NO: 274516 - DNA, 20 bp, human
ggggtgaggtggtgaaatat

SEQ ID NO: 274517 - DNA, 20 bp, human
gctggtaaggacatctcctt

SEQ ID NO: 274518 - DNA, 20 bp, human
ggaggtggtgaaatattggt

SEQ ID NO: 274519 - DNA, 20 bp, human
gctaggtgatcgcaccctcc

SEQ ID NO: 274520 - DNA, 20 bp, human
gtgatcgcaccctcctggta

SEQ ID NO: 274521 - DNA, 20 bp, human
gaggacatctccttgggtct

SEQ ID NO: 274522 - DNA, 20 bp, human
gggagatgtccttaccagga

SEQ ID NO: 274523 - DNA, 20 bp, human
gtggtgaaatattggtgggc

SEQ ID NO: 274524 - DNA, 20 bp, human
gatcaattcaagagtaagat

SEQ ID NO: 274525 - DNA, 20 bp, human
gagtatctttcctgccgggc

SEQ ID NO: 274526 - DNA, 20 bp, human
gacgtggcgctcgagtggga

SEQ ID NO: 274527 - DNA, 20 bp, human
gggggcgccccagaacgcgc

SEQ ID NO: 274528 - DNA, 20 bp, human
gagcggcgaggactcgaccg

SEQ ID NO: 274529 - DNA, 20 bp, human
gtggcgctcgagtgggaggg

SEQ ID NO: 274530 - DNA, 20 bp, human
gcggggtccagactccacgc

SEQ ID NO: 274531 - DNA, 20 bp, human
gcggcacgtggcgctcgagt

SEQ ID NO: 274532 - DNA, 20 bp, human
gagggcccgccagatcctcg

SEQ ID NO: 274533 - DNA, 20 bp, human
ggcactgcgcgctgcggtgg

SEQ ID NO: 274534 - DNA, 20 bp, human
gactctggggctacccctta

SEQ ID NO: 274535 - DNA, 20 bp, human
ggaattgtagagcagaacct

SEQ ID NO: 274536 - DNA, 20 bp, human
gagggtgcccggccggaaat

SEQ ID NO: 274537 - DNA, 20 bp, human
gccctggagcaagcgaccgg

SEQ ID NO: 274538 - DNA, 20 bp, human
gcaggtggactgagcttcgg

SEQ ID NO: 274539 - DNA, 20 bp, human
ggggtggggtgtagacagat

SEQ ID NO: 274540 - DNA, 20 bp, human
gagggctggggctgacccta

SEQ ID NO: 274541 - DNA, 20 bp, human
gcgcccagtccaggcggctc

SEQ ID NO: 274542 - DNA, 20 bp, human
gccccagaggcacctcacct

SEQ ID NO: 274543 - DNA, 20 bp, human
gctggggctgaccctagggg

SEQ ID NO: 274544 - DNA, 20 bp, human
ggtgctgccagccaccccta

SEQ ID NO: 274545 - DNA, 20 bp, human
gggctctggcctgtatcctc

SEQ ID NO: 274546 - DNA, 20 bp, human
ggtacccagcgccctctata

SEQ ID NO: 274547 - DNA, 20 bp, human
gccagaaacgcagcggggag

SEQ ID NO: 274548 - DNA, 20 bp, human
gagagtgaaacccatataga

SEQ ID NO: 274549 - DNA, 20 bp, human
gctaatccaaggatcactga

SEQ ID NO: 274550 - DNA, 20 bp, human
gtggattaggagtgacaagg

SEQ ID NO: 274551 - DNA, 20 bp, human
gccttggattaggagtgaca

SEQ ID NO: 274552 - DNA, 20 bp, human
gaaacccatatagagggcgc

SEQ ID NO: 274553 - DNA, 20 bp, human
gtaggagtgacaaggtggac

SEQ ID NO: 274554 - DNA, 20 bp, human
gacatcctgttttggagcag

SEQ ID NO: 274555 - DNA, 20 bp, human
gtctggcactgggaattatc

SEQ ID NO: 274556 - DNA, 20 bp, human
ggctccccgagaagccccga

SEQ ID NO: 274557 - DNA, 20 bp, human
gagaggggcaagagtcctgg

SEQ ID NO: 274558 - DNA, 20 bp, human
gggagcggggcgatttcgaa

SEQ ID NO: 274559 - DNA, 20 bp, human
ggagccgggagcggacgcgt

SEQ ID NO: 274560 - DNA, 20 bp, human
gcgcccctcggggcttctcg

SEQ ID NO: 274561 - DNA, 20 bp, human
gaagagtcctggaggcccgg

SEQ ID NO: 274562 - DNA, 20 bp, human
gagcggacgcgtgggtgagt

SEQ ID NO: 274563 - DNA, 20 bp, human
gcggggcgatttcgaaagga

SEQ ID NO: 274564 - DNA, 20 bp, human
ggctgcgcgtcggagcccga

SEQ ID NO: 274565 - DNA, 20 bp, human
gctgaccgccagacccaagc

SEQ ID NO: 274566 - DNA, 20 bp, human
ggatctaggctccagactga

SEQ ID NO: 274567 - DNA, 20 bp, human
gaggaacagggtgaccctgc

SEQ ID NO: 274568 - DNA, 20 bp, human
gggccacagagcccagcaag

SEQ ID NO: 274569 - DNA, 20 bp, human
gccctgtgaagatggtcttc

SEQ ID NO: 274570 - DNA, 20 bp, human
gacggaccacgccccttgct

SEQ ID NO: 274571 - DNA, 20 bp, human
gtcgataaaggatgtggctc

SEQ ID NO: 274572 - DNA, 20 bp, human
gcccccagcttcctcgataa

SEQ ID NO: 274573 - DNA, 20 bp, human
gcccagacagaccctcagtc

SEQ ID NO: 274574 - DNA, 20 bp, human
gtggtccgtgcctgttccca

SEQ ID NO: 274575 - DNA, 20 bp, human
ggcttcctcgataaaggatg

SEQ ID NO: 274576 - DNA, 20 bp, human
gcaacggaccccaccccgat

SEQ ID NO: 274577 - DNA, 20 bp, human
gggcggggagtcaggggatg

SEQ ID NO: 274578 - DNA, 20 bp, human
gcaccccgataggcttggaa

SEQ ID NO: 274579 - DNA, 20 bp, human
gcaggggatggggcaagtca

SEQ ID NO: 274580 - DNA, 20 bp, human
gaggaacgcccactccccca

SEQ ID NO: 274581 - DNA, 20 bp, human
ggccccttccaagcctatcg

SEQ ID NO: 274582 - DNA, 20 bp, human
gctcgtgggccgcctctggc

SEQ ID NO: 274583 - DNA, 20 bp, human
gcccactcccccatggcgct

SEQ ID NO: 274584 - DNA, 20 bp, human
ggagaccagtatgaaacgga

SEQ ID NO: 274585 - DNA, 20 bp, human
ggaccccaccccgataggct

SEQ ID NO: 274586 - DNA, 20 bp, human
ggacacaggaattcagaata

SEQ ID NO: 274587 - DNA, 20 bp, human
gcacaggccgggaatatccc

SEQ ID NO: 274588 - DNA, 20 bp, human
gaataagggcgagatccttg

SEQ ID NO: 274589 - DNA, 20 bp, human
gggcagccccctactcactg

SEQ ID NO: 274590 - DNA, 20 bp, human
gtactcactggggaagtcat

SEQ ID NO: 274591 - DNA, 20 bp, human
gtactcgcctgggatattcc

SEQ ID NO: 274592 - DNA, 20 bp, human
gctgcctgcaccaatgacac

SEQ ID NO: 274593 - DNA, 20 bp, human
gccacaaatggcaagtggaa

SEQ ID NO: 274594 - DNA, 20 bp, human
gcctcagaggcaaacggctt

SEQ ID NO: 274595 - DNA, 20 bp, human
ggcttagggccgtctcaact

SEQ ID NO: 274596 - DNA, 20 bp, human
gcaagaggccacccccacaa

SEQ ID NO: 274597 - DNA, 20 bp, human
gggactgtatctaaattagt

SEQ ID NO: 274598 - DNA, 20 bp, human
gagtcaagggattattagat

SEQ ID NO: 274599 - DNA, 20 bp, human
gcccagagatctaagagtaa

SEQ ID NO: 274600 - DNA, 20 bp, human
gggagtgccagcaaagcaag

SEQ ID NO: 274601 - DNA, 20 bp, human
gctttgctggcactcctggc

SEQ ID NO: 274602 - DNA, 20 bp, human
gtctaagagtaaaggaggag

SEQ ID NO: 274603 - DNA, 20 bp, human
gttttgggacagagatagga

SEQ ID NO: 274604 - DNA, 20 bp, human
gagtgctcagaacctttgtg

SEQ ID NO: 274605 - DNA, 20 bp, human
gatgctgacagtgtaagtca

SEQ ID NO: 274606 - DNA, 20 bp, human
gcgaacgctcggacaggcag

SEQ ID NO: 274607 - DNA, 20 bp, human
ggctccaggggcgtgtcagg

SEQ ID NO: 274608 - DNA, 20 bp, human
gagggcgatgagacgtcacg

SEQ ID NO: 274609 - DNA, 20 bp, human
gcccccaccgcgtaccccca

SEQ ID NO: 274610 - DNA, 20 bp, human
gaaggctccaggggcgtgtc

SEQ ID NO: 274611 - DNA, 20 bp, human
gcccacgtgacctactgcgc

SEQ ID NO: 274612 - DNA, 20 bp, human
gaggcggcggcccgcgcagt

SEQ ID NO: 274613 - DNA, 20 bp, human
gaggctgcgcgcgggtaaag

SEQ ID NO: 274614 - DNA, 20 bp, human
gaagagccgaacgctcggac

SEQ ID NO: 274615 - DNA, 20 bp, human
ggagccttgggggtacgcgg

SEQ ID NO: 274616 - DNA, 20 bp, human
gagtcaggagcacaaggcgc

SEQ ID NO: 274617 - DNA, 20 bp, human
gaggcgccgcgccagttaaa

SEQ ID NO: 274618 - DNA, 20 bp, human
gcacacaaaagagtgaacgc

SEQ ID NO: 274619 - DNA, 20 bp, human
gaccgccgtggcctgggaaa

SEQ ID NO: 274620 - DNA, 20 bp, human
gtcccaggccacggcggtgt

SEQ ID NO: 274621 - DNA, 20 bp, human
gctggaggtgaagcctgggc

SEQ ID NO: 274622 - DNA, 20 bp, human
gcccaacaccgccgtggcct

SEQ ID NO: 274623 - DNA, 20 bp, human
gcagacctgcactattaaga

SEQ ID NO: 274624 - DNA, 20 bp, human
gcgcgccagttaaagggcaa

SEQ ID NO: 274625 - DNA, 20 bp, human
ggcaacctttgccctttaac

SEQ ID NO: 274626 - DNA, 20 bp, human
gtccagtcgccggccgcggt

SEQ ID NO: 274627 - DNA, 20 bp, human
gtgagcatggctggcgatct

SEQ ID NO: 274628 - DNA, 20 bp, human
ggcccgtggcgtcacggcgt

SEQ ID NO: 274629 - DNA, 20 bp, human
gtcagccggagagcctagag

SEQ ID NO: 274630 - DNA, 20 bp, human
gcccaacccgggccccaacc

SEQ ID NO: 274631 - DNA, 20 bp, human
gtggcgtcacggcgtcgggg

SEQ ID NO: 274632 - DNA, 20 bp, human
gtccccgggcggcccaaccc

SEQ ID NO: 274633 - DNA, 20 bp, human
gagcctccagtcgccggccg

SEQ ID NO: 274634 - DNA, 20 bp, human
ggcgcgcgcccgtggcgtca

SEQ ID NO: 274635 - DNA, 20 bp, human
gcacggcgtcggggtggagc

SEQ ID NO: 274636 - DNA, 20 bp, human
gtccaaacgcctcacgtagg

SEQ ID NO: 274637 - DNA, 20 bp, human
gggagagcgcggctgagagc

SEQ ID NO: 274638 - DNA, 20 bp, human
ggcctagagtctcactccct

SEQ ID NO: 274639 - DNA, 20 bp, human
gcccgagggagtgagactct

SEQ ID NO: 274640 - DNA, 20 bp, human
ggacgcggagagcggttaga

SEQ ID NO: 274641 - DNA, 20 bp, human
ggggggtttgtttattttcg

SEQ ID NO: 274642 - DNA, 20 bp, human
gtaaccgctctccgcgtcgc

SEQ ID NO: 274643 - DNA, 20 bp, human
gaaacgcctcacgtaggcgg

SEQ ID NO: 274644 - DNA, 20 bp, human
ggagagcggttagagggccc

SEQ ID NO: 274645 - DNA, 20 bp, human
gtcacctgcgacgcggagag

SEQ ID NO: 274646 - DNA, 20 bp, human
gggaaggcctagtatacacg

SEQ ID NO: 274647 - DNA, 20 bp, human
gcacgcccacagctttgact

SEQ ID NO: 274648 - DNA, 20 bp, human
gcaaactaggtgttatcagg

SEQ ID NO: 274649 - DNA, 20 bp, human
ggaaaagccacgtgtatact

SEQ ID NO: 274650 - DNA, 20 bp, human
gactcaaactaggtgttatc

SEQ ID NO: 274651 - DNA, 20 bp, human
gctcacccagtcaaagctgt

SEQ ID NO: 274652 - DNA, 20 bp, human
gttagcaaggaactttcaca

SEQ ID NO: 274653 - DNA, 20 bp, human
gaaccaggttgactcaaact

SEQ ID NO: 274654 - DNA, 20 bp, human
ggcagctcctataggaatgt

SEQ ID NO: 274655 - DNA, 20 bp, human
gttcctggtacactggctca

SEQ ID NO: 274656 - DNA, 20 bp, human
gagacggggtgccaagacag

SEQ ID NO: 274657 - DNA, 20 bp, human
gctgataaaggagtttgcta

SEQ ID NO: 274658 - DNA, 20 bp, human
gcagcatagtacaaatagca

SEQ ID NO: 274659 - DNA, 20 bp, human
gaatgaacttcattgatatc

SEQ ID NO: 274660 - DNA, 20 bp, human
ggaagaacgaagaaagtcct

SEQ ID NO: 274661 - DNA, 20 bp, human
gagggaacggatatgagacg

SEQ ID NO: 274662 - DNA, 20 bp, human
gtgtgtcagagatatagaca

SEQ ID NO: 274663 - DNA, 20 bp, human
gttctaacatctcctcctaa

SEQ ID NO: 274664 - DNA, 20 bp, human
ggtgaaaagacattgagttg

SEQ ID NO: 274665 - DNA, 20 bp, human
gtatttacagagtgaccaag

SEQ ID NO: 274666 - DNA, 20 bp, human
gggcgggtcaatatcaagaa

SEQ ID NO: 274667 - DNA, 20 bp, human
gcaactctcggcttaaactc

SEQ ID NO: 274668 - DNA, 20 bp, human
gcaccgtgacaatgcagctg

SEQ ID NO: 274669 - DNA, 20 bp, human
ggtcttacgtgactgattat

SEQ ID NO: 274670 - DNA, 20 bp, human
gcctacgtcatgtgagatct

SEQ ID NO: 274671 - DNA, 20 bp, human
ggattattggtctacctctg

SEQ ID NO: 274672 - DNA, 20 bp, human
gggtgattggtccgcccctg

SEQ ID NO: 274673 - DNA, 20 bp, human
gggacagcataaatttccgc

SEQ ID NO: 274674 - DNA, 20 bp, human
gaggaacccagaactacatc

SEQ ID NO: 274675 - DNA, 20 bp, human
gcggtcacgtgagcaactct

SEQ ID NO: 274676 - DNA, 20 bp, human
gctgctgaaagcaggccctc

SEQ ID NO: 274677 - DNA, 20 bp, human
gaacccagatagtactatcc

SEQ ID NO: 274678 - DNA, 20 bp, human
gcgcgccgccgcgtgactcc

SEQ ID NO: 274679 - DNA, 20 bp, human
gctccggactgcagttccaa

SEQ ID NO: 274680 - DNA, 20 bp, human
gggggattggacatgaatca

SEQ ID NO: 274681 - DNA, 20 bp, human
gctatcctggagtcacgcgg

SEQ ID NO: 274682 - DNA, 20 bp, human
gaggggcggtgccaggccgt

SEQ ID NO: 274683 - DNA, 20 bp, human
gccgcccggctcggccacag

SEQ ID NO: 274684 - DNA, 20 bp, human
ggcttcgcgtcacttgacta

SEQ ID NO: 274685 - DNA, 20 bp, human
gctggctgctgggccgacga

SEQ ID NO: 274686 - DNA, 20 bp, human
gagggaacctcagcgagcaa

SEQ ID NO: 274687 - DNA, 20 bp, human
gagagtaagggggtggctgc

SEQ ID NO: 274688 - DNA, 20 bp, human
gttacaaactagtagagtaa

SEQ ID NO: 274689 - DNA, 20 bp, human
gaacgcctggcaacttgagg

SEQ ID NO: 274690 - DNA, 20 bp, human
gcacgtgtcggattcctggg

SEQ ID NO: 274691 - DNA, 20 bp, human
gctaaacgcctggcaacttg

SEQ ID NO: 274692 - DNA, 20 bp, human
gaactagtagagtaaggggg

SEQ ID NO: 274693 - DNA, 20 bp, human
ggaagtccaggctaaacgcc

SEQ ID NO: 274694 - DNA, 20 bp, human
ggaaaccacctcaagttgcc

SEQ ID NO: 274695 - DNA, 20 bp, human
gacctcagcgagcaaggggg

SEQ ID NO: 274696 - DNA, 20 bp, human
gtgggctcctagaccggggt

SEQ ID NO: 274697 - DNA, 20 bp, human
ggcagggcccaccccggtct

SEQ ID NO: 274698 - DNA, 20 bp, human
ggggctctgggctcctagac

SEQ ID NO: 274699 - DNA, 20 bp, human
gctgcactgccggactgacc

SEQ ID NO: 274700 - DNA, 20 bp, human
gggtcggtggcgcttctctc

SEQ ID NO: 274701 - DNA, 20 bp, human
ggagcatagcgtagtttcag

SEQ ID NO: 274702 - DNA, 20 bp, human
gagcgggggctgcccaaaga

SEQ ID NO: 274703 - DNA, 20 bp, human
gcttctctctggcccgagcc

SEQ ID NO: 274704 - DNA, 20 bp, human
gcccaaagatgggctggggt

SEQ ID NO: 274705 - DNA, 20 bp, human
gccacccctgaagctggcga

SEQ ID NO: 274706 - DNA, 20 bp, human
gctgcaccgctccacgacac

SEQ ID NO: 274707 - DNA, 20 bp, human
gcggggacaaggtctcggta

SEQ ID NO: 274708 - DNA, 20 bp, human
gacgaggtctcggtaggaga

SEQ ID NO: 274709 - DNA, 20 bp, human
gcccgcttgcgcgaggccta

SEQ ID NO: 274710 - DNA, 20 bp, human
ggggcggggcctctgtcggg

SEQ ID NO: 274711 - DNA, 20 bp, human
gacaaggtctcggtagggga

SEQ ID NO: 274712 - DNA, 20 bp, human
gagccccagccaatgagcgc

SEQ ID NO: 274713 - DNA, 20 bp, human
ggctccgcgcctgcagccct

SEQ ID NO: 274714 - DNA, 20 bp, human
gtgcccaggcgaccagtgcg

SEQ ID NO: 274715 - DNA, 20 bp, human
gtctcggtaggggacgggtc

SEQ ID NO: 274716 - DNA, 20 bp, human
ggaactctagctccccgaca

SEQ ID NO: 274717 - DNA, 20 bp, human
gtcggggagctagagttctc

SEQ ID NO: 274718 - DNA, 20 bp, human
gtgccaagaggtagccgtgt

SEQ ID NO: 274719 - DNA, 20 bp, human
gccgcgcgcgcgactggaaa

SEQ ID NO: 274720 - DNA, 20 bp, human
gaattggggcgcagagcctt

SEQ ID NO: 274721 - DNA, 20 bp, human
gggcaaacgagcgagaattg

SEQ ID NO: 274722 - DNA, 20 bp, human
ggactctctcctgcccctcg

SEQ ID NO: 274723 - DNA, 20 bp, human
gccccgacacggctacctct

SEQ ID NO: 274724 - DNA, 20 bp, human
gcgcgctcgcatctgctgtg

SEQ ID NO: 274725 - DNA, 20 bp, human
ggggagggccgttccctcgg

SEQ ID NO: 274726 - DNA, 20 bp, human
gacccccgccgcctcggcga

SEQ ID NO: 274727 - DNA, 20 bp, human
gcgtgcgtgcagccctgcga

SEQ ID NO: 274728 - DNA, 20 bp, human
gccgcagcgagcatttccat

SEQ ID NO: 274729 - DNA, 20 bp, human
gaagcagtgtccaatgacaa

SEQ ID NO: 274730 - DNA, 20 bp, human
ggggctcggtgtggcggtca

SEQ ID NO: 274731 - DNA, 20 bp, human
gaggggtggcagcgtgaggt

SEQ ID NO: 274732 - DNA, 20 bp, human
ggccccgccttcaaagtagg

SEQ ID NO: 274733 - DNA, 20 bp, human
ggggcgaattagttgccatt

SEQ ID NO: 274734 - DNA, 20 bp, human
gcacaccgagcccagccggg

SEQ ID NO: 274735 - DNA, 20 bp, human
gaatcactcgagttctagtg

SEQ ID NO: 274736 - DNA, 20 bp, human
gcgcccgtcctgcagccgac

SEQ ID NO: 274737 - DNA, 20 bp, human
gaagaagaggggcggagaag

SEQ ID NO: 274738 - DNA, 20 bp, human
ggctcctcgagtgacagtcc

SEQ ID NO: 274739 - DNA, 20 bp, human
ggccgtggctgggatctcgc

SEQ ID NO: 274740 - DNA, 20 bp, human
gcagcctgtcggctgcagga

SEQ ID NO: 274741 - DNA, 20 bp, human
gccacggcggggggcggtag

SEQ ID NO: 274742 - DNA, 20 bp, human
gccagccacggcaaggggcg

SEQ ID NO: 274743 - DNA, 20 bp, human
gagatcccagccacggcaag

SEQ ID NO: 274744 - DNA, 20 bp, human
gctgccaggactgtcactcg

SEQ ID NO: 274745 - DNA, 20 bp, human
gcaggacgggcggcaggact

SEQ ID NO: 274746 - DNA, 20 bp, human
ggaagcgggactccacggaa

SEQ ID NO: 274747 - DNA, 20 bp, human
gcactggggcaagatcaggt

SEQ ID NO: 274748 - DNA, 20 bp, human
gcccgcttcccctggaccgg

SEQ ID NO: 274749 - DNA, 20 bp, human
gcaccagccagcgtcggagt

SEQ ID NO: 274750 - DNA, 20 bp, human
ggggactccacggaagggct

SEQ ID NO: 274751 - DNA, 20 bp, human
gagggtgtggagccgcactg

SEQ ID NO: 274752 - DNA, 20 bp, human
gcaggggaagcgggactcca

SEQ ID NO: 274753 - DNA, 20 bp, human
gctgggaagagggtaggaag

SEQ ID NO: 274754 - DNA, 20 bp, human
gtgggacagcccaaagactc

SEQ ID NO: 274755 - DNA, 20 bp, human
ggaacttggcccggagtctt

SEQ ID NO: 274756 - DNA, 20 bp, human
ggggacaggcgggcagaagc

SEQ ID NO: 274757 - DNA, 20 bp, human
gcaaagcaagggtcagactg

SEQ ID NO: 274758 - DNA, 20 bp, human
gtctgcccgcctgtccctct

SEQ ID NO: 274759 - DNA, 20 bp, human
gggcgcccgagcagcccaga

SEQ ID NO: 274760 - DNA, 20 bp, human
ggggatggggacagtagtgg

SEQ ID NO: 274761 - DNA, 20 bp, human
gccagctggcggggcgggat

SEQ ID NO: 274762 - DNA, 20 bp, human
gggaggcagcctgcggagga

SEQ ID NO: 274763 - DNA, 20 bp, human
gggtagaagggggtggaatc

SEQ ID NO: 274764 - DNA, 20 bp, human
gcccaggaaggggatggata

SEQ ID NO: 274765 - DNA, 20 bp, human
gtacgcctcgggcaagccgt

SEQ ID NO: 274766 - DNA, 20 bp, human
gcgcaggcgcactggtggga

SEQ ID NO: 274767 - DNA, 20 bp, human
gacagccaagccctgcgcgc

SEQ ID NO: 274768 - DNA, 20 bp, human
ggtcggggcacgttccgcag

SEQ ID NO: 274769 - DNA, 20 bp, human
ggggagcgtcgccggaggtg

SEQ ID NO: 274770 - DNA, 20 bp, human
gcagccccggggattgggag

SEQ ID NO: 274771 - DNA, 20 bp, human
ggtggggcgtgcaggcgtta

SEQ ID NO: 274772 - DNA, 20 bp, human
ggggaacgcgggagcgtcgc

SEQ ID NO: 274773 - DNA, 20 bp, human
gttcccggcggctgattcga

SEQ ID NO: 274774 - DNA, 20 bp, human
gaaccaccgctcccaatccc

SEQ ID NO: 274775 - DNA, 20 bp, human
gttcagcagccccggggatt

SEQ ID NO: 274776 - DNA, 20 bp, human
gcgacccgcgaacccagagt

SEQ ID NO: 274777 - DNA, 20 bp, human
ggcggcgctccttacccggg

SEQ ID NO: 274778 - DNA, 20 bp, human
gtctcccgcccgccggtcca

SEQ ID NO: 274779 - DNA, 20 bp, human
gcgaacccagagtggggcga

SEQ ID NO: 274780 - DNA, 20 bp, human
gacccagagtggggcgaagg

SEQ ID NO: 274781 - DNA, 20 bp, human
gccagcaacccccccgggta

SEQ ID NO: 274782 - DNA, 20 bp, human
gagagcggcgctccttaccc

SEQ ID NO: 274783 - DNA, 20 bp, human
ggcgccgcgtatttaaatga

SEQ ID NO: 274784 - DNA, 20 bp, human
ggcgaaggaggaggccgtgc

SEQ ID NO: 274785 - DNA, 20 bp, human
gcgcacacaccctggaccgg

SEQ ID NO: 274786 - DNA, 20 bp, human
gggccccgacaaccagattg

SEQ ID NO: 274787 - DNA, 20 bp, human
gcgggtgtcatgtgtgagaa

SEQ ID NO: 274788 - DNA, 20 bp, human
ggaggaaaatattgcggggc

SEQ ID NO: 274789 - DNA, 20 bp, human
gacgtagagccggggttcta

SEQ ID NO: 274790 - DNA, 20 bp, human
gaggcctgcagataaaccac

SEQ ID NO: 274791 - DNA, 20 bp, human
ggtgacgtggtgcggagggg

SEQ ID NO: 274792 - DNA, 20 bp, human
gggatcggctggccccaaag

SEQ ID NO: 274793 - DNA, 20 bp, human
ggggacagagttgcggtttg

SEQ ID NO: 274794 - DNA, 20 bp, human
gaagttccatccaaagggtg

SEQ ID NO: 274795 - DNA, 20 bp, human
gctcagttagcaccaaccaa

SEQ ID NO: 274796 - DNA, 20 bp, human
gcgagcggcggtgtgaatct

SEQ ID NO: 274797 - DNA, 20 bp, human
gacctctgtctgtgaatcat

SEQ ID NO: 274798 - DNA, 20 bp, human
gctcttataattgggaagga

SEQ ID NO: 274799 - DNA, 20 bp, human
gagaagaccagacgaatccc

SEQ ID NO: 274800 - DNA, 20 bp, human
gtgggtcggcgtttcccggc

SEQ ID NO: 274801 - DNA, 20 bp, human
gacccgccactcatatcagt

SEQ ID NO: 274802 - DNA, 20 bp, human
gggcgggtagcctctgatga

SEQ ID NO: 274803 - DNA, 20 bp, human
gtgaaaggttctggtgagca

SEQ ID NO: 274804 - DNA, 20 bp, human
ggcgtttcccggctgggttt

SEQ ID NO: 274805 - DNA, 20 bp, human
gggtcttctgaacgacctca

SEQ ID NO: 274806 - DNA, 20 bp, human
ggcccaggacccacacgcat

SEQ ID NO: 274807 - DNA, 20 bp, human
gcctgtgagtcactcgttag

SEQ ID NO: 274808 - DNA, 20 bp, human
gctggagattgattttgcct

SEQ ID NO: 274809 - DNA, 20 bp, human
gtgagaacaccgtggctctg

SEQ ID NO: 274810 - DNA, 20 bp, human
gagcagaggtgagaacaccg

SEQ ID NO: 274811 - DNA, 20 bp, human
gggtggctgtgactgctgag

SEQ ID NO: 274812 - DNA, 20 bp, human
gagaggagttcaaagaaacc

SEQ ID NO: 274813 - DNA, 20 bp, human
gggagggtgtctgggatttc

SEQ ID NO: 274814 - DNA, 20 bp, human
gaagtcacagacgtgtgcat

SEQ ID NO: 274815 - DNA, 20 bp, human
gaattagagcattgttcccc

SEQ ID NO: 274816 - DNA, 20 bp, human
gcaggagaggcgtacggctg

SEQ ID NO: 274817 - DNA, 20 bp, human
ggcaccgcctgcactactca

SEQ ID NO: 274818 - DNA, 20 bp, human
gggatgccaggagaggcgta

SEQ ID NO: 274819 - DNA, 20 bp, human
gcggcctggtgccccgtgct

SEQ ID NO: 274820 - DNA, 20 bp, human
gtcccctccgagcccgagag

SEQ ID NO: 274821 - DNA, 20 bp, human
gttctgatttggttcaaccg

SEQ ID NO: 274822 - DNA, 20 bp, human
ggggtggaaaagttgtccct

SEQ ID NO: 274823 - DNA, 20 bp, human
gtggttcaaccgcgggaggg

SEQ ID NO: 274824 - DNA, 20 bp, human
gctgcacgagcgggagggag

SEQ ID NO: 274825 - DNA, 20 bp, human
ggatgccggagctgcacgag

SEQ ID NO: 274826 - DNA, 20 bp, human
gtccccgcccctcccctcgt

SEQ ID NO: 274827 - DNA, 20 bp, human
gcagcccacgaggggagggg

SEQ ID NO: 274828 - DNA, 20 bp, human
ggcgcgggcgcagcccacga

SEQ ID NO: 274829 - DNA, 20 bp, human
gcgcctcggtggccgtgtgg

SEQ ID NO: 274830 - DNA, 20 bp, human
gggaggaccgcacgcctcgg

SEQ ID NO: 274831 - DNA, 20 bp, human
ggtacgcgaaagccacgcgc

SEQ ID NO: 274832 - DNA, 20 bp, human
gaggcctggagtgcacggag

SEQ ID NO: 274833 - DNA, 20 bp, human
gcgcacttccgggacgctct

SEQ ID NO: 274834 - DNA, 20 bp, human
gggaaagcaggcagaatcga

SEQ ID NO: 274835 - DNA, 20 bp, human
gcccgggcgctttgcaggcg

SEQ ID NO: 274836 - DNA, 20 bp, human
gtaaaaatctatgtcgtaat

SEQ ID NO: 274837 - DNA, 20 bp, human
ggctaggtttgcaaagctgt

SEQ ID NO: 274838 - DNA, 20 bp, human
gtcagacttccttttgaatt

SEQ ID NO: 274839 - DNA, 20 bp, human
gcatatcaacacatagtggt

SEQ ID NO: 274840 - DNA, 20 bp, human
gaaacgggtttctccatata

SEQ ID NO: 274841 - DNA, 20 bp, human
gcgcaacctccattaaaaat

SEQ ID NO: 274842 - DNA, 20 bp, human
gctcaaagctgaagtcggct

SEQ ID NO: 274843 - DNA, 20 bp, human
ggagacttcagaattttctt

SEQ ID NO: 274844 - DNA, 20 bp, human
gacctagaattcattcacga

SEQ ID NO: 274845 - DNA, 20 bp, human
gaaatatctcccaattcaaa

SEQ ID NO: 274846 - DNA, 20 bp, human
gtgactgcgcggaccagtaa

SEQ ID NO: 274847 - DNA, 20 bp, human
ggggttgccccagccgttac

SEQ ID NO: 274848 - DNA, 20 bp, human
gagctcagagctttgtggaa

SEQ ID NO: 274849 - DNA, 20 bp, human
gtgcgggggcgtggggaaat

SEQ ID NO: 274850 - DNA, 20 bp, human
gcgcggaccagtaacggctg

SEQ ID NO: 274851 - DNA, 20 bp, human
gtgtcgctgtggggaagaac

SEQ ID NO: 274852 - DNA, 20 bp, human
gacaaagctctgagctacag

SEQ ID NO: 274853 - DNA, 20 bp, human
gtgcggcaggatggagccaa

SEQ ID NO: 274854 - DNA, 20 bp, human
ggtaatctgcagagcgcgtc

SEQ ID NO: 274855 - DNA, 20 bp, human
gtgagtcgccctctggtgga

SEQ ID NO: 274856 - DNA, 20 bp, human
gagggaggggagagtgggta

SEQ ID NO: 274857 - DNA, 20 bp, human
gctcccggaaggagaaaggg

SEQ ID NO: 274858 - DNA, 20 bp, human
gccagtgacctgccaatcta

SEQ ID NO: 274859 - DNA, 20 bp, human
gccgcctcccggaaggagaa

SEQ ID NO: 274860 - DNA, 20 bp, human
ggattggcaggtcactggga

SEQ ID NO: 274861 - DNA, 20 bp, human
ggtgacctgccaatctacgg

SEQ ID NO: 274862 - DNA, 20 bp, human
ggcgtcctccgtagattggc

SEQ ID NO: 274863 - DNA, 20 bp, human
gcaagccttgtcccgcctcc

SEQ ID NO: 274864 - DNA, 20 bp, human
gtccaactcaacaggtaatg

SEQ ID NO: 274865 - DNA, 20 bp, human
gcagtgtcagaaatcaattc

SEQ ID NO: 274866 - DNA, 20 bp, human
gtcccggagagctcacccct

SEQ ID NO: 274867 - DNA, 20 bp, human
gggaagggacagctcggtgt

SEQ ID NO: 274868 - DNA, 20 bp, human
gggctccccggatgcggccg

SEQ ID NO: 274869 - DNA, 20 bp, human
gtcccaggggtgagctctcc

SEQ ID NO: 274870 - DNA, 20 bp, human
gtataaggagcgacagctga

SEQ ID NO: 274871 - DNA, 20 bp, human
gacagctcggtgtggggtcc

SEQ ID NO: 274872 - DNA, 20 bp, human
ggagccccgcggccgcatcc

SEQ ID NO: 274873 - DNA, 20 bp, human
gaaggagcgacagctgaggg

SEQ ID NO: 274874 - DNA, 20 bp, human
ggccgagggctccccggatg

SEQ ID NO: 274875 - DNA, 20 bp, human
gggggagccctcggcagtcg

SEQ ID NO: 274876 - DNA, 20 bp, human
gcaaagctgcagacagtagg

SEQ ID NO: 274877 - DNA, 20 bp, human
ggtctcacatctttgggaat

SEQ ID NO: 274878 - DNA, 20 bp, human
ggccaacacacacatgtaga

SEQ ID NO: 274879 - DNA, 20 bp, human
gtagaagtctgtaaagtgct

SEQ ID NO: 274880 - DNA, 20 bp, human
gagagctggcattcacacga

SEQ ID NO: 274881 - DNA, 20 bp, human
gcagagcccagctggcgtga

SEQ ID NO: 274882 - DNA, 20 bp, human
gaccttctacatgtgtgtgt

SEQ ID NO: 274883 - DNA, 20 bp, human
gtctactgtctcacatcttt

SEQ ID NO: 274884 - DNA, 20 bp, human
gtaaagtgctgggcagatac

SEQ ID NO: 274885 - DNA, 20 bp, human
gtcattatctggtttggtgt

SEQ ID NO: 274886 - DNA, 20 bp, human
gccccccgtcccatcggtag

SEQ ID NO: 274887 - DNA, 20 bp, human
gagtcctggggtgcgagggg

SEQ ID NO: 274888 - DNA, 20 bp, human
ggcagtggctggaagtcctg

SEQ ID NO: 274889 - DNA, 20 bp, human
gccagagccccccgtcccat

SEQ ID NO: 274890 - DNA, 20 bp, human
gcagtccactaccgatggga

SEQ ID NO: 274891 - DNA, 20 bp, human
gccatcggtagtggactgaa

SEQ ID NO: 274892 - DNA, 20 bp, human
ggggctagtcaaggtcctgc

SEQ ID NO: 274893 - DNA, 20 bp, human
gacctgaatgtctctgtttg

SEQ ID NO: 274894 - DNA, 20 bp, human
gtccactaccgatgggacgg

SEQ ID NO: 274895 - DNA, 20 bp, human
gcagcccctacctgtgcatg

SEQ ID NO: 274896 - DNA, 20 bp, human
gggctcgcgggtcactaggc

SEQ ID NO: 274897 - DNA, 20 bp, human
gactaggctggccaattcga

SEQ ID NO: 274898 - DNA, 20 bp, human
gtgtgtgcggccgcgagggc

SEQ ID NO: 274899 - DNA, 20 bp, human
gtgtgtgtgaatgcgtcaag

SEQ ID NO: 274900 - DNA, 20 bp, human
ggtcgaggaactccagaaca

SEQ ID NO: 274901 - DNA, 20 bp, human
gacaagctcggccttcgaat

SEQ ID NO: 274902 - DNA, 20 bp, human
ggatgtgtgtgcggccgcga

SEQ ID NO: 274903 - DNA, 20 bp, human
gtccagaacagggtaacagc

SEQ ID NO: 274904 - DNA, 20 bp, human
gggcgggctcgcgggtcact

SEQ ID NO: 274905 - DNA, 20 bp, human
gccctccggcgctcacactc

SEQ ID NO: 274906 - DNA, 20 bp, human
gtcaggggaggggttctccc

SEQ ID NO: 274907 - DNA, 20 bp, human
ggggcctcggggcgagacgc

SEQ ID NO: 274908 - DNA, 20 bp, human
ggcggtctataactcgagat

SEQ ID NO: 274909 - DNA, 20 bp, human
gggcccagcgaagtccgcca

SEQ ID NO: 274910 - DNA, 20 bp, human
gcccccatggcggacttcgc

SEQ ID NO: 274911 - DNA, 20 bp, human
gccttgcggccggcagaaga

SEQ ID NO: 274912 - DNA, 20 bp, human
ggcgcgcgggcgctcctgaa

SEQ ID NO: 274913 - DNA, 20 bp, human
gtctgccggccgcaaggccg

SEQ ID NO: 274914 - DNA, 20 bp, human
gagactactctcccccatgg

SEQ ID NO: 274915 - DNA, 20 bp, human
gcaggagcgcccgcgcgctg

SEQ ID NO: 274916 - DNA, 20 bp, human
gggtggaggcgctgactcac

SEQ ID NO: 274917 - DNA, 20 bp, human
gggagccttgcgcataaagg

SEQ ID NO: 274918 - DNA, 20 bp, human
ggccctgtgccgccttaact

SEQ ID NO: 274919 - DNA, 20 bp, human
gtgaggcatagtcctgtggg

SEQ ID NO: 274920 - DNA, 20 bp, human
gagtctgaggcatagtcctg

SEQ ID NO: 274921 - DNA, 20 bp, human
gacagggccgaggcgtagtg

SEQ ID NO: 274922 - DNA, 20 bp, human
gttaactaggaatggcgcga

SEQ ID NO: 274923 - DNA, 20 bp, human
gtttatgcgcaaggctcctt

SEQ ID NO: 274924 - DNA, 20 bp, human
gagtcacccacactacgcct

SEQ ID NO: 274925 - DNA, 20 bp, human
ggcgccattcctagttaagg

SEQ ID NO: 274926 - DNA, 20 bp, human
gggcgctggtgagacccgcg

SEQ ID NO: 274927 - DNA, 20 bp, human
gccccgcaaggcaccatctg

SEQ ID NO: 274928 - DNA, 20 bp, human
gcacgaaagcgcgccgtcgg

SEQ ID NO: 274929 - DNA, 20 bp, human
ggtcgcacgacaaacctcgc

SEQ ID NO: 274930 - DNA, 20 bp, human
ggtgacgcagcccgggtctc

SEQ ID NO: 274931 - DNA, 20 bp, human
ggacccagcgcctcgcgtca

SEQ ID NO: 274932 - DNA, 20 bp, human
ggtacagcccagtccacgaa

SEQ ID NO: 274933 - DNA, 20 bp, human
gtcggcggctagtgacgtca

SEQ ID NO: 274934 - DNA, 20 bp, human
gggaccttgacgcgaggcgc

SEQ ID NO: 274935 - DNA, 20 bp, human
gcgcgtcaaggtcccaagcc

SEQ ID NO: 274936 - DNA, 20 bp, human
gttaaagtggatgtgtgtaa

SEQ ID NO: 274937 - DNA, 20 bp, human
gggactgtgggaggtgacac

SEQ ID NO: 274938 - DNA, 20 bp, human
gggtcctcccgacaatcctc

SEQ ID NO: 274939 - DNA, 20 bp, human
gtcagcgcctggagatcaag

SEQ ID NO: 274940 - DNA, 20 bp, human
gcgcctggagatcaaggggc

SEQ ID NO: 274941 - DNA, 20 bp, human
gtgtgggaggtgacacaggt

SEQ ID NO: 274942 - DNA, 20 bp, human
gcaaaattgaaagcttaaag

SEQ ID NO: 274943 - DNA, 20 bp, human
gggattgtcgggaggaccct

SEQ ID NO: 274944 - DNA, 20 bp, human
gggtaggtagtgcaaatgga

SEQ ID NO: 274945 - DNA, 20 bp, human
gggactttaacattaaattc

SEQ ID NO: 274946 - DNA, 20 bp, human
gtgtcggcgctcagagctgg

SEQ ID NO: 274947 - DNA, 20 bp, human
ggcacccctctgccggtccc

SEQ ID NO: 274948 - DNA, 20 bp, human
ggaccggcagaggggtgcgg

SEQ ID NO: 274949 - DNA, 20 bp, human
gagggaccctgaatgggcgg

SEQ ID NO: 274950 - DNA, 20 bp, human
gactgctctccgagcgagcg

SEQ ID NO: 274951 - DNA, 20 bp, human
gtcccgggccaggagatagc

SEQ ID NO: 274952 - DNA, 20 bp, human
gccggccgccagagacccct

SEQ ID NO: 274953 - DNA, 20 bp, human
gcactgtcggcgctcagagc

SEQ ID NO: 274954 - DNA, 20 bp, human
gccaggatagtcaaggttgg

SEQ ID NO: 274955 - DNA, 20 bp, human
gctggcccgggaccggcaga

SEQ ID NO: 274956 - DNA, 20 bp, human
gaaagtaaacaaagctctgg

SEQ ID NO: 274957 - DNA, 20 bp, human
gcagctgggagatgccaatc

SEQ ID NO: 274958 - DNA, 20 bp, human
gccatcccaaataaacagtg

SEQ ID NO: 274959 - DNA, 20 bp, human
gtgtggcatgctcaggggaa

SEQ ID NO: 274960 - DNA, 20 bp, human
gagctgggctgaaccttgga

SEQ ID NO: 274961 - DNA, 20 bp, human
gagcagacattagcagacca

SEQ ID NO: 274962 - DNA, 20 bp, human
gtgggctcctgatgcttgct

SEQ ID NO: 274963 - DNA, 20 bp, human
ggccccacctagcaagcatc

SEQ ID NO: 274964 - DNA, 20 bp, human
ggggcacgtggctgacagac

SEQ ID NO: 274965 - DNA, 20 bp, human
gtctgcatggcatgagcctc

SEQ ID NO: 274966 - DNA, 20 bp, human
gggcctcggaccgttggatt

SEQ ID NO: 274967 - DNA, 20 bp, human
gcgctggggaggcacgtttg

SEQ ID NO: 274968 - DNA, 20 bp, human
gtggattgggcgagcatctt

SEQ ID NO: 274969 - DNA, 20 bp, human
gagcgctggcctcggaccgt

SEQ ID NO: 274970 - DNA, 20 bp, human
gcgcccaatccaacggtccg

SEQ ID NO: 274971 - DNA, 20 bp, human
ggggaggcacgtttgggggt

SEQ ID NO: 274972 - DNA, 20 bp, human
gggccggcctgagggggtta

SEQ ID NO: 274973 - DNA, 20 bp, human
gggtccctggctaccccgcg

SEQ ID NO: 274974 - DNA, 20 bp, human
ggcgaggggaaagcggttga

SEQ ID NO: 274975 - DNA, 20 bp, human
gcgtgtctgttggctccctg

SEQ ID NO: 274976 - DNA, 20 bp, human
gcagcgaggggatactgaag

SEQ ID NO: 274977 - DNA, 20 bp, human
gcggggaaaagcattcaaga

SEQ ID NO: 274978 - DNA, 20 bp, human
ggtgactggccgttcagcga

SEQ ID NO: 274979 - DNA, 20 bp, human
gggacgtgcctgctgttcga

SEQ ID NO: 274980 - DNA, 20 bp, human
gcggagagggtgagggaagt

SEQ ID NO: 274981 - DNA, 20 bp, human
ggaaatgctaggctgtcggt

SEQ ID NO: 274982 - DNA, 20 bp, human
ggagaagagaggtcgggaga

SEQ ID NO: 274983 - DNA, 20 bp, human
ggagaggtcgggagacggag

SEQ ID NO: 274984 - DNA, 20 bp, human
gcgccccaagcaactgaaaa

SEQ ID NO: 274985 - DNA, 20 bp, human
gtccgagtgctgaaatttat

SEQ ID NO: 274986 - DNA, 20 bp, human
gcccgctgtgcggtcgtgat

SEQ ID NO: 274987 - DNA, 20 bp, human
gagtgacaggccacttacga

SEQ ID NO: 274988 - DNA, 20 bp, human
gcacagcgggacggagtgac

SEQ ID NO: 274989 - DNA, 20 bp, human
gccccgcctaccgtcgtaag

SEQ ID NO: 274990 - DNA, 20 bp, human
ggcgactggagcgaggtggg

SEQ ID NO: 274991 - DNA, 20 bp, human
ggcgcggcaaagggaagcgg

SEQ ID NO: 274992 - DNA, 20 bp, human
gacaggccacttacgacggt

SEQ ID NO: 274993 - DNA, 20 bp, human
gcccggaagggaatactaaa

SEQ ID NO: 274994 - DNA, 20 bp, human
gcgtgattggtcgacaggac

SEQ ID NO: 274995 - DNA, 20 bp, human
gaaacccagaccctggcgga

SEQ ID NO: 274996 - DNA, 20 bp, human
gtcctccctggcacacgggc

SEQ ID NO: 274997 - DNA, 20 bp, human
gagggaggagggagaccggt

SEQ ID NO: 274998 - DNA, 20 bp, human
gggaggagcttgggctgcca

SEQ ID NO: 274999 - DNA, 20 bp, human
gtcccctccaagactcttca

SEQ ID NO: 275000 - DNA, 20 bp, human
gaaagctggtcgggagtggg

SEQ ID NO: 275001 - DNA, 20 bp, human
gaggttggacagaacacctc

SEQ ID NO: 275002 - DNA, 20 bp, human
gttcggagggtgcatctagg

SEQ ID NO: 275003 - DNA, 20 bp, human
gggagggtgcatctaggggg

SEQ ID NO: 275004 - DNA, 20 bp, human
gaggaaagctggtcgggagt

SEQ ID NO: 275005 - DNA, 20 bp, human
ggatgaaaggaaagctggtc

SEQ ID NO: 275006 - DNA, 20 bp, human
gtgtacccccctcactcctt

SEQ ID NO: 275007 - DNA, 20 bp, human
gtaacccctccaatgcctga

SEQ ID NO: 275008 - DNA, 20 bp, human
ggtcccctaaggagtgaggg

SEQ ID NO: 275009 - DNA, 20 bp, human
gtccccttcaggcattggag

SEQ ID NO: 275010 - DNA, 20 bp, human
gtaaaggagttggggacgaa

SEQ ID NO: 275011 - DNA, 20 bp, human
gtcacggcatcgtccccttc

SEQ ID NO: 275012 - DNA, 20 bp, human
gtaggggactaaaggagttg

SEQ ID NO: 275013 - DNA, 20 bp, human
gcggtcgccaggttcccccg

SEQ ID NO: 275014 - DNA, 20 bp, human
gggaacctggcgaccgcggg

SEQ ID NO: 275015 - DNA, 20 bp, human
gcatcgtccccttcaggcat

SEQ ID NO: 275016 - DNA, 20 bp, human
gaaagtgcttactcacaaag

SEQ ID NO: 275017 - DNA, 20 bp, human
gagcttgctcgagttttaaa

SEQ ID NO: 275018 - DNA, 20 bp, human
gtcactagttagcaatgccc

SEQ ID NO: 275019 - DNA, 20 bp, human
gtaataaggaacctccctgg

SEQ ID NO: 275020 - DNA, 20 bp, human
gaaaactcgagcaagctacc

SEQ ID NO: 275021 - DNA, 20 bp, human
gcagagtttagtcacctctg

SEQ ID NO: 275022 - DNA, 20 bp, human
gaactctgatcattgccaat

SEQ ID NO: 275023 - DNA, 20 bp, human
gtacaactgtatctcctaga

SEQ ID NO: 275024 - DNA, 20 bp, human
ggggaggttccttattaaat

SEQ ID NO: 275025 - DNA, 20 bp, human
gagaccgcagcccatcggca

SEQ ID NO: 275026 - DNA, 20 bp, human
ggcggcgcgggcagtccgga

SEQ ID NO: 275027 - DNA, 20 bp, human
gctaaaggatgtttacacgt

SEQ ID NO: 275028 - DNA, 20 bp, human
ggacgctcataaaggctccc

SEQ ID NO: 275029 - DNA, 20 bp, human
gtcagctgcgaggaggtgac

SEQ ID NO: 275030 - DNA, 20 bp, human
gagccgcttctcccctctaa

SEQ ID NO: 275031 - DNA, 20 bp, human
gacacgtgggtggcactcgc

SEQ ID NO: 275032 - DNA, 20 bp, human
gtcgctggaatccagcgctc

SEQ ID NO: 275033 - DNA, 20 bp, human
gccggaggaggcgggctccc

SEQ ID NO: 275034 - DNA, 20 bp, human
gaggatggtggcagacatgc

SEQ ID NO: 275035 - DNA, 20 bp, human
gggtttagggacgctcataa

SEQ ID NO: 275036 - DNA, 20 bp, human
gccaaaaggggcctcggcgg

SEQ ID NO: 275037 - DNA, 20 bp, human
gggctctggatcccgctggg

SEQ ID NO: 275038 - DNA, 20 bp, human
gatcccaaaaggggcctcgg

SEQ ID NO: 275039 - DNA, 20 bp, human
gggagtgcccagacttggca

SEQ ID NO: 275040 - DNA, 20 bp, human
gagcctgagaaatcccaaaa

SEQ ID NO: 275041 - DNA, 20 bp, human
gcacatccggccgccggcac

SEQ ID NO: 275042 - DNA, 20 bp, human
gaagtctgggcactccgctg

SEQ ID NO: 275043 - DNA, 20 bp, human
ggcggctgaggcagctgtag

SEQ ID NO: 275044 - DNA, 20 bp, human
ggcgggctctggatcccgct

SEQ ID NO: 275045 - DNA, 20 bp, human
gggggccacggggagctgag

SEQ ID NO: 275046 - DNA, 20 bp, human
ggtcccgcccggcaggtagg

SEQ ID NO: 275047 - DNA, 20 bp, human
ggcgggacgagcaacatgat

SEQ ID NO: 275048 - DNA, 20 bp, human
gaggcccacctcctacctgc

SEQ ID NO: 275049 - DNA, 20 bp, human
gctaaactgccctccgtgat

SEQ ID NO: 275050 - DNA, 20 bp, human
gggactacgccgagacaact

SEQ ID NO: 275051 - DNA, 20 bp, human
gaggcagtaggatgaggctc

SEQ ID NO: 275052 - DNA, 20 bp, human
gaacgagaggcaaaacaaga

SEQ ID NO: 275053 - DNA, 20 bp, human
gctgccttactattggtcgt

SEQ ID NO: 275054 - DNA, 20 bp, human
gtccgcggaacgccgggaag

SEQ ID NO: 275055 - DNA, 20 bp, human
gcatcctactgccttactat

SEQ ID NO: 275056 - DNA, 20 bp, human
gagggcagtcaaatttctct

SEQ ID NO: 275057 - DNA, 20 bp, human
gtctgggtgcgcggagagta

SEQ ID NO: 275058 - DNA, 20 bp, human
gtggcacggcgtgcagaaag

SEQ ID NO: 275059 - DNA, 20 bp, human
gagctgttggggagactcat

SEQ ID NO: 275060 - DNA, 20 bp, human
ggaggctaaagcgcagggga

SEQ ID NO: 275061 - DNA, 20 bp, human
ggtcaaactgacgtgtgaag

SEQ ID NO: 275062 - DNA, 20 bp, human
gtcactgccctcggctgcgg

SEQ ID NO: 275063 - DNA, 20 bp, human
ggcacgccgtgccaactccg

SEQ ID NO: 275064 - DNA, 20 bp, human
gccaatcaaaagagaggtcg

SEQ ID NO: 275065 - DNA, 20 bp, human
ggccagatgcgagctgggat

SEQ ID NO: 275066 - DNA, 20 bp, human
ggggaccttgcgacagtctg

SEQ ID NO: 275067 - DNA, 20 bp, human
gcggatgctgagggcgggaa

SEQ ID NO: 275068 - DNA, 20 bp, human
gcccaatgagagcaagacgg

SEQ ID NO: 275069 - DNA, 20 bp, human
ggctccccgggaacaccgtg

SEQ ID NO: 275070 - DNA, 20 bp, human
gcggcgagcgcgggtatccg

SEQ ID NO: 275071 - DNA, 20 bp, human
gtctgcggatgcttccgcgt

SEQ ID NO: 275072 - DNA, 20 bp, human
gttgaggcggggaaagggta

SEQ ID NO: 275073 - DNA, 20 bp, human
gaagcaaaaacattgaggcg

SEQ ID NO: 275074 - DNA, 20 bp, human
gtaggggcaccctcaggaca

SEQ ID NO: 275075 - DNA, 20 bp, human
gcccaccgtcttgctctcat

SEQ ID NO: 275076 - DNA, 20 bp, human
gggtcctggtccccgtgtga

SEQ ID NO: 275077 - DNA, 20 bp, human
gccacggggaccaggaccat

SEQ ID NO: 275078 - DNA, 20 bp, human
ggaccacagtccctcacacg

SEQ ID NO: 275079 - DNA, 20 bp, human
gcccgtggggtccatcacca

SEQ ID NO: 275080 - DNA, 20 bp, human
ggtggcgcgggtgtgccccg

SEQ ID NO: 275081 - DNA, 20 bp, human
ggaccacagtcccttccacg

SEQ ID NO: 275082 - DNA, 20 bp, human
gaccgcggctaccctggtga

SEQ ID NO: 275083 - DNA, 20 bp, human
gggcgcgagccctgggtgcg

SEQ ID NO: 275084 - DNA, 20 bp, human
gctcgggcggcgcgagccct

SEQ ID NO: 275085 - DNA, 20 bp, human
gccgcgccaccccgcaccca

SEQ ID NO: 275086 - DNA, 20 bp, human
ggcagtggcgtgttccctat

SEQ ID NO: 275087 - DNA, 20 bp, human
gggaggcttcacgtgggatt

SEQ ID NO: 275088 - DNA, 20 bp, human
gaagcctccaacacaagctc

SEQ ID NO: 275089 - DNA, 20 bp, human
gtgtgttggaggcttcacgt

SEQ ID NO: 275090 - DNA, 20 bp, human
gaaggcattagactttacaa

SEQ ID NO: 275091 - DNA, 20 bp, human
gagactttacaatggaagtc

SEQ ID NO: 275092 - DNA, 20 bp, human
gaatttacaagtgctctcaa

SEQ ID NO: 275093 - DNA, 20 bp, human
ggtgtggacacacagcgcag

SEQ ID NO: 275094 - DNA, 20 bp, human
gatttggtttacaagcccat

SEQ ID NO: 275095 - DNA, 20 bp, human
gcacttgtaaatttttagac

SEQ ID NO: 275096 - DNA, 20 bp, human
gctgccgccggggtcctcgc

SEQ ID NO: 275097 - DNA, 20 bp, human
gaagcccgggagagcgatgg

SEQ ID NO: 275098 - DNA, 20 bp, human
gcgggctggctgggcgtagt

SEQ ID NO: 275099 - DNA, 20 bp, human
gctgacggcgaacacttcac

SEQ ID NO: 275100 - DNA, 20 bp, human
gacgcccagccagcccgcag

SEQ ID NO: 275101 - DNA, 20 bp, human
ggggaaaaaggccgtcgcca

SEQ ID NO: 275102 - DNA, 20 bp, human
gtgggcgtagtggggctgcg

SEQ ID NO: 275103 - DNA, 20 bp, human
gtctaagcccgggagagcga

SEQ ID NO: 275104 - DNA, 20 bp, human
gcggctgccacggagctaga

SEQ ID NO: 275105 - DNA, 20 bp, human
gcggaagcggaagtctccga

SEQ ID NO: 275106 - DNA, 20 bp, human
ggggaacccaggagttgcgc

SEQ ID NO: 275107 - DNA, 20 bp, human
gccggccagccgagcacatc

SEQ ID NO: 275108 - DNA, 20 bp, human
gggatgcgccagacttcctc

SEQ ID NO: 275109 - DNA, 20 bp, human
gctaccacacgttgagtcga

SEQ ID NO: 275110 - DNA, 20 bp, human
gaagtctggcgcatccgagc

SEQ ID NO: 275111 - DNA, 20 bp, human
ggagttgcgctggcagagag

SEQ ID NO: 275112 - DNA, 20 bp, human
gcacttagccagaggaagtc

SEQ ID NO: 275113 - DNA, 20 bp, human
ggcaaaaaacaacgctgttc

SEQ ID NO: 275114 - DNA, 20 bp, human
gagccgagcacatctggaag

SEQ ID NO: 275115 - DNA, 20 bp, human
gtcccagcggcttcgcgcag

SEQ ID NO: 275116 - DNA, 20 bp, human
gccgccccgcccccgctcac

SEQ ID NO: 275117 - DNA, 20 bp, human
gaggaggtgcgccggttcat

SEQ ID NO: 275118 - DNA, 20 bp, human
ggggggcgcggagacctcgg

SEQ ID NO: 275119 - DNA, 20 bp, human
gggacgcagaggaggtgcgc

SEQ ID NO: 275120 - DNA, 20 bp, human
ggcggcgggaggcacacctg

SEQ ID NO: 275121 - DNA, 20 bp, human
ggaggtctccgcgcccccat

SEQ ID NO: 275122 - DNA, 20 bp, human
gtcggcggcgggcgcggatt

SEQ ID NO: 275123 - DNA, 20 bp, human
ggcggcgcgcccggcagttt

SEQ ID NO: 275124 - DNA, 20 bp, human
gattgggagccggtgagcgg

SEQ ID NO: 275125 - DNA, 20 bp, human
gtgcgccggttcatgggtcc

SEQ ID NO: 275126 - DNA, 20 bp, human
gggcgccgggcctcctgatt

SEQ ID NO: 275127 - DNA, 20 bp, human
ggggcagcatccaaccaatc

SEQ ID NO: 275128 - DNA, 20 bp, human
gctagccggaaacgcgggtc

SEQ ID NO: 275129 - DNA, 20 bp, human
ggcgccccgacccgcgtttc

SEQ ID NO: 275130 - DNA, 20 bp, human
gcgcaccggaagttgcagcg

SEQ ID NO: 275131 - DNA, 20 bp, human
ggcccgccgccctgattggt

SEQ ID NO: 275132 - DNA, 20 bp, human
gggtgcgctagccggaaacg

SEQ ID NO: 275133 - DNA, 20 bp, human
gcaccgcaggcgggcctcgc

SEQ ID NO: 275134 - DNA, 20 bp, human
ggacccgcgaggcccgcctg

SEQ ID NO: 275135 - DNA, 20 bp, human
gctgcgcagtgcatcaccgc

SEQ ID NO: 275136 - DNA, 20 bp, human
gaagaggcactctgagtatt

SEQ ID NO: 275137 - DNA, 20 bp, human
gtaccctgggtgcgaggaac

SEQ ID NO: 275138 - DNA, 20 bp, human
gacagctggccctacaggga

SEQ ID NO: 275139 - DNA, 20 bp, human
gtgctacagctggccctaca

SEQ ID NO: 275140 - DNA, 20 bp, human
gtgtccctccgcctccagga

SEQ ID NO: 275141 - DNA, 20 bp, human
gcccaaagggcagctaccct

SEQ ID NO: 275142 - DNA, 20 bp, human
gtgggccctaaattcactct

SEQ ID NO: 275143 - DNA, 20 bp, human
gtagctgccctttggggcga

SEQ ID NO: 275144 - DNA, 20 bp, human
gggcagctaccctgggtgcg

SEQ ID NO: 275145 - DNA, 20 bp, human
gacccagggtagctgccctt

SEQ ID NO: 275146 - DNA, 20 bp, human
gtgggctgcaagcatcggga

SEQ ID NO: 275147 - DNA, 20 bp, human
gtgtgcgctgcgcagtgctg

SEQ ID NO: 275148 - DNA, 20 bp, human
gctcaccaagcgctcgctaa

SEQ ID NO: 275149 - DNA, 20 bp, human
gcggcctggtggggcggaaa

SEQ ID NO: 275150 - DNA, 20 bp, human
gaaaagctcgtgcacacagt

SEQ ID NO: 275151 - DNA, 20 bp, human
gcatcgggagggcaggtccg

SEQ ID NO: 275152 - DNA, 20 bp, human
gacaccaccgcggcgtcctg

SEQ ID NO: 275153 - DNA, 20 bp, human
ggtgtgcacgagcttttcta

SEQ ID NO: 275154 - DNA, 20 bp, human
gcccgccagcagggcgttta

SEQ ID NO: 275155 - DNA, 20 bp, human
gcagcagggcgtttacggcc

SEQ ID NO: 275156 - DNA, 20 bp, human
ggcccgggcgcagagcatga

SEQ ID NO: 275157 - DNA, 20 bp, human
gcagagcatgaaggccgggc

SEQ ID NO: 275158 - DNA, 20 bp, human
ggcaggcgagcggtttgccc

SEQ ID NO: 275159 - DNA, 20 bp, human
gggcgcagagcatgaaggcc

SEQ ID NO: 275160 - DNA, 20 bp, human
gaggtagacgagcaggcgag

SEQ ID NO: 275161 - DNA, 20 bp, human
gtcaagttaaactgggtggg

SEQ ID NO: 275162 - DNA, 20 bp, human
gggcgagaaccgaagtttgg

SEQ ID NO: 275163 - DNA, 20 bp, human
gagtttggaggtagacgagc

SEQ ID NO: 275164 - DNA, 20 bp, human
gcgtgtcaagttaaactggg

SEQ ID NO: 275165 - DNA, 20 bp, human
gttcccgtgtcaagttaaac

SEQ ID NO: 275166 - DNA, 20 bp, human
gaggaagtacgtcacggaag

SEQ ID NO: 275167 - DNA, 20 bp, human
gcgggtggtaggaaagagac

SEQ ID NO: 275168 - DNA, 20 bp, human
gagtacgtcacggaagaggg

SEQ ID NO: 275169 - DNA, 20 bp, human
gtgccaggaggctgccatct

SEQ ID NO: 275170 - DNA, 20 bp, human
ggggctttttgggacgccag

SEQ ID NO: 275171 - DNA, 20 bp, human
gagtgactggagttgccagg

SEQ ID NO: 275172 - DNA, 20 bp, human
gcctaacggcggcgggtggt

SEQ ID NO: 275173 - DNA, 20 bp, human
gcgctgtaaagaatggagga

SEQ ID NO: 275174 - DNA, 20 bp, human
ggggatctgaagattcctaa

SEQ ID NO: 275175 - DNA, 20 bp, human
gtgaagattcctaacggcgg

SEQ ID NO: 275176 - DNA, 20 bp, human
gctcgcgcgccagtggggaa

SEQ ID NO: 275177 - DNA, 20 bp, human
gaggacggacttcggggaca

SEQ ID NO: 275178 - DNA, 20 bp, human
ggggcgctcgccacctaacg

SEQ ID NO: 275179 - DNA, 20 bp, human
gggaggggaacggacgggag

SEQ ID NO: 275180 - DNA, 20 bp, human
gccgccagcgaggcccgggg

SEQ ID NO: 275181 - DNA, 20 bp, human
gggcgagcgcccgaggggag

SEQ ID NO: 275182 - DNA, 20 bp, human
gagagtggaggggaacggac

SEQ ID NO: 275183 - DNA, 20 bp, human
gggaggcccggcgccctggg

SEQ ID NO: 275184 - DNA, 20 bp, human
gaggccgcacccgcctccgg

SEQ ID NO: 275185 - DNA, 20 bp, human
ggggaggaagggtcccgcgc

SEQ ID NO: 275186 - DNA, 20 bp, human
gaaccagggcgccggacctc

SEQ ID NO: 275187 - DNA, 20 bp, human
gccgttaggtggcgcccaag

SEQ ID NO: 275188 - DNA, 20 bp, human
gtaggtggcgcccaagggga

SEQ ID NO: 275189 - DNA, 20 bp, human
gcctccgggtccggaggtcc

SEQ ID NO: 275190 - DNA, 20 bp, human
gacctccggacccggaggtc

SEQ ID NO: 275191 - DNA, 20 bp, human
gcgccccggacctccggacc

SEQ ID NO: 275192 - DNA, 20 bp, human
gggcgccggacctccgggtc

SEQ ID NO: 275193 - DNA, 20 bp, human
gcggggaggacggactttgg

SEQ ID NO: 275194 - DNA, 20 bp, human
gcggggcgccggacccgccg

SEQ ID NO: 275195 - DNA, 20 bp, human
gagggcgccaaccagggcgc

SEQ ID NO: 275196 - DNA, 20 bp, human
ggctctgcagagtcgagagt

SEQ ID NO: 275197 - DNA, 20 bp, human
gggggtgggggcaagcgaac

SEQ ID NO: 275198 - DNA, 20 bp, human
ggccccgcggccattgggcg

SEQ ID NO: 275199 - DNA, 20 bp, human
ggccccgggccgcggataaa

SEQ ID NO: 275200 - DNA, 20 bp, human
ggctcctcgcccaatggccg

SEQ ID NO: 275201 - DNA, 20 bp, human
gccgcccccggtgccctgat

SEQ ID NO: 275202 - DNA, 20 bp, human
ggggccgcggataaagggtg

SEQ ID NO: 275203 - DNA, 20 bp, human
ggaccaggtaagcccccgga

SEQ ID NO: 275204 - DNA, 20 bp, human
gtggccgctgggagccaatc

SEQ ID NO: 275205 - DNA, 20 bp, human
gcggcgggcgccgctggggt

SEQ ID NO: 275206 - DNA, 20 bp, human
ggggcccatgttgaagtaat

SEQ ID NO: 275207 - DNA, 20 bp, human
gaggccagatactggaagga

SEQ ID NO: 275208 - DNA, 20 bp, human
gcatgggcccgtgagaggca

SEQ ID NO: 275209 - DNA, 20 bp, human
gtgaagtaattggctctgca

SEQ ID NO: 275210 - DNA, 20 bp, human
gttggctctgcatggttgag

SEQ ID NO: 275211 - DNA, 20 bp, human
ggagccaattacttcaacat

SEQ ID NO: 275212 - DNA, 20 bp, human
gcaacaggccagatactgga

SEQ ID NO: 275213 - DNA, 20 bp, human
gtgtaatagaagcaaggcag

SEQ ID NO: 275214 - DNA, 20 bp, human
gaatctggtgtcagttctag

SEQ ID NO: 275215 - DNA, 20 bp, human
gttcaacatgggcccgtgag

SEQ ID NO: 275216 - DNA, 20 bp, human
ggagttggatgctgtagcag

SEQ ID NO: 275217 - DNA, 20 bp, human
gaaccaattgccaaggaaga

SEQ ID NO: 275218 - DNA, 20 bp, human
gcaggaactcaggcgaccta

SEQ ID NO: 275219 - DNA, 20 bp, human
gtcaagtctgcctatgattc

SEQ ID NO: 275220 - DNA, 20 bp, human
gacgtaggggtcctttacta

SEQ ID NO: 275221 - DNA, 20 bp, human
gttcagtttgccagaatcat

SEQ ID NO: 275222 - DNA, 20 bp, human
gctggagctagcactggcag

SEQ ID NO: 275223 - DNA, 20 bp, human
gaagcaatcataatttatga

SEQ ID NO: 275224 - DNA, 20 bp, human
gtcaatataaccaattgcca

SEQ ID NO: 275225 - DNA, 20 bp, human
gatactttttgagggacgta

SEQ ID NO: 275226 - DNA, 20 bp, human
gtgtaacaatactccagtgt

SEQ ID NO: 275227 - DNA, 20 bp, human
gaacccaattagatgaggtt

SEQ ID NO: 275228 - DNA, 20 bp, human
gcaattagatgaggttagga

SEQ ID NO: 275229 - DNA, 20 bp, human
gtgtagcaaaatttattgaa

SEQ ID NO: 275230 - DNA, 20 bp, human
gacgttacagtttacccaca

SEQ ID NO: 275231 - DNA, 20 bp, human
gagttcccggtgatcccatc

SEQ ID NO: 275232 - DNA, 20 bp, human
gacaagagagtgtgttgtct

SEQ ID NO: 275233 - DNA, 20 bp, human
ggatcatcctttaatggact

SEQ ID NO: 275234 - DNA, 20 bp, human
gctccccagtttcttaattt

SEQ ID NO: 275235 - DNA, 20 bp, human
gtgatccaaaattaagaaac

SEQ ID NO: 275236 - DNA, 20 bp, human
gctaaagtggagcaacaggg

SEQ ID NO: 275237 - DNA, 20 bp, human
gcacaggctttgtagaccag

SEQ ID NO: 275238 - DNA, 20 bp, human
gtgtctatggacagaacgtc

SEQ ID NO: 275239 - DNA, 20 bp, human
gtaattgatcttgaaggagg

SEQ ID NO: 275240 - DNA, 20 bp, human
gttgtagaagctgctcaata

SEQ ID NO: 275241 - DNA, 20 bp, human
gtgtctaaagtggagcaaca

SEQ ID NO: 275242 - DNA, 20 bp, human
gtactgacatcatttaaata

SEQ ID NO: 275243 - DNA, 20 bp, human
ggcctgtgatttcttgtcta

SEQ ID NO: 275244 - DNA, 20 bp, human
gacagattgccaggcactct

SEQ ID NO: 275245 - DNA, 20 bp, human
gaacttccttgaggcatttt

SEQ ID NO: 275246 - DNA, 20 bp, human
gttgctgccctaaacttcca

SEQ ID NO: 275247 - DNA, 20 bp, human
gaaggctaaatgtgataaaa

SEQ ID NO: 275248 - DNA, 20 bp, human
gagcccttagtggaaacagg

SEQ ID NO: 275249 - DNA, 20 bp, human
gcattggcttttacaccata

SEQ ID NO: 275250 - DNA, 20 bp, human
ggtgcccacacctgtagacg

SEQ ID NO: 275251 - DNA, 20 bp, human
gaatcaagattagtattcat

SEQ ID NO: 275252 - DNA, 20 bp, human
ggacggggaggagtttatga

SEQ ID NO: 275253 - DNA, 20 bp, human
gtaaactcctccccgtctac

SEQ ID NO: 275254 - DNA, 20 bp, human
gcctccccgtctacaggtgt

SEQ ID NO: 275255 - DNA, 20 bp, human
gcactaagggctaattagag

SEQ ID NO: 275256 - DNA, 20 bp, human
gaaaaaatcggcaatcggtg

SEQ ID NO: 275257 - DNA, 20 bp, human
gagactggagtgcagagtcg

SEQ ID NO: 275258 - DNA, 20 bp, human
gtctggctgaagccggtgtc

SEQ ID NO: 275259 - DNA, 20 bp, human
gtgcgagctctggctgaagc

SEQ ID NO: 275260 - DNA, 20 bp, human
gtgggtggagcggcgcaggc

SEQ ID NO: 275261 - DNA, 20 bp, human
gctccacccacccacacttc

SEQ ID NO: 275262 - DNA, 20 bp, human
ggagtgcagagtcgcggttt

SEQ ID NO: 275263 - DNA, 20 bp, human
gatcggcaatcggtgaggcg

SEQ ID NO: 275264 - DNA, 20 bp, human
gcaaaaaaaaaatcggcaat

SEQ ID NO: 275265 - DNA, 20 bp, human
gatgctaaactctcccctcc

SEQ ID NO: 275266 - DNA, 20 bp, human
ggtaacagcgcagaagtgca

SEQ ID NO: 275267 - DNA, 20 bp, human
gcttctgcgctgttaccctg

SEQ ID NO: 275268 - DNA, 20 bp, human
gggaagtcagggtctatagg

SEQ ID NO: 275269 - DNA, 20 bp, human
gcaaggaaggagtgccagaa

SEQ ID NO: 275270 - DNA, 20 bp, human
ggggctcagggtcagttggt

SEQ ID NO: 275271 - DNA, 20 bp, human
gctgggaagtcagggtctat

SEQ ID NO: 275272 - DNA, 20 bp, human
gagcgcagaagtgcaggggg

SEQ ID NO: 275273 - DNA, 20 bp, human
gagaaaggggcgttgcccca

SEQ ID NO: 275274 - DNA, 20 bp, human
gtgccctgaggatgtgttct

SEQ ID NO: 275275 - DNA, 20 bp, human
gaacccagaacacatcctca

SEQ ID NO: 275276 - DNA, 20 bp, human
gcgcgcccgccggggatcat

SEQ ID NO: 275277 - DNA, 20 bp, human
ggggatcattggtcgaccga

SEQ ID NO: 275278 - DNA, 20 bp, human
gctccggcgcgcggagaccg

SEQ ID NO: 275279 - DNA, 20 bp, human
gcgcggtgacgtcagagtag

SEQ ID NO: 275280 - DNA, 20 bp, human
gtgtcacgagccgaagggag

SEQ ID NO: 275281 - DNA, 20 bp, human
gtcgaccaatgatccccggc

SEQ ID NO: 275282 - DNA, 20 bp, human
gtggtcgggcccactccaat

SEQ ID NO: 275283 - DNA, 20 bp, human
gaagcgcccgcggtctgagg

SEQ ID NO: 275284 - DNA, 20 bp, human
ggccgggagtctctgcgctc

SEQ ID NO: 275285 - DNA, 20 bp, human
gccggcccccgtcacgtggt

SEQ ID NO: 275286 - DNA, 20 bp, human
ggctccaatgaaaagagcga

SEQ ID NO: 275287 - DNA, 20 bp, human
ggggctgaaggcggctggaa

SEQ ID NO: 275288 - DNA, 20 bp, human
ggtcccggccagagacttcc

SEQ ID NO: 275289 - DNA, 20 bp, human
ggggcggagccgggaggaat

SEQ ID NO: 275290 - DNA, 20 bp, human
gccttccctctctggggcgt

SEQ ID NO: 275291 - DNA, 20 bp, human
gtccgcctacgccccagaga

SEQ ID NO: 275292 - DNA, 20 bp, human
gacacctacgctagagagac

SEQ ID NO: 275293 - DNA, 20 bp, human
gtctggggcgtaggcggagt

SEQ ID NO: 275294 - DNA, 20 bp, human
ggccccctcgctcttttcat

SEQ ID NO: 275295 - DNA, 20 bp, human
gttctcggccgggaagtctc

SEQ ID NO: 275296 - DNA, 20 bp, human
gcgaagttcgggttagtcag

SEQ ID NO: 275297 - DNA, 20 bp, human
gagtgcaggctggtgttttc

SEQ ID NO: 275298 - DNA, 20 bp, human
ggtacggcgagcctccggaa

SEQ ID NO: 275299 - DNA, 20 bp, human
gggggcaaggcgtgcgtgcg

SEQ ID NO: 275300 - DNA, 20 bp, human
ggtggagcctgcgcacaatc

SEQ ID NO: 275301 - DNA, 20 bp, human
gcaaggcgtgcgtgcgtggc

SEQ ID NO: 275302 - DNA, 20 bp, human
gcaatccggcgcgccagtgc

SEQ ID NO: 275303 - DNA, 20 bp, human
gcaacaaagcgcgggacgga

SEQ ID NO: 275304 - DNA, 20 bp, human
gccagcctgcactggcgcgc

SEQ ID NO: 275305 - DNA, 20 bp, human
gggcgcgccggattgtgcgc

SEQ ID NO: 275306 - DNA, 20 bp, human
ggggcctgctacagcgtcgc

SEQ ID NO: 275307 - DNA, 20 bp, human
gcccgcgcggtggccgtcgg

SEQ ID NO: 275308 - DNA, 20 bp, human
gaccccggccctgtgacccc

SEQ ID NO: 275309 - DNA, 20 bp, human
gggccagccaggcgagaggc

SEQ ID NO: 275310 - DNA, 20 bp, human
gtcgcctggctggccgtggg

SEQ ID NO: 275311 - DNA, 20 bp, human
ggcggtggccgtcggcggag

SEQ ID NO: 275312 - DNA, 20 bp, human
gcccgacgggccaagcagcg

SEQ ID NO: 275313 - DNA, 20 bp, human
ggtggcctcccgaatctccc

SEQ ID NO: 275314 - DNA, 20 bp, human
gcggccaaggcgggcccgac

SEQ ID NO: 275315 - DNA, 20 bp, human
gcagccggcgacgctgtagc

SEQ ID NO: 275316 - DNA, 20 bp, human
gctagcttggccctcaattg

SEQ ID NO: 275317 - DNA, 20 bp, human
ggagagctggcgccttaaag

SEQ ID NO: 275318 - DNA, 20 bp, human
gctcggtgggaccggcaata

SEQ ID NO: 275319 - DNA, 20 bp, human
ggcgggaaggagagttactg

SEQ ID NO: 275320 - DNA, 20 bp, human
ggggcgaaagaattctgctt

SEQ ID NO: 275321 - DNA, 20 bp, human
gtaaggcgccagctctccgg

SEQ ID NO: 275322 - DNA, 20 bp, human
ggaggattaaccttagccaa

SEQ ID NO: 275323 - DNA, 20 bp, human
gacgggtcagacaatgctta

SEQ ID NO: 275324 - DNA, 20 bp, human
gggccggaagtgttgaagcc

SEQ ID NO: 275325 - DNA, 20 bp, human
gggctaaggttaatcctcgg

SEQ ID NO: 275326 - DNA, 20 bp, human
ggcaggcaacgcccgaccgg

SEQ ID NO: 275327 - DNA, 20 bp, human
gaaggcggggccgtgaaata

SEQ ID NO: 275328 - DNA, 20 bp, human
gacggcgctcccagcgtgga

SEQ ID NO: 275329 - DNA, 20 bp, human
gaggggactcccctgcgggg

SEQ ID NO: 275330 - DNA, 20 bp, human
gtggcgctcgcggaggagga

SEQ ID NO: 275331 - DNA, 20 bp, human
gccgtgaaataaggcccgac

SEQ ID NO: 275332 - DNA, 20 bp, human
gaggaggaacctgcggcgtt

SEQ ID NO: 275333 - DNA, 20 bp, human
gcgttaggagctgacagtgt

SEQ ID NO: 275334 - DNA, 20 bp, human
ggcgcgtgggcactgctccc

SEQ ID NO: 275335 - DNA, 20 bp, human
gggagggccggacacttatt

SEQ ID NO: 275336 - DNA, 20 bp, human
gtcagcgggccggcacgtga

SEQ ID NO: 275337 - DNA, 20 bp, human
gaggccgcgttgataggtgg

SEQ ID NO: 275338 - DNA, 20 bp, human
gcagagcgtcctcctctaga

SEQ ID NO: 275339 - DNA, 20 bp, human
gcgtgatggcggacggcaaa

SEQ ID NO: 275340 - DNA, 20 bp, human
gagcttgaagactgcgaaaa

SEQ ID NO: 275341 - DNA, 20 bp, human
gccaggcgccggggcaggaa

SEQ ID NO: 275342 - DNA, 20 bp, human
gccgctgaggccgcgttgat

SEQ ID NO: 275343 - DNA, 20 bp, human
gctgaggccgcgttgatagg

SEQ ID NO: 275344 - DNA, 20 bp, human
ggcgggccggcacgtgatgg

SEQ ID NO: 275345 - DNA, 20 bp, human
gtcgcccccacctatcaacg

SEQ ID NO: 275346 - DNA, 20 bp, human
gcaaggaagctttggaaccc

SEQ ID NO: 275347 - DNA, 20 bp, human
gacaggtcctggcagatgag

SEQ ID NO: 275348 - DNA, 20 bp, human
gcaggaaatcgctcagacca

SEQ ID NO: 275349 - DNA, 20 bp, human
ggggcgggctgtgcagtagg

SEQ ID NO: 275350 - DNA, 20 bp, human
ggggtgaagttacttagcta

SEQ ID NO: 275351 - DNA, 20 bp, human
gtctgggacaactgtcacag

SEQ ID NO: 275352 - DNA, 20 bp, human
ggtctgagcgatttcctgac

SEQ ID NO: 275353 - DNA, 20 bp, human
ggtgacagttgtcccagaaa

SEQ ID NO: 275354 - DNA, 20 bp, human
gcataaacaggatgtggtgt

SEQ ID NO: 275355 - DNA, 20 bp, human
gcgtggggaccggggctgta

SEQ ID NO: 275356 - DNA, 20 bp, human
gccccctgagcgaccactcg

SEQ ID NO: 275357 - DNA, 20 bp, human
gcagcctcgagtggtcgctc

SEQ ID NO: 275358 - DNA, 20 bp, human
gacccagtttcaagcggctc

SEQ ID NO: 275359 - DNA, 20 bp, human
gggggcgtggtctgatgcgg

SEQ ID NO: 275360 - DNA, 20 bp, human
gttgaaactgggtcgggcca

SEQ ID NO: 275361 - DNA, 20 bp, human
gcaagcggctcaggtagaga

SEQ ID NO: 275362 - DNA, 20 bp, human
gtacctgagccgcttgaaac

SEQ ID NO: 275363 - DNA, 20 bp, human
gagaccacgcccccgtagcc

SEQ ID NO: 275364 - DNA, 20 bp, human
ggcgtcgccctgcccagcgg

SEQ ID NO: 275365 - DNA, 20 bp, human
gctgcggcggcaggaaatcg

SEQ ID NO: 275366 - DNA, 20 bp, human
gggccaaggtgactacagaa

SEQ ID NO: 275367 - DNA, 20 bp, human
gtgactacagaaggggagcg

SEQ ID NO: 275368 - DNA, 20 bp, human
gaagcgcgtcagtgggcgga

SEQ ID NO: 275369 - DNA, 20 bp, human
gctgaggatgccttcaagtt

SEQ ID NO: 275370 - DNA, 20 bp, human
gtgccagaagcccaacttga

SEQ ID NO: 275371 - DNA, 20 bp, human
ggggctgctgaaggggggta

SEQ ID NO: 275372 - DNA, 20 bp, human
ggagtcgggctgctgaaggg

SEQ ID NO: 275373 - DNA, 20 bp, human
gtgatggctcggtgatgccc

SEQ ID NO: 275374 - DNA, 20 bp, human
gttctctcgtaatgacactg

SEQ ID NO: 275375 - DNA, 20 bp, human
gcttgccagtaattagctga

SEQ ID NO: 275376 - DNA, 20 bp, human
gcccatctgccagtgttcaa

SEQ ID NO: 275377 - DNA, 20 bp, human
ggggtcgcaccctgagcgga

SEQ ID NO: 275378 - DNA, 20 bp, human
ggggcctgggcggtgccaac

SEQ ID NO: 275379 - DNA, 20 bp, human
ggccaacaggctgccgaggg

SEQ ID NO: 275380 - DNA, 20 bp, human
gagggtccggaaggagggcg

SEQ ID NO: 275381 - DNA, 20 bp, human
gttcctggaccctccctcta

SEQ ID NO: 275382 - DNA, 20 bp, human
gttctagaagcgcacggccc

SEQ ID NO: 275383 - DNA, 20 bp, human
gtccccgtggctttcctaaa

SEQ ID NO: 275384 - DNA, 20 bp, human
gtctgccagtgttcaaaggt

SEQ ID NO: 275385 - DNA, 20 bp, human
gggtgccaacaggctgccga

SEQ ID NO: 275386 - DNA, 20 bp, human
gtggtgagaggctgtcaaac

SEQ ID NO: 275387 - DNA, 20 bp, human
ggactcctggctcacgtcac

SEQ ID NO: 275388 - DNA, 20 bp, human
gcgctctgtgatttggtgag

SEQ ID NO: 275389 - DNA, 20 bp, human
gcgagcgccgctctgtgatt

SEQ ID NO: 275390 - DNA, 20 bp, human
gccgcggcgagtccacactg

SEQ ID NO: 275391 - DNA, 20 bp, human
gggccagatcggcaggtccc

SEQ ID NO: 275392 - DNA, 20 bp, human
gagaggcgagttctaatctg

SEQ ID NO: 275393 - DNA, 20 bp, human
gccgcgcacccggagcgaga

SEQ ID NO: 275394 - DNA, 20 bp, human
gcgggagctctgggcgtcac

SEQ ID NO: 275395 - DNA, 20 bp, human
gcaggtccctggtcccggcg

SEQ ID NO: 275396 - DNA, 20 bp, human
gcctgcgcctgcgcggtcaa

SEQ ID NO: 275397 - DNA, 20 bp, human
gtccaagagcagggtcggag

SEQ ID NO: 275398 - DNA, 20 bp, human
gcgaccgtggggatcagcgt

SEQ ID NO: 275399 - DNA, 20 bp, human
ggaccgcgcaggcgcaggaa

SEQ ID NO: 275400 - DNA, 20 bp, human
gcaacggtagcgagtacttg

SEQ ID NO: 275401 - DNA, 20 bp, human
ggaccgtgggggttttctgc

SEQ ID NO: 275402 - DNA, 20 bp, human
ggggttgggaggtgagtcga

SEQ ID NO: 275403 - DNA, 20 bp, human
gagcccgcagaaaaccccca

SEQ ID NO: 275404 - DNA, 20 bp, human
ggagtacttgaggaccgtgg

SEQ ID NO: 275405 - DNA, 20 bp, human
gaactgacgcagacgagggg

SEQ ID NO: 275406 - DNA, 20 bp, human
gggtgtgaccaagggatcgc

SEQ ID NO: 275407 - DNA, 20 bp, human
gaagaggtgctgaagtccag

SEQ ID NO: 275408 - DNA, 20 bp, human
gcggggttaaatgcgaagaa

SEQ ID NO: 275409 - DNA, 20 bp, human
gttaaatgcgaagaagggtg

SEQ ID NO: 275410 - DNA, 20 bp, human
ggatcccttggtcacacccc

SEQ ID NO: 275411 - DNA, 20 bp, human
gtgaccaagggatcgcgggg

SEQ ID NO: 275412 - DNA, 20 bp, human
gtacccgctttctaacttta

SEQ ID NO: 275413 - DNA, 20 bp, human
gcggggcagcagccgaagtg

SEQ ID NO: 275414 - DNA, 20 bp, human
gcaggggcaaacagccacaa

SEQ ID NO: 275415 - DNA, 20 bp, human
gccagcctggaacttaagac

SEQ ID NO: 275416 - DNA, 20 bp, human
ggtcccggcccgggtctcca

SEQ ID NO: 275417 - DNA, 20 bp, human
ggccgccggcgtcggaacgt

SEQ ID NO: 275418 - DNA, 20 bp, human
gcgagtacgccgggctgcca

SEQ ID NO: 275419 - DNA, 20 bp, human
gctgccatggagacccgggc

SEQ ID NO: 275420 - DNA, 20 bp, human
gaatgagcgcccgagtacgc

SEQ ID NO: 275421 - DNA, 20 bp, human
gctcgccccgagggtgacca

SEQ ID NO: 275422 - DNA, 20 bp, human
gccaatggccagctgacccg

SEQ ID NO: 275423 - DNA, 20 bp, human
gggcggccgtgccacgtacg

SEQ ID NO: 275424 - DNA, 20 bp, human
gccagctgacccgcgggtcc

SEQ ID NO: 275425 - DNA, 20 bp, human
gcgcccgaggcctgcgccgg

SEQ ID NO: 275426 - DNA, 20 bp, human
ggctgtacacctgaggggga

SEQ ID NO: 275427 - DNA, 20 bp, human
ggtgtggctgccttatccaa

SEQ ID NO: 275428 - DNA, 20 bp, human
ggcggcggcgcgaggaggaa

SEQ ID NO: 275429 - DNA, 20 bp, human
ggcccccgtccttccccctc

SEQ ID NO: 275430 - DNA, 20 bp, human
gagactggttagggacagat

SEQ ID NO: 275431 - DNA, 20 bp, human
gtacacctgagggggaagga

SEQ ID NO: 275432 - DNA, 20 bp, human
gttgagaggcagactggtta

SEQ ID NO: 275433 - DNA, 20 bp, human
ggcagtgaccgaatggggac

SEQ ID NO: 275434 - DNA, 20 bp, human
gacgggctgtacacctgagg

SEQ ID NO: 275435 - DNA, 20 bp, human
gcccgtggcagtgaccgaat

SEQ ID NO: 275436 - DNA, 20 bp, human
gggaccgcctcctggcacga

SEQ ID NO: 275437 - DNA, 20 bp, human
gcccccactgggttccggaa

SEQ ID NO: 275438 - DNA, 20 bp, human
gggcaactagaggaacctgt

SEQ ID NO: 275439 - DNA, 20 bp, human
gcgacgaattccagcttcgg

SEQ ID NO: 275440 - DNA, 20 bp, human
ggcggcagggcgaggccttc

SEQ ID NO: 275441 - DNA, 20 bp, human
gaacgaaggaatgttggcga

SEQ ID NO: 275442 - DNA, 20 bp, human
gagcctttccggaacccagt

SEQ ID NO: 275443 - DNA, 20 bp, human
gaggggtggtgggaaatagg

SEQ ID NO: 275444 - DNA, 20 bp, human
gcacgcactgaggttgctgt

SEQ ID NO: 275445 - DNA, 20 bp, human
ggcccgggctagcgaaaagt

SEQ ID NO: 275446 - DNA, 20 bp, human
gcggctgcggagggtatctg

SEQ ID NO: 275447 - DNA, 20 bp, human
ggccacaggcccctcctccg

SEQ ID NO: 275448 - DNA, 20 bp, human
gaaaccggccggccctcgag

SEQ ID NO: 275449 - DNA, 20 bp, human
gcggccggccctcgagagga

SEQ ID NO: 275450 - DNA, 20 bp, human
gtctcccgcggcccgccctt

SEQ ID NO: 275451 - DNA, 20 bp, human
gcgcgagcccctcctctcga

SEQ ID NO: 275452 - DNA, 20 bp, human
ggcggagggtatctgaggct

SEQ ID NO: 275453 - DNA, 20 bp, human
gggaggagccagagcccgtt

SEQ ID NO: 275454 - DNA, 20 bp, human
gagcccctcctctcgagggc

SEQ ID NO: 275455 - DNA, 20 bp, human
gaggagcccgcggcatccac

SEQ ID NO: 275456 - DNA, 20 bp, human
gtcggcgggcgcgaaagggg

SEQ ID NO: 275457 - DNA, 20 bp, human
gtcggcgcaaccaaacccgc

SEQ ID NO: 275458 - DNA, 20 bp, human
ggccaagcgcgcccaccatg

SEQ ID NO: 275459 - DNA, 20 bp, human
ggcgtcggcgggcgcgaaag

SEQ ID NO: 275460 - DNA, 20 bp, human
ggggacgcgcagccgggagc

SEQ ID NO: 275461 - DNA, 20 bp, human
gtgggagcgcagcccgcgac

SEQ ID NO: 275462 - DNA, 20 bp, human
gccgcgacgggcagacggtg

SEQ ID NO: 275463 - DNA, 20 bp, human
ggggaccgagcggggccgaa

SEQ ID NO: 275464 - DNA, 20 bp, human
gtggttgcgccgacgtggga

SEQ ID NO: 275465 - DNA, 20 bp, human
gggtttggttgcgccgacgt

SEQ ID NO: 275466 - DNA, 20 bp, human
ggaaagaggcgggatctttg

SEQ ID NO: 275467 - DNA, 20 bp, human
ggggccggctgccgtccatc

SEQ ID NO: 275468 - DNA, 20 bp, human
gatcccttccggcctcgggg

SEQ ID NO: 275469 - DNA, 20 bp, human
ggcgagatgagccaatcgaa

SEQ ID NO: 275470 - DNA, 20 bp, human
ggggtcgacgccgaaagagg

SEQ ID NO: 275471 - DNA, 20 bp, human
gacctcgcggagtagcccaa

SEQ ID NO: 275472 - DNA, 20 bp, human
gaccccgccccgaggccgga

SEQ ID NO: 275473 - DNA, 20 bp, human
ggccgtgagagcccttcgat

SEQ ID NO: 275474 - DNA, 20 bp, human
ggggaggcgggcatcccttc

SEQ ID NO: 275475 - DNA, 20 bp, human
gaggtgaaggcgcttctcat

SEQ ID NO: 275476 - DNA, 20 bp, human
gcgctcccgctgcctcccgg

SEQ ID NO: 275477 - DNA, 20 bp, human
gcgggagcgcgcacgctccg

SEQ ID NO: 275478 - DNA, 20 bp, human
gagctcgtgactcgccgccc

SEQ ID NO: 275479 - DNA, 20 bp, human
gaaccagcgaactgactcgc

SEQ ID NO: 275480 - DNA, 20 bp, human
gtgaggaaccgcggtcacgt

SEQ ID NO: 275481 - DNA, 20 bp, human
gtccggggccaccgcccctc

SEQ ID NO: 275482 - DNA, 20 bp, human
gggcgcgcaacgcgggagaa

SEQ ID NO: 275483 - DNA, 20 bp, human
ggggccaggacagcggggga

SEQ ID NO: 275484 - DNA, 20 bp, human
ggcctcgaaatgggtcgggt

SEQ ID NO: 275485 - DNA, 20 bp, human
gggagaaagggaggctaagt

SEQ ID NO: 275486 - DNA, 20 bp, human
gcgggacgccccagccaggg

SEQ ID NO: 275487 - DNA, 20 bp, human
gtcggcttggggtgcccaga

SEQ ID NO: 275488 - DNA, 20 bp, human
ggaaggcgcctggaagtgaa

SEQ ID NO: 275489 - DNA, 20 bp, human
gaggcccagccacactttac

SEQ ID NO: 275490 - DNA, 20 bp, human
gaccccaagccgaaggcgcc

SEQ ID NO: 275491 - DNA, 20 bp, human
gccaggcaccgggttccgac

SEQ ID NO: 275492 - DNA, 20 bp, human
gaagcggaaggagccagtct

SEQ ID NO: 275493 - DNA, 20 bp, human
gggccgggacgccccagcca

SEQ ID NO: 275494 - DNA, 20 bp, human
gcggcgccaagcgtctgttg

SEQ ID NO: 275495 - DNA, 20 bp, human
gtcactcacctgtcggaacc

SEQ ID NO: 275496 - DNA, 20 bp, human
gaggacccagtctgcggtgg

SEQ ID NO: 275497 - DNA, 20 bp, human
gacccggcccgacaggttga

SEQ ID NO: 275498 - DNA, 20 bp, human
ggggtctgacggttcctgat

SEQ ID NO: 275499 - DNA, 20 bp, human
gaatccgccccttctccaga

SEQ ID NO: 275500 - DNA, 20 bp, human
gaaaacccccaccgcagact

SEQ ID NO: 275501 - DNA, 20 bp, human
gcccgacaggttgacggtga

SEQ ID NO: 275502 - DNA, 20 bp, human
gtgccaggagagggtgaggt

SEQ ID NO: 275503 - DNA, 20 bp, human
gtgctcagacccggcccgac

SEQ ID NO: 275504 - DNA, 20 bp, human
ggaaggggcggattctcctc

SEQ ID NO: 275505 - DNA, 20 bp, human
gcgggtctgagcaggtctgg

SEQ ID NO: 275506 - DNA, 20 bp, human
gggcgccgcgccaccactga

SEQ ID NO: 275507 - DNA, 20 bp, human
gcgccccctggcagcgtccc

SEQ ID NO: 275508 - DNA, 20 bp, human
gcgtacctgccccttcgggt

SEQ ID NO: 275509 - DNA, 20 bp, human
ggccccggggacgctgccag

SEQ ID NO: 275510 - DNA, 20 bp, human
gcgcgctctgggagtggtcg

SEQ ID NO: 275511 - DNA, 20 bp, human
gctcccacccccacccgaag

SEQ ID NO: 275512 - DNA, 20 bp, human
gtgtccgagggcacgtgcgc

SEQ ID NO: 275513 - DNA, 20 bp, human
ggcagaaggccacagccccg

SEQ ID NO: 275514 - DNA, 20 bp, human
gcccccaagtcccgggtttg

SEQ ID NO: 275515 - DNA, 20 bp, human
gccgtgagaaacagggaact

SEQ ID NO: 275516 - DNA, 20 bp, human
gggcggatctgttaacccga

SEQ ID NO: 275517 - DNA, 20 bp, human
ggttaacagatccgccctcc

SEQ ID NO: 275518 - DNA, 20 bp, human
gggctcgagggcggagcgaa

SEQ ID NO: 275519 - DNA, 20 bp, human
gcgcccagtgccgggtcccg

SEQ ID NO: 275520 - DNA, 20 bp, human
gaggctgttgattggctcga

SEQ ID NO: 275521 - DNA, 20 bp, human
gcggggccagaggagattag

SEQ ID NO: 275522 - DNA, 20 bp, human
ggcagcccaggcccgagcct

SEQ ID NO: 275523 - DNA, 20 bp, human
ggcagcccaggctcgggcct

SEQ ID NO: 275524 - DNA, 20 bp, human
ggagattagaggctgttgat

SEQ ID NO: 275525 - DNA, 20 bp, human
gggagaaaaggcaatagggg

SEQ ID NO: 275526 - DNA, 20 bp, human
ggaaggctgcggggcgtcgc

SEQ ID NO: 275527 - DNA, 20 bp, human
gagaccgaaagcggaagtca

SEQ ID NO: 275528 - DNA, 20 bp, human
ggaggagttgagaccgaaag

SEQ ID NO: 275529 - DNA, 20 bp, human
ggaggcttcaagttgggcgg

SEQ ID NO: 275530 - DNA, 20 bp, human
gagcggaagtcacggggagc

SEQ ID NO: 275531 - DNA, 20 bp, human
ggtaaatgaggcttcaagtt

SEQ ID NO: 275532 - DNA, 20 bp, human
gaaccactctcctcagggag

SEQ ID NO: 275533 - DNA, 20 bp, human
ggtcacggggagctggcggc

SEQ ID NO: 275534 - DNA, 20 bp, human
gtgaagcctcatttaccttt

SEQ ID NO: 275535 - DNA, 20 bp, human
gagagtggtttaaacggtga

SEQ ID NO: 275536 - DNA, 20 bp, human
gtcagggagctgacccccca

SEQ ID NO: 275537 - DNA, 20 bp, human
gggaggggtctcagtaacgg

SEQ ID NO: 275538 - DNA, 20 bp, human
ggtagcagaggaacgaacta

SEQ ID NO: 275539 - DNA, 20 bp, human
gtaaagacaggaggctcggg

SEQ ID NO: 275540 - DNA, 20 bp, human
gcggctctggccctattgga

SEQ ID NO: 275541 - DNA, 20 bp, human
ggctcccagttgaccgtctc

SEQ ID NO: 275542 - DNA, 20 bp, human
gctgccggctctggccctat

SEQ ID NO: 275543 - DNA, 20 bp, human
gcctggcgggcgaagactcg

SEQ ID NO: 275544 - DNA, 20 bp, human
ggctcgggaggcggcgacgt

SEQ ID NO: 275545 - DNA, 20 bp, human
ggggggctggaggtaaagac

SEQ ID NO: 275546 - DNA, 20 bp, human
ggggtcccagagggcgacga

SEQ ID NO: 275547 - DNA, 20 bp, human
ggcgccaccggggtcccaga

SEQ ID NO: 275548 - DNA, 20 bp, human
gccgcccagcgggtccccga

SEQ ID NO: 275549 - DNA, 20 bp, human
gaggacagagcgcgccaccg

SEQ ID NO: 275550 - DNA, 20 bp, human
gcgggatcccagaccaggga

SEQ ID NO: 275551 - DNA, 20 bp, human
gaagggacgtggggcgaacc

SEQ ID NO: 275552 - DNA, 20 bp, human
gccacctcggctgtctccag

SEQ ID NO: 275553 - DNA, 20 bp, human
gggagggggcgcacgtccga

SEQ ID NO: 275554 - DNA, 20 bp, human
ggccccctcggggacccgct

SEQ ID NO: 275555 - DNA, 20 bp, human
gaccccccacggagcccggc

SEQ ID NO: 275556 - DNA, 20 bp, human
gcgggcccccgggacgggga

SEQ ID NO: 275557 - DNA, 20 bp, human
gccgccagctgacgtcagca

SEQ ID NO: 275558 - DNA, 20 bp, human
gcagcgcgcgagtgcgccag

SEQ ID NO: 275559 - DNA, 20 bp, human
gagttcgcgtcagccggcgg

SEQ ID NO: 275560 - DNA, 20 bp, human
gccgcaagcacccaccccgg

SEQ ID NO: 275561 - DNA, 20 bp, human
ggtcccgcaagcacccaccc

SEQ ID NO: 275562 - DNA, 20 bp, human
gcggagttcgcgtcagccgg

SEQ ID NO: 275563 - DNA, 20 bp, human
ggacgtcagctggcggcccg

SEQ ID NO: 275564 - DNA, 20 bp, human
gaacaagcgcgcgcgcgcct

SEQ ID NO: 275565 - DNA, 20 bp, human
gcgtcagcagggccgcgcgc

SEQ ID NO: 275566 - DNA, 20 bp, human
gggcgaggcgagagccgcac

SEQ ID NO: 275567 - DNA, 20 bp, human
gctggagcacagatccggga

SEQ ID NO: 275568 - DNA, 20 bp, human
gggctcgggctgcgcgtcgg

SEQ ID NO: 275569 - DNA, 20 bp, human
ggcgcccgcggactctgccg

SEQ ID NO: 275570 - DNA, 20 bp, human
ggctccgcgcctggcaatcg

SEQ ID NO: 275571 - DNA, 20 bp, human
ggccgcgctcccgggccggt

SEQ ID NO: 275572 - DNA, 20 bp, human
gtccgcgggcgcagcagtca

SEQ ID NO: 275573 - DNA, 20 bp, human
gccgcccccggccgaagtcg

SEQ ID NO: 275574 - DNA, 20 bp, human
gcggccctggcacgcaacgg

SEQ ID NO: 275575 - DNA, 20 bp, human
ggcaccctcggcagagtccg

SEQ ID NO: 275576 - DNA, 20 bp, human
gacgccaacgctccaccccc

SEQ ID NO: 275577 - DNA, 20 bp, human
gtcgtgcgaggggtcgtcac

SEQ ID NO: 275578 - DNA, 20 bp, human
gcggcggcgaggggggtgga

SEQ ID NO: 275579 - DNA, 20 bp, human
gccggccgaggcaataagag

SEQ ID NO: 275580 - DNA, 20 bp, human
ggagggcgggagccggcgga

SEQ ID NO: 275581 - DNA, 20 bp, human
gcgagccaaaagcgccgcgg

SEQ ID NO: 275582 - DNA, 20 bp, human
gcgaggggtcgtcactggcg

SEQ ID NO: 275583 - DNA, 20 bp, human
gccgggcgacgcggtccggg

SEQ ID NO: 275584 - DNA, 20 bp, human
gggagcgcgcgcccggactt

SEQ ID NO: 275585 - DNA, 20 bp, human
ggagcgttggcgtcgtgcga

SEQ ID NO: 275586 - DNA, 20 bp, human
ggacatgttcagtagggtca

SEQ ID NO: 275587 - DNA, 20 bp, human
gtggggagacatgttcagta

SEQ ID NO: 275588 - DNA, 20 bp, human
gccccccaacccttctaatc

SEQ ID NO: 275589 - DNA, 20 bp, human
gtgccagggcctctcctgga

SEQ ID NO: 275590 - DNA, 20 bp, human
gaaccgctgactctgcactc

SEQ ID NO: 275591 - DNA, 20 bp, human
gcctctcctggagggttgcg

SEQ ID NO: 275592 - DNA, 20 bp, human
gagcccgattagaagggttg

SEQ ID NO: 275593 - DNA, 20 bp, human
ggtgcagagtcagcggttga

SEQ ID NO: 275594 - DNA, 20 bp, human
ggggctgcttagtgggattt

SEQ ID NO: 275595 - DNA, 20 bp, human
gtatgccagcccgattagaa

SEQ ID NO: 275596 - DNA, 20 bp, human
gagcgtcatcgccacctcgt

SEQ ID NO: 275597 - DNA, 20 bp, human
gagcactgggttatttgagg

SEQ ID NO: 275598 - DNA, 20 bp, human
gcctctggtaccgcaagcac

SEQ ID NO: 275599 - DNA, 20 bp, human
ggtgcccaacgccctcgcag

SEQ ID NO: 275600 - DNA, 20 bp, human
ggcaagcactgggttatttg

SEQ ID NO: 275601 - DNA, 20 bp, human
gcgcaggggcaagctcagaa

SEQ ID NO: 275602 - DNA, 20 bp, human
gccttcaggtgaaatgcaag

SEQ ID NO: 275603 - DNA, 20 bp, human
gcagagggaattagctcttt

SEQ ID NO: 275604 - DNA, 20 bp, human
ggctccacccaagctcccca

SEQ ID NO: 275605 - DNA, 20 bp, human
gttgcccctgcgagggcgtt

SEQ ID NO: 275606 - DNA, 20 bp, human
gactagggaaatgatctgct

SEQ ID NO: 275607 - DNA, 20 bp, human
gtctgctgggttctgacgga

SEQ ID NO: 275608 - DNA, 20 bp, human
gaacagaagtacaaagagag

SEQ ID NO: 275609 - DNA, 20 bp, human
gcaggggatgaaccccttaa

SEQ ID NO: 275610 - DNA, 20 bp, human
ggttgagcctccagattata

SEQ ID NO: 275611 - DNA, 20 bp, human
gggaagcaagagactttcag

SEQ ID NO: 275612 - DNA, 20 bp, human
gaatccctagactaagaagt

SEQ ID NO: 275613 - DNA, 20 bp, human
gaagagaggggccaatgcaa

SEQ ID NO: 275614 - DNA, 20 bp, human
ggactacttccatcctttaa

SEQ ID NO: 275615 - DNA, 20 bp, human
gtcaaatgtttctataacta

SEQ ID NO: 275616 - DNA, 20 bp, human
gcgggcacatcttcgaaaac

SEQ ID NO: 275617 - DNA, 20 bp, human
gtaaaaccatacccccctga

SEQ ID NO: 275618 - DNA, 20 bp, human
gcctctctagcctccatcag

SEQ ID NO: 275619 - DNA, 20 bp, human
gaaccatacccccctgatgg

SEQ ID NO: 275620 - DNA, 20 bp, human
gcatctgtcacctgatcagg

SEQ ID NO: 275621 - DNA, 20 bp, human
gtctcatctgtcacctgatc

SEQ ID NO: 275622 - DNA, 20 bp, human
gtcaaattaaatgactgctt

SEQ ID NO: 275623 - DNA, 20 bp, human
gatggttttaccacctgatc

SEQ ID NO: 275624 - DNA, 20 bp, human
gagcctccatcaggggggta

SEQ ID NO: 275625 - DNA, 20 bp, human
gtaagtaataatctaagcat

SEQ ID NO: 275626 - DNA, 20 bp, human
gcggcgcggggagctcttgc

SEQ ID NO: 275627 - DNA, 20 bp, human
ggccagtagcccaatgggga

SEQ ID NO: 275628 - DNA, 20 bp, human
ggccgcccgccgccagtccg

SEQ ID NO: 275629 - DNA, 20 bp, human
gagcccaatggggacggaca

SEQ ID NO: 275630 - DNA, 20 bp, human
ggacgggccagtagcccaat

SEQ ID NO: 275631 - DNA, 20 bp, human
ggggcggacccgcggactgg

SEQ ID NO: 275632 - DNA, 20 bp, human
gcctgtgcccaatggacaga

SEQ ID NO: 275633 - DNA, 20 bp, human
gcccgccgggcaccacgcgc

SEQ ID NO: 275634 - DNA, 20 bp, human
ggcacccccccgcccgcggt

SEQ ID NO: 275635 - DNA, 20 bp, human
ggcgggcggcgcacacactc

SEQ ID NO: 275636 - DNA, 20 bp, human
gacgcgctcggggcccgatg

SEQ ID NO: 275637 - DNA, 20 bp, human
gccggggcagcggtacccga

SEQ ID NO: 275638 - DNA, 20 bp, human
gcgcgctcgccaggcccgac

SEQ ID NO: 275639 - DNA, 20 bp, human
ggtacccgaaggcagcagca

SEQ ID NO: 275640 - DNA, 20 bp, human
gccccgagcgcgtgtccgag

SEQ ID NO: 275641 - DNA, 20 bp, human
ggctggaggcgtctgagggg

SEQ ID NO: 275642 - DNA, 20 bp, human
ggtgtccgagcggcttaaag

SEQ ID NO: 275643 - DNA, 20 bp, human
ggccctccggggacagggta

SEQ ID NO: 275644 - DNA, 20 bp, human
ggaccctcggagttgggatg

SEQ ID NO: 275645 - DNA, 20 bp, human
gtgcgcgtgcccgtcgggcc

SEQ ID NO: 275646 - DNA, 20 bp, human
ggccacacggcatacagcgc

SEQ ID NO: 275647 - DNA, 20 bp, human
gacggcatacagcgcaggcg

SEQ ID NO: 275648 - DNA, 20 bp, human
gctgccgcgccagcagggac

SEQ ID NO: 275649 - DNA, 20 bp, human
ggtgccgcgcggtgggtgat

SEQ ID NO: 275650 - DNA, 20 bp, human
gcgtgtggccgctacctcgc

SEQ ID NO: 275651 - DNA, 20 bp, human
ggcggccgccgtgtacgacc

SEQ ID NO: 275652 - DNA, 20 bp, human
ggggagagcctgcgaggtag

SEQ ID NO: 275653 - DNA, 20 bp, human
ggcgcaggcgcggcctggat

SEQ ID NO: 275654 - DNA, 20 bp, human
gcggcactgccgcgccagca

SEQ ID NO: 275655 - DNA, 20 bp, human
ggcggccgcgcgcacgctgg

SEQ ID NO: 275656 - DNA, 20 bp, human
gcgtggcccaaccgggaact

SEQ ID NO: 275657 - DNA, 20 bp, human
gctcccgccccgcctggaat

SEQ ID NO: 275658 - DNA, 20 bp, human
gagttcgacgccccagttcc

SEQ ID NO: 275659 - DNA, 20 bp, human
gggagacaaaaccccaccga

SEQ ID NO: 275660 - DNA, 20 bp, human
gctcctccagtcccagaggg

SEQ ID NO: 275661 - DNA, 20 bp, human
gaagcgtagggtgagaacct

SEQ ID NO: 275662 - DNA, 20 bp, human
gagtaagacatcccccctct

SEQ ID NO: 275663 - DNA, 20 bp, human
ggcggcagccgcgtcactgg

SEQ ID NO: 275664 - DNA, 20 bp, human
gaccaactgcctcgcacttg

SEQ ID NO: 275665 - DNA, 20 bp, human
ggacgcaaaccgtactcaaa

SEQ ID NO: 275666 - DNA, 20 bp, human
ggcagcccggcggtcctcat

SEQ ID NO: 275667 - DNA, 20 bp, human
ggtagagcgagaagcgaaag

SEQ ID NO: 275668 - DNA, 20 bp, human
gcccgctcgaccatgcaaaa

SEQ ID NO: 275669 - DNA, 20 bp, human
gttgagcagaaatgtatcat

SEQ ID NO: 275670 - DNA, 20 bp, human
gcggcgccatgtaatgcaaa

SEQ ID NO: 275671 - DNA, 20 bp, human
ggcgaaagaggtgaagtgta

SEQ ID NO: 275672 - DNA, 20 bp, human
gggtgcggggagggttgacg

SEQ ID NO: 275673 - DNA, 20 bp, human
ggcagtcagattttgttgta

SEQ ID NO: 275674 - DNA, 20 bp, human
gtccccgcaccaagtggaac

SEQ ID NO: 275675 - DNA, 20 bp, human
gtgtacggcacattcccatg

SEQ ID NO: 275676 - DNA, 20 bp, human
gagtgtggggccatagagag

SEQ ID NO: 275677 - DNA, 20 bp, human
gagacttgggcccagccggg

SEQ ID NO: 275678 - DNA, 20 bp, human
gtgcctgcagagactgacca

SEQ ID NO: 275679 - DNA, 20 bp, human
gtaagagcatcaggccccac

SEQ ID NO: 275680 - DNA, 20 bp, human
gaaatgaaatcagctggcag

SEQ ID NO: 275681 - DNA, 20 bp, human
gctgtgaggattaagggttg

SEQ ID NO: 275682 - DNA, 20 bp, human
gcctctctcagggcttgtgg

SEQ ID NO: 275683 - DNA, 20 bp, human
gtgggggggcctgacaggga

SEQ ID NO: 275684 - DNA, 20 bp, human
gttccctggtcagtctctgc

SEQ ID NO: 275685 - DNA, 20 bp, human
gtggtcccggcccccatcca

SEQ ID NO: 275686 - DNA, 20 bp, human
gggcccggcggggacgtgcc

SEQ ID NO: 275687 - DNA, 20 bp, human
ggtccccggcacgtccccgc

SEQ ID NO: 275688 - DNA, 20 bp, human
gagcccgggcggggggcgaa

SEQ ID NO: 275689 - DNA, 20 bp, human
gctcccagcagccaactccg

SEQ ID NO: 275690 - DNA, 20 bp, human
gtggccggcggctctggtct

SEQ ID NO: 275691 - DNA, 20 bp, human
ggcgccgcggagttggctgc

SEQ ID NO: 275692 - DNA, 20 bp, human
gtccagccacgtccccgccc

SEQ ID NO: 275693 - DNA, 20 bp, human
gtccgcggcgcgccggagcc

SEQ ID NO: 275694 - DNA, 20 bp, human
gaactggcgcctgtcagcgc

SEQ ID NO: 275695 - DNA, 20 bp, human
gagccaactccgcggcgcgc

SEQ ID NO: 275696 - DNA, 20 bp, human
gcgcccaggtgcggggtctt

SEQ ID NO: 275697 - DNA, 20 bp, human
ggctgctggcgtcatcgcgg

SEQ ID NO: 275698 - DNA, 20 bp, human
ggaagcggggagtcccgagt

SEQ ID NO: 275699 - DNA, 20 bp, human
gagcctctctcctccgggag

SEQ ID NO: 275700 - DNA, 20 bp, human
ggggctcaggcgcagcagcc

SEQ ID NO: 275701 - DNA, 20 bp, human
ggtgcggggtcttggggctc

SEQ ID NO: 275702 - DNA, 20 bp, human
gctgacgcggacatcgcacc

SEQ ID NO: 275703 - DNA, 20 bp, human
gccgctccagcagccgtccc

SEQ ID NO: 275704 - DNA, 20 bp, human
ggcccgaggacgcacacaga

SEQ ID NO: 275705 - DNA, 20 bp, human
ggatctgcacgagaggcttg

SEQ ID NO: 275706 - DNA, 20 bp, human
gcaatcacgcgagctctctc

SEQ ID NO: 275707 - DNA, 20 bp, human
gaataccgccgggaaggtgg

SEQ ID NO: 275708 - DNA, 20 bp, human
ggccatggaagatggtccgc

SEQ ID NO: 275709 - DNA, 20 bp, human
gcctcaaaataccgccggga

SEQ ID NO: 275710 - DNA, 20 bp, human
gtcggggcgggagcacaagc

SEQ ID NO: 275711 - DNA, 20 bp, human
ggaggaggacgcttcggggc

SEQ ID NO: 275712 - DNA, 20 bp, human
gtgcgcctcaaaataccgcc

SEQ ID NO: 275713 - DNA, 20 bp, human
ggctctctcgggtggcgtca

SEQ ID NO: 275714 - DNA, 20 bp, human
gtggctgggcgagcgaggag

SEQ ID NO: 275715 - DNA, 20 bp, human
ggccgggaaggtgggggacg

SEQ ID NO: 275716 - DNA, 20 bp, human
gagggcgtgggacgcgagga

SEQ ID NO: 275717 - DNA, 20 bp, human
gggatgagcaggaatcgcga

SEQ ID NO: 275718 - DNA, 20 bp, human
ggcagctgggcctggaaccg

SEQ ID NO: 275719 - DNA, 20 bp, human
ggtgggacgcgaggatggag

SEQ ID NO: 275720 - DNA, 20 bp, human
gcgccccagcccacccggcg

SEQ ID NO: 275721 - DNA, 20 bp, human
ggcaggaatcgcgagggcgt

SEQ ID NO: 275722 - DNA, 20 bp, human
gaagcggctccgcgccgggt

SEQ ID NO: 275723 - DNA, 20 bp, human
gctggcaagcggctccgcgc

SEQ ID NO: 275724 - DNA, 20 bp, human
gacccctgagaaatgagaac

SEQ ID NO: 275725 - DNA, 20 bp, human
gctggggtccccgctgtctc

SEQ ID NO: 275726 - DNA, 20 bp, human
gctgcccgggtgctagatga

SEQ ID NO: 275727 - DNA, 20 bp, human
gccgtggccagcatccctgc

SEQ ID NO: 275728 - DNA, 20 bp, human
gctgctgggcgattgagcag

SEQ ID NO: 275729 - DNA, 20 bp, human
gagggatgctggccacggac

SEQ ID NO: 275730 - DNA, 20 bp, human
gcagcgtgccccagcttcct

SEQ ID NO: 275731 - DNA, 20 bp, human
gctgccacgcccgcggggga

SEQ ID NO: 275732 - DNA, 20 bp, human
gggacctgccacgcccgcgg

SEQ ID NO: 275733 - DNA, 20 bp, human
gaatgcggacgcttaagaaa

SEQ ID NO: 275734 - DNA, 20 bp, human
gtcaggacctgccacgcccg

SEQ ID NO: 275735 - DNA, 20 bp, human
ggcgtggcaggtcctgagtc

SEQ ID NO: 275736 - DNA, 20 bp, human
gctcctgcggggccacaacg

SEQ ID NO: 275737 - DNA, 20 bp, human
gacagcacagccagggcgtc

SEQ ID NO: 275738 - DNA, 20 bp, human
gtggaagctcggtggacgtc

SEQ ID NO: 275739 - DNA, 20 bp, human
gggggcgggtcgtagagtgg

SEQ ID NO: 275740 - DNA, 20 bp, human
gcaccccagcgaggcggagc

SEQ ID NO: 275741 - DNA, 20 bp, human
gacagccagggcgtccgggc

SEQ ID NO: 275742 - DNA, 20 bp, human
gctggcctgtggaagctcgg

SEQ ID NO: 275743 - DNA, 20 bp, human
gtgtggccccgcaggaggag

SEQ ID NO: 275744 - DNA, 20 bp, human
ggctgtgctgtcccgggccg

SEQ ID NO: 275745 - DNA, 20 bp, human
ggcccgcgttgtggccccgc

SEQ ID NO: 275746 - DNA, 20 bp, human
gttccctgaggggccagctt

SEQ ID NO: 275747 - DNA, 20 bp, human
gtgcagccaggggccagtgt

SEQ ID NO: 275748 - DNA, 20 bp, human
gcatccgctgggtgagccca

SEQ ID NO: 275749 - DNA, 20 bp, human
ggggaacccaccccctcaag

SEQ ID NO: 275750 - DNA, 20 bp, human
gggcccaagctggcccctca

SEQ ID NO: 275751 - DNA, 20 bp, human
gacccaccccctcaagtgga

SEQ ID NO: 275752 - DNA, 20 bp, human
gtggctgcatgtccatccgc

SEQ ID NO: 275753 - DNA, 20 bp, human
gggtctgggaacaggggatc

SEQ ID NO: 275754 - DNA, 20 bp, human
gggaaggagacctctccacc

SEQ ID NO: 275755 - DNA, 20 bp, human
gctcccctgggctcacccag

SEQ ID NO: 275756 - DNA, 20 bp, human
gctgggtggggactagtccc

SEQ ID NO: 275757 - DNA, 20 bp, human
gctgtcgtggaggtgaccgt

SEQ ID NO: 275758 - DNA, 20 bp, human
ggggaccacagtaaatcagg

SEQ ID NO: 275759 - DNA, 20 bp, human
ggggccgactgagcagtgtg

SEQ ID NO: 275760 - DNA, 20 bp, human
gggtggttttgtctgctcct

SEQ ID NO: 275761 - DNA, 20 bp, human
gccctttgttcaagtccctc

SEQ ID NO: 275762 - DNA, 20 bp, human
gtgtgtggaagctgtcgtgg

SEQ ID NO: 275763 - DNA, 20 bp, human
ggaggctggtgtgggatctc

SEQ ID NO: 275764 - DNA, 20 bp, human
gaggttcaggctaaaaaagc

SEQ ID NO: 275765 - DNA, 20 bp, human
ggaacagtggaggctggtgt

SEQ ID NO: 275766 - DNA, 20 bp, human
gagtcaggatgcctgcaatg

SEQ ID NO: 275767 - DNA, 20 bp, human
gagtgaactagcgacagtgg

SEQ ID NO: 275768 - DNA, 20 bp, human
gaggatgcctgcaatggggg

SEQ ID NO: 275769 - DNA, 20 bp, human
ggccgactccccctctcaaa

SEQ ID NO: 275770 - DNA, 20 bp, human
gcgacagtgggggtgtgcgc

SEQ ID NO: 275771 - DNA, 20 bp, human
gggcagtgaactagcgacag

SEQ ID NO: 275772 - DNA, 20 bp, human
gcgcagggatgcaggcagct

SEQ ID NO: 275773 - DNA, 20 bp, human
gccactgcaggggccgtcat

SEQ ID NO: 275774 - DNA, 20 bp, human
gaggaggggaacaaaatatt

SEQ ID NO: 275775 - DNA, 20 bp, human
gcctgcagtggagtctgtac

SEQ ID NO: 275776 - DNA, 20 bp, human
gcagaagcccccagcgtcca

SEQ ID NO: 275777 - DNA, 20 bp, human
gtggccgggggaccactgga

SEQ ID NO: 275778 - DNA, 20 bp, human
gccgccgcggggtctcgccc

SEQ ID NO: 275779 - DNA, 20 bp, human
gtctgggcccccacggcaca

SEQ ID NO: 275780 - DNA, 20 bp, human
gccccagcgtccagggccgg

SEQ ID NO: 275781 - DNA, 20 bp, human
gctgcagggcccgaccacgc

SEQ ID NO: 275782 - DNA, 20 bp, human
ggggcgcggccagcgtggaa

SEQ ID NO: 275783 - DNA, 20 bp, human
ggcgagggtcgcagagtcgc

SEQ ID NO: 275784 - DNA, 20 bp, human
ggacgctgggggcttctgct

SEQ ID NO: 275785 - DNA, 20 bp, human
gtcggccccctgtgccgtgg

SEQ ID NO: 275786 - DNA, 20 bp, human
gaaggggcggagcagtcggt

SEQ ID NO: 275787 - DNA, 20 bp, human
gcgagcgcgagcctggagga

SEQ ID NO: 275788 - DNA, 20 bp, human
gccccagccccgctgacccg

SEQ ID NO: 275789 - DNA, 20 bp, human
gggaagtgaggggagatact

SEQ ID NO: 275790 - DNA, 20 bp, human
gagacacgcctgtacggggc

SEQ ID NO: 275791 - DNA, 20 bp, human
gcgcgcatgcgcaccgaggg

SEQ ID NO: 275792 - DNA, 20 bp, human
gtctccgcctcgggtcagcg

SEQ ID NO: 275793 - DNA, 20 bp, human
gcagccccgctgacccgagg

SEQ ID NO: 275794 - DNA, 20 bp, human
gagcaggggcgctgattcgc

SEQ ID NO: 275795 - DNA, 20 bp, human
gctaatcggcccctctggag

SEQ ID NO: 275796 - DNA, 20 bp, human
ggggcgaagagcggctttcc

SEQ ID NO: 275797 - DNA, 20 bp, human
gagcggggtaggctgcgccc

SEQ ID NO: 275798 - DNA, 20 bp, human
ggggcggggccgacactcgg

SEQ ID NO: 275799 - DNA, 20 bp, human
gcaatcgcgagccccggctg

SEQ ID NO: 275800 - DNA, 20 bp, human
gtggccttgccgggacgcca

SEQ ID NO: 275801 - DNA, 20 bp, human
gtcggccccgcccccgcaga

SEQ ID NO: 275802 - DNA, 20 bp, human
gagggtgacttcgtgacgtc

SEQ ID NO: 275803 - DNA, 20 bp, human
ggaaccagctcacctagcgc

SEQ ID NO: 275804 - DNA, 20 bp, human
gtgcggagggtcccacgaga

SEQ ID NO: 275805 - DNA, 20 bp, human
gggggcgggccctggcgtcc

SEQ ID NO: 275806 - DNA, 20 bp, human
gcaggtgtcctcacccccgg

SEQ ID NO: 275807 - DNA, 20 bp, human
gcccccaggccaattagcag

SEQ ID NO: 275808 - DNA, 20 bp, human
gccctggagccactgctaat

SEQ ID NO: 275809 - DNA, 20 bp, human
gcacagagggggcctcatta

SEQ ID NO: 275810 - DNA, 20 bp, human
gggaggggcgcacagatggg

SEQ ID NO: 275811 - DNA, 20 bp, human
gaactcgggcacctgaggag

SEQ ID NO: 275812 - DNA, 20 bp, human
ggaaggaggggcgcacagat

SEQ ID NO: 275813 - DNA, 20 bp, human
gtgctgccaaggccctaatg

SEQ ID NO: 275814 - DNA, 20 bp, human
gaggtgaccagggctagggt

SEQ ID NO: 275815 - DNA, 20 bp, human
gaggcctatcggatggacag

SEQ ID NO: 275816 - DNA, 20 bp, human
ggacataaaacataggtgga

SEQ ID NO: 275817 - DNA, 20 bp, human
gtcagcaggtttgttgggag

SEQ ID NO: 275818 - DNA, 20 bp, human
gaacctgctgaacaggtgtt

SEQ ID NO: 275819 - DNA, 20 bp, human
gaaacataggtggagggttt

SEQ ID NO: 275820 - DNA, 20 bp, human
gtggaattgaaagtaaggat

SEQ ID NO: 275821 - DNA, 20 bp, human
gtaaagcgcctccttgcccc

SEQ ID NO: 275822 - DNA, 20 bp, human
gacctgttcagcaggtttgt

SEQ ID NO: 275823 - DNA, 20 bp, human
gaaatgacataaaacatagg

SEQ ID NO: 275824 - DNA, 20 bp, human
gttacactatacaaaagacc

SEQ ID NO: 275825 - DNA, 20 bp, human
gcccaacaaacctgctgaac

SEQ ID NO: 275826 - DNA, 20 bp, human
gaaaacgagcgggctccctg

SEQ ID NO: 275827 - DNA, 20 bp, human
gaggcagagcaaccaatcaa

SEQ ID NO: 275828 - DNA, 20 bp, human
gaggacaactatgtgcaggt

SEQ ID NO: 275829 - DNA, 20 bp, human
gctcagggtcccccctccgg

SEQ ID NO: 275830 - DNA, 20 bp, human
ggggtgagactcaaaacgag

SEQ ID NO: 275831 - DNA, 20 bp, human
ggggtcagggttaagtattg

SEQ ID NO: 275832 - DNA, 20 bp, human
ggggctcagggtcccccctc

SEQ ID NO: 275833 - DNA, 20 bp, human
gactggccgggaggctctga

SEQ ID NO: 275834 - DNA, 20 bp, human
gtgacaccccagcccccgga

SEQ ID NO: 275835 - DNA, 20 bp, human
ggagatccccactggccggg

SEQ ID NO: 275836 - DNA, 20 bp, human
gtctctgctctgctgtagtg

SEQ ID NO: 275837 - DNA, 20 bp, human
ggaaggctcaagcgggtgat

SEQ ID NO: 275838 - DNA, 20 bp, human
gaggcaaggtggtgaaaagg

SEQ ID NO: 275839 - DNA, 20 bp, human
gaggcgaagcggggtaagtg

SEQ ID NO: 275840 - DNA, 20 bp, human
gagggcttgaaggctcaagc

SEQ ID NO: 275841 - DNA, 20 bp, human
gtcagagcatgctcagaggt

SEQ ID NO: 275842 - DNA, 20 bp, human
gaaagtgtgaggctaacgca

SEQ ID NO: 275843 - DNA, 20 bp, human
gtggagaaatagaagcgctg

SEQ ID NO: 275844 - DNA, 20 bp, human
gtgcgggctctaagctagtg

SEQ ID NO: 275845 - DNA, 20 bp, human
gaggctaacgcaaggcaagg

SEQ ID NO: 275846 - DNA, 20 bp, human
gagagccagtggcaccgaga

SEQ ID NO: 275847 - DNA, 20 bp, human
ggaccaggctaactccgtca

SEQ ID NO: 275848 - DNA, 20 bp, human
gcgagaggatgatgcggggt

SEQ ID NO: 275849 - DNA, 20 bp, human
ggggcggggcctactaccta

SEQ ID NO: 275850 - DNA, 20 bp, human
gctctcgcctcgctcctgga

SEQ ID NO: 275851 - DNA, 20 bp, human
gcgggacaaggacttttggg

SEQ ID NO: 275852 - DNA, 20 bp, human
gaggcgcgcgtgggaggacc

SEQ ID NO: 275853 - DNA, 20 bp, human
gatgatgcggggtgggctac

SEQ ID NO: 275854 - DNA, 20 bp, human
ggtgagtggtaggttctccc

SEQ ID NO: 275855 - DNA, 20 bp, human
gcgaggaaggaggcgcgcgt

SEQ ID NO: 275856 - DNA, 20 bp, human
gttcacaggaagtcgctctg

SEQ ID NO: 275857 - DNA, 20 bp, human
gaggccgagagggacgcgag

SEQ ID NO: 275858 - DNA, 20 bp, human
ggcgcgcgccgtcaccctcc

SEQ ID NO: 275859 - DNA, 20 bp, human
gcgggctggggctccacgca

SEQ ID NO: 275860 - DNA, 20 bp, human
gacgcctaggcggctggagc

SEQ ID NO: 275861 - DNA, 20 bp, human
ggggcagcttggcggttgct

SEQ ID NO: 275862 - DNA, 20 bp, human
gagcgggggcggagccagga

SEQ ID NO: 275863 - DNA, 20 bp, human
gtccacgcagggcgacgcct

SEQ ID NO: 275864 - DNA, 20 bp, human
gtggacccaactgggagctc

SEQ ID NO: 275865 - DNA, 20 bp, human
gacgcagggcgacgcctagg

SEQ ID NO: 275866 - DNA, 20 bp, human
ggcggcaccgggaggggtaa

SEQ ID NO: 275867 - DNA, 20 bp, human
gggtgccgaagcgacggcag

SEQ ID NO: 275868 - DNA, 20 bp, human
ggtaagggaggtgagggcgg

SEQ ID NO: 275869 - DNA, 20 bp, human
ggcggcgggtgccgaagcga

SEQ ID NO: 275870 - DNA, 20 bp, human
gacaaaggcgcactacgggt

SEQ ID NO: 275871 - DNA, 20 bp, human
ggaagctgccccgcgacgag

SEQ ID NO: 275872 - DNA, 20 bp, human
gggagcaatagcagcagccg

SEQ ID NO: 275873 - DNA, 20 bp, human
gcgcgggactggttttgcgg

SEQ ID NO: 275874 - DNA, 20 bp, human
gcggagcagggatcgcttgg

SEQ ID NO: 275875 - DNA, 20 bp, human
ggcggccgctgccgtcgctt

SEQ ID NO: 275876 - DNA, 20 bp, human
gccagcgtggtcgcgaagaa

SEQ ID NO: 275877 - DNA, 20 bp, human
gcaccgtgcggtctccgcgg

SEQ ID NO: 275878 - DNA, 20 bp, human
ggtcgcgaagaagggacggg

SEQ ID NO: 275879 - DNA, 20 bp, human
gcggcctgggatccggaagt

SEQ ID NO: 275880 - DNA, 20 bp, human
gcgtggtcgcgaagaaggga

SEQ ID NO: 275881 - DNA, 20 bp, human
gcccgactccgcccaccgtg

SEQ ID NO: 275882 - DNA, 20 bp, human
ggcgccgccggcctgggatc

SEQ ID NO: 275883 - DNA, 20 bp, human
gggaggacggggaaatgacc

SEQ ID NO: 275884 - DNA, 20 bp, human
ggcagctaggctccgacttc

SEQ ID NO: 275885 - DNA, 20 bp, human
gcccgtagttaaggaaatag

SEQ ID NO: 275886 - DNA, 20 bp, human
gccctccatcggcacatccc

SEQ ID NO: 275887 - DNA, 20 bp, human
ggggagatgacatacaaaaa

SEQ ID NO: 275888 - DNA, 20 bp, human
gggaacgtacttgtactaag

SEQ ID NO: 275889 - DNA, 20 bp, human
gcccacacaactagaatgtg

SEQ ID NO: 275890 - DNA, 20 bp, human
gtgtgtgaagaagcagctca

SEQ ID NO: 275891 - DNA, 20 bp, human
gagcagctgccaggatgcct

SEQ ID NO: 275892 - DNA, 20 bp, human
ggatgcctgggatgtgccga

SEQ ID NO: 275893 - DNA, 20 bp, human
gtgtggtaaacccagtgaca

SEQ ID NO: 275894 - DNA, 20 bp, human
gtcaagccgaagtaccacag

SEQ ID NO: 275895 - DNA, 20 bp, human
ggcctgggatgtgccgatgg

SEQ ID NO: 275896 - DNA, 20 bp, human
gcctctgtgcaatcccacgg

SEQ ID NO: 275897 - DNA, 20 bp, human
gccggtgcagggaagacagg

SEQ ID NO: 275898 - DNA, 20 bp, human
gcgggctccgcccctggatt

SEQ ID NO: 275899 - DNA, 20 bp, human
gcccgggttaagtgggcaga

SEQ ID NO: 275900 - DNA, 20 bp, human
gtcagctctgcggatctcag

SEQ ID NO: 275901 - DNA, 20 bp, human
gtgcaatcccacggcgggag

SEQ ID NO: 275902 - DNA, 20 bp, human
ggagggtcctctcccgccgt

SEQ ID NO: 275903 - DNA, 20 bp, human
gaacccgggtctcgaggaga

SEQ ID NO: 275904 - DNA, 20 bp, human
gagcgccaggcgggcaggac

SEQ ID NO: 275905 - DNA, 20 bp, human
ggctccgcccctggattcgg

SEQ ID NO: 275906 - DNA, 20 bp, human
ggtgcagcgcggcagaatga

SEQ ID NO: 275907 - DNA, 20 bp, human
gccctgcgcggcttccgtcc

SEQ ID NO: 275908 - DNA, 20 bp, human
ggcagagcgtcaagaagtgt

SEQ ID NO: 275909 - DNA, 20 bp, human
ggctgaccccacaatgtcgc

SEQ ID NO: 275910 - DNA, 20 bp, human
ggaagtgtcggagaactggg

SEQ ID NO: 275911 - DNA, 20 bp, human
ggacggccctacttcgccta

SEQ ID NO: 275912 - DNA, 20 bp, human
gactgcgcgcatgcgctgca

SEQ ID NO: 275913 - DNA, 20 bp, human
gagtcgcggaacccggaagc

SEQ ID NO: 275914 - DNA, 20 bp, human
gtcaagaagtgtcggagaac

SEQ ID NO: 275915 - DNA, 20 bp, human
gcagccgctacacaggatcc

SEQ ID NO: 275916 - DNA, 20 bp, human
gcggggccagggaccgaggt

SEQ ID NO: 275917 - DNA, 20 bp, human
gtggccggaactcctccacc

SEQ ID NO: 275918 - DNA, 20 bp, human
gggaccgaggtgggactgag

SEQ ID NO: 275919 - DNA, 20 bp, human
gccacctgggagagtcggtc

SEQ ID NO: 275920 - DNA, 20 bp, human
gctcccaggtggaggagttc

SEQ ID NO: 275921 - DNA, 20 bp, human
gcaagaggagggagacttga

SEQ ID NO: 275922 - DNA, 20 bp, human
gggaggcggggattcgagtc

SEQ ID NO: 275923 - DNA, 20 bp, human
gaatacaaccccctggacct

SEQ ID NO: 275924 - DNA, 20 bp, human
ggagtcggtccgggtagctg

SEQ ID NO: 275925 - DNA, 20 bp, human
gccaagctgagtcagcccgg

SEQ ID NO: 275926 - DNA, 20 bp, human
ggctgggcgctcttcttgcc

SEQ ID NO: 275927 - DNA, 20 bp, human
ggaggagttcggtccgagtg

SEQ ID NO: 275928 - DNA, 20 bp, human
gactcctcgcgtctcacctc

SEQ ID NO: 275929 - DNA, 20 bp, human
gctcacctcaggcgtcctaa

SEQ ID NO: 275930 - DNA, 20 bp, human
gcgcccagccgcaccgcact

SEQ ID NO: 275931 - DNA, 20 bp, human
gccctctttgaaagatgggg

SEQ ID NO: 275932 - DNA, 20 bp, human
gacctcaggcgtcctaaagg

SEQ ID NO: 275933 - DNA, 20 bp, human
gacgcctgaggtgagacgcg

SEQ ID NO: 275934 - DNA, 20 bp, human
ggttcggtccgagtgcggtg

SEQ ID NO: 275935 - DNA, 20 bp, human
gagcgcgaatcccacggacc

SEQ ID NO: 275936 - DNA, 20 bp, human
ggtccggcggccaccgcccc

SEQ ID NO: 275937 - DNA, 20 bp, human
ggaggccagctttggtccgg

SEQ ID NO: 275938 - DNA, 20 bp, human
gacgcggtgggaaaggcctt

SEQ ID NO: 275939 - DNA, 20 bp, human
gtgcgcgcggccctgcgtga

SEQ ID NO: 275940 - DNA, 20 bp, human
ggcgccgcgactcgagcctc

SEQ ID NO: 275941 - DNA, 20 bp, human
ggtggccgccggaccaaagc

SEQ ID NO: 275942 - DNA, 20 bp, human
gcgtaagtggtgaccagtgt

SEQ ID NO: 275943 - DNA, 20 bp, human
ggggaaccgcggcccagacg

SEQ ID NO: 275944 - DNA, 20 bp, human
ggggccgcggttcccaactg

SEQ ID NO: 275945 - DNA, 20 bp, human
gtcccaccgcgtcattgtct

SEQ ID NO: 275946 - DNA, 20 bp, human
gtgcgcaagcgcaggtgggg

SEQ ID NO: 275947 - DNA, 20 bp, human
gtggaggacggaggggcata

SEQ ID NO: 275948 - DNA, 20 bp, human
gcgccacctggaggacggag

SEQ ID NO: 275949 - DNA, 20 bp, human
gctctcgcccggccagaccc

SEQ ID NO: 275950 - DNA, 20 bp, human
ggggatccacttacccggtt

SEQ ID NO: 275951 - DNA, 20 bp, human
gcggggtctccagcgccacc

SEQ ID NO: 275952 - DNA, 20 bp, human
gtccacttacccggttgggc

SEQ ID NO: 275953 - DNA, 20 bp, human
ggagctgggatccacttacc

SEQ ID NO: 275954 - DNA, 20 bp, human
gagccgggagcccacgccct

SEQ ID NO: 275955 - DNA, 20 bp, human
gcgcggcggaggcggacctg

SEQ ID NO: 275956 - DNA, 20 bp, human
gcaccccaggtccgcgccat

SEQ ID NO: 275957 - DNA, 20 bp, human
ggcgcggtcacgtgaagtga

SEQ ID NO: 275958 - DNA, 20 bp, human
gcggcccatggcgcggacct

SEQ ID NO: 275959 - DNA, 20 bp, human
ggtcacgtgaccacggggac

SEQ ID NO: 275960 - DNA, 20 bp, human
gagccgcacagcccattggg

SEQ ID NO: 275961 - DNA, 20 bp, human
gccgcgctgcagggtgagcg

SEQ ID NO: 275962 - DNA, 20 bp, human
gagggtgagcgaggcgtgat

SEQ ID NO: 275963 - DNA, 20 bp, human
gcggctgccagcgcttgcgc

SEQ ID NO: 275964 - DNA, 20 bp, human
gtgacggtcacgtgaccacg

SEQ ID NO: 275965 - DNA, 20 bp, human
gagagcgggtcagggtttga

SEQ ID NO: 275966 - DNA, 20 bp, human
gctcacataaagccctttaa

SEQ ID NO: 275967 - DNA, 20 bp, human
gaggaagggtgtagactaga

SEQ ID NO: 275968 - DNA, 20 bp, human
gaatctaacagatataccag

SEQ ID NO: 275969 - DNA, 20 bp, human
ggctagattggattcccttg

SEQ ID NO: 275970 - DNA, 20 bp, human
gcagacctatcaagagttca

SEQ ID NO: 275971 - DNA, 20 bp, human
ggctataaaagttttagctg

SEQ ID NO: 275972 - DNA, 20 bp, human
gatgtaattggaacaccccc

SEQ ID NO: 275973 - DNA, 20 bp, human
gtctgggagcttctggctct

SEQ ID NO: 275974 - DNA, 20 bp, human
ggattaaaatccagctagat

SEQ ID NO: 275975 - DNA, 20 bp, human
ggacattgagtcaggatgtc

SEQ ID NO: 275976 - DNA, 20 bp, human
ggggagggagcatgtgtcgg

SEQ ID NO: 275977 - DNA, 20 bp, human
ggtggggagggagcatgtgt

SEQ ID NO: 275978 - DNA, 20 bp, human
gaagatgcagcctgggaagt

SEQ ID NO: 275979 - DNA, 20 bp, human
gactccagtgacgtcttcag

SEQ ID NO: 275980 - DNA, 20 bp, human
ggctgcctggtgaatgttca

SEQ ID NO: 275981 - DNA, 20 bp, human
ggaaggtgagaccaggacat

SEQ ID NO: 275982 - DNA, 20 bp, human
gcctgggcctgaaggctcct

SEQ ID NO: 275983 - DNA, 20 bp, human
gctgttcagaggtacagggg

SEQ ID NO: 275984 - DNA, 20 bp, human
gcagcctaaagcaagagtcc

SEQ ID NO: 275985 - DNA, 20 bp, human
gatgctctgggaagcgggtt

SEQ ID NO: 275986 - DNA, 20 bp, human
ggaggtgctacagttacatg

SEQ ID NO: 275987 - DNA, 20 bp, human
gtgactatccttcttcactt

SEQ ID NO: 275988 - DNA, 20 bp, human
gagcacctcagcagatggtc

SEQ ID NO: 275989 - DNA, 20 bp, human
ggcaggccaaatgcattctg

SEQ ID NO: 275990 - DNA, 20 bp, human
gctttagatggaaacgtcac

SEQ ID NO: 275991 - DNA, 20 bp, human
gactgtagcacctcagcaga

SEQ ID NO: 275992 - DNA, 20 bp, human
gcactcttcctaagtgaaga

SEQ ID NO: 275993 - DNA, 20 bp, human
gtacttaatgtgaaagatca

SEQ ID NO: 275994 - DNA, 20 bp, human
gtatttctgccttctttaga

SEQ ID NO: 275995 - DNA, 20 bp, human
gtttcacattaagtatctca

SEQ ID NO: 275996 - DNA, 20 bp, human
gtcaggcagtggcggaaaag

SEQ ID NO: 275997 - DNA, 20 bp, human
gcggactggcgcagcctgga

SEQ ID NO: 275998 - DNA, 20 bp, human
gggcagtggcggaaaagggg

SEQ ID NO: 275999 - DNA, 20 bp, human
ggggcggagaaccgggaaaa

SEQ ID NO: 276000 - DNA, 20 bp, human
ggtcacgtgacggccggcgt

SEQ ID NO: 276001 - DNA, 20 bp, human
gcaacccgagcctgcgcgag

SEQ ID NO: 276002 - DNA, 20 bp, human
gggcgcgatcacgtgagcca

SEQ ID NO: 276003 - DNA, 20 bp, human
gctgcgcgagaggtacgtac

SEQ ID NO: 276004 - DNA, 20 bp, human
gtgcgcggtcacgtgacggc

SEQ ID NO: 276005 - DNA, 20 bp, human
gtcgacttggggattaaata

SEQ ID NO: 276006 - DNA, 20 bp, human
gcgcccgtgcgcggccttgg

SEQ ID NO: 276007 - DNA, 20 bp, human
gcgcgccggaagtgactgcg

SEQ ID NO: 276008 - DNA, 20 bp, human
gccggaagtgactgcgcggt

SEQ ID NO: 276009 - DNA, 20 bp, human
gcggaacggctggagttctc

SEQ ID NO: 276010 - DNA, 20 bp, human
gctcgctgacgtggcgaact

SEQ ID NO: 276011 - DNA, 20 bp, human
gcggcccagtcgccgctcag

SEQ ID NO: 276012 - DNA, 20 bp, human
gcgtgcagagcgtggtaagt

SEQ ID NO: 276013 - DNA, 20 bp, human
ggacgtggcgaactgggctg

SEQ ID NO: 276014 - DNA, 20 bp, human
ggctgggagacgtgcggttc

SEQ ID NO: 276015 - DNA, 20 bp, human
gcccagtcgccgctcagagg

SEQ ID NO: 276016 - DNA, 20 bp, human
gatactggagcgcagaatgg

SEQ ID NO: 276017 - DNA, 20 bp, human
gagaaatatgaagcggaagg

SEQ ID NO: 276018 - DNA, 20 bp, human
gcccgcccctctcccgaggt

SEQ ID NO: 276019 - DNA, 20 bp, human
gctgcgctccagtatcgccc

SEQ ID NO: 276020 - DNA, 20 bp, human
gggcgtaaccagggcgatac

SEQ ID NO: 276021 - DNA, 20 bp, human
gcgggccaggaactctgacc

SEQ ID NO: 276022 - DNA, 20 bp, human
gctcaaagatcaaagcccat

SEQ ID NO: 276023 - DNA, 20 bp, human
gagtcggagagcgacctctc

SEQ ID NO: 276024 - DNA, 20 bp, human
ggcgatcccggcaaccactg

SEQ ID NO: 276025 - DNA, 20 bp, human
gtctgacccggagtgtgaac

SEQ ID NO: 276026 - DNA, 20 bp, human
gagctcgatccggaccctgt

SEQ ID NO: 276027 - DNA, 20 bp, human
gtcttcaagtggccacccta

SEQ ID NO: 276028 - DNA, 20 bp, human
ggcgcggccgagctcggtgt

SEQ ID NO: 276029 - DNA, 20 bp, human
ggggtggccacttgaagaag

SEQ ID NO: 276030 - DNA, 20 bp, human
ggcggcctcatcacagtcgg

SEQ ID NO: 276031 - DNA, 20 bp, human
gagggtccccggccctaggg

SEQ ID NO: 276032 - DNA, 20 bp, human
gtggggcggggacccgacta

SEQ ID NO: 276033 - DNA, 20 bp, human
gaagtggcgtggccggggct

SEQ ID NO: 276034 - DNA, 20 bp, human
gctcacctccgactgtgatg

SEQ ID NO: 276035 - DNA, 20 bp, human
ggcgagcggtgcatcggcct

SEQ ID NO: 276036 - DNA, 20 bp, human
gcggctcagaaccggagcgt

SEQ ID NO: 276037 - DNA, 20 bp, human
gcgtgcggagaccgccgtcg

SEQ ID NO: 276038 - DNA, 20 bp, human
gcactggaggacgcaaggtt

SEQ ID NO: 276039 - DNA, 20 bp, human
gtggccctgcgaaatcagac

SEQ ID NO: 276040 - DNA, 20 bp, human
gaacacagggatgagcgtca

SEQ ID NO: 276041 - DNA, 20 bp, human
gcggccgagcgcgcatgtgc

SEQ ID NO: 276042 - DNA, 20 bp, human
gcgccgtcgcggctcagaac

SEQ ID NO: 276043 - DNA, 20 bp, human
gcagcgagttcggaagcgac

SEQ ID NO: 276044 - DNA, 20 bp, human
gctccggttctgagccgcga

SEQ ID NO: 276045 - DNA, 20 bp, human
gtaactacggagcaccggat

SEQ ID NO: 276046 - DNA, 20 bp, human
gctcgccgcgggcggaaaag

SEQ ID NO: 276047 - DNA, 20 bp, human
ggggccacgtgggtgaccaa

SEQ ID NO: 276048 - DNA, 20 bp, human
gcgtgcgggccgtccaccgg

SEQ ID NO: 276049 - DNA, 20 bp, human
gccacgtgggtgaccaaagg

SEQ ID NO: 276050 - DNA, 20 bp, human
gaagggcggggccttactgc

SEQ ID NO: 276051 - DNA, 20 bp, human
gcccgcggcgagaacaggcg

SEQ ID NO: 276052 - DNA, 20 bp, human
ggtaaggccccgccctttgt

SEQ ID NO: 276053 - DNA, 20 bp, human
ggctacggggtcctcgcgca

SEQ ID NO: 276054 - DNA, 20 bp, human
ggtggctcgccgccggtgga

SEQ ID NO: 276055 - DNA, 20 bp, human
ggcttccgggagacgtggaa

SEQ ID NO: 276056 - DNA, 20 bp, human
gtcaaactcaaaaaccagac

SEQ ID NO: 276057 - DNA, 20 bp, human
gcactgtgggtggttgacaa

SEQ ID NO: 276058 - DNA, 20 bp, human
gcaagtttgggaagcctgag

SEQ ID NO: 276059 - DNA, 20 bp, human
gtgaaagtgacttggaagac

SEQ ID NO: 276060 - DNA, 20 bp, human
gggaaggagctagagagtgt

SEQ ID NO: 276061 - DNA, 20 bp, human
gtccccatcagtaaagaggg

SEQ ID NO: 276062 - DNA, 20 bp, human
gctaccttagatggccctgc

SEQ ID NO: 276063 - DNA, 20 bp, human
gggagctgtgcaccgaaggg

SEQ ID NO: 276064 - DNA, 20 bp, human
gaaaccagacgggtaagatg

SEQ ID NO: 276065 - DNA, 20 bp, human
gatgactcctcacacccgga

SEQ ID NO: 276066 - DNA, 20 bp, human
gcccgcgcggggattgtttc

SEQ ID NO: 276067 - DNA, 20 bp, human
gagaggcggggcgagctgtg

SEQ ID NO: 276068 - DNA, 20 bp, human
gaagctgcgcgctgtggggc

SEQ ID NO: 276069 - DNA, 20 bp, human
gaagggaaatgatgtgggcg

SEQ ID NO: 276070 - DNA, 20 bp, human
gagggtgggtcccagacctg

SEQ ID NO: 276071 - DNA, 20 bp, human
gcgagcgcgcgggggtgtga

SEQ ID NO: 276072 - DNA, 20 bp, human
gtccccgcgcgggcggaagg

SEQ ID NO: 276073 - DNA, 20 bp, human
gcggcctcctacctcaggtc

SEQ ID NO: 276074 - DNA, 20 bp, human
gacccctcacaatcagtgat

SEQ ID NO: 276075 - DNA, 20 bp, human
gcgcggggattgtttccgga

SEQ ID NO: 276076 - DNA, 20 bp, human
gaagcgagcgcagagctccg

SEQ ID NO: 276077 - DNA, 20 bp, human
gagctctgcgctcgcttccg

SEQ ID NO: 276078 - DNA, 20 bp, human
gctccggggctctcacgagg

SEQ ID NO: 276079 - DNA, 20 bp, human
gctccccctcgtgagagccc

SEQ ID NO: 276080 - DNA, 20 bp, human
gcgggagcggtcagccttgc

SEQ ID NO: 276081 - DNA, 20 bp, human
gcgctcgcttccgtggcccc

SEQ ID NO: 276082 - DNA, 20 bp, human
gatccagcctgaaggacagt

SEQ ID NO: 276083 - DNA, 20 bp, human
gagtggggcaggaatttttc

SEQ ID NO: 276084 - DNA, 20 bp, human
gaggctgaagcgtcttgccc

SEQ ID NO: 276085 - DNA, 20 bp, human
gcccgggacatccagcctga

SEQ ID NO: 276086 - DNA, 20 bp, human
gggccaacgagaaagatgac

SEQ ID NO: 276087 - DNA, 20 bp, human
gcccgctctgggagagtgga

SEQ ID NO: 276088 - DNA, 20 bp, human
gcgagaaagatgacagggaa

SEQ ID NO: 276089 - DNA, 20 bp, human
gacccagaggcagcgtaacc

SEQ ID NO: 276090 - DNA, 20 bp, human
ggagggacctgtggctcatc

SEQ ID NO: 276091 - DNA, 20 bp, human
ggccctggttacgctgcctc

SEQ ID NO: 276092 - DNA, 20 bp, human
gcatctttctcgttggccaa

SEQ ID NO: 276093 - DNA, 20 bp, human
ggtggatttcccacttttat

SEQ ID NO: 276094 - DNA, 20 bp, human
gatacagatcctataaaagt

SEQ ID NO: 276095 - DNA, 20 bp, human
gtatgcaaggtctgtcattt

SEQ ID NO: 276096 - DNA, 20 bp, human
ggacaggcagaccggcagct

SEQ ID NO: 276097 - DNA, 20 bp, human
gacggtgtagcggtgggcaa

SEQ ID NO: 276098 - DNA, 20 bp, human
gaacgacacggtgtagcggt

SEQ ID NO: 276099 - DNA, 20 bp, human
ggcggtgggcaaaggaatca

SEQ ID NO: 276100 - DNA, 20 bp, human
gctacaacgacacggtgtag

SEQ ID NO: 276101 - DNA, 20 bp, human
gatgaacttgggtggagatg

SEQ ID NO: 276102 - DNA, 20 bp, human
gtcatgttagtgatgaactt

SEQ ID NO: 276103 - DNA, 20 bp, human
gggactgtcctacaacgaca

SEQ ID NO: 276104 - DNA, 20 bp, human
gccctggcagctcaggaccc

SEQ ID NO: 276105 - DNA, 20 bp, human
gtgtgtggtgtgtatgaggt

SEQ ID NO: 276106 - DNA, 20 bp, human
gaatacctactgatttggtt

SEQ ID NO: 276107 - DNA, 20 bp, human
gagagccaaaccaaatcagt

SEQ ID NO: 276108 - DNA, 20 bp, human
ggaaaacacacttacttcat

SEQ ID NO: 276109 - DNA, 20 bp, human
gaaaatactgaactaatttt

SEQ ID NO: 276110 - DNA, 20 bp, human
gacttcatagggttggcaaa

SEQ ID NO: 276111 - DNA, 20 bp, human
ggctaaaagtttcataaatt

SEQ ID NO: 276112 - DNA, 20 bp, human
gcacacttacttcatagggt

SEQ ID NO: 276113 - DNA, 20 bp, human
gaaattaatacctactgatt

SEQ ID NO: 276114 - DNA, 20 bp, human
gaaaacagatgcctttctta

SEQ ID NO: 276115 - DNA, 20 bp, human
gagttttctcacataaaatg

SEQ ID NO: 276116 - DNA, 20 bp, human
ggcgcacgcgcactgagctg

SEQ ID NO: 276117 - DNA, 20 bp, human
ggtccagccgggaggatcta

SEQ ID NO: 276118 - DNA, 20 bp, human
gggccccagtgatccaagag

SEQ ID NO: 276119 - DNA, 20 bp, human
gtagcccggaagctgaatag

SEQ ID NO: 276120 - DNA, 20 bp, human
gtccccgcgcgcggtgtcgc

SEQ ID NO: 276121 - DNA, 20 bp, human
gccggctggacccgggtcct

SEQ ID NO: 276122 - DNA, 20 bp, human
gacccgctcttggatcactg

SEQ ID NO: 276123 - DNA, 20 bp, human
gggcgggtgcacccaggacc

SEQ ID NO: 276124 - DNA, 20 bp, human
gcgggtgaggtaaagcggca

SEQ ID NO: 276125 - DNA, 20 bp, human
gaggtaaagcggcagggacc

SEQ ID NO: 276126 - DNA, 20 bp, human
ggaccctaaagagtgaatga

SEQ ID NO: 276127 - DNA, 20 bp, human
gtgccccggaacaagatctg

SEQ ID NO: 276128 - DNA, 20 bp, human
ggggacaggaagtgtcgagt

SEQ ID NO: 276129 - DNA, 20 bp, human
gggctgtttctttgaggaag

SEQ ID NO: 276130 - DNA, 20 bp, human
gccggaacaagatctgggga

SEQ ID NO: 276131 - DNA, 20 bp, human
gggtttccgtcattgttgat

SEQ ID NO: 276132 - DNA, 20 bp, human
gacaagatctggggagggac

SEQ ID NO: 276133 - DNA, 20 bp, human
gtcccctcattcactcttta

SEQ ID NO: 276134 - DNA, 20 bp, human
gggagtgattagacgcgagt

SEQ ID NO: 276135 - DNA, 20 bp, human
ggataggttggtaacaaaca

SEQ ID NO: 276136 - DNA, 20 bp, human
gcgcccacgtggagtcggag

SEQ ID NO: 276137 - DNA, 20 bp, human
gcggacgggcccaatgagca

SEQ ID NO: 276138 - DNA, 20 bp, human
gccagtgccggggccggcta

SEQ ID NO: 276139 - DNA, 20 bp, human
gaggcagtgccgggctcgat

SEQ ID NO: 276140 - DNA, 20 bp, human
gtgggaagaggcaggcggaa

SEQ ID NO: 276141 - DNA, 20 bp, human
gccgtgggtgacacgtaagt

SEQ ID NO: 276142 - DNA, 20 bp, human
gggagggaaggtgcggccct

SEQ ID NO: 276143 - DNA, 20 bp, human
gagggagcgtctgctcggac

SEQ ID NO: 276144 - DNA, 20 bp, human
gcccgtgcggcctgcccaat

SEQ ID NO: 276145 - DNA, 20 bp, human
gacgtggagtcggagagggt

SEQ ID NO: 276146 - DNA, 20 bp, human
gagcgcggagaagcgaggca

SEQ ID NO: 276147 - DNA, 20 bp, human
gacgcccagcggcgagaact

SEQ ID NO: 276148 - DNA, 20 bp, human
ggggaaggggcaacgcccag

SEQ ID NO: 276149 - DNA, 20 bp, human
gtccagcgccgccgcgtctc

SEQ ID NO: 276150 - DNA, 20 bp, human
ggccggggcgcgcgcaccgt

SEQ ID NO: 276151 - DNA, 20 bp, human
gcccgccgaggggcggccac

SEQ ID NO: 276152 - DNA, 20 bp, human
ggagcggggaagcggctgtg

SEQ ID NO: 276153 - DNA, 20 bp, human
ggccagctcccgcgtcggaa

SEQ ID NO: 276154 - DNA, 20 bp, human
gtgggtgcggttggctgttc

SEQ ID NO: 276155 - DNA, 20 bp, human
gtggggtggcccgggggaag

SEQ ID NO: 276156 - DNA, 20 bp, human
gcggccccggctgacgtcac

SEQ ID NO: 276157 - DNA, 20 bp, human
gactgcaggaccgcgggtca

SEQ ID NO: 276158 - DNA, 20 bp, human
gccagccctgggtagtgaag

SEQ ID NO: 276159 - DNA, 20 bp, human
gctgacgtcaccggaggatg

SEQ ID NO: 276160 - DNA, 20 bp, human
ggaaacggggaacggaagga

SEQ ID NO: 276161 - DNA, 20 bp, human
ggcggtgtctggggcgtgga

SEQ ID NO: 276162 - DNA, 20 bp, human
gccgaagacggcggtgtctg

SEQ ID NO: 276163 - DNA, 20 bp, human
gaggagggagggcacgtcac

SEQ ID NO: 276164 - DNA, 20 bp, human
ggggtagtgaaggggaaacg

SEQ ID NO: 276165 - DNA, 20 bp, human
gtggcggggccccccgtgaa

SEQ ID NO: 276166 - DNA, 20 bp, human
gcagctggtcaatccaatga

SEQ ID NO: 276167 - DNA, 20 bp, human
gaatcggagctcacaggggg

SEQ ID NO: 276168 - DNA, 20 bp, human
ggatcgcaacagaatagctg

SEQ ID NO: 276169 - DNA, 20 bp, human
ggcgctgagtgagctaacat

SEQ ID NO: 276170 - DNA, 20 bp, human
gaacaccaccaaaaggaggc

SEQ ID NO: 276171 - DNA, 20 bp, human
gccgccaatcggagctcaca

SEQ ID NO: 276172 - DNA, 20 bp, human
gtccaccaaggttccttcat

SEQ ID NO: 276173 - DNA, 20 bp, human
gttgcgttcaacctgacagc

SEQ ID NO: 276174 - DNA, 20 bp, human
gtccaatgaaggaaccttgg

SEQ ID NO: 276175 - DNA, 20 bp, human
gaggaaccttggtggaagag

SEQ ID NO: 276176 - DNA, 20 bp, human
gtgcgaggaaagggtcaggt

SEQ ID NO: 276177 - DNA, 20 bp, human
gaccgcgaggtgcgaggaaa

SEQ ID NO: 276178 - DNA, 20 bp, human
ggggcggggcattgccctac

SEQ ID NO: 276179 - DNA, 20 bp, human
gtgccctaccggaaaacggg

SEQ ID NO: 276180 - DNA, 20 bp, human
gcctcctcccgttttccggt

SEQ ID NO: 276181 - DNA, 20 bp, human
ggcgagtagaagcacctgcg

SEQ ID NO: 276182 - DNA, 20 bp, human
gcattgccctaccggaaaac

SEQ ID NO: 276183 - DNA, 20 bp, human
gtggaagcattggaatctag

SEQ ID NO: 276184 - DNA, 20 bp, human
gggcatctgcgcatcccttt

SEQ ID NO: 276185 - DNA, 20 bp, human
ggcacatgctaggcgctggg

SEQ ID NO: 276186 - DNA, 20 bp, human
gtgaacggaccgacccggaa

SEQ ID NO: 276187 - DNA, 20 bp, human
gcccttctctaattggtcaa

SEQ ID NO: 276188 - DNA, 20 bp, human
gtctaattggtcaaggggtg

SEQ ID NO: 276189 - DNA, 20 bp, human
ggaagggagttatctgtgat

SEQ ID NO: 276190 - DNA, 20 bp, human
gagcatccacccttccgggt

SEQ ID NO: 276191 - DNA, 20 bp, human
gacggaccgacccggaaggg

SEQ ID NO: 276192 - DNA, 20 bp, human
gctgagagcatccacccttc

SEQ ID NO: 276193 - DNA, 20 bp, human
gagatcggagagtcggacac

SEQ ID NO: 276194 - DNA, 20 bp, human
gagatccgagagtcggagat

SEQ ID NO: 276195 - DNA, 20 bp, human
gccccttgaccaattagaga

SEQ ID NO: 276196 - DNA, 20 bp, human
gttgagtaggataactccat

SEQ ID NO: 276197 - DNA, 20 bp, human
gaactgacgcactaacgttg

SEQ ID NO: 276198 - DNA, 20 bp, human
gtgggatggcgcatagtgtt

SEQ ID NO: 276199 - DNA, 20 bp, human
ggccgcgccgcagtgcatca

SEQ ID NO: 276200 - DNA, 20 bp, human
gcgtgcgcgtccccgagcct

SEQ ID NO: 276201 - DNA, 20 bp, human
gactctgccctaaaatggga

SEQ ID NO: 276202 - DNA, 20 bp, human
gacgttagtgcgtcagttat

SEQ ID NO: 276203 - DNA, 20 bp, human
ggcacgcaattcgctgttgt

SEQ ID NO: 276204 - DNA, 20 bp, human
gcttcactctgccctaaaat

SEQ ID NO: 276205 - DNA, 20 bp, human
gcatgctccttgatgcactg

SEQ ID NO: 276206 - DNA, 20 bp, human
ggatgcaggtgcagtcagac

SEQ ID NO: 276207 - DNA, 20 bp, human
gaggaccattcggaagaagg

SEQ ID NO: 276208 - DNA, 20 bp, human
ggcggagcctacctctcatc

SEQ ID NO: 276209 - DNA, 20 bp, human
gactggtcctgatgagaggt

SEQ ID NO: 276210 - DNA, 20 bp, human
gccgaggaccattcggaaga

SEQ ID NO: 276211 - DNA, 20 bp, human
ggcagctgacaactaggggc

SEQ ID NO: 276212 - DNA, 20 bp, human
gagactccgcctcttccgaa

SEQ ID NO: 276213 - DNA, 20 bp, human
gcagctcttaagatgctccg

SEQ ID NO: 276214 - DNA, 20 bp, human
ggctgacttccgtaatcttt

SEQ ID NO: 276215 - DNA, 20 bp, human
gtagagctctaggtcaggga

SEQ ID NO: 276216 - DNA, 20 bp, human
gcagccacgagggacaaaat

SEQ ID NO: 276217 - DNA, 20 bp, human
gaaaggcctcagcttgggag

SEQ ID NO: 276218 - DNA, 20 bp, human
gggacaaaataggcggggac

SEQ ID NO: 276219 - DNA, 20 bp, human
gtgggcggacgcagccacga

SEQ ID NO: 276220 - DNA, 20 bp, human
gacgagggacaaaataggcg

SEQ ID NO: 276221 - DNA, 20 bp, human
gacaggccgctcccaagctg

SEQ ID NO: 276222 - DNA, 20 bp, human
gcttgggagcggcctgtcag

SEQ ID NO: 276223 - DNA, 20 bp, human
ggccaccgcagcaactttct

SEQ ID NO: 276224 - DNA, 20 bp, human
ggcggtggcatctagggtca

SEQ ID NO: 276225 - DNA, 20 bp, human
ggtggcatctagggtcaggg

SEQ ID NO: 276226 - DNA, 20 bp, human
gtctccccggcctcagggtc

SEQ ID NO: 276227 - DNA, 20 bp, human
gggaaggagcaacaagtcgg

SEQ ID NO: 276228 - DNA, 20 bp, human
ggagagtagaggtaagccag

SEQ ID NO: 276229 - DNA, 20 bp, human
ggaaatggcgatggggataa

SEQ ID NO: 276230 - DNA, 20 bp, human
gccgcggccggggaaaaacc

SEQ ID NO: 276231 - DNA, 20 bp, human
gccgcggccaatcagtgcat

SEQ ID NO: 276232 - DNA, 20 bp, human
ggctcccgccccacaggtac

SEQ ID NO: 276233 - DNA, 20 bp, human
ggtgcctgacaaactgccta

SEQ ID NO: 276234 - DNA, 20 bp, human
gccctctctccccggcctca

SEQ ID NO: 276235 - DNA, 20 bp, human
gtgcgtggcaaggtttcctt

SEQ ID NO: 276236 - DNA, 20 bp, human
gcgctcgcggctccgagtcc

SEQ ID NO: 276237 - DNA, 20 bp, human
gattcccgaggcagggtcgt

SEQ ID NO: 276238 - DNA, 20 bp, human
gcccgggccacgcaccataa

SEQ ID NO: 276239 - DNA, 20 bp, human
gtggcccgggcgctgtccga

SEQ ID NO: 276240 - DNA, 20 bp, human
gcaggggcggggagtcacga

SEQ ID NO: 276241 - DNA, 20 bp, human
ggagtccgggtctggtgggg

SEQ ID NO: 276242 - DNA, 20 bp, human
ggagcgggattcccgaggca

SEQ ID NO: 276243 - DNA, 20 bp, human
gtgcaccgccccaccagacc

SEQ ID NO: 276244 - DNA, 20 bp, human
gggtcgtgggcactctatcg

SEQ ID NO: 276245 - DNA, 20 bp, human
gcgtgggcactctatcgcgg

SEQ ID NO: 276246 - DNA, 20 bp, human
gctgccgcgagccactggaa

SEQ ID NO: 276247 - DNA, 20 bp, human
ggaaggggcccgagcgctcg

SEQ ID NO: 276248 - DNA, 20 bp, human
gttgctacggggccctggat

SEQ ID NO: 276249 - DNA, 20 bp, human
gtagcaaggcgccaaagctg

SEQ ID NO: 276250 - DNA, 20 bp, human
gaatgcgcttcccccagctt

SEQ ID NO: 276251 - DNA, 20 bp, human
gtcccggcccgcgagcgctc

SEQ ID NO: 276252 - DNA, 20 bp, human
ggcgccttgctacggggccc

SEQ ID NO: 276253 - DNA, 20 bp, human
gtggttgcaggtccccctgg

SEQ ID NO: 276254 - DNA, 20 bp, human
gccacgtcccaagtgctacg

SEQ ID NO: 276255 - DNA, 20 bp, human
gagcagagacgatctcccgg

SEQ ID NO: 276256 - DNA, 20 bp, human
gcaggtggcagtgtccgcgg

SEQ ID NO: 276257 - DNA, 20 bp, human
ggaaagcgggaatgaaagac

SEQ ID NO: 276258 - DNA, 20 bp, human
ggacgggatgcgagcctccg

SEQ ID NO: 276259 - DNA, 20 bp, human
gcagcaggtggcagtgtccg

SEQ ID NO: 276260 - DNA, 20 bp, human
ggaaaggataagccgagatg

SEQ ID NO: 276261 - DNA, 20 bp, human
gggtttggggcgcagaaagc

SEQ ID NO: 276262 - DNA, 20 bp, human
gccgtcggccctggctctca

SEQ ID NO: 276263 - DNA, 20 bp, human
gacgcaccatggtgactttc

SEQ ID NO: 276264 - DNA, 20 bp, human
ggctcgcatcccgtcggccc

SEQ ID NO: 276265 - DNA, 20 bp, human
gaacgtggatgatggagcac

SEQ ID NO: 276266 - DNA, 20 bp, human
gtggttgcgagatcggagaa

SEQ ID NO: 276267 - DNA, 20 bp, human
ggaaggataagtgtagtcac

SEQ ID NO: 276268 - DNA, 20 bp, human
gaagccggaaaccggaaggg

SEQ ID NO: 276269 - DNA, 20 bp, human
gaaatgaggccggcgacgga

SEQ ID NO: 276270 - DNA, 20 bp, human
gcggaagccggaaaccggaa

SEQ ID NO: 276271 - DNA, 20 bp, human
ggtcctcagagcaaagttga

SEQ ID NO: 276272 - DNA, 20 bp, human
gcgggcagccctggccggca

SEQ ID NO: 276273 - DNA, 20 bp, human
gaggctcggcttcacgtgaa

SEQ ID NO: 276274 - DNA, 20 bp, human
gttcgctgaaggctagcctc

SEQ ID NO: 276275 - DNA, 20 bp, human
ggggtcctgcgaccggaagc

SEQ ID NO: 276276 - DNA, 20 bp, human
ggaggcgtgggcgaagacta

SEQ ID NO: 276277 - DNA, 20 bp, human
gcaaccaatgcaatttcctc

SEQ ID NO: 276278 - DNA, 20 bp, human
gtctgacgacgaaggcacag

SEQ ID NO: 276279 - DNA, 20 bp, human
gcagccggaggaaattgcat

SEQ ID NO: 276280 - DNA, 20 bp, human
ggcattggttgcatcattct

SEQ ID NO: 276281 - DNA, 20 bp, human
ggccctcgaaggtcgaaagg

SEQ ID NO: 276282 - DNA, 20 bp, human
gcgccagcttctgacgacga

SEQ ID NO: 276283 - DNA, 20 bp, human
ggccacctttcgaccttcga

SEQ ID NO: 276284 - DNA, 20 bp, human
ggggacacccgccgctcgct

SEQ ID NO: 276285 - DNA, 20 bp, human
gtcgcccacgcctcagccgg

SEQ ID NO: 276286 - DNA, 20 bp, human
ggggccacaggaacattcca

SEQ ID NO: 276287 - DNA, 20 bp, human
gaagagaaggcattgagtga

SEQ ID NO: 276288 - DNA, 20 bp, human
gtgcagaggcgctggacaac

SEQ ID NO: 276289 - DNA, 20 bp, human
ggccctgtcatctaaggagt

SEQ ID NO: 276290 - DNA, 20 bp, human
ggtaccctggaatgttcctg

SEQ ID NO: 276291 - DNA, 20 bp, human
gagggcaggataacaatctc

SEQ ID NO: 276292 - DNA, 20 bp, human
ggcccactccttagatgaca

SEQ ID NO: 276293 - DNA, 20 bp, human
ggagtgagggaaacgggctt

SEQ ID NO: 276294 - DNA, 20 bp, human
gttgtggtggcgatccacag

SEQ ID NO: 276295 - DNA, 20 bp, human
ggctggacaacgggttgcca

SEQ ID NO: 276296 - DNA, 20 bp, human
gtcagcggaggtcgtggaag

SEQ ID NO: 276297 - DNA, 20 bp, human
ggccagggatcgctgtgacg

SEQ ID NO: 276298 - DNA, 20 bp, human
gaatgaatgaagcgcagcaa

SEQ ID NO: 276299 - DNA, 20 bp, human
gcgcagcaagggctgggcgt

SEQ ID NO: 276300 - DNA, 20 bp, human
gatgaagcgcagcaagggct

SEQ ID NO: 276301 - DNA, 20 bp, human
ggccacgtcacagcgatccc

SEQ ID NO: 276302 - DNA, 20 bp, human
gcacagcgatccctggcggc

SEQ ID NO: 276303 - DNA, 20 bp, human
gcaggcctggccggccgaag

SEQ ID NO: 276304 - DNA, 20 bp, human
gacgcggccgctctggccca

SEQ ID NO: 276305 - DNA, 20 bp, human
ggatcgctgtgacgtggctc

SEQ ID NO: 276306 - DNA, 20 bp, human
gccgtggagtgaggcgataa

SEQ ID NO: 276307 - DNA, 20 bp, human
gatggcagaaggctgtttgg

SEQ ID NO: 276308 - DNA, 20 bp, human
gaggaaatgcaggcctgata

SEQ ID NO: 276309 - DNA, 20 bp, human
gggtcactggaatccctatc

SEQ ID NO: 276310 - DNA, 20 bp, human
ggaaccacaaagagggcctg

SEQ ID NO: 276311 - DNA, 20 bp, human
gcttgtgtccaggggattcc

SEQ ID NO: 276312 - DNA, 20 bp, human
gcactccacggctttccccc

SEQ ID NO: 276313 - DNA, 20 bp, human
gtccgctttccttttacaca

SEQ ID NO: 276314 - DNA, 20 bp, human
gccttttacacaggggagat

SEQ ID NO: 276315 - DNA, 20 bp, human
gtcagaatgcagctgtgaag

SEQ ID NO: 276316 - DNA, 20 bp, human
gtgtgcccctgagagcgggt

SEQ ID NO: 276317 - DNA, 20 bp, human
ggcagatagcacactatcgc

SEQ ID NO: 276318 - DNA, 20 bp, human
gcggaggccgcaggccgctc

SEQ ID NO: 276319 - DNA, 20 bp, human
gtggccctctctgaccttgg

SEQ ID NO: 276320 - DNA, 20 bp, human
ggcgcggacgcgcgctgcag

SEQ ID NO: 276321 - DNA, 20 bp, human
ggatcccccaaggtcagaga

SEQ ID NO: 276322 - DNA, 20 bp, human
gcgggtgagcagcaccgcgg

SEQ ID NO: 276323 - DNA, 20 bp, human
gggtgacaggagaacaatgt

SEQ ID NO: 276324 - DNA, 20 bp, human
gagggcgtcccggagacgga

SEQ ID NO: 276325 - DNA, 20 bp, human
gctggtgtccaggggtgcga

SEQ ID NO: 276326 - DNA, 20 bp, human
gggaagggttgacattgtga

SEQ ID NO: 276327 - DNA, 20 bp, human
gcatacctgtgcaccaattg

SEQ ID NO: 276328 - DNA, 20 bp, human
gcactgggcttgttgagtgg

SEQ ID NO: 276329 - DNA, 20 bp, human
gaggaagcttaatacccaaa

SEQ ID NO: 276330 - DNA, 20 bp, human
ggagttctaggccatacact

SEQ ID NO: 276331 - DNA, 20 bp, human
gcgcaaaggatggtgaaaga

SEQ ID NO: 276332 - DNA, 20 bp, human
gtcaccatcctttgcgtaaa

SEQ ID NO: 276333 - DNA, 20 bp, human
gcaggtatgatgggagttct

SEQ ID NO: 276334 - DNA, 20 bp, human
gattggtgcacaggtatgat

SEQ ID NO: 276335 - DNA, 20 bp, human
gccatgtgtctctcctcaat

SEQ ID NO: 276336 - DNA, 20 bp, human
ggacagatagagcgagataa

SEQ ID NO: 276337 - DNA, 20 bp, human
gagctgcattgtttcaaagt

SEQ ID NO: 276338 - DNA, 20 bp, human
gaggaacatgaggctcggtt

SEQ ID NO: 276339 - DNA, 20 bp, human
gccagctctaagcttgcctt

SEQ ID NO: 276340 - DNA, 20 bp, human
gctcaggatggtccctgctc

SEQ ID NO: 276341 - DNA, 20 bp, human
gactgcagaatgtcctagaa

SEQ ID NO: 276342 - DNA, 20 bp, human
gccccctgaaatgtcctcta

SEQ ID NO: 276343 - DNA, 20 bp, human
gtttgtgtgcaggtattcac

SEQ ID NO: 276344 - DNA, 20 bp, human
gcaagataagattagggcat

SEQ ID NO: 276345 - DNA, 20 bp, human
gttgacagtaagcaaaccaa

SEQ ID NO: 276346 - DNA, 20 bp, human
gacgccgcgcagtgctcggg

SEQ ID NO: 276347 - DNA, 20 bp, human
gaagctggcggacaggggaa

SEQ ID NO: 276348 - DNA, 20 bp, human
gtgtctgaaaaagcaaccgt

SEQ ID NO: 276349 - DNA, 20 bp, human
ggggagtgtggtcaacacac

SEQ ID NO: 276350 - DNA, 20 bp, human
gcacaaagtgcaggatccca

SEQ ID NO: 276351 - DNA, 20 bp, human
gagcttgcaagtgtgtcttc

SEQ ID NO: 276352 - DNA, 20 bp, human
gtctactgtgcgcggtgctc

SEQ ID NO: 276353 - DNA, 20 bp, human
gagggggactctactgtgcg

SEQ ID NO: 276354 - DNA, 20 bp, human
gcgcgcctgtactgaaccct

SEQ ID NO: 276355 - DNA, 20 bp, human
gaaaagcaaccgtgggagtg

SEQ ID NO: 276356 - DNA, 20 bp, human
gtggccagaggagataagcg

SEQ ID NO: 276357 - DNA, 20 bp, human
ggagccgcgcttatctcctc

SEQ ID NO: 276358 - DNA, 20 bp, human
gtgtactgaggagccggcta

SEQ ID NO: 276359 - DNA, 20 bp, human
ggccccagcaggcggacaaa

SEQ ID NO: 276360 - DNA, 20 bp, human
gagtcactgtactgaggagc

SEQ ID NO: 276361 - DNA, 20 bp, human
ggacttgcacacaagctcca

SEQ ID NO: 276362 - DNA, 20 bp, human
gaaacggtgcaacgccaggc

SEQ ID NO: 276363 - DNA, 20 bp, human
gggctcgatgagtctcaatt

SEQ ID NO: 276364 - DNA, 20 bp, human
gagactcatcgagccgtagc

SEQ ID NO: 276365 - DNA, 20 bp, human
ggtgacatcagggagtttat

SEQ ID NO: 276366 - DNA, 20 bp, human
gccaaggcgcgggcccctga

SEQ ID NO: 276367 - DNA, 20 bp, human
ggacccccttctataaaccg

SEQ ID NO: 276368 - DNA, 20 bp, human
gtggctgagaacaccatggt

SEQ ID NO: 276369 - DNA, 20 bp, human
gcagaggcaggaggccctca

SEQ ID NO: 276370 - DNA, 20 bp, human
gtggttctgtgcccaaggcg

SEQ ID NO: 276371 - DNA, 20 bp, human
gctcaaccccggtttataga

SEQ ID NO: 276372 - DNA, 20 bp, human
gcctctggaaataggcccca

SEQ ID NO: 276373 - DNA, 20 bp, human
gaagcccatcaaggcactgg

SEQ ID NO: 276374 - DNA, 20 bp, human
gaaccccggtttatagaagg

SEQ ID NO: 276375 - DNA, 20 bp, human
gggctttggaatcaggtctg

SEQ ID NO: 276376 - DNA, 20 bp, human
gctactccaaaggtcccaag

SEQ ID NO: 276377 - DNA, 20 bp, human
gtggtttaaggggaacttga

SEQ ID NO: 276378 - DNA, 20 bp, human
ggggaggtggctggtttaag

SEQ ID NO: 276379 - DNA, 20 bp, human
gcatgtgtcacctactccaa

SEQ ID NO: 276380 - DNA, 20 bp, human
gaggggaacttgagggaagt

SEQ ID NO: 276381 - DNA, 20 bp, human
gaagtagggaagactcctct

SEQ ID NO: 276382 - DNA, 20 bp, human
gggggtggaggctgtagaag

SEQ ID NO: 276383 - DNA, 20 bp, human
gtgcccagcctcagctggat

SEQ ID NO: 276384 - DNA, 20 bp, human
gtctcttgcgcactgtgggg

SEQ ID NO: 276385 - DNA, 20 bp, human
gtgagaagagggaaaattgc

SEQ ID NO: 276386 - DNA, 20 bp, human
gagcaggccgagctggtcgg

SEQ ID NO: 276387 - DNA, 20 bp, human
gcggactcccaaacccgctc

SEQ ID NO: 276388 - DNA, 20 bp, human
gcaggtcctgccggcctcac

SEQ ID NO: 276389 - DNA, 20 bp, human
gaggcaggtagccctacagc

SEQ ID NO: 276390 - DNA, 20 bp, human
gccggcagcacacagtgtta

SEQ ID NO: 276391 - DNA, 20 bp, human
gtcgcagtgcaccccccggg

SEQ ID NO: 276392 - DNA, 20 bp, human
gtcgcagcccccgaccagct

SEQ ID NO: 276393 - DNA, 20 bp, human
ggcgctgcccccactagagt

SEQ ID NO: 276394 - DNA, 20 bp, human
ggcgcgcatgtccagagcag

SEQ ID NO: 276395 - DNA, 20 bp, human
gagagccgcggccggctgga

SEQ ID NO: 276396 - DNA, 20 bp, human
gtccggacccgccagtggta

SEQ ID NO: 276397 - DNA, 20 bp, human
gtagactccggacccgccag

SEQ ID NO: 276398 - DNA, 20 bp, human
gcgactgtggagcaagcatt

SEQ ID NO: 276399 - DNA, 20 bp, human
gcgaagaatggcaggtttcc

SEQ ID NO: 276400 - DNA, 20 bp, human
gaagaatctgggcgtcgaag

SEQ ID NO: 276401 - DNA, 20 bp, human
gggagtctagcacgcgactg

SEQ ID NO: 276402 - DNA, 20 bp, human
gtgagaatcaaggggagact

SEQ ID NO: 276403 - DNA, 20 bp, human
ggccttgtagttcacggtaa

SEQ ID NO: 276404 - DNA, 20 bp, human
gaggggagactgggcgtcga

SEQ ID NO: 276405 - DNA, 20 bp, human
ggtaaaggggtcgactcacg

SEQ ID NO: 276406 - DNA, 20 bp, human
gggagcgtgagcggatccga

SEQ ID NO: 276407 - DNA, 20 bp, human
ggcccggcctgcgagcctca

SEQ ID NO: 276408 - DNA, 20 bp, human
gcacgctccctgaggctcgc

SEQ ID NO: 276409 - DNA, 20 bp, human
gctccctgaggctcgcaggc

SEQ ID NO: 276410 - DNA, 20 bp, human
gggcgcgtggcattgacgcg

SEQ ID NO: 276411 - DNA, 20 bp, human
gcccggcgctggctagccgg

SEQ ID NO: 276412 - DNA, 20 bp, human
gagtacacacattacaccct

SEQ ID NO: 276413 - DNA, 20 bp, human
ggcccccggcgctggctagc

SEQ ID NO: 276414 - DNA, 20 bp, human
ggccgccggctagccagcgc

SEQ ID NO: 276415 - DNA, 20 bp, human
gaatgtgcgcgtgggctatc

SEQ ID NO: 276416 - DNA, 20 bp, human
ggcccccaacccgtgagaaa

SEQ ID NO: 276417 - DNA, 20 bp, human
ggtcgtgcgcgggtcatcct

SEQ ID NO: 276418 - DNA, 20 bp, human
ggggtgaagaggctgactta

SEQ ID NO: 276419 - DNA, 20 bp, human
gaccaggtccggcacgaagg

SEQ ID NO: 276420 - DNA, 20 bp, human
ggtgccgctcccagcgacaa

SEQ ID NO: 276421 - DNA, 20 bp, human
gcgaccgcggcaggcgaagt

SEQ ID NO: 276422 - DNA, 20 bp, human
ggggctcctccttttctcac

SEQ ID NO: 276423 - DNA, 20 bp, human
gagcactaggatctgtcggt

SEQ ID NO: 276424 - DNA, 20 bp, human
gcccaggtggcgcgagcact

SEQ ID NO: 276425 - DNA, 20 bp, human
gcacaacccacattacttga

SEQ ID NO: 276426 - DNA, 20 bp, human
gtagggccgagacaggagtc

SEQ ID NO: 276427 - DNA, 20 bp, human
gaccacacgaatgaacacac

SEQ ID NO: 276428 - DNA, 20 bp, human
ggccggtgtgttcattcgtg

SEQ ID NO: 276429 - DNA, 20 bp, human
gtaagacctgactcctgtct

SEQ ID NO: 276430 - DNA, 20 bp, human
ggggaggggagtactgcagg

SEQ ID NO: 276431 - DNA, 20 bp, human
gcaggccatccccagagcac

SEQ ID NO: 276432 - DNA, 20 bp, human
gctcgaagctcaagcacccg

SEQ ID NO: 276433 - DNA, 20 bp, human
gggtgggaggggagtactgc

SEQ ID NO: 276434 - DNA, 20 bp, human
gccccagagcacgggtcccg

SEQ ID NO: 276435 - DNA, 20 bp, human
ggaccagcgcgcatcccaat

SEQ ID NO: 276436 - DNA, 20 bp, human
gaacacgtccccacctctta

SEQ ID NO: 276437 - DNA, 20 bp, human
gacccaatctgggtctgaga

SEQ ID NO: 276438 - DNA, 20 bp, human
gggtggggacgtgttcacaa

SEQ ID NO: 276439 - DNA, 20 bp, human
ggagaactccttaagaggtg

SEQ ID NO: 276440 - DNA, 20 bp, human
gtagtctaaagtctctgctt

SEQ ID NO: 276441 - DNA, 20 bp, human
gtgttcacaacggcaaaact

SEQ ID NO: 276442 - DNA, 20 bp, human
gagcatgagaactccttaag

SEQ ID NO: 276443 - DNA, 20 bp, human
gctcggtcccagacccaatc

SEQ ID NO: 276444 - DNA, 20 bp, human
ggtcagatgtgctgcttctt

SEQ ID NO: 276445 - DNA, 20 bp, human
gaaagagcacactgagtcct

SEQ ID NO: 276446 - DNA, 20 bp, human
gggacggcctaccacaggat

SEQ ID NO: 276447 - DNA, 20 bp, human
ggaaccccggtgatgctgga

SEQ ID NO: 276448 - DNA, 20 bp, human
ggcctgcgctccggattctc

SEQ ID NO: 276449 - DNA, 20 bp, human
ggggctaggatgggatgtcg

SEQ ID NO: 276450 - DNA, 20 bp, human
ggcggcccgagcctgcgctc

SEQ ID NO: 276451 - DNA, 20 bp, human
ggggccccgccccctcgcta

SEQ ID NO: 276452 - DNA, 20 bp, human
ggcgggggaaggtgtcctag

SEQ ID NO: 276453 - DNA, 20 bp, human
ggcacatcgcggggctagga

SEQ ID NO: 276454 - DNA, 20 bp, human
gccaaggccgccgtagcgag

SEQ ID NO: 276455 - DNA, 20 bp, human
ggaatccggagcgcaggctc

SEQ ID NO: 276456 - DNA, 20 bp, human
gggaagagcgcttgcgcgga

SEQ ID NO: 276457 - DNA, 20 bp, human
ggggcatccgggtctcttgg

SEQ ID NO: 276458 - DNA, 20 bp, human
gctcccgcactcctacctgc

SEQ ID NO: 276459 - DNA, 20 bp, human
ggggtggggataggaggacg

SEQ ID NO: 276460 - DNA, 20 bp, human
gtggaaattcgcggcgggtg

SEQ ID NO: 276461 - DNA, 20 bp, human
gtctgcactaggaaactggt

SEQ ID NO: 276462 - DNA, 20 bp, human
gggtaggagtgcgggaggtg

SEQ ID NO: 276463 - DNA, 20 bp, human
gcgtgtcaacatgcatgctt

SEQ ID NO: 276464 - DNA, 20 bp, human
gctcacctcgtagtctggaa

SEQ ID NO: 276465 - DNA, 20 bp, human
gaagtccgacgctggtcggt

SEQ ID NO: 276466 - DNA, 20 bp, human
gagtaggaagaggggattat

SEQ ID NO: 276467 - DNA, 20 bp, human
ggaaccccgggagtgagcta

SEQ ID NO: 276468 - DNA, 20 bp, human
gctactgcgagtaggaagag

SEQ ID NO: 276469 - DNA, 20 bp, human
gaaggggaaagcagtaaacg

SEQ ID NO: 276470 - DNA, 20 bp, human
gtgaacaaaaagtcgaaccc

SEQ ID NO: 276471 - DNA, 20 bp, human
gtaaaccatagctcactccc

SEQ ID NO: 276472 - DNA, 20 bp, human
gtaccggtctccatggtaac

SEQ ID NO: 276473 - DNA, 20 bp, human
gaacaccagttgtaaaccca

SEQ ID NO: 276474 - DNA, 20 bp, human
ggaagaggggattataggaa

SEQ ID NO: 276475 - DNA, 20 bp, human
gaagagaaggatcgcgtaaa

SEQ ID NO: 276476 - DNA, 20 bp, human
gacaaggaggggtgttgaat

SEQ ID NO: 276477 - DNA, 20 bp, human
gaggggtgttgaatagggtc

SEQ ID NO: 276478 - DNA, 20 bp, human
gaagccccggcggtgagagt

SEQ ID NO: 276479 - DNA, 20 bp, human
gccgggaaagggcgtctcag

SEQ ID NO: 276480 - DNA, 20 bp, human
gcgggcggaagcactgggtc

SEQ ID NO: 276481 - DNA, 20 bp, human
gaggggctggctgcacgatt

SEQ ID NO: 276482 - DNA, 20 bp, human
ggggttgaggtgccccacgt

SEQ ID NO: 276483 - DNA, 20 bp, human
gcctgtggctccgcccaccg

SEQ ID NO: 276484 - DNA, 20 bp, human
ggggccgactctcaccgccg

SEQ ID NO: 276485 - DNA, 20 bp, human
gacccacttccgccccgcgg

SEQ ID NO: 276486 - DNA, 20 bp, human
ggggttgtggaacctggagc

SEQ ID NO: 276487 - DNA, 20 bp, human
gatcgccggcttccctctgt

SEQ ID NO: 276488 - DNA, 20 bp, human
gctaactagtcctttgggat

SEQ ID NO: 276489 - DNA, 20 bp, human
gctcccgcaggcttcttatt

SEQ ID NO: 276490 - DNA, 20 bp, human
ggatgatggaaaaactcacc

SEQ ID NO: 276491 - DNA, 20 bp, human
gggattggggttgtggaacc

SEQ ID NO: 276492 - DNA, 20 bp, human
gcaaaaatgacccctcccgc

SEQ ID NO: 276493 - DNA, 20 bp, human
gtgagtttttccatcatcgc

SEQ ID NO: 276494 - DNA, 20 bp, human
gtcacaatctcgcaacgcag

SEQ ID NO: 276495 - DNA, 20 bp, human
ggaaaaactcacctggaaaa

SEQ ID NO: 276496 - DNA, 20 bp, human
gggagcgtgcccattttcgg

SEQ ID NO: 276497 - DNA, 20 bp, human
gtggctgctcaaggattgca

SEQ ID NO: 276498 - DNA, 20 bp, human
ggaaaccatagagacgtccg

SEQ ID NO: 276499 - DNA, 20 bp, human
gagtcccgggcgcaaatacg

SEQ ID NO: 276500 - DNA, 20 bp, human
gactagctcagtgtaggacg

SEQ ID NO: 276501 - DNA, 20 bp, human
gcctcggaacctccgaaaat

SEQ ID NO: 276502 - DNA, 20 bp, human
gagtactaactggccctctc

SEQ ID NO: 276503 - DNA, 20 bp, human
gctccaggtcccagtttcta

SEQ ID NO: 276504 - DNA, 20 bp, human
gccgttcttggcatcctgag

SEQ ID NO: 276505 - DNA, 20 bp, human
gccgggcgcaaatacgagga

SEQ ID NO: 276506 - DNA, 20 bp, human
gtgcgcacgcgcggccaccg

SEQ ID NO: 276507 - DNA, 20 bp, human
ggagccgcgagagcttccgg

SEQ ID NO: 276508 - DNA, 20 bp, human
ggggcgggagtgcgcacgcg

SEQ ID NO: 276509 - DNA, 20 bp, human
gggcaccgtgcggacaaatc

SEQ ID NO: 276510 - DNA, 20 bp, human
gcgagaatgcgcgtcctgac

SEQ ID NO: 276511 - DNA, 20 bp, human
gcgagagccgcgagagcttc

SEQ ID NO: 276512 - DNA, 20 bp, human
gcgcgcggagcaggggctag

SEQ ID NO: 276513 - DNA, 20 bp, human
gttccctccggaagctctcg

SEQ ID NO: 276514 - DNA, 20 bp, human
ggcgcgacccggagcgaccc

SEQ ID NO: 276515 - DNA, 20 bp, human
gaccgggcgcgcgcagccga

SEQ ID NO: 276516 - DNA, 20 bp, human
gtaaatgcatcagctgaggc

SEQ ID NO: 276517 - DNA, 20 bp, human
gcctaggtggcagggggaga

SEQ ID NO: 276518 - DNA, 20 bp, human
gaatgtaaatgcatcagctg

SEQ ID NO: 276519 - DNA, 20 bp, human
gagggaaactgccacctagg

SEQ ID NO: 276520 - DNA, 20 bp, human
ggctctggggatgtgaccat

SEQ ID NO: 276521 - DNA, 20 bp, human
gattactccgagctggagta

SEQ ID NO: 276522 - DNA, 20 bp, human
gccacccagtggggacagcg

SEQ ID NO: 276523 - DNA, 20 bp, human
gctggccccgctgtccccac

SEQ ID NO: 276524 - DNA, 20 bp, human
gcctcccagttgctgcagtt

SEQ ID NO: 276525 - DNA, 20 bp, human
gtacccaggctctgcccgtc

SEQ ID NO: 276526 - DNA, 20 bp, human
gaggcggggaaggaactaga

SEQ ID NO: 276527 - DNA, 20 bp, human
gcccaggcgcccgacgtaga

SEQ ID NO: 276528 - DNA, 20 bp, human
ggctgcgcagagggcgagag

SEQ ID NO: 276529 - DNA, 20 bp, human
ggcgaacgaacctactgggc

SEQ ID NO: 276530 - DNA, 20 bp, human
ggggggagaaggcgtggcta

SEQ ID NO: 276531 - DNA, 20 bp, human
gtcctggtgtcccgcccagt

SEQ ID NO: 276532 - DNA, 20 bp, human
gcttgggccagaaggttctc

SEQ ID NO: 276533 - DNA, 20 bp, human
ggcggtgcgaacgaacctac

SEQ ID NO: 276534 - DNA, 20 bp, human
gagaaggcgtggctaaggct

SEQ ID NO: 276535 - DNA, 20 bp, human
gggctccacgcggtgacgtc

SEQ ID NO: 276536 - DNA, 20 bp, human
gcatgcgcaagggactgctc

SEQ ID NO: 276537 - DNA, 20 bp, human
ggtaaggcggggtcggacgg

SEQ ID NO: 276538 - DNA, 20 bp, human
gtgtgtaaggcggggtcgga

SEQ ID NO: 276539 - DNA, 20 bp, human
gcgttggcagcgtagggaac

SEQ ID NO: 276540 - DNA, 20 bp, human
gcgcatgcgcttcttcaggt

SEQ ID NO: 276541 - DNA, 20 bp, human
gcctcaggcggcacgaggaa

SEQ ID NO: 276542 - DNA, 20 bp, human
gtagggaactggcgtccggg

SEQ ID NO: 276543 - DNA, 20 bp, human
gactgctccggcgaccctcc

SEQ ID NO: 276544 - DNA, 20 bp, human
ggggtatcgcactactggaa

SEQ ID NO: 276545 - DNA, 20 bp, human
gcggcccacaaggtccagga

SEQ ID NO: 276546 - DNA, 20 bp, human
ggcggtggcaccacctgtgg

SEQ ID NO: 276547 - DNA, 20 bp, human
ggcggccgcgggagaggaga

SEQ ID NO: 276548 - DNA, 20 bp, human
ggggactgggagcaccgggc

SEQ ID NO: 276549 - DNA, 20 bp, human
gcgactctatcgatccccgg

SEQ ID NO: 276550 - DNA, 20 bp, human
ggcggccaggcgggccctct

SEQ ID NO: 276551 - DNA, 20 bp, human
ggggcgctcctctggctctt

SEQ ID NO: 276552 - DNA, 20 bp, human
ggggagcgggatgccgattt

SEQ ID NO: 276553 - DNA, 20 bp, human
gcggcgggctagcgcagtcc

SEQ ID NO: 276554 - DNA, 20 bp, human
gcgccctgggcgctgggcgt

SEQ ID NO: 276555 - DNA, 20 bp, human
gcctcccgcgccccaatcag

SEQ ID NO: 276556 - DNA, 20 bp, human
gtagcgcggaagctcggcag

SEQ ID NO: 276557 - DNA, 20 bp, human
ggacccggctggcactcagg

SEQ ID NO: 276558 - DNA, 20 bp, human
gcaatggagtaggagattga

SEQ ID NO: 276559 - DNA, 20 bp, human
gggggcgtggtctccctcgg

SEQ ID NO: 276560 - DNA, 20 bp, human
ggagccggcttcaggggcgg

SEQ ID NO: 276561 - DNA, 20 bp, human
gtgcccaagcccacgtgaga

SEQ ID NO: 276562 - DNA, 20 bp, human
gcaggaggttggtgaaatag

SEQ ID NO: 276563 - DNA, 20 bp, human
gggcggggccccgccaataa

SEQ ID NO: 276564 - DNA, 20 bp, human
gtgcgcaagcgcaatcccaa

SEQ ID NO: 276565 - DNA, 20 bp, human
gcggctggcactcaggaggt

SEQ ID NO: 276566 - DNA, 20 bp, human
ggaggcgagccgcgcggcca

SEQ ID NO: 276567 - DNA, 20 bp, human
gttgtgcggccggtagccgg

SEQ ID NO: 276568 - DNA, 20 bp, human
gaaggcctgtggcgaagcgg

SEQ ID NO: 276569 - DNA, 20 bp, human
gcggttgtgcggccggtagc

SEQ ID NO: 276570 - DNA, 20 bp, human
gcagagcgccctgtgtagag

SEQ ID NO: 276571 - DNA, 20 bp, human
gcggagggggacctaagtca

SEQ ID NO: 276572 - DNA, 20 bp, human
gccgcgccgcggtgccccag

SEQ ID NO: 276573 - DNA, 20 bp, human
ggcccccaggaaggatgaaa

SEQ ID NO: 276574 - DNA, 20 bp, human
gcccgcaccccgccggctac

SEQ ID NO: 276575 - DNA, 20 bp, human
gcaggctgtaggccaatgag

SEQ ID NO: 276576 - DNA, 20 bp, human
gggccgctccggatccaacc

SEQ ID NO: 276577 - DNA, 20 bp, human
gtggctccccgcctccgagg

SEQ ID NO: 276578 - DNA, 20 bp, human
gcggccaaatccacttccta

SEQ ID NO: 276579 - DNA, 20 bp, human
gggtgcggccccctaggaag

SEQ ID NO: 276580 - DNA, 20 bp, human
gtccccgcctccgaggagga

SEQ ID NO: 276581 - DNA, 20 bp, human
gggtggggcgtgtcacgcga

SEQ ID NO: 276582 - DNA, 20 bp, human
gggctggctccccgcctccg

SEQ ID NO: 276583 - DNA, 20 bp, human
gggcccaggttctggggaac

SEQ ID NO: 276584 - DNA, 20 bp, human
gacgccggccagtcaatcag

SEQ ID NO: 276585 - DNA, 20 bp, human
gctggaagccgggttggatc

SEQ ID NO: 276586 - DNA, 20 bp, human
gcgtatgacagcatcttagt

SEQ ID NO: 276587 - DNA, 20 bp, human
gcaggggcgtggcctgtccg

SEQ ID NO: 276588 - DNA, 20 bp, human
ggctccgagtcttcagcact

SEQ ID NO: 276589 - DNA, 20 bp, human
gcactccccgccccgcggac

SEQ ID NO: 276590 - DNA, 20 bp, human
ggagcgggacagcgcgccgg

SEQ ID NO: 276591 - DNA, 20 bp, human
ggacagcatcttagtgggtg

SEQ ID NO: 276592 - DNA, 20 bp, human
gccgcggggcggggagtgcg

SEQ ID NO: 276593 - DNA, 20 bp, human
ggcggagcgggacagcgcgc

SEQ ID NO: 276594 - DNA, 20 bp, human
ggctctcccagtccgttctg

SEQ ID NO: 276595 - DNA, 20 bp, human
gggactgggagagcgaggtc

SEQ ID NO: 276596 - DNA, 20 bp, human
gtcttcctagtcggtagaaa

SEQ ID NO: 276597 - DNA, 20 bp, human
ggactggatctcttcctagt

SEQ ID NO: 276598 - DNA, 20 bp, human
gtcaaaggcaaaacctggac

SEQ ID NO: 276599 - DNA, 20 bp, human
ggtgaagtgaataagaaaat

SEQ ID NO: 276600 - DNA, 20 bp, human
gatagacgggagttcatggg

SEQ ID NO: 276601 - DNA, 20 bp, human
ggcctccagtgactgtctcc

SEQ ID NO: 276602 - DNA, 20 bp, human
gtttcccctttctaccgact

SEQ ID NO: 276603 - DNA, 20 bp, human
ggtcatagacgggagttcat

SEQ ID NO: 276604 - DNA, 20 bp, human
gaattcacaggccgagtcaa

SEQ ID NO: 276605 - DNA, 20 bp, human
gagtggaaatagtcatagac

SEQ ID NO: 276606 - DNA, 20 bp, human
gggcccgcgcgttcctggaa

SEQ ID NO: 276607 - DNA, 20 bp, human
gtggaaagggctgacgtacg

SEQ ID NO: 276608 - DNA, 20 bp, human
gaatcggcagccgcgtgcgg

SEQ ID NO: 276609 - DNA, 20 bp, human
gcgccggggtcggctgagaa

SEQ ID NO: 276610 - DNA, 20 bp, human
gagagctgccctggggtcat

SEQ ID NO: 276611 - DNA, 20 bp, human
gcggcgccgtcccagccaat

SEQ ID NO: 276612 - DNA, 20 bp, human
ggaagggcagcggggacacg

SEQ ID NO: 276613 - DNA, 20 bp, human
gcagccgcgtgcggggggtg

SEQ ID NO: 276614 - DNA, 20 bp, human
gcccacgtgggttatttcta

SEQ ID NO: 276615 - DNA, 20 bp, human
gggctgacgtacgcggccga

SEQ ID NO: 276616 - DNA, 20 bp, human
ggagagacaggggtacagac

SEQ ID NO: 276617 - DNA, 20 bp, human
gctagccggcagaggagcta

SEQ ID NO: 276618 - DNA, 20 bp, human
gtggctgcacccacgtgtgg

SEQ ID NO: 276619 - DNA, 20 bp, human
gagccccgccctccaggggt

SEQ ID NO: 276620 - DNA, 20 bp, human
ggcttggctgcacccacgtg

SEQ ID NO: 276621 - DNA, 20 bp, human
gactgtcagccgatgagccc

SEQ ID NO: 276622 - DNA, 20 bp, human
gccagactctctatctccct

SEQ ID NO: 276623 - DNA, 20 bp, human
gcactccctagctcctctgc

SEQ ID NO: 276624 - DNA, 20 bp, human
gctcaaaatgagaccatggt

SEQ ID NO: 276625 - DNA, 20 bp, human
gctaggggaatgcttttcag

SEQ ID NO: 276626 - DNA, 20 bp, human
gggcgtgcgcagtggttctt

SEQ ID NO: 276627 - DNA, 20 bp, human
gtcccgacgtgcctcgggca

SEQ ID NO: 276628 - DNA, 20 bp, human
gcgccctgcccgaggcacgt

SEQ ID NO: 276629 - DNA, 20 bp, human
gggcgcgagtcgctgctcag

SEQ ID NO: 276630 - DNA, 20 bp, human
ggggccgccgccagccgctg

SEQ ID NO: 276631 - DNA, 20 bp, human
gagggccgcgcagcgacggg

SEQ ID NO: 276632 - DNA, 20 bp, human
ggctgcgggcaaggctgaac

SEQ ID NO: 276633 - DNA, 20 bp, human
gcctagggccgcgcagcgac

SEQ ID NO: 276634 - DNA, 20 bp, human
gctcccgccgcgccacatgc

SEQ ID NO: 276635 - DNA, 20 bp, human
gcgggggtggccgcgaccat

SEQ ID NO: 276636 - DNA, 20 bp, human
gcctcccggaggcctgacca

SEQ ID NO: 276637 - DNA, 20 bp, human
gcggggaaacgcggaagtgg

SEQ ID NO: 276638 - DNA, 20 bp, human
gagcctgggcccgaggtatc

SEQ ID NO: 276639 - DNA, 20 bp, human
gccggcccagcggggaaacg

SEQ ID NO: 276640 - DNA, 20 bp, human
gcccggaggcctgaccaggg

SEQ ID NO: 276641 - DNA, 20 bp, human
gcagcggggaaacgcggaag

SEQ ID NO: 276642 - DNA, 20 bp, human
gcctcctgcccggatacctc

SEQ ID NO: 276643 - DNA, 20 bp, human
gcgctggcaaggcggggcgg

SEQ ID NO: 276644 - DNA, 20 bp, human
ggctgcgcgaccccacccgg

SEQ ID NO: 276645 - DNA, 20 bp, human
ggggcgagggcacaggaaat

SEQ ID NO: 276646 - DNA, 20 bp, human
ggagctgattgccaaagtgt

SEQ ID NO: 276647 - DNA, 20 bp, human
gaaagaaaggtttgtatctg

SEQ ID NO: 276648 - DNA, 20 bp, human
gtctactagacttgtttttg

SEQ ID NO: 276649 - DNA, 20 bp, human
ggaggagccagagaggagcg

SEQ ID NO: 276650 - DNA, 20 bp, human
gggcaataacctgtcctcct

SEQ ID NO: 276651 - DNA, 20 bp, human
gccaacagtgtcggactgtg

SEQ ID NO: 276652 - DNA, 20 bp, human
gagtttgaaggcatcatact

SEQ ID NO: 276653 - DNA, 20 bp, human
gatattgcttgcttcaaccc

SEQ ID NO: 276654 - DNA, 20 bp, human
gaacttaggaatctgagtac

SEQ ID NO: 276655 - DNA, 20 bp, human
gtggagcgtcgtgacacaag

SEQ ID NO: 276656 - DNA, 20 bp, human
gacacaggggtcaagactct

SEQ ID NO: 276657 - DNA, 20 bp, human
gtgaaagccgatctccaaga

SEQ ID NO: 276658 - DNA, 20 bp, human
gcccaggtgggatcgctctg

SEQ ID NO: 276659 - DNA, 20 bp, human
gtgggctgtgggtagctttt

SEQ ID NO: 276660 - DNA, 20 bp, human
ggccacgccctcttggagat

SEQ ID NO: 276661 - DNA, 20 bp, human
ggcctcagagcgatcccacc

SEQ ID NO: 276662 - DNA, 20 bp, human
ggggcgtggctccaaaatgc

SEQ ID NO: 276663 - DNA, 20 bp, human
gggcctcgataagtcagatg

SEQ ID NO: 276664 - DNA, 20 bp, human
gagagcaagatcccccaggt

SEQ ID NO: 276665 - DNA, 20 bp, human
gttatcgaggcctgggctgt

SEQ ID NO: 276666 - DNA, 20 bp, human
ggtagttccacctggttctc

SEQ ID NO: 276667 - DNA, 20 bp, human
gaagagaggcagatccttac

SEQ ID NO: 276668 - DNA, 20 bp, human
gagaaagttaccttggtggg

SEQ ID NO: 276669 - DNA, 20 bp, human
gggtgggtggcataatccta

SEQ ID NO: 276670 - DNA, 20 bp, human
gagactggctttctattcca

SEQ ID NO: 276671 - DNA, 20 bp, human
ggaaacatgttgtcggttaa

SEQ ID NO: 276672 - DNA, 20 bp, human
gtgttctcctgagaaccagg

SEQ ID NO: 276673 - DNA, 20 bp, human
gagtcagaggtagttccacc

SEQ ID NO: 276674 - DNA, 20 bp, human
gaaatagaaagttaccttgg

SEQ ID NO: 276675 - DNA, 20 bp, human
ggtgtttagtagttcctgta

SEQ ID NO: 276676 - DNA, 20 bp, human
gcgcgcgagtagcaccggat

SEQ ID NO: 276677 - DNA, 20 bp, human
gagctcgggtgctgagtatt

SEQ ID NO: 276678 - DNA, 20 bp, human
ggcgatccgcggtcctactc

SEQ ID NO: 276679 - DNA, 20 bp, human
ggggtgctgagtattgggag

SEQ ID NO: 276680 - DNA, 20 bp, human
gtggaactcgtggagagtga

SEQ ID NO: 276681 - DNA, 20 bp, human
gctgggcgcgcgagtagcac

SEQ ID NO: 276682 - DNA, 20 bp, human
ggagccggcccagcctgagt

SEQ ID NO: 276683 - DNA, 20 bp, human
ggaggtgtcaggctcggcag

SEQ ID NO: 276684 - DNA, 20 bp, human
gtctgtctggggcccggccg

SEQ ID NO: 276685 - DNA, 20 bp, human
gcggattggctgagtgaacg

SEQ ID NO: 276686 - DNA, 20 bp, human
gaagcggcggcgcaagaggt

SEQ ID NO: 276687 - DNA, 20 bp, human
ggcccgcggccgctgatctg

SEQ ID NO: 276688 - DNA, 20 bp, human
ggacccgcgccccgataccc

SEQ ID NO: 276689 - DNA, 20 bp, human
gcgcgggcaaggtcgctcag

SEQ ID NO: 276690 - DNA, 20 bp, human
gggcacccggcctgggtatc

SEQ ID NO: 276691 - DNA, 20 bp, human
gagctgaggccccagatcag

SEQ ID NO: 276692 - DNA, 20 bp, human
gggcagagcccggggatcac

SEQ ID NO: 276693 - DNA, 20 bp, human
gtctgcccggaagtggcagt

SEQ ID NO: 276694 - DNA, 20 bp, human
ggcactccctgtgcactagt

SEQ ID NO: 276695 - DNA, 20 bp, human
gcgcgccccgatacccaggc

SEQ ID NO: 276696 - DNA, 20 bp, human
gtggccccagatgtcctgga

SEQ ID NO: 276697 - DNA, 20 bp, human
gcaggacatctggggccaga

SEQ ID NO: 276698 - DNA, 20 bp, human
ggtcaggcatggcccattcc

SEQ ID NO: 276699 - DNA, 20 bp, human
gggagggaaacaacagtccc

SEQ ID NO: 276700 - DNA, 20 bp, human
gggagctggggaccagtgtg

SEQ ID NO: 276701 - DNA, 20 bp, human
gctctggagctgcggtaagt

SEQ ID NO: 276702 - DNA, 20 bp, human
gcatggggttgaggggtgtc

SEQ ID NO: 276703 - DNA, 20 bp, human
gagggagcctcgccccggaa

SEQ ID NO: 276704 - DNA, 20 bp, human
gacccctcaaccccatgtct

SEQ ID NO: 276705 - DNA, 20 bp, human
gtgggtgtgatgctgactct

SEQ ID NO: 276706 - DNA, 20 bp, human
gcctcccgccggtgccacag

SEQ ID NO: 276707 - DNA, 20 bp, human
gcggcgggagggggcggtaa

SEQ ID NO: 276708 - DNA, 20 bp, human
gcggtgccacagtggttgat

SEQ ID NO: 276709 - DNA, 20 bp, human
gtcgctctttcaaacgtggt

SEQ ID NO: 276710 - DNA, 20 bp, human
gcgcgtcgcgccaagcgccc

SEQ ID NO: 276711 - DNA, 20 bp, human
ggggggcggtaaggggccgt

SEQ ID NO: 276712 - DNA, 20 bp, human
gggttcagatcgctaggggc

SEQ ID NO: 276713 - DNA, 20 bp, human
ggagcgacaattacttccca

SEQ ID NO: 276714 - DNA, 20 bp, human
gagtttgggttcagatcgct

SEQ ID NO: 276715 - DNA, 20 bp, human
gagtttttacgcactttggc

SEQ ID NO: 276716 - DNA, 20 bp, human
gtggaaagtcagagcaacaa

SEQ ID NO: 276717 - DNA, 20 bp, human
gggcccctggccagaatcat

SEQ ID NO: 276718 - DNA, 20 bp, human
gtccccgcccctccacggtt

SEQ ID NO: 276719 - DNA, 20 bp, human
gaagcctaaccgtggagggg

SEQ ID NO: 276720 - DNA, 20 bp, human
gcatccgggctctctcacct

SEQ ID NO: 276721 - DNA, 20 bp, human
gcagcggcagaaagcctcgt

SEQ ID NO: 276722 - DNA, 20 bp, human
gttccccagggtatacaaag

SEQ ID NO: 276723 - DNA, 20 bp, human
ggccgtgcgcgctgcctacg

SEQ ID NO: 276724 - DNA, 20 bp, human
ggcacaggagggaggcgacg

SEQ ID NO: 276725 - DNA, 20 bp, human
gaacaagcctaaccgtggag

SEQ ID NO: 276726 - DNA, 20 bp, human
gaagcaaacaagaggaacga

SEQ ID NO: 276727 - DNA, 20 bp, human
gctcttgtttgcttggagac

SEQ ID NO: 276728 - DNA, 20 bp, human
gtggtggtcggcttcatgtt

SEQ ID NO: 276729 - DNA, 20 bp, human
gtgggctttaaattggaaac

SEQ ID NO: 276730 - DNA, 20 bp, human
ggcttacagtggtacacaat

SEQ ID NO: 276731 - DNA, 20 bp, human
gtgggaagctccaacagcag

SEQ ID NO: 276732 - DNA, 20 bp, human
gggaattacgggttggtggt

SEQ ID NO: 276733 - DNA, 20 bp, human
gggaaagcccagattcccgt

SEQ ID NO: 276734 - DNA, 20 bp, human
gaatctgggctttcccactc

SEQ ID NO: 276735 - DNA, 20 bp, human
gtggtcggcttcatgttagg

SEQ ID NO: 276736 - DNA, 20 bp, human
ggagacccacagtgaagggg

SEQ ID NO: 276737 - DNA, 20 bp, human
gccagcggagacaactcgca

SEQ ID NO: 276738 - DNA, 20 bp, human
gggaggagacccacagtgaa

SEQ ID NO: 276739 - DNA, 20 bp, human
ggaaaacgggcttctcgcag

SEQ ID NO: 276740 - DNA, 20 bp, human
ggggcgcctggcgactctgc

SEQ ID NO: 276741 - DNA, 20 bp, human
gggcgcgaggagcctcagcg

SEQ ID NO: 276742 - DNA, 20 bp, human
gggcttctcgcagaggaggc

SEQ ID NO: 276743 - DNA, 20 bp, human
gttggctaccgagtcggttg

SEQ ID NO: 276744 - DNA, 20 bp, human
ggagttgtctccgctgggag

SEQ ID NO: 276745 - DNA, 20 bp, human
gggcgaggctgtcacttgcc

SEQ ID NO: 276746 - DNA, 20 bp, human
gtggctagaagaaatgaggt

SEQ ID NO: 276747 - DNA, 20 bp, human
gaacaaagtcacgtggtggg

SEQ ID NO: 276748 - DNA, 20 bp, human
gcctggcaaaacatattcaa

SEQ ID NO: 276749 - DNA, 20 bp, human
ggatttgtgacatcagagga

SEQ ID NO: 276750 - DNA, 20 bp, human
gtacttggctagaagaaatg

SEQ ID NO: 276751 - DNA, 20 bp, human
gcaaggaggaagagcccggt

SEQ ID NO: 276752 - DNA, 20 bp, human
gtaaactgatacatcataaa

SEQ ID NO: 276753 - DNA, 20 bp, human
gagggaagaaaactcaaaca

SEQ ID NO: 276754 - DNA, 20 bp, human
gaccaacaaagtcacgtggt

SEQ ID NO: 276755 - DNA, 20 bp, human
gaatgctaattaattctccc

SEQ ID NO: 276756 - DNA, 20 bp, human
ggaaacttccgcaatgttct

SEQ ID NO: 276757 - DNA, 20 bp, human
gtgctagtggtgtgagtcat

SEQ ID NO: 276758 - DNA, 20 bp, human
ggaggggcgcggcggttgcc

SEQ ID NO: 276759 - DNA, 20 bp, human
gaaccaccacagcgtcagaa

SEQ ID NO: 276760 - DNA, 20 bp, human
gggaatccagctagtggtaa

SEQ ID NO: 276761 - DNA, 20 bp, human
gggaccttcagtgactggag

SEQ ID NO: 276762 - DNA, 20 bp, human
gtgggagggcttttgtctcc

SEQ ID NO: 276763 - DNA, 20 bp, human
gagaaacagactgggtggtc

SEQ ID NO: 276764 - DNA, 20 bp, human
gaactgaggtaatacctccc

SEQ ID NO: 276765 - DNA, 20 bp, human
gccgctcctttctgacgctg

SEQ ID NO: 276766 - DNA, 20 bp, human
gcgggtagtgggtcgaatgt

SEQ ID NO: 276767 - DNA, 20 bp, human
ggggacgaagctagacgccg

SEQ ID NO: 276768 - DNA, 20 bp, human
gactacccgcgagagaaatg

SEQ ID NO: 276769 - DNA, 20 bp, human
gactgccagcggagagtccg

SEQ ID NO: 276770 - DNA, 20 bp, human
gggaagtcccgccctcacgg

SEQ ID NO: 276771 - DNA, 20 bp, human
ggaagctagacgccgagggg

SEQ ID NO: 276772 - DNA, 20 bp, human
gagtccgcgggaggtggctt

SEQ ID NO: 276773 - DNA, 20 bp, human
gccagtgagggtagaggcgg

SEQ ID NO: 276774 - DNA, 20 bp, human
ggggcgggacttcctctcgt

SEQ ID NO: 276775 - DNA, 20 bp, human
ggaaacggcgagccaacgag

SEQ ID NO: 276776 - DNA, 20 bp, human
ggtcctgagaaaaaagggga

SEQ ID NO: 276777 - DNA, 20 bp, human
gtgccccgtagtaggaggtg

SEQ ID NO: 276778 - DNA, 20 bp, human
gcgggctgccccgtagtagg

SEQ ID NO: 276779 - DNA, 20 bp, human
ggggcgtcgcgcgaaggcta

SEQ ID NO: 276780 - DNA, 20 bp, human
gtggaggcgtagaaagaatg

SEQ ID NO: 276781 - DNA, 20 bp, human
gaacgcgtcctgagaaaaaa

SEQ ID NO: 276782 - DNA, 20 bp, human
gcgcgacgcccactgagctc

SEQ ID NO: 276783 - DNA, 20 bp, human
gtctaccacacctcctacta

SEQ ID NO: 276784 - DNA, 20 bp, human
ggtaggaggtgtggtagaac

SEQ ID NO: 276785 - DNA, 20 bp, human
gggaggtgtggtagaactgg

SEQ ID NO: 276786 - DNA, 20 bp, human
ggaacttgagagaccagatc

SEQ ID NO: 276787 - DNA, 20 bp, human
ggaataaatagatgccaaga

SEQ ID NO: 276788 - DNA, 20 bp, human
gtccttgaatctagtaaatg

SEQ ID NO: 276789 - DNA, 20 bp, human
gcatcacatgatcctccccg

SEQ ID NO: 276790 - DNA, 20 bp, human
gaattaaatacagggcctcg

SEQ ID NO: 276791 - DNA, 20 bp, human
gtaagcggcactgcctgatc

SEQ ID NO: 276792 - DNA, 20 bp, human
gtggtaaagaatattgagcc

SEQ ID NO: 276793 - DNA, 20 bp, human
gtccacatttactagattca

SEQ ID NO: 276794 - DNA, 20 bp, human
gctctattttaattaaatac

SEQ ID NO: 276795 - DNA, 20 bp, human
gatattgaaatagagtctat

SEQ ID NO: 276796 - DNA, 20 bp, human
gtggaagggctcctgtgatc

SEQ ID NO: 276797 - DNA, 20 bp, human
gggcacggccgcctgatcac

SEQ ID NO: 276798 - DNA, 20 bp, human
gtgaaagagcacggggagta

SEQ ID NO: 276799 - DNA, 20 bp, human
ggcagcgccaccgtgtggaa

SEQ ID NO: 276800 - DNA, 20 bp, human
ggaagggcactcctgtaagg

SEQ ID NO: 276801 - DNA, 20 bp, human
ggacctgagcaggtgtctcc

SEQ ID NO: 276802 - DNA, 20 bp, human
ggaacactgtggtaagggcg

SEQ ID NO: 276803 - DNA, 20 bp, human
gaagggctcctgtgatcagg

SEQ ID NO: 276804 - DNA, 20 bp, human
gggtcacccaagacctgagc

SEQ ID NO: 276805 - DNA, 20 bp, human
gcaggagcccttccacacgg

SEQ ID NO: 276806 - DNA, 20 bp, human
ggcagaacagctagtagcag

SEQ ID NO: 276807 - DNA, 20 bp, human
gtacccagacaaaggagggc

SEQ ID NO: 276808 - DNA, 20 bp, human
gtgtagagaagaatgatgtt

SEQ ID NO: 276809 - DNA, 20 bp, human
gcaaaagcctacccagacaa

SEQ ID NO: 276810 - DNA, 20 bp, human
gaatttttatggaggggggt

SEQ ID NO: 276811 - DNA, 20 bp, human
ggcagactgaaaatcggtaa

SEQ ID NO: 276812 - DNA, 20 bp, human
gactgaaaatcggtaatgga

SEQ ID NO: 276813 - DNA, 20 bp, human
gttcttacacaaacataggc

SEQ ID NO: 276814 - DNA, 20 bp, human
gacccagccctcctttgtct

SEQ ID NO: 276815 - DNA, 20 bp, human
gtctgctgcagactgaaaat

SEQ ID NO: 276816 - DNA, 20 bp, human
gctggcgaaggcgaacaggt

SEQ ID NO: 276817 - DNA, 20 bp, human
gaaccagggccgtgcagaag

SEQ ID NO: 276818 - DNA, 20 bp, human
ggacgctggcgaaggcgaac

SEQ ID NO: 276819 - DNA, 20 bp, human
gtgttgaggggccagaagag

SEQ ID NO: 276820 - DNA, 20 bp, human
ggaggtggccaccacccagg

SEQ ID NO: 276821 - DNA, 20 bp, human
gaggtgggtgaggctaacca

SEQ ID NO: 276822 - DNA, 20 bp, human
gtccactgacaccacgacaa

SEQ ID NO: 276823 - DNA, 20 bp, human
gctgctgcagatttcgctcg

SEQ ID NO: 276824 - DNA, 20 bp, human
gcagcaggtcggtgacgagg

SEQ ID NO: 276825 - DNA, 20 bp, human
gagggcgtgagacaggttgc

SEQ ID NO: 276826 - DNA, 20 bp, human
gaaaacgaccacagggtcag

SEQ ID NO: 276827 - DNA, 20 bp, human
gcacaggagcggccgatcga

SEQ ID NO: 276828 - DNA, 20 bp, human
gtccggggacccctgatctc

SEQ ID NO: 276829 - DNA, 20 bp, human
ggcgacctaggaagtcgtcg

SEQ ID NO: 276830 - DNA, 20 bp, human
gcacctcggggcccttcgat

SEQ ID NO: 276831 - DNA, 20 bp, human
gtcactgagcgttgactcgg

SEQ ID NO: 276832 - DNA, 20 bp, human
gtgtgtcagccgcacggtgt

SEQ ID NO: 276833 - DNA, 20 bp, human
ggctccccgggcccttccgg

SEQ ID NO: 276834 - DNA, 20 bp, human
ggcccacgtccggggtgaaa

SEQ ID NO: 276835 - DNA, 20 bp, human
gcctctcccgcccacgtccg

SEQ ID NO: 276836 - DNA, 20 bp, human
gggacagcaccggttccgaa

SEQ ID NO: 276837 - DNA, 20 bp, human
ggtcccggacagttaagagt

SEQ ID NO: 276838 - DNA, 20 bp, human
gcggctctcccattcggaac

SEQ ID NO: 276839 - DNA, 20 bp, human
gcgcctgcttgcgtcaccga

SEQ ID NO: 276840 - DNA, 20 bp, human
gcggaaccggtgctgtccgt

SEQ ID NO: 276841 - DNA, 20 bp, human
gcggagaggcaattgctgat

SEQ ID NO: 276842 - DNA, 20 bp, human
gcgtcaccgacggacagcac

SEQ ID NO: 276843 - DNA, 20 bp, human
gcgggcttgggcgccagagg

SEQ ID NO: 276844 - DNA, 20 bp, human
gacgcaagcaggcgggcttg

SEQ ID NO: 276845 - DNA, 20 bp, human
ggcaattgctgattggttgg

SEQ ID NO: 276846 - DNA, 20 bp, human
gtgggagagaaaagctctag

SEQ ID NO: 276847 - DNA, 20 bp, human
gcccgcttaaagtcactatc

SEQ ID NO: 276848 - DNA, 20 bp, human
gtctcccagcagacataaat

SEQ ID NO: 276849 - DNA, 20 bp, human
gtgtgcaggtagacaagcct

SEQ ID NO: 276850 - DNA, 20 bp, human
gtcctgtggggcagaaataa

SEQ ID NO: 276851 - DNA, 20 bp, human
gacccagtgtgttcagaggt

SEQ ID NO: 276852 - DNA, 20 bp, human
ggagaggtgggtaattcctg

SEQ ID NO: 276853 - DNA, 20 bp, human
gttaaagtcactatcaggtc

SEQ ID NO: 276854 - DNA, 20 bp, human
gctgggtggggtagtaccaa

SEQ ID NO: 276855 - DNA, 20 bp, human
ggaaaagctctaggggaatg

SEQ ID NO: 276856 - DNA, 20 bp, human
gggactctcacaaaaagcaa

SEQ ID NO: 276857 - DNA, 20 bp, human
gaagactgtggtggcagcac

SEQ ID NO: 276858 - DNA, 20 bp, human
gagtgggaggggcaatgcac

SEQ ID NO: 276859 - DNA, 20 bp, human
gtcacaccaggtgacagacg

SEQ ID NO: 276860 - DNA, 20 bp, human
ggcacaggatgtgtgatgca

SEQ ID NO: 276861 - DNA, 20 bp, human
ggagaccgataggaatgatt

SEQ ID NO: 276862 - DNA, 20 bp, human
gaggctcctgtcttgggcaa

SEQ ID NO: 276863 - DNA, 20 bp, human
gagagtccgcgtctgtcacc

SEQ ID NO: 276864 - DNA, 20 bp, human
gtgagcctaaagatgaaatt

SEQ ID NO: 276865 - DNA, 20 bp, human
gccccaagcagaggcacttg

SEQ ID NO: 276866 - DNA, 20 bp, human
ggcggcttgtagcacgtcat

SEQ ID NO: 276867 - DNA, 20 bp, human
ggaaagagccctcaaattaa

SEQ ID NO: 276868 - DNA, 20 bp, human
gcaataacccattaatttga

SEQ ID NO: 276869 - DNA, 20 bp, human
ggctggcttcaccttacaga

SEQ ID NO: 276870 - DNA, 20 bp, human
gtctttcccagttttcacta

SEQ ID NO: 276871 - DNA, 20 bp, human
gcgggtagatcctctttttg

SEQ ID NO: 276872 - DNA, 20 bp, human
ggtgtcattacagcccctta

SEQ ID NO: 276873 - DNA, 20 bp, human
gtccagtgagggtaaatagc

SEQ ID NO: 276874 - DNA, 20 bp, human
ggtacttgtttacttgacta

SEQ ID NO: 276875 - DNA, 20 bp, human
gttatggggcttattgatcc

SEQ ID NO: 276876 - DNA, 20 bp, human
gtggacaacagcagtgtcgg

SEQ ID NO: 276877 - DNA, 20 bp, human
ggatgggcggggagaagcgt

SEQ ID NO: 276878 - DNA, 20 bp, human
gtctccccgcccatcgaggg

SEQ ID NO: 276879 - DNA, 20 bp, human
ggacactgctgttgtccaat

SEQ ID NO: 276880 - DNA, 20 bp, human
gctagcaaccccccctcgat

SEQ ID NO: 276881 - DNA, 20 bp, human
gcactgagaggcggccgaag

SEQ ID NO: 276882 - DNA, 20 bp, human
ggcttctccccgcccatcga

SEQ ID NO: 276883 - DNA, 20 bp, human
gttgcctgatccacgccgat

SEQ ID NO: 276884 - DNA, 20 bp, human
ggcggctacgcgtgcgcggt

SEQ ID NO: 276885 - DNA, 20 bp, human
ggctacgcgtgcgcggtggg

SEQ ID NO: 276886 - DNA, 20 bp, human
gtacggggtgataccctcaa

SEQ ID NO: 276887 - DNA, 20 bp, human
gggaagtcgggaggcgtctg

SEQ ID NO: 276888 - DNA, 20 bp, human
gaagtagctgcagactctac

SEQ ID NO: 276889 - DNA, 20 bp, human
gtaccctcaaagggtgacca

SEQ ID NO: 276890 - DNA, 20 bp, human
ggggtcttgcgcactgcata

SEQ ID NO: 276891 - DNA, 20 bp, human
gtccttgagcacctccacag

SEQ ID NO: 276892 - DNA, 20 bp, human
ggtcgggaggcgtctgtggg

SEQ ID NO: 276893 - DNA, 20 bp, human
gatgccctggtcaccctttg

SEQ ID NO: 276894 - DNA, 20 bp, human
gggcatgaccgacagctcga

SEQ ID NO: 276895 - DNA, 20 bp, human
gaagtgagagtgtggtgcct

SEQ ID NO: 276896 - DNA, 20 bp, human
gcactgggataattggaagg

SEQ ID NO: 276897 - DNA, 20 bp, human
gctgcactgggataattgga

SEQ ID NO: 276898 - DNA, 20 bp, human
gcatgcaatcatctgagata

SEQ ID NO: 276899 - DNA, 20 bp, human
gtctgctgcactgggataat

SEQ ID NO: 276900 - DNA, 20 bp, human
gcacgcctaagagaaattac

SEQ ID NO: 276901 - DNA, 20 bp, human
ggacactgtgtccacttgtg

SEQ ID NO: 276902 - DNA, 20 bp, human
ggtgcttcatggacccatag

SEQ ID NO: 276903 - DNA, 20 bp, human
gtaatggatttgcttcagac

SEQ ID NO: 276904 - DNA, 20 bp, human
gtctgtgattcactccacta

SEQ ID NO: 276905 - DNA, 20 bp, human
gtgcacaagccttgaaactg

SEQ ID NO: 276906 - DNA, 20 bp, human
gcaggctccctagaggaaac

SEQ ID NO: 276907 - DNA, 20 bp, human
gaaacaggaaacttgtcctc

SEQ ID NO: 276908 - DNA, 20 bp, human
gaagtttcctgtttcctcta

SEQ ID NO: 276909 - DNA, 20 bp, human
gaccccaggcaaggagctga

SEQ ID NO: 276910 - DNA, 20 bp, human
gacgggagacactgactgac

SEQ ID NO: 276911 - DNA, 20 bp, human
gggcatcaggcaccaaatat

SEQ ID NO: 276912 - DNA, 20 bp, human
gggcccatcagctccttgcc

SEQ ID NO: 276913 - DNA, 20 bp, human
gttacagagcagctgatgac

SEQ ID NO: 276914 - DNA, 20 bp, human
gatcaggaggccaccatccg

SEQ ID NO: 276915 - DNA, 20 bp, human
gaccccctaagctctgtctt

SEQ ID NO: 276916 - DNA, 20 bp, human
gccaagtggacagacttgtt

SEQ ID NO: 276917 - DNA, 20 bp, human
gccttcagatccttcttatc

SEQ ID NO: 276918 - DNA, 20 bp, human
gtagagctaatgagaagtac

SEQ ID NO: 276919 - DNA, 20 bp, human
gaaatcgcacacgccatccg

SEQ ID NO: 276920 - DNA, 20 bp, human
ggtctgtccacttggtggag

SEQ ID NO: 276921 - DNA, 20 bp, human
ggaaagaaaagtgagaacta

SEQ ID NO: 276922 - DNA, 20 bp, human
gatgagaagtacaggatgtc

SEQ ID NO: 276923 - DNA, 20 bp, human
gaggactaagcaacttctct

SEQ ID NO: 276924 - DNA, 20 bp, human
gcctggtcctcttccccgga

SEQ ID NO: 276925 - DNA, 20 bp, human
gttgaggtacagccctcccg

SEQ ID NO: 276926 - DNA, 20 bp, human
gtccctgaagcaccagtgaa

SEQ ID NO: 276927 - DNA, 20 bp, human
gagggacagggacattcatc

SEQ ID NO: 276928 - DNA, 20 bp, human
gggtgcttcagggactctgg

SEQ ID NO: 276929 - DNA, 20 bp, human
gacagcatgtacaggtactt

SEQ ID NO: 276930 - DNA, 20 bp, human
ggggactagctcagggccca

SEQ ID NO: 276931 - DNA, 20 bp, human
gctcccttcactggtgcttc

SEQ ID NO: 276932 - DNA, 20 bp, human
ggatcctagggatgagaaac

SEQ ID NO: 276933 - DNA, 20 bp, human
gactggtgcttcagggactc

SEQ ID NO: 276934 - DNA, 20 bp, human
gagtaacttgctggttggag

SEQ ID NO: 276935 - DNA, 20 bp, human
gatccctaggatctcagttg

SEQ ID NO: 276936 - DNA, 20 bp, human
gcgcgcgcccccacgggtca

SEQ ID NO: 276937 - DNA, 20 bp, human
gctagggtgcgggcaggcga

SEQ ID NO: 276938 - DNA, 20 bp, human
gggcctcgcggggatcccgc

SEQ ID NO: 276939 - DNA, 20 bp, human
ggaaaccacaggaacgaaat

SEQ ID NO: 276940 - DNA, 20 bp, human
gctagagcagccctgacccg

SEQ ID NO: 276941 - DNA, 20 bp, human
gcagggctgctctagggtgc

SEQ ID NO: 276942 - DNA, 20 bp, human
gggcgaggggcgaaggagcc

SEQ ID NO: 276943 - DNA, 20 bp, human
ggctgctctagggtgcgggc

SEQ ID NO: 276944 - DNA, 20 bp, human
gatgcggggtggacaggtta

SEQ ID NO: 276945 - DNA, 20 bp, human
gaggaacgaaataggtcaca

SEQ ID NO: 276946 - DNA, 20 bp, human
gcggcggcgttttcgggcga

SEQ ID NO: 276947 - DNA, 20 bp, human
gcgggcgagggtctggtgct

SEQ ID NO: 276948 - DNA, 20 bp, human
gggaccggggcgggcgatgg

SEQ ID NO: 276949 - DNA, 20 bp, human
gggcgcgtaaccatggggac

SEQ ID NO: 276950 - DNA, 20 bp, human
ggtaaccatggggaccgggg

SEQ ID NO: 276951 - DNA, 20 bp, human
ggcccgaaaacgccgccggg

SEQ ID NO: 276952 - DNA, 20 bp, human
gtggtgctggggagcgagcg

SEQ ID NO: 276953 - DNA, 20 bp, human
gtccgcccggcggcgttttc

SEQ ID NO: 276954 - DNA, 20 bp, human
gaggcaggcgcgtaaccatg

SEQ ID NO: 276955 - DNA, 20 bp, human
gacgctctgcagtgtgacgg

SEQ ID NO: 276956 - DNA, 20 bp, human
gacaagcgggagaggagtgt

SEQ ID NO: 276957 - DNA, 20 bp, human
gcctagaccctctgccgagt

SEQ ID NO: 276958 - DNA, 20 bp, human
gggagaggagtgttggtgca

SEQ ID NO: 276959 - DNA, 20 bp, human
gcggctcagaggtctgagat

SEQ ID NO: 276960 - DNA, 20 bp, human
gcagctggcccgcccccact

SEQ ID NO: 276961 - DNA, 20 bp, human
gaccctctgccgagtggggg

SEQ ID NO: 276962 - DNA, 20 bp, human
gtcggcagagggtctaggcc

SEQ ID NO: 276963 - DNA, 20 bp, human
ggggcgggccagctggttcg

SEQ ID NO: 276964 - DNA, 20 bp, human
ggcccgcccccactcggcag

SEQ ID NO: 276965 - DNA, 20 bp, human
gacgagggaaattttgtgga

SEQ ID NO: 276966 - DNA, 20 bp, human
gtggcccggaggatggagta

SEQ ID NO: 276967 - DNA, 20 bp, human
gccgggcagctgcagacacg

SEQ ID NO: 276968 - DNA, 20 bp, human
ggcagctgcccgggacctcg

SEQ ID NO: 276969 - DNA, 20 bp, human
gctgcagacacggggagagc

SEQ ID NO: 276970 - DNA, 20 bp, human
gcgagcgcggtggcggcgaa

SEQ ID NO: 276971 - DNA, 20 bp, human
gcgcgcgcgggtcctggcca

SEQ ID NO: 276972 - DNA, 20 bp, human
gagcggcgctgggacccatg

SEQ ID NO: 276973 - DNA, 20 bp, human
gccccacaactcctgcccgg

SEQ ID NO: 276974 - DNA, 20 bp, human
gctcgcgccgggcggtagag

SEQ ID NO: 276975 - DNA, 20 bp, human
gtggcccaaggagcctggcc

SEQ ID NO: 276976 - DNA, 20 bp, human
gagggggacccaagtaccta

SEQ ID NO: 276977 - DNA, 20 bp, human
ggggacccaagtacctaggg

SEQ ID NO: 276978 - DNA, 20 bp, human
ggggcggagcgcacgggtcc

SEQ ID NO: 276979 - DNA, 20 bp, human
gagcccagctccagtcacgc

SEQ ID NO: 276980 - DNA, 20 bp, human
gccgcggagcgcccagacca

SEQ ID NO: 276981 - DNA, 20 bp, human
ggagctgggctcaggtgcgg

SEQ ID NO: 276982 - DNA, 20 bp, human
gacccaagtacctagggtgg

SEQ ID NO: 276983 - DNA, 20 bp, human
ggagtcccgcctcccgccag

SEQ ID NO: 276984 - DNA, 20 bp, human
gaggaagtagggtgtgcgtg

SEQ ID NO: 276985 - DNA, 20 bp, human
ggccaccaccctaggtactt

SEQ ID NO: 276986 - DNA, 20 bp, human
gccgagccataggtgactac

SEQ ID NO: 276987 - DNA, 20 bp, human
ggaggaaatcacaaaggcag

SEQ ID NO: 276988 - DNA, 20 bp, human
gggaatagggagataactca

SEQ ID NO: 276989 - DNA, 20 bp, human
gtctctcggggaaatgaact

SEQ ID NO: 276990 - DNA, 20 bp, human
gatacaggaagccgagccat

SEQ ID NO: 276991 - DNA, 20 bp, human
gggttgccagtagtcaccta

SEQ ID NO: 276992 - DNA, 20 bp, human
gggggagggactagccacaa

SEQ ID NO: 276993 - DNA, 20 bp, human
gctcagggcaataaagaaga

SEQ ID NO: 276994 - DNA, 20 bp, human
gttcactctgtggcttgtct

SEQ ID NO: 276995 - DNA, 20 bp, human
gcacacaaaacactctctcg

SEQ ID NO: 276996 - DNA, 20 bp, human
gggctgccttagctagattg

SEQ ID NO: 276997 - DNA, 20 bp, human
ggctactagagtgtatccat

SEQ ID NO: 276998 - DNA, 20 bp, human
ggtggaaaactgagtggaca

SEQ ID NO: 276999 - DNA, 20 bp, human
gacaaggaaggatgcaaacg

SEQ ID NO: 277000 - DNA, 20 bp, human
gagtagccccaatctagcta

SEQ ID NO: 277001 - DNA, 20 bp, human
gtgtatccatgggccagcgc

SEQ ID NO: 277002 - DNA, 20 bp, human
gccagcctttcctgtttgac

SEQ ID NO: 277003 - DNA, 20 bp, human
ggtactttgtcctttacaca

SEQ ID NO: 277004 - DNA, 20 bp, human
gggttcactgtgtgttacaa

SEQ ID NO: 277005 - DNA, 20 bp, human
gttaatcaatcctgtcaaac

SEQ ID NO: 277006 - DNA, 20 bp, human
ggctaaaagaggtaagactg

SEQ ID NO: 277007 - DNA, 20 bp, human
gtggcctcgtcaccttcctg

SEQ ID NO: 277008 - DNA, 20 bp, human
gactcccctaaccacaaaca

SEQ ID NO: 277009 - DNA, 20 bp, human
gaggggttagccaaccgggc

SEQ ID NO: 277010 - DNA, 20 bp, human
gagccaggctccactcactc

SEQ ID NO: 277011 - DNA, 20 bp, human
gcagacaggcaaggcaggac

SEQ ID NO: 277012 - DNA, 20 bp, human
gtcgtcaccttcctgaggga

SEQ ID NO: 277013 - DNA, 20 bp, human
gccgggctggggtatcttac

SEQ ID NO: 277014 - DNA, 20 bp, human
gcggggtgccaggagtagag

SEQ ID NO: 277015 - DNA, 20 bp, human
ggggtcctggaaaggctgca

SEQ ID NO: 277016 - DNA, 20 bp, human
gcgtcctgctctctgggtgg

SEQ ID NO: 277017 - DNA, 20 bp, human
gccccctccacccagagagc

SEQ ID NO: 277018 - DNA, 20 bp, human
gaccaaacagacatggtgtg

SEQ ID NO: 277019 - DNA, 20 bp, human
gggtcagcgcttaatatgga

SEQ ID NO: 277020 - DNA, 20 bp, human
gtggtcagcaccttcaaagt

SEQ ID NO: 277021 - DNA, 20 bp, human
gttaatatggagggcacagt

SEQ ID NO: 277022 - DNA, 20 bp, human
gaccaggaggatgttctcaa

SEQ ID NO: 277023 - DNA, 20 bp, human
gaagagaatgaagttgacag

SEQ ID NO: 277024 - DNA, 20 bp, human
gcggacgtcagtgaaagcta

SEQ ID NO: 277025 - DNA, 20 bp, human
gtttgaaggtgctgaccaga

SEQ ID NO: 277026 - DNA, 20 bp, human
gcacccgggccggtaacctc

SEQ ID NO: 277027 - DNA, 20 bp, human
ggggccggtaacctccggag

SEQ ID NO: 277028 - DNA, 20 bp, human
ggaaacccgaacacccgggc

SEQ ID NO: 277029 - DNA, 20 bp, human
gtgccaggtcgacctcctga

SEQ ID NO: 277030 - DNA, 20 bp, human
ggtccctcaggaggtcgacc

SEQ ID NO: 277031 - DNA, 20 bp, human
gcgcgacaccgccactccgg

SEQ ID NO: 277032 - DNA, 20 bp, human
ggttaccggcccgggtgttc

SEQ ID NO: 277033 - DNA, 20 bp, human
gacgctggaacccacgtcaa

SEQ ID NO: 277034 - DNA, 20 bp, human
gacccgcgacaccgccactc

SEQ ID NO: 277035 - DNA, 20 bp, human
ggaggtcgacctggcactct

SEQ ID NO: 277036 - DNA, 20 bp, human
gcccgttgcccaagcaacta

SEQ ID NO: 277037 - DNA, 20 bp, human
gcggagcccggggtgctgga

SEQ ID NO: 277038 - DNA, 20 bp, human
ggggcctcgagatcgggctt

SEQ ID NO: 277039 - DNA, 20 bp, human
gacctctcggaacgtcactc

SEQ ID NO: 277040 - DNA, 20 bp, human
gggtcaggggcctcgagatc

SEQ ID NO: 277041 - DNA, 20 bp, human
gtgcccaagcaactagggcc

SEQ ID NO: 277042 - DNA, 20 bp, human
ggacgttccgagaggtgatt

SEQ ID NO: 277043 - DNA, 20 bp, human
ggctccgggccctagttgct

SEQ ID NO: 277044 - DNA, 20 bp, human
ggggtccaccggggttctga

SEQ ID NO: 277045 - DNA, 20 bp, human
gtccgagaggtgattgggcc

SEQ ID NO: 277046 - DNA, 20 bp, human
gcgcccggggttacgggagg

SEQ ID NO: 277047 - DNA, 20 bp, human
gcgggtgcggcgctggactg

SEQ ID NO: 277048 - DNA, 20 bp, human
ggggcgcccggggttacggg

SEQ ID NO: 277049 - DNA, 20 bp, human
ggggccgtgccgcatccagg

SEQ ID NO: 277050 - DNA, 20 bp, human
ggttacgggaggcggcagga

SEQ ID NO: 277051 - DNA, 20 bp, human
ggagggcggccgagttgcgg

SEQ ID NO: 277052 - DNA, 20 bp, human
gtggcgggcgcccggggtta

SEQ ID NO: 277053 - DNA, 20 bp, human
gctgccgcctcccgtaaccc

SEQ ID NO: 277054 - DNA, 20 bp, human
gggcccgcgcgggggattcg

SEQ ID NO: 277055 - DNA, 20 bp, human
ggctcgcgccaattctcgta

SEQ ID NO: 277056 - DNA, 20 bp, human
gaggaggcgtgcggctctgg

SEQ ID NO: 277057 - DNA, 20 bp, human
gagcgcgcggtggcgaggat

SEQ ID NO: 277058 - DNA, 20 bp, human
ggaaggcgcgcggtgcccgg

SEQ ID NO: 277059 - DNA, 20 bp, human
ggggcgggccggggttcgcg

SEQ ID NO: 277060 - DNA, 20 bp, human
gaggaggcgcgcggttctgg

SEQ ID NO: 277061 - DNA, 20 bp, human
ggggaagagacgcggggctc

SEQ ID NO: 277062 - DNA, 20 bp, human
ggcggtggcgaggatagggc

SEQ ID NO: 277063 - DNA, 20 bp, human
ggccgcgcgctacccgtccc

SEQ ID NO: 277064 - DNA, 20 bp, human
gggcgaggatagggcgggcc

SEQ ID NO: 277065 - DNA, 20 bp, human
ggctctgggggcgcgcactg

SEQ ID NO: 277066 - DNA, 20 bp, human
gtacaggggcgggagaaagt

SEQ ID NO: 277067 - DNA, 20 bp, human
gagggccccgagatctgatt

SEQ ID NO: 277068 - DNA, 20 bp, human
gacgcgcccaatcagatctc

SEQ ID NO: 277069 - DNA, 20 bp, human
gcgcaggacccgtcgctcga

SEQ ID NO: 277070 - DNA, 20 bp, human
gaacgggcggtgcagtagca

SEQ ID NO: 277071 - DNA, 20 bp, human
gtctcggggccctcgagcga

SEQ ID NO: 277072 - DNA, 20 bp, human
ggggtgggaagtacaggggc

SEQ ID NO: 277073 - DNA, 20 bp, human
gcagggccaatcagcagcgt

SEQ ID NO: 277074 - DNA, 20 bp, human
ggcgtgggtgggaagtacag

SEQ ID NO: 277075 - DNA, 20 bp, human
gcgccgcgctcggaaggcca

SEQ ID NO: 277076 - DNA, 20 bp, human
gaaagtggagccaagcgagg

SEQ ID NO: 277077 - DNA, 20 bp, human
gggactggaagcattggaga

SEQ ID NO: 277078 - DNA, 20 bp, human
ggaggagtgaggagccgctg

SEQ ID NO: 277079 - DNA, 20 bp, human
gccctcggggttggagattg

SEQ ID NO: 277080 - DNA, 20 bp, human
gccccgaaggaagaccggag

SEQ ID NO: 277081 - DNA, 20 bp, human
gttagacctgggagccccga

SEQ ID NO: 277082 - DNA, 20 bp, human
gctggaagcggagtgtgtgt

SEQ ID NO: 277083 - DNA, 20 bp, human
gcaaactgaggacacgctgg

SEQ ID NO: 277084 - DNA, 20 bp, human
gctcccgcctcaaagccggg

SEQ ID NO: 277085 - DNA, 20 bp, human
gagccccccggctttgaggc

SEQ ID NO: 277086 - DNA, 20 bp, human
ggagccctaagttaccagtg

SEQ ID NO: 277087 - DNA, 20 bp, human
gaaactgtgtattgttcttc

SEQ ID NO: 277088 - DNA, 20 bp, human
gtgtgctataggggcagggg

SEQ ID NO: 277089 - DNA, 20 bp, human
gggacagctcaccaagcaaa

SEQ ID NO: 277090 - DNA, 20 bp, human
ggagtgtgctataggggcag

SEQ ID NO: 277091 - DNA, 20 bp, human
gtaaaatcagagtgtgctat

SEQ ID NO: 277092 - DNA, 20 bp, human
gaatggcattgactgggata

SEQ ID NO: 277093 - DNA, 20 bp, human
gtcttaaacatgagtagtcc

SEQ ID NO: 277094 - DNA, 20 bp, human
ggtgaggtatagagcaactc

SEQ ID NO: 277095 - DNA, 20 bp, human
gtatacctcactggtaactt

SEQ ID NO: 277096 - DNA, 20 bp, human
ggtaggctgctagcccacgg

SEQ ID NO: 277097 - DNA, 20 bp, human
gtcagaggtgactgccttag

SEQ ID NO: 277098 - DNA, 20 bp, human
ggaagggatcctatccacta

SEQ ID NO: 277099 - DNA, 20 bp, human
gtggtgtcagtgaccagggt

SEQ ID NO: 277100 - DNA, 20 bp, human
gggtgtggtgtcagtgacca

SEQ ID NO: 277101 - DNA, 20 bp, human
ggctgctagcccacggtgga

SEQ ID NO: 277102 - DNA, 20 bp, human
gagggtaggctgctagccca

SEQ ID NO: 277103 - DNA, 20 bp, human
gataggatcccttccaccgt

SEQ ID NO: 277104 - DNA, 20 bp, human
gcactgacaccacaccatgt

SEQ ID NO: 277105 - DNA, 20 bp, human
ggggcctctcacctctgtat

SEQ ID NO: 277106 - DNA, 20 bp, human
ggcctcacgaggtgatgctt

SEQ ID NO: 277107 - DNA, 20 bp, human
ggcaggtttggcgctctagg

SEQ ID NO: 277108 - DNA, 20 bp, human
gtcacgaggtgatgcttggg

SEQ ID NO: 277109 - DNA, 20 bp, human
gcagtagagccaggctcggt

SEQ ID NO: 277110 - DNA, 20 bp, human
gccaggaaggcttggtgaat

SEQ ID NO: 277111 - DNA, 20 bp, human
gtctagaagaccagtaaaga

SEQ ID NO: 277112 - DNA, 20 bp, human
gaggaaagatctagtccacg

SEQ ID NO: 277113 - DNA, 20 bp, human
gaggtggcagagaaaccacc

SEQ ID NO: 277114 - DNA, 20 bp, human
gaacgccacgaggcctcacg

SEQ ID NO: 277115 - DNA, 20 bp, human
gtggacaaccatctctactt

SEQ ID NO: 277116 - DNA, 20 bp, human
gctgaacccgcccatgtcta

SEQ ID NO: 277117 - DNA, 20 bp, human
gctggtgttcgacgagagga

SEQ ID NO: 277118 - DNA, 20 bp, human
ggggccccaggttggtatga

SEQ ID NO: 277119 - DNA, 20 bp, human
ggaagcaagaaccccatcag

SEQ ID NO: 277120 - DNA, 20 bp, human
gtggccaaactgctgctcgc

SEQ ID NO: 277121 - DNA, 20 bp, human
gtggcactgcagccccctga

SEQ ID NO: 277122 - DNA, 20 bp, human
gggactgggaccctccctgg

SEQ ID NO: 277123 - DNA, 20 bp, human
gcaactgcaagtgtgagggg

SEQ ID NO: 277124 - DNA, 20 bp, human
ggcgtcggggcttgactctt

SEQ ID NO: 277125 - DNA, 20 bp, human
gtcgcagggcctggtatggt

SEQ ID NO: 277126 - DNA, 20 bp, human
gggaaccgctcggaccagtg

SEQ ID NO: 277127 - DNA, 20 bp, human
gtggtccgagcggttccccg

SEQ ID NO: 277128 - DNA, 20 bp, human
gtagaccgcggggaaccgct

SEQ ID NO: 277129 - DNA, 20 bp, human
gccctcgcggctagaccgcg

SEQ ID NO: 277130 - DNA, 20 bp, human
gccaacctcactggtccgag

SEQ ID NO: 277131 - DNA, 20 bp, human
gctcgtgcgagattccctgt

SEQ ID NO: 277132 - DNA, 20 bp, human
gtgtgtacacagggcccggg

SEQ ID NO: 277133 - DNA, 20 bp, human
gcggtctagccgcgagggcg

SEQ ID NO: 277134 - DNA, 20 bp, human
gctcgcacgagttcgtcaaa

SEQ ID NO: 277135 - DNA, 20 bp, human
gtccccgcggtctagccgcg

SEQ ID NO: 277136 - DNA, 20 bp, human
ggggcggtggcgcctgccaa

SEQ ID NO: 277137 - DNA, 20 bp, human
gcggtggcgcctgccaaggg

SEQ ID NO: 277138 - DNA, 20 bp, human
gcctgcggggaacttaccag

SEQ ID NO: 277139 - DNA, 20 bp, human
gctgcccccaggctctcggt

SEQ ID NO: 277140 - DNA, 20 bp, human
gcgcctgcgcgtgcgtgtga

SEQ ID NO: 277141 - DNA, 20 bp, human
gccctcctgctgtttacagc

SEQ ID NO: 277142 - DNA, 20 bp, human
gcgcctgccaagggaggcag

SEQ ID NO: 277143 - DNA, 20 bp, human
ggaacccggctgtaaacagc

SEQ ID NO: 277144 - DNA, 20 bp, human
gagaaacgaggggccgtgct

SEQ ID NO: 277145 - DNA, 20 bp, human
ggcccctcgtttctggaacc

SEQ ID NO: 277146 - DNA, 20 bp, human
gtgtgcagctgcatgtgcgt

SEQ ID NO: 277147 - DNA, 20 bp, human
gtgagccaagcagacaggtt

SEQ ID NO: 277148 - DNA, 20 bp, human
gccgggctgccctcctagaa

SEQ ID NO: 277149 - DNA, 20 bp, human
gagataggggacacttctgg

SEQ ID NO: 277150 - DNA, 20 bp, human
ggctcacagggagtgtgcaa

SEQ ID NO: 277151 - DNA, 20 bp, human
ggcccccaaacctgtctgct

SEQ ID NO: 277152 - DNA, 20 bp, human
ggactgcaaaatggtggcag

SEQ ID NO: 277153 - DNA, 20 bp, human
ggaagtgtcccctatctcag

SEQ ID NO: 277154 - DNA, 20 bp, human
gggggtcagtgactgcaaaa

SEQ ID NO: 277155 - DNA, 20 bp, human
ggctcgacagaggtcagacc

SEQ ID NO: 277156 - DNA, 20 bp, human
gctgcagctccgaggatcac

SEQ ID NO: 277157 - DNA, 20 bp, human
ggatcctcggagctgcagga

SEQ ID NO: 277158 - DNA, 20 bp, human
gaaagcagtcccttagttac

SEQ ID NO: 277159 - DNA, 20 bp, human
gaagctactccagtaactaa

SEQ ID NO: 277160 - DNA, 20 bp, human
gcctccttcctgcagctccg

SEQ ID NO: 277161 - DNA, 20 bp, human
gactctttcaaagcaagaaa

SEQ ID NO: 277162 - DNA, 20 bp, human
gggaggagtcagctccaagc

SEQ ID NO: 277163 - DNA, 20 bp, human
gacatctgactcttatgcat

SEQ ID NO: 277164 - DNA, 20 bp, human
gagtagcttagacctctcac

SEQ ID NO: 277165 - DNA, 20 bp, human
ggatgatattcttcctccaa

SEQ ID NO: 277166 - DNA, 20 bp, human
gcactctgattggtgttggt

SEQ ID NO: 277167 - DNA, 20 bp, human
gaagcaaaggaggtctttaa

SEQ ID NO: 277168 - DNA, 20 bp, human
ggcaccactctgattggtgt

SEQ ID NO: 277169 - DNA, 20 bp, human
ggattggtgttggttggttg

SEQ ID NO: 277170 - DNA, 20 bp, human
ggcatttgctcgtgaaactg

SEQ ID NO: 277171 - DNA, 20 bp, human
gttgtatactggtatgattt

SEQ ID NO: 277172 - DNA, 20 bp, human
gccaagatctttaaagggag

SEQ ID NO: 277173 - DNA, 20 bp, human
ggtttgacctagttgtatac

SEQ ID NO: 277174 - DNA, 20 bp, human
gatcttctatgtgaaacaga

SEQ ID NO: 277175 - DNA, 20 bp, human
ggtttgtccaagatctttaa

SEQ ID NO: 277176 - DNA, 20 bp, human
ggggtccgcggcttccgcga

SEQ ID NO: 277177 - DNA, 20 bp, human
ggcccccgacgctaccctcg

SEQ ID NO: 277178 - DNA, 20 bp, human
gtccgcgagggtagcgtcgg

SEQ ID NO: 277179 - DNA, 20 bp, human
gcgcggggaaggtggagaat

SEQ ID NO: 277180 - DNA, 20 bp, human
ggcttccgcgagggtagcgt

SEQ ID NO: 277181 - DNA, 20 bp, human
ggctaccctcgcggaagccg

SEQ ID NO: 277182 - DNA, 20 bp, human
gggaatgggagggaagacgc

SEQ ID NO: 277183 - DNA, 20 bp, human
ggaagagtacccgccgggaa

SEQ ID NO: 277184 - DNA, 20 bp, human
gcttccctcccattcccggc

SEQ ID NO: 277185 - DNA, 20 bp, human
gatgaggttctcagcgccca

SEQ ID NO: 277186 - DNA, 20 bp, human
ggtaccgactgtcagatagc

SEQ ID NO: 277187 - DNA, 20 bp, human
gtggctctagtgacccccca

SEQ ID NO: 277188 - DNA, 20 bp, human
ggggtcactagagccagtca

SEQ ID NO: 277189 - DNA, 20 bp, human
ggaagctcatctctgcagag

SEQ ID NO: 277190 - DNA, 20 bp, human
gatctctgcagagtgggtag

SEQ ID NO: 277191 - DNA, 20 bp, human
gtggccggatccagtgggtc

SEQ ID NO: 277192 - DNA, 20 bp, human
gctccacagggctgacgatt

SEQ ID NO: 277193 - DNA, 20 bp, human
gtatatttgtattactccac

SEQ ID NO: 277194 - DNA, 20 bp, human
gtaccaaatcgtcagccctg

SEQ ID NO: 277195 - DNA, 20 bp, human
gcccactggatccggccatc

SEQ ID NO: 277196 - DNA, 20 bp, human
gctatgccaaggacttgaag

SEQ ID NO: 277197 - DNA, 20 bp, human
gaaggtgatgacaatggcgc

SEQ ID NO: 277198 - DNA, 20 bp, human
gggtgtgaatgaccgagtat

SEQ ID NO: 277199 - DNA, 20 bp, human
gagaatcagtgaaggtagga

SEQ ID NO: 277200 - DNA, 20 bp, human
ggtcatccacttcaagtcct

SEQ ID NO: 277201 - DNA, 20 bp, human
gaaaagtctgggttgagccc

SEQ ID NO: 277202 - DNA, 20 bp, human
ggtgcctggtgaatcaatga

SEQ ID NO: 277203 - DNA, 20 bp, human
gctgtaaagtagattgtatg

SEQ ID NO: 277204 - DNA, 20 bp, human
gcataggataattactcaaa

SEQ ID NO: 277205 - DNA, 20 bp, human
ggagtaattatcctatgcca

SEQ ID NO: 277206 - DNA, 20 bp, human
gcgggcggacgcggggacac

SEQ ID NO: 277207 - DNA, 20 bp, human
gcagaggcgcggccgtctgt

SEQ ID NO: 277208 - DNA, 20 bp, human
gcgggtgggctgcgtacgga

SEQ ID NO: 277209 - DNA, 20 bp, human
gagggcgcatgtctccgccg

SEQ ID NO: 277210 - DNA, 20 bp, human
gggccggcccgagcctccct

SEQ ID NO: 277211 - DNA, 20 bp, human
gagacggccgcgcctctgag

SEQ ID NO: 277212 - DNA, 20 bp, human
ggacacgggtgggctgcgta

SEQ ID NO: 277213 - DNA, 20 bp, human
gccccgcccgctcagaggcg

SEQ ID NO: 277214 - DNA, 20 bp, human
gttgccccggcgtccgaagg

SEQ ID NO: 277215 - DNA, 20 bp, human
ggcccggcgcagcagcggag

SEQ ID NO: 277216 - DNA, 20 bp, human
gtaccctggggctccgaggc

SEQ ID NO: 277217 - DNA, 20 bp, human
ggggaggctcccagccggca

SEQ ID NO: 277218 - DNA, 20 bp, human
gagggcgggacggagactct

SEQ ID NO: 277219 - DNA, 20 bp, human
ggtcccgccccggaggatcg

SEQ ID NO: 277220 - DNA, 20 bp, human
ggggaagcggcccgtcttgc

SEQ ID NO: 277221 - DNA, 20 bp, human
gccgtcttgctggaagttcg

SEQ ID NO: 277222 - DNA, 20 bp, human
ggggcggggccgggtaccct

SEQ ID NO: 277223 - DNA, 20 bp, human
gtgagctgacagggccgcat

SEQ ID NO: 277224 - DNA, 20 bp, human
ggctcccagccggcagggcg

SEQ ID NO: 277225 - DNA, 20 bp, human
gtcccagccgcgatcctccg

SEQ ID NO: 277226 - DNA, 20 bp, human
ggggactcggcggcgacgca

SEQ ID NO: 277227 - DNA, 20 bp, human
gcgaccctgctctcccgcga

SEQ ID NO: 277228 - DNA, 20 bp, human
gtctcccgcgagggccggga

SEQ ID NO: 277229 - DNA, 20 bp, human
gacgcaaggagaaagatccg

SEQ ID NO: 277230 - DNA, 20 bp, human
ggtcgccgccgagtcccctg

SEQ ID NO: 277231 - DNA, 20 bp, human
gggaaggcgccccccaggga

SEQ ID NO: 277232 - DNA, 20 bp, human
ggaggcgcgtggagtctgca

SEQ ID NO: 277233 - DNA, 20 bp, human
gtctctgaggagacggccgg

SEQ ID NO: 277234 - DNA, 20 bp, human
ggctggctcgaggcccggga

SEQ ID NO: 277235 - DNA, 20 bp, human
gaatctgaagctcctcgccc

SEQ ID NO: 277236 - DNA, 20 bp, human
gcgccccgcccctatatccc

SEQ ID NO: 277237 - DNA, 20 bp, human
ggctcagggcccgggatata

SEQ ID NO: 277238 - DNA, 20 bp, human
gcggggcaacgggacgagga

SEQ ID NO: 277239 - DNA, 20 bp, human
ggccgggggacgtgtgtccg

SEQ ID NO: 277240 - DNA, 20 bp, human
gggaagggcatgtgggccgg

SEQ ID NO: 277241 - DNA, 20 bp, human
gaaaggccggggtaccgggg

SEQ ID NO: 277242 - DNA, 20 bp, human
ggtgtggcggggtgcgtggg

SEQ ID NO: 277243 - DNA, 20 bp, human
gtggagcttggaagcctcag

SEQ ID NO: 277244 - DNA, 20 bp, human
gtgtccggggctcggattgt

SEQ ID NO: 277245 - DNA, 20 bp, human
gccacagggcccagagacct

SEQ ID NO: 277246 - DNA, 20 bp, human
ggggagaagcagagattcgg

SEQ ID NO: 277247 - DNA, 20 bp, human
ggcagtcggctgattgacag

SEQ ID NO: 277248 - DNA, 20 bp, human
gacttgcagccgccctacaa

SEQ ID NO: 277249 - DNA, 20 bp, human
ggccgcctcgggttcagcac

SEQ ID NO: 277250 - DNA, 20 bp, human
gaaacctgcgtgggtggcgt

SEQ ID NO: 277251 - DNA, 20 bp, human
gctgtccagtgctgaacccg

SEQ ID NO: 277252 - DNA, 20 bp, human
ggaggaaagccagtttaaag

SEQ ID NO: 277253 - DNA, 20 bp, human
ggagtcatccggaacgcgag

SEQ ID NO: 277254 - DNA, 20 bp, human
ggccgcaaccaaacccttgt

SEQ ID NO: 277255 - DNA, 20 bp, human
ggcgagtgggtgcgaggact

SEQ ID NO: 277256 - DNA, 20 bp, human
gccccccgccggctaggaga

SEQ ID NO: 277257 - DNA, 20 bp, human
gcagtgcgggagccgcttgg

SEQ ID NO: 277258 - DNA, 20 bp, human
gctcccgcactgcgcacccc

SEQ ID NO: 277259 - DNA, 20 bp, human
ggagagggctgagttgaggc

SEQ ID NO: 277260 - DNA, 20 bp, human
gcagccctctcctagccggc

SEQ ID NO: 277261 - DNA, 20 bp, human
ggggccgggtcctcaagatg

SEQ ID NO: 277262 - DNA, 20 bp, human
gaaatgcgggcgtcagagac

SEQ ID NO: 277263 - DNA, 20 bp, human
gctgagttgaggctggcaga

SEQ ID NO: 277264 - DNA, 20 bp, human
gtgagcgcgcacgtcccgtc

SEQ ID NO: 277265 - DNA, 20 bp, human
ggccccgcgcgctcccggga

SEQ ID NO: 277266 - DNA, 20 bp, human
ggggaaagaagcagccggga

SEQ ID NO: 277267 - DNA, 20 bp, human
gcggacggacgcgaaggaag

SEQ ID NO: 277268 - DNA, 20 bp, human
ggctgttcgtgggaagaaat

SEQ ID NO: 277269 - DNA, 20 bp, human
gagacaaagagcagcagccg

SEQ ID NO: 277270 - DNA, 20 bp, human
gggaactggggcggaggaac

SEQ ID NO: 277271 - DNA, 20 bp, human
ggggcggaggaacgggaaca

SEQ ID NO: 277272 - DNA, 20 bp, human
gagcagccgaggctgttcgt

SEQ ID NO: 277273 - DNA, 20 bp, human
gaaagtggggcgagccgaga

SEQ ID NO: 277274 - DNA, 20 bp, human
gcctgagttaggcaccacaa

SEQ ID NO: 277275 - DNA, 20 bp, human
gggaaaaggcgacgtcccag

SEQ ID NO: 277276 - DNA, 20 bp, human
ggaactggacggtggtgact

SEQ ID NO: 277277 - DNA, 20 bp, human
gctcactggcaggacgaccc

SEQ ID NO: 277278 - DNA, 20 bp, human
ggtggtgactcggggaggag

SEQ ID NO: 277279 - DNA, 20 bp, human
gaccccgggagagagggtcc

SEQ ID NO: 277280 - DNA, 20 bp, human
gccagtgagcccaggccaga

SEQ ID NO: 277281 - DNA, 20 bp, human
gcagagaccgagtgagccgt

SEQ ID NO: 277282 - DNA, 20 bp, human
gggggcgggaaacgagtgca

SEQ ID NO: 277283 - DNA, 20 bp, human
gggctgggaaccggcttcat

SEQ ID NO: 277284 - DNA, 20 bp, human
gcgggaaacgagtgcagggt

SEQ ID NO: 277285 - DNA, 20 bp, human
gggacggtggtgactcgggg

SEQ ID NO: 277286 - DNA, 20 bp, human
ggggcgctgtcctgtccgtg

SEQ ID NO: 277287 - DNA, 20 bp, human
gagagactcagagcaggcgg

SEQ ID NO: 277288 - DNA, 20 bp, human
ggagcagcccgacacaacaa

SEQ ID NO: 277289 - DNA, 20 bp, human
gtgtcctgtccgtgaggatg

SEQ ID NO: 277290 - DNA, 20 bp, human
gggccagcggtcagattcat

SEQ ID NO: 277291 - DNA, 20 bp, human
gaggacagcgccccattatg

SEQ ID NO: 277292 - DNA, 20 bp, human
gtgcagaaggggagctgcac

SEQ ID NO: 277293 - DNA, 20 bp, human
gacaacaggacgtttcagaa

SEQ ID NO: 277294 - DNA, 20 bp, human
gacacaacaagggacccctc

SEQ ID NO: 277295 - DNA, 20 bp, human
gagggagaccacagcccctc

SEQ ID NO: 277296 - DNA, 20 bp, human
gtcactcttcatgccttgat

SEQ ID NO: 277297 - DNA, 20 bp, human
gtaattattaatccccatca

SEQ ID NO: 277298 - DNA, 20 bp, human
gattgacgtagatgaaactg

SEQ ID NO: 277299 - DNA, 20 bp, human
gtatgacacaaaacatacct

SEQ ID NO: 277300 - DNA, 20 bp, human
gctggaaatagaaataaaaa

SEQ ID NO: 277301 - DNA, 20 bp, human
gattttaaaaccacacaaaa

SEQ ID NO: 277302 - DNA, 20 bp, human
gattaataattaaagatata

SEQ ID NO: 277303 - DNA, 20 bp, human
gtaattactgttaatatttt

SEQ ID NO: 277304 - DNA, 20 bp, human
gtgttcattatagaaaaatc

SEQ ID NO: 277305 - DNA, 20 bp, human
gtaataataggtgtctcagc

SEQ ID NO: 277306 - DNA, 20 bp, human
ggggacggacaggcctgatg

SEQ ID NO: 277307 - DNA, 20 bp, human
gtgggtgtccccagcatcgt

SEQ ID NO: 277308 - DNA, 20 bp, human
gggctcagagcatccgaggg

SEQ ID NO: 277309 - DNA, 20 bp, human
ggggtcctcatgcaaaacga

SEQ ID NO: 277310 - DNA, 20 bp, human
gaccgtgcaaatcgaggaga

SEQ ID NO: 277311 - DNA, 20 bp, human
ggcaccaagggcctgccaga

SEQ ID NO: 277312 - DNA, 20 bp, human
ggaggagaggggggacggac

SEQ ID NO: 277313 - DNA, 20 bp, human
ggtgcaccggggtggttccc

SEQ ID NO: 277314 - DNA, 20 bp, human
gggtggctcagagcatccga

SEQ ID NO: 277315 - DNA, 20 bp, human
gagcatcagtggggagtccg

SEQ ID NO: 277316 - DNA, 20 bp, human
gatgagtccgccactcttca

SEQ ID NO: 277317 - DNA, 20 bp, human
gtcttcagggatgattaact

SEQ ID NO: 277318 - DNA, 20 bp, human
ggagaaggctatcgtcatat

SEQ ID NO: 277319 - DNA, 20 bp, human
gtttggctcacatagaagaa

SEQ ID NO: 277320 - DNA, 20 bp, human
ggctaaaaagtaggaaacaa

SEQ ID NO: 277321 - DNA, 20 bp, human
gaatttgaggaactgctata

SEQ ID NO: 277322 - DNA, 20 bp, human
gttggaaagatcagctttct

SEQ ID NO: 277323 - DNA, 20 bp, human
gccttctctttacaggtgtc

SEQ ID NO: 277324 - DNA, 20 bp, human
gtgaaaaaattcttaagtaa

SEQ ID NO: 277325 - DNA, 20 bp, human
ggtacattccttttccaaat

SEQ ID NO: 277326 - DNA, 20 bp, human
ggtggcccagcccactcgac

SEQ ID NO: 277327 - DNA, 20 bp, human
gcgggtcctccgcccctcga

SEQ ID NO: 277328 - DNA, 20 bp, human
gcagcccgaggggactggag

SEQ ID NO: 277329 - DNA, 20 bp, human
gtgccctagccctcgagggg

SEQ ID NO: 277330 - DNA, 20 bp, human
gtgcgtcagcccgaggggac

SEQ ID NO: 277331 - DNA, 20 bp, human
ggaggacccgcggttgaagg

SEQ ID NO: 277332 - DNA, 20 bp, human
gggtcggagccacaagtgag

SEQ ID NO: 277333 - DNA, 20 bp, human
ggggatgccctagccctcga

SEQ ID NO: 277334 - DNA, 20 bp, human
gaggcattcgatggtcaagg

SEQ ID NO: 277335 - DNA, 20 bp, human
gtcgagtgcgtcagcccgag

SEQ ID NO: 277336 - DNA, 20 bp, human
gcctcgggagcagatgtgga

SEQ ID NO: 277337 - DNA, 20 bp, human
gaggggcacaagctcatctg

SEQ ID NO: 277338 - DNA, 20 bp, human
ggggagcctgaatactggat

SEQ ID NO: 277339 - DNA, 20 bp, human
gtctccctcgggagcagatg

SEQ ID NO: 277340 - DNA, 20 bp, human
ggggccgcactgagacagta

SEQ ID NO: 277341 - DNA, 20 bp, human
ggccccctactgtctcagtg

SEQ ID NO: 277342 - DNA, 20 bp, human
gatggagggagcctgaatac

SEQ ID NO: 277343 - DNA, 20 bp, human
gaggagagatgggcaaatcc

SEQ ID NO: 277344 - DNA, 20 bp, human
ggcctgaatactggatagga

SEQ ID NO: 277345 - DNA, 20 bp, human
gttgagaatggggatgttga

SEQ ID NO: 277346 - DNA, 20 bp, human
gagggcccctacaatcctac

SEQ ID NO: 277347 - DNA, 20 bp, human
gtaagctccccttgaaatga

SEQ ID NO: 277348 - DNA, 20 bp, human
gttgaagtctgcatcatcta

SEQ ID NO: 277349 - DNA, 20 bp, human
gaggaagtgctctctgaaat

SEQ ID NO: 277350 - DNA, 20 bp, human
gatatccagtaggattgtag

SEQ ID NO: 277351 - DNA, 20 bp, human
gtatgactttaccctggatg

SEQ ID NO: 277352 - DNA, 20 bp, human
gccaagtgcttaatagtacc

SEQ ID NO: 277353 - DNA, 20 bp, human
gaatatatgccatcatttca

SEQ ID NO: 277354 - DNA, 20 bp, human
gagataatactatatccagt

SEQ ID NO: 277355 - DNA, 20 bp, human
gcttagtaggtactcctaaa

SEQ ID NO: 277356 - DNA, 20 bp, human
gaatcccacaagcccttcga

SEQ ID NO: 277357 - DNA, 20 bp, human
ggcccgcctcattggctctc

SEQ ID NO: 277358 - DNA, 20 bp, human
gctcagtagcaagacgtgct

SEQ ID NO: 277359 - DNA, 20 bp, human
gagtccgcggggccttcgaa

SEQ ID NO: 277360 - DNA, 20 bp, human
gtctgactggtgaatgtctt

SEQ ID NO: 277361 - DNA, 20 bp, human
gtcaaaagccggggactgat

SEQ ID NO: 277362 - DNA, 20 bp, human
ggggaactagtcaaaagccg

SEQ ID NO: 277363 - DNA, 20 bp, human
gacgtgctaggcaatgagga

SEQ ID NO: 277364 - DNA, 20 bp, human
ggcagaggagcccgcctcat

SEQ ID NO: 277365 - DNA, 20 bp, human
gtcccccagctgccgacgtg

SEQ ID NO: 277366 - DNA, 20 bp, human
gacatcccctgtaaccggat

SEQ ID NO: 277367 - DNA, 20 bp, human
ggggattccaagctgactta

SEQ ID NO: 277368 - DNA, 20 bp, human
gtcccccaatccggttacag

SEQ ID NO: 277369 - DNA, 20 bp, human
gtccaagctgacttagggag

SEQ ID NO: 277370 - DNA, 20 bp, human
gaaattcattcagcgggtga

SEQ ID NO: 277371 - DNA, 20 bp, human
gaaaagacccggtgtgccag

SEQ ID NO: 277372 - DNA, 20 bp, human
gtcccctgtaaccggattgg

SEQ ID NO: 277373 - DNA, 20 bp, human
ggacccggtgtgccagtggc

SEQ ID NO: 277374 - DNA, 20 bp, human
gctgggacatcccctgtaac

SEQ ID NO: 277375 - DNA, 20 bp, human
gtccccgccactggcacacc

SEQ ID NO: 277376 - DNA, 20 bp, human
ggcagcctctcgactgaaaa

SEQ ID NO: 277377 - DNA, 20 bp, human
gtcattacatgctcagtcac

SEQ ID NO: 277378 - DNA, 20 bp, human
gtccaggatgtggagtggac

SEQ ID NO: 277379 - DNA, 20 bp, human
gtgggggtgagtgacagtcc

SEQ ID NO: 277380 - DNA, 20 bp, human
gaagtgcacacacgtacacg

SEQ ID NO: 277381 - DNA, 20 bp, human
gtgcagacctccttttatgg

SEQ ID NO: 277382 - DNA, 20 bp, human
gaacaggtttctgtggcgtg

SEQ ID NO: 277383 - DNA, 20 bp, human
gtccctgataccaagtttcc

SEQ ID NO: 277384 - DNA, 20 bp, human
gtcataagctgtggataagg

SEQ ID NO: 277385 - DNA, 20 bp, human
gacctggaaacttggtatca

SEQ ID NO: 277386 - DNA, 20 bp, human
ggtcccagatgtgtgctaag

SEQ ID NO: 277387 - DNA, 20 bp, human
gggaggggcaacaagagagt

SEQ ID NO: 277388 - DNA, 20 bp, human
gtgtgctaagggggatccag

SEQ ID NO: 277389 - DNA, 20 bp, human
ggctctggaatgtgtcacat

SEQ ID NO: 277390 - DNA, 20 bp, human
gcatactgagcaactctgaa

SEQ ID NO: 277391 - DNA, 20 bp, human
ggcaacaagagagtggggct

SEQ ID NO: 277392 - DNA, 20 bp, human
gggatccagaggggaggtta

SEQ ID NO: 277393 - DNA, 20 bp, human
gaatggatcatgtggctgaa

SEQ ID NO: 277394 - DNA, 20 bp, human
ggtgacacattccagagcct

SEQ ID NO: 277395 - DNA, 20 bp, human
ggagggtgtaatgctgtccg

SEQ ID NO: 277396 - DNA, 20 bp, human
gcaaacgtgcactcccgggg

SEQ ID NO: 277397 - DNA, 20 bp, human
ggggtgggatctcaacgcca

SEQ ID NO: 277398 - DNA, 20 bp, human
gtcctcaggcagatctcgcg

SEQ ID NO: 277399 - DNA, 20 bp, human
gatctcgcgtggtttggtga

SEQ ID NO: 277400 - DNA, 20 bp, human
ggcgcaaacgtgcactcccg

SEQ ID NO: 277401 - DNA, 20 bp, human
gtgaggagaagcgccacccc

SEQ ID NO: 277402 - DNA, 20 bp, human
gggaaaaccttcatactagc

SEQ ID NO: 277403 - DNA, 20 bp, human
gtgatggccggctagtatga

SEQ ID NO: 277404 - DNA, 20 bp, human
gggctagcggcatttctctg

SEQ ID NO: 277405 - DNA, 20 bp, human
gcgcgtggtttggtgatggc

SEQ ID NO: 277406 - DNA, 20 bp, human
ggccccaggcaccgtccctc

SEQ ID NO: 277407 - DNA, 20 bp, human
gccgcccccaggaggagtca

SEQ ID NO: 277408 - DNA, 20 bp, human
gagcctgagggacggtgcct

SEQ ID NO: 277409 - DNA, 20 bp, human
ggagccttgactcctcctgg

SEQ ID NO: 277410 - DNA, 20 bp, human
ggccgtaggaaggcgaggtc

SEQ ID NO: 277411 - DNA, 20 bp, human
gcccggacctcgccttccta

SEQ ID NO: 277412 - DNA, 20 bp, human
gtctgagccttgactcctcc

SEQ ID NO: 277413 - DNA, 20 bp, human
gcacacccactggagacaga

SEQ ID NO: 277414 - DNA, 20 bp, human
gtggcctgacgtcaggccgt

SEQ ID NO: 277415 - DNA, 20 bp, human
ggacgtcaggccagcgcttg

SEQ ID NO: 277416 - DNA, 20 bp, human
ggaaggggtagtaacagaac

SEQ ID NO: 277417 - DNA, 20 bp, human
gcctgcagtgcaccatttga

SEQ ID NO: 277418 - DNA, 20 bp, human
gtagtagataagcagaattc

SEQ ID NO: 277419 - DNA, 20 bp, human
gactgtgcagtctggaaatc

SEQ ID NO: 277420 - DNA, 20 bp, human
gctgcttatctactaaaagg

SEQ ID NO: 277421 - DNA, 20 bp, human
gcgaggaaacagccttcaaa

SEQ ID NO: 277422 - DNA, 20 bp, human
gatagcgtagtgtcaaatat

SEQ ID NO: 277423 - DNA, 20 bp, human
gtttccagactgcacagtgt

SEQ ID NO: 277424 - DNA, 20 bp, human
ggggggattccagacagacg

SEQ ID NO: 277425 - DNA, 20 bp, human
gactgaaacacactaccaga

SEQ ID NO: 277426 - DNA, 20 bp, human
gacactgcatctctctgcag

SEQ ID NO: 277427 - DNA, 20 bp, human
gtccccactgttttatataa

SEQ ID NO: 277428 - DNA, 20 bp, human
ggtgcttcatatgtatagca

SEQ ID NO: 277429 - DNA, 20 bp, human
gaaaaggctaaatttatgag

SEQ ID NO: 277430 - DNA, 20 bp, human
ggctcacagtaaagatgcag

SEQ ID NO: 277431 - DNA, 20 bp, human
gtgtattcactaattttgat

SEQ ID NO: 277432 - DNA, 20 bp, human
gtttgattggtcagttgtat

SEQ ID NO: 277433 - DNA, 20 bp, human
ggtattcaagtcatcttctc

SEQ ID NO: 277434 - DNA, 20 bp, human
gtgcagggaggtgggggaac

SEQ ID NO: 277435 - DNA, 20 bp, human
gaaaaaaaaatgcagggagg

SEQ ID NO: 277436 - DNA, 20 bp, human
gcgggtcagccccaaatcgg

SEQ ID NO: 277437 - DNA, 20 bp, human
gaagccggaggcaaatgggt

SEQ ID NO: 277438 - DNA, 20 bp, human
gcctcgggtcagccccaaat

SEQ ID NO: 277439 - DNA, 20 bp, human
gacctgcccggcctcccagt

SEQ ID NO: 277440 - DNA, 20 bp, human
ggcttctgtgagagagatgg

SEQ ID NO: 277441 - DNA, 20 bp, human
ggggccacgctcctactggg

SEQ ID NO: 277442 - DNA, 20 bp, human
gggggctgacccgaggggta

SEQ ID NO: 277443 - DNA, 20 bp, human
gacccaagccggaggcaaat

SEQ ID NO: 277444 - DNA, 20 bp, human
gaatgggccacgctcctact

SEQ ID NO: 277445 - DNA, 20 bp, human
ggggacacagcagatctggg

SEQ ID NO: 277446 - DNA, 20 bp, human
gaccctgcaccggagccttc

SEQ ID NO: 277447 - DNA, 20 bp, human
gtgagccaatcaccctgcac

SEQ ID NO: 277448 - DNA, 20 bp, human
gcggagggaaccagccccga

SEQ ID NO: 277449 - DNA, 20 bp, human
gacggagagaacagcgcggg

SEQ ID NO: 277450 - DNA, 20 bp, human
ggaaccagccccgaaggctc

SEQ ID NO: 277451 - DNA, 20 bp, human
gtcacacttacaggctcgga

SEQ ID NO: 277452 - DNA, 20 bp, human
gatagcatgcaggcggggac

SEQ ID NO: 277453 - DNA, 20 bp, human
gcagggtgattggctcactg

SEQ ID NO: 277454 - DNA, 20 bp, human
ggccccgaaggctccggtgc

SEQ ID NO: 277455 - DNA, 20 bp, human
gctatcacagaaatccccac

SEQ ID NO: 277456 - DNA, 20 bp, human
ggcggcagcagcggaggagt

SEQ ID NO: 277457 - DNA, 20 bp, human
ggcggtgcgggatgcctcgg

SEQ ID NO: 277458 - DNA, 20 bp, human
ggcagcagcggaggagtagg

SEQ ID NO: 277459 - DNA, 20 bp, human
gaggcagggcccaggacgca

SEQ ID NO: 277460 - DNA, 20 bp, human
ggcggccgcgctgcgcgctc

SEQ ID NO: 277461 - DNA, 20 bp, human
ggaggcatcccgcaccgcct

SEQ ID NO: 277462 - DNA, 20 bp, human
gggggcagagccaagaggcg

SEQ ID NO: 277463 - DNA, 20 bp, human
gcgctgcgcgctccggcgga

SEQ ID NO: 277464 - DNA, 20 bp, human
ggccggacccccgttacctg

SEQ ID NO: 277465 - DNA, 20 bp, human
gtcttggctctgccccccgc

SEQ ID NO: 277466 - DNA, 20 bp, human
gagcgcgggcagactcggga

SEQ ID NO: 277467 - DNA, 20 bp, human
gccgcccccggccaccggtt

SEQ ID NO: 277468 - DNA, 20 bp, human
ggaaacccccggcccgcaga

SEQ ID NO: 277469 - DNA, 20 bp, human
gcccagcgcgccgcgcccat

SEQ ID NO: 277470 - DNA, 20 bp, human
ggttgcgcggcatagtaata

SEQ ID NO: 277471 - DNA, 20 bp, human
ggggcgcagcgcgcgttgcg

SEQ ID NO: 277472 - DNA, 20 bp, human
gcgcagagggcgccgcgtca

SEQ ID NO: 277473 - DNA, 20 bp, human
ggaggctgcagggaacgtgg

SEQ ID NO: 277474 - DNA, 20 bp, human
gaccgctgacgtcaccgaac

SEQ ID NO: 277475 - DNA, 20 bp, human
gcacggtcgctttttatgaa

SEQ ID NO: 277476 - DNA, 20 bp, human
gtaatgtcctataacgtctg

SEQ ID NO: 277477 - DNA, 20 bp, human
gctggacccccagacgttat

SEQ ID NO: 277478 - DNA, 20 bp, human
ggtgtttcgcttcacatcac

SEQ ID NO: 277479 - DNA, 20 bp, human
gcatcagctatggaatgagc

SEQ ID NO: 277480 - DNA, 20 bp, human
gcaagtgaaaccatcagcta

SEQ ID NO: 277481 - DNA, 20 bp, human
gtgctgggatccttctgcat

SEQ ID NO: 277482 - DNA, 20 bp, human
gactcctcagctttgcagcc

SEQ ID NO: 277483 - DNA, 20 bp, human
gctagtacaccacttggatt

SEQ ID NO: 277484 - DNA, 20 bp, human
gaaatcaagccccatgcaga

SEQ ID NO: 277485 - DNA, 20 bp, human
gccacacttaaacttgaaag

SEQ ID NO: 277486 - DNA, 20 bp, human
gaatggagaaatcatgaatg

SEQ ID NO: 277487 - DNA, 20 bp, human
gacaagagcgatcacgtgtc

SEQ ID NO: 277488 - DNA, 20 bp, human
gacgtgatcgctcttgttcc

SEQ ID NO: 277489 - DNA, 20 bp, human
gaagcattccataaaaatta

SEQ ID NO: 277490 - DNA, 20 bp, human
ggatcacgtgtcaggacccc

SEQ ID NO: 277491 - DNA, 20 bp, human
gccaggaagatgaactcttc

SEQ ID NO: 277492 - DNA, 20 bp, human
gctccattccataattttta

SEQ ID NO: 277493 - DNA, 20 bp, human
gttccataaaaattatggaa

SEQ ID NO: 277494 - DNA, 20 bp, human
gatcatgaatggggtctcgg

SEQ ID NO: 277495 - DNA, 20 bp, human
ggaaatcatgaatggggtct

SEQ ID NO: 277496 - DNA, 20 bp, human
gtgtaagtgaccaagtgcag

SEQ ID NO: 277497 - DNA, 20 bp, human
gcagtgtgctatgatcatgg

SEQ ID NO: 277498 - DNA, 20 bp, human
ggtggaatttactgctatag

SEQ ID NO: 277499 - DNA, 20 bp, human
gggatgacccaatacgagaa

SEQ ID NO: 277500 - DNA, 20 bp, human
ggttaattcccttctcgtat

SEQ ID NO: 277501 - DNA, 20 bp, human
gcgtattgggtcatcccgcc

SEQ ID NO: 277502 - DNA, 20 bp, human
gattatttctccattttgag

SEQ ID NO: 277503 - DNA, 20 bp, human
gctaagtcatttcatttaaa

SEQ ID NO: 277504 - DNA, 20 bp, human
gtctctctcttttgagaggc

SEQ ID NO: 277505 - DNA, 20 bp, human
gattatttaaatactcagtg

SEQ ID NO: 277506 - DNA, 20 bp, human
gcggtcgtggtgcaattggt

SEQ ID NO: 277507 - DNA, 20 bp, human
ggggctcttccatccggtcg

SEQ ID NO: 277508 - DNA, 20 bp, human
gtgagcttaaagttgttcca

SEQ ID NO: 277509 - DNA, 20 bp, human
gagacgagtctcagtgtcta

SEQ ID NO: 277510 - DNA, 20 bp, human
gtcagctgggctcttccatc

SEQ ID NO: 277511 - DNA, 20 bp, human
gcaattgcaccacgaccgga

SEQ ID NO: 277512 - DNA, 20 bp, human
gccttccaacttgacaattg

SEQ ID NO: 277513 - DNA, 20 bp, human
gtcaaccaacactgaacttt

SEQ ID NO: 277514 - DNA, 20 bp, human
gaagttgttccatggtagta

SEQ ID NO: 277515 - DNA, 20 bp, human
gtcgtcttggttgtgtcagc

SEQ ID NO: 277516 - DNA, 20 bp, human
ggggaggaggaaggctccgt

SEQ ID NO: 277517 - DNA, 20 bp, human
gactgacggcagcaggtcag

SEQ ID NO: 277518 - DNA, 20 bp, human
ggcagcaggtcaggggtaac

SEQ ID NO: 277519 - DNA, 20 bp, human
gggggcgggcggctgactga

SEQ ID NO: 277520 - DNA, 20 bp, human
gactctgcccctccttaagg

SEQ ID NO: 277521 - DNA, 20 bp, human
gtcttcagaggtgtcagcac

SEQ ID NO: 277522 - DNA, 20 bp, human
gcgcccccccaccttaagga

SEQ ID NO: 277523 - DNA, 20 bp, human
gtgcaccagccccagctaga

SEQ ID NO: 277524 - DNA, 20 bp, human
ggcgtgggggatttctggga

SEQ ID NO: 277525 - DNA, 20 bp, human
gaaggatgctggctcttcag

SEQ ID NO: 277526 - DNA, 20 bp, human
ggggtccctggcggtactgt

SEQ ID NO: 277527 - DNA, 20 bp, human
gcaggcccacagtaccgcca

SEQ ID NO: 277528 - DNA, 20 bp, human
gtggccctggcagatccgga

SEQ ID NO: 277529 - DNA, 20 bp, human
gactgtgggcctgcagagtg

SEQ ID NO: 277530 - DNA, 20 bp, human
gaggcagaggcgtcacgaat

SEQ ID NO: 277531 - DNA, 20 bp, human
gaggaaggaggtgctctcat

SEQ ID NO: 277532 - DNA, 20 bp, human
ggggacaaagtccacaggaa

SEQ ID NO: 277533 - DNA, 20 bp, human
gtgcccgtccggatctgcca

SEQ ID NO: 277534 - DNA, 20 bp, human
ggatccggacgggcaggact

SEQ ID NO: 277535 - DNA, 20 bp, human
gaactctccggaatgcttga

SEQ ID NO: 277536 - DNA, 20 bp, human
ggcccgcgaagctcgactct

SEQ ID NO: 277537 - DNA, 20 bp, human
gaaccagtatctctccgagg

SEQ ID NO: 277538 - DNA, 20 bp, human
ggggccaggcagtgcgcggc

SEQ ID NO: 277539 - DNA, 20 bp, human
gagccgagagtcgagcttcg

SEQ ID NO: 277540 - DNA, 20 bp, human
gcctgcgcggctcgaggcta

SEQ ID NO: 277541 - DNA, 20 bp, human
gagagggcgccgctcgtcgg

SEQ ID NO: 277542 - DNA, 20 bp, human
ggagtggaagccgctacaaa

SEQ ID NO: 277543 - DNA, 20 bp, human
gctcctcctcggagagatac

SEQ ID NO: 277544 - DNA, 20 bp, human
gccgcgggccaggcagtgcg

SEQ ID NO: 277545 - DNA, 20 bp, human
ggcttgaatgaaacgtgtgt

SEQ ID NO: 277546 - DNA, 20 bp, human
gctgagaagcggcgtcgtgg

SEQ ID NO: 277547 - DNA, 20 bp, human
gtggaggacgagatgtgtga

SEQ ID NO: 277548 - DNA, 20 bp, human
gatgccagacgcctgactgg

SEQ ID NO: 277549 - DNA, 20 bp, human
gtcaggccctacagcatgtc

SEQ ID NO: 277550 - DNA, 20 bp, human
gcctacagcatgtcaggctg

SEQ ID NO: 277551 - DNA, 20 bp, human
gagtgctatgtgtccagcag

SEQ ID NO: 277552 - DNA, 20 bp, human
gtctctggagcccagctctt

SEQ ID NO: 277553 - DNA, 20 bp, human
ggaggagctgccttagaatc

SEQ ID NO: 277554 - DNA, 20 bp, human
gcaggctgtggggccctaag

SEQ ID NO: 277555 - DNA, 20 bp, human
gcaggcccctgaaactaggg

SEQ ID NO: 277556 - DNA, 20 bp, human
ggctctgggaatgtggaccg

SEQ ID NO: 277557 - DNA, 20 bp, human
gagtgcgccctcggcgaaga

SEQ ID NO: 277558 - DNA, 20 bp, human
ggaccggggctctcaagtgc

SEQ ID NO: 277559 - DNA, 20 bp, human
ggcgaggcggagtgcgccct

SEQ ID NO: 277560 - DNA, 20 bp, human
gcctcccgcagctcgggaga

SEQ ID NO: 277561 - DNA, 20 bp, human
gagggcagcggtggacgtgg

SEQ ID NO: 277562 - DNA, 20 bp, human
gccctgggggcccccttcga

SEQ ID NO: 277563 - DNA, 20 bp, human
gaaggaagaggagtgctgcg

SEQ ID NO: 277564 - DNA, 20 bp, human
gtgccggcacttgagagccc

SEQ ID NO: 277565 - DNA, 20 bp, human
gaccccgcctcccgcagctc

SEQ ID NO: 277566 - DNA, 20 bp, human
gcccccgcggggcagaacag

SEQ ID NO: 277567 - DNA, 20 bp, human
ggcaaaggtggggttaatgg

SEQ ID NO: 277568 - DNA, 20 bp, human
ggaagcctgaaaggggttaa

SEQ ID NO: 277569 - DNA, 20 bp, human
gggttaaggggcagcggcaa

SEQ ID NO: 277570 - DNA, 20 bp, human
gtggctggaggcgtttaatg

SEQ ID NO: 277571 - DNA, 20 bp, human
gatggggtgaagcctgaaag

SEQ ID NO: 277572 - DNA, 20 bp, human
gacgcctccagccacgggtg

SEQ ID NO: 277573 - DNA, 20 bp, human
gtggggacttggaaggattc

SEQ ID NO: 277574 - DNA, 20 bp, human
gggtgaggctcatctgctac

SEQ ID NO: 277575 - DNA, 20 bp, human
gagcagatgagcctcacccg

SEQ ID NO: 277576 - DNA, 20 bp, human
ggtggagagacccttggagc

SEQ ID NO: 277577 - DNA, 20 bp, human
gtccaagggtctctccacga

SEQ ID NO: 277578 - DNA, 20 bp, human
gagggctcccctcagcactt

SEQ ID NO: 277579 - DNA, 20 bp, human
gtgcaacagcacgtcccttg

SEQ ID NO: 277580 - DNA, 20 bp, human
ggcagccacccaagtgctga

SEQ ID NO: 277581 - DNA, 20 bp, human
gctgaggggtgcgggcaact

SEQ ID NO: 277582 - DNA, 20 bp, human
gaggggtgcgggcaactggg

SEQ ID NO: 277583 - DNA, 20 bp, human
gtgggtggaccccgagtctg

SEQ ID NO: 277584 - DNA, 20 bp, human
gaaggagatcctgaggggtg

SEQ ID NO: 277585 - DNA, 20 bp, human
gagctgggacagaaatggcc

SEQ ID NO: 277586 - DNA, 20 bp, human
gtagagaggaagtacataca

SEQ ID NO: 277587 - DNA, 20 bp, human
ggggaggtctgattggtcgg

SEQ ID NO: 277588 - DNA, 20 bp, human
gccctgcctctcaatctccc

SEQ ID NO: 277589 - DNA, 20 bp, human
ggcaagatgacacctcaatg

SEQ ID NO: 277590 - DNA, 20 bp, human
ggccaaggggggggtattca

SEQ ID NO: 277591 - DNA, 20 bp, human
gaaggggggggtattcaggg

SEQ ID NO: 277592 - DNA, 20 bp, human
gacctgggagattgagaggc

SEQ ID NO: 277593 - DNA, 20 bp, human
gatgatgcttgcaaggtacc

SEQ ID NO: 277594 - DNA, 20 bp, human
gtggtcggggggagggattt

SEQ ID NO: 277595 - DNA, 20 bp, human
ggtattcagggaggtctgat

SEQ ID NO: 277596 - DNA, 20 bp, human
gaggggataagctagaaagg

SEQ ID NO: 277597 - DNA, 20 bp, human
gggtggggggggggcggtaa

SEQ ID NO: 277598 - DNA, 20 bp, human
gctaagaaactgcctctctt

SEQ ID NO: 277599 - DNA, 20 bp, human
gcccccccgcccgaaagctg

SEQ ID NO: 277600 - DNA, 20 bp, human
gaaaactctgaaactgtctc

SEQ ID NO: 277601 - DNA, 20 bp, human
gtgtctttgggcttagttca

SEQ ID NO: 277602 - DNA, 20 bp, human
gacacacctcagctttcggg

SEQ ID NO: 277603 - DNA, 20 bp, human
ggtcactaattagtttcctc

SEQ ID NO: 277604 - DNA, 20 bp, human
gagttctttgagggcaccag

SEQ ID NO: 277605 - DNA, 20 bp, human
gagttcagggattgatgttg

SEQ ID NO: 277606 - DNA, 20 bp, human
gtgctctggggtctacagag

SEQ ID NO: 277607 - DNA, 20 bp, human
ggcccctgttagggtgtctg

SEQ ID NO: 277608 - DNA, 20 bp, human
gggtgtctggggtgcgtagg

SEQ ID NO: 277609 - DNA, 20 bp, human
gggcgtgcagatcttccaag

SEQ ID NO: 277610 - DNA, 20 bp, human
gcaccccagacaccctaaca

SEQ ID NO: 277611 - DNA, 20 bp, human
gtggaactagagtgtggaca

SEQ ID NO: 277612 - DNA, 20 bp, human
gcttaggggctcttgctctg

SEQ ID NO: 277613 - DNA, 20 bp, human
ggctgtgtggaactagagtg

SEQ ID NO: 277614 - DNA, 20 bp, human
gcctgtgtggtgcccctgtt

SEQ ID NO: 277615 - DNA, 20 bp, human
gagagtgtagaccctcctcc

SEQ ID NO: 277616 - DNA, 20 bp, human
gagcgctgaggcagtgatcc

SEQ ID NO: 277617 - DNA, 20 bp, human
gttgcccggcgctgagtcat

SEQ ID NO: 277618 - DNA, 20 bp, human
gcctgggaggcgacagatgg

SEQ ID NO: 277619 - DNA, 20 bp, human
ggctgaggcagtgatcctgg

SEQ ID NO: 277620 - DNA, 20 bp, human
ggcaaccccggcctctctgt

SEQ ID NO: 277621 - DNA, 20 bp, human
gtcctccctgagcttgactg

SEQ ID NO: 277622 - DNA, 20 bp, human
gtgagtcatggatttctcag

SEQ ID NO: 277623 - DNA, 20 bp, human
gggacgatatatgtgagtca

SEQ ID NO: 277624 - DNA, 20 bp, human
ggaggaagcagagtgatccc

SEQ ID NO: 277625 - DNA, 20 bp, human
gtgagtcatgggcatccccc

SEQ ID NO: 277626 - DNA, 20 bp, human
gctatctgagggtcctagga

SEQ ID NO: 277627 - DNA, 20 bp, human
gtgcccccaacactatctga

SEQ ID NO: 277628 - DNA, 20 bp, human
gaggaccctcagatagtgtt

SEQ ID NO: 277629 - DNA, 20 bp, human
gcgctgcagattgacaggca

SEQ ID NO: 277630 - DNA, 20 bp, human
gagaagggggaggttgggac

SEQ ID NO: 277631 - DNA, 20 bp, human
gggaagttctggactggagg

SEQ ID NO: 277632 - DNA, 20 bp, human
ggcgcgcgctgcagattgac

SEQ ID NO: 277633 - DNA, 20 bp, human
gccaacctcccccttctccg

SEQ ID NO: 277634 - DNA, 20 bp, human
gtgggacaggggtgtttgat

SEQ ID NO: 277635 - DNA, 20 bp, human
gcagcgtcaaagatcactga

SEQ ID NO: 277636 - DNA, 20 bp, human
gtgctccagaagtgactctg

SEQ ID NO: 277637 - DNA, 20 bp, human
ggggccaggaaatgataggt

SEQ ID NO: 277638 - DNA, 20 bp, human
gagcccctcagagtcacttc

SEQ ID NO: 277639 - DNA, 20 bp, human
gcgtggggccaggaaatgat

SEQ ID NO: 277640 - DNA, 20 bp, human
gcactgcagtgagcggtgag

SEQ ID NO: 277641 - DNA, 20 bp, human
ggagagcctctgggtcctaa

SEQ ID NO: 277642 - DNA, 20 bp, human
gggctccaggggatggtcca

SEQ ID NO: 277643 - DNA, 20 bp, human
gcctgaagcactgcagtgag

SEQ ID NO: 277644 - DNA, 20 bp, human
gggaagctgcctaatgcgta

SEQ ID NO: 277645 - DNA, 20 bp, human
ggcgtctcaaaaatttcgtg

SEQ ID NO: 277646 - DNA, 20 bp, human
ggggggtgcctctagggtgg

SEQ ID NO: 277647 - DNA, 20 bp, human
gttggagcctagacttgaga

SEQ ID NO: 277648 - DNA, 20 bp, human
ggtgcttgggggtgcctcta

SEQ ID NO: 277649 - DNA, 20 bp, human
gcccctgtcggagatggtac

SEQ ID NO: 277650 - DNA, 20 bp, human
gcttgagagggttagagtgt

SEQ ID NO: 277651 - DNA, 20 bp, human
gcacacggctggcaagggag

SEQ ID NO: 277652 - DNA, 20 bp, human
gctctgctgtggaagtgctt

SEQ ID NO: 277653 - DNA, 20 bp, human
gatgccctggccccccaaga

SEQ ID NO: 277654 - DNA, 20 bp, human
gggggccagggcatgcctaa

SEQ ID NO: 277655 - DNA, 20 bp, human
gcctgctctacctttctcag

SEQ ID NO: 277656 - DNA, 20 bp, human
ggaggcaagtaaaaagggag

SEQ ID NO: 277657 - DNA, 20 bp, human
gccacgcccgagctgcccca

SEQ ID NO: 277658 - DNA, 20 bp, human
gatccgccctggggcagctc

SEQ ID NO: 277659 - DNA, 20 bp, human
gccggccccggttttagacc

SEQ ID NO: 277660 - DNA, 20 bp, human
ggggccggcgatccgccctg

SEQ ID NO: 277661 - DNA, 20 bp, human
ggggcgcaggccaacgacga

SEQ ID NO: 277662 - DNA, 20 bp, human
gacctcccggtctaaaaccg

SEQ ID NO: 277663 - DNA, 20 bp, human
gggcagggagcggtcgaaag

SEQ ID NO: 277664 - DNA, 20 bp, human
ggtagagacggagagatccc

SEQ ID NO: 277665 - DNA, 20 bp, human
ggggagcggtcgaaaggggc

SEQ ID NO: 277666 - DNA, 20 bp, human
gtccccaaggaggagctcgc

SEQ ID NO: 277667 - DNA, 20 bp, human
ggtaccggggcgagccctaa

SEQ ID NO: 277668 - DNA, 20 bp, human
gccagcgcggcgtggcgcgt

SEQ ID NO: 277669 - DNA, 20 bp, human
gcggggcccccggctgcggt

SEQ ID NO: 277670 - DNA, 20 bp, human
gactcagcggctcaccttta

SEQ ID NO: 277671 - DNA, 20 bp, human
ggcccaccccaccgcagccg

SEQ ID NO: 277672 - DNA, 20 bp, human
gcagcgcggccggccgaagc

SEQ ID NO: 277673 - DNA, 20 bp, human
gctcccagcccggcttcggc

SEQ ID NO: 277674 - DNA, 20 bp, human
gtggaggttggggtccgttg

SEQ ID NO: 277675 - DNA, 20 bp, human
gcaggggccggggagaagcg

SEQ ID NO: 277676 - DNA, 20 bp, human
gcggggagatgtatacgaac

SEQ ID NO: 277677 - DNA, 20 bp, human
gagcagcatctcaatgagaa

SEQ ID NO: 277678 - DNA, 20 bp, human
gtgaagaagtacttcaagag

SEQ ID NO: 277679 - DNA, 20 bp, human
gagaaaccaacactgctgag

SEQ ID NO: 277680 - DNA, 20 bp, human
gagataggggaggatattgt

SEQ ID NO: 277681 - DNA, 20 bp, human
gtggatgtgtgagatagggg

SEQ ID NO: 277682 - DNA, 20 bp, human
gggatattgtaggtagattc

SEQ ID NO: 277683 - DNA, 20 bp, human
gcatttggatgtgtgagata

SEQ ID NO: 277684 - DNA, 20 bp, human
gtcagggtgataaagttcct

SEQ ID NO: 277685 - DNA, 20 bp, human
gaataatgattgtaatgcaa

SEQ ID NO: 277686 - DNA, 20 bp, human
gtgaactccaatctggtgtc

SEQ ID NO: 277687 - DNA, 20 bp, human
ggaggctgctcactgactct

SEQ ID NO: 277688 - DNA, 20 bp, human
gggaaccactcgccagccag

SEQ ID NO: 277689 - DNA, 20 bp, human
ggcccagcctgacaccagat

SEQ ID NO: 277690 - DNA, 20 bp, human
gaatgtgaaagcctgagcta

SEQ ID NO: 277691 - DNA, 20 bp, human
ggctgcgggaagtcgctgga

SEQ ID NO: 277692 - DNA, 20 bp, human
ggctgcccattcccgagctg

SEQ ID NO: 277693 - DNA, 20 bp, human
gtctgcctcagctcgggaat

SEQ ID NO: 277694 - DNA, 20 bp, human
gagtcagtgagcagcctcgc

SEQ ID NO: 277695 - DNA, 20 bp, human
gggagggagagctgggatcg

SEQ ID NO: 277696 - DNA, 20 bp, human
gaggcccgcaaagacctccc

SEQ ID NO: 277697 - DNA, 20 bp, human
gccgctgcccgcctcacgag

SEQ ID NO: 277698 - DNA, 20 bp, human
gggctcaagcgcccctcgtg

SEQ ID NO: 277699 - DNA, 20 bp, human
gggaaagataggggtactga

SEQ ID NO: 277700 - DNA, 20 bp, human
gagagcaaggtggagtggta

SEQ ID NO: 277701 - DNA, 20 bp, human
ggccaggcccgggtgtccgg

SEQ ID NO: 277702 - DNA, 20 bp, human
ggggcagggtaagcagccta

SEQ ID NO: 277703 - DNA, 20 bp, human
ggacgccaggcccgggtgtc

SEQ ID NO: 277704 - DNA, 20 bp, human
gtgatggcacgcagggaccc

SEQ ID NO: 277705 - DNA, 20 bp, human
gtcaagcgcccctcgtgagg

SEQ ID NO: 277706 - DNA, 20 bp, human
gtggctggagaaagcggcgg

SEQ ID NO: 277707 - DNA, 20 bp, human
gaggagacgtggcggcggtt

SEQ ID NO: 277708 - DNA, 20 bp, human
gtctccggaaggagacgtgg

SEQ ID NO: 277709 - DNA, 20 bp, human
gacgtcccggcccccgtagg

SEQ ID NO: 277710 - DNA, 20 bp, human
ggcggcgttgccgggctctc

SEQ ID NO: 277711 - DNA, 20 bp, human
gtctgctccaggaggagagg

SEQ ID NO: 277712 - DNA, 20 bp, human
gcggttgggccggtgatacc

SEQ ID NO: 277713 - DNA, 20 bp, human
ggggcggaggcggcgttgcc

SEQ ID NO: 277714 - DNA, 20 bp, human
gccggaaggagacgtggcgg

SEQ ID NO: 277715 - DNA, 20 bp, human
gccccggaaacggtgacagg

SEQ ID NO: 277716 - DNA, 20 bp, human
gcggggcagagggagtgacg

SEQ ID NO: 277717 - DNA, 20 bp, human
gccaaactggagcgacctgg

SEQ ID NO: 277718 - DNA, 20 bp, human
gggagggagaggcgtggcga

SEQ ID NO: 277719 - DNA, 20 bp, human
gacctggtggcttatagggg

SEQ ID NO: 277720 - DNA, 20 bp, human
ggtggcttataggggcggta

SEQ ID NO: 277721 - DNA, 20 bp, human
gtcggctggaggtgtgacca

SEQ ID NO: 277722 - DNA, 20 bp, human
ggcagagggagtgacggggc

SEQ ID NO: 277723 - DNA, 20 bp, human
ggcgacaagaagtggaaaca

SEQ ID NO: 277724 - DNA, 20 bp, human
ggcaagaagctgtgcaggcg

SEQ ID NO: 277725 - DNA, 20 bp, human
ggcgacctggtggcttatag

SEQ ID NO: 277726 - DNA, 20 bp, human
gtaagcacagactgcaccca

SEQ ID NO: 277727 - DNA, 20 bp, human
ggtattgggttactacagag

SEQ ID NO: 277728 - DNA, 20 bp, human
gcacagactgcacccagggt

SEQ ID NO: 277729 - DNA, 20 bp, human
gaaatgagggttttttgagg

SEQ ID NO: 277730 - DNA, 20 bp, human
ggggcaattagaaacagagt

SEQ ID NO: 277731 - DNA, 20 bp, human
gcagtcaatcgtgcaaacaa

SEQ ID NO: 277732 - DNA, 20 bp, human
gagaacttcatgatcatctg

SEQ ID NO: 277733 - DNA, 20 bp, human
gagtaacccaatacaaatat

SEQ ID NO: 277734 - DNA, 20 bp, human
gtcgtgcaaacaaaggttac

SEQ ID NO: 277735 - DNA, 20 bp, human
gtcacaggtttaatccccca

SEQ ID NO: 277736 - DNA, 20 bp, human
ggaagcccacaggggcactt

SEQ ID NO: 277737 - DNA, 20 bp, human
ggcaacggcgccacccggta

SEQ ID NO: 277738 - DNA, 20 bp, human
ggcgccacccggtagggtgg

SEQ ID NO: 277739 - DNA, 20 bp, human
gccccgaagcgaagccctgt

SEQ ID NO: 277740 - DNA, 20 bp, human
gcgctccctagcagcctggt

SEQ ID NO: 277741 - DNA, 20 bp, human
gagacgccgcgctgcccaat

SEQ ID NO: 277742 - DNA, 20 bp, human
gctccccccaccctaccggg

SEQ ID NO: 277743 - DNA, 20 bp, human
gccccagattgcattcctgg

SEQ ID NO: 277744 - DNA, 20 bp, human
gcggcgacggtgacgcgctc

SEQ ID NO: 277745 - DNA, 20 bp, human
gctggctccccccaccctac

SEQ ID NO: 277746 - DNA, 20 bp, human
ggaagagtgaaaccactctg

SEQ ID NO: 277747 - DNA, 20 bp, human
ggcaaaatgagtaggaccgg

SEQ ID NO: 277748 - DNA, 20 bp, human
gcactctgaggtaagtagcg

SEQ ID NO: 277749 - DNA, 20 bp, human
gtgggtttcaggaaggagaa

SEQ ID NO: 277750 - DNA, 20 bp, human
gagttctgccatgcaaagag

SEQ ID NO: 277751 - DNA, 20 bp, human
ggcttcggctagtgaaatct

SEQ ID NO: 277752 - DNA, 20 bp, human
gaaatgagtaggaccggagg

SEQ ID NO: 277753 - DNA, 20 bp, human
ggccaagaattgctagggca

SEQ ID NO: 277754 - DNA, 20 bp, human
ggaaggaagtggctgggatt

SEQ ID NO: 277755 - DNA, 20 bp, human
gggaacttggtcttatcttt

SEQ ID NO: 277756 - DNA, 20 bp, human
gaagaagggaaggcacgtta

SEQ ID NO: 277757 - DNA, 20 bp, human
gaaagtgtctggggaaggtt

SEQ ID NO: 277758 - DNA, 20 bp, human
ggcggcccctgcgttactgg

SEQ ID NO: 277759 - DNA, 20 bp, human
gcccactacaaatgcgggga

SEQ ID NO: 277760 - DNA, 20 bp, human
gaaagggaagaaagtgtctg

SEQ ID NO: 277761 - DNA, 20 bp, human
ggccgcggcccctgcgttac

SEQ ID NO: 277762 - DNA, 20 bp, human
gcagctctggagtcaggtag

SEQ ID NO: 277763 - DNA, 20 bp, human
ggggagaaagctaagttcag

SEQ ID NO: 277764 - DNA, 20 bp, human
ggggagggggcgggcgtcac

SEQ ID NO: 277765 - DNA, 20 bp, human
gtagggttccgggaagctga

SEQ ID NO: 277766 - DNA, 20 bp, human
gaagtctgcttaaggagtgg

SEQ ID NO: 277767 - DNA, 20 bp, human
ggagtgggggatgaagtctc

SEQ ID NO: 277768 - DNA, 20 bp, human
gtcacctgaaggaaacacag

SEQ ID NO: 277769 - DNA, 20 bp, human
ggggatgaagtctcgggttg

SEQ ID NO: 277770 - DNA, 20 bp, human
gaggtgagatttgtcgactg

SEQ ID NO: 277771 - DNA, 20 bp, human
gactgccagaagtctgctta

SEQ ID NO: 277772 - DNA, 20 bp, human
gagccctctgtgtttccttc

SEQ ID NO: 277773 - DNA, 20 bp, human
gcagatggtgattcacctga

SEQ ID NO: 277774 - DNA, 20 bp, human
gctagatagcaataggaggc

SEQ ID NO: 277775 - DNA, 20 bp, human
gttggatctgatgagttagt

SEQ ID NO: 277776 - DNA, 20 bp, human
ggcaccctgtgctcagaagc

SEQ ID NO: 277777 - DNA, 20 bp, human
gggaataaagagatcagtcc

SEQ ID NO: 277778 - DNA, 20 bp, human
ggcaggagagagcttcgagt

SEQ ID NO: 277779 - DNA, 20 bp, human
gcttagttatacatcatcca

SEQ ID NO: 277780 - DNA, 20 bp, human
ggatgaaaaataaggtgatt

SEQ ID NO: 277781 - DNA, 20 bp, human
gagagaaacttgttaacgac

SEQ ID NO: 277782 - DNA, 20 bp, human
ggagatcagtcctgggtact

SEQ ID NO: 277783 - DNA, 20 bp, human
ggactgagatgaaatactct

SEQ ID NO: 277784 - DNA, 20 bp, human
ggaaagtacgatttaaattg

SEQ ID NO: 277785 - DNA, 20 bp, human
gattcatgccaagcgtggaa

SEQ ID NO: 277786 - DNA, 20 bp, human
gcgcccgccttggtctcccc

SEQ ID NO: 277787 - DNA, 20 bp, human
gcccgccgcggaggccccag

SEQ ID NO: 277788 - DNA, 20 bp, human
gcccgcccctggggcctccg

SEQ ID NO: 277789 - DNA, 20 bp, human
gggacgctaggctcccgccg

SEQ ID NO: 277790 - DNA, 20 bp, human
gcgctaggctcccgccgcgg

SEQ ID NO: 277791 - DNA, 20 bp, human
gtctgaggctgaaggaggta

SEQ ID NO: 277792 - DNA, 20 bp, human
ggggcggggcttattagggg

SEQ ID NO: 277793 - DNA, 20 bp, human
gcccaggggcggggcttatt

SEQ ID NO: 277794 - DNA, 20 bp, human
gggtagcgttaacgtttctg

SEQ ID NO: 277795 - DNA, 20 bp, human
gttaacgtttctgaggctga

SEQ ID NO: 277796 - DNA, 20 bp, human
gttccgccgcggaagcccca

SEQ ID NO: 277797 - DNA, 20 bp, human
gcccgcccctggggcttccg

SEQ ID NO: 277798 - DNA, 20 bp, human
gggacgctaggcttccgccg

SEQ ID NO: 277799 - DNA, 20 bp, human
ggggcggggcttattagggg

SEQ ID NO: 277800 - DNA, 20 bp, human
gcaggggcggggcttattag

SEQ ID NO: 277801 - DNA, 20 bp, human
gtctgaggctgaaggaggta

SEQ ID NO: 277802 - DNA, 20 bp, human
ggccccagtcagccaatcag

SEQ ID NO: 277803 - DNA, 20 bp, human
gggtagcgttaacgtttctg

SEQ ID NO: 277804 - DNA, 20 bp, human
gttaacgtttctgaggctga

SEQ ID NO: 277805 - DNA, 20 bp, human
gtagccgctgattggctgac

SEQ ID NO: 277806 - DNA, 20 bp, human
gcccagggtgcggtgagact

SEQ ID NO: 277807 - DNA, 20 bp, human
ggccccgggggcacatacct

SEQ ID NO: 277808 - DNA, 20 bp, human
gcactggggtgggatctacg

SEQ ID NO: 277809 - DNA, 20 bp, human
gcgggggcacatacctgggt

SEQ ID NO: 277810 - DNA, 20 bp, human
ggtgggatctacggggctag

SEQ ID NO: 277811 - DNA, 20 bp, human
ggtgcccccggggccccact

SEQ ID NO: 277812 - DNA, 20 bp, human
gtgagaggaggggtctgagt

SEQ ID NO: 277813 - DNA, 20 bp, human
gccattggttgggttgtgaa

SEQ ID NO: 277814 - DNA, 20 bp, human
gtggctcagagcggatccct

SEQ ID NO: 277815 - DNA, 20 bp, human
gctcgatggcgccattggtt

SEQ ID NO: 277816 - DNA, 20 bp, human
gcggacctggctgcccgctg

SEQ ID NO: 277817 - DNA, 20 bp, human
gctcacctgaccagcggagc

SEQ ID NO: 277818 - DNA, 20 bp, human
gcacccccgctccgctggtc

SEQ ID NO: 277819 - DNA, 20 bp, human
gcgacgccagagcgcggacc

SEQ ID NO: 277820 - DNA, 20 bp, human
gctgctggaagagtccatta

SEQ ID NO: 277821 - DNA, 20 bp, human
gctgccttggccatccctaa

SEQ ID NO: 277822 - DNA, 20 bp, human
gggcagccaggtccgcgctc

SEQ ID NO: 277823 - DNA, 20 bp, human
gagcagagcgaggatgcaga

SEQ ID NO: 277824 - DNA, 20 bp, human
gcgcctaggctgacctgcct

SEQ ID NO: 277825 - DNA, 20 bp, human
gtctgctccaataggaccca

SEQ ID NO: 277826 - DNA, 20 bp, human
gaactatggtggttctgtga

SEQ ID NO: 277827 - DNA, 20 bp, human
gatggtggttctgtgagggg

SEQ ID NO: 277828 - DNA, 20 bp, human
gcagacaggcccggggttct

SEQ ID NO: 277829 - DNA, 20 bp, human
gccccaaccgcccccctata

SEQ ID NO: 277830 - DNA, 20 bp, human
gccaggacgagccccagccg

SEQ ID NO: 277831 - DNA, 20 bp, human
gggtgagcagactagggagg

SEQ ID NO: 277832 - DNA, 20 bp, human
gaatatatggcaccggcggg

SEQ ID NO: 277833 - DNA, 20 bp, human
ggaaggagggtgagcagact

SEQ ID NO: 277834 - DNA, 20 bp, human
gcctccttcctggatgttaa

SEQ ID NO: 277835 - DNA, 20 bp, human
gcacccagcagtccttatag

SEQ ID NO: 277836 - DNA, 20 bp, human
gtcggggtcggaactacggt

SEQ ID NO: 277837 - DNA, 20 bp, human
ggccctgcccacctcggggt

SEQ ID NO: 277838 - DNA, 20 bp, human
gactacggtgggcctgggat

SEQ ID NO: 277839 - DNA, 20 bp, human
gtcggaactacggtgggcct

SEQ ID NO: 277840 - DNA, 20 bp, human
ggtagttccgaccccgaggt

SEQ ID NO: 277841 - DNA, 20 bp, human
gtacagcagcgacagaaata

SEQ ID NO: 277842 - DNA, 20 bp, human
ggtgcagacacatcacgggg

SEQ ID NO: 277843 - DNA, 20 bp, human
gctgtaatatatgggaccag

SEQ ID NO: 277844 - DNA, 20 bp, human
gcccaaccgcccccctcaca

SEQ ID NO: 277845 - DNA, 20 bp, human
ggccgcgctggagagaacag

SEQ ID NO: 277846 - DNA, 20 bp, human
gcacccccgcccagcttcca

SEQ ID NO: 277847 - DNA, 20 bp, human
gcaaggagggggagggtcga

SEQ ID NO: 277848 - DNA, 20 bp, human
gtcccccgggaggtgacagc

SEQ ID NO: 277849 - DNA, 20 bp, human
gaaaaaccgtctgacgtcag

SEQ ID NO: 277850 - DNA, 20 bp, human
gcgttccctccctccggcga

SEQ ID NO: 277851 - DNA, 20 bp, human
gacagctggcggggcccgta

SEQ ID NO: 277852 - DNA, 20 bp, human
ggagtccgatgcgctgggca

SEQ ID NO: 277853 - DNA, 20 bp, human
gaggcgggtgtggctccccc

SEQ ID NO: 277854 - DNA, 20 bp, human
gcacccctggaagctgggcg

SEQ ID NO: 277855 - DNA, 20 bp, human
gtgctcacgcgctggtccca

SEQ ID NO: 277856 - DNA, 20 bp, human
ggaagaggacgtaggtgagc

SEQ ID NO: 277857 - DNA, 20 bp, human
gtcttcattgcgacgaggag

SEQ ID NO: 277858 - DNA, 20 bp, human
gggtcagcgccatcaagaag

SEQ ID NO: 277859 - DNA, 20 bp, human
gaatggagaggagcatcgtg

SEQ ID NO: 277860 - DNA, 20 bp, human
gcaaagtcttcattgcgacg

SEQ ID NO: 277861 - DNA, 20 bp, human
gcccgtgaaggaaccacaga

SEQ ID NO: 277862 - DNA, 20 bp, human
gaccttctgtggttccttca

SEQ ID NO: 277863 - DNA, 20 bp, human
gacctacgtcctcttcttga

SEQ ID NO: 277864 - DNA, 20 bp, human
gacgggctggaagagacatg

SEQ ID NO: 277865 - DNA, 20 bp, human
ggaggacgtaggtgagcagg

SEQ ID NO: 277866 - DNA, 20 bp, human
gcccgccggcggttccgcgc

SEQ ID NO: 277867 - DNA, 20 bp, human
gcgagccgggcaactcccca

SEQ ID NO: 277868 - DNA, 20 bp, human
ggggaatcgtctctgagatc

SEQ ID NO: 277869 - DNA, 20 bp, human
gtagccccgcgcggaaccgc

SEQ ID NO: 277870 - DNA, 20 bp, human
ggggagttgcccggctcgtc

SEQ ID NO: 277871 - DNA, 20 bp, human
ggggctagaagctacgagct

SEQ ID NO: 277872 - DNA, 20 bp, human
gctacgagcttgggctccgg

SEQ ID NO: 277873 - DNA, 20 bp, human
gccccgcgcggaaccgccgg

SEQ ID NO: 277874 - DNA, 20 bp, human
gcgccggcgggaccgggggt

SEQ ID NO: 277875 - DNA, 20 bp, human
gcctccctcggtaagtgtat

SEQ ID NO: 277876 - DNA, 20 bp, human
gaaaggggagggtatctccc

SEQ ID NO: 277877 - DNA, 20 bp, human
gtgcgcgcgcccgcatgcgg

SEQ ID NO: 277878 - DNA, 20 bp, human
gctctctggaagacgcggtg

SEQ ID NO: 277879 - DNA, 20 bp, human
ggccggggcaattggtgtga

SEQ ID NO: 277880 - DNA, 20 bp, human
ggacacgcgcggggctacct

SEQ ID NO: 277881 - DNA, 20 bp, human
gctaccttggcgcgtctccg

SEQ ID NO: 277882 - DNA, 20 bp, human
gcaccccggaacagggagtg

SEQ ID NO: 277883 - DNA, 20 bp, human
gagggccctggagacgcgga

SEQ ID NO: 277884 - DNA, 20 bp, human
gacaccaattgccccggcga

SEQ ID NO: 277885 - DNA, 20 bp, human
gacgcggtggggggtgcgca

SEQ ID NO: 277886 - DNA, 20 bp, human
gcacccgctccctaaggcca

SEQ ID NO: 277887 - DNA, 20 bp, human
gcgggtgtaaatctgaaagt

SEQ ID NO: 277888 - DNA, 20 bp, human
gtgaaagtgggtataaatct

SEQ ID NO: 277889 - DNA, 20 bp, human
gcagaggcaccttggcctta

SEQ ID NO: 277890 - DNA, 20 bp, human
gccctcaggtgacttacacc

SEQ ID NO: 277891 - DNA, 20 bp, human
gggtataaatctaggaaaga

SEQ ID NO: 277892 - DNA, 20 bp, human
ggaacctcagtgagagccta

SEQ ID NO: 277893 - DNA, 20 bp, human
ggatttacacccgctcccta

SEQ ID NO: 277894 - DNA, 20 bp, human
gcaccttggccttagggagc

SEQ ID NO: 277895 - DNA, 20 bp, human
gcattcagggaagctacaca

SEQ ID NO: 277896 - DNA, 20 bp, human
gtactctagtgatatgtcaa

SEQ ID NO: 277897 - DNA, 20 bp, human
ggaaatgccaacgtgactca

SEQ ID NO: 277898 - DNA, 20 bp, human
gcaagggccctgagtcacgt

SEQ ID NO: 277899 - DNA, 20 bp, human
gatcacattatctctaacac

SEQ ID NO: 277900 - DNA, 20 bp, human
gaaaaagcctgtgttcttat

SEQ ID NO: 277901 - DNA, 20 bp, human
ggaactgtctatttctaaag

SEQ ID NO: 277902 - DNA, 20 bp, human
gtaaaaaggtatcacattca

SEQ ID NO: 277903 - DNA, 20 bp, human
gatttctaacacagggaaag

SEQ ID NO: 277904 - DNA, 20 bp, human
gctttcaagaagaagcagtt

SEQ ID NO: 277905 - DNA, 20 bp, human
ggctacatatttctaacaca

SEQ ID NO: 277906 - DNA, 20 bp, human
gagcccagcggccgcagtta

SEQ ID NO: 277907 - DNA, 20 bp, human
gcgctggccaaccctaactg

SEQ ID NO: 277908 - DNA, 20 bp, human
gcgaggacggcgcggaaccc

SEQ ID NO: 277909 - DNA, 20 bp, human
gggccgcctcggaaccgcga

SEQ ID NO: 277910 - DNA, 20 bp, human
gcagcggccgcagttagggt

SEQ ID NO: 277911 - DNA, 20 bp, human
gccgcggccggagggagcga

SEQ ID NO: 277912 - DNA, 20 bp, human
gagcaaaggggcagcctctc

SEQ ID NO: 277913 - DNA, 20 bp, human
gtccggccgcggtttccccg

SEQ ID NO: 277914 - DNA, 20 bp, human
ggtgggaacccgctcgagga

SEQ ID NO: 277915 - DNA, 20 bp, human
gaccgcggggaaaccgcggc

SEQ ID NO: 277916 - DNA, 20 bp, human
gcaagcgccgggtacaggga

SEQ ID NO: 277917 - DNA, 20 bp, human
gaccgaggacagtggggacc

SEQ ID NO: 277918 - DNA, 20 bp, human
ggctccgcgcgctcccgttg

SEQ ID NO: 277919 - DNA, 20 bp, human
gaggcggcgcagtaggctga

SEQ ID NO: 277920 - DNA, 20 bp, human
gggagcaagcgccgggtaca

SEQ ID NO: 277921 - DNA, 20 bp, human
gtggggacccggcctgagga

SEQ ID NO: 277922 - DNA, 20 bp, human
gcggcgggcgagagggtgag

SEQ ID NO: 277923 - DNA, 20 bp, human
gagaacaggcggtcgtggtg

SEQ ID NO: 277924 - DNA, 20 bp, human
ggggggaagcgctgctcctg

SEQ ID NO: 277925 - DNA, 20 bp, human
gtctggggccggagaatcgt

SEQ ID NO: 277926 - DNA, 20 bp, human
gtgggcagcgctggacagat

SEQ ID NO: 277927 - DNA, 20 bp, human
gtcccccaggaccgggaagg

SEQ ID NO: 277928 - DNA, 20 bp, human
ggccgggcgcagagccagtt

SEQ ID NO: 277929 - DNA, 20 bp, human
gggacagatgggtacacccc

SEQ ID NO: 277930 - DNA, 20 bp, human
gggcctgacggatgaacagt

SEQ ID NO: 277931 - DNA, 20 bp, human
gccgggagctaggaggggtc

SEQ ID NO: 277932 - DNA, 20 bp, human
ggggcgcagagccagtttgg

SEQ ID NO: 277933 - DNA, 20 bp, human
gagaggggcgacagctttgc

SEQ ID NO: 277934 - DNA, 20 bp, human
gcagtcgggcgtagaccgag

SEQ ID NO: 277935 - DNA, 20 bp, human
gcccgccttcccggtcctgg

SEQ ID NO: 277936 - DNA, 20 bp, human
ggggccgctgcgttcttaaa

SEQ ID NO: 277937 - DNA, 20 bp, human
gtgcgagcggagaacctggc

SEQ ID NO: 277938 - DNA, 20 bp, human
gtcgctgccccggaagtgga

SEQ ID NO: 277939 - DNA, 20 bp, human
ggcgctgcgagcggagaacc

SEQ ID NO: 277940 - DNA, 20 bp, human
gggacccccggcgctgcgag

SEQ ID NO: 277941 - DNA, 20 bp, human
gagtaacagcagcgcggcca

SEQ ID NO: 277942 - DNA, 20 bp, human
gttctccgctcgcagcgccg

SEQ ID NO: 277943 - DNA, 20 bp, human
gcgccgcccacccacggctc

SEQ ID NO: 277944 - DNA, 20 bp, human
gtgggccgggcctagaccct

SEQ ID NO: 277945 - DNA, 20 bp, human
gccccgcgccccggaagcga

SEQ ID NO: 277946 - DNA, 20 bp, human
gggcgtacaaaccccgtcgc

SEQ ID NO: 277947 - DNA, 20 bp, human
gcgacctcacaggtgaaaga

SEQ ID NO: 277948 - DNA, 20 bp, human
gcggcccggccgagtccttc

SEQ ID NO: 277949 - DNA, 20 bp, human
gcagagaaggcgggtaggaa

SEQ ID NO: 277950 - DNA, 20 bp, human
ggggccgccggatgtgacgc

SEQ ID NO: 277951 - DNA, 20 bp, human
ggcccctgcgtcacatccgg

SEQ ID NO: 277952 - DNA, 20 bp, human
gcggcggcggccgacctcac

SEQ ID NO: 277953 - DNA, 20 bp, human
gccttccggagtcacggcgg

SEQ ID NO: 277954 - DNA, 20 bp, human
gggatgtgacgcaggggcca

SEQ ID NO: 277955 - DNA, 20 bp, human
gcttctctgcgctttctcag

SEQ ID NO: 277956 - DNA, 20 bp, human
ggtgaggcgggcagtccccg

SEQ ID NO: 277957 - DNA, 20 bp, human
gcgcagagggaggcacgcgg

SEQ ID NO: 277958 - DNA, 20 bp, human
gctctcccctgcattccctg

SEQ ID NO: 277959 - DNA, 20 bp, human
ggcgggcggcggtgacatca

SEQ ID NO: 277960 - DNA, 20 bp, human
gccccgcagagggaggcacg

SEQ ID NO: 277961 - DNA, 20 bp, human
gcgggcagtccccggggagg

SEQ ID NO: 277962 - DNA, 20 bp, human
gccccgccccccgcagaggg

SEQ ID NO: 277963 - DNA, 20 bp, human
gcccgcgcacatcacttcct

SEQ ID NO: 277964 - DNA, 20 bp, human
gcggggggaggggcgccgtg

SEQ ID NO: 277965 - DNA, 20 bp, human
gggagggggcgcggaccggg

SEQ ID NO: 277966 - DNA, 20 bp, human
gtgcgtgtcaaggtgacagg

SEQ ID NO: 277967 - DNA, 20 bp, human
ggggaaccgtctgcgtgtca

SEQ ID NO: 277968 - DNA, 20 bp, human
gttccccaggactgcgaaga

SEQ ID NO: 277969 - DNA, 20 bp, human
gaggagggcggtgttgagac

SEQ ID NO: 277970 - DNA, 20 bp, human
ggaaagacgcggggcgttgt

SEQ ID NO: 277971 - DNA, 20 bp, human
gggacgctccgggaaagcga

SEQ ID NO: 277972 - DNA, 20 bp, human
gacacgtcccggagcagagg

SEQ ID NO: 277973 - DNA, 20 bp, human
gtcaaggtgacagggggctt

SEQ ID NO: 277974 - DNA, 20 bp, human
ggggacccctaggtggcgga

SEQ ID NO: 277975 - DNA, 20 bp, human
ggagcggcgggacccctagg

SEQ ID NO: 277976 - DNA, 20 bp, human
gagggattaggggactactg

SEQ ID NO: 277977 - DNA, 20 bp, human
gctacaccagggtctatctt

SEQ ID NO: 277978 - DNA, 20 bp, human
gccagtcccggtaagtaaga

SEQ ID NO: 277979 - DNA, 20 bp, human
ggaactagctacacaggaag

SEQ ID NO: 277980 - DNA, 20 bp, human
gagggccaaatcctacacca

SEQ ID NO: 277981 - DNA, 20 bp, human
gagtggagggggctcatggt

SEQ ID NO: 277982 - DNA, 20 bp, human
ggtctatcttagggagggaa

SEQ ID NO: 277983 - DNA, 20 bp, human
gccagggtctatcttaggga

SEQ ID NO: 277984 - DNA, 20 bp, human
gatgggcggggcccgtgggg

SEQ ID NO: 277985 - DNA, 20 bp, human
gtacttaccgggactgggag

SEQ ID NO: 277986 - DNA, 20 bp, human
gagcaggagacccacatggg

SEQ ID NO: 277987 - DNA, 20 bp, human
gtgcctagtgtccccacgaa

SEQ ID NO: 277988 - DNA, 20 bp, human
ggagagcaggagacccacat

SEQ ID NO: 277989 - DNA, 20 bp, human
ggtccccacgaagggagagc

SEQ ID NO: 277990 - DNA, 20 bp, human
gggagacccacatggggggt

SEQ ID NO: 277991 - DNA, 20 bp, human
ggctctgagggactagacat

SEQ ID NO: 277992 - DNA, 20 bp, human
gtcagtccggacagctctga

SEQ ID NO: 277993 - DNA, 20 bp, human
ggggccccgccccacccgtc

SEQ ID NO: 277994 - DNA, 20 bp, human
gctcccttcgtggggacact

SEQ ID NO: 277995 - DNA, 20 bp, human
gaggcagtgggtgaggtggc

SEQ ID NO: 277996 - DNA, 20 bp, human
gtgaggacacccttccaacc

SEQ ID NO: 277997 - DNA, 20 bp, human
gctggtggcaggtggacctt

SEQ ID NO: 277998 - DNA, 20 bp, human
gttcccctagcatccctggt

SEQ ID NO: 277999 - DNA, 20 bp, human
gttaggggcctcaagcagga

SEQ ID NO: 278000 - DNA, 20 bp, human
gcttccaaccagggatgcta

SEQ ID NO: 278001 - DNA, 20 bp, human
ggctggttaaatttagtgtg

SEQ ID NO: 278002 - DNA, 20 bp, human
ggggacccacaaccccccca

SEQ ID NO: 278003 - DNA, 20 bp, human
gcctggcaagggagtccaag

SEQ ID NO: 278004 - DNA, 20 bp, human
gcgtcagcccagtgtccttt

SEQ ID NO: 278005 - DNA, 20 bp, human
gacaatgtgtcagggtgagg

SEQ ID NO: 278006 - DNA, 20 bp, human
gcggacgcgccactggggac

SEQ ID NO: 278007 - DNA, 20 bp, human
gctactgtccggtcccggtc

SEQ ID NO: 278008 - DNA, 20 bp, human
gtcactctccgcagccgctc

SEQ ID NO: 278009 - DNA, 20 bp, human
gaacgctcccgcctactgtc

SEQ ID NO: 278010 - DNA, 20 bp, human
gggctctttgtcccagttga

SEQ ID NO: 278011 - DNA, 20 bp, human
ggcccggcgcggggcgctgt

SEQ ID NO: 278012 - DNA, 20 bp, human
ggggcggccccgacggtggt

SEQ ID NO: 278013 - DNA, 20 bp, human
gctcgcacacccaccaccgt

SEQ ID NO: 278014 - DNA, 20 bp, human
gcccgcctactgtccggtcc

SEQ ID NO: 278015 - DNA, 20 bp, human
ggggagcgttcgtccgaacg

SEQ ID NO: 278016 - DNA, 20 bp, human
gaaggagcagcaggcatgtc

SEQ ID NO: 278017 - DNA, 20 bp, human
ggggccgagccctccgggta

SEQ ID NO: 278018 - DNA, 20 bp, human
gcaagggctggggccctcga

SEQ ID NO: 278019 - DNA, 20 bp, human
gaaccaggcggcagcggtcc

SEQ ID NO: 278020 - DNA, 20 bp, human
gccaggcaaccaggcggcag

SEQ ID NO: 278021 - DNA, 20 bp, human
gaggagcacgcgtcccgctc

SEQ ID NO: 278022 - DNA, 20 bp, human
gagaaaaaacggagccctcg

SEQ ID NO: 278023 - DNA, 20 bp, human
ggctggagagtgcgcccgag

SEQ ID NO: 278024 - DNA, 20 bp, human
ggagccctccgggtagggcg

SEQ ID NO: 278025 - DNA, 20 bp, human
ggggacagccagagggatct

SEQ ID NO: 278026 - DNA, 20 bp, human
gccccaccctgctgcaacct

SEQ ID NO: 278027 - DNA, 20 bp, human
gcaaacagcacttacaggtg

SEQ ID NO: 278028 - DNA, 20 bp, human
gtcccaggttgcagcagggt

SEQ ID NO: 278029 - DNA, 20 bp, human
gtgtaagtgctgtttgaaca

SEQ ID NO: 278030 - DNA, 20 bp, human
gaagtgctgtttgaacaagg

SEQ ID NO: 278031 - DNA, 20 bp, human
gcagagccctaaaggtcgaa

SEQ ID NO: 278032 - DNA, 20 bp, human
gccttgttcagtctgttaat

SEQ ID NO: 278033 - DNA, 20 bp, human
gtccaccaggacaaaatcaa

SEQ ID NO: 278034 - DNA, 20 bp, human
gaggatgacttagcaaaaac

SEQ ID NO: 278035 - DNA, 20 bp, human
gccctaaaggtcgaatggag

SEQ ID NO: 278036 - DNA, 20 bp, human
gtcactgtcgccccgggacg

SEQ ID NO: 278037 - DNA, 20 bp, human
gaccgcctcccacgtccaca

SEQ ID NO: 278038 - DNA, 20 bp, human
gcacccgagggcttgaaagg

SEQ ID NO: 278039 - DNA, 20 bp, human
gaggtccctgtggacgtggg

SEQ ID NO: 278040 - DNA, 20 bp, human
gtaggcggctgggatttcag

SEQ ID NO: 278041 - DNA, 20 bp, human
ggtcaggtccctgtggacgt

SEQ ID NO: 278042 - DNA, 20 bp, human
gcgattggctgcaagggtct

SEQ ID NO: 278043 - DNA, 20 bp, human
gggctccaaagtgcgaaagg

SEQ ID NO: 278044 - DNA, 20 bp, human
gcgcactttggagccaaaag

SEQ ID NO: 278045 - DNA, 20 bp, human
ggcggattggtcacacccga

SEQ ID NO: 278046 - DNA, 20 bp, human
ggggaggcagcgcagttatc

SEQ ID NO: 278047 - DNA, 20 bp, human
ggccccgccgtggccctcaa

SEQ ID NO: 278048 - DNA, 20 bp, human
gcggggctgctgcgcccgag

SEQ ID NO: 278049 - DNA, 20 bp, human
gccgacgcgcgtccattggt

SEQ ID NO: 278050 - DNA, 20 bp, human
gggcggagctggaccgttga

SEQ ID NO: 278051 - DNA, 20 bp, human
gggaccgttgagggccacgg

SEQ ID NO: 278052 - DNA, 20 bp, human
ggctgcgcccgagcggttgg

SEQ ID NO: 278053 - DNA, 20 bp, human
gccggcacgcgcgcctgcaa

SEQ ID NO: 278054 - DNA, 20 bp, human
ggaagccggcgctgctctgt

SEQ ID NO: 278055 - DNA, 20 bp, human
gtccgcgcccccaaccgctc

SEQ ID NO: 278056 - DNA, 20 bp, human
gcccccacaggccagtcaca

SEQ ID NO: 278057 - DNA, 20 bp, human
gaagcgctgagtgctcacgg

SEQ ID NO: 278058 - DNA, 20 bp, human
gtgctcacgggggtgtgtgt

SEQ ID NO: 278059 - DNA, 20 bp, human
gattcccgacgcatgaggtc

SEQ ID NO: 278060 - DNA, 20 bp, human
gtaccactgcaatgaggacc

SEQ ID NO: 278061 - DNA, 20 bp, human
gcctctgaggtccttaaaca

SEQ ID NO: 278062 - DNA, 20 bp, human
gggtgatagcaagccctctg

SEQ ID NO: 278063 - DNA, 20 bp, human
ggtgtgtgtgggacaggatg

SEQ ID NO: 278064 - DNA, 20 bp, human
gacctgggactcataagttc

SEQ ID NO: 278065 - DNA, 20 bp, human
gtcaccccgacctcatgcgt

SEQ ID NO: 278066 - DNA, 20 bp, human
gtgaaactaaagtctgggtg

SEQ ID NO: 278067 - DNA, 20 bp, human
ggagcaggctcgatggtgag

SEQ ID NO: 278068 - DNA, 20 bp, human
gaatgccttttgtgtgaagc

SEQ ID NO: 278069 - DNA, 20 bp, human
gaagctggcagaggcaacgc

SEQ ID NO: 278070 - DNA, 20 bp, human
ggcaggtggagcaggctcga

SEQ ID NO: 278071 - DNA, 20 bp, human
gcctcttgaaactaaagtct

SEQ ID NO: 278072 - DNA, 20 bp, human
gagaacttgggaatgtgtgt

SEQ ID NO: 278073 - DNA, 20 bp, human
ggaggggtttacaactgaag

SEQ ID NO: 278074 - DNA, 20 bp, human
gtctgccagcttcacacaaa

SEQ ID NO: 278075 - DNA, 20 bp, human
gaatgccactctgcgattgg

SEQ ID NO: 278076 - DNA, 20 bp, human
ggaaacgaactccggtctca

SEQ ID NO: 278077 - DNA, 20 bp, human
gtccgcaggcggtggatgtc

SEQ ID NO: 278078 - DNA, 20 bp, human
gagaaactgaggtcggagtg

SEQ ID NO: 278079 - DNA, 20 bp, human
gaatcctgaaaccctggctc

SEQ ID NO: 278080 - DNA, 20 bp, human
gaccggagttcgtttcagtg

SEQ ID NO: 278081 - DNA, 20 bp, human
gtgcgctgcctcaggacaga

SEQ ID NO: 278082 - DNA, 20 bp, human
gtgcggagggaacgagaacg

SEQ ID NO: 278083 - DNA, 20 bp, human
ggccggacatccaccgcctg

SEQ ID NO: 278084 - DNA, 20 bp, human
gttctcgttccctccgcagg

SEQ ID NO: 278085 - DNA, 20 bp, human
gggcggtggatgtccggctc

SEQ ID NO: 278086 - DNA, 20 bp, human
ggtaactcgaaagctacgga

SEQ ID NO: 278087 - DNA, 20 bp, human
gaggagctgaaacttgaaac

SEQ ID NO: 278088 - DNA, 20 bp, human
gacggaaaaccaggaaggac

SEQ ID NO: 278089 - DNA, 20 bp, human
ggaaagaccacttctcagag

SEQ ID NO: 278090 - DNA, 20 bp, human
gttacaagagcaccatcttc

SEQ ID NO: 278091 - DNA, 20 bp, human
ggccttagctagatgaatca

SEQ ID NO: 278092 - DNA, 20 bp, human
gtgaaaccggcttagtttaa

SEQ ID NO: 278093 - DNA, 20 bp, human
ggtaatagtaacgtccttca

SEQ ID NO: 278094 - DNA, 20 bp, human
gaccctgattcatctagcta

SEQ ID NO: 278095 - DNA, 20 bp, human
gcagctcctccttgaattcc

SEQ ID NO: 278096 - DNA, 20 bp, human
gacgccgcggcggcctccgg

SEQ ID NO: 278097 - DNA, 20 bp, human
gtgagagccggggcgaaggt

SEQ ID NO: 278098 - DNA, 20 bp, human
gaggggcatagtagttgcta

SEQ ID NO: 278099 - DNA, 20 bp, human
gggggccgcagaggcctaga

SEQ ID NO: 278100 - DNA, 20 bp, human
gcagctgcctgcccgcaggt

SEQ ID NO: 278101 - DNA, 20 bp, human
ggggaagtccctagaaacgg

SEQ ID NO: 278102 - DNA, 20 bp, human
gtgggggcggcgccgtgacg

SEQ ID NO: 278103 - DNA, 20 bp, human
gccgccttccctcccgggct

SEQ ID NO: 278104 - DNA, 20 bp, human
gagggggctccccaacctgc

SEQ ID NO: 278105 - DNA, 20 bp, human
gcagctgcctccacgatgtt

SEQ ID NO: 278106 - DNA, 20 bp, human
gagagggtgcgtgaggaatg

SEQ ID NO: 278107 - DNA, 20 bp, human
gtgtcccaggcactcaccac

SEQ ID NO: 278108 - DNA, 20 bp, human
gtctgtcagcatccactcag

SEQ ID NO: 278109 - DNA, 20 bp, human
ggggcattttaacccctgag

SEQ ID NO: 278110 - DNA, 20 bp, human
ggaggtgtgcagaggaccta

SEQ ID NO: 278111 - DNA, 20 bp, human
ggggacagaatatcagggag

SEQ ID NO: 278112 - DNA, 20 bp, human
ggagccgcctgcccgagctg

SEQ ID NO: 278113 - DNA, 20 bp, human
gtcagagctggtatgaggtg

SEQ ID NO: 278114 - DNA, 20 bp, human
ggctgttgacggcaactcca

SEQ ID NO: 278115 - DNA, 20 bp, human
gaaatgccccacccctgcgg

SEQ ID NO: 278116 - DNA, 20 bp, human
ggcggctggaagtactcgga

SEQ ID NO: 278117 - DNA, 20 bp, human
gctgaaggcttgtctttcta

SEQ ID NO: 278118 - DNA, 20 bp, human
ggtgaaggattcctgacgat

SEQ ID NO: 278119 - DNA, 20 bp, human
gagcgcgcgctgcgagttac

SEQ ID NO: 278120 - DNA, 20 bp, human
gagctgcggctggaagtact

SEQ ID NO: 278121 - DNA, 20 bp, human
gtgttaccgggttagcctga

SEQ ID NO: 278122 - DNA, 20 bp, human
gaatccttcacggccgccag

SEQ ID NO: 278123 - DNA, 20 bp, human
gcccggtaacacccatcgtc

SEQ ID NO: 278124 - DNA, 20 bp, human
ggaagtactcggagggccgg

SEQ ID NO: 278125 - DNA, 20 bp, human
gctggaagtactcggagggc

SEQ ID NO: 278126 - DNA, 20 bp, human
gtccgggacctcccagtccg

SEQ ID NO: 278127 - DNA, 20 bp, human
gggacccaagccgcaagact

SEQ ID NO: 278128 - DNA, 20 bp, human
gccgcccgcccgcccattgg

SEQ ID NO: 278129 - DNA, 20 bp, human
gctcctgtccctcacgtcga

SEQ ID NO: 278130 - DNA, 20 bp, human
gagggggaggaacggccaat

SEQ ID NO: 278131 - DNA, 20 bp, human
ggggcggggcgggctctcga

SEQ ID NO: 278132 - DNA, 20 bp, human
gctggctcccgggttcgtgg

SEQ ID NO: 278133 - DNA, 20 bp, human
gcgacccgccaatgggcggg

SEQ ID NO: 278134 - DNA, 20 bp, human
gatcctagcgctcggttccc

SEQ ID NO: 278135 - DNA, 20 bp, human
ggacgacagaagcgtccaga

SEQ ID NO: 278136 - DNA, 20 bp, human
gtgaacgagtctttcgggag

SEQ ID NO: 278137 - DNA, 20 bp, human
ggacctggacacgtcggagc

SEQ ID NO: 278138 - DNA, 20 bp, human
gcctcctgggttggggaaag

SEQ ID NO: 278139 - DNA, 20 bp, human
gccactgtggaaaagccgag

SEQ ID NO: 278140 - DNA, 20 bp, human
ggtaacagggggatttttag

SEQ ID NO: 278141 - DNA, 20 bp, human
ggccgcggacctggacacgt

SEQ ID NO: 278142 - DNA, 20 bp, human
gcggctctagataccggaaa

SEQ ID NO: 278143 - DNA, 20 bp, human
ggaaatggagacgtctgagt

SEQ ID NO: 278144 - DNA, 20 bp, human
ggtgtccaggtccgcggccc

SEQ ID NO: 278145 - DNA, 20 bp, human
gcgcccgctccgacgtgtcc

SEQ ID NO: 278146 - DNA, 20 bp, human
gcccacacgcagggcacggc

SEQ ID NO: 278147 - DNA, 20 bp, human
ggccctgcacccatcaggtg

SEQ ID NO: 278148 - DNA, 20 bp, human
gaccggccgtgccctgcgtg

SEQ ID NO: 278149 - DNA, 20 bp, human
gggccccacctgatgggtgc

SEQ ID NO: 278150 - DNA, 20 bp, human
gggccaagggccccacctga

SEQ ID NO: 278151 - DNA, 20 bp, human
ggggggcctcgcttggtggg

SEQ ID NO: 278152 - DNA, 20 bp, human
gcaagggaagaatgctgctc

SEQ ID NO: 278153 - DNA, 20 bp, human
gcccccgccctgcacccatc

SEQ ID NO: 278154 - DNA, 20 bp, human
ggagggccagccatgccaaa

SEQ ID NO: 278155 - DNA, 20 bp, human
gaagaatgctgctctggcat

SEQ ID NO: 278156 - DNA, 20 bp, human
gcagccgggccctgatgtgg

SEQ ID NO: 278157 - DNA, 20 bp, human
gagagccgccagataataag

SEQ ID NO: 278158 - DNA, 20 bp, human
gaggactgagacttggagga

SEQ ID NO: 278159 - DNA, 20 bp, human
gtcccccagggacattgctt

SEQ ID NO: 278160 - DNA, 20 bp, human
gcagataataaggggatgaa

SEQ ID NO: 278161 - DNA, 20 bp, human
gagggacccagaactcggag

SEQ ID NO: 278162 - DNA, 20 bp, human
gacagctgacctccacatca

SEQ ID NO: 278163 - DNA, 20 bp, human
gagggcaagcgccagagacc

SEQ ID NO: 278164 - DNA, 20 bp, human
gggaggtcagctgtgatcca

SEQ ID NO: 278165 - DNA, 20 bp, human
gcctcctaagcaatgtccct

SEQ ID NO: 278166 - DNA, 20 bp, human
gtcaacaagacttgtaggtc

SEQ ID NO: 278167 - DNA, 20 bp, human
gtggagcctggatggatcct

SEQ ID NO: 278168 - DNA, 20 bp, human
gaggtgggacttaaatccta

SEQ ID NO: 278169 - DNA, 20 bp, human
gacttgtaggtcgggcgcga

SEQ ID NO: 278170 - DNA, 20 bp, human
ggtgagccaaggatccatcc

SEQ ID NO: 278171 - DNA, 20 bp, human
gtacaagtcttgttgacctt

SEQ ID NO: 278172 - DNA, 20 bp, human
gcaatggcgcaatctcaggc

SEQ ID NO: 278173 - DNA, 20 bp, human
gtggcgcaatctcaggcagg

SEQ ID NO: 278174 - DNA, 20 bp, human
gggattgcttggagcctgga

SEQ ID NO: 278175 - DNA, 20 bp, human
gggttttcaccatgttacca

SEQ ID NO: 278176 - DNA, 20 bp, human
gacaggaactagcacatatg

SEQ ID NO: 278177 - DNA, 20 bp, human
ggaggaggaggcacagttaa

SEQ ID NO: 278178 - DNA, 20 bp, human
gtatggggcttcggagagtt

SEQ ID NO: 278179 - DNA, 20 bp, human
gcagactgcagggctgacta

SEQ ID NO: 278180 - DNA, 20 bp, human
gggtttgcctacagactgca

SEQ ID NO: 278181 - DNA, 20 bp, human
gtgaacacaagtgttcaggg

SEQ ID NO: 278182 - DNA, 20 bp, human
gactagcacatatggggctt

SEQ ID NO: 278183 - DNA, 20 bp, human
ggcgtgagccttagattatg

SEQ ID NO: 278184 - DNA, 20 bp, human
gtaacattgtgagtgatcga

SEQ ID NO: 278185 - DNA, 20 bp, human
ggtctgtaggcaaaccacac

SEQ ID NO: 278186 - DNA, 20 bp, human
ggcacctggggtctgaggta

SEQ ID NO: 278187 - DNA, 20 bp, human
gtctgaggtagggacagagc

SEQ ID NO: 278188 - DNA, 20 bp, human
gactccccaagggccattcc

SEQ ID NO: 278189 - DNA, 20 bp, human
gggaaaagatggagagtcat

SEQ ID NO: 278190 - DNA, 20 bp, human
gccccactcccagagcttca

SEQ ID NO: 278191 - DNA, 20 bp, human
gtgagccagcaggacagctt

SEQ ID NO: 278192 - DNA, 20 bp, human
gaacagacatgtcacagagc

SEQ ID NO: 278193 - DNA, 20 bp, human
ggcttcagggagactcccca

SEQ ID NO: 278194 - DNA, 20 bp, human
gggagtctccctgaagctct

SEQ ID NO: 278195 - DNA, 20 bp, human
gagaccccaggtgccaggaa

SEQ ID NO: 278196 - DNA, 20 bp, human
gctcggggctgcgtgatacc

SEQ ID NO: 278197 - DNA, 20 bp, human
ggggctgcgtgatacctgga

SEQ ID NO: 278198 - DNA, 20 bp, human
gccacggcgctcgacggccg

SEQ ID NO: 278199 - DNA, 20 bp, human
ggggcgggatgaggcccccg

SEQ ID NO: 278200 - DNA, 20 bp, human
gacctggaggggtctgtgaa

SEQ ID NO: 278201 - DNA, 20 bp, human
gccccgcccacggcgctcga

SEQ ID NO: 278202 - DNA, 20 bp, human
gcggggctgcgcaggagtag

SEQ ID NO: 278203 - DNA, 20 bp, human
gtaagaagcctggggagtcg

SEQ ID NO: 278204 - DNA, 20 bp, human
ggggagggtcctccgtgctg

SEQ ID NO: 278205 - DNA, 20 bp, human
gcgctctcggagcctataaa

SEQ ID NO: 278206 - DNA, 20 bp, human
gcgccgcccggaccgctcgg

SEQ ID NO: 278207 - DNA, 20 bp, human
ggaggagcaggaaaagtagc

SEQ ID NO: 278208 - DNA, 20 bp, human
ggagcaggaaaagtagccgg

SEQ ID NO: 278209 - DNA, 20 bp, human
gcgcgctggcggccgccgag

SEQ ID NO: 278210 - DNA, 20 bp, human
gggcggccgccgagcggtcc

SEQ ID NO: 278211 - DNA, 20 bp, human
gctgccccgtactctgtcgt

SEQ ID NO: 278212 - DNA, 20 bp, human
gagcccggggcaggaacctc

SEQ ID NO: 278213 - DNA, 20 bp, human
gggccgccgagcggtccggg

SEQ ID NO: 278214 - DNA, 20 bp, human
gagtcccgaggacagcagga

SEQ ID NO: 278215 - DNA, 20 bp, human
gcgagtttaaagcccatcga

SEQ ID NO: 278216 - DNA, 20 bp, human
ggggaacaaggggttcttca

SEQ ID NO: 278217 - DNA, 20 bp, human
gcgtccttgcccatcaggcg

SEQ ID NO: 278218 - DNA, 20 bp, human
gcacagcccccccgcctgat

SEQ ID NO: 278219 - DNA, 20 bp, human
gtctgcgaatgcggcgtagc

SEQ ID NO: 278220 - DNA, 20 bp, human
gcgtagcgggtagacatgga

SEQ ID NO: 278221 - DNA, 20 bp, human
gtggccgcgtcacatgggtt

SEQ ID NO: 278222 - DNA, 20 bp, human
ggcggcgtagcgggtagaca

SEQ ID NO: 278223 - DNA, 20 bp, human
gacgccccaacgcccggcgg

SEQ ID NO: 278224 - DNA, 20 bp, human
ggatcctggaagagtagaac

SEQ ID NO: 278225 - DNA, 20 bp, human
ggggcgtggccgcgtcacat

SEQ ID NO: 278226 - DNA, 20 bp, human
gctcccgcgccgtcccatcc

SEQ ID NO: 278227 - DNA, 20 bp, human
ggtcccggatgggacggcgc

SEQ ID NO: 278228 - DNA, 20 bp, human
gccggcctcgcgtcccggat

SEQ ID NO: 278229 - DNA, 20 bp, human
gggcgcgggagcaatgccag

SEQ ID NO: 278230 - DNA, 20 bp, human
gcggcgaggcaaggcgcgga

SEQ ID NO: 278231 - DNA, 20 bp, human
gccgtcccatccgggacgcg

SEQ ID NO: 278232 - DNA, 20 bp, human
gtccccgcctccagcggcgc

SEQ ID NO: 278233 - DNA, 20 bp, human
ggggagggcgcgagagcggc

SEQ ID NO: 278234 - DNA, 20 bp, human
gcggtcccggcctcgcgtcc

SEQ ID NO: 278235 - DNA, 20 bp, human
gccgagcgggcgctcccgct

SEQ ID NO: 278236 - DNA, 20 bp, human
ggggaaccagctaggtgtca

SEQ ID NO: 278237 - DNA, 20 bp, human
gtacccgctctggcaccgag

SEQ ID NO: 278238 - DNA, 20 bp, human
gagccgggcccctgcgggta

SEQ ID NO: 278239 - DNA, 20 bp, human
gtcctcagccgggcccctgc

SEQ ID NO: 278240 - DNA, 20 bp, human
ggagagggttacggcgaccc

SEQ ID NO: 278241 - DNA, 20 bp, human
gcctacccatccaactgcct

SEQ ID NO: 278242 - DNA, 20 bp, human
gaaccctctcggtgccagag

SEQ ID NO: 278243 - DNA, 20 bp, human
gcccgcgagacttcccccgg

SEQ ID NO: 278244 - DNA, 20 bp, human
ggcagcaggtggcctccgca

SEQ ID NO: 278245 - DNA, 20 bp, human
gatgcgccctgacacctagc

SEQ ID NO: 278246 - DNA, 20 bp, human
gacacccagcgggaaggaag

SEQ ID NO: 278247 - DNA, 20 bp, human
gaggcctgtcagtcgcctgg

SEQ ID NO: 278248 - DNA, 20 bp, human
gggaaaggcggagactgagt

SEQ ID NO: 278249 - DNA, 20 bp, human
ggaaaagaggaagaagtcgg

SEQ ID NO: 278250 - DNA, 20 bp, human
gaggaagaggaagtgtgttc

SEQ ID NO: 278251 - DNA, 20 bp, human
ggtgcactgcgtgcaggaac

SEQ ID NO: 278252 - DNA, 20 bp, human
ggcacgcagtgcacacccag

SEQ ID NO: 278253 - DNA, 20 bp, human
ggggggccgaggctgaaaag

SEQ ID NO: 278254 - DNA, 20 bp, human
gcggcccccaggcgactgac

SEQ ID NO: 278255 - DNA, 20 bp, human
gaagaggaagaagtcggcgg

SEQ ID NO: 278256 - DNA, 20 bp, human
gcaggtaaggggaccgagat

SEQ ID NO: 278257 - DNA, 20 bp, human
gctggggctcctccaggtaa

SEQ ID NO: 278258 - DNA, 20 bp, human
ggagggggacaggtagttaa

SEQ ID NO: 278259 - DNA, 20 bp, human
gtcccccgctcggtgatgtc

SEQ ID NO: 278260 - DNA, 20 bp, human
ggagccccagcaggagtagc

SEQ ID NO: 278261 - DNA, 20 bp, human
gccgaagtctggctccgtct

SEQ ID NO: 278262 - DNA, 20 bp, human
gggccgccggccagttcagc

SEQ ID NO: 278263 - DNA, 20 bp, human
gcggagactggcacagcctg

SEQ ID NO: 278264 - DNA, 20 bp, human
gggccagttcagccggagac

SEQ ID NO: 278265 - DNA, 20 bp, human
gcgcctgggaggaggaaacc

SEQ ID NO: 278266 - DNA, 20 bp, human
gtacgctgtgcaaagaacaa

SEQ ID NO: 278267 - DNA, 20 bp, human
ggggctaagaagacacgaaa

SEQ ID NO: 278268 - DNA, 20 bp, human
ggacccagcaaaacacttca

SEQ ID NO: 278269 - DNA, 20 bp, human
ggctacctgtagtccttcgg

SEQ ID NO: 278270 - DNA, 20 bp, human
gtagccctgaagtgttttgc

SEQ ID NO: 278271 - DNA, 20 bp, human
gcttgcctccgaaggactac

SEQ ID NO: 278272 - DNA, 20 bp, human
gagggtcaggagaagaacac

SEQ ID NO: 278273 - DNA, 20 bp, human
gctaagaagacacgaaacgg

SEQ ID NO: 278274 - DNA, 20 bp, human
gcagcctggcttgcctccga

SEQ ID NO: 278275 - DNA, 20 bp, human
gagtccttcggaggcaagcc

SEQ ID NO: 278276 - DNA, 20 bp, human
ggctgggcggggggcgtcgt

SEQ ID NO: 278277 - DNA, 20 bp, human
gcacctgaggaatccgcctc

SEQ ID NO: 278278 - DNA, 20 bp, human
gggggggcgtcgttggaggg

SEQ ID NO: 278279 - DNA, 20 bp, human
ggacccccaaaagccactcg

SEQ ID NO: 278280 - DNA, 20 bp, human
gcgcccaccaccctcacaga

SEQ ID NO: 278281 - DNA, 20 bp, human
gcgtccgcgagtggcttttg

SEQ ID NO: 278282 - DNA, 20 bp, human
gggtccctcgccctctgtga

SEQ ID NO: 278283 - DNA, 20 bp, human
ggccccgcgggggtgtacag

SEQ ID NO: 278284 - DNA, 20 bp, human
ggtccgcgcgctcagttccc

SEQ ID NO: 278285 - DNA, 20 bp, human
gaatccgcctccggctgcgg

SEQ ID NO: 278286 - DNA, 20 bp, human
gaccccgcggggaagcagga

SEQ ID NO: 278287 - DNA, 20 bp, human
gccgaggcccccaacttcga

SEQ ID NO: 278288 - DNA, 20 bp, human
gggcggagaggggaccccgc

SEQ ID NO: 278289 - DNA, 20 bp, human
gggggcagtaccgggaaagg

SEQ ID NO: 278290 - DNA, 20 bp, human
gcggggccgcgcctctccat

SEQ ID NO: 278291 - DNA, 20 bp, human
ggggaagagcgagatctccg

SEQ ID NO: 278292 - DNA, 20 bp, human
ggctgggagaggtcacccca

SEQ ID NO: 278293 - DNA, 20 bp, human
gcaccccagggaaccgcgcc

SEQ ID NO: 278294 - DNA, 20 bp, human
ggggcggatagcgggtctgg

SEQ ID NO: 278295 - DNA, 20 bp, human
gcaacgcaggcgatgccggg

SEQ ID NO: 278296 - DNA, 20 bp, human
gcagtggatttacaaccctg

SEQ ID NO: 278297 - DNA, 20 bp, human
gaaatccactgactggaagg

SEQ ID NO: 278298 - DNA, 20 bp, human
gtgcaagcgactgaagtgtg

SEQ ID NO: 278299 - DNA, 20 bp, human
ggtgtggctgcaatgtttgt

SEQ ID NO: 278300 - DNA, 20 bp, human
gaatcctctcggcgctgcat

SEQ ID NO: 278301 - DNA, 20 bp, human
gtgtaaatccactgactgga

SEQ ID NO: 278302 - DNA, 20 bp, human
ggcgctgagtgaaacagaga

SEQ ID NO: 278303 - DNA, 20 bp, human
gtaaacaagaaggttagaat

SEQ ID NO: 278304 - DNA, 20 bp, human
ggtggctggtgtgatttgtt

SEQ ID NO: 278305 - DNA, 20 bp, human
gatccccatgcagcgccgag

SEQ ID NO: 278306 - DNA, 20 bp, human
gcgcctgccctgacaggaga

SEQ ID NO: 278307 - DNA, 20 bp, human
ggggctgcgcgcccgactcg

SEQ ID NO: 278308 - DNA, 20 bp, human
ggtcgcgcctcctgattggt

SEQ ID NO: 278309 - DNA, 20 bp, human
ggccccgggagcgcagtccc

SEQ ID NO: 278310 - DNA, 20 bp, human
ggttccgcgaggttgcgccc

SEQ ID NO: 278311 - DNA, 20 bp, human
gagtcccgggcgcaacctcg

SEQ ID NO: 278312 - DNA, 20 bp, human
gcgtacgcgcctgccctgac

SEQ ID NO: 278313 - DNA, 20 bp, human
gttctcgccgaccaatcagg

SEQ ID NO: 278314 - DNA, 20 bp, human
gtgacggggacgagcggcgc

SEQ ID NO: 278315 - DNA, 20 bp, human
ggccgggctcggccgctcat

SEQ ID NO: 278316 - DNA, 20 bp, human
gcggcatgcttgcagctcgg

SEQ ID NO: 278317 - DNA, 20 bp, human
ggcagaggcgcgctcaggta

SEQ ID NO: 278318 - DNA, 20 bp, human
gggacgagctgcgcgatgat

SEQ ID NO: 278319 - DNA, 20 bp, human
ggctccactcgggtaaactt

SEQ ID NO: 278320 - DNA, 20 bp, human
gggtgagctgccattggcag

SEQ ID NO: 278321 - DNA, 20 bp, human
gctaaagggtacaagcccga

SEQ ID NO: 278322 - DNA, 20 bp, human
gaaggcccttctccgagtgc

SEQ ID NO: 278323 - DNA, 20 bp, human
ggccaatggcagctcacctg

SEQ ID NO: 278324 - DNA, 20 bp, human
gtagccggaaaggtgggata

SEQ ID NO: 278325 - DNA, 20 bp, human
gacatggggcccgagctcgg

SEQ ID NO: 278326 - DNA, 20 bp, human
ggaggagggcggagctatgg

SEQ ID NO: 278327 - DNA, 20 bp, human
gccccagtggtacagaagga

SEQ ID NO: 278328 - DNA, 20 bp, human
gccctcaccaaggaaggaat

SEQ ID NO: 278329 - DNA, 20 bp, human
gtgggacaatgactagaaac

SEQ ID NO: 278330 - DNA, 20 bp, human
ggccgaggagggcggagcta

SEQ ID NO: 278331 - DNA, 20 bp, human
gactggaggtatacctcaac

SEQ ID NO: 278332 - DNA, 20 bp, human
gttaacagctgcacctgttg

SEQ ID NO: 278333 - DNA, 20 bp, human
gtgggggtggggatgtttct

SEQ ID NO: 278334 - DNA, 20 bp, human
gaaagaagcaagataactag

SEQ ID NO: 278335 - DNA, 20 bp, human
gccccctccttctgtaccac

SEQ ID NO: 278336 - DNA, 20 bp, human
gcacacaaggacactgtgta

SEQ ID NO: 278337 - DNA, 20 bp, human
gggtgcgcctcgtgccactg

SEQ ID NO: 278338 - DNA, 20 bp, human
gggggtgtggcttcgcgaga

SEQ ID NO: 278339 - DNA, 20 bp, human
ggagagggagcgccgggttg

SEQ ID NO: 278340 - DNA, 20 bp, human
gatcccgtccaaggcctcat

SEQ ID NO: 278341 - DNA, 20 bp, human
gccggcccagctacattccc

SEQ ID NO: 278342 - DNA, 20 bp, human
ggctcccatgaggccttgga

SEQ ID NO: 278343 - DNA, 20 bp, human
ggggggcagtatcccgtcca

SEQ ID NO: 278344 - DNA, 20 bp, human
gcggtgactgtgcgtgctcg

SEQ ID NO: 278345 - DNA, 20 bp, human
gaaaaagcagggctcccatg

SEQ ID NO: 278346 - DNA, 20 bp, human
gagacaggagcaggcaactc

SEQ ID NO: 278347 - DNA, 20 bp, human
gcgggctgtgctgatgaaaa

SEQ ID NO: 278348 - DNA, 20 bp, human
gctcctccaaagcgggtggg

SEQ ID NO: 278349 - DNA, 20 bp, human
gtctggaacagcggccctca

SEQ ID NO: 278350 - DNA, 20 bp, human
ggctcccctgaggctgtgac

SEQ ID NO: 278351 - DNA, 20 bp, human
gtcccagtcccgcaaagggt

SEQ ID NO: 278352 - DNA, 20 bp, human
gcacccgctttggaggagac

SEQ ID NO: 278353 - DNA, 20 bp, human
gtgaaaagggtctgccctga

SEQ ID NO: 278354 - DNA, 20 bp, human
gtcagccagtcacagcctca

SEQ ID NO: 278355 - DNA, 20 bp, human
gctgggggctagttacagtg

SEQ ID NO: 278356 - DNA, 20 bp, human
gggaggaagggggaacaggt

SEQ ID NO: 278357 - DNA, 20 bp, human
gctccagctagcatgaggac

SEQ ID NO: 278358 - DNA, 20 bp, human
gagagagaggcaggctgcga

SEQ ID NO: 278359 - DNA, 20 bp, human
gtgtgcagaaaggtggaggt

SEQ ID NO: 278360 - DNA, 20 bp, human
gtgtgtgtgcagaaaggtgg

SEQ ID NO: 278361 - DNA, 20 bp, human
ggaagggggaacaggtaggg

SEQ ID NO: 278362 - DNA, 20 bp, human
gagcccgtcctcatgctagc

SEQ ID NO: 278363 - DNA, 20 bp, human
ggtggaactccaagctagct

SEQ ID NO: 278364 - DNA, 20 bp, human
ggaactccaagctagctcgg

SEQ ID NO: 278365 - DNA, 20 bp, human
gggagggtaaagaggactgt

SEQ ID NO: 278366 - DNA, 20 bp, human
gagacccgaggtctcgcgga

SEQ ID NO: 278367 - DNA, 20 bp, human
gcgacagccccggagacccg

SEQ ID NO: 278368 - DNA, 20 bp, human
gcgcgtgcgcgactcgcggc

SEQ ID NO: 278369 - DNA, 20 bp, human
ggagtcgcgcacgcgcgccc

SEQ ID NO: 278370 - DNA, 20 bp, human
gcacaggcaagtcacagaga

SEQ ID NO: 278371 - DNA, 20 bp, human
ggcggtgggcgcgacagccc

SEQ ID NO: 278372 - DNA, 20 bp, human
gcgcgactcgcggcaggagg

SEQ ID NO: 278373 - DNA, 20 bp, human
gcgctgagaaagcacagctc

SEQ ID NO: 278374 - DNA, 20 bp, human
ggcacgcgacgcgtccacgg

SEQ ID NO: 278375 - DNA, 20 bp, human
gcacgaaggtagctccgggc

SEQ ID NO: 278376 - DNA, 20 bp, human
gcccccccgcaaaagatggt

SEQ ID NO: 278377 - DNA, 20 bp, human
gagggggtgtgagagatcct

SEQ ID NO: 278378 - DNA, 20 bp, human
gatagggacagaaatcgctt

SEQ ID NO: 278379 - DNA, 20 bp, human
gagagatcctgggagcgaga

SEQ ID NO: 278380 - DNA, 20 bp, human
ggggttcattggctgcaagc

SEQ ID NO: 278381 - DNA, 20 bp, human
gatctggaaggcgggttcat

SEQ ID NO: 278382 - DNA, 20 bp, human
gatggtaggtctaaagaggg

SEQ ID NO: 278383 - DNA, 20 bp, human
gttggaagagcccaattcac

SEQ ID NO: 278384 - DNA, 20 bp, human
ggaattgggctcttccaatt

SEQ ID NO: 278385 - DNA, 20 bp, human
ggtcttcacaccaatctgga

SEQ ID NO: 278386 - DNA, 20 bp, human
gagtcagcgagtggtcagaa

SEQ ID NO: 278387 - DNA, 20 bp, human
gcccccggagcccccgattg

SEQ ID NO: 278388 - DNA, 20 bp, human
gggagtgcgcgctcgaggag

SEQ ID NO: 278389 - DNA, 20 bp, human
gaggagggcagcgatgctcc

SEQ ID NO: 278390 - DNA, 20 bp, human
ggctggtgcaggcttgctgg

SEQ ID NO: 278391 - DNA, 20 bp, human
ggcgagcgcgagtgcgagtg

SEQ ID NO: 278392 - DNA, 20 bp, human
gcacacaaacactggcgccg

SEQ ID NO: 278393 - DNA, 20 bp, human
gaaaatctggcggctcgcga

SEQ ID NO: 278394 - DNA, 20 bp, human
ggactgcgggaaaaatctgg

SEQ ID NO: 278395 - DNA, 20 bp, human
gccgggagactggggcgctc

SEQ ID NO: 278396 - DNA, 20 bp, human
ggccgggtgctccacgctcc

SEQ ID NO: 278397 - DNA, 20 bp, human
gcgcttcgggagcccctcga

SEQ ID NO: 278398 - DNA, 20 bp, human
gcgcccgctcgcggctcgga

SEQ ID NO: 278399 - DNA, 20 bp, human
gccgcagtcacgtggtagag

SEQ ID NO: 278400 - DNA, 20 bp, human
gtccgagcgtcccccgagcc

SEQ ID NO: 278401 - DNA, 20 bp, human
gtggtagagaggcgggcgga

SEQ ID NO: 278402 - DNA, 20 bp, human
ggtgctccacgctcccggct

SEQ ID NO: 278403 - DNA, 20 bp, human
ggcggcgcgccgagctctga

SEQ ID NO: 278404 - DNA, 20 bp, human
gtcggagaccggcacagcgg

SEQ ID NO: 278405 - DNA, 20 bp, human
gcacgtggtagagaggcggg

SEQ ID NO: 278406 - DNA, 20 bp, human
ggtgctgtcaggcggagaga

SEQ ID NO: 278407 - DNA, 20 bp, human
gagagagcggtgctgtcagg

SEQ ID NO: 278408 - DNA, 20 bp, human
ggcgagagagcggtgctgtc

SEQ ID NO: 278409 - DNA, 20 bp, human
gtggcgggatgcaggaagca

SEQ ID NO: 278410 - DNA, 20 bp, human
ggagcgagcctgcgagagag

SEQ ID NO: 278411 - DNA, 20 bp, human
ggcaggctgcaggatgcttt

SEQ ID NO: 278412 - DNA, 20 bp, human
gtcccggttgaagattccat

SEQ ID NO: 278413 - DNA, 20 bp, human
gccaccgcgccccagcaaac

SEQ ID NO: 278414 - DNA, 20 bp, human
gtcaaccgggactgagaaaa

SEQ ID NO: 278415 - DNA, 20 bp, human
gtccccctatctgcaataca

SEQ ID NO: 278416 - DNA, 20 bp, human
gcaggcgaggatcctgggaa

SEQ ID NO: 278417 - DNA, 20 bp, human
gccaaggggagtgagcgcgg

SEQ ID NO: 278418 - DNA, 20 bp, human
gcaccccagagcgaccaaaa

SEQ ID NO: 278419 - DNA, 20 bp, human
gaccccggggagggtaaaca

SEQ ID NO: 278420 - DNA, 20 bp, human
ggatcctgggaagggaataa

SEQ ID NO: 278421 - DNA, 20 bp, human
ggggactcgccactgtgtgg

SEQ ID NO: 278422 - DNA, 20 bp, human
gaggacgcaggcgaggatcc

SEQ ID NO: 278423 - DNA, 20 bp, human
gggccgggacggctcgggag

SEQ ID NO: 278424 - DNA, 20 bp, human
gcctggaggcccagcgtaaa

SEQ ID NO: 278425 - DNA, 20 bp, human
ggacccttttggtcgctctg

SEQ ID NO: 278426 - DNA, 20 bp, human
gcgggctgagtccgggaaga

SEQ ID NO: 278427 - DNA, 20 bp, human
ggcggggtgaatggcagcaa

SEQ ID NO: 278428 - DNA, 20 bp, human
ggggcaggctgcggggtgaa

SEQ ID NO: 278429 - DNA, 20 bp, human
gacccggcgggatccgggga

SEQ ID NO: 278430 - DNA, 20 bp, human
ggggatggaggagcagtcgc

SEQ ID NO: 278431 - DNA, 20 bp, human
gggaaacccggcgggatccg

SEQ ID NO: 278432 - DNA, 20 bp, human
ggagggggcgggctgagtcc

SEQ ID NO: 278433 - DNA, 20 bp, human
gaacagcagtccagcccaga

SEQ ID NO: 278434 - DNA, 20 bp, human
gagtcgcaggcccaggaggc

SEQ ID NO: 278435 - DNA, 20 bp, human
gtccctccccggatcccgcc

SEQ ID NO: 278436 - DNA, 20 bp, human
gcagcagagcgcaaagttga

SEQ ID NO: 278437 - DNA, 20 bp, human
gtggggcgggcagtaaataa

SEQ ID NO: 278438 - DNA, 20 bp, human
gaaagggtggggccagcgag

SEQ ID NO: 278439 - DNA, 20 bp, human
gcgcgagtatcttgatcagt

SEQ ID NO: 278440 - DNA, 20 bp, human
gcactcacagcggacagcag

SEQ ID NO: 278441 - DNA, 20 bp, human
ggcttccttgccactcacag

SEQ ID NO: 278442 - DNA, 20 bp, human
gctgtccgctgtgagtggca

SEQ ID NO: 278443 - DNA, 20 bp, human
ggaggatgatgaacagggga

SEQ ID NO: 278444 - DNA, 20 bp, human
gcgggcagtaaataaagggt

SEQ ID NO: 278445 - DNA, 20 bp, human
gtccgtgtgcacctgttagg

SEQ ID NO: 278446 - DNA, 20 bp, human
gtgcagcagtgcagtagaat

SEQ ID NO: 278447 - DNA, 20 bp, human
gcggttgcataatagatatt

SEQ ID NO: 278448 - DNA, 20 bp, human
gaatgactggtgtatgtaag

SEQ ID NO: 278449 - DNA, 20 bp, human
gtcaaggcgggctgtcagat

SEQ ID NO: 278450 - DNA, 20 bp, human
gactggccgggagccttaag

SEQ ID NO: 278451 - DNA, 20 bp, human
gtagatattggggagctcac

SEQ ID NO: 278452 - DNA, 20 bp, human
ggattggaatgcaattggag

SEQ ID NO: 278453 - DNA, 20 bp, human
ggacatctcgtccgttacca

SEQ ID NO: 278454 - DNA, 20 bp, human
gagaaagtgatctaagacgg

SEQ ID NO: 278455 - DNA, 20 bp, human
gattggggagctcactggcc

SEQ ID NO: 278456 - DNA, 20 bp, human
gggggcgggtggggacgtct

SEQ ID NO: 278457 - DNA, 20 bp, human
gcgggcgtccccctacaatg

SEQ ID NO: 278458 - DNA, 20 bp, human
gcgggcgatagcatcggcgg

SEQ ID NO: 278459 - DNA, 20 bp, human
gaccctggccccattgtagg

SEQ ID NO: 278460 - DNA, 20 bp, human
ggggaccctggccccattgt

SEQ ID NO: 278461 - DNA, 20 bp, human
gccagtcccttctactgcga

SEQ ID NO: 278462 - DNA, 20 bp, human
gtggggacgtctgggaagcg

SEQ ID NO: 278463 - DNA, 20 bp, human
ggcgctcacacctgcgcggg

SEQ ID NO: 278464 - DNA, 20 bp, human
gttcacactcacacttgccg

SEQ ID NO: 278465 - DNA, 20 bp, human
gaccgggagcccgccgtctg

SEQ ID NO: 278466 - DNA, 20 bp, human
gctcccgggcgacgctccga

SEQ ID NO: 278467 - DNA, 20 bp, human
gctccggcccggccccgaag

SEQ ID NO: 278468 - DNA, 20 bp, human
ggcccctcggagcgtcgccc

SEQ ID NO: 278469 - DNA, 20 bp, human
gggggcgccccttcggggcc

SEQ ID NO: 278470 - DNA, 20 bp, human
gccgggggggcgccccttcg

SEQ ID NO: 278471 - DNA, 20 bp, human
ggcagccgcaagtttgcccc

SEQ ID NO: 278472 - DNA, 20 bp, human
ggcgccgggttccccacctg

SEQ ID NO: 278473 - DNA, 20 bp, human
ggcaaaggggcagcccgccc

SEQ ID NO: 278474 - DNA, 20 bp, human
gcaaacttgcggctgcccgg

SEQ ID NO: 278475 - DNA, 20 bp, human
ggcgggctgcccctttgcgc

SEQ ID NO: 278476 - DNA, 20 bp, human
gcaaatgcgtatgagggagg

SEQ ID NO: 278477 - DNA, 20 bp, human
ggcaccaatgagcatcaggt

SEQ ID NO: 278478 - DNA, 20 bp, human
gtggctgctgaagattaaaa

SEQ ID NO: 278479 - DNA, 20 bp, human
gttgtgccaaagtggatcag

SEQ ID NO: 278480 - DNA, 20 bp, human
gcaagctcaaatgcgtatga

SEQ ID NO: 278481 - DNA, 20 bp, human
gtgcctccctcatggggaat

SEQ ID NO: 278482 - DNA, 20 bp, human
ggcaggctgaagatgacaga

SEQ ID NO: 278483 - DNA, 20 bp, human
ggaaagcccctgatccactt

SEQ ID NO: 278484 - DNA, 20 bp, human
gcagccaacctgatgctcat

SEQ ID NO: 278485 - DNA, 20 bp, human
ggtattgcccatagttacta

SEQ ID NO: 278486 - DNA, 20 bp, human
gtgtgagcgcgtgcctggag

SEQ ID NO: 278487 - DNA, 20 bp, human
ggacaggggcctgtgctgtc

SEQ ID NO: 278488 - DNA, 20 bp, human
gaaaaggcacgcaagggtgc

SEQ ID NO: 278489 - DNA, 20 bp, human
gtcggagcgcgcgtgagccg

SEQ ID NO: 278490 - DNA, 20 bp, human
gcgaacgcaggcgcacgctc

SEQ ID NO: 278491 - DNA, 20 bp, human
ggtgctgtcggggacctgca

SEQ ID NO: 278492 - DNA, 20 bp, human
ggggctaagaggaataggga

SEQ ID NO: 278493 - DNA, 20 bp, human
gtggggaggggaaccttgaa

SEQ ID NO: 278494 - DNA, 20 bp, human
gcaggcgcacgctctggcgc

SEQ ID NO: 278495 - DNA, 20 bp, human
gtcccaacacggaggcgaag

SEQ ID NO: 278496 - DNA, 20 bp, human
ggagctggcccagcagcgaa

SEQ ID NO: 278497 - DNA, 20 bp, human
gtcgccgccgagggactgcg

SEQ ID NO: 278498 - DNA, 20 bp, human
gagggtgtccaggcgctcac

SEQ ID NO: 278499 - DNA, 20 bp, human
ggcccccgctcaagcccaag

SEQ ID NO: 278500 - DNA, 20 bp, human
gctcacccggtcccatgatc

SEQ ID NO: 278501 - DNA, 20 bp, human
gcggactcccgctgggaagt

SEQ ID NO: 278502 - DNA, 20 bp, human
gcgctcaccggactcccgct

SEQ ID NO: 278503 - DNA, 20 bp, human
gagaccccgcagtccctcgg

SEQ ID NO: 278504 - DNA, 20 bp, human
gtgagaacaagtccctaagt

SEQ ID NO: 278505 - DNA, 20 bp, human
gggggcaggaagcggagcta

SEQ ID NO: 278506 - DNA, 20 bp, human
ggacaggcacggatgagagg

SEQ ID NO: 278507 - DNA, 20 bp, human
gtctcatccgtgcctgtccc

SEQ ID NO: 278508 - DNA, 20 bp, human
ggtgggaaagccaacctgaa

SEQ ID NO: 278509 - DNA, 20 bp, human
gaagccaacctgaatggaag

SEQ ID NO: 278510 - DNA, 20 bp, human
gcggggcgcgtgcgcgtcgg

SEQ ID NO: 278511 - DNA, 20 bp, human
gcccacagagtgcacacgag

SEQ ID NO: 278512 - DNA, 20 bp, human
gcgggggtgagtgtgcgcgg

SEQ ID NO: 278513 - DNA, 20 bp, human
ggctataccattcctgggac

SEQ ID NO: 278514 - DNA, 20 bp, human
gggtctggctataccattcc

SEQ ID NO: 278515 - DNA, 20 bp, human
gcagcaatgcagatggggct

SEQ ID NO: 278516 - DNA, 20 bp, human
ggcaccgccaagacctggac

SEQ ID NO: 278517 - DNA, 20 bp, human
gaagtccccttggacgacca

SEQ ID NO: 278518 - DNA, 20 bp, human
gcgcctgcgccggtctctgg

SEQ ID NO: 278519 - DNA, 20 bp, human
ggaaaccgagtggacgaatg

SEQ ID NO: 278520 - DNA, 20 bp, human
ggacctgggagaatcggagt

SEQ ID NO: 278521 - DNA, 20 bp, human
ggggtcacgacccagcttgg

SEQ ID NO: 278522 - DNA, 20 bp, human
gggacccgcgccacgcctcc

SEQ ID NO: 278523 - DNA, 20 bp, human
ggaccccgagtcccgcagtg

SEQ ID NO: 278524 - DNA, 20 bp, human
gccggagccgcggacgccgg

SEQ ID NO: 278525 - DNA, 20 bp, human
ggagtcgagaaggtgaaagg

SEQ ID NO: 278526 - DNA, 20 bp, human
ggagggaaaggggacatgct

SEQ ID NO: 278527 - DNA, 20 bp, human
gggaaagaaaaggggactct

SEQ ID NO: 278528 - DNA, 20 bp, human
ggagtctggaaccttatcct

SEQ ID NO: 278529 - DNA, 20 bp, human
gagaagagagattccagctg

SEQ ID NO: 278530 - DNA, 20 bp, human
gaggaagccgtcctcattga

SEQ ID NO: 278531 - DNA, 20 bp, human
gattactccttcaatgagga

SEQ ID NO: 278532 - DNA, 20 bp, human
gcccagtgccccccaggata

SEQ ID NO: 278533 - DNA, 20 bp, human
gtctggaaccttatcctggg

SEQ ID NO: 278534 - DNA, 20 bp, human
gcgggattactccttcaatg

SEQ ID NO: 278535 - DNA, 20 bp, human
gaccaagctgaaagagagtc

SEQ ID NO: 278536 - DNA, 20 bp, human
gtgttggtgagattcccgag

SEQ ID NO: 278537 - DNA, 20 bp, human
gaagcgacaggcaggcgcca

SEQ ID NO: 278538 - DNA, 20 bp, human
gggcgcgggatgtgccactc

SEQ ID NO: 278539 - DNA, 20 bp, human
gtatgacgcccagcctttga

SEQ ID NO: 278540 - DNA, 20 bp, human
ggctgaggcggggagaactt

SEQ ID NO: 278541 - DNA, 20 bp, human
gtgagggatctgaaattcgg

SEQ ID NO: 278542 - DNA, 20 bp, human
ggcgactggccagcaaaggg

SEQ ID NO: 278543 - DNA, 20 bp, human
ggaggactttccaggggcgc

SEQ ID NO: 278544 - DNA, 20 bp, human
gggaacgggcgctccagctg

SEQ ID NO: 278545 - DNA, 20 bp, human
gtgcgctaaacgcccactgt

SEQ ID NO: 278546 - DNA, 20 bp, human
ggggttcccagcaaccgcgc

SEQ ID NO: 278547 - DNA, 20 bp, human
gttaaagcgcagtcttttcc

SEQ ID NO: 278548 - DNA, 20 bp, human
gcaggccacagatggaacgg

SEQ ID NO: 278549 - DNA, 20 bp, human
gggcagtggttaggcgtccc

SEQ ID NO: 278550 - DNA, 20 bp, human
gcggcggcggtgacacctgg

SEQ ID NO: 278551 - DNA, 20 bp, human
gtgcccagggcgggatgggg

SEQ ID NO: 278552 - DNA, 20 bp, human
ggccctgcccagggcgggat

SEQ ID NO: 278553 - DNA, 20 bp, human
gttcccagcaaccgcgcggg

SEQ ID NO: 278554 - DNA, 20 bp, human
gcccatccctgctctgattc

SEQ ID NO: 278555 - DNA, 20 bp, human
ggccggcctcaaacaaccac

SEQ ID NO: 278556 - DNA, 20 bp, human
ggcaaggcggcgcagcggga

SEQ ID NO: 278557 - DNA, 20 bp, human
gaacacgcaaggcggcgcag

SEQ ID NO: 278558 - DNA, 20 bp, human
ggggcgctgaagacccctgg

SEQ ID NO: 278559 - DNA, 20 bp, human
gagaacggacggtcagtccc

SEQ ID NO: 278560 - DNA, 20 bp, human
ggcctctggccggagcgaag

SEQ ID NO: 278561 - DNA, 20 bp, human
gcgaagaggaacacgcaagg

SEQ ID NO: 278562 - DNA, 20 bp, human
gggcggggccgggcgagctt

SEQ ID NO: 278563 - DNA, 20 bp, human
ggccgggcgagcttcggggt

SEQ ID NO: 278564 - DNA, 20 bp, human
gcccctcggcagacagtgag

SEQ ID NO: 278565 - DNA, 20 bp, human
gacagtgagaggcgggcctc

SEQ ID NO: 278566 - DNA, 20 bp, human
ggcagggacgacactgtgtg

SEQ ID NO: 278567 - DNA, 20 bp, human
gtcccccttcacaatcacaa

SEQ ID NO: 278568 - DNA, 20 bp, human
gaggtccgctacatgtcatc

SEQ ID NO: 278569 - DNA, 20 bp, human
gcaccaaattgtacaaagca

SEQ ID NO: 278570 - DNA, 20 bp, human
gggagaaaggtagtcccagt

SEQ ID NO: 278571 - DNA, 20 bp, human
gtagggctaggcagacaatc

SEQ ID NO: 278572 - DNA, 20 bp, human
ggaacagtgcattctgttta

SEQ ID NO: 278573 - DNA, 20 bp, human
ggacctctgcatcagccaag

SEQ ID NO: 278574 - DNA, 20 bp, human
gagggagggccgtttatatt

SEQ ID NO: 278575 - DNA, 20 bp, human
ggtccctgctttgtacaatt

SEQ ID NO: 278576 - DNA, 20 bp, human
gcgggcggctctctgcttaa

SEQ ID NO: 278577 - DNA, 20 bp, human
ggacagggggtctttgaagg

SEQ ID NO: 278578 - DNA, 20 bp, human
gaaaaactgatgcctagtga

SEQ ID NO: 278579 - DNA, 20 bp, human
gggggacatggctattgtca

SEQ ID NO: 278580 - DNA, 20 bp, human
gggaagctcacagctcccac

SEQ ID NO: 278581 - DNA, 20 bp, human
gggagggtctccaagctcaa

SEQ ID NO: 278582 - DNA, 20 bp, human
ggagagccgcccgctgcagt

SEQ ID NO: 278583 - DNA, 20 bp, human
gtctctgcttaaaggggaca

SEQ ID NO: 278584 - DNA, 20 bp, human
gcccagggcaagttagaagc

SEQ ID NO: 278585 - DNA, 20 bp, human
gccgctgcagtgggtggact

SEQ ID NO: 278586 - DNA, 20 bp, human
gcgtctgcgcagaaagctgg

SEQ ID NO: 278587 - DNA, 20 bp, human
gagaacgaaaccgacgagtc

SEQ ID NO: 278588 - DNA, 20 bp, human
gacgagtccacccatgaaac

SEQ ID NO: 278589 - DNA, 20 bp, human
ggggtagaacctaattccga

SEQ ID NO: 278590 - DNA, 20 bp, human
ggcgcctcctggcagtatta

SEQ ID NO: 278591 - DNA, 20 bp, human
gctcctggcagtattaaggt

SEQ ID NO: 278592 - DNA, 20 bp, human
gctgcgcagaaagctggcgg

SEQ ID NO: 278593 - DNA, 20 bp, human
gtacagttcacctgactcgt

SEQ ID NO: 278594 - DNA, 20 bp, human
gatgggtggactcgtcgcta

SEQ ID NO: 278595 - DNA, 20 bp, human
gtattacatccccgtttcat

SEQ ID NO: 278596 - DNA, 20 bp, human
gccgggcagaatgatctaat

SEQ ID NO: 278597 - DNA, 20 bp, human
gaggcggccccttggaggaa

SEQ ID NO: 278598 - DNA, 20 bp, human
ggaaaagtgaggcggcccct

SEQ ID NO: 278599 - DNA, 20 bp, human
gagcctggctgctgaagcca

SEQ ID NO: 278600 - DNA, 20 bp, human
gggttgtttgtccttctcag

SEQ ID NO: 278601 - DNA, 20 bp, human
gccaggctaaatcccagccg

SEQ ID NO: 278602 - DNA, 20 bp, human
gccgtcaggcccacatccca

SEQ ID NO: 278603 - DNA, 20 bp, human
gggggtcacggaggacgctt

SEQ ID NO: 278604 - DNA, 20 bp, human
gtaaatcccagccggggtca

SEQ ID NO: 278605 - DNA, 20 bp, human
gggatgtgggcctgacggag

SEQ ID NO: 278606 - DNA, 20 bp, human
gctaccctaagacacgtgcc

SEQ ID NO: 278607 - DNA, 20 bp, human
gttctcgcgagacgaggaag

SEQ ID NO: 278608 - DNA, 20 bp, human
gcggcccggcacgtgtctta

SEQ ID NO: 278609 - DNA, 20 bp, human
ggcggcccgccgtgtactct

SEQ ID NO: 278610 - DNA, 20 bp, human
ggccctgcgccaagagtaca

SEQ ID NO: 278611 - DNA, 20 bp, human
gtaagccgagcctgcgggcg

SEQ ID NO: 278612 - DNA, 20 bp, human
gagacgaggaagcggttccg

SEQ ID NO: 278613 - DNA, 20 bp, human
gaacaccgcgcccgcaggct

SEQ ID NO: 278614 - DNA, 20 bp, human
ggcgaaggcgaagaaggtcg

SEQ ID NO: 278615 - DNA, 20 bp, human
gggaagacgcgccacgacgt

SEQ ID NO: 278616 - DNA, 20 bp, human
gcctgctagtaccacacccc

SEQ ID NO: 278617 - DNA, 20 bp, human
gtcccctcagtccctcccgg

SEQ ID NO: 278618 - DNA, 20 bp, human
ggcgccgcgagcaccgaggc

SEQ ID NO: 278619 - DNA, 20 bp, human
gactgcgcaagcgccggccc

SEQ ID NO: 278620 - DNA, 20 bp, human
gcggccgacaggcgactcaa

SEQ ID NO: 278621 - DNA, 20 bp, human
gcctcctgcctcggtgctcg

SEQ ID NO: 278622 - DNA, 20 bp, human
gctagtaccacacccccggg

SEQ ID NO: 278623 - DNA, 20 bp, human
ggagtgacagagacacgcgg

SEQ ID NO: 278624 - DNA, 20 bp, human
gtggtactagcaggctcggg

SEQ ID NO: 278625 - DNA, 20 bp, human
gccgacaggcgactcaaagg

SEQ ID NO: 278626 - DNA, 20 bp, human
gccctcagccgggacaatgg

SEQ ID NO: 278627 - DNA, 20 bp, human
gactcgctcaaagaagtacg

SEQ ID NO: 278628 - DNA, 20 bp, human
gcctcagaccaaccaggaag

SEQ ID NO: 278629 - DNA, 20 bp, human
gtcagccgggacaatggagg

SEQ ID NO: 278630 - DNA, 20 bp, human
gggcgggggaaaaaatgaag

SEQ ID NO: 278631 - DNA, 20 bp, human
gactctccgccccctcccgg

SEQ ID NO: 278632 - DNA, 20 bp, human
ggccgccgggccacaccttc

SEQ ID NO: 278633 - DNA, 20 bp, human
gcccggtgattggtcaaatg

SEQ ID NO: 278634 - DNA, 20 bp, human
ggagccctcagccgggacaa

SEQ ID NO: 278635 - DNA, 20 bp, human
ggccggggtggcccccggga

SEQ ID NO: 278636 - DNA, 20 bp, human
ggtaacctgctcttcgtgtc

SEQ ID NO: 278637 - DNA, 20 bp, human
gtaagatgaagggaccagtg

SEQ ID NO: 278638 - DNA, 20 bp, human
gatgaagggaccagtggggg

SEQ ID NO: 278639 - DNA, 20 bp, human
gaggactccagtgttggcca

SEQ ID NO: 278640 - DNA, 20 bp, human
gggcctgtgggtgggacccg

SEQ ID NO: 278641 - DNA, 20 bp, human
gctgtgggtgggacccgtgg

SEQ ID NO: 278642 - DNA, 20 bp, human
gtgccaaggcgaaagctgct

SEQ ID NO: 278643 - DNA, 20 bp, human
ggagaaagaccctaagatga

SEQ ID NO: 278644 - DNA, 20 bp, human
ggtcccagcagctttcgcct

SEQ ID NO: 278645 - DNA, 20 bp, human
gaacggtatgatcacttcct

SEQ ID NO: 278646 - DNA, 20 bp, human
gtcgtttgatagagggagga

SEQ ID NO: 278647 - DNA, 20 bp, human
gtcagtcgtttgatagaggg

SEQ ID NO: 278648 - DNA, 20 bp, human
gaccgcaagggaaaaagagg

SEQ ID NO: 278649 - DNA, 20 bp, human
gaactgcctaggctgctttg

SEQ ID NO: 278650 - DNA, 20 bp, human
gaggcagttctccacttctt

SEQ ID NO: 278651 - DNA, 20 bp, human
ggagataatagacaagcctt

SEQ ID NO: 278652 - DNA, 20 bp, human
gaatcaggaagaggctgcat

SEQ ID NO: 278653 - DNA, 20 bp, human
gaaaatcagtcgtttgatag

SEQ ID NO: 278654 - DNA, 20 bp, human
gaattcctttactatatgag

SEQ ID NO: 278655 - DNA, 20 bp, human
ggtctgactattcacgtatc

SEQ ID NO: 278656 - DNA, 20 bp, human
ggagtgtccagaggaggcgg

SEQ ID NO: 278657 - DNA, 20 bp, human
gctggcgtctggaggaacgg

SEQ ID NO: 278658 - DNA, 20 bp, human
gtggagcgcggagtgtccag

SEQ ID NO: 278659 - DNA, 20 bp, human
ggtctggaggaacggaggag

SEQ ID NO: 278660 - DNA, 20 bp, human
gccacgaggcggacagctcc

SEQ ID NO: 278661 - DNA, 20 bp, human
gcgcagagcgagagcgctcg

SEQ ID NO: 278662 - DNA, 20 bp, human
gtctgactatggggcggagt

SEQ ID NO: 278663 - DNA, 20 bp, human
gcaggagacctggcgtctgg

SEQ ID NO: 278664 - DNA, 20 bp, human
gaggtggtagtctgactatg

SEQ ID NO: 278665 - DNA, 20 bp, human
gtggtagtctgactatgggg

SEQ ID NO: 278666 - DNA, 20 bp, human
gtggtcttccgcggagggga

SEQ ID NO: 278667 - DNA, 20 bp, human
ggggacccagtggtcttccg

SEQ ID NO: 278668 - DNA, 20 bp, human
ggagtgggaaaacggagggg

SEQ ID NO: 278669 - DNA, 20 bp, human
ggtccagcgtgcagccggga

SEQ ID NO: 278670 - DNA, 20 bp, human
gacccagtggtcttccgcgg

SEQ ID NO: 278671 - DNA, 20 bp, human
gggggagtgggaaaacggag

SEQ ID NO: 278672 - DNA, 20 bp, human
ggaagccgtcgcatctaatt

SEQ ID NO: 278673 - DNA, 20 bp, human
gccctccgcggaagaccact

SEQ ID NO: 278674 - DNA, 20 bp, human
gtgggcgtggcttttctcca

SEQ ID NO: 278675 - DNA, 20 bp, human
ggagggaaaagaacgagaga

SEQ ID NO: 278676 - DNA, 20 bp, human
gatgggatcctcttaaagag

SEQ ID NO: 278677 - DNA, 20 bp, human
ggacccctgtggtgtcactc

SEQ ID NO: 278678 - DNA, 20 bp, human
ggaggccggagcccaatagg

SEQ ID NO: 278679 - DNA, 20 bp, human
gaaaacctgagtgacaccac

SEQ ID NO: 278680 - DNA, 20 bp, human
gtgggagtggcaagtgtggg

SEQ ID NO: 278681 - DNA, 20 bp, human
ggtgtcactcaggttttaat

SEQ ID NO: 278682 - DNA, 20 bp, human
ggtgtgggagtggcaagtgt

SEQ ID NO: 278683 - DNA, 20 bp, human
gctttaagaggatcccatca

SEQ ID NO: 278684 - DNA, 20 bp, human
gaatggtgcaggtcgtgtag

SEQ ID NO: 278685 - DNA, 20 bp, human
gactcccacctggcagctag

SEQ ID NO: 278686 - DNA, 20 bp, human
gtcaaaaccccaccaggcta

SEQ ID NO: 278687 - DNA, 20 bp, human
ggcaagtggagtcacctcac

SEQ ID NO: 278688 - DNA, 20 bp, human
ggggttttgaggtggtaagg

SEQ ID NO: 278689 - DNA, 20 bp, human
gaccacctcaaaaccccacc

SEQ ID NO: 278690 - DNA, 20 bp, human
gacttgaatcaggagcagtg

SEQ ID NO: 278691 - DNA, 20 bp, human
gtccagtgacgcaccagggt

SEQ ID NO: 278692 - DNA, 20 bp, human
gtcccaccctggtgcgtcac

SEQ ID NO: 278693 - DNA, 20 bp, human
gggcaggcagcgtggaagtg

SEQ ID NO: 278694 - DNA, 20 bp, human
ggcaggctgcagtgagactc

SEQ ID NO: 278695 - DNA, 20 bp, human
ggattcaagtatataacaag

SEQ ID NO: 278696 - DNA, 20 bp, human
gcatgtgaaaagtaagtcct

SEQ ID NO: 278697 - DNA, 20 bp, human
gacagatgctcacatggcaa

SEQ ID NO: 278698 - DNA, 20 bp, human
ggctcacatggcaagggagc

SEQ ID NO: 278699 - DNA, 20 bp, human
ggagcatctgttgacagagc

SEQ ID NO: 278700 - DNA, 20 bp, human
gtgtagacatccttgtctca

SEQ ID NO: 278701 - DNA, 20 bp, human
gtttaaagattaggtagtca

SEQ ID NO: 278702 - DNA, 20 bp, human
gccaatccagtttaaagatt

SEQ ID NO: 278703 - DNA, 20 bp, human
gtacccatccagattcaccc

SEQ ID NO: 278704 - DNA, 20 bp, human
gtttaggaacatagactcct

SEQ ID NO: 278705 - DNA, 20 bp, human
ggccctttctcactcaatac

SEQ ID NO: 278706 - DNA, 20 bp, human
gtatgggggtggtgaaggaa

SEQ ID NO: 278707 - DNA, 20 bp, human
gaccacccccataactgccc

SEQ ID NO: 278708 - DNA, 20 bp, human
ggcagttatgggggtggtga

SEQ ID NO: 278709 - DNA, 20 bp, human
gaacgaagaataaattttaa

SEQ ID NO: 278710 - DNA, 20 bp, human
gaataaattttaacggatgt

SEQ ID NO: 278711 - DNA, 20 bp, human
gggctcccagagggaacgtg

SEQ ID NO: 278712 - DNA, 20 bp, human
ggaggaggaaagctgtgcgg

SEQ ID NO: 278713 - DNA, 20 bp, human
gtcctcccatggctcccaga

SEQ ID NO: 278714 - DNA, 20 bp, human
gcacacctctgaatcatctc

SEQ ID NO: 278715 - DNA, 20 bp, human
gaaggggcgtcactgctgga

SEQ ID NO: 278716 - DNA, 20 bp, human
ggagacccctcctgagtgtg

SEQ ID NO: 278717 - DNA, 20 bp, human
ggaaaacagacccagagatt

SEQ ID NO: 278718 - DNA, 20 bp, human
gggatgagagaccgctccga

SEQ ID NO: 278719 - DNA, 20 bp, human
ggatttaaggattctaggga

SEQ ID NO: 278720 - DNA, 20 bp, human
ggcgtctgactcagactgtc

SEQ ID NO: 278721 - DNA, 20 bp, human
gcccagagattgggagaggg

SEQ ID NO: 278722 - DNA, 20 bp, human
gggagggcctaaggaagagg

SEQ ID NO: 278723 - DNA, 20 bp, human
ggagagacagaaaaggggtc

SEQ ID NO: 278724 - DNA, 20 bp, human
gaccgccaccccccacactc

SEQ ID NO: 278725 - DNA, 20 bp, human
gccctcctgagtgtgggggg

SEQ ID NO: 278726 - DNA, 20 bp, human
gtgcgtgctgaggtaagggg

SEQ ID NO: 278727 - DNA, 20 bp, human
ggtgcccagaacgtgggtgt

SEQ ID NO: 278728 - DNA, 20 bp, human
gggggctgcgtgctgaggta

SEQ ID NO: 278729 - DNA, 20 bp, human
ggtaagggggggaaacgggt

SEQ ID NO: 278730 - DNA, 20 bp, human
gcagaacgtgggtgtgggta

SEQ ID NO: 278731 - DNA, 20 bp, human
ggtggtccccagggaatcta

SEQ ID NO: 278732 - DNA, 20 bp, human
gcgtgatgatgcaaaccagt

SEQ ID NO: 278733 - DNA, 20 bp, human
gtgcatcatcacgcagggag

SEQ ID NO: 278734 - DNA, 20 bp, human
gaggcttccacagtgagtta

SEQ ID NO: 278735 - DNA, 20 bp, human
ggacacccgtgcccagaacg

SEQ ID NO: 278736 - DNA, 20 bp, human
gaaagctgatcgcccagctc

SEQ ID NO: 278737 - DNA, 20 bp, human
gcccagctccggccagtggc

SEQ ID NO: 278738 - DNA, 20 bp, human
gttaagtccgcatctccctc

SEQ ID NO: 278739 - DNA, 20 bp, human
gtgcccgcagacgtgacccc

SEQ ID NO: 278740 - DNA, 20 bp, human
gtctgcgtcagggagatagt

SEQ ID NO: 278741 - DNA, 20 bp, human
gcgcagacgtgacccccggt

SEQ ID NO: 278742 - DNA, 20 bp, human
gaggtgctgggaccttcctc

SEQ ID NO: 278743 - DNA, 20 bp, human
gacccccggttggtttgctc

SEQ ID NO: 278744 - DNA, 20 bp, human
ggcccggagcaaaccaaccg

SEQ ID NO: 278745 - DNA, 20 bp, human
gcggaggctggctacaggtc

SEQ ID NO: 278746 - DNA, 20 bp, human
gcgggaggaggaacccccga

SEQ ID NO: 278747 - DNA, 20 bp, human
ggggtgacaccgaaatccag

SEQ ID NO: 278748 - DNA, 20 bp, human
gggtgctgcccgctgtgctc

SEQ ID NO: 278749 - DNA, 20 bp, human
gtcaggctgaagagcggagg

SEQ ID NO: 278750 - DNA, 20 bp, human
gaggaggaacccccgagggg

SEQ ID NO: 278751 - DNA, 20 bp, human
gtgcctggcgagcccgggac

SEQ ID NO: 278752 - DNA, 20 bp, human
ggcttcaggctgaagagcgg

SEQ ID NO: 278753 - DNA, 20 bp, human
gagaagaaggaatatggttg

SEQ ID NO: 278754 - DNA, 20 bp, human
gcgcgccaaccagtcacctc

SEQ ID NO: 278755 - DNA, 20 bp, human
gccgggcgcgatcctggccg

SEQ ID NO: 278756 - DNA, 20 bp, human
gtgtggggcgagaggaagca

SEQ ID NO: 278757 - DNA, 20 bp, human
gatccctagaaatggggtgt

SEQ ID NO: 278758 - DNA, 20 bp, human
ggccccacaccccatttcta

SEQ ID NO: 278759 - DNA, 20 bp, human
gctgcaggatgggttaagga

SEQ ID NO: 278760 - DNA, 20 bp, human
gcacatgatccctagaaatg

SEQ ID NO: 278761 - DNA, 20 bp, human
gtatagaggtggggccagcc

SEQ ID NO: 278762 - DNA, 20 bp, human
ggataagtagccaatgggag

SEQ ID NO: 278763 - DNA, 20 bp, human
gtggggcattgacagtgcga

SEQ ID NO: 278764 - DNA, 20 bp, human
gccctggccaatggaaactg

SEQ ID NO: 278765 - DNA, 20 bp, human
gtaggcgggtcatcgcgctg

SEQ ID NO: 278766 - DNA, 20 bp, human
gtccccgccgagtgatgaaa

SEQ ID NO: 278767 - DNA, 20 bp, human
gcggcggcggagctcctccg

SEQ ID NO: 278768 - DNA, 20 bp, human
ggatgtggggaaggcggacg

SEQ ID NO: 278769 - DNA, 20 bp, human
gggggctacgaggaaaaaag

SEQ ID NO: 278770 - DNA, 20 bp, human
gcgggcttccatataaagta

SEQ ID NO: 278771 - DNA, 20 bp, human
gcctctccggcgcgctccaa

SEQ ID NO: 278772 - DNA, 20 bp, human
gcagccttttcatcactcgg

SEQ ID NO: 278773 - DNA, 20 bp, human
gggaaggcgtcgaggaccgg

SEQ ID NO: 278774 - DNA, 20 bp, human
gcagcgccccggttagctat

SEQ ID NO: 278775 - DNA, 20 bp, human
gctggtgacccggacctcgg

SEQ ID NO: 278776 - DNA, 20 bp, human
gggggcctgaggcgtaccgg

SEQ ID NO: 278777 - DNA, 20 bp, human
ggaggccctgaagaggtgaa

SEQ ID NO: 278778 - DNA, 20 bp, human
gcgtaccggaggccctgaag

SEQ ID NO: 278779 - DNA, 20 bp, human
gtggctgaggcgaagtagta

SEQ ID NO: 278780 - DNA, 20 bp, human
gagggcctccggtacgcctc

SEQ ID NO: 278781 - DNA, 20 bp, human
gaggaggcagcgtgaggggg

SEQ ID NO: 278782 - DNA, 20 bp, human
gaggaaaagcgattacggat

SEQ ID NO: 278783 - DNA, 20 bp, human
gggcggggcctgaggcgtac

SEQ ID NO: 278784 - DNA, 20 bp, human
ggcatcgccacgcccacagg

SEQ ID NO: 278785 - DNA, 20 bp, human
gatgccgggaggagccaatg

SEQ ID NO: 278786 - DNA, 20 bp, human
gggagctaaggcaacacttc

SEQ ID NO: 278787 - DNA, 20 bp, human
ggggaacggcgcggcccatc

SEQ ID NO: 278788 - DNA, 20 bp, human
gcggacgaccggatggggaa

SEQ ID NO: 278789 - DNA, 20 bp, human
gtatgcttccggttgcccga

SEQ ID NO: 278790 - DNA, 20 bp, human
gggccgcgccgttccccatc

SEQ ID NO: 278791 - DNA, 20 bp, human
gcgcggaacacactgagagc

SEQ ID NO: 278792 - DNA, 20 bp, human
gctgtccggaagtcctgaga

SEQ ID NO: 278793 - DNA, 20 bp, human
ggaccggatggggaacggcg

SEQ ID NO: 278794 - DNA, 20 bp, human
gctaggacctcgcctacccg

SEQ ID NO: 278795 - DNA, 20 bp, human
ggaagcatagcgttcctgtc

SEQ ID NO: 278796 - DNA, 20 bp, human
ggagaatgccagccccctgc

SEQ ID NO: 278797 - DNA, 20 bp, human
gaggatgctttgcacgtcac

SEQ ID NO: 278798 - DNA, 20 bp, human
ggctaggtaggaactgcagt

SEQ ID NO: 278799 - DNA, 20 bp, human
gagtgattgaagtgtccagc

SEQ ID NO: 278800 - DNA, 20 bp, human
gcacgggcttcaccagcaaa

SEQ ID NO: 278801 - DNA, 20 bp, human
gcagcggagctgccgtttgc

SEQ ID NO: 278802 - DNA, 20 bp, human
gctctgtctataagtaacac

SEQ ID NO: 278803 - DNA, 20 bp, human
gagaaatcctcaaatcctat

SEQ ID NO: 278804 - DNA, 20 bp, human
gtgtaagcacatagcaccta

SEQ ID NO: 278805 - DNA, 20 bp, human
gtgcaaagcatcctgcctat

SEQ ID NO: 278806 - DNA, 20 bp, human
ggcctccgagagtcggaagg

SEQ ID NO: 278807 - DNA, 20 bp, human
gtgcccgcggcgcatgtgcc

SEQ ID NO: 278808 - DNA, 20 bp, human
ggggcagccccgcccaaggg

SEQ ID NO: 278809 - DNA, 20 bp, human
gctggcgcgagatccctccc

SEQ ID NO: 278810 - DNA, 20 bp, human
gccgcccaagggcggagact

SEQ ID NO: 278811 - DNA, 20 bp, human
gaggagcacagggtggacgg

SEQ ID NO: 278812 - DNA, 20 bp, human
gccgcccagtctccgccctt

SEQ ID NO: 278813 - DNA, 20 bp, human
gcccgcgaggcgcacacgga

SEQ ID NO: 278814 - DNA, 20 bp, human
gcgcacacggagggacggag

SEQ ID NO: 278815 - DNA, 20 bp, human
gatccccgggcgtgcccgcg

SEQ ID NO: 278816 - DNA, 20 bp, human
gtgggggcggggaggacttg

SEQ ID NO: 278817 - DNA, 20 bp, human
ggtcccgcgggcagaatcgg

SEQ ID NO: 278818 - DNA, 20 bp, human
gcctgctcccggggcttccg

SEQ ID NO: 278819 - DNA, 20 bp, human
ggcctcccgcagaacccccg

SEQ ID NO: 278820 - DNA, 20 bp, human
gtgggggggcgggaggactt

SEQ ID NO: 278821 - DNA, 20 bp, human
gcgcccgcggtcccgccgga

SEQ ID NO: 278822 - DNA, 20 bp, human
gctgggggcgggaggacctg

SEQ ID NO: 278823 - DNA, 20 bp, human
gggcgcttaagtccttccgg

SEQ ID NO: 278824 - DNA, 20 bp, human
gcgaggccgcggcgtcccgc

SEQ ID NO: 278825 - DNA, 20 bp, human
gcggcctggacccgggtgag

SEQ ID NO: 278826 - DNA, 20 bp, human
gggagagggtgcggaaacgc

SEQ ID NO: 278827 - DNA, 20 bp, human
gtgggaccgctaatcggaga

SEQ ID NO: 278828 - DNA, 20 bp, human
gcgccagcgaaagaagcctg

SEQ ID NO: 278829 - DNA, 20 bp, human
gcgaaagaagcctgcggata

SEQ ID NO: 278830 - DNA, 20 bp, human
gccgctaatcggagagggtg

SEQ ID NO: 278831 - DNA, 20 bp, human
ggagggtgcggaaacgctgg

SEQ ID NO: 278832 - DNA, 20 bp, human
gcagtagggcggatctcatt

SEQ ID NO: 278833 - DNA, 20 bp, human
gaggccttgccactaccgcg

SEQ ID NO: 278834 - DNA, 20 bp, human
gggaatcaaactggacaatg

SEQ ID NO: 278835 - DNA, 20 bp, human
gggagttgtagttctacggg

SEQ ID NO: 278836 - DNA, 20 bp, human
gccatggtggactctttaac

SEQ ID NO: 278837 - DNA, 20 bp, human
ggaactttgaagccaatggt

SEQ ID NO: 278838 - DNA, 20 bp, human
gagagacatgtccactgctc

SEQ ID NO: 278839 - DNA, 20 bp, human
gttacctctaacctctggtt

SEQ ID NO: 278840 - DNA, 20 bp, human
gttgaaaaggacctgagcag

SEQ ID NO: 278841 - DNA, 20 bp, human
gagaggttagaggtaaaatg

SEQ ID NO: 278842 - DNA, 20 bp, human
ggcttgaactttgaagccaa

SEQ ID NO: 278843 - DNA, 20 bp, human
gccttttcaatgcccaccat

SEQ ID NO: 278844 - DNA, 20 bp, human
gtttgcgggttttagtttaa

SEQ ID NO: 278845 - DNA, 20 bp, human
gaaggctgagatcattttgc

SEQ ID NO: 278846 - DNA, 20 bp, human
ggtgaagtcatggtgagctt

SEQ ID NO: 278847 - DNA, 20 bp, human
gtcaagttgttgctggggta

SEQ ID NO: 278848 - DNA, 20 bp, human
gatgaaaaggcaggtgattc

SEQ ID NO: 278849 - DNA, 20 bp, human
gcgtgcagccggtgaaactt

SEQ ID NO: 278850 - DNA, 20 bp, human
gttgatagaccctcatgaaa

SEQ ID NO: 278851 - DNA, 20 bp, human
ggcaggtgattctggtttga

SEQ ID NO: 278852 - DNA, 20 bp, human
gtctggtttgatggagtgga

SEQ ID NO: 278853 - DNA, 20 bp, human
gaacatgtgccaattcaata

SEQ ID NO: 278854 - DNA, 20 bp, human
gcctcaggttaagaaaggtt

SEQ ID NO: 278855 - DNA, 20 bp, human
gtctatcaatatttaatgta

SEQ ID NO: 278856 - DNA, 20 bp, human
gtacccgccgtgcccggctc

SEQ ID NO: 278857 - DNA, 20 bp, human
ggcctccgcgcgcaccttcg

SEQ ID NO: 278858 - DNA, 20 bp, human
ggggcacggcgggtagcggt

SEQ ID NO: 278859 - DNA, 20 bp, human
gtgggctagcggcctcgcca

SEQ ID NO: 278860 - DNA, 20 bp, human
gatagagggcgcaaagacgt

SEQ ID NO: 278861 - DNA, 20 bp, human
gcggtggggcggggtggacc

SEQ ID NO: 278862 - DNA, 20 bp, human
gcaaagacgtgggcgcttca

SEQ ID NO: 278863 - DNA, 20 bp, human
gaccagctcctcccggccgg

SEQ ID NO: 278864 - DNA, 20 bp, human
ggaaaataggccgaccctcc

SEQ ID NO: 278865 - DNA, 20 bp, human
gcggcgggtagcggtggggc

SEQ ID NO: 278866 - DNA, 20 bp, human
gccgcggcccggctgccgaa

SEQ ID NO: 278867 - DNA, 20 bp, human
ggaacgctgcggctagggga

SEQ ID NO: 278868 - DNA, 20 bp, human
gtgagctccgtcctacccgc

SEQ ID NO: 278869 - DNA, 20 bp, human
gttcgctgaactcaacccgc

SEQ ID NO: 278870 - DNA, 20 bp, human
gtcagcgaacgctgcggcta

SEQ ID NO: 278871 - DNA, 20 bp, human
ggaccagctgaacctcttgt

SEQ ID NO: 278872 - DNA, 20 bp, human
gactcaacccgcgggtagga

SEQ ID NO: 278873 - DNA, 20 bp, human
gttgagttcagcgaacgctg

SEQ ID NO: 278874 - DNA, 20 bp, human
gctgaactcaacccgcgggt

SEQ ID NO: 278875 - DNA, 20 bp, human
gattaccaggaactaaatcc

SEQ ID NO: 278876 - DNA, 20 bp, human
gggtggggcaggaggacgcg

SEQ ID NO: 278877 - DNA, 20 bp, human
ggccctgcctccgcgcgcgg

SEQ ID NO: 278878 - DNA, 20 bp, human
gggtcggggcgccctccgag

SEQ ID NO: 278879 - DNA, 20 bp, human
ggccctgccagcttgagcgg

SEQ ID NO: 278880 - DNA, 20 bp, human
gccgggcgtccagtccacgc

SEQ ID NO: 278881 - DNA, 20 bp, human
ggtcgccctgccagcttgag

SEQ ID NO: 278882 - DNA, 20 bp, human
gggagcgcgcagtaatcccc

SEQ ID NO: 278883 - DNA, 20 bp, human
ggcccccgcgcgcggaggca

SEQ ID NO: 278884 - DNA, 20 bp, human
ggcagggcgacctgcgggga

SEQ ID NO: 278885 - DNA, 20 bp, human
gggcctggcagccgctcgga

SEQ ID NO: 278886 - DNA, 20 bp, human
ggccaggcaggtgccagcgt

SEQ ID NO: 278887 - DNA, 20 bp, human
gaggcaggtgcctttgggag

SEQ ID NO: 278888 - DNA, 20 bp, human
ggcctttgggaggggtgcag

SEQ ID NO: 278889 - DNA, 20 bp, human
gtggctacccccacccacgc

SEQ ID NO: 278890 - DNA, 20 bp, human
ggtagccaaggctgatagag

SEQ ID NO: 278891 - DNA, 20 bp, human
gggttggcttgtggattgag

SEQ ID NO: 278892 - DNA, 20 bp, human
gccgagatgctccccaatga

SEQ ID NO: 278893 - DNA, 20 bp, human
ggccagggcacacgtggaac

SEQ ID NO: 278894 - DNA, 20 bp, human
gggggagcatctcggattca

SEQ ID NO: 278895 - DNA, 20 bp, human
gtagaagcagatgtctgagt

SEQ ID NO: 278896 - DNA, 20 bp, human
gctccagctcagttataagg

SEQ ID NO: 278897 - DNA, 20 bp, human
gtataaggtggcttatctaa

SEQ ID NO: 278898 - DNA, 20 bp, human
gcttcctggacgggtgggta

SEQ ID NO: 278899 - DNA, 20 bp, human
gtggaacttcctggacgggt

SEQ ID NO: 278900 - DNA, 20 bp, human
gcagccctacccacccgtcc

SEQ ID NO: 278901 - DNA, 20 bp, human
gtatctaaaggcttgggagg

SEQ ID NO: 278902 - DNA, 20 bp, human
gagaagaaggggttctggcc

SEQ ID NO: 278903 - DNA, 20 bp, human
gggtgtggaacttcctggac

SEQ ID NO: 278904 - DNA, 20 bp, human
ggtggcttatctaaaggctt

SEQ ID NO: 278905 - DNA, 20 bp, human
ggtccaggtgtggaacttcc

SEQ ID NO: 278906 - DNA, 20 bp, human
gctagctggaacaacttctt

SEQ ID NO: 278907 - DNA, 20 bp, human
ggggacaggcactagcgcca

SEQ ID NO: 278908 - DNA, 20 bp, human
ggaaacccatagggagtaat

SEQ ID NO: 278909 - DNA, 20 bp, human
ggcactagcgccagggccct

SEQ ID NO: 278910 - DNA, 20 bp, human
gccacatgtaggcagttcag

SEQ ID NO: 278911 - DNA, 20 bp, human
gtctttggctcgtattcctc

SEQ ID NO: 278912 - DNA, 20 bp, human
gtgagcaagtctttgattca

SEQ ID NO: 278913 - DNA, 20 bp, human
gctgctgaagttgcctttcc

SEQ ID NO: 278914 - DNA, 20 bp, human
gcagttcagaggtgcttccc

SEQ ID NO: 278915 - DNA, 20 bp, human
gggaaatgggtgtgactctg

SEQ ID NO: 278916 - DNA, 20 bp, human
gcgcgcgtccggaggaacct

SEQ ID NO: 278917 - DNA, 20 bp, human
gcgccctcccggaaccgtcc

SEQ ID NO: 278918 - DNA, 20 bp, human
gcgccaagccaaggttcctc

SEQ ID NO: 278919 - DNA, 20 bp, human
gttggcttggcgccccatcc

SEQ ID NO: 278920 - DNA, 20 bp, human
gctccgggacggttccggga

SEQ ID NO: 278921 - DNA, 20 bp, human
gaggtgatccgcccgggcac

SEQ ID NO: 278922 - DNA, 20 bp, human
gagcaccagcctcgcgcgtc

SEQ ID NO: 278923 - DNA, 20 bp, human
gagtttgaggctaccaggat

SEQ ID NO: 278924 - DNA, 20 bp, human
ggggctctccgggacggttc

SEQ ID NO: 278925 - DNA, 20 bp, human
gcgtcccggagagcccgccc

SEQ ID NO: 278926 - DNA, 20 bp, human
ggaaacccgacacctcccgc

SEQ ID NO: 278927 - DNA, 20 bp, human
gagtgggcggcgttgcgttt

SEQ ID NO: 278928 - DNA, 20 bp, human
gtcagccagcgggaggtgtc

SEQ ID NO: 278929 - DNA, 20 bp, human
gtggggaggtggagcttccg

SEQ ID NO: 278930 - DNA, 20 bp, human
gtgagccggggacaccagcg

SEQ ID NO: 278931 - DNA, 20 bp, human
gcggggaggggcgtgtgcct

SEQ ID NO: 278932 - DNA, 20 bp, human
ggcggccccgctggtgtccc

SEQ ID NO: 278933 - DNA, 20 bp, human
gtgcctgggcgggtggatcc

SEQ ID NO: 278934 - DNA, 20 bp, human
gcgggccactggctcgctcc

SEQ ID NO: 278935 - DNA, 20 bp, human
gcccccgagcagtccagcca

SEQ ID NO: 278936 - DNA, 20 bp, human
ggaccccccccaatccttat

SEQ ID NO: 278937 - DNA, 20 bp, human
gcggggttgggtgacccgtg

SEQ ID NO: 278938 - DNA, 20 bp, human
gtcctcccataaggattggg

SEQ ID NO: 278939 - DNA, 20 bp, human
gcccccccaatccttatggg

SEQ ID NO: 278940 - DNA, 20 bp, human
gcatgctgggtacctaccag

SEQ ID NO: 278941 - DNA, 20 bp, human
ggcctcctcccataaggatt

SEQ ID NO: 278942 - DNA, 20 bp, human
gagtggctggatgtcttctg

SEQ ID NO: 278943 - DNA, 20 bp, human
gccctcagcctcctcccata

SEQ ID NO: 278944 - DNA, 20 bp, human
ggattggggggggtcatgct

SEQ ID NO: 278945 - DNA, 20 bp, human
gaataagataagcactgatc

SEQ ID NO: 278946 - DNA, 20 bp, human
ggggacgcgcgcccctccgt

SEQ ID NO: 278947 - DNA, 20 bp, human
gggctccggaacagtgtcgc

SEQ ID NO: 278948 - DNA, 20 bp, human
gagcccgcccgcacggggag

SEQ ID NO: 278949 - DNA, 20 bp, human
ggcgtctcagaccctcaccc

SEQ ID NO: 278950 - DNA, 20 bp, human
ggccgtggggatcttttctc

SEQ ID NO: 278951 - DNA, 20 bp, human
ggcggccggcgacactgttc

SEQ ID NO: 278952 - DNA, 20 bp, human
gtggctcggatttctttcgg

SEQ ID NO: 278953 - DNA, 20 bp, human
gggggcgtccctccactccc

SEQ ID NO: 278954 - DNA, 20 bp, human
gtggggcaacaaaacccgcc

SEQ ID NO: 278955 - DNA, 20 bp, human
gttccggagcccgcccgcac

SEQ ID NO: 278956 - DNA, 20 bp, human
gggacgggacggaaaactgg

SEQ ID NO: 278957 - DNA, 20 bp, human
gcaagcgcgctcctgactcc

SEQ ID NO: 278958 - DNA, 20 bp, human
gtgtgcgtacagttcggttc

SEQ ID NO: 278959 - DNA, 20 bp, human
gcggccgtcccgagaggcca

SEQ ID NO: 278960 - DNA, 20 bp, human
gtaagcgcggccgtcccgag

SEQ ID NO: 278961 - DNA, 20 bp, human
ggcctgaagcgggtaacgag

SEQ ID NO: 278962 - DNA, 20 bp, human
gcggtcatggctctcgtttc

SEQ ID NO: 278963 - DNA, 20 bp, human
gcgcgcttgtgcgtacagtt

SEQ ID NO: 278964 - DNA, 20 bp, human
gagacccagggacgaagcta

SEQ ID NO: 278965 - DNA, 20 bp, human
gcgtcccgagaggccagggg

SEQ ID NO: 278966 - DNA, 20 bp, human
gagaccgcgggaatgatggg

SEQ ID NO: 278967 - DNA, 20 bp, human
ggggctccccgtcgtacagt

SEQ ID NO: 278968 - DNA, 20 bp, human
gaatgatgggcgggaatgac

SEQ ID NO: 278969 - DNA, 20 bp, human
ggacgggtcacgctgtacgt

SEQ ID NO: 278970 - DNA, 20 bp, human
gagtagaccgcgggaatgat

SEQ ID NO: 278971 - DNA, 20 bp, human
gcacgctgtacgtcgggaaa

SEQ ID NO: 278972 - DNA, 20 bp, human
ggccacgcggctctctgtgc

SEQ ID NO: 278973 - DNA, 20 bp, human
gaagcctcagagtagaccgc

SEQ ID NO: 278974 - DNA, 20 bp, human
gattcccgcggtctactctg

SEQ ID NO: 278975 - DNA, 20 bp, human
gtgtcagccgactgtacgac

SEQ ID NO: 278976 - DNA, 20 bp, human
ggcccgcgtaacaggcgtct

SEQ ID NO: 278977 - DNA, 20 bp, human
ggggcggtgtaaggctgggt

SEQ ID NO: 278978 - DNA, 20 bp, human
ggccccacgctcgcccgctt

SEQ ID NO: 278979 - DNA, 20 bp, human
gctgggagccgaagcccgaa

SEQ ID NO: 278980 - DNA, 20 bp, human
gtccgtgattggctccgttc

SEQ ID NO: 278981 - DNA, 20 bp, human
gaacaaacgacgtccgtgat

SEQ ID NO: 278982 - DNA, 20 bp, human
ggtgaattcgccttgttcgg

SEQ ID NO: 278983 - DNA, 20 bp, human
ggccccgccgcccgcgtaac

SEQ ID NO: 278984 - DNA, 20 bp, human
gattggctccgttcgggctt

SEQ ID NO: 278985 - DNA, 20 bp, human
gagccgaagcgggcgagcgt

SEQ ID NO: 278986 - DNA, 20 bp, human
gaggcgcgttcccggctgta

SEQ ID NO: 278987 - DNA, 20 bp, human
gcggcggcgcgccgggagtc

SEQ ID NO: 278988 - DNA, 20 bp, human
gttcacgagacccagactcc

SEQ ID NO: 278989 - DNA, 20 bp, human
gcggaagtgacgccacactg

SEQ ID NO: 278990 - DNA, 20 bp, human
ggcgggggctggagcagttc

SEQ ID NO: 278991 - DNA, 20 bp, human
gggcgactggagccgaccgg

SEQ ID NO: 278992 - DNA, 20 bp, human
gcacttccgccagcgcccgg

SEQ ID NO: 278993 - DNA, 20 bp, human
gcggctccagtcgcctccgg

SEQ ID NO: 278994 - DNA, 20 bp, human
gacactggggccgcggaagg

SEQ ID NO: 278995 - DNA, 20 bp, human
gcaggagcgtccctacagcc

SEQ ID NO: 278996 - DNA, 20 bp, human
ggagcgccaggccctcccgt

SEQ ID NO: 278997 - DNA, 20 bp, human
ggaggggtccccctggacga

SEQ ID NO: 278998 - DNA, 20 bp, human
ggtgaagcgaggggtccccc

SEQ ID NO: 278999 - DNA, 20 bp, human
gcctcccgtcggctgctggg

SEQ ID NO: 279000 - DNA, 20 bp, human
gccaagctcgccttcgtcca

SEQ ID NO: 279001 - DNA, 20 bp, human
gacggaggggagatctgaag

SEQ ID NO: 279002 - DNA, 20 bp, human
gccacccgcccagcagccga

SEQ ID NO: 279003 - DNA, 20 bp, human
gctgaagaggcctagggtcg

SEQ ID NO: 279004 - DNA, 20 bp, human
gctgaggcccggagcacgga

SEQ ID NO: 279005 - DNA, 20 bp, human
gaagaggcctagggtcgggg

SEQ ID NO: 279006 - DNA, 20 bp, human
ggcgctaaatagccggaaac

SEQ ID NO: 279007 - DNA, 20 bp, human
ggccacccgtaccttcgcct

SEQ ID NO: 279008 - DNA, 20 bp, human
gaccgaggcgaaggtacggg

SEQ ID NO: 279009 - DNA, 20 bp, human
ggcccccgggaaaaccgcag

SEQ ID NO: 279010 - DNA, 20 bp, human
gcgacgggagtcgaagttca

SEQ ID NO: 279011 - DNA, 20 bp, human
gtcccgccgcgctaaatagc

SEQ ID NO: 279012 - DNA, 20 bp, human
gaccccgctgcggttttccc

SEQ ID NO: 279013 - DNA, 20 bp, human
ggccccacctgtcacctggt

SEQ ID NO: 279014 - DNA, 20 bp, human
gcgcccgcgctaccccgctg

SEQ ID NO: 279015 - DNA, 20 bp, human
ggcgaggggtcaatccgcgc

SEQ ID NO: 279016 - DNA, 20 bp, human
gcacgcccggcgttgggtcg

SEQ ID NO: 279017 - DNA, 20 bp, human
gagcgtacggatagcagcga

SEQ ID NO: 279018 - DNA, 20 bp, human
ggaggagtcggaagtggttg

SEQ ID NO: 279019 - DNA, 20 bp, human
gggggtggaggagtcggaag

SEQ ID NO: 279020 - DNA, 20 bp, human
gcccggcgttgggtcggggg

SEQ ID NO: 279021 - DNA, 20 bp, human
gtcaatccacgcccggcgtt

SEQ ID NO: 279022 - DNA, 20 bp, human
gaaacctagacaggaacaca

SEQ ID NO: 279023 - DNA, 20 bp, human
gtcggaagtggttggggttt

SEQ ID NO: 279024 - DNA, 20 bp, human
gtacttttggacttagcccg

SEQ ID NO: 279025 - DNA, 20 bp, human
gaggcaaggaatgggtaggg

SEQ ID NO: 279026 - DNA, 20 bp, human
gccgccgctaggcaagaccc

SEQ ID NO: 279027 - DNA, 20 bp, human
gaccggggcggggaactggg

SEQ ID NO: 279028 - DNA, 20 bp, human
gccgctaggcaagacccagg

SEQ ID NO: 279029 - DNA, 20 bp, human
gggaggcggagaaacccctc

SEQ ID NO: 279030 - DNA, 20 bp, human
ggggaggcggccccgcctct

SEQ ID NO: 279031 - DNA, 20 bp, human
ggggcggtccccggggtagg

SEQ ID NO: 279032 - DNA, 20 bp, human
gcgcatgcttagtcaccgtg

SEQ ID NO: 279033 - DNA, 20 bp, human
ggccggggtgagaacggagg

SEQ ID NO: 279034 - DNA, 20 bp, human
ggccaccggggcggggaact

SEQ ID NO: 279035 - DNA, 20 bp, human
gggcgccgctcgggatccag

SEQ ID NO: 279036 - DNA, 20 bp, human
gagagggcggccttagcatt

SEQ ID NO: 279037 - DNA, 20 bp, human
ggggcagagacccatacctt

SEQ ID NO: 279038 - DNA, 20 bp, human
ggaaggggcggtcgatgaga

SEQ ID NO: 279039 - DNA, 20 bp, human
gtcccaaggtccatccgcca

SEQ ID NO: 279040 - DNA, 20 bp, human
gcaccctggcggatggacct

SEQ ID NO: 279041 - DNA, 20 bp, human
gtaggcttaaagagcaggcg

SEQ ID NO: 279042 - DNA, 20 bp, human
gggggtcggcggggagctac

SEQ ID NO: 279043 - DNA, 20 bp, human
gaggggaccatcggggtcgg

SEQ ID NO: 279044 - DNA, 20 bp, human
gcgacgcactcctaatgcta

SEQ ID NO: 279045 - DNA, 20 bp, human
gtgcgctgaccgccccggct

SEQ ID NO: 279046 - DNA, 20 bp, human
gatgctttttttcatgagtt

SEQ ID NO: 279047 - DNA, 20 bp, human
ggagttgggtgcaaagacta

SEQ ID NO: 279048 - DNA, 20 bp, human
gtgaaagaagagtcaagtta

SEQ ID NO: 279049 - DNA, 20 bp, human
ggtgggagagaactattgag

SEQ ID NO: 279050 - DNA, 20 bp, human
gcaacccagtaagaaaacgg

SEQ ID NO: 279051 - DNA, 20 bp, human
gacttgactcttctttcagt

SEQ ID NO: 279052 - DNA, 20 bp, human
gctgaaattcacatttaggt

SEQ ID NO: 279053 - DNA, 20 bp, human
gataatatttcagtataatc

SEQ ID NO: 279054 - DNA, 20 bp, human
gtggccaaggggccacctac

SEQ ID NO: 279055 - DNA, 20 bp, human
ggccactcccacacatttca

SEQ ID NO: 279056 - DNA, 20 bp, human
gtgacccttctttcagtggg

SEQ ID NO: 279057 - DNA, 20 bp, human
gtcccagctatgctcacaat

SEQ ID NO: 279058 - DNA, 20 bp, human
ggttccctcccactgaaaga

SEQ ID NO: 279059 - DNA, 20 bp, human
gtgaaagaagggtcaagtta

SEQ ID NO: 279060 - DNA, 20 bp, human
gacttgacccttctttcagt

SEQ ID NO: 279061 - DNA, 20 bp, human
gcaacccagtaagaaaacgg

SEQ ID NO: 279062 - DNA, 20 bp, human
gctgaaattcacatttaggt

SEQ ID NO: 279063 - DNA, 20 bp, human
ggatactttttttcatgagt

SEQ ID NO: 279064 - DNA, 20 bp, human
gataatatttcagtataatc

SEQ ID NO: 279065 - DNA, 20 bp, human
gtggccaaggggccacctac

SEQ ID NO: 279066 - DNA, 20 bp, human
gctggagactaaagtggtgt

SEQ ID NO: 279067 - DNA, 20 bp, human
gatcctgtgaacactgctta

SEQ ID NO: 279068 - DNA, 20 bp, human
gctccttaagcagtgttcac

SEQ ID NO: 279069 - DNA, 20 bp, human
gggaactctggagactaaag

SEQ ID NO: 279070 - DNA, 20 bp, human
gctagcagatcatggaactc

SEQ ID NO: 279071 - DNA, 20 bp, human
gaaggaggatcttgttaaat

SEQ ID NO: 279072 - DNA, 20 bp, human
ggagagtcataggagatgtc

SEQ ID NO: 279073 - DNA, 20 bp, human
ggaagggggtggagtctagt

SEQ ID NO: 279074 - DNA, 20 bp, human
ggagaggaggaaagtgtcat

SEQ ID NO: 279075 - DNA, 20 bp, human
ggcagtgttcacaggatact

SEQ ID NO: 279076 - DNA, 20 bp, human
gttgggtacctcggatgtga

SEQ ID NO: 279077 - DNA, 20 bp, human
gtccgggacgacctcaccaa

SEQ ID NO: 279078 - DNA, 20 bp, human
ggataaacggacttgatttc

SEQ ID NO: 279079 - DNA, 20 bp, human
gactgcagtctccattggtg

SEQ ID NO: 279080 - DNA, 20 bp, human
gctgctggtctcacccagcc

SEQ ID NO: 279081 - DNA, 20 bp, human
ggctctagcgcgcgggagct

SEQ ID NO: 279082 - DNA, 20 bp, human
gtaaatactgcagtctccat

SEQ ID NO: 279083 - DNA, 20 bp, human
gagcaggcggctctagcgcg

SEQ ID NO: 279084 - DNA, 20 bp, human
gtggatagtgtcaaaacagc

SEQ ID NO: 279085 - DNA, 20 bp, human
ggaatgccttgcagatgggt

SEQ ID NO: 279086 - DNA, 20 bp, human
ggggtggcaggcgttgaaga

SEQ ID NO: 279087 - DNA, 20 bp, human
ggggttgaagacgcgaaatt

SEQ ID NO: 279088 - DNA, 20 bp, human
ggcgttgaagagggtagcga

SEQ ID NO: 279089 - DNA, 20 bp, human
gaggggcgaaatgaatattc

SEQ ID NO: 279090 - DNA, 20 bp, human
ggcagccaccgcatgcgtga

SEQ ID NO: 279091 - DNA, 20 bp, human
gcctatcccccagctgaatt

SEQ ID NO: 279092 - DNA, 20 bp, human
ggacgcgaaattgggactgt

SEQ ID NO: 279093 - DNA, 20 bp, human
gcatttcgcccctgagcact

SEQ ID NO: 279094 - DNA, 20 bp, human
gcgtcttcaacccagtgctc

SEQ ID NO: 279095 - DNA, 20 bp, human
gaggaaaatcgcacagccac

SEQ ID NO: 279096 - DNA, 20 bp, human
gaaaggagaaaggtcaagtt

SEQ ID NO: 279097 - DNA, 20 bp, human
gctttctcctttcagtggga

SEQ ID NO: 279098 - DNA, 20 bp, human
gcataccgtgtttggaacat

SEQ ID NO: 279099 - DNA, 20 bp, human
ggatgcttttttttgtgagt

SEQ ID NO: 279100 - DNA, 20 bp, human
gtttttgtgagttggatgca

SEQ ID NO: 279101 - DNA, 20 bp, human
gccatgaaatgtgtgggagt

SEQ ID NO: 279102 - DNA, 20 bp, human
gttgacctttctcctttcag

SEQ ID NO: 279103 - DNA, 20 bp, human
gatagttccctcccactgaa

SEQ ID NO: 279104 - DNA, 20 bp, human
ggtgggagggaactattgaa

SEQ ID NO: 279105 - DNA, 20 bp, human
ggagttggatgcaaggacta

SEQ ID NO: 279106 - DNA, 20 bp, human
gccaccgggaacagacggat

SEQ ID NO: 279107 - DNA, 20 bp, human
ggggaacagacggatcggca

SEQ ID NO: 279108 - DNA, 20 bp, human
gaacagacggatcggcaggg

SEQ ID NO: 279109 - DNA, 20 bp, human
gggggtctcgagcctccagg

SEQ ID NO: 279110 - DNA, 20 bp, human
gtgcgggaaccgtttccgaa

SEQ ID NO: 279111 - DNA, 20 bp, human
gtccgaaagcaggaaaacaa

SEQ ID NO: 279112 - DNA, 20 bp, human
gtcccggcccgcaactccct

SEQ ID NO: 279113 - DNA, 20 bp, human
gcacctcgctcctggcgcgg

SEQ ID NO: 279114 - DNA, 20 bp, human
gaaacggttcccgcactggc

SEQ ID NO: 279115 - DNA, 20 bp, human
gctgttcccggtggtccctt

SEQ ID NO: 279116 - DNA, 20 bp, human
gaggctgcgcgctaaggcgg

SEQ ID NO: 279117 - DNA, 20 bp, human
gagcgcgcaggtgtggacaa

SEQ ID NO: 279118 - DNA, 20 bp, human
ggggtgggtagggacccctt

SEQ ID NO: 279119 - DNA, 20 bp, human
gcggaggtggacctctacca

SEQ ID NO: 279120 - DNA, 20 bp, human
gagagaaactgccctggtag

SEQ ID NO: 279121 - DNA, 20 bp, human
gacacctgcgcgctccccaa

SEQ ID NO: 279122 - DNA, 20 bp, human
gtgccccgctgcgccggagg

SEQ ID NO: 279123 - DNA, 20 bp, human
ggcctacggcccccagccag

SEQ ID NO: 279124 - DNA, 20 bp, human
gtaaggcggtgggcggtccc

SEQ ID NO: 279125 - DNA, 20 bp, human
gtgcgcgctaaggcggtggg

SEQ ID NO: 279126 - DNA, 20 bp, human
gctcccaggcccgagggttc

SEQ ID NO: 279127 - DNA, 20 bp, human
ggccccgcctgtcccctctc

SEQ ID NO: 279128 - DNA, 20 bp, human
gctgagggacaccgcgggca

SEQ ID NO: 279129 - DNA, 20 bp, human
gcggcccgccacaacccgaa

SEQ ID NO: 279130 - DNA, 20 bp, human
gattctggaggcccgggaga

SEQ ID NO: 279131 - DNA, 20 bp, human
ggaaggctgagggacaccgc

SEQ ID NO: 279132 - DNA, 20 bp, human
gaacccgaaaggcgccattc

SEQ ID NO: 279133 - DNA, 20 bp, human
gcttcgctcccggaaccctc

SEQ ID NO: 279134 - DNA, 20 bp, human
gtcccggaaccctcgggcct

SEQ ID NO: 279135 - DNA, 20 bp, human
gagagctccggagaggggac

SEQ ID NO: 279136 - DNA, 20 bp, human
gcgctcatggggctaggagt

SEQ ID NO: 279137 - DNA, 20 bp, human
gggcctggagcgcgctcatg

SEQ ID NO: 279138 - DNA, 20 bp, human
gcccccgaaacgggccaatc

SEQ ID NO: 279139 - DNA, 20 bp, human
gctctctcctgaaacccacg

SEQ ID NO: 279140 - DNA, 20 bp, human
ggcccagggcgggggagaac

SEQ ID NO: 279141 - DNA, 20 bp, human
gccgaaacgggccaatctgg

SEQ ID NO: 279142 - DNA, 20 bp, human
gcccgccctgcccccgaaac

SEQ ID NO: 279143 - DNA, 20 bp, human
gtcccacctcccagccccgt

SEQ ID NO: 279144 - DNA, 20 bp, human
gctcctgaaacccacggggc

SEQ ID NO: 279145 - DNA, 20 bp, human
gagccccatgagcgcgctcc

SEQ ID NO: 279146 - DNA, 20 bp, human
gtcggctgccgagttcccac

SEQ ID NO: 279147 - DNA, 20 bp, human
gacccagcagaggtccgaag

SEQ ID NO: 279148 - DNA, 20 bp, human
gctgagttggggagcgtgaa

SEQ ID NO: 279149 - DNA, 20 bp, human
gagttggggagcgtgaatgg

SEQ ID NO: 279150 - DNA, 20 bp, human
gtccgcttcggacctctgct

SEQ ID NO: 279151 - DNA, 20 bp, human
gacgtccggagaagaagaaa

SEQ ID NO: 279152 - DNA, 20 bp, human
gtccggagaagaagaaacgg

SEQ ID NO: 279153 - DNA, 20 bp, human
gcgcgcacagccgagtccct

SEQ ID NO: 279154 - DNA, 20 bp, human
ggtgctctctctgctgagtt

SEQ ID NO: 279155 - DNA, 20 bp, human
ggaactggcccaatgcaaaa

SEQ ID NO: 279156 - DNA, 20 bp, human
ggctccacagggccgtgcgc

SEQ ID NO: 279157 - DNA, 20 bp, human
gaggcaagggacggagaacg

SEQ ID NO: 279158 - DNA, 20 bp, human
gaatgccggcgttggggttc

SEQ ID NO: 279159 - DNA, 20 bp, human
gaggccctgaaccccaacgc

SEQ ID NO: 279160 - DNA, 20 bp, human
gctgcccgggtcccgcctcg

SEQ ID NO: 279161 - DNA, 20 bp, human
gggccccgcccccttatgtc

SEQ ID NO: 279162 - DNA, 20 bp, human
gagcaaaggacccgaggttg

SEQ ID NO: 279163 - DNA, 20 bp, human
gggcctggcgaccccgaggc

SEQ ID NO: 279164 - DNA, 20 bp, human
gtctccgtcccttgcctccg

SEQ ID NO: 279165 - DNA, 20 bp, human
gtggggaccctagttaccca

SEQ ID NO: 279166 - DNA, 20 bp, human
gaggtccggaagcactagga

SEQ ID NO: 279167 - DNA, 20 bp, human
gacccagcagaggtccgaag

SEQ ID NO: 279168 - DNA, 20 bp, human
gtccgcttcggacctctgct

SEQ ID NO: 279169 - DNA, 20 bp, human
gacgtccggagaagaagaaa

SEQ ID NO: 279170 - DNA, 20 bp, human
gcaggttgctggatcctcac

SEQ ID NO: 279171 - DNA, 20 bp, human
gtcggctgccgagttcccac

SEQ ID NO: 279172 - DNA, 20 bp, human
gtccggagaagaagaaacgg

SEQ ID NO: 279173 - DNA, 20 bp, human
ggcctcccgcgcctgttggt

SEQ ID NO: 279174 - DNA, 20 bp, human
gctgagttggggagcgtgaa

SEQ ID NO: 279175 - DNA, 20 bp, human
gggggcggggctacggaagc

SEQ ID NO: 279176 - DNA, 20 bp, human
gcctcgctcccggaaccctg

SEQ ID NO: 279177 - DNA, 20 bp, human
ggcccccgagcgagcgcccg

SEQ ID NO: 279178 - DNA, 20 bp, human
gcgctcgggggcctacagaa

SEQ ID NO: 279179 - DNA, 20 bp, human
ggccccgggcgctcgctcgg

SEQ ID NO: 279180 - DNA, 20 bp, human
gtggagcctcagggcgggtt

SEQ ID NO: 279181 - DNA, 20 bp, human
gtacagaatggcgtgtttcg

SEQ ID NO: 279182 - DNA, 20 bp, human
gctgagggattctgcgggca

SEQ ID NO: 279183 - DNA, 20 bp, human
gcgtgtttcggggttgtggc

SEQ ID NO: 279184 - DNA, 20 bp, human
gggcttattgattccagccc

SEQ ID NO: 279185 - DNA, 20 bp, human
gatggcgtgtttcggggttg

SEQ ID NO: 279186 - DNA, 20 bp, human
gcctccgcccccgaacgaag

SEQ ID NO: 279187 - DNA, 20 bp, human
gaaagccgggaaggcacaac

SEQ ID NO: 279188 - DNA, 20 bp, human
ggcccttaaaacatcttaag

SEQ ID NO: 279189 - DNA, 20 bp, human
gcgtggagccccgtggagtg

SEQ ID NO: 279190 - DNA, 20 bp, human
gtggtgaccccttcgttcgg

SEQ ID NO: 279191 - DNA, 20 bp, human
gaagtcgtgaagccttggga

SEQ ID NO: 279192 - DNA, 20 bp, human
gggccaagggctgcacccac

SEQ ID NO: 279193 - DNA, 20 bp, human
gtcagggtcagggtcagacg

SEQ ID NO: 279194 - DNA, 20 bp, human
ggacctcatggctcactcac

SEQ ID NO: 279195 - DNA, 20 bp, human
gcaccactccgcactccacg

SEQ ID NO: 279196 - DNA, 20 bp, human
gcacctggagaccatgtctg

SEQ ID NO: 279197 - DNA, 20 bp, human
ggaaaggtgagtgctctcca

SEQ ID NO: 279198 - DNA, 20 bp, human
ggcagcggtggcgagccaca

SEQ ID NO: 279199 - DNA, 20 bp, human
ggggagctgcgcaaaccacc

SEQ ID NO: 279200 - DNA, 20 bp, human
ggccgcgtgacagaaaatgt

SEQ ID NO: 279201 - DNA, 20 bp, human
ggcggtggcgagccacaggg

SEQ ID NO: 279202 - DNA, 20 bp, human
gccttggcctgcagaccggc

SEQ ID NO: 279203 - DNA, 20 bp, human
gcatgtctggggatgcgacc

SEQ ID NO: 279204 - DNA, 20 bp, human
ggctcacggtcgccgccctg

SEQ ID NO: 279205 - DNA, 20 bp, human
gccatggggtccgcgagctg

SEQ ID NO: 279206 - DNA, 20 bp, human
gtggaggccgcttagaggaa

SEQ ID NO: 279207 - DNA, 20 bp, human
gcgccggccgctcttctgga

SEQ ID NO: 279208 - DNA, 20 bp, human
gcctctgcggccgacgcccg

SEQ ID NO: 279209 - DNA, 20 bp, human
ggggcgggaccacccttata

SEQ ID NO: 279210 - DNA, 20 bp, human
gtactccctaggccccgctg

SEQ ID NO: 279211 - DNA, 20 bp, human
ggccgacgcccggggtgcag

SEQ ID NO: 279212 - DNA, 20 bp, human
gcggcgactccggggactcc

SEQ ID NO: 279213 - DNA, 20 bp, human
gtggggccggcgggagtccg

SEQ ID NO: 279214 - DNA, 20 bp, human
ggggtcccgcggactcccgc

SEQ ID NO: 279215 - DNA, 20 bp, human
gagtcgccgcgcagctggcc

SEQ ID NO: 279216 - DNA, 20 bp, human
gcaatggggcacagcggtcg

SEQ ID NO: 279217 - DNA, 20 bp, human
gcggcgggcggcctgtctca

SEQ ID NO: 279218 - DNA, 20 bp, human
ggcgtccgtgccgcccaatg

SEQ ID NO: 279219 - DNA, 20 bp, human
gaccgctgtgccccattggg

SEQ ID NO: 279220 - DNA, 20 bp, human
ggccgcccgccgcccgcaat

SEQ ID NO: 279221 - DNA, 20 bp, human
gtctcagggctgggcccgcc

SEQ ID NO: 279222 - DNA, 20 bp, human
gtcggggtgcgtagccgcag

SEQ ID NO: 279223 - DNA, 20 bp, human
ggagcgagccaggcacgaaa

SEQ ID NO: 279224 - DNA, 20 bp, human
gcacgaaagggatgggactg

SEQ ID NO: 279225 - DNA, 20 bp, human
gacactctttagtccaattg

SEQ ID NO: 279226 - DNA, 20 bp, human
ggcaggtgtcccaaactggt

SEQ ID NO: 279227 - DNA, 20 bp, human
gtcaaggttcccaccagttt

SEQ ID NO: 279228 - DNA, 20 bp, human
gtgcaagtgtcacatcccac

SEQ ID NO: 279229 - DNA, 20 bp, human
gaaactctaagatccctttt

SEQ ID NO: 279230 - DNA, 20 bp, human
gatcttagagtttcacccag

SEQ ID NO: 279231 - DNA, 20 bp, human
gacttgcaggtgtcccaaac

SEQ ID NO: 279232 - DNA, 20 bp, human
gtatgaacgcacagctggga

SEQ ID NO: 279233 - DNA, 20 bp, human
gtagggacgcacggatctgg

SEQ ID NO: 279234 - DNA, 20 bp, human
gccgtgcgtccctacaggga

SEQ ID NO: 279235 - DNA, 20 bp, human
gcgtcctccctgccagtcga

SEQ ID NO: 279236 - DNA, 20 bp, human
ggcaggtgtcccaaactggt

SEQ ID NO: 279237 - DNA, 20 bp, human
gtgcaagtgtcacatcccac

SEQ ID NO: 279238 - DNA, 20 bp, human
gatcttagagtttcacccag

SEQ ID NO: 279239 - DNA, 20 bp, human
gacttgcaggtgtcccaaac

SEQ ID NO: 279240 - DNA, 20 bp, human
gaaactctaagatccctttt

SEQ ID NO: 279241 - DNA, 20 bp, human
gtagggacgcacggatctgg

SEQ ID NO: 279242 - DNA, 20 bp, human
gtatgaacgcacagctggga

SEQ ID NO: 279243 - DNA, 20 bp, human
gcctggggacagcacccaat

SEQ ID NO: 279244 - DNA, 20 bp, human
gccgtgcgtccctacaggga

SEQ ID NO: 279245 - DNA, 20 bp, human
gtgcgtccctacagggaggg

SEQ ID NO: 279246 - DNA, 20 bp, human
ggcgcagagcatgtcgggac

SEQ ID NO: 279247 - DNA, 20 bp, human
gccgccaaggagtcacaaga

SEQ ID NO: 279248 - DNA, 20 bp, human
gcaggaggcgcagagcatgt

SEQ ID NO: 279249 - DNA, 20 bp, human
gggcccggggcgggggggac

SEQ ID NO: 279250 - DNA, 20 bp, human
gccgccacgccccgtacctg

SEQ ID NO: 279251 - DNA, 20 bp, human
ggagcatgtcgggaccggga

SEQ ID NO: 279252 - DNA, 20 bp, human
gggggcgggcagcgtggtcg

SEQ ID NO: 279253 - DNA, 20 bp, human
gccagcagcccccaggtacg

SEQ ID NO: 279254 - DNA, 20 bp, human
ggcaacgcccttcactgcag

SEQ ID NO: 279255 - DNA, 20 bp, human
gggagagctgggcgagccag

SEQ ID NO: 279256 - DNA, 20 bp, human
gaacccgcaaaagggagagg

SEQ ID NO: 279257 - DNA, 20 bp, human
gagggcgcctgttacggcgt

SEQ ID NO: 279258 - DNA, 20 bp, human
gggggcgagggcgcctgtta

SEQ ID NO: 279259 - DNA, 20 bp, human
gcggccggggcctctcaata

SEQ ID NO: 279260 - DNA, 20 bp, human
ggcctgttacggcgtgggtg

SEQ ID NO: 279261 - DNA, 20 bp, human
gcggctggagggaggttcgg

SEQ ID NO: 279262 - DNA, 20 bp, human
gactacgccaggagcggccg

SEQ ID NO: 279263 - DNA, 20 bp, human
gcaaaatcagtaaggtgaac

SEQ ID NO: 279264 - DNA, 20 bp, human
gcgggggtgcaaaatcagta

SEQ ID NO: 279265 - DNA, 20 bp, human
ggcacaaaaaccctattgag

SEQ ID NO: 279266 - DNA, 20 bp, human
ggcggcggggaagaactcgg

SEQ ID NO: 279267 - DNA, 20 bp, human
gcgcgcggcggggaagaact

SEQ ID NO: 279268 - DNA, 20 bp, human
gcagaagccgcgaggagggg

SEQ ID NO: 279269 - DNA, 20 bp, human
ggcggccagggtagcgagag

SEQ ID NO: 279270 - DNA, 20 bp, human
gagctccgcaccctcgggat

SEQ ID NO: 279271 - DNA, 20 bp, human
gaagagttgggctgcggcca

SEQ ID NO: 279272 - DNA, 20 bp, human
gccagggtagcgagaggggg

SEQ ID NO: 279273 - DNA, 20 bp, human
gacaacagaagccgcgagga

SEQ ID NO: 279274 - DNA, 20 bp, human
ggggagactttgcaaagtgt

SEQ ID NO: 279275 - DNA, 20 bp, human
ggcatcacgtgccagggtgg

SEQ ID NO: 279276 - DNA, 20 bp, human
gcgggagcgccgctgactca

SEQ ID NO: 279277 - DNA, 20 bp, human
gcgcgccagcggagtccggg

SEQ ID NO: 279278 - DNA, 20 bp, human
gcggcccgcccgcgcaatcg

SEQ ID NO: 279279 - DNA, 20 bp, human
ggtggggagcagtgcgaggc

SEQ ID NO: 279280 - DNA, 20 bp, human
ggagtccgggcggcgcagag

SEQ ID NO: 279281 - DNA, 20 bp, human
gaaagctgaaagggcggaca

SEQ ID NO: 279282 - DNA, 20 bp, human
gtggggcggagcgattcgcg

SEQ ID NO: 279283 - DNA, 20 bp, human
gacctcgcgccagcggagtc

SEQ ID NO: 279284 - DNA, 20 bp, human
gtgcgccgcccggactccgc

SEQ ID NO: 279285 - DNA, 20 bp, human
ggtgctgacgagatgggaaa

SEQ ID NO: 279286 - DNA, 20 bp, human
gcctgcgcacgcggctctcg

SEQ ID NO: 279287 - DNA, 20 bp, human
ggcacccaggcggaagtctg

SEQ ID NO: 279288 - DNA, 20 bp, human
gtgacaacgcggctcgccgg

SEQ ID NO: 279289 - DNA, 20 bp, human
ggtggcgggtactggactgg

SEQ ID NO: 279290 - DNA, 20 bp, human
ggccacggcgcgtgacaacg

SEQ ID NO: 279291 - DNA, 20 bp, human
ggccgagagacagggtgaag

SEQ ID NO: 279292 - DNA, 20 bp, human
gaatggccgcggaggaggac

SEQ ID NO: 279293 - DNA, 20 bp, human
ggctcgcgtgatcacgtggt

SEQ ID NO: 279294 - DNA, 20 bp, human
gcacgcgccgtggcgggtac

SEQ ID NO: 279295 - DNA, 20 bp, human
gcacgtggttggcacccagg

SEQ ID NO: 279296 - DNA, 20 bp, human
gcaaccacggagaacgccgg

SEQ ID NO: 279297 - DNA, 20 bp, human
ggtcaaggcggagaggcggt

SEQ ID NO: 279298 - DNA, 20 bp, human
gtgccctcggagggaaacac
